United States Patent 7,312,035 (METHODS OF GENETIC ANALYSIS OF YEAST) - sequence listing, part 2

SEQ ID NO: 38135 - DNA, 25 bp, S. cerevisiae
gatagccgcacataatagaaactct

SEQ ID NO: 38136 - DNA, 25 bp, S. cerevisiae
gataggcacctacaagaggcaattt

SEQ ID NO: 38137 - DNA, 25 bp, S. cerevisiae
gatcattcaccatacaagaccatag

SEQ ID NO: 38138 - DNA, 25 bp, S. cerevisiae
gatcattcaggcttccaaacgtggg

SEQ ID NO: 38139 - DNA, 25 bp, S. cerevisiae
gttccaacttctcatattgctgggc

SEQ ID NO: 38140 - DNA, 25 bp, S. cerevisiae
gatctccagatcatcgttatccagg

SEQ ID NO: 38141 - DNA, 25 bp, S. cerevisiae
gatccgcctttatactctgattgta

SEQ ID NO: 38142 - DNA, 25 bp, S. cerevisiae
gatccgcgctttttacatatgcttg

SEQ ID NO: 38143 - DNA, 25 bp, S. cerevisiae
gatcgcccggatgtgtctctgaatg

SEQ ID NO: 38144 - DNA, 25 bp, S. cerevisiae
gatcgaattcgtatgatggcttcag

SEQ ID NO: 38145 - DNA, 25 bp, S. cerevisiae
gatcgcgttacaacatggtcatata

SEQ ID NO: 38146 - DNA, 25 bp, S. cerevisiae
gatcgtggcgaaaatggccaatttt

SEQ ID NO: 38147 - DNA, 25 bp, S. cerevisiae
gatcgattcgaaaccgcacgtagct

SEQ ID NO: 38148 - DNA, 25 bp, S. cerevisiae
gatcaggattctttattacgtacgc

SEQ ID NO: 38149 - DNA, 25 bp, S. cerevisiae
gatcgagtcctcatatgccctggaa

SEQ ID NO: 38150 - DNA, 25 bp, S. cerevisiae
gatcatgggctatgggatactccct

SEQ ID NO: 38151 - DNA, 25 bp, S. cerevisiae
gatcggtgctaagagaattcactct

SEQ ID NO: 38152 - DNA, 25 bp, S. cerevisiae
gatcgagttctatttctgcattact

SEQ ID NO: 38153 - DNA, 25 bp, S. cerevisiae
gatctcagtttgtttcgtttttcct

SEQ ID NO: 38154 - DNA, 25 bp, S. cerevisiae
gatacgtctctgtttccgttttggt

SEQ ID NO: 38155 - DNA, 25 bp, S. cerevisiae
gattcggccatttatttggatcggg

SEQ ID NO: 38156 - DNA, 25 bp, S. cerevisiae
gatctcagttcattgtagtctcgct

SEQ ID NO: 38157 - DNA, 25 bp, S. cerevisiae
gatctgtgggatcgtttccaggata

SEQ ID NO: 38158 - DNA, 25 bp, S. cerevisiae
gatctatgcgagtgtctggccgaat

SEQ ID NO: 38159 - DNA, 25 bp, S. cerevisiae
gatcatcacaatctcaaacgcgaat

SEQ ID NO: 38160 - DNA, 25 bp, S. cerevisiae
gatctcatttgaaacccctgaattt

SEQ ID NO: 38161 - DNA, 25 bp, S. cerevisiae
gatctacatgaattcgctatcttgc

SEQ ID NO: 38162 - DNA, 25 bp, S. cerevisiae
gatcagcttaggtctaatgctatta

SEQ ID NO: 38163 - DNA, 25 bp, S. cerevisiae
gatcgtctcaggcttatgttcacag

SEQ ID NO: 38164 - DNA, 25 bp, S. cerevisiae
gatctgcctacgcttgcattatgat

SEQ ID NO: 38165 - DNA, 25 bp, S. cerevisiae
gatctactacgcttgtgagttgctt

SEQ ID NO: 38166 - DNA, 25 bp, S. cerevisiae
gatcaatcatactacagctggtctg

SEQ ID NO: 38167 - DNA, 25 bp, S. cerevisiae
gatcgtaacgatcgtgaccgcgatt

SEQ ID NO: 38168 - DNA, 25 bp, S. cerevisiae
gatctaattcgaactccggtgtgtc

SEQ ID NO: 38169 - DNA, 25 bp, S. cerevisiae
gatctaatcgccattcctaatagtg

SEQ ID NO: 38170 - DNA, 25 bp, S. cerevisiae
gatcgattccgcagacttactagtg

SEQ ID NO: 38171 - DNA, 25 bp, S. cerevisiae
gatcaggtacgtgacttcatatcaa

SEQ ID NO: 38172 - DNA, 25 bp, S. cerevisiae
gatcagtgtccctgactggcaaaat

SEQ ID NO: 38173 - DNA, 25 bp, S. cerevisiae
gatctggttccattaggccaaacat

SEQ ID NO: 38174 - DNA, 25 bp, S. cerevisiae
gatctgatcgtctatgcaacttcca

SEQ ID NO: 38175 - DNA, 25 bp, S. cerevisiae
gatcatgatctgttatcgagttcga

SEQ ID NO: 38176 - DNA, 25 bp, S. cerevisiae
gatcttcattgacttatgaccctgt

SEQ ID NO: 38177 - DNA, 25 bp, S. cerevisiae
gatcgatactgtgaaatgcccgcaa

SEQ ID NO: 38178 - DNA, 25 bp, S. cerevisiae
gatcattcaattacaaggcccgcaa

SEQ ID NO: 38179 - DNA, 25 bp, S. cerevisiae
gatcttgctataccgtagtaacgtt

SEQ ID NO: 38180 - DNA, 25 bp, S. cerevisiae
gatcttgtcgattctctattaactg

SEQ ID NO: 38181 - DNA, 25 bp, S. cerevisiae
gatttattacctaaccgtgaaccat

SEQ ID NO: 38182 - DNA, 25 bp, S. cerevisiae
gtagtgttccaatacccttacgaag

SEQ ID NO: 38183 - DNA, 25 bp, S. cerevisiae
gatatggtacccaaacacccaacta

SEQ ID NO: 38184 - DNA, 25 bp, S. cerevisiae
gataatgtaaccaaacctgttcctg

SEQ ID NO: 38185 - DNA, 25 bp, S. cerevisiae
gataagtaccctttcttgctatacg

SEQ ID NO: 38186 - DNA, 25 bp, S. cerevisiae
gataactaaacagctctcttctaag

SEQ ID NO: 38187 - DNA, 25 bp, S. cerevisiae
gatcaagctagaaagccattcttct

SEQ ID NO: 38188 - DNA, 25 bp, S. cerevisiae
gatctcttggatgacgaatcttctt

SEQ ID NO: 38189 - DNA, 25 bp, S. cerevisiae
gatctctaggtggtgctaatgctct

SEQ ID NO: 38190 - DNA, 25 bp, S. cerevisiae
gatcactgtcggatgctgaatctac

SEQ ID NO: 38191 - DNA, 25 bp, S. cerevisiae
gatctgtcatggaactgtgcgggaa

SEQ ID NO: 38192 - DNA, 25 bp, S. cerevisiae
gatctcattgaccactatgaccaca

SEQ ID NO: 38193 - DNA, 25 bp, S. cerevisiae
gatctataacgatttgtccaccaag

SEQ ID NO: 38194 - DNA, 25 bp, S. cerevisiae
gatctcaaagccaaattagcgccta

SEQ ID NO: 38195 - DNA, 25 bp, S. cerevisiae
gatactccaattaacgacgacgacg

SEQ ID NO: 38196 - DNA, 25 bp, S. cerevisiae
gatagtcctgattatggcgacgaaa

SEQ ID NO: 38197 - DNA, 25 bp, S. cerevisiae
gatctgatcggtgataatcctggtt

SEQ ID NO: 38198 - DNA, 25 bp, S. cerevisiae
gatctaactgttgctacgctggttt

SEQ ID NO: 38199 - DNA, 25 bp, S. cerevisiae
gataccaagggcctagagaatctaa

SEQ ID NO: 38200 - DNA, 25 bp, S. cerevisiae
gatactgcgggccaggaacgttaca

SEQ ID NO: 38201 - DNA, 25 bp, S. cerevisiae
gatagcgacggcgacggacgtttaa

SEQ ID NO: 38202 - DNA, 25 bp, S. cerevisiae
gatacgatccgagccaactttaaat

SEQ ID NO: 38203 - DNA, 25 bp, S. cerevisiae
gataagacaagagcacgttttccct

SEQ ID NO: 38204 - DNA, 25 bp, S. cerevisiae
gatcgacgaaaatggtactctgcta

SEQ ID NO: 38205 - DNA, 25 bp, S. cerevisiae
gatcgtccaaaacatgaactctcta

SEQ ID NO: 38206 - DNA, 25 bp, S. cerevisiae
gataatcagcagcacccaaactatt

SEQ ID NO: 38207 - DNA, 25 bp, S. cerevisiae
gataaatcccgaggccaacgaacat

SEQ ID NO: 38208 - DNA, 25 bp, S. cerevisiae
gatacagacgtcaccgacacgcaag

SEQ ID NO: 38209 - DNA, 25 bp, S. cerevisiae
gatacaacgatcctaataaccttgg

SEQ ID NO: 38210 - DNA, 25 bp, S. cerevisiae
gatcttgccgacgattttgttacta

SEQ ID NO: 38211 - DNA, 25 bp, S. cerevisiae
gatcttccaactaccagtcatttgt

SEQ ID NO: 38212 - DNA, 25 bp, S. cerevisiae
gatcgttaagttcatgtattctgtc

SEQ ID NO: 38213 - DNA, 25 bp, S. cerevisiae
gatcggtgcgctacgttatttggaa

SEQ ID NO: 38214 - DNA, 25 bp, S. cerevisiae
gatcattgcaggtgccattggacag

SEQ ID NO: 38215 - DNA, 25 bp, S. cerevisiae
gatctcgctcatatccattagacgt

SEQ ID NO: 38216 - DNA, 25 bp, S. cerevisiae
gatcatctgcatatctgttccaagg

SEQ ID NO: 38217 - DNA, 25 bp, S. cerevisiae
gatctctacagccttttcaagacgt

SEQ ID NO: 38218 - DNA, 25 bp, S. cerevisiae
gatcactctaagtttctgtcttctg

SEQ ID NO: 38219 - DNA, 25 bp, S. cerevisiae
gatcgtgtcaaagtcttggcggcta

SEQ ID NO: 38220 - DNA, 25 bp, S. cerevisiae
gatcttattatcgtacggtgccaaa

SEQ ID NO: 38221 - DNA, 25 bp, S. cerevisiae
gatcttttttctacgatggcagtta

SEQ ID NO: 38222 - DNA, 25 bp, S. cerevisiae
gatcagatttccttcaaagacgcaa

SEQ ID NO: 38223 - DNA, 25 bp, S. cerevisiae
gatcggaatcctgcatgaagagtca

SEQ ID NO: 38224 - DNA, 25 bp, S. cerevisiae
gatcggtatgcaacctcaacagtgt

SEQ ID NO: 38225 - DNA, 25 bp, S. cerevisiae
gatcgtcttcatgcaaaatttggtc

SEQ ID NO: 38226 - DNA, 25 bp, S. cerevisiae
gattcagtctcagcaaactccgagt

SEQ ID NO: 38227 - DNA, 25 bp, S. cerevisiae
gatcttccacgctaatacgcggagt

SEQ ID NO: 38228 - DNA, 25 bp, S. cerevisiae
gatctttcacgcatacatcggaagg

SEQ ID NO: 38229 - DNA, 25 bp, S. cerevisiae
gatcattatctgactgctctattgg

SEQ ID NO: 38230 - DNA, 25 bp, S. cerevisiae
gatctaacgcttttgcagcagggcc

SEQ ID NO: 38231 - DNA, 25 bp, S. cerevisiae
gatcaaactatctgcatcgaagcta

SEQ ID NO: 38232 - DNA, 25 bp, S. cerevisiae
gatcaggcacgttctatcgaagcta

SEQ ID NO: 38233 - DNA, 25 bp, S. cerevisiae
gatcagaccctattttgatggcata

SEQ ID NO: 38234 - DNA, 25 bp, S. cerevisiae
gataagccctcgtttaactcattca

SEQ ID NO: 38235 - DNA, 25 bp, S. cerevisiae
gattacagaccccatggacttactt

SEQ ID NO: 38236 - DNA, 25 bp, S. cerevisiae
gatctaaaccattcttccatttttc

SEQ ID NO: 38237 - DNA, 25 bp, S. cerevisiae
gatctgaacccttatacaattccat

SEQ ID NO: 38238 - DNA, 25 bp, S. cerevisiae
gatcatatgatttgttcgacgccat

SEQ ID NO: 38239 - DNA, 25 bp, S. cerevisiae
gatcaaggtcaaaatcaccccacca

SEQ ID NO: 38240 - DNA, 25 bp, S. cerevisiae
gatataggtataccacagggcgcct

SEQ ID NO: 38241 - DNA, 25 bp, S. cerevisiae
gattcaaggtatcactgcggcagcc

SEQ ID NO: 38242 - DNA, 25 bp, S. cerevisiae
gatctcaagagcaagaactgggcga

SEQ ID NO: 38243 - DNA, 25 bp, S. cerevisiae
gatcacgaagcatctaacggattat

SEQ ID NO: 38244 - DNA, 25 bp, S. cerevisiae
gatcatcgacgaccgcatatttaga

SEQ ID NO: 38245 - DNA, 25 bp, S. cerevisiae
gatcatctggaaacgctgctaaagg

SEQ ID NO: 38246 - DNA, 25 bp, S. cerevisiae
gatcttggcatacttctagacatag

SEQ ID NO: 38247 - DNA, 25 bp, S. cerevisiae
gatcttatccttggctggtcagatt

SEQ ID NO: 38248 - DNA, 25 bp, S. cerevisiae
gataggatgccttcggcgatgaccc

SEQ ID NO: 38249 - DNA, 25 bp, S. cerevisiae
gtaagatcttgaccggtaccgtcgt

SEQ ID NO: 38250 - DNA, 25 bp, S. cerevisiae
gtattattcaccacgtacgtttgga

SEQ ID NO: 38251 - DNA, 25 bp, S. cerevisiae
gatcttatttacaagcgtacgcttc

SEQ ID NO: 38252 - DNA, 25 bp, S. cerevisiae
gatctctcattttctgttgtacagc

SEQ ID NO: 38253 - DNA, 25 bp, S. cerevisiae
gatctagatctttcatttttcgact

SEQ ID NO: 38254 - DNA, 25 bp, S. cerevisiae
gatcttcttttgattcattcgccac

SEQ ID NO: 38255 - DNA, 25 bp, S. cerevisiae
gatcttttcgataccattgtcactg

SEQ ID NO: 38256 - DNA, 25 bp, S. cerevisiae
gatctactcatatctaaattacgcg

SEQ ID NO: 38257 - DNA, 25 bp, S. cerevisiae
gatctgcatccagtacttaacaaag

SEQ ID NO: 38258 - DNA, 25 bp, S. cerevisiae
gatctccgaatccttgaaatgacgt

SEQ ID NO: 38259 - DNA, 25 bp, S. cerevisiae
gatctcctgcaactctttaatactt

SEQ ID NO: 38260 - DNA, 25 bp, S. cerevisiae
gatcttcatctatggtgcttctgac

SEQ ID NO: 38261 - DNA, 25 bp, S. cerevisiae
gatatgcgagctatgactccaacaa

SEQ ID NO: 38262 - DNA, 25 bp, S. cerevisiae
gatcatgcagagctatctcgccaag

SEQ ID NO: 38263 - DNA, 25 bp, S. cerevisiae
gatcagatgctcgattgggcacaag

SEQ ID NO: 38264 - DNA, 25 bp, S. cerevisiae
gatcacaggttttacatccatgggt

SEQ ID NO: 38265 - DNA, 25 bp, S. cerevisiae
gatcaatcgcagcatttggaactaa

SEQ ID NO: 38266 - DNA, 25 bp, S. cerevisiae
gataatgcctcgagagccacatcta

SEQ ID NO: 38267 - DNA, 25 bp, S. cerevisiae
gataattctagcaatggccactgga

SEQ ID NO: 38268 - DNA, 25 bp, S. cerevisiae
gataatttagccaccatgtctattc

SEQ ID NO: 38269 - DNA, 25 bp, S. cerevisiae
gataattgtggtgtcctactctata

SEQ ID NO: 38270 - DNA, 25 bp, S. cerevisiae
gatcaagtacctatcctaagctcat

SEQ ID NO: 38271 - DNA, 25 bp, S. cerevisiae
gataagctgacgaacctcatgaccc

SEQ ID NO: 38272 - DNA, 25 bp, S. cerevisiae
gataacgatttatggaacactccct

SEQ ID NO: 38273 - DNA, 25 bp, S. cerevisiae
gataacgtttgatggcgagcccgcc

SEQ ID NO: 38274 - DNA, 25 bp, S. cerevisiae
gataacgagtctgaattgagagcca

SEQ ID NO: 38275 - DNA, 25 bp, S. cerevisiae
gataacgaggcagatgctatccaaa

SEQ ID NO: 38276 - DNA, 25 bp, S. cerevisiae
gataaattgagatccatggttagaa

SEQ ID NO: 38277 - DNA, 25 bp, S. cerevisiae
gatatagattcgtcatcgcggtcac

SEQ ID NO: 38278 - DNA, 25 bp, S. cerevisiae
gatcatgataccgttgacgcagctc

SEQ ID NO: 38279 - DNA, 25 bp, S. cerevisiae
gatcatatcaccatctgatgccgtt

SEQ ID NO: 38280 - DNA, 25 bp, S. cerevisiae
gatcttgagcttaatgctgacactt

SEQ ID NO: 38281 - DNA, 25 bp, S. cerevisiae
gatcaacagttaatcagccagcttt

SEQ ID NO: 38282 - DNA, 25 bp, S. cerevisiae
gatcataaacagttcactcgcaatg

SEQ ID NO: 38283 - DNA, 25 bp, S. cerevisiae
gatcaaaccaaaacccaatgtccca

SEQ ID NO: 38284 - DNA, 25 bp, S. cerevisiae
gatctgcaacaccagcaaactctag

SEQ ID NO: 38285 - DNA, 25 bp, S. cerevisiae
gatctccacacgcacaatttacata

SEQ ID NO: 38286 - DNA, 25 bp, S. cerevisiae
gatcatgacaatagaccaatttaca

SEQ ID NO: 38287 - DNA, 25 bp, S. cerevisiae
gatcatctgctttattatctttgct

SEQ ID NO: 38288 - DNA, 25 bp, S. cerevisiae
gatagcgcatcggtgaagtcattga

SEQ ID NO: 38289 - DNA, 25 bp, S. cerevisiae
gatctggcatgcgtacaagtcatta

SEQ ID NO: 38290 - DNA, 25 bp, S. cerevisiae
gatctaattgccgtttactactcat

SEQ ID NO: 38291 - DNA, 25 bp, S. cerevisiae
gataaatcgccccacattaatgtct

SEQ ID NO: 38292 - DNA, 25 bp, S. cerevisiae
gataagctcgccgtgggaaatttta

SEQ ID NO: 38293 - DNA, 25 bp, S. cerevisiae
gatacccgaagtctactcttttatg

SEQ ID NO: 38294 - DNA, 25 bp, S. cerevisiae
gataccaagtttctcagttttaaag

SEQ ID NO: 38295 - DNA, 25 bp, S. cerevisiae
gatctctttgttggtaactgtccct

SEQ ID NO: 38296 - DNA, 25 bp, S. cerevisiae
gatcttcgtttttagtgctttagca

SEQ ID NO: 38297 - DNA, 25 bp, S. cerevisiae
gatctgatccgacaatatgacctac

SEQ ID NO: 38298 - DNA, 25 bp, S. cerevisiae
gatagacctgacgatttgccgcaac

SEQ ID NO: 38299 - DNA, 25 bp, S. cerevisiae
gatcagtgcctatatgttcaaccaa

SEQ ID NO: 38300 - DNA, 25 bp, S. cerevisiae
gatcattccattcagtgtttctcta

SEQ ID NO: 38301 - DNA, 25 bp, S. cerevisiae
gatctactgctcatggtatttctgc

SEQ ID NO: 38302 - DNA, 25 bp, S. cerevisiae
gatctcgttggttcagcattcctat

SEQ ID NO: 38303 - DNA, 25 bp, S. cerevisiae
gatctgttgctggtagcgacttata

SEQ ID NO: 38304 - DNA, 25 bp, S. cerevisiae
gatctttggtttggacttctgcagt

SEQ ID NO: 38305 - DNA, 25 bp, S. cerevisiae
gattcgtggtttcaacttggtattg

SEQ ID NO: 38306 - DNA, 25 bp, S. cerevisiae
gatacggttattcaattttgtgcaa

SEQ ID NO: 38307 - DNA, 25 bp, S. cerevisiae
gatagtggttgcctaaatccggata

SEQ ID NO: 38308 - DNA, 25 bp, S. cerevisiae
gatcaggtttccaacaataaggcat

SEQ ID NO: 38309 - DNA, 25 bp, S. cerevisiae
gatcatttctataccggccacaatg

SEQ ID NO: 38310 - DNA, 25 bp, S. cerevisiae
gatcttcctataccaatccacgatt

SEQ ID NO: 38311 - DNA, 25 bp, S. cerevisiae
gatcttcttctcctactctaagtag

SEQ ID NO: 38312 - DNA, 25 bp, S. cerevisiae
gatctcacgctaaggaaatgggtat

SEQ ID NO: 38313 - DNA, 25 bp, S. cerevisiae
gatctccctcatcgatgtcataaat

SEQ ID NO: 38314 - DNA, 25 bp, S. cerevisiae
gatcatgcccgctagattcaatact

SEQ ID NO: 38315 - DNA, 25 bp, S. cerevisiae
gatcattatccgaatccaatacttg

SEQ ID NO: 38316 - DNA, 25 bp, S. cerevisiae
gatcagtataatgcgcaggccaccg

SEQ ID NO: 38317 - DNA, 25 bp, S. cerevisiae
gataattacgcgtcaccaaacatat

SEQ ID NO: 38318 - DNA, 25 bp, S. cerevisiae
gataatggcagtgactccactcact

SEQ ID NO: 38319 - DNA, 25 bp, S. cerevisiae
gatcatacgctttactcgatgctaa

SEQ ID NO: 38320 - DNA, 25 bp, S. cerevisiae
gatcatagattttacttggcttcca

SEQ ID NO: 38321 - DNA, 25 bp, S. cerevisiae
gataggttttactaccattccaagg

SEQ ID NO: 38322 - DNA, 25 bp, S. cerevisiae
gtaggtgtcaagcaaatcatgtcca

SEQ ID NO: 38323 - DNA, 25 bp, S. cerevisiae
gatactttcaagacaaacgccgcaa

SEQ ID NO: 38324 - DNA, 25 bp, S. cerevisiae
gatactattggccacgtcttgaagc

SEQ ID NO: 38325 - DNA, 25 bp, S. cerevisiae
gataggtggcgcacttgttgaaagt

SEQ ID NO: 38326 - DNA, 25 bp, S. cerevisiae
gatcaatgagttccttgctaacaag

SEQ ID NO: 38327 - DNA, 25 bp, S. cerevisiae
gataaagtcgtatcctccgtatcct

SEQ ID NO: 38328 - DNA, 25 bp, S. cerevisiae
gataaaatttcctttccaggtccat

SEQ ID NO: 38329 - DNA, 25 bp, S. cerevisiae
gataaaaacccatttccgagatact

SEQ ID NO: 38330 - DNA, 25 bp, S. cerevisiae
gatcatataaaacccttccaacata

SEQ ID NO: 38331 - DNA, 25 bp, S. cerevisiae
gatcagatcaaaatggcacgtgcca

SEQ ID NO: 38332 - DNA, 25 bp, S. cerevisiae
gataccatttaattcaacgcccttt

SEQ ID NO: 38333 - DNA, 25 bp, S. cerevisiae
gataactattccgtaatggcctttt

SEQ ID NO: 38334 - DNA, 25 bp, S. cerevisiae
gataaaagtcactcacacaagcctt

SEQ ID NO: 38335 - DNA, 25 bp, S. cerevisiae
gtttgagaggactggccaacgccat

SEQ ID NO: 38336 - DNA, 25 bp, S. cerevisiae
gtacgaccagtacaacaacgccagt

SEQ ID NO: 38337 - DNA, 25 bp, S. cerevisiae
gatactattcggataataccccatg

SEQ ID NO: 38338 - DNA, 25 bp, S. cerevisiae
gataccaataaggtggccgccctac

SEQ ID NO: 38339 - DNA, 25 bp, S. cerevisiae
gatacgaatttgctacaagacgcta

SEQ ID NO: 38340 - DNA, 25 bp, S. cerevisiae
gatcacgattttgctatcgacccga

SEQ ID NO: 38341 - DNA, 25 bp, S. cerevisiae
gatcaagttttcagatgaaccggca

SEQ ID NO: 38342 - DNA, 25 bp, S. cerevisiae
gataacccgttgcatatagtcggct

SEQ ID NO: 38343 - DNA, 25 bp, S. cerevisiae
gataaacggtgtgcctattcacctc

SEQ ID NO: 38344 - DNA, 25 bp, S. cerevisiae
gatcacaatgcgaagggccagtccc

SEQ ID NO: 38345 - DNA, 25 bp, S. cerevisiae
gataacatcggagggactgtctaca

SEQ ID NO: 38346 - DNA, 25 bp, S. cerevisiae
gataacatgcgtcgtgaagttcaac

SEQ ID NO: 38347 - DNA, 25 bp, S. cerevisiae
gatcataaggcatctgacactttgg

SEQ ID NO: 38348 - DNA, 25 bp, S. cerevisiae
gatctcaatgtcatcagctgcctga

SEQ ID NO: 38349 - DNA, 25 bp, S. cerevisiae
gatcagtcaggcatactctagtggt

SEQ ID NO: 38350 - DNA, 25 bp, S. cerevisiae
gatacagatgacgtgcttcagtgaa

SEQ ID NO: 38351 - DNA, 25 bp, S. cerevisiae
gatatcgtgccgttatgcctaagga

SEQ ID NO: 38352 - DNA, 25 bp, S. cerevisiae
gatcagctgtcatccatatgaggag

SEQ ID NO: 38353 - DNA, 25 bp, S. cerevisiae
gatcacttatacagctttacacaga

SEQ ID NO: 38354 - DNA, 25 bp, S. cerevisiae
gtaccgttctaacactgacgcggat

SEQ ID NO: 38355 - DNA, 25 bp, S. cerevisiae
tgcagaccggttcaaaatttctccc

SEQ ID NO: 38356 - DNA, 25 bp, S. cerevisiae
gatatcgcattatcctcgggttcag

SEQ ID NO: 38357 - DNA, 25 bp, S. cerevisiae
gatcatgttttttgacgaggccaca

SEQ ID NO: 38358 - DNA, 25 bp, S. cerevisiae
gatcatatttctatggctggtccat

SEQ ID NO: 38359 - DNA, 25 bp, S. cerevisiae
gatcataattctccacttttccagg

SEQ ID NO: 38360 - DNA, 25 bp, S. cerevisiae
gatcaaatctcatccatatttccag

SEQ ID NO: 38361 - DNA, 25 bp, S. cerevisiae
gatcagacacgatgttacctccagc

SEQ ID NO: 38362 - DNA, 25 bp, S. cerevisiae
gatcacccatattctttgttactta

SEQ ID NO: 38363 - DNA, 25 bp, S. cerevisiae
gatcactcccatagaatcctttttc

SEQ ID NO: 38364 - DNA, 25 bp, S. cerevisiae
gatcattcctcattcagttttatat

SEQ ID NO: 38365 - DNA, 25 bp, S. cerevisiae
gatcttgttgtctttggtcgtgctg

SEQ ID NO: 38366 - DNA, 25 bp, S. cerevisiae
gatcttatcttgtttttctcttctt

SEQ ID NO: 38367 - DNA, 25 bp, S. cerevisiae
gataaggaggcatgtttccccttta

SEQ ID NO: 38368 - DNA, 25 bp, S. cerevisiae
gatcaccaacgcaacttttcgagaa

SEQ ID NO: 38369 - DNA, 25 bp, S. cerevisiae
gatcacgccagttcacaattagcta

SEQ ID NO: 38370 - DNA, 25 bp, S. cerevisiae
gatcattccgtcacatattagccac

SEQ ID NO: 38371 - DNA, 25 bp, S. cerevisiae
gatcagctcgttcatgctattagga

SEQ ID NO: 38372 - DNA, 25 bp, S. cerevisiae
gatcaggctattgttaccgagacta

SEQ ID NO: 38373 - DNA, 25 bp, S. cerevisiae
gataaaatttcagcccattggttct

SEQ ID NO: 38374 - DNA, 25 bp, S. cerevisiae
gatcaaaatttcaacccatcaggta

SEQ ID NO: 38375 - DNA, 25 bp, S. cerevisiae
gatagaaaccttaccgagttcgaca

SEQ ID NO: 38376 - DNA, 25 bp, S. cerevisiae
gataacacaacttccagcgacttaa

SEQ ID NO: 38377 - DNA, 25 bp, S. cerevisiae
gatacagccaaatctaggatcctaa

SEQ ID NO: 38378 - DNA, 25 bp, S. cerevisiae
gatcaatgcccataattggtcccat

SEQ ID NO: 38379 - DNA, 25 bp, S. cerevisiae
gataatcccttgtttggtcatctct

SEQ ID NO: 38380 - DNA, 25 bp, S. cerevisiae
gatacgcccgaaacttcagatgctg

SEQ ID NO: 38381 - DNA, 25 bp, S. cerevisiae
gatcacgccacgtattttggcatgg

SEQ ID NO: 38382 - DNA, 25 bp, S. cerevisiae
gataagaacgtgtccgatgccatgg

SEQ ID NO: 38383 - DNA, 25 bp, S. cerevisiae
gataatggtagcgaccttgccggtg

SEQ ID NO: 38384 - DNA, 25 bp, S. cerevisiae
gatacatttagcgagcactaccaag

SEQ ID NO: 38385 - DNA, 25 bp, S. cerevisiae
gataattgttcttgaccagggtagt

SEQ ID NO: 38386 - DNA, 25 bp, S. cerevisiae
gataacgctactagaactgggtggt

SEQ ID NO: 38387 - DNA, 25 bp, S. cerevisiae
gataaccagtttaacggatggctta

SEQ ID NO: 38388 - DNA, 25 bp, S. cerevisiae
gataactatttggaacgtcgcgttc

SEQ ID NO: 38389 - DNA, 25 bp, S. cerevisiae
gatcatcccactggaaaaatggctt

SEQ ID NO: 38390 - DNA, 25 bp, S. cerevisiae
gatcacgcccacacaagagagttta

SEQ ID NO: 38391 - DNA, 25 bp, S. cerevisiae
gataaccccaatgggctctgtagta

SEQ ID NO: 38392 - DNA, 25 bp, S. cerevisiae
gataacatcccattcggcattttta

SEQ ID NO: 38393 - DNA, 25 bp, S. cerevisiae
gatagatcagcatcaagggcagttt

SEQ ID NO: 38394 - DNA, 25 bp, S. cerevisiae
gatcagcacaatcccaggaactcta

SEQ ID NO: 38395 - DNA, 25 bp, S. cerevisiae
gatagccacatcaacagcatgtcct

SEQ ID NO: 38396 - DNA, 25 bp, S. cerevisiae
gatcatgccaatacagccttctgga

SEQ ID NO: 38397 - DNA, 25 bp, S. cerevisiae
gatcatgccattaagctgtcacgaa

SEQ ID NO: 38398 - DNA, 25 bp, S. cerevisiae
gatcagatcactacagattcactgt

SEQ ID NO: 38399 - DNA, 25 bp, S. cerevisiae
gatagtccctcgtgcactttaaaga

SEQ ID NO: 38400 - DNA, 25 bp, S. cerevisiae
gataactccacctctctggaaaaac

SEQ ID NO: 38401 - DNA, 25 bp, S. cerevisiae
gtagaagactactgcctggaaaaag

SEQ ID NO: 38402 - DNA, 25 bp, S. cerevisiae
gtagaactggtcgtgccggtaacac

SEQ ID NO: 38403 - DNA, 25 bp, S. cerevisiae
gatcaaacgttggactctgagtata

SEQ ID NO: 38404 - DNA, 25 bp, S. cerevisiae
gatcaaatgatgagacacctgtttt

SEQ ID NO: 38405 - DNA, 25 bp, S. cerevisiae
gatcacattggcgtactacatgttt

SEQ ID NO: 38406 - DNA, 25 bp, S. cerevisiae
gatcaagtcattgaccgcggttcaa

SEQ ID NO: 38407 - DNA, 25 bp, S. cerevisiae
gataattatttctcagtggttccag

SEQ ID NO: 38408 - DNA, 25 bp, S. cerevisiae
gatactggttcagaggcggtgcctt

SEQ ID NO: 38409 - DNA, 25 bp, S. cerevisiae
gatcacgttgtcgaacatgcggctg

SEQ ID NO: 38410 - DNA, 25 bp, S. cerevisiae
gatcatccgtataatttgaacctct

SEQ ID NO: 38411 - DNA, 25 bp, S. cerevisiae
gatcacacgtcttactaaaccagca

SEQ ID NO: 38412 - DNA, 25 bp, S. cerevisiae
gatcaacgttccttcaaagcctatt

SEQ ID NO: 38413 - DNA, 25 bp, S. cerevisiae
gataacgtctataccaaagcctctg

SEQ ID NO: 38414 - DNA, 25 bp, S. cerevisiae
gataacatggtctccgaagtcacta

SEQ ID NO: 38415 - DNA, 25 bp, S. cerevisiae
gtaaagatgctctggacaagtacca

SEQ ID NO: 38416 - DNA, 25 bp, S. cerevisiae
gtcaaagtcgctggagtatcgttct

SEQ ID NO: 38417 - DNA, 25 bp, S. cerevisiae
gataatggccttatttcgtttgtaa

SEQ ID NO: 38418 - DNA, 25 bp, S. cerevisiae
gatacttggcctagtttcgtttact

SEQ ID NO: 38419 - DNA, 25 bp, S. cerevisiae
gataccgctaccttagcctataatg

SEQ ID NO: 38420 - DNA, 25 bp, S. cerevisiae
gataaactacgttaacattacatgt

SEQ ID NO: 38421 - DNA, 25 bp, S. cerevisiae
gatacagactacatcgaacgctacg

SEQ ID NO: 38422 - DNA, 25 bp, S. cerevisiae
gatcaagtgcgaatgccggtcctac

SEQ ID NO: 38423 - DNA, 25 bp, S. cerevisiae
gatagaaggaattcgctgccagatt

SEQ ID NO: 38424 - DNA, 25 bp, S. cerevisiae
gataacactcaattggcttcagacg

SEQ ID NO: 38425 - DNA, 25 bp, S. cerevisiae
gataacgtggaaagcttgaacagta

SEQ ID NO: 38426 - DNA, 25 bp, S. cerevisiae
gatcatcagtggtgttgcatccgtc

SEQ ID NO: 38427 - DNA, 25 bp, S. cerevisiae
gatcaagatcctttaacggccataa

SEQ ID NO: 38428 - DNA, 25 bp, S. cerevisiae
gatcaagattggagacccgccatca

SEQ ID NO: 38429 - DNA, 25 bp, S. cerevisiae
gatcagtttcgagattatgtcaaaa

SEQ ID NO: 38430 - DNA, 25 bp, S. cerevisiae
gatagttctggtgttagtatccaca

SEQ ID NO: 38431 - DNA, 25 bp, S. cerevisiae
gatagtgacgatgttccagttccaa

SEQ ID NO: 38432 - DNA, 25 bp, S. cerevisiae
gatacgtccaaaatccagtttccta

SEQ ID NO: 38433 - DNA, 25 bp, S. cerevisiae
gatcatcctgatgcttatgagccta

SEQ ID NO: 38434 - DNA, 25 bp, S. cerevisiae
gatcacctaatatcatggcctcgta

SEQ ID NO: 38435 - DNA, 25 bp, S. cerevisiae
gataatgctttacaggccaagcgat

SEQ ID NO: 38436 - DNA, 25 bp, S. cerevisiae
gatcagacgaaaccaaccaagcaga

SEQ ID NO: 38437 - DNA, 25 bp, S. cerevisiae
gatcagattgagaaccaacaacact

SEQ ID NO: 38438 - DNA, 25 bp, S. cerevisiae
gatcatattgctggacgaagctaca

SEQ ID NO: 38439 - DNA, 25 bp, S. cerevisiae
gatacacatcagctgcttgatctct

SEQ ID NO: 38440 - DNA, 25 bp, S. cerevisiae
gataatgccatcgatatggtgacat

SEQ ID NO: 38441 - DNA, 25 bp, S. cerevisiae
gataatgccagcgattttgacatga

SEQ ID NO: 38442 - DNA, 25 bp, S. cerevisiae
gatagtacagccatattcggattca

SEQ ID NO: 38443 - DNA, 25 bp, S. cerevisiae
gatagtagcgacagtgacagtgatt

SEQ ID NO: 38444 - DNA, 25 bp, S. cerevisiae
gatcaggtgcccaagaactcgattt

SEQ ID NO: 38445 - DNA, 25 bp, S. cerevisiae
gatacacccgaagatgtcagtactg

SEQ ID NO: 38446 - DNA, 25 bp, S. cerevisiae
gatacatctccacaggctaagaacg

SEQ ID NO: 38447 - DNA, 25 bp, S. cerevisiae
gatagctcttgccaaccttgagtac

SEQ ID NO: 38448 - DNA, 25 bp, S. cerevisiae
gatacagtttcagctgcggcaacag

SEQ ID NO: 38449 - DNA, 25 bp, S. cerevisiae
gatcagagtgtctacgtaccgcaac

SEQ ID NO: 38450 - DNA, 25 bp, S. cerevisiae
gatcactgttcctaatgttgtcgtc

SEQ ID NO: 38451 - DNA, 25 bp, S. cerevisiae
gatcactcctattactttgtcagca

SEQ ID NO: 38452 - DNA, 25 bp, S. cerevisiae
gatcagtctgctacagcaccttctt

SEQ ID NO: 38453 - DNA, 25 bp, S. cerevisiae
gatcatgtatcatcccgttattttg

SEQ ID NO: 38454 - DNA, 25 bp, S. cerevisiae
gatcatgtcaactagccgtatcctt

SEQ ID NO: 38455 - DNA, 25 bp, S. cerevisiae
gatatgtacggatctgtaacgcctt

SEQ ID NO: 38456 - DNA, 25 bp, S. cerevisiae
gattttggcgactggcaaggcacac

SEQ ID NO: 38457 - DNA, 25 bp, S. cerevisiae
gatagtcgtttaaggcccgatcaaa

SEQ ID NO: 38458 - DNA, 25 bp, S. cerevisiae
gatacaggtgatgatttccccattt

SEQ ID NO: 38459 - DNA, 25 bp, S. cerevisiae
gataatggtatgcttgtccctggtt

SEQ ID NO: 38460 - DNA, 25 bp, S. cerevisiae
gatattaaccctttcgacgactcaa

SEQ ID NO: 38461 - DNA, 25 bp, S. cerevisiae
gataggaaatcctttgcgatgtgta

SEQ ID NO: 38462 - DNA, 25 bp, S. cerevisiae
gatagaaaacaatcctggtcatgat

SEQ ID NO: 38463 - DNA, 25 bp, S. cerevisiae
gataatgtcgaacacctggtcatga

SEQ ID NO: 38464 - DNA, 25 bp, S. cerevisiae
gataccagcgatgattccattgaag

SEQ ID NO: 38465 - DNA, 25 bp, S. cerevisiae
gatcaactggatccttcaattgcac

SEQ ID NO: 38466 - DNA, 25 bp, S. cerevisiae
gatcaatacgatcctgcctatatag

SEQ ID NO: 38467 - DNA, 25 bp, S. cerevisiae
gataatatcgtccatatccgcaacg

SEQ ID NO: 38468 - DNA, 25 bp, S. cerevisiae
gatacagtcctcaatgccatcgaag

SEQ ID NO: 38469 - DNA, 25 bp, S. cerevisiae
gataatcccagaagtcatcgcacgc

SEQ ID NO: 38470 - DNA, 25 bp, S. cerevisiae
gataatccgccaattatcgcctttg

SEQ ID NO: 38471 - DNA, 25 bp, S. cerevisiae
gataaacccacaagtccattcattg

SEQ ID NO: 38472 - DNA, 25 bp, S. cerevisiae
gatacttttcaatcaccgtgggcag

SEQ ID NO: 38473 - DNA, 25 bp, S. cerevisiae
gatactatttactttcgtggcaagg

SEQ ID NO: 38474 - DNA, 25 bp, S. cerevisiae
gatcaaatggtagcatctggtggaa

SEQ ID NO: 38475 - DNA, 25 bp, S. cerevisiae
gatcaacaatatttccacctggacc

SEQ ID NO: 38476 - DNA, 25 bp, S. cerevisiae
gataagatattctcacccgatagtg

SEQ ID NO: 38477 - DNA, 25 bp, S. cerevisiae
gataactttgaaaccgccattgctg

SEQ ID NO: 38478 - DNA, 25 bp, S. cerevisiae
gatcagccactggtgctaaacgtgc

SEQ ID NO: 38479 - DNA, 25 bp, S. cerevisiae
gatagccacgaattgaacctgatgt

SEQ ID NO: 38480 - DNA, 25 bp, S. cerevisiae
gatagcgcattgttaagaccgggaa

SEQ ID NO: 38481 - DNA, 25 bp, S. cerevisiae
gatagctgctatatgcacacaccct

SEQ ID NO: 38482 - DNA, 25 bp, S. cerevisiae
gatacctagattcgataacctgttg

SEQ ID NO: 38483 - DNA, 25 bp, S. cerevisiae
gatacaacaagacgcatccaactgt

SEQ ID NO: 38484 - DNA, 25 bp, S. cerevisiae
gataaatcaagaccaccacgtccac

SEQ ID NO: 38485 - DNA, 25 bp, S. cerevisiae
gataatggcacaaccgacagcgtcc

SEQ ID NO: 38486 - DNA, 25 bp, S. cerevisiae
gatcaactatcacccctaagaggta

SEQ ID NO: 38487 - DNA, 25 bp, S. cerevisiae
gatagcacctccaccatattgggaa

SEQ ID NO: 38488 - DNA, 25 bp, S. cerevisiae
gataagccgccaaacctgggaggta

SEQ ID NO: 38489 - DNA, 25 bp, S. cerevisiae
gatacgcggacttactatacaggtt

SEQ ID NO: 38490 - DNA, 25 bp, S. cerevisiae
gatacgaggtcttacatacccttaa

SEQ ID NO: 38491 - DNA, 25 bp, S. cerevisiae
gatcagcgagttggtttcatgcgaa

SEQ ID NO: 38492 - DNA, 25 bp, S. cerevisiae
gatcagccatctattctacaggaag

SEQ ID NO: 38493 - DNA, 25 bp, S. cerevisiae
gatacatgccatacatttgcagcag

SEQ ID NO: 38494 - DNA, 25 bp, S. cerevisiae
gatcaagatcgagtcccaactgtta

SEQ ID NO: 38495 - DNA, 25 bp, S. cerevisiae
gatcacggctcgtacgatgacggta

SEQ ID NO: 38496 - DNA, 25 bp, S. cerevisiae
gatacggctctatattagggttttc

SEQ ID NO: 38497 - DNA, 25 bp, S. cerevisiae
tgcagactgggcaccattagagttt

SEQ ID NO: 38498 - DNA, 25 bp, S. cerevisiae
ggcagttgatgctcttcgaagtttg

SEQ ID NO: 38499 - DNA, 25 bp, S. cerevisiae
gatcaattggacgttcgagcaggtt

SEQ ID NO: 38500 - DNA, 25 bp, S. cerevisiae
gatacgcagctccagtctatatgat

SEQ ID NO: 38501 - DNA, 25 bp, S. cerevisiae
gatcacagcgatagtgtctttcatt

SEQ ID NO: 38502 - DNA, 25 bp, S. cerevisiae
gatacgtaccagattctatttcgca

SEQ ID NO: 38503 - DNA, 25 bp, S. cerevisiae
gatacttggatctcttgacttttca

SEQ ID NO: 38504 - DNA, 25 bp, S. cerevisiae
gatacttggttggtggtgcttctaa

SEQ ID NO: 38505 - DNA, 25 bp, S. cerevisiae
gataaagctcttctgcaatttgccg

SEQ ID NO: 38506 - DNA, 25 bp, S. cerevisiae
gataatatccttctgaattcccaag

SEQ ID NO: 38507 - DNA, 25 bp, S. cerevisiae
gatagcaaaccttcgaaacctttca

SEQ ID NO: 38508 - DNA, 25 bp, S. cerevisiae
gatactatcgactttgaagccattg

SEQ ID NO: 38509 - DNA, 25 bp, S. cerevisiae
gataagatcgactcaggttgcaata

SEQ ID NO: 38510 - DNA, 25 bp, S. cerevisiae
gataaccgactttggcttcgcaaaa

SEQ ID NO: 38511 - DNA, 25 bp, S. cerevisiae
gatactcttcctcattttccaaaaa

SEQ ID NO: 38512 - DNA, 25 bp, S. cerevisiae
gatcacagcttcttttctttctaaa

SEQ ID NO: 38513 - DNA, 25 bp, S. cerevisiae
gatcaatgtgtctccgttttactaa

SEQ ID NO: 38514 - DNA, 25 bp, S. cerevisiae
gataatgtgttgctctacgttacta

SEQ ID NO: 38515 - DNA, 25 bp, S. cerevisiae
gataaattcaaactgccgcctactt

SEQ ID NO: 38516 - DNA, 25 bp, S. cerevisiae
gataattacgaactcacggcaacat

SEQ ID NO: 38517 - DNA, 25 bp, S. cerevisiae
gatacagtggattcttcagtcgata

SEQ ID NO: 38518 - DNA, 25 bp, S. cerevisiae
gatacacgagtgtctgggatgcgct

SEQ ID NO: 38519 - DNA, 25 bp, S. cerevisiae
gatactcagcactcgaagacttcat

SEQ ID NO: 38520 - DNA, 25 bp, S. cerevisiae
gatactctatcatctgcaatgggta

SEQ ID NO: 38521 - DNA, 25 bp, S. cerevisiae
gataattctcagttgtataggacat

SEQ ID NO: 38522 - DNA, 25 bp, S. cerevisiae
gataatgtcttcttgtttggtaacc

SEQ ID NO: 38523 - DNA, 25 bp, S. cerevisiae
gataatttcactattcctgtcctgt

SEQ ID NO: 38524 - DNA, 25 bp, S. cerevisiae
gatcaatttcccttacaatccactg

SEQ ID NO: 38525 - DNA, 25 bp, S. cerevisiae
gatcaattccatcgcgatacaatat

SEQ ID NO: 38526 - DNA, 25 bp, S. cerevisiae
gatcaaaccgtgtcaagcaattttc

SEQ ID NO: 38527 - DNA, 25 bp, S. cerevisiae
gataaacacatttgcaccacttcag

SEQ ID NO: 38528 - DNA, 25 bp, S. cerevisiae
gataaagattatagccccttcagaa

SEQ ID NO: 38529 - DNA, 25 bp, S. cerevisiae
gatcaaaattcgacccttggcaaca

SEQ ID NO: 38530 - DNA, 25 bp, S. cerevisiae
gatacaagcattgaactcgggtaca

SEQ ID NO: 38531 - DNA, 25 bp, S. cerevisiae
gatagcgaatctgttccacgttagt

SEQ ID NO: 38532 - DNA, 25 bp, S. cerevisiae
gatactgaactgatacgcgatttga

SEQ ID NO: 38533 - DNA, 25 bp, S. cerevisiae
gatactgacgatactatggctttaa

SEQ ID NO: 38534 - DNA, 25 bp, S. cerevisiae
gatactgtctcgagggtgctggata

SEQ ID NO: 38535 - DNA, 25 bp, S. cerevisiae
gatacagtactttcggctctgctga

SEQ ID NO: 38536 - DNA, 25 bp, S. cerevisiae
gataatcagtttggcgcgttcgact

SEQ ID NO: 38537 - DNA, 25 bp, S. cerevisiae
gataactttagcgaagtgactccaa

SEQ ID NO: 38538 - DNA, 25 bp, S. cerevisiae
gtagttatatagcagggacccacgg

SEQ ID NO: 38539 - DNA, 25 bp, S. cerevisiae
gataggtttgcacagctggatcctc

SEQ ID NO: 38540 - DNA, 25 bp, S. cerevisiae
gatacgttacaatggtacctccgaa

SEQ ID NO: 38541 - DNA, 25 bp, S. cerevisiae
gatacttcaaagtgttacccctaat

SEQ ID NO: 38542 - DNA, 25 bp, S. cerevisiae
gatactaagtagtgttcctccctta

SEQ ID NO: 38543 - DNA, 25 bp, S. cerevisiae
gatactttcgttcatgttaccgatt

SEQ ID NO: 38544 - DNA, 25 bp, S. cerevisiae
gatacctttgtacatgttaccgatt

SEQ ID NO: 38545 - DNA, 25 bp, S. cerevisiae
gataactttgaatatttagcccagc

SEQ ID NO: 38546 - DNA, 25 bp, S. cerevisiae
gataccagcgatttatgttctacgg

SEQ ID NO: 38547 - DNA, 25 bp, S. cerevisiae
gatcaatctgtcaaggtgtctcgta

SEQ ID NO: 38548 - DNA, 25 bp, S. cerevisiae
gtaccatgcatcaagacggctacca

SEQ ID NO: 38549 - DNA, 25 bp, S. cerevisiae
gatagcatatctaatccggtagcca

SEQ ID NO: 38550 - DNA, 25 bp, S. cerevisiae
gataattgcttctttggttccacaa

SEQ ID NO: 38551 - DNA, 25 bp, S. cerevisiae
gatagtgatcttgtgctgcgactca

SEQ ID NO: 38552 - DNA, 25 bp, S. cerevisiae
gatacatttatggtgtcgactcgta

SEQ ID NO: 38553 - DNA, 25 bp, S. cerevisiae
gataagttggtttcagactctctct

SEQ ID NO: 38554 - DNA, 25 bp, S. cerevisiae
gataagttggttttgctcacacctt

SEQ ID NO: 38555 - DNA, 25 bp, S. cerevisiae
gataagccttggaattgtccccatg

SEQ ID NO: 38556 - DNA, 25 bp, S. cerevisiae
gatacaccttggaaaatgaccctga

SEQ ID NO: 38557 - DNA, 25 bp, S. cerevisiae
gatcaagcgtgtcaaaatgcaacaa

SEQ ID NO: 38558 - DNA, 25 bp, S. cerevisiae
gatacacctgtgtacaaattgacag

SEQ ID NO: 38559 - DNA, 25 bp, S. cerevisiae
gataccttggataaaccttcagtaa

SEQ ID NO: 38560 - DNA, 25 bp, S. cerevisiae
gataaagtcattcacaaattctcaa

SEQ ID NO: 38561 - DNA, 25 bp, S. cerevisiae
gataatatctctcgtagtagcatgt

SEQ ID NO: 38562 - DNA, 25 bp, S. cerevisiae
gataatattcatcctcgcatacagt

SEQ ID NO: 38563 - DNA, 25 bp, S. cerevisiae
gataatgattcaagcgtaccactaa

SEQ ID NO: 38564 - DNA, 25 bp, S. cerevisiae
gatacccgctactcaacgtgatata

SEQ ID NO: 38565 - DNA, 25 bp, S. cerevisiae
gataccggttgctacatgtttgact

SEQ ID NO: 38566 - DNA, 25 bp, S. cerevisiae
gataccggtgcctgattttaatatt

SEQ ID NO: 38567 - DNA, 25 bp, S. cerevisiae
gatagaccgcccttgaaacagaaat

SEQ ID NO: 38568 - DNA, 25 bp, S. cerevisiae
gatacctggcctttcgtatcaggaa

SEQ ID NO: 38569 - DNA, 25 bp, S. cerevisiae
gatagtgccgccctacgtgaagaat

SEQ ID NO: 38570 - DNA, 25 bp, S. cerevisiae
gatagaggccctgcaccagaagtac

SEQ ID NO: 38571 - DNA, 25 bp, S. cerevisiae
gataacccactaactcgcttgaatt

SEQ ID NO: 38572 - DNA, 25 bp, S. cerevisiae
gatacctcatccttctgaaaaccta

SEQ ID NO: 38573 - DNA, 25 bp, S. cerevisiae
gataattcctccgtcaaaaactcag

SEQ ID NO: 38574 - DNA, 25 bp, S. cerevisiae
gataattcacattcaccactaacag

SEQ ID NO: 38575 - DNA, 25 bp, S. cerevisiae
gataagtcagcgtcaggcaccaaat

SEQ ID NO: 38576 - DNA, 25 bp, S. cerevisiae
gataggtttcaactccacaggttat

SEQ ID NO: 38577 - DNA, 25 bp, S. cerevisiae
gataaattgacctccacagctgttt

SEQ ID NO: 38578 - DNA, 25 bp, S. cerevisiae
gatacagttccttagttcctattga

SEQ ID NO: 38579 - DNA, 25 bp, S. cerevisiae
gatacaaatcttgttctgccttcgc

SEQ ID NO: 38580 - DNA, 25 bp, S. cerevisiae
gataatcctatccttacatccaatc

SEQ ID NO: 38581 - DNA, 25 bp, S. cerevisiae
gataagcatttttgtattccactgt

SEQ ID NO: 38582 - DNA, 25 bp, S. cerevisiae
gataacaattcttttcctacgatgt

SEQ ID NO: 38583 - DNA, 25 bp, S. cerevisiae
gatatacttcggttgctcaaacgtt

SEQ ID NO: 38584 - DNA, 25 bp, S. cerevisiae
gatacgctggtctgcaaaccacatg

SEQ ID NO: 38585 - DNA, 25 bp, S. cerevisiae
gatacggacttactgaacctgttac

SEQ ID NO: 38586 - DNA, 25 bp, S. cerevisiae
gttcttgttcggaccaactttagct

SEQ ID NO: 38587 - DNA, 25 bp, S. cerevisiae
gtagatcttttacaacctcttttat

SEQ ID NO: 38588 - DNA, 25 bp, S. cerevisiae
gataactggtttcaaaagctctttt

SEQ ID NO: 38589 - DNA, 25 bp, S. cerevisiae
gataagtgcgctactcaacagaatt

SEQ ID NO: 38590 - DNA, 25 bp, S. cerevisiae
gatatccctgatgacgaagtcgcct

SEQ ID NO: 38591 - DNA, 25 bp, S. cerevisiae
gatatcttcgcaaacggaatcccaa

SEQ ID NO: 38592 - DNA, 25 bp, S. cerevisiae
gatactatgacgtactcgcagggct

SEQ ID NO: 38593 - DNA, 25 bp, S. cerevisiae
gatactgagaggcaatcacgagtct

SEQ ID NO: 38594 - DNA, 25 bp, S. cerevisiae
gataatgacaccgagcacgcaagta

SEQ ID NO: 38595 - DNA, 25 bp, S. cerevisiae
gatatcagggccgactgctgcaaaa

SEQ ID NO: 38596 - DNA, 25 bp, S. cerevisiae
gataagctctataaacctgcaggaa

SEQ ID NO: 38597 - DNA, 25 bp, S. cerevisiae
gataagttcatcaagaccgcgacat

SEQ ID NO: 38598 - DNA, 25 bp, S. cerevisiae
gatagatctccaataccgcaaacac

SEQ ID NO: 38599 - DNA, 25 bp, S. cerevisiae
gataagttgctagcccttgttgata

SEQ ID NO: 38600 - DNA, 25 bp, S. cerevisiae
gataatgactctatctccttgaaga

SEQ ID NO: 38601 - DNA, 25 bp, S. cerevisiae
gatagcaagaataatgtccccgccg

SEQ ID NO: 38602 - DNA, 25 bp, S. cerevisiae
gatagtagataacttccccacttta

SEQ ID NO: 38603 - DNA, 25 bp, S. cerevisiae
gatttcggagccacaaacactttca

SEQ ID NO: 38604 - DNA, 25 bp, S. cerevisiae
gattaatatgccaccggaagtcgtt

SEQ ID NO: 38605 - DNA, 25 bp, S. cerevisiae
gattacatgggagccgccaagtcca

SEQ ID NO: 38606 - DNA, 25 bp, S. cerevisiae
gataccctcgaagacgaagctctac

SEQ ID NO: 38607 - DNA, 25 bp, S. cerevisiae
gatagcccacggtaaccaattgata

SEQ ID NO: 38608 - DNA, 25 bp, S. cerevisiae
gataagaaacgtactgcctctttag

SEQ ID NO: 38609 - DNA, 25 bp, S. cerevisiae
gatagattccatttggcaatcctag

SEQ ID NO: 38610 - DNA, 25 bp, S. cerevisiae
gatactcccagttgcaaatcttact

SEQ ID NO: 38611 - DNA, 25 bp, S. cerevisiae
gatactatcgtggaggcgtttggtt

SEQ ID NO: 38612 - DNA, 25 bp, S. cerevisiae
gatactccggaacgttctttgcata

SEQ ID NO: 38613 - DNA, 25 bp, S. cerevisiae
gataacaagcctacgttttcagaga

SEQ ID NO: 38614 - DNA, 25 bp, S. cerevisiae
gataaattcctacttttcagtgcag

SEQ ID NO: 38615 - DNA, 25 bp, S. cerevisiae
gataagatgttcatggtcctggaat

SEQ ID NO: 38616 - DNA, 25 bp, S. cerevisiae
gataagatcttttgcgttcatggag

SEQ ID NO: 38617 - DNA, 25 bp, S. cerevisiae
gatacagttcatatggaatacgaga

SEQ ID NO: 38618 - DNA, 25 bp, S. cerevisiae
gatactggtccaaatgctccatcga

SEQ ID NO: 38619 - DNA, 25 bp, S. cerevisiae
gatagccaatcgtatagctcgcttg

SEQ ID NO: 38620 - DNA, 25 bp, S. cerevisiae
gatagctgaagccaattcctcattg

SEQ ID NO: 38621 - DNA, 25 bp, S. cerevisiae
gatactgacgccgatatcctagcat

SEQ ID NO: 38622 - DNA, 25 bp, S. cerevisiae
gatactgtcgtcgaagcagcaacaa

SEQ ID NO: 38623 - DNA, 25 bp, S. cerevisiae
gatagcgatcactcaagcaggaaac

SEQ ID NO: 38624 - DNA, 25 bp, S. cerevisiae
gatagccattgctagcaccatggga

SEQ ID NO: 38625 - DNA, 25 bp, S. cerevisiae
gatatgcttgatgatgactcgttga

SEQ ID NO: 38626 - DNA, 25 bp, S. cerevisiae
gatacatctgatgcatcgttgtcag

SEQ ID NO: 38627 - DNA, 25 bp, S. cerevisiae
gatacattatactccttggtttcaa

SEQ ID NO: 38628 - DNA, 25 bp, S. cerevisiae
gatacacttggctctttacttagaa

SEQ ID NO: 38629 - DNA, 25 bp, S. cerevisiae
gatacctttgccaatttaatcgaga

SEQ ID NO: 38630 - DNA, 25 bp, S. cerevisiae
gatacctactcattttttacctctc

SEQ ID NO: 38631 - DNA, 25 bp, S. cerevisiae
gatactttctctttattttattagc

SEQ ID NO: 38632 - DNA, 25 bp, S. cerevisiae
gatacgattgttctttctgtggtaa

SEQ ID NO: 38633 - DNA, 25 bp, S. cerevisiae
gatagggttttattctgtcggtgaa

SEQ ID NO: 38634 - DNA, 25 bp, S. cerevisiae
gatagtggttggtacgcttgcattt

SEQ ID NO: 38635 - DNA, 25 bp, S. cerevisiae
gatagcggtttcacgtgtgctgatt

SEQ ID NO: 38636 - DNA, 25 bp, S. cerevisiae
gatacgtttaggtctggtgcagttg

SEQ ID NO: 38637 - DNA, 25 bp, S. cerevisiae
gataccgcagattcactactaaagg

SEQ ID NO: 38638 - DNA, 25 bp, S. cerevisiae
gatacagcggtattctattcaaaag

SEQ ID NO: 38639 - DNA, 25 bp, S. cerevisiae
gatagtacggacttgatgcacgtga

SEQ ID NO: 38640 - DNA, 25 bp, S. cerevisiae
gatactactggatctcaatcgttag

SEQ ID NO: 38641 - DNA, 25 bp, S. cerevisiae
gatactgaaagtgttgccgcgtttt

SEQ ID NO: 38642 - DNA, 25 bp, S. cerevisiae
gtaggtaactcatttcctccaactg

SEQ ID NO: 38643 - DNA, 25 bp, S. cerevisiae
gttggataacttctcacccaagaga

SEQ ID NO: 38644 - DNA, 25 bp, S. cerevisiae
tatcgtgaacgcaccttcgggaaac

SEQ ID NO: 38645 - DNA, 25 bp, S. cerevisiae
gataacagcgttttcagccggaata

SEQ ID NO: 38646 - DNA, 25 bp, S. cerevisiae
gatagccgcctccaagaacgtaaaa

SEQ ID NO: 38647 - DNA, 25 bp, S. cerevisiae
gatacccttcgggacaagatgagaa

SEQ ID NO: 38648 - DNA, 25 bp, S. cerevisiae
gatagcgcgctttcgattgtcaaga

SEQ ID NO: 38649 - DNA, 25 bp, S. cerevisiae
gataaattctacattgccgctgaca

SEQ ID NO: 38650 - DNA, 25 bp, S. cerevisiae
gataaatttgttacgcctcaggcaa

SEQ ID NO: 38651 - DNA, 25 bp, S. cerevisiae
gatacagatttatttggcgccccaa

SEQ ID NO: 38652 - DNA, 25 bp, S. cerevisiae
gatagcaatacttttggccccattt

SEQ ID NO: 38653 - DNA, 25 bp, S. cerevisiae
gatagaatagagtttgaccccaaga

SEQ ID NO: 38654 - DNA, 25 bp, S. cerevisiae
gataggccaaaatcagtcccacctg

SEQ ID NO: 38655 - DNA, 25 bp, S. cerevisiae
gatattctaattttggccctacccg

SEQ ID NO: 38656 - DNA, 25 bp, S. cerevisiae
gatactgctaatattgcctcatttc

SEQ ID NO: 38657 - DNA, 25 bp, S. cerevisiae
gatacgctgaagattcccatcattg

SEQ ID NO: 38658 - DNA, 25 bp, S. cerevisiae
gataacaaagtttctccagcagctg

SEQ ID NO: 38659 - DNA, 25 bp, S. cerevisiae
gatacgtccacgattctgcaaagaa

SEQ ID NO: 38660 - DNA, 25 bp, S. cerevisiae
gatattgaccggctgctggaatttt

SEQ ID NO: 38661 - DNA, 25 bp, S. cerevisiae
gatacagcattaccaagcaatattg

SEQ ID NO: 38662 - DNA, 25 bp, S. cerevisiae
gatacaccttctacactgtttcaaa

SEQ ID NO: 38663 - DNA, 25 bp, S. cerevisiae
gatacccctcttcgtgatggtgata

SEQ ID NO: 38664 - DNA, 25 bp, S. cerevisiae
gatatcgccctatacttgggtgata

SEQ ID NO: 38665 - DNA, 25 bp, S. cerevisiae
gatatcatgacacaccagctatggt

SEQ ID NO: 38666 - DNA, 25 bp, S. cerevisiae
gatacagacaatcccgctatttcaa

SEQ ID NO: 38667 - DNA, 25 bp, S. cerevisiae
gatacaagcactcaagcttacgaag

SEQ ID NO: 38668 - DNA, 25 bp, S. cerevisiae
gataaagtcaccaactccacaggag

SEQ ID NO: 38669 - DNA, 25 bp, S. cerevisiae
gataaattacgcacctctaagtttt

SEQ ID NO: 38670 - DNA, 25 bp, S. cerevisiae
gttgcagatcatcaacccggcaaaa

SEQ ID NO: 38671 - DNA, 25 bp, S. cerevisiae
gatacagactcaaacctcggtaata

SEQ ID NO: 38672 - DNA, 25 bp, S. cerevisiae
gataaacgcaaaccgctgtctgaat

SEQ ID NO: 38673 - DNA, 25 bp, S. cerevisiae
gataaatcgggacctgctgtgcaaa

SEQ ID NO: 38674 - DNA, 25 bp, S. cerevisiae
gatacgtcagattcacctcaagatg

SEQ ID NO: 38675 - DNA, 25 bp, S. cerevisiae
gatactgtgctgttcccatagctag

SEQ ID NO: 38676 - DNA, 25 bp, S. cerevisiae
gatattgaaggctcccactgacgta

SEQ ID NO: 38677 - DNA, 25 bp, S. cerevisiae
gatacggtaattggtcctcacggca

SEQ ID NO: 38678 - DNA, 25 bp, S. cerevisiae
gatacgtgtacattagtgcccaaga

SEQ ID NO: 38679 - DNA, 25 bp, S. cerevisiae
gatatctcggactaactcgggtacc

SEQ ID NO: 38680 - DNA, 25 bp, S. cerevisiae
gatttcgctatcacagtccatggaa

SEQ ID NO: 38681 - DNA, 25 bp, S. cerevisiae
gatacattttcttcgtccatcagta

SEQ ID NO: 38682 - DNA, 25 bp, S. cerevisiae
gatacagctatataccaccacaaat

SEQ ID NO: 38683 - DNA, 25 bp, S. cerevisiae
gatagacacatttacgttggccctc

SEQ ID NO: 38684 - DNA, 25 bp, S. cerevisiae
gatatagaaggccacgtcggcgccc

SEQ ID NO: 38685 - DNA, 25 bp, S. cerevisiae
gatacgaaatcaacttcccgcagaa

SEQ ID NO: 38686 - DNA, 25 bp, S. cerevisiae
gatacaaaatcggttcgccatgcat

SEQ ID NO: 38687 - DNA, 25 bp, S. cerevisiae
gatacgggagcacttcttgtttata

SEQ ID NO: 38688 - DNA, 25 bp, S. cerevisiae
gatacgagcttatttttcttcaatg

SEQ ID NO: 38689 - DNA, 25 bp, S. cerevisiae
gatagagcacttactgcagccgtta

SEQ ID NO: 38690 - DNA, 25 bp, S. cerevisiae
gatacagcgaatacacagccgttca

SEQ ID NO: 38691 - DNA, 25 bp, S. cerevisiae
gatacagcaaattcatcgccactat

SEQ ID NO: 38692 - DNA, 25 bp, S. cerevisiae
gataccaatgatatactaggcgatt

SEQ ID NO: 38693 - DNA, 25 bp, S. cerevisiae
gataccagagatattgttgcggaca

SEQ ID NO: 38694 - DNA, 25 bp, S. cerevisiae
gatagctcagcacttgttctagggc

SEQ ID NO: 38695 - DNA, 25 bp, S. cerevisiae
gatatagttggtgctctcagaagga

SEQ ID NO: 38696 - DNA, 25 bp, S. cerevisiae
gatattaacgtggtccatgccgagt

SEQ ID NO: 38697 - DNA, 25 bp, S. cerevisiae
gataaatactgtggtttcattagat

SEQ ID NO: 38698 - DNA, 25 bp, S. cerevisiae
gatacaatctctgcgtttcataaat

SEQ ID NO: 38699 - DNA, 25 bp, S. cerevisiae
gatactgcctcatattctacaggaa

SEQ ID NO: 38700 - DNA, 25 bp, S. cerevisiae
gatatccctatttctgttaggcaag

SEQ ID NO: 38701 - DNA, 25 bp, S. cerevisiae
gatacataccgaacgagtcttccga

SEQ ID NO: 38702 - DNA, 25 bp, S. cerevisiae
gatatcggcaacactgcgctatcag

SEQ ID NO: 38703 - DNA, 25 bp, S. cerevisiae
gatacctgcaacaactagtgccaat

SEQ ID NO: 38704 - DNA, 25 bp, S. cerevisiae
gatacttcatacatgctagccgcat

SEQ ID NO: 38705 - DNA, 25 bp, S. cerevisiae
gatatcgtctggaacaatgccctgc

SEQ ID NO: 38706 - DNA, 25 bp, S. cerevisiae
gataccattgcaagaatagccactg

SEQ ID NO: 38707 - DNA, 25 bp, S. cerevisiae
gatacatcgacttggaagctcctgt

SEQ ID NO: 38708 - DNA, 25 bp, S. cerevisiae
gatattcatgcagtggctagcgtat

SEQ ID NO: 38709 - DNA, 25 bp, S. cerevisiae
gatatcgatgacgttagtgcttcca

SEQ ID NO: 38710 - DNA, 25 bp, S. cerevisiae
gatatcgatgcatccttagattaca

SEQ ID NO: 38711 - DNA, 25 bp, S. cerevisiae
gataccagcgtcatttactagcaat

SEQ ID NO: 38712 - DNA, 25 bp, S. cerevisiae
gatactccggtctttgattgcactt

SEQ ID NO: 38713 - DNA, 25 bp, S. cerevisiae
gatatgtcccgtccattagatgtta

SEQ ID NO: 38714 - DNA, 25 bp, S. cerevisiae
gataggctcacgttctgaatgcaaa

SEQ ID NO: 38715 - DNA, 25 bp, S. cerevisiae
gataggtacatctacagcgtccagg

SEQ ID NO: 38716 - DNA, 25 bp, S. cerevisiae
gatagactacgatcaggcgcgcaag

SEQ ID NO: 38717 - DNA, 25 bp, S. cerevisiae
gatacactaagaactgtttcggcag

SEQ ID NO: 38718 - DNA, 25 bp, S. cerevisiae
gattcttgcttatcgtttttggaag

SEQ ID NO: 38719 - DNA, 25 bp, S. cerevisiae
gatactgtaaatgccgtgttcatca

SEQ ID NO: 38720 - DNA, 25 bp, S. cerevisiae
gatagtttagtagtgggcagcccat

SEQ ID NO: 38721 - DNA, 25 bp, S. cerevisiae
gatagtcgaaagtcgtgtagcctta

SEQ ID NO: 38722 - DNA, 25 bp, S. cerevisiae
gataccaactagcttaattcctgaa

SEQ ID NO: 38723 - DNA, 25 bp, S. cerevisiae
gatacatgccctcctataaacttta

SEQ ID NO: 38724 - DNA, 25 bp, S. cerevisiae
gatactgctattacttcatggtacg

SEQ ID NO: 38725 - DNA, 25 bp, S. cerevisiae
gatactctctgaaaacgcggaagca

SEQ ID NO: 38726 - DNA, 25 bp, S. cerevisiae
gatacttctgatatctgggcaaaga

SEQ ID NO: 38727 - DNA, 25 bp, S. cerevisiae
gattcttctccctggaacaaacact

SEQ ID NO: 38728 - DNA, 25 bp, S. cerevisiae
gattcgtctctataaggcaaaacca

SEQ ID NO: 38729 - DNA, 25 bp, S. cerevisiae
gatagtgcgccaatgcatatacgtt

SEQ ID NO: 38730 - DNA, 25 bp, S. cerevisiae
gatactgccgcaatgaacctgaata

SEQ ID NO: 38731 - DNA, 25 bp, S. cerevisiae
gataccgtcaaatcgctgataacga

SEQ ID NO: 38732 - DNA, 25 bp, S. cerevisiae
gatactcgagatcaacaagtttcca

SEQ ID NO: 38733 - DNA, 25 bp, S. cerevisiae
gatactaaatcctttttcttgctaa

SEQ ID NO: 38734 - DNA, 25 bp, S. cerevisiae
gatactcatcagcattttcctctag

SEQ ID NO: 38735 - DNA, 25 bp, S. cerevisiae
gatacttcaactatatgccttcgag

SEQ ID NO: 38736 - DNA, 25 bp, S. cerevisiae
gatacattccatccagtacgtgtga

SEQ ID NO: 38737 - DNA, 25 bp, S. cerevisiae
gatactatgcccctaacgcaagaac

SEQ ID NO: 38738 - DNA, 25 bp, S. cerevisiae
gatactcatcccatcacaaaagcta

SEQ ID NO: 38739 - DNA, 25 bp, S. cerevisiae
gatactttccataacacttctgtaa

SEQ ID NO: 38740 - DNA, 25 bp, S. cerevisiae
gatattagtcccacgttcgctgaag

SEQ ID NO: 38741 - DNA, 25 bp, S. cerevisiae
gatactatggccctttgttggtaaa

SEQ ID NO: 38742 - DNA, 25 bp, S. cerevisiae
gatatgatgtcccactattccatgg

SEQ ID NO: 38743 - DNA, 25 bp, S. cerevisiae
gataccaaggtcaagcagctctcgt

SEQ ID NO: 38744 - DNA, 25 bp, S. cerevisiae
gatatcaagttctttccccgaacta

SEQ ID NO: 38745 - DNA, 25 bp, S. cerevisiae
gatataatgagtgagctgcccgctt

SEQ ID NO: 38746 - DNA, 25 bp, S. cerevisiae
gatagtgatatttcgaccagctctt

SEQ ID NO: 38747 - DNA, 25 bp, S. cerevisiae
gatagtcctgattccaacagcattt

SEQ ID NO: 38748 - DNA, 25 bp, S. cerevisiae
gatagactatgttccacgcatcatc

SEQ ID NO: 38749 - DNA, 25 bp, S. cerevisiae
gatagctcttcctcagatgattcgg

SEQ ID NO: 38750 - DNA, 25 bp, S. cerevisiae
gatagcctttcatcagtcgtacagt

SEQ ID NO: 38751 - DNA, 25 bp, S. cerevisiae
gatagagccacctataccgtacagt

SEQ ID NO: 38752 - DNA, 25 bp, S. cerevisiae
gatactaacgtcaacactgctgcca

SEQ ID NO: 38753 - DNA, 25 bp, S. cerevisiae
gatagatcaaccctggaatgcccaa

SEQ ID NO: 38754 - DNA, 25 bp, S. cerevisiae
gataccattcgtcctgattgggaga

SEQ ID NO: 38755 - DNA, 25 bp, S. cerevisiae
gatatgtgactgtctgcagctatgt

SEQ ID NO: 38756 - DNA, 25 bp, S. cerevisiae
gatagtagcgatagcagccttggaa

SEQ ID NO: 38757 - DNA, 25 bp, S. cerevisiae
gatagtgcactgatcttaatgtata

SEQ ID NO: 38758 - DNA, 25 bp, S. cerevisiae
gattctgacgccacggaacaagttc

SEQ ID NO: 38759 - DNA, 25 bp, S. cerevisiae
gatactcaacccttacacgtgtatt

SEQ ID NO: 38760 - DNA, 25 bp, S. cerevisiae
gatactaccccattaccagatgttg

SEQ ID NO: 38761 - DNA, 25 bp, S. cerevisiae
gatactactcctggtgagcaagcag

SEQ ID NO: 38762 - DNA, 25 bp, S. cerevisiae
gatactccgatttcgtcagattacg

SEQ ID NO: 38763 - DNA, 25 bp, S. cerevisiae
gataggtatgttcggatcttcgata

SEQ ID NO: 38764 - DNA, 25 bp, S. cerevisiae
gatatccgtatccaccagaaacata

SEQ ID NO: 38765 - DNA, 25 bp, S. cerevisiae
gatatcccatttttcgacaagctga

SEQ ID NO: 38766 - DNA, 25 bp, S. cerevisiae
gatactctcttgttcaaggcgccaa

SEQ ID NO: 38767 - DNA, 25 bp, S. cerevisiae
gatatcgtctacgtggagaacccaa

SEQ ID NO: 38768 - DNA, 25 bp, S. cerevisiae
gatattcctgtcgagtacggacctg

SEQ ID NO: 38769 - DNA, 25 bp, S. cerevisiae
gatttgctacatgcgtcagctgtga

SEQ ID NO: 38770 - DNA, 25 bp, S. cerevisiae
gatagtctattctcctttaaaaagc

SEQ ID NO: 38771 - DNA, 25 bp, S. cerevisiae
gatagtaaatcaccgctgctgctaa

SEQ ID NO: 38772 - DNA, 25 bp, S. cerevisiae
gatatcgcgtgctatgaccaaatta

SEQ ID NO: 38773 - DNA, 25 bp, S. cerevisiae
gatacggcatctattgaggagcaac

SEQ ID NO: 38774 - DNA, 25 bp, S. cerevisiae
gatatgaagcttccttgcgtcaatt

SEQ ID NO: 38775 - DNA, 25 bp, S. cerevisiae
gatagtctagatcctttttctgaag

SEQ ID NO: 38776 - DNA, 25 bp, S. cerevisiae
gatacctagacagacttggccaaga

SEQ ID NO: 38777 - DNA, 25 bp, S. cerevisiae
gatacctgaaagcattctggaacct

SEQ ID NO: 38778 - DNA, 25 bp, S. cerevisiae
gatactgagatttctgaggcgccca

SEQ ID NO: 38779 - DNA, 25 bp, S. cerevisiae
gatagtgatgatttgccattggctc

SEQ ID NO: 38780 - DNA, 25 bp, S. cerevisiae
gatagaatgctagcgctctttgctg

SEQ ID NO: 38781 - DNA, 25 bp, S. cerevisiae
gatatacccgatggctcattgattg

SEQ ID NO: 38782 - DNA, 25 bp, S. cerevisiae
gatacctatcagacaaccataccat

SEQ ID NO: 38783 - DNA, 25 bp, S. cerevisiae
gataccatatgcaggtgtttccttt

SEQ ID NO: 38784 - DNA, 25 bp, S. cerevisiae
gatatcgaagccgtggttactcttt

SEQ ID NO: 38785 - DNA, 25 bp, S. cerevisiae
gatacggttagcaacgtcacaatca

SEQ ID NO: 38786 - DNA, 25 bp, S. cerevisiae
gattgagtttcaaccttcccaagga

SEQ ID NO: 38787 - DNA, 25 bp, S. cerevisiae
gatataccgtagcagtttcccacga

SEQ ID NO: 38788 - DNA, 25 bp, S. cerevisiae
gatatggccttcaaatgtccaattt

SEQ ID NO: 38789 - DNA, 25 bp, S. cerevisiae
gatatggttgatctgtcctcttttg

SEQ ID NO: 38790 - DNA, 25 bp, S. cerevisiae
gataggtctatcttgttccataatt

SEQ ID NO: 38791 - DNA, 25 bp, S. cerevisiae
gatatggtgctattttggccaatac

SEQ ID NO: 38792 - DNA, 25 bp, S. cerevisiae
gatatactattttccgatcatcggc

SEQ ID NO: 38793 - DNA, 25 bp, S. cerevisiae
gatagagcattcttttcgaactggg

SEQ ID NO: 38794 - DNA, 25 bp, S. cerevisiae
gataggttcattaccgaatcagcga

SEQ ID NO: 38795 - DNA, 25 bp, S. cerevisiae
gataggttttatccaggcacgctgt

SEQ ID NO: 38796 - DNA, 25 bp, S. cerevisiae
gataggttctactacgaccctgtag

SEQ ID NO: 38797 - DNA, 25 bp, S. cerevisiae
gatatggtgatttatttccctgtgc

SEQ ID NO: 38798 - DNA, 25 bp, S. cerevisiae
gatagagttctgtcttttctctctc

SEQ ID NO: 38799 - DNA, 25 bp, S. cerevisiae
gatatgttctattttacagggcgac

SEQ ID NO: 38800 - DNA, 25 bp, S. cerevisiae
gattgaacttttgaaggactccgag

SEQ ID NO: 38801 - DNA, 25 bp, S. cerevisiae
gattgaacactttgaaaatgacccc

SEQ ID NO: 38802 - DNA, 25 bp, S. cerevisiae
gatagaactaacgaccttacgaatt

SEQ ID NO: 38803 - DNA, 25 bp, S. cerevisiae
gatataacttccaaacctcctgcaa

SEQ ID NO: 38804 - DNA, 25 bp, S. cerevisiae
gatattacttagacaagccggcgaa

SEQ ID NO: 38805 - DNA, 25 bp, S. cerevisiae
gatttggtttggtaccaggccaata

SEQ ID NO: 38806 - DNA, 25 bp, S. cerevisiae
gatttggtcttcctacgtatttcat

SEQ ID NO: 38807 - DNA, 25 bp, S. cerevisiae
gatttggttctctggatgtcgtact

SEQ ID NO: 38808 - DNA, 25 bp, S. cerevisiae
gatatccgtcgaacaacgttctatt

SEQ ID NO: 38809 - DNA, 25 bp, S. cerevisiae
gatatccgtgcgaactatagcttaa

SEQ ID NO: 38810 - DNA, 25 bp, S. cerevisiae
gataccgggcgaagatcctgctcga

SEQ ID NO: 38811 - DNA, 25 bp, S. cerevisiae
gatagtccttggagacactgccagg

SEQ ID NO: 38812 - DNA, 25 bp, S. cerevisiae
gatagaccatcgagttctcatccag

SEQ ID NO: 38813 - DNA, 25 bp, S. cerevisiae
gatatacagtctcgaactcttgcca

SEQ ID NO: 38814 - DNA, 25 bp, S. cerevisiae
gatatatgccctcgagacttcaaag

SEQ ID NO: 38815 - DNA, 25 bp, S. cerevisiae
gatttggccttcaactacataacat

SEQ ID NO: 38816 - DNA, 25 bp, S. cerevisiae
gatttcccacctacctataaattcg

SEQ ID NO: 38817 - DNA, 25 bp, S. cerevisiae
gattacccaattgccactcaagata

SEQ ID NO: 38818 - DNA, 25 bp, S. cerevisiae
gatacctatcttcaaacaaaagcag

SEQ ID NO: 38819 - DNA, 25 bp, S. cerevisiae
gataccgtctatctcaacgtcaaga

SEQ ID NO: 38820 - DNA, 25 bp, S. cerevisiae
gataccgccgaagcagtcatttcag

SEQ ID NO: 38821 - DNA, 25 bp, S. cerevisiae
gataccgttcaagtgcactctttgt

SEQ ID NO: 38822 - DNA, 25 bp, S. cerevisiae
gatatgcacgttccaaacacttctt

SEQ ID NO: 38823 - DNA, 25 bp, S. cerevisiae
gatatgaccctgtcaaacaactttg

SEQ ID NO: 38824 - DNA, 25 bp, S. cerevisiae
gatagcccctctaataatccattta

SEQ ID NO: 38825 - DNA, 25 bp, S. cerevisiae
gatatgacctttacgcttttggact

SEQ ID NO: 38826 - DNA, 25 bp, S. cerevisiae
gatagcctctgtcaatgattcttta

SEQ ID NO: 38827 - DNA, 25 bp, S. cerevisiae
gataccttgtacaatcctgatttaa

SEQ ID NO: 38828 - DNA, 25 bp, S. cerevisiae
gataccagaatcaggctcttcttca

SEQ ID NO: 38829 - DNA, 25 bp, S. cerevisiae
gatagtcaattttcagcacccttta

SEQ ID NO: 38830 - DNA, 25 bp, S. cerevisiae
gatagtaataatgccaccccatgtg

SEQ ID NO: 38831 - DNA, 25 bp, S. cerevisiae
gatatcaaaaattcgtcctcaaggt

SEQ ID NO: 38832 - DNA, 25 bp, S. cerevisiae
gatatcagtaagttttccgcacagt

SEQ ID NO: 38833 - DNA, 25 bp, S. cerevisiae
gatatttgaagcatgtctccagaag

SEQ ID NO: 38834 - DNA, 25 bp, S. cerevisiae
gatatttgacgatttactagcagaa

SEQ ID NO: 38835 - DNA, 25 bp, S. cerevisiae
gatatctattggttcttctgtgcag

SEQ ID NO: 38836 - DNA, 25 bp, S. cerevisiae
gatatgccaacgtcaattcttcaat

SEQ ID NO: 38837 - DNA, 25 bp, S. cerevisiae
gatagtcaatcctgatgttccagat

SEQ ID NO: 38838 - DNA, 25 bp, S. cerevisiae
gatatctgttcatgttccaactgtc

SEQ ID NO: 38839 - DNA, 25 bp, S. cerevisiae
gatttttaaggcaaccacgtcacct

SEQ ID NO: 38840 - DNA, 25 bp, S. cerevisiae
gatattttcttaaacgtcgttcttg

SEQ ID NO: 38841 - DNA, 25 bp, S. cerevisiae
gttgcttttgttgaatcctttggtg

SEQ ID NO: 38842 - DNA, 25 bp, S. cerevisiae
gatttttattctcaacctttcgcca

SEQ ID NO: 38843 - DNA, 25 bp, S. cerevisiae
gattttaccactaaaccacttgcgc

SEQ ID NO: 38844 - DNA, 25 bp, S. cerevisiae
gattttaacccaaccatagcttacg

SEQ ID NO: 38845 - DNA, 25 bp, S. cerevisiae
gatatactgcaacttttcggccttt

SEQ ID NO: 38846 - DNA, 25 bp, S. cerevisiae
gatattcggcttttgttgggcactt

SEQ ID NO: 38847 - DNA, 25 bp, S. cerevisiae
gattacgcgtacttggcatggctac

SEQ ID NO: 38848 - DNA, 25 bp, S. cerevisiae
gatttgatgaatttatggctggctt

SEQ ID NO: 38849 - DNA, 25 bp, S. cerevisiae
gattcaggaatatactcagaggcac

SEQ ID NO: 38850 - DNA, 25 bp, S. cerevisiae
gatattgagtcctcgttaacacagg

SEQ ID NO: 38851 - DNA, 25 bp, S. cerevisiae
gatatggacccaagcctgatagagg

SEQ ID NO: 38852 - DNA, 25 bp, S. cerevisiae
gatatagatctcaagcccgtagaag

SEQ ID NO: 38853 - DNA, 25 bp, S. cerevisiae
gatatggctctcaatgacctagaaa

SEQ ID NO: 38854 - DNA, 25 bp, S. cerevisiae
gatatgccatacatttccgaaagga

SEQ ID NO: 38855 - DNA, 25 bp, S. cerevisiae
gatatgctgcatttttcatccacaa

SEQ ID NO: 38856 - DNA, 25 bp, S. cerevisiae
gataccatatttagcacccacagat

SEQ ID NO: 38857 - DNA, 25 bp, S. cerevisiae
gataccatattattccacaagcgca

SEQ ID NO: 38858 - DNA, 25 bp, S. cerevisiae
gatattttaagctccatctggactg

SEQ ID NO: 38859 - DNA, 25 bp, S. cerevisiae
gatattttagatgttttgaacctac

SEQ ID NO: 38860 - DNA, 25 bp, S. cerevisiae
gattcgttctttattcttacgggca

SEQ ID NO: 38861 - DNA, 25 bp, S. cerevisiae
gatttggttttcaagttacactgga

SEQ ID NO: 38862 - DNA, 25 bp, S. cerevisiae
gatatatggtctactgcttgtctaa

SEQ ID NO: 38863 - DNA, 25 bp, S. cerevisiae
gatatccttttccaggttacttcgg

SEQ ID NO: 38864 - DNA, 25 bp, S. cerevisiae
gatatcgcccttaaatggttccaaa

SEQ ID NO: 38865 - DNA, 25 bp, S. cerevisiae
gataggcccataatttcatcgatta

SEQ ID NO: 38866 - DNA, 25 bp, S. cerevisiae
gtttccgttaccaagcctttggatg

SEQ ID NO: 38867 - DNA, 25 bp, S. cerevisiae
gttgaccggtatccccgctgaccaa

SEQ ID NO: 38868 - DNA, 25 bp, S. cerevisiae
gttgaccggtatccccgctgaccaa

SEQ ID NO: 38869 - DNA, 25 bp, S. cerevisiae
gttgtccaagaactcaccgggcgaa

SEQ ID NO: 38870 - DNA, 25 bp, S. cerevisiae
gatttccatcaagattcacggccag

SEQ ID NO: 38871 - DNA, 25 bp, S. cerevisiae
gatttcaaaagggatccgccacact

SEQ ID NO: 38872 - DNA, 25 bp, S. cerevisiae
gtacaccagaagattcgttaacgtt

SEQ ID NO: 38873 - DNA, 25 bp, S. cerevisiae
gatagcttcaaaaattcctgtacac

SEQ ID NO: 38874 - DNA, 25 bp, S. cerevisiae
gatatcttaaaccttcgcgtgaaac

SEQ ID NO: 38875 - DNA, 25 bp, S. cerevisiae
gatattcttgaaggcgaaacgcaac

SEQ ID NO: 38876 - DNA, 25 bp, S. cerevisiae
gatattacagaccagccttgcattg

SEQ ID NO: 38877 - DNA, 25 bp, S. cerevisiae
gatttcgagattccgtactgtacat

SEQ ID NO: 38878 - DNA, 25 bp, S. cerevisiae
gatttttcatcggttgagccaacgg

SEQ ID NO: 38879 - DNA, 25 bp, S. cerevisiae
gatattactcccctgttagtgataa

SEQ ID NO: 38880 - DNA, 25 bp, S. cerevisiae
gatatttaccctggactcattgcaa

SEQ ID NO: 38881 - DNA, 25 bp, S. cerevisiae
gatttgattccgcaagctttgaagg

SEQ ID NO: 38882 - DNA, 25 bp, S. cerevisiae
gattcttgacctgaacaagtcgctg

SEQ ID NO: 38883 - DNA, 25 bp, S. cerevisiae
gatatcactacagctacaccagttg

SEQ ID NO: 38884 - DNA, 25 bp, S. cerevisiae
gatagcatgctttcgaacctttttt

SEQ ID NO: 38885 - DNA, 25 bp, S. cerevisiae
gatatgatgtcttccaacgcttcca

SEQ ID NO: 38886 - DNA, 25 bp, S. cerevisiae
gatatagatcccgaagctgccttcc

SEQ ID NO: 38887 - DNA, 25 bp, S. cerevisiae
gatagcattttgaccttttccgata

SEQ ID NO: 38888 - DNA, 25 bp, S. cerevisiae
gatatcggtcattctgacgaagcat

SEQ ID NO: 38889 - DNA, 25 bp, S. cerevisiae
gatatagattacctgacgacacatt

SEQ ID NO: 38890 - DNA, 25 bp, S. cerevisiae
gatatattgacctccgtgtctagaa

SEQ ID NO: 38891 - DNA, 25 bp, S. cerevisiae
gatatgttcacgttcctagtgggag

SEQ ID NO: 38892 - DNA, 25 bp, S. cerevisiae
gatatcttaagttttcctgtgacag

SEQ ID NO: 38893 - DNA, 25 bp, S. cerevisiae
gatatatttagttgcttcgctggaa

SEQ ID NO: 38894 - DNA, 25 bp, S. cerevisiae
gatatttttaagttctccattgatg

SEQ ID NO: 38895 - DNA, 25 bp, S. cerevisiae
gattttttagcatgactcctgttgg

SEQ ID NO: 38896 - DNA, 25 bp, S. cerevisiae
gatatttgtttgatggcactgtctt

SEQ ID NO: 38897 - DNA, 25 bp, S. cerevisiae
gatattttccgttgacattggagtc

SEQ ID NO: 38898 - DNA, 25 bp, S. cerevisiae
gatatgtttttctacggtgattacg

SEQ ID NO: 38899 - DNA, 25 bp, S. cerevisiae
gatttgttttgtactgttcctgtaa

SEQ ID NO: 38900 - DNA, 25 bp, S. cerevisiae
gatatgttactcctcaatttctgtt

SEQ ID NO: 38901 - DNA, 25 bp, S. cerevisiae
gatatgctatattcccaattgggct

SEQ ID NO: 38902 - DNA, 25 bp, S. cerevisiae
gatttggcggcaatctgactgctgc

SEQ ID NO: 38903 - DNA, 25 bp, S. cerevisiae
gatttccgtaacacgatcattgtga

SEQ ID NO: 38904 - DNA, 25 bp, S. cerevisiae
gatttccgtgtgatatcgtttcgac

SEQ ID NO: 38905 - DNA, 25 bp, S. cerevisiae
gatattcctggtcttggttatttgg

SEQ ID NO: 38906 - DNA, 25 bp, S. cerevisiae
gatttcttgaagcagtggttaacag

SEQ ID NO: 38907 - DNA, 25 bp, S. cerevisiae
gattttgtcggcgattccctaagag

SEQ ID NO: 38908 - DNA, 25 bp, S. cerevisiae
gatttaccagtatcgtccttagatt

SEQ ID NO: 38909 - DNA, 25 bp, S. cerevisiae
gttgtaacagtatcttcaccggtaa

SEQ ID NO: 38910 - DNA, 25 bp, S. cerevisiae
gatatgacactgttaccacctggaa

SEQ ID NO: 38911 - DNA, 25 bp, S. cerevisiae
gatatccctgcacttgaaatcgcta

SEQ ID NO: 38912 - DNA, 25 bp, S. cerevisiae
gatatcacatttggacaagtcggca

SEQ ID NO: 38913 - DNA, 25 bp, S. cerevisiae
gatattctttaacgagacggagtaa

SEQ ID NO: 38914 - DNA, 25 bp, S. cerevisiae
gatatcacattctttggcgaagcac

SEQ ID NO: 38915 - DNA, 25 bp, S. cerevisiae
gatatcactgtctctatcggtgcaa

SEQ ID NO: 38916 - DNA, 25 bp, S. cerevisiae
gatatgtgcacgattgtcttcgaaa

SEQ ID NO: 38917 - DNA, 25 bp, S. cerevisiae
gatattcaggaaatgtggctcaaca

SEQ ID NO: 38918 - DNA, 25 bp, S. cerevisiae
gattcctctcaataaaccactttta

SEQ ID NO: 38919 - DNA, 25 bp, S. cerevisiae
gatttcgtcatattttcccagtttt

SEQ ID NO: 38920 - DNA, 25 bp, S. cerevisiae
gatatagcttactggtctgacgaaa

SEQ ID NO: 38921 - DNA, 25 bp, S. cerevisiae
gataggtctatcaagctctggaatt

SEQ ID NO: 38922 - DNA, 25 bp, S. cerevisiae
gatatttctcgaacctggaatgcta

SEQ ID NO: 38923 - DNA, 25 bp, S. cerevisiae
gatatatattccctctgatgctgtt

SEQ ID NO: 38924 - DNA, 25 bp, S. cerevisiae
gatatccagtggtctcgcactgaat

SEQ ID NO: 38925 - DNA, 25 bp, S. cerevisiae
gatatccggatcttcgcagttatta

SEQ ID NO: 38926 - DNA, 25 bp, S. cerevisiae
gatagtgctccttctgttttttata

SEQ ID NO: 38927 - DNA, 25 bp, S. cerevisiae
gatatcgtcacattccgttgtttaa

SEQ ID NO: 38928 - DNA, 25 bp, S. cerevisiae
gatagattccattcctcgtgatgtt

SEQ ID NO: 38929 - DNA, 25 bp, S. cerevisiae
gtagatgatcaacaccgtcattcag

SEQ ID NO: 38930 - DNA, 25 bp, S. cerevisiae
gatagatataagcaccctcaagaca

SEQ ID NO: 38931 - DNA, 25 bp, S. cerevisiae
gatagataaacccaccatcaagaag

SEQ ID NO: 38932 - DNA, 25 bp, S. cerevisiae
gatagatgtatacctgacctccaaa

SEQ ID NO: 38933 - DNA, 25 bp, S. cerevisiae
gatagattaatcgagtccttgcaaa

SEQ ID NO: 38934 - DNA, 25 bp, S. cerevisiae
gatatgactcaatttccctctgatt

SEQ ID NO: 38935 - DNA, 25 bp, S. cerevisiae
gatatcttgcattttcacctttacc

SEQ ID NO: 38936 - DNA, 25 bp, S. cerevisiae
gatatatatcgtttacctccaagct

SEQ ID NO: 38937 - DNA, 25 bp, S. cerevisiae
gatatggatcttgataccggcagaa

SEQ ID NO: 38938 - DNA, 25 bp, S. cerevisiae
gatatgctagctaccgacttggcag

SEQ ID NO: 38939 - DNA, 25 bp, S. cerevisiae
gatatgctactttaatctctgggaa

SEQ ID NO: 38940 - DNA, 25 bp, S. cerevisiae
gatatggtcgcaatgtcaggcacaa

SEQ ID NO: 38941 - DNA, 25 bp, S. cerevisiae
gatatggctctgagaagcctcatat

SEQ ID NO: 38942 - DNA, 25 bp, S. cerevisiae
gatatccctgatatagcgcctgaac

SEQ ID NO: 38943 - DNA, 25 bp, S. cerevisiae
gatatcctcgaactggtcttgaact

SEQ ID NO: 38944 - DNA, 25 bp, S. cerevisiae
gatattagcgtcatcgtttgaatct

SEQ ID NO: 38945 - DNA, 25 bp, S. cerevisiae
gatattcctgtctacgttaaagcct

SEQ ID NO: 38946 - DNA, 25 bp, S. cerevisiae
gatattccgattttgtcgcaagggt

SEQ ID NO: 38947 - DNA, 25 bp, S. cerevisiae
gattacgaattcttggcgccatggt

SEQ ID NO: 38948 - DNA, 25 bp, S. cerevisiae
gatttctgaattacctagaggcgct

SEQ ID NO: 38949 - DNA, 25 bp, S. cerevisiae
gttactaaggagctctacctcgttg

SEQ ID NO: 38950 - DNA, 25 bp, S. cerevisiae
gattaaaggacaccgttgcctcgtt

SEQ ID NO: 38951 - DNA, 25 bp, S. cerevisiae
gatttaaatgatccctttgtcccgc

SEQ ID NO: 38952 - DNA, 25 bp, S. cerevisiae
gattataaacagtcttttgtctagt

SEQ ID NO: 38953 - DNA, 25 bp, S. cerevisiae
gatttagtggcttactcccattgac

SEQ ID NO: 38954 - DNA, 25 bp, S. cerevisiae
gatttgcaaagggtctcgacgtcaa

SEQ ID NO: 38955 - DNA, 25 bp, S. cerevisiae
gatattgcgcgtatttcattcccta

SEQ ID NO: 38956 - DNA, 25 bp, S. cerevisiae
gatattccagtattttggcccatct

SEQ ID NO: 38957 - DNA, 25 bp, S. cerevisiae
gatatttcattgtactgggtccaag

SEQ ID NO: 38958 - DNA, 25 bp, S. cerevisiae
gatatattcaatcaggccagacaat

SEQ ID NO: 38959 - DNA, 25 bp, S. cerevisiae
gatatggtcaatcagcagctagcat

SEQ ID NO: 38960 - DNA, 25 bp, S. cerevisiae
gatatggtcactgaagctcacaaga

SEQ ID NO: 38961 - DNA, 25 bp, S. cerevisiae
gatattgctactcatagacacgggt

SEQ ID NO: 38962 - DNA, 25 bp, S. cerevisiae
gatattgctattgctggtacaggcc

SEQ ID NO: 38963 - DNA, 25 bp, S. cerevisiae
gattcaggcagtgttgtccggtata

SEQ ID NO: 38964 - DNA, 25 bp, S. cerevisiae
gattagatggttccacgcaagtgaa

SEQ ID NO: 38965 - DNA, 25 bp, S. cerevisiae
gatattatcgttcactcaagagagt

SEQ ID NO: 38966 - DNA, 25 bp, S. cerevisiae
gatatattctttgtgtcctagacta

SEQ ID NO: 38967 - DNA, 25 bp, S. cerevisiae
gatattattccaattgcttccggag

SEQ ID NO: 38968 - DNA, 25 bp, S. cerevisiae
gatatcatttcgatctgcttcagca

SEQ ID NO: 38969 - DNA, 25 bp, S. cerevisiae
gatatcacacggtcggatctgctac

SEQ ID NO: 38970 - DNA, 25 bp, S. cerevisiae
gatattcatcggtccaagcttactt

SEQ ID NO: 38971 - DNA, 25 bp, S. cerevisiae
gatattatcgctgcagagtcgcata

SEQ ID NO: 38972 - DNA, 25 bp, S. cerevisiae
gatatttcgctcctggacgcaagta

SEQ ID NO: 38973 - DNA, 25 bp, S. cerevisiae
gatatcttacgcaataacgccaata

SEQ ID NO: 38974 - DNA, 25 bp, S. cerevisiae
gatttctaccaatacttcaagcctc

SEQ ID NO: 38975 - DNA, 25 bp, S. cerevisiae
gatttcactttccaaggttactctt

SEQ ID NO: 38976 - DNA, 25 bp, S. cerevisiae
gatatgctccaattttcatttcgtt

SEQ ID NO: 38977 - DNA, 25 bp, S. cerevisiae
gatattgtcctatactctgctacta

SEQ ID NO: 38978 - DNA, 25 bp, S. cerevisiae
gatattgctccttgaaatgctataa

SEQ ID NO: 38979 - DNA, 25 bp, S. cerevisiae
gatttgtcagcgaacataccataga

SEQ ID NO: 38980 - DNA, 25 bp, S. cerevisiae
gatttgtacagatgtcgcagctaga

SEQ ID NO: 38981 - DNA, 25 bp, S. cerevisiae
gatattcccatgacaatcgatctag

SEQ ID NO: 38982 - DNA, 25 bp, S. cerevisiae
gatatgctcacctcaagaatctatg

SEQ ID NO: 38983 - DNA, 25 bp, S. cerevisiae
gatataccaacttgcatgtcgcgat

SEQ ID NO: 38984 - DNA, 25 bp, S. cerevisiae
gatatagtcaacaactacgccttga

SEQ ID NO: 38985 - DNA, 25 bp, S. cerevisiae
gatatcagacaacggcgattccaaa

SEQ ID NO: 38986 - DNA, 25 bp, S. cerevisiae
gatatcgagaagctccttgacgaaa

SEQ ID NO: 38987 - DNA, 25 bp, S. cerevisiae
gatatccaggaagccttgtcaagat

SEQ ID NO: 38988 - DNA, 25 bp, S. cerevisiae
gatttgtattttctcgattgggtga

SEQ ID NO: 38989 - DNA, 25 bp, S. cerevisiae
gatattcttttttcgctgaccaggg

SEQ ID NO: 38990 - DNA, 25 bp, S. cerevisiae
gatattgctaccacatccttgaaag

SEQ ID NO: 38991 - DNA, 25 bp, S. cerevisiae
gatttgcccaagttacgatccagca

SEQ ID NO: 38992 - DNA, 25 bp, S. cerevisiae
gatttctacaatttgctggttcagc

SEQ ID NO: 38993 - DNA, 25 bp, S. cerevisiae
gatttagatccattttgggtcccaa

SEQ ID NO: 38994 - DNA, 25 bp, S. cerevisiae
ggttattccgatcttgttcctgacg

SEQ ID NO: 38995 - DNA, 25 bp, S. cerevisiae
gttgtattccaaagatttccctgac

SEQ ID NO: 38996 - DNA, 25 bp, S. cerevisiae
gattttgcccaaaagttacctgaca

SEQ ID NO: 38997 - DNA, 25 bp, S. cerevisiae
gatattcatatctctccgttcaggc

SEQ ID NO: 38998 - DNA, 25 bp, S. cerevisiae
gatatgtattctctgggttaccgct

SEQ ID NO: 38999 - DNA, 25 bp, S. cerevisiae
gatatttactcattggtttacagcc

SEQ ID NO: 39000 - DNA, 25 bp, S. cerevisiae
gatttgtactaactgcatatccaac

SEQ ID NO: 39001 - DNA, 25 bp, S. cerevisiae
gatattgctactgttgaagccatga

SEQ ID NO: 39002 - DNA, 25 bp, S. cerevisiae
gatattgccacaggtaacacatcag

SEQ ID NO: 39003 - DNA, 25 bp, S. cerevisiae
gatatttctcatcagacacaagttt

SEQ ID NO: 39004 - DNA, 25 bp, S. cerevisiae
gatattctgagccaaacaaattcta

SEQ ID NO: 39005 - DNA, 25 bp, S. cerevisiae
gatttccaaatcaacgttctgccca

SEQ ID NO: 39006 - DNA, 25 bp, S. cerevisiae
gatttaaaaacacctcttcgcgcaa

SEQ ID NO: 39007 - DNA, 25 bp, S. cerevisiae
gattttagaaatccacttttgccaa

SEQ ID NO: 39008 - DNA, 25 bp, S. cerevisiae
gatttctggcgtaaacttgactagc

SEQ ID NO: 39009 - DNA, 25 bp, S. cerevisiae
gattattacggaaactctgcctcca

SEQ ID NO: 39010 - DNA, 25 bp, S. cerevisiae
gatatgtaacgccaaaattcccctc

SEQ ID NO: 39011 - DNA, 25 bp, S. cerevisiae
gatttatcggtccaaatggcgaaca

SEQ ID NO: 39012 - DNA, 25 bp, S. cerevisiae
gatttacgcggttcaattgcgccag

SEQ ID NO: 39013 - DNA, 25 bp, S. cerevisiae
gatattgcccatagttacttggaca

SEQ ID NO: 39014 - DNA, 25 bp, S. cerevisiae
gatattctccggtcatgacttgtga

SEQ ID NO: 39015 - DNA, 25 bp, S. cerevisiae
gatatattcgcctcagcatccggaa

SEQ ID NO: 39016 - DNA, 25 bp, S. cerevisiae
gatttaatgctctacaatgcctgtg

SEQ ID NO: 39017 - DNA, 25 bp, S. cerevisiae
gatatcgaagcttccattgcagagg

SEQ ID NO: 39018 - DNA, 25 bp, S. cerevisiae
gattcagcaggttagcaacagattg

SEQ ID NO: 39019 - DNA, 25 bp, S. cerevisiae
gatatcaaggtttcactagcattgt

SEQ ID NO: 39020 - DNA, 25 bp, S. cerevisiae
gatattttctattctcatccctatg

SEQ ID NO: 39021 - DNA, 25 bp, S. cerevisiae
gatatttggtattgccacaccggaa

SEQ ID NO: 39022 - DNA, 25 bp, S. cerevisiae
gatttccctagctcaagccaagtat

SEQ ID NO: 39023 - DNA, 25 bp, S. cerevisiae
gatttccagttctaggaccacaact

SEQ ID NO: 39024 - DNA, 25 bp, S. cerevisiae
gatatactatgtgcattggactcaa

SEQ ID NO: 39025 - DNA, 25 bp, S. cerevisiae
gatttctgtgtcatgcttagcttgg

SEQ ID NO: 39026 - DNA, 25 bp, S. cerevisiae
gattagctattaactgctccgatag

SEQ ID NO: 39027 - DNA, 25 bp, S. cerevisiae
gattatccattcaagccaccgaagg

SEQ ID NO: 39028 - DNA, 25 bp, S. cerevisiae
gatttagtagcgtcgttctacacca

SEQ ID NO: 39029 - DNA, 25 bp, S. cerevisiae
gatttcaacttggtcaacattagag

SEQ ID NO: 39030 - DNA, 25 bp, S. cerevisiae
gatattgcacatttcgtagacttga

SEQ ID NO: 39031 - DNA, 25 bp, S. cerevisiae
gatatgctttgaccagtacactctg

SEQ ID NO: 39032 - DNA, 25 bp, S. cerevisiae
gatatcattggtgaggaccttcctc

SEQ ID NO: 39033 - DNA, 25 bp, S. cerevisiae
gatatcggtgatgcaggttctatac

SEQ ID NO: 39034 - DNA, 25 bp, S. cerevisiae
gatatcatgcgcatcttgcttagga

SEQ ID NO: 39035 - DNA, 25 bp, S. cerevisiae
gattaggcccttttgaggacgacac

SEQ ID NO: 39036 - DNA, 25 bp, S. cerevisiae
gatattgaaaccacgagagccttac

SEQ ID NO: 39037 - DNA, 25 bp, S. cerevisiae
gatttcctttcaaaaaagctgctca

SEQ ID NO: 39038 - DNA, 25 bp, S. cerevisiae
gatattactttcctgccaaacttga

SEQ ID NO: 39039 - DNA, 25 bp, S. cerevisiae
gattatactgatccgcatgccaata

SEQ ID NO: 39040 - DNA, 25 bp, S. cerevisiae
gatattgtctacttgcctgatttca

SEQ ID NO: 39041 - DNA, 25 bp, S. cerevisiae
gatttgctcgataaggatgttctcc

SEQ ID NO: 39042 - DNA, 25 bp, S. cerevisiae
gatattcatgttccactattgcctg

SEQ ID NO: 39043 - DNA, 25 bp, S. cerevisiae
gatatttgttccttactggctattg

SEQ ID NO: 39044 - DNA, 25 bp, S. cerevisiae
gatattctatctctctacgggttga

SEQ ID NO: 39045 - DNA, 25 bp, S. cerevisiae
gatattcatcttcattcagcggagt

SEQ ID NO: 39046 - DNA, 25 bp, S. cerevisiae
gttgaagatactgccggtggtttat

SEQ ID NO: 39047 - DNA, 25 bp, S. cerevisiae
gatttcgctatctacaggttgttta

SEQ ID NO: 39048 - DNA, 25 bp, S. cerevisiae
gattatttcgaagacgactctgcct

SEQ ID NO: 39049 - DNA, 25 bp, S. cerevisiae
tactttagcgtggaagcgccaccgt

SEQ ID NO: 39050 - DNA, 25 bp, S. cerevisiae
gattttaggtgaaagcgccccgcaa

SEQ ID NO: 39051 - DNA, 25 bp, S. cerevisiae
gtctttggttcgagcggtcctaaat

SEQ ID NO: 39052 - DNA, 25 bp, S. cerevisiae
gatttttgccttctgtaatacacac

SEQ ID NO: 39053 - DNA, 25 bp, S. cerevisiae
gatttctccagttcctttaacacaa

SEQ ID NO: 39054 - DNA, 25 bp, S. cerevisiae
gattttcgcattcaagcactgtcaa

SEQ ID NO: 39055 - DNA, 25 bp, S. cerevisiae
gatttgaagcaaaaggcactcttga

SEQ ID NO: 39056 - DNA, 25 bp, S. cerevisiae
gatttcgaccactacgacatcgatg

SEQ ID NO: 39057 - DNA, 25 bp, S. cerevisiae
gattaggctcgcttgctgaggacga

SEQ ID NO: 39058 - DNA, 25 bp, S. cerevisiae
gatttggtcacagacatgttcaata

SEQ ID NO: 39059 - DNA, 25 bp, S. cerevisiae
gattgcggtgccacaattaccagaa

SEQ ID NO: 39060 - DNA, 25 bp, S. cerevisiae
gattagtctgacaccaacaccaaac

SEQ ID NO: 39061 - DNA, 25 bp, S. cerevisiae
gattagactgctaggccaatacccc

SEQ ID NO: 39062 - DNA, 25 bp, S. cerevisiae
gattcaaggtgtgtagcatacccta

SEQ ID NO: 39063 - DNA, 25 bp, S. cerevisiae
gattcaagttcgatactcacggtga

SEQ ID NO: 39064 - DNA, 25 bp, S. cerevisiae
gatttggaatcgaatgctctcatta

SEQ ID NO: 39065 - DNA, 25 bp, S. cerevisiae
gattttcaatgcgagagcttacgaa

SEQ ID NO: 39066 - DNA, 25 bp, S. cerevisiae
gtaacgattcgaagtgggcaccggc

SEQ ID NO: 39067 - DNA, 25 bp, S. cerevisiae
gatttcgttcgaattgcgtacggag

SEQ ID NO: 39068 - DNA, 25 bp, S. cerevisiae
gatattttctcgtttcttgtcggaa

SEQ ID NO: 39069 - DNA, 25 bp, S. cerevisiae
gatattattcatgtttcgtctccag

SEQ ID NO: 39070 - DNA, 25 bp, S. cerevisiae
gatattgatcatgacctttttaggt

SEQ ID NO: 39071 - DNA, 25 bp, S. cerevisiae
gatatatacaacactatttctgagg

SEQ ID NO: 39072 - DNA, 25 bp, S. cerevisiae
gatatcaagccttccaatgttctga

SEQ ID NO: 39073 - DNA, 25 bp, S. cerevisiae
gattcaggcctgactacattgtcgt

SEQ ID NO: 39074 - DNA, 25 bp, S. cerevisiae
gatatttccagatggcatggcctac

SEQ ID NO: 39075 - DNA, 25 bp, S. cerevisiae
gatattatcatgcaaggacccttct

SEQ ID NO: 39076 - DNA, 25 bp, S. cerevisiae
gttaatatgggcgtggctcctcctt

SEQ ID NO: 39077 - DNA, 25 bp, S. cerevisiae
gatatacaacccgatggccactgtc

SEQ ID NO: 39078 - DNA, 25 bp, S. cerevisiae
gatataaacccaagtcgcacctatg

SEQ ID NO: 39079 - DNA, 25 bp, S. cerevisiae
gatttacattcctgattacactgat

SEQ ID NO: 39080 - DNA, 25 bp, S. cerevisiae
gattttgggtagatacgtcgtcgat

SEQ ID NO: 39081 - DNA, 25 bp, S. cerevisiae
gattatggcgttggtaaccggtcca

SEQ ID NO: 39082 - DNA, 25 bp, S. cerevisiae
gatataccgttgctaacctacacag

SEQ ID NO: 39083 - DNA, 25 bp, S. cerevisiae
gatatttctgccaagtccaactaca

SEQ ID NO: 39084 - DNA, 25 bp, S. cerevisiae
gatttgggtctgttaacactcatca

SEQ ID NO: 39085 - DNA, 25 bp, S. cerevisiae
gatttggcccatttacgtgctgtac

SEQ ID NO: 39086 - DNA, 25 bp, S. cerevisiae
gatatttccaacttgaagcgtccat

SEQ ID NO: 39087 - DNA, 25 bp, S. cerevisiae
gatatcttggcgtttttcctcacat

SEQ ID NO: 39088 - DNA, 25 bp, S. cerevisiae
gattatatccgctcctaaatcgggt

SEQ ID NO: 39089 - DNA, 25 bp, S. cerevisiae
gattttgccaataacctaccgaagg

SEQ ID NO: 39090 - DNA, 25 bp, S. cerevisiae
gatttcgccaataaattcggctttg

SEQ ID NO: 39091 - DNA, 25 bp, S. cerevisiae
gatttcaaaaaagtattgtccttgc

SEQ ID NO: 39092 - DNA, 25 bp, S. cerevisiae
gatttcaatgaaccattttggccta

SEQ ID NO: 39093 - DNA, 25 bp, S. cerevisiae
gatttacatgttttgtgttcagcct

SEQ ID NO: 39094 - DNA, 25 bp, S. cerevisiae
gatattaattccattcttcgctctc

SEQ ID NO: 39095 - DNA, 25 bp, S. cerevisiae
gattaaatcaatgtccgatccgaaa

SEQ ID NO: 39096 - DNA, 25 bp, S. cerevisiae
gattaaattgcaagggcttccggga

SEQ ID NO: 39097 - DNA, 25 bp, S. cerevisiae
gttcaaactaagttgacccgtgaat

SEQ ID NO: 39098 - DNA, 25 bp, S. cerevisiae
gattccaaatttgttccccacggat

SEQ ID NO: 39099 - DNA, 25 bp, S. cerevisiae
gatttatctttatcgggctccaagc

SEQ ID NO: 39100 - DNA, 25 bp, S. cerevisiae
gatattactgttctggctggttcat

SEQ ID NO: 39101 - DNA, 25 bp, S. cerevisiae
gatatttctttcctttagcctgacg

SEQ ID NO: 39102 - DNA, 25 bp, S. cerevisiae
gatatttggttctggtggcacgaca

SEQ ID NO: 39103 - DNA, 25 bp, S. cerevisiae
gatttctggcctacgttagtgtatt

SEQ ID NO: 39104 - DNA, 25 bp, S. cerevisiae
gatattccagagattgataagcgta

SEQ ID NO: 39105 - DNA, 25 bp, S. cerevisiae
gatattccaggtgcgagaagccatg

SEQ ID NO: 39106 - DNA, 25 bp, S. cerevisiae
gatatatcccttgaaaagcaattag

SEQ ID NO: 39107 - DNA, 25 bp, S. cerevisiae
gatttccacatttcacgacggtcaa

SEQ ID NO: 39108 - DNA, 25 bp, S. cerevisiae
gatttccagccctttattgatagcg

SEQ ID NO: 39109 - DNA, 25 bp, S. cerevisiae
gattatgctaccaccaagggatgtt

SEQ ID NO: 39110 - DNA, 25 bp, S. cerevisiae
gattatgaacgttccaaggcctata

SEQ ID NO: 39111 - DNA, 25 bp, S. cerevisiae
gatttatctatttcgaacccttcaa

SEQ ID NO: 39112 - DNA, 25 bp, S. cerevisiae
gatttatatctttcgaaaactcgca

SEQ ID NO: 39113 - DNA, 25 bp, S. cerevisiae
gatttgatgaccactaacaacccca

SEQ ID NO: 39114 - DNA, 25 bp, S. cerevisiae
gattcagctgtacatgtcaaccggg

SEQ ID NO: 39115 - DNA, 25 bp, S. cerevisiae
gattggcttgaaaaatacaccggtg

SEQ ID NO: 39116 - DNA, 25 bp, S. cerevisiae
gatttcctgatgttgtatttacgca

SEQ ID NO: 39117 - DNA, 25 bp, S. cerevisiae
gatatttcttttcactctcttcata

SEQ ID NO: 39118 - DNA, 25 bp, S. cerevisiae
gatttgatcattttggccttgccca

SEQ ID NO: 39119 - DNA, 25 bp, S. cerevisiae
gatttcaacgatagttttgcctcag

SEQ ID NO: 39120 - DNA, 25 bp, S. cerevisiae
gatattcacatagacgagcccaaga

SEQ ID NO: 39121 - DNA, 25 bp, S. cerevisiae
gatttcctccgaagatcctcaaaaa

SEQ ID NO: 39122 - DNA, 25 bp, S. cerevisiae
gatattcactcctttgtcagatcat

SEQ ID NO: 39123 - DNA, 25 bp, S. cerevisiae
gattatatatgccaattctcagaca

SEQ ID NO: 39124 - DNA, 25 bp, S. cerevisiae
gatattatgccagacttcagccctt

SEQ ID NO: 39125 - DNA, 25 bp, S. cerevisiae
gatttcgaccagaccaatccggatg

SEQ ID NO: 39126 - DNA, 25 bp, S. cerevisiae
gatttcgatccactacaatacggta

SEQ ID NO: 39127 - DNA, 25 bp, S. cerevisiae
gattttctcaccttaatacgctttt

SEQ ID NO: 39128 - DNA, 25 bp, S. cerevisiae
gattttgttccagaaaacccagaga

SEQ ID NO: 39129 - DNA, 25 bp, S. cerevisiae
gattttgagttacgcccaacaacca

SEQ ID NO: 39130 - DNA, 25 bp, S. cerevisiae
gattttcagaatccgccgcaaagaa

SEQ ID NO: 39131 - DNA, 25 bp, S. cerevisiae
gattattcccaatgtcggtctatgt

SEQ ID NO: 39132 - DNA, 25 bp, S. cerevisiae
gattagctagaagaggtggtgtcaa

SEQ ID NO: 39133 - DNA, 25 bp, S. cerevisiae
gatattccagaagaggccgctgctt

SEQ ID NO: 39134 - DNA, 25 bp, S. cerevisiae
gatttggtctatcagttgtcacaag

SEQ ID NO: 39135 - DNA, 25 bp, S. cerevisiae
gatttcattcgaacgtttacatggg

SEQ ID NO: 39136 - DNA, 25 bp, S. cerevisiae
gattattgttttcccaagaaatggt

SEQ ID NO: 39137 - DNA, 25 bp, S. cerevisiae
gattatcgttttcccaagagacggt

SEQ ID NO: 39138 - DNA, 25 bp, S. cerevisiae
gattatttatttcctattggtcggg

SEQ ID NO: 39139 - DNA, 25 bp, S. cerevisiae
gatttattcgacttgtttgggccta

SEQ ID NO: 39140 - DNA, 25 bp, S. cerevisiae
gatttttgttgttttctgtggccat

SEQ ID NO: 39141 - DNA, 25 bp, S. cerevisiae
gattggttttattttcctgccctgg

SEQ ID NO: 39142 - DNA, 25 bp, S. cerevisiae
gatttttcgatttggtccccggatg

SEQ ID NO: 39143 - DNA, 25 bp, S. cerevisiae
gatatttaatctcagggtggccatg

SEQ ID NO: 39144 - DNA, 25 bp, S. cerevisiae
gatttcatgactgctgactggttcc

SEQ ID NO: 39145 - DNA, 25 bp, S. cerevisiae
gatattcctgctatttcagacggag

SEQ ID NO: 39146 - DNA, 25 bp, S. cerevisiae
gatttcactgcatctcaacaacgga

SEQ ID NO: 39147 - DNA, 25 bp, S. cerevisiae
gatattcacgcttccatcagaaagt

SEQ ID NO: 39148 - DNA, 25 bp, S. cerevisiae
gatttacgctcgacacaagaactta

SEQ ID NO: 39149 - DNA, 25 bp, S. cerevisiae
gatattgacctcgatagcggacatt

SEQ ID NO: 39150 - DNA, 25 bp, S. cerevisiae
gatttgcacacaacaaccacttgac

SEQ ID NO: 39151 - DNA, 25 bp, S. cerevisiae
gattcatgcagaaagaacagcctta

SEQ ID NO: 39152 - DNA, 25 bp, S. cerevisiae
gatttatataaagcgcctgttctaa

SEQ ID NO: 39153 - DNA, 25 bp, S. cerevisiae
gatttacaaactgccgctgtctttg

SEQ ID NO: 39154 - DNA, 25 bp, S. cerevisiae
gatattgatacaagcgtccctgtca

SEQ ID NO: 39155 - DNA, 25 bp, S. cerevisiae
gatattgtgtcagtcgttcgtgtct

SEQ ID NO: 39156 - DNA, 25 bp, S. cerevisiae
gatattcttggaagtctccttgcta

SEQ ID NO: 39157 - DNA, 25 bp, S. cerevisiae
gatttccatggaaaccccagagcag

SEQ ID NO: 39158 - DNA, 25 bp, S. cerevisiae
gattatccatacaaaccaccggcta

SEQ ID NO: 39159 - DNA, 25 bp, S. cerevisiae
gatttagacgtcctgtaccattgta

SEQ ID NO: 39160 - DNA, 25 bp, S. cerevisiae
gattctgtagatgcagttgacacgg

SEQ ID NO: 39161 - DNA, 25 bp, S. cerevisiae
gatttgctaatctgcgtgactctac

SEQ ID NO: 39162 - DNA, 25 bp, S. cerevisiae
gatttttgcccggtatgttacacgc

SEQ ID NO: 39163 - DNA, 25 bp, S. cerevisiae
gatttttgccacagatcatttgccc

SEQ ID NO: 39164 - DNA, 25 bp, S. cerevisiae
gatttgttcccaggtattatctctc

SEQ ID NO: 39165 - DNA, 25 bp, S. cerevisiae
gatttcttccctgtcattgatcaat

SEQ ID NO: 39166 - DNA, 25 bp, S. cerevisiae
gattcgctagttgttaattttctgc

SEQ ID NO: 39167 - DNA, 25 bp, S. cerevisiae
gatttatgcatcctgatggcccagt

SEQ ID NO: 39168 - DNA, 25 bp, S. cerevisiae
gatttgcatctttagcacctatgta

SEQ ID NO: 39169 - DNA, 25 bp, S. cerevisiae
gatttgttctgtgcaactatctcat

SEQ ID NO: 39170 - DNA, 25 bp, S. cerevisiae
gatattgtctttgctactgtccagt

SEQ ID NO: 39171 - DNA, 25 bp, S. cerevisiae
gattttctttttcaaccagatccgt

SEQ ID NO: 39172 - DNA, 25 bp, S. cerevisiae
gatttgttatccgtaatgacccacc

SEQ ID NO: 39173 - DNA, 25 bp, S. cerevisiae
gatttgattaacgtggatgagtcct

SEQ ID NO: 39174 - DNA, 25 bp, S. cerevisiae
gatattcttctgttcatctccaaac

SEQ ID NO: 39175 - DNA, 25 bp, S. cerevisiae
gattatgatgaacgtgacccacaag

SEQ ID NO: 39176 - DNA, 25 bp, S. cerevisiae
gattattgagccgtgatccgacaag

SEQ ID NO: 39177 - DNA, 25 bp, S. cerevisiae
gattccatggtccatcctggtaaga

SEQ ID NO: 39178 - DNA, 25 bp, S. cerevisiae
gatttcagcgattcaactagtgacg

SEQ ID NO: 39179 - DNA, 25 bp, S. cerevisiae
gatttgacttctactttgctaggca

SEQ ID NO: 39180 - DNA, 25 bp, S. cerevisiae
gatttgcctttgacttcgccaagaa

SEQ ID NO: 39181 - DNA, 25 bp, S. cerevisiae
gatttgttttgaacctccagagaca

SEQ ID NO: 39182 - DNA, 25 bp, S. cerevisiae
gattttgtttactatctggttaata

SEQ ID NO: 39183 - DNA, 25 bp, S. cerevisiae
gatttttcacagtctttggtttctc

SEQ ID NO: 39184 - DNA, 25 bp, S. cerevisiae
gatttctatactgttgctcttcgtc

SEQ ID NO: 39185 - DNA, 25 bp, S. cerevisiae
gatttgtatcctgtcggcttagatt

SEQ ID NO: 39186 - DNA, 25 bp, S. cerevisiae
gatttactcgatgatccggtatttc

SEQ ID NO: 39187 - DNA, 25 bp, S. cerevisiae
gattttggtgtagcttttcagtata

SEQ ID NO: 39188 - DNA, 25 bp, S. cerevisiae
gattttcgaatttccacttggttca

SEQ ID NO: 39189 - DNA, 25 bp, S. cerevisiae
gatttcgggatcaataaccagccta

SEQ ID NO: 39190 - DNA, 25 bp, S. cerevisiae
gatttacaggatactagagccaggt

SEQ ID NO: 39191 - DNA, 25 bp, S. cerevisiae
gattacgagggtaagccaccacctg

SEQ ID NO: 39192 - DNA, 25 bp, S. cerevisiae
gttgacgacgatgctcttacggacg

SEQ ID NO: 39193 - DNA, 25 bp, S. cerevisiae
gatttcaacaatactgcttcagagg

SEQ ID NO: 39194 - DNA, 25 bp, S. cerevisiae
gatttctccaccatgaagctgattg

SEQ ID NO: 39195 - DNA, 25 bp, S. cerevisiae
gatttgcctgacctttacgttgata

SEQ ID NO: 39196 - DNA, 25 bp, S. cerevisiae
gattccgcccctaagtcagttaaag

SEQ ID NO: 39197 - DNA, 25 bp, S. cerevisiae
gattacttagtgcattaggcccacg

SEQ ID NO: 39198 - DNA, 25 bp, S. cerevisiae
gattatcttttggatttggccggcc

SEQ ID NO: 39199 - DNA, 25 bp, S. cerevisiae
gatttcatctctttatttggtccgt

SEQ ID NO: 39200 - DNA, 25 bp, S. cerevisiae
gatttcatcaagttcgatgccggta

SEQ ID NO: 39201 - DNA, 25 bp, S. cerevisiae
gatttgcgccaaaggtcatgagact

SEQ ID NO: 39202 - DNA, 25 bp, S. cerevisiae
gatttggccacaagatacgcgattt

SEQ ID NO: 39203 - DNA, 25 bp, S. cerevisiae
gattttggcacagcatacgaattgg

SEQ ID NO: 39204 - DNA, 25 bp, S. cerevisiae
gattatccgccaatgtacaaatgtg

SEQ ID NO: 39205 - DNA, 25 bp, S. cerevisiae
gatttgcgcgcttattcaacaatgt

SEQ ID NO: 39206 - DNA, 25 bp, S. cerevisiae
gatttgcgctgagaatctactcgat

SEQ ID NO: 39207 - DNA, 25 bp, S. cerevisiae
gatttgcgataacttcttgatcaga

SEQ ID NO: 39208 - DNA, 25 bp, S. cerevisiae
gattcaggtgttgtttgcattgctt

SEQ ID NO: 39209 - DNA, 25 bp, S. cerevisiae
gatttcgatgttgctgttttgccat

SEQ ID NO: 39210 - DNA, 25 bp, S. cerevisiae
gatttcctgcatcgcgggtagtaaa

SEQ ID NO: 39211 - DNA, 25 bp, S. cerevisiae
gatttttcgctgctggtgatgttca

SEQ ID NO: 39212 - DNA, 25 bp, S. cerevisiae
gatttctggcacatctatttcttac

SEQ ID NO: 39213 - DNA, 25 bp, S. cerevisiae
gatttggccaatcctgacggtaatt

SEQ ID NO: 39214 - DNA, 25 bp, S. cerevisiae
gatttgacacaggtttccgtggtta

SEQ ID NO: 39215 - DNA, 25 bp, S. cerevisiae
gatttaaatgcctttccgtggtcaa

SEQ ID NO: 39216 - DNA, 25 bp, S. cerevisiae
gattttgaatcctctacaaccatga

SEQ ID NO: 39217 - DNA, 25 bp, S. cerevisiae
gatttaaatctaagcccatcctcga

SEQ ID NO: 39218 - DNA, 25 bp, S. cerevisiae
gatttgaacatggaacctctcgttg

SEQ ID NO: 39219 - DNA, 25 bp, S. cerevisiae
gatttcaagatggtacctccgtagt

SEQ ID NO: 39220 - DNA, 25 bp, S. cerevisiae
gatttcttgcatgtatcctctggct

SEQ ID NO: 39221 - DNA, 25 bp, S. cerevisiae
gatttctgtagcatactcgcttcaa

SEQ ID NO: 39222 - DNA, 25 bp, S. cerevisiae
gatttcttcggtagctctcatcaaa

SEQ ID NO: 39223 - DNA, 25 bp, S. cerevisiae
gattttcctggtactccagaagcca

SEQ ID NO: 39224 - DNA, 25 bp, S. cerevisiae
gttgttcatctcacacttgggagcc

SEQ ID NO: 39225 - DNA, 25 bp, S. cerevisiae
gatttctcattaccaattctcggca

SEQ ID NO: 39226 - DNA, 25 bp, S. cerevisiae
gattatgctatgtctccaagtctgc

SEQ ID NO: 39227 - DNA, 25 bp, S. cerevisiae
gattgaggccctgcagagtgccaaa

SEQ ID NO: 39228 - DNA, 25 bp, S. cerevisiae
gattacccttggcagatgacatcaa

SEQ ID NO: 39229 - DNA, 25 bp, S. cerevisiae
gattcactcagttcatggcttcaat

SEQ ID NO: 39230 - DNA, 25 bp, S. cerevisiae
gattcctcaccattgcagagtcaga

SEQ ID NO: 39231 - DNA, 25 bp, S. cerevisiae
gattacatcacctatcagatcagta

SEQ ID NO: 39232 - DNA, 25 bp, S. cerevisiae
gatttcagcattgacgatattccag

SEQ ID NO: 39233 - DNA, 25 bp, S. cerevisiae
gatttcgatatctctcatgcttacg

SEQ ID NO: 39234 - DNA, 25 bp, S. cerevisiae
gatttctcaatctttgctggctagc

SEQ ID NO: 39235 - DNA, 25 bp, S. cerevisiae
gatttcgctacttttgcagcagcag

SEQ ID NO: 39236 - DNA, 25 bp, S. cerevisiae
gattaccaagacaacctgagccact

SEQ ID NO: 39237 - DNA, 25 bp, S. cerevisiae
gatttactttcaccagttgcctcat

SEQ ID NO: 39238 - DNA, 25 bp, S. cerevisiae
gatttgacagtaaccgctagcatta

SEQ ID NO: 39239 - DNA, 25 bp, S. cerevisiae
gatttgcaagcgatgtcacgaattc

SEQ ID NO: 39240 - DNA, 25 bp, S. cerevisiae
gattttaattctgagggcctgcctc

SEQ ID NO: 39241 - DNA, 25 bp, S. cerevisiae
gattttgatcatgtcgggtacaggc

SEQ ID NO: 39242 - DNA, 25 bp, S. cerevisiae
gatttgtcctctcctgttatgaaga

SEQ ID NO: 39243 - DNA, 25 bp, S. cerevisiae
gatttattctgaccaagccaggcct

SEQ ID NO: 39244 - DNA, 25 bp, S. cerevisiae
gatttattacagacggcctggcaca

SEQ ID NO: 39245 - DNA, 25 bp, S. cerevisiae
gatttgttcctgaagcgacacgcaa

SEQ ID NO: 39246 - DNA, 25 bp, S. cerevisiae
gatttgtttgtcatggacgctcaga

SEQ ID NO: 39247 - DNA, 25 bp, S. cerevisiae
gatttgtttatgattccagctggat

SEQ ID NO: 39248 - DNA, 25 bp, S. cerevisiae
gattcttcggattctgccaagacat

SEQ ID NO: 39249 - DNA, 25 bp, S. cerevisiae
gattcaatcgcttttgacatcgatc

SEQ ID NO: 39250 - DNA, 25 bp, S. cerevisiae
gatttatgtcgtaagatccccacaa

SEQ ID NO: 39251 - DNA, 25 bp, S. cerevisiae
gatttcatcaattggctatcttcaa

SEQ ID NO: 39252 - DNA, 25 bp, S. cerevisiae
gatttccatcatacagtgactccat

SEQ ID NO: 39253 - DNA, 25 bp, S. cerevisiae
gatttcgctcatcatgttctcattg

SEQ ID NO: 39254 - DNA, 25 bp, S. cerevisiae
gattaggtctgttttttctggcgtc

SEQ ID NO: 39255 - DNA, 25 bp, S. cerevisiae
gattatcgcttttattccctgggta

SEQ ID NO: 39256 - DNA, 25 bp, S. cerevisiae
gatttcctgttctatgatccctata

SEQ ID NO: 39257 - DNA, 25 bp, S. cerevisiae
gattatatcttctccatccgatgga

SEQ ID NO: 39258 - DNA, 25 bp, S. cerevisiae
gattccattggctctactcgtgtag

SEQ ID NO: 39259 - DNA, 25 bp, S. cerevisiae
gatttagctttctttccttgtactc

SEQ ID NO: 39260 - DNA, 25 bp, S. cerevisiae
gatttacttatttcccttgcgaccg

SEQ ID NO: 39261 - DNA, 25 bp, S. cerevisiae
gatttactgttgatcctttccatgg

SEQ ID NO: 39262 - DNA, 25 bp, S. cerevisiae
gatttacagtcttccaagttccagc

SEQ ID NO: 39263 - DNA, 25 bp, S. cerevisiae
gattcggcttttgcaactttaggca

SEQ ID NO: 39264 - DNA, 25 bp, S. cerevisiae
gatttcacgaactcaacatccaata

SEQ ID NO: 39265 - DNA, 25 bp, S. cerevisiae
gatttgaccaaatcagagatgaaca

SEQ ID NO: 39266 - DNA, 25 bp, S. cerevisiae
gatttgcccgtggtatgacttccaa

SEQ ID NO: 39267 - DNA, 25 bp, S. cerevisiae
gattaccacgagttgaaagtagcaa

SEQ ID NO: 39268 - DNA, 25 bp, S. cerevisiae
gattactcaaggttccggtaccaga

SEQ ID NO: 39269 - DNA, 25 bp, S. cerevisiae
gttaccaatcgtcaccgtattacaa

SEQ ID NO: 39270 - DNA, 25 bp, S. cerevisiae
gttgaccaaggtcgaccgtgagaca

SEQ ID NO: 39271 - DNA, 25 bp, S. cerevisiae
gattccaaacctcttctgaagtcaa

SEQ ID NO: 39272 - DNA, 25 bp, S. cerevisiae
gatttgctatttatcccctacatgc

SEQ ID NO: 39273 - DNA, 25 bp, S. cerevisiae
gatttgaattcactatgtcccctcc

SEQ ID NO: 39274 - DNA, 25 bp, S. cerevisiae
gattagaatcactttgacctccacc

SEQ ID NO: 39275 - DNA, 25 bp, S. cerevisiae
gatttaaacctacattcattcacca

SEQ ID NO: 39276 - DNA, 25 bp, S. cerevisiae
gatttcctcctgaatgtattgctaa

SEQ ID NO: 39277 - DNA, 25 bp, S. cerevisiae
gatttaccaatgttgttttcccagg

SEQ ID NO: 39278 - DNA, 25 bp, S. cerevisiae
gatttacccgagattgtgacgaatt

SEQ ID NO: 39279 - DNA, 25 bp, S. cerevisiae
gattttccctatcgcttggacggaa

SEQ ID NO: 39280 - DNA, 25 bp, S. cerevisiae
gattattcaccgttttgtgagcgca

SEQ ID NO: 39281 - DNA, 25 bp, S. cerevisiae
gattttcacccagctatcattggtt

SEQ ID NO: 39282 - DNA, 25 bp, S. cerevisiae
gattatttttcgagacattccagac

SEQ ID NO: 39283 - DNA, 25 bp, S. cerevisiae
gatttctattccaacactttgagac

SEQ ID NO: 39284 - DNA, 25 bp, S. cerevisiae
gattacagaaactcctttgatggca

SEQ ID NO: 39285 - DNA, 25 bp, S. cerevisiae
gatttcaagttctcgcaatgggcgg

SEQ ID NO: 39286 - DNA, 25 bp, S. cerevisiae
gatttatcggcattgacctccgatc

SEQ ID NO: 39287 - DNA, 25 bp, S. cerevisiae
gatttatgccgttgtaattgccttt

SEQ ID NO: 39288 - DNA, 25 bp, S. cerevisiae
gattctcctggtatatgtttcccaa

SEQ ID NO: 39289 - DNA, 25 bp, S. cerevisiae
gattatccgccgaaggtttagccaa

SEQ ID NO: 39290 - DNA, 25 bp, S. cerevisiae
gatttcctgcggtgaatcattttta

SEQ ID NO: 39291 - DNA, 25 bp, S. cerevisiae
gatttactgcgagaaattttcactg

SEQ ID NO: 39292 - DNA, 25 bp, S. cerevisiae
gattacactccagagactttcttcg

SEQ ID NO: 39293 - DNA, 25 bp, S. cerevisiae
gattaccaacgccagccatattgta

SEQ ID NO: 39294 - DNA, 25 bp, S. cerevisiae
gattaggtaccccagaatctgtcaa

SEQ ID NO: 39295 - DNA, 25 bp, S. cerevisiae
gattcattgggatcgatgtttaccg

SEQ ID NO: 39296 - DNA, 25 bp, S. cerevisiae
gattatgtggaatcgatgccccaga

SEQ ID NO: 39297 - DNA, 25 bp, S. cerevisiae
gattgtgggaacctcatccgtgaga

SEQ ID NO: 39298 - DNA, 25 bp, S. cerevisiae
gatttatggtacctattccttggat

SEQ ID NO: 39299 - DNA, 25 bp, S. cerevisiae
gatttacgacagcttatccattaat

SEQ ID NO: 39300 - DNA, 25 bp, S. cerevisiae
gattttgaatccactactgcggtcc

SEQ ID NO: 39301 - DNA, 25 bp, S. cerevisiae
gatttcgactctagttacgcaaccc

SEQ ID NO: 39302 - DNA, 25 bp, S. cerevisiae
gatttctcccgttgtcaaagatagt

SEQ ID NO: 39303 - DNA, 25 bp, S. cerevisiae
gatttttcgccggtgcacaaaagta

SEQ ID NO: 39304 - DNA, 25 bp, S. cerevisiae
gattttcatgaaggtatctcctacg

SEQ ID NO: 39305 - DNA, 25 bp, S. cerevisiae
gattttagtgatatgagcacccacg

SEQ ID NO: 39306 - DNA, 25 bp, S. cerevisiae
gatttctaagatcggtgcacctgca

SEQ ID NO: 39307 - DNA, 25 bp, S. cerevisiae
gatttcgagcaacgtgtcagtctga

SEQ ID NO: 39308 - DNA, 25 bp, S. cerevisiae
gtgctcgtggatcccagtacgatag

SEQ ID NO: 39309 - DNA, 25 bp, S. cerevisiae
gattcgtcgatcacactactggagt

SEQ ID NO: 39310 - DNA, 25 bp, S. cerevisiae
gattttccaattttgccacctctaa

SEQ ID NO: 39311 - DNA, 25 bp, S. cerevisiae
gattcagtctgttggatgcgtccgc

SEQ ID NO: 39312 - DNA, 25 bp, S. cerevisiae
gatttttgtggtggctctacagctc

SEQ ID NO: 39313 - DNA, 25 bp, S. cerevisiae
gattcagaagatgctcacaagtcca

SEQ ID NO: 39314 - DNA, 25 bp, S. cerevisiae
gattataggcatgcgccaggtaata

SEQ ID NO: 39315 - DNA, 25 bp, S. cerevisiae
gatttagttcctgttcatcatgaag

SEQ ID NO: 39316 - DNA, 25 bp, S. cerevisiae
gatttacttctttcctgatctaatt

SEQ ID NO: 39317 - DNA, 25 bp, S. cerevisiae
gattcagacgctacatccatggatg

SEQ ID NO: 39318 - DNA, 25 bp, S. cerevisiae
gattcatcagctgtcatgccaaggc

SEQ ID NO: 39319 - DNA, 25 bp, S. cerevisiae
gattcagagtctttcagcgaggtct

SEQ ID NO: 39320 - DNA, 25 bp, S. cerevisiae
gattttctttccaagaccatgtatt

SEQ ID NO: 39321 - DNA, 25 bp, S. cerevisiae
gattacttgtattaggacgccctgc

SEQ ID NO: 39322 - DNA, 25 bp, S. cerevisiae
gattattcagttgcagggtgaccaa

SEQ ID NO: 39323 - DNA, 25 bp, S. cerevisiae
gatttcttgtctgctggttacgaag

SEQ ID NO: 39324 - DNA, 25 bp, S. cerevisiae
gatttcttccccaagttgaggcaaa

SEQ ID NO: 39325 - DNA, 25 bp, S. cerevisiae
gttgttacgaacaggctccattgac

SEQ ID NO: 39326 - DNA, 25 bp, S. cerevisiae
gattttcagcgagagcaggttgcta

SEQ ID NO: 39327 - DNA, 25 bp, S. cerevisiae
gattctttgattgcgcaacctataa

SEQ ID NO: 39328 - DNA, 25 bp, S. cerevisiae
gattatcttcacgaagcaaaccata

SEQ ID NO: 39329 - DNA, 25 bp, S. cerevisiae
gattccctcaaggacgaactgctag

SEQ ID NO: 39330 - DNA, 25 bp, S. cerevisiae
gattccttatcgcaggcaagcatta

SEQ ID NO: 39331 - DNA, 25 bp, S. cerevisiae
gattccttatcattaactagcatac

SEQ ID NO: 39332 - DNA, 25 bp, S. cerevisiae
gattgacttgtatactgcaactacc

SEQ ID NO: 39333 - DNA, 25 bp, S. cerevisiae
gattatcctggatttcgaacaacac

SEQ ID NO: 39334 - DNA, 25 bp, S. cerevisiae
gattaagtacaccattccacaaagt

SEQ ID NO: 39335 - DNA, 25 bp, S. cerevisiae
gattaattggcgctttcaaaggtaa

SEQ ID NO: 39336 - DNA, 25 bp, S. cerevisiae
gattaaagccagctatctccaaggc

SEQ ID NO: 39337 - DNA, 25 bp, S. cerevisiae
gattatctccggatatgaccacggt

SEQ ID NO: 39338 - DNA, 25 bp, S. cerevisiae
gattattcccgtatacacacgtggc

SEQ ID NO: 39339 - DNA, 25 bp, S. cerevisiae
gattccggacttataaatgcctggc

SEQ ID NO: 39340 - DNA, 25 bp, S. cerevisiae
gattacgtccgattataccagccga

SEQ ID NO: 39341 - DNA, 25 bp, S. cerevisiae
gatttagtaccataagtagcgctga

SEQ ID NO: 39342 - DNA, 25 bp, S. cerevisiae
gattccatatcaaccctggtacttg

SEQ ID NO: 39343 - DNA, 25 bp, S. cerevisiae
gattttcctagcgtcatggtttatg

SEQ ID NO: 39344 - DNA, 25 bp, S. cerevisiae
gattttcagcacaccagttctattt

SEQ ID NO: 39345 - DNA, 25 bp, S. cerevisiae
gattttcagcgaccttttcttttga

SEQ ID NO: 39346 - DNA, 25 bp, S. cerevisiae
gattaccaggcgagaactttgttga

SEQ ID NO: 39347 - DNA, 25 bp, S. cerevisiae
gattatctccggactgaacttttat

SEQ ID NO: 39348 - DNA, 25 bp, S. cerevisiae
gattattcgagccagttcagctata

SEQ ID NO: 39349 - DNA, 25 bp, S. cerevisiae
gttgaacatggacgcgtcagctttt

SEQ ID NO: 39350 - DNA, 25 bp, S. cerevisiae
gttaacagggatctcgcctttttat

SEQ ID NO: 39351 - DNA, 25 bp, S. cerevisiae
gattaagcggtctctcgcaagttta

SEQ ID NO: 39352 - DNA, 25 bp, S. cerevisiae
gatttaagtctcaatttctatatgt

SEQ ID NO: 39353 - DNA, 25 bp, S. cerevisiae
gattacaaggtgcatgtacctcatg

SEQ ID NO: 39354 - DNA, 25 bp, S. cerevisiae
gattctttggtttttggcttggaca

SEQ ID NO: 39355 - DNA, 25 bp, S. cerevisiae
gattatgatcggtgtaagcgcatct

SEQ ID NO: 39356 - DNA, 25 bp, S. cerevisiae
gattattcatgacgactcactagta

SEQ ID NO: 39357 - DNA, 25 bp, S. cerevisiae
gattttggcagaatacccgctgtac

SEQ ID NO: 39358 - DNA, 25 bp, S. cerevisiae
gattttagcaacgacttcgtctcag

SEQ ID NO: 39359 - DNA, 25 bp, S. cerevisiae
gattttcaccatatttcgcatgcta

SEQ ID NO: 39360 - DNA, 25 bp, S. cerevisiae
gattttgtcaatgttgctccatcta

SEQ ID NO: 39361 - DNA, 25 bp, S. cerevisiae
gattttctcaatttatgcctcccaa

SEQ ID NO: 39362 - DNA, 25 bp, S. cerevisiae
gatttaatcttctcgcagtctgcag

SEQ ID NO: 39363 - DNA, 25 bp, S. cerevisiae
gattttgcatgaaataccttgtgac

SEQ ID NO: 39364 - DNA, 25 bp, S. cerevisiae
tgaaaatggtgggtccttctcgggc

SEQ ID NO: 39365 - DNA, 25 bp, S. cerevisiae
tttcaaaggtgcctcggtccgatgg

SEQ ID NO: 39366 - DNA, 25 bp, S. cerevisiae
gattcaaacgtttcggtcgcagtgg

SEQ ID NO: 39367 - DNA, 25 bp, S. cerevisiae
gttgaaacgttgtctgagcaggaat

SEQ ID NO: 39368 - DNA, 25 bp, S. cerevisiae
gattcaaagccctagacgcaagtaa

SEQ ID NO: 39369 - DNA, 25 bp, S. cerevisiae
gatttattatctatgctggcgttcc

SEQ ID NO: 39370 - DNA, 25 bp, S. cerevisiae
gattttcgcatttctcactggttga

SEQ ID NO: 39371 - DNA, 25 bp, S. cerevisiae
gttctccgtccattcctagaaatta

SEQ ID NO: 39372 - DNA, 25 bp, S. cerevisiae
gattacgtcatgtatggtaccgctt

SEQ ID NO: 39373 - DNA, 25 bp, S. cerevisiae
gattacggcgatagcttaagcatca

SEQ ID NO: 39374 - DNA, 25 bp, S. cerevisiae
gattatgcgtgtacagcttaaccgt

SEQ ID NO: 39375 - DNA, 25 bp, S. cerevisiae
gttacagagccagtgcgttcgtatg

SEQ ID NO: 39376 - DNA, 25 bp, S. cerevisiae
gttgatgcagcccatgttttagaat

SEQ ID NO: 39377 - DNA, 25 bp, S. cerevisiae
gattatgcatcaggtgccttggaat

SEQ ID NO: 39378 - DNA, 25 bp, S. cerevisiae
gattcagatcatggatcctgagcaa

SEQ ID NO: 39379 - DNA, 25 bp, S. cerevisiae
gattagccgctgaactgagagccca

SEQ ID NO: 39380 - DNA, 25 bp, S. cerevisiae
gattatgtccgattttaccgtggaa

SEQ ID NO: 39381 - DNA, 25 bp, S. cerevisiae
gattgtgactccatgaataacgaat

SEQ ID NO: 39382 - DNA, 25 bp, S. cerevisiae
gattctagcctctttgtacatttta

SEQ ID NO: 39383 - DNA, 25 bp, S. cerevisiae
gattattcatttttgcagccaccgg

SEQ ID NO: 39384 - DNA, 25 bp, S. cerevisiae
gattttgatagactttggacctgga

SEQ ID NO: 39385 - DNA, 25 bp, S. cerevisiae
gattttaagaccttggcaccacgaa

SEQ ID NO: 39386 - DNA, 25 bp, S. cerevisiae
gattactacgaattggtctccaaag

SEQ ID NO: 39387 - DNA, 25 bp, S. cerevisiae
tacttgaaggcgcttggctattaca

SEQ ID NO: 39388 - DNA, 25 bp, S. cerevisiae
gattttgcggcactttgagtaccat

SEQ ID NO: 39389 - DNA, 25 bp, S. cerevisiae
gattttgcgatgatgtttggacttt

SEQ ID NO: 39390 - DNA, 25 bp, S. cerevisiae
gattctggtgacatagtggccgtca

SEQ ID NO: 39391 - DNA, 25 bp, S. cerevisiae
gattcgctggaactacagatactga

SEQ ID NO: 39392 - DNA, 25 bp, S. cerevisiae
gattattgtacaccagaagattcgt

SEQ ID NO: 39393 - DNA, 25 bp, S. cerevisiae
gattttatatccctacgcatactcg

SEQ ID NO: 39394 - DNA, 25 bp, S. cerevisiae
gattttttctgcataccaagcaagt

SEQ ID NO: 39395 - DNA, 25 bp, S. cerevisiae
gattttatcatcgttaccagagagt

SEQ ID NO: 39396 - DNA, 25 bp, S. cerevisiae
gatttttcagcaaactcggacgata

SEQ ID NO: 39397 - DNA, 25 bp, S. cerevisiae
gattgtttacatgacctcgtcgcat

SEQ ID NO: 39398 - DNA, 25 bp, S. cerevisiae
gattggtacacacacgtggtcacat

SEQ ID NO: 39399 - DNA, 25 bp, S. cerevisiae
gattatatcaaaccagccactgctg

SEQ ID NO: 39400 - DNA, 25 bp, S. cerevisiae
gattcatttgtagagtcgtgccata

SEQ ID NO: 39401 - DNA, 25 bp, S. cerevisiae
gattttttggtcttgtgctggtata

SEQ ID NO: 39402 - DNA, 25 bp, S. cerevisiae
gattttcttggttgcggtgatctaa

SEQ ID NO: 39403 - DNA, 25 bp, S. cerevisiae
gattactccaggttgcattagacaa

SEQ ID NO: 39404 - DNA, 25 bp, S. cerevisiae
gattacatccaatggtccttgctgg

SEQ ID NO: 39405 - DNA, 25 bp, S. cerevisiae
gattatatctacatggatcatccgg

SEQ ID NO: 39406 - DNA, 25 bp, S. cerevisiae
gttgaacttcttaatcatgccatgg

SEQ ID NO: 39407 - DNA, 25 bp, S. cerevisiae
gttgacacatttctaattccgccat

SEQ ID NO: 39408 - DNA, 25 bp, S. cerevisiae
gattatattcctatggttccaccat

SEQ ID NO: 39409 - DNA, 25 bp, S. cerevisiae
gattatttgcggagtttgccgtcat

SEQ ID NO: 39410 - DNA, 25 bp, S. cerevisiae
gattttatctcatgaaggctccgtt

SEQ ID NO: 39411 - DNA, 25 bp, S. cerevisiae
gattttatctctacagggttccatt

SEQ ID NO: 39412 - DNA, 25 bp, S. cerevisiae
gattttagtttggacgttcagcaga

SEQ ID NO: 39413 - DNA, 25 bp, S. cerevisiae
gattttggatttgccacctcaagag

SEQ ID NO: 39414 - DNA, 25 bp, S. cerevisiae
gattttcacttcattctgaggagga

SEQ ID NO: 39415 - DNA, 25 bp, S. cerevisiae
gattttgttttcaactgtaaggaag

SEQ ID NO: 39416 - DNA, 25 bp, S. cerevisiae
gattccatggtttataggctgttca

SEQ ID NO: 39417 - DNA, 25 bp, S. cerevisiae
gattagatttcgcatcagttcatga

SEQ ID NO: 39418 - DNA, 25 bp, S. cerevisiae
gattatgattttgcgcctcttttaa

SEQ ID NO: 39419 - DNA, 25 bp, S. cerevisiae
gattatttcagcaaactttcggtga

SEQ ID NO: 39420 - DNA, 25 bp, S. cerevisiae
gattcatcattaaaacccctggtgg

SEQ ID NO: 39421 - DNA, 25 bp, S. cerevisiae
gttccattactatcatccctcagga

SEQ ID NO: 39422 - DNA, 25 bp, S. cerevisiae
gattctgtaatactttcctccgacc

SEQ ID NO: 39423 - DNA, 25 bp, S. cerevisiae
gattctgaaaccactatccaccatt

SEQ ID NO: 39424 - DNA, 25 bp, S. cerevisiae
gattcttcgagtgtgtctttttctg

SEQ ID NO: 39425 - DNA, 25 bp, S. cerevisiae
gattttcaatctctggctttttcca

SEQ ID NO: 39426 - DNA, 25 bp, S. cerevisiae
gattttgctaatcacctttttacag

SEQ ID NO: 39427 - DNA, 25 bp, S. cerevisiae
gattttcatgttctccattctagcc

SEQ ID NO: 39428 - DNA, 25 bp, S. cerevisiae
gattctttcattcctttaagccttg

SEQ ID NO: 39429 - DNA, 25 bp, S. cerevisiae
gattttctagatcgttgccaacctg

SEQ ID NO: 39430 - DNA, 25 bp, S. cerevisiae
gattcttcccaggattcgaacttga

SEQ ID NO: 39431 - DNA, 25 bp, S. cerevisiae
gattgcctacgggatcacgaacgag

SEQ ID NO: 39432 - DNA, 25 bp, S. cerevisiae
gattcactaccactgttggcggaga

SEQ ID NO: 39433 - DNA, 25 bp, S. cerevisiae
gattatgtttgaccatcgtctagga

SEQ ID NO: 39434 - DNA, 25 bp, S. cerevisiae
gattcacttctacattttacgagct

SEQ ID NO: 39435 - DNA, 25 bp, S. cerevisiae
gattgctttacagatacactccgga

SEQ ID NO: 39436 - DNA, 25 bp, S. cerevisiae
gattttgaccgcagtcgtgtgggta

SEQ ID NO: 39437 - DNA, 25 bp, S. cerevisiae
gttggaacccttacctgatgggtct

SEQ ID NO: 39438 - DNA, 25 bp, S. cerevisiae
gttggtgacatcgttaccgtcggcc

SEQ ID NO: 39439 - DNA, 25 bp, S. cerevisiae
gttggcacaacgtcccaagcgtggt

SEQ ID NO: 39440 - DNA, 25 bp, S. cerevisiae
gattggcaaacattacgggactgga

SEQ ID NO: 39441 - DNA, 25 bp, S. cerevisiae
gattattttcaaaccggcactgcca

SEQ ID NO: 39442 - DNA, 25 bp, S. cerevisiae
gattatcttcgttcacgctggatca

SEQ ID NO: 39443 - DNA, 25 bp, S. cerevisiae
gattattatggattagcaggcgtca

SEQ ID NO: 39444 - DNA, 25 bp, S. cerevisiae
gattttgagccattcgatgcgagtc

SEQ ID NO: 39445 - DNA, 25 bp, S. cerevisiae
gattgctctgaggaccatcaattag

SEQ ID NO: 39446 - DNA, 25 bp, S. cerevisiae
gattcctcgcgatccttttggattt

SEQ ID NO: 39447 - DNA, 25 bp, S. cerevisiae
gattccttggacttcgtagatggtt

SEQ ID NO: 39448 - DNA, 25 bp, S. cerevisiae
gttgataagagacgccctactgggt

SEQ ID NO: 39449 - DNA, 25 bp, S. cerevisiae
gattcgacccatcatctagcgatag

SEQ ID NO: 39450 - DNA, 25 bp, S. cerevisiae
gattctaccacgaactatgcagctg

SEQ ID NO: 39451 - DNA, 25 bp, S. cerevisiae
gattcaacttcgatctcatcagcgt

SEQ ID NO: 39452 - DNA, 25 bp, S. cerevisiae
gattatcatttccttccatttctat

SEQ ID NO: 39453 - DNA, 25 bp, S. cerevisiae
gattattttcctataaccgcattag

SEQ ID NO: 39454 - DNA, 25 bp, S. cerevisiae
gattatacttcccattacccagtaa

SEQ ID NO: 39455 - DNA, 25 bp, S. cerevisiae
gattaatactcctagtctgaccgga

SEQ ID NO: 39456 - DNA, 25 bp, S. cerevisiae
gattacgacgtctatttgacccatg

SEQ ID NO: 39457 - DNA, 25 bp, S. cerevisiae
gattttgagcgtgatattattccaa

SEQ ID NO: 39458 - DNA, 25 bp, S. cerevisiae
gattttgcacgtgatcatattacaa

SEQ ID NO: 39459 - DNA, 25 bp, S. cerevisiae
gattttgccaatgatcagctcgaag

SEQ ID NO: 39460 - DNA, 25 bp, S. cerevisiae
gattttgcaacacttcgccgaggaa

SEQ ID NO: 39461 - DNA, 25 bp, S. cerevisiae
gattttgatattactgctcctgatg

SEQ ID NO: 39462 - DNA, 25 bp, S. cerevisiae
gattcttacaatctggcgcctttga

SEQ ID NO: 39463 - DNA, 25 bp, S. cerevisiae
gattttggcgctatcagcttttttc

SEQ ID NO: 39464 - DNA, 25 bp, S. cerevisiae
gattagtggtgcatttggtctttta

SEQ ID NO: 39465 - DNA, 25 bp, S. cerevisiae
gattatgtcagaacctggagcgctt

SEQ ID NO: 39466 - DNA, 25 bp, S. cerevisiae
gattagcatctgaaccgggcattat

SEQ ID NO: 39467 - DNA, 25 bp, S. cerevisiae
gattatttgtatcgccgtttgcatg

SEQ ID NO: 39468 - DNA, 25 bp, S. cerevisiae
gattttggatctgctgcgtatgtca

SEQ ID NO: 39469 - DNA, 25 bp, S. cerevisiae
gattctagacgctgtactatgcaaa

SEQ ID NO: 39470 - DNA, 25 bp, S. cerevisiae
gattcctacgggtaatatcgtcgat

SEQ ID NO: 39471 - DNA, 25 bp, S. cerevisiae
gattcctagctggtatactgtcgtc

SEQ ID NO: 39472 - DNA, 25 bp, S. cerevisiae
gattccttcagagagattacatata

SEQ ID NO: 39473 - DNA, 25 bp, S. cerevisiae
gattcagtctcgacttttcgatagg

SEQ ID NO: 39474 - DNA, 25 bp, S. cerevisiae
gattatgacctacttttccagaacg

SEQ ID NO: 39475 - DNA, 25 bp, S. cerevisiae
gattaacactatcccttcaatgaaa

SEQ ID NO: 39476 - DNA, 25 bp, S. cerevisiae
gattcagaacataccctagcaacca

SEQ ID NO: 39477 - DNA, 25 bp, S. cerevisiae
gattaggccaacagtatccactcag

SEQ ID NO: 39478 - DNA, 25 bp, S. cerevisiae
gattacttactgatcgatacccctc

SEQ ID NO: 39479 - DNA, 25 bp, S. cerevisiae
gattactttgcaattctgtaactgg

SEQ ID NO: 39480 - DNA, 25 bp, S. cerevisiae
gattacgttgctttagtgcatccag

SEQ ID NO: 39481 - DNA, 25 bp, S. cerevisiae
gattccgggcatttcattcaagaag

SEQ ID NO: 39482 - DNA, 25 bp, S. cerevisiae
gattacgttgcctcactcaatgaat

SEQ ID NO: 39483 - DNA, 25 bp, S. cerevisiae
gattcttcttcctcttcagatgaat

SEQ ID NO: 39484 - DNA, 25 bp, S. cerevisiae
gattgcactattacagactttcggt

SEQ ID NO: 39485 - DNA, 25 bp, S. cerevisiae
gattcagctgctacaaacttcatca

SEQ ID NO: 39486 - DNA, 25 bp, S. cerevisiae
gattgactgccaagggttccaagat

SEQ ID NO: 39487 - DNA, 25 bp, S. cerevisiae
gattcagatcaccagacttcattcg

SEQ ID NO: 39488 - DNA, 25 bp, S. cerevisiae
gattcataatcgtccatatttggtg

SEQ ID NO: 39489 - DNA, 25 bp, S. cerevisiae
gattacaggacttgttttgcgaata

SEQ ID NO: 39490 - DNA, 25 bp, S. cerevisiae
gattacctaacgtatcttctgcagg

SEQ ID NO: 39491 - DNA, 25 bp, S. cerevisiae
gattccctgattcaacattgcgtgg

SEQ ID NO: 39492 - DNA, 25 bp, S. cerevisiae
gattatcaagatttgccatggcaat

SEQ ID NO: 39493 - DNA, 25 bp, S. cerevisiae
gattatcactctttgcacaggcatt

SEQ ID NO: 39494 - DNA, 25 bp, S. cerevisiae
gtttattgatttgcggaccacctaa

SEQ ID NO: 39495 - DNA, 25 bp, S. cerevisiae
gttcattatgtctttcgtacctacc

SEQ ID NO: 39496 - DNA, 25 bp, S. cerevisiae
gattcgagcttgagagacgcctcta

SEQ ID NO: 39497 - DNA, 25 bp, S. cerevisiae
gattctgattcgaggaacgtgcaag

SEQ ID NO: 39498 - DNA, 25 bp, S. cerevisiae
gttgtgctatccatgggacgctgaa

SEQ ID NO: 39499 - DNA, 25 bp, S. cerevisiae
gattgacaagcttttaaccgtacta

SEQ ID NO: 39500 - DNA, 25 bp, S. cerevisiae
gattgaaggttcctccaaccattgc

SEQ ID NO: 39501 - DNA, 25 bp, S. cerevisiae
gattatagcgatattccagcggcag

SEQ ID NO: 39502 - DNA, 25 bp, S. cerevisiae
gttgaacgtttctcagcttcaggtc

SEQ ID NO: 39503 - DNA, 25 bp, S. cerevisiae
gttcatacgtctacaccatttcgaa

SEQ ID NO: 39504 - DNA, 25 bp, S. cerevisiae
gattctactgtggtactctaactat

SEQ ID NO: 39505 - DNA, 25 bp, S. cerevisiae
gattctgaactaaacgctctactcc

SEQ ID NO: 39506 - DNA, 25 bp, S. cerevisiae
gattctaccatcaaagccacattct

SEQ ID NO: 39507 - DNA, 25 bp, S. cerevisiae
gattgtcagccattgaattccctag

SEQ ID NO: 39508 - DNA, 25 bp, S. cerevisiae
gattatatgcttgaatgcctctcta

SEQ ID NO: 39509 - DNA, 25 bp, S. cerevisiae
gattaacttgggacttttacgcgca

SEQ ID NO: 39510 - DNA, 25 bp, S. cerevisiae
gattcgggattcagtctcttactac

SEQ ID NO: 39511 - DNA, 25 bp, S. cerevisiae
gttccggcattaactcctaatgata

SEQ ID NO: 39512 - DNA, 25 bp, S. cerevisiae
gtggagggccaaacgccatacgact

SEQ ID NO: 39513 - DNA, 25 bp, S. cerevisiae
gttgacacggaatcgcaaacagaat

SEQ ID NO: 39514 - DNA, 25 bp, S. cerevisiae
gattatgactgatgtacccgctttc

SEQ ID NO: 39515 - DNA, 25 bp, S. cerevisiae
gattctaagagtttcaccgttccct

SEQ ID NO: 39516 - DNA, 25 bp, S. cerevisiae
gattcaaatgccactcaaggttccc

SEQ ID NO: 39517 - DNA, 25 bp, S. cerevisiae
gattcaagatgcactctataggatt

SEQ ID NO: 39518 - DNA, 25 bp, S. cerevisiae
gattaatcagaccaacaagcatgtt

SEQ ID NO: 39519 - DNA, 25 bp, S. cerevisiae
gattgaatcgcccatgacaaatttc

SEQ ID NO: 39520 - DNA, 25 bp, S. cerevisiae
gattactacgctgctttggctaaaa

SEQ ID NO: 39521 - DNA, 25 bp, S. cerevisiae
gattacgactgtagtacctctaaac

SEQ ID NO: 39522 - DNA, 25 bp, S. cerevisiae
gattacgatcgattgagacccttgt

SEQ ID NO: 39523 - DNA, 25 bp, S. cerevisiae
tgatcccgacgatggaacactacca

SEQ ID NO: 39524 - DNA, 25 bp, S. cerevisiae
gattccagagtttgaaataccgaca

SEQ ID NO: 39525 - DNA, 25 bp, S. cerevisiae
gattgggtcgccgtggttttagaat

SEQ ID NO: 39526 - DNA, 25 bp, S. cerevisiae
gttggagcccacaggtaatgtaccg

SEQ ID NO: 39527 - DNA, 25 bp, S. cerevisiae
gttgaagacgactcggctttaccga

SEQ ID NO: 39528 - DNA, 25 bp, S. cerevisiae
gttgaacttgaacttgacggatgac

SEQ ID NO: 39529 - DNA, 25 bp, S. cerevisiae
gattcttctgttttggagtttgact

SEQ ID NO: 39530 - DNA, 25 bp, S. cerevisiae
gattctttccttgagttttacgcgg

SEQ ID NO: 39531 - DNA, 25 bp, S. cerevisiae
gattctttccccatttttcacgtat

SEQ ID NO: 39532 - DNA, 25 bp, S. cerevisiae
gattcactgtcgtactttttcagca

SEQ ID NO: 39533 - DNA, 25 bp, S. cerevisiae
gattaccatccatcttctcatgaga

SEQ ID NO: 39534 - DNA, 25 bp, S. cerevisiae
gattaaagccagccatctccagtgc

SEQ ID NO: 39535 - DNA, 25 bp, S. cerevisiae
gattaaatccattgtgttttcccag

SEQ ID NO: 39536 - DNA, 25 bp, S. cerevisiae
gattaactgccccactttggatgat

SEQ ID NO: 39537 - DNA, 25 bp, S. cerevisiae
gattactgctatccccttagtatta

SEQ ID NO: 39538 - DNA, 25 bp, S. cerevisiae
gattacttgttcgtggtaccatcga

SEQ ID NO: 39539 - DNA, 25 bp, S. cerevisiae
gattactatttcattcttcgtcagt

SEQ ID NO: 39540 - DNA, 25 bp, S. cerevisiae
gattacgacttcatccttatgctaa

SEQ ID NO: 39541 - DNA, 25 bp, S. cerevisiae
gattacagacttcatggttactagc

SEQ ID NO: 39542 - DNA, 25 bp, S. cerevisiae
gattccaatttgtcaggttaccaag

SEQ ID NO: 39543 - DNA, 25 bp, S. cerevisiae
gattacggttgcaagttattccact

SEQ ID NO: 39544 - DNA, 25 bp, S. cerevisiae
gattccggaagcaagttattacagt

SEQ ID NO: 39545 - DNA, 25 bp, S. cerevisiae
gattgccgccagaagaactggtttg

SEQ ID NO: 39546 - DNA, 25 bp, S. cerevisiae
gattgctctgtgtaaaactggttta

SEQ ID NO: 39547 - DNA, 25 bp, S. cerevisiae
gattcttcagtataagcgtttccca

SEQ ID NO: 39548 - DNA, 25 bp, S. cerevisiae
gattacctgctttaactgttatcct

SEQ ID NO: 39549 - DNA, 25 bp, S. cerevisiae
gattcaccctcgaaattgttatccg

SEQ ID NO: 39550 - DNA, 25 bp, S. cerevisiae
gattcaaccaactctaacttctttc

SEQ ID NO: 39551 - DNA, 25 bp, S. cerevisiae
gattcaccgtacttgataactttag

SEQ ID NO: 39552 - DNA, 25 bp, S. cerevisiae
gattccaagtactctatccatgtta

SEQ ID NO: 39553 - DNA, 25 bp, S. cerevisiae
gattccaaggacatctacacagtct

SEQ ID NO: 39554 - DNA, 25 bp, S. cerevisiae
gattccagaggcaagtcaagctaat

SEQ ID NO: 39555 - DNA, 25 bp, S. cerevisiae
gattacgtcaaggactccaagcagt

SEQ ID NO: 39556 - DNA, 25 bp, S. cerevisiae
gattgacgcactgggtaccgaattt

SEQ ID NO: 39557 - DNA, 25 bp, S. cerevisiae
gattagttcccagaggtactgctaa

SEQ ID NO: 39558 - DNA, 25 bp, S. cerevisiae
gattcggcttcctcgagtaggtcaa

SEQ ID NO: 39559 - DNA, 25 bp, S. cerevisiae
gattctattgtcaaggcttctaact

SEQ ID NO: 39560 - DNA, 25 bp, S. cerevisiae
gttgttggtcccatccaatgacatt

SEQ ID NO: 39561 - DNA, 25 bp, S. cerevisiae
gttgtcatgttcaccccaatattta

SEQ ID NO: 39562 - DNA, 25 bp, S. cerevisiae
gattcttttcttaccgaaatggcta

SEQ ID NO: 39563 - DNA, 25 bp, S. cerevisiae
gattcatttagattgtccgcagcaa

SEQ ID NO: 39564 - DNA, 25 bp, S. cerevisiae
gattcgccatgtctatacaccaaac

SEQ ID NO: 39565 - DNA, 25 bp, S. cerevisiae
gattctcgatactaatgtggcacaa

SEQ ID NO: 39566 - DNA, 25 bp, S. cerevisiae
gattctccaatcaacctgaaagtca

SEQ ID NO: 39567 - DNA, 25 bp, S. cerevisiae
gattctgccatggacccaggcaaga

SEQ ID NO: 39568 - DNA, 25 bp, S. cerevisiae
gattcgtcatcttgcccgatatgaa

SEQ ID NO: 39569 - DNA, 25 bp, S. cerevisiae
gattcatgccactgatcctgaagaa

SEQ ID NO: 39570 - DNA, 25 bp, S. cerevisiae
gattctcgctttgggcgacttcctg

SEQ ID NO: 39571 - DNA, 25 bp, S. cerevisiae
gattcaacattattctccttctgat

SEQ ID NO: 39572 - DNA, 25 bp, S. cerevisiae
gattacaattttgcctatgctatga

SEQ ID NO: 39573 - DNA, 25 bp, S. cerevisiae
gattcaatagtcttaccttgttatg

SEQ ID NO: 39574 - DNA, 25 bp, S. cerevisiae
gattctcaggattctacttttcttg

SEQ ID NO: 39575 - DNA, 25 bp, S. cerevisiae
gattgaatgatacatcgccaagcag

SEQ ID NO: 39576 - DNA, 25 bp, S. cerevisiae
gattctgatgtatctgcgcccaata

SEQ ID NO: 39577 - DNA, 25 bp, S. cerevisiae
gattcgatgatctcttccgatttta

SEQ ID NO: 39578 - DNA, 25 bp, S. cerevisiae
tgattggtggacaggcaggactaac

SEQ ID NO: 39579 - DNA, 25 bp, S. cerevisiae
gattgcggaacttaacgacgaactt

SEQ ID NO: 39580 - DNA, 25 bp, S. cerevisiae
gttggagtaccaaacgacgtgctgt

SEQ ID NO: 39581 - DNA, 25 bp, S. cerevisiae
gttgttgtcccagccgttgtcaaaa

SEQ ID NO: 39582 - DNA, 25 bp, S. cerevisiae
gttgggcgtcctcatgaaagataaa

SEQ ID NO: 39583 - DNA, 25 bp, S. cerevisiae
gttgttccgcctccaaacagtgaaa

SEQ ID NO: 39584 - DNA, 25 bp, S. cerevisiae
gttggttacctcacgtcatggaaat

SEQ ID NO: 39585 - DNA, 25 bp, S. cerevisiae
gttggttccaccatctttattgaat

SEQ ID NO: 39586 - DNA, 25 bp, S. cerevisiae
gttgttagaaccactttattgcctg

SEQ ID NO: 39587 - DNA, 25 bp, S. cerevisiae
gattgctacaaacaacgtcactcat

SEQ ID NO: 39588 - DNA, 25 bp, S. cerevisiae
gattctcgggactaacgacatctca

SEQ ID NO: 39589 - DNA, 25 bp, S. cerevisiae
gattccatcggattaacattatcac

SEQ ID NO: 39590 - DNA, 25 bp, S. cerevisiae
gattcacagagccttcagagaccaa

SEQ ID NO: 39591 - DNA, 25 bp, S. cerevisiae
gattcatcgatctctgattttgtta

SEQ ID NO: 39592 - DNA, 25 bp, S. cerevisiae
gattccctaggccatcatgttgatt

SEQ ID NO: 39593 - DNA, 25 bp, S. cerevisiae
gattcacggaattctgcaattcaca

SEQ ID NO: 39594 - DNA, 25 bp, S. cerevisiae
gattcaagtgatgctgctttgacag

SEQ ID NO: 39595 - DNA, 25 bp, S. cerevisiae
gattcattggatggcgttgttcaca

SEQ ID NO: 39596 - DNA, 25 bp, S. cerevisiae
gattcaggcgcatggatcttgacca

SEQ ID NO: 39597 - DNA, 25 bp, S. cerevisiae
gattcagggacgtttacagcatcga

SEQ ID NO: 39598 - DNA, 25 bp, S. cerevisiae
gattccggcgctattcaagagctat

SEQ ID NO: 39599 - DNA, 25 bp, S. cerevisiae
gattcaaacactaactcaacgcctc

SEQ ID NO: 39600 - DNA, 25 bp, S. cerevisiae
gttggtagtcgcattggtactggca

SEQ ID NO: 39601 - DNA, 25 bp, S. cerevisiae
gattcattcttcctccatgtttttt

SEQ ID NO: 39602 - DNA, 25 bp, S. cerevisiae
gattcagacctgcaccatattttgg

SEQ ID NO: 39603 - DNA, 25 bp, S. cerevisiae
gattctgctggtggcaatgctgttt

SEQ ID NO: 39604 - DNA, 25 bp, S. cerevisiae
gattccagtatccagaaggttttta

SEQ ID NO: 39605 - DNA, 25 bp, S. cerevisiae
gattcagagccccagaagctttgtt

SEQ ID NO: 39606 - DNA, 25 bp, S. cerevisiae
gattcatattccaatcagatacgtt

SEQ ID NO: 39607 - DNA, 25 bp, S. cerevisiae
gattcattccttagagaacggtctt

SEQ ID NO: 39608 - DNA, 25 bp, S. cerevisiae
gattctattgttaaagcctccaact

SEQ ID NO: 39609 - DNA, 25 bp, S. cerevisiae
gattgctaatctgccttacaacaac

SEQ ID NO: 39610 - DNA, 25 bp, S. cerevisiae
gattctatcaaaatgtacccaacct

SEQ ID NO: 39611 - DNA, 25 bp, S. cerevisiae
gattctatcaatctgctactgccat

SEQ ID NO: 39612 - DNA, 25 bp, S. cerevisiae
gattcttcatcatcggatccatcat

SEQ ID NO: 39613 - DNA, 25 bp, S. cerevisiae
gattccatcgattccgctttggaag

SEQ ID NO: 39614 - DNA, 25 bp, S. cerevisiae
gattccattgaaactgcttcgctag

SEQ ID NO: 39615 - DNA, 25 bp, S. cerevisiae
gattcatctacattgcattccaaag

SEQ ID NO: 39616 - DNA, 25 bp, S. cerevisiae
gattgcctagcccatttgaaaataa

SEQ ID NO: 39617 - DNA, 25 bp, S. cerevisiae
gttatcaccttttggactaatcggg

SEQ ID NO: 39618 - DNA, 25 bp, S. cerevisiae
gttgataccactttacctggttggg

SEQ ID NO: 39619 - DNA, 25 bp, S. cerevisiae
gattcacacaagttacacctgggtc

SEQ ID NO: 39620 - DNA, 25 bp, S. cerevisiae
gttaaacaatctactccggttaatg

SEQ ID NO: 39621 - DNA, 25 bp, S. cerevisiae
gattaaaattgttcacccagattgg

SEQ ID NO: 39622 - DNA, 25 bp, S. cerevisiae
gattgctaccgttattttctacgcc

SEQ ID NO: 39623 - DNA, 25 bp, S. cerevisiae
gattgccctcagatgttcttgatac

SEQ ID NO: 39624 - DNA, 25 bp, S. cerevisiae
gattgccaccggatcacttgataga

SEQ ID NO: 39625 - DNA, 25 bp, S. cerevisiae
gattgtgggccctgacatcatgaat

SEQ ID NO: 39626 - DNA, 25 bp, S. cerevisiae
gattctgccgctgttgaacatgcaa

SEQ ID NO: 39627 - DNA, 25 bp, S. cerevisiae
gattggccccaagaacatgaaatga

SEQ ID NO: 39628 - DNA, 25 bp, S. cerevisiae
gattgccgcactacaagtaactcta

SEQ ID NO: 39629 - DNA, 25 bp, S. cerevisiae
gattccaacgaatgtttcttcacct

SEQ ID NO: 39630 - DNA, 25 bp, S. cerevisiae
gattcggtcaaatgtttttcccaga

SEQ ID NO: 39631 - DNA, 25 bp, S. cerevisiae
gattcaggaaacttgttcttttgct

SEQ ID NO: 39632 - DNA, 25 bp, S. cerevisiae
gattctgagacttccatgtgatctt

SEQ ID NO: 39633 - DNA, 25 bp, S. cerevisiae
gattctatcctgaaatacatgcccg

SEQ ID NO: 39634 - DNA, 25 bp, S. cerevisiae
gattctcacaagcataagggccatg

SEQ ID NO: 39635 - DNA, 25 bp, S. cerevisiae
gattcgccatactatctgaggagtc

SEQ ID NO: 39636 - DNA, 25 bp, S. cerevisiae
gattgcgactccttaagtagcttgg

SEQ ID NO: 39637 - DNA, 25 bp, S. cerevisiae
gattgcgctcttttggaaacatttc

SEQ ID NO: 39638 - DNA, 25 bp, S. cerevisiae
gattgcctttttggaaagccagtta

SEQ ID NO: 39639 - DNA, 25 bp, S. cerevisiae
gattcttctattactgttgccggtt

SEQ ID NO: 39640 - DNA, 25 bp, S. cerevisiae
gattcctgaatggttctcatatcct

SEQ ID NO: 39641 - DNA, 25 bp, S. cerevisiae
gattcgcagttgatctccatcccaa

SEQ ID NO: 39642 - DNA, 25 bp, S. cerevisiae
gattcggatgattttgccacctcaa

SEQ ID NO: 39643 - DNA, 25 bp, S. cerevisiae
gattctatgatgctttcaatccata

SEQ ID NO: 39644 - DNA, 25 bp, S. cerevisiae
gattctgctgagatcttagacgcaa

SEQ ID NO: 39645 - DNA, 25 bp, S. cerevisiae
gattctgctgatttctcagaggcac

SEQ ID NO: 39646 - DNA, 25 bp, S. cerevisiae
gattctctgcgattctagattcacc

SEQ ID NO: 39647 - DNA, 25 bp, S. cerevisiae
gattgataaattctccattccataa

SEQ ID NO: 39648 - DNA, 25 bp, S. cerevisiae
gattgtaattcgaacccactaaagg

SEQ ID NO: 39649 - DNA, 25 bp, S. cerevisiae
gattctggaacggtgcctcttataa

SEQ ID NO: 39650 - DNA, 25 bp, S. cerevisiae
gattctcggactggtgtttacattt

SEQ ID NO: 39651 - DNA, 25 bp, S. cerevisiae
gattcattgtctttgcggtgggata

SEQ ID NO: 39652 - DNA, 25 bp, S. cerevisiae
gattgccgcttatgctggtgttgaa

SEQ ID NO: 39653 - DNA, 25 bp, S. cerevisiae
gattgcgctgtgaaggccgttagaa

SEQ ID NO: 39654 - DNA, 25 bp, S. cerevisiae
gattcattgttaccatccatgacgg

SEQ ID NO: 39655 - DNA, 25 bp, S. cerevisiae
gattcgttattccatgccatacagg

SEQ ID NO: 39656 - DNA, 25 bp, S. cerevisiae
gattctttattttctcatgctatgg

SEQ ID NO: 39657 - DNA, 25 bp, S. cerevisiae
gattctctcttttccactcatgagt

SEQ ID NO: 39658 - DNA, 25 bp, S. cerevisiae
gattctgcgctgctaaacttgatgg

SEQ ID NO: 39659 - DNA, 25 bp, S. cerevisiae
gtttgcctggtatacgttaatgtct

SEQ ID NO: 39660 - DNA, 25 bp, S. cerevisiae
gttgtcctagttacacatggtattt

SEQ ID NO: 39661 - DNA, 25 bp, S. cerevisiae
gattgctgccagaagaaccggttta

SEQ ID NO: 39662 - DNA, 25 bp, S. cerevisiae
gattgtgctgcagtcgaaccgcgag

SEQ ID NO: 39663 - DNA, 25 bp, S. cerevisiae
gattctcatgtaagatctcatccag

SEQ ID NO: 39664 - DNA, 25 bp, S. cerevisiae
gattctcatgctatgtgctcaccaa

SEQ ID NO: 39665 - DNA, 25 bp, S. cerevisiae
gattcatatcgactggtaccataga

SEQ ID NO: 39666 - DNA, 25 bp, S. cerevisiae
gattcattaggtatacagctcgatg

SEQ ID NO: 39667 - DNA, 25 bp, S. cerevisiae
gattcttctaagtactcactgggaa

SEQ ID NO: 39668 - DNA, 25 bp, S. cerevisiae
gattgccctatggatgtcggaagat

SEQ ID NO: 39669 - DNA, 25 bp, S. cerevisiae
gttgtggtacgtttatcggaccatt

SEQ ID NO: 39670 - DNA, 25 bp, S. cerevisiae
gattgtttacgaactagcgtccccg

SEQ ID NO: 39671 - DNA, 25 bp, S. cerevisiae
gttggtttcgatgctagatttcccc

SEQ ID NO: 39672 - DNA, 25 bp, S. cerevisiae
gattcctcaatccatacaccattat

SEQ ID NO: 39673 - DNA, 25 bp, S. cerevisiae
gattcttttagcatcgccatttcag

SEQ ID NO: 39674 - DNA, 25 bp, S. cerevisiae
gattctctcatatcaaaccttcagc

SEQ ID NO: 39675 - DNA, 25 bp, S. cerevisiae
gattcccgaatatatggcttctccg

SEQ ID NO: 39676 - DNA, 25 bp, S. cerevisiae
gattccttggtagaggagtctccca

SEQ ID NO: 39677 - DNA, 25 bp, S. cerevisiae
gattcccattctttggttgtgctta

SEQ ID NO: 39678 - DNA, 25 bp, S. cerevisiae
gattgcccctcaaacgttgtgttat

SEQ ID NO: 39679 - DNA, 25 bp, S. cerevisiae
gattctttggtgacgatctttgcaa

SEQ ID NO: 39680 - DNA, 25 bp, S. cerevisiae
gattcttcaagctcgtctgattcaa

SEQ ID NO: 39681 - DNA, 25 bp, S. cerevisiae
gattcgcatcaaactgtttctactt

SEQ ID NO: 39682 - DNA, 25 bp, S. cerevisiae
gttgctgtagaacctgttgtcactt

SEQ ID NO: 39683 - DNA, 25 bp, S. cerevisiae
gattgctgaagctggcttagcctta

SEQ ID NO: 39684 - DNA, 25 bp, S. cerevisiae
gattcgaagaagacccatctgccta

SEQ ID NO: 39685 - DNA, 25 bp, S. cerevisiae
gattcggagctaacctcatctgcaa

SEQ ID NO: 39686 - DNA, 25 bp, S. cerevisiae
gttctttccacgacagcaagagcaa

SEQ ID NO: 39687 - DNA, 25 bp, S. cerevisiae
gattctttgactcctcagcaattga

SEQ ID NO: 39688 - DNA, 25 bp, S. cerevisiae
gattctttctctactactacaacta

SEQ ID NO: 39689 - DNA, 25 bp, S. cerevisiae
gattctctctctaattgttccaagg

SEQ ID NO: 39690 - DNA, 25 bp, S. cerevisiae
gattgctttcattgcattgttgcca

SEQ ID NO: 39691 - DNA, 25 bp, S. cerevisiae
gattcgttgcaagagggccatttta

SEQ ID NO: 39692 - DNA, 25 bp, S. cerevisiae
gattgacttctcgtaaggttccctt

SEQ ID NO: 39693 - DNA, 25 bp, S. cerevisiae
gattgccaactcgaattgtggtaca

SEQ ID NO: 39694 - DNA, 25 bp, S. cerevisiae
gattcctgaagagttgtcgccatcc

SEQ ID NO: 39695 - DNA, 25 bp, S. cerevisiae
gattcgtcaagatgtgctactaaga

SEQ ID NO: 39696 - DNA, 25 bp, S. cerevisiae
gattctgatggagacattttacgca

SEQ ID NO: 39697 - DNA, 25 bp, S. cerevisiae
gattcgctgaattaattttccctga

SEQ ID NO: 39698 - DNA, 25 bp, S. cerevisiae
gattcgtaaagattttcctgcagta

SEQ ID NO: 39699 - DNA, 25 bp, S. cerevisiae
gttcaggttcagtgggacattctaa

SEQ ID NO: 39700 - DNA, 25 bp, S. cerevisiae
gttcagggccttagggacacctaca

SEQ ID NO: 39701 - DNA, 25 bp, S. cerevisiae
gttggtaccgctaggaaatccttca

SEQ ID NO: 39702 - DNA, 25 bp, S. cerevisiae
gttggtaccggtctaatcacacgta

SEQ ID NO: 39703 - DNA, 25 bp, S. cerevisiae
gttggctacaaagctactgcgacag

SEQ ID NO: 39704 - DNA, 25 bp, S. cerevisiae
gttggcaggcaaccaggcgacaaat

SEQ ID NO: 39705 - DNA, 25 bp, S. cerevisiae
gattggccacagaactgggtcaaac

SEQ ID NO: 39706 - DNA, 25 bp, S. cerevisiae
gattcgcatcaccatgacgagttag

SEQ ID NO: 39707 - DNA, 25 bp, S. cerevisiae
gattctattgtcagaggtactactt

SEQ ID NO: 39708 - DNA, 25 bp, S. cerevisiae
gattgtacgtcaaaggtaagcactt

SEQ ID NO: 39709 - DNA, 25 bp, S. cerevisiae
gattgaacgatccaactgctacacc

SEQ ID NO: 39710 - DNA, 25 bp, S. cerevisiae
gttgacgttcgtgaaacttttgact

SEQ ID NO: 39711 - DNA, 25 bp, S. cerevisiae
gattgcatgtttggaattctaccta

SEQ ID NO: 39712 - DNA, 25 bp, S. cerevisiae
gattctttcttttctgtcatgcttt

SEQ ID NO: 39713 - DNA, 25 bp, S. cerevisiae
gattgcgatcctttgactgttgcat

SEQ ID NO: 39714 - DNA, 25 bp, S. cerevisiae
gattgcgtctatttatgtggtcaag

SEQ ID NO: 39715 - DNA, 25 bp, S. cerevisiae
gattgctcgcaaaagttatcggaat

SEQ ID NO: 39716 - DNA, 25 bp, S. cerevisiae
gttggatgaaggtactgcattgtca

SEQ ID NO: 39717 - DNA, 25 bp, S. cerevisiae
gattctcaaatggtccttcttttcc

SEQ ID NO: 39718 - DNA, 25 bp, S. cerevisiae
gattctataacttcttctctttcac

SEQ ID NO: 39719 - DNA, 25 bp, S. cerevisiae
gattgtataagaccttccgcattcc

SEQ ID NO: 39720 - DNA, 25 bp, S. cerevisiae
gattgttaatgacctatcccatttg

SEQ ID NO: 39721 - DNA, 25 bp, S. cerevisiae
gattctccaaatgatgagccaattt

SEQ ID NO: 39722 - DNA, 25 bp, S. cerevisiae
gattctactaatgacagctctcttg

SEQ ID NO: 39723 - DNA, 25 bp, S. cerevisiae
gttgttttcctaccagctttgtgta

SEQ ID NO: 39724 - DNA, 25 bp, S. cerevisiae
gattctggatctgcttgtttcacac

SEQ ID NO: 39725 - DNA, 25 bp, S. cerevisiae
gattctcagtctactggacttccat

SEQ ID NO: 39726 - DNA, 25 bp, S. cerevisiae
gattgacactgcttctaagttcggt

SEQ ID NO: 39727 - DNA, 25 bp, S. cerevisiae
gattctcagacttactccacaatta

SEQ ID NO: 39728 - DNA, 25 bp, S. cerevisiae
gattctcagaattcgctcaaaaatg

SEQ ID NO: 39729 - DNA, 25 bp, S. cerevisiae
gattccatatctgctaccaagaatg

SEQ ID NO: 39730 - DNA, 25 bp, S. cerevisiae
gattccaacatcgtcatcggcaaat

SEQ ID NO: 39731 - DNA, 25 bp, S. cerevisiae
gattgcatttacgttcttgactaaa

SEQ ID NO: 39732 - DNA, 25 bp, S. cerevisiae
gattctgcctgtctactatgatgag

SEQ ID NO: 39733 - DNA, 25 bp, S. cerevisiae
gattctgccgttaagctcgctgaaa

SEQ ID NO: 39734 - DNA, 25 bp, S. cerevisiae
gattcgcctttgaacatctctcaat

SEQ ID NO: 39735 - DNA, 25 bp, S. cerevisiae
gattcgccttcaaaatctacgacat

SEQ ID NO: 39736 - DNA, 25 bp, S. cerevisiae
gattggcgacgttcttttaccagat

SEQ ID NO: 39737 - DNA, 25 bp, S. cerevisiae
gttggatgacgctcaggattctgac

SEQ ID NO: 39738 - DNA, 25 bp, S. cerevisiae
gattgcgttactccatatatattga

SEQ ID NO: 39739 - DNA, 25 bp, S. cerevisiae
gattcgccattctatttcagtccta

SEQ ID NO: 39740 - DNA, 25 bp, S. cerevisiae
gattgctccaagacctctagatctc

SEQ ID NO: 39741 - DNA, 25 bp, S. cerevisiae
gattggcctatggtgccagcatgtt

SEQ ID NO: 39742 - DNA, 25 bp, S. cerevisiae
gattctgatatttttgctgagctgg

SEQ ID NO: 39743 - DNA, 25 bp, S. cerevisiae
gattctgatattttctccttcttgg

SEQ ID NO: 39744 - DNA, 25 bp, S. cerevisiae
gattcgttcggctgtgatatcacta

SEQ ID NO: 39745 - DNA, 25 bp, S. cerevisiae
gattgcgcaatcttcgaaattatca

SEQ ID NO: 39746 - DNA, 25 bp, S. cerevisiae
gattggtatcgtcgaaatctctcca

SEQ ID NO: 39747 - DNA, 25 bp, S. cerevisiae
gattcgtcacagttaatatgcctta

SEQ ID NO: 39748 - DNA, 25 bp, S. cerevisiae
gattggtcacggtacattcctgaat

SEQ ID NO: 39749 - DNA, 25 bp, S. cerevisiae
gattgcattactctatatacctgat

SEQ ID NO: 39750 - DNA, 25 bp, S. cerevisiae
gattgattgggctatgctacactcc

SEQ ID NO: 39751 - DNA, 25 bp, S. cerevisiae
gattgttgcaggtgtagaccctacg

SEQ ID NO: 39752 - DNA, 25 bp, S. cerevisiae
gattgtatctggtttagagctatca

SEQ ID NO: 39753 - DNA, 25 bp, S. cerevisiae
gttgtcattgagaccgcgcagttca

SEQ ID NO: 39754 - DNA, 25 bp, S. cerevisiae
gattgatacgacaacgcacatgctt

SEQ ID NO: 39755 - DNA, 25 bp, S. cerevisiae
gattcgaactcatctccaagactta

SEQ ID NO: 39756 - DNA, 25 bp, S. cerevisiae
gattggactaatcctcacgatttta

SEQ ID NO: 39757 - DNA, 25 bp, S. cerevisiae
gattgagatcgcattcttcctatga

SEQ ID NO: 39758 - DNA, 25 bp, S. cerevisiae
gattccggccatatttctgacattt

SEQ ID NO: 39759 - DNA, 25 bp, S. cerevisiae
gattccggtagttactatacattga

SEQ ID NO: 39760 - DNA, 25 bp, S. cerevisiae
gttggctggtagatcaccacacttg

SEQ ID NO: 39761 - DNA, 25 bp, S. cerevisiae
gttggcgaagagcatcccaattcga

SEQ ID NO: 39762 - DNA, 25 bp, S. cerevisiae
gttggaggatgttgccacggcactt

SEQ ID NO: 39763 - DNA, 25 bp, S. cerevisiae
gttgtcagagtcgaacacgtcacac

SEQ ID NO: 39764 - DNA, 25 bp, S. cerevisiae
gtactaggcgttgaggtcttccgtc

SEQ ID NO: 39765 - DNA, 25 bp, S. cerevisiae
gggcctgggataagccagtttccgt

SEQ ID NO: 39766 - DNA, 25 bp, S. cerevisiae
gattcgtggaaaaccagcatttcgt

SEQ ID NO: 39767 - DNA, 25 bp, S. cerevisiae
gttggcttggcatgtacggtaccgt

SEQ ID NO: 39768 - DNA, 25 bp, S. cerevisiae
gattggctattctacatactggtac

SEQ ID NO: 39769 - DNA, 25 bp, S. cerevisiae
gattgttactctatccatggtgtgg

SEQ ID NO: 39770 - DNA, 25 bp, S. cerevisiae
gttgaagcctactcaccatttggga

SEQ ID NO: 39771 - DNA, 25 bp, S. cerevisiae
tgattggaacgataccctttgggat

SEQ ID NO: 39772 - DNA, 25 bp, S. cerevisiae
gattggatccagttacctttttagg

SEQ ID NO: 39773 - DNA, 25 bp, S. cerevisiae
gttggcattgcgttacctgaattga

SEQ ID NO: 39774 - DNA, 25 bp, S. cerevisiae
gttggtgttcactgtcggaaacgaa

SEQ ID NO: 39775 - DNA, 25 bp, S. cerevisiae
gttgggttcactttccgacatagaa

SEQ ID NO: 39776 - DNA, 25 bp, S. cerevisiae
gattgggttacgtcgcatcagtaaa

SEQ ID NO: 39777 - DNA, 25 bp, S. cerevisiae
gattgggcgtcaactagcagccgaa

SEQ ID NO: 39778 - DNA, 25 bp, S. cerevisiae
gattgagacctctctggagacatta

SEQ ID NO: 39779 - DNA, 25 bp, S. cerevisiae
gattgaaccacaaccggagctagaa

SEQ ID NO: 39780 - DNA, 25 bp, S. cerevisiae
gattgtactccgaggcgagcgcaaa

SEQ ID NO: 39781 - DNA, 25 bp, S. cerevisiae
gattgtgtgtgcataccgttatcac

SEQ ID NO: 39782 - DNA, 25 bp, S. cerevisiae
gattgtttctttctttgatacctat

SEQ ID NO: 39783 - DNA, 25 bp, S. cerevisiae
gattgttttcttcacttggtctcca

SEQ ID NO: 39784 - DNA, 25 bp, S. cerevisiae
gattgcatggataccttaattggcc

SEQ ID NO: 39785 - DNA, 25 bp, S. cerevisiae
gattggaatcctacgttgcctccat

SEQ ID NO: 39786 - DNA, 25 bp, S. cerevisiae
gattggactcgcagtatggctacta

SEQ ID NO: 39787 - DNA, 25 bp, S. cerevisiae
gattgtcttcacatgtttctactta

SEQ ID NO: 39788 - DNA, 25 bp, S. cerevisiae
gttgaagtcggttcttacaccaaag

SEQ ID NO: 39789 - DNA, 25 bp, S. cerevisiae
gattgggatgggttcttgaccccaa

SEQ ID NO: 39790 - DNA, 25 bp, S. cerevisiae
gattgagatctggtactttggcccc

SEQ ID NO: 39791 - DNA, 25 bp, S. cerevisiae
gttgagattgaacccttacgccaag

SEQ ID NO: 39792 - DNA, 25 bp, S. cerevisiae
gattgagaattaccccaacgccagg

SEQ ID NO: 39793 - DNA, 25 bp, S. cerevisiae
gttgaaacacccactatatcgatgg

SEQ ID NO: 39794 - DNA, 25 bp, S. cerevisiae
gggccgaccccaacattattagagt

SEQ ID NO: 39795 - DNA, 25 bp, S. cerevisiae
gattccagagattacagccgcttta

SEQ ID NO: 39796 - DNA, 25 bp, S. cerevisiae
gattgctggccacgacgaatttaat

SEQ ID NO: 39797 - DNA, 25 bp, S. cerevisiae
gttgatatcaaccactgacaaatac

SEQ ID NO: 39798 - DNA, 25 bp, S. cerevisiae
gattgaccgctctagactatgttag

SEQ ID NO: 39799 - DNA, 25 bp, S. cerevisiae
gattgtcacaagctatggatgtcct

SEQ ID NO: 39800 - DNA, 25 bp, S. cerevisiae
gattgccacaggtgttatttctacc

SEQ ID NO: 39801 - DNA, 25 bp, S. cerevisiae
gattgccactggtagtaatacgcga

SEQ ID NO: 39802 - DNA, 25 bp, S. cerevisiae
gttggagcaaattgccctacagcaa

SEQ ID NO: 39803 - DNA, 25 bp, S. cerevisiae
gattgtggacaagcgcaccgagacg

SEQ ID NO: 39804 - DNA, 25 bp, S. cerevisiae
gattgtcttaagactaccgtactta

SEQ ID NO: 39805 - DNA, 25 bp, S. cerevisiae
gattgtatgctcaacttacggccct

SEQ ID NO: 39806 - DNA, 25 bp, S. cerevisiae
gattggagccaacttcattttctct

SEQ ID NO: 39807 - DNA, 25 bp, S. cerevisiae
gattggagctcattttcgaaggatt

SEQ ID NO: 39808 - DNA, 25 bp, S. cerevisiae
gattggttccatttgaggatccgca

SEQ ID NO: 39809 - DNA, 25 bp, S. cerevisiae
gattggtcatcctgatcatgcacgt

SEQ ID NO: 39810 - DNA, 25 bp, S. cerevisiae
gattgggatgaacttgcagctttga

SEQ ID NO: 39811 - DNA, 25 bp, S. cerevisiae
gattccacaatttcttgccacaaag

SEQ ID NO: 39812 - DNA, 25 bp, S. cerevisiae
gttccataattattcctcgcagcag

SEQ ID NO: 39813 - DNA, 25 bp, S. cerevisiae
gttgttcaacaagtacagaccagaa

SEQ ID NO: 39814 - DNA, 25 bp, S. cerevisiae
gttgtatgacagtactgctccttca

SEQ ID NO: 39815 - DNA, 25 bp, S. cerevisiae
gattgggcatggtacatcttttcta

SEQ ID NO: 39816 - DNA, 25 bp, S. cerevisiae
gattgggctatttcctactttcaca

SEQ ID NO: 39817 - DNA, 25 bp, S. cerevisiae
gtaggactttcatgggccttaaaat

SEQ ID NO: 39818 - DNA, 25 bp, S. cerevisiae
gattgcgttgctgatggtacttttg

SEQ ID NO: 39819 - DNA, 25 bp, S. cerevisiae
gttggatccaactactgtttcgtat

SEQ ID NO: 39820 - DNA, 25 bp, S. cerevisiae
gattggttactcctcaaagattgca

SEQ ID NO: 39821 - DNA, 25 bp, S. cerevisiae
gattggattgccttctcaaaacgaa

SEQ ID NO: 39822 - DNA, 25 bp, S. cerevisiae
gattgtgtgtcatttcatccgaacg

SEQ ID NO: 39823 - DNA, 25 bp, S. cerevisiae
gattgttgctacttttggattcggt

SEQ ID NO: 39824 - DNA, 25 bp, S. cerevisiae
gattggtgaacatctctggtttccc

SEQ ID NO: 39825 - DNA, 25 bp, S. cerevisiae
gttggtgatacttccatcgatttac

SEQ ID NO: 39826 - DNA, 25 bp, S. cerevisiae
gttggtccacacttcaagcaagcta

SEQ ID NO: 39827 - DNA, 25 bp, S. cerevisiae
gttgaacaaatcaccgtaacgccgt

SEQ ID NO: 39828 - DNA, 25 bp, S. cerevisiae
gttccaagaacagccgatagatcag

SEQ ID NO: 39829 - DNA, 25 bp, S. cerevisiae
gttccaatagaagcgctgttgcaga

SEQ ID NO: 39830 - DNA, 25 bp, S. cerevisiae
gattccaccttagagcagttgcaga

SEQ ID NO: 39831 - DNA, 25 bp, S. cerevisiae
gattccaacacttctatcagattag

SEQ ID NO: 39832 - DNA, 25 bp, S. cerevisiae
gattccagtgtttctacagacatca

SEQ ID NO: 39833 - DNA, 25 bp, S. cerevisiae
gttgtcctgggaaatattctgtggg

SEQ ID NO: 39834 - DNA, 25 bp, S. cerevisiae
gttgccgaacaagctttacgtttct

SEQ ID NO: 39835 - DNA, 25 bp, S. cerevisiae
gttgcagctaacagacctttggttt

SEQ ID NO: 39836 - DNA, 25 bp, S. cerevisiae
gttggccaacctgttcgatgaattt

SEQ ID NO: 39837 - DNA, 25 bp, S. cerevisiae
gattggccaacgacttttatcagat

SEQ ID NO: 39838 - DNA, 25 bp, S. cerevisiae
gattggccactagatgtatttcgat

SEQ ID NO: 39839 - DNA, 25 bp, S. cerevisiae
gttgacgccgtttatagttcgtctt

SEQ ID NO: 39840 - DNA, 25 bp, S. cerevisiae
gattgattctctttcttacttcctc

SEQ ID NO: 39841 - DNA, 25 bp, S. cerevisiae
gattgcccttggtttatgtgacaac

SEQ ID NO: 39842 - DNA, 25 bp, S. cerevisiae
gattgcatatttacccagttttgaa

SEQ ID NO: 39843 - DNA, 25 bp, S. cerevisiae
gttggttgattgtattcgccatcat

SEQ ID NO: 39844 - DNA, 25 bp, S. cerevisiae
gttggcctgttgtttattgattcat

SEQ ID NO: 39845 - DNA, 25 bp, S. cerevisiae
gttggcttccatgttggctattgat

SEQ ID NO: 39846 - DNA, 25 bp, S. cerevisiae
gattggttcctcatgggttttccaa

SEQ ID NO: 39847 - DNA, 25 bp, S. cerevisiae
gattggttttcaaggaagttctcaa

SEQ ID NO: 39848 - DNA, 25 bp, S. cerevisiae
gttggtgctgtctggtaagttctca

SEQ ID NO: 39849 - DNA, 25 bp, S. cerevisiae
gattgttctctcgttaagtcagatg

SEQ ID NO: 39850 - DNA, 25 bp, S. cerevisiae
gattgcaatcctgttcatcgagtat

SEQ ID NO: 39851 - DNA, 25 bp, S. cerevisiae
gattgcagctccagttcagaagttg

SEQ ID NO: 39852 - DNA, 25 bp, S. cerevisiae
gttggtcaaccaaaggacttcttgt

SEQ ID NO: 39853 - DNA, 25 bp, S. cerevisiae
gttgtttctgccgtagtttacttca

SEQ ID NO: 39854 - DNA, 25 bp, S. cerevisiae
gttgcttctcggctacacgaaattc

SEQ ID NO: 39855 - DNA, 25 bp, S. cerevisiae
gttggtcatggaactacctactttc

SEQ ID NO: 39856 - DNA, 25 bp, S. cerevisiae
gattgccttattggtcactcagtgt

SEQ ID NO: 39857 - DNA, 25 bp, S. cerevisiae
gattgacgctattgctgtcaccaag

SEQ ID NO: 39858 - DNA, 25 bp, S. cerevisiae
gttgtcgatatcctgttctcacaaa

SEQ ID NO: 39859 - DNA, 25 bp, S. cerevisiae
gttgataccaacataagcattacga

SEQ ID NO: 39860 - DNA, 25 bp, S. cerevisiae
gttgtgaaacacaccggttctcatt

SEQ ID NO: 39861 - DNA, 25 bp, S. cerevisiae
gattgaaaggcattatcccgatttt

SEQ ID NO: 39862 - DNA, 25 bp, S. cerevisiae
gttggaaggccaactcagccgaaga

SEQ ID NO: 39863 - DNA, 25 bp, S. cerevisiae
gattgggaatattaccgctcgaaga

SEQ ID NO: 39864 - DNA, 25 bp, S. cerevisiae
gttggacattttatcctcaaccgat

SEQ ID NO: 39865 - DNA, 25 bp, S. cerevisiae
gattggtttcgtcactacttacaag

SEQ ID NO: 39866 - DNA, 25 bp, S. cerevisiae
gttggtggcggtaactacctagaat

SEQ ID NO: 39867 - DNA, 25 bp, S. cerevisiae
gattgttcgctcattcagatgctga

SEQ ID NO: 39868 - DNA, 25 bp, S. cerevisiae
gattgctttgcatctattgacgaaa

SEQ ID NO: 39869 - DNA, 25 bp, S. cerevisiae
gattggttgcatcccatattcaaaa

SEQ ID NO: 39870 - DNA, 25 bp, S. cerevisiae
gattggcccatatcttcatcaaatt

SEQ ID NO: 39871 - DNA, 25 bp, S. cerevisiae
gttggccacactgcttcacagaatg

SEQ ID NO: 39872 - DNA, 25 bp, S. cerevisiae
gttggtacacacgttcaagacgcat

SEQ ID NO: 39873 - DNA, 25 bp, S. cerevisiae
gttggccacaatgcgatgaaacgat

SEQ ID NO: 39874 - DNA, 25 bp, S. cerevisiae
gttgcaggacaaggtgctggcccaa

SEQ ID NO: 39875 - DNA, 25 bp, S. cerevisiae
gttgcggaaaaagatgcctccttca

SEQ ID NO: 39876 - DNA, 25 bp, S. cerevisiae
gttgtgccaaagaacgaccccttat

SEQ ID NO: 39877 - DNA, 25 bp, S. cerevisiae
gattggcgccgtacagacattactg

SEQ ID NO: 39878 - DNA, 25 bp, S. cerevisiae
gttggcccgttatcgatcatctgat

SEQ ID NO: 39879 - DNA, 25 bp, S. cerevisiae
gttgtggcacattctagaggatctc

SEQ ID NO: 39880 - DNA, 25 bp, S. cerevisiae
gttggatccatactattgacctgca

SEQ ID NO: 39881 - DNA, 25 bp, S. cerevisiae
gttccaattggtgaagccggtgatt

SEQ ID NO: 39882 - DNA, 25 bp, S. cerevisiae
gttggaaagttcagagcccgtatct

SEQ ID NO: 39883 - DNA, 25 bp, S. cerevisiae
gttcgaaggaagtctatacgctatt

SEQ ID NO: 39884 - DNA, 25 bp, S. cerevisiae
gattgggaggacgtctaccctggta

SEQ ID NO: 39885 - DNA, 25 bp, S. cerevisiae
gattggtgaggatcttccaccggct

SEQ ID NO: 39886 - DNA, 25 bp, S. cerevisiae
gttgttgatgcgataatggaccctt

SEQ ID NO: 39887 - DNA, 25 bp, S. cerevisiae
gttgtctacctactctagagcccaa

SEQ ID NO: 39888 - DNA, 25 bp, S. cerevisiae
gattggaggtgctattttctttgaa

SEQ ID NO: 39889 - DNA, 25 bp, S. cerevisiae
gttgtcgttgctttaaaacctgacg

SEQ ID NO: 39890 - DNA, 25 bp, S. cerevisiae
gattgattcatttggcacttctaat

SEQ ID NO: 39891 - DNA, 25 bp, S. cerevisiae
gattgagattactacctgtgcttat

SEQ ID NO: 39892 - DNA, 25 bp, S. cerevisiae
gattggcatatttaccatggtgcaa

SEQ ID NO: 39893 - DNA, 25 bp, S. cerevisiae
gttgttcaggtactgcagccagcgt

SEQ ID NO: 39894 - DNA, 25 bp, S. cerevisiae
gttgtgacggatgatggcactgcat

SEQ ID NO: 39895 - DNA, 25 bp, S. cerevisiae
gttggacagtggtagccccagcgat

SEQ ID NO: 39896 - DNA, 25 bp, S. cerevisiae
gttgtaggtctgtgcgtatcggtaa

SEQ ID NO: 39897 - DNA, 25 bp, S. cerevisiae
gttgtcgcagctgtttgtcacggtc

SEQ ID NO: 39898 - DNA, 25 bp, S. cerevisiae
gattgtcaggcattctttgaacgga

SEQ ID NO: 39899 - DNA, 25 bp, S. cerevisiae
gttgcatttggtgttgagattgaga

SEQ ID NO: 39900 - DNA, 25 bp, S. cerevisiae
gttgcactgggatcatcggatggat

SEQ ID NO: 39901 - DNA, 25 bp, S. cerevisiae
gtcccttggaaccaactgtgggcaa

SEQ ID NO: 39902 - DNA, 25 bp, S. cerevisiae
gttgtttgggcccaattattgccaa

SEQ ID NO: 39903 - DNA, 25 bp, S. cerevisiae
gttgatcttaacacacttttcccag

SEQ ID NO: 39904 - DNA, 25 bp, S. cerevisiae
gattgatctccaaaccaggtttcct

SEQ ID NO: 39905 - DNA, 25 bp, S. cerevisiae
gattgttactttgtgcgttgttgcc

SEQ ID NO: 39906 - DNA, 25 bp, S. cerevisiae
gattgtgaaccaaacgcctatattg

SEQ ID NO: 39907 - DNA, 25 bp, S. cerevisiae
gattgtggcccaaactatccagatt

SEQ ID NO: 39908 - DNA, 25 bp, S. cerevisiae
gttgggcttggaacatgaaccgcta

SEQ ID NO: 39909 - DNA, 25 bp, S. cerevisiae
gttggtgttcgctaacaagcaagat

SEQ ID NO: 39910 - DNA, 25 bp, S. cerevisiae
gttggtcaattctatgccttttatg

SEQ ID NO: 39911 - DNA, 25 bp, S. cerevisiae
gttggtcagttatccatttcataat

SEQ ID NO: 39912 - DNA, 25 bp, S. cerevisiae
gttggtcttaaacatttctgttggt

SEQ ID NO: 39913 - DNA, 25 bp, S. cerevisiae
gttggcattaacgtacatcttttca

SEQ ID NO: 39914 - DNA, 25 bp, S. cerevisiae
gattggttagaaagctccttcccat

SEQ ID NO: 39915 - DNA, 25 bp, S. cerevisiae
gattgttagaatacctgagcctctc

SEQ ID NO: 39916 - DNA, 25 bp, S. cerevisiae
gattgttcaggcaacctagtccact

SEQ ID NO: 39917 - DNA, 25 bp, S. cerevisiae
gttgtcgcctctcataattaccaat

SEQ ID NO: 39918 - DNA, 25 bp, S. cerevisiae
gttggcccattttagataaccctca

SEQ ID NO: 39919 - DNA, 25 bp, S. cerevisiae
gttcgcctgtttgggtaataccaca

SEQ ID NO: 39920 - DNA, 25 bp, S. cerevisiae
gttcgtctttgctgcggtatcgaaa

SEQ ID NO: 39921 - DNA, 25 bp, S. cerevisiae
gttgtggcttaagtggttgctgact

SEQ ID NO: 39922 - DNA, 25 bp, S. cerevisiae
gattggcacttgcaactttcgacaa

SEQ ID NO: 39923 - DNA, 25 bp, S. cerevisiae
gttgaaacaatcgactccttgaaga

SEQ ID NO: 39924 - DNA, 25 bp, S. cerevisiae
gttttccaacgctccattggatact

SEQ ID NO: 39925 - DNA, 25 bp, S. cerevisiae
gttctatcgaacgagtgactctgga

SEQ ID NO: 39926 - DNA, 25 bp, S. cerevisiae
gttgatgcacaacccaaacctaagc

SEQ ID NO: 39927 - DNA, 25 bp, S. cerevisiae
gttgtattcaggttgttccagtgga

SEQ ID NO: 39928 - DNA, 25 bp, S. cerevisiae
gattgtcttaggtatttccattcta

SEQ ID NO: 39929 - DNA, 25 bp, S. cerevisiae
gattgtgttgtcctttttcttacga

SEQ ID NO: 39930 - DNA, 25 bp, S. cerevisiae
gttgtctgtgtctaattgatctatg

SEQ ID NO: 39931 - DNA, 25 bp, S. cerevisiae
gttgttcgagtctttgcacgatcac

SEQ ID NO: 39932 - DNA, 25 bp, S. cerevisiae
gttgaatcactttctagaaacctag

SEQ ID NO: 39933 - DNA, 25 bp, S. cerevisiae
gtcggtatctacaacggtaaggctt

SEQ ID NO: 39934 - DNA, 25 bp, S. cerevisiae
gattgtccccaccagatatgagtac

SEQ ID NO: 39935 - DNA, 25 bp, S. cerevisiae
gattgggccacgtctagatttcaaa

SEQ ID NO: 39936 - DNA, 25 bp, S. cerevisiae
gttgctgacccgtgagttcaagaat

SEQ ID NO: 39937 - DNA, 25 bp, S. cerevisiae
gttgcgtaccgaagagacccaccat

SEQ ID NO: 39938 - DNA, 25 bp, S. cerevisiae
gttgttgaccctattcaatccgtta

SEQ ID NO: 39939 - DNA, 25 bp, S. cerevisiae
gtcatggtacctcatttaccgggta

SEQ ID NO: 39940 - DNA, 25 bp, S. cerevisiae
gattggtacttcttattcactggag

SEQ ID NO: 39941 - DNA, 25 bp, S. cerevisiae
gttggctccaaatttctcactgtat

SEQ ID NO: 39942 - DNA, 25 bp, S. cerevisiae
gttggtccaatattcacgggtatac

SEQ ID NO: 39943 - DNA, 25 bp, S. cerevisiae
gattgtgagcgctttttcgaacgta

SEQ ID NO: 39944 - DNA, 25 bp, S. cerevisiae
gattggcacgctgttaggatccatt

SEQ ID NO: 39945 - DNA, 25 bp, S. cerevisiae
gattggcagccggattcagtatcct

SEQ ID NO: 39946 - DNA, 25 bp, S. cerevisiae
gattgtcccagtcagatgtttctca

SEQ ID NO: 39947 - DNA, 25 bp, S. cerevisiae
gttgataacgatacgctgtccaaat

SEQ ID NO: 39948 - DNA, 25 bp, S. cerevisiae
gattggcaacctttatcctggattt

SEQ ID NO: 39949 - DNA, 25 bp, S. cerevisiae
gattggcgccacatttttggtgtta

SEQ ID NO: 39950 - DNA, 25 bp, S. cerevisiae
gattggcgccagtttgttagtttta

SEQ ID NO: 39951 - DNA, 25 bp, S. cerevisiae
gttggtattccaaagttgtctgttg

SEQ ID NO: 39952 - DNA, 25 bp, S. cerevisiae
gttgactttcatattccaccagagt

SEQ ID NO: 39953 - DNA, 25 bp, S. cerevisiae
gattggcgccactaatagacctgat

SEQ ID NO: 39954 - DNA, 25 bp, S. cerevisiae
gtctcggaagccagtcactaggtgt

SEQ ID NO: 39955 - DNA, 25 bp, S. cerevisiae
gttgcggaagtcaagccccaagtta

SEQ ID NO: 39956 - DNA, 25 bp, S. cerevisiae
gttggtaagcattatcccgttgttg

SEQ ID NO: 39957 - DNA, 25 bp, S. cerevisiae
gttgttaccgtttccatgttgattg

SEQ ID NO: 39958 - DNA, 25 bp, S. cerevisiae
gattggtgacctctccagtattgaa

SEQ ID NO: 39959 - DNA, 25 bp, S. cerevisiae
gttggtcacgtcctactatatatat

SEQ ID NO: 39960 - DNA, 25 bp, S. cerevisiae
gttggagtctatcgacgttctgtta

SEQ ID NO: 39961 - DNA, 25 bp, S. cerevisiae
gattgtctttaaattcctgtcgtct

SEQ ID NO: 39962 - DNA, 25 bp, S. cerevisiae
gttgcactgtgatatcgactacgat

SEQ ID NO: 39963 - DNA, 25 bp, S. cerevisiae
gttgacggcaaaagcaatggcgttc

SEQ ID NO: 39964 - DNA, 25 bp, S. cerevisiae
gttgtcggaactacaggcggctatt

SEQ ID NO: 39965 - DNA, 25 bp, S. cerevisiae
gttgccgaggcagtcaagtctggta

SEQ ID NO: 39966 - DNA, 25 bp, S. cerevisiae
gttggtggtcacaaatttgctgcaa

SEQ ID NO: 39967 - DNA, 25 bp, S. cerevisiae
gttggctctttcaactgttgctaat

SEQ ID NO: 39968 - DNA, 25 bp, S. cerevisiae
gttgtgcctcctaccatttaaagat

SEQ ID NO: 39969 - DNA, 25 bp, S. cerevisiae
gttgtcacctcttcctaataagcta

SEQ ID NO: 39970 - DNA, 25 bp, S. cerevisiae
gttgctaccattgcccaagaaactt

SEQ ID NO: 39971 - DNA, 25 bp, S. cerevisiae
gttccaacatatcctccaaagacgt

SEQ ID NO: 39972 - DNA, 25 bp, S. cerevisiae
gttgtcgaagttggcggattccaca

SEQ ID NO: 39973 - DNA, 25 bp, S. cerevisiae
gttactgagtagtccaggtttccat

SEQ ID NO: 39974 - DNA, 25 bp, S. cerevisiae
gttgctatctgcaggaccgattacc

SEQ ID NO: 39975 - DNA, 25 bp, S. cerevisiae
gttgcccaccgtacagagcttgagc

SEQ ID NO: 39976 - DNA, 25 bp, S. cerevisiae
gttggcgcaaacgagtgttactaca

SEQ ID NO: 39977 - DNA, 25 bp, S. cerevisiae
gttggcccaggtggttctaacatca

SEQ ID NO: 39978 - DNA, 25 bp, S. cerevisiae
gttgtcattcgttttggtcgcaaaa

SEQ ID NO: 39979 - DNA, 25 bp, S. cerevisiae
gttgacaaggctttgttggctgaaa

SEQ ID NO: 39980 - DNA, 25 bp, S. cerevisiae
gttccagttcccatttttcggagag

SEQ ID NO: 39981 - DNA, 25 bp, S. cerevisiae
gttgaagttgattccttttccggcg

SEQ ID NO: 39982 - DNA, 25 bp, S. cerevisiae
gttgacgtctttgtattccatagtg

SEQ ID NO: 39983 - DNA, 25 bp, S. cerevisiae
gttggcgttttcaaacatccatcaa

SEQ ID NO: 39984 - DNA, 25 bp, S. cerevisiae
gttgtctgctgatttcaagaacctg

SEQ ID NO: 39985 - DNA, 25 bp, S. cerevisiae
gttgtctgcagactatccaagattc

SEQ ID NO: 39986 - DNA, 25 bp, S. cerevisiae
gttggccgaattgctaattgcgtat

SEQ ID NO: 39987 - DNA, 25 bp, S. cerevisiae
gttggtgataatagcgctttcggta

SEQ ID NO: 39988 - DNA, 25 bp, S. cerevisiae
gttggccatatattaggtctaggtg

SEQ ID NO: 39989 - DNA, 25 bp, S. cerevisiae
gttgatcctgatttgggtctagacc

SEQ ID NO: 39990 - DNA, 25 bp, S. cerevisiae
gttgatatcgactggagcgctgcaa

SEQ ID NO: 39991 - DNA, 25 bp, S. cerevisiae
gttgatatacttggtgacgctcact

SEQ ID NO: 39992 - DNA, 25 bp, S. cerevisiae
gttgatgatagtttgtcggccatta

SEQ ID NO: 39993 - DNA, 25 bp, S. cerevisiae
gttgttatcgttaaaccacatgatg

SEQ ID NO: 39994 - DNA, 25 bp, S. cerevisiae
gttgattacctgattactcacaatg

SEQ ID NO: 39995 - DNA, 25 bp, S. cerevisiae
gttgtacaccgaatggaaccttcta

SEQ ID NO: 39996 - DNA, 25 bp, S. cerevisiae
gttgtacccaatataccacccagat

SEQ ID NO: 39997 - DNA, 25 bp, S. cerevisiae
gttgttcagcaaaatggcacgtcta

SEQ ID NO: 39998 - DNA, 25 bp, S. cerevisiae
gttgtccatattacatccatctact

SEQ ID NO: 39999 - DNA, 25 bp, S. cerevisiae
gttgtatcacattgaacacttggca

SEQ ID NO: 40000 - DNA, 25 bp, S. cerevisiae
gttgatgacacactaattcatgggt

SEQ ID NO: 40001 - DNA, 25 bp, S. cerevisiae
gttcgaatggaacttcagggtctaa

SEQ ID NO: 40002 - DNA, 25 bp, S. cerevisiae
gattggcctgtcaactaatacttaa

SEQ ID NO: 40003 - DNA, 25 bp, S. cerevisiae
gttggcctctaagtttgtcttcaag

SEQ ID NO: 40004 - DNA, 25 bp, S. cerevisiae
gttggcttcaaacttctttgctcaa

SEQ ID NO: 40005 - DNA, 25 bp, S. cerevisiae
gttgacttcaaactcattgagctct

SEQ ID NO: 40006 - DNA, 25 bp, S. cerevisiae
gattggaaccctactattgattcac

SEQ ID NO: 40007 - DNA, 25 bp, S. cerevisiae
gattggagcctccttctcaatgatt

SEQ ID NO: 40008 - DNA, 25 bp, S. cerevisiae
gttgggcggctggatacatagatat

SEQ ID NO: 40009 - DNA, 25 bp, S. cerevisiae
gttggccgttggtatcagagctcac

SEQ ID NO: 40010 - DNA, 25 bp, S. cerevisiae
gttgcacggcaacgatcatgatgaa

SEQ ID NO: 40011 - DNA, 25 bp, S. cerevisiae
gttggctcaatcaataccggatccc

SEQ ID NO: 40012 - DNA, 25 bp, S. cerevisiae
gtcttacaagtttacgagtcctcct

SEQ ID NO: 40013 - DNA, 25 bp, S. cerevisiae
gttcttgagcgttaaaggttccact

SEQ ID NO: 40014 - DNA, 25 bp, S. cerevisiae
gttcctgaagaaccaacgttgccgt

SEQ ID NO: 40015 - DNA, 25 bp, S. cerevisiae
gttggctcatgctatgttgtccatt

SEQ ID NO: 40016 - DNA, 25 bp, S. cerevisiae
gattggctatgcttcattacgtcta

SEQ ID NO: 40017 - DNA, 25 bp, S. cerevisiae
gttggcaaatgtctctactggttta

SEQ ID NO: 40018 - DNA, 25 bp, S. cerevisiae
gttgtaaatggtaccgctgttagga

SEQ ID NO: 40019 - DNA, 25 bp, S. cerevisiae
gttgtcgacatgttagccgtttacg

SEQ ID NO: 40020 - DNA, 25 bp, S. cerevisiae
gttgcgaagggctacatctatggct

SEQ ID NO: 40021 - DNA, 25 bp, S. cerevisiae
tcttggatttctacggagggcccga

SEQ ID NO: 40022 - DNA, 25 bp, S. cerevisiae
gttggcattgaattactagcaggca

SEQ ID NO: 40023 - DNA, 25 bp, S. cerevisiae
gttggttccttaagcgttatcacgc

SEQ ID NO: 40024 - DNA, 25 bp, S. cerevisiae
gttcctttaacgcttcacctgataa

SEQ ID NO: 40025 - DNA, 25 bp, S. cerevisiae
gttgctcaagtaacgggtcacccaa

SEQ ID NO: 40026 - DNA, 25 bp, S. cerevisiae
gttgaattctctaagtttatctaca

SEQ ID NO: 40027 - DNA, 25 bp, S. cerevisiae
gttgtacatctctaggtttagctga

SEQ ID NO: 40028 - DNA, 25 bp, S. cerevisiae
gttgggtcttatccttgaacgcaga

SEQ ID NO: 40029 - DNA, 25 bp, S. cerevisiae
gttggatactagttcctgaaacgag

SEQ ID NO: 40030 - DNA, 25 bp, S. cerevisiae
gttcgaacaggcttccgaatccgag

SEQ ID NO: 40031 - DNA, 25 bp, S. cerevisiae
gttccttgcaaccacctttaatgat

SEQ ID NO: 40032 - DNA, 25 bp, S. cerevisiae
tttccaggtaactcttcttatgcgg

SEQ ID NO: 40033 - DNA, 25 bp, S. cerevisiae
gttccaggtacatctgtttactccg

SEQ ID NO: 40034 - DNA, 25 bp, S. cerevisiae
gttcggcgtaccatttattaccatg

SEQ ID NO: 40035 - DNA, 25 bp, S. cerevisiae
gttgttgctgttgcttctttaacta

SEQ ID NO: 40036 - DNA, 25 bp, S. cerevisiae
gttgctagcaaatcgccaccaaaga

SEQ ID NO: 40037 - DNA, 25 bp, S. cerevisiae
gttgtgattcagacaccttacaagt

SEQ ID NO: 40038 - DNA, 25 bp, S. cerevisiae
gttgatcatcattccgacttaaatt

SEQ ID NO: 40039 - DNA, 25 bp, S. cerevisiae
gttgacatctgcgtctacaatgcca

SEQ ID NO: 40040 - DNA, 25 bp, S. cerevisiae
gttggcagttgctttcagatgcatt

SEQ ID NO: 40041 - DNA, 25 bp, S. cerevisiae
gttgagcatcaacctgtcacatatc

SEQ ID NO: 40042 - DNA, 25 bp, S. cerevisiae
gttgacaaaggtccgatctctcagc

SEQ ID NO: 40043 - DNA, 25 bp, S. cerevisiae
gttcaagaagtcaggtctctcggaa

SEQ ID NO: 40044 - DNA, 25 bp, S. cerevisiae
gttgtcatcaacatcgacgctggca

SEQ ID NO: 40045 - DNA, 25 bp, S. cerevisiae
gttgtcgatatcatcaaagctgaac

SEQ ID NO: 40046 - DNA, 25 bp, S. cerevisiae
gttgagagccactaaaattgaatta

SEQ ID NO: 40047 - DNA, 25 bp, S. cerevisiae
gttggacccagatagtgatgctgat

SEQ ID NO: 40048 - DNA, 25 bp, S. cerevisiae
gttggaatccaacatgctcattgat

SEQ ID NO: 40049 - DNA, 25 bp, S. cerevisiae
gttgggtgccaacagcttacatgaa

SEQ ID NO: 40050 - DNA, 25 bp, S. cerevisiae
gttgggttcctactgcttatatgac

SEQ ID NO: 40051 - DNA, 25 bp, S. cerevisiae
gttggagcttccattgctattgatg

SEQ ID NO: 40052 - DNA, 25 bp, S. cerevisiae
gttggtgcgaaaatcagcttcatca

SEQ ID NO: 40053 - DNA, 25 bp, S. cerevisiae
gttcaattcaatgtcgataccggta

SEQ ID NO: 40054 - DNA, 25 bp, S. cerevisiae
gttccttcacacagaaacgggtcag

SEQ ID NO: 40055 - DNA, 25 bp, S. cerevisiae
gtatgccgtaccagaaaaggaacca

SEQ ID NO: 40056 - DNA, 25 bp, S. cerevisiae
gttcctgaacacatgctaggtccta

SEQ ID NO: 40057 - DNA, 25 bp, S. cerevisiae
gttgtccaagaaggactattccatc

SEQ ID NO: 40058 - DNA, 25 bp, S. cerevisiae
gttgatcgccagaagaaccttgcaa

SEQ ID NO: 40059 - DNA, 25 bp, S. cerevisiae
gttggacgtgctatacggcatgcaa

SEQ ID NO: 40060 - DNA, 25 bp, S. cerevisiae
gttgttttactagttcctcattgcg

SEQ ID NO: 40061 - DNA, 25 bp, S. cerevisiae
gttgatttctccaatactctacaga

SEQ ID NO: 40062 - DNA, 25 bp, S. cerevisiae
gttgataaccaaatgctcttagcca

SEQ ID NO: 40063 - DNA, 25 bp, S. cerevisiae
gtctaacccaaagtatttcacccat

SEQ ID NO: 40064 - DNA, 25 bp, S. cerevisiae
gttaaccctagatatttacagcctt

SEQ ID NO: 40065 - DNA, 25 bp, S. cerevisiae
gttggatctctcttgaatacgtaca

SEQ ID NO: 40066 - DNA, 25 bp, S. cerevisiae
gttggactccttggacactgtcgag

SEQ ID NO: 40067 - DNA, 25 bp, S. cerevisiae
gttggatctactattcacgacgagt

SEQ ID NO: 40068 - DNA, 25 bp, S. cerevisiae
gttggattatgctcttatcgaccct

SEQ ID NO: 40069 - DNA, 25 bp, S. cerevisiae
gtagttcttgacgtagacccggccg

SEQ ID NO: 40070 - DNA, 25 bp, S. cerevisiae
tgaagtcccaaagaacaccggtcga

SEQ ID NO: 40071 - DNA, 25 bp, S. cerevisiae
gtcccgtagacgagaatgcctatat

SEQ ID NO: 40072 - DNA, 25 bp, S. cerevisiae
gttctttactctatagtacctcctc

SEQ ID NO: 40073 - DNA, 25 bp, S. cerevisiae
gttgttaagagctctgtccaccatg

SEQ ID NO: 40074 - DNA, 25 bp, S. cerevisiae
gttgtcgtggatgatgttctcgcca

SEQ ID NO: 40075 - DNA, 25 bp, S. cerevisiae
gttgatcggtgtggtctcattgaca

SEQ ID NO: 40076 - DNA, 25 bp, S. cerevisiae
gttgtcttgtgggatctcgatactt

SEQ ID NO: 40077 - DNA, 25 bp, S. cerevisiae
gttgttgctacgtctttgaatcctc

SEQ ID NO: 40078 - DNA, 25 bp, S. cerevisiae
gttgttttcaacacagaagctcatc

SEQ ID NO: 40079 - DNA, 25 bp, S. cerevisiae
gttgtctattacgacgcagttcagt

SEQ ID NO: 40080 - DNA, 25 bp, S. cerevisiae
gttggttatctccttgcagcattga

SEQ ID NO: 40081 - DNA, 25 bp, S. cerevisiae
gttggtactatctttgcaggtgcct

SEQ ID NO: 40082 - DNA, 25 bp, S. cerevisiae
gttggtgccttcttaatactgttga

SEQ ID NO: 40083 - DNA, 25 bp, S. cerevisiae
gttggtgacattgttaccgttggtc

SEQ ID NO: 40084 - DNA, 25 bp, S. cerevisiae
gttggatttccggtaatcgtgcttt

SEQ ID NO: 40085 - DNA, 25 bp, S. cerevisiae
gttgttgttaccgtttggctgaatt

SEQ ID NO: 40086 - DNA, 25 bp, S. cerevisiae
gttgttttatccatagttctgccat

SEQ ID NO: 40087 - DNA, 25 bp, S. cerevisiae
gttgggtttggccaagtctgtccac

SEQ ID NO: 40088 - DNA, 25 bp, S. cerevisiae
gttgacgagttgatacttccattta

SEQ ID NO: 40089 - DNA, 25 bp, S. cerevisiae
gttcctggactgctacgggtagtat

SEQ ID NO: 40090 - DNA, 25 bp, S. cerevisiae
gttgcacgcatgttccacgagaaac

SEQ ID NO: 40091 - DNA, 25 bp, S. cerevisiae
gttgcattgctatttcacgattgga

SEQ ID NO: 40092 - DNA, 25 bp, S. cerevisiae
gttgacattgtcattcgcacaggga

SEQ ID NO: 40093 - DNA, 25 bp, S. cerevisiae
gttgcaagagcgttttctttcgaat

SEQ ID NO: 40094 - DNA, 25 bp, S. cerevisiae
gttgagaaccacttttttgcgcact

SEQ ID NO: 40095 - DNA, 25 bp, S. cerevisiae
gttgaaaccacatggcggtggcagt

SEQ ID NO: 40096 - DNA, 25 bp, S. cerevisiae
gttggtgctttatgtcctgaacaat

SEQ ID NO: 40097 - DNA, 25 bp, S. cerevisiae
gttggtcttttgttcatcgattcat

SEQ ID NO: 40098 - DNA, 25 bp, S. cerevisiae
gttgattatcactctaagctgtata

SEQ ID NO: 40099 - DNA, 25 bp, S. cerevisiae
gttagaatcgcgtccagtgcactca

SEQ ID NO: 40100 - DNA, 25 bp, S. cerevisiae
gttcgtattgagtgcagtcaccgat

SEQ ID NO: 40101 - DNA, 25 bp, S. cerevisiae
gttgcggacatgaccattgtaacga

SEQ ID NO: 40102 - DNA, 25 bp, S. cerevisiae
gttgctggactgactgcagatgcag

SEQ ID NO: 40103 - DNA, 25 bp, S. cerevisiae
gttgctgaatcggtgaatgactctt

SEQ ID NO: 40104 - DNA, 25 bp, S. cerevisiae
gttgtgataactgcaagcccctatt

SEQ ID NO: 40105 - DNA, 25 bp, S. cerevisiae
gttgacgaagtcgatgacacccgta

SEQ ID NO: 40106 - DNA, 25 bp, S. cerevisiae
gttgatcgtactgaggctgacttat

SEQ ID NO: 40107 - DNA, 25 bp, S. cerevisiae
gttgaagccttccaatggaccgaca

SEQ ID NO: 40108 - DNA, 25 bp, S. cerevisiae
gttcgtgacttgtcccaattgagtg

SEQ ID NO: 40109 - DNA, 25 bp, S. cerevisiae
gttgagtccttaacgcaatcggtgt

SEQ ID NO: 40110 - DNA, 25 bp, S. cerevisiae
gttcgtgttgagttcttggaagaca

SEQ ID NO: 40111 - DNA, 25 bp, S. cerevisiae
gttgcagacaaatttttccgtgtta

SEQ ID NO: 40112 - DNA, 25 bp, S. cerevisiae
gttctacaaaactggtcgagttcat

SEQ ID NO: 40113 - DNA, 25 bp, S. cerevisiae
gttcgcacgaaagccctgaagtaca

SEQ ID NO: 40114 - DNA, 25 bp, S. cerevisiae
gttccactgagaaggctgcctcaat

SEQ ID NO: 40115 - DNA, 25 bp, S. cerevisiae
gttgtctatgtttaattaacctatg

SEQ ID NO: 40116 - DNA, 25 bp, S. cerevisiae
gttgctaagttttttgattcctaca

SEQ ID NO: 40117 - DNA, 25 bp, S. cerevisiae
gttgtgacccttttgcccataaagt

SEQ ID NO: 40118 - DNA, 25 bp, S. cerevisiae
gttgtgcattttagattgtcgtcgt

SEQ ID NO: 40119 - DNA, 25 bp, S. cerevisiae
gttgctgacatttccgattctgacg

SEQ ID NO: 40120 - DNA, 25 bp, S. cerevisiae
gttcttcctacgtatctggtggtaa

SEQ ID NO: 40121 - DNA, 25 bp, S. cerevisiae
gttgttcctgacatattgtgcgttg

SEQ ID NO: 40122 - DNA, 25 bp, S. cerevisiae
gttgtccttatctacagaatctgat

SEQ ID NO: 40123 - DNA, 25 bp, S. cerevisiae
gttgtcagtctttatggcggtgcat

SEQ ID NO: 40124 - DNA, 25 bp, S. cerevisiae
gttgtcgatgctattggccctgaaa

SEQ ID NO: 40125 - DNA, 25 bp, S. cerevisiae
gttgtgatttcattagcagctcaat

SEQ ID NO: 40126 - DNA, 25 bp, S. cerevisiae
gtttgatttcgggtgctattgggcc

SEQ ID NO: 40127 - DNA, 25 bp, S. cerevisiae
gtttcggcgaccataacttgggtga

SEQ ID NO: 40128 - DNA, 25 bp, S. cerevisiae
gttgccgtggacatcatcaattttg

SEQ ID NO: 40129 - DNA, 25 bp, S. cerevisiae
gttgcctgggtcatcacagcagaat

SEQ ID NO: 40130 - DNA, 25 bp, S. cerevisiae
gttccgggcaaatagcacatatgtc

SEQ ID NO: 40131 - DNA, 25 bp, S. cerevisiae
gttgatcggtttactatcttccatt

SEQ ID NO: 40132 - DNA, 25 bp, S. cerevisiae
gttgcgcagtagtccaaatcctttt

SEQ ID NO: 40133 - DNA, 25 bp, S. cerevisiae
gttctggtgcagtcaataaagtttt

SEQ ID NO: 40134 - DNA, 25 bp, S. cerevisiae
gttgcccttaggtgatatcgagccc

SEQ ID NO: 40135 - DNA, 25 bp, S. cerevisiae
gttcccatccgatagtacgcagacg

SEQ ID NO: 40136 - DNA, 25 bp, S. cerevisiae
gttgcctccatcgaacaaactgtca

SEQ ID NO: 40137 - DNA, 25 bp, S. cerevisiae
gttgctgtcgacgaacaatctccaa

SEQ ID NO: 40138 - DNA, 25 bp, S. cerevisiae
gttgaccgaaattactcttctgagg

SEQ ID NO: 40139 - DNA, 25 bp, S. cerevisiae
gttgctcccaactatacttttgaag

SEQ ID NO: 40140 - DNA, 25 bp, S. cerevisiae
gttgactttgactaacgctgccaat

SEQ ID NO: 40141 - DNA, 25 bp, S. cerevisiae
gttgtctattggtcactttgctaat

SEQ ID NO: 40142 - DNA, 25 bp, S. cerevisiae
gttgccgccggaaaattagaatata

SEQ ID NO: 40143 - DNA, 25 bp, S. cerevisiae
tttcctccaggtgttaatgacgatg

SEQ ID NO: 40144 - DNA, 25 bp, S. cerevisiae
gttcctccggatgttattgctagta

SEQ ID NO: 40145 - DNA, 25 bp, S. cerevisiae
gttgaccctaacattattgctcgat

SEQ ID NO: 40146 - DNA, 25 bp, S. cerevisiae
gttgtccctgtacggtatctacgaa

SEQ ID NO: 40147 - DNA, 25 bp, S. cerevisiae
gttgcttaccatcaaaaatatgtcg

SEQ ID NO: 40148 - DNA, 25 bp, S. cerevisiae
gttgcttaccatcaaaaatatgtcg

SEQ ID NO: 40149 - DNA, 25 bp, S. cerevisiae
gttgatttacaaacagtctccttag

SEQ ID NO: 40150 - DNA, 25 bp, S. cerevisiae
gttgcccgaaaactgttgtgttatc

SEQ ID NO: 40151 - DNA, 25 bp, S. cerevisiae
gtcacccgaagtcttttatttcaat

SEQ ID NO: 40152 - DNA, 25 bp, S. cerevisiae
gttcttgattctagcatttccggta

SEQ ID NO: 40153 - DNA, 25 bp, S. cerevisiae
gttgttgcagtttgttaccggtact

SEQ ID NO: 40154 - DNA, 25 bp, S. cerevisiae
gttgttcaattgattggcgccgtac

SEQ ID NO: 40155 - DNA, 25 bp, S. cerevisiae
gttaaggcgtctgacataaccgaca

SEQ ID NO: 40156 - DNA, 25 bp, S. cerevisiae
gttgacgttcttcactttccaacaa

SEQ ID NO: 40157 - DNA, 25 bp, S. cerevisiae
gttcgttgccgaaggtgctaacatg

SEQ ID NO: 40158 - DNA, 25 bp, S. cerevisiae
gttgcattggccaagggtctaccgt

SEQ ID NO: 40159 - DNA, 25 bp, S. cerevisiae
gttctactctgaaggttctaccggc

SEQ ID NO: 40160 - DNA, 25 bp, S. cerevisiae
gttgcttctcaagagttgtggctca

SEQ ID NO: 40161 - DNA, 25 bp, S. cerevisiae
gttgaggcgcagaatcccattatta

SEQ ID NO: 40162 - DNA, 25 bp, S. cerevisiae
gttgctgctgcacaagcccaaagta

SEQ ID NO: 40163 - DNA, 25 bp, S. cerevisiae
gttgctgctgaacaggctctcaaat

SEQ ID NO: 40164 - DNA, 25 bp, S. cerevisiae
gttgttaagctattttaccgccgat

SEQ ID NO: 40165 - DNA, 25 bp, S. cerevisiae
gttgtttacctattttcctgccaat

SEQ ID NO: 40166 - DNA, 25 bp, S. cerevisiae
gttgttcgaacctattgctctttat

SEQ ID NO: 40167 - DNA, 25 bp, S. cerevisiae
gttgcttctgaattcgacggtattt

SEQ ID NO: 40168 - DNA, 25 bp, S. cerevisiae
gttgctactattacgtgggcttatt

SEQ ID NO: 40169 - DNA, 25 bp, S. cerevisiae
gttgcctcgattctgtggtggaaat

SEQ ID NO: 40170 - DNA, 25 bp, S. cerevisiae
gtagcggacccatggatttccagaa

SEQ ID NO: 40171 - DNA, 25 bp, S. cerevisiae
gttgatgtcaatgccaagctcttct

SEQ ID NO: 40172 - DNA, 25 bp, S. cerevisiae
gtctcgtcagctagtgcaagtgcca

SEQ ID NO: 40173 - DNA, 25 bp, S. cerevisiae
gttgcagaagcgctcagagctgcca

SEQ ID NO: 40174 - DNA, 25 bp, S. cerevisiae
gttgcagaagatcctcagctgtaca

SEQ ID NO: 40175 - DNA, 25 bp, S. cerevisiae
gttgacggcgaaatacctatatatt

SEQ ID NO: 40176 - DNA, 25 bp, S. cerevisiae
gttgacccagaaatctgtcgcaata

SEQ ID NO: 40177 - DNA, 25 bp, S. cerevisiae
gttgatcctaccttgtgtagagctg

SEQ ID NO: 40178 - DNA, 25 bp, S. cerevisiae
gttgcctactcgtttggtcatggtt

SEQ ID NO: 40179 - DNA, 25 bp, S. cerevisiae
gttgtttccatcgaattctctaaga

SEQ ID NO: 40180 - DNA, 25 bp, S. cerevisiae
gttgccgctttgagaaccgttaaat

SEQ ID NO: 40181 - DNA, 25 bp, S. cerevisiae
ggtccgacttggaggctgagttcaa

SEQ ID NO: 40182 - DNA, 25 bp, S. cerevisiae
gttcactacggtacccataattatg

SEQ ID NO: 40183 - DNA, 25 bp, S. cerevisiae
gtcccatacgcgtgaccaaaattca

SEQ ID NO: 40184 - DNA, 25 bp, S. cerevisiae
ggtccatgacctgcgcaaaaaagtg

SEQ ID NO: 40185 - DNA, 25 bp, S. cerevisiae
gttgcccacgttgcaatgacggtga

SEQ ID NO: 40186 - DNA, 25 bp, S. cerevisiae
gttctacacgttgcaacctatggat

SEQ ID NO: 40187 - DNA, 25 bp, S. cerevisiae
gttctaacttcagattgccttccaa

SEQ ID NO: 40188 - DNA, 25 bp, S. cerevisiae
gttgctttctcatttttcctattca

SEQ ID NO: 40189 - DNA, 25 bp, S. cerevisiae
gttgctcctccgctttgaaagagat

SEQ ID NO: 40190 - DNA, 25 bp, S. cerevisiae
gttcttcaccactcttatcaaggaa

SEQ ID NO: 40191 - DNA, 25 bp, S. cerevisiae
gttcggacgcctgtaacatgtactt

SEQ ID NO: 40192 - DNA, 25 bp, S. cerevisiae
gttgactggtcctcaattggctgac

SEQ ID NO: 40193 - DNA, 25 bp, S. cerevisiae
gttgttccttcaactgcagtgagtt

SEQ ID NO: 40194 - DNA, 25 bp, S. cerevisiae
gttgcttccttacctttgaatgttg

SEQ ID NO: 40195 - DNA, 25 bp, S. cerevisiae
gttccccttggtcattgcaaatttc

SEQ ID NO: 40196 - DNA, 25 bp, S. cerevisiae
gttccatcgttaaccaacattactt

SEQ ID NO: 40197 - DNA, 25 bp, S. cerevisiae
gttgctcatgcagttcatccaaact

SEQ ID NO: 40198 - DNA, 25 bp, S. cerevisiae
gttgctagcgcagtatccagatgtc

SEQ ID NO: 40199 - DNA, 25 bp, S. cerevisiae
gttgctggaatcatcgttggtacat

SEQ ID NO: 40200 - DNA, 25 bp, S. cerevisiae
gttctgcttgagtaacatttttcca

SEQ ID NO: 40201 - DNA, 25 bp, S. cerevisiae
gttccttcgaaccattcattttctt

SEQ ID NO: 40202 - DNA, 25 bp, S. cerevisiae
gttccttgggaacctgttgaccttg

SEQ ID NO: 40203 - DNA, 25 bp, S. cerevisiae
gttcccggagagaagcgttactatt

SEQ ID NO: 40204 - DNA, 25 bp, S. cerevisiae
gttcccgaggagctaatggatgctt

SEQ ID NO: 40205 - DNA, 25 bp, S. cerevisiae
gttgcgcataacacgaagacatttg

SEQ ID NO: 40206 - DNA, 25 bp, S. cerevisiae
gttcgacgaacccattgaatgcttc

SEQ ID NO: 40207 - DNA, 25 bp, S. cerevisiae
ggtccgtatggaagggccccaacat

SEQ ID NO: 40208 - DNA, 25 bp, S. cerevisiae
gttgccctttctagagctgtttcaa

SEQ ID NO: 40209 - DNA, 25 bp, S. cerevisiae
gttgttgctgtttttgttgctgttg

SEQ ID NO: 40210 - DNA, 25 bp, S. cerevisiae
gtcactgggttactaatgtccgttt

SEQ ID NO: 40211 - DNA, 25 bp, S. cerevisiae
gttgaattctatccagaaccgcctt

SEQ ID NO: 40212 - DNA, 25 bp, S. cerevisiae
gttaactgcgattgccaaggccact

SEQ ID NO: 40213 - DNA, 25 bp, S. cerevisiae
gttgagacctgttgtcagagctcca

SEQ ID NO: 40214 - DNA, 25 bp, S. cerevisiae
gttgcaccctgtagatatggcttct

SEQ ID NO: 40215 - DNA, 25 bp, S. cerevisiae
gttgccatctctggtgctgcaggtg

SEQ ID NO: 40216 - DNA, 25 bp, S. cerevisiae
gttgctcatcttatcgctggtgata

SEQ ID NO: 40217 - DNA, 25 bp, S. cerevisiae
gttcatgccatctgcaactacgaag

SEQ ID NO: 40218 - DNA, 25 bp, S. cerevisiae
gttgcgccatcatgatatctagtta

SEQ ID NO: 40219 - DNA, 25 bp, S. cerevisiae
gttgaagacacctttacacctgatt

SEQ ID NO: 40220 - DNA, 25 bp, S. cerevisiae
gttgccagtcaagatttcccatact

SEQ ID NO: 40221 - DNA, 25 bp, S. cerevisiae
gttgcatgtatcttaacactaccac

SEQ ID NO: 40222 - DNA, 25 bp, S. cerevisiae
gttcatatatcagaccctaaccggc

SEQ ID NO: 40223 - DNA, 25 bp, S. cerevisiae
gttcatggacgttccctgaaatcag

SEQ ID NO: 40224 - DNA, 25 bp, S. cerevisiae
gttgctaatcactcctggacttcaa

SEQ ID NO: 40225 - DNA, 25 bp, S. cerevisiae
gttgacattgactctttattagcca

SEQ ID NO: 40226 - DNA, 25 bp, S. cerevisiae
gttgacttcgaccatttgattacca

SEQ ID NO: 40227 - DNA, 25 bp, S. cerevisiae
gttgacttcaggcatgattgtctca

SEQ ID NO: 40228 - DNA, 25 bp, S. cerevisiae
gttgacattgacgttagcgatgact

SEQ ID NO: 40229 - DNA, 25 bp, S. cerevisiae
gttgaccccgacgatcattgatgga

SEQ ID NO: 40230 - DNA, 25 bp, S. cerevisiae
gttgcagtacatggaagcttggctc

SEQ ID NO: 40231 - DNA, 25 bp, S. cerevisiae
gttcttcatgtagacttcgactgtt

SEQ ID NO: 40232 - DNA, 25 bp, S. cerevisiae
gttttgcgtaaaccggatcctcgat

SEQ ID NO: 40233 - DNA, 25 bp, S. cerevisiae
gttccatctgattaagggtacccct

SEQ ID NO: 40234 - DNA, 25 bp, S. cerevisiae
gttcttatgttcatgggcagtggcc

SEQ ID NO: 40235 - DNA, 25 bp, S. cerevisiae
gttcgtgtgacgttaaattccctat

SEQ ID NO: 40236 - DNA, 25 bp, S. cerevisiae
gttcgtgttgcgtttactgctccat

SEQ ID NO: 40237 - DNA, 25 bp, S. cerevisiae
gttgagttgatgacccaatccgcat

SEQ ID NO: 40238 - DNA, 25 bp, S. cerevisiae
gttgctttataacccatcactgtgt

SEQ ID NO: 40239 - DNA, 25 bp, S. cerevisiae
gttcattattgtcgacccactgata

SEQ ID NO: 40240 - DNA, 25 bp, S. cerevisiae
gttgagtacgaccacccaggatatc

SEQ ID NO: 40241 - DNA, 25 bp, S. cerevisiae
gttccattggtgttactatcgtctg

SEQ ID NO: 40242 - DNA, 25 bp, S. cerevisiae
gttccattatggttgcgtaggcctg

SEQ ID NO: 40243 - DNA, 25 bp, S. cerevisiae
gttccttggttgttaagtcctccat

SEQ ID NO: 40244 - DNA, 25 bp, S. cerevisiae
gttctagggcttgttgcaggatttt

SEQ ID NO: 40245 - DNA, 25 bp, S. cerevisiae
gtgttatggctacccctaaggttat

SEQ ID NO: 40246 - DNA, 25 bp, S. cerevisiae
gttgctaggctacacaccaagagtt

SEQ ID NO: 40247 - DNA, 25 bp, S. cerevisiae
gttctgatcctgaaggtccagctga

SEQ ID NO: 40248 - DNA, 25 bp, S. cerevisiae
gttcgcttgtcttggtatagtatca

SEQ ID NO: 40249 - DNA, 25 bp, S. cerevisiae
gttgcatctgtcagtgggctaacca

SEQ ID NO: 40250 - DNA, 25 bp, S. cerevisiae
gttccttttttaccaatgcgcacag

SEQ ID NO: 40251 - DNA, 25 bp, S. cerevisiae
gttcctggtgtattatttatcgacg

SEQ ID NO: 40252 - DNA, 25 bp, S. cerevisiae
gttgaaactgtttctccatccagca

SEQ ID NO: 40253 - DNA, 25 bp, S. cerevisiae
gttgccacaactgagcctaactaac

SEQ ID NO: 40254 - DNA, 25 bp, S. cerevisiae
gtctccaatgggtggcggatttgaa

SEQ ID NO: 40255 - DNA, 25 bp, S. cerevisiae
gttccgatcggaagctctaatttga

SEQ ID NO: 40256 - DNA, 25 bp, S. cerevisiae
gttctctcctgtgcgtgttgcaaaa

SEQ ID NO: 40257 - DNA, 25 bp, S. cerevisiae
gttctttccacgctttgaaacacgt

SEQ ID NO: 40258 - DNA, 25 bp, S. cerevisiae
gtatccggaactcttcgaaactggc

SEQ ID NO: 40259 - DNA, 25 bp, S. cerevisiae
gtttccaaggttcctataaacaatg

SEQ ID NO: 40260 - DNA, 25 bp, S. cerevisiae
gtcgatacaaggactgcccataaag

SEQ ID NO: 40261 - DNA, 25 bp, S. cerevisiae
gttgacatctatcacatctcctaaa

SEQ ID NO: 40262 - DNA, 25 bp, S. cerevisiae
gttgcacctgcatcacacttcaaaa

SEQ ID NO: 40263 - DNA, 25 bp, S. cerevisiae
gttgacagtatacccattggacgtt

SEQ ID NO: 40264 - DNA, 25 bp, S. cerevisiae
gtagaaaatgcacccagcggacctt

SEQ ID NO: 40265 - DNA, 25 bp, S. cerevisiae
gttgaaaaagcccagctagcaccct

SEQ ID NO: 40266 - DNA, 25 bp, S. cerevisiae
gttgaaaagccgacagtataccatt

SEQ ID NO: 40267 - DNA, 25 bp, S. cerevisiae
gttaagtagctttgaggcccctaat

SEQ ID NO: 40268 - DNA, 25 bp, S. cerevisiae
gttccatttgtttgtggcgctaaag

SEQ ID NO: 40269 - DNA, 25 bp, S. cerevisiae
gttgcctgcaagatgtcatgctgtt

SEQ ID NO: 40270 - DNA, 25 bp, S. cerevisiae
gttgcgtcaatgtgtggcatttcaa

SEQ ID NO: 40271 - DNA, 25 bp, S. cerevisiae
gttgcttgtcgcgagtttattcagt

SEQ ID NO: 40272 - DNA, 25 bp, S. cerevisiae
gttctggctgctttggattacttga

SEQ ID NO: 40273 - DNA, 25 bp, S. cerevisiae
gttgcactcgactattggttctgta

SEQ ID NO: 40274 - DNA, 25 bp, S. cerevisiae
gttgcgttaactgtgtctgggagat

SEQ ID NO: 40275 - DNA, 25 bp, S. cerevisiae
gttccgttacctgactggtgtagac

SEQ ID NO: 40276 - DNA, 25 bp, S. cerevisiae
gttccttctaacattctgcgtaaga

SEQ ID NO: 40277 - DNA, 25 bp, S. cerevisiae
gttcctcatttagttgtgggtcata

SEQ ID NO: 40278 - DNA, 25 bp, S. cerevisiae
gttctttgaggcaacggactatgta

SEQ ID NO: 40279 - DNA, 25 bp, S. cerevisiae
gttcatcttggacactgagcagttt

SEQ ID NO: 40280 - DNA, 25 bp, S. cerevisiae
gttgcatttggaagtagccgctcta

SEQ ID NO: 40281 - DNA, 25 bp, S. cerevisiae
gttgcttttctttctgaacgctata

SEQ ID NO: 40282 - DNA, 25 bp, S. cerevisiae
gttctgtttctgtagttgacgcatt

SEQ ID NO: 40283 - DNA, 25 bp, S. cerevisiae
gttcttattaagcacgaccatacga

SEQ ID NO: 40284 - DNA, 25 bp, S. cerevisiae
gttgaaggccgctttattgaacaga

SEQ ID NO: 40285 - DNA, 25 bp, S. cerevisiae
gttgcaagaccgcttagtgtacctg

SEQ ID NO: 40286 - DNA, 25 bp, S. cerevisiae
gttgcaacccgcatttgttaccttg

SEQ ID NO: 40287 - DNA, 25 bp, S. cerevisiae
gttccaaccgataattgtaaagcca

SEQ ID NO: 40288 - DNA, 25 bp, S. cerevisiae
gttcgaaccaacttacagattagtc

SEQ ID NO: 40289 - DNA, 25 bp, S. cerevisiae
gtagtcctagttcaaacaccagtgg

SEQ ID NO: 40290 - DNA, 25 bp, S. cerevisiae
ttatttctacgacagaacccgtcca

SEQ ID NO: 40291 - DNA, 25 bp, S. cerevisiae
gttgcctccagggtggaaacctatt

SEQ ID NO: 40292 - DNA, 25 bp, S. cerevisiae
gttgccgccattgttgactatgttt

SEQ ID NO: 40293 - DNA, 25 bp, S. cerevisiae
gttccagccactccattgacatatt

SEQ ID NO: 40294 - DNA, 25 bp, S. cerevisiae
gttgcacccactccataaaatactg

SEQ ID NO: 40295 - DNA, 25 bp, S. cerevisiae
gttcgccgtcatctagggatactga

SEQ ID NO: 40296 - DNA, 25 bp, S. cerevisiae
gttccacaggatctcgtagaagcta

SEQ ID NO: 40297 - DNA, 25 bp, S. cerevisiae
gttctctcagaaaacggcagcaccg

SEQ ID NO: 40298 - DNA, 25 bp, S. cerevisiae
gttctgctaagaaaggtgctacact

SEQ ID NO: 40299 - DNA, 25 bp, S. cerevisiae
gttctgctaactttgtcttctacta

SEQ ID NO: 40300 - DNA, 25 bp, S. cerevisiae
gttccagagattcatgatttcccta

SEQ ID NO: 40301 - DNA, 25 bp, S. cerevisiae
gttctcgctggactcatttgataat

SEQ ID NO: 40302 - DNA, 25 bp, S. cerevisiae
gttccgcgaggatactgaagatcac

SEQ ID NO: 40303 - DNA, 25 bp, S. cerevisiae
gttcccgtggtgtctaagcagctag

SEQ ID NO: 40304 - DNA, 25 bp, S. cerevisiae
gttcgcctatggtcgctgaagcaga

SEQ ID NO: 40305 - DNA, 25 bp, S. cerevisiae
gttccacgctggtccaaagtgtgta

SEQ ID NO: 40306 - DNA, 25 bp, S. cerevisiae
gttcaaactgtctagcaaggtctgg

SEQ ID NO: 40307 - DNA, 25 bp, S. cerevisiae
gttgcactgtcttgtctatacttac

SEQ ID NO: 40308 - DNA, 25 bp, S. cerevisiae
gttgcactccttatcttggttttag

SEQ ID NO: 40309 - DNA, 25 bp, S. cerevisiae
gttccactggtcctgtgaatagttt

SEQ ID NO: 40310 - DNA, 25 bp, S. cerevisiae
gttgctctggttgcaatcagtactg

SEQ ID NO: 40311 - DNA, 25 bp, S. cerevisiae
gttgcagtctgtgtacatcgaccca

SEQ ID NO: 40312 - DNA, 25 bp, S. cerevisiae
gttcgacagattaccggacaccaga

SEQ ID NO: 40313 - DNA, 25 bp, S. cerevisiae
gttgctgaaattgaaaagactgctg

SEQ ID NO: 40314 - DNA, 25 bp, S. cerevisiae
gttccagaatttttccagactgcga

SEQ ID NO: 40315 - DNA, 25 bp, S. cerevisiae
gttccaaatgattccttttcttgtg

SEQ ID NO: 40316 - DNA, 25 bp, S. cerevisiae
gttccaagtatgttcatgtggcgac

SEQ ID NO: 40317 - DNA, 25 bp, S. cerevisiae
gttccaacctatacatctggccaat

SEQ ID NO: 40318 - DNA, 25 bp, S. cerevisiae
gttctcgagcctatttgtgtctagt

SEQ ID NO: 40319 - DNA, 25 bp, S. cerevisiae
gttcgcggcgtcactgatggtaaat

SEQ ID NO: 40320 - DNA, 25 bp, S. cerevisiae
gttcagggttggtctctggtcaaat

SEQ ID NO: 40321 - DNA, 25 bp, S. cerevisiae
gttcggtgactctccaaggcaaata

SEQ ID NO: 40322 - DNA, 25 bp, S. cerevisiae
gttgcagagtgcgtctaccaaggta

SEQ ID NO: 40323 - DNA, 25 bp, S. cerevisiae
gttcatgcaatccatttctccagtg

SEQ ID NO: 40324 - DNA, 25 bp, S. cerevisiae
gttctggcacatgcgtcagcaacaa

SEQ ID NO: 40325 - DNA, 25 bp, S. cerevisiae
gttgccgacaaatttcgtgcactgc

SEQ ID NO: 40326 - DNA, 25 bp, S. cerevisiae
gttcacaaaaagttgcggcatccgc

SEQ ID NO: 40327 - DNA, 25 bp, S. cerevisiae
gttcccatagtagctcaggatccac

SEQ ID NO: 40328 - DNA, 25 bp, S. cerevisiae
gttctacaagcttaccaaggctacg

SEQ ID NO: 40329 - DNA, 25 bp, S. cerevisiae
gttctacgagtttgccaagccaaac

SEQ ID NO: 40330 - DNA, 25 bp, S. cerevisiae
gttcttacagtattggcaaccacat

SEQ ID NO: 40331 - DNA, 25 bp, S. cerevisiae
gttcttaacagatcgcaaacagatg

SEQ ID NO: 40332 - DNA, 25 bp, S. cerevisiae
gttgcttcagcacatgttccaaaag

SEQ ID NO: 40333 - DNA, 25 bp, S. cerevisiae
gttgcgttgcataattcactacatg

SEQ ID NO: 40334 - DNA, 25 bp, S. cerevisiae
gttcgatgcatcctcttcaataaca

SEQ ID NO: 40335 - DNA, 25 bp, S. cerevisiae
gttctgtatttcaaaccgcttggga

SEQ ID NO: 40336 - DNA, 25 bp, S. cerevisiae
gttgcttataccatgatcactgctt

SEQ ID NO: 40337 - DNA, 25 bp, S. cerevisiae
gttgctagatccgattggctgctat

SEQ ID NO: 40338 - DNA, 25 bp, S. cerevisiae
gttgctcagtcagatgttgttacca

SEQ ID NO: 40339 - DNA, 25 bp, S. cerevisiae
gttgcgcaagcttcgtttcaagtca

SEQ ID NO: 40340 - DNA, 25 bp, S. cerevisiae
gttcctgataatgaggcctcctaca

SEQ ID NO: 40341 - DNA, 25 bp, S. cerevisiae
gttcgctgaatacccagattctttc

SEQ ID NO: 40342 - DNA, 25 bp, S. cerevisiae
gtatagcgaaactcaaaccgtcaat

SEQ ID NO: 40343 - DNA, 25 bp, S. cerevisiae
gtatagagacgaccctaaccagaaa

SEQ ID NO: 40344 - DNA, 25 bp, S. cerevisiae
tttgaaacgaacctagacccgcaca

SEQ ID NO: 40345 - DNA, 25 bp, S. cerevisiae
taattacccatacaagtcgccaagc

SEQ ID NO: 40346 - DNA, 25 bp, S. cerevisiae
tacattgaccaacaaaccggcaaag

SEQ ID NO: 40347 - DNA, 25 bp, S. cerevisiae
taatagaccatagccaaccgaacac

SEQ ID NO: 40348 - DNA, 25 bp, S. cerevisiae
gttagtccaattcccagagttacag

SEQ ID NO: 40349 - DNA, 25 bp, S. cerevisiae
gttcgtcaagtaaccaattctacag

SEQ ID NO: 40350 - DNA, 25 bp, S. cerevisiae
gttctgatgttttactcggcaacga

SEQ ID NO: 40351 - DNA, 25 bp, S. cerevisiae
gttctgatgttgtttttggcgacca

SEQ ID NO: 40352 - DNA, 25 bp, S. cerevisiae
gttgctaggtgaattatctggcgct

SEQ ID NO: 40353 - DNA, 25 bp, S. cerevisiae
gttgctgtcctatcatcgaggcttt

SEQ ID NO: 40354 - DNA, 25 bp, S. cerevisiae
gttctcatctcgttacagctggttt

SEQ ID NO: 40355 - DNA, 25 bp, S. cerevisiae
gttccatcaatgctatgagtgccgt

SEQ ID NO: 40356 - DNA, 25 bp, S. cerevisiae
gttgcctatgtccttatctctgagt

SEQ ID NO: 40357 - DNA, 25 bp, S. cerevisiae
gttgctgttgcatcttttctacaaa

SEQ ID NO: 40358 - DNA, 25 bp, S. cerevisiae
gttgctttgctatatgctgcttaca

SEQ ID NO: 40359 - DNA, 25 bp, S. cerevisiae
gttctgaaacggatcctctttggga

SEQ ID NO: 40360 - DNA, 25 bp, S. cerevisiae
gttctacaattgcttcctttatcgg

SEQ ID NO: 40361 - DNA, 25 bp, S. cerevisiae
gttgctgaaaatataccgcttgtgc

SEQ ID NO: 40362 - DNA, 25 bp, S. cerevisiae
gttctcgcaatatggctggtgatca

SEQ ID NO: 40363 - DNA, 25 bp, S. cerevisiae
gttcatccatgattggtgccggtgt

SEQ ID NO: 40364 - DNA, 25 bp, S. cerevisiae
gttctaccacacttgaaaggctcgc

SEQ ID NO: 40365 - DNA, 25 bp, S. cerevisiae
gttcgacagtactgacactagtctg

SEQ ID NO: 40366 - DNA, 25 bp, S. cerevisiae
gtatcccgtacagacatctagcagg

SEQ ID NO: 40367 - DNA, 25 bp, S. cerevisiae
gttgctcttaaattgtcttgatcca

SEQ ID NO: 40368 - DNA, 25 bp, S. cerevisiae
gttgcgttcaaccattcttattcgg

SEQ ID NO: 40369 - DNA, 25 bp, S. cerevisiae
gtgcaactcctaatttacacgggtt

SEQ ID NO: 40370 - DNA, 25 bp, S. cerevisiae
gttaccagtatctccaaggccatta

SEQ ID NO: 40371 - DNA, 25 bp, S. cerevisiae
gttcccggacatcaaaacctgtatt

SEQ ID NO: 40372 - DNA, 25 bp, S. cerevisiae
gttcagcgaattaattaacttccaa

SEQ ID NO: 40373 - DNA, 25 bp, S. cerevisiae
gttctcgctcaaactctaaggttac

SEQ ID NO: 40374 - DNA, 25 bp, S. cerevisiae
gttccctcaacagctattgtttcca

SEQ ID NO: 40375 - DNA, 25 bp, S. cerevisiae
ggtgggcttcgcatttttggttgaa

SEQ ID NO: 40376 - DNA, 25 bp, S. cerevisiae
ggtacttgcctgaattaaccgtaca

SEQ ID NO: 40377 - DNA, 25 bp, S. cerevisiae
gttactggtcggataaccggtgcaa

SEQ ID NO: 40378 - DNA, 25 bp, S. cerevisiae
gttgccattttgattactgccgttc

SEQ ID NO: 40379 - DNA, 25 bp, S. cerevisiae
gttcctgcagaagcaagccctgtag

SEQ ID NO: 40380 - DNA, 25 bp, S. cerevisiae
gttcgttcaaactaccatgcttgtt

SEQ ID NO: 40381 - DNA, 25 bp, S. cerevisiae
gttgccgaattatgcgggtttcaaa

SEQ ID NO: 40382 - DNA, 25 bp, S. cerevisiae
gtaccagatacgtcagcggttctta

SEQ ID NO: 40383 - DNA, 25 bp, S. cerevisiae
gttccgttgagagcttacacacatg

SEQ ID NO: 40384 - DNA, 25 bp, S. cerevisiae
gttacgttacgctttacaattattg

SEQ ID NO: 40385 - DNA, 25 bp, S. cerevisiae
gtttcgccgaggtttttagtagcag

SEQ ID NO: 40386 - DNA, 25 bp, S. cerevisiae
gttcggaagagccagtatatttaga

SEQ ID NO: 40387 - DNA, 25 bp, S. cerevisiae
gttccaaacgcgcataaattcatta

SEQ ID NO: 40388 - DNA, 25 bp, S. cerevisiae
gttctcttcagacggtttaccagta

SEQ ID NO: 40389 - DNA, 25 bp, S. cerevisiae
gttccccaagtcctgattaatcgtg

SEQ ID NO: 40390 - DNA, 25 bp, S. cerevisiae
gttcctaagccagcaagtacttctt

SEQ ID NO: 40391 - DNA, 25 bp, S. cerevisiae
gttccattagacttcgaccctgata

SEQ ID NO: 40392 - DNA, 25 bp, S. cerevisiae
gtttcactagactgggtccattcac

SEQ ID NO: 40393 - DNA, 25 bp, S. cerevisiae
gttcccgaagaatttgtgctaagta

SEQ ID NO: 40394 - DNA, 25 bp, S. cerevisiae
gttcccatgcctgaattctctaagt

SEQ ID NO: 40395 - DNA, 25 bp, S. cerevisiae
gttacacgcagcatcgttctttggg

SEQ ID NO: 40396 - DNA, 25 bp, S. cerevisiae
gttccttacattctcaatgtgtgtg

SEQ ID NO: 40397 - DNA, 25 bp, S. cerevisiae
gttcttctacgttcttatttggcca

SEQ ID NO: 40398 - DNA, 25 bp, S. cerevisiae
gttcaactaggctctaaactggaca

SEQ ID NO: 40399 - DNA, 25 bp, S. cerevisiae
gggaatgggcctctaacactgtaaa

SEQ ID NO: 40400 - DNA, 25 bp, S. cerevisiae
gttcatttactgttccgtacaccaa

SEQ ID NO: 40401 - DNA, 25 bp, S. cerevisiae
gttcttgtttgtgagcctataccga

SEQ ID NO: 40402 - DNA, 25 bp, S. cerevisiae
gttcttgttattgttccaaccgata

SEQ ID NO: 40403 - DNA, 25 bp, S. cerevisiae
gttcgtgccattccaagttagttta

SEQ ID NO: 40404 - DNA, 25 bp, S. cerevisiae
gttctcaatcagtgaaatctcgtgt

SEQ ID NO: 40405 - DNA, 25 bp, S. cerevisiae
gttccaacagcttgtaattcttacg

SEQ ID NO: 40406 - DNA, 25 bp, S. cerevisiae
gttccaacacttacatcattcttca

SEQ ID NO: 40407 - DNA, 25 bp, S. cerevisiae
gttcctgacgtcacatatacattat

SEQ ID NO: 40408 - DNA, 25 bp, S. cerevisiae
gttccgacgaatctacatcttctga

SEQ ID NO: 40409 - DNA, 25 bp, S. cerevisiae
gttcctcaagaagtttcatcctcta

SEQ ID NO: 40410 - DNA, 25 bp, S. cerevisiae
gttctttccctcactagtttgatgg

SEQ ID NO: 40411 - DNA, 25 bp, S. cerevisiae
gttctcttgattcagatgtggtcat

SEQ ID NO: 40412 - DNA, 25 bp, S. cerevisiae
gttccagttagatcagtgactccga

SEQ ID NO: 40413 - DNA, 25 bp, S. cerevisiae
gttccagaaccaaagttgttcagaa

SEQ ID NO: 40414 - DNA, 25 bp, S. cerevisiae
gttccagttccaaagtattcgccaa

SEQ ID NO: 40415 - DNA, 25 bp, S. cerevisiae
gtagaaatgcttccctttgaggtcg

SEQ ID NO: 40416 - DNA, 25 bp, S. cerevisiae
gtagcagacggttccttagagccta

SEQ ID NO: 40417 - DNA, 25 bp, S. cerevisiae
gttctatggtggttcaatcactact

SEQ ID NO: 40418 - DNA, 25 bp, S. cerevisiae
gttcgtggtgatgctactccaatta

SEQ ID NO: 40419 - DNA, 25 bp, S. cerevisiae
gttccaggatttaaccatgcactaa

SEQ ID NO: 40420 - DNA, 25 bp, S. cerevisiae
gttccggatgttttgtctgatctta

SEQ ID NO: 40421 - DNA, 25 bp, S. cerevisiae
gttcctgctggcctttatttggata

SEQ ID NO: 40422 - DNA, 25 bp, S. cerevisiae
gttccgggcttggatatcttttaca

SEQ ID NO: 40423 - DNA, 25 bp, S. cerevisiae
gttccacttgctttcgatattttaa

SEQ ID NO: 40424 - DNA, 25 bp, S. cerevisiae
gttcactttattggcaacggtcctt

SEQ ID NO: 40425 - DNA, 25 bp, S. cerevisiae
gttgccaatttttgatcctttcctg

SEQ ID NO: 40426 - DNA, 25 bp, S. cerevisiae
gttcctatgttcgttgctctgtata

SEQ ID NO: 40427 - DNA, 25 bp, S. cerevisiae
gttccttccagctatcggtattcaa

SEQ ID NO: 40428 - DNA, 25 bp, S. cerevisiae
gttgccttcctctatagtttcacag

SEQ ID NO: 40429 - DNA, 25 bp, S. cerevisiae
gttcccattccaatactgtgtacat

SEQ ID NO: 40430 - DNA, 25 bp, S. cerevisiae
gttcccatcttctatcttggatatc

SEQ ID NO: 40431 - DNA, 25 bp, S. cerevisiae
gttctgtctcgtgatttcgatgtcg

SEQ ID NO: 40432 - DNA, 25 bp, S. cerevisiae
gttctgttgcgtcatttggttcaca

SEQ ID NO: 40433 - DNA, 25 bp, S. cerevisiae
gttcggtcccagcttttaatcatag

SEQ ID NO: 40434 - DNA, 25 bp, S. cerevisiae
gttccttcttttatattcctgttcg

SEQ ID NO: 40435 - DNA, 25 bp, S. cerevisiae
gttgcctttattaaatactactcaa

SEQ ID NO: 40436 - DNA, 25 bp, S. cerevisiae
gtagccgttgttatggaagcttctc

SEQ ID NO: 40437 - DNA, 25 bp, S. cerevisiae
gtatctcgggttctggatcctatca

SEQ ID NO: 40438 - DNA, 25 bp, S. cerevisiae
gtatccaaaccggtgctggtgttgt

SEQ ID NO: 40439 - DNA, 25 bp, S. cerevisiae
gttcgccaacatcatgcgttttgtc

SEQ ID NO: 40440 - DNA, 25 bp, S. cerevisiae
gttccaacttctgggactacttcta

SEQ ID NO: 40441 - DNA, 25 bp, S. cerevisiae
gttgccacaattagacgttccttta

SEQ ID NO: 40442 - DNA, 25 bp, S. cerevisiae
gttgccatgccattatgacaattcc

SEQ ID NO: 40443 - DNA, 25 bp, S. cerevisiae
gttcgatagacattgcgctcgtgtt

SEQ ID NO: 40444 - DNA, 25 bp, S. cerevisiae
gttcataatgtcactgctttggcac

SEQ ID NO: 40445 - DNA, 25 bp, S. cerevisiae
gttcggcagtcaacgattcagcaga

SEQ ID NO: 40446 - DNA, 25 bp, S. cerevisiae
gttcccaggcagagactatcatcat

SEQ ID NO: 40447 - DNA, 25 bp, S. cerevisiae
gttccacggagcatgtctttacaag

SEQ ID NO: 40448 - DNA, 25 bp, S. cerevisiae
gttccaccggatttccatggagcaa

SEQ ID NO: 40449 - DNA, 25 bp, S. cerevisiae
gttcgagagcaccatctacaactgc

SEQ ID NO: 40450 - DNA, 25 bp, S. cerevisiae
gttctctggaagattcatccgctca

SEQ ID NO: 40451 - DNA, 25 bp, S. cerevisiae
gttcgtatgtttccattgtcttcag

SEQ ID NO: 40452 - DNA, 25 bp, S. cerevisiae
gttcaagcagttgcctgtgccgagg

SEQ ID NO: 40453 - DNA, 25 bp, S. cerevisiae
gttccgcagttctcgtctatgaaga

SEQ ID NO: 40454 - DNA, 25 bp, S. cerevisiae
gttctgccgttctaagtgtcacaag

SEQ ID NO: 40455 - DNA, 25 bp, S. cerevisiae
gttctccagttactatgcgttcagc

SEQ ID NO: 40456 - DNA, 25 bp, S. cerevisiae
gttcccatgtttagatacgttgtgt

SEQ ID NO: 40457 - DNA, 25 bp, S. cerevisiae
gttcgttataatttagcgatcgcct

SEQ ID NO: 40458 - DNA, 25 bp, S. cerevisiae
gttccatttatttcaagcccgactc

SEQ ID NO: 40459 - DNA, 25 bp, S. cerevisiae
gttccattagaagtcgctgagcaaa

SEQ ID NO: 40460 - DNA, 25 bp, S. cerevisiae
gttccttgtcaagtcatgagcacta

SEQ ID NO: 40461 - DNA, 25 bp, S. cerevisiae
gttccatattcaagactacctcagc

SEQ ID NO: 40462 - DNA, 25 bp, S. cerevisiae
gttcctcagtcaataaactctccga

SEQ ID NO: 40463 - DNA, 25 bp, S. cerevisiae
gttccttgccactattaaccgcaat

SEQ ID NO: 40464 - DNA, 25 bp, S. cerevisiae
gttcgttccagaattatcacgctac

SEQ ID NO: 40465 - DNA, 25 bp, S. cerevisiae
gtttaatggcatattctaccgtagg

SEQ ID NO: 40466 - DNA, 25 bp, S. cerevisiae
gttctacgccgtaactaatgtctta

SEQ ID NO: 40467 - DNA, 25 bp, S. cerevisiae
gttagtagccgcaccgacagtcagt

SEQ ID NO: 40468 - DNA, 25 bp, S. cerevisiae
gttatgagagcccaaaagatgacca

SEQ ID NO: 40469 - DNA, 25 bp, S. cerevisiae
gtgatttacctccaacggcactaag

SEQ ID NO: 40470 - DNA, 25 bp, S. cerevisiae
gttcttacctgccttcgacaaaaag

SEQ ID NO: 40471 - DNA, 25 bp, S. cerevisiae
gttctcgtccatggctaggtgaatt

SEQ ID NO: 40472 - DNA, 25 bp, S. cerevisiae
gttccagtccccaggtgaagcataa

SEQ ID NO: 40473 - DNA, 25 bp, S. cerevisiae
gttccgcccaccagattgaaagcat

SEQ ID NO: 40474 - DNA, 25 bp, S. cerevisiae
gttaccgacccaagattagacgctc

SEQ ID NO: 40475 - DNA, 25 bp, S. cerevisiae
gttaacgtcaccttggataatccgc

SEQ ID NO: 40476 - DNA, 25 bp, S. cerevisiae
gttctacccctactgagaaagtcga

SEQ ID NO: 40477 - DNA, 25 bp, S. cerevisiae
gttcacgcccttcgataaaagccaa

SEQ ID NO: 40478 - DNA, 25 bp, S. cerevisiae
gttaccctcgcctggtgaaactaag

SEQ ID NO: 40479 - DNA, 25 bp, S. cerevisiae
gttcctgcctcgaaaagacctagtg

SEQ ID NO: 40480 - DNA, 25 bp, S. cerevisiae
gttcccttcagactaacaccaaatt

SEQ ID NO: 40481 - DNA, 25 bp, S. cerevisiae
gttcttactagcttccggattgtta

SEQ ID NO: 40482 - DNA, 25 bp, S. cerevisiae
gttctttgcattttgttttcgcatt

SEQ ID NO: 40483 - DNA, 25 bp, S. cerevisiae
gttcattgtccagtaaccttaagca

SEQ ID NO: 40484 - DNA, 25 bp, S. cerevisiae
gttcacatgtccacctacttgaaga

SEQ ID NO: 40485 - DNA, 25 bp, S. cerevisiae
gttacagtaagagacttcttgtcga

SEQ ID NO: 40486 - DNA, 25 bp, S. cerevisiae
gttcattgaaatgacgccgcagcaa

SEQ ID NO: 40487 - DNA, 25 bp, S. cerevisiae
gttcgtaagatttacccgcaagttg

SEQ ID NO: 40488 - DNA, 25 bp, S. cerevisiae
gttcaaacggttaccacggaggatg

SEQ ID NO: 40489 - DNA, 25 bp, S. cerevisiae
gttcatttcgagtttccaagggtat

SEQ ID NO: 40490 - DNA, 25 bp, S. cerevisiae
gttctagtagcagttcccaaaagtt

SEQ ID NO: 40491 - DNA, 25 bp, S. cerevisiae
gttactgggttacacgatcttgacg

SEQ ID NO: 40492 - DNA, 25 bp, S. cerevisiae
gttctggacgtggattctacaggta

SEQ ID NO: 40493 - DNA, 25 bp, S. cerevisiae
gttcgtgatgcttccgaaattccag

SEQ ID NO: 40494 - DNA, 25 bp, S. cerevisiae
gttcttggttctgtatgccacttga

SEQ ID NO: 40495 - DNA, 25 bp, S. cerevisiae
gtttctaagcttttcgaatggacca

SEQ ID NO: 40496 - DNA, 25 bp, S. cerevisiae
gttcttgtcgctatggattgggcta

SEQ ID NO: 40497 - DNA, 25 bp, S. cerevisiae
gttcttagcgtctatggccggtgta

SEQ ID NO: 40498 - DNA, 25 bp, S. cerevisiae
gttcaattttcttatgccatcggta

SEQ ID NO: 40499 - DNA, 25 bp, S. cerevisiae
gttcgcgcagttgatattcttggta

SEQ ID NO: 40500 - DNA, 25 bp, S. cerevisiae
gtataccaattatttccttcgaatg

SEQ ID NO: 40501 - DNA, 25 bp, S. cerevisiae
gttcaccaattctctttagctacta

SEQ ID NO: 40502 - DNA, 25 bp, S. cerevisiae
gttcccctcatctgtttttattgaa

SEQ ID NO: 40503 - DNA, 25 bp, S. cerevisiae
gttccctttgcatgtatttcttata

SEQ ID NO: 40504 - DNA, 25 bp, S. cerevisiae
gttcctcttctacttctctaaataa

SEQ ID NO: 40505 - DNA, 25 bp, S. cerevisiae
gttcgccctcaacgtttgacagtaa

SEQ ID NO: 40506 - DNA, 25 bp, S. cerevisiae
gttctgacccaatattcgaagcata

SEQ ID NO: 40507 - DNA, 25 bp, S. cerevisiae
gttactcgcgcctgtgcactacatt

SEQ ID NO: 40508 - DNA, 25 bp, S. cerevisiae
gttctgtcgaacaacgtcccatata

SEQ ID NO: 40509 - DNA, 25 bp, S. cerevisiae
gttcgtgagaacattgatcccatta

SEQ ID NO: 40510 - DNA, 25 bp, S. cerevisiae
gttaacgcaaatgtaccacctctaa

SEQ ID NO: 40511 - DNA, 25 bp, S. cerevisiae
gttcattcgaaaagcaatcctcctc

SEQ ID NO: 40512 - DNA, 25 bp, S. cerevisiae
gttcaaaaaacctatgagcccgtct

SEQ ID NO: 40513 - DNA, 25 bp, S. cerevisiae
gtccagaattttgacccctaatttg

SEQ ID NO: 40514 - DNA, 25 bp, S. cerevisiae
gttcttctttctccttttcattatt

SEQ ID NO: 40515 - DNA, 25 bp, S. cerevisiae
gttctcgttttggtttgtccagact

SEQ ID NO: 40516 - DNA, 25 bp, S. cerevisiae
gttcaactttcggtatttccgcatt

SEQ ID NO: 40517 - DNA, 25 bp, S. cerevisiae
gttctgaggcagaggcacttgataa

SEQ ID NO: 40518 - DNA, 25 bp, S. cerevisiae
gttctggcacagaggaattctcaga

SEQ ID NO: 40519 - DNA, 25 bp, S. cerevisiae
gttctcccacttcgaagtctcggaa

SEQ ID NO: 40520 - DNA, 25 bp, S. cerevisiae
gttccgtaccggtgatatcgctgaa

SEQ ID NO: 40521 - DNA, 25 bp, S. cerevisiae
gttccccgatctggatagcatggca

SEQ ID NO: 40522 - DNA, 25 bp, S. cerevisiae
gttaccatcgacgacgagtgctgca

SEQ ID NO: 40523 - DNA, 25 bp, S. cerevisiae
gttaatgtttcctttagtcagtctg

SEQ ID NO: 40524 - DNA, 25 bp, S. cerevisiae
gttcgttatctcttttaaagccagt

SEQ ID NO: 40525 - DNA, 25 bp, S. cerevisiae
gttcccgctaccaagattcattgat

SEQ ID NO: 40526 - DNA, 25 bp, S. cerevisiae
gttccctgaagtacatcaccattgt

SEQ ID NO: 40527 - DNA, 25 bp, S. cerevisiae
gttcagcttagtgcaaactcctcat

SEQ ID NO: 40528 - DNA, 25 bp, S. cerevisiae
gttcgattcactgataagcaacttg

SEQ ID NO: 40529 - DNA, 25 bp, S. cerevisiae
gttcgaccacattcacgatggacat

SEQ ID NO: 40530 - DNA, 25 bp, S. cerevisiae
gttcaacgtattgcgctggatcatc

SEQ ID NO: 40531 - DNA, 25 bp, S. cerevisiae
gttcaaaagttcctgggcttcctcg

SEQ ID NO: 40532 - DNA, 25 bp, S. cerevisiae
gttcaacaaggtctcagttctgcct

SEQ ID NO: 40533 - DNA, 25 bp, S. cerevisiae
gttcaattaccgctaatgcttgcct

SEQ ID NO: 40534 - DNA, 25 bp, S. cerevisiae
gttctttgacggaaacagctctgaa

SEQ ID NO: 40535 - DNA, 25 bp, S. cerevisiae
gttcgttgacgaaaccaccagaaag

SEQ ID NO: 40536 - DNA, 25 bp, S. cerevisiae
gttactgtactacgactaccaggaa

SEQ ID NO: 40537 - DNA, 25 bp, S. cerevisiae
gttcaatccctacacttcgaagagt

SEQ ID NO: 40538 - DNA, 25 bp, S. cerevisiae
ggttacaccattctttacggtagct

SEQ ID NO: 40539 - DNA, 25 bp, S. cerevisiae
tcgaaactatcggtcctgaacgggt

SEQ ID NO: 40540 - DNA, 25 bp, S. cerevisiae
tagaaatttcgagaaaagcgggtca

SEQ ID NO: 40541 - DNA, 25 bp, S. cerevisiae
gttcaaacggattgtaccatgccaa

SEQ ID NO: 40542 - DNA, 25 bp, S. cerevisiae
gttcagcacgggtgtcatcaagcta

SEQ ID NO: 40543 - DNA, 25 bp, S. cerevisiae
gttcgccacctcatggatatcaatg

SEQ ID NO: 40544 - DNA, 25 bp, S. cerevisiae
gttctctagctcgtgctggtaaagt

SEQ ID NO: 40545 - DNA, 25 bp, S. cerevisiae
gttctccgttgtctgtacaagctga

SEQ ID NO: 40546 - DNA, 25 bp, S. cerevisiae
gttctgccatttttggtagcacctt

SEQ ID NO: 40547 - DNA, 25 bp, S. cerevisiae
gtttccctacagacagctactacta

SEQ ID NO: 40548 - DNA, 25 bp, S. cerevisiae
gttaccgcatggtcaagttctttga

SEQ ID NO: 40549 - DNA, 25 bp, S. cerevisiae
gttctcctttgtccaaagattccag

SEQ ID NO: 40550 - DNA, 25 bp, S. cerevisiae
gttcatgcctcttatccaaaggagt

SEQ ID NO: 40551 - DNA, 25 bp, S. cerevisiae
tgttcaactctaccgattatggcgt

SEQ ID NO: 40552 - DNA, 25 bp, S. cerevisiae
gttcagcaactatacatttggcact

SEQ ID NO: 40553 - DNA, 25 bp, S. cerevisiae
gttcacagacatcattaccttcaca

SEQ ID NO: 40554 - DNA, 25 bp, S. cerevisiae
gttctaacttatatccttctgcgga

SEQ ID NO: 40555 - DNA, 25 bp, S. cerevisiae
gttcatcaacaataccctttgcgac

SEQ ID NO: 40556 - DNA, 25 bp, S. cerevisiae
gttctcaacaaacgcccattatgca

SEQ ID NO: 40557 - DNA, 25 bp, S. cerevisiae
gttctgctactctagtcgacagttg

SEQ ID NO: 40558 - DNA, 25 bp, S. cerevisiae
gttaatcgtctagtcagccagggtt

SEQ ID NO: 40559 - DNA, 25 bp, S. cerevisiae
gttaaccacattgatccaggacatt

SEQ ID NO: 40560 - DNA, 25 bp, S. cerevisiae
gttcaccaactttgcagtctggtat

SEQ ID NO: 40561 - DNA, 25 bp, S. cerevisiae
gttaatgcccatgcttactttgaca

SEQ ID NO: 40562 - DNA, 25 bp, S. cerevisiae
gttcaagagtctcctagtggaccat

SEQ ID NO: 40563 - DNA, 25 bp, S. cerevisiae
gttagaagatctacacagggacaac

SEQ ID NO: 40564 - DNA, 25 bp, S. cerevisiae
gttcaatctatacgttcatccactc

SEQ ID NO: 40565 - DNA, 25 bp, S. cerevisiae
gttcaccgataatttgatggcactt

SEQ ID NO: 40566 - DNA, 25 bp, S. cerevisiae
gttaagcgtttcatcttgaaggcat

SEQ ID NO: 40567 - DNA, 25 bp, S. cerevisiae
gttcactggtttatcgctacaattg

SEQ ID NO: 40568 - DNA, 25 bp, S. cerevisiae
gttctggtcatttcatcacattcac

SEQ ID NO: 40569 - DNA, 25 bp, S. cerevisiae
gttctctccatcacacaatagcaat

SEQ ID NO: 40570 - DNA, 25 bp, S. cerevisiae
gtatatgaccataacgacgacggac

SEQ ID NO: 40571 - DNA, 25 bp, S. cerevisiae
gttctgatatctgacgacgacgcca

SEQ ID NO: 40572 - DNA, 25 bp, S. cerevisiae
gttcgagattaacgtcggcgacact

SEQ ID NO: 40573 - DNA, 25 bp, S. cerevisiae
gttttgatcaaaccctggctcaagc

SEQ ID NO: 40574 - DNA, 25 bp, S. cerevisiae
gttttgccaattccggagctagatg

SEQ ID NO: 40575 - DNA, 25 bp, S. cerevisiae
gttaaccctagtccagagtgcagat

SEQ ID NO: 40576 - DNA, 25 bp, S. cerevisiae
gttctgccggcattctatggtatga

SEQ ID NO: 40577 - DNA, 25 bp, S. cerevisiae
gttctgactacactcatgacggtga

SEQ ID NO: 40578 - DNA, 25 bp, S. cerevisiae
gttcgactcacactgcaacatcgtg

SEQ ID NO: 40579 - DNA, 25 bp, S. cerevisiae
gttctggaagcgttttctccttact

SEQ ID NO: 40580 - DNA, 25 bp, S. cerevisiae
gttctggaactgttattgccgttta

SEQ ID NO: 40581 - DNA, 25 bp, S. cerevisiae
gttaagcaatttttgaccaaggact

SEQ ID NO: 40582 - DNA, 25 bp, S. cerevisiae
gtctcaaaggttttccgaagccgct

SEQ ID NO: 40583 - DNA, 25 bp, S. cerevisiae
gttaaagcgactctcctacaaagtg

SEQ ID NO: 40584 - DNA, 25 bp, S. cerevisiae
gttagagttggtgtcttgtccgaag

SEQ ID NO: 40585 - DNA, 25 bp, S. cerevisiae
gttagagacttcacacacttaccag

SEQ ID NO: 40586 - DNA, 25 bp, S. cerevisiae
gttacatgactccaacagacttaat

SEQ ID NO: 40587 - DNA, 25 bp, S. cerevisiae
gttcaatgcctcagtcaaattatta

SEQ ID NO: 40588 - DNA, 25 bp, S. cerevisiae
gttcgtgccgaagctgaatctttgg

SEQ ID NO: 40589 - DNA, 25 bp, S. cerevisiae
gttctggccgaaagctaactcctat

SEQ ID NO: 40590 - DNA, 25 bp, S. cerevisiae
gttctaggctacctatatgggtgct

SEQ ID NO: 40591 - DNA, 25 bp, S. cerevisiae
gttcaagtgtaatgactggttctta

SEQ ID NO: 40592 - DNA, 25 bp, S. cerevisiae
gttcgtgttcatttgtcctatgtta

SEQ ID NO: 40593 - DNA, 25 bp, S. cerevisiae
gttcagggcccagtatcattatgac

SEQ ID NO: 40594 - DNA, 25 bp, S. cerevisiae
gttctgttgtcagctcctttacaaa

SEQ ID NO: 40595 - DNA, 25 bp, S. cerevisiae
gttcttccattgattgttgctgcta

SEQ ID NO: 40596 - DNA, 25 bp, S. cerevisiae
gttcttcagcaaggattttcagcaa

SEQ ID NO: 40597 - DNA, 25 bp, S. cerevisiae
gttcattcatgccagtttctacaag

SEQ ID NO: 40598 - DNA, 25 bp, S. cerevisiae
gttctggtacaggttgcagtgccaa

SEQ ID NO: 40599 - DNA, 25 bp, S. cerevisiae
gttcagagctatgttcagtcggcat

SEQ ID NO: 40600 - DNA, 25 bp, S. cerevisiae
gttcaatccatctttgactgcggac

SEQ ID NO: 40601 - DNA, 25 bp, S. cerevisiae
gttaggcttgttctctgacgcaaag

SEQ ID NO: 40602 - DNA, 25 bp, S. cerevisiae
gttaaatttcctacgccaattctgc

SEQ ID NO: 40603 - DNA, 25 bp, S. cerevisiae
gttcaagtttacctcggatgcctac

SEQ ID NO: 40604 - DNA, 25 bp, S. cerevisiae
gttcaagtatgtacccagggctgcc

SEQ ID NO: 40605 - DNA, 25 bp, S. cerevisiae
gttacattatgcatcgcagcaaggg

SEQ ID NO: 40606 - DNA, 25 bp, S. cerevisiae
gttcactttccggatcaagggcatt

SEQ ID NO: 40607 - DNA, 25 bp, S. cerevisiae
gttacttttccgaatcagacagtgt

SEQ ID NO: 40608 - DNA, 25 bp, S. cerevisiae
gttcacgattttgcggagtcattag

SEQ ID NO: 40609 - DNA, 25 bp, S. cerevisiae
gttcatggtggattgtcgccagttt

SEQ ID NO: 40610 - DNA, 25 bp, S. cerevisiae
gttcatgggcgttgtgtcaggtatt

SEQ ID NO: 40611 - DNA, 25 bp, S. cerevisiae
gttctcgtcgaatgctaggtcaatt

SEQ ID NO: 40612 - DNA, 25 bp, S. cerevisiae
gttctctctcgcttcctacgttact

SEQ ID NO: 40613 - DNA, 25 bp, S. cerevisiae
gttctgtggttgttctttgatggca

SEQ ID NO: 40614 - DNA, 25 bp, S. cerevisiae
gttctggtgccgctgattatgacga

SEQ ID NO: 40615 - DNA, 25 bp, S. cerevisiae
gttaaagtcgttattgccggtgcta

SEQ ID NO: 40616 - DNA, 25 bp, S. cerevisiae
gttctacaaccatattaccctgcta

SEQ ID NO: 40617 - DNA, 25 bp, S. cerevisiae
gttctaaaccactctttgcgtgttt

SEQ ID NO: 40618 - DNA, 25 bp, S. cerevisiae
gtttccaacgcttccaacggttgtg

SEQ ID NO: 40619 - DNA, 25 bp, S. cerevisiae
gttcattcaacggaacgcccttttg

SEQ ID NO: 40620 - DNA, 25 bp, S. cerevisiae
gtatcattaaaccaaccaccgaggg

SEQ ID NO: 40621 - DNA, 25 bp, S. cerevisiae
gttctttatttatcaccctaggcgt

SEQ ID NO: 40622 - DNA, 25 bp, S. cerevisiae
gttcagtttttcagactgcctggga

SEQ ID NO: 40623 - DNA, 25 bp, S. cerevisiae
gttacatttcgagccgttgttttca

SEQ ID NO: 40624 - DNA, 25 bp, S. cerevisiae
gttacgtttagtgttatgcctccta

SEQ ID NO: 40625 - DNA, 25 bp, S. cerevisiae
gttacggttaagatgctccacggat

SEQ ID NO: 40626 - DNA, 25 bp, S. cerevisiae
gttactttggttgttgcctcaggta

SEQ ID NO: 40627 - DNA, 25 bp, S. cerevisiae
gttctttcgttagatctcttccaag

SEQ ID NO: 40628 - DNA, 25 bp, S. cerevisiae
gttcttttgctttcgaatgcttcta

SEQ ID NO: 40629 - DNA, 25 bp, S. cerevisiae
gtttacttcagtggcggtattttct

SEQ ID NO: 40630 - DNA, 25 bp, S. cerevisiae
ggtcccttccaaggaacgtattgca

SEQ ID NO: 40631 - DNA, 25 bp, S. cerevisiae
gttcttcgttcaagtgaccgtttca

SEQ ID NO: 40632 - DNA, 25 bp, S. cerevisiae
gttctaatttcaccgactctttgtc

SEQ ID NO: 40633 - DNA, 25 bp, S. cerevisiae
gttcaaaattggagcgccttctggt

SEQ ID NO: 40634 - DNA, 25 bp, S. cerevisiae
gttaactttatgagccctgtgacga

SEQ ID NO: 40635 - DNA, 25 bp, S. cerevisiae
gttaacggattcttccagttccaga

SEQ ID NO: 40636 - DNA, 25 bp, S. cerevisiae
gttaacgtgttggtacagtggctaa

SEQ ID NO: 40637 - DNA, 25 bp, S. cerevisiae
gttcattttttggtatctttgctat

SEQ ID NO: 40638 - DNA, 25 bp, S. cerevisiae
gttcatcattcaagggtcattttta

SEQ ID NO: 40639 - DNA, 25 bp, S. cerevisiae
gttagccatggagaccttaatctta

SEQ ID NO: 40640 - DNA, 25 bp, S. cerevisiae
gttcttggatgtccttttacctcaa

SEQ ID NO: 40641 - DNA, 25 bp, S. cerevisiae
gttcttgattgcatttttcacccca

SEQ ID NO: 40642 - DNA, 25 bp, S. cerevisiae
gttcttgatcagttttttcactcca

SEQ ID NO: 40643 - DNA, 25 bp, S. cerevisiae
gttcattgtcatttggccagtcact

SEQ ID NO: 40644 - DNA, 25 bp, S. cerevisiae
gttacaatcgcccattagttctaag

SEQ ID NO: 40645 - DNA, 25 bp, S. cerevisiae
gttcaaacctcccagactctaataa

SEQ ID NO: 40646 - DNA, 25 bp, S. cerevisiae
gttcaagagatatcgctaccattat

SEQ ID NO: 40647 - DNA, 25 bp, S. cerevisiae
gttcatgataaccacagtacctata

SEQ ID NO: 40648 - DNA, 25 bp, S. cerevisiae
gttcataatggccaaaactttgcaa

SEQ ID NO: 40649 - DNA, 25 bp, S. cerevisiae
gttcttcgcttttcttattcttgta

SEQ ID NO: 40650 - DNA, 25 bp, S. cerevisiae
gttactacaatttcggtcctgagcc

SEQ ID NO: 40651 - DNA, 25 bp, S. cerevisiae
gttaccactgaagtcaagtccgttg

SEQ ID NO: 40652 - DNA, 25 bp, S. cerevisiae
gttaccatctacacgttgggattca

SEQ ID NO: 40653 - DNA, 25 bp, S. cerevisiae
gttaatgatcccttttgggccaata

SEQ ID NO: 40654 - DNA, 25 bp, S. cerevisiae
gttacactacgaacttaaggccgca

SEQ ID NO: 40655 - DNA, 25 bp, S. cerevisiae
gttagcacgtctcggcattaatggc

SEQ ID NO: 40656 - DNA, 25 bp, S. cerevisiae
gttctcttcccttgtatcaaacgaa

SEQ ID NO: 40657 - DNA, 25 bp, S. cerevisiae
gttaaccctgtccttattgcaatat

SEQ ID NO: 40658 - DNA, 25 bp, S. cerevisiae
gttacttgccgatatacttttagaa

SEQ ID NO: 40659 - DNA, 25 bp, S. cerevisiae
gttcatcttcctcttaagttctaaa

SEQ ID NO: 40660 - DNA, 25 bp, S. cerevisiae
gttatcttcgctaggtactacttgg

SEQ ID NO: 40661 - DNA, 25 bp, S. cerevisiae
gttacatgtcttggtcacggagcgc

SEQ ID NO: 40662 - DNA, 25 bp, S. cerevisiae
gttacacttgtggtcaagctggcca

SEQ ID NO: 40663 - DNA, 25 bp, S. cerevisiae
gttaatatcagtttgccacaggaca

SEQ ID NO: 40664 - DNA, 25 bp, S. cerevisiae
gttagatgacattgttctgccaaaa

SEQ ID NO: 40665 - DNA, 25 bp, S. cerevisiae
gttaccaagtgggtcgactactcca

SEQ ID NO: 40666 - DNA, 25 bp, S. cerevisiae
gttcagagacgccattcttgttttt

SEQ ID NO: 40667 - DNA, 25 bp, S. cerevisiae
gttagccactggtatcatcgatcca

SEQ ID NO: 40668 - DNA, 25 bp, S. cerevisiae
gtatacgaggactatgcttatgcca

SEQ ID NO: 40669 - DNA, 25 bp, S. cerevisiae
gttagaagcctgcattgtagccttt

SEQ ID NO: 40670 - DNA, 25 bp, S. cerevisiae
gttttgcccggccttcacgaaggat

SEQ ID NO: 40671 - DNA, 25 bp, S. cerevisiae
gttcttgttttgtactatgccccat

SEQ ID NO: 40672 - DNA, 25 bp, S. cerevisiae
gttcaagcatacaatcccgagtttc

SEQ ID NO: 40673 - DNA, 25 bp, S. cerevisiae
gttcagcgcatctttgactgcatta

SEQ ID NO: 40674 - DNA, 25 bp, S. cerevisiae
gttcagctagcttctttgcattcga

SEQ ID NO: 40675 - DNA, 25 bp, S. cerevisiae
gttcacagctagaaactaccacaag

SEQ ID NO: 40676 - DNA, 25 bp, S. cerevisiae
gttcagcattagcacgctcattgca

SEQ ID NO: 40677 - DNA, 25 bp, S. cerevisiae
gttcaatatagccactgtcaaatta

SEQ ID NO: 40678 - DNA, 25 bp, S. cerevisiae
gtatcaaaaccattgtggaagccat

SEQ ID NO: 40679 - DNA, 25 bp, S. cerevisiae
gttcattctaatgggatcttccgtt

SEQ ID NO: 40680 - DNA, 25 bp, S. cerevisiae
gttattccatggttggttccgttat

SEQ ID NO: 40681 - DNA, 25 bp, S. cerevisiae
gttaactcatgcactggattcctct

SEQ ID NO: 40682 - DNA, 25 bp, S. cerevisiae
gttcatcatgcgagatcacaggctg

SEQ ID NO: 40683 - DNA, 25 bp, S. cerevisiae
gttcagatttgattcttccgccaac

SEQ ID NO: 40684 - DNA, 25 bp, S. cerevisiae
gttacaatcagaagacccaatggca

SEQ ID NO: 40685 - DNA, 25 bp, S. cerevisiae
gttcatggaggtatatcgcccgatt

SEQ ID NO: 40686 - DNA, 25 bp, S. cerevisiae
gttaggcgaatgctacacaactgga

SEQ ID NO: 40687 - DNA, 25 bp, S. cerevisiae
gttaacttctacaaaccactggata

SEQ ID NO: 40688 - DNA, 25 bp, S. cerevisiae
gttacatttgtactagtgtccgaat

SEQ ID NO: 40689 - DNA, 25 bp, S. cerevisiae
gttaatcattttcctgcgtccgttc

SEQ ID NO: 40690 - DNA, 25 bp, S. cerevisiae
gttacctgaaaaggcacgctaccgg

SEQ ID NO: 40691 - DNA, 25 bp, S. cerevisiae
gttaccatgattgacgacctcatcc

SEQ ID NO: 40692 - DNA, 25 bp, S. cerevisiae
gttacagtgtctatacaaccctttt

SEQ ID NO: 40693 - DNA, 25 bp, S. cerevisiae
gttaatggcccatagagcacccata

SEQ ID NO: 40694 - DNA, 25 bp, S. cerevisiae
gttcaagaattgttacaccacccca

SEQ ID NO: 40695 - DNA, 25 bp, S. cerevisiae
gtatcgaagacgttactccagtccc

SEQ ID NO: 40696 - DNA, 25 bp, S. cerevisiae
gttagcaacgcttgactcacaaacc

SEQ ID NO: 40697 - DNA, 25 bp, S. cerevisiae
gttaaagaatggttcgccggccgag

SEQ ID NO: 40698 - DNA, 25 bp, S. cerevisiae
gtatacaaacggtgcgacgagccaa

SEQ ID NO: 40699 - DNA, 25 bp, S. cerevisiae
tgttaccgtctggaaaccgaataag

SEQ ID NO: 40700 - DNA, 25 bp, S. cerevisiae
gttaacgactaataccgagcaaggt

SEQ ID NO: 40701 - DNA, 25 bp, S. cerevisiae
gttaacgacacaaaagtgtgaaagt

SEQ ID NO: 40702 - DNA, 25 bp, S. cerevisiae
gtattccaaccgataaaggccctag

SEQ ID NO: 40703 - DNA, 25 bp, S. cerevisiae
gttacccatccgctaagactagatc

SEQ ID NO: 40704 - DNA, 25 bp, S. cerevisiae
gttaccgcccatttccaaagagatg

SEQ ID NO: 40705 - DNA, 25 bp, S. cerevisiae
gttcaattcccagtctaccaaggtg

SEQ ID NO: 40706 - DNA, 25 bp, S. cerevisiae
gttcttgaccacctccaaaattggt

SEQ ID NO: 40707 - DNA, 25 bp, S. cerevisiae
gtttgaactccgctagaaagttgcg

SEQ ID NO: 40708 - DNA, 25 bp, S. cerevisiae
gttacaacccgcttcaagtattacg

SEQ ID NO: 40709 - DNA, 25 bp, S. cerevisiae
gttcacataaatctctctttggaca

SEQ ID NO: 40710 - DNA, 25 bp, S. cerevisiae
gttcaattccgatacaactgcgatc

SEQ ID NO: 40711 - DNA, 25 bp, S. cerevisiae
gttcaattaccagcacgatctcgat

SEQ ID NO: 40712 - DNA, 25 bp, S. cerevisiae
gttcagtcaactttttcttcactat

SEQ ID NO: 40713 - DNA, 25 bp, S. cerevisiae
gttaattcttggtgctgaggtggat

SEQ ID NO: 40714 - DNA, 25 bp, S. cerevisiae
gttcaacatctataatctacggagt

SEQ ID NO: 40715 - DNA, 25 bp, S. cerevisiae
gttaacataaagcatcccggtttag

SEQ ID NO: 40716 - DNA, 25 bp, S. cerevisiae
gttcaaacaaattcatccctggtat

SEQ ID NO: 40717 - DNA, 25 bp, S. cerevisiae
gttcaagatgaatgccaccacaggc

SEQ ID NO: 40718 - DNA, 25 bp, S. cerevisiae
gttcatgcttgatctcattgtcgtt

SEQ ID NO: 40719 - DNA, 25 bp, S. cerevisiae
gttcatgtcgactcctgtgagcaat

SEQ ID NO: 40720 - DNA, 25 bp, S. cerevisiae
gtatcactgccgaccaaatcattgc

SEQ ID NO: 40721 - DNA, 25 bp, S. cerevisiae
gttactgccgtcgaaaagtctaccg

SEQ ID NO: 40722 - DNA, 25 bp, S. cerevisiae
gttacaggcggcgtatacaagtggt

SEQ ID NO: 40723 - DNA, 25 bp, S. cerevisiae
gttacaggttccaagacaagacgat

SEQ ID NO: 40724 - DNA, 25 bp, S. cerevisiae
gttcattctcaactgccttttatca

SEQ ID NO: 40725 - DNA, 25 bp, S. cerevisiae
gttcattgacattgctaatacctct

SEQ ID NO: 40726 - DNA, 25 bp, S. cerevisiae
gttagctgccttttacgacgatgta

SEQ ID NO: 40727 - DNA, 25 bp, S. cerevisiae
gttacatgaccaattcaccagggtt

SEQ ID NO: 40728 - DNA, 25 bp, S. cerevisiae
gttacagattatagtcagtcggcga

SEQ ID NO: 40729 - DNA, 25 bp, S. cerevisiae
gttagggttcttggccgcaggtcac

SEQ ID NO: 40730 - DNA, 25 bp, S. cerevisiae
gttcataagttcaagcctgacgctt

SEQ ID NO: 40731 - DNA, 25 bp, S. cerevisiae
gttcaaggatagagccgccagcgat

SEQ ID NO: 40732 - DNA, 25 bp, S. cerevisiae
gttcatcgagtatatccgccaaata

SEQ ID NO: 40733 - DNA, 25 bp, S. cerevisiae
gttacgaaggataccgctatggaat

SEQ ID NO: 40734 - DNA, 25 bp, S. cerevisiae
gttactatcgaattttccaccaacg

SEQ ID NO: 40735 - DNA, 25 bp, S. cerevisiae
gttcaccactggtacttctcgtata

SEQ ID NO: 40736 - DNA, 25 bp, S. cerevisiae
gttcacgttggtactttctgttagc

SEQ ID NO: 40737 - DNA, 25 bp, S. cerevisiae
gttacgtctcgagctatttattata

SEQ ID NO: 40738 - DNA, 25 bp, S. cerevisiae
gttagagccccaactgttaagtata

SEQ ID NO: 40739 - DNA, 25 bp, S. cerevisiae
gttagtaacagtgataccaacatag

SEQ ID NO: 40740 - DNA, 25 bp, S. cerevisiae
gttagaacaattctgctccaagcat

SEQ ID NO: 40741 - DNA, 25 bp, S. cerevisiae
gttaacgatattccttctacactag

SEQ ID NO: 40742 - DNA, 25 bp, S. cerevisiae
gttaaccaatattccttcaattcag

SEQ ID NO: 40743 - DNA, 25 bp, S. cerevisiae
gttaacgcctactgtggttctaaga

SEQ ID NO: 40744 - DNA, 25 bp, S. cerevisiae
gttaagccacacgatgagggttcta

SEQ ID NO: 40745 - DNA, 25 bp, S. cerevisiae
gttaataacagcgaggtccctcaac

SEQ ID NO: 40746 - DNA, 25 bp, S. cerevisiae
gttaaaaccactcgtacgctcaatt

SEQ ID NO: 40747 - DNA, 25 bp, S. cerevisiae
gttaaaaaatgcagtccctccttcg

SEQ ID NO: 40748 - DNA, 25 bp, S. cerevisiae
gttcaaattaatacctcccatgagg

SEQ ID NO: 40749 - DNA, 25 bp, S. cerevisiae
gttaaagctaatgctctgcccgaaa

SEQ ID NO: 40750 - DNA, 25 bp, S. cerevisiae
gtcaaggcccgatatttcggcagaa

SEQ ID NO: 40751 - DNA, 25 bp, S. cerevisiae
gttaagctgggatgtttcacacaat

SEQ ID NO: 40752 - DNA, 25 bp, S. cerevisiae
gttaagtggcgtccttgtagtcaaa

SEQ ID NO: 40753 - DNA, 25 bp, S. cerevisiae
gttagatcccgttccgtacagaaga

SEQ ID NO: 40754 - DNA, 25 bp, S. cerevisiae
gttagatctatcattccgtttgcag

SEQ ID NO: 40755 - DNA, 25 bp, S. cerevisiae
gttatggctatcttgactggttctg

SEQ ID NO: 40756 - DNA, 25 bp, S. cerevisiae
gtttgctatggcgatgaccctacac

SEQ ID NO: 40757 - DNA, 25 bp, S. cerevisiae
gttacagcctgattctgatgcagtc

SEQ ID NO: 40758 - DNA, 25 bp, S. cerevisiae
gttactgcatctgccatggattcta

SEQ ID NO: 40759 - DNA, 25 bp, S. cerevisiae
gttaattcctaacgcgatccactgg

SEQ ID NO: 40760 - DNA, 25 bp, S. cerevisiae
gttaagtttaaagatgccatgcatg

SEQ ID NO: 40761 - DNA, 25 bp, S. cerevisiae
gttacagtattattcctatgcacag

SEQ ID NO: 40762 - DNA, 25 bp, S. cerevisiae
gttagagagtcaattgtctgataca

SEQ ID NO: 40763 - DNA, 25 bp, S. cerevisiae
gttaaagatctcagcacgcatcaat

SEQ ID NO: 40764 - DNA, 25 bp, S. cerevisiae
gttaaggttactgtcatcgcatttg

SEQ ID NO: 40765 - DNA, 25 bp, S. cerevisiae
gttcaaggcttcgacaatccagctg

SEQ ID NO: 40766 - DNA, 25 bp, S. cerevisiae
gttcaagtacgaatacccactgcag

SEQ ID NO: 40767 - DNA, 25 bp, S. cerevisiae
gttcaagtaagttcaccagcgcttt

SEQ ID NO: 40768 - DNA, 25 bp, S. cerevisiae
gttcaaataccgatccatttcacga

SEQ ID NO: 40769 - DNA, 25 bp, S. cerevisiae
ggatcaacggtaaaccccatgatta

SEQ ID NO: 40770 - DNA, 25 bp, S. cerevisiae
gtttatgggctataccgaatgttca

SEQ ID NO: 40771 - DNA, 25 bp, S. cerevisiae
gttattccgattctttgaacgtcga

SEQ ID NO: 40772 - DNA, 25 bp, S. cerevisiae
gtattcccgactctttgaacggtca

SEQ ID NO: 40773 - DNA, 25 bp, S. cerevisiae
tgcaaccaaccccacgtaagaaagc

SEQ ID NO: 40774 - DNA, 25 bp, S. cerevisiae
tgttcagccaaccaaggcaccgtaa

SEQ ID NO: 40775 - DNA, 25 bp, S. cerevisiae
gttagcccgactttcaatgacaatg

SEQ ID NO: 40776 - DNA, 25 bp, S. cerevisiae
gttaggcctactgatgtaccagatt

SEQ ID NO: 40777 - DNA, 25 bp, S. cerevisiae
gttaatggaccgttgactagatcac

SEQ ID NO: 40778 - DNA, 25 bp, S. cerevisiae
gttaaggctgcccaatgatctaaaa

SEQ ID NO: 40779 - DNA, 25 bp, S. cerevisiae
gttaatggctccgaatttgttcaca

SEQ ID NO: 40780 - DNA, 25 bp, S. cerevisiae
gttaccagcgttgagattttcccaa

SEQ ID NO: 40781 - DNA, 25 bp, S. cerevisiae
gttaccctgtggaaatcgactcctt

SEQ ID NO: 40782 - DNA, 25 bp, S. cerevisiae
gttcacaccttaaattcgtcatcgc

SEQ ID NO: 40783 - DNA, 25 bp, S. cerevisiae
gttatgaaatggtaccctgtcctaa

SEQ ID NO: 40784 - DNA, 25 bp, S. cerevisiae
gtaacaacagggtggcttctcataa

SEQ ID NO: 40785 - DNA, 25 bp, S. cerevisiae
gttactacttagtgtgcgtgctcaa

SEQ ID NO: 40786 - DNA, 25 bp, S. cerevisiae
gttactagctgttaatgtcgttgca

SEQ ID NO: 40787 - DNA, 25 bp, S. cerevisiae
gttacactcgtttagcgcagattca

SEQ ID NO: 40788 - DNA, 25 bp, S. cerevisiae
gttactggacgaaacactgcttaaa

SEQ ID NO: 40789 - DNA, 25 bp, S. cerevisiae
gttattcctgacatgaagctttatg

SEQ ID NO: 40790 - DNA, 25 bp, S. cerevisiae
gttaacattccagtcattgctttga

SEQ ID NO: 40791 - DNA, 25 bp, S. cerevisiae
gttaatagtgcagctgcttcttctg

SEQ ID NO: 40792 - DNA, 25 bp, S. cerevisiae
gttacaaccagccaaatctattccg

SEQ ID NO: 40793 - DNA, 25 bp, S. cerevisiae
gttaagtctacaacaccatacgtta

SEQ ID NO: 40794 - DNA, 25 bp, S. cerevisiae
gttactactctcacccatactgatg

SEQ ID NO: 40795 - DNA, 25 bp, S. cerevisiae
gttacttctgtagatccattctggt

SEQ ID NO: 40796 - DNA, 25 bp, S. cerevisiae
gttaaactgttcaatgctacctgtg

SEQ ID NO: 40797 - DNA, 25 bp, S. cerevisiae
gttaatactttcgatgctgttgcag

SEQ ID NO: 40798 - DNA, 25 bp, S. cerevisiae
gttaatgctcatgtgctgccaaatg

SEQ ID NO: 40799 - DNA, 25 bp, S. cerevisiae
gttattctatcattgctcgagacat

SEQ ID NO: 40800 - DNA, 25 bp, S. cerevisiae
gttagtcgatattcacatcagagca

SEQ ID NO: 40801 - DNA, 25 bp, S. cerevisiae
gttagattctttgatcagggctaca

SEQ ID NO: 40802 - DNA, 25 bp, S. cerevisiae
gttagactattgtccgacgacgaat

SEQ ID NO: 40803 - DNA, 25 bp, S. cerevisiae
gttaagatccttggctactacgaat

SEQ ID NO: 40804 - DNA, 25 bp, S. cerevisiae
gttaacatccctgtcattgctctaa

SEQ ID NO: 40805 - DNA, 25 bp, S. cerevisiae
gttagatgttcgctacgtctggaat

SEQ ID NO: 40806 - DNA, 25 bp, S. cerevisiae
gttaattgtctcgaactgttgataa

SEQ ID NO: 40807 - DNA, 25 bp, S. cerevisiae
gttagacgagcttccagctgtggaa

SEQ ID NO: 40808 - DNA, 25 bp, S. cerevisiae
gttaacatagatgccttcctacatg

SEQ ID NO: 40809 - DNA, 25 bp, S. cerevisiae
gtttaatcaacgcacctctactgat

SEQ ID NO: 40810 - DNA, 25 bp, S. cerevisiae
gtttggctcaacgaacacgtaggta

SEQ ID NO: 40811 - DNA, 25 bp, S. cerevisiae
gtagggcgaacggtactgttgtctt

SEQ ID NO: 40812 - DNA, 25 bp, S. cerevisiae
gtttgccgaatctgaacgtttccta

SEQ ID NO: 40813 - DNA, 25 bp, S. cerevisiae
gtttcagaaaattaccgagcttgca

SEQ ID NO: 40814 - DNA, 25 bp, S. cerevisiae
gttagggatcaaatcacttccttga

SEQ ID NO: 40815 - DNA, 25 bp, S. cerevisiae
gttagccgccatcgacaatgggttg

SEQ ID NO: 40816 - DNA, 25 bp, S. cerevisiae
gttaaccctgatattagagaccata

SEQ ID NO: 40817 - DNA, 25 bp, S. cerevisiae
gttaacccgatcattaaaggctggt

SEQ ID NO: 40818 - DNA, 25 bp, S. cerevisiae
gttagcccggtgtcttattttgata

SEQ ID NO: 40819 - DNA, 25 bp, S. cerevisiae
gttagctttggtctaattcctgaat

SEQ ID NO: 40820 - DNA, 25 bp, S. cerevisiae
gttaccactgttctcattgttctga

SEQ ID NO: 40821 - DNA, 25 bp, S. cerevisiae
gttacacctggtgccatcactattg

SEQ ID NO: 40822 - DNA, 25 bp, S. cerevisiae
gttaaatctaatcgcacactcaatg

SEQ ID NO: 40823 - DNA, 25 bp, S. cerevisiae
gttaagtgtaaccacattgctgagt

SEQ ID NO: 40824 - DNA, 25 bp, S. cerevisiae
gttaagttcaagaccttcgggtgtg

SEQ ID NO: 40825 - DNA, 25 bp, S. cerevisiae
gttaaggcgcaaagaccaatcactg

SEQ ID NO: 40826 - DNA, 25 bp, S. cerevisiae
gttaagtgtgcatcagcaaccataa

SEQ ID NO: 40827 - DNA, 25 bp, S. cerevisiae
gttagtgtgagcacgcacctcgaaa

SEQ ID NO: 40828 - DNA, 25 bp, S. cerevisiae
gttagtgtcgcatggatcctctcca

SEQ ID NO: 40829 - DNA, 25 bp, S. cerevisiae
gttttgaccaccgtgggcactatta

SEQ ID NO: 40830 - DNA, 25 bp, S. cerevisiae
gttttcaaacttcgtgccattttag

SEQ ID NO: 40831 - DNA, 25 bp, S. cerevisiae
gttatgcatcgaggacgccgagcac

SEQ ID NO: 40832 - DNA, 25 bp, S. cerevisiae
gttagctctgtccactattgcaaat

SEQ ID NO: 40833 - DNA, 25 bp, S. cerevisiae
gttagtggtcaaggtgctggtccaa

SEQ ID NO: 40834 - DNA, 25 bp, S. cerevisiae
gttaatcctcaattgcgtgggcatt

SEQ ID NO: 40835 - DNA, 25 bp, S. cerevisiae
gttaacacagtgcttgccgaaaagg

SEQ ID NO: 40836 - DNA, 25 bp, S. cerevisiae
gttacgccaatcctatgccaaaaag

SEQ ID NO: 40837 - DNA, 25 bp, S. cerevisiae
gttacaagttccgtaccaacaattg

SEQ ID NO: 40838 - DNA, 25 bp, S. cerevisiae
gttacaatttgctctaccacacgaa

SEQ ID NO: 40839 - DNA, 25 bp, S. cerevisiae
gttatcatatctcctacaacgctga

SEQ ID NO: 40840 - DNA, 25 bp, S. cerevisiae
gttacatatcaaaggacactggttt

SEQ ID NO: 40841 - DNA, 25 bp, S. cerevisiae
gttactttatcattaccagcaccag

SEQ ID NO: 40842 - DNA, 25 bp, S. cerevisiae
gttacttcaggctatagaaacccat

SEQ ID NO: 40843 - DNA, 25 bp, S. cerevisiae
gttactgttctttacggacctgatc

SEQ ID NO: 40844 - DNA, 25 bp, S. cerevisiae
gttacgttcattgactggattcctt

SEQ ID NO: 40845 - DNA, 25 bp, S. cerevisiae
gttatctgtccaatccaaggtgcca

SEQ ID NO: 40846 - DNA, 25 bp, S. cerevisiae
gttacaggccatatcttctgaagac

SEQ ID NO: 40847 - DNA, 25 bp, S. cerevisiae
gttacaaaccagttaccaccaggat

SEQ ID NO: 40848 - DNA, 25 bp, S. cerevisiae
gttacaaacgcaatctaccatcgga

SEQ ID NO: 40849 - DNA, 25 bp, S. cerevisiae
gttaacaacgcgaacatctcctgtg

SEQ ID NO: 40850 - DNA, 25 bp, S. cerevisiae
gttacatcgcaatggagcacactag

SEQ ID NO: 40851 - DNA, 25 bp, S. cerevisiae
gttactccaacagaacctcgagtgg

SEQ ID NO: 40852 - DNA, 25 bp, S. cerevisiae
gtttcttactatggcaaccctacga

SEQ ID NO: 40853 - DNA, 25 bp, S. cerevisiae
gttatcttttttcaccatcagggcg

SEQ ID NO: 40854 - DNA, 25 bp, S. cerevisiae
gttacatcttttggatcacctagga

SEQ ID NO: 40855 - DNA, 25 bp, S. cerevisiae
gttactgttagtgccatctgtagga

SEQ ID NO: 40856 - DNA, 25 bp, S. cerevisiae
gttactctatactacatgccgtgga

SEQ ID NO: 40857 - DNA, 25 bp, S. cerevisiae
gtaacgtccaaatcatcgaggtcaa

SEQ ID NO: 40858 - DNA, 25 bp, S. cerevisiae
gttaccgctggtagtgctgccgtag

SEQ ID NO: 40859 - DNA, 25 bp, S. cerevisiae
gttaccgcaatgaatggctcctttc

SEQ ID NO: 40860 - DNA, 25 bp, S. cerevisiae
gttactcttcattgatcgtctttta

SEQ ID NO: 40861 - DNA, 25 bp, S. cerevisiae
gttactgatttgttcatgttcttat

SEQ ID NO: 40862 - DNA, 25 bp, S. cerevisiae
gttacgattggtgccgaccttgtgc

SEQ ID NO: 40863 - DNA, 25 bp, S. cerevisiae
gttatcgtctttgttgaactctgga

SEQ ID NO: 40864 - DNA, 25 bp, S. cerevisiae
gttaacctttttagcaccttgatga

SEQ ID NO: 40865 - DNA, 25 bp, S. cerevisiae
gttattaccttaattgcccttgtcg

SEQ ID NO: 40866 - DNA, 25 bp, S. cerevisiae
gttaggattaccagagcaagctctt

SEQ ID NO: 40867 - DNA, 25 bp, S. cerevisiae
gttactatatcacatggacctgctt

SEQ ID NO: 40868 - DNA, 25 bp, S. cerevisiae
gttaggcaacatttcagaccagaat

SEQ ID NO: 40869 - DNA, 25 bp, S. cerevisiae
gttatagttccaccagaagtccgtt

SEQ ID NO: 40870 - DNA, 25 bp, S. cerevisiae
gttaacgctccacaaatttctgctg

SEQ ID NO: 40871 - DNA, 25 bp, S. cerevisiae
gttagacgtcctcgatactttcaaa

SEQ ID NO: 40872 - DNA, 25 bp, S. cerevisiae
gttacaggatcccaaactattggaa

SEQ ID NO: 40873 - DNA, 25 bp, S. cerevisiae
gttaactcctccttctttgatgtaa

SEQ ID NO: 40874 - DNA, 25 bp, S. cerevisiae
gttacgcaagccattgacctattaa

SEQ ID NO: 40875 - DNA, 25 bp, S. cerevisiae
gttagaatcgcatctctacacggcg

SEQ ID NO: 40876 - DNA, 25 bp, S. cerevisiae
gttacagaccattacaatcaccgcg

SEQ ID NO: 40877 - DNA, 25 bp, S. cerevisiae
gttatcaccgatgcaagaacctcgt

SEQ ID NO: 40878 - DNA, 25 bp, S. cerevisiae
gttagcgacgatcagggactttcat

SEQ ID NO: 40879 - DNA, 25 bp, S. cerevisiae
gttaggacgtctcagagttctttct

SEQ ID NO: 40880 - DNA, 25 bp, S. cerevisiae
gtttggagaggctgaagttcttcaa

SEQ ID NO: 40881 - DNA, 25 bp, S. cerevisiae
gttagggacgaaatactctgtgatt

SEQ ID NO: 40882 - DNA, 25 bp, S. cerevisiae
gttatgcagcaatgacaaagtcgtt

SEQ ID NO: 40883 - DNA, 25 bp, S. cerevisiae
gtttacagttaccaagaagttgccg

SEQ ID NO: 40884 - DNA, 25 bp, S. cerevisiae
gtttacgctttccaaccagttatcg

SEQ ID NO: 40885 - DNA, 25 bp, S. cerevisiae
gtttaaattttccaatcgtcaccat

SEQ ID NO: 40886 - DNA, 25 bp, S. cerevisiae
gttaacaacgccgaagatccgtcta

SEQ ID NO: 40887 - DNA, 25 bp, S. cerevisiae
gttaactctcgtggaattggtacaa

SEQ ID NO: 40888 - DNA, 25 bp, S. cerevisiae
gttatacctggtcgcgatcgtgtac

SEQ ID NO: 40889 - DNA, 25 bp, S. cerevisiae
gttaaattggtactcgctgcctgca

SEQ ID NO: 40890 - DNA, 25 bp, S. cerevisiae
gttagcatcgtatatcgtatcgtca

SEQ ID NO: 40891 - DNA, 25 bp, S. cerevisiae
gtttctccccggcaagaatttatca

SEQ ID NO: 40892 - DNA, 25 bp, S. cerevisiae
gtatttcccgtacaaacaatatccg

SEQ ID NO: 40893 - DNA, 25 bp, S. cerevisiae
gttacaccaacaatattctccactt

SEQ ID NO: 40894 - DNA, 25 bp, S. cerevisiae
gttacaccaatcctgttgtcattca

SEQ ID NO: 40895 - DNA, 25 bp, S. cerevisiae
gttacacgcattgttggtcttcaaa

SEQ ID NO: 40896 - DNA, 25 bp, S. cerevisiae
gttagcagcttcaatttccagtctc

SEQ ID NO: 40897 - DNA, 25 bp, S. cerevisiae
gttaaacatggctgcgcattcgcat

SEQ ID NO: 40898 - DNA, 25 bp, S. cerevisiae
gttaaagcatcgtcacttacagcaa

SEQ ID NO: 40899 - DNA, 25 bp, S. cerevisiae
gttaccgcattgtatgactaccaag

SEQ ID NO: 40900 - DNA, 25 bp, S. cerevisiae
gttagaaatcttcattgcctcaatt

SEQ ID NO: 40901 - DNA, 25 bp, S. cerevisiae
gttatgataacgttttcccacttat

SEQ ID NO: 40902 - DNA, 25 bp, S. cerevisiae
gttatgtaacgtggtcatcgctgcc

SEQ ID NO: 40903 - DNA, 25 bp, S. cerevisiae
gttatgtagaccgtgctggacttaa

SEQ ID NO: 40904 - DNA, 25 bp, S. cerevisiae
gttacaacacaactaccaccaataa

SEQ ID NO: 40905 - DNA, 25 bp, S. cerevisiae
gttaaacaaaccatcagtctttcca

SEQ ID NO: 40906 - DNA, 25 bp, S. cerevisiae
gtaatatcgggtgttccactcggaa

SEQ ID NO: 40907 - DNA, 25 bp, S. cerevisiae
gttatttgattccttttccacgagc

SEQ ID NO: 40908 - DNA, 25 bp, S. cerevisiae
gttaccttcttgattttagctggac

SEQ ID NO: 40909 - DNA, 25 bp, S. cerevisiae
gttactcctcttgtttccgtagaga

SEQ ID NO: 40910 - DNA, 25 bp, S. cerevisiae
gttagtctccatatacgattccaat

SEQ ID NO: 40911 - DNA, 25 bp, S. cerevisiae
gttactctccatattgccgtgattc

SEQ ID NO: 40912 - DNA, 25 bp, S. cerevisiae
gttagtttctttctcgtttgcttat

SEQ ID NO: 40913 - DNA, 25 bp, S. cerevisiae
gttactttgatttccccatttgttg

SEQ ID NO: 40914 - DNA, 25 bp, S. cerevisiae
gttactatactgtctccatttgatt

SEQ ID NO: 40915 - DNA, 25 bp, S. cerevisiae
gttacgtggtgaagcaattccccaa

SEQ ID NO: 40916 - DNA, 25 bp, S. cerevisiae
gttatcatcatccatgacgctttcc

SEQ ID NO: 40917 - DNA, 25 bp, S. cerevisiae
gttacactactcatttgatgaaaag

SEQ ID NO: 40918 - DNA, 25 bp, S. cerevisiae
gttacactaccagtatgttatcatg

SEQ ID NO: 40919 - DNA, 25 bp, S. cerevisiae
gttactctctctgagcttctaagaa

SEQ ID NO: 40920 - DNA, 25 bp, S. cerevisiae
gttatccttgccctcaactaagaga

SEQ ID NO: 40921 - DNA, 25 bp, S. cerevisiae
gttatcgatgctgttgccaaaggat

SEQ ID NO: 40922 - DNA, 25 bp, S. cerevisiae
gttactccatgggatgccaacggga

SEQ ID NO: 40923 - DNA, 25 bp, S. cerevisiae
gttacttcatcagaccaaccgtttt

SEQ ID NO: 40924 - DNA, 25 bp, S. cerevisiae
gttatttccatcaagactaagcgtt

SEQ ID NO: 40925 - DNA, 25 bp, S. cerevisiae
gttatcccaattaagctcgcagcag

SEQ ID NO: 40926 - DNA, 25 bp, S. cerevisiae
gttatacccgtgaagaagccgctta

SEQ ID NO: 40927 - DNA, 25 bp, S. cerevisiae
gttatactactccaagtcgccgttc

SEQ ID NO: 40928 - DNA, 25 bp, S. cerevisiae
gttacatattagactacgcgctagt

SEQ ID NO: 40929 - DNA, 25 bp, S. cerevisiae
gttactttgagaaaccctagcacta

SEQ ID NO: 40930 - DNA, 25 bp, S. cerevisiae
gttacgtatgatgacaccgcggcta

SEQ ID NO: 40931 - DNA, 25 bp, S. cerevisiae
gttagcagtatgttacccactggaa

SEQ ID NO: 40932 - DNA, 25 bp, S. cerevisiae
gttatactattttacaccgtatact

SEQ ID NO: 40933 - DNA, 25 bp, S. cerevisiae
gttatactattttacaccgtatact

SEQ ID NO: 40934 - DNA, 25 bp, S. cerevisiae
gttatcagtagcatacgcactccga

SEQ ID NO: 40935 - DNA, 25 bp, S. cerevisiae
gttatcgtcaatactccacatttaa

SEQ ID NO: 40936 - DNA, 25 bp, S. cerevisiae
gttatcactaagttacacttggaca

SEQ ID NO: 40937 - DNA, 25 bp, S. cerevisiae
gttataggaaattacacttgccatt

SEQ ID NO: 40938 - DNA, 25 bp, S. cerevisiae
gttatgggaaacacacacactgtta

SEQ ID NO: 40939 - DNA, 25 bp, S. cerevisiae
gttatgtggcgtttatttcgttata

SEQ ID NO: 40940 - DNA, 25 bp, S. cerevisiae
gttaccacaaatcgccattctttat

SEQ ID NO: 40941 - DNA, 25 bp, S. cerevisiae
gttacctggcaatgctagctctatt

SEQ ID NO: 40942 - DNA, 25 bp, S. cerevisiae
gttactcttctcaaaagctatcccg

SEQ ID NO: 40943 - DNA, 25 bp, S. cerevisiae
gttaccattttttatatatcgcctg

SEQ ID NO: 40944 - DNA, 25 bp, S. cerevisiae
gttacatgttccaacgtgacttcag

SEQ ID NO: 40945 - DNA, 25 bp, S. cerevisiae
gtttgtagaacactggtcctgaccc

SEQ ID NO: 40946 - DNA, 25 bp, S. cerevisiae
gttatagaactcactcggcagaccg

SEQ ID NO: 40947 - DNA, 25 bp, S. cerevisiae
gttatggcaactaccctagaacagt

SEQ ID NO: 40948 - DNA, 25 bp, S. cerevisiae
gttatcatcaacgtcccaaggaagt

SEQ ID NO: 40949 - DNA, 25 bp, S. cerevisiae
gttatgctagcaatgtcctcacagg

SEQ ID NO: 40950 - DNA, 25 bp, S. cerevisiae
gttagcggcatatatccatcaggaa

SEQ ID NO: 40951 - DNA, 25 bp, S. cerevisiae
gttactggtgtgttgaagcgatact

SEQ ID NO: 40952 - DNA, 25 bp, S. cerevisiae
gttatcgtgtctttggtggaacctc

SEQ ID NO: 40953 - DNA, 25 bp, S. cerevisiae
tgccctcggcaaaagaaacaacgtt

SEQ ID NO: 40954 - DNA, 25 bp, S. cerevisiae
gttatggaacctctcagtacggcga

SEQ ID NO: 40955 - DNA, 25 bp, S. cerevisiae
gtttaagccatggtcccgtaataca

SEQ ID NO: 40956 - DNA, 25 bp, S. cerevisiae
gttttcttaagatccgccggtggtg

SEQ ID NO: 40957 - DNA, 25 bp, S. cerevisiae
gttttcgacgggttctatcctatca

SEQ ID NO: 40958 - DNA, 25 bp, S. cerevisiae
gttatttctgctcaacatgctgatg

SEQ ID NO: 40959 - DNA, 25 bp, S. cerevisiae
gttattgcctgtcaattcgatcaag

SEQ ID NO: 40960 - DNA, 25 bp, S. cerevisiae
gtttaatcaggcaaattccaaggtt

SEQ ID NO: 40961 - DNA, 25 bp, S. cerevisiae
gtaaaaagctctatttcaagttcca

SEQ ID NO: 40962 - DNA, 25 bp, S. cerevisiae
gttttcaagctaccttaaggctact

SEQ ID NO: 40963 - DNA, 25 bp, S. cerevisiae
gttattcagcaatctttttggcaac

SEQ ID NO: 40964 - DNA, 25 bp, S. cerevisiae
gttatccaagaaggattattccata

SEQ ID NO: 40965 - DNA, 25 bp, S. cerevisiae
gttacccagcgagatgtttctagga

SEQ ID NO: 40966 - DNA, 25 bp, S. cerevisiae
gttagcccctaacatgacattaagt

SEQ ID NO: 40967 - DNA, 25 bp, S. cerevisiae
gttatgccctttacggttggacagt

SEQ ID NO: 40968 - DNA, 25 bp, S. cerevisiae
gttacgcttgtctattagtggccac

SEQ ID NO: 40969 - DNA, 25 bp, S. cerevisiae
gttaggttgccttatgggtttcata

SEQ ID NO: 40970 - DNA, 25 bp, S. cerevisiae
gttatggagtttttgccgttctata

SEQ ID NO: 40971 - DNA, 25 bp, S. cerevisiae
gttaggaatctcatttgggctcttt

SEQ ID NO: 40972 - DNA, 25 bp, S. cerevisiae
gttaccactgttttcaacgttcttg

SEQ ID NO: 40973 - DNA, 25 bp, S. cerevisiae
gtttggctgctaagatgcatgctaa

SEQ ID NO: 40974 - DNA, 25 bp, S. cerevisiae
gttactcgtcacacaggcattgcaa

SEQ ID NO: 40975 - DNA, 25 bp, S. cerevisiae
gttacctgctactagggcattcatt

SEQ ID NO: 40976 - DNA, 25 bp, S. cerevisiae
gttactgcctacaaaccatttctgg

SEQ ID NO: 40977 - DNA, 25 bp, S. cerevisiae
gttagagcggacgatttgtcaacaa

SEQ ID NO: 40978 - DNA, 25 bp, S. cerevisiae
gttatgggcgattcgttgccaccaa

SEQ ID NO: 40979 - DNA, 25 bp, S. cerevisiae
gttagtatgcctttgttgccaccga

SEQ ID NO: 40980 - DNA, 25 bp, S. cerevisiae
gttagaatcttcttgtacccatcca

SEQ ID NO: 40981 - DNA, 25 bp, S. cerevisiae
gttagatcactttgaaactcctgga

SEQ ID NO: 40982 - DNA, 25 bp, S. cerevisiae
gttttgcagcttcgagcaactcaag

SEQ ID NO: 40983 - DNA, 25 bp, S. cerevisiae
gtttcataccgatattaagcccgat

SEQ ID NO: 40984 - DNA, 25 bp, S. cerevisiae
gttttcaggacgcaagacactctag

SEQ ID NO: 40985 - DNA, 25 bp, S. cerevisiae
gtatttcagcaaacggtaccgccgg

SEQ ID NO: 40986 - DNA, 25 bp, S. cerevisiae
gttttggaaactctacccggtgcat

SEQ ID NO: 40987 - DNA, 25 bp, S. cerevisiae
gtttaaaaagatcacactccggaga

SEQ ID NO: 40988 - DNA, 25 bp, S. cerevisiae
gtttaacaagatcactccaccagga

SEQ ID NO: 40989 - DNA, 25 bp, S. cerevisiae
gtttaccaaattctctggcggaggt

SEQ ID NO: 40990 - DNA, 25 bp, S. cerevisiae
gtttgaacaaaagaatgccggtggt

SEQ ID NO: 40991 - DNA, 25 bp, S. cerevisiae
gtttaccagtcgaaattacccagca

SEQ ID NO: 40992 - DNA, 25 bp, S. cerevisiae
gtttcacgcggataagtactcaagt

SEQ ID NO: 40993 - DNA, 25 bp, S. cerevisiae
gttagagcaagcataccctgaaaaa

SEQ ID NO: 40994 - DNA, 25 bp, S. cerevisiae
gttattgcggcattgtgccacttga

SEQ ID NO: 40995 - DNA, 25 bp, S. cerevisiae
gttattgcagtcgatgtgctccgcc

SEQ ID NO: 40996 - DNA, 25 bp, S. cerevisiae
gttttcgtcatcgatcccaagaaga

SEQ ID NO: 40997 - DNA, 25 bp, S. cerevisiae
gttattgctataactgatgcatcag

SEQ ID NO: 40998 - DNA, 25 bp, S. cerevisiae
gttatttctgaaatcttgaccagag

SEQ ID NO: 40999 - DNA, 25 bp, S. cerevisiae
gttattgcttcagttttagcacagg

SEQ ID NO: 41000 - DNA, 25 bp, S. cerevisiae
gttagattctcaaacactagctcat

SEQ ID NO: 41001 - DNA, 25 bp, S. cerevisiae
gttagatactcaaatcgcccagtta

SEQ ID NO: 41002 - DNA, 25 bp, S. cerevisiae
gttatgcaactccattaaagcgtta

SEQ ID NO: 41003 - DNA, 25 bp, S. cerevisiae
gttagcaatcccgtaaactcctcgt

SEQ ID NO: 41004 - DNA, 25 bp, S. cerevisiae
gttataaccacagaaccactcacgg

SEQ ID NO: 41005 - DNA, 25 bp, S. cerevisiae
gttatttacgcagatacgtctcccg

SEQ ID NO: 41006 - DNA, 25 bp, S. cerevisiae
gtttttaacagaaagcttgccgtcg

SEQ ID NO: 41007 - DNA, 25 bp, S. cerevisiae
gtagtcgcaggcctaggttccctag

SEQ ID NO: 41008 - DNA, 25 bp, S. cerevisiae
gtatggtcatggttgggtgcttaaa

SEQ ID NO: 41009 - DNA, 25 bp, S. cerevisiae
gtacggatgcttctggtcaaaaatc

SEQ ID NO: 41010 - DNA, 25 bp, S. cerevisiae
gtagaggacctcgtgggcgtaaatt

SEQ ID NO: 41011 - DNA, 25 bp, S. cerevisiae
tggaatggaccgaggcacgtcgttt

SEQ ID NO: 41012 - DNA, 25 bp, S. cerevisiae
gttattgacactttggcagccggtt

SEQ ID NO: 41013 - DNA, 25 bp, S. cerevisiae
gttatcctacatcattccggttata

SEQ ID NO: 41014 - DNA, 25 bp, S. cerevisiae
tgacggtccaaagcgtgaacttatt

SEQ ID NO: 41015 - DNA, 25 bp, S. cerevisiae
tgaccgacccaagagtacatccaat

SEQ ID NO: 41016 - DNA, 25 bp, S. cerevisiae
gttatgtacccgaatatgtcagttt

SEQ ID NO: 41017 - DNA, 25 bp, S. cerevisiae
gttagtaaacgctatatcctccaaa

SEQ ID NO: 41018 - DNA, 25 bp, S. cerevisiae
gttagttctattgccacagctcgtt

SEQ ID NO: 41019 - DNA, 25 bp, S. cerevisiae
gttagcttgaaggacgcaacttcca

SEQ ID NO: 41020 - DNA, 25 bp, S. cerevisiae
gttagctggtactaccgagtcacca

SEQ ID NO: 41021 - DNA, 25 bp, S. cerevisiae
gttagctggtactactgaatctcct

SEQ ID NO: 41022 - DNA, 25 bp, S. cerevisiae
gttttggcccatgaaatcggtcact

SEQ ID NO: 41023 - DNA, 25 bp, S. cerevisiae
gttatttcattctggtttctcaagc

SEQ ID NO: 41024 - DNA, 25 bp, S. cerevisiae
gtttacctatcctctcttcaaatta

SEQ ID NO: 41025 - DNA, 25 bp, S. cerevisiae
gttatttccatgtatgaccagttgc

SEQ ID NO: 41026 - DNA, 25 bp, S. cerevisiae
gttagaccaatcttgaacagctttg

SEQ ID NO: 41027 - DNA, 25 bp, S. cerevisiae
gttagatccaaatgaaacctctgaa

SEQ ID NO: 41028 - DNA, 25 bp, S. cerevisiae
gtttagtcagcatctacaagcccta

SEQ ID NO: 41029 - DNA, 25 bp, S. cerevisiae
gttattatcgatgctgacgccacct

SEQ ID NO: 41030 - DNA, 25 bp, S. cerevisiae
gttattttggcaaccatcgcttttt

SEQ ID NO: 41031 - DNA, 25 bp, S. cerevisiae
gttatccacattgatttcggcgatt

SEQ ID NO: 41032 - DNA, 25 bp, S. cerevisiae
gttatcgttcattcctatacagttc

SEQ ID NO: 41033 - DNA, 25 bp, S. cerevisiae
gttatttggccaacaattctgcggt

SEQ ID NO: 41034 - DNA, 25 bp, S. cerevisiae
gttattttcacatcacatgtcgcta

SEQ ID NO: 41035 - DNA, 25 bp, S. cerevisiae
gttatttatccttgatgtgccgcat

SEQ ID NO: 41036 - DNA, 25 bp, S. cerevisiae
gtttttcaacagacatccgatggtg

SEQ ID NO: 41037 - DNA, 25 bp, S. cerevisiae
gttttgagaacagctccagtcttga

SEQ ID NO: 41038 - DNA, 25 bp, S. cerevisiae
gtttacgatgtttctcaattcaaag

SEQ ID NO: 41039 - DNA, 25 bp, S. cerevisiae
gttatgatccaccaagcgataccaa

SEQ ID NO: 41040 - DNA, 25 bp, S. cerevisiae
gttattctgccgtcgaacagcacaa

SEQ ID NO: 41041 - DNA, 25 bp, S. cerevisiae
gttttccaacaagtacctcgagctg

SEQ ID NO: 41042 - DNA, 25 bp, S. cerevisiae
gttattcataagttcggcctctggg

SEQ ID NO: 41043 - DNA, 25 bp, S. cerevisiae
gttttcataatgtcacgccgactgg

SEQ ID NO: 41044 - DNA, 25 bp, S. cerevisiae
gttatttccgaaatcttgactaagg

SEQ ID NO: 41045 - DNA, 25 bp, S. cerevisiae
gtggtttcgtccactacggtgaaat

SEQ ID NO: 41046 - DNA, 25 bp, S. cerevisiae
gtggttttactagcatacttccctg

SEQ ID NO: 41047 - DNA, 25 bp, S. cerevisiae
gtttttaacgctatccttaccgatg

SEQ ID NO: 41048 - DNA, 25 bp, S. cerevisiae
gtttgttgaacactaacgttgacgg

SEQ ID NO: 41049 - DNA, 25 bp, S. cerevisiae
gttttggaagagtacgctaggcgct

SEQ ID NO: 41050 - DNA, 25 bp, S. cerevisiae
gtttgttcagggtacttggtgctat

SEQ ID NO: 41051 - DNA, 25 bp, S. cerevisiae
gttttgccagcttacccatggtata

SEQ ID NO: 41052 - DNA, 25 bp, S. cerevisiae
gttattttcggacctgcttacaaag

SEQ ID NO: 41053 - DNA, 25 bp, S. cerevisiae
gttatctggaccgaagctgctttca

SEQ ID NO: 41054 - DNA, 25 bp, S. cerevisiae
gttttgcaacgttatcatgctttga

SEQ ID NO: 41055 - DNA, 25 bp, S. cerevisiae
gtttacaacgactacgctggcagtg

SEQ ID NO: 41056 - DNA, 25 bp, S. cerevisiae
gtttaccaatactcacgtggctgct

SEQ ID NO: 41057 - DNA, 25 bp, S. cerevisiae
gtttcgtatttagacagatcccgta

SEQ ID NO: 41058 - DNA, 25 bp, S. cerevisiae
gttttgggcaagacgtcttcactgt

SEQ ID NO: 41059 - DNA, 25 bp, S. cerevisiae
gtttttgccaaggaactctgatttg

SEQ ID NO: 41060 - DNA, 25 bp, S. cerevisiae
gttagggcgcaagttttatcattag

SEQ ID NO: 41061 - DNA, 25 bp, S. cerevisiae
gttaggtccaagagttcctctcaga

SEQ ID NO: 41062 - DNA, 25 bp, S. cerevisiae
gtttttaacgcgttgacttcgcaag

SEQ ID NO: 41063 - DNA, 25 bp, S. cerevisiae
gtttttctacgatggacttgactgc

SEQ ID NO: 41064 - DNA, 25 bp, S. cerevisiae
gttttaccaatgtctgtcgggcact

SEQ ID NO: 41065 - DNA, 25 bp, S. cerevisiae
gttatggctacaaccgtgatcgcgg

SEQ ID NO: 41066 - DNA, 25 bp, S. cerevisiae
gttatgttgccagtctttgatgctc

SEQ ID NO: 41067 - DNA, 25 bp, S. cerevisiae
gttatcgattttatgccagctggtc

SEQ ID NO: 41068 - DNA, 25 bp, S. cerevisiae
gttatcgtttattggctacagcctc

SEQ ID NO: 41069 - DNA, 25 bp, S. cerevisiae
gtttgaccgtaacagtgatcatcct

SEQ ID NO: 41070 - DNA, 25 bp, S. cerevisiae
gttatacacattaagcccgacaatt

SEQ ID NO: 41071 - DNA, 25 bp, S. cerevisiae
gttatattcaggtttcccacagcag

SEQ ID NO: 41072 - DNA, 25 bp, S. cerevisiae
gttatttcttggacatactgcgccc

SEQ ID NO: 41073 - DNA, 25 bp, S. cerevisiae
gttatcatttctcaggcaataccga

SEQ ID NO: 41074 - DNA, 25 bp, S. cerevisiae
gttatgttacacagttggacagcca

SEQ ID NO: 41075 - DNA, 25 bp, S. cerevisiae
gttattattctaaagcgggcaccat

SEQ ID NO: 41076 - DNA, 25 bp, S. cerevisiae
gttattgacttatccggtactcagg

SEQ ID NO: 41077 - DNA, 25 bp, S. cerevisiae
gttttcaccctatccaaagagtcat

SEQ ID NO: 41078 - DNA, 25 bp, S. cerevisiae
gtttccaacatgtgtactacgagca

SEQ ID NO: 41079 - DNA, 25 bp, S. cerevisiae
gttatagtaccagtgcaaccgcaca

SEQ ID NO: 41080 - DNA, 25 bp, S. cerevisiae
gtttgactacgtacgaccgtgccaa

SEQ ID NO: 41081 - DNA, 25 bp, S. cerevisiae
gttttgttctggaattgaccacctt

SEQ ID NO: 41082 - DNA, 25 bp, S. cerevisiae
gttatttttgacactgctccaactg

SEQ ID NO: 41083 - DNA, 25 bp, S. cerevisiae
gtttaccgtttgataccattgacac

SEQ ID NO: 41084 - DNA, 25 bp, S. cerevisiae
gtatctacactgctgtaccaaacta

SEQ ID NO: 41085 - DNA, 25 bp, S. cerevisiae
gttttggcgatttctcacgacgaat

SEQ ID NO: 41086 - DNA, 25 bp, S. cerevisiae
gtttatgttctttatactcaaaatc

SEQ ID NO: 41087 - DNA, 25 bp, S. cerevisiae
gtttatgttgttgctactcacggta

SEQ ID NO: 41088 - DNA, 25 bp, S. cerevisiae
gttttcaattctgcatactacgctt

SEQ ID NO: 41089 - DNA, 25 bp, S. cerevisiae
gttttcaattctgcaatatttgctt

SEQ ID NO: 41090 - DNA, 25 bp, S. cerevisiae
gtttagcaggcatcatcgacagttg

SEQ ID NO: 41091 - DNA, 25 bp, S. cerevisiae
gtttcgcacaaaccgacagttgaga

SEQ ID NO: 41092 - DNA, 25 bp, S. cerevisiae
gtttacccacacaacttgaagctgt

SEQ ID NO: 41093 - DNA, 25 bp, S. cerevisiae
gtttacgctaacaatttgggcatgc

SEQ ID NO: 41094 - DNA, 25 bp, S. cerevisiae
gtttatcactcgcttggttcagtac

SEQ ID NO: 41095 - DNA, 25 bp, S. cerevisiae
gttttcccttggatttgctctacaa

SEQ ID NO: 41096 - DNA, 25 bp, S. cerevisiae
gttttcgcttctgttggtgttacaa

SEQ ID NO: 41097 - DNA, 25 bp, S. cerevisiae
gttattcctccaaaattcttcaaga

SEQ ID NO: 41098 - DNA, 25 bp, S. cerevisiae
gtctacctcaacaggaagtctccga

SEQ ID NO: 41099 - DNA, 25 bp, S. cerevisiae
gtttcaattcgacgcggagttccaa

SEQ ID NO: 41100 - DNA, 25 bp, S. cerevisiae
gtttatatcaatctttccgagcaat

SEQ ID NO: 41101 - DNA, 25 bp, S. cerevisiae
gttatcgtcctacgttcttgagaca

SEQ ID NO: 41102 - DNA, 25 bp, S. cerevisiae
gttatattccaccattggctcatgt

SEQ ID NO: 41103 - DNA, 25 bp, S. cerevisiae
gttatctcccagtatgggccagata

SEQ ID NO: 41104 - DNA, 25 bp, S. cerevisiae
gttttgcaccaatacgcgatgaccc

SEQ ID NO: 41105 - DNA, 25 bp, S. cerevisiae
gttttgcaacaagatcagttcacca

SEQ ID NO: 41106 - DNA, 25 bp, S. cerevisiae
gttttgcaacgacaatttcatccaa

SEQ ID NO: 41107 - DNA, 25 bp, S. cerevisiae
gttattccattgaagtcgttcctca

SEQ ID NO: 41108 - DNA, 25 bp, S. cerevisiae
gtttcccattaagagtcaaatccaa

SEQ ID NO: 41109 - DNA, 25 bp, S. cerevisiae
gtttcaagtcgaaaagtctcaactt

SEQ ID NO: 41110 - DNA, 25 bp, S. cerevisiae
gtttaccattggaagccttgcaact

SEQ ID NO: 41111 - DNA, 25 bp, S. cerevisiae
gtttatcgtaaaccacgctgcagag

SEQ ID NO: 41112 - DNA, 25 bp, S. cerevisiae
gttttagatcaattccgcaggcaga

SEQ ID NO: 41113 - DNA, 25 bp, S. cerevisiae
gtttcacagatacatcctgatggac

SEQ ID NO: 41114 - DNA, 25 bp, S. cerevisiae
gtttccagttggtttatcgacatcg

SEQ ID NO: 41115 - DNA, 25 bp, S. cerevisiae
gtttttatcgcgtccactttacgag

SEQ ID NO: 41116 - DNA, 25 bp, S. cerevisiae
gttttgaatccgtccaagtaccaag

SEQ ID NO: 41117 - DNA, 25 bp, S. cerevisiae
gtacttgaacgttccaaacacccat

SEQ ID NO: 41118 - DNA, 25 bp, S. cerevisiae
gtttgctacgagacggtaccacttt

SEQ ID NO: 41119 - DNA, 25 bp, S. cerevisiae
gttatctacagcagttttctcacta

SEQ ID NO: 41120 - DNA, 25 bp, S. cerevisiae
gttatattgatattgcttctcctca

SEQ ID NO: 41121 - DNA, 25 bp, S. cerevisiae
gttatatatgagttcagagcccatg

SEQ ID NO: 41122 - DNA, 25 bp, S. cerevisiae
gttatataaccatgcctatcaccgt

SEQ ID NO: 41123 - DNA, 25 bp, S. cerevisiae
gtttatacagccttgagtgcactat

SEQ ID NO: 41124 - DNA, 25 bp, S. cerevisiae
gtttgcaaagacagattcctaccga

SEQ ID NO: 41125 - DNA, 25 bp, S. cerevisiae
gtttacaacttgtcatcacctgacc

SEQ ID NO: 41126 - DNA, 25 bp, S. cerevisiae
gtttatgaacaccaggcccggcgga

SEQ ID NO: 41127 - DNA, 25 bp, S. cerevisiae
gtttcatgaagatctgtcacccaga

SEQ ID NO: 41128 - DNA, 25 bp, S. cerevisiae
gttataacagttctccagcctacac

SEQ ID NO: 41129 - DNA, 25 bp, S. cerevisiae
gttttggctgttggtattccttatc

SEQ ID NO: 41130 - DNA, 25 bp, S. cerevisiae
gttttggcattagctattcctgaag

SEQ ID NO: 41131 - DNA, 25 bp, S. cerevisiae
tgttactgggctttactacgggcaa

SEQ ID NO: 41132 - DNA, 25 bp, S. cerevisiae
gttttatcaagtgaacctcatccaa

SEQ ID NO: 41133 - DNA, 25 bp, S. cerevisiae
gttttccgctgttttgattatccca

SEQ ID NO: 41134 - DNA, 25 bp, S. cerevisiae
gtttcggttatgttcaattctccaa

SEQ ID NO: 41135 - DNA, 25 bp, S. cerevisiae
gtttcgtgggtcctgaattgatcaa

SEQ ID NO: 41136 - DNA, 25 bp, S. cerevisiae
gttatctaagattcgtcgtgctgca

SEQ ID NO: 41137 - DNA, 25 bp, S. cerevisiae
gtttcctacttcacccagagtgtga

SEQ ID NO: 41138 - DNA, 25 bp, S. cerevisiae
gtttactcacccgttacaggtgcaa

SEQ ID NO: 41139 - DNA, 25 bp, S. cerevisiae
gtttggatcaactcatctaacgatg

SEQ ID NO: 41140 - DNA, 25 bp, S. cerevisiae
gttattccactctcagcatcgatcg

SEQ ID NO: 41141 - DNA, 25 bp, S. cerevisiae
gtttactacaacagctctatctagc

SEQ ID NO: 41142 - DNA, 25 bp, S. cerevisiae
tgatttggattcaaagccccttccg

SEQ ID NO: 41143 - DNA, 25 bp, S. cerevisiae
gtttcgttaaagtcccaatgcctga

SEQ ID NO: 41144 - DNA, 25 bp, S. cerevisiae
gtttagttgatattgccaccgtcct

SEQ ID NO: 41145 - DNA, 25 bp, S. cerevisiae
gttattatttatttcgccgcatctg

SEQ ID NO: 41146 - DNA, 25 bp, S. cerevisiae
gttattatctctttacgccgttaca

SEQ ID NO: 41147 - DNA, 25 bp, S. cerevisiae
gttatagatcagctgtacatctgct

SEQ ID NO: 41148 - DNA, 25 bp, S. cerevisiae
gttattatcattactcactctgctg

SEQ ID NO: 41149 - DNA, 25 bp, S. cerevisiae
gttttggattgtcacactgctcaca

SEQ ID NO: 41150 - DNA, 25 bp, S. cerevisiae
gtttcagaacgggtcaagcaacatt

SEQ ID NO: 41151 - DNA, 25 bp, S. cerevisiae
gtttagcacctaacatagacagcgt

SEQ ID NO: 41152 - DNA, 25 bp, S. cerevisiae
gttttgccattttccaacagcacaa

SEQ ID NO: 41153 - DNA, 25 bp, S. cerevisiae
gttttgcctcaaccaatcaatgcta

SEQ ID NO: 41154 - DNA, 25 bp, S. cerevisiae
gttttggctgccagaatcatcgctg

SEQ ID NO: 41155 - DNA, 25 bp, S. cerevisiae
ttacagggcgccagaaactttctct

SEQ ID NO: 41156 - DNA, 25 bp, S. cerevisiae
ttagatttccccagaagtagccaaa

SEQ ID NO: 41157 - DNA, 25 bp, S. cerevisiae
gtactttcaacctgaaccccaagat

SEQ ID NO: 41158 - DNA, 25 bp, S. cerevisiae
gtttccggcttcaaaacacgacaag

SEQ ID NO: 41159 - DNA, 25 bp, S. cerevisiae
gtattcccgccgaccaagttaccag

SEQ ID NO: 41160 - DNA, 25 bp, S. cerevisiae
gtattcccgccgaccaagttaccag

SEQ ID NO: 41161 - DNA, 25 bp, S. cerevisiae
gttattaaacccgaatttgagccag

SEQ ID NO: 41162 - DNA, 25 bp, S. cerevisiae
gtttctacaactaccactttagcgc

SEQ ID NO: 41163 - DNA, 25 bp, S. cerevisiae
gttttagcatttacctgtttcagca

SEQ ID NO: 41164 - DNA, 25 bp, S. cerevisiae
gttttagcaagcacgtgggatccaa

SEQ ID NO: 41165 - DNA, 25 bp, S. cerevisiae
gtttagctcaacttcgcatgtggat

SEQ ID NO: 41166 - DNA, 25 bp, S. cerevisiae
gtttcagcgctcaaggcggaggata

SEQ ID NO: 41167 - DNA, 25 bp, S. cerevisiae
gtctacttgtgcaacctcgggtgaa

SEQ ID NO: 41168 - DNA, 25 bp, S. cerevisiae
gtatactctgtggacgttaacaaca

SEQ ID NO: 41169 - DNA, 25 bp, S. cerevisiae
gttttctgggacgttgcactgtaca

SEQ ID NO: 41170 - DNA, 25 bp, S. cerevisiae
gttttgcagcgccaacaaactctag

SEQ ID NO: 41171 - DNA, 25 bp, S. cerevisiae
tgactttggccttagaaacttcgct

SEQ ID NO: 41172 - DNA, 25 bp, S. cerevisiae
gttttagccatgtatgacaacccca

SEQ ID NO: 41173 - DNA, 25 bp, S. cerevisiae
gttattaatgcatctgggtccccac

SEQ ID NO: 41174 - DNA, 25 bp, S. cerevisiae
gtttgctcaagtcattggtgctaca

SEQ ID NO: 41175 - DNA, 25 bp, S. cerevisiae
gtttatcaaagtacggctgctcaag

SEQ ID NO: 41176 - DNA, 25 bp, S. cerevisiae
gtttttgcacaacatcctgacaagt

SEQ ID NO: 41177 - DNA, 25 bp, S. cerevisiae
gttttccatgccactgtttatgatg

SEQ ID NO: 41178 - DNA, 25 bp, S. cerevisiae
gttttgccatggaaatcaccttctt

SEQ ID NO: 41179 - DNA, 25 bp, S. cerevisiae
gttttcgccgaaaccttgaagcatg

SEQ ID NO: 41180 - DNA, 25 bp, S. cerevisiae
gtttttgcgtttgctttgaacttca

SEQ ID NO: 41181 - DNA, 25 bp, S. cerevisiae
ggttctgggaacactacaaccctga

SEQ ID NO: 41182 - DNA, 25 bp, S. cerevisiae
tgtttcgggtacttctaaacagacg

SEQ ID NO: 41183 - DNA, 25 bp, S. cerevisiae
gtttcccaccggaatcctagaattg

SEQ ID NO: 41184 - DNA, 25 bp, S. cerevisiae
gtttccccgtcgaattcaaaatctg

SEQ ID NO: 41185 - DNA, 25 bp, S. cerevisiae
gtttacccattccagagttaacagt

SEQ ID NO: 41186 - DNA, 25 bp, S. cerevisiae
gtttatggctgcgtctttgcaacaa

SEQ ID NO: 41187 - DNA, 25 bp, S. cerevisiae
gttttcattcctgtttggacttcat

SEQ ID NO: 41188 - DNA, 25 bp, S. cerevisiae
gtttctctaccgcatttaggctatt

SEQ ID NO: 41189 - DNA, 25 bp, S. cerevisiae
gtttttggtctgatcttaggtgcat

SEQ ID NO: 41190 - DNA, 25 bp, S. cerevisiae
gtttcttggccggtttgattgagtc

SEQ ID NO: 41191 - DNA, 25 bp, S. cerevisiae
gtttcgacgccggtttgcaaaaatg

SEQ ID NO: 41192 - DNA, 25 bp, S. cerevisiae
gttttctgttggatttggctcatac

SEQ ID NO: 41193 - DNA, 25 bp, S. cerevisiae
gtttcctattctttttgttcgcctg

SEQ ID NO: 41194 - DNA, 25 bp, S. cerevisiae
gttttccatgttccaacctgtaaat

SEQ ID NO: 41195 - DNA, 25 bp, S. cerevisiae
gttattccaaggcaactctgtgaaa

SEQ ID NO: 41196 - DNA, 25 bp, S. cerevisiae
gttattcctaggtaccaggtagcat

SEQ ID NO: 41197 - DNA, 25 bp, S. cerevisiae
gtatattcccggtgcgagtgataat

SEQ ID NO: 41198 - DNA, 25 bp, S. cerevisiae
gtttatctcatgtgatcctgcaaga

SEQ ID NO: 41199 - DNA, 25 bp, S. cerevisiae
gttttctgtaccactcaatgactta

SEQ ID NO: 41200 - DNA, 25 bp, S. cerevisiae
gtttttcatatctattcccacacgc

SEQ ID NO: 41201 - DNA, 25 bp, S. cerevisiae
gttattgctgcttctattaccacca

SEQ ID NO: 41202 - DNA, 25 bp, S. cerevisiae
gttttcgtcgtcttcatgttcctat

SEQ ID NO: 41203 - DNA, 25 bp, S. cerevisiae
gttttgcagctcgagaatccttgaa

SEQ ID NO: 41204 - DNA, 25 bp, S. cerevisiae
gttttcatcactatatgcacgctct

SEQ ID NO: 41205 - DNA, 25 bp, S. cerevisiae
gtttatctcgataagttcgccgttc

SEQ ID NO: 41206 - DNA, 25 bp, S. cerevisiae
gttttcctgcataatgttgccatca

SEQ ID NO: 41207 - DNA, 25 bp, S. cerevisiae
gtgttccacaagtaaacgcggcgac

SEQ ID NO: 41208 - DNA, 25 bp, S. cerevisiae
gtcttccaagaatataggttcggca

SEQ ID NO: 41209 - DNA, 25 bp, S. cerevisiae
gttttacccagttatagtcctgaat

SEQ ID NO: 41210 - DNA, 25 bp, S. cerevisiae
gtttaaccaatgataccacgttgca

SEQ ID NO: 41211 - DNA, 25 bp, S. cerevisiae
gtttgagaacaatattcccggagat

SEQ ID NO: 41212 - DNA, 25 bp, S. cerevisiae
gttttagagaattcttcgaccgagt

SEQ ID NO: 41213 - DNA, 25 bp, S. cerevisiae
gtttgaaaaatctgacgctctcgtt

SEQ ID NO: 41214 - DNA, 25 bp, S. cerevisiae
gtttaaataatcttgacaccgctta

SEQ ID NO: 41215 - DNA, 25 bp, S. cerevisiae
gtttccaagaattctacttccttca

SEQ ID NO: 41216 - DNA, 25 bp, S. cerevisiae
gtttagcggcttattagaaccctca

SEQ ID NO: 41217 - DNA, 25 bp, S. cerevisiae
gttttcttacaccatcttgttctac

SEQ ID NO: 41218 - DNA, 25 bp, S. cerevisiae
gttttcttttgaactatctggcaag

SEQ ID NO: 41219 - DNA, 25 bp, S. cerevisiae
gtttctgtctctgttttggtcgaca

SEQ ID NO: 41220 - DNA, 25 bp, S. cerevisiae
gttttctccatcttactacgttgta

SEQ ID NO: 41221 - DNA, 25 bp, S. cerevisiae
gttttctccgtcaacgacagttgct

SEQ ID NO: 41222 - DNA, 25 bp, S. cerevisiae
gttttcgccgctgatcgagagaatc

SEQ ID NO: 41223 - DNA, 25 bp, S. cerevisiae
gtttataccccgagatgagaccatt

SEQ ID NO: 41224 - DNA, 25 bp, S. cerevisiae
gtttagtatgttcaggtctcctatt

SEQ ID NO: 41225 - DNA, 25 bp, S. cerevisiae
gttttgttgtctatttgctctcttt

SEQ ID NO: 41226 - DNA, 25 bp, S. cerevisiae
gtttcttgtggtgctgttttttatc

SEQ ID NO: 41227 - DNA, 25 bp, S. cerevisiae
gttttccaggtatgtttttgcaagc

SEQ ID NO: 41228 - DNA, 25 bp, S. cerevisiae
gttttcacggtattgttctcgataa

SEQ ID NO: 41229 - DNA, 25 bp, S. cerevisiae
gtttgcctccgtcggtgtgacaaag

SEQ ID NO: 41230 - DNA, 25 bp, S. cerevisiae
gtttgtccccatcaatcaacaacag

SEQ ID NO: 41231 - DNA, 25 bp, S. cerevisiae
gttttccgcgccaaattattgtggt

SEQ ID NO: 41232 - DNA, 25 bp, S. cerevisiae
gtattaccccagaaaccaggtggtg

SEQ ID NO: 41233 - DNA, 25 bp, S. cerevisiae
gttttcgacaagaacaccagcggta

SEQ ID NO: 41234 - DNA, 25 bp, S. cerevisiae
gtaattcgaaatgccggacgttcat

SEQ ID NO: 41235 - DNA, 25 bp, S. cerevisiae
gtattacaggaacccgaccgtgaca

SEQ ID NO: 41236 - DNA, 25 bp, S. cerevisiae
gtttcctagaggcataccggacatt

SEQ ID NO: 41237 - DNA, 25 bp, S. cerevisiae
gtttcctcacaacttaacgaatctt

SEQ ID NO: 41238 - DNA, 25 bp, S. cerevisiae
tgaccaagtcgaattttacccagtt

SEQ ID NO: 41239 - DNA, 25 bp, S. cerevisiae
gtttacatcgcttggattactgtta

SEQ ID NO: 41240 - DNA, 25 bp, S. cerevisiae
gtttttcgcaaattatgtactacat

SEQ ID NO: 41241 - DNA, 25 bp, S. cerevisiae
gttttctccaaattcagaaccggtg

SEQ ID NO: 41242 - DNA, 25 bp, S. cerevisiae
gtttgtcttcaatacggcagccgtt

SEQ ID NO: 41243 - DNA, 25 bp, S. cerevisiae
gttttctctacccaggtcaagatca

SEQ ID NO: 41244 - DNA, 25 bp, S. cerevisiae
gtttttctaccacaataagcacatg

SEQ ID NO: 41245 - DNA, 25 bp, S. cerevisiae
gttttattacttggattactacgat

SEQ ID NO: 41246 - DNA, 25 bp, S. cerevisiae
gtttcatcatccatacggtgaccat

SEQ ID NO: 41247 - DNA, 25 bp, S. cerevisiae
gtttttgcaccaacgatgatacctg

SEQ ID NO: 41248 - DNA, 25 bp, S. cerevisiae
gttttcccagttgcagaatactctt

SEQ ID NO: 41249 - DNA, 25 bp, S. cerevisiae
gttttactgccgtagaacttgccaa

SEQ ID NO: 41250 - DNA, 25 bp, S. cerevisiae
gttttatttctaaggcctctgccaa

SEQ ID NO: 41251 - DNA, 25 bp, S. cerevisiae
gtttctcaagtcagcggtgttctcc

SEQ ID NO: 41252 - DNA, 25 bp, S. cerevisiae
gttttcctcaacaaagtcactggca

SEQ ID NO: 41253 - DNA, 25 bp, S. cerevisiae
gtattgcctaaactacttcgggaca

SEQ ID NO: 41254 - DNA, 25 bp, S. cerevisiae
gtttttcaattttcgtcacttctat

SEQ ID NO: 41255 - DNA, 25 bp, S. cerevisiae
gttttattgttttccgcacattctc

SEQ ID NO: 41256 - DNA, 25 bp, S. cerevisiae
gtttataacatcctttgcacgcttc

SEQ ID NO: 41257 - DNA, 25 bp, S. cerevisiae
gtttgctgaggacatcgtgactttc

SEQ ID NO: 41258 - DNA, 25 bp, S. cerevisiae
gttttcaaccgccaatcacagtatg

SEQ ID NO: 41259 - DNA, 25 bp, S. cerevisiae
gttttcagaacccattcacagcatc

SEQ ID NO: 41260 - DNA, 25 bp, S. cerevisiae
gtttaatgctttttacagcgccctt

SEQ ID NO: 41261 - DNA, 25 bp, S. cerevisiae
gtttaccttggagtgatatccccat

SEQ ID NO: 41262 - DNA, 25 bp, S. cerevisiae
gtttaaattggtgtcccagcagcaa

SEQ ID NO: 41263 - DNA, 25 bp, S. cerevisiae
gtttaattcatgataggccaggcag

SEQ ID NO: 41264 - DNA, 25 bp, S. cerevisiae
gtttttgaaaccactctgcagaata

SEQ ID NO: 41265 - DNA, 25 bp, S. cerevisiae
gtttatgttccacctcatcatagga

SEQ ID NO: 41266 - DNA, 25 bp, S. cerevisiae
gtttattgtcgatcagcatgcaagt

SEQ ID NO: 41267 - DNA, 25 bp, S. cerevisiae
gtttcttcgttcagcagcagaggtc

SEQ ID NO: 41268 - DNA, 25 bp, S. cerevisiae
gtttccgactaccaaaaggccagtg

SEQ ID NO: 41269 - DNA, 25 bp, S. cerevisiae
gtttttgacaaacatacggcgcaga

SEQ ID NO: 41270 - DNA, 25 bp, S. cerevisiae
gtttattgaaacctccacatacgta

SEQ ID NO: 41271 - DNA, 25 bp, S. cerevisiae
gttttcttaagcctacagtacgatg

SEQ ID NO: 41272 - DNA, 25 bp, S. cerevisiae
gttttctggcatcggtacattcaaa

SEQ ID NO: 41273 - DNA, 25 bp, S. cerevisiae
gtttactggctgacactagctctat

SEQ ID NO: 41274 - DNA, 25 bp, S. cerevisiae
gtttatctaggctaccgtcttcaag

SEQ ID NO: 41275 - DNA, 25 bp, S. cerevisiae
gtttactacttgaccaacatcgatg

SEQ ID NO: 41276 - DNA, 25 bp, S. cerevisiae
gtttcctccttaacagagtatatgt

SEQ ID NO: 41277 - DNA, 25 bp, S. cerevisiae
gtttcccttgtttcggcattagaag

SEQ ID NO: 41278 - DNA, 25 bp, S. cerevisiae
gttttcaccagagacccagagcaaa

SEQ ID NO: 41279 - DNA, 25 bp, S. cerevisiae
gtttgttctcacacagatccctgta

SEQ ID NO: 41280 - DNA, 25 bp, S. cerevisiae
gtttcattatcctattacattatca

SEQ ID NO: 41281 - DNA, 25 bp, S. cerevisiae
gtttttgttaattcagcctcatcaa

SEQ ID NO: 41282 - DNA, 25 bp, S. cerevisiae
gtttttgttcaggtcgcatgtccta

SEQ ID NO: 41283 - DNA, 25 bp, S. cerevisiae
gtttttgtaggtttcatctcgtggt

SEQ ID NO: 41284 - DNA, 25 bp, S. cerevisiae
gtttcgttgggttgcaagcgttgtt

SEQ ID NO: 41285 - DNA, 25 bp, S. cerevisiae
gtttgtcctaaatgcacctgttgtt

SEQ ID NO: 41286 - DNA, 25 bp, S. cerevisiae
gttttcatctatatcttctttctct

SEQ ID NO: 41287 - DNA, 25 bp, S. cerevisiae
gtttgacatttacacaacctcgcac

SEQ ID NO: 41288 - DNA, 25 bp, S. cerevisiae
gtttacttcgattatcaacccacca

SEQ ID NO: 41289 - DNA, 25 bp, S. cerevisiae
gtttgtttaggctataacccaccat

SEQ ID NO: 41290 - DNA, 25 bp, S. cerevisiae
gtttttaaggcctatcatcccgaat

SEQ ID NO: 41291 - DNA, 25 bp, S. cerevisiae
gtttttgaagaattccctgcgctca

SEQ ID NO: 41292 - DNA, 25 bp, S. cerevisiae
gtttttgaacgaatcaccgactcag

SEQ ID NO: 41293 - DNA, 25 bp, S. cerevisiae
gtttttggcaacatgattccgcaca

SEQ ID NO: 41294 - DNA, 25 bp, S. cerevisiae
gttttatctgctaaagacccatcca

SEQ ID NO: 41295 - DNA, 25 bp, S. cerevisiae
gttttttccaagcatgatctctcca

SEQ ID NO: 41296 - DNA, 25 bp, S. cerevisiae
gtttattgcccacaagtttgccagt

SEQ ID NO: 41297 - DNA, 25 bp, S. cerevisiae
gtttctcccacagcggttatcgagg

SEQ ID NO: 41298 - DNA, 25 bp, S. cerevisiae
gtttatcaccagaaagggcttccag

SEQ ID NO: 41299 - DNA, 25 bp, S. cerevisiae
gtttcaacgcgcgaaggcaggtaca

SEQ ID NO: 41300 - DNA, 25 bp, S. cerevisiae
gtttcaagcaccatcctcaagtaag

SEQ ID NO: 41301 - DNA, 25 bp, S. cerevisiae
gtttcaaccgctactatctgcagta

SEQ ID NO: 41302 - DNA, 25 bp, S. cerevisiae
gtttgaagacatcccagattcgcta

SEQ ID NO: 41303 - DNA, 25 bp, S. cerevisiae
gtttgcggagcaactcttggccaat

SEQ ID NO: 41304 - DNA, 25 bp, S. cerevisiae
gttttttcgcgctgtgatactttca

SEQ ID NO: 41305 - DNA, 25 bp, S. cerevisiae
gtttccgatgacgttgattctgatg

SEQ ID NO: 41306 - DNA, 25 bp, S. cerevisiae
gtttcactcggaattgcagtatcta

SEQ ID NO: 41307 - DNA, 25 bp, S. cerevisiae
gtttgagagttgcatcctcgttgga

SEQ ID NO: 41308 - DNA, 25 bp, S. cerevisiae
gtttctgtatgtggtgtacggatta

SEQ ID NO: 41309 - DNA, 25 bp, S. cerevisiae
gtttcccaggaacagacactgctat

SEQ ID NO: 41310 - DNA, 25 bp, S. cerevisiae
gtttctttagaacaatgcagcgtaa

SEQ ID NO: 41311 - DNA, 25 bp, S. cerevisiae
gtttttctcttctttatgacaccaa

SEQ ID NO: 41312 - DNA, 25 bp, S. cerevisiae
gtttttcctgtatttgcgtctgcca

SEQ ID NO: 41313 - DNA, 25 bp, S. cerevisiae
gtttttccagacttatcgttcgcta

SEQ ID NO: 41314 - DNA, 25 bp, S. cerevisiae
gtttttcgatgatctttgtgccgtc

SEQ ID NO: 41315 - DNA, 25 bp, S. cerevisiae
gtttaggcggcatcttattgcatcc

SEQ ID NO: 41316 - DNA, 25 bp, S. cerevisiae
gtaattacgtacaggagcacaggga

SEQ ID NO: 41317 - DNA, 25 bp, S. cerevisiae
gtttctacgctatcaaggacgggtc

SEQ ID NO: 41318 - DNA, 25 bp, S. cerevisiae
gtttgctcaccccagaagaacaagt

SEQ ID NO: 41319 - DNA, 25 bp, S. cerevisiae
gtttgcaacacccaaaagtgcggct

SEQ ID NO: 41320 - DNA, 25 bp, S. cerevisiae
gtttaaccacattccaagagctgag

SEQ ID NO: 41321 - DNA, 25 bp, S. cerevisiae
gtttaccacttgtattcatgccaat

SEQ ID NO: 41322 - DNA, 25 bp, S. cerevisiae
gtttcccttatcttttgccaattat

SEQ ID NO: 41323 - DNA, 25 bp, S. cerevisiae
gtttcttttattgttgctcgttcca

SEQ ID NO: 41324 - DNA, 25 bp, S. cerevisiae
gtcttcgttcttaaaccatggccat

SEQ ID NO: 41325 - DNA, 25 bp, S. cerevisiae
gtttctttgaaagtcgcgattattc

SEQ ID NO: 41326 - DNA, 25 bp, S. cerevisiae
gtttgacgggtttctagacagcgaa

SEQ ID NO: 41327 - DNA, 25 bp, S. cerevisiae
gtttccgtgttaatcaaccgtattg

SEQ ID NO: 41328 - DNA, 25 bp, S. cerevisiae
gtttattttcaccatgctacacctg

SEQ ID NO: 41329 - DNA, 25 bp, S. cerevisiae
gtttgcaatggtgctgtcgctttaa

SEQ ID NO: 41330 - DNA, 25 bp, S. cerevisiae
gtttgataggctacgatccgtggga

SEQ ID NO: 41331 - DNA, 25 bp, S. cerevisiae
gtttatcaggtacttccatggcgtc

SEQ ID NO: 41332 - DNA, 25 bp, S. cerevisiae
gtttcacgaatgtgtctcacttgac

SEQ ID NO: 41333 - DNA, 25 bp, S. cerevisiae
gtttagcaggcttaaccctatacat

SEQ ID NO: 41334 - DNA, 25 bp, S. cerevisiae
gtttacaggtcaaactcctatgtga

SEQ ID NO: 41335 - DNA, 25 bp, S. cerevisiae
gtttattcattttcttcttcgctat

SEQ ID NO: 41336 - DNA, 25 bp, S. cerevisiae
gtttaccaatgacatcgcgtccaat

SEQ ID NO: 41337 - DNA, 25 bp, S. cerevisiae
tatttagctccggttgggccctggg

SEQ ID NO: 41338 - DNA, 25 bp, S. cerevisiae
gtttcacgcgccttttttaatagat

SEQ ID NO: 41339 - DNA, 25 bp, S. cerevisiae
gtttcacgggccattagattctatg

SEQ ID NO: 41340 - DNA, 25 bp, S. cerevisiae
gtttcagaacgtggtgctttcatac

SEQ ID NO: 41341 - DNA, 25 bp, S. cerevisiae
gtcattggtcgtcgtttaccaactg

SEQ ID NO: 41342 - DNA, 25 bp, S. cerevisiae
gtttggtcccgaattcacgaaagca

SEQ ID NO: 41343 - DNA, 25 bp, S. cerevisiae
gtttagcatctccagagttcatcga

SEQ ID NO: 41344 - DNA, 25 bp, S. cerevisiae
gtttggcaaatctgttggtagcgca

SEQ ID NO: 41345 - DNA, 25 bp, S. cerevisiae
gtattgcttacttaaacggtctcct

SEQ ID NO: 41346 - DNA, 25 bp, S. cerevisiae
gtattttatttctgtgctcgggcta

SEQ ID NO: 41347 - DNA, 25 bp, S. cerevisiae
gtttcttaataacgttcctctgcta

SEQ ID NO: 41348 - DNA, 25 bp, S. cerevisiae
gtttcaatagatacaccttccgtga

SEQ ID NO: 41349 - DNA, 25 bp, S. cerevisiae
gtttcaaagcatgatctacctcctg

SEQ ID NO: 41350 - DNA, 25 bp, S. cerevisiae
gtttagacagtgtaaatccctctga

SEQ ID NO: 41351 - DNA, 25 bp, S. cerevisiae
gtttcatcatgaagtatgcccgccg

SEQ ID NO: 41352 - DNA, 25 bp, S. cerevisiae
gtttcggatgtcgagcttacagacg

SEQ ID NO: 41353 - DNA, 25 bp, S. cerevisiae
gtttcactgggcacttccaaaatca

SEQ ID NO: 41354 - DNA, 25 bp, S. cerevisiae
gtttcacttccttttccgtatatat

SEQ ID NO: 41355 - DNA, 25 bp, S. cerevisiae
gtttatttccttctacatccaatct

SEQ ID NO: 41356 - DNA, 25 bp, S. cerevisiae
gtttatgcaaggctgttccaccatt

SEQ ID NO: 41357 - DNA, 25 bp, S. cerevisiae
gtttctgtagggtttctcctcatat

SEQ ID NO: 41358 - DNA, 25 bp, S. cerevisiae
gtttgaaagctggtacgaccgtgat

SEQ ID NO: 41359 - DNA, 25 bp, S. cerevisiae
gtagtaagactagttccaccgcttc

SEQ ID NO: 41360 - DNA, 25 bp, S. cerevisiae
gtttaagactcagatctcatcccgc

SEQ ID NO: 41361 - DNA, 25 bp, S. cerevisiae
gtttcaagataatagtggcgccatt

SEQ ID NO: 41362 - DNA, 25 bp, S. cerevisiae
gtttcaacttcaagctgtcaaccag

SEQ ID NO: 41363 - DNA, 25 bp, S. cerevisiae
gtttcagacagttcaggacatccca

SEQ ID NO: 41364 - DNA, 25 bp, S. cerevisiae
gtttcatacagttgagcgacgccta

SEQ ID NO: 41365 - DNA, 25 bp, S. cerevisiae
gtttatacacgttgcagaccactgc

SEQ ID NO: 41366 - DNA, 25 bp, S. cerevisiae
gtttacattccctattgctcattgc

SEQ ID NO: 41367 - DNA, 25 bp, S. cerevisiae
gtttatgctgacatcgacacgttcc

SEQ ID NO: 41368 - DNA, 25 bp, S. cerevisiae
gtatactcaggagccagcgggacca

SEQ ID NO: 41369 - DNA, 25 bp, S. cerevisiae
gtattccaagaaccagcgcgacaag

SEQ ID NO: 41370 - DNA, 25 bp, S. cerevisiae
gtttcaccaagcactatcagcacgg

SEQ ID NO: 41371 - DNA, 25 bp, S. cerevisiae
gtttcatccaaattcactaccatac

SEQ ID NO: 41372 - DNA, 25 bp, S. cerevisiae
gtttatcgcaatactcaaaggtcca

SEQ ID NO: 41373 - DNA, 25 bp, S. cerevisiae
gtttactgcgaaacctgttcatcca

SEQ ID NO: 41374 - DNA, 25 bp, S. cerevisiae
gtttgtggtggtacttcttcattga

SEQ ID NO: 41375 - DNA, 25 bp, S. cerevisiae
gtttatgcattggtttccctctata

SEQ ID NO: 41376 - DNA, 25 bp, S. cerevisiae
gtttcatcattactataccgtttat

SEQ ID NO: 41377 - DNA, 25 bp, S. cerevisiae
gtttcactatcgtatatggcttttc

SEQ ID NO: 41378 - DNA, 25 bp, S. cerevisiae
gtttccaatggccaagttttctcca

SEQ ID NO: 41379 - DNA, 25 bp, S. cerevisiae
gtttctgccatcgtttattttacca

SEQ ID NO: 41380 - DNA, 25 bp, S. cerevisiae
gtttccctggttacgtgttcaagca

SEQ ID NO: 41381 - DNA, 25 bp, S. cerevisiae
gtttctcaagatcgcacctgtatta

SEQ ID NO: 41382 - DNA, 25 bp, S. cerevisiae
gtttctctacatccgtgcattatta

SEQ ID NO: 41383 - DNA, 25 bp, S. cerevisiae
gtttccgaatctggttccgaatctg

SEQ ID NO: 41384 - DNA, 25 bp, S. cerevisiae
gtttcgattatcttcttcaattaac

SEQ ID NO: 41385 - DNA, 25 bp, S. cerevisiae
gtttacagcctgagacatctatgga

SEQ ID NO: 41386 - DNA, 25 bp, S. cerevisiae
gtcttgagtcgctggactcgggaca

SEQ ID NO: 41387 - DNA, 25 bp, S. cerevisiae
gtattggctgggagtccaccgaaca

SEQ ID NO: 41388 - DNA, 25 bp, S. cerevisiae
gtttcgttgttttccagcagtgaac

SEQ ID NO: 41389 - DNA, 25 bp, S. cerevisiae
gtttggtcgtaattcccagtggtgt

SEQ ID NO: 41390 - DNA, 25 bp, S. cerevisiae
gtattggttttattgcagtcggtat

SEQ ID NO: 41391 - DNA, 25 bp, S. cerevisiae
gtttggtttctctgggtacatcatc

SEQ ID NO: 41392 - DNA, 25 bp, S. cerevisiae
gtattgacatcgtcattcgctccag

SEQ ID NO: 41393 - DNA, 25 bp, S. cerevisiae
gtttcacttgattgtgagctccaaa

SEQ ID NO: 41394 - DNA, 25 bp, S. cerevisiae
gtttaatgctttggcctgcagacat

SEQ ID NO: 41395 - DNA, 25 bp, S. cerevisiae
gtttgcagatggctccctgagagta

SEQ ID NO: 41396 - DNA, 25 bp, S. cerevisiae
gtttggcactgtcaaccaggcagaa

SEQ ID NO: 41397 - DNA, 25 bp, S. cerevisiae
gtttggacttcatcaatgcactcga

SEQ ID NO: 41398 - DNA, 25 bp, S. cerevisiae
gtttctaccattttgcgaattcgtg

SEQ ID NO: 41399 - DNA, 25 bp, S. cerevisiae
gtttgcaactcactttcatgaattg

SEQ ID NO: 41400 - DNA, 25 bp, S. cerevisiae
gtttcaacgcatttgctgctttgga

SEQ ID NO: 41401 - DNA, 25 bp, S. cerevisiae
gtttcaatcaagttctgttgtgcca

SEQ ID NO: 41402 - DNA, 25 bp, S. cerevisiae
gtttccatcttctcttagagccaag

SEQ ID NO: 41403 - DNA, 25 bp, S. cerevisiae
gtttgcccctcatgatcttgggtaa

SEQ ID NO: 41404 - DNA, 25 bp, S. cerevisiae
gtatagttcctttatttgagatccg

SEQ ID NO: 41405 - DNA, 25 bp, S. cerevisiae
gtttgcctttttggtgattggaata

SEQ ID NO: 41406 - DNA, 25 bp, S. cerevisiae
gtttccgctggaaggagacgccgaa

SEQ ID NO: 41407 - DNA, 25 bp, S. cerevisiae
gtttgctaaaatttcagatcgcggt

SEQ ID NO: 41408 - DNA, 25 bp, S. cerevisiae
gtttgctaaggatcaagtcgcagac

SEQ ID NO: 41409 - DNA, 25 bp, S. cerevisiae
gtattgtaaagatccagtctccaga

SEQ ID NO: 41410 - DNA, 25 bp, S. cerevisiae
gtttcaggtagactgccgtcatcaa

SEQ ID NO: 41411 - DNA, 25 bp, S. cerevisiae
gtttcactcccaatctcgatggaat

SEQ ID NO: 41412 - DNA, 25 bp, S. cerevisiae
gtttccgtgacaatatcgagaccag

SEQ ID NO: 41413 - DNA, 25 bp, S. cerevisiae
gtttccctgcatacttcaagttcag

SEQ ID NO: 41414 - DNA, 25 bp, S. cerevisiae
gtttctgcccatactacacatttag

SEQ ID NO: 41415 - DNA, 25 bp, S. cerevisiae
gtttcttccatgctactaccaagaa

SEQ ID NO: 41416 - DNA, 25 bp, S. cerevisiae
gtttccgggaattcaccaaatgcga

SEQ ID NO: 41417 - DNA, 25 bp, S. cerevisiae
gtttctccaggttacactcatttaa

SEQ ID NO: 41418 - DNA, 25 bp, S. cerevisiae
gtttctcttctttatgcctcatttt

SEQ ID NO: 41419 - DNA, 25 bp, S. cerevisiae
gtttctcttcttctagtaatggcca

SEQ ID NO: 41420 - DNA, 25 bp, S. cerevisiae
gtttccatccaaggtttcaaggccg

SEQ ID NO: 41421 - DNA, 25 bp, S. cerevisiae
gtttcgccaaacgtcgtaagagctc

SEQ ID NO: 41422 - DNA, 25 bp, S. cerevisiae
gtttccgcatactgtggttccaaga

SEQ ID NO: 41423 - DNA, 25 bp, S. cerevisiae
gtttcggcacactgtataactcata

SEQ ID NO: 41424 - DNA, 25 bp, S. cerevisiae
gtttctggaccttttggatctaaat

SEQ ID NO: 41425 - DNA, 25 bp, S. cerevisiae
gtttctcaaccttttgtcatcccat

SEQ ID NO: 41426 - DNA, 25 bp, S. cerevisiae
gtttggctccagagttaagctgtta

SEQ ID NO: 41427 - DNA, 25 bp, S. cerevisiae
gtttggtggatgctcttgatacttt

SEQ ID NO: 41428 - DNA, 25 bp, S. cerevisiae
gtttcggtttctctgtgatgttttc

SEQ ID NO: 41429 - DNA, 25 bp, S. cerevisiae
gtttggctgacttgcaaggttctga

SEQ ID NO: 41430 - DNA, 25 bp, S. cerevisiae
gtctaggattcttacaggacttaag

SEQ ID NO: 41431 - DNA, 25 bp, S. cerevisiae
gtataggcaggcgtacgggctaaat

SEQ ID NO: 41432 - DNA, 25 bp, S. cerevisiae
gtttgatcgcgaggacgggcaacat

SEQ ID NO: 41433 - DNA, 25 bp, S. cerevisiae
gtttcattgccatccaggccattag

SEQ ID NO: 41434 - DNA, 25 bp, S. cerevisiae
gtttcttctgctgaatatgcactac

SEQ ID NO: 41435 - DNA, 25 bp, S. cerevisiae
gtttctgccctttatatcaccaaga

SEQ ID NO: 41436 - DNA, 25 bp, S. cerevisiae
gtttgccggtgttatcatcctacaa

SEQ ID NO: 41437 - DNA, 25 bp, S. cerevisiae
gtttgcgggttcaattgttgctcat

SEQ ID NO: 41438 - DNA, 25 bp, S. cerevisiae
gtttctgtattgacgatggacccac

SEQ ID NO: 41439 - DNA, 25 bp, S. cerevisiae
gtttcgctattagagctgtgtccac

SEQ ID NO: 41440 - DNA, 25 bp, S. cerevisiae
gtttcatgtgtttgtttgtgctgca

SEQ ID NO: 41441 - DNA, 25 bp, S. cerevisiae
gtttctggcttgtatctatgtgtca

SEQ ID NO: 41442 - DNA, 25 bp, S. cerevisiae
gtattttttgcctgaagtcactggt

SEQ ID NO: 41443 - DNA, 25 bp, S. cerevisiae
gtttctccatccttacaagattcgg

SEQ ID NO: 41444 - DNA, 25 bp, S. cerevisiae
gtttccccaatgatctggcatttgg

SEQ ID NO: 41445 - DNA, 25 bp, S. cerevisiae
gtttcgacgcaattttgcttgcatt

SEQ ID NO: 41446 - DNA, 25 bp, S. cerevisiae
gtttgaagtccatttgattccttta

SEQ ID NO: 41447 - DNA, 25 bp, S. cerevisiae
gtttgaaccacgttgttgccttgat

SEQ ID NO: 41448 - DNA, 25 bp, S. cerevisiae
gtattgtacgactttttcctcgagg

SEQ ID NO: 41449 - DNA, 25 bp, S. cerevisiae
gtttgtaaattttccatccatcgtg

SEQ ID NO: 41450 - DNA, 25 bp, S. cerevisiae
gtttggagaccactacctacatttt

SEQ ID NO: 41451 - DNA, 25 bp, S. cerevisiae
gtttggccactttgttgggtcacaa

SEQ ID NO: 41452 - DNA, 25 bp, S. cerevisiae
gtttggatctgtcaacttcaaccag

SEQ ID NO: 41453 - DNA, 25 bp, S. cerevisiae
gtttctgcacctttactttacttca

SEQ ID NO: 41454 - DNA, 25 bp, S. cerevisiae
gtattcttaaccatccagttccgaa

SEQ ID NO: 41455 - DNA, 25 bp, S. cerevisiae
gtaatcaagtgagaggccgttccta

SEQ ID NO: 41456 - DNA, 25 bp, S. cerevisiae
gtttctaagatccttatcgaggtca

SEQ ID NO: 41457 - DNA, 25 bp, S. cerevisiae
gtattttggtcacctgtcgcggcaa

SEQ ID NO: 41458 - DNA, 25 bp, S. cerevisiae
gtttcattctcctggtcgcgccaga

SEQ ID NO: 41459 - DNA, 25 bp, S. cerevisiae
gtttgcttcccaagaactgatccaa

SEQ ID NO: 41460 - DNA, 25 bp, S. cerevisiae
gtttgaccccataaatttcgccact

SEQ ID NO: 41461 - DNA, 25 bp, S. cerevisiae
gtagtacccgcaataataatagcgc

SEQ ID NO: 41462 - DNA, 25 bp, S. cerevisiae
gtataactgcccttaatacatacgt

SEQ ID NO: 41463 - DNA, 25 bp, S. cerevisiae
gtacagacaaatgggccgcaacggc

SEQ ID NO: 41464 - DNA, 25 bp, S. cerevisiae
gtatcaaactgacaccagaacagat

SEQ ID NO: 41465 - DNA, 25 bp, S. cerevisiae
gtatagcaacttttcggagagcata

SEQ ID NO: 41466 - DNA, 25 bp, S. cerevisiae
gtatgcgtacagattgccgaactat

SEQ ID NO: 41467 - DNA, 25 bp, S. cerevisiae
gtatcaaacgttgtccacagtagtt

SEQ ID NO: 41468 - DNA, 25 bp, S. cerevisiae
gtatctgacatctttggagaagctg

SEQ ID NO: 41469 - DNA, 25 bp, S. cerevisiae
gtatttttagcacctcgaatgccct

SEQ ID NO: 41470 - DNA, 25 bp, S. cerevisiae
gtattttcggcactcttggtcttcg

SEQ ID NO: 41471 - DNA, 25 bp, S. cerevisiae
gtatcgttccacctttgaatttctg

SEQ ID NO: 41472 - DNA, 25 bp, S. cerevisiae
gtatatcttcgttattttatttcgt

SEQ ID NO: 41473 - DNA, 25 bp, S. cerevisiae
gtatactaaagtattgcttcctttg

SEQ ID NO: 41474 - DNA, 25 bp, S. cerevisiae
gtatgactgtactgttgctgacccg

SEQ ID NO: 41475 - DNA, 25 bp, S. cerevisiae
gtatactgtgagttctactgagtca

SEQ ID NO: 41476 - DNA, 25 bp, S. cerevisiae
gtattggtagagaatcaggcgacac

SEQ ID NO: 41477 - DNA, 25 bp, S. cerevisiae
gtataggcatagtaagcggtacctt

SEQ ID NO: 41478 - DNA, 25 bp, S. cerevisiae
gtataccgagccaaagaatcccatt

SEQ ID NO: 41479 - DNA, 25 bp, S. cerevisiae
gtatctcctgcacaaaaacgtctta

SEQ ID NO: 41480 - DNA, 25 bp, S. cerevisiae
gtgtatcgggaccaaaccatgttca

SEQ ID NO: 41481 - DNA, 25 bp, S. cerevisiae
gtattctgcggctcggacaatttgc

SEQ ID NO: 41482 - DNA, 25 bp, S. cerevisiae
gtttgccaatgctaatagggtcttc

SEQ ID NO: 41483 - DNA, 25 bp, S. cerevisiae
gtttctttcgaaatgtgggcgctgc

SEQ ID NO: 41484 - DNA, 25 bp, S. cerevisiae
gtattctcgagcagtactgtgcgcc

SEQ ID NO: 41485 - DNA, 25 bp, S. cerevisiae
gtatatgctgcaccatggatatgct

SEQ ID NO: 41486 - DNA, 25 bp, S. cerevisiae
gtttcgatcaatccaccaacgttaa

SEQ ID NO: 41487 - DNA, 25 bp, S. cerevisiae
gtttctgaacatctctaactcctaa

SEQ ID NO: 41488 - DNA, 25 bp, S. cerevisiae
gtttcgaagatttcttgactcctca

SEQ ID NO: 41489 - DNA, 25 bp, S. cerevisiae
gtttccacagattctaaccctgttg

SEQ ID NO: 41490 - DNA, 25 bp, S. cerevisiae
gtttccactgagtcgaaggaccttc

SEQ ID NO: 41491 - DNA, 25 bp, S. cerevisiae
gtttctcttcagtagcaacgaccat

SEQ ID NO: 41492 - DNA, 25 bp, S. cerevisiae
gtattccctgtggaaagtcacctac

SEQ ID NO: 41493 - DNA, 25 bp, S. cerevisiae
gtttgaaggcgtttcgtcaccaata

SEQ ID NO: 41494 - DNA, 25 bp, S. cerevisiae
gtttgcaccagcgtattggttccaa

SEQ ID NO: 41495 - DNA, 25 bp, S. cerevisiae
gtttctgctcaattgttgtttccaa

SEQ ID NO: 41496 - DNA, 25 bp, S. cerevisiae
gtttctcattatgccagatctgctg

SEQ ID NO: 41497 - DNA, 25 bp, S. cerevisiae
gtttccattcacatctgacgataca

SEQ ID NO: 41498 - DNA, 25 bp, S. cerevisiae
gtttgccattcacctccaagagaat

SEQ ID NO: 41499 - DNA, 25 bp, S. cerevisiae
gtttgccatcattgcctcaaggaga

SEQ ID NO: 41500 - DNA, 25 bp, S. cerevisiae
gtttcccatcttcatatggatgcag

SEQ ID NO: 41501 - DNA, 25 bp, S. cerevisiae
gtttcccatcttatataaggggatg

SEQ ID NO: 41502 - DNA, 25 bp, S. cerevisiae
gtatactaccgtcataagattcgat

SEQ ID NO: 41503 - DNA, 25 bp, S. cerevisiae
gtttccatccgtggtaagatcttga

SEQ ID NO: 41504 - DNA, 25 bp, S. cerevisiae
gtttgtctactgaagctggtcatat

SEQ ID NO: 41505 - DNA, 25 bp, S. cerevisiae
gtttcgctatactgactgacttgca

SEQ ID NO: 41506 - DNA, 25 bp, S. cerevisiae
gtattgcctacgtctacagagcctc

SEQ ID NO: 41507 - DNA, 25 bp, S. cerevisiae
gtattgctcacagactgaagaccat

SEQ ID NO: 41508 - DNA, 25 bp, S. cerevisiae
gtttccacactttgcaagatcctac

SEQ ID NO: 41509 - DNA, 25 bp, S. cerevisiae
gtttgccgacgtggtgaactcacaa

SEQ ID NO: 41510 - DNA, 25 bp, S. cerevisiae
gtttggcgctcgttatcaaccacaa

SEQ ID NO: 41511 - DNA, 25 bp, S. cerevisiae
gtttgtctcttatatacagccggaa

SEQ ID NO: 41512 - DNA, 25 bp, S. cerevisiae
gtttgtccttatgcaacgctggtaa

SEQ ID NO: 41513 - DNA, 25 bp, S. cerevisiae
gtattcagtattgtccaccgattta

SEQ ID NO: 41514 - DNA, 25 bp, S. cerevisiae
gtttgcgttgtgttccatttcattt

SEQ ID NO: 41515 - DNA, 25 bp, S. cerevisiae
gtttccgctcaacctagttggttag

SEQ ID NO: 41516 - DNA, 25 bp, S. cerevisiae
gtttccggcgcacctattgtaagga

SEQ ID NO: 41517 - DNA, 25 bp, S. cerevisiae
gtatacgcccacatcgttggatgga

SEQ ID NO: 41518 - DNA, 25 bp, S. cerevisiae
gtttcccattgattcctagtggcta

SEQ ID NO: 41519 - DNA, 25 bp, S. cerevisiae
gtttcctatatttgttcacggtact

SEQ ID NO: 41520 - DNA, 25 bp, S. cerevisiae
gtttccatgatgtttactacgtcta

SEQ ID NO: 41521 - DNA, 25 bp, S. cerevisiae
gtttgctgctatgttactgttctgt

SEQ ID NO: 41522 - DNA, 25 bp, S. cerevisiae
gtttcgttgcaaaatttctcctcca

SEQ ID NO: 41523 - DNA, 25 bp, S. cerevisiae
gtattagatcgacacttttcccaaa

SEQ ID NO: 41524 - DNA, 25 bp, S. cerevisiae
gtattcttggacaacgtttctccat

SEQ ID NO: 41525 - DNA, 25 bp, S. cerevisiae
gtttgtcacaatcttttcagcacca

SEQ ID NO: 41526 - DNA, 25 bp, S. cerevisiae
gtatttcatactgtatcttccccta

SEQ ID NO: 41527 - DNA, 25 bp, S. cerevisiae
gtatttatacggcaggtcatccaat

SEQ ID NO: 41528 - DNA, 25 bp, S. cerevisiae
gtatttaccctgcagtggatccatt

SEQ ID NO: 41529 - DNA, 25 bp, S. cerevisiae
gtttgtaccgctacaggtcatacgg

SEQ ID NO: 41530 - DNA, 25 bp, S. cerevisiae
gtttgcctcccgttttatgcaatta

SEQ ID NO: 41531 - DNA, 25 bp, S. cerevisiae
gtttgccgtaagtgttatgctagat

SEQ ID NO: 41532 - DNA, 25 bp, S. cerevisiae
gtttgatcttaaccatgggctcatt

SEQ ID NO: 41533 - DNA, 25 bp, S. cerevisiae
gtttgaattccactttggctgctac

SEQ ID NO: 41534 - DNA, 25 bp, S. cerevisiae
gtttgaagtcgccattggtctcaat

SEQ ID NO: 41535 - DNA, 25 bp, S. cerevisiae
gtttgccagtgctagaaggtcacca

SEQ ID NO: 41536 - DNA, 25 bp, S. cerevisiae
gtttccggtcatagattatccacat

SEQ ID NO: 41537 - DNA, 25 bp, S. cerevisiae
gtttgccgatgacttgtccaattct

SEQ ID NO: 41538 - DNA, 25 bp, S. cerevisiae
gtttgcatagttcagcgccaatctt

SEQ ID NO: 41539 - DNA, 25 bp, S. cerevisiae
gtttgcatctgcttacatgttctgg

SEQ ID NO: 41540 - DNA, 25 bp, S. cerevisiae
gtttgcgcactgataatacacgtta

SEQ ID NO: 41541 - DNA, 25 bp, S. cerevisiae
gtttgccctagatatcaacgcttat

SEQ ID NO: 41542 - DNA, 25 bp, S. cerevisiae
gtttgccgttctatcaacactaaga

SEQ ID NO: 41543 - DNA, 25 bp, S. cerevisiae
gtttgtccgtcttatttgtcatgca

SEQ ID NO: 41544 - DNA, 25 bp, S. cerevisiae
gtattttctattgtttctgcccttt

SEQ ID NO: 41545 - DNA, 25 bp, S. cerevisiae
gtaagggcggccactactatttccg

SEQ ID NO: 41546 - DNA, 25 bp, S. cerevisiae
tgataaggtggtccctccattttac

SEQ ID NO: 41547 - DNA, 25 bp, S. cerevisiae
gtaccaccctcaaggagaggagctt

SEQ ID NO: 41548 - DNA, 25 bp, S. cerevisiae
gtatcccggcttaggacttgagttt

SEQ ID NO: 41549 - DNA, 25 bp, S. cerevisiae
gtattcagtcgtccgaaagcctgtt

SEQ ID NO: 41550 - DNA, 25 bp, S. cerevisiae
gtatccatggtctcgaaacctagtg

SEQ ID NO: 41551 - DNA, 25 bp, S. cerevisiae
gtgttttcccagtttaccagtatgc

SEQ ID NO: 41552 - DNA, 25 bp, S. cerevisiae
gtttggtaccatttctttgcacaat

SEQ ID NO: 41553 - DNA, 25 bp, S. cerevisiae
gtatatcgtactttgcttccacgtc

SEQ ID NO: 41554 - DNA, 25 bp, S. cerevisiae
gtattgttcctatctgtcggtttca

SEQ ID NO: 41555 - DNA, 25 bp, S. cerevisiae
gtatctgttttatccggtcattcca

SEQ ID NO: 41556 - DNA, 25 bp, S. cerevisiae
gtttgattgaattgtccggtgggca

SEQ ID NO: 41557 - DNA, 25 bp, S. cerevisiae
gtatttctgctcacgacaggtcgat

SEQ ID NO: 41558 - DNA, 25 bp, S. cerevisiae
gtacgaggtcatcactcaagtggac

SEQ ID NO: 41559 - DNA, 25 bp, S. cerevisiae
gtcgcaacgcgatggtacagggcac

SEQ ID NO: 41560 - DNA, 25 bp, S. cerevisiae
gtagcatacctgtggtaagggcgca

SEQ ID NO: 41561 - DNA, 25 bp, S. cerevisiae
gtacatacccaccactaaggaagct

SEQ ID NO: 41562 - DNA, 25 bp, S. cerevisiae
gtattacgctagatggactgcttaa

SEQ ID NO: 41563 - DNA, 25 bp, S. cerevisiae
gtttgcagcaaatttccacgctaag

SEQ ID NO: 41564 - DNA, 25 bp, S. cerevisiae
gtatcaatgcctggcgttcagtgat

SEQ ID NO: 41565 - DNA, 25 bp, S. cerevisiae
gtattgcccatcattgagtacgagg

SEQ ID NO: 41566 - DNA, 25 bp, S. cerevisiae
gtattttctcatgtagctagttggg

SEQ ID NO: 41567 - DNA, 25 bp, S. cerevisiae
gtattttggctttaccacttggtgt

SEQ ID NO: 41568 - DNA, 25 bp, S. cerevisiae
gtatttgtccttgacctctctaata

SEQ ID NO: 41569 - DNA, 25 bp, S. cerevisiae
gtattagccaccaattctaccaaca

SEQ ID NO: 41570 - DNA, 25 bp, S. cerevisiae
gtatataccaggctattttgcggat

SEQ ID NO: 41571 - DNA, 25 bp, S. cerevisiae
gtatcacgaccgttcctgatttgac

SEQ ID NO: 41572 - DNA, 25 bp, S. cerevisiae
gtttggctccagaagtacatcagca

SEQ ID NO: 41573 - DNA, 25 bp, S. cerevisiae
gtttgtcccagctgctcactgatga

SEQ ID NO: 41574 - DNA, 25 bp, S. cerevisiae
gtttggtcccattgtaactgtatcc

SEQ ID NO: 41575 - DNA, 25 bp, S. cerevisiae
gtttggtccgtactactttatcagt

SEQ ID NO: 41576 - DNA, 25 bp, S. cerevisiae
gtattcttccacaatcaacgattat

SEQ ID NO: 41577 - DNA, 25 bp, S. cerevisiae
gtattcttaccaacgagctaggaca

SEQ ID NO: 41578 - DNA, 25 bp, S. cerevisiae
gtatacttcaaaactgatccaggcg

SEQ ID NO: 41579 - DNA, 25 bp, S. cerevisiae
gtattttaacagatcctcaggccaa

SEQ ID NO: 41580 - DNA, 25 bp, S. cerevisiae
gtttgctgagagtcaagttccccga

SEQ ID NO: 41581 - DNA, 25 bp, S. cerevisiae
gtatcttgaaggttactgccgtcga

SEQ ID NO: 41582 - DNA, 25 bp, S. cerevisiae
gtattcataaggtgcccaagtggac

SEQ ID NO: 41583 - DNA, 25 bp, S. cerevisiae
gtattaaaagacctcactcgtgggt

SEQ ID NO: 41584 - DNA, 25 bp, S. cerevisiae
tgtagtcaaacgtgaagccgggctt

SEQ ID NO: 41585 - DNA, 25 bp, S. cerevisiae
gtagaactaggtcatcgcagccggc

SEQ ID NO: 41586 - DNA, 25 bp, S. cerevisiae
gtatacgtaactcacggcggcagca

SEQ ID NO: 41587 - DNA, 25 bp, S. cerevisiae
gtattcatccacatgtctttttgcc

SEQ ID NO: 41588 - DNA, 25 bp, S. cerevisiae
gtttggctcaatcactggacactat

SEQ ID NO: 41589 - DNA, 25 bp, S. cerevisiae
gtttgtgccaatgactgatgacttt

SEQ ID NO: 41590 - DNA, 25 bp, S. cerevisiae
gtagatgaagaattgggtccctcca

SEQ ID NO: 41591 - DNA, 25 bp, S. cerevisiae
gtagaataattcaggcgcttccgcc

SEQ ID NO: 41592 - DNA, 25 bp, S. cerevisiae
gtatcatattggcacggctgtcctc

SEQ ID NO: 41593 - DNA, 25 bp, S. cerevisiae
gtatcttgccaggtggtggtactgc

SEQ ID NO: 41594 - DNA, 25 bp, S. cerevisiae
gtatagtttcaagacatgcacgata

SEQ ID NO: 41595 - DNA, 25 bp, S. cerevisiae
taatgaccctagtgcctcgttagtg

SEQ ID NO: 41596 - DNA, 25 bp, S. cerevisiae
gtatgcccctagtgttcagttgaat

SEQ ID NO: 41597 - DNA, 25 bp, S. cerevisiae
gtatgctatcgaaacctgaaacttt

SEQ ID NO: 41598 - DNA, 25 bp, S. cerevisiae
gtatcgtctaaacctgaaccaattg

SEQ ID NO: 41599 - DNA, 25 bp, S. cerevisiae
gtatttgctcaaagtcaaccctatt

SEQ ID NO: 41600 - DNA, 25 bp, S. cerevisiae
gtttgttgccatttagagcgcctat

SEQ ID NO: 41601 - DNA, 25 bp, S. cerevisiae
gtattattcaaccaagtccgattca

SEQ ID NO: 41602 - DNA, 25 bp, S. cerevisiae
gtttgaatctaacgtgtgcttccca

SEQ ID NO: 41603 - DNA, 25 bp, S. cerevisiae
gtttggcagttattgcttcctccaa

SEQ ID NO: 41604 - DNA, 25 bp, S. cerevisiae
gtagaagttccgttatttgttcaat

SEQ ID NO: 41605 - DNA, 25 bp, S. cerevisiae
gtctcaaccacctctttggtttgga

SEQ ID NO: 41606 - DNA, 25 bp, S. cerevisiae
gtcttcctcgtcagttttttatgga

SEQ ID NO: 41607 - DNA, 25 bp, S. cerevisiae
gtttggacgtccttctacattaata

SEQ ID NO: 41608 - DNA, 25 bp, S. cerevisiae
gtattggtggataccccactggcac

SEQ ID NO: 41609 - DNA, 25 bp, S. cerevisiae
gtttgattgatgatgccgccactga

SEQ ID NO: 41610 - DNA, 25 bp, S. cerevisiae
gtttgcattttccagcatcactgat

SEQ ID NO: 41611 - DNA, 25 bp, S. cerevisiae
gtttgcttatattttcccgactgaa

SEQ ID NO: 41612 - DNA, 25 bp, S. cerevisiae
gtatctgtaaacgtcccactgaacc

SEQ ID NO: 41613 - DNA, 25 bp, S. cerevisiae
gtatcaaaacctacacccgtaatca

SEQ ID NO: 41614 - DNA, 25 bp, S. cerevisiae
gtagaagggcgcttacctacaacca

SEQ ID NO: 41615 - DNA, 25 bp, S. cerevisiae
gtattagggcgctaactgctgccga

SEQ ID NO: 41616 - DNA, 25 bp, S. cerevisiae
gtattagtgcgtttcccgtagacga

SEQ ID NO: 41617 - DNA, 25 bp, S. cerevisiae
gtattggcgaggttatccctaacga

SEQ ID NO: 41618 - DNA, 25 bp, S. cerevisiae
gtattgctgatattgtgaaccctaa

SEQ ID NO: 41619 - DNA, 25 bp, S. cerevisiae
gtttgtatactgaatcacccattag

SEQ ID NO: 41620 - DNA, 25 bp, S. cerevisiae
gtatttgtactaattgctgcgttac

SEQ ID NO: 41621 - DNA, 25 bp, S. cerevisiae
gtatttttctaggtgagggctcatc

SEQ ID NO: 41622 - DNA, 25 bp, S. cerevisiae
gtatttctttagttctgaccgagcc

SEQ ID NO: 41623 - DNA, 25 bp, S. cerevisiae
gtattgttccaaatgacggcagaaa

SEQ ID NO: 41624 - DNA, 25 bp, S. cerevisiae
gtttgagaatgccacaccagcagaa

SEQ ID NO: 41625 - DNA, 25 bp, S. cerevisiae
gtattatcaatcctgaaaggcaaag

SEQ ID NO: 41626 - DNA, 25 bp, S. cerevisiae
gtattgtcacttccaattggctcac

SEQ ID NO: 41627 - DNA, 25 bp, S. cerevisiae
gtataacactaccagacgactacat

SEQ ID NO: 41628 - DNA, 25 bp, S. cerevisiae
gtatagatactaacaacgccatcgt

SEQ ID NO: 41629 - DNA, 25 bp, S. cerevisiae
gtattcacctcctgaaatccatgtc

SEQ ID NO: 41630 - DNA, 25 bp, S. cerevisiae
gtattctctcatgtggtgaagtcca

SEQ ID NO: 41631 - DNA, 25 bp, S. cerevisiae
gtattccgtcgatttaagttctcaa

SEQ ID NO: 41632 - DNA, 25 bp, S. cerevisiae
gtattcatccggtcgtaagttctaa

SEQ ID NO: 41633 - DNA, 25 bp, S. cerevisiae
gtatttgggaacctgaagtcatcaa

SEQ ID NO: 41634 - DNA, 25 bp, S. cerevisiae
gtatggtaacaagtggaggctcaat

SEQ ID NO: 41635 - DNA, 25 bp, S. cerevisiae
gtatggttactcaatggcaatccct

SEQ ID NO: 41636 - DNA, 25 bp, S. cerevisiae
gtttgtacaatcactggtgtgcact

SEQ ID NO: 41637 - DNA, 25 bp, S. cerevisiae
gtattggccaagaatcaccggttat

SEQ ID NO: 41638 - DNA, 25 bp, S. cerevisiae
gtattgtcaaatccaccgggtatga

SEQ ID NO: 41639 - DNA, 25 bp, S. cerevisiae
gtataacaacattgaccccggtcag

SEQ ID NO: 41640 - DNA, 25 bp, S. cerevisiae
gtataccaaattccagtacaggcac

SEQ ID NO: 41641 - DNA, 25 bp, S. cerevisiae
gtataccgtattattaagagtgcaa

SEQ ID NO: 41642 - DNA, 25 bp, S. cerevisiae
gtatccactgtacaatttgagccga

SEQ ID NO: 41643 - DNA, 25 bp, S. cerevisiae
gtattgtcgctgttggtttatgtaa

SEQ ID NO: 41644 - DNA, 25 bp, S. cerevisiae
gtattccttggttgctattggtgaa

SEQ ID NO: 41645 - DNA, 25 bp, S. cerevisiae
gtttgattcatcagctgcggtacag

SEQ ID NO: 41646 - DNA, 25 bp, S. cerevisiae
gtattgccggtgttgtctgctcaga

SEQ ID NO: 41647 - DNA, 25 bp, S. cerevisiae
gtattggtacagtccttgcatatta

SEQ ID NO: 41648 - DNA, 25 bp, S. cerevisiae
gtatctgcgtagtgtcagcctttgg

SEQ ID NO: 41649 - DNA, 25 bp, S. cerevisiae
gtattcagaacaggctcacactttc

SEQ ID NO: 41650 - DNA, 25 bp, S. cerevisiae
gtattagacacacagacccatttgg

SEQ ID NO: 41651 - DNA, 25 bp, S. cerevisiae
gtataacaactccaacccattcatg

SEQ ID NO: 41652 - DNA, 25 bp, S. cerevisiae
gtataacagggtcgactgccactca

SEQ ID NO: 41653 - DNA, 25 bp, S. cerevisiae
gtatataccactctcaagttaccct

SEQ ID NO: 41654 - DNA, 25 bp, S. cerevisiae
gtattccccattgaagctgtacgat

SEQ ID NO: 41655 - DNA, 25 bp, S. cerevisiae
gtattctcccacttatctttacaga

SEQ ID NO: 41656 - DNA, 25 bp, S. cerevisiae
gtatttgacaggtttggctcataac

SEQ ID NO: 41657 - DNA, 25 bp, S. cerevisiae
gtattgtgacggtctattccaccat

SEQ ID NO: 41658 - DNA, 25 bp, S. cerevisiae
gtatttcccaattttgccacattgt

SEQ ID NO: 41659 - DNA, 25 bp, S. cerevisiae
gtatacggccatgtctggatacgaa

SEQ ID NO: 41660 - DNA, 25 bp, S. cerevisiae
gtatactagccttccgaacactgaa

SEQ ID NO: 41661 - DNA, 25 bp, S. cerevisiae
gtatagctacctacaagcccggata

SEQ ID NO: 41662 - DNA, 25 bp, S. cerevisiae
gtattctgaccaacacttcggttca

SEQ ID NO: 41663 - DNA, 25 bp, S. cerevisiae
gtattggctgcgtactattcacgtt

SEQ ID NO: 41664 - DNA, 25 bp, S. cerevisiae
gtttggctgagctttacgcacgata

SEQ ID NO: 41665 - DNA, 25 bp, S. cerevisiae
gtatagtgaaccttcagagccagaa

SEQ ID NO: 41666 - DNA, 25 bp, S. cerevisiae
gtatgctctgtacaagcaagccact

SEQ ID NO: 41667 - DNA, 25 bp, S. cerevisiae
gtatatgtccggtacatccttacaa

SEQ ID NO: 41668 - DNA, 25 bp, S. cerevisiae
gtaagggcgctgtctattcgttcga

SEQ ID NO: 41669 - DNA, 25 bp, S. cerevisiae
gtacagggacacattggcgtttgag

SEQ ID NO: 41670 - DNA, 25 bp, S. cerevisiae
gtatccttgcacctttacgtttgaa

SEQ ID NO: 41671 - DNA, 25 bp, S. cerevisiae
gtatatctggcgttttactggctct

SEQ ID NO: 41672 - DNA, 25 bp, S. cerevisiae
gtattcgatcagttagatgctcagc

SEQ ID NO: 41673 - DNA, 25 bp, S. cerevisiae
gtattcggacgcaatagctatcata

SEQ ID NO: 41674 - DNA, 25 bp, S. cerevisiae
gtatttttgggcacatcatcacatt

SEQ ID NO: 41675 - DNA, 25 bp, S. cerevisiae
gtttggttgagaatcctgtggcaat

SEQ ID NO: 41676 - DNA, 25 bp, S. cerevisiae
gtatttttgccaatctatgctggcc

SEQ ID NO: 41677 - DNA, 25 bp, S. cerevisiae
gtatttttcctttcatttcctggat

SEQ ID NO: 41678 - DNA, 25 bp, S. cerevisiae
gtattaccacaagcgattactcgag

SEQ ID NO: 41679 - DNA, 25 bp, S. cerevisiae
gtatatttgtgctgaatgttctagt

SEQ ID NO: 41680 - DNA, 25 bp, S. cerevisiae
gtattgcggtgctagaattcttggc

SEQ ID NO: 41681 - DNA, 25 bp, S. cerevisiae
gtttggcaattcttcatacactatt

SEQ ID NO: 41682 - DNA, 25 bp, S. cerevisiae
gtttggaagccaccgacgatgtttt

SEQ ID NO: 41683 - DNA, 25 bp, S. cerevisiae
gtttggcaactaccgaaaagcaaga

SEQ ID NO: 41684 - DNA, 25 bp, S. cerevisiae
gtttgggcctatcggcaaaatcaat

SEQ ID NO: 41685 - DNA, 25 bp, S. cerevisiae
gtagtagccggtcgcgaagacattt

SEQ ID NO: 41686 - DNA, 25 bp, S. cerevisiae
gtagggccgaagtcaggaagtttca

SEQ ID NO: 41687 - DNA, 25 bp, S. cerevisiae
gtagtatcggtcattggaaactcca

SEQ ID NO: 41688 - DNA, 25 bp, S. cerevisiae
gtattcgcacaacctgcctattggg

SEQ ID NO: 41689 - DNA, 25 bp, S. cerevisiae
gtattttggagcaaacgcccgtgct

SEQ ID NO: 41690 - DNA, 25 bp, S. cerevisiae
gtaggatatggagaccacctcggtc

SEQ ID NO: 41691 - DNA, 25 bp, S. cerevisiae
gtatcagaagttggtccggactcaa

SEQ ID NO: 41692 - DNA, 25 bp, S. cerevisiae
gtattgctcgttacaaggctttcaa

SEQ ID NO: 41693 - DNA, 25 bp, S. cerevisiae
gtattgcgatggataagctgcttgt

SEQ ID NO: 41694 - DNA, 25 bp, S. cerevisiae
gtattgccattattgctaccattat

SEQ ID NO: 41695 - DNA, 25 bp, S. cerevisiae
gtattggatcttatagcactgcttc

SEQ ID NO: 41696 - DNA, 25 bp, S. cerevisiae
gtattgctactgcagtaccagcttc

SEQ ID NO: 41697 - DNA, 25 bp, S. cerevisiae
gtattgccactactttcgacttgga

SEQ ID NO: 41698 - DNA, 25 bp, S. cerevisiae
gtatcactcgactttccctgtagat

SEQ ID NO: 41699 - DNA, 25 bp, S. cerevisiae
gtatggataagtttcgacgctggag

SEQ ID NO: 41700 - DNA, 25 bp, S. cerevisiae
gtatacaaactctctgaccagaagt

SEQ ID NO: 41701 - DNA, 25 bp, S. cerevisiae
gtatggtcgttatcaggctggtccg

SEQ ID NO: 41702 - DNA, 25 bp, S. cerevisiae
gtattgggtttaggacctgctccaa

SEQ ID NO: 41703 - DNA, 25 bp, S. cerevisiae
gtattattcttcaagcgccgtgcat

SEQ ID NO: 41704 - DNA, 25 bp, S. cerevisiae
gtatacgatctttccttttcatttt

SEQ ID NO: 41705 - DNA, 25 bp, S. cerevisiae
gtatactacagatctttgtctcctt

SEQ ID NO: 41706 - DNA, 25 bp, S. cerevisiae
gtattatcattgaagaccgcgtcac

SEQ ID NO: 41707 - DNA, 25 bp, S. cerevisiae
gtattcggtggactaggcagcctca

SEQ ID NO: 41708 - DNA, 25 bp, S. cerevisiae
gtattcgttaacaggccattgcaaa

SEQ ID NO: 41709 - DNA, 25 bp, S. cerevisiae
gtactggtacaacttggccaaggca

SEQ ID NO: 41710 - DNA, 25 bp, S. cerevisiae
gtacgagacatgcaagtggccacac

SEQ ID NO: 41711 - DNA, 25 bp, S. cerevisiae
gtattgtgactccatgggcagacca

SEQ ID NO: 41712 - DNA, 25 bp, S. cerevisiae
gtattgataacctgcgtgaccgtct

SEQ ID NO: 41713 - DNA, 25 bp, S. cerevisiae
gtattaaatattatctctccgctta

SEQ ID NO: 41714 - DNA, 25 bp, S. cerevisiae
gtatctgataattgctttccctcgt

SEQ ID NO: 41715 - DNA, 25 bp, S. cerevisiae
gtattgccgcaggtttgaatgccaa

SEQ ID NO: 41716 - DNA, 25 bp, S. cerevisiae
gtgtgagtacgtgcgcacgtccaac

SEQ ID NO: 41717 - DNA, 25 bp, S. cerevisiae
gtatttttgcatccgacttgccaaa

SEQ ID NO: 41718 - DNA, 25 bp, S. cerevisiae
gtattcaaagatcacgtcagcgcag

SEQ ID NO: 41719 - DNA, 25 bp, S. cerevisiae
gtattccagctgaacaagtcaccag

SEQ ID NO: 41720 - DNA, 25 bp, S. cerevisiae
gtatttcttcgaagtccgcagcatt

SEQ ID NO: 41721 - DNA, 25 bp, S. cerevisiae
gtatttttccaatcaccacctagtt

SEQ ID NO: 41722 - DNA, 25 bp, S. cerevisiae
gtatatgttcccttaaccacgagag

SEQ ID NO: 41723 - DNA, 25 bp, S. cerevisiae
gtagtagtgaggtttacaagcccaa

SEQ ID NO: 41724 - DNA, 25 bp, S. cerevisiae
gtatctaaggtttacctcgcctcaa

SEQ ID NO: 41725 - DNA, 25 bp, S. cerevisiae
gtatttgttaaccacttgctcctgt

SEQ ID NO: 41726 - DNA, 25 bp, S. cerevisiae
gtattatgtctattcgctttctatt

SEQ ID NO: 41727 - DNA, 25 bp, S. cerevisiae
gtattcctctgaaccaattctactt

SEQ ID NO: 41728 - DNA, 25 bp, S. cerevisiae
gtatgacacatccagtcgcaattta

SEQ ID NO: 41729 - DNA, 25 bp, S. cerevisiae
gtatggccatacttgcgaataacag

SEQ ID NO: 41730 - DNA, 25 bp, S. cerevisiae
gtatgggctccagtagtagaatgat

SEQ ID NO: 41731 - DNA, 25 bp, S. cerevisiae
gtatattgcactatatccgaatgat

SEQ ID NO: 41732 - DNA, 25 bp, S. cerevisiae
gtattcatcgacttcaccaaagaga

SEQ ID NO: 41733 - DNA, 25 bp, S. cerevisiae
gtatatctgtatctcccaataaggg

SEQ ID NO: 41734 - DNA, 25 bp, S. cerevisiae
gtattaggactccatgccatacaaa

SEQ ID NO: 41735 - DNA, 25 bp, S. cerevisiae
gtattacgtcaaatcttgccagtga

SEQ ID NO: 41736 - DNA, 25 bp, S. cerevisiae
gtatactctgttgtggcaccgctaa

SEQ ID NO: 41737 - DNA, 25 bp, S. cerevisiae
gtatttctattctcttcctgtaagc

SEQ ID NO: 41738 - DNA, 25 bp, S. cerevisiae
gtattattttcaaatgtcctatcat

SEQ ID NO: 41739 - DNA, 25 bp, S. cerevisiae
gtattactcttcatgtttctgctgg

SEQ ID NO: 41740 - DNA, 25 bp, S. cerevisiae
gtatatctcagactgttcaattgtg

SEQ ID NO: 41741 - DNA, 25 bp, S. cerevisiae
gtatatccactactcaacatgttgg

SEQ ID NO: 41742 - DNA, 25 bp, S. cerevisiae
gtattctacattatctgctgatgag

SEQ ID NO: 41743 - DNA, 25 bp, S. cerevisiae
gtattctttgttcgctgctgacagc

SEQ ID NO: 41744 - DNA, 25 bp, S. cerevisiae
gtatttctggtttgatctacgaaga

SEQ ID NO: 41745 - DNA, 25 bp, S. cerevisiae
gtatttctgattttgttgcactcat

SEQ ID NO: 41746 - DNA, 25 bp, S. cerevisiae
gtatttctttattcatggctcacat

SEQ ID NO: 41747 - DNA, 25 bp, S. cerevisiae
gtattagatgccaccagatcgcgtc

SEQ ID NO: 41748 - DNA, 25 bp, S. cerevisiae
gtatcacaattagctaatggcgtca

SEQ ID NO: 41749 - DNA, 25 bp, S. cerevisiae
gtatccgcactatattggacacaat

SEQ ID NO: 41750 - DNA, 25 bp, S. cerevisiae
gtatatggtcgcctctgcatgctgc

SEQ ID NO: 41751 - DNA, 25 bp, S. cerevisiae
gtacagatagtactcttccgaaagg

SEQ ID NO: 41752 - DNA, 25 bp, S. cerevisiae
gtagggcctacaattccaataagcg

SEQ ID NO: 41753 - DNA, 25 bp, S. cerevisiae
gtataggcccatggagtgccaaaat

SEQ ID NO: 41754 - DNA, 25 bp, S. cerevisiae
gtattcaggtcaatcagcagttaag

SEQ ID NO: 41755 - DNA, 25 bp, S. cerevisiae
gtatatgcgctgcactagcctggac

SEQ ID NO: 41756 - DNA, 25 bp, S. cerevisiae
gtatattatgatttagccgctgtgt

SEQ ID NO: 41757 - DNA, 25 bp, S. cerevisiae
gtattattgttggagcatcgcttga

SEQ ID NO: 41758 - DNA, 25 bp, S. cerevisiae
gtatacaccagcatatgagcacttt

SEQ ID NO: 41759 - DNA, 25 bp, S. cerevisiae
gtatgagctattactggaccacatt

SEQ ID NO: 41760 - DNA, 25 bp, S. cerevisiae
gtatagctagtgaactgtcgacaat

SEQ ID NO: 41761 - DNA, 25 bp, S. cerevisiae
gtagtgctacgtacgtgaagcagca

SEQ ID NO: 41762 - DNA, 25 bp, S. cerevisiae
gtatgcatcgatgatcacccaagcc

SEQ ID NO: 41763 - DNA, 25 bp, S. cerevisiae
gtattcatatgctacctatcacacc

SEQ ID NO: 41764 - DNA, 25 bp, S. cerevisiae
gtaggatggctgtaataaccggcat

SEQ ID NO: 41765 - DNA, 25 bp, S. cerevisiae
gtctaggatctatgcctttcaggca

SEQ ID NO: 41766 - DNA, 25 bp, S. cerevisiae
gtatagagatggtgcctttcgccat

SEQ ID NO: 41767 - DNA, 25 bp, S. cerevisiae
gtacacggagtatgtctttactacg

SEQ ID NO: 41768 - DNA, 25 bp, S. cerevisiae
gtatccacggtatgttcttggctca

SEQ ID NO: 41769 - DNA, 25 bp, S. cerevisiae
gtatcgatcggtacggatgcagtct

SEQ ID NO: 41770 - DNA, 25 bp, S. cerevisiae
gtatcctcgcggactagacacgata

SEQ ID NO: 41771 - DNA, 25 bp, S. cerevisiae
gtattttactctcgtgtcaaagcag

SEQ ID NO: 41772 - DNA, 25 bp, S. cerevisiae
gtatttggactcgagttcctcagaa

SEQ ID NO: 41773 - DNA, 25 bp, S. cerevisiae
gtatttggatttactcttcgcaata

SEQ ID NO: 41774 - DNA, 25 bp, S. cerevisiae
gtatttccattgttgctttactaaa

SEQ ID NO: 41775 - DNA, 25 bp, S. cerevisiae
gtatttctcgtgattctcgtcacaa

SEQ ID NO: 41776 - DNA, 25 bp, S. cerevisiae
gtatttattagttggctcctcgata

SEQ ID NO: 41777 - DNA, 25 bp, S. cerevisiae
gtattttgccatcagccatgttaga

SEQ ID NO: 41778 - DNA, 25 bp, S. cerevisiae
gtattttccataacgctgtattcaa

SEQ ID NO: 41779 - DNA, 25 bp, S. cerevisiae
gtatttctacaggttcgtttccaat

SEQ ID NO: 41780 - DNA, 25 bp, S. cerevisiae
gtatttctcgtgatgatctgccctt

SEQ ID NO: 41781 - DNA, 25 bp, S. cerevisiae
gtatttagcaagactggctgcccat

SEQ ID NO: 41782 - DNA, 25 bp, S. cerevisiae
gtatttgttgattgtgcttctcgta

SEQ ID NO: 41783 - DNA, 25 bp, S. cerevisiae
gtatttgttatgagccaccaagtgt

SEQ ID NO: 41784 - DNA, 25 bp, S. cerevisiae
gtattttctgtcagcgaaaccgcta

SEQ ID NO: 41785 - DNA, 25 bp, S. cerevisiae
gtatccttgtgttctagaaactccc

SEQ ID NO: 41786 - DNA, 25 bp, S. cerevisiae
gtatacgatctaaaactcagcgaag

SEQ ID NO: 41787 - DNA, 25 bp, S. cerevisiae
gtatacgaggtatcccactaatttg

SEQ ID NO: 41788 - DNA, 25 bp, S. cerevisiae
gtaaatacgccaactccagaattcc

SEQ ID NO: 41789 - DNA, 25 bp, S. cerevisiae
gtatgttaccgcgatttatagtggc

SEQ ID NO: 41790 - DNA, 25 bp, S. cerevisiae
gtatctatggctggaatgcctctct

SEQ ID NO: 41791 - DNA, 25 bp, S. cerevisiae
gtcatctttgatggcgcactaggag

SEQ ID NO: 41792 - DNA, 25 bp, S. cerevisiae
gtatcatggatgtttcttcagagag

SEQ ID NO: 41793 - DNA, 25 bp, S. cerevisiae
gtatgtctggtatccacaggtgctc

SEQ ID NO: 41794 - DNA, 25 bp, S. cerevisiae
gtatgaaccgcccattcaacaggga

SEQ ID NO: 41795 - DNA, 25 bp, S. cerevisiae
gtatgaacatgctccattgaacgaa

SEQ ID NO: 41796 - DNA, 25 bp, S. cerevisiae
gtatatatcatctcaagttacccta

SEQ ID NO: 41797 - DNA, 25 bp, S. cerevisiae
gtatccatcataccgcaatttcctg

SEQ ID NO: 41798 - DNA, 25 bp, S. cerevisiae
gtaccataggtacgttccctgagta

SEQ ID NO: 41799 - DNA, 25 bp, S. cerevisiae
ggttcaagttatcttcctgggtttg

SEQ ID NO: 41800 - DNA, 25 bp, S. cerevisiae
gggatcaaggctaccaacgtgggtt

SEQ ID NO: 41801 - DNA, 25 bp, S. cerevisiae
gggctacaggttcaacgtctatttc

SEQ ID NO: 41802 - DNA, 25 bp, S. cerevisiae
ggtgggctatttgaacgttgactac

SEQ ID NO: 41803 - DNA, 25 bp, S. cerevisiae
gtatgccaaaccgaaactgtgacag

SEQ ID NO: 41804 - DNA, 25 bp, S. cerevisiae
gtatccaaatttcatgccttgcgct

SEQ ID NO: 41805 - DNA, 25 bp, S. cerevisiae
gtcttcaggttttcgtttgacttct

SEQ ID NO: 41806 - DNA, 25 bp, S. cerevisiae
gtatatgtacttttgcgtaccctaa

SEQ ID NO: 41807 - DNA, 25 bp, S. cerevisiae
gtatcatatactcttgcgctaaccc

SEQ ID NO: 41808 - DNA, 25 bp, S. cerevisiae
gtatttcattgactgctgtgctaag

SEQ ID NO: 41809 - DNA, 25 bp, S. cerevisiae
gtatacagcaactttggcgtctcca

SEQ ID NO: 41810 - DNA, 25 bp, S. cerevisiae
gtatacagattcgttgcttctcgca

SEQ ID NO: 41811 - DNA, 25 bp, S. cerevisiae
gtatatctcattgtcccatttccaa

SEQ ID NO: 41812 - DNA, 25 bp, S. cerevisiae
gtatcaatctatctctgacttccac

SEQ ID NO: 41813 - DNA, 25 bp, S. cerevisiae
gtatgaatggcaacctgataaagat

SEQ ID NO: 41814 - DNA, 25 bp, S. cerevisiae
gtatactatgattccactctgcacc

SEQ ID NO: 41815 - DNA, 25 bp, S. cerevisiae
gtatcgcatatgatccaagtggcct

SEQ ID NO: 41816 - DNA, 25 bp, S. cerevisiae
gtcagttttgtatcttccaggttgt

SEQ ID NO: 41817 - DNA, 25 bp, S. cerevisiae
gtatcgctccaaatttaccaggttt

SEQ ID NO: 41818 - DNA, 25 bp, S. cerevisiae
gtatcctcatttgattaacgccttt

SEQ ID NO: 41819 - DNA, 25 bp, S. cerevisiae
gtaccgtttagttatgccacctact

SEQ ID NO: 41820 - DNA, 25 bp, S. cerevisiae
gtatcatccgtttgtgaatgcgccc

SEQ ID NO: 41821 - DNA, 25 bp, S. cerevisiae
gtatcttctatttcagagagcgctg

SEQ ID NO: 41822 - DNA, 25 bp, S. cerevisiae
gtatcattggctctttgtgtctatt

SEQ ID NO: 41823 - DNA, 25 bp, S. cerevisiae
gtatcaactcttttgccaatgtctt

SEQ ID NO: 41824 - DNA, 25 bp, S. cerevisiae
gtatacgctatcgtccaagtcttgt

SEQ ID NO: 41825 - DNA, 25 bp, S. cerevisiae
gtatcaaccttctgctgtcgtgtta

SEQ ID NO: 41826 - DNA, 25 bp, S. cerevisiae
gtatcggtttaagccacatgttagg

SEQ ID NO: 41827 - DNA, 25 bp, S. cerevisiae
gtacggattatgtgtaactgtatta

SEQ ID NO: 41828 - DNA, 25 bp, S. cerevisiae
gtatgcggtatttcgaaacggcttt

SEQ ID NO: 41829 - DNA, 25 bp, S. cerevisiae
gtatcaagtatgacccatccatcgg

SEQ ID NO: 41830 - DNA, 25 bp, S. cerevisiae
gtataagctttcagatccatcattg

SEQ ID NO: 41831 - DNA, 25 bp, S. cerevisiae
gtatcagatttttccgtccaacaac

SEQ ID NO: 41832 - DNA, 25 bp, S. cerevisiae
gtatcagtcttcaattctatccaga

SEQ ID NO: 41833 - DNA, 25 bp, S. cerevisiae
gtatggttattctgcactgatcgta

SEQ ID NO: 41834 - DNA, 25 bp, S. cerevisiae
gtaggacgcaaacctgctgagcatc

SEQ ID NO: 41835 - DNA, 25 bp, S. cerevisiae
gtatgactacggtacaatcctcaat

SEQ ID NO: 41836 - DNA, 25 bp, S. cerevisiae
gtatttgacggagattccacaacag

SEQ ID NO: 41837 - DNA, 25 bp, S. cerevisiae
gtatcttaacagtctttccgtgaac

SEQ ID NO: 41838 - DNA, 25 bp, S. cerevisiae
gtatcgttatcatccgatgcgttct

SEQ ID NO: 41839 - DNA, 25 bp, S. cerevisiae
gtagcgttactacggagtttctctc

SEQ ID NO: 41840 - DNA, 25 bp, S. cerevisiae
gtatcgattatcaacctatttcacg

SEQ ID NO: 41841 - DNA, 25 bp, S. cerevisiae
gtatcttcgcataactcacattcac

SEQ ID NO: 41842 - DNA, 25 bp, S. cerevisiae
gtatcagttctatggacagtgcaag

SEQ ID NO: 41843 - DNA, 25 bp, S. cerevisiae
gtataggaactttatcgtgcaagat

SEQ ID NO: 41844 - DNA, 25 bp, S. cerevisiae
gtatgggtatgctacagtcagtcaa

SEQ ID NO: 41845 - DNA, 25 bp, S. cerevisiae
gtatgggtcatgatcagtccgaagg

SEQ ID NO: 41846 - DNA, 25 bp, S. cerevisiae
gtatcttcaactgcaacctgaacaa

SEQ ID NO: 41847 - DNA, 25 bp, S. cerevisiae
gtatcattaaagacaccgccaagct

SEQ ID NO: 41848 - DNA, 25 bp, S. cerevisiae
gtagtcttgagtcgcactggtccag

SEQ ID NO: 41849 - DNA, 25 bp, S. cerevisiae
gtagatcccttggttgagatccggg

SEQ ID NO: 41850 - DNA, 25 bp, S. cerevisiae
gtatctccctcggtttgtcaaagga

SEQ ID NO: 41851 - DNA, 25 bp, S. cerevisiae
gtatcttcccctatttacgcaggaa

SEQ ID NO: 41852 - DNA, 25 bp, S. cerevisiae
gtatctctggtgttcgaggtaccaa

SEQ ID NO: 41853 - DNA, 25 bp, S. cerevisiae
gtatgattccatcttgagggaccaa

SEQ ID NO: 41854 - DNA, 25 bp, S. cerevisiae
gtagatggccacttgattcaggacc

SEQ ID NO: 41855 - DNA, 25 bp, S. cerevisiae
gtatgatcaagctattgcccgaaca

SEQ ID NO: 41856 - DNA, 25 bp, S. cerevisiae
gtatactactgctagcgttgcaaac

SEQ ID NO: 41857 - DNA, 25 bp, S. cerevisiae
gtatgtagactagcacccggtggtt

SEQ ID NO: 41858 - DNA, 25 bp, S. cerevisiae
gtatgacatattttcaccgcggttt

SEQ ID NO: 41859 - DNA, 25 bp, S. cerevisiae
gtataacctcatatgctgtgtctcc

SEQ ID NO: 41860 - DNA, 25 bp, S. cerevisiae
gtatacctatatccagtttcctcat

SEQ ID NO: 41861 - DNA, 25 bp, S. cerevisiae
gtatcatcctggagcttttgcccag

SEQ ID NO: 41862 - DNA, 25 bp, S. cerevisiae
gtatagctggatcggcttatttgct

SEQ ID NO: 41863 - DNA, 25 bp, S. cerevisiae
gtatagaataccctttgtttgcaaa

SEQ ID NO: 41864 - DNA, 25 bp, S. cerevisiae
gtatccgtcttcactgtcgatataa

SEQ ID NO: 41865 - DNA, 25 bp, S. cerevisiae
gtatcctttttacgagatgaaatga

SEQ ID NO: 41866 - DNA, 25 bp, S. cerevisiae
gtatacatccgtacatccgtacatc

SEQ ID NO: 41867 - DNA, 25 bp, S. cerevisiae
gtatgggacgtcaggtctacttctc

SEQ ID NO: 41868 - DNA, 25 bp, S. cerevisiae
gtatggtgtcattcagtggtcaaat

SEQ ID NO: 41869 - DNA, 25 bp, S. cerevisiae
gtatctgcgttgacgttcacgtgga

SEQ ID NO: 41870 - DNA, 25 bp, S. cerevisiae
gtacaaggctcattggattggcgtt

SEQ ID NO: 41871 - DNA, 25 bp, S. cerevisiae
gtatgccttactgtgaccgagttta

SEQ ID NO: 41872 - DNA, 25 bp, S. cerevisiae
gtatcctcaactgctaaggcatgtt

SEQ ID NO: 41873 - DNA, 25 bp, S. cerevisiae
gtagagcaccaaccatttccaaaat

SEQ ID NO: 41874 - DNA, 25 bp, S. cerevisiae
gtatcatctactccgtttttgagca

SEQ ID NO: 41875 - DNA, 25 bp, S. cerevisiae
gtatctgcgcagcaaggttttgtca

SEQ ID NO: 41876 - DNA, 25 bp, S. cerevisiae
gtatcaacgcctcaatgaaatcgga

SEQ ID NO: 41877 - DNA, 25 bp, S. cerevisiae
gtatcaccagccaaaaaagaccagt

SEQ ID NO: 41878 - DNA, 25 bp, S. cerevisiae
gtatgcaggacctctacacaacaag

SEQ ID NO: 41879 - DNA, 25 bp, S. cerevisiae
gtatcggcaccttcattgacaacaa

SEQ ID NO: 41880 - DNA, 25 bp, S. cerevisiae
gtaggcaacattgtcttcgtcagct

SEQ ID NO: 41881 - DNA, 25 bp, S. cerevisiae
gtatgtgcagttctttcatctatga

SEQ ID NO: 41882 - DNA, 25 bp, S. cerevisiae
gtactatgccgaaactcagcgacga

SEQ ID NO: 41883 - DNA, 25 bp, S. cerevisiae
gtctgctaacgattactacggcgga

SEQ ID NO: 41884 - DNA, 25 bp, S. cerevisiae
gtatcagctgatagggatcttccat

SEQ ID NO: 41885 - DNA, 25 bp, S. cerevisiae
gtatcctgatggagcacttcgctaa

SEQ ID NO: 41886 - DNA, 25 bp, S. cerevisiae
gtatccttggtcaatcaactatcta

SEQ ID NO: 41887 - DNA, 25 bp, S. cerevisiae
gtatctgagcggttattctgacttg

SEQ ID NO: 41888 - DNA, 25 bp, S. cerevisiae
gtatctctgttgtttgctcatgcct

SEQ ID NO: 41889 - DNA, 25 bp, S. cerevisiae
gtagtgtttttagatctgccggctc

SEQ ID NO: 41890 - DNA, 25 bp, S. cerevisiae
gtagacatagacacgtgccacaagt

SEQ ID NO: 41891 - DNA, 25 bp, S. cerevisiae
gtagttggcctccaaatccaagcga

SEQ ID NO: 41892 - DNA, 25 bp, S. cerevisiae
gtatgcgtactttagacccaagcga

SEQ ID NO: 41893 - DNA, 25 bp, S. cerevisiae
gtaccagtttcagcaccagaacgag

SEQ ID NO: 41894 - DNA, 25 bp, S. cerevisiae
gtataatatttagcactcgtacgtt

SEQ ID NO: 41895 - DNA, 25 bp, S. cerevisiae
gtatcacgagctcatctagagcctt

SEQ ID NO: 41896 - DNA, 25 bp, S. cerevisiae
gtatgccggacttgtccaagtatca

SEQ ID NO: 41897 - DNA, 25 bp, S. cerevisiae
gtatgtattccatgttcaagcaata

SEQ ID NO: 41898 - DNA, 25 bp, S. cerevisiae
gtagcgcatactatgtcagtcaggt

SEQ ID NO: 41899 - DNA, 25 bp, S. cerevisiae
gtatcacaagttttcatttctgcca

SEQ ID NO: 41900 - DNA, 25 bp, S. cerevisiae
gtatctctattttcctctagctcga

SEQ ID NO: 41901 - DNA, 25 bp, S. cerevisiae
gtatcctgtggagcgacgtttatcc

SEQ ID NO: 41902 - DNA, 25 bp, S. cerevisiae
gtcacgttgggtgcaagattctatc

SEQ ID NO: 41903 - DNA, 25 bp, S. cerevisiae
gtacttccccatgcacttggaattg

SEQ ID NO: 41904 - DNA, 25 bp, S. cerevisiae
gtagctaacgactcaccatgcggtt

SEQ ID NO: 41905 - DNA, 25 bp, S. cerevisiae
gtagaacttgccaaacacctcaaag

SEQ ID NO: 41906 - DNA, 25 bp, S. cerevisiae
gtacgactttttcagccaacctgat

SEQ ID NO: 41907 - DNA, 25 bp, S. cerevisiae
gtatcgactgttctgtgagccataa

SEQ ID NO: 41908 - DNA, 25 bp, S. cerevisiae
gtcacttcagtcttggtggccatga

SEQ ID NO: 41909 - DNA, 25 bp, S. cerevisiae
gtatcttcattcatgcagcaggttt

SEQ ID NO: 41910 - DNA, 25 bp, S. cerevisiae
gtatcctttgctacacatggtctta

SEQ ID NO: 41911 - DNA, 25 bp, S. cerevisiae
gtatcctttgtaggctcgtgctcca

SEQ ID NO: 41912 - DNA, 25 bp, S. cerevisiae
gtatcctttatgaagtctggtccca

SEQ ID NO: 41913 - DNA, 25 bp, S. cerevisiae
gtatcccatcaatgaggcggtccaa

SEQ ID NO: 41914 - DNA, 25 bp, S. cerevisiae
gtatccagtacatgatcgcggttcc

SEQ ID NO: 41915 - DNA, 25 bp, S. cerevisiae
gtatcacaccagtagaagctgcgtt

SEQ ID NO: 41916 - DNA, 25 bp, S. cerevisiae
gtatccatccgaagacgtcgctgct

SEQ ID NO: 41917 - DNA, 25 bp, S. cerevisiae
gtatccaaagtatcaacagctctcg

SEQ ID NO: 41918 - DNA, 25 bp, S. cerevisiae
gtatggttcgcacttgcaacatggt

SEQ ID NO: 41919 - DNA, 25 bp, S. cerevisiae
gtatgcgacagctgatcaaattgaa

SEQ ID NO: 41920 - DNA, 25 bp, S. cerevisiae
gtatctgcgtgtcacagcatttttg

SEQ ID NO: 41921 - DNA, 25 bp, S. cerevisiae
gtatcgcaagtgtacagtttagcat

SEQ ID NO: 41922 - DNA, 25 bp, S. cerevisiae
gtatctcgaggaagcttttccatta

SEQ ID NO: 41923 - DNA, 25 bp, S. cerevisiae
gtgatgccaaggctgctggttccta

SEQ ID NO: 41924 - DNA, 25 bp, S. cerevisiae
gtatcagaatcgcacttgttcacga

SEQ ID NO: 41925 - DNA, 25 bp, S. cerevisiae
gtagtccttgagctagttctgcaac

SEQ ID NO: 41926 - DNA, 25 bp, S. cerevisiae
gtagtagccatcaacggacgcatat

SEQ ID NO: 41927 - DNA, 25 bp, S. cerevisiae
gtagacgaaactatggctccacaaa

SEQ ID NO: 41928 - DNA, 25 bp, S. cerevisiae
gtatcacgaaggtgtgcgctcgcaa

SEQ ID NO: 41929 - DNA, 25 bp, S. cerevisiae
gtatcagcgaagatttccacccatt

SEQ ID NO: 41930 - DNA, 25 bp, S. cerevisiae
gtatcgagaaactacttccagcggt

SEQ ID NO: 41931 - DNA, 25 bp, S. cerevisiae
gtatcgatcaaacctacccagggat

SEQ ID NO: 41932 - DNA, 25 bp, S. cerevisiae
gtatcgatcatattgtctacttcaa

SEQ ID NO: 41933 - DNA, 25 bp, S. cerevisiae
gtatcgccatcatttctaccattat

SEQ ID NO: 41934 - DNA, 25 bp, S. cerevisiae
gtatctgcttcaccattacctgata

SEQ ID NO: 41935 - DNA, 25 bp, S. cerevisiae
gtatgcttcaaccattcatcactga

SEQ ID NO: 41936 - DNA, 25 bp, S. cerevisiae
gtatgatccaaacaatcagcagttt

SEQ ID NO: 41937 - DNA, 25 bp, S. cerevisiae
gtagtaacaataaatcggcttccaa

SEQ ID NO: 41938 - DNA, 25 bp, S. cerevisiae
gtaaggacgctaccaaggctttcag

SEQ ID NO: 41939 - DNA, 25 bp, S. cerevisiae
gtagttacactaccagtatgttatc

SEQ ID NO: 41940 - DNA, 25 bp, S. cerevisiae
gtatcctgacaccaaagctgtactg

SEQ ID NO: 41941 - DNA, 25 bp, S. cerevisiae
gtatccttcacagcaggtttcagca

SEQ ID NO: 41942 - DNA, 25 bp, S. cerevisiae
gtatccatcgataccagtgttctgg

SEQ ID NO: 41943 - DNA, 25 bp, S. cerevisiae
gtagttcagttgtcggtgccggtat

SEQ ID NO: 41944 - DNA, 25 bp, S. cerevisiae
gtagagaatctagccaccgacaaca

SEQ ID NO: 41945 - DNA, 25 bp, S. cerevisiae
gtagtgattcgtttagagcccgtca

SEQ ID NO: 41946 - DNA, 25 bp, S. cerevisiae
gtagagttagaaccaagaccgtcaa

SEQ ID NO: 41947 - DNA, 25 bp, S. cerevisiae
gtagaaataatgtccaacccgccca

SEQ ID NO: 41948 - DNA, 25 bp, S. cerevisiae
gtagtattcaaacagcgtcaccacc

SEQ ID NO: 41949 - DNA, 25 bp, S. cerevisiae
gtagctcccaaaacaactatcgata

SEQ ID NO: 41950 - DNA, 25 bp, S. cerevisiae
gtagtcactacaaagccaaccattg

SEQ ID NO: 41951 - DNA, 25 bp, S. cerevisiae
gtatgcagccatgcttacatctgaa

SEQ ID NO: 41952 - DNA, 25 bp, S. cerevisiae
gtatgccagctcatgcttactgcaa

SEQ ID NO: 41953 - DNA, 25 bp, S. cerevisiae
gtatggctgcttctgacaacgtagt

SEQ ID NO: 41954 - DNA, 25 bp, S. cerevisiae
gtatctctgccgtcatgattcaaga

SEQ ID NO: 41955 - DNA, 25 bp, S. cerevisiae
gtatgttactgactcaccaagactt

SEQ ID NO: 41956 - DNA, 25 bp, S. cerevisiae
gtatgtcggcgattcatctcaagta

SEQ ID NO: 41957 - DNA, 25 bp, S. cerevisiae
gtatctgatgtgatgatgtcctaca

SEQ ID NO: 41958 - DNA, 25 bp, S. cerevisiae
gtagatatcatacgttctcataact

SEQ ID NO: 41959 - DNA, 25 bp, S. cerevisiae
gtagtactgctggtatgggcaaaca

SEQ ID NO: 41960 - DNA, 25 bp, S. cerevisiae
gtaggcgaaggcgactccattgcaa

SEQ ID NO: 41961 - DNA, 25 bp, S. cerevisiae
gtatgtcgcaggagatccagtccaa

SEQ ID NO: 41962 - DNA, 25 bp, S. cerevisiae
gtatggtagcacagccattaccaca

SEQ ID NO: 41963 - DNA, 25 bp, S. cerevisiae
gtatgtgtcagctgtacttttggca

SEQ ID NO: 41964 - DNA, 25 bp, S. cerevisiae
gtatctccatctgtggtgctttgaa

SEQ ID NO: 41965 - DNA, 25 bp, S. cerevisiae
gtatgttgagcattcctgtttctga

SEQ ID NO: 41966 - DNA, 25 bp, S. cerevisiae
gtatgtacaggttcatgggactcaa

SEQ ID NO: 41967 - DNA, 25 bp, S. cerevisiae
gtatctacaaattctctggtgtcta

SEQ ID NO: 41968 - DNA, 25 bp, S. cerevisiae
gtatccaacctcaacgatgctgtag

SEQ ID NO: 41969 - DNA, 25 bp, S. cerevisiae
gtatgcccaagaccagtcggtagca

SEQ ID NO: 41970 - DNA, 25 bp, S. cerevisiae
gtatccacacgagattgcggaagct

SEQ ID NO: 41971 - DNA, 25 bp, S. cerevisiae
gtatcgccaagtttcatgttgaagc

SEQ ID NO: 41972 - DNA, 25 bp, S. cerevisiae
gtatcgcagtggattgttcgctcat

SEQ ID NO: 41973 - DNA, 25 bp, S. cerevisiae
gtatcgctatgtcatggttcacctt

SEQ ID NO: 41974 - DNA, 25 bp, S. cerevisiae
gtagcgcagattctagttcaccaga

SEQ ID NO: 41975 - DNA, 25 bp, S. cerevisiae
gtagtggctaattcccgtaaggcga

SEQ ID NO: 41976 - DNA, 25 bp, S. cerevisiae
gtagttgtgaatgaccgattaggca

SEQ ID NO: 41977 - DNA, 25 bp, S. cerevisiae
gtagctatatcagcgaccgcattcg

SEQ ID NO: 41978 - DNA, 25 bp, S. cerevisiae
gtatgcaaaggttctcttccaataa

SEQ ID NO: 41979 - DNA, 25 bp, S. cerevisiae
gtatgatcaacgtttccccaattgg

SEQ ID NO: 41980 - DNA, 25 bp, S. cerevisiae
gtatcgccaatgcatctataacagc

SEQ ID NO: 41981 - DNA, 25 bp, S. cerevisiae
gtagatcagtcatcaatggcgccac

SEQ ID NO: 41982 - DNA, 25 bp, S. cerevisiae
gtatgaccatcttcagtcggcaaga

SEQ ID NO: 41983 - DNA, 25 bp, S. cerevisiae
gtatgccgctcttcaacatgacaag

SEQ ID NO: 41984 - DNA, 25 bp, S. cerevisiae
gtatcggttccatttcttggcgatt

SEQ ID NO: 41985 - DNA, 25 bp, S. cerevisiae
gtatgcttgtttttgaccctgcgaa

SEQ ID NO: 41986 - DNA, 25 bp, S. cerevisiae
gtatgttttcacttactcctctaat

SEQ ID NO: 41987 - DNA, 25 bp, S. cerevisiae
gtatgtttctatttcttcagcgagc

SEQ ID NO: 41988 - DNA, 25 bp, S. cerevisiae
gtatccgctggtcaactttatcata

SEQ ID NO: 41989 - DNA, 25 bp, S. cerevisiae
gtatcgagcgtgataacggtactga

SEQ ID NO: 41990 - DNA, 25 bp, S. cerevisiae
gtatcctcgctcatgaacggattgg

SEQ ID NO: 41991 - DNA, 25 bp, S. cerevisiae
gtaccataggttgcacggacatcag

SEQ ID NO: 41992 - DNA, 25 bp, S. cerevisiae
gtacgtaatgtaccaggacgccatg

SEQ ID NO: 41993 - DNA, 25 bp, S. cerevisiae
gtatggatcactgccacggtggtaa

SEQ ID NO: 41994 - DNA, 25 bp, S. cerevisiae
gtctactgctactaccggtaaaagg

SEQ ID NO: 41995 - DNA, 25 bp, S. cerevisiae
gtatgccttgaatccagcccaaata

SEQ ID NO: 41996 - DNA, 25 bp, S. cerevisiae
gtatcccacctccatacgataagaa

SEQ ID NO: 41997 - DNA, 25 bp, S. cerevisiae
gtacaagcccgcctacaaaaaacag

SEQ ID NO: 41998 - DNA, 25 bp, S. cerevisiae
gtatggtttattccctcttgcaaga

SEQ ID NO: 41999 - DNA, 25 bp, S. cerevisiae
gtatggtgcttactctttctgtaca

SEQ ID NO: 42000 - DNA, 25 bp, S. cerevisiae
gtaggtgatgacgtccacagcaaaa

SEQ ID NO: 42001 - DNA, 25 bp, S. cerevisiae
gtagagatgcaaacgccagcgaagc

SEQ ID NO: 42002 - DNA, 25 bp, S. cerevisiae
gtaccattggattgtcgagcgcgga

SEQ ID NO: 42003 - DNA, 25 bp, S. cerevisiae
gtatccttggattctctggttagag

SEQ ID NO: 42004 - DNA, 25 bp, S. cerevisiae
gtatcctaagattcttgcttccaga

SEQ ID NO: 42005 - DNA, 25 bp, S. cerevisiae
gtatgccgaaatccgttacatcaaa

SEQ ID NO: 42006 - DNA, 25 bp, S. cerevisiae
gtcaccgcaaatcccgtaacaaagg

SEQ ID NO: 42007 - DNA, 25 bp, S. cerevisiae
gtaccaggagtttttgaagaagcaa

SEQ ID NO: 42008 - DNA, 25 bp, S. cerevisiae
gtacctcggtctctagaggcacaga

SEQ ID NO: 42009 - DNA, 25 bp, S. cerevisiae
gtatcccgaaatctggtgtcacgcc

SEQ ID NO: 42010 - DNA, 25 bp, S. cerevisiae
gtatgctcagcgatcttcggttatt

SEQ ID NO: 42011 - DNA, 25 bp, S. cerevisiae
gtatcctcgcattgatatagcgttt

SEQ ID NO: 42012 - DNA, 25 bp, S. cerevisiae
gtatgcttccatacaacagcggttc

SEQ ID NO: 42013 - DNA, 25 bp, S. cerevisiae
gtatgcgaatccaacaagtgcttta

SEQ ID NO: 42014 - DNA, 25 bp, S. cerevisiae
gtatgcaagagcctataacgccgat

SEQ ID NO: 42015 - DNA, 25 bp, S. cerevisiae
gtatgcaccacactatgaacagccg

SEQ ID NO: 42016 - DNA, 25 bp, S. cerevisiae
gtacaaaactgaaacactgggcgca

SEQ ID NO: 42017 - DNA, 25 bp, S. cerevisiae
gtcaagtaccgcatggattgggcca

SEQ ID NO: 42018 - DNA, 25 bp, S. cerevisiae
gtagagtcaccgattaatgcgaata

SEQ ID NO: 42019 - DNA, 25 bp, S. cerevisiae
gtatggtcacccactacactactcg

SEQ ID NO: 42020 - DNA, 25 bp, S. cerevisiae
gtatggtaaccactcttttattcta

SEQ ID NO: 42021 - DNA, 25 bp, S. cerevisiae
gtatggaaaccccattctaatttca

SEQ ID NO: 42022 - DNA, 25 bp, S. cerevisiae
gtagttcgagcgacattgcgcgttt

SEQ ID NO: 42023 - DNA, 25 bp, S. cerevisiae
gtatgttgcatttagctttcagctt

SEQ ID NO: 42024 - DNA, 25 bp, S. cerevisiae
gtatgtgccttcaaatcaacgccag

SEQ ID NO: 42025 - DNA, 25 bp, S. cerevisiae
gtaggccacaataatagcagcagct

SEQ ID NO: 42026 - DNA, 25 bp, S. cerevisiae
gtagagaacatcttcacgcacctga

SEQ ID NO: 42027 - DNA, 25 bp, S. cerevisiae
gtactgtgacggaacattcccggaa

SEQ ID NO: 42028 - DNA, 25 bp, S. cerevisiae
gtatgctccaatctttccttgatag

SEQ ID NO: 42029 - DNA, 25 bp, S. cerevisiae
gtgcgtacatagctaaccgtgtgac

SEQ ID NO: 42030 - DNA, 25 bp, S. cerevisiae
gtagatctacttcccacaagaacaa

SEQ ID NO: 42031 - DNA, 25 bp, S. cerevisiae
gtaggcgacttgttccaatcaatgc

SEQ ID NO: 42032 - DNA, 25 bp, S. cerevisiae
gtagggttttaccaataagcgcatt

SEQ ID NO: 42033 - DNA, 25 bp, S. cerevisiae
gtaggtgccttgatcgtttacgata

SEQ ID NO: 42034 - DNA, 25 bp, S. cerevisiae
gtaggaccactaccgttggacgtga

SEQ ID NO: 42035 - DNA, 25 bp, S. cerevisiae
gtatggcaccaaacccttggtccaa

SEQ ID NO: 42036 - DNA, 25 bp, S. cerevisiae
gtagtgacgaagatgcctttcccaa

SEQ ID NO: 42037 - DNA, 25 bp, S. cerevisiae
gtatgctcatcaatcgttcggactc

SEQ ID NO: 42038 - DNA, 25 bp, S. cerevisiae
gtatgccgtatctttcttactaagc

SEQ ID NO: 42039 - DNA, 25 bp, S. cerevisiae
gtatgtttgccttcttgttttggaa

SEQ ID NO: 42040 - DNA, 25 bp, S. cerevisiae
gtagcaattaccgtggccttactaa

SEQ ID NO: 42041 - DNA, 25 bp, S. cerevisiae
gtagaagtactgtgggaaccgcaaa

SEQ ID NO: 42042 - DNA, 25 bp, S. cerevisiae
gtagaagttcctgaagtacctgccc

SEQ ID NO: 42043 - DNA, 25 bp, S. cerevisiae
gtagtcaatctatcggatctcgttg

SEQ ID NO: 42044 - DNA, 25 bp, S. cerevisiae
gtagtacccacaatggatgtcctgg

SEQ ID NO: 42045 - DNA, 25 bp, S. cerevisiae
gtaggagctacatcaggttccagaa

SEQ ID NO: 42046 - DNA, 25 bp, S. cerevisiae
gtagaggtgccatcagttattctga

SEQ ID NO: 42047 - DNA, 25 bp, S. cerevisiae
gtagtgttgctcagtttgattccaa

SEQ ID NO: 42048 - DNA, 25 bp, S. cerevisiae
gtatgttatcaaggctttgcaatcc

SEQ ID NO: 42049 - DNA, 25 bp, S. cerevisiae
gtatgttatcaaggctttgcaatcc

SEQ ID NO: 42050 - DNA, 25 bp, S. cerevisiae
gtatgtcattaaggctttacaatcc

SEQ ID NO: 42051 - DNA, 25 bp, S. cerevisiae
gtcatccagagtcagtgtccaagca

SEQ ID NO: 42052 - DNA, 25 bp, S. cerevisiae
gtagtgatgatgaccgcgctgatga

SEQ ID NO: 42053 - DNA, 25 bp, S. cerevisiae
gtagacccaggttttgatgagtttc

SEQ ID NO: 42054 - DNA, 25 bp, S. cerevisiae
gtagtacgcagacgtttgtgcctat

SEQ ID NO: 42055 - DNA, 25 bp, S. cerevisiae
gtagttagagcaggcttcactccaa

SEQ ID NO: 42056 - DNA, 25 bp, S. cerevisiae
gtagggcctatccagagcagttcaa

SEQ ID NO: 42057 - DNA, 25 bp, S. cerevisiae
gtaccgcaacttcgacgtttttgag

SEQ ID NO: 42058 - DNA, 25 bp, S. cerevisiae
gtacccatatcttacaggtcgtatt

SEQ ID NO: 42059 - DNA, 25 bp, S. cerevisiae
gtaggtatattgtctcagcgtcttt

SEQ ID NO: 42060 - DNA, 25 bp, S. cerevisiae
gtagtgtgtccggttcgaagttgat

SEQ ID NO: 42061 - DNA, 25 bp, S. cerevisiae
gtagcagaaacttaccaacgatagt

SEQ ID NO: 42062 - DNA, 25 bp, S. cerevisiae
gtagatgcaaccaaactgacacctg

SEQ ID NO: 42063 - DNA, 25 bp, S. cerevisiae
gtagacaactattcagcgacccatg

SEQ ID NO: 42064 - DNA, 25 bp, S. cerevisiae
gtaggcaactatacactgaccgtgg

SEQ ID NO: 42065 - DNA, 25 bp, S. cerevisiae
gtatggacattttcactgctcacag

SEQ ID NO: 42066 - DNA, 25 bp, S. cerevisiae
gtatggttggctaacttcatcagta

SEQ ID NO: 42067 - DNA, 25 bp, S. cerevisiae
gtatgggtaccaactctgcatcagg

SEQ ID NO: 42068 - DNA, 25 bp, S. cerevisiae
gtagtcctattccaatagctccgat

SEQ ID NO: 42069 - DNA, 25 bp, S. cerevisiae
gtatgctgctcctggactaactaat

SEQ ID NO: 42070 - DNA, 25 bp, S. cerevisiae
gtagctgtacgggtgcttttaatac

SEQ ID NO: 42071 - DNA, 25 bp, S. cerevisiae
gtagaccaactagccatattccaga

SEQ ID NO: 42072 - DNA, 25 bp, S. cerevisiae
gtatgggcgcttggctcaaacacaa

SEQ ID NO: 42073 - DNA, 25 bp, S. cerevisiae
gtatgggccatcattacgtacaaga

SEQ ID NO: 42074 - DNA, 25 bp, S. cerevisiae
gtagtgccacatggaaacgttgtat

SEQ ID NO: 42075 - DNA, 25 bp, S. cerevisiae
gtatgagaccatgcaaccgcttagt

SEQ ID NO: 42076 - DNA, 25 bp, S. cerevisiae
gtatgcaatgccaacaaccttcagg

SEQ ID NO: 42077 - DNA, 25 bp, S. cerevisiae
gtatgattgccattaacccaggtag

SEQ ID NO: 42078 - DNA, 25 bp, S. cerevisiae
gtagattccaaaccccagctgaaaa

SEQ ID NO: 42079 - DNA, 25 bp, S. cerevisiae
gtaggcttcactgctcatgggagag

SEQ ID NO: 42080 - DNA, 25 bp, S. cerevisiae
gtctgcgtacttttgtgggtggccc

SEQ ID NO: 42081 - DNA, 25 bp, S. cerevisiae
gtatgtctaccgattacgacgcatg

SEQ ID NO: 42082 - DNA, 25 bp, S. cerevisiae
gtagtatcgccgaagtcggaccata

SEQ ID NO: 42083 - DNA, 25 bp, S. cerevisiae
gtagtatgacaattatttacccgct

SEQ ID NO: 42084 - DNA, 25 bp, S. cerevisiae
gtagtagacaattcctttaccagaa

SEQ ID NO: 42085 - DNA, 25 bp, S. cerevisiae
gtagtttctatactgttgttggtgt

SEQ ID NO: 42086 - DNA, 25 bp, S. cerevisiae
gtatggcatttgtcactttcagtgg

SEQ ID NO: 42087 - DNA, 25 bp, S. cerevisiae
ttcatgcatactggcgatgggctgc

SEQ ID NO: 42088 - DNA, 25 bp, S. cerevisiae
gtatgacaccaggatggagctcctt

SEQ ID NO: 42089 - DNA, 25 bp, S. cerevisiae
gtagaagtaggcaagacatccatat

SEQ ID NO: 42090 - DNA, 25 bp, S. cerevisiae
gtagaaaatctcctgacccaattga

SEQ ID NO: 42091 - DNA, 25 bp, S. cerevisiae
gtaagtcaacttcatctccttcagt

SEQ ID NO: 42092 - DNA, 25 bp, S. cerevisiae
gtaggcgtcaagcttaagttcaaca

SEQ ID NO: 42093 - DNA, 25 bp, S. cerevisiae
gtacggtccaccaaaggctgctaac

SEQ ID NO: 42094 - DNA, 25 bp, S. cerevisiae
ggactgggaccgctaatggcaaaat

SEQ ID NO: 42095 - DNA, 25 bp, S. cerevisiae
gtacggtaccatcttaggcaacatt

SEQ ID NO: 42096 - DNA, 25 bp, S. cerevisiae
gtagtagttctgtgctttccaagag

SEQ ID NO: 42097 - DNA, 25 bp, S. cerevisiae
gtactcgttcggctattccaagaat

SEQ ID NO: 42098 - DNA, 25 bp, S. cerevisiae
gtaacttggccatcggtgaccagga

SEQ ID NO: 42099 - DNA, 25 bp, S. cerevisiae
gtagaatcgcggttcgttgaatcct

SEQ ID NO: 42100 - DNA, 25 bp, S. cerevisiae
gtatgtggattcacttgccaatcat

SEQ ID NO: 42101 - DNA, 25 bp, S. cerevisiae
gtagatcaagatcgccattcacagt

SEQ ID NO: 42102 - DNA, 25 bp, S. cerevisiae
gtaatccatagcgacttgcgtgaaa

SEQ ID NO: 42103 - DNA, 25 bp, S. cerevisiae
gtaatcaaagagacttggcaagaca

SEQ ID NO: 42104 - DNA, 25 bp, S. cerevisiae
gtaggaggaagcatcgtcacgacat

SEQ ID NO: 42105 - DNA, 25 bp, S. cerevisiae
gtagcaaggacgatattggcgacat

SEQ ID NO: 42106 - DNA, 25 bp, S. cerevisiae
gtagataaagctgcacatcttgatg

SEQ ID NO: 42107 - DNA, 25 bp, S. cerevisiae
gtagcgcacaccagagtcctcaatt

SEQ ID NO: 42108 - DNA, 25 bp, S. cerevisiae
gtagcgcaccaagaggccgaatatt

SEQ ID NO: 42109 - DNA, 25 bp, S. cerevisiae
gtaggcgcttttatctccagaggtg

SEQ ID NO: 42110 - DNA, 25 bp, S. cerevisiae
gtaggcctttccactgaagagctag

SEQ ID NO: 42111 - DNA, 25 bp, S. cerevisiae
gtatggcctttcgtttttgagcaca

SEQ ID NO: 42112 - DNA, 25 bp, S. cerevisiae
gtgaggacccgcagtacgtctggat

SEQ ID NO: 42113 - DNA, 25 bp, S. cerevisiae
tctggcgacccttcgtaaactcaat

SEQ ID NO: 42114 - DNA, 25 bp, S. cerevisiae
gtgacggccccttcataaaagatca

SEQ ID NO: 42115 - DNA, 25 bp, S. cerevisiae
gtagagttcccttttatgaaacaag

SEQ ID NO: 42116 - DNA, 25 bp, S. cerevisiae
gtagagtaccctgttggtcacaaat

SEQ ID NO: 42117 - DNA, 25 bp, S. cerevisiae
gtagtgctactgtatctagtggtaa

SEQ ID NO: 42118 - DNA, 25 bp, S. cerevisiae
gtagtgtcacccatagatgcttaca

SEQ ID NO: 42119 - DNA, 25 bp, S. cerevisiae
gtacgttccccaagacgacgatttg

SEQ ID NO: 42120 - DNA, 25 bp, S. cerevisiae
gtagcattaccatgggacgctccat

SEQ ID NO: 42121 - DNA, 25 bp, S. cerevisiae
gtagcacaactgtcgtgaatgccag

SEQ ID NO: 42122 - DNA, 25 bp, S. cerevisiae
gtagactgacattggatattcctgt

SEQ ID NO: 42123 - DNA, 25 bp, S. cerevisiae
gtaggcctgctattcaattgctctc

SEQ ID NO: 42124 - DNA, 25 bp, S. cerevisiae
gtaccatttacgctcattgttcttc

SEQ ID NO: 42125 - DNA, 25 bp, S. cerevisiae
gtacactttgggagcatcttattcg

SEQ ID NO: 42126 - DNA, 25 bp, S. cerevisiae
gtacgtacgcggatgactgtttagt

SEQ ID NO: 42127 - DNA, 25 bp, S. cerevisiae
gtacccacagggaagatccttttcg

SEQ ID NO: 42128 - DNA, 25 bp, S. cerevisiae
gtagaacttgacctcgacactttag

SEQ ID NO: 42129 - DNA, 25 bp, S. cerevisiae
gtagaagggcacctttgcagcttcc

SEQ ID NO: 42130 - DNA, 25 bp, S. cerevisiae
gtacaagtagcatctcttgctgctc

SEQ ID NO: 42131 - DNA, 25 bp, S. cerevisiae
gtaccgtatcacaatattctgccag

SEQ ID NO: 42132 - DNA, 25 bp, S. cerevisiae
gtaccactgaacaagtttgggtgct

SEQ ID NO: 42133 - DNA, 25 bp, S. cerevisiae
gtacgttatacatgtcgggtggctt

SEQ ID NO: 42134 - DNA, 25 bp, S. cerevisiae
gtactgtttacatgactccgggcga

SEQ ID NO: 42135 - DNA, 25 bp, S. cerevisiae
gtactgtttacagactcaaagagct

SEQ ID NO: 42136 - DNA, 25 bp, S. cerevisiae
gtactgttatcctctgtaagtcgtt

SEQ ID NO: 42137 - DNA, 25 bp, S. cerevisiae
gtagctgtttccactgcatgaagca

SEQ ID NO: 42138 - DNA, 25 bp, S. cerevisiae
gtagctatgctcctatcggcaataa

SEQ ID NO: 42139 - DNA, 25 bp, S. cerevisiae
gtatggtcgttcaagaaccgatcaa

SEQ ID NO: 42140 - DNA, 25 bp, S. cerevisiae
gtagttcagttgttgatccaggaca

SEQ ID NO: 42141 - DNA, 25 bp, S. cerevisiae
gtagatgtcgtagctatccttctca

SEQ ID NO: 42142 - DNA, 25 bp, S. cerevisiae
gtagatcctctaataatgactttca

SEQ ID NO: 42143 - DNA, 25 bp, S. cerevisiae
gtaggccagttgactcaaaggctat

SEQ ID NO: 42144 - DNA, 25 bp, S. cerevisiae
gtaggaactgtactcataatgcatt

SEQ ID NO: 42145 - DNA, 25 bp, S. cerevisiae
gtaggaacttctgcaacatgttgta

SEQ ID NO: 42146 - DNA, 25 bp, S. cerevisiae
gtagtgatcactttccttgctgctt

SEQ ID NO: 42147 - DNA, 25 bp, S. cerevisiae
gtagctacagcgttcactttggcat

SEQ ID NO: 42148 - DNA, 25 bp, S. cerevisiae
gtagaatgcttcgaatcctttattg

SEQ ID NO: 42149 - DNA, 25 bp, S. cerevisiae
gtagttggcttatccagtttaccag

SEQ ID NO: 42150 - DNA, 25 bp, S. cerevisiae
tgtaagggcctttccagtattacaa

SEQ ID NO: 42151 - DNA, 25 bp, S. cerevisiae
gtagcacttacctcacatgacaaac

SEQ ID NO: 42152 - DNA, 25 bp, S. cerevisiae
gtagcattaccatcacaagacaaaa

SEQ ID NO: 42153 - DNA, 25 bp, S. cerevisiae
gtactgattctgtccagcaagccaa

SEQ ID NO: 42154 - DNA, 25 bp, S. cerevisiae
gtagctatattctcagcggcgccga

SEQ ID NO: 42155 - DNA, 25 bp, S. cerevisiae
gtactaagtccaatcgagcccaata

SEQ ID NO: 42156 - DNA, 25 bp, S. cerevisiae
gtactaagtacccaggcgctactaa

SEQ ID NO: 42157 - DNA, 25 bp, S. cerevisiae
gtaataacgaccatggccaactagg

SEQ ID NO: 42158 - DNA, 25 bp, S. cerevisiae
gtacaaacgtatgtggcccatgcct

SEQ ID NO: 42159 - DNA, 25 bp, S. cerevisiae
gtactggacggagagttgccactaa

SEQ ID NO: 42160 - DNA, 25 bp, S. cerevisiae
gtacttcaatggaaaggtccccatg

SEQ ID NO: 42161 - DNA, 25 bp, S. cerevisiae
gtaccgcaaggagttaatccaccat

SEQ ID NO: 42162 - DNA, 25 bp, S. cerevisiae
gtacctaagggactctggtgaccat

SEQ ID NO: 42163 - DNA, 25 bp, S. cerevisiae
gtacctatcgtctatctggagttca

SEQ ID NO: 42164 - DNA, 25 bp, S. cerevisiae
gtagcgcttttattaagagttcatc

SEQ ID NO: 42165 - DNA, 25 bp, S. cerevisiae
gtagcacttctaacaaagcaggatc

SEQ ID NO: 42166 - DNA, 25 bp, S. cerevisiae
gtacctacgagccacactgatggat

SEQ ID NO: 42167 - DNA, 25 bp, S. cerevisiae
gtacccatacgacgctgatgacgat

SEQ ID NO: 42168 - DNA, 25 bp, S. cerevisiae
gtacacctagaaccagatacgactg

SEQ ID NO: 42169 - DNA, 25 bp, S. cerevisiae
gtagatctcacttttatttttggca

SEQ ID NO: 42170 - DNA, 25 bp, S. cerevisiae
gtaggccacatatttttgctgggta

SEQ ID NO: 42171 - DNA, 25 bp, S. cerevisiae
gtaggcgcatattttgtgctctcgc

SEQ ID NO: 42172 - DNA, 25 bp, S. cerevisiae
gtaggcgcatacttctatcatacgt

SEQ ID NO: 42173 - DNA, 25 bp, S. cerevisiae
gtagcagcgggcgtatatcttggta

SEQ ID NO: 42174 - DNA, 25 bp, S. cerevisiae
gtagcagtccgcaaaatcaatgatg

SEQ ID NO: 42175 - DNA, 25 bp, S. cerevisiae
gtaccacgtcgcaaaattagcacag

SEQ ID NO: 42176 - DNA, 25 bp, S. cerevisiae
gtaccggttccagtattaatcacaa

SEQ ID NO: 42177 - DNA, 25 bp, S. cerevisiae
gtagccaattttatcttactaacaa

SEQ ID NO: 42178 - DNA, 25 bp, S. cerevisiae
gtacgcaaccagttttcgagcttga

SEQ ID NO: 42179 - DNA, 25 bp, S. cerevisiae
gtagcgattccaagtcttctggctg

SEQ ID NO: 42180 - DNA, 25 bp, S. cerevisiae
gtagtctatcttggagccacctatc

SEQ ID NO: 42181 - DNA, 25 bp, S. cerevisiae
gtcacgcaattgtcgtaaggtctaa

SEQ ID NO: 42182 - DNA, 25 bp, S. cerevisiae
gtagtcaccgcagccaaagttttat

SEQ ID NO: 42183 - DNA, 25 bp, S. cerevisiae
gtagacccggtttcaagctgttgtt

SEQ ID NO: 42184 - DNA, 25 bp, S. cerevisiae
gtagtcgtgaatctttgctcaccaa

SEQ ID NO: 42185 - DNA, 25 bp, S. cerevisiae
gtagctgctgagacgattaccaata

SEQ ID NO: 42186 - DNA, 25 bp, S. cerevisiae
gtacgtgcagcacttcaaatgcaat

SEQ ID NO: 42187 - DNA, 25 bp, S. cerevisiae
gtactgctgagcgatcatcaatcac

SEQ ID NO: 42188 - DNA, 25 bp, S. cerevisiae
gtagatcagcagcaatacgccatgg

SEQ ID NO: 42189 - DNA, 25 bp, S. cerevisiae
gtaagaccgagaagaaggattggaa

SEQ ID NO: 42190 - DNA, 25 bp, S. cerevisiae
gtagctcagccgatgccaggtgtaa

SEQ ID NO: 42191 - DNA, 25 bp, S. cerevisiae
gtacgcccagcgacaaggtgataac

SEQ ID NO: 42192 - DNA, 25 bp, S. cerevisiae
gtaccggccagaccgatattcaatt

SEQ ID NO: 42193 - DNA, 25 bp, S. cerevisiae
gtacggccacgcaacagtatgggat

SEQ ID NO: 42194 - DNA, 25 bp, S. cerevisiae
gtaccccacgcaagatgaatttgat

SEQ ID NO: 42195 - DNA, 25 bp, S. cerevisiae
gtaccgcccgcaagattaagttcaa

SEQ ID NO: 42196 - DNA, 25 bp, S. cerevisiae
gtaattttactcttgcgggcattcc

SEQ ID NO: 42197 - DNA, 25 bp, S. cerevisiae
gtagtattttcaccgcatagaccaa

SEQ ID NO: 42198 - DNA, 25 bp, S. cerevisiae
gtagattggttatctcagcggctaa

SEQ ID NO: 42199 - DNA, 25 bp, S. cerevisiae
gtagagttactgactcgactcgcca

SEQ ID NO: 42200 - DNA, 25 bp, S. cerevisiae
gtagaacctcgtcagatatcgcgtg

SEQ ID NO: 42201 - DNA, 25 bp, S. cerevisiae
gtagatccggtaggtttggccactt

SEQ ID NO: 42202 - DNA, 25 bp, S. cerevisiae
gtagaaactgctcatgttgctaaag

SEQ ID NO: 42203 - DNA, 25 bp, S. cerevisiae
gtagatcccttcgatgttcatgaat

SEQ ID NO: 42204 - DNA, 25 bp, S. cerevisiae
gtagcagctgctgaagcttccaaga

SEQ ID NO: 42205 - DNA, 25 bp, S. cerevisiae
gtagcctctgctaagatccacaaac

SEQ ID NO: 42206 - DNA, 25 bp, S. cerevisiae
gtagcattcatcaaggcacaccagt

SEQ ID NO: 42207 - DNA, 25 bp, S. cerevisiae
gtagagtgatcttgacgcccaatgt

SEQ ID NO: 42208 - DNA, 25 bp, S. cerevisiae
gtagcgctgactttatccaaaatgt

SEQ ID NO: 42209 - DNA, 25 bp, S. cerevisiae
gtagcagtacttaatccggatggat

SEQ ID NO: 42210 - DNA, 25 bp, S. cerevisiae
gtagctattttttccagtcggcaaa

SEQ ID NO: 42211 - DNA, 25 bp, S. cerevisiae
gtagttctttttcatatcagtggac

SEQ ID NO: 42212 - DNA, 25 bp, S. cerevisiae
gtagcactatgttcctttacgttaa

SEQ ID NO: 42213 - DNA, 25 bp, S. cerevisiae
gtagtgtcagttatgcttcaggtta

SEQ ID NO: 42214 - DNA, 25 bp, S. cerevisiae
gtagtgttgacatgatcttgcagaa

SEQ ID NO: 42215 - DNA, 25 bp, S. cerevisiae
gtagtcccagttctgctgctaattt

SEQ ID NO: 42216 - DNA, 25 bp, S. cerevisiae
gtagtgccagcgatcttgagataat

SEQ ID NO: 42217 - DNA, 25 bp, S. cerevisiae
gtagtgacaaacatgcctctggata

SEQ ID NO: 42218 - DNA, 25 bp, S. cerevisiae
gtagctacaaacgatgccggcctga

SEQ ID NO: 42219 - DNA, 25 bp, S. cerevisiae
gtagtcataaatcgtctcgtgcctc

SEQ ID NO: 42220 - DNA, 25 bp, S. cerevisiae
gtagttgaattacctcattgccatc

SEQ ID NO: 42221 - DNA, 25 bp, S. cerevisiae
gtaccgcaaatgtctctgtctatga

SEQ ID NO: 42222 - DNA, 25 bp, S. cerevisiae
gtagaaccacatacctctgttgatg

SEQ ID NO: 42223 - DNA, 25 bp, S. cerevisiae
gtactgttccactgctttcatagat

SEQ ID NO: 42224 - DNA, 25 bp, S. cerevisiae
gtacggtctctctgatggcgaagat

SEQ ID NO: 42225 - DNA, 25 bp, S. cerevisiae
gtagcacctggcgtattgactgaac

SEQ ID NO: 42226 - DNA, 25 bp, S. cerevisiae
gtagccatcgcacctgttaatgaac

SEQ ID NO: 42227 - DNA, 25 bp, S. cerevisiae
gtacctcatgctcttctagtgaagt

SEQ ID NO: 42228 - DNA, 25 bp, S. cerevisiae
gtactctccaggtgacttgatcatt

SEQ ID NO: 42229 - DNA, 25 bp, S. cerevisiae
gtagccaacgtaggagccttccaaa

SEQ ID NO: 42230 - DNA, 25 bp, S. cerevisiae
gtacaccaaagagtttcctacagtt

SEQ ID NO: 42231 - DNA, 25 bp, S. cerevisiae
gtacccaatgagctgttgccattca

SEQ ID NO: 42232 - DNA, 25 bp, S. cerevisiae
gtagcgttctcatcttataccaact

SEQ ID NO: 42233 - DNA, 25 bp, S. cerevisiae
gtagcggctcaacctttttgacaaa

SEQ ID NO: 42234 - DNA, 25 bp, S. cerevisiae
gtagcgagatcttcacacttttggt

SEQ ID NO: 42235 - DNA, 25 bp, S. cerevisiae
gtagcgataggtacctcactcattg

SEQ ID NO: 42236 - DNA, 25 bp, S. cerevisiae
gtagcaattggttccagagcacata

SEQ ID NO: 42237 - DNA, 25 bp, S. cerevisiae
gtagaattgtcattcctgctccata

SEQ ID NO: 42238 - DNA, 25 bp, S. cerevisiae
gtagaatgactccatctggtcacaa

SEQ ID NO: 42239 - DNA, 25 bp, S. cerevisiae
gtagaaggtccagtggctcatcacc

SEQ ID NO: 42240 - DNA, 25 bp, S. cerevisiae
gtagaaggcttcttactccaaccgt

SEQ ID NO: 42241 - DNA, 25 bp, S. cerevisiae
gtagaaggtgttttcaaccactctt

SEQ ID NO: 42242 - DNA, 25 bp, S. cerevisiae
gtactcggctgactgctataaaagt

SEQ ID NO: 42243 - DNA, 25 bp, S. cerevisiae
gtacccctgaagaatcaaacgtgtt

SEQ ID NO: 42244 - DNA, 25 bp, S. cerevisiae
gtacgctttaatgacaccggaattg

SEQ ID NO: 42245 - DNA, 25 bp, S. cerevisiae
gtacccttcaaaagaccattggatt

SEQ ID NO: 42246 - DNA, 25 bp, S. cerevisiae
gtcacccctttctaataacgcatta

SEQ ID NO: 42247 - DNA, 25 bp, S. cerevisiae
gtacgtcctattgattacgcgtgta

SEQ ID NO: 42248 - DNA, 25 bp, S. cerevisiae
gtacgatgcgttaaatttctgattg

SEQ ID NO: 42249 - DNA, 25 bp, S. cerevisiae
gtaccgttaccgttgacttatcaga

SEQ ID NO: 42250 - DNA, 25 bp, S. cerevisiae
gtactggtaagagattggctaagaa

SEQ ID NO: 42251 - DNA, 25 bp, S. cerevisiae
gtagaaagcgctggtgccatgacac

SEQ ID NO: 42252 - DNA, 25 bp, S. cerevisiae
gtagcgcgctgacttatgacaggtt

SEQ ID NO: 42253 - DNA, 25 bp, S. cerevisiae
gtcagccagggtttgatcggattaa

SEQ ID NO: 42254 - DNA, 25 bp, S. cerevisiae
ggcccaaattggctggaccacgcat

SEQ ID NO: 42255 - DNA, 25 bp, S. cerevisiae
ggtacaatttggcagcctacacgta

SEQ ID NO: 42256 - DNA, 25 bp, S. cerevisiae
gggacattttggcaggtactattca

SEQ ID NO: 42257 - DNA, 25 bp, S. cerevisiae
gtaaagagactacctcctggtcttt

SEQ ID NO: 42258 - DNA, 25 bp, S. cerevisiae
gtactggagagtagaccctggtatt

SEQ ID NO: 42259 - DNA, 25 bp, S. cerevisiae
gtacaggcacaccagaacatgatca

SEQ ID NO: 42260 - DNA, 25 bp, S. cerevisiae
gtactcgcatcactcggacgtagaa

SEQ ID NO: 42261 - DNA, 25 bp, S. cerevisiae
gtaccctgcttcagtggaccatgaa

SEQ ID NO: 42262 - DNA, 25 bp, S. cerevisiae
gtagcccttgtagcgattcatggaa

SEQ ID NO: 42263 - DNA, 25 bp, S. cerevisiae
gtaccaattcgtcctttaacactag

SEQ ID NO: 42264 - DNA, 25 bp, S. cerevisiae
gtacgctttggttttcataacacga

SEQ ID NO: 42265 - DNA, 25 bp, S. cerevisiae
gtactttttcttatatgtcaacggg

SEQ ID NO: 42266 - DNA, 25 bp, S. cerevisiae
gtacctggtgagctttatgatgcga

SEQ ID NO: 42267 - DNA, 25 bp, S. cerevisiae
gtaccggtagagactgcattagcaa

SEQ ID NO: 42268 - DNA, 25 bp, S. cerevisiae
gtaccgctggtagccttcaaattgt

SEQ ID NO: 42269 - DNA, 25 bp, S. cerevisiae
gtaagccggtcgctcatgagttgaa

SEQ ID NO: 42270 - DNA, 25 bp, S. cerevisiae
gtaacgcgcaaacactaccgctata

SEQ ID NO: 42271 - DNA, 25 bp, S. cerevisiae
gtaccgggtcagcatttgccgataa

SEQ ID NO: 42272 - DNA, 25 bp, S. cerevisiae
gtgaaacgaacctgcgctaccgata

SEQ ID NO: 42273 - DNA, 25 bp, S. cerevisiae
gtagagcacttatgggcctatttga

SEQ ID NO: 42274 - DNA, 25 bp, S. cerevisiae
gtagagactctttctggtgatttca

SEQ ID NO: 42275 - DNA, 25 bp, S. cerevisiae
gtagagcactccatgctgattgcca

SEQ ID NO: 42276 - DNA, 25 bp, S. cerevisiae
gtagagctgttatgtgcgttgccaa

SEQ ID NO: 42277 - DNA, 25 bp, S. cerevisiae
gtagcgagcctattgatccttcgaa

SEQ ID NO: 42278 - DNA, 25 bp, S. cerevisiae
gtagcgaccataacaccagtaacaa

SEQ ID NO: 42279 - DNA, 25 bp, S. cerevisiae
gtactgccgcaaaagaagctaccga

SEQ ID NO: 42280 - DNA, 25 bp, S. cerevisiae
gtacgcccagcatagcatgatgttc

SEQ ID NO: 42281 - DNA, 25 bp, S. cerevisiae
gtacttgtacttgagagctgtcggt

SEQ ID NO: 42282 - DNA, 25 bp, S. cerevisiae
gtacagtttgccacgaatgtcaggt

SEQ ID NO: 42283 - DNA, 25 bp, S. cerevisiae
gtacgagatctcgagctattcaaag

SEQ ID NO: 42284 - DNA, 25 bp, S. cerevisiae
gtacgacagataacgcttcaaattc

SEQ ID NO: 42285 - DNA, 25 bp, S. cerevisiae
gtacgacgactctgggcatatatta

SEQ ID NO: 42286 - DNA, 25 bp, S. cerevisiae
gtacgattactctggcggtgattat

SEQ ID NO: 42287 - DNA, 25 bp, S. cerevisiae
gtaagattggcctgtcgttcactac

SEQ ID NO: 42288 - DNA, 25 bp, S. cerevisiae
ggaaatttgactatcgtgtccccaa

SEQ ID NO: 42289 - DNA, 25 bp, S. cerevisiae
gtacgatttagaagcctggttccca

SEQ ID NO: 42290 - DNA, 25 bp, S. cerevisiae
gtgacgaccaagaggaggcttccga

SEQ ID NO: 42291 - DNA, 25 bp, S. cerevisiae
gtacgttgccagaaaggtcgctcta

SEQ ID NO: 42292 - DNA, 25 bp, S. cerevisiae
gtagagttgccggataattacccat

SEQ ID NO: 42293 - DNA, 25 bp, S. cerevisiae
gtagagttcctttcagatttcttgg

SEQ ID NO: 42294 - DNA, 25 bp, S. cerevisiae
gtagaggtactttatttgtccgtgg

SEQ ID NO: 42295 - DNA, 25 bp, S. cerevisiae
gtagcggtactaatagttcctcgga

SEQ ID NO: 42296 - DNA, 25 bp, S. cerevisiae
gtagcggacaacaaacttgcctcag

SEQ ID NO: 42297 - DNA, 25 bp, S. cerevisiae
gtagcatctaccgtgacttatcctc

SEQ ID NO: 42298 - DNA, 25 bp, S. cerevisiae
gtacgtcaagtctactacgccggta

SEQ ID NO: 42299 - DNA, 25 bp, S. cerevisiae
gtacgccaattccagttcagggtga

SEQ ID NO: 42300 - DNA, 25 bp, S. cerevisiae
gtacctaaccaaattcgtcgatgac

SEQ ID NO: 42301 - DNA, 25 bp, S. cerevisiae
gtacctcaaccatttcgactagtgt

SEQ ID NO: 42302 - DNA, 25 bp, S. cerevisiae
gtacttccgtttgtagttggataca

SEQ ID NO: 42303 - DNA, 25 bp, S. cerevisiae
gtagccccattgaccgacagatata

SEQ ID NO: 42304 - DNA, 25 bp, S. cerevisiae
gtagccgtattaagcgccatgaaaa

SEQ ID NO: 42305 - DNA, 25 bp, S. cerevisiae
gtaccaattccaaggcctgacacaa

SEQ ID NO: 42306 - DNA, 25 bp, S. cerevisiae
gtacgattacgactctttagcccga

SEQ ID NO: 42307 - DNA, 25 bp, S. cerevisiae
gtacttaacaacgttgtgccgccta

SEQ ID NO: 42308 - DNA, 25 bp, S. cerevisiae
gtactcctgaatttcccaagtgtgg

SEQ ID NO: 42309 - DNA, 25 bp, S. cerevisiae
gtaccgtttatgttagttgcctcag

SEQ ID NO: 42310 - DNA, 25 bp, S. cerevisiae
gtactcaaatataacgtgctttcta

SEQ ID NO: 42311 - DNA, 25 bp, S. cerevisiae
gtacttgtacaatggattacaacat

SEQ ID NO: 42312 - DNA, 25 bp, S. cerevisiae
gtactggttcaatggctatgccaag

SEQ ID NO: 42313 - DNA, 25 bp, S. cerevisiae
gtactggtttgatgggtgctgccct

SEQ ID NO: 42314 - DNA, 25 bp, S. cerevisiae
gtacaggttcttcaggtgctaccat

SEQ ID NO: 42315 - DNA, 25 bp, S. cerevisiae
gtacggttcgtctaagatacatcct

SEQ ID NO: 42316 - DNA, 25 bp, S. cerevisiae
gtaccgtatcgccttgaaactggct

SEQ ID NO: 42317 - DNA, 25 bp, S. cerevisiae
gtacggtgttagatgatgacataag

SEQ ID NO: 42318 - DNA, 25 bp, S. cerevisiae
gtaccagtgatgtcgttagcattaa

SEQ ID NO: 42319 - DNA, 25 bp, S. cerevisiae
gtacgcagttgctttcatggatggg

SEQ ID NO: 42320 - DNA, 25 bp, S. cerevisiae
gtaccgatgggtataatgcatttca

SEQ ID NO: 42321 - DNA, 25 bp, S. cerevisiae
gtaccacagtagattctgcccaata

SEQ ID NO: 42322 - DNA, 25 bp, S. cerevisiae
gtaccaccacaacagagagcacttt

SEQ ID NO: 42323 - DNA, 25 bp, S. cerevisiae
gtacgcattcctgttcaagagactg

SEQ ID NO: 42324 - DNA, 25 bp, S. cerevisiae
gtaccttccgacgtaaacattgacg

SEQ ID NO: 42325 - DNA, 25 bp, S. cerevisiae
gtacgtaagcaataccctgttgaag

SEQ ID NO: 42326 - DNA, 25 bp, S. cerevisiae
gtacgctagaaattcctctgcttgg

SEQ ID NO: 42327 - DNA, 25 bp, S. cerevisiae
gtactcaagtcttctgtatcaggga

SEQ ID NO: 42328 - DNA, 25 bp, S. cerevisiae
gtacgaattgcttcaggccagggat

SEQ ID NO: 42329 - DNA, 25 bp, S. cerevisiae
gtagcggctcatcttctaaaggcaa

SEQ ID NO: 42330 - DNA, 25 bp, S. cerevisiae
gtacttctggttcggatgtcggcaa

SEQ ID NO: 42331 - DNA, 25 bp, S. cerevisiae
gtactcttttcgttactggtcatcg

SEQ ID NO: 42332 - DNA, 25 bp, S. cerevisiae
gtagcgttggacctatacttccaaa

SEQ ID NO: 42333 - DNA, 25 bp, S. cerevisiae
gtacgttagcgcatactttgtcgtt

SEQ ID NO: 42334 - DNA, 25 bp, S. cerevisiae
gtacccaattttccttttagatgat

SEQ ID NO: 42335 - DNA, 25 bp, S. cerevisiae
gtactccattgtttaccgtcaaggc

SEQ ID NO: 42336 - DNA, 25 bp, S. cerevisiae
gtagcaacgccgttaccttcaagga

SEQ ID NO: 42337 - DNA, 25 bp, S. cerevisiae
gtaccatacatataacctcatctat

SEQ ID NO: 42338 - DNA, 25 bp, S. cerevisiae
gtagcaatatcatgaccagacctat

SEQ ID NO: 42339 - DNA, 25 bp, S. cerevisiae
gtacttcccaatctcacctgaaaaa

SEQ ID NO: 42340 - DNA, 25 bp, S. cerevisiae
gtacctggatttttatggcggcttt

SEQ ID NO: 42341 - DNA, 25 bp, S. cerevisiae
gtacttcgaagttatcttggtcgac

SEQ ID NO: 42342 - DNA, 25 bp, S. cerevisiae
gtgagttcaaagacgccttggccaa

SEQ ID NO: 42343 - DNA, 25 bp, S. cerevisiae
gtacgacacaagttcccataccaaa

SEQ ID NO: 42344 - DNA, 25 bp, S. cerevisiae
gtaccagccaaatctctgaatctca

SEQ ID NO: 42345 - DNA, 25 bp, S. cerevisiae
gtaccacctatactcttgtcattga

SEQ ID NO: 42346 - DNA, 25 bp, S. cerevisiae
gtaccatccacatattttttccaag

SEQ ID NO: 42347 - DNA, 25 bp, S. cerevisiae
gtaccggatcatcttttattccaag

SEQ ID NO: 42348 - DNA, 25 bp, S. cerevisiae
gtacctgtactacgtggctgtattg

SEQ ID NO: 42349 - DNA, 25 bp, S. cerevisiae
gtagccaaagcggtatcatcgttga

SEQ ID NO: 42350 - DNA, 25 bp, S. cerevisiae
gtaccaaatgcacccacatcattat

SEQ ID NO: 42351 - DNA, 25 bp, S. cerevisiae
gtaagaaatgctcgcggctcactga

SEQ ID NO: 42352 - DNA, 25 bp, S. cerevisiae
gtaagcaaatctacttctccggctg

SEQ ID NO: 42353 - DNA, 25 bp, S. cerevisiae
gtacccagtgcgtatggaaccagat

SEQ ID NO: 42354 - DNA, 25 bp, S. cerevisiae
gtagcggtacgttcaattccataat

SEQ ID NO: 42355 - DNA, 25 bp, S. cerevisiae
gtagcgtgtcaaattctttgccaaa

SEQ ID NO: 42356 - DNA, 25 bp, S. cerevisiae
gtacgttactagtctttgacacaag

SEQ ID NO: 42357 - DNA, 25 bp, S. cerevisiae
gtacgttacatgtttttcagaccag

SEQ ID NO: 42358 - DNA, 25 bp, S. cerevisiae
gtacgcgggcatttatttcatggaa

SEQ ID NO: 42359 - DNA, 25 bp, S. cerevisiae
gtaccagcaactactctatatcatt

SEQ ID NO: 42360 - DNA, 25 bp, S. cerevisiae
gtacgcgctggcaattgttccagat

SEQ ID NO: 42361 - DNA, 25 bp, S. cerevisiae
gtacgccatgtatatgttgggcctt

SEQ ID NO: 42362 - DNA, 25 bp, S. cerevisiae
gtagctctagcattggatcttacag

SEQ ID NO: 42363 - DNA, 25 bp, S. cerevisiae
gtagcatctcattgtgcgttcacac

SEQ ID NO: 42364 - DNA, 25 bp, S. cerevisiae
gtacaccttaggttacaagtccact

SEQ ID NO: 42365 - DNA, 25 bp, S. cerevisiae
gtacttcctagacgttaagtgccca

SEQ ID NO: 42366 - DNA, 25 bp, S. cerevisiae
gtcagttggtggtcgttaagtcttt

SEQ ID NO: 42367 - DNA, 25 bp, S. cerevisiae
gtacttggacgtcttcacagatttt

SEQ ID NO: 42368 - DNA, 25 bp, S. cerevisiae
gtagctatacttctgcgttatgcaa

SEQ ID NO: 42369 - DNA, 25 bp, S. cerevisiae
gtaccatacttcgtcttcattcaaa

SEQ ID NO: 42370 - DNA, 25 bp, S. cerevisiae
gtcactattcatctcaatgctctgt

SEQ ID NO: 42371 - DNA, 25 bp, S. cerevisiae
gtaccatcgcgttcacattgctatg

SEQ ID NO: 42372 - DNA, 25 bp, S. cerevisiae
gtaatcagatgcaaccgaacggaag

SEQ ID NO: 42373 - DNA, 25 bp, S. cerevisiae
gtacccgctcttcgtcaaagatata

SEQ ID NO: 42374 - DNA, 25 bp, S. cerevisiae
gtaccggccccgcaagagaaagcat

SEQ ID NO: 42375 - DNA, 25 bp, S. cerevisiae
gtacctgccccaactaagaatgaag

SEQ ID NO: 42376 - DNA, 25 bp, S. cerevisiae
gtaaatgcccctgacaagactgaag

SEQ ID NO: 42377 - DNA, 25 bp, S. cerevisiae
gtgaaatcctttgtcaggccagcac

SEQ ID NO: 42378 - DNA, 25 bp, S. cerevisiae
gtaacaccgattgttgagccatcga

SEQ ID NO: 42379 - DNA, 25 bp, S. cerevisiae
gtaaaccgcttctgatgacgtccac

SEQ ID NO: 42380 - DNA, 25 bp, S. cerevisiae
gtactagtccaatgtaaggctttca

SEQ ID NO: 42381 - DNA, 25 bp, S. cerevisiae
gtacagccattggaggtttctcaat

SEQ ID NO: 42382 - DNA, 25 bp, S. cerevisiae
gtaccgatgatgaggctgtctcgac

SEQ ID NO: 42383 - DNA, 25 bp, S. cerevisiae
gtaccgatctgactgcattattgcc

SEQ ID NO: 42384 - DNA, 25 bp, S. cerevisiae
gtacgtgatcctgactacttgaaga

SEQ ID NO: 42385 - DNA, 25 bp, S. cerevisiae
gtacttttacggctctcttgataca

SEQ ID NO: 42386 - DNA, 25 bp, S. cerevisiae
gtacgggttgcacttaccatctgaa

SEQ ID NO: 42387 - DNA, 25 bp, S. cerevisiae
gtacctctttccacacaattgaatg

SEQ ID NO: 42388 - DNA, 25 bp, S. cerevisiae
gtaccacttcccaagtattgcttag

SEQ ID NO: 42389 - DNA, 25 bp, S. cerevisiae
gtactttgtgtaccattgattccat

SEQ ID NO: 42390 - DNA, 25 bp, S. cerevisiae
gtactttttctagtggatcccatga

SEQ ID NO: 42391 - DNA, 25 bp, S. cerevisiae
gtactttgttttgaagctcccactg

SEQ ID NO: 42392 - DNA, 25 bp, S. cerevisiae
gtactatcaggtctcacaagtctcc

SEQ ID NO: 42393 - DNA, 25 bp, S. cerevisiae
gtacttcagttttatcaagttccct

SEQ ID NO: 42394 - DNA, 25 bp, S. cerevisiae
gtacttctgtttctcacgtttcaga

SEQ ID NO: 42395 - DNA, 25 bp, S. cerevisiae
gtaccttttacatcactgcttatca

SEQ ID NO: 42396 - DNA, 25 bp, S. cerevisiae
gtaaatcggtacctacacctagtct

SEQ ID NO: 42397 - DNA, 25 bp, S. cerevisiae
gtacgacgtcaatagctccatcgag

SEQ ID NO: 42398 - DNA, 25 bp, S. cerevisiae
gtacgacgtggctggtgccatcaaa

SEQ ID NO: 42399 - DNA, 25 bp, S. cerevisiae
gtacttactgtaacgtctcttcgac

SEQ ID NO: 42400 - DNA, 25 bp, S. cerevisiae
gtacttgggtcaactattttaacag

SEQ ID NO: 42401 - DNA, 25 bp, S. cerevisiae
gtacccgtccgattacatattcgta

SEQ ID NO: 42402 - DNA, 25 bp, S. cerevisiae
gtaccctgtcgcctttgataatatt

SEQ ID NO: 42403 - DNA, 25 bp, S. cerevisiae
gtaccgtctcctaccgtagatatat

SEQ ID NO: 42404 - DNA, 25 bp, S. cerevisiae
gtacctgacaacgatccgccagaaa

SEQ ID NO: 42405 - DNA, 25 bp, S. cerevisiae
gtacacggcaatgtccgctggtgaa

SEQ ID NO: 42406 - DNA, 25 bp, S. cerevisiae
gtaccggaatagttactgcgttgca

SEQ ID NO: 42407 - DNA, 25 bp, S. cerevisiae
gtacgcttgaaatccactgcggtaa

SEQ ID NO: 42408 - DNA, 25 bp, S. cerevisiae
gtacgttgacgaacaatccaagaac

SEQ ID NO: 42409 - DNA, 25 bp, S. cerevisiae
gtaagattgacaccgcaaccaagaa

SEQ ID NO: 42410 - DNA, 25 bp, S. cerevisiae
gtaaactacactgccaccattttgg

SEQ ID NO: 42411 - DNA, 25 bp, S. cerevisiae
gtaaacttgccagacttcaattcta

SEQ ID NO: 42412 - DNA, 25 bp, S. cerevisiae
gtaaaagtgttccacgaccctctat

SEQ ID NO: 42413 - DNA, 25 bp, S. cerevisiae
gtaccaagaattgacctccttcgat

SEQ ID NO: 42414 - DNA, 25 bp, S. cerevisiae
gtaccaacaattgtcattcaactta

SEQ ID NO: 42415 - DNA, 25 bp, S. cerevisiae
gtaaccaagaagctttcacccctca

SEQ ID NO: 42416 - DNA, 25 bp, S. cerevisiae
gtaaccaaggcgatttcaaccaaat

SEQ ID NO: 42417 - DNA, 25 bp, S. cerevisiae
gtacctaaagcatcgattcaaccag

SEQ ID NO: 42418 - DNA, 25 bp, S. cerevisiae
gtacctaagcagtgagaaacccagt

SEQ ID NO: 42419 - DNA, 25 bp, S. cerevisiae
gtacactgattacaacaagaacggt

SEQ ID NO: 42420 - DNA, 25 bp, S. cerevisiae
gtagcctttggccaattgatgaacg

SEQ ID NO: 42421 - DNA, 25 bp, S. cerevisiae
gtaccccaatttcgttaatctcact

SEQ ID NO: 42422 - DNA, 25 bp, S. cerevisiae
gtaccgcctatttgaagccagtttt

SEQ ID NO: 42423 - DNA, 25 bp, S. cerevisiae
gtacccagcctttcaaaagttcttg

SEQ ID NO: 42424 - DNA, 25 bp, S. cerevisiae
gtaccccgtgtcttcaaatggtttg

SEQ ID NO: 42425 - DNA, 25 bp, S. cerevisiae
gtcagacgaggtcattcaatggttt

SEQ ID NO: 42426 - DNA, 25 bp, S. cerevisiae
gtaagccgggaaaaatgcatgaatt

SEQ ID NO: 42427 - DNA, 25 bp, S. cerevisiae
gtacgggcttctgttatggtgtcaa

SEQ ID NO: 42428 - DNA, 25 bp, S. cerevisiae
gtaccattcattgactctttcgttc

SEQ ID NO: 42429 - DNA, 25 bp, S. cerevisiae
gtaccacacttcattacgctttgag

SEQ ID NO: 42430 - DNA, 25 bp, S. cerevisiae
gtaccattgttcgataacgctttga

SEQ ID NO: 42431 - DNA, 25 bp, S. cerevisiae
gtactattttggtatacgctacaga

SEQ ID NO: 42432 - DNA, 25 bp, S. cerevisiae
gtactgattttattgacgccttgaa

SEQ ID NO: 42433 - DNA, 25 bp, S. cerevisiae
gtacagatacgtccatgatccactt

SEQ ID NO: 42434 - DNA, 25 bp, S. cerevisiae
gtacgatccgacagaatcctctatg

SEQ ID NO: 42435 - DNA, 25 bp, S. cerevisiae
gtaccagccgacaaaccattagatg

SEQ ID NO: 42436 - DNA, 25 bp, S. cerevisiae
gtaccgctagacaatggccttggca

SEQ ID NO: 42437 - DNA, 25 bp, S. cerevisiae
gtaccttgagataatgtccaccgct

SEQ ID NO: 42438 - DNA, 25 bp, S. cerevisiae
gtaccttcagcatttgttccaggaa

SEQ ID NO: 42439 - DNA, 25 bp, S. cerevisiae
gtaccatgtgccatctatccaataa

SEQ ID NO: 42440 - DNA, 25 bp, S. cerevisiae
gtacaaagggttgagtgcctcttat

SEQ ID NO: 42441 - DNA, 25 bp, S. cerevisiae
gtacaaagagtgcatgaagggttat

SEQ ID NO: 42442 - DNA, 25 bp, S. cerevisiae
gtactcgacatcttatagggtccct

SEQ ID NO: 42443 - DNA, 25 bp, S. cerevisiae
gtaccccatattaagcgtgtcctgt

SEQ ID NO: 42444 - DNA, 25 bp, S. cerevisiae
gtactacacctctcaggacattaga

SEQ ID NO: 42445 - DNA, 25 bp, S. cerevisiae
gtacgacacgatgccgtccagagag

SEQ ID NO: 42446 - DNA, 25 bp, S. cerevisiae
gtaccattttccgttgatccgattt

SEQ ID NO: 42447 - DNA, 25 bp, S. cerevisiae
gtaccttttagcctaagcgccaatt

SEQ ID NO: 42448 - DNA, 25 bp, S. cerevisiae
gtaaatcctgcttggactggcgggt

SEQ ID NO: 42449 - DNA, 25 bp, S. cerevisiae
gtacaattgtttaactcctggtgga

SEQ ID NO: 42450 - DNA, 25 bp, S. cerevisiae
gtacgattctttcaagcctgtgctg

SEQ ID NO: 42451 - DNA, 25 bp, S. cerevisiae
gtacgttgtttcgaatcttgaggtt

SEQ ID NO: 42452 - DNA, 25 bp, S. cerevisiae
gtaacactggccactttactcaagt

SEQ ID NO: 42453 - DNA, 25 bp, S. cerevisiae
gtaccattccgctctatatgtatat

SEQ ID NO: 42454 - DNA, 25 bp, S. cerevisiae
gtacgacgatgtaacctgtgacaaa

SEQ ID NO: 42455 - DNA, 25 bp, S. cerevisiae
gtacaagcttttcactggacatgga

SEQ ID NO: 42456 - DNA, 25 bp, S. cerevisiae
gtactcaatgctgtctactgaacat

SEQ ID NO: 42457 - DNA, 25 bp, S. cerevisiae
ttataacatatctctaccaaacccc

SEQ ID NO: 42458 - DNA, 25 bp, S. cerevisiae
gtaaacagatctaccaccaaaccta

SEQ ID NO: 42459 - DNA, 25 bp, S. cerevisiae
gtacggtatatctgccacaaacttc

SEQ ID NO: 42460 - DNA, 25 bp, S. cerevisiae
gtacgtgattttttccaattcttcg

SEQ ID NO: 42461 - DNA, 25 bp, S. cerevisiae
gtacggtcttatttgccatggtcaa

SEQ ID NO: 42462 - DNA, 25 bp, S. cerevisiae
gtacctctttctttttgatgcttca

SEQ ID NO: 42463 - DNA, 25 bp, S. cerevisiae
gtacccatttctgtttatgattcac

SEQ ID NO: 42464 - DNA, 25 bp, S. cerevisiae
gtacccattgtgttgttcctgatta

SEQ ID NO: 42465 - DNA, 25 bp, S. cerevisiae
gtacgcagtactcatcttcaagaca

SEQ ID NO: 42466 - DNA, 25 bp, S. cerevisiae
gtactctccattggttcgtaacggt

SEQ ID NO: 42467 - DNA, 25 bp, S. cerevisiae
gtacgctcaattgtctttcaagtgg

SEQ ID NO: 42468 - DNA, 25 bp, S. cerevisiae
gtacgctcaattcattaccgtcggg

SEQ ID NO: 42469 - DNA, 25 bp, S. cerevisiae
gtacggaggcttaatgttatcattc

SEQ ID NO: 42470 - DNA, 25 bp, S. cerevisiae
gtaccgtcaacctaggacacatcag

SEQ ID NO: 42471 - DNA, 25 bp, S. cerevisiae
gtactcagtacttcaaaaatcacag

SEQ ID NO: 42472 - DNA, 25 bp, S. cerevisiae
gtactagaaatgtcggagccccggt

SEQ ID NO: 42473 - DNA, 25 bp, S. cerevisiae
gtactacgaagaggcaggcatccac

SEQ ID NO: 42474 - DNA, 25 bp, S. cerevisiae
gtacgacgccatagtgaagcccaca

SEQ ID NO: 42475 - DNA, 25 bp, S. cerevisiae
gtacgcttgcattttttaacgaact

SEQ ID NO: 42476 - DNA, 25 bp, S. cerevisiae
gtacgacgctgatgtgctcgataaa

SEQ ID NO: 42477 - DNA, 25 bp, S. cerevisiae
gtacgtcagctggagcgctaaatct

SEQ ID NO: 42478 - DNA, 25 bp, S. cerevisiae
gtacgctcctgcagagtattgactt

SEQ ID NO: 42479 - DNA, 25 bp, S. cerevisiae
gtacgcaatgtagtggatctgataa

SEQ ID NO: 42480 - DNA, 25 bp, S. cerevisiae
gtacccagcatctatggacttcaat

SEQ ID NO: 42481 - DNA, 25 bp, S. cerevisiae
gtactgtcatcatcgtttgctccga

SEQ ID NO: 42482 - DNA, 25 bp, S. cerevisiae
gtacgattgagtgcttgtctgacga

SEQ ID NO: 42483 - DNA, 25 bp, S. cerevisiae
gtacgcagtggttctttctacagtg

SEQ ID NO: 42484 - DNA, 25 bp, S. cerevisiae
gtactgcgtgtaaatgttcccattg

SEQ ID NO: 42485 - DNA, 25 bp, S. cerevisiae
gtacgctgtcttaagtttgcctgta

SEQ ID NO: 42486 - DNA, 25 bp, S. cerevisiae
gtacggcttaaacatctgtcgtcaa

SEQ ID NO: 42487 - DNA, 25 bp, S. cerevisiae
gtactgtgacttcaaaatcttgcaa

SEQ ID NO: 42488 - DNA, 25 bp, S. cerevisiae
gtactttatcgatctattcctcaca

SEQ ID NO: 42489 - DNA, 25 bp, S. cerevisiae
gtacgcgttgataaagcttccactt

SEQ ID NO: 42490 - DNA, 25 bp, S. cerevisiae
gtaagggtgacgagctctccatttc

SEQ ID NO: 42491 - DNA, 25 bp, S. cerevisiae
gtgaacggcccgctattgaatttga

SEQ ID NO: 42492 - DNA, 25 bp, S. cerevisiae
gtacaggccagtgttcattgacttt

SEQ ID NO: 42493 - DNA, 25 bp, S. cerevisiae
gtacgggagttttcacgcacgctaa

SEQ ID NO: 42494 - DNA, 25 bp, S. cerevisiae
gtaaatatacaccaggatcctcctt

SEQ ID NO: 42495 - DNA, 25 bp, S. cerevisiae
gtacaactacggcatgaacccactg

SEQ ID NO: 42496 - DNA, 25 bp, S. cerevisiae
gtactaatccgccaataacgcactg

SEQ ID NO: 42497 - DNA, 25 bp, S. cerevisiae
gtacagaaggtcttgcggccctcta

SEQ ID NO: 42498 - DNA, 25 bp, S. cerevisiae
gtacaggcgaattgtggtccccata

SEQ ID NO: 42499 - DNA, 25 bp, S. cerevisiae
tgtaacctgtactgaagactccctt

SEQ ID NO: 42500 - DNA, 25 bp, S. cerevisiae
gtaacctgtaagcacggtcacttct

SEQ ID NO: 42501 - DNA, 25 bp, S. cerevisiae
gtaacctctaaccattgggccgaag

SEQ ID NO: 42502 - DNA, 25 bp, S. cerevisiae
gtactacagctatctattggtccga

SEQ ID NO: 42503 - DNA, 25 bp, S. cerevisiae
gtactcaagtggtcatgtttattta

SEQ ID NO: 42504 - DNA, 25 bp, S. cerevisiae
gtaaccggctcattgcacgtttgca

SEQ ID NO: 42505 - DNA, 25 bp, S. cerevisiae
gtactacggcacatgatcaggatat

SEQ ID NO: 42506 - DNA, 25 bp, S. cerevisiae
gtcactgaaggtcaagctgaagcta

SEQ ID NO: 42507 - DNA, 25 bp, S. cerevisiae
gtacatcagggagctgccgaactaa

SEQ ID NO: 42508 - DNA, 25 bp, S. cerevisiae
gtaaggattttgctaacaccagaaa

SEQ ID NO: 42509 - DNA, 25 bp, S. cerevisiae
gtaaacatttatagtaccccaacat

SEQ ID NO: 42510 - DNA, 25 bp, S. cerevisiae
gtaaacattgcccttacgtctttat

SEQ ID NO: 42511 - DNA, 25 bp, S. cerevisiae
gtacacaacgccaacagatcaacag

SEQ ID NO: 42512 - DNA, 25 bp, S. cerevisiae
gtaaagatatgtcccgtgagcaaac

SEQ ID NO: 42513 - DNA, 25 bp, S. cerevisiae
gtacaggttgatgccgaagagaaga

SEQ ID NO: 42514 - DNA, 25 bp, S. cerevisiae
gtacgatctttcacgcagacatgcg

SEQ ID NO: 42515 - DNA, 25 bp, S. cerevisiae
gtacttgcatatacagacgcggatg

SEQ ID NO: 42516 - DNA, 25 bp, S. cerevisiae
gtacagtgattttgacattggccat

SEQ ID NO: 42517 - DNA, 25 bp, S. cerevisiae
gtacattggttgtcatattggccat

SEQ ID NO: 42518 - DNA, 25 bp, S. cerevisiae
gtcaagggtagattcgctgtccacc

SEQ ID NO: 42519 - DNA, 25 bp, S. cerevisiae
gtgtagcggcttctttttgtaagga

SEQ ID NO: 42520 - DNA, 25 bp, S. cerevisiae
gtcaagcctcttgtgaaagtaacct

SEQ ID NO: 42521 - DNA, 25 bp, S. cerevisiae
gtcaagcgttactcaaagggcaatt

SEQ ID NO: 42522 - DNA, 25 bp, S. cerevisiae
gtacgtcgatcaccatggcatgtgt

SEQ ID NO: 42523 - DNA, 25 bp, S. cerevisiae
gtacggtatcatcatggccgcattt

SEQ ID NO: 42524 - DNA, 25 bp, S. cerevisiae
gtacgactcatgaagtggcctgtcc

SEQ ID NO: 42525 - DNA, 25 bp, S. cerevisiae
gtacaactagtcatgaggctacgct

SEQ ID NO: 42526 - DNA, 25 bp, S. cerevisiae
gtaacattcgcgctggtgtgacgat

SEQ ID NO: 42527 - DNA, 25 bp, S. cerevisiae
gtaacttacagcttcgtagggacta

SEQ ID NO: 42528 - DNA, 25 bp, S. cerevisiae
gtactacttccccaataatcatcga

SEQ ID NO: 42529 - DNA, 25 bp, S. cerevisiae
gtactcttcctctactcaagcataa

SEQ ID NO: 42530 - DNA, 25 bp, S. cerevisiae
gtacgatgatgctaaatgcgctaaa

SEQ ID NO: 42531 - DNA, 25 bp, S. cerevisiae
gtacgtcatctatcatggattacca

SEQ ID NO: 42532 - DNA, 25 bp, S. cerevisiae
gtacattcattatcttgatccgtga

SEQ ID NO: 42533 - DNA, 25 bp, S. cerevisiae
gtacatgtctgttgacgggactgta

SEQ ID NO: 42534 - DNA, 25 bp, S. cerevisiae
gtaattcttctcagggtcacttggt

SEQ ID NO: 42535 - DNA, 25 bp, S. cerevisiae
gtaagttcaaatctgctgttttcga

SEQ ID NO: 42536 - DNA, 25 bp, S. cerevisiae
gtcaagcccaagtttgattttccaa

SEQ ID NO: 42537 - DNA, 25 bp, S. cerevisiae
gtaacctagcagttaaagctcttca

SEQ ID NO: 42538 - DNA, 25 bp, S. cerevisiae
gtacatcggctctgaaaccgcaatt

SEQ ID NO: 42539 - DNA, 25 bp, S. cerevisiae
gtactggaaaatgcctcccatcaag

SEQ ID NO: 42540 - DNA, 25 bp, S. cerevisiae
gtacgatactttaccatttctggaa

SEQ ID NO: 42541 - DNA, 25 bp, S. cerevisiae
gtaagtcacctatttcaacacgaaa

SEQ ID NO: 42542 - DNA, 25 bp, S. cerevisiae
gtaagatacggttccaatgcagaaa

SEQ ID NO: 42543 - DNA, 25 bp, S. cerevisiae
gtaagtacgttgtcctagcctttat

SEQ ID NO: 42544 - DNA, 25 bp, S. cerevisiae
gtaaattctccatctgtcaacaagc

SEQ ID NO: 42545 - DNA, 25 bp, S. cerevisiae
gtaaatcgtctacgcttaagctatt

SEQ ID NO: 42546 - DNA, 25 bp, S. cerevisiae
gtaaacctctgactggtcaaggctt

SEQ ID NO: 42547 - DNA, 25 bp, S. cerevisiae
ggctactggccgtgggtaacgaaca

SEQ ID NO: 42548 - DNA, 25 bp, S. cerevisiae
gtgaattgtccgtggaggtccctga

SEQ ID NO: 42549 - DNA, 25 bp, S. cerevisiae
gtactttgccagatgttgggcgcct

SEQ ID NO: 42550 - DNA, 25 bp, S. cerevisiae
gtacttaacgttgtggaggctctgc

SEQ ID NO: 42551 - DNA, 25 bp, S. cerevisiae
gtactgtgcaacgttgtttcaactg

SEQ ID NO: 42552 - DNA, 25 bp, S. cerevisiae
gtacttctaatgttttcgtcacgga

SEQ ID NO: 42553 - DNA, 25 bp, S. cerevisiae
gtacaagctatcaacttccctacgg

SEQ ID NO: 42554 - DNA, 25 bp, S. cerevisiae
gtactttctgtactcgtatcgagga

SEQ ID NO: 42555 - DNA, 25 bp, S. cerevisiae
gtacaagctgcacctgtgatgctat

SEQ ID NO: 42556 - DNA, 25 bp, S. cerevisiae
gtacggtaagcgttgctgtttcaaa

SEQ ID NO: 42557 - DNA, 25 bp, S. cerevisiae
gtacgtatgagagccatgcctttca

SEQ ID NO: 42558 - DNA, 25 bp, S. cerevisiae
gtacgagtccaacaagcatttcagt

SEQ ID NO: 42559 - DNA, 25 bp, S. cerevisiae
gtccctaactctctaaacggattcg

SEQ ID NO: 42560 - DNA, 25 bp, S. cerevisiae
gtgaatcgctaacgtttaaccaact

SEQ ID NO: 42561 - DNA, 25 bp, S. cerevisiae
gtgaaactacccttgaaacgataat

SEQ ID NO: 42562 - DNA, 25 bp, S. cerevisiae
gtaacagcagcaccgatttaacgat

SEQ ID NO: 42563 - DNA, 25 bp, S. cerevisiae
gtaaaggctcatcgactgccaacga

SEQ ID NO: 42564 - DNA, 25 bp, S. cerevisiae
gtaaatgccacactactgtcattgg

SEQ ID NO: 42565 - DNA, 25 bp, S. cerevisiae
gtacgttgacccaaatgtcttgcca

SEQ ID NO: 42566 - DNA, 25 bp, S. cerevisiae
gtaacgtcaccgaattgaccttcta

SEQ ID NO: 42567 - DNA, 25 bp, S. cerevisiae
gtaacaccattccaaaaacttctat

SEQ ID NO: 42568 - DNA, 25 bp, S. cerevisiae
gtaaattcctcacaaactgcttcct

SEQ ID NO: 42569 - DNA, 25 bp, S. cerevisiae
gtacttactcactcaacagcagatc

SEQ ID NO: 42570 - DNA, 25 bp, S. cerevisiae
gtacattaataagtgacgccgacga

SEQ ID NO: 42571 - DNA, 25 bp, S. cerevisiae
gtaactccagaattgaccgctaaga

SEQ ID NO: 42572 - DNA, 25 bp, S. cerevisiae
gtaactacaagttcaccgtctggtt

SEQ ID NO: 42573 - DNA, 25 bp, S. cerevisiae
gtaatatagccgaggccaccggtgt

SEQ ID NO: 42574 - DNA, 25 bp, S. cerevisiae
gtacatattttgaagcctacgcggt

SEQ ID NO: 42575 - DNA, 25 bp, S. cerevisiae
gtacaatttggcagcctacacgtag

SEQ ID NO: 42576 - DNA, 25 bp, S. cerevisiae
gtacactttgcagggtcatacagct

SEQ ID NO: 42577 - DNA, 25 bp, S. cerevisiae
gtacactatatgctttcaacgtcca

SEQ ID NO: 42578 - DNA, 25 bp, S. cerevisiae
gtaacttgccaatttgtatcgccaa

SEQ ID NO: 42579 - DNA, 25 bp, S. cerevisiae
gtcagaaatccgtcgttttgaacaa

SEQ ID NO: 42580 - DNA, 25 bp, S. cerevisiae
gtacacatgaccctcttttatttca

SEQ ID NO: 42581 - DNA, 25 bp, S. cerevisiae
gtacttcgccacgttgttattacac

SEQ ID NO: 42582 - DNA, 25 bp, S. cerevisiae
gtacttctggccctgtttttcagag

SEQ ID NO: 42583 - DNA, 25 bp, S. cerevisiae
gtaactcatttgcttttgttcagaa

SEQ ID NO: 42584 - DNA, 25 bp, S. cerevisiae
gtcacggtcctgctatttttgatgg

SEQ ID NO: 42585 - DNA, 25 bp, S. cerevisiae
gtcaccactccgattttgagctaga

SEQ ID NO: 42586 - DNA, 25 bp, S. cerevisiae
tctactacttcgttatcggaccagt

SEQ ID NO: 42587 - DNA, 25 bp, S. cerevisiae
gtactcctctagattggaaccagct

SEQ ID NO: 42588 - DNA, 25 bp, S. cerevisiae
gtacatctccagaggctgatttttg

SEQ ID NO: 42589 - DNA, 25 bp, S. cerevisiae
gtacatctcctaaacggttcggtat

SEQ ID NO: 42590 - DNA, 25 bp, S. cerevisiae
gtactacttagacaccttccgtgaa

SEQ ID NO: 42591 - DNA, 25 bp, S. cerevisiae
gtcactccattagaatcccttttaa

SEQ ID NO: 42592 - DNA, 25 bp, S. cerevisiae
gtacatacagggaacgtcctctacc

SEQ ID NO: 42593 - DNA, 25 bp, S. cerevisiae
gtacatggcaaagacctcacttgat

SEQ ID NO: 42594 - DNA, 25 bp, S. cerevisiae
gtactacagatgatcccgatactgg

SEQ ID NO: 42595 - DNA, 25 bp, S. cerevisiae
gtaaacacgatccatttgaagcgta

SEQ ID NO: 42596 - DNA, 25 bp, S. cerevisiae
gtaaaccagggcatcatatacgcta

SEQ ID NO: 42597 - DNA, 25 bp, S. cerevisiae
gtcaccaagggtgtgccagaactat

SEQ ID NO: 42598 - DNA, 25 bp, S. cerevisiae
gtaaacaaccgaatccagaacaatt

SEQ ID NO: 42599 - DNA, 25 bp, S. cerevisiae
gtgaaaccccagttgccaaacatta

SEQ ID NO: 42600 - DNA, 25 bp, S. cerevisiae
gtaaacacgtcatttgctcataaaa

SEQ ID NO: 42601 - DNA, 25 bp, S. cerevisiae
gtaacattggccatttcgatatcga

SEQ ID NO: 42602 - DNA, 25 bp, S. cerevisiae
gtacactagcccgttgaggtatctg

SEQ ID NO: 42603 - DNA, 25 bp, S. cerevisiae
gtaaagaaatgccataccgtgattt

SEQ ID NO: 42604 - DNA, 25 bp, S. cerevisiae
gtaaaggtcatgatcacacagtgtt

SEQ ID NO: 42605 - DNA, 25 bp, S. cerevisiae
gtacaatcagataataaacactttt

SEQ ID NO: 42606 - DNA, 25 bp, S. cerevisiae
gtactggtttatcccttacatgact

SEQ ID NO: 42607 - DNA, 25 bp, S. cerevisiae
gtactggtactacttcttgagttca

SEQ ID NO: 42608 - DNA, 25 bp, S. cerevisiae
gtactggtgtctatatcttcgtcgt

SEQ ID NO: 42609 - DNA, 25 bp, S. cerevisiae
gtaagatctgctctactgggttcac

SEQ ID NO: 42610 - DNA, 25 bp, S. cerevisiae
gtaacggctgctaatctgctggaaa

SEQ ID NO: 42611 - DNA, 25 bp, S. cerevisiae
gtacacagggtccatgtgctacaca

SEQ ID NO: 42612 - DNA, 25 bp, S. cerevisiae
gtacagcaagtgaggttgaggcaat

SEQ ID NO: 42613 - DNA, 25 bp, S. cerevisiae
gtacactagtaacattgctggcaaa

SEQ ID NO: 42614 - DNA, 25 bp, S. cerevisiae
gtaatcgagaagttttgttcagaga

SEQ ID NO: 42615 - DNA, 25 bp, S. cerevisiae
gtaactcagaaggttcacccagcga

SEQ ID NO: 42616 - DNA, 25 bp, S. cerevisiae
gtacagtaatgggtgttccctccat

SEQ ID NO: 42617 - DNA, 25 bp, S. cerevisiae
gtacattcaattggtgtctccctac

SEQ ID NO: 42618 - DNA, 25 bp, S. cerevisiae
gtactttgacactttctggtttatc

SEQ ID NO: 42619 - DNA, 25 bp, S. cerevisiae
gtactttggcatctcttgaatctca

SEQ ID NO: 42620 - DNA, 25 bp, S. cerevisiae
gtactcgtatgctttcttggacatc

SEQ ID NO: 42621 - DNA, 25 bp, S. cerevisiae
gtactcgcatttcttgcagcaaatc

SEQ ID NO: 42622 - DNA, 25 bp, S. cerevisiae
gtacatccatttcactctcttatga

SEQ ID NO: 42623 - DNA, 25 bp, S. cerevisiae
gtactagtgctaaaaccttcattgt

SEQ ID NO: 42624 - DNA, 25 bp, S. cerevisiae
gtactaatgatctcgacctctggct

SEQ ID NO: 42625 - DNA, 25 bp, S. cerevisiae
gtaatgaaatgctcgatccacgccg

SEQ ID NO: 42626 - DNA, 25 bp, S. cerevisiae
gtacaaacagttcacatcacgcacg

SEQ ID NO: 42627 - DNA, 25 bp, S. cerevisiae
gtaactgactaccaactacctaagg

SEQ ID NO: 42628 - DNA, 25 bp, S. cerevisiae
gtaacgcaactccataccaggtaga

SEQ ID NO: 42629 - DNA, 25 bp, S. cerevisiae
gtacactcagacgtcaagccatggt

SEQ ID NO: 42630 - DNA, 25 bp, S. cerevisiae
gtacaattgcccatagctctggtaa

SEQ ID NO: 42631 - DNA, 25 bp, S. cerevisiae
gtcaccataccctctcaattaagat

SEQ ID NO: 42632 - DNA, 25 bp, S. cerevisiae
gtaaaatcgcctctaatgacgtgca

SEQ ID NO: 42633 - DNA, 25 bp, S. cerevisiae
gtaacattcgcatctaaataccgca

SEQ ID NO: 42634 - DNA, 25 bp, S. cerevisiae
gtacattccaaaaaattgccggcaa

SEQ ID NO: 42635 - DNA, 25 bp, S. cerevisiae
gtcaagtttaagattaatcgggcca

SEQ ID NO: 42636 - DNA, 25 bp, S. cerevisiae
gtaacgttatagagtctaccggcgt

SEQ ID NO: 42637 - DNA, 25 bp, S. cerevisiae
gtaacgtataaatccgcatccgggt

SEQ ID NO: 42638 - DNA, 25 bp, S. cerevisiae
gtacaagttatggatgtgcatcgca

SEQ ID NO: 42639 - DNA, 25 bp, S. cerevisiae
gtacttgtccatgattctatctgca

SEQ ID NO: 42640 - DNA, 25 bp, S. cerevisiae
gtacactaacgctagcaacgcttaa

SEQ ID NO: 42641 - DNA, 25 bp, S. cerevisiae
gtaatcacgacatggaagctctctt

SEQ ID NO: 42642 - DNA, 25 bp, S. cerevisiae
gtaaacgattatgaagccgctagag

SEQ ID NO: 42643 - DNA, 25 bp, S. cerevisiae
gtctaacgttgttcaagctcgtgac

SEQ ID NO: 42644 - DNA, 25 bp, S. cerevisiae
gtactatctttgcaggtgcctttgt

SEQ ID NO: 42645 - DNA, 25 bp, S. cerevisiae
gtcttttcttgcaaaccccaatgtt

SEQ ID NO: 42646 - DNA, 25 bp, S. cerevisiae
gtactcatttggtacaccctataat

SEQ ID NO: 42647 - DNA, 25 bp, S. cerevisiae
gtactactgaatctcctggtgaata

SEQ ID NO: 42648 - DNA, 25 bp, S. cerevisiae
gtacatttgctaagatgccgattgc

SEQ ID NO: 42649 - DNA, 25 bp, S. cerevisiae
gtacttctttgattaccttgccatc

SEQ ID NO: 42650 - DNA, 25 bp, S. cerevisiae
gtacttgtattattatgccaccgat

SEQ ID NO: 42651 - DNA, 25 bp, S. cerevisiae
gtcaccgtagaaaacacaccgatag

SEQ ID NO: 42652 - DNA, 25 bp, S. cerevisiae
gtcaccatttgtttaactccgttct

SEQ ID NO: 42653 - DNA, 25 bp, S. cerevisiae
gtgctaatcgtttgggaccacgtcc

SEQ ID NO: 42654 - DNA, 25 bp, S. cerevisiae
gtgcagaaaggatggctccaccgtt

SEQ ID NO: 42655 - DNA, 25 bp, S. cerevisiae
gtgggaaggaactctccccagagaa

SEQ ID NO: 42656 - DNA, 25 bp, S. cerevisiae
gtaacggtgaactcccacagcaaaa

SEQ ID NO: 42657 - DNA, 25 bp, S. cerevisiae
gtacatccgtacatctgtacacaaa

SEQ ID NO: 42658 - DNA, 25 bp, S. cerevisiae
gtacttccgtcagctgttaagccaa

SEQ ID NO: 42659 - DNA, 25 bp, S. cerevisiae
gtactacccgcaaccataatagcgc

SEQ ID NO: 42660 - DNA, 25 bp, S. cerevisiae
gtcaacccggcttcaacaatagcag

SEQ ID NO: 42661 - DNA, 25 bp, S. cerevisiae
gtaaggtctcctcacatcataaatt

SEQ ID NO: 42662 - DNA, 25 bp, S. cerevisiae
gtaagtgaccccaacgaagatttga

SEQ ID NO: 42663 - DNA, 25 bp, S. cerevisiae
gtcaacgagctaccaacgaagccct

SEQ ID NO: 42664 - DNA, 25 bp, S. cerevisiae
gtaacgatgattcccatcagaaggg

SEQ ID NO: 42665 - DNA, 25 bp, S. cerevisiae
gtaagcactgattcgaataatggca

SEQ ID NO: 42666 - DNA, 25 bp, S. cerevisiae
gtaataaatagcagcccgggtcact

SEQ ID NO: 42667 - DNA, 25 bp, S. cerevisiae
gtaatactgaagtgccggaggctca

SEQ ID NO: 42668 - DNA, 25 bp, S. cerevisiae
gtaagactgaactcaccaggctctg

SEQ ID NO: 42669 - DNA, 25 bp, S. cerevisiae
gtcaaacgtgcctccaaggctttga

SEQ ID NO: 42670 - DNA, 25 bp, S. cerevisiae
gtaaacgtccaaacatgtccatttt

SEQ ID NO: 42671 - DNA, 25 bp, S. cerevisiae
gtaaaagatcctacgctgtccttta

SEQ ID NO: 42672 - DNA, 25 bp, S. cerevisiae
gtaacaatttccctcgttattatag

SEQ ID NO: 42673 - DNA, 25 bp, S. cerevisiae
gtaacttctccgctacatttgatga

SEQ ID NO: 42674 - DNA, 25 bp, S. cerevisiae
gtcaacaacccgttacatcacagga

SEQ ID NO: 42675 - DNA, 25 bp, S. cerevisiae
gtaacgaagcagttgacgccaccca

SEQ ID NO: 42676 - DNA, 25 bp, S. cerevisiae
gtaacctaggtgacatcgtgactcc

SEQ ID NO: 42677 - DNA, 25 bp, S. cerevisiae
gtaatcctggttctgcgaatgtcgc

SEQ ID NO: 42678 - DNA, 25 bp, S. cerevisiae
gtaaacctcacaaagatggcgatcg

SEQ ID NO: 42679 - DNA, 25 bp, S. cerevisiae
gtaaccccattaagtggcctctgta

SEQ ID NO: 42680 - DNA, 25 bp, S. cerevisiae
gtactacctttgcatcccaattatt

SEQ ID NO: 42681 - DNA, 25 bp, S. cerevisiae
gtacatgggtttccattccaataaa

SEQ ID NO: 42682 - DNA, 25 bp, S. cerevisiae
gtaacaggttcggtggatttcaata

SEQ ID NO: 42683 - DNA, 25 bp, S. cerevisiae
gtactatgcacctattaactcgata

SEQ ID NO: 42684 - DNA, 25 bp, S. cerevisiae
gtacagctccacaactggatcagtg

SEQ ID NO: 42685 - DNA, 25 bp, S. cerevisiae
gtcacagtctccatgggcatcagga

SEQ ID NO: 42686 - DNA, 25 bp, S. cerevisiae
gtaactctcgatacgccaaggttgg

SEQ ID NO: 42687 - DNA, 25 bp, S. cerevisiae
gtacaagatcgctcttcgttgggaa

SEQ ID NO: 42688 - DNA, 25 bp, S. cerevisiae
gtacaatgccgctgaggacttggat

SEQ ID NO: 42689 - DNA, 25 bp, S. cerevisiae
gtcaaatggtggacgctactagcat

SEQ ID NO: 42690 - DNA, 25 bp, S. cerevisiae
gtcagacacgggacagaactccatt

SEQ ID NO: 42691 - DNA, 25 bp, S. cerevisiae
gtcaaccgggatgtccattctatgt

SEQ ID NO: 42692 - DNA, 25 bp, S. cerevisiae
gtacaaggcaggtattcctatcggt

SEQ ID NO: 42693 - DNA, 25 bp, S. cerevisiae
gtcaaacgctgatatccctgagggt

SEQ ID NO: 42694 - DNA, 25 bp, S. cerevisiae
gtaaacaggatttcttcgaggtcga

SEQ ID NO: 42695 - DNA, 25 bp, S. cerevisiae
gtaaacgttgtaatgctcagggtaa

SEQ ID NO: 42696 - DNA, 25 bp, S. cerevisiae
gtaaattccgttttgctctattgat

SEQ ID NO: 42697 - DNA, 25 bp, S. cerevisiae
gtacatttgcctttttcgcgggatt

SEQ ID NO: 42698 - DNA, 25 bp, S. cerevisiae
gtaaactacgatattcctgtggatt

SEQ ID NO: 42699 - DNA, 25 bp, S. cerevisiae
gtaaggcaatgagatccgccgctgc

SEQ ID NO: 42700 - DNA, 25 bp, S. cerevisiae
gtaaaagtacaatcgcctgtgcgct

SEQ ID NO: 42701 - DNA, 25 bp, S. cerevisiae
gtaaaatcgcacaggccgtcttaaa

SEQ ID NO: 42702 - DNA, 25 bp, S. cerevisiae
gtaatttatctcctaccgaagacta

SEQ ID NO: 42703 - DNA, 25 bp, S. cerevisiae
gtaattttctcacatcctgaagccg

SEQ ID NO: 42704 - DNA, 25 bp, S. cerevisiae
gtacattattctatctccagcacaa

SEQ ID NO: 42705 - DNA, 25 bp, S. cerevisiae
gtacaggaattgatgcccaaccata

SEQ ID NO: 42706 - DNA, 25 bp, S. cerevisiae
gtacataagtcaacacccaagcaga

SEQ ID NO: 42707 - DNA, 25 bp, S. cerevisiae
gtacatgctaactggcttgggtgaa

SEQ ID NO: 42708 - DNA, 25 bp, S. cerevisiae
gtcaattaagtatgcttgggccaaa

SEQ ID NO: 42709 - DNA, 25 bp, S. cerevisiae
gtaatctaagtgtgggtgacatgct

SEQ ID NO: 42710 - DNA, 25 bp, S. cerevisiae
gtaactactggcttgacggatatct

SEQ ID NO: 42711 - DNA, 25 bp, S. cerevisiae
gtacaattctagttgaggccgcatc

SEQ ID NO: 42712 - DNA, 25 bp, S. cerevisiae
gtcaactccacccaagctgaagaaa

SEQ ID NO: 42713 - DNA, 25 bp, S. cerevisiae
gtacacctgtacaaacgcaatgata

SEQ ID NO: 42714 - DNA, 25 bp, S. cerevisiae
gtacaccttaccaatctgatatcga

SEQ ID NO: 42715 - DNA, 25 bp, S. cerevisiae
gtaacccttaccttgatcttaggtg

SEQ ID NO: 42716 - DNA, 25 bp, S. cerevisiae
gtaaaagctacagactatcaccatg

SEQ ID NO: 42717 - DNA, 25 bp, S. cerevisiae
gtaagaaccaccgatcttcagcaat

SEQ ID NO: 42718 - DNA, 25 bp, S. cerevisiae
gtacacttctcatctgtcttcaaaa

SEQ ID NO: 42719 - DNA, 25 bp, S. cerevisiae
gtaatcatatcgaggttgtccgcaa

SEQ ID NO: 42720 - DNA, 25 bp, S. cerevisiae
gtaaactccaagtatcagggccaag

SEQ ID NO: 42721 - DNA, 25 bp, S. cerevisiae
gtaaagtcgagtttctggagcccgt

SEQ ID NO: 42722 - DNA, 25 bp, S. cerevisiae
gtaagcttgttgtaccatctggaga

SEQ ID NO: 42723 - DNA, 25 bp, S. cerevisiae
gtaagcatcgtattcaccgtcgaaa

SEQ ID NO: 42724 - DNA, 25 bp, S. cerevisiae
gtacaccgaattgccatcttataag

SEQ ID NO: 42725 - DNA, 25 bp, S. cerevisiae
gtaaacaagacacccattggcgaat

SEQ ID NO: 42726 - DNA, 25 bp, S. cerevisiae
gtacatatgccagagtccttgcgaa

SEQ ID NO: 42727 - DNA, 25 bp, S. cerevisiae
gtacagtaatgagccctgaatcaga

SEQ ID NO: 42728 - DNA, 25 bp, S. cerevisiae
gtacaagacttcgtcactgctggac

SEQ ID NO: 42729 - DNA, 25 bp, S. cerevisiae
gtacatatgatgctgtcgactccga

SEQ ID NO: 42730 - DNA, 25 bp, S. cerevisiae
gtcacatgcaagatgtagacccaac

SEQ ID NO: 42731 - DNA, 25 bp, S. cerevisiae
gtaatgaaactgaagaccccaccca

SEQ ID NO: 42732 - DNA, 25 bp, S. cerevisiae
gtaatgaaaatgtccacccaacctt

SEQ ID NO: 42733 - DNA, 25 bp, S. cerevisiae
gtaaagatctcttcgtgaccactgc

SEQ ID NO: 42734 - DNA, 25 bp, S. cerevisiae
gtaatatttttaccaccgtgcgcac

SEQ ID NO: 42735 - DNA, 25 bp, S. cerevisiae
gtaaatctgtcttcaccaacgttaa

SEQ ID NO: 42736 - DNA, 25 bp, S. cerevisiae
gtacaatctgttcaagatcacgaat

SEQ ID NO: 42737 - DNA, 25 bp, S. cerevisiae
gtacaacatgttttagtcgccaatc

SEQ ID NO: 42738 - DNA, 25 bp, S. cerevisiae
gtacacatttgccattattcgcgaa

SEQ ID NO: 42739 - DNA, 25 bp, S. cerevisiae
gtaatcatcttgcattttctaacct

SEQ ID NO: 42740 - DNA, 25 bp, S. cerevisiae
gtacaattacactctgttccacgtt

SEQ ID NO: 42741 - DNA, 25 bp, S. cerevisiae
gtaagattcagctgattttccctcc

SEQ ID NO: 42742 - DNA, 25 bp, S. cerevisiae
gtaacataatatttcttcccctcgt

SEQ ID NO: 42743 - DNA, 25 bp, S. cerevisiae
gtaaataatactccttcaccagccg

SEQ ID NO: 42744 - DNA, 25 bp, S. cerevisiae
gtaaatcaattgtcctctacgcaca

SEQ ID NO: 42745 - DNA, 25 bp, S. cerevisiae
gtacagtttctttcgtagtggcaga

SEQ ID NO: 42746 - DNA, 25 bp, S. cerevisiae
gtcagcagtgtcagtaacgtcaccg

SEQ ID NO: 42747 - DNA, 25 bp, S. cerevisiae
gtcttggtatttaacgatcctcatg

SEQ ID NO: 42748 - DNA, 25 bp, S. cerevisiae
gtcgggtacgacacagactctgagc

SEQ ID NO: 42749 - DNA, 25 bp, S. cerevisiae
gtaagagccacactattggtccaaa

SEQ ID NO: 42750 - DNA, 25 bp, S. cerevisiae
gtaacatagctcatggtccattctg

SEQ ID NO: 42751 - DNA, 25 bp, S. cerevisiae
gtaagagacttcttgtcgattcgtt

SEQ ID NO: 42752 - DNA, 25 bp, S. cerevisiae
gtaagtgtcagtttgctcacggact

SEQ ID NO: 42753 - DNA, 25 bp, S. cerevisiae
gtacaggtacatttgcacttgtatt

SEQ ID NO: 42754 - DNA, 25 bp, S. cerevisiae
gtacagcaaaattatgccattataa

SEQ ID NO: 42755 - DNA, 25 bp, S. cerevisiae
gtaagacctcatcgagccatctata

SEQ ID NO: 42756 - DNA, 25 bp, S. cerevisiae
gtacaacatcccaatttgcatcgtc

SEQ ID NO: 42757 - DNA, 25 bp, S. cerevisiae
gtaatgcaaaggtcgttagttcaat

SEQ ID NO: 42758 - DNA, 25 bp, S. cerevisiae
gtaaaagagggtccatagtctacaa

SEQ ID NO: 42759 - DNA, 25 bp, S. cerevisiae
gtaataacactgctaccacgctaaa

SEQ ID NO: 42760 - DNA, 25 bp, S. cerevisiae
gtaaacagtctgctgagccacaaaa

SEQ ID NO: 42761 - DNA, 25 bp, S. cerevisiae
gtaaccgattcctaccaacaagatc

SEQ ID NO: 42762 - DNA, 25 bp, S. cerevisiae
gtaaccgttatatatcctgctgtcc

SEQ ID NO: 42763 - DNA, 25 bp, S. cerevisiae
gtaagtggttgggattcttcgtcca

SEQ ID NO: 42764 - DNA, 25 bp, S. cerevisiae
gtaacttattgcgaaatttctgctc

SEQ ID NO: 42765 - DNA, 25 bp, S. cerevisiae
gtaacttttggccaagtaggcagaa

SEQ ID NO: 42766 - DNA, 25 bp, S. cerevisiae
gtaattctatttccagtgtagccaa

SEQ ID NO: 42767 - DNA, 25 bp, S. cerevisiae
gtacaattccttccggctattcaaa

SEQ ID NO: 42768 - DNA, 25 bp, S. cerevisiae
gtgaaggttcttcttgtagatcaac

SEQ ID NO: 42769 - DNA, 25 bp, S. cerevisiae
gtaagcggcctaacttgttcagaat

SEQ ID NO: 42770 - DNA, 25 bp, S. cerevisiae
gtaagtggcaatcctcgtaacccaa

SEQ ID NO: 42771 - DNA, 25 bp, S. cerevisiae
gtaaagatgtgccatatattgcccc

SEQ ID NO: 42772 - DNA, 25 bp, S. cerevisiae
gtcaagatatgctgcggcttactcc

SEQ ID NO: 42773 - DNA, 25 bp, S. cerevisiae
gtcaacggtttgtcaatactctata

SEQ ID NO: 42774 - DNA, 25 bp, S. cerevisiae
gtaacggctgtgataatgtcctaga

SEQ ID NO: 42775 - DNA, 25 bp, S. cerevisiae
gtaatccattgtatactaccccgaa

SEQ ID NO: 42776 - DNA, 25 bp, S. cerevisiae
gtcaagacattggttacaagtccct

SEQ ID NO: 42777 - DNA, 25 bp, S. cerevisiae
gtcaaccttttaaactgtccacatt

SEQ ID NO: 42778 - DNA, 25 bp, S. cerevisiae
gtaatgcagtccacctacaagctat

SEQ ID NO: 42779 - DNA, 25 bp, S. cerevisiae
gtaacgtatttgatgttcctcttca

SEQ ID NO: 42780 - DNA, 25 bp, S. cerevisiae
gtaaagtcttcgctgattatcacat

SEQ ID NO: 42781 - DNA, 25 bp, S. cerevisiae
gtaatcccctcgagagttcatgcat

SEQ ID NO: 42782 - DNA, 25 bp, S. cerevisiae
gtaaatccctcgaaagtcgaatttg

SEQ ID NO: 42783 - DNA, 25 bp, S. cerevisiae
gtaaacatccattacatgagctgat

SEQ ID NO: 42784 - DNA, 25 bp, S. cerevisiae
gtacaacatgtccattatgcagaga

SEQ ID NO: 42785 - DNA, 25 bp, S. cerevisiae
gtcacagacattgaagcgagcagta

SEQ ID NO: 42786 - DNA, 25 bp, S. cerevisiae
gtcagcagacagatagccgccagtg

SEQ ID NO: 42787 - DNA, 25 bp, S. cerevisiae
gtcatcagtgccatacgatccatat

SEQ ID NO: 42788 - DNA, 25 bp, S. cerevisiae
gtaaatgtcgatgcggtttctatga

SEQ ID NO: 42789 - DNA, 25 bp, S. cerevisiae
gtaaagctgctgacctttcttctaa

SEQ ID NO: 42790 - DNA, 25 bp, S. cerevisiae
gtaacgatcctatggcttttcagcc

SEQ ID NO: 42791 - DNA, 25 bp, S. cerevisiae
gtgttactgaacttttggacgaatt

SEQ ID NO: 42792 - DNA, 25 bp, S. cerevisiae
gtcattgctagaagtaggcgggctt

SEQ ID NO: 42793 - DNA, 25 bp, S. cerevisiae
gtctagctcaaggagtggccgattt

SEQ ID NO: 42794 - DNA, 25 bp, S. cerevisiae
gtaacgatgccgcagaggtcgcact

SEQ ID NO: 42795 - DNA, 25 bp, S. cerevisiae
gtcaaggtagcgaaccagtgggatt

SEQ ID NO: 42796 - DNA, 25 bp, S. cerevisiae
gtaaccttagcgcagtacctacaaa

SEQ ID NO: 42797 - DNA, 25 bp, S. cerevisiae
gtaaccaaaagcaaggcgcctacaa

SEQ ID NO: 42798 - DNA, 25 bp, S. cerevisiae
gtaagctgcatatggccactgcgtt

SEQ ID NO: 42799 - DNA, 25 bp, S. cerevisiae
gtaaatgctcaaaacgcatccaaca

SEQ ID NO: 42800 - DNA, 25 bp, S. cerevisiae
gtaagactcacaagcaagattcgga

SEQ ID NO: 42801 - DNA, 25 bp, S. cerevisiae
gtaaatctcagatgaagcttctcga

SEQ ID NO: 42802 - DNA, 25 bp, S. cerevisiae
gtaacttagctcttggtgaccagga

SEQ ID NO: 42803 - DNA, 25 bp, S. cerevisiae
gtaacttagcatttgttcatgcctc

SEQ ID NO: 42804 - DNA, 25 bp, S. cerevisiae
gtgaactccatcaacgtcaagactc

SEQ ID NO: 42805 - DNA, 25 bp, S. cerevisiae
gtcaaccccaacctgaagttcaaat

SEQ ID NO: 42806 - DNA, 25 bp, S. cerevisiae
gtaactccaaagctgaaccaaccaa

SEQ ID NO: 42807 - DNA, 25 bp, S. cerevisiae
gtaagaacttgtctaccttcgatta

SEQ ID NO: 42808 - DNA, 25 bp, S. cerevisiae
gtaatatcaaacactagagctatgc

SEQ ID NO: 42809 - DNA, 25 bp, S. cerevisiae
gtaatcacactagaccacgtagaga

SEQ ID NO: 42810 - DNA, 25 bp, S. cerevisiae
gtaattcgaatgtcctcagtggtga

SEQ ID NO: 42811 - DNA, 25 bp, S. cerevisiae
gtaactcaaggtaccaggcaatcaa

SEQ ID NO: 42812 - DNA, 25 bp, S. cerevisiae
gtaactcaagttactcttctcatta

SEQ ID NO: 42813 - DNA, 25 bp, S. cerevisiae
gtaaacgccatttgctgtactatca

SEQ ID NO: 42814 - DNA, 25 bp, S. cerevisiae
gtaactgtcctgacatctgtcctga

SEQ ID NO: 42815 - DNA, 25 bp, S. cerevisiae
gtctaccgacgggttcaaatttgca

SEQ ID NO: 42816 - DNA, 25 bp, S. cerevisiae
ggtacggacgactggaaattggcta

SEQ ID NO: 42817 - DNA, 25 bp, S. cerevisiae
ggtactctacgtgtgggaactccta

SEQ ID NO: 42818 - DNA, 25 bp, S. cerevisiae
ggttcatcaacctccggaaatacta

SEQ ID NO: 42819 - DNA, 25 bp, S. cerevisiae
gtcttgtcccaagtaaggctatccc

SEQ ID NO: 42820 - DNA, 25 bp, S. cerevisiae
gtcgtgtggaaacaagccgtgccaa

SEQ ID NO: 42821 - DNA, 25 bp, S. cerevisiae
gtaacacattatctactccagagga

SEQ ID NO: 42822 - DNA, 25 bp, S. cerevisiae
gtaacttcatgtactcctacttgaa

SEQ ID NO: 42823 - DNA, 25 bp, S. cerevisiae
gtcaatggactcgagggtagcacat

SEQ ID NO: 42824 - DNA, 25 bp, S. cerevisiae
gtaaagacacctggcgtatgctgct

SEQ ID NO: 42825 - DNA, 25 bp, S. cerevisiae
gtaaagacactttgaggttgctaat

SEQ ID NO: 42826 - DNA, 25 bp, S. cerevisiae
gtaagagacctatgagcgctcgctc

SEQ ID NO: 42827 - DNA, 25 bp, S. cerevisiae
gtctagaaccggaacctaccatgat

SEQ ID NO: 42828 - DNA, 25 bp, S. cerevisiae
gtcaataactcggaaccttctactt

SEQ ID NO: 42829 - DNA, 25 bp, S. cerevisiae
gtctccagaagatttaagaacggtt

SEQ ID NO: 42830 - DNA, 25 bp, S. cerevisiae
gtcaccccagctttaaacaattgtt

SEQ ID NO: 42831 - DNA, 25 bp, S. cerevisiae
gtcaccttacattttaacgcacaga

SEQ ID NO: 42832 - DNA, 25 bp, S. cerevisiae
gtaatttaccattctcaacagcaag

SEQ ID NO: 42833 - DNA, 25 bp, S. cerevisiae
gtaacaccattgaccccaaaggagt

SEQ ID NO: 42834 - DNA, 25 bp, S. cerevisiae
gtaacaccagtgaagcctccaagag

SEQ ID NO: 42835 - DNA, 25 bp, S. cerevisiae
gtaacttcttgtatgcttggagggt

SEQ ID NO: 42836 - DNA, 25 bp, S. cerevisiae
gtaacactgtttgggcctgtggcgc

SEQ ID NO: 42837 - DNA, 25 bp, S. cerevisiae
gtcaacctctcgttaccggtattgt

SEQ ID NO: 42838 - DNA, 25 bp, S. cerevisiae
taaaggttgccccaacgatggcctt

SEQ ID NO: 42839 - DNA, 25 bp, S. cerevisiae
gtaaggtaccccaacattgacgatt

SEQ ID NO: 42840 - DNA, 25 bp, S. cerevisiae
gtaattagctacaacgcctactggt

SEQ ID NO: 42841 - DNA, 25 bp, S. cerevisiae
gtcacaattcaatggcagcggcaat

SEQ ID NO: 42842 - DNA, 25 bp, S. cerevisiae
gtcaaatcataagtggtgcggccat

SEQ ID NO: 42843 - DNA, 25 bp, S. cerevisiae
gtaatgactgtaatggtgtggccaa

SEQ ID NO: 42844 - DNA, 25 bp, S. cerevisiae
gtaaagagtcaagctgtcccagaga

SEQ ID NO: 42845 - DNA, 25 bp, S. cerevisiae
gtaagacaatcttccttcctaagcc

SEQ ID NO: 42846 - DNA, 25 bp, S. cerevisiae
gtaaaattgcttccattttcaacta

SEQ ID NO: 42847 - DNA, 25 bp, S. cerevisiae
gtcaagtttgttcctttccacaatg

SEQ ID NO: 42848 - DNA, 25 bp, S. cerevisiae
gtcaatgtcgtgtttgttcttccca

SEQ ID NO: 42849 - DNA, 25 bp, S. cerevisiae
gtcaatgtcgtgtttgttcttccca

SEQ ID NO: 42850 - DNA, 25 bp, S. cerevisiae
gtaagcctttgtttcctggcaccaa

SEQ ID NO: 42851 - DNA, 25 bp, S. cerevisiae
gtaagcgtttgttttcttcaatcag

SEQ ID NO: 42852 - DNA, 25 bp, S. cerevisiae
gtaagcttgtcgtttttgatgcaga

SEQ ID NO: 42853 - DNA, 25 bp, S. cerevisiae
gtaacaatgatggtccctgcgtcag

SEQ ID NO: 42854 - DNA, 25 bp, S. cerevisiae
gtaacctctgatgtggtcagtccaa

SEQ ID NO: 42855 - DNA, 25 bp, S. cerevisiae
gtaaccctgatctggctattcatga

SEQ ID NO: 42856 - DNA, 25 bp, S. cerevisiae
gtaaactatttaacgagctctctaa

SEQ ID NO: 42857 - DNA, 25 bp, S. cerevisiae
gtaaagctttggacacttcctcttt

SEQ ID NO: 42858 - DNA, 25 bp, S. cerevisiae
gtaatagcatgattttgggtcccca

SEQ ID NO: 42859 - DNA, 25 bp, S. cerevisiae
gtaatagatatcgtggaggccccaa

SEQ ID NO: 42860 - DNA, 25 bp, S. cerevisiae
gtcacaattatagtgtcggccccat

SEQ ID NO: 42861 - DNA, 25 bp, S. cerevisiae
gtaagcatgtcaaattcccaccagt

SEQ ID NO: 42862 - DNA, 25 bp, S. cerevisiae
gtaagtccataattctcgttcattg

SEQ ID NO: 42863 - DNA, 25 bp, S. cerevisiae
gtcaattcgttcatcatcaggtcat

SEQ ID NO: 42864 - DNA, 25 bp, S. cerevisiae
gtcgtccgtaccaagcgctgagttg

SEQ ID NO: 42865 - DNA, 25 bp, S. cerevisiae
gtcgatttcgaaactcaagggccaa

SEQ ID NO: 42866 - DNA, 25 bp, S. cerevisiae
ggcggtctctattaccaaaggccat

SEQ ID NO: 42867 - DNA, 25 bp, S. cerevisiae
gtgagcggaaaataccacacgattt

SEQ ID NO: 42868 - DNA, 25 bp, S. cerevisiae
gtcacggacacatataccaatagtt

SEQ ID NO: 42869 - DNA, 25 bp, S. cerevisiae
gtaagtttcccatgcttgatgaggc

SEQ ID NO: 42870 - DNA, 25 bp, S. cerevisiae
gtaatatccttccatagttctgaga

SEQ ID NO: 42871 - DNA, 25 bp, S. cerevisiae
gtaagatcacattcgcaagcttagg

SEQ ID NO: 42872 - DNA, 25 bp, S. cerevisiae
gtaatcatcctaggtgactctggtg

SEQ ID NO: 42873 - DNA, 25 bp, S. cerevisiae
gtaatctctccaagttccatggcaa

SEQ ID NO: 42874 - DNA, 25 bp, S. cerevisiae
gtaacttccatgcattcatcgtcta

SEQ ID NO: 42875 - DNA, 25 bp, S. cerevisiae
gtaaaagtcttctattcgccatctc

SEQ ID NO: 42876 - DNA, 25 bp, S. cerevisiae
gtaaaacaatgtacgtttcctctga

SEQ ID NO: 42877 - DNA, 25 bp, S. cerevisiae
gtaagaaagacccatgttcctgcct

SEQ ID NO: 42878 - DNA, 25 bp, S. cerevisiae
gtaagagattaccactattttccca

SEQ ID NO: 42879 - DNA, 25 bp, S. cerevisiae
gtcaaggtctaatccgtgttttcag

SEQ ID NO: 42880 - DNA, 25 bp, S. cerevisiae
gtcggtgatgactctttagaaagcc

SEQ ID NO: 42881 - DNA, 25 bp, S. cerevisiae
gtctctgttacttccggtaaagctc

SEQ ID NO: 42882 - DNA, 25 bp, S. cerevisiae
gtgatggtaaattctcggttgagca

SEQ ID NO: 42883 - DNA, 25 bp, S. cerevisiae
gtaacatttctcaggatgcgcaaga

SEQ ID NO: 42884 - DNA, 25 bp, S. cerevisiae
gtaattgaacctgagctggaagaac

SEQ ID NO: 42885 - DNA, 25 bp, S. cerevisiae
gtcaataaccaaccacactacagag

SEQ ID NO: 42886 - DNA, 25 bp, S. cerevisiae
gtcaatgatactttgccacctactg

SEQ ID NO: 42887 - DNA, 25 bp, S. cerevisiae
gtcaatgtcgtgtctgctcctccca

SEQ ID NO: 42888 - DNA, 25 bp, S. cerevisiae
gtcaatgtcgtgtctgctcctccca

SEQ ID NO: 42889 - DNA, 25 bp, S. cerevisiae
gtaattggtgcccttagtgcgttca

SEQ ID NO: 42890 - DNA, 25 bp, S. cerevisiae
gtaattgtgactggctttggcttta

SEQ ID NO: 42891 - DNA, 25 bp, S. cerevisiae
gtaattggccatggtttggacccaa

SEQ ID NO: 42892 - DNA, 25 bp, S. cerevisiae
gtcaaggtgaatctttggcagacca

SEQ ID NO: 42893 - DNA, 25 bp, S. cerevisiae
gtcaaggtccagattacaccacaat

SEQ ID NO: 42894 - DNA, 25 bp, S. cerevisiae
gtcaagggcatgttttcaaccacag

SEQ ID NO: 42895 - DNA, 25 bp, S. cerevisiae
gtaatggtgcatttgtcatccgtcc

SEQ ID NO: 42896 - DNA, 25 bp, S. cerevisiae
gtcagctatgtgaggatatccgttc

SEQ ID NO: 42897 - DNA, 25 bp, S. cerevisiae
gtcattagagcttggaatccgagtt

SEQ ID NO: 42898 - DNA, 25 bp, S. cerevisiae
gtaagaagcttctctcgcatagatt

SEQ ID NO: 42899 - DNA, 25 bp, S. cerevisiae
gtaatagccgtctacatcctaatca

SEQ ID NO: 42900 - DNA, 25 bp, S. cerevisiae
gtaatgactctgattcaactttcaa

SEQ ID NO: 42901 - DNA, 25 bp, S. cerevisiae
gtaagacctgtcgtaagcacactca

SEQ ID NO: 42902 - DNA, 25 bp, S. cerevisiae
gtcaagcaaggtaagcctcacccag

SEQ ID NO: 42903 - DNA, 25 bp, S. cerevisiae
gtaatgcgactacggtctcatcagt

SEQ ID NO: 42904 - DNA, 25 bp, S. cerevisiae
gtaatcaactcactggaccacatga

SEQ ID NO: 42905 - DNA, 25 bp, S. cerevisiae
gtaatcatactgctgacgctattgg

SEQ ID NO: 42906 - DNA, 25 bp, S. cerevisiae
gtaacaacgcaggtgcgcgcatctg

SEQ ID NO: 42907 - DNA, 25 bp, S. cerevisiae
gtcaacgacttcactccagaggagg

SEQ ID NO: 42908 - DNA, 25 bp, S. cerevisiae
gtaattgttctcgacaacgacagtg

SEQ ID NO: 42909 - DNA, 25 bp, S. cerevisiae
gtaaggcttctactcaacaagtcgt

SEQ ID NO: 42910 - DNA, 25 bp, S. cerevisiae
gtaattacacctacgtgaactcggc

SEQ ID NO: 42911 - DNA, 25 bp, S. cerevisiae
tgaaaggaaccattactaatcttgg

SEQ ID NO: 42912 - DNA, 25 bp, S. cerevisiae
gtaaggcaattgttccaagatttgg

SEQ ID NO: 42913 - DNA, 25 bp, S. cerevisiae
gtcaagaaacatgcaacccactggt

SEQ ID NO: 42914 - DNA, 25 bp, S. cerevisiae
gtcataaacataaaggccaccagaa

SEQ ID NO: 42915 - DNA, 25 bp, S. cerevisiae
gtcaagcaaattggaatgccccaga

SEQ ID NO: 42916 - DNA, 25 bp, S. cerevisiae
gtcatgaaattcgtcaatggcctaa

SEQ ID NO: 42917 - DNA, 25 bp, S. cerevisiae
gtcagctactacacaaggtctcaga

SEQ ID NO: 42918 - DNA, 25 bp, S. cerevisiae
gtcagatctaccatcaagttccaat

SEQ ID NO: 42919 - DNA, 25 bp, S. cerevisiae
gtaatttctcatcactattctcaaa

SEQ ID NO: 42920 - DNA, 25 bp, S. cerevisiae
gtaacatgcccaaacttgccattaa

SEQ ID NO: 42921 - DNA, 25 bp, S. cerevisiae
gtcaaagctatttacaccgcagtga

SEQ ID NO: 42922 - DNA, 25 bp, S. cerevisiae
gtaacttatttcagcagcccatagc

SEQ ID NO: 42923 - DNA, 25 bp, S. cerevisiae
gtcagattttggtacaggagggaac

SEQ ID NO: 42924 - DNA, 25 bp, S. cerevisiae
gtcaggtattggtatcgccggtata

SEQ ID NO: 42925 - DNA, 25 bp, S. cerevisiae
gtcagtgcttgggattcgcggtaaa

SEQ ID NO: 42926 - DNA, 25 bp, S. cerevisiae
gtaagccattcagacaaaccaagtt

SEQ ID NO: 42927 - DNA, 25 bp, S. cerevisiae
gtcttcttcaaatctcaacggagga

SEQ ID NO: 42928 - DNA, 25 bp, S. cerevisiae
ggtccttagtgagcgacatcggtaa

SEQ ID NO: 42929 - DNA, 25 bp, S. cerevisiae
gtgaagtagatgaaaccccggtaat

SEQ ID NO: 42930 - DNA, 25 bp, S. cerevisiae
gtaagaagaataaccccggcagaag

SEQ ID NO: 42931 - DNA, 25 bp, S. cerevisiae
gtaagcaagaaaaacccctgagcag

SEQ ID NO: 42932 - DNA, 25 bp, S. cerevisiae
gtaaccgataatattgccacagatg

SEQ ID NO: 42933 - DNA, 25 bp, S. cerevisiae
gtgataccgtggaccgcttggagac

SEQ ID NO: 42934 - DNA, 25 bp, S. cerevisiae
gtaaccaccgacctcatggcaagag

SEQ ID NO: 42935 - DNA, 25 bp, S. cerevisiae
gtcaacccggtcaaatggcaagcat

SEQ ID NO: 42936 - DNA, 25 bp, S. cerevisiae
gtaacggacgcaacacaggcatggt

SEQ ID NO: 42937 - DNA, 25 bp, S. cerevisiae
gtaacgctgtcactgtcactgaaga

SEQ ID NO: 42938 - DNA, 25 bp, S. cerevisiae
gtaagctgagcatacctttgccgcg

SEQ ID NO: 42939 - DNA, 25 bp, S. cerevisiae
gtaagcgtgatcaaattcttcccgt

SEQ ID NO: 42940 - DNA, 25 bp, S. cerevisiae
gtaacgctatgaaattcttgcccaa

SEQ ID NO: 42941 - DNA, 25 bp, S. cerevisiae
gtaacctatggaacgctctaccaat

SEQ ID NO: 42942 - DNA, 25 bp, S. cerevisiae
gtaatgctttgaaggccctaccaaa

SEQ ID NO: 42943 - DNA, 25 bp, S. cerevisiae
gtaatgctttgaacgccttgccaaa

SEQ ID NO: 42944 - DNA, 25 bp, S. cerevisiae
gtaacgtcatcattgttcctcattc

SEQ ID NO: 42945 - DNA, 25 bp, S. cerevisiae
gtctttgaaatacgtcccctttctg

SEQ ID NO: 42946 - DNA, 25 bp, S. cerevisiae
gtcattttaaacatccaactggtca

SEQ ID NO: 42947 - DNA, 25 bp, S. cerevisiae
gtaatccacaaccagcttatacttt

SEQ ID NO: 42948 - DNA, 25 bp, S. cerevisiae
gtaattcaccaccacttggacatta

SEQ ID NO: 42949 - DNA, 25 bp, S. cerevisiae
gtaacggagcaacctgtgcaaccaa

SEQ ID NO: 42950 - DNA, 25 bp, S. cerevisiae
gtaaccgaaactggcgatgacatta

SEQ ID NO: 42951 - DNA, 25 bp, S. cerevisiae
gtaagcctgcaaccggcgatttgaa

SEQ ID NO: 42952 - DNA, 25 bp, S. cerevisiae
gtaagcctgcgtccggaaaatatat

SEQ ID NO: 42953 - DNA, 25 bp, S. cerevisiae
gtcacgccgcttctggaaacaatga

SEQ ID NO: 42954 - DNA, 25 bp, S. cerevisiae
gtaagccctgtctaattccattttt

SEQ ID NO: 42955 - DNA, 25 bp, S. cerevisiae
gtaatcgcgtatggtgcttcacaat

SEQ ID NO: 42956 - DNA, 25 bp, S. cerevisiae
gtcaatcgggtatcttgccagagaa

SEQ ID NO: 42957 - DNA, 25 bp, S. cerevisiae
gtaattgccgtgtcgcatggaccta

SEQ ID NO: 42958 - DNA, 25 bp, S. cerevisiae
gtaatctgccattctcacagggtta

SEQ ID NO: 42959 - DNA, 25 bp, S. cerevisiae
gtaatctccaacgaacagtgttcta

SEQ ID NO: 42960 - DNA, 25 bp, S. cerevisiae
gtaatctggcatacctacttattta

SEQ ID NO: 42961 - DNA, 25 bp, S. cerevisiae
gtaacgactctctatcaggtgctgt

SEQ ID NO: 42962 - DNA, 25 bp, S. cerevisiae
gtaatccaaattgctacctgcatta

SEQ ID NO: 42963 - DNA, 25 bp, S. cerevisiae
gtcaaccttgaatatcccgttggat

SEQ ID NO: 42964 - DNA, 25 bp, S. cerevisiae
gtaagtgcttttaatccaggattct

SEQ ID NO: 42965 - DNA, 25 bp, S. cerevisiae
gtcagattcgtcaaagtccttggga

SEQ ID NO: 42966 - DNA, 25 bp, S. cerevisiae
gtcacttcacccaagtcgtatggaa

SEQ ID NO: 42967 - DNA, 25 bp, S. cerevisiae
gtcactgttttcaagccgtctgaga

SEQ ID NO: 42968 - DNA, 25 bp, S. cerevisiae
gtcactgaattctcttaccgttaca

SEQ ID NO: 42969 - DNA, 25 bp, S. cerevisiae
gtcaagtctgaagctctatgccagt

SEQ ID NO: 42970 - DNA, 25 bp, S. cerevisiae
gtcaagcttaacgtccacatcgatg

SEQ ID NO: 42971 - DNA, 25 bp, S. cerevisiae
gtaatgctgtcgattctgatgattt

SEQ ID NO: 42972 - DNA, 25 bp, S. cerevisiae
gtaagttccattttagatgttccca

SEQ ID NO: 42973 - DNA, 25 bp, S. cerevisiae
gtaaggtcttttttgttatcccatg

SEQ ID NO: 42974 - DNA, 25 bp, S. cerevisiae
gtgacgttttaatcggtatccctga

SEQ ID NO: 42975 - DNA, 25 bp, S. cerevisiae
gtctacttttaatgcagaaaccgct

SEQ ID NO: 42976 - DNA, 25 bp, S. cerevisiae
gtctagcgatttaaccgaatccggt

SEQ ID NO: 42977 - DNA, 25 bp, S. cerevisiae
gtctaaggcttctaccgcaacaggt

SEQ ID NO: 42978 - DNA, 25 bp, S. cerevisiae
gtcagtgggaattcactatcgccga

SEQ ID NO: 42979 - DNA, 25 bp, S. cerevisiae
gtaaggcactaatggtttcacaaag

SEQ ID NO: 42980 - DNA, 25 bp, S. cerevisiae
gtcaaggccttgaagaggctgacta

SEQ ID NO: 42981 - DNA, 25 bp, S. cerevisiae
gtaaggctcttgaggctgctaatat

SEQ ID NO: 42982 - DNA, 25 bp, S. cerevisiae
gtaagtgctgctaacagttctaaca

SEQ ID NO: 42983 - DNA, 25 bp, S. cerevisiae
gtcaacctgctccacggattatgaa

SEQ ID NO: 42984 - DNA, 25 bp, S. cerevisiae
gtcaagcctgctagatccaaacatt

SEQ ID NO: 42985 - DNA, 25 bp, S. cerevisiae
gtcaagatttgtccgctttctggaa

SEQ ID NO: 42986 - DNA, 25 bp, S. cerevisiae
gtcaaatttctatcttgcccgatga

SEQ ID NO: 42987 - DNA, 25 bp, S. cerevisiae
gtcaagattcttgcccatgtttaag

SEQ ID NO: 42988 - DNA, 25 bp, S. cerevisiae
gtaagcttgtctaaccaggtcacca

SEQ ID NO: 42989 - DNA, 25 bp, S. cerevisiae
gtcaagcccacaataccaggtacga

SEQ ID NO: 42990 - DNA, 25 bp, S. cerevisiae
gtaagcctccatatactggtagcaa

SEQ ID NO: 42991 - DNA, 25 bp, S. cerevisiae
gtcaactctgacttgtacggtgaaa

SEQ ID NO: 42992 - DNA, 25 bp, S. cerevisiae
gtaatatcctgcttatcttcgggaa

SEQ ID NO: 42993 - DNA, 25 bp, S. cerevisiae
gtaaggaccgtggttccgacatatt

SEQ ID NO: 42994 - DNA, 25 bp, S. cerevisiae
gtaaggacaaggcttcgctcaataa

SEQ ID NO: 42995 - DNA, 25 bp, S. cerevisiae
gtcacagaacaacacaatcagctca

SEQ ID NO: 42996 - DNA, 25 bp, S. cerevisiae
gtcaagacacaagtacaagttatgg

SEQ ID NO: 42997 - DNA, 25 bp, S. cerevisiae
gtcacaacaagtcccacactttgtg

SEQ ID NO: 42998 - DNA, 25 bp, S. cerevisiae
gtcagaattggtaccgacatttttg

SEQ ID NO: 42999 - DNA, 25 bp, S. cerevisiae
gtcgggtggcttagcttacacttta

SEQ ID NO: 43000 - DNA, 25 bp, S. cerevisiae
gtcattttttcccaattttctacat

SEQ ID NO: 43001 - DNA, 25 bp, S. cerevisiae
gtctaacttacaaatacccggcaag

SEQ ID NO: 43002 - DNA, 25 bp, S. cerevisiae
gtcacttcgggatgaattcaggcca

SEQ ID NO: 43003 - DNA, 25 bp, S. cerevisiae
gtcacttctgagcaagtacgggaat

SEQ ID NO: 43004 - DNA, 25 bp, S. cerevisiae
gtctttctgaagaggattgggagcc

SEQ ID NO: 43005 - DNA, 25 bp, S. cerevisiae
gtcacgccaaggtccatttggttac

SEQ ID NO: 43006 - DNA, 25 bp, S. cerevisiae
gtcacgctaaagtccatttggttgc

SEQ ID NO: 43007 - DNA, 25 bp, S. cerevisiae
gtcgggaatttcatccctttgtcat

SEQ ID NO: 43008 - DNA, 25 bp, S. cerevisiae
gtaagaagacctctgcccaatacta

SEQ ID NO: 43009 - DNA, 25 bp, S. cerevisiae
gtgaaggccctctttgttcaaactg

SEQ ID NO: 43010 - DNA, 25 bp, S. cerevisiae
gtaaggccatcgttgtattatctac

SEQ ID NO: 43011 - DNA, 25 bp, S. cerevisiae
tatccaaccggaagccactgacgaa

SEQ ID NO: 43012 - DNA, 25 bp, S. cerevisiae
gtcaagggctcgttcttcaagaaat

SEQ ID NO: 43013 - DNA, 25 bp, S. cerevisiae
gtcaaggtatgccaactccaaagaa

SEQ ID NO: 43014 - DNA, 25 bp, S. cerevisiae
gtcagacgtagccataccgaatttg

SEQ ID NO: 43015 - DNA, 25 bp, S. cerevisiae
gtcaagcatttctatcaccatcatc

SEQ ID NO: 43016 - DNA, 25 bp, S. cerevisiae
gtcaatgtcgacaatacccagatgt

SEQ ID NO: 43017 - DNA, 25 bp, S. cerevisiae
gtaatacaggcattcccatagtcga

SEQ ID NO: 43018 - DNA, 25 bp, S. cerevisiae
gtcaatgacaagaccaccgagtcga

SEQ ID NO: 43019 - DNA, 25 bp, S. cerevisiae
gtctatgacggatcgtggagctcga

SEQ ID NO: 43020 - DNA, 25 bp, S. cerevisiae
gtcaacaagtcatcattgccgttag

SEQ ID NO: 43021 - DNA, 25 bp, S. cerevisiae
gtcaactatgactacaagcacttta

SEQ ID NO: 43022 - DNA, 25 bp, S. cerevisiae
gtcaagcgtgcttctaaggctttga

SEQ ID NO: 43023 - DNA, 25 bp, S. cerevisiae
gtcggttctacggttggagttgtca

SEQ ID NO: 43024 - DNA, 25 bp, S. cerevisiae
gtcggaaattccgtggcagtttaca

SEQ ID NO: 43025 - DNA, 25 bp, S. cerevisiae
gtcaacatgttctctgaagcttccg

SEQ ID NO: 43026 - DNA, 25 bp, S. cerevisiae
gtcaatctcgtttccaaaaatgcaa

SEQ ID NO: 43027 - DNA, 25 bp, S. cerevisiae
gtcaacacagtcgttaagacccgtt

SEQ ID NO: 43028 - DNA, 25 bp, S. cerevisiae
gtcagaaccacagttagaacccata

SEQ ID NO: 43029 - DNA, 25 bp, S. cerevisiae
gtaatggcggcttctttcaggaatt

SEQ ID NO: 43030 - DNA, 25 bp, S. cerevisiae
gtaatgctcttcatcttcgttttgc

SEQ ID NO: 43031 - DNA, 25 bp, S. cerevisiae
gtaatcttcccattcttttttgcac

SEQ ID NO: 43032 - DNA, 25 bp, S. cerevisiae
gtaattctccaaatgtttcttctat

SEQ ID NO: 43033 - DNA, 25 bp, S. cerevisiae
gtaatcctcacagtcgttttttcac

SEQ ID NO: 43034 - DNA, 25 bp, S. cerevisiae
gtcactcaactggtcgttacttttg

SEQ ID NO: 43035 - DNA, 25 bp, S. cerevisiae
gtcacaaactgtggccattattttt

SEQ ID NO: 43036 - DNA, 25 bp, S. cerevisiae
gtcacagagccctagtcggtttatt

SEQ ID NO: 43037 - DNA, 25 bp, S. cerevisiae
gtcacgcatgccatctagtttcgat

SEQ ID NO: 43038 - DNA, 25 bp, S. cerevisiae
gtcaccctagtggagtttgcagatt

SEQ ID NO: 43039 - DNA, 25 bp, S. cerevisiae
gtgcccgtggtatcgttagatgtcg

SEQ ID NO: 43040 - DNA, 25 bp, S. cerevisiae
gtcagtggttccgtggaggcatcat

SEQ ID NO: 43041 - DNA, 25 bp, S. cerevisiae
gtcagtttacattggtcagtctatt

SEQ ID NO: 43042 - DNA, 25 bp, S. cerevisiae
gtctggctatctcgaagtacaacat

SEQ ID NO: 43043 - DNA, 25 bp, S. cerevisiae
gtctatatatcttgagtggacatac

SEQ ID NO: 43044 - DNA, 25 bp, S. cerevisiae
gtcagcacttctacagtcgaaactg

SEQ ID NO: 43045 - DNA, 25 bp, S. cerevisiae
gtcatccccttcttcaaagagtgtg

SEQ ID NO: 43046 - DNA, 25 bp, S. cerevisiae
gtcacccactgtgatgacaatggat

SEQ ID NO: 43047 - DNA, 25 bp, S. cerevisiae
gtcacccacttgtcataacatgttt

SEQ ID NO: 43048 - DNA, 25 bp, S. cerevisiae
gtcatactccgattcagaacgtctt

SEQ ID NO: 43049 - DNA, 25 bp, S. cerevisiae
gtaatacttataggatgctcgtctt

SEQ ID NO: 43050 - DNA, 25 bp, S. cerevisiae
gtaatgaaggtgacgcctctccttt

SEQ ID NO: 43051 - DNA, 25 bp, S. cerevisiae
gtcaacatctgcgaaggttccttca

SEQ ID NO: 43052 - DNA, 25 bp, S. cerevisiae
gtaatcttcccatctgtattgctaa

SEQ ID NO: 43053 - DNA, 25 bp, S. cerevisiae
gtaatccattactctggtccgatga

SEQ ID NO: 43054 - DNA, 25 bp, S. cerevisiae
gtcctttacgcatattttgtcccaa

SEQ ID NO: 43055 - DNA, 25 bp, S. cerevisiae
gtgtttcgacggatttgaactctag

SEQ ID NO: 43056 - DNA, 25 bp, S. cerevisiae
gtccggtgaaatcttccagtgttct

SEQ ID NO: 43057 - DNA, 25 bp, S. cerevisiae
gtcaaagaaaactagtggcactcac

SEQ ID NO: 43058 - DNA, 25 bp, S. cerevisiae
gtaatagtaacaacgctggcacctc

SEQ ID NO: 43059 - DNA, 25 bp, S. cerevisiae
gtcaagaaagagtatgccgccaatt

SEQ ID NO: 43060 - DNA, 25 bp, S. cerevisiae
gtcacaatttggttatgccgccatg

SEQ ID NO: 43061 - DNA, 25 bp, S. cerevisiae
gtcatctaccagtgataataatgct

SEQ ID NO: 43062 - DNA, 25 bp, S. cerevisiae
tgtcttggacgtgcggataggccta

SEQ ID NO: 43063 - DNA, 25 bp, S. cerevisiae
gtcaatcaaccttgcctacggtaat

SEQ ID NO: 43064 - DNA, 25 bp, S. cerevisiae
gtaatccaacttcccatgcgaatag

SEQ ID NO: 43065 - DNA, 25 bp, S. cerevisiae
gtaatgctccacctggcaatggtat

SEQ ID NO: 43066 - DNA, 25 bp, S. cerevisiae
gtcaatctgctccagctgaaactgt

SEQ ID NO: 43067 - DNA, 25 bp, S. cerevisiae
gtcaatggcatatgatacacctctt

SEQ ID NO: 43068 - DNA, 25 bp, S. cerevisiae
gtcaattgcagactgtgatgcccct

SEQ ID NO: 43069 - DNA, 25 bp, S. cerevisiae
gtcactagcgagttcattctccaat

SEQ ID NO: 43070 - DNA, 25 bp, S. cerevisiae
gtcacttccatctaagtctacgttg

SEQ ID NO: 43071 - DNA, 25 bp, S. cerevisiae
gtcactttctcaacgattaggtctc

SEQ ID NO: 43072 - DNA, 25 bp, S. cerevisiae
gtaatttgtcattcgatgtcacaga

SEQ ID NO: 43073 - DNA, 25 bp, S. cerevisiae
gtcagaaatgtcaagggtccagtta

SEQ ID NO: 43074 - DNA, 25 bp, S. cerevisiae
gtcatttagacaagcggtaccctta

SEQ ID NO: 43075 - DNA, 25 bp, S. cerevisiae
gtctttcaaacttccaaatcggcta

SEQ ID NO: 43076 - DNA, 25 bp, S. cerevisiae
gtgttttggtcgcacaaggtgtctc

SEQ ID NO: 43077 - DNA, 25 bp, S. cerevisiae
gtgtcattccgtctacaaggttaac

SEQ ID NO: 43078 - DNA, 25 bp, S. cerevisiae
gtctcccctgctttaagggtcacaa

SEQ ID NO: 43079 - DNA, 25 bp, S. cerevisiae
gtcacaggcgtggatggcctattca

SEQ ID NO: 43080 - DNA, 25 bp, S. cerevisiae
gtcatatggcttgcaagatcttaca

SEQ ID NO: 43081 - DNA, 25 bp, S. cerevisiae
gtcattgagctttccgagtttgcag

SEQ ID NO: 43082 - DNA, 25 bp, S. cerevisiae
gtcttacttatcaagaagccatgga

SEQ ID NO: 43083 - DNA, 25 bp, S. cerevisiae
gtcatcttcaatattgaccctggca

SEQ ID NO: 43084 - DNA, 25 bp, S. cerevisiae
gtcacacagacagctcatctaatca

SEQ ID NO: 43085 - DNA, 25 bp, S. cerevisiae
gtcacgtcatcgttgatccagacta

SEQ ID NO: 43086 - DNA, 25 bp, S. cerevisiae
gtcaatgtacatcttctcgtcaagg

SEQ ID NO: 43087 - DNA, 25 bp, S. cerevisiae
gtcaagaccatcattgctcttcaca

SEQ ID NO: 43088 - DNA, 25 bp, S. cerevisiae
gtcttaccgaacatagtgcgccatt

SEQ ID NO: 43089 - DNA, 25 bp, S. cerevisiae
gtcatttttgaaccaaggcgctact

SEQ ID NO: 43090 - DNA, 25 bp, S. cerevisiae
gtcttttattaccaacaactcagca

SEQ ID NO: 43091 - DNA, 25 bp, S. cerevisiae
gtcaggatgtatgtgggcccattcc

SEQ ID NO: 43092 - DNA, 25 bp, S. cerevisiae
gtcacttggaaatcaggctcataca

SEQ ID NO: 43093 - DNA, 25 bp, S. cerevisiae
gtcagtttaagcaaggaccccaatt

SEQ ID NO: 43094 - DNA, 25 bp, S. cerevisiae
gtcagtttcaaaaagagagctccaa

SEQ ID NO: 43095 - DNA, 25 bp, S. cerevisiae
gtcactttgcaatctgaaaccccaa

SEQ ID NO: 43096 - DNA, 25 bp, S. cerevisiae
gtcatttgcgaatctggatacccaa

SEQ ID NO: 43097 - DNA, 25 bp, S. cerevisiae
gtcaaacgtattcgcgtacccaaga

SEQ ID NO: 43098 - DNA, 25 bp, S. cerevisiae
gtcaagcgcttaatggacttcctgg

SEQ ID NO: 43099 - DNA, 25 bp, S. cerevisiae
gtcaccgctgtgactttaattaaat

SEQ ID NO: 43100 - DNA, 25 bp, S. cerevisiae
gtcaacggattctttccattcaaag

SEQ ID NO: 43101 - DNA, 25 bp, S. cerevisiae
gtcagctgggacttttcgatttaag

SEQ ID NO: 43102 - DNA, 25 bp, S. cerevisiae
gtcaatgggctcctgaaaattctaa

SEQ ID NO: 43103 - DNA, 25 bp, S. cerevisiae
gtcaatgttgccatgacaagggcca

SEQ ID NO: 43104 - DNA, 25 bp, S. cerevisiae
gtcaatattgcccatacactgttca

SEQ ID NO: 43105 - DNA, 25 bp, S. cerevisiae
gtcaatacgccttaactggtgctat

SEQ ID NO: 43106 - DNA, 25 bp, S. cerevisiae
gtcagtgagccattaaacggttcaa

SEQ ID NO: 43107 - DNA, 25 bp, S. cerevisiae
gtcaatcaccttgttaggtgccggt

SEQ ID NO: 43108 - DNA, 25 bp, S. cerevisiae
gtcaatagttcttcattctccctta

SEQ ID NO: 43109 - DNA, 25 bp, S. cerevisiae
gtcagaattttcttgtacccatcta

SEQ ID NO: 43110 - DNA, 25 bp, S. cerevisiae
gtcaagattttctagctacctgcaa

SEQ ID NO: 43111 - DNA, 25 bp, S. cerevisiae
gtcaacactgtttggtcacatgcta

SEQ ID NO: 43112 - DNA, 25 bp, S. cerevisiae
gtcaacttctaaatctggcagctca

SEQ ID NO: 43113 - DNA, 25 bp, S. cerevisiae
gtcacatctatcttgcttctaacta

SEQ ID NO: 43114 - DNA, 25 bp, S. cerevisiae
gtcatcacaatggatctccatgcct

SEQ ID NO: 43115 - DNA, 25 bp, S. cerevisiae
gtctcaacaggaacatcatcggcgt

SEQ ID NO: 43116 - DNA, 25 bp, S. cerevisiae
gtctcacaaaaccatccaggcagta

SEQ ID NO: 43117 - DNA, 25 bp, S. cerevisiae
gtcattgattgacgacccgcaagaa

SEQ ID NO: 43118 - DNA, 25 bp, S. cerevisiae
gtcgttctagcggatccacaaggat

SEQ ID NO: 43119 - DNA, 25 bp, S. cerevisiae
gtgatttccggcatgccatcaagag

SEQ ID NO: 43120 - DNA, 25 bp, S. cerevisiae
gtcacatttaccaccaacattgtct

SEQ ID NO: 43121 - DNA, 25 bp, S. cerevisiae
gtctcaaacaacaactccgatactt

SEQ ID NO: 43122 - DNA, 25 bp, S. cerevisiae
tgtcattgaggaggctacccgtaat

SEQ ID NO: 43123 - DNA, 25 bp, S. cerevisiae
gtctttatcatccacaccagctgca

SEQ ID NO: 43124 - DNA, 25 bp, S. cerevisiae
gtcactatccattcacaaatctcag

SEQ ID NO: 43125 - DNA, 25 bp, S. cerevisiae
gtcaagcattttcctttggacgcta

SEQ ID NO: 43126 - DNA, 25 bp, S. cerevisiae
gtcatcgaattcctcatactacacg

SEQ ID NO: 43127 - DNA, 25 bp, S. cerevisiae
gtcagcttatatgttctttgctaat

SEQ ID NO: 43128 - DNA, 25 bp, S. cerevisiae
gtcacattatacattttcgcgaagg

SEQ ID NO: 43129 - DNA, 25 bp, S. cerevisiae
gtcgattcatacatttctccggcgt

SEQ ID NO: 43130 - DNA, 25 bp, S. cerevisiae
gtctaagaagccagcagtttcccat

SEQ ID NO: 43131 - DNA, 25 bp, S. cerevisiae
gtcaaaagtttccagaattgccctc

SEQ ID NO: 43132 - DNA, 25 bp, S. cerevisiae
gtcaaagacagattccggttcccca

SEQ ID NO: 43133 - DNA, 25 bp, S. cerevisiae
gtcatttgctatctcttgcaggtta

SEQ ID NO: 43134 - DNA, 25 bp, S. cerevisiae
gtcattcctattattggcgtcctat

SEQ ID NO: 43135 - DNA, 25 bp, S. cerevisiae
gtcttccccaatcttcaggtaaaca

SEQ ID NO: 43136 - DNA, 25 bp, S. cerevisiae
gtcacccttgtttctgattcagaga

SEQ ID NO: 43137 - DNA, 25 bp, S. cerevisiae
gtcagatacttacttgcatgtgcat

SEQ ID NO: 43138 - DNA, 25 bp, S. cerevisiae
gtcacagattgggatttgtcaacct

SEQ ID NO: 43139 - DNA, 25 bp, S. cerevisiae
gtcaacttgatcgattttgcacgtt

SEQ ID NO: 43140 - DNA, 25 bp, S. cerevisiae
gtcacatcaagatcgtttatggtta

SEQ ID NO: 43141 - DNA, 25 bp, S. cerevisiae
gtcagacgccgaaatcttgagacaa

SEQ ID NO: 43142 - DNA, 25 bp, S. cerevisiae
gtcaggcccacaaatgtacatacca

SEQ ID NO: 43143 - DNA, 25 bp, S. cerevisiae
gtcagggctaccagtcacaacagag

SEQ ID NO: 43144 - DNA, 25 bp, S. cerevisiae
gtcagtagtgacgttgctccaaatg

SEQ ID NO: 43145 - DNA, 25 bp, S. cerevisiae
gtcaatggtgcttgctcttacgaaa

SEQ ID NO: 43146 - DNA, 25 bp, S. cerevisiae
gtcattaggcatacttctaccaagt

SEQ ID NO: 43147 - DNA, 25 bp, S. cerevisiae
gtcaaacttacttcgagctcaacta

SEQ ID NO: 43148 - DNA, 25 bp, S. cerevisiae
gtcaaacttgtcatcgagcacagaa

SEQ ID NO: 43149 - DNA, 25 bp, S. cerevisiae
gtcagcaactttgttctgcagcaga

SEQ ID NO: 43150 - DNA, 25 bp, S. cerevisiae
gtcacaaccgcgactaatgatgatg

SEQ ID NO: 43151 - DNA, 25 bp, S. cerevisiae
gtctatgaacgtttactgtgatggt

SEQ ID NO: 43152 - DNA, 25 bp, S. cerevisiae
gtcattagacttttacatcggtggt

SEQ ID NO: 43153 - DNA, 25 bp, S. cerevisiae
gtcataagttcctatacacggctgg

SEQ ID NO: 43154 - DNA, 25 bp, S. cerevisiae
gtctcagagctgtggcaaacgttct

SEQ ID NO: 43155 - DNA, 25 bp, S. cerevisiae
gtcacagacgaccagtacaatattt

SEQ ID NO: 43156 - DNA, 25 bp, S. cerevisiae
gtcagtatcgacctgtgaagatcac

SEQ ID NO: 43157 - DNA, 25 bp, S. cerevisiae
gtctgtgaaacccattgacaactac

SEQ ID NO: 43158 - DNA, 25 bp, S. cerevisiae
gtcttgaaatccttcttggaatccg

SEQ ID NO: 43159 - DNA, 25 bp, S. cerevisiae
gtcatagaaccgctccaaaatccga

SEQ ID NO: 43160 - DNA, 25 bp, S. cerevisiae
gtcagagcaaccaactcaccaagat

SEQ ID NO: 43161 - DNA, 25 bp, S. cerevisiae
gtctaccggtaagtcttctaacatc

SEQ ID NO: 43162 - DNA, 25 bp, S. cerevisiae
gtcttaccagacaacgttccaatca

SEQ ID NO: 43163 - DNA, 25 bp, S. cerevisiae
gtctcattagtagccgttccattag

SEQ ID NO: 43164 - DNA, 25 bp, S. cerevisiae
gtctcctggtgctgtcattattttc

SEQ ID NO: 43165 - DNA, 25 bp, S. cerevisiae
gtcattgtccttggcgagggtgtaa

SEQ ID NO: 43166 - DNA, 25 bp, S. cerevisiae
gtcactatctgtatgccaaagtcca

SEQ ID NO: 43167 - DNA, 25 bp, S. cerevisiae
gtcacagaactgctccaaagtctga

SEQ ID NO: 43168 - DNA, 25 bp, S. cerevisiae
gtcatggaccagctggaaattctaa

SEQ ID NO: 43169 - DNA, 25 bp, S. cerevisiae
gtcatgactgtactctggaaattct

SEQ ID NO: 43170 - DNA, 25 bp, S. cerevisiae
gtcactttagcttgggtcatcatcg

SEQ ID NO: 43171 - DNA, 25 bp, S. cerevisiae
gtcatgttaggttccgtgctacgag

SEQ ID NO: 43172 - DNA, 25 bp, S. cerevisiae
gtcatttgggttgtggcttctatat

SEQ ID NO: 43173 - DNA, 25 bp, S. cerevisiae
gtcgacgccctatcaaacttgttga

SEQ ID NO: 43174 - DNA, 25 bp, S. cerevisiae
gtctacccagtagatatagccgtta

SEQ ID NO: 43175 - DNA, 25 bp, S. cerevisiae
gtcttcctagtagatatagccgcta

SEQ ID NO: 43176 - DNA, 25 bp, S. cerevisiae
gtcttcctcgaagaatggcggcaaa

SEQ ID NO: 43177 - DNA, 25 bp, S. cerevisiae
gtcattccagctaaggtcttcggta

SEQ ID NO: 43178 - DNA, 25 bp, S. cerevisiae
gtcacttgatgaggccgttaaaatt

SEQ ID NO: 43179 - DNA, 25 bp, S. cerevisiae
gtcacacttaagaacgcatacaaat

SEQ ID NO: 43180 - DNA, 25 bp, S. cerevisiae
gtcaacctgcaaaatccttcaagat

SEQ ID NO: 43181 - DNA, 25 bp, S. cerevisiae
gtcatagccgccatcaatcaaaaga

SEQ ID NO: 43182 - DNA, 25 bp, S. cerevisiae
gtcaagcctgagactcacatcaatt

SEQ ID NO: 43183 - DNA, 25 bp, S. cerevisiae
gtcaacagatggatttgcttcgaat

SEQ ID NO: 43184 - DNA, 25 bp, S. cerevisiae
gtcacaaattggtaacattttccta

SEQ ID NO: 43185 - DNA, 25 bp, S. cerevisiae
gtcacctattggtcatactttgtca

SEQ ID NO: 43186 - DNA, 25 bp, S. cerevisiae
gtcaggtttaatccctttggcaagg

SEQ ID NO: 43187 - DNA, 25 bp, S. cerevisiae
gtcagtctggataccttgcattatt

SEQ ID NO: 43188 - DNA, 25 bp, S. cerevisiae
gtcatatcggatttcagtcttgcat

SEQ ID NO: 43189 - DNA, 25 bp, S. cerevisiae
gtcattgaagagtcatctgaaccta

SEQ ID NO: 43190 - DNA, 25 bp, S. cerevisiae
gtcattattacactcatacgccatc

SEQ ID NO: 43191 - DNA, 25 bp, S. cerevisiae
gtcaaattcacactatccactatca

SEQ ID NO: 43192 - DNA, 25 bp, S. cerevisiae
gtgctactataactacgactacgcc

SEQ ID NO: 43193 - DNA, 25 bp, S. cerevisiae
gtctggtacagacacgtttgcgctg

SEQ ID NO: 43194 - DNA, 25 bp, S. cerevisiae
gtcttgccaaaatctgtgaatcccg

SEQ ID NO: 43195 - DNA, 25 bp, S. cerevisiae
gtcttggcagactttggtatagcta

SEQ ID NO: 43196 - DNA, 25 bp, S. cerevisiae
gtcattcgacacctggtcaaagcta

SEQ ID NO: 43197 - DNA, 25 bp, S. cerevisiae
gtcaggatcaaaataccacgaagtc

SEQ ID NO: 43198 - DNA, 25 bp, S. cerevisiae
gtcaggcacaagtttaccaaagatt

SEQ ID NO: 43199 - DNA, 25 bp, S. cerevisiae
gtcagtgccggtattgtcaacgtct

SEQ ID NO: 43200 - DNA, 25 bp, S. cerevisiae
gtcttcttcttcgtacatcaactat

SEQ ID NO: 43201 - DNA, 25 bp, S. cerevisiae
gtcttcgtcctccattactttagag

SEQ ID NO: 43202 - DNA, 25 bp, S. cerevisiae
gtcactcttcgcaatcactgcaaaa

SEQ ID NO: 43203 - DNA, 25 bp, S. cerevisiae
gtcacatttgcacttgacgctaatg

SEQ ID NO: 43204 - DNA, 25 bp, S. cerevisiae
gtcaacaagccagtaccgagcatat

SEQ ID NO: 43205 - DNA, 25 bp, S. cerevisiae
gtcgtcaaccctacaggagcttgat

SEQ ID NO: 43206 - DNA, 25 bp, S. cerevisiae
gtctgataatcagcttcggcggtat

SEQ ID NO: 43207 - DNA, 25 bp, S. cerevisiae
gtcttccattccatcgtggcagtta

SEQ ID NO: 43208 - DNA, 25 bp, S. cerevisiae
gtcacctcttcgctttcaagatcta

SEQ ID NO: 43209 - DNA, 25 bp, S. cerevisiae
gtcataccgcacagaaatccttcga

SEQ ID NO: 43210 - DNA, 25 bp, S. cerevisiae
gtcatcctcggcagacaatgtcatg

SEQ ID NO: 43211 - DNA, 25 bp, S. cerevisiae
gtcaccctggtgtacaatttggaac

SEQ ID NO: 43212 - DNA, 25 bp, S. cerevisiae
gtcaccctggatttatacggcgaag

SEQ ID NO: 43213 - DNA, 25 bp, S. cerevisiae
gtcactactggtcgtaagcgtcgtt

SEQ ID NO: 43214 - DNA, 25 bp, S. cerevisiae
gtcattggactcgttaacctcttta

SEQ ID NO: 43215 - DNA, 25 bp, S. cerevisiae
gtcattgaattctgtccgaagctta

SEQ ID NO: 43216 - DNA, 25 bp, S. cerevisiae
gtcacgatagattcttcacccttaa

SEQ ID NO: 43217 - DNA, 25 bp, S. cerevisiae
gtcacagatctattacttgccctta

SEQ ID NO: 43218 - DNA, 25 bp, S. cerevisiae
gtcacttgtgaatcatgctctactg

SEQ ID NO: 43219 - DNA, 25 bp, S. cerevisiae
gtcagcctcaattatcatctcaaca

SEQ ID NO: 43220 - DNA, 25 bp, S. cerevisiae
gtcagcatatgctatttccgcaagc

SEQ ID NO: 43221 - DNA, 25 bp, S. cerevisiae
gtcagcatcactttttgtgcaacct

SEQ ID NO: 43222 - DNA, 25 bp, S. cerevisiae
gtcaaactcttcaatactgcacatg

SEQ ID NO: 43223 - DNA, 25 bp, S. cerevisiae
gtcaaactttgtaactggctatcca

SEQ ID NO: 43224 - DNA, 25 bp, S. cerevisiae
gtcaaacttattacaatgctggtct

SEQ ID NO: 43225 - DNA, 25 bp, S. cerevisiae
gtcaggcctttaaacaatggtcatt

SEQ ID NO: 43226 - DNA, 25 bp, S. cerevisiae
gtcacgattttattcacctgctttg

SEQ ID NO: 43227 - DNA, 25 bp, S. cerevisiae
gtcatcgaacttcgtcaccattagg

SEQ ID NO: 43228 - DNA, 25 bp, S. cerevisiae
gtcaccaacttcaacagcacaaacg

SEQ ID NO: 43229 - DNA, 25 bp, S. cerevisiae
gtcaccgatctaatcatccagcaaa

SEQ ID NO: 43230 - DNA, 25 bp, S. cerevisiae
gtcagctctggtacaagtcacaaca

SEQ ID NO: 43231 - DNA, 25 bp, S. cerevisiae
gtcaccaggtgaatacttctacaag

SEQ ID NO: 43232 - DNA, 25 bp, S. cerevisiae
gtcgggctatgatcgaggccatcaa

SEQ ID NO: 43233 - DNA, 25 bp, S. cerevisiae
gtcggagaatggtcaggcgctatta

SEQ ID NO: 43234 - DNA, 25 bp, S. cerevisiae
gtctatcttcggaaacacgttcaaa

SEQ ID NO: 43235 - DNA, 25 bp, S. cerevisiae
gtgctatcttcacaacgggtttcaa

SEQ ID NO: 43236 - DNA, 25 bp, S. cerevisiae
gtcattcgtctgtatacggttctta

SEQ ID NO: 43237 - DNA, 25 bp, S. cerevisiae
gtctacacgggcacgagatttttcg

SEQ ID NO: 43238 - DNA, 25 bp, S. cerevisiae
gtcataagctggtttttagctagct

SEQ ID NO: 43239 - DNA, 25 bp, S. cerevisiae
gtcagagactgttccttgtatccac

SEQ ID NO: 43240 - DNA, 25 bp, S. cerevisiae
gtcactgcacttttcttggcattag

SEQ ID NO: 43241 - DNA, 25 bp, S. cerevisiae
gtcaccatactagtttctctgctaa

SEQ ID NO: 43242 - DNA, 25 bp, S. cerevisiae
gtcagatctcgtgtttatgcgtact

SEQ ID NO: 43243 - DNA, 25 bp, S. cerevisiae
tccccttcgttgtgcacggaataat

SEQ ID NO: 43244 - DNA, 25 bp, S. cerevisiae
tcgaattgccagcttccttggaagt

SEQ ID NO: 43245 - DNA, 25 bp, S. cerevisiae
gtctttgcgcaaacagctatcggtt

SEQ ID NO: 43246 - DNA, 25 bp, S. cerevisiae
gtcttctccaaaggccgtggcatta

SEQ ID NO: 43247 - DNA, 25 bp, S. cerevisiae
gtcgatgaagccagaatcaacgaat

SEQ ID NO: 43248 - DNA, 25 bp, S. cerevisiae
gtctagacccttctatatcgggttg

SEQ ID NO: 43249 - DNA, 25 bp, S. cerevisiae
gtcagtatccctccacaaatatagt

SEQ ID NO: 43250 - DNA, 25 bp, S. cerevisiae
gtcagttacctttacgaatcaagta

SEQ ID NO: 43251 - DNA, 25 bp, S. cerevisiae
gtcattaaggctttacaatccttga

SEQ ID NO: 43252 - DNA, 25 bp, S. cerevisiae
gtcattaaggctttacaatccttga

SEQ ID NO: 43253 - DNA, 25 bp, S. cerevisiae
gtcttttgactgattactctctacc

SEQ ID NO: 43254 - DNA, 25 bp, S. cerevisiae
gtcattgttacccaagacagctctg

SEQ ID NO: 43255 - DNA, 25 bp, S. cerevisiae
gtcatggtataacgatctggatgtt

SEQ ID NO: 43256 - DNA, 25 bp, S. cerevisiae
gtcactggatgaacagctgttgcta

SEQ ID NO: 43257 - DNA, 25 bp, S. cerevisiae
gtcagcggatgaacctatttcacat

SEQ ID NO: 43258 - DNA, 25 bp, S. cerevisiae
gtcacggtgaccaaatttccagctt

SEQ ID NO: 43259 - DNA, 25 bp, S. cerevisiae
gtctaattcaccaagtttctgcctc

SEQ ID NO: 43260 - DNA, 25 bp, S. cerevisiae
gtcgaaccagttttggttgcctctg

SEQ ID NO: 43261 - DNA, 25 bp, S. cerevisiae
gtctacctagtcttttttggtgcct

SEQ ID NO: 43262 - DNA, 25 bp, S. cerevisiae
gtcacgcagcattgtcatgttttag

SEQ ID NO: 43263 - DNA, 25 bp, S. cerevisiae
gtcatccaatggttgattcctacta

SEQ ID NO: 43264 - DNA, 25 bp, S. cerevisiae
gtcatcgtattgctgttgcctatta

SEQ ID NO: 43265 - DNA, 25 bp, S. cerevisiae
gtcatcttgcttcctttttcttact

SEQ ID NO: 43266 - DNA, 25 bp, S. cerevisiae
gtcatcgatcctcttatttattctc

SEQ ID NO: 43267 - DNA, 25 bp, S. cerevisiae
gtcactgcacgtgtttcagtatgct

SEQ ID NO: 43268 - DNA, 25 bp, S. cerevisiae
gtcatctacaaccaattccatatcg

SEQ ID NO: 43269 - DNA, 25 bp, S. cerevisiae
gtcatcaagccacaattccatcagt

SEQ ID NO: 43270 - DNA, 25 bp, S. cerevisiae
gtgaggagcccgaacatcaagcagt

SEQ ID NO: 43271 - DNA, 25 bp, S. cerevisiae
gtcacgagcttaccattcaaattat

SEQ ID NO: 43272 - DNA, 25 bp, S. cerevisiae
gtctcggtgtcactattttcactat

SEQ ID NO: 43273 - DNA, 25 bp, S. cerevisiae
gtcactctggtcatattttgcgttt

SEQ ID NO: 43274 - DNA, 25 bp, S. cerevisiae
gtcttctcaacaatatgtccatcgt

SEQ ID NO: 43275 - DNA, 25 bp, S. cerevisiae
gtctgctgcagaccaatcggaagtg

SEQ ID NO: 43276 - DNA, 25 bp, S. cerevisiae
gtcatcggcgtagcgttgatcagat

SEQ ID NO: 43277 - DNA, 25 bp, S. cerevisiae
gtccccgtagatgtccatgttagta

SEQ ID NO: 43278 - DNA, 25 bp, S. cerevisiae
gggccaagtaccaccatttagatac

SEQ ID NO: 43279 - DNA, 25 bp, S. cerevisiae
gtcgacaactggctcccaattagaa

SEQ ID NO: 43280 - DNA, 25 bp, S. cerevisiae
gtcgacggcttgctgtacaattgga

SEQ ID NO: 43281 - DNA, 25 bp, S. cerevisiae
gtctggtgacttctataacttgtat

SEQ ID NO: 43282 - DNA, 25 bp, S. cerevisiae
gtcagaactctctagcttggcgatt

SEQ ID NO: 43283 - DNA, 25 bp, S. cerevisiae
gtcagaatcctactgccgagagatg

SEQ ID NO: 43284 - DNA, 25 bp, S. cerevisiae
gtgagtgatctttcccagaagggtc

SEQ ID NO: 43285 - DNA, 25 bp, S. cerevisiae
gtgcgtgtattaccaaaaggagcta

SEQ ID NO: 43286 - DNA, 25 bp, S. cerevisiae
gtctttcgctcctatctgaacatta

SEQ ID NO: 43287 - DNA, 25 bp, S. cerevisiae
gtcttccgctgccatagagcaagat

SEQ ID NO: 43288 - DNA, 25 bp, S. cerevisiae
gtcccattgggttgtgtaccatttt

SEQ ID NO: 43289 - DNA, 25 bp, S. cerevisiae
gtcggcttcggctggtgacgatcct

SEQ ID NO: 43290 - DNA, 25 bp, S. cerevisiae
gtctgggaacatttcaccaactgtg

SEQ ID NO: 43291 - DNA, 25 bp, S. cerevisiae
gtcaccatctggtcacaagactttc

SEQ ID NO: 43292 - DNA, 25 bp, S. cerevisiae
gtcggaattccggtaataatcttct

SEQ ID NO: 43293 - DNA, 25 bp, S. cerevisiae
gtcgaatttcgcgtctaaggtcaat

SEQ ID NO: 43294 - DNA, 25 bp, S. cerevisiae
gtcagagctccaactgttaagtaca

SEQ ID NO: 43295 - DNA, 25 bp, S. cerevisiae
gtcaccattgactttgaatctgcca

SEQ ID NO: 43296 - DNA, 25 bp, S. cerevisiae
gtcaccttagctaaagtcatcaaag

SEQ ID NO: 43297 - DNA, 25 bp, S. cerevisiae
gtcaggttatgaatgtgcttccagc

SEQ ID NO: 43298 - DNA, 25 bp, S. cerevisiae
gtctgtgattcatatcttgacgcag

SEQ ID NO: 43299 - DNA, 25 bp, S. cerevisiae
gtcattcttgcctacgtgtttaagg

SEQ ID NO: 43300 - DNA, 25 bp, S. cerevisiae
gtcttcttcgcatctggagctttag

SEQ ID NO: 43301 - DNA, 25 bp, S. cerevisiae
gtcaccatatctagcaacactgttg

SEQ ID NO: 43302 - DNA, 25 bp, S. cerevisiae
gtcatcccacctttgattttggtta

SEQ ID NO: 43303 - DNA, 25 bp, S. cerevisiae
gtcattatcatgtcgacggtctgcg

SEQ ID NO: 43304 - DNA, 25 bp, S. cerevisiae
gtcagtacatagatttggccctcac

SEQ ID NO: 43305 - DNA, 25 bp, S. cerevisiae
gtcagaactagcattattgtccaga

SEQ ID NO: 43306 - DNA, 25 bp, S. cerevisiae
gtcagacagtgtcttggttgcacaa

SEQ ID NO: 43307 - DNA, 25 bp, S. cerevisiae
gtctcacgctgctgctgggtgtcac

SEQ ID NO: 43308 - DNA, 25 bp, S. cerevisiae
gtcatgacctgctcgggatgttctg

SEQ ID NO: 43309 - DNA, 25 bp, S. cerevisiae
gtcatgaccgctcaaaggttcgttt

SEQ ID NO: 43310 - DNA, 25 bp, S. cerevisiae
gtcttttacaattctggtccagcca

SEQ ID NO: 43311 - DNA, 25 bp, S. cerevisiae
gtcttgacgacatactggacaacta

SEQ ID NO: 43312 - DNA, 25 bp, S. cerevisiae
gtctatgtccaacaaggtcaaccaa

SEQ ID NO: 43313 - DNA, 25 bp, S. cerevisiae
gtcattatctagacaagggctcaat

SEQ ID NO: 43314 - DNA, 25 bp, S. cerevisiae
gtcatcttctaacaccgtatatgat

SEQ ID NO: 43315 - DNA, 25 bp, S. cerevisiae
tgtccctgggcgaaccggaatttga

SEQ ID NO: 43316 - DNA, 25 bp, S. cerevisiae
gtcatagccgccgagcttttgaaaa

SEQ ID NO: 43317 - DNA, 25 bp, S. cerevisiae
gtctctgggatgcatcgttctggaa

SEQ ID NO: 43318 - DNA, 25 bp, S. cerevisiae
gtcatccgaagtgctgtcgcatatt

SEQ ID NO: 43319 - DNA, 25 bp, S. cerevisiae
gtcatctccagagttcagtcagaat

SEQ ID NO: 43320 - DNA, 25 bp, S. cerevisiae
gtgttactggtcgtatcacctacat

SEQ ID NO: 43321 - DNA, 25 bp, S. cerevisiae
gtcttattggcaaaaatcctacttc

SEQ ID NO: 43322 - DNA, 25 bp, S. cerevisiae
gtctgcttctggcataaacgaactg

SEQ ID NO: 43323 - DNA, 25 bp, S. cerevisiae
tgtcctttgcggcttagcgagatta

SEQ ID NO: 43324 - DNA, 25 bp, S. cerevisiae
gtcttggcgctttggcaattgctaa

SEQ ID NO: 43325 - DNA, 25 bp, S. cerevisiae
gtctctggctcagcagaagcggttt

SEQ ID NO: 43326 - DNA, 25 bp, S. cerevisiae
gtcatgatcgatgccatgcttgcgt

SEQ ID NO: 43327 - DNA, 25 bp, S. cerevisiae
gtcagtacgatgcatccttggatca

SEQ ID NO: 43328 - DNA, 25 bp, S. cerevisiae
gtcgttaatcgagatattacccagt

SEQ ID NO: 43329 - DNA, 25 bp, S. cerevisiae
gtctatttatcacttgggttcctcc

SEQ ID NO: 43330 - DNA, 25 bp, S. cerevisiae
gtctatttatcagacgcgccatgtc

SEQ ID NO: 43331 - DNA, 25 bp, S. cerevisiae
gtctttattcatttctttcctgtta

SEQ ID NO: 43332 - DNA, 25 bp, S. cerevisiae
gtcttctgtcgcaaggactatacgt

SEQ ID NO: 43333 - DNA, 25 bp, S. cerevisiae
gtgttttcaccacaggagacgtcga

SEQ ID NO: 43334 - DNA, 25 bp, S. cerevisiae
gtctcattgatcgtattcaaacgcg

SEQ ID NO: 43335 - DNA, 25 bp, S. cerevisiae
gtcctcgacctacatagtccagaaa

SEQ ID NO: 43336 - DNA, 25 bp, S. cerevisiae
gtcagttctcaaaccacgcgttata

SEQ ID NO: 43337 - DNA, 25 bp, S. cerevisiae
gtcagatcactcaatgatgccctgg

SEQ ID NO: 43338 - DNA, 25 bp, S. cerevisiae
gtctcaatgcatggaccgtctacaa

SEQ ID NO: 43339 - DNA, 25 bp, S. cerevisiae
gtctatatatatccattgacggtat

SEQ ID NO: 43340 - DNA, 25 bp, S. cerevisiae
gtcttctacatgctctgacgctgaa

SEQ ID NO: 43341 - DNA, 25 bp, S. cerevisiae
gtcttcgagatgactctacgccgaa

SEQ ID NO: 43342 - DNA, 25 bp, S. cerevisiae
gtcgggtcaaccaactcaagttact

SEQ ID NO: 43343 - DNA, 25 bp, S. cerevisiae
gtctgcaagacaacctaatccgtgt

SEQ ID NO: 43344 - DNA, 25 bp, S. cerevisiae
gtctgcacaggcatcctatttggtg

SEQ ID NO: 43345 - DNA, 25 bp, S. cerevisiae
gtcttggcgcaatgtctattcgatg

SEQ ID NO: 43346 - DNA, 25 bp, S. cerevisiae
gtcttgtctcaattgttcatcacga

SEQ ID NO: 43347 - DNA, 25 bp, S. cerevisiae
gtctatttcaaacttagccctcagg

SEQ ID NO: 43348 - DNA, 25 bp, S. cerevisiae
gtctatttgacttcctcacagaact

SEQ ID NO: 43349 - DNA, 25 bp, S. cerevisiae
gtcttttcactattctaccgatcat

SEQ ID NO: 43350 - DNA, 25 bp, S. cerevisiae
gtcttctccgaattatagtctcatt

SEQ ID NO: 43351 - DNA, 25 bp, S. cerevisiae
gtcttctctcgttatgctatttctg

SEQ ID NO: 43352 - DNA, 25 bp, S. cerevisiae
gtctccgacgttttaaatgcctcga

SEQ ID NO: 43353 - DNA, 25 bp, S. cerevisiae
gtccaccacaacgttaaggcgtcta

SEQ ID NO: 43354 - DNA, 25 bp, S. cerevisiae
gtcgattgcttaggttacgggtcta

SEQ ID NO: 43355 - DNA, 25 bp, S. cerevisiae
gtctacgcccgtgatttgaagtttg

SEQ ID NO: 43356 - DNA, 25 bp, S. cerevisiae
gtctagagccatgtcgatttcaact

SEQ ID NO: 43357 - DNA, 25 bp, S. cerevisiae
gtctagagccatgtcgatttcaact

SEQ ID NO: 43358 - DNA, 25 bp, S. cerevisiae
gtcatcccagatgtcaattaccacg

SEQ ID NO: 43359 - DNA, 25 bp, S. cerevisiae
gtctcccagtcccaaagactagagc

SEQ ID NO: 43360 - DNA, 25 bp, S. cerevisiae
gtgctgccaccaaggacggtttttt

SEQ ID NO: 43361 - DNA, 25 bp, S. cerevisiae
gtccccttatggaggtttaatgtcg

SEQ ID NO: 43362 - DNA, 25 bp, S. cerevisiae
tgtccccggaggtgtgtttaaggca

SEQ ID NO: 43363 - DNA, 25 bp, S. cerevisiae
gtctcaagcagttcgatagtttcca

SEQ ID NO: 43364 - DNA, 25 bp, S. cerevisiae
gtgctaaacgctggccaaatcgata

SEQ ID NO: 43365 - DNA, 25 bp, S. cerevisiae
gtcttaacgcccctgatgatgagga

SEQ ID NO: 43366 - DNA, 25 bp, S. cerevisiae
gtcttgaacatctccgttggtgaat

SEQ ID NO: 43367 - DNA, 25 bp, S. cerevisiae
gtcatttctattgctgtttgtccag

SEQ ID NO: 43368 - DNA, 25 bp, S. cerevisiae
gtcatcgatgatatcccactggtta

SEQ ID NO: 43369 - DNA, 25 bp, S. cerevisiae
gtcatcctctcattcgtcattgaaa

SEQ ID NO: 43370 - DNA, 25 bp, S. cerevisiae
gtctatcctgattgaatgtgtcccc

SEQ ID NO: 43371 - DNA, 25 bp, S. cerevisiae
gtcttcgttagtatgagcccgctcc

SEQ ID NO: 43372 - DNA, 25 bp, S. cerevisiae
gtcatatgtgttattggagcctcgg

SEQ ID NO: 43373 - DNA, 25 bp, S. cerevisiae
gtcatcatcgatctgcctgagacaa

SEQ ID NO: 43374 - DNA, 25 bp, S. cerevisiae
gtcatcatcttcttgtgtgtacagt

SEQ ID NO: 43375 - DNA, 25 bp, S. cerevisiae
gtctcagctactatgtgtacgaaag

SEQ ID NO: 43376 - DNA, 25 bp, S. cerevisiae
gtctccaagctcatgtactcgataa

SEQ ID NO: 43377 - DNA, 25 bp, S. cerevisiae
gtcatgtctagttctgtcgctaatt

SEQ ID NO: 43378 - DNA, 25 bp, S. cerevisiae
gtcatgtttgtctttcctatcttac

SEQ ID NO: 43379 - DNA, 25 bp, S. cerevisiae
gtcattatttccaaccaactctttt

SEQ ID NO: 43380 - DNA, 25 bp, S. cerevisiae
gtcatctaaatgctaaatctgtcaa

SEQ ID NO: 43381 - DNA, 25 bp, S. cerevisiae
gtctctaaaacaaatgcagtcacag

SEQ ID NO: 43382 - DNA, 25 bp, S. cerevisiae
gtgctctatacaaccatggaaccct

SEQ ID NO: 43383 - DNA, 25 bp, S. cerevisiae
gtcggaaaatccaaacagctcgcgt

SEQ ID NO: 43384 - DNA, 25 bp, S. cerevisiae
gtcggcgctatcaaaaacgcttggt

SEQ ID NO: 43385 - DNA, 25 bp, S. cerevisiae
gtcggatgatttgcaccggcggtaa

SEQ ID NO: 43386 - DNA, 25 bp, S. cerevisiae
gtcatcgatatgtcttcaccgggag

SEQ ID NO: 43387 - DNA, 25 bp, S. cerevisiae
gtcatcgaaaagtcaccaatcgcag

SEQ ID NO: 43388 - DNA, 25 bp, S. cerevisiae
gtcattgacgaagttctccttggat

SEQ ID NO: 43389 - DNA, 25 bp, S. cerevisiae
gtgctttcaaccactgttttttccg

SEQ ID NO: 43390 - DNA, 25 bp, S. cerevisiae
gtctgttgaaccagttgttgtcatt

SEQ ID NO: 43391 - DNA, 25 bp, S. cerevisiae
gtcttcaaaagcttcctggtacctt

SEQ ID NO: 43392 - DNA, 25 bp, S. cerevisiae
gtctactcaaaactccatgggcagc

SEQ ID NO: 43393 - DNA, 25 bp, S. cerevisiae
gtctttgatgcaacttcttggctaa

SEQ ID NO: 43394 - DNA, 25 bp, S. cerevisiae
gtcatttttgcattggacgtcctca

SEQ ID NO: 43395 - DNA, 25 bp, S. cerevisiae
gtcatctctattgatcacttgcctt

SEQ ID NO: 43396 - DNA, 25 bp, S. cerevisiae
gtcatctccttgtacccaaaagttg

SEQ ID NO: 43397 - DNA, 25 bp, S. cerevisiae
gtcatcttcctttccacaaaaatca

SEQ ID NO: 43398 - DNA, 25 bp, S. cerevisiae
gtctgacaatgtctacttgaaattg

SEQ ID NO: 43399 - DNA, 25 bp, S. cerevisiae
gtctgcacaagacccttcgaattta

SEQ ID NO: 43400 - DNA, 25 bp, S. cerevisiae
gtctgaacgcagatttcttacttga

SEQ ID NO: 43401 - DNA, 25 bp, S. cerevisiae
gtctggccgaatgtcttgctttaga

SEQ ID NO: 43402 - DNA, 25 bp, S. cerevisiae
gtctccgtagtttgctttgttatct

SEQ ID NO: 43403 - DNA, 25 bp, S. cerevisiae
gtctcacgtatggtgtacgcttatt

SEQ ID NO: 43404 - DNA, 25 bp, S. cerevisiae
gtcatatcctgaacgtacggcgaat

SEQ ID NO: 43405 - DNA, 25 bp, S. cerevisiae
gtcattcggaaccaacactgcagaa

SEQ ID NO: 43406 - DNA, 25 bp, S. cerevisiae
gtgagggcgaaaccatcctggacat

SEQ ID NO: 43407 - DNA, 25 bp, S. cerevisiae
gtcattattctgtactcctatcaag

SEQ ID NO: 43408 - DNA, 25 bp, S. cerevisiae
gtcatcttctctggccttgcagaaa

SEQ ID NO: 43409 - DNA, 25 bp, S. cerevisiae
gtctaatccttctcgtgttgacgaa

SEQ ID NO: 43410 - DNA, 25 bp, S. cerevisiae
gtccaggtggaaaaagctgccgcaa

SEQ ID NO: 43411 - DNA, 25 bp, S. cerevisiae
gtcctggaatcgtcacaaacctata

SEQ ID NO: 43412 - DNA, 25 bp, S. cerevisiae
gtctctgttaggtcaaatgtgcgct

SEQ ID NO: 43413 - DNA, 25 bp, S. cerevisiae
gtctacagacgggtcgatcatcttt

SEQ ID NO: 43414 - DNA, 25 bp, S. cerevisiae
gtctttgcgtataggcagcaacctg

SEQ ID NO: 43415 - DNA, 25 bp, S. cerevisiae
gtcattcccatatggtcaacctcaa

SEQ ID NO: 43416 - DNA, 25 bp, S. cerevisiae
gtcttgatgctctgaaggcgatcct

SEQ ID NO: 43417 - DNA, 25 bp, S. cerevisiae
gtctaattgtggtagctgtcgggct

SEQ ID NO: 43418 - DNA, 25 bp, S. cerevisiae
gtcattatttattgcggctcggcct

SEQ ID NO: 43419 - DNA, 25 bp, S. cerevisiae
gtctctttcgaagatgttctcctga

SEQ ID NO: 43420 - DNA, 25 bp, S. cerevisiae
gtcttcttccaggtgattttccaga

SEQ ID NO: 43421 - DNA, 25 bp, S. cerevisiae
gtctctaacttatcctgggacgcat

SEQ ID NO: 43422 - DNA, 25 bp, S. cerevisiae
gtcttgctacattttactggttacg

SEQ ID NO: 43423 - DNA, 25 bp, S. cerevisiae
gtcttggtcatctttggtggtctaa

SEQ ID NO: 43424 - DNA, 25 bp, S. cerevisiae
gtcgcatttatatttgggaactaca

SEQ ID NO: 43425 - DNA, 25 bp, S. cerevisiae
gtctccttcatctttgagtaccgat

SEQ ID NO: 43426 - DNA, 25 bp, S. cerevisiae
gtcctgctgcaaatggtagaaccgt

SEQ ID NO: 43427 - DNA, 25 bp, S. cerevisiae
gtcgcagaaggatttggcaaccaaa

SEQ ID NO: 43428 - DNA, 25 bp, S. cerevisiae
gtctgcgaagcgaattgaagtccac

SEQ ID NO: 43429 - DNA, 25 bp, S. cerevisiae
gtctgactcgtatcctagtgagcat

SEQ ID NO: 43430 - DNA, 25 bp, S. cerevisiae
gtcatttatgctttctttctgtggt

SEQ ID NO: 43431 - DNA, 25 bp, S. cerevisiae
gtcatttcattactctgctgtttgg

SEQ ID NO: 43432 - DNA, 25 bp, S. cerevisiae
gtcttgatcttactagctggtcgtt

SEQ ID NO: 43433 - DNA, 25 bp, S. cerevisiae
gtctcacttacagcccttaaattta

SEQ ID NO: 43434 - DNA, 25 bp, S. cerevisiae
gtctcttctgaaccctgcattaaac

SEQ ID NO: 43435 - DNA, 25 bp, S. cerevisiae
gtctttcgaaagctgtccacataat

SEQ ID NO: 43436 - DNA, 25 bp, S. cerevisiae
gtctgatttgggtctcttatcctat

SEQ ID NO: 43437 - DNA, 25 bp, S. cerevisiae
gtcccttccctaaatctcagttgaa

SEQ ID NO: 43438 - DNA, 25 bp, S. cerevisiae
gtcttttcagaaacccattccatta

SEQ ID NO: 43439 - DNA, 25 bp, S. cerevisiae
gtcttttctgaatatggagtccctg

SEQ ID NO: 43440 - DNA, 25 bp, S. cerevisiae
gtcttcttctaatacgttatcctcc

SEQ ID NO: 43441 - DNA, 25 bp, S. cerevisiae
gtcttgaccacgacgtctctaaaga

SEQ ID NO: 43442 - DNA, 25 bp, S. cerevisiae
gtcttatccatcgtcctctaaaaaa

SEQ ID NO: 43443 - DNA, 25 bp, S. cerevisiae
gtcgtcatacgctcactacagataa

SEQ ID NO: 43444 - DNA, 25 bp, S. cerevisiae
gtcttccttaggttattcatctgaa

SEQ ID NO: 43445 - DNA, 25 bp, S. cerevisiae
gtcttcgctgtgttgtgtcttttaa

SEQ ID NO: 43446 - DNA, 25 bp, S. cerevisiae
gtctactgtgcttcgtggattttca

SEQ ID NO: 43447 - DNA, 25 bp, S. cerevisiae
gtcgtatatctttcggacctatcag

SEQ ID NO: 43448 - DNA, 25 bp, S. cerevisiae
gtcgactattttggaaacactcatg

SEQ ID NO: 43449 - DNA, 25 bp, S. cerevisiae
gtcgtttgattttcggtaccattgc

SEQ ID NO: 43450 - DNA, 25 bp, S. cerevisiae
ttccttaccggctgtaacgtacaat

SEQ ID NO: 43451 - DNA, 25 bp, S. cerevisiae
gtctacgcctttctcaaccatatga

SEQ ID NO: 43452 - DNA, 25 bp, S. cerevisiae
gtgactcctactatccaaaggccag

SEQ ID NO: 43453 - DNA, 25 bp, S. cerevisiae
gtgcaaagctacaccctacaggagg

SEQ ID NO: 43454 - DNA, 25 bp, S. cerevisiae
tgtaaagtgcaaaccgcttaccggg

SEQ ID NO: 43455 - DNA, 25 bp, S. cerevisiae
gtctcaaggcgaagctctgttcaac

SEQ ID NO: 43456 - DNA, 25 bp, S. cerevisiae
gtctgccacggaggctactttggaa

SEQ ID NO: 43457 - DNA, 25 bp, S. cerevisiae
gtctccctcggtgatacatagtaat

SEQ ID NO: 43458 - DNA, 25 bp, S. cerevisiae
gtcttcacaaataattgatcgtcca

SEQ ID NO: 43459 - DNA, 25 bp, S. cerevisiae
gtcttcacaacaatcatcgtctttc

SEQ ID NO: 43460 - DNA, 25 bp, S. cerevisiae
gtctccactgatgatatcgtcactg

SEQ ID NO: 43461 - DNA, 25 bp, S. cerevisiae
gtctccactcattagaagaccactg

SEQ ID NO: 43462 - DNA, 25 bp, S. cerevisiae
gtctgcgctgcattcaaaagaacga

SEQ ID NO: 43463 - DNA, 25 bp, S. cerevisiae
gtctcgtctttgtcaagccattgaa

SEQ ID NO: 43464 - DNA, 25 bp, S. cerevisiae
gtctactgttcctttattgttacct

SEQ ID NO: 43465 - DNA, 25 bp, S. cerevisiae
gtctagctgcttctcataagggctt

SEQ ID NO: 43466 - DNA, 25 bp, S. cerevisiae
gtctgctcgccttttaagaggcttt

SEQ ID NO: 43467 - DNA, 25 bp, S. cerevisiae
gtctcagtccaatttcatccaggtt

SEQ ID NO: 43468 - DNA, 25 bp, S. cerevisiae
gtctggcccagatttcattaaacgg

SEQ ID NO: 43469 - DNA, 25 bp, S. cerevisiae
gtcggagcctttgctggcataacca

SEQ ID NO: 43470 - DNA, 25 bp, S. cerevisiae
gtctgttattcggagcggcttcaat

SEQ ID NO: 43471 - DNA, 25 bp, S. cerevisiae
gtctactcattcgatagcacgctta

SEQ ID NO: 43472 - DNA, 25 bp, S. cerevisiae
gtcgaggccaagaagcagactttta

SEQ ID NO: 43473 - DNA, 25 bp, S. cerevisiae
gtctgcccggcttaattgttgttat

SEQ ID NO: 43474 - DNA, 25 bp, S. cerevisiae
gtcgaccgggcatagaatagcttct

SEQ ID NO: 43475 - DNA, 25 bp, S. cerevisiae
gtctaaaggtcccaaaagctgttca

SEQ ID NO: 43476 - DNA, 25 bp, S. cerevisiae
gtctctaatggccactgtaagtttg

SEQ ID NO: 43477 - DNA, 25 bp, S. cerevisiae
gtctaggtgctgctattgtcgttag

SEQ ID NO: 43478 - DNA, 25 bp, S. cerevisiae
gtctagtggtatgattctcgctttg

SEQ ID NO: 43479 - DNA, 25 bp, S. cerevisiae
gtctcttggtatcattggcgcttaa

SEQ ID NO: 43480 - DNA, 25 bp, S. cerevisiae
gtcgccatccgacattgggttgata

SEQ ID NO: 43481 - DNA, 25 bp, S. cerevisiae
gtcgccgtcagacaatttgctttca

SEQ ID NO: 43482 - DNA, 25 bp, S. cerevisiae
gtctgatacaaagcaattggctgaa

SEQ ID NO: 43483 - DNA, 25 bp, S. cerevisiae
gtcgctggtggcctactatggaaaa

SEQ ID NO: 43484 - DNA, 25 bp, S. cerevisiae
gtccgcgggctgtggaaattctatc

SEQ ID NO: 43485 - DNA, 25 bp, S. cerevisiae
gtcgtcggacgagcagtaatgttta

SEQ ID NO: 43486 - DNA, 25 bp, S. cerevisiae
gtctgtgaagtactggccgttgatt

SEQ ID NO: 43487 - DNA, 25 bp, S. cerevisiae
gtctctaagaaacctcaatgctgat

SEQ ID NO: 43488 - DNA, 25 bp, S. cerevisiae
gtctcatgaaggtgttatcgctgca

SEQ ID NO: 43489 - DNA, 25 bp, S. cerevisiae
gtcgaagtctttgttggctacgggt

SEQ ID NO: 43490 - DNA, 25 bp, S. cerevisiae
gtcggtctacctgactttgaaggaa

SEQ ID NO: 43491 - DNA, 25 bp, S. cerevisiae
gtcgattttcccttcttacaagtca

SEQ ID NO: 43492 - DNA, 25 bp, S. cerevisiae
gtcgttgtactcatccttaaatggt

SEQ ID NO: 43493 - DNA, 25 bp, S. cerevisiae
gtcgttttgttcatcattcaagggt

SEQ ID NO: 43494 - DNA, 25 bp, S. cerevisiae
gtcgtttctttgattatcccgtatg

SEQ ID NO: 43495 - DNA, 25 bp, S. cerevisiae
gtctgacgctgtcactattcgtacc

SEQ ID NO: 43496 - DNA, 25 bp, S. cerevisiae
gtctgacgctgttactatccgtact

SEQ ID NO: 43497 - DNA, 25 bp, S. cerevisiae
gtctgcaacagcacagtcagcgact

SEQ ID NO: 43498 - DNA, 25 bp, S. cerevisiae
gtctccaaatctacaatctgccaat

SEQ ID NO: 43499 - DNA, 25 bp, S. cerevisiae
tctctacccattctttttgctttaa

SEQ ID NO: 43500 - DNA, 25 bp, S. cerevisiae
gtctcgttactggtatttcttgcaa

SEQ ID NO: 43501 - DNA, 25 bp, S. cerevisiae
gtctagatctggtgttgctgttgct

SEQ ID NO: 43502 - DNA, 25 bp, S. cerevisiae
gtcgatgacttgtagggctcttgca

SEQ ID NO: 43503 - DNA, 25 bp, S. cerevisiae
gtcggtaccgtttgcattcagctgg

SEQ ID NO: 43504 - DNA, 25 bp, S. cerevisiae
ggtcccttcaaggaaagagcggtct

SEQ ID NO: 43505 - DNA, 25 bp, S. cerevisiae
gtctttttgctatgcccagtttttt

SEQ ID NO: 43506 - DNA, 25 bp, S. cerevisiae
gtctcagagagcttcgaagtgtgac

SEQ ID NO: 43507 - DNA, 25 bp, S. cerevisiae
gtccggatctttccagcatgatggt

SEQ ID NO: 43508 - DNA, 25 bp, S. cerevisiae
ttccgttttggttgatagattaaag

SEQ ID NO: 43509 - DNA, 25 bp, S. cerevisiae
gtctctgttttggtcgacagattaa

SEQ ID NO: 43510 - DNA, 25 bp, S. cerevisiae
gtctcttttatcaacgacgagcctc

SEQ ID NO: 43511 - DNA, 25 bp, S. cerevisiae
gtctaaaattcgtcgtgctgccaga

SEQ ID NO: 43512 - DNA, 25 bp, S. cerevisiae
gtcgaaaatttgttgccgctcagcg

SEQ ID NO: 43513 - DNA, 25 bp, S. cerevisiae
gtcgacacggagattatgccttcgt

SEQ ID NO: 43514 - DNA, 25 bp, S. cerevisiae
gtcgtgagactacaattttacgctt

SEQ ID NO: 43515 - DNA, 25 bp, S. cerevisiae
gtcgcttaccaccaaaagtacgttg

SEQ ID NO: 43516 - DNA, 25 bp, S. cerevisiae
gtcgtcgcctaccaagaagcaacaa

SEQ ID NO: 43517 - DNA, 25 bp, S. cerevisiae
gtcgtaccaacacaaacaggctatg

SEQ ID NO: 43518 - DNA, 25 bp, S. cerevisiae
gtctaccgccaacaaaatcagtcaa

SEQ ID NO: 43519 - DNA, 25 bp, S. cerevisiae
gtgccctcgggcttaaattatccag

SEQ ID NO: 43520 - DNA, 25 bp, S. cerevisiae
gtcccttcggacatgacaaatccag

SEQ ID NO: 43521 - DNA, 25 bp, S. cerevisiae
gtctcctccgtcagttaaatccaag

SEQ ID NO: 43522 - DNA, 25 bp, S. cerevisiae
gtcgaattcgtttatctcaaatcac

SEQ ID NO: 43523 - DNA, 25 bp, S. cerevisiae
gtcgttacagtttattccacatgga

SEQ ID NO: 43524 - DNA, 25 bp, S. cerevisiae
gtctgttgacgaattaattactgaa

SEQ ID NO: 43525 - DNA, 25 bp, S. cerevisiae
gtctgctggtactcaaagttctaag

SEQ ID NO: 43526 - DNA, 25 bp, S. cerevisiae
gtctttgtacaccaacacttctaga

SEQ ID NO: 43527 - DNA, 25 bp, S. cerevisiae
gtcgttgtcaactaaactacttgtt

SEQ ID NO: 43528 - DNA, 25 bp, S. cerevisiae
gggacattaggactgctaggtttat

SEQ ID NO: 43529 - DNA, 25 bp, S. cerevisiae
gtcgtcactggagcgattggttttt

SEQ ID NO: 43530 - DNA, 25 bp, S. cerevisiae
gtcgaaatctctccaaagggtggta

SEQ ID NO: 43531 - DNA, 25 bp, S. cerevisiae
gtcggtgattcttcagtgagagcca

SEQ ID NO: 43532 - DNA, 25 bp, S. cerevisiae
gtctggagtggttaagcaacaactt

SEQ ID NO: 43533 - DNA, 25 bp, S. cerevisiae
gtctacaaggctttgcacccaatct

SEQ ID NO: 43534 - DNA, 25 bp, S. cerevisiae
gtctatccggcaatttctacaactt

SEQ ID NO: 43535 - DNA, 25 bp, S. cerevisiae
gtcggtaataatctctcatccacaa

SEQ ID NO: 43536 - DNA, 25 bp, S. cerevisiae
gtctgatatttctcaactctggtga

SEQ ID NO: 43537 - DNA, 25 bp, S. cerevisiae
gtctctctcttccaaagtgctggta

SEQ ID NO: 43538 - DNA, 25 bp, S. cerevisiae
gtctctattatccaactgcgcatgg

SEQ ID NO: 43539 - DNA, 25 bp, S. cerevisiae
gtctcactcagctcataattcatca

SEQ ID NO: 43540 - DNA, 25 bp, S. cerevisiae
gtctgtccaaccgaaatcattgctt

SEQ ID NO: 43541 - DNA, 25 bp, S. cerevisiae
gtcgttccatctaaggaaggctctt

SEQ ID NO: 43542 - DNA, 25 bp, S. cerevisiae
gtcgtgttgatttcaagaaccctca

SEQ ID NO: 43543 - DNA, 25 bp, S. cerevisiae
gtcggttgatttgcaaacgctgtta

SEQ ID NO: 43544 - DNA, 25 bp, S. cerevisiae
gtcgatgttgttattgaacgccttc

SEQ ID NO: 43545 - DNA, 25 bp, S. cerevisiae
gtctccatatggtgtcttcaacagt

SEQ ID NO: 43546 - DNA, 25 bp, S. cerevisiae
gtcgaggcacagacttcaacagcaa

SEQ ID NO: 43547 - DNA, 25 bp, S. cerevisiae
gtcgactggcaagtacgatcaacag

SEQ ID NO: 43548 - DNA, 25 bp, S. cerevisiae
gtcggctacaaggtctggcacaagg

SEQ ID NO: 43549 - DNA, 25 bp, S. cerevisiae
gtccagtctgacattgtggcacaag

SEQ ID NO: 43550 - DNA, 25 bp, S. cerevisiae
gtctcggtgagccatgctttgacaa

SEQ ID NO: 43551 - DNA, 25 bp, S. cerevisiae
gtctctcctagatcgttacaaaaat

SEQ ID NO: 43552 - DNA, 25 bp, S. cerevisiae
gtcctctcaacctcctacaaagaga

SEQ ID NO: 43553 - DNA, 25 bp, S. cerevisiae
gtgcggatcctagggtgagaaacta

SEQ ID NO: 43554 - DNA, 25 bp, S. cerevisiae
gtctcttctttcattttgcggcaga

SEQ ID NO: 43555 - DNA, 25 bp, S. cerevisiae
gtctctgttgttattcgtggtgcaa

SEQ ID NO: 43556 - DNA, 25 bp, S. cerevisiae
gtctcaaggctggttatatgttctc

SEQ ID NO: 43557 - DNA, 25 bp, S. cerevisiae
gtcggcaaatgctacttcactgatc

SEQ ID NO: 43558 - DNA, 25 bp, S. cerevisiae
gtctcgcagatactacttccattgg

SEQ ID NO: 43559 - DNA, 25 bp, S. cerevisiae
gtctgcgcagatttccttcgattaa

SEQ ID NO: 43560 - DNA, 25 bp, S. cerevisiae
gtctgcagaatattccgcccaatag

SEQ ID NO: 43561 - DNA, 25 bp, S. cerevisiae
gtctcaactgacgacccaaattgtg

SEQ ID NO: 43562 - DNA, 25 bp, S. cerevisiae
gtccaactggaagcgtactgatgag

SEQ ID NO: 43563 - DNA, 25 bp, S. cerevisiae
gtccaagcaattgtccaaggccatt

SEQ ID NO: 43564 - DNA, 25 bp, S. cerevisiae
gtctctatttcatttctcaaggcca

SEQ ID NO: 43565 - DNA, 25 bp, S. cerevisiae
gtctacatttaagtctgaatatcca

SEQ ID NO: 43566 - DNA, 25 bp, S. cerevisiae
gtcccactaacatctactgtatcga

SEQ ID NO: 43567 - DNA, 25 bp, S. cerevisiae
gtccgcattggaaggtactgtcatt

SEQ ID NO: 43568 - DNA, 25 bp, S. cerevisiae
gtctggctctatatggtgctgcaag

SEQ ID NO: 43569 - DNA, 25 bp, S. cerevisiae
gtctctcctacaagatgtgtcgtta

SEQ ID NO: 43570 - DNA, 25 bp, S. cerevisiae
gtctcttgctccaattgtactgatt

SEQ ID NO: 43571 - DNA, 25 bp, S. cerevisiae
gtctgacatgtccttttttgatttg

SEQ ID NO: 43572 - DNA, 25 bp, S. cerevisiae
gtctgaataccaatgcttgtggcat

SEQ ID NO: 43573 - DNA, 25 bp, S. cerevisiae
gtctgactgcattcattcctgagaa

SEQ ID NO: 43574 - DNA, 25 bp, S. cerevisiae
gtctgttagaattgggtctagctca

SEQ ID NO: 43575 - DNA, 25 bp, S. cerevisiae
gtcgtttcaatcctgtcgtactaca

SEQ ID NO: 43576 - DNA, 25 bp, S. cerevisiae
gtcgtttcctcggatggatacctat

SEQ ID NO: 43577 - DNA, 25 bp, S. cerevisiae
gtcgaattaccctatggtgctcatg

SEQ ID NO: 43578 - DNA, 25 bp, S. cerevisiae
gtctctatgtgaaattctgtcccag

SEQ ID NO: 43579 - DNA, 25 bp, S. cerevisiae
gtcgtaatgacacctattatcactg

SEQ ID NO: 43580 - DNA, 25 bp, S. cerevisiae
gtcgtagcagacatcaacttctcgg

SEQ ID NO: 43581 - DNA, 25 bp, S. cerevisiae
ggcagattttgcctcgaaatacggg

SEQ ID NO: 43582 - DNA, 25 bp, S. cerevisiae
gggcggattctctcaataccagggc

SEQ ID NO: 43583 - DNA, 25 bp, S. cerevisiae
gtctggaatccagccttcgacatta

SEQ ID NO: 43584 - DNA, 25 bp, S. cerevisiae
gtctaacaccatccagcatgcaata

SEQ ID NO: 43585 - DNA, 25 bp, S. cerevisiae
gtctaacaccatccagcatgcaata

SEQ ID NO: 43586 - DNA, 25 bp, S. cerevisiae
gtctaacaccatccagcatgcaata

SEQ ID NO: 43587 - DNA, 25 bp, S. cerevisiae
gtcccagctgtgctgccagaaaaaa

SEQ ID NO: 43588 - DNA, 25 bp, S. cerevisiae
gtgcccctccgttcgaagaagaaat

SEQ ID NO: 43589 - DNA, 25 bp, S. cerevisiae
gtccccttagcgataatttcattga

SEQ ID NO: 43590 - DNA, 25 bp, S. cerevisiae
gtgccaatgctagaggattcccttg

SEQ ID NO: 43591 - DNA, 25 bp, S. cerevisiae
gtcgacttgagtaagttctccctaa

SEQ ID NO: 43592 - DNA, 25 bp, S. cerevisiae
gtcgaattagctgacatgtaccact

SEQ ID NO: 43593 - DNA, 25 bp, S. cerevisiae
gtctgatccacttgaccttagattt

SEQ ID NO: 43594 - DNA, 25 bp, S. cerevisiae
gtctctgccactttccattattatg

SEQ ID NO: 43595 - DNA, 25 bp, S. cerevisiae
gtctcgcctctgtcagaatatctta

SEQ ID NO: 43596 - DNA, 25 bp, S. cerevisiae
gtgagaggccgttcctatccatggg

SEQ ID NO: 43597 - DNA, 25 bp, S. cerevisiae
gtgaggtacacttcccaacatgagt

SEQ ID NO: 43598 - DNA, 25 bp, S. cerevisiae
gtcgagttactttctaatcattgct

SEQ ID NO: 43599 - DNA, 25 bp, S. cerevisiae
gtcggtatcaccacaaatgaatgct

SEQ ID NO: 43600 - DNA, 25 bp, S. cerevisiae
gtccctaccgttggtggaatctgac

SEQ ID NO: 43601 - DNA, 25 bp, S. cerevisiae
gtccgatatatcctcttgggtttta

SEQ ID NO: 43602 - DNA, 25 bp, S. cerevisiae
gtctgcgtaattactctcggttatg

SEQ ID NO: 43603 - DNA, 25 bp, S. cerevisiae
gtctcgatggctcaaactctttaaa

SEQ ID NO: 43604 - DNA, 25 bp, S. cerevisiae
gtctcgctggagtaaatttttcaac

SEQ ID NO: 43605 - DNA, 25 bp, S. cerevisiae
gtcgccgaagccaactttttcaagg

SEQ ID NO: 43606 - DNA, 25 bp, S. cerevisiae
gtctgcaaaaactactctgattctg

SEQ ID NO: 43607 - DNA, 25 bp, S. cerevisiae
gtctgggacaactctctgttgtaaa

SEQ ID NO: 43608 - DNA, 25 bp, S. cerevisiae
gtctgtcagttacatgattcttcta

SEQ ID NO: 43609 - DNA, 25 bp, S. cerevisiae
gtcgtcctgagtcgctaattgtaca

SEQ ID NO: 43610 - DNA, 25 bp, S. cerevisiae
gtcggctctgggtctttctgcaaga

SEQ ID NO: 43611 - DNA, 25 bp, S. cerevisiae
gtcgctgctgcaagaactttacaag

SEQ ID NO: 43612 - DNA, 25 bp, S. cerevisiae
gtctcgctcaaaaatcgcgttcagg

SEQ ID NO: 43613 - DNA, 25 bp, S. cerevisiae
gtccgttaatcactcatgcgaaggt

SEQ ID NO: 43614 - DNA, 25 bp, S. cerevisiae
gtctgccaagattagcttcgaagat

SEQ ID NO: 43615 - DNA, 25 bp, S. cerevisiae
gtctgcctcagttgcatgttctaaa

SEQ ID NO: 43616 - DNA, 25 bp, S. cerevisiae
gtcccgagggtaaagagtctgcgtt

SEQ ID NO: 43617 - DNA, 25 bp, S. cerevisiae
gtctccatcctttaactggccaaaa

SEQ ID NO: 43618 - DNA, 25 bp, S. cerevisiae
gtctcctgaggacccaggtctaaag

SEQ ID NO: 43619 - DNA, 25 bp, S. cerevisiae
gtcgcccagttcagcgtcattaacg

SEQ ID NO: 43620 - DNA, 25 bp, S. cerevisiae
gtctcctcactctatacgtattata

SEQ ID NO: 43621 - DNA, 25 bp, S. cerevisiae
gtctctgctacttctactgctagtt

SEQ ID NO: 43622 - DNA, 25 bp, S. cerevisiae
gtccataatcagtcttacggtcatc

SEQ ID NO: 43623 - DNA, 25 bp, S. cerevisiae
gtcgctaactgggtgtgacggcact

SEQ ID NO: 43624 - DNA, 25 bp, S. cerevisiae
gtctgccaaagctcaaaaccctatg

SEQ ID NO: 43625 - DNA, 25 bp, S. cerevisiae
gtctgccaagactgccaaagcttct

SEQ ID NO: 43626 - DNA, 25 bp, S. cerevisiae
gtctgcgaaacaagccatcaacgta

SEQ ID NO: 43627 - DNA, 25 bp, S. cerevisiae
gtctccaaaacagctagtcgatata

SEQ ID NO: 43628 - DNA, 25 bp, S. cerevisiae
gtctcccaaatcactgatggccaaa

SEQ ID NO: 43629 - DNA, 25 bp, S. cerevisiae
gtctcctaacgcacgaggcatgttg

SEQ ID NO: 43630 - DNA, 25 bp, S. cerevisiae
gtcccagaaattgttcccttcagac

SEQ ID NO: 43631 - DNA, 25 bp, S. cerevisiae
gtcctagaagatattccctccttga

SEQ ID NO: 43632 - DNA, 25 bp, S. cerevisiae
gtcgacgaagtatttcagcacctct

SEQ ID NO: 43633 - DNA, 25 bp, S. cerevisiae
gtctgtagtcatacctcgacaacat

SEQ ID NO: 43634 - DNA, 25 bp, S. cerevisiae
gtcgtctactcatttcggcaacaaa

SEQ ID NO: 43635 - DNA, 25 bp, S. cerevisiae
gtctgctgctactcttatgtttgaa

SEQ ID NO: 43636 - DNA, 25 bp, S. cerevisiae
gtctcctcgtggacaagccaattta

SEQ ID NO: 43637 - DNA, 25 bp, S. cerevisiae
gtccgatcctaagtatctttcgttg

SEQ ID NO: 43638 - DNA, 25 bp, S. cerevisiae
gtcgaattgggtgtttacgtctccg

SEQ ID NO: 43639 - DNA, 25 bp, S. cerevisiae
gtccaaaacatctgtgtctacgctg

SEQ ID NO: 43640 - DNA, 25 bp, S. cerevisiae
gtccaaatacgcttggtataccaga

SEQ ID NO: 43641 - DNA, 25 bp, S. cerevisiae
gtcccaaactgaatgctttactgaa

SEQ ID NO: 43642 - DNA, 25 bp, S. cerevisiae
gtcctgacaccattggctatttgga

SEQ ID NO: 43643 - DNA, 25 bp, S. cerevisiae
gtcgttgacaaaggatccattaaga

SEQ ID NO: 43644 - DNA, 25 bp, S. cerevisiae
gtcggcaccaaattcaccttgaaga

SEQ ID NO: 43645 - DNA, 25 bp, S. cerevisiae
gtcggcaccgaattactgttatcgt

SEQ ID NO: 43646 - DNA, 25 bp, S. cerevisiae
gtcggtgtcacaagcttatatccaa

SEQ ID NO: 43647 - DNA, 25 bp, S. cerevisiae
gtcgcttctccagctgtcaaaaagt

SEQ ID NO: 43648 - DNA, 25 bp, S. cerevisiae
gtcgcgtactcccagtaataacaat

SEQ ID NO: 43649 - DNA, 25 bp, S. cerevisiae
gtccaaagccgccagtagcataata

SEQ ID NO: 43650 - DNA, 25 bp, S. cerevisiae
gtctccatatgctcaaaagccatta

SEQ ID NO: 43651 - DNA, 25 bp, S. cerevisiae
gtctccttcaagaagagagctccaa

SEQ ID NO: 43652 - DNA, 25 bp, S. cerevisiae
gtcgcactattgcagtaagttccat

SEQ ID NO: 43653 - DNA, 25 bp, S. cerevisiae
gtccattggcgggaaattctccagg

SEQ ID NO: 43654 - DNA, 25 bp, S. cerevisiae
gtccgacatggagttggcacagatt

SEQ ID NO: 43655 - DNA, 25 bp, S. cerevisiae
gtcctatcattatcgtctaacatct

SEQ ID NO: 43656 - DNA, 25 bp, S. cerevisiae
gtcggttctggcaaagttccactga

SEQ ID NO: 43657 - DNA, 25 bp, S. cerevisiae
gtcgttttaattggtcttgcactag

SEQ ID NO: 43658 - DNA, 25 bp, S. cerevisiae
gtcccatttggtacgtcttgcacga

SEQ ID NO: 43659 - DNA, 25 bp, S. cerevisiae
gtcgttactccaacttggtctgtaa

SEQ ID NO: 43660 - DNA, 25 bp, S. cerevisiae
gtctgttcatcgaaacttggtttat

SEQ ID NO: 43661 - DNA, 25 bp, S. cerevisiae
gtctgcgcttattgtacgtacactg

SEQ ID NO: 43662 - DNA, 25 bp, S. cerevisiae
gtcgctgcctgatagtgttttacca

SEQ ID NO: 43663 - DNA, 25 bp, S. cerevisiae
gtctgcgtactaccgtggtgctgta

SEQ ID NO: 43664 - DNA, 25 bp, S. cerevisiae
gtccgctggtataggcttgccgaga

SEQ ID NO: 43665 - DNA, 25 bp, S. cerevisiae
gtcggtggtcaaattactcatggca

SEQ ID NO: 43666 - DNA, 25 bp, S. cerevisiae
gtcggattccagctacaggcaggta

SEQ ID NO: 43667 - DNA, 25 bp, S. cerevisiae
gtccgagtccggtcaagctgaagac

SEQ ID NO: 43668 - DNA, 25 bp, S. cerevisiae
gtcggttatgctacctgctatacaa

SEQ ID NO: 43669 - DNA, 25 bp, S. cerevisiae
gtctggatttgtatttgccgtcctt

SEQ ID NO: 43670 - DNA, 25 bp, S. cerevisiae
gtcctatttgtagattgcctgtctt

SEQ ID NO: 43671 - DNA, 25 bp, S. cerevisiae
gtcggatccgcaagcaactttgatt

SEQ ID NO: 43672 - DNA, 25 bp, S. cerevisiae
gtcggaggtgatccaacagattatt

SEQ ID NO: 43673 - DNA, 25 bp, S. cerevisiae
gtcctagtggacgatcagagtaatt

SEQ ID NO: 43674 - DNA, 25 bp, S. cerevisiae
gtccaactggtttcaagatcggtat

SEQ ID NO: 43675 - DNA, 25 bp, S. cerevisiae
gtccagacgcgtacccaaagaataa

SEQ ID NO: 43676 - DNA, 25 bp, S. cerevisiae
gtctggacactatcaagctttcata

SEQ ID NO: 43677 - DNA, 25 bp, S. cerevisiae
gtcgggttgactgttttctcgaaat

SEQ ID NO: 43678 - DNA, 25 bp, S. cerevisiae
gtcgttcctcagctcatatgtctag

SEQ ID NO: 43679 - DNA, 25 bp, S. cerevisiae
gtcgtttctttcatatctgatgcca

SEQ ID NO: 43680 - DNA, 25 bp, S. cerevisiae
gtcctcaggtttgtatctgacgatt

SEQ ID NO: 43681 - DNA, 25 bp, S. cerevisiae
gtccccgtcattttcagcggcgaaa

SEQ ID NO: 43682 - DNA, 25 bp, S. cerevisiae
gtcgcccgcttgtactgaaattaac

SEQ ID NO: 43683 - DNA, 25 bp, S. cerevisiae
gtgacaccggtttagaaatagcctc

SEQ ID NO: 43684 - DNA, 25 bp, S. cerevisiae
gtgaccagggtaacgatttcacgtt

SEQ ID NO: 43685 - DNA, 25 bp, S. cerevisiae
gtgacggtggtaacgacctgccagc

SEQ ID NO: 43686 - DNA, 25 bp, S. cerevisiae
taccctttcttgctatacgaggtgg

SEQ ID NO: 43687 - DNA, 25 bp, S. cerevisiae
ggacctttgtccataacgacgtgga

SEQ ID NO: 43688 - DNA, 25 bp, S. cerevisiae
ggaccgacgcccaaaaagcctgtag

SEQ ID NO: 43689 - DNA, 25 bp, S. cerevisiae
gtcccacactttgtgtaacagatgt

SEQ ID NO: 43690 - DNA, 25 bp, S. cerevisiae
gtccccaagtatattccaagcatgt

SEQ ID NO: 43691 - DNA, 25 bp, S. cerevisiae
gtgcctatggaagtccgttgctcaa

SEQ ID NO: 43692 - DNA, 25 bp, S. cerevisiae
ggccccggagcgagtgttgcaacta

SEQ ID NO: 43693 - DNA, 25 bp, S. cerevisiae
gtccctaggtccaatgctctattat

SEQ ID NO: 43694 - DNA, 25 bp, S. cerevisiae
gtcgacatcaaagccaatggttcta

SEQ ID NO: 43695 - DNA, 25 bp, S. cerevisiae
gtcccgcctatacagggctgatatg

SEQ ID NO: 43696 - DNA, 25 bp, S. cerevisiae
gtcggttattgacaggctctgataa

SEQ ID NO: 43697 - DNA, 25 bp, S. cerevisiae
gtgcggcttttcatcagacgtggaa

SEQ ID NO: 43698 - DNA, 25 bp, S. cerevisiae
gtctggcttttaatgcagctcggat

SEQ ID NO: 43699 - DNA, 25 bp, S. cerevisiae
gtcgttgcattgctaacatgtggca

SEQ ID NO: 43700 - DNA, 25 bp, S. cerevisiae
gtcgtatctacgtcaactatggcta

SEQ ID NO: 43701 - DNA, 25 bp, S. cerevisiae
gtcgcaactacgaacagtcatggga

SEQ ID NO: 43702 - DNA, 25 bp, S. cerevisiae
gtcgcacctttgaagtctcaggaca

SEQ ID NO: 43703 - DNA, 25 bp, S. cerevisiae
gtctgggtttttcatgcaagtagca

SEQ ID NO: 43704 - DNA, 25 bp, S. cerevisiae
gtcgacagttaatgttttgagatac

SEQ ID NO: 43705 - DNA, 25 bp, S. cerevisiae
gtcgactacgattacttactttata

SEQ ID NO: 43706 - DNA, 25 bp, S. cerevisiae
gtcgaccaagtctgcatgttcttta

SEQ ID NO: 43707 - DNA, 25 bp, S. cerevisiae
gtcgccctaccagcaattgctttaa

SEQ ID NO: 43708 - DNA, 25 bp, S. cerevisiae
gtcgtcttcttaacatgttccttat

SEQ ID NO: 43709 - DNA, 25 bp, S. cerevisiae
gtctggaagaaataccggctcccac

SEQ ID NO: 43710 - DNA, 25 bp, S. cerevisiae
gtcgacaacggtttctggtccgata

SEQ ID NO: 43711 - DNA, 25 bp, S. cerevisiae
gtcgtagccggttatttatcgcaaa

SEQ ID NO: 43712 - DNA, 25 bp, S. cerevisiae
gtcgtcatctcgacttttttggaga

SEQ ID NO: 43713 - DNA, 25 bp, S. cerevisiae
gtcgttgttgacttttttgccacat

SEQ ID NO: 43714 - DNA, 25 bp, S. cerevisiae
gtcgccccaggtattgtggacacag

SEQ ID NO: 43715 - DNA, 25 bp, S. cerevisiae
gtgcgacgacgactgattctattgg

SEQ ID NO: 43716 - DNA, 25 bp, S. cerevisiae
gtgccgccaccttagaaacaatctt

SEQ ID NO: 43717 - DNA, 25 bp, S. cerevisiae
gtccctcaacgtggcagttcaattt

SEQ ID NO: 43718 - DNA, 25 bp, S. cerevisiae
gtcggcgatactgctgggacttatc

SEQ ID NO: 43719 - DNA, 25 bp, S. cerevisiae
gtcgacgacttggtggatacttcat

SEQ ID NO: 43720 - DNA, 25 bp, S. cerevisiae
gtcgacgacattatgccttctttag

SEQ ID NO: 43721 - DNA, 25 bp, S. cerevisiae
gtcgcacggattgagtcttttgttc

SEQ ID NO: 43722 - DNA, 25 bp, S. cerevisiae
gtcccaattataactgctctgcagc

SEQ ID NO: 43723 - DNA, 25 bp, S. cerevisiae
gtcctttgtctgctgtgtatgtgat

SEQ ID NO: 43724 - DNA, 25 bp, S. cerevisiae
gtcgccgaatcttcaatctacttca

SEQ ID NO: 43725 - DNA, 25 bp, S. cerevisiae
gtcgaacctgataaacttccgaagt

SEQ ID NO: 43726 - DNA, 25 bp, S. cerevisiae
gtcgatcatcttttacgccaaggtt

SEQ ID NO: 43727 - DNA, 25 bp, S. cerevisiae
gtcgaaattccctttggtggcattg

SEQ ID NO: 43728 - DNA, 25 bp, S. cerevisiae
gtcgaaatctccaatcttgacgttt

SEQ ID NO: 43729 - DNA, 25 bp, S. cerevisiae
gtcgtctattccaattaccattcgt

SEQ ID NO: 43730 - DNA, 25 bp, S. cerevisiae
gtcccatattcctttgcaccatttt

SEQ ID NO: 43731 - DNA, 25 bp, S. cerevisiae
gtcccaatatcgttagcttctatcc

SEQ ID NO: 43732 - DNA, 25 bp, S. cerevisiae
gtcgaagatacgtaacctatgcatt

SEQ ID NO: 43733 - DNA, 25 bp, S. cerevisiae
gtcgcagaataactaccgtcatcaa

SEQ ID NO: 43734 - DNA, 25 bp, S. cerevisiae
gtcggtgccgagatttcaaaacaga

SEQ ID NO: 43735 - DNA, 25 bp, S. cerevisiae
gtcgcgtccaagattgttttcacta

SEQ ID NO: 43736 - DNA, 25 bp, S. cerevisiae
gtcgatgattataaacctgctcttg

SEQ ID NO: 43737 - DNA, 25 bp, S. cerevisiae
gtcgatgatacaacaagacgcatcc

SEQ ID NO: 43738 - DNA, 25 bp, S. cerevisiae
gtcgttgacgcagatgacaatccag

SEQ ID NO: 43739 - DNA, 25 bp, S. cerevisiae
gtcgtcctttggtgaagatgcccta

SEQ ID NO: 43740 - DNA, 25 bp, S. cerevisiae
gggatcgtttagtgaaggccttgaa

SEQ ID NO: 43741 - DNA, 25 bp, S. cerevisiae
gtcgaggatcttgagccagagcctt

SEQ ID NO: 43742 - DNA, 25 bp, S. cerevisiae
gtcgaagtcgtcaagaaagcctctt

SEQ ID NO: 43743 - DNA, 25 bp, S. cerevisiae
gtcgaagtcgaacgctaacctttat

SEQ ID NO: 43744 - DNA, 25 bp, S. cerevisiae
gtccgagttaaccagcaaagctttt

SEQ ID NO: 43745 - DNA, 25 bp, S. cerevisiae
gtcggtcagaactaatcatatacct

SEQ ID NO: 43746 - DNA, 25 bp, S. cerevisiae
gtccgatggaactcaatgaacctaa

SEQ ID NO: 43747 - DNA, 25 bp, S. cerevisiae
ggtcgggtacagcaacaaagccatg

SEQ ID NO: 43748 - DNA, 25 bp, S. cerevisiae
gtgcccgttggttatcgaaaatcga

SEQ ID NO: 43749 - DNA, 25 bp, S. cerevisiae
gtcccttctagttcatcggaatctt

SEQ ID NO: 43750 - DNA, 25 bp, S. cerevisiae
gtccgttccgagaatcctgacgtaa

SEQ ID NO: 43751 - DNA, 25 bp, S. cerevisiae
gtgagcggtacgatggcccaagaca

SEQ ID NO: 43752 - DNA, 25 bp, S. cerevisiae
gtggaagaacgtaaccctgaggaat

SEQ ID NO: 43753 - DNA, 25 bp, S. cerevisiae
gtccagaaggtgttgtctacgccgt

SEQ ID NO: 43754 - DNA, 25 bp, S. cerevisiae
gtcgcaagaccaacggatattcctg

SEQ ID NO: 43755 - DNA, 25 bp, S. cerevisiae
gtcgctaacacaacaggcaactaat

SEQ ID NO: 43756 - DNA, 25 bp, S. cerevisiae
gtcctaccacaggtcgcaagcatga

SEQ ID NO: 43757 - DNA, 25 bp, S. cerevisiae
gtcccaccccaggtaaacatggaat

SEQ ID NO: 43758 - DNA, 25 bp, S. cerevisiae
gtcctccaagcggtaaaacttacat

SEQ ID NO: 43759 - DNA, 25 bp, S. cerevisiae
gtccaccaatcttttccaatttcaa

SEQ ID NO: 43760 - DNA, 25 bp, S. cerevisiae
gtcgacaccacttctgattttactt

SEQ ID NO: 43761 - DNA, 25 bp, S. cerevisiae
gtcgtcaagcgatggatttatccaa

SEQ ID NO: 43762 - DNA, 25 bp, S. cerevisiae
gtcgtcggtacgcagattgatctaa

SEQ ID NO: 43763 - DNA, 25 bp, S. cerevisiae
gtccgcttttcgctgattatcttaa

SEQ ID NO: 43764 - DNA, 25 bp, S. cerevisiae
gtcgtggctttcattcatcttttga

SEQ ID NO: 43765 - DNA, 25 bp, S. cerevisiae
gtgcctcaattgctgcttgttttag

SEQ ID NO: 43766 - DNA, 25 bp, S. cerevisiae
gtcgtagattcttctgcgagttcat

SEQ ID NO: 43767 - DNA, 25 bp, S. cerevisiae
gtcgttcaattcttgcagagtgtca

SEQ ID NO: 43768 - DNA, 25 bp, S. cerevisiae
gtcgttgccgattacagagttcacc

SEQ ID NO: 43769 - DNA, 25 bp, S. cerevisiae
gtgctgagcatttcacaggctggac

SEQ ID NO: 43770 - DNA, 25 bp, S. cerevisiae
ttgcaaccccaatcgagtaacttta

SEQ ID NO: 43771 - DNA, 25 bp, S. cerevisiae
gtccgtggaacgtccatgctaggat

SEQ ID NO: 43772 - DNA, 25 bp, S. cerevisiae
gtccgatgatgcaaagccctgctac

SEQ ID NO: 43773 - DNA, 25 bp, S. cerevisiae
gtccgatgatcaatagtaccagcag

SEQ ID NO: 43774 - DNA, 25 bp, S. cerevisiae
gtcgcatggctgaagcgcaaccaga

SEQ ID NO: 43775 - DNA, 25 bp, S. cerevisiae
gtcgtcagcatatgcgcaagcgcaa

SEQ ID NO: 43776 - DNA, 25 bp, S. cerevisiae
gtgctctccagcagacgtcatgaag

SEQ ID NO: 43777 - DNA, 25 bp, S. cerevisiae
gtgccacagcacagaaatccggtac

SEQ ID NO: 43778 - DNA, 25 bp, S. cerevisiae
gtcgtctccaccaagatgcaccgta

SEQ ID NO: 43779 - DNA, 25 bp, S. cerevisiae
gtccagtcagactaccaaccaaggt

SEQ ID NO: 43780 - DNA, 25 bp, S. cerevisiae
gtccggatggtgtatctccaccaag

SEQ ID NO: 43781 - DNA, 25 bp, S. cerevisiae
gtgcctgaagaagacttccccgtag

SEQ ID NO: 43782 - DNA, 25 bp, S. cerevisiae
gtgccgtgaaattatttaacgccat

SEQ ID NO: 43783 - DNA, 25 bp, S. cerevisiae
gtcctcgatgaatttgttaagccaa

SEQ ID NO: 43784 - DNA, 25 bp, S. cerevisiae
gtccccatggaattggttatcatca

SEQ ID NO: 43785 - DNA, 25 bp, S. cerevisiae
gtcctcctccacagagtttacaaat

SEQ ID NO: 43786 - DNA, 25 bp, S. cerevisiae
gtcctccatcccagaagaacaacta

SEQ ID NO: 43787 - DNA, 25 bp, S. cerevisiae
gtccctaactcaaggtaaagcactt

SEQ ID NO: 43788 - DNA, 25 bp, S. cerevisiae
gtgccaattccctgtgtaaagcttt

SEQ ID NO: 43789 - DNA, 25 bp, S. cerevisiae
gtcgaatttgttaagcatgagctaa

SEQ ID NO: 43790 - DNA, 25 bp, S. cerevisiae
gtgcgtacgctggatctaaggtgtc

SEQ ID NO: 43791 - DNA, 25 bp, S. cerevisiae
gtcgataccatggatattacggcaa

SEQ ID NO: 43792 - DNA, 25 bp, S. cerevisiae
gtcgattaccaatctccagtgcaat

SEQ ID NO: 43793 - DNA, 25 bp, S. cerevisiae
tccgactaacggacggcagtgcaga

SEQ ID NO: 43794 - DNA, 25 bp, S. cerevisiae
gtgctaccgaccaaacgcttgatga

SEQ ID NO: 43795 - DNA, 25 bp, S. cerevisiae
gtgcccatcgaaacgaccctgagaa

SEQ ID NO: 43796 - DNA, 25 bp, S. cerevisiae
gtcgcagtgagattacgcagccgtg

SEQ ID NO: 43797 - DNA, 25 bp, S. cerevisiae
gtcgccgttcacttctaggaagcaa

SEQ ID NO: 43798 - DNA, 25 bp, S. cerevisiae
gtccaacatttgtctggtggtgaat

SEQ ID NO: 43799 - DNA, 25 bp, S. cerevisiae
gtcccctggcgaagtacattgtcga

SEQ ID NO: 43800 - DNA, 25 bp, S. cerevisiae
gtccgcacgtggaggccataattga

SEQ ID NO: 43801 - DNA, 25 bp, S. cerevisiae
gtgccactggtagaggtattgccta

SEQ ID NO: 43802 - DNA, 25 bp, S. cerevisiae
gtcgatatggactcacgtattgccc

SEQ ID NO: 43803 - DNA, 25 bp, S. cerevisiae
gtcgatcttttcgttcatgatgcaa

SEQ ID NO: 43804 - DNA, 25 bp, S. cerevisiae
gtcgccaattgtcagcgccaattaa

SEQ ID NO: 43805 - DNA, 25 bp, S. cerevisiae
gtccgggacgaagatgcttgccaca

SEQ ID NO: 43806 - DNA, 25 bp, S. cerevisiae
gtcctgggtgctataccgttgaatt

SEQ ID NO: 43807 - DNA, 25 bp, S. cerevisiae
gtccagggtgcgaccatatgtagtg

SEQ ID NO: 43808 - DNA, 25 bp, S. cerevisiae
gtgccaggtggcttacaaagtgatt

SEQ ID NO: 43809 - DNA, 25 bp, S. cerevisiae
gtgccatagctggtgtttacggtat

SEQ ID NO: 43810 - DNA, 25 bp, S. cerevisiae
gtcctttttcggtcctcgaatgaag

SEQ ID NO: 43811 - DNA, 25 bp, S. cerevisiae
gtcccattcccgatagagcaacaga

SEQ ID NO: 43812 - DNA, 25 bp, S. cerevisiae
gtcccatctcccttttgaagtatca

SEQ ID NO: 43813 - DNA, 25 bp, S. cerevisiae
gtcctcactgctgccggaaaattca

SEQ ID NO: 43814 - DNA, 25 bp, S. cerevisiae
gtgccatccagggaggtaaccatta

SEQ ID NO: 43815 - DNA, 25 bp, S. cerevisiae
gtgacatcctgtccggtagattaaa

SEQ ID NO: 43816 - DNA, 25 bp, S. cerevisiae
tgatgacgacggctgggaattccaa

SEQ ID NO: 43817 - DNA, 25 bp, S. cerevisiae
gtcgctgttttccaattgcattttg

SEQ ID NO: 43818 - DNA, 25 bp, S. cerevisiae
gtccctttgcaattgtttgtcgtag

SEQ ID NO: 43819 - DNA, 25 bp, S. cerevisiae
gtcgcatccaaaacgtactgtccat

SEQ ID NO: 43820 - DNA, 25 bp, S. cerevisiae
gtccctaaagactaacgctccatgg

SEQ ID NO: 43821 - DNA, 25 bp, S. cerevisiae
gtcctgctaaaagtgacccatcttc

SEQ ID NO: 43822 - DNA, 25 bp, S. cerevisiae
gtcgcctaaacatgcttccatttta

SEQ ID NO: 43823 - DNA, 25 bp, S. cerevisiae
gtcgacactgatgaagcgggctaca

SEQ ID NO: 43824 - DNA, 25 bp, S. cerevisiae
gtcgaaccccaccaatgaatcataa

SEQ ID NO: 43825 - DNA, 25 bp, S. cerevisiae
gtccatgacgctcccaatagaatat

SEQ ID NO: 43826 - DNA, 25 bp, S. cerevisiae
gtccattggtctacaggcatgaatt

SEQ ID NO: 43827 - DNA, 25 bp, S. cerevisiae
gtccaggagttatctatgcttttaa

SEQ ID NO: 43828 - DNA, 25 bp, S. cerevisiae
gtcgcggcaacttactactatgtgt

SEQ ID NO: 43829 - DNA, 25 bp, S. cerevisiae
gtgccgtcaaataaccccatttttg

SEQ ID NO: 43830 - DNA, 25 bp, S. cerevisiae
gtccttcaacgttatatgcactctt

SEQ ID NO: 43831 - DNA, 25 bp, S. cerevisiae
gtccaagggctgttttgacacgtca

SEQ ID NO: 43832 - DNA, 25 bp, S. cerevisiae
gtccaaagatagttctgtgccccta

SEQ ID NO: 43833 - DNA, 25 bp, S. cerevisiae
gggctaagatttcttccatcctagt

SEQ ID NO: 43834 - DNA, 25 bp, S. cerevisiae
ggaatgaaagtttttcccacttgtg

SEQ ID NO: 43835 - DNA, 25 bp, S. cerevisiae
gtggagaaactttttgattaccgtg

SEQ ID NO: 43836 - DNA, 25 bp, S. cerevisiae
gggaagggtcttttgctatctcgca

SEQ ID NO: 43837 - DNA, 25 bp, S. cerevisiae
gggtaaggttatctatattccagtt

SEQ ID NO: 43838 - DNA, 25 bp, S. cerevisiae
ggtcaaatgggctcttttctcaaac

SEQ ID NO: 43839 - DNA, 25 bp, S. cerevisiae
gtccaacaagactactttcccaaag

SEQ ID NO: 43840 - DNA, 25 bp, S. cerevisiae
gtgccggaaattgtcttgcgtctga

SEQ ID NO: 43841 - DNA, 25 bp, S. cerevisiae
gtccatggaaatatatcaacgttgt

SEQ ID NO: 43842 - DNA, 25 bp, S. cerevisiae
gtcctcgcgaagaacaacaggctcg

SEQ ID NO: 43843 - DNA, 25 bp, S. cerevisiae
gtgcgctcggaaataaaactctcag

SEQ ID NO: 43844 - DNA, 25 bp, S. cerevisiae
gtcgcatcagaagtattcacctcca

SEQ ID NO: 43845 - DNA, 25 bp, S. cerevisiae
gtcctcacttcaatcctttcaagaa

SEQ ID NO: 43846 - DNA, 25 bp, S. cerevisiae
gtcgccacgctaattcattacggtt

SEQ ID NO: 43847 - DNA, 25 bp, S. cerevisiae
gtcgccatcgtattctccaacgtca

SEQ ID NO: 43848 - DNA, 25 bp, S. cerevisiae
gtcctgtccaacatgctggtcaaga

SEQ ID NO: 43849 - DNA, 25 bp, S. cerevisiae
gtccctgagggtgagcagtctgaac

SEQ ID NO: 43850 - DNA, 25 bp, S. cerevisiae
gtccctatgggaacagtgctctata

SEQ ID NO: 43851 - DNA, 25 bp, S. cerevisiae
gtccttcctgaggaaagcggctaca

SEQ ID NO: 43852 - DNA, 25 bp, S. cerevisiae
gtccaattctgggagcaaccggcag

SEQ ID NO: 43853 - DNA, 25 bp, S. cerevisiae
gtccgattcatcaaacactggccaa

SEQ ID NO: 43854 - DNA, 25 bp, S. cerevisiae
gtcgcaatcttctaattcgtccaag

SEQ ID NO: 43855 - DNA, 25 bp, S. cerevisiae
gggaaacttcaacaatatacaggac

SEQ ID NO: 43856 - DNA, 25 bp, S. cerevisiae
gtgcctatccctagatttcgtcgtg

SEQ ID NO: 43857 - DNA, 25 bp, S. cerevisiae
gtcgcaagggtttgatgcttttgat

SEQ ID NO: 43858 - DNA, 25 bp, S. cerevisiae
gtcctaggcgtcaaagatatgtctc

SEQ ID NO: 43859 - DNA, 25 bp, S. cerevisiae
gtcccaatggctgataaatgctctt

SEQ ID NO: 43860 - DNA, 25 bp, S. cerevisiae
gtcgccaatcctactaaatatgaat

SEQ ID NO: 43861 - DNA, 25 bp, S. cerevisiae
gtccacctgctctactaacaatggt

SEQ ID NO: 43862 - DNA, 25 bp, S. cerevisiae
gtccctgtcgacttgctgaagacaa

SEQ ID NO: 43863 - DNA, 25 bp, S. cerevisiae
gtcgctctgccatcattctagatga

SEQ ID NO: 43864 - DNA, 25 bp, S. cerevisiae
gtgactccaaaactatatccggtac

SEQ ID NO: 43865 - DNA, 25 bp, S. cerevisiae
gtgtctgccaaagattaccggtttt

SEQ ID NO: 43866 - DNA, 25 bp, S. cerevisiae
gtccttgaagttaatcctgacggat

SEQ ID NO: 43867 - DNA, 25 bp, S. cerevisiae
gtccttgaagctattgccgagcatg

SEQ ID NO: 43868 - DNA, 25 bp, S. cerevisiae
gtgccactgaacactacgagagtaa

SEQ ID NO: 43869 - DNA, 25 bp, S. cerevisiae
gtgccggcgacatctgctggagaac

SEQ ID NO: 43870 - DNA, 25 bp, S. cerevisiae
gtcgccgcacaagattctttgacag

SEQ ID NO: 43871 - DNA, 25 bp, S. cerevisiae
gtcgcacatgcatagcttttttgct

SEQ ID NO: 43872 - DNA, 25 bp, S. cerevisiae
gtcgcatccatattgacatccattc

SEQ ID NO: 43873 - DNA, 25 bp, S. cerevisiae
gtccatcatctatatatcctgggta

SEQ ID NO: 43874 - DNA, 25 bp, S. cerevisiae
gtcccaattatgatacttgtggtgg

SEQ ID NO: 43875 - DNA, 25 bp, S. cerevisiae
gtccccttggtttgctttgttgtct

SEQ ID NO: 43876 - DNA, 25 bp, S. cerevisiae
gtccgctttggaaggtaagtctgtt

SEQ ID NO: 43877 - DNA, 25 bp, S. cerevisiae
gtgccgttctggacatggttaccga

SEQ ID NO: 43878 - DNA, 25 bp, S. cerevisiae
gtcgcagttagtcagcgttttgcaa

SEQ ID NO: 43879 - DNA, 25 bp, S. cerevisiae
gtcgctttacaaggtatgttccaga

SEQ ID NO: 43880 - DNA, 25 bp, S. cerevisiae
gtcctctccaagttatgtgttccag

SEQ ID NO: 43881 - DNA, 25 bp, S. cerevisiae
gtccctccgatggtattgtatacag

SEQ ID NO: 43882 - DNA, 25 bp, S. cerevisiae
gtgctgacaccgaactttttacatg

SEQ ID NO: 43883 - DNA, 25 bp, S. cerevisiae
gtcctttcagcagtttcacttcaag

SEQ ID NO: 43884 - DNA, 25 bp, S. cerevisiae
gtcctaacgcgtactatacatgcat

SEQ ID NO: 43885 - DNA, 25 bp, S. cerevisiae
gtcctattcgctcactgacaatgta

SEQ ID NO: 43886 - DNA, 25 bp, S. cerevisiae
gtccaagcatattccagcgagtgtg

SEQ ID NO: 43887 - DNA, 25 bp, S. cerevisiae
gtcctgatgtgaccacagccattat

SEQ ID NO: 43888 - DNA, 25 bp, S. cerevisiae
gtgcctggtgactgtctccaagaat

SEQ ID NO: 43889 - DNA, 25 bp, S. cerevisiae
gtccatggtcactagtatccgagaa

SEQ ID NO: 43890 - DNA, 25 bp, S. cerevisiae
gtcgctattttcaatcttcgatatt

SEQ ID NO: 43891 - DNA, 25 bp, S. cerevisiae
gtcctcaaatacagcagcgcgttta

SEQ ID NO: 43892 - DNA, 25 bp, S. cerevisiae
gtcctgccaaatactcaccgatttt

SEQ ID NO: 43893 - DNA, 25 bp, S. cerevisiae
ggcacctgtaggactaagcgacgag

SEQ ID NO: 43894 - DNA, 25 bp, S. cerevisiae
gtcctcttttgtcaacgcgcagaga

SEQ ID NO: 43895 - DNA, 25 bp, S. cerevisiae
gtccactttttggtattctagcagt

SEQ ID NO: 43896 - DNA, 25 bp, S. cerevisiae
gtcctttttgtttctgtgatgccca

SEQ ID NO: 43897 - DNA, 25 bp, S. cerevisiae
gtccaggttctgaggcattagctaa

SEQ ID NO: 43898 - DNA, 25 bp, S. cerevisiae
tggccaatgttgttctaatcgttta

SEQ ID NO: 43899 - DNA, 25 bp, S. cerevisiae
gtgcgcaatgcagaattcaaggttt

SEQ ID NO: 43900 - DNA, 25 bp, S. cerevisiae
gtggtacagaaggtgccggttatcc

SEQ ID NO: 43901 - DNA, 25 bp, S. cerevisiae
gtgcgttcaaagattcgatgattca

SEQ ID NO: 43902 - DNA, 25 bp, S. cerevisiae
gtgcccctaagtatgtggaatgttt

SEQ ID NO: 43903 - DNA, 25 bp, S. cerevisiae
tggtgcaagatcacaagaaatgatg

SEQ ID NO: 43904 - DNA, 25 bp, S. cerevisiae
gtggtagatctttcgaacaggccgt

SEQ ID NO: 43905 - DNA, 25 bp, S. cerevisiae
gggacagttgtcaagccaacgccgt

SEQ ID NO: 43906 - DNA, 25 bp, S. cerevisiae
gggcacggcgaattcctactccgtg

SEQ ID NO: 43907 - DNA, 25 bp, S. cerevisiae
ggacacgagaatatccaagaccgga

SEQ ID NO: 43908 - DNA, 25 bp, S. cerevisiae
gtccctagaatcatacttcaacggt

SEQ ID NO: 43909 - DNA, 25 bp, S. cerevisiae
gtcgctgacaatttcatatttccag

SEQ ID NO: 43910 - DNA, 25 bp, S. cerevisiae
gtcgcggcaatgatcatcgtaccat

SEQ ID NO: 43911 - DNA, 25 bp, S. cerevisiae
gtccgcaaatgaagctgtggtctct

SEQ ID NO: 43912 - DNA, 25 bp, S. cerevisiae
gtgcccgtatcattggtggttgttg

SEQ ID NO: 43913 - DNA, 25 bp, S. cerevisiae
gtgcgcatgcgtttggctcaattaa

SEQ ID NO: 43914 - DNA, 25 bp, S. cerevisiae
gtgctcctgttgcttctattagtat

SEQ ID NO: 43915 - DNA, 25 bp, S. cerevisiae
gtgcgacgtggacgaatcaccagat

SEQ ID NO: 43916 - DNA, 25 bp, S. cerevisiae
gtgccacgctgatagatatcccgat

SEQ ID NO: 43917 - DNA, 25 bp, S. cerevisiae
gtccaagtgccagatactcctactt

SEQ ID NO: 43918 - DNA, 25 bp, S. cerevisiae
gtcccattggtgctttacttcttta

SEQ ID NO: 43919 - DNA, 25 bp, S. cerevisiae
gtgcccacggtatcatcaatgtttc

SEQ ID NO: 43920 - DNA, 25 bp, S. cerevisiae
gtccttcgtgtaacaatatgctact

SEQ ID NO: 43921 - DNA, 25 bp, S. cerevisiae
gtccgtcgcttgtgaatagaatgat

SEQ ID NO: 43922 - DNA, 25 bp, S. cerevisiae
gtcccctcatcattccaatatttta

SEQ ID NO: 43923 - DNA, 25 bp, S. cerevisiae
gtcctcgcaatttacacttgttacc

SEQ ID NO: 43924 - DNA, 25 bp, S. cerevisiae
gtcctcagctattcaaattggtccc

SEQ ID NO: 43925 - DNA, 25 bp, S. cerevisiae
gtcccgtatagccaattcgttcaaa

SEQ ID NO: 43926 - DNA, 25 bp, S. cerevisiae
gtccgcgcaacagtacgataatgaa

SEQ ID NO: 43927 - DNA, 25 bp, S. cerevisiae
gtcccgccatcagtttgatctaata

SEQ ID NO: 43928 - DNA, 25 bp, S. cerevisiae
gtccttgccatggttcacattatga

SEQ ID NO: 43929 - DNA, 25 bp, S. cerevisiae
gtccttgtatttctctgcattgcat

SEQ ID NO: 43930 - DNA, 25 bp, S. cerevisiae
gtgctgcacgattacgatcttgctg

SEQ ID NO: 43931 - DNA, 25 bp, S. cerevisiae
gtgccagaaattcgagccaaccttc

SEQ ID NO: 43932 - DNA, 25 bp, S. cerevisiae
gtgatcgaggtgtacgaaaccacga

SEQ ID NO: 43933 - DNA, 25 bp, S. cerevisiae
gtgacccagttcacaagcaccgtga

SEQ ID NO: 43934 - DNA, 25 bp, S. cerevisiae
gtgccactaattactcaaaccaggt

SEQ ID NO: 43935 - DNA, 25 bp, S. cerevisiae
gtgccaggcggcaaaaagaccccta

SEQ ID NO: 43936 - DNA, 25 bp, S. cerevisiae
gtgactgaccgcgaaaaacccgata

SEQ ID NO: 43937 - DNA, 25 bp, S. cerevisiae
gtgactgccgccgataacgacgatc

SEQ ID NO: 43938 - DNA, 25 bp, S. cerevisiae
gtgccatcccgaataatctgtctat

SEQ ID NO: 43939 - DNA, 25 bp, S. cerevisiae
gtccatcactcaaatacctatcttg

SEQ ID NO: 43940 - DNA, 25 bp, S. cerevisiae
ttgccgggcaaatcgtttctgaggg

SEQ ID NO: 43941 - DNA, 25 bp, S. cerevisiae
gtcccgcgggttagattacaaacat

SEQ ID NO: 43942 - DNA, 25 bp, S. cerevisiae
gtcctccagggttttctaataacat

SEQ ID NO: 43943 - DNA, 25 bp, S. cerevisiae
gtccttggtggttcctcttacaaag

SEQ ID NO: 43944 - DNA, 25 bp, S. cerevisiae
gtccaagcgtgtcatcctcgaaaaa

SEQ ID NO: 43945 - DNA, 25 bp, S. cerevisiae
gtcccagtgctgacataggctcgaa

SEQ ID NO: 43946 - DNA, 25 bp, S. cerevisiae
gtgctgctagacgtcaagctgtcga

SEQ ID NO: 43947 - DNA, 25 bp, S. cerevisiae
gtgcgtaacgccactggtgaaccaa

SEQ ID NO: 43948 - DNA, 25 bp, S. cerevisiae
tttttccggccctgaaaccagcaat

SEQ ID NO: 43949 - DNA, 25 bp, S. cerevisiae
gtgtttgccggctctaataaccaac

SEQ ID NO: 43950 - DNA, 25 bp, S. cerevisiae
gggttgcacgaacacttaccaatat

SEQ ID NO: 43951 - DNA, 25 bp, S. cerevisiae
gggaataccaaatacgacgttatct

SEQ ID NO: 43952 - DNA, 25 bp, S. cerevisiae
gggaaacctaactctacagtcttag

SEQ ID NO: 43953 - DNA, 25 bp, S. cerevisiae
gggaacaccaaaaggctacggctat

SEQ ID NO: 43954 - DNA, 25 bp, S. cerevisiae
gggcaaagtcaccagaactcacggt

SEQ ID NO: 43955 - DNA, 25 bp, S. cerevisiae
gtccaagtgtatggctattgctcaa

SEQ ID NO: 43956 - DNA, 25 bp, S. cerevisiae
gtccagaggcattgttatcggcagt

SEQ ID NO: 43957 - DNA, 25 bp, S. cerevisiae
gggtccctatttcattgaaccttgg

SEQ ID NO: 43958 - DNA, 25 bp, S. cerevisiae
gtgcgatacccttttttgaattctt

SEQ ID NO: 43959 - DNA, 25 bp, S. cerevisiae
gtgcgaacaacgtttttggctccag

SEQ ID NO: 43960 - DNA, 25 bp, S. cerevisiae
gtccaggattccacattacttaacc

SEQ ID NO: 43961 - DNA, 25 bp, S. cerevisiae
gtcctggacccaacttatgtgaaac

SEQ ID NO: 43962 - DNA, 25 bp, S. cerevisiae
gtgccattgcaggttctttgttttc

SEQ ID NO: 43963 - DNA, 25 bp, S. cerevisiae
gtgcctcagctgagaaggtccctta

SEQ ID NO: 43964 - DNA, 25 bp, S. cerevisiae
gtgcgtaatattagaccgtccttca

SEQ ID NO: 43965 - DNA, 25 bp, S. cerevisiae
gtgcgtaaacttgacatggactttg

SEQ ID NO: 43966 - DNA, 25 bp, S. cerevisiae
gtggaaaagctttattggacctact

SEQ ID NO: 43967 - DNA, 25 bp, S. cerevisiae
gtgaaaagtccaagtcttccccaat

SEQ ID NO: 43968 - DNA, 25 bp, S. cerevisiae
gtgtagtcaacctaactttcgaaat

SEQ ID NO: 43969 - DNA, 25 bp, S. cerevisiae
gtgctggtgcggttcgtctagaaaa

SEQ ID NO: 43970 - DNA, 25 bp, S. cerevisiae
gtgagtctggtgtctgttccgaaac

SEQ ID NO: 43971 - DNA, 25 bp, S. cerevisiae
gtcctgcggatgtattctcgctgaa

SEQ ID NO: 43972 - DNA, 25 bp, S. cerevisiae
gtccccgctgcaattgtcgagagag

SEQ ID NO: 43973 - DNA, 25 bp, S. cerevisiae
gtgctcactccgacttgttgaaggt

SEQ ID NO: 43974 - DNA, 25 bp, S. cerevisiae
gtgcgctagcattcactatcgaagc

SEQ ID NO: 43975 - DNA, 25 bp, S. cerevisiae
gtgccaatcagagtacagaatccgt

SEQ ID NO: 43976 - DNA, 25 bp, S. cerevisiae
gtgccagtctacacgcaacatcagt

SEQ ID NO: 43977 - DNA, 25 bp, S. cerevisiae
gtgccgcacttaccagaactagatt

SEQ ID NO: 43978 - DNA, 25 bp, S. cerevisiae
gtgcgtgctccctatgaagtactaa

SEQ ID NO: 43979 - DNA, 25 bp, S. cerevisiae
gtgctgtgcaactggctactactga

SEQ ID NO: 43980 - DNA, 25 bp, S. cerevisiae
gtgctggcattgttagtgactactt

SEQ ID NO: 43981 - DNA, 25 bp, S. cerevisiae
gtgctgacacagtgcaggccaactt

SEQ ID NO: 43982 - DNA, 25 bp, S. cerevisiae
gtgcgaagatgcgttatgcctggaa

SEQ ID NO: 43983 - DNA, 25 bp, S. cerevisiae
gtgcgaactcattcatatgccttag

SEQ ID NO: 43984 - DNA, 25 bp, S. cerevisiae
gtgccaagttggtcgttatcccaga

SEQ ID NO: 43985 - DNA, 25 bp, S. cerevisiae
gtccaagatctttactttctctcga

SEQ ID NO: 43986 - DNA, 25 bp, S. cerevisiae
ttaattcgtgtaagggcttccctga

SEQ ID NO: 43987 - DNA, 25 bp, S. cerevisiae
ttacttgggtaagcgtattgcctac

SEQ ID NO: 43988 - DNA, 25 bp, S. cerevisiae
ttgacttacaaatccgaactttcca

SEQ ID NO: 43989 - DNA, 25 bp, S. cerevisiae
gtgaattacaaagagtcgccatcgt

SEQ ID NO: 43990 - DNA, 25 bp, S. cerevisiae
gtgacatagacataccattggccca

SEQ ID NO: 43991 - DNA, 25 bp, S. cerevisiae
gtgaaaaccgtgtactggacgactt

SEQ ID NO: 43992 - DNA, 25 bp, S. cerevisiae
gtgccaatcaacctgttcctgaaga

SEQ ID NO: 43993 - DNA, 25 bp, S. cerevisiae
gtccactacccaattcacgaagata

SEQ ID NO: 43994 - DNA, 25 bp, S. cerevisiae
gtccttctagcagcaagcattcttg

SEQ ID NO: 43995 - DNA, 25 bp, S. cerevisiae
tggtggtgccaatgaaaacgttctc

SEQ ID NO: 43996 - DNA, 25 bp, S. cerevisiae
ggtggtgcacaagataagaccgtca

SEQ ID NO: 43997 - DNA, 25 bp, S. cerevisiae
gtgctgcggccaacaataatgacca

SEQ ID NO: 43998 - DNA, 25 bp, S. cerevisiae
gtgcgacaggcacagtcactaatgt

SEQ ID NO: 43999 - DNA, 25 bp, S. cerevisiae
gtgctttgtgcttttggcagcatca

SEQ ID NO: 44000 - DNA, 25 bp, S. cerevisiae
gtgcagctattgcttgatgagccaa

SEQ ID NO: 44001 - DNA, 25 bp, S. cerevisiae
gtgcggatgctgttgctggacaaac

SEQ ID NO: 44002 - DNA, 25 bp, S. cerevisiae
gtgcttgcacagatgaaaacagaca

SEQ ID NO: 44003 - DNA, 25 bp, S. cerevisiae
gtgctatgcgcaacgacatgccaaa

SEQ ID NO: 44004 - DNA, 25 bp, S. cerevisiae
gtgccatcatgctgccaagtgacaa

SEQ ID NO: 44005 - DNA, 25 bp, S. cerevisiae
gtgaaggttctttccaagttgacta

SEQ ID NO: 44006 - DNA, 25 bp, S. cerevisiae
gtgctacctccggtgaaggtttgta

SEQ ID NO: 44007 - DNA, 25 bp, S. cerevisiae
gtgccacacttcatcaggaggtttt

SEQ ID NO: 44008 - DNA, 25 bp, S. cerevisiae
gtccgattgtcgacaggcaagtttt

SEQ ID NO: 44009 - DNA, 25 bp, S. cerevisiae
gtccgagtctccaaggaatcattgt

SEQ ID NO: 44010 - DNA, 25 bp, S. cerevisiae
gtcctgagtctaaaccaaacgtgaa

SEQ ID NO: 44011 - DNA, 25 bp, S. cerevisiae
gtgcctggttataacgactgtccga

SEQ ID NO: 44012 - DNA, 25 bp, S. cerevisiae
gtgccggttgaatcccagtacagaa

SEQ ID NO: 44013 - DNA, 25 bp, S. cerevisiae
gtcctatcgtaatttctggcccaag

SEQ ID NO: 44014 - DNA, 25 bp, S. cerevisiae
gtccttatttacttcatgggcaaac

SEQ ID NO: 44015 - DNA, 25 bp, S. cerevisiae
gtgcggattttctagtcggtacgat

SEQ ID NO: 44016 - DNA, 25 bp, S. cerevisiae
gtgcgtgattaccatgatttcttaa

SEQ ID NO: 44017 - DNA, 25 bp, S. cerevisiae
gtcctactcagctgatgtttccaaa

SEQ ID NO: 44018 - DNA, 25 bp, S. cerevisiae
gtgactacctattatggtccgaata

SEQ ID NO: 44019 - DNA, 25 bp, S. cerevisiae
gtgtaagcctactaagtcgtgggta

SEQ ID NO: 44020 - DNA, 25 bp, S. cerevisiae
gtgtcaagcttttaagtcctgggtc

SEQ ID NO: 44021 - DNA, 25 bp, S. cerevisiae
ggtcaagaaattgcactccgggcct

SEQ ID NO: 44022 - DNA, 25 bp, S. cerevisiae
gtccacttccatttgattcctaaga

SEQ ID NO: 44023 - DNA, 25 bp, S. cerevisiae
gtcctttcatctccctttctttatt

SEQ ID NO: 44024 - DNA, 25 bp, S. cerevisiae
gtcctctacccacgttttattgttg

SEQ ID NO: 44025 - DNA, 25 bp, S. cerevisiae
gtccttcatgttgttctcgtttatc

SEQ ID NO: 44026 - DNA, 25 bp, S. cerevisiae
gtcctacggctatttttctgttgga

SEQ ID NO: 44027 - DNA, 25 bp, S. cerevisiae
gtgagcatacggttattttccttgg

SEQ ID NO: 44028 - DNA, 25 bp, S. cerevisiae
taatctaccagtgaccaatcctagc

SEQ ID NO: 44029 - DNA, 25 bp, S. cerevisiae
gtgctgtacctacggaggagtccaa

SEQ ID NO: 44030 - DNA, 25 bp, S. cerevisiae
gtgctcaactgctattaacgtcaac

SEQ ID NO: 44031 - DNA, 25 bp, S. cerevisiae
gtgccaacgatttcccgtataactt

SEQ ID NO: 44032 - DNA, 25 bp, S. cerevisiae
gtccatatgatgatgaaccaaccag

SEQ ID NO: 44033 - DNA, 25 bp, S. cerevisiae
gtgcctccatgattgccacgaagga

SEQ ID NO: 44034 - DNA, 25 bp, S. cerevisiae
gtcctccagcagacatccaaagaac

SEQ ID NO: 44035 - DNA, 25 bp, S. cerevisiae
gtcctgccagacgatgttgaagaat

SEQ ID NO: 44036 - DNA, 25 bp, S. cerevisiae
gtgcacctgcatccggattaagaat

SEQ ID NO: 44037 - DNA, 25 bp, S. cerevisiae
gtgacttatgtcatggtatccacag

SEQ ID NO: 44038 - DNA, 25 bp, S. cerevisiae
gtgacaaagctaatggcgaaactgt

SEQ ID NO: 44039 - DNA, 25 bp, S. cerevisiae
ggcaaaggtttgagacataagttat

SEQ ID NO: 44040 - DNA, 25 bp, S. cerevisiae
gtgcaagaacttgttgacctagttt

SEQ ID NO: 44041 - DNA, 25 bp, S. cerevisiae
gtgccttagtttccaacaatgtcgt

SEQ ID NO: 44042 - DNA, 25 bp, S. cerevisiae
gtgccttcgccaatcaaacaagagg

SEQ ID NO: 44043 - DNA, 25 bp, S. cerevisiae
gtgcgttcacacctcaatacaagga

SEQ ID NO: 44044 - DNA, 25 bp, S. cerevisiae
gtccttccaggcaaatccaacagaa

SEQ ID NO: 44045 - DNA, 25 bp, S. cerevisiae
gtgccagctacagtttatgccaaat

SEQ ID NO: 44046 - DNA, 25 bp, S. cerevisiae
gtccaaatctgccaacaccaagcaa

SEQ ID NO: 44047 - DNA, 25 bp, S. cerevisiae
gtccaaagatgtcaaccgtgcaagt

SEQ ID NO: 44048 - DNA, 25 bp, S. cerevisiae
gtgccataatgaatttacccgaagg

SEQ ID NO: 44049 - DNA, 25 bp, S. cerevisiae
gtgccaagtctcataagactcgctt

SEQ ID NO: 44050 - DNA, 25 bp, S. cerevisiae
gtccaattacctacaaatccttcga

SEQ ID NO: 44051 - DNA, 25 bp, S. cerevisiae
ggcacatttaccactaaacaccggt

SEQ ID NO: 44052 - DNA, 25 bp, S. cerevisiae
ggaacttaccaacaatgaccacctt

SEQ ID NO: 44053 - DNA, 25 bp, S. cerevisiae
ggacgcttcaacagcgaaacctcct

SEQ ID NO: 44054 - DNA, 25 bp, S. cerevisiae
gtgaagttcaacactcagcggaccc

SEQ ID NO: 44055 - DNA, 25 bp, S. cerevisiae
gtggatgggacgacctcagcgatac

SEQ ID NO: 44056 - DNA, 25 bp, S. cerevisiae
gtgcccaacatgtcaagaagttagc

SEQ ID NO: 44057 - DNA, 25 bp, S. cerevisiae
gtgcgattcactgcttgacaggcta

SEQ ID NO: 44058 - DNA, 25 bp, S. cerevisiae
gtgccattcactttcggcgtgagaa

SEQ ID NO: 44059 - DNA, 25 bp, S. cerevisiae
gtccatggaactctcaaggtacaaa

SEQ ID NO: 44060 - DNA, 25 bp, S. cerevisiae
gtgcctgggaaaccacaagttgctt

SEQ ID NO: 44061 - DNA, 25 bp, S. cerevisiae
gtgcggcttaaaccacaggattgat

SEQ ID NO: 44062 - DNA, 25 bp, S. cerevisiae
gtcctaaaaggctatgatcaactga

SEQ ID NO: 44063 - DNA, 25 bp, S. cerevisiae
gtccaagaaggactattccatcgac

SEQ ID NO: 44064 - DNA, 25 bp, S. cerevisiae
gtccaaatcaaggtgttgcccagca

SEQ ID NO: 44065 - DNA, 25 bp, S. cerevisiae
gtgccagcgccatacgttacaaaga

SEQ ID NO: 44066 - DNA, 25 bp, S. cerevisiae
gtgctcaaagtaaccgctaccaatc

SEQ ID NO: 44067 - DNA, 25 bp, S. cerevisiae
gtgctgctgcagtttcaacgacaac

SEQ ID NO: 44068 - DNA, 25 bp, S. cerevisiae
gtgcgatctgtagcaaaccatccac

SEQ ID NO: 44069 - DNA, 25 bp, S. cerevisiae
gtgctggtttggctatggctactat

SEQ ID NO: 44070 - DNA, 25 bp, S. cerevisiae
gtgggcaattggcactcagctactg

SEQ ID NO: 44071 - DNA, 25 bp, S. cerevisiae
gtgcaacagttggacccactagtga

SEQ ID NO: 44072 - DNA, 25 bp, S. cerevisiae
gtgcgccatttaactcaacaactga

SEQ ID NO: 44073 - DNA, 25 bp, S. cerevisiae
gtgccagatctcaaggttacctcat

SEQ ID NO: 44074 - DNA, 25 bp, S. cerevisiae
gtgctattgtcaaaggtgccacagt

SEQ ID NO: 44075 - DNA, 25 bp, S. cerevisiae
gtgctgctggtacagagcctcaatg

SEQ ID NO: 44076 - DNA, 25 bp, S. cerevisiae
gtgcagctgggatgatggcttgtat

SEQ ID NO: 44077 - DNA, 25 bp, S. cerevisiae
gtccatgggtcgttgattctgttaa

SEQ ID NO: 44078 - DNA, 25 bp, S. cerevisiae
gtgtcagtttctattggaacgtcaa

SEQ ID NO: 44079 - DNA, 25 bp, S. cerevisiae
gtcctttcgcatattctcactaaaa

SEQ ID NO: 44080 - DNA, 25 bp, S. cerevisiae
gtgcccttcgctatttcactgaaaa

SEQ ID NO: 44081 - DNA, 25 bp, S. cerevisiae
gtgccgtccctaatttactcaaaag

SEQ ID NO: 44082 - DNA, 25 bp, S. cerevisiae
gtgcctattgccaacgtaccaaaga

SEQ ID NO: 44083 - DNA, 25 bp, S. cerevisiae
gtgcctgatttgaacctacttacaa

SEQ ID NO: 44084 - DNA, 25 bp, S. cerevisiae
gtgcaggattatggccgttacttaa

SEQ ID NO: 44085 - DNA, 25 bp, S. cerevisiae
gtgccccaagaaacatggccactgg

SEQ ID NO: 44086 - DNA, 25 bp, S. cerevisiae
gtgcccaaggcttacatttacactt

SEQ ID NO: 44087 - DNA, 25 bp, S. cerevisiae
gtgagccaaggtgactatgaacata

SEQ ID NO: 44088 - DNA, 25 bp, S. cerevisiae
gtggtgactgcgctactatgcatag

SEQ ID NO: 44089 - DNA, 25 bp, S. cerevisiae
gtgcgccgccatttgcattgtaaaa

SEQ ID NO: 44090 - DNA, 25 bp, S. cerevisiae
gtgccgtccatctttctacttactt

SEQ ID NO: 44091 - DNA, 25 bp, S. cerevisiae
gtgccgctcctaatctaaactttat

SEQ ID NO: 44092 - DNA, 25 bp, S. cerevisiae
gtgcgcctccaaagttcaatttttc

SEQ ID NO: 44093 - DNA, 25 bp, S. cerevisiae
gtggcttgaggaacccgatttttca

SEQ ID NO: 44094 - DNA, 25 bp, S. cerevisiae
gtgctgttgggaaaacgtgccttct

SEQ ID NO: 44095 - DNA, 25 bp, S. cerevisiae
gtgctaagcgacgaattctgccaag

SEQ ID NO: 44096 - DNA, 25 bp, S. cerevisiae
gtccaccgattctattgtcaaggct

SEQ ID NO: 44097 - DNA, 25 bp, S. cerevisiae
gtgctactgcaacaaaggagggatc

SEQ ID NO: 44098 - DNA, 25 bp, S. cerevisiae
gtgccaaactcgatgatgaatactc

SEQ ID NO: 44099 - DNA, 25 bp, S. cerevisiae
gtggagaacccttggaagagtcaga

SEQ ID NO: 44100 - DNA, 25 bp, S. cerevisiae
gtgaaacccttagaatcgtcagcaa

SEQ ID NO: 44101 - DNA, 25 bp, S. cerevisiae
ggtaactacggtgaatctccaaatc

SEQ ID NO: 44102 - DNA, 25 bp, S. cerevisiae
gtccacacaagggtaaggctccaag

SEQ ID NO: 44103 - DNA, 25 bp, S. cerevisiae
gtccattcataaggcacagggtcaa

SEQ ID NO: 44104 - DNA, 25 bp, S. cerevisiae
gtgccattcaagtgcccaattcaaa

SEQ ID NO: 44105 - DNA, 25 bp, S. cerevisiae
gtgccattaacatccctatcattat

SEQ ID NO: 44106 - DNA, 25 bp, S. cerevisiae
gtccaataagcttaccaatgcatgt

SEQ ID NO: 44107 - DNA, 25 bp, S. cerevisiae
gtccaattccaatcaaagcagcatt

SEQ ID NO: 44108 - DNA, 25 bp, S. cerevisiae
gtgagagctttaccgaaacgcaatt

SEQ ID NO: 44109 - DNA, 25 bp, S. cerevisiae
gtgcggatagatcacaatcgccgaa

SEQ ID NO: 44110 - DNA, 25 bp, S. cerevisiae
gtgcggctttgaacgatcctgctaa

SEQ ID NO: 44111 - DNA, 25 bp, S. cerevisiae
gtccactctttgactgctactcaaa

SEQ ID NO: 44112 - DNA, 25 bp, S. cerevisiae
gtccatctttctacttacttgaagg

SEQ ID NO: 44113 - DNA, 25 bp, S. cerevisiae
gtccactgtttcctctgatgggaag

SEQ ID NO: 44114 - DNA, 25 bp, S. cerevisiae
gtccatatgagtttcctatagaggg

SEQ ID NO: 44115 - DNA, 25 bp, S. cerevisiae
gtgcaggtccacaactttctaaatg

SEQ ID NO: 44116 - DNA, 25 bp, S. cerevisiae
gtgcacctctaggactattccgaat

SEQ ID NO: 44117 - DNA, 25 bp, S. cerevisiae
gtccattttggttgcttccatgaca

SEQ ID NO: 44118 - DNA, 25 bp, S. cerevisiae
gtccatatgctattattgcccacta

SEQ ID NO: 44119 - DNA, 25 bp, S. cerevisiae
gtccaaccagttgcccttaagaagt

SEQ ID NO: 44120 - DNA, 25 bp, S. cerevisiae
gtccacccgtatatactcattagca

SEQ ID NO: 44121 - DNA, 25 bp, S. cerevisiae
gtgctatcccaggtgagtacgttac

SEQ ID NO: 44122 - DNA, 25 bp, S. cerevisiae
gtgactttccgcaagctacaggcca

SEQ ID NO: 44123 - DNA, 25 bp, S. cerevisiae
gtgaacttcctgaaaacgccaaaat

SEQ ID NO: 44124 - DNA, 25 bp, S. cerevisiae
gtccatactctcaaaaccgtcaata

SEQ ID NO: 44125 - DNA, 25 bp, S. cerevisiae
gtggaagacctattcaagtgtacaa

SEQ ID NO: 44126 - DNA, 25 bp, S. cerevisiae
ttaaaacgcctatccctaagagtgg

SEQ ID NO: 44127 - DNA, 25 bp, S. cerevisiae
gtgaaaacttccatccactcgaagg

SEQ ID NO: 44128 - DNA, 25 bp, S. cerevisiae
gtgcgcttcctgatgttgttgttaa

SEQ ID NO: 44129 - DNA, 25 bp, S. cerevisiae
gtgccatctctacagttgcgacaaa

SEQ ID NO: 44130 - DNA, 25 bp, S. cerevisiae
gtgccacctcaacatatgtactcta

SEQ ID NO: 44131 - DNA, 25 bp, S. cerevisiae
gtgcatacacctcaaagtattctga

SEQ ID NO: 44132 - DNA, 25 bp, S. cerevisiae
gtgccaccatccaattagatttcca

SEQ ID NO: 44133 - DNA, 25 bp, S. cerevisiae
gtgccactgcgctacatggtgattt

SEQ ID NO: 44134 - DNA, 25 bp, S. cerevisiae
gtgcatttcacaatactatacgctg

SEQ ID NO: 44135 - DNA, 25 bp, S. cerevisiae
gtgctgttactcaagttgccattag

SEQ ID NO: 44136 - DNA, 25 bp, S. cerevisiae
gtgcgttcactggttctaatttgtc

SEQ ID NO: 44137 - DNA, 25 bp, S. cerevisiae
gtgcgctcgcaattttctaagttct

SEQ ID NO: 44138 - DNA, 25 bp, S. cerevisiae
gtgcctgtgacatttcctttttcgg

SEQ ID NO: 44139 - DNA, 25 bp, S. cerevisiae
gtgcttatgcaattttcctttccag

SEQ ID NO: 44140 - DNA, 25 bp, S. cerevisiae
gtgagttaaccaggtcttctacgaa

SEQ ID NO: 44141 - DNA, 25 bp, S. cerevisiae
gtgccgaaaccacatttttacaaga

SEQ ID NO: 44142 - DNA, 25 bp, S. cerevisiae
gtgcatctcaaaacacctttgtggt

SEQ ID NO: 44143 - DNA, 25 bp, S. cerevisiae
gtgacttggaataacctgtgggaat

SEQ ID NO: 44144 - DNA, 25 bp, S. cerevisiae
gtgaactgcgaaaacctgagggtgt

SEQ ID NO: 44145 - DNA, 25 bp, S. cerevisiae
gtgtcccacaatcttcttggagtgt

SEQ ID NO: 44146 - DNA, 25 bp, S. cerevisiae
gtgtctccatttgtgacttgacggt

SEQ ID NO: 44147 - DNA, 25 bp, S. cerevisiae
gtgcctttcgatgaagtcttccata

SEQ ID NO: 44148 - DNA, 25 bp, S. cerevisiae
gtgccagttcgtacaggtggttcaa

SEQ ID NO: 44149 - DNA, 25 bp, S. cerevisiae
gtgctggcttagtaacggaattgaa

SEQ ID NO: 44150 - DNA, 25 bp, S. cerevisiae
gtggcatcttattcaacggactgga

SEQ ID NO: 44151 - DNA, 25 bp, S. cerevisiae
gtgccattttatttaccgcgtatct

SEQ ID NO: 44152 - DNA, 25 bp, S. cerevisiae
gtgcttgtttgtttacaccgtgaaa

SEQ ID NO: 44153 - DNA, 25 bp, S. cerevisiae
gtgctgattttattccctacttgaa

SEQ ID NO: 44154 - DNA, 25 bp, S. cerevisiae
gtgagtccattatttcctccactaa

SEQ ID NO: 44155 - DNA, 25 bp, S. cerevisiae
gtgagcgtctttgttgacccatcaa

SEQ ID NO: 44156 - DNA, 25 bp, S. cerevisiae
gtgcaggtacttggttgctacgaaa

SEQ ID NO: 44157 - DNA, 25 bp, S. cerevisiae
gtgcattgtatggtcggagtctcca

SEQ ID NO: 44158 - DNA, 25 bp, S. cerevisiae
gtgctgttctggataatggctccaa

SEQ ID NO: 44159 - DNA, 25 bp, S. cerevisiae
gtgcatactgtgtttgagggctcct

SEQ ID NO: 44160 - DNA, 25 bp, S. cerevisiae
gtgaagcttaccttggagtccaatt

SEQ ID NO: 44161 - DNA, 25 bp, S. cerevisiae
gtgctagctttgatcttattcccat

SEQ ID NO: 44162 - DNA, 25 bp, S. cerevisiae
gtgctatttccgtgagtaatccatt

SEQ ID NO: 44163 - DNA, 25 bp, S. cerevisiae
gtgccaatgtgtacaatcgccaaca

SEQ ID NO: 44164 - DNA, 25 bp, S. cerevisiae
gtccaacttgtccagcagattcaga

SEQ ID NO: 44165 - DNA, 25 bp, S. cerevisiae
gtgctagctgataatcctggattga

SEQ ID NO: 44166 - DNA, 25 bp, S. cerevisiae
gtgctggatgcaaccttacatggat

SEQ ID NO: 44167 - DNA, 25 bp, S. cerevisiae
gtgctgccatgaacatatgctacgt

SEQ ID NO: 44168 - DNA, 25 bp, S. cerevisiae
gtgcctttatatactcgctgggatc

SEQ ID NO: 44169 - DNA, 25 bp, S. cerevisiae
gtgcgctttgattctggcttgggaa

SEQ ID NO: 44170 - DNA, 25 bp, S. cerevisiae
gtgccgtttattgattcgtatttca

SEQ ID NO: 44171 - DNA, 25 bp, S. cerevisiae
gtgccgatgttattgtaccgaagtc

SEQ ID NO: 44172 - DNA, 25 bp, S. cerevisiae
gtgaccatgtctgacttccgaagtg

SEQ ID NO: 44173 - DNA, 25 bp, S. cerevisiae
gtgacaatttgtttattcgtagatg

SEQ ID NO: 44174 - DNA, 25 bp, S. cerevisiae
gtgcccttttgtatctgggttcaag

SEQ ID NO: 44175 - DNA, 25 bp, S. cerevisiae
gtgccacttttgctacttttgaatt

SEQ ID NO: 44176 - DNA, 25 bp, S. cerevisiae
gtgcctatacttcattcagttttta

SEQ ID NO: 44177 - DNA, 25 bp, S. cerevisiae
gtgcacttacaattttctggtttcg

SEQ ID NO: 44178 - DNA, 25 bp, S. cerevisiae
gtgctctcgctacttttctggtatt

SEQ ID NO: 44179 - DNA, 25 bp, S. cerevisiae
gtgccatctggtattgcttcacaaa

SEQ ID NO: 44180 - DNA, 25 bp, S. cerevisiae
gtgaccatgattcgtccaagtccaa

SEQ ID NO: 44181 - DNA, 25 bp, S. cerevisiae
gtgaagctacctttagagacgcctc

SEQ ID NO: 44182 - DNA, 25 bp, S. cerevisiae
gtgcaactgggatctagaagccgcc

SEQ ID NO: 44183 - DNA, 25 bp, S. cerevisiae
gtgctggacagcgtttattgacctt

SEQ ID NO: 44184 - DNA, 25 bp, S. cerevisiae
gtgatccgtatatttttggccgtgg

SEQ ID NO: 44185 - DNA, 25 bp, S. cerevisiae
gtgcgcctttcttattggtttgtga

SEQ ID NO: 44186 - DNA, 25 bp, S. cerevisiae
gtgctagctttttatttgtcgtggt

SEQ ID NO: 44187 - DNA, 25 bp, S. cerevisiae
gtgctactttgattaccggtggtga

SEQ ID NO: 44188 - DNA, 25 bp, S. cerevisiae
gtgcccacacattactacaagcagt

SEQ ID NO: 44189 - DNA, 25 bp, S. cerevisiae
gtgcaggaacttactcctcaagtgg

SEQ ID NO: 44190 - DNA, 25 bp, S. cerevisiae
gtgcggacaatgaactacccatgga

SEQ ID NO: 44191 - DNA, 25 bp, S. cerevisiae
gtgcgtgttttttatcattgttctt

SEQ ID NO: 44192 - DNA, 25 bp, S. cerevisiae
gtgcgctggtatttttcttcaactt

SEQ ID NO: 44193 - DNA, 25 bp, S. cerevisiae
gtgactttatattcctgttttccta

SEQ ID NO: 44194 - DNA, 25 bp, S. cerevisiae
gtgccgtttgaagcatttttccaat

SEQ ID NO: 44195 - DNA, 25 bp, S. cerevisiae
gtgaagttcttacatctaggccatt

SEQ ID NO: 44196 - DNA, 25 bp, S. cerevisiae
gtgacgtccttacactttcagaatt

SEQ ID NO: 44197 - DNA, 25 bp, S. cerevisiae
gtgccgctcatcagaatcacattat

SEQ ID NO: 44198 - DNA, 25 bp, S. cerevisiae
gtgacggctctacgatttctgtaaa

SEQ ID NO: 44199 - DNA, 25 bp, S. cerevisiae
gtgttaaattccttgactcaaaaat

SEQ ID NO: 44200 - DNA, 25 bp, S. cerevisiae
gtgaaaaatccccttctagaacttg

SEQ ID NO: 44201 - DNA, 25 bp, S. cerevisiae
gtgaacaaatgtccgccttagaagt

SEQ ID NO: 44202 - DNA, 25 bp, S. cerevisiae
gtgcgatataataggcccaatttcc

SEQ ID NO: 44203 - DNA, 25 bp, S. cerevisiae
gtgacatatatatacccacacactc

SEQ ID NO: 44204 - DNA, 25 bp, S. cerevisiae
gtgacatatatatacccacacactc

SEQ ID NO: 44205 - DNA, 25 bp, S. cerevisiae
gtgacaaagagacccgcaacttcaa

SEQ ID NO: 44206 - DNA, 25 bp, S. cerevisiae
gtgacaagtgttctcaaagctacaa

SEQ ID NO: 44207 - DNA, 25 bp, S. cerevisiae
gggacggcccaatgagttactacaa

SEQ ID NO: 44208 - DNA, 25 bp, S. cerevisiae
gtgaacgagccgtacaagtcgatta

SEQ ID NO: 44209 - DNA, 25 bp, S. cerevisiae
gtgacactggtccataccttcaata

SEQ ID NO: 44210 - DNA, 25 bp, S. cerevisiae
gtgcttctacaaatacgtcttctgc

SEQ ID NO: 44211 - DNA, 25 bp, S. cerevisiae
gtgctcctaccgtcaattaacatat

SEQ ID NO: 44212 - DNA, 25 bp, S. cerevisiae
gtgccgctgattttattgcttctaa

SEQ ID NO: 44213 - DNA, 25 bp, S. cerevisiae
gtgctctgagacaactgccaaccat

SEQ ID NO: 44214 - DNA, 25 bp, S. cerevisiae
gtgcgataacagtgccatcaccaat

SEQ ID NO: 44215 - DNA, 25 bp, S. cerevisiae
gtgagacgacgataacgccgcaaaa

SEQ ID NO: 44216 - DNA, 25 bp, S. cerevisiae
gtgaaacgtgaatacgccgcaacaa

SEQ ID NO: 44217 - DNA, 25 bp, S. cerevisiae
gtgaaaaatacctagacctaataga

SEQ ID NO: 44218 - DNA, 25 bp, S. cerevisiae
ggaaaaaactaccagctcgaaagct

SEQ ID NO: 44219 - DNA, 25 bp, S. cerevisiae
gtgaaaactacttccactccataca

SEQ ID NO: 44220 - DNA, 25 bp, S. cerevisiae
gtgagaacactcctacaactactgg

SEQ ID NO: 44221 - DNA, 25 bp, S. cerevisiae
gtgaaacgtcacctgattctactcc

SEQ ID NO: 44222 - DNA, 25 bp, S. cerevisiae
gtgcaaactctattaacgacgcttt

SEQ ID NO: 44223 - DNA, 25 bp, S. cerevisiae
gtgcaaatttcttaacctggtctat

SEQ ID NO: 44224 - DNA, 25 bp, S. cerevisiae
gggtacgtggagcttcgtcctcaac

SEQ ID NO: 44225 - DNA, 25 bp, S. cerevisiae
gtgctactggtactgctatatcttt

SEQ ID NO: 44226 - DNA, 25 bp, S. cerevisiae
gtgcaggatggctctttggcagtaa

SEQ ID NO: 44227 - DNA, 25 bp, S. cerevisiae
gtgcatgtttcttctaggtgagcta

SEQ ID NO: 44228 - DNA, 25 bp, S. cerevisiae
gtgcattgcatgactcactatgtgt

SEQ ID NO: 44229 - DNA, 25 bp, S. cerevisiae
gtgcggcatccattttgtctgatat

SEQ ID NO: 44230 - DNA, 25 bp, S. cerevisiae
gtgcaatggcaaatccgctgggtaa

SEQ ID NO: 44231 - DNA, 25 bp, S. cerevisiae
gtgcatattgaactccagggacttc

SEQ ID NO: 44232 - DNA, 25 bp, S. cerevisiae
gtgctatcatggctacagaagtctt

SEQ ID NO: 44233 - DNA, 25 bp, S. cerevisiae
gtgctgcatattctacaaactcatt

SEQ ID NO: 44234 - DNA, 25 bp, S. cerevisiae
gtgctggaaccatcaagaccgtttt

SEQ ID NO: 44235 - DNA, 25 bp, S. cerevisiae
gtgagagaccgtgaaagttttacta

SEQ ID NO: 44236 - DNA, 25 bp, S. cerevisiae
gtgaaacagccctcgctttttataa

SEQ ID NO: 44237 - DNA, 25 bp, S. cerevisiae
gtgcaaaagccaatttctgagttaa

SEQ ID NO: 44238 - DNA, 25 bp, S. cerevisiae
gtgcgtttcatgcatgtaacataat

SEQ ID NO: 44239 - DNA, 25 bp, S. cerevisiae
gtgctgctttcgctgctgaagaaat

SEQ ID NO: 44240 - DNA, 25 bp, S. cerevisiae
gtgctcctatgacgtcgatggtgta

SEQ ID NO: 44241 - DNA, 25 bp, S. cerevisiae
gtgcccaatcttgaaacgtgtttgt

SEQ ID NO: 44242 - DNA, 25 bp, S. cerevisiae
gtgctaatccagaagcgcttgaatt

SEQ ID NO: 44243 - DNA, 25 bp, S. cerevisiae
gtgctgcaagaaatcataccctctc

SEQ ID NO: 44244 - DNA, 25 bp, S. cerevisiae
gtgctggatacttatacgctcttgc

SEQ ID NO: 44245 - DNA, 25 bp, S. cerevisiae
gtgctagtggcttgagatcttcgtc

SEQ ID NO: 44246 - DNA, 25 bp, S. cerevisiae
gtgctaggtgcatttacttcattca

SEQ ID NO: 44247 - DNA, 25 bp, S. cerevisiae
gtgcgggtgcctatgactatatcaa

SEQ ID NO: 44248 - DNA, 25 bp, S. cerevisiae
gtgcttgctgcgaacctgaatttaa

SEQ ID NO: 44249 - DNA, 25 bp, S. cerevisiae
gtgctggcaacagacccattttcaa

SEQ ID NO: 44250 - DNA, 25 bp, S. cerevisiae
ggtaaaaactccgtgattgccgccg

SEQ ID NO: 44251 - DNA, 25 bp, S. cerevisiae
ggtaattatcgttcctatcgtcgtc

SEQ ID NO: 44252 - DNA, 25 bp, S. cerevisiae
gtgaacgactttaccgatttggcga

SEQ ID NO: 44253 - DNA, 25 bp, S. cerevisiae
gtgacaagactttaccgggtggcta

SEQ ID NO: 44254 - DNA, 25 bp, S. cerevisiae
gtgagaaacatattagccgccgggc

SEQ ID NO: 44255 - DNA, 25 bp, S. cerevisiae
gtgacaaagctagacgtaccgatgg

SEQ ID NO: 44256 - DNA, 25 bp, S. cerevisiae
gtgcagacaccgtcatttttgtaga

SEQ ID NO: 44257 - DNA, 25 bp, S. cerevisiae
gtgctggtttacctactgttataaa

SEQ ID NO: 44258 - DNA, 25 bp, S. cerevisiae
gtggagccctgataacttggaacat

SEQ ID NO: 44259 - DNA, 25 bp, S. cerevisiae
gtgaggcacgtaccaacgtggacaa

SEQ ID NO: 44260 - DNA, 25 bp, S. cerevisiae
gtgcatgccaccgtcaaagttatgg

SEQ ID NO: 44261 - DNA, 25 bp, S. cerevisiae
gtgagtccctttcagattcagatct

SEQ ID NO: 44262 - DNA, 25 bp, S. cerevisiae
gtgcatacgccggtgttgacaacat

SEQ ID NO: 44263 - DNA, 25 bp, S. cerevisiae
gtgaacgccatttggtccactatat

SEQ ID NO: 44264 - DNA, 25 bp, S. cerevisiae
gtgaaccaaccgtcaccaggaagac

SEQ ID NO: 44265 - DNA, 25 bp, S. cerevisiae
gtgacccaagccctactagaaatgg

SEQ ID NO: 44266 - DNA, 25 bp, S. cerevisiae
ggaccgaacatttggctagacatat

SEQ ID NO: 44267 - DNA, 25 bp, S. cerevisiae
gtgctccgacgcataggcttgaaga

SEQ ID NO: 44268 - DNA, 25 bp, S. cerevisiae
gtgcaatcagcaagttacctaaaga

SEQ ID NO: 44269 - DNA, 25 bp, S. cerevisiae
gtgcgtgtgttatacattcaccaaa

SEQ ID NO: 44270 - DNA, 25 bp, S. cerevisiae
gtgctggttcattacctggttactg

SEQ ID NO: 44271 - DNA, 25 bp, S. cerevisiae
gtgctggtctttcggtacttaatga

SEQ ID NO: 44272 - DNA, 25 bp, S. cerevisiae
gtgcgattctaatggtgactgtaca

SEQ ID NO: 44273 - DNA, 25 bp, S. cerevisiae
gtgtataaactctaccacctggtgg

SEQ ID NO: 44274 - DNA, 25 bp, S. cerevisiae
gtgaatctaccctctgtagagccaa

SEQ ID NO: 44275 - DNA, 25 bp, S. cerevisiae
gtgagcaaccatccatatttgacga

SEQ ID NO: 44276 - DNA, 25 bp, S. cerevisiae
gtgcgatgacgactatactggacaa

SEQ ID NO: 44277 - DNA, 25 bp, S. cerevisiae
gtgcagtatccccaatggtgcgttt

SEQ ID NO: 44278 - DNA, 25 bp, S. cerevisiae
gtgcttaccaaactgttcccatgtt

SEQ ID NO: 44279 - DNA, 25 bp, S. cerevisiae
gtgcattgtcggttggtttttacat

SEQ ID NO: 44280 - DNA, 25 bp, S. cerevisiae
gtgaggaaccactttattttcaacg

SEQ ID NO: 44281 - DNA, 25 bp, S. cerevisiae
gtgcattctccgtctttattttcaa

SEQ ID NO: 44282 - DNA, 25 bp, S. cerevisiae
gtgagttcggtgtttggtttcaaga

SEQ ID NO: 44283 - DNA, 25 bp, S. cerevisiae
tgacaaacggttcaggttcatcaac

SEQ ID NO: 44284 - DNA, 25 bp, S. cerevisiae
tgctttaccggaggacgtactcata

SEQ ID NO: 44285 - DNA, 25 bp, S. cerevisiae
gtgttaacgggcagccttctataag

SEQ ID NO: 44286 - DNA, 25 bp, S. cerevisiae
gtgtagtacccgtggaatcatcagc

SEQ ID NO: 44287 - DNA, 25 bp, S. cerevisiae
gtgctagaaccccactggcaatata

SEQ ID NO: 44288 - DNA, 25 bp, S. cerevisiae
gtgaaattgcctactcgaatacgaa

SEQ ID NO: 44289 - DNA, 25 bp, S. cerevisiae
gtgaaagcagcttctcctcaaaagg

SEQ ID NO: 44290 - DNA, 25 bp, S. cerevisiae
gtgatccattggctgcagattcaaa

SEQ ID NO: 44291 - DNA, 25 bp, S. cerevisiae
gtgacaaagttgtggcctcaaggaa

SEQ ID NO: 44292 - DNA, 25 bp, S. cerevisiae
gtgacacagagtatttccccaggga

SEQ ID NO: 44293 - DNA, 25 bp, S. cerevisiae
gtgctgcaacaattttaaccgctgt

SEQ ID NO: 44294 - DNA, 25 bp, S. cerevisiae
gtgcaaaatcgacttcatgaccagt

SEQ ID NO: 44295 - DNA, 25 bp, S. cerevisiae
gtgcaagacctacttctaccagaag

SEQ ID NO: 44296 - DNA, 25 bp, S. cerevisiae
gtgaagaaccttttctgacaacagt

SEQ ID NO: 44297 - DNA, 25 bp, S. cerevisiae
gtgacagtgacgttttctaccaatg

SEQ ID NO: 44298 - DNA, 25 bp, S. cerevisiae
gtgacaacatgcgttctactaccaa

SEQ ID NO: 44299 - DNA, 25 bp, S. cerevisiae
gtgaagaatcttactacgcccaaaa

SEQ ID NO: 44300 - DNA, 25 bp, S. cerevisiae
gtgcataatttttgtgtaccaccaa

SEQ ID NO: 44301 - DNA, 25 bp, S. cerevisiae
gtgcatacttcttgatggtaccctc

SEQ ID NO: 44302 - DNA, 25 bp, S. cerevisiae
gtgaacttaagaaccaggccttcca

SEQ ID NO: 44303 - DNA, 25 bp, S. cerevisiae
gtgcacattttaatgaccgtccttc

SEQ ID NO: 44304 - DNA, 25 bp, S. cerevisiae
gtgcatggttatttacgcctccgtt

SEQ ID NO: 44305 - DNA, 25 bp, S. cerevisiae
gtgatcgtggcataaaactcggcag

SEQ ID NO: 44306 - DNA, 25 bp, S. cerevisiae
gtgctacagactccaagaaacgccc

SEQ ID NO: 44307 - DNA, 25 bp, S. cerevisiae
gtgctactgcacaatcggaagaccg

SEQ ID NO: 44308 - DNA, 25 bp, S. cerevisiae
gtgaagtactatgctgaggcccaga

SEQ ID NO: 44309 - DNA, 25 bp, S. cerevisiae
gtgaccgtctggtggaatcctgcca

SEQ ID NO: 44310 - DNA, 25 bp, S. cerevisiae
gtgactcttctttgggaacgtcttc

SEQ ID NO: 44311 - DNA, 25 bp, S. cerevisiae
gtgactttactgatagagggccatt

SEQ ID NO: 44312 - DNA, 25 bp, S. cerevisiae
gtgttgttcaacagcagggtgtgct

SEQ ID NO: 44313 - DNA, 25 bp, S. cerevisiae
gtgctgatttggtgtttgatgtcga

SEQ ID NO: 44314 - DNA, 25 bp, S. cerevisiae
gtgctatcactaaccgtcaacaatt

SEQ ID NO: 44315 - DNA, 25 bp, S. cerevisiae
gtgctatccaatttcttttctttat

SEQ ID NO: 44316 - DNA, 25 bp, S. cerevisiae
gtgcttctcgtaatgcttcttttta

SEQ ID NO: 44317 - DNA, 25 bp, S. cerevisiae
gtgctctacaaggtatttccacttt

SEQ ID NO: 44318 - DNA, 25 bp, S. cerevisiae
gtgctctaaggttgactgttccgat

SEQ ID NO: 44319 - DNA, 25 bp, S. cerevisiae
gtgaagctagagaagttatgcaaag

SEQ ID NO: 44320 - DNA, 25 bp, S. cerevisiae
gtgaagctgagcaacaagaccatga

SEQ ID NO: 44321 - DNA, 25 bp, S. cerevisiae
gtgaatggacatttactgctcgaac

SEQ ID NO: 44322 - DNA, 25 bp, S. cerevisiae
gtgagatcatgatgtcccaatcaat

SEQ ID NO: 44323 - DNA, 25 bp, S. cerevisiae
gtgctcctaattactgctacagatg

SEQ ID NO: 44324 - DNA, 25 bp, S. cerevisiae
gtgctcctagagaaactgcccatgg

SEQ ID NO: 44325 - DNA, 25 bp, S. cerevisiae
gtgcagttttttcctcgagattcaa

SEQ ID NO: 44326 - DNA, 25 bp, S. cerevisiae
gtgggccaaaccttgcaagttactg

SEQ ID NO: 44327 - DNA, 25 bp, S. cerevisiae
gtgggacattccgttggagctacct

SEQ ID NO: 44328 - DNA, 25 bp, S. cerevisiae
gtgagtagcatcaccggtgactcca

SEQ ID NO: 44329 - DNA, 25 bp, S. cerevisiae
gtgatcatagcgcttgggtttacat

SEQ ID NO: 44330 - DNA, 25 bp, S. cerevisiae
gtgtcagaccctaccgatttgaaat

SEQ ID NO: 44331 - DNA, 25 bp, S. cerevisiae
gtgctctattgctttccattttcta

SEQ ID NO: 44332 - DNA, 25 bp, S. cerevisiae
gtgcatctattgttaccggtggtaa

SEQ ID NO: 44333 - DNA, 25 bp, S. cerevisiae
gtgcattattgtcatcctgtggtat

SEQ ID NO: 44334 - DNA, 25 bp, S. cerevisiae
gtgcataaagtgctcctgtctctat

SEQ ID NO: 44335 - DNA, 25 bp, S. cerevisiae
gtgcttcagaggttcttgatcaatt

SEQ ID NO: 44336 - DNA, 25 bp, S. cerevisiae
gtgagtcagacgctctttcaatgaa

SEQ ID NO: 44337 - DNA, 25 bp, S. cerevisiae
gtgcaggcgcacactttatacaaca

SEQ ID NO: 44338 - DNA, 25 bp, S. cerevisiae
gtgagtgataacctgccaagcttta

SEQ ID NO: 44339 - DNA, 25 bp, S. cerevisiae
gtgagttcaagccaccgatcataat

SEQ ID NO: 44340 - DNA, 25 bp, S. cerevisiae
gtgatcataatcaggacacgcgtca

SEQ ID NO: 44341 - DNA, 25 bp, S. cerevisiae
gtgcttatcttgctcacacatattt

SEQ ID NO: 44342 - DNA, 25 bp, S. cerevisiae
gtgctctctgttttcatcactatat

SEQ ID NO: 44343 - DNA, 25 bp, S. cerevisiae
gtgctattgtctttatgccttctta

SEQ ID NO: 44344 - DNA, 25 bp, S. cerevisiae
gtgctttgcctatttggaatttcgt

SEQ ID NO: 44345 - DNA, 25 bp, S. cerevisiae
gtggcttccatagtggccactattg

SEQ ID NO: 44346 - DNA, 25 bp, S. cerevisiae
gtgatgtttgccaccaataggccca

SEQ ID NO: 44347 - DNA, 25 bp, S. cerevisiae
gtgttgatggaccaaccatactccc

SEQ ID NO: 44348 - DNA, 25 bp, S. cerevisiae
gtgatatcacgacacagaccaccgt

SEQ ID NO: 44349 - DNA, 25 bp, S. cerevisiae
gtgaactcaaagacaagcaagccga

SEQ ID NO: 44350 - DNA, 25 bp, S. cerevisiae
gtgctactcaactttcgtacaatac

SEQ ID NO: 44351 - DNA, 25 bp, S. cerevisiae
gtgtcaataccccaaatgagcctag

SEQ ID NO: 44352 - DNA, 25 bp, S. cerevisiae
gtgcagaaaagcttatccttcctaa

SEQ ID NO: 44353 - DNA, 25 bp, S. cerevisiae
gtgaagtcacacattttggctggaa

SEQ ID NO: 44354 - DNA, 25 bp, S. cerevisiae
gtgacgatcccaacactatggcaaa

SEQ ID NO: 44355 - DNA, 25 bp, S. cerevisiae
gtgtagttccaagatcgcatgccaa

SEQ ID NO: 44356 - DNA, 25 bp, S. cerevisiae
gtgcatattttgaaggagcgccaga

SEQ ID NO: 44357 - DNA, 25 bp, S. cerevisiae
gtgaatctcttgaagcagtctcgaa

SEQ ID NO: 44358 - DNA, 25 bp, S. cerevisiae
gtgaaatctttcaaggatcctggat

SEQ ID NO: 44359 - DNA, 25 bp, S. cerevisiae
gtgaactcccaaatactccagattt

SEQ ID NO: 44360 - DNA, 25 bp, S. cerevisiae
gtgaactatccaatagtccgcagaa

SEQ ID NO: 44361 - DNA, 25 bp, S. cerevisiae
gtgaattaaacaatgctgccgctaa

SEQ ID NO: 44362 - DNA, 25 bp, S. cerevisiae
gtgataacggtttgcccctatcaaa

SEQ ID NO: 44363 - DNA, 25 bp, S. cerevisiae
gtgacaccggatttggcgtctttaa

SEQ ID NO: 44364 - DNA, 25 bp, S. cerevisiae
gtgacctggcaagtgcgtatttgtt

SEQ ID NO: 44365 - DNA, 25 bp, S. cerevisiae
gtgaatgatttattgatacccgaag

SEQ ID NO: 44366 - DNA, 25 bp, S. cerevisiae
gtgatttctattaccaccccaataa

SEQ ID NO: 44367 - DNA, 25 bp, S. cerevisiae
gtgttcaaacacctggatcgctacc

SEQ ID NO: 44368 - DNA, 25 bp, S. cerevisiae
gtgaacgaacacctggattgctaca

SEQ ID NO: 44369 - DNA, 25 bp, S. cerevisiae
gtgacccaacaaaaggcacttgaag

SEQ ID NO: 44370 - DNA, 25 bp, S. cerevisiae
gtgactactccttggccattgattt

SEQ ID NO: 44371 - DNA, 25 bp, S. cerevisiae
gtgacacctcacagttcgataagta

SEQ ID NO: 44372 - DNA, 25 bp, S. cerevisiae
gtgaacgccgtggattcattagaaa

SEQ ID NO: 44373 - DNA, 25 bp, S. cerevisiae
gtgcaaactacttttgtccagcgtt

SEQ ID NO: 44374 - DNA, 25 bp, S. cerevisiae
gtgcaaacgaacttggctaccgatc

SEQ ID NO: 44375 - DNA, 25 bp, S. cerevisiae
gtgcatttcctgtatggctaggcat

SEQ ID NO: 44376 - DNA, 25 bp, S. cerevisiae
gtgctttcctgtttgggagctgcca

SEQ ID NO: 44377 - DNA, 25 bp, S. cerevisiae
gtgcttcccacgcttatatgatgga

SEQ ID NO: 44378 - DNA, 25 bp, S. cerevisiae
gtgttcctacccttatattgtggca

SEQ ID NO: 44379 - DNA, 25 bp, S. cerevisiae
gtgatattctcctctttattttcag

SEQ ID NO: 44380 - DNA, 25 bp, S. cerevisiae
tgtcatttacacctcgttaaaccca

SEQ ID NO: 44381 - DNA, 25 bp, S. cerevisiae
tgtacagtaaccattttagccccac

SEQ ID NO: 44382 - DNA, 25 bp, S. cerevisiae
gtgagcatgaaagctatcttttcgt

SEQ ID NO: 44383 - DNA, 25 bp, S. cerevisiae
gtgacacttcttctcagtagcattg

SEQ ID NO: 44384 - DNA, 25 bp, S. cerevisiae
gtgaattctggttcgcactcggatt

SEQ ID NO: 44385 - DNA, 25 bp, S. cerevisiae
gtgaattcacgttctattgctggtt

SEQ ID NO: 44386 - DNA, 25 bp, S. cerevisiae
gtgaacaacattcgtacttcctcag

SEQ ID NO: 44387 - DNA, 25 bp, S. cerevisiae
gtgaagctgccgtagaaatttctaa

SEQ ID NO: 44388 - DNA, 25 bp, S. cerevisiae
gtgaaatgctctctaatttcctcaa

SEQ ID NO: 44389 - DNA, 25 bp, S. cerevisiae
gtgatgctacttctacttatgccaa

SEQ ID NO: 44390 - DNA, 25 bp, S. cerevisiae
gtgttgacttcaagaatccccatga

SEQ ID NO: 44391 - DNA, 25 bp, S. cerevisiae
gtgattggactgcagtacccaccaa

SEQ ID NO: 44392 - DNA, 25 bp, S. cerevisiae
gtgatttatcagttctaccaaccaa

SEQ ID NO: 44393 - DNA, 25 bp, S. cerevisiae
gtgactgcagaatctctaccagacc

SEQ ID NO: 44394 - DNA, 25 bp, S. cerevisiae
gtgcagtgaagttctttccaggatt

SEQ ID NO: 44395 - DNA, 25 bp, S. cerevisiae
gtgagcgacagtagttacgacgaat

SEQ ID NO: 44396 - DNA, 25 bp, S. cerevisiae
gtgcagttcagcatttagcgggaat

SEQ ID NO: 44397 - DNA, 25 bp, S. cerevisiae
gtgaaagtgcacctatccaggatcc

SEQ ID NO: 44398 - DNA, 25 bp, S. cerevisiae
gtgcagtttgagtaccatcttcatg

SEQ ID NO: 44399 - DNA, 25 bp, S. cerevisiae
gtgaattatcgctagcagcactact

SEQ ID NO: 44400 - DNA, 25 bp, S. cerevisiae
gtgactttgtctcaccaaacaacca

SEQ ID NO: 44401 - DNA, 25 bp, S. cerevisiae
gtgcattcgattttagcagcagtaa

SEQ ID NO: 44402 - DNA, 25 bp, S. cerevisiae
gtgacatgcaattttctcctgattt

SEQ ID NO: 44403 - DNA, 25 bp, S. cerevisiae
gtgagagatctgtccttccaattgc

SEQ ID NO: 44404 - DNA, 25 bp, S. cerevisiae
gtgacagacagatctttgaagcttt

SEQ ID NO: 44405 - DNA, 25 bp, S. cerevisiae
gtgcaccttctaccaatacatatac

SEQ ID NO: 44406 - DNA, 25 bp, S. cerevisiae
gtgcactttctgactccaacaattt

SEQ ID NO: 44407 - DNA, 25 bp, S. cerevisiae
gtgagcgcactccaggtcaacaatt

SEQ ID NO: 44408 - DNA, 25 bp, S. cerevisiae
gtgaaagctttcgacaggcattgta

SEQ ID NO: 44409 - DNA, 25 bp, S. cerevisiae
gtgcaacaatttttcaggcgctgac

SEQ ID NO: 44410 - DNA, 25 bp, S. cerevisiae
tattccgagttgtgtattatagtag

SEQ ID NO: 44411 - DNA, 25 bp, S. cerevisiae
tgtcgtcggttgtgctatgttttat

SEQ ID NO: 44412 - DNA, 25 bp, S. cerevisiae
gtgcattgcgtttttacagtgttat

SEQ ID NO: 44413 - DNA, 25 bp, S. cerevisiae
gtgcacttgtcattagaagctcatt

SEQ ID NO: 44414 - DNA, 25 bp, S. cerevisiae
gtgactatgacctaagcatgcgatt

SEQ ID NO: 44415 - DNA, 25 bp, S. cerevisiae
gtgacgggcttccaatgcagtatca

SEQ ID NO: 44416 - DNA, 25 bp, S. cerevisiae
gtgacggtgctttccaattgacagt

SEQ ID NO: 44417 - DNA, 25 bp, S. cerevisiae
gtgacgatagtttccaagattttct

SEQ ID NO: 44418 - DNA, 25 bp, S. cerevisiae
gtgaatcgtatgcttaccttgctta

SEQ ID NO: 44419 - DNA, 25 bp, S. cerevisiae
gtgagcaatcattcgaccaaccata

SEQ ID NO: 44420 - DNA, 25 bp, S. cerevisiae
gtgatcatcatcaaggctcgagacc

SEQ ID NO: 44421 - DNA, 25 bp, S. cerevisiae
gtgatagctctatgggagacctaac

SEQ ID NO: 44422 - DNA, 25 bp, S. cerevisiae
gtgatcctgcactggatgacaacca

SEQ ID NO: 44423 - DNA, 25 bp, S. cerevisiae
gtgactctgcacttttggaaccgta

SEQ ID NO: 44424 - DNA, 25 bp, S. cerevisiae
gtgactgggcatattcgaactcaat

SEQ ID NO: 44425 - DNA, 25 bp, S. cerevisiae
gtgacgctgtgaacttggttgccac

SEQ ID NO: 44426 - DNA, 25 bp, S. cerevisiae
gtgtactatttcagtttgaaccacg

SEQ ID NO: 44427 - DNA, 25 bp, S. cerevisiae
gtgatgacgttgacaggctgttgaa

SEQ ID NO: 44428 - DNA, 25 bp, S. cerevisiae
gtgaatctttattggctgttcctta

SEQ ID NO: 44429 - DNA, 25 bp, S. cerevisiae
gtgaattttgcacattttggctata

SEQ ID NO: 44430 - DNA, 25 bp, S. cerevisiae
gtgcacccatctgttctgaatacta

SEQ ID NO: 44431 - DNA, 25 bp, S. cerevisiae
gtgcatggccatttgaatacttctt

SEQ ID NO: 44432 - DNA, 25 bp, S. cerevisiae
gtgatggtcctacaacttcattaca

SEQ ID NO: 44433 - DNA, 25 bp, S. cerevisiae
gtgagcgaccatttagacgcaatct

SEQ ID NO: 44434 - DNA, 25 bp, S. cerevisiae
ggatcgcaggaagagggcaacctta

SEQ ID NO: 44435 - DNA, 25 bp, S. cerevisiae
gtgtccacagaagaaacaaccgttg

SEQ ID NO: 44436 - DNA, 25 bp, S. cerevisiae
gtgtactcaggtgcaagaactctcg

SEQ ID NO: 44437 - DNA, 25 bp, S. cerevisiae
gtgaacctaattcggaactgctgaa

SEQ ID NO: 44438 - DNA, 25 bp, S. cerevisiae
gtgcaacttttttcagatacctcag

SEQ ID NO: 44439 - DNA, 25 bp, S. cerevisiae
gtgacagacttacactccattttgt

SEQ ID NO: 44440 - DNA, 25 bp, S. cerevisiae
gtgaacactggaactttatcatcgg

SEQ ID NO: 44441 - DNA, 25 bp, S. cerevisiae
gtgcaattcaggaactttgattcaa

SEQ ID NO: 44442 - DNA, 25 bp, S. cerevisiae
gtgcaatcacggtgccactggtaga

SEQ ID NO: 44443 - DNA, 25 bp, S. cerevisiae
gtgcaaagaatatccctctgctaga

SEQ ID NO: 44444 - DNA, 25 bp, S. cerevisiae
gtgcaaactgaatcgctctgccgac

SEQ ID NO: 44445 - DNA, 25 bp, S. cerevisiae
gtgaacactgatttggacatcctga

SEQ ID NO: 44446 - DNA, 25 bp, S. cerevisiae
gtgacgaagattctgctcatcctga

SEQ ID NO: 44447 - DNA, 25 bp, S. cerevisiae
gtgcaaggtgaattagctgagatta

SEQ ID NO: 44448 - DNA, 25 bp, S. cerevisiae
gtgcaatttgtatcagctagctttc

SEQ ID NO: 44449 - DNA, 25 bp, S. cerevisiae
gtgcaatctattaagcgcgaattta

SEQ ID NO: 44450 - DNA, 25 bp, S. cerevisiae
gtgagctctatgatgtgctgagaat

SEQ ID NO: 44451 - DNA, 25 bp, S. cerevisiae
gtgacgctgctttggtcaagttcgt

SEQ ID NO: 44452 - DNA, 25 bp, S. cerevisiae
gtgacttcttctggtatatttgcga

SEQ ID NO: 44453 - DNA, 25 bp, S. cerevisiae
gtgacattatttcgtcttcatctaa

SEQ ID NO: 44454 - DNA, 25 bp, S. cerevisiae
gtgagatccatagaagcgcctccgt

SEQ ID NO: 44455 - DNA, 25 bp, S. cerevisiae
gtgaatcacttcgaagggatgtccg

SEQ ID NO: 44456 - DNA, 25 bp, S. cerevisiae
gtgaatcgttcaccatcaaggcaaa

SEQ ID NO: 44457 - DNA, 25 bp, S. cerevisiae
gtgattcgcgatatatagcggccaa

SEQ ID NO: 44458 - DNA, 25 bp, S. cerevisiae
ggtactggcagttcaatggcgtaat

SEQ ID NO: 44459 - DNA, 25 bp, S. cerevisiae
gtgtccttcttatcagacgaaacta

SEQ ID NO: 44460 - DNA, 25 bp, S. cerevisiae
gtgacgctcagcaactttacgaaag

SEQ ID NO: 44461 - DNA, 25 bp, S. cerevisiae
gtgacgctatgtatcctacgaattg

SEQ ID NO: 44462 - DNA, 25 bp, S. cerevisiae
gtgatcaaagtactcgcctggaaaa

SEQ ID NO: 44463 - DNA, 25 bp, S. cerevisiae
gtgtatagagtcacccagggctaga

SEQ ID NO: 44464 - DNA, 25 bp, S. cerevisiae
gtgttatgactaccccaagtgccat

SEQ ID NO: 44465 - DNA, 25 bp, S. cerevisiae
gtgatgaatacaaccccaagagtga

SEQ ID NO: 44466 - DNA, 25 bp, S. cerevisiae
gtgatatttcaaccgacaatgggcg

SEQ ID NO: 44467 - DNA, 25 bp, S. cerevisiae
gtgaaatactgtctctagccaagtt

SEQ ID NO: 44468 - DNA, 25 bp, S. cerevisiae
gtgacaaatcgttactgacgccaga

SEQ ID NO: 44469 - DNA, 25 bp, S. cerevisiae
gtgacaaggctgtctacgccggtga

SEQ ID NO: 44470 - DNA, 25 bp, S. cerevisiae
gtgaaaggctatctctgcgcaggac

SEQ ID NO: 44471 - DNA, 25 bp, S. cerevisiae
gtgaacgttatgctgcccaagattt

SEQ ID NO: 44472 - DNA, 25 bp, S. cerevisiae
gtgtacgtttgcttcacattagtag

SEQ ID NO: 44473 - DNA, 25 bp, S. cerevisiae
gtgaacttttcacatggtcaggcat

SEQ ID NO: 44474 - DNA, 25 bp, S. cerevisiae
gtgaacttcttgagggcatacgcat

SEQ ID NO: 44475 - DNA, 25 bp, S. cerevisiae
gtgagaattcttatggcgctattga

SEQ ID NO: 44476 - DNA, 25 bp, S. cerevisiae
gtgagaaattccatgcccgtagcaa

SEQ ID NO: 44477 - DNA, 25 bp, S. cerevisiae
gtgaagaacctcctgtacggactac

SEQ ID NO: 44478 - DNA, 25 bp, S. cerevisiae
gtgaaattgttcttgctgctcgtaa

SEQ ID NO: 44479 - DNA, 25 bp, S. cerevisiae
gtgaatactgcatcttgtccaagga

SEQ ID NO: 44480 - DNA, 25 bp, S. cerevisiae
gtgaacatctatttactgctattaa

SEQ ID NO: 44481 - DNA, 25 bp, S. cerevisiae
gtgacagctgttttcttggcattag

SEQ ID NO: 44482 - DNA, 25 bp, S. cerevisiae
gtgaagctcagttcattcgtgcaaa

SEQ ID NO: 44483 - DNA, 25 bp, S. cerevisiae
gtgacaccgattactcattctgttc

SEQ ID NO: 44484 - DNA, 25 bp, S. cerevisiae
gtgacttcgttgactgtatccttag

SEQ ID NO: 44485 - DNA, 25 bp, S. cerevisiae
gtggtgtcaccccaagaattggttt

SEQ ID NO: 44486 - DNA, 25 bp, S. cerevisiae
gtgagaaacctccaatacttgctgt

SEQ ID NO: 44487 - DNA, 25 bp, S. cerevisiae
gtgatcaacgctactcgctggaaga

SEQ ID NO: 44488 - DNA, 25 bp, S. cerevisiae
gtgtctgcacttctttggctaagcg

SEQ ID NO: 44489 - DNA, 25 bp, S. cerevisiae
gtgtcaccttaccattggatgccaa

SEQ ID NO: 44490 - DNA, 25 bp, S. cerevisiae
gtgtaccgcttcaacaacgctttat

SEQ ID NO: 44491 - DNA, 25 bp, S. cerevisiae
gtgtacctggctcaccaagagattt

SEQ ID NO: 44492 - DNA, 25 bp, S. cerevisiae
gtgatacctatgaaaacgatgcgat

SEQ ID NO: 44493 - DNA, 25 bp, S. cerevisiae
gtgagagatcctgaacctgatgaat

SEQ ID NO: 44494 - DNA, 25 bp, S. cerevisiae
gtgaaattttcacctctgatgacat

SEQ ID NO: 44495 - DNA, 25 bp, S. cerevisiae
gtgaaacatcttcccattctgacga

SEQ ID NO: 44496 - DNA, 25 bp, S. cerevisiae
gtgacttgatgctaatcctttctac

SEQ ID NO: 44497 - DNA, 25 bp, S. cerevisiae
gtgactctactgacccgtttaatag

SEQ ID NO: 44498 - DNA, 25 bp, S. cerevisiae
gtgtcggtctagcaccattattatc

SEQ ID NO: 44499 - DNA, 25 bp, S. cerevisiae
gtgtcggaaacacccaacatcttgg

SEQ ID NO: 44500 - DNA, 25 bp, S. cerevisiae
gtgatttaaccaccttgaatttgaa

SEQ ID NO: 44501 - DNA, 25 bp, S. cerevisiae
gtgattctgatacgactttggattt

SEQ ID NO: 44502 - DNA, 25 bp, S. cerevisiae
gtgttacgaaacgaagacttgctta

SEQ ID NO: 44503 - DNA, 25 bp, S. cerevisiae
gtgatatactcctccaatacattga

SEQ ID NO: 44504 - DNA, 25 bp, S. cerevisiae
gtgactacaagctacaccgagcgta

SEQ ID NO: 44505 - DNA, 25 bp, S. cerevisiae
gtgacttcagaaagcatggtgccgt

SEQ ID NO: 44506 - DNA, 25 bp, S. cerevisiae
gtgactttcaacatgagctcgccta

SEQ ID NO: 44507 - DNA, 25 bp, S. cerevisiae
gtgagctgacaatgttgcctttcaa

SEQ ID NO: 44508 - DNA, 25 bp, S. cerevisiae
gtgaccccaagattcctatgcaaaa

SEQ ID NO: 44509 - DNA, 25 bp, S. cerevisiae
gtgacaaccacgatgcctatgaaca

SEQ ID NO: 44510 - DNA, 25 bp, S. cerevisiae
gtgtctctgaccattttgcatactc

SEQ ID NO: 44511 - DNA, 25 bp, S. cerevisiae
gtgtcgcgggctgaactgaatcatt

SEQ ID NO: 44512 - DNA, 25 bp, S. cerevisiae
gtgaccactggtaaagctcttcttt

SEQ ID NO: 44513 - DNA, 25 bp, S. cerevisiae
gtgagccctctaaatacgtgttaaa

SEQ ID NO: 44514 - DNA, 25 bp, S. cerevisiae
gtgagccgttaaacatcgttatcaa

SEQ ID NO: 44515 - DNA, 25 bp, S. cerevisiae
gtgatttccgtaagctcagagccct

SEQ ID NO: 44516 - DNA, 25 bp, S. cerevisiae
gtgacttatttagtgaggtcgaata

SEQ ID NO: 44517 - DNA, 25 bp, S. cerevisiae
gtgttcgcccaagttacctgtagaa

SEQ ID NO: 44518 - DNA, 25 bp, S. cerevisiae
gtgttagccactttctactttcaaa

SEQ ID NO: 44519 - DNA, 25 bp, S. cerevisiae
gtgttaccatggagtattttcgcat

SEQ ID NO: 44520 - DNA, 25 bp, S. cerevisiae
ggttaccgaattcttatccatggaa

SEQ ID NO: 44521 - DNA, 25 bp, S. cerevisiae
ggtaaccaggccatacagtacgcta

SEQ ID NO: 44522 - DNA, 25 bp, S. cerevisiae
tctccccggccgttgatgaaattga

SEQ ID NO: 44523 - DNA, 25 bp, S. cerevisiae
tgtcccgttgcctactttgaagtat

SEQ ID NO: 44524 - DNA, 25 bp, S. cerevisiae
gtgaccgtgttcactgtgagctatt

SEQ ID NO: 44525 - DNA, 25 bp, S. cerevisiae
gtgttggtttcgttccagtcaggaa

SEQ ID NO: 44526 - DNA, 25 bp, S. cerevisiae
gtgttttttgtgtatcccagggcaa

SEQ ID NO: 44527 - DNA, 25 bp, S. cerevisiae
gtgaggattccaaacgctaccactg

SEQ ID NO: 44528 - DNA, 25 bp, S. cerevisiae
gtgggtctacaagcggccacactag

SEQ ID NO: 44529 - DNA, 25 bp, S. cerevisiae
gtggtttgaaaagacccatactggt

SEQ ID NO: 44530 - DNA, 25 bp, S. cerevisiae
gtgtttatgaattggtcgcctcgct

SEQ ID NO: 44531 - DNA, 25 bp, S. cerevisiae
gtgtttagaatgatcgcgcactctg

SEQ ID NO: 44532 - DNA, 25 bp, S. cerevisiae
ggtggtcaaacaagtatcaggccct

SEQ ID NO: 44533 - DNA, 25 bp, S. cerevisiae
gtgtccttcgagattttctcctgaa

SEQ ID NO: 44534 - DNA, 25 bp, S. cerevisiae
gtgtccgccaaaattaatcatactg

SEQ ID NO: 44535 - DNA, 25 bp, S. cerevisiae
gtgtcacgggtggtgtcactcaagc

SEQ ID NO: 44536 - DNA, 25 bp, S. cerevisiae
gtgtcatccaaaagtgccagtcggt

SEQ ID NO: 44537 - DNA, 25 bp, S. cerevisiae
gtgtcatcctgcaagagcttcaatc

SEQ ID NO: 44538 - DNA, 25 bp, S. cerevisiae
gtgtcaccaacccatttttaactga

SEQ ID NO: 44539 - DNA, 25 bp, S. cerevisiae
gtggttgttagcgttttcttccaat

SEQ ID NO: 44540 - DNA, 25 bp, S. cerevisiae
gtgggtaaccatgatttcttccctg

SEQ ID NO: 44541 - DNA, 25 bp, S. cerevisiae
gtggtccaaccatattttttctaga

SEQ ID NO: 44542 - DNA, 25 bp, S. cerevisiae
gtggtcaaaccaagcctgttttcca

SEQ ID NO: 44543 - DNA, 25 bp, S. cerevisiae
gtgttacgatgcagacatgttttgt

SEQ ID NO: 44544 - DNA, 25 bp, S. cerevisiae
tatgttacgtgataaattttcccaa

SEQ ID NO: 44545 - DNA, 25 bp, S. cerevisiae
gtgatgctgatattgaggaactact

SEQ ID NO: 44546 - DNA, 25 bp, S. cerevisiae
gtgatgctatcaaaagcacctccaa

SEQ ID NO: 44547 - DNA, 25 bp, S. cerevisiae
gtgactctcaatgggcagccttcaa

SEQ ID NO: 44548 - DNA, 25 bp, S. cerevisiae
gtgttgtggtctccaatgcatcaga

SEQ ID NO: 44549 - DNA, 25 bp, S. cerevisiae
gtgtatgcacatcctgaaatccaag

SEQ ID NO: 44550 - DNA, 25 bp, S. cerevisiae
gtgtaagaaccactgcatctcaaat

SEQ ID NO: 44551 - DNA, 25 bp, S. cerevisiae
gtgaaaatcacattccattcttagg

SEQ ID NO: 44552 - DNA, 25 bp, S. cerevisiae
gtgacatattactctacctttgggt

SEQ ID NO: 44553 - DNA, 25 bp, S. cerevisiae
gtgaccaatgccagttcctttgaga

SEQ ID NO: 44554 - DNA, 25 bp, S. cerevisiae
gtgactctgttcatttactttgcga

SEQ ID NO: 44555 - DNA, 25 bp, S. cerevisiae
gtgacttttgagcttgacgacttga

SEQ ID NO: 44556 - DNA, 25 bp, S. cerevisiae
gtgtcgtttatgtgagaccacctat

SEQ ID NO: 44557 - DNA, 25 bp, S. cerevisiae
gtgacgactctattatcgctggcca

SEQ ID NO: 44558 - DNA, 25 bp, S. cerevisiae
gtgatcttttgaactcatctacatc

SEQ ID NO: 44559 - DNA, 25 bp, S. cerevisiae
gtgactcttccaatgcaaatactca

SEQ ID NO: 44560 - DNA, 25 bp, S. cerevisiae
gtgacacttcgaatgacttaccagc

SEQ ID NO: 44561 - DNA, 25 bp, S. cerevisiae
gtgacactttcatggatctcggttc

SEQ ID NO: 44562 - DNA, 25 bp, S. cerevisiae
gtgactctttctaagcatcgcgaat

SEQ ID NO: 44563 - DNA, 25 bp, S. cerevisiae
gtgactcttccaaagcccaatattt

SEQ ID NO: 44564 - DNA, 25 bp, S. cerevisiae
gtgtcgcttaatcttaccgacgatg

SEQ ID NO: 44565 - DNA, 25 bp, S. cerevisiae
gtgtcgtgagaaacttgcctaccgg

SEQ ID NO: 44566 - DNA, 25 bp, S. cerevisiae
gtgagcaggaaaacgctgatccgcc

SEQ ID NO: 44567 - DNA, 25 bp, S. cerevisiae
gtgacagtagctccaagattccgcc

SEQ ID NO: 44568 - DNA, 25 bp, S. cerevisiae
gtgatcgtgagccacaaggtttgca

SEQ ID NO: 44569 - DNA, 25 bp, S. cerevisiae
gtgtcaaatctgtcaaggctatccc

SEQ ID NO: 44570 - DNA, 25 bp, S. cerevisiae
gtgtcagattttttcctttctttgt

SEQ ID NO: 44571 - DNA, 25 bp, S. cerevisiae
gtgacgattttgttgctaggttaac

SEQ ID NO: 44572 - DNA, 25 bp, S. cerevisiae
gtgacggtatctttcgggtgtgtaa

SEQ ID NO: 44573 - DNA, 25 bp, S. cerevisiae
gtgactggtgcatttttggtgttta

SEQ ID NO: 44574 - DNA, 25 bp, S. cerevisiae
gtgtgcattggacccgaatttatct

SEQ ID NO: 44575 - DNA, 25 bp, S. cerevisiae
gtgatgaggaaattcaatatgacat

SEQ ID NO: 44576 - DNA, 25 bp, S. cerevisiae
gtgtgtgctttagacttgaccaccc

SEQ ID NO: 44577 - DNA, 25 bp, S. cerevisiae
gtgtcctttagaactcataactcgc

SEQ ID NO: 44578 - DNA, 25 bp, S. cerevisiae
ggtcactttcacaaggtcaaacgct

SEQ ID NO: 44579 - DNA, 25 bp, S. cerevisiae
gtgtcgcaggtaaaatcccaccaat

SEQ ID NO: 44580 - DNA, 25 bp, S. cerevisiae
gtgttacaccggttcacgagacata

SEQ ID NO: 44581 - DNA, 25 bp, S. cerevisiae
gtgtttcaagcgatcacgtcgacta

SEQ ID NO: 44582 - DNA, 25 bp, S. cerevisiae
gtgttcgaagcttacattggcggct

SEQ ID NO: 44583 - DNA, 25 bp, S. cerevisiae
gtgttcacgttatcatgtactggta

SEQ ID NO: 44584 - DNA, 25 bp, S. cerevisiae
gtgtatgctgaaaacatgcgtattc

SEQ ID NO: 44585 - DNA, 25 bp, S. cerevisiae
gtgatgcactagacgcaacttctta

SEQ ID NO: 44586 - DNA, 25 bp, S. cerevisiae
gtgagatcacagacgctattaaggc

SEQ ID NO: 44587 - DNA, 25 bp, S. cerevisiae
gtgagcactcatcgccgttaaacga

SEQ ID NO: 44588 - DNA, 25 bp, S. cerevisiae
gtgaccagttctactacccagatat

SEQ ID NO: 44589 - DNA, 25 bp, S. cerevisiae
gtgacggtgtccaagcaaccagttt

SEQ ID NO: 44590 - DNA, 25 bp, S. cerevisiae
gtgacgatgattttggtaaggctct

SEQ ID NO: 44591 - DNA, 25 bp, S. cerevisiae
gggctgatgtttacgctaaggcttt

SEQ ID NO: 44592 - DNA, 25 bp, S. cerevisiae
gtgtcgtgttgtccacattaggtgt

SEQ ID NO: 44593 - DNA, 25 bp, S. cerevisiae
gtgtcccttcatcaataatccaaat

SEQ ID NO: 44594 - DNA, 25 bp, S. cerevisiae
gtggcaccgtcaacagaaacgctcg

SEQ ID NO: 44595 - DNA, 25 bp, S. cerevisiae
gtggcaagggcaatcgggcactttt

SEQ ID NO: 44596 - DNA, 25 bp, S. cerevisiae
gggccagtccatatgttagtttagc

SEQ ID NO: 44597 - DNA, 25 bp, S. cerevisiae
ggtcggtccatgatttacgtgagct

SEQ ID NO: 44598 - DNA, 25 bp, S. cerevisiae
ggtcgtccctgatgtttgggacttt

SEQ ID NO: 44599 - DNA, 25 bp, S. cerevisiae
gtgtcttccctatcttttgaaccat

SEQ ID NO: 44600 - DNA, 25 bp, S. cerevisiae
gtgttacccaacttttgtaccagca

SEQ ID NO: 44601 - DNA, 25 bp, S. cerevisiae
gtgtggatatcctccgttttacgaa

SEQ ID NO: 44602 - DNA, 25 bp, S. cerevisiae
gtgtctggaccatctgtatgatcat

SEQ ID NO: 44603 - DNA, 25 bp, S. cerevisiae
gtgatggtactcctgctgtgataaa

SEQ ID NO: 44604 - DNA, 25 bp, S. cerevisiae
gtgacggtgacgaagatgctgttta

SEQ ID NO: 44605 - DNA, 25 bp, S. cerevisiae
gtggctggcaaaccggtgcattaat

SEQ ID NO: 44606 - DNA, 25 bp, S. cerevisiae
gtgagctccaaaagcttgctcttaa

SEQ ID NO: 44607 - DNA, 25 bp, S. cerevisiae
gtgtcataatcgcatctgatctgtt

SEQ ID NO: 44608 - DNA, 25 bp, S. cerevisiae
gtgtcttagctgacattactgttgc

SEQ ID NO: 44609 - DNA, 25 bp, S. cerevisiae
gtgtcattattattacgcattcggc

SEQ ID NO: 44610 - DNA, 25 bp, S. cerevisiae
gtgattcttggtaacttcgtcgaca

SEQ ID NO: 44611 - DNA, 25 bp, S. cerevisiae
gtgatctttacgaccttttcgagac

SEQ ID NO: 44612 - DNA, 25 bp, S. cerevisiae
gtgtctttgacgaagtctccttgga

SEQ ID NO: 44613 - DNA, 25 bp, S. cerevisiae
gtgtaccgataatgccaactctacc

SEQ ID NO: 44614 - DNA, 25 bp, S. cerevisiae
gtgatcccgtcaagcacgcagaatt

SEQ ID NO: 44615 - DNA, 25 bp, S. cerevisiae
gtgaccactgataataggcgcaata

SEQ ID NO: 44616 - DNA, 25 bp, S. cerevisiae
gtgactaatgacaacgcagcgcctg

SEQ ID NO: 44617 - DNA, 25 bp, S. cerevisiae
tgagttaacagataggtcccgagct

SEQ ID NO: 44618 - DNA, 25 bp, S. cerevisiae
gtgatcatatacctctactaacaga

SEQ ID NO: 44619 - DNA, 25 bp, S. cerevisiae
gtgatattacacctaatgacccaat

SEQ ID NO: 44620 - DNA, 25 bp, S. cerevisiae
gtgtcattacacatcaaggtgccaa

SEQ ID NO: 44621 - DNA, 25 bp, S. cerevisiae
gtgagttcaggcttaaccatcaata

SEQ ID NO: 44622 - DNA, 25 bp, S. cerevisiae
gtgatgttaacctctgccaaatact

SEQ ID NO: 44623 - DNA, 25 bp, S. cerevisiae
gtgatattcgtcgtcttgccaataa

SEQ ID NO: 44624 - DNA, 25 bp, S. cerevisiae
gtgatgctgcaaattctcattctaa

SEQ ID NO: 44625 - DNA, 25 bp, S. cerevisiae
gtgagccaactctgattgccagcaa

SEQ ID NO: 44626 - DNA, 25 bp, S. cerevisiae
gtgatcgacagtcaatatccgttgt

SEQ ID NO: 44627 - DNA, 25 bp, S. cerevisiae
gtgagaatgttgcttattggtgcta

SEQ ID NO: 44628 - DNA, 25 bp, S. cerevisiae
gtgttgtcacatctatccttggtat

SEQ ID NO: 44629 - DNA, 25 bp, S. cerevisiae
gtgtccccaatctcggtttgacttg

SEQ ID NO: 44630 - DNA, 25 bp, S. cerevisiae
gtgacctggcaactactaagagatt

SEQ ID NO: 44631 - DNA, 25 bp, S. cerevisiae
gtgattctggaacaccctcaattgt

SEQ ID NO: 44632 - DNA, 25 bp, S. cerevisiae
gtggtgaaatcacgaagtctgctca

SEQ ID NO: 44633 - DNA, 25 bp, S. cerevisiae
gtgtctatagtaagtgctcggccaa

SEQ ID NO: 44634 - DNA, 25 bp, S. cerevisiae
gtgtatatacattagcatgccgttc

SEQ ID NO: 44635 - DNA, 25 bp, S. cerevisiae
gtgatatcctgagcgttttagccat

SEQ ID NO: 44636 - DNA, 25 bp, S. cerevisiae
gtgatatcattaccgttgacccaca

SEQ ID NO: 44637 - DNA, 25 bp, S. cerevisiae
gtgtacttacacttggtgaaccttt

SEQ ID NO: 44638 - DNA, 25 bp, S. cerevisiae
gtgttctttgccaatgagcgtacct

SEQ ID NO: 44639 - DNA, 25 bp, S. cerevisiae
gtgttagattccagccagtacgatt

SEQ ID NO: 44640 - DNA, 25 bp, S. cerevisiae
gtgtttgctttcaagccagggctat

SEQ ID NO: 44641 - DNA, 25 bp, S. cerevisiae
gtggtatatactcttcgtggtccgc

SEQ ID NO: 44642 - DNA, 25 bp, S. cerevisiae
gtgatttcaccggattggactcgca

SEQ ID NO: 44643 - DNA, 25 bp, S. cerevisiae
gtgttgaacagagattttgagcgtg

SEQ ID NO: 44644 - DNA, 25 bp, S. cerevisiae
gtgtagtgtcaagctctttatggat

SEQ ID NO: 44645 - DNA, 25 bp, S. cerevisiae
gtgagccttttgcaactgaattcta

SEQ ID NO: 44646 - DNA, 25 bp, S. cerevisiae
gtgatgcccctgagttaaccattaa

SEQ ID NO: 44647 - DNA, 25 bp, S. cerevisiae
gtgagatccgtgagttgttccagct

SEQ ID NO: 44648 - DNA, 25 bp, S. cerevisiae
gtgattatgcaatgtttcccactaa

SEQ ID NO: 44649 - DNA, 25 bp, S. cerevisiae
gtgtctcatcagtgattttcgtttt

SEQ ID NO: 44650 - DNA, 25 bp, S. cerevisiae
gtgtttctgcattgtttgccgttat

SEQ ID NO: 44651 - DNA, 25 bp, S. cerevisiae
gtgattgttctactttcttgatggt

SEQ ID NO: 44652 - DNA, 25 bp, S. cerevisiae
gtgtcggccaagtcatcaagggttg

SEQ ID NO: 44653 - DNA, 25 bp, S. cerevisiae
gtgttggctgcacataccaagtttg

SEQ ID NO: 44654 - DNA, 25 bp, S. cerevisiae
gtgttatcctcgaaactgactctaa

SEQ ID NO: 44655 - DNA, 25 bp, S. cerevisiae
gtgagatttccaacaactacttatg

SEQ ID NO: 44656 - DNA, 25 bp, S. cerevisiae
gtgagatcggttccaatctaccttc

SEQ ID NO: 44657 - DNA, 25 bp, S. cerevisiae
gtgtgtcaagttgcaccaatccctg

SEQ ID NO: 44658 - DNA, 25 bp, S. cerevisiae
gtgttgctgccatccaatcgataag

SEQ ID NO: 44659 - DNA, 25 bp, S. cerevisiae
gtgattcgccataccacttgaacag

SEQ ID NO: 44660 - DNA, 25 bp, S. cerevisiae
gtgagctctctaactctatcagaac

SEQ ID NO: 44661 - DNA, 25 bp, S. cerevisiae
gtgatgacactagttctgatgatga

SEQ ID NO: 44662 - DNA, 25 bp, S. cerevisiae
gtgagggtctacgacaccaggattt

SEQ ID NO: 44663 - DNA, 25 bp, S. cerevisiae
gtgaggactagtgctcccacaaagt

SEQ ID NO: 44664 - DNA, 25 bp, S. cerevisiae
ggtggtccggtatcgaaatcttata

SEQ ID NO: 44665 - DNA, 25 bp, S. cerevisiae
ggtagacctggtcagctaaagttac

SEQ ID NO: 44666 - DNA, 25 bp, S. cerevisiae
gggaccttgaggacccaaagtctat

SEQ ID NO: 44667 - DNA, 25 bp, S. cerevisiae
gggacgtttttaccaatagatctgt

SEQ ID NO: 44668 - DNA, 25 bp, S. cerevisiae
ggcaaggtcggtttggatgacttaa

SEQ ID NO: 44669 - DNA, 25 bp, S. cerevisiae
ttccgggttcatattgtacttttct

SEQ ID NO: 44670 - DNA, 25 bp, S. cerevisiae
tgtcgggaagtcctgtttacttttg

SEQ ID NO: 44671 - DNA, 25 bp, S. cerevisiae
gtgtactgttcttaactttgactta

SEQ ID NO: 44672 - DNA, 25 bp, S. cerevisiae
gtgttcgtcgtggtacagatgtctt

SEQ ID NO: 44673 - DNA, 25 bp, S. cerevisiae
gtgtcttgcatcctgaagtcatgat

SEQ ID NO: 44674 - DNA, 25 bp, S. cerevisiae
gtgttgagtctgtcaatgattctaa

SEQ ID NO: 44675 - DNA, 25 bp, S. cerevisiae
ggtcgatcctggacacagttgacgt

SEQ ID NO: 44676 - DNA, 25 bp, S. cerevisiae
ggtggagccattgccggtattgtta

SEQ ID NO: 44677 - DNA, 25 bp, S. cerevisiae
gggaagtcacgaccggctatttatc

SEQ ID NO: 44678 - DNA, 25 bp, S. cerevisiae
gggatggtatcctccgtaagtacga

SEQ ID NO: 44679 - DNA, 25 bp, S. cerevisiae
gtggttgttccatccgttgtggaaa

SEQ ID NO: 44680 - DNA, 25 bp, S. cerevisiae
gtgtctttccttaccgctatgagtg

SEQ ID NO: 44681 - DNA, 25 bp, S. cerevisiae
gtgatgtacatcttggacttctatt

SEQ ID NO: 44682 - DNA, 25 bp, S. cerevisiae
gtgaggatccaatgactacttacgt

SEQ ID NO: 44683 - DNA, 25 bp, S. cerevisiae
gtgagtcctatcttacagcagcgaa

SEQ ID NO: 44684 - DNA, 25 bp, S. cerevisiae
gtgattctccacttgacgtagacat

SEQ ID NO: 44685 - DNA, 25 bp, S. cerevisiae
gtgtattcccattgtttaccatcca

SEQ ID NO: 44686 - DNA, 25 bp, S. cerevisiae
gtgtttccttcgatgtggagcccaa

SEQ ID NO: 44687 - DNA, 25 bp, S. cerevisiae
gtgatttccatcaggcgttcaatag

SEQ ID NO: 44688 - DNA, 25 bp, S. cerevisiae
gtgatgttcctcatatcctaaaaga

SEQ ID NO: 44689 - DNA, 25 bp, S. cerevisiae
gtgttactgcccttcgagaaaagct

SEQ ID NO: 44690 - DNA, 25 bp, S. cerevisiae
gtgatatccccttttatagaatggt

SEQ ID NO: 44691 - DNA, 25 bp, S. cerevisiae
gtgtatgccgttattctacagaggc

SEQ ID NO: 44692 - DNA, 25 bp, S. cerevisiae
gtgatagctttgatctttccagaga

SEQ ID NO: 44693 - DNA, 25 bp, S. cerevisiae
gtgatgatccggctgttaccaagaa

SEQ ID NO: 44694 - DNA, 25 bp, S. cerevisiae
gtgatgtctccgcttatattccaac

SEQ ID NO: 44695 - DNA, 25 bp, S. cerevisiae
gtgtttcactgttgattgctggcca

SEQ ID NO: 44696 - DNA, 25 bp, S. cerevisiae
gtgatgcatcttgttcttgttggaa

SEQ ID NO: 44697 - DNA, 25 bp, S. cerevisiae
gggcatgtggcctacaactatacaa

SEQ ID NO: 44698 - DNA, 25 bp, S. cerevisiae
gtgtcttcgccatcaaattacaagt

SEQ ID NO: 44699 - DNA, 25 bp, S. cerevisiae
gtgtacctacacgtgaaattctaag

SEQ ID NO: 44700 - DNA, 25 bp, S. cerevisiae
gtggacgtatcagcagacactacca

SEQ ID NO: 44701 - DNA, 25 bp, S. cerevisiae
gtgatgactttagacaactttcaga

SEQ ID NO: 44702 - DNA, 25 bp, S. cerevisiae
gtgattattttacctgactgttctc

SEQ ID NO: 44703 - DNA, 25 bp, S. cerevisiae
gtgttgccagcgaactacgcattat

SEQ ID NO: 44704 - DNA, 25 bp, S. cerevisiae
gtgattccagacaactagccagatt

SEQ ID NO: 44705 - DNA, 25 bp, S. cerevisiae
gtgatatccaggacccatgggtgtt

SEQ ID NO: 44706 - DNA, 25 bp, S. cerevisiae
gtgttgtcagagaccttgttgatga

SEQ ID NO: 44707 - DNA, 25 bp, S. cerevisiae
gtggcaatgaggaccctgtttacaa

SEQ ID NO: 44708 - DNA, 25 bp, S. cerevisiae
gtgtacatatggaccgcttgttcat

SEQ ID NO: 44709 - DNA, 25 bp, S. cerevisiae
gtgtatccaaactgtctcttcattt

SEQ ID NO: 44710 - DNA, 25 bp, S. cerevisiae
gtgattccaattctgatatctcgca

SEQ ID NO: 44711 - DNA, 25 bp, S. cerevisiae
gtgttcatgctgtttggagactcct

SEQ ID NO: 44712 - DNA, 25 bp, S. cerevisiae
gtgttactggcgacaagcactcgtc

SEQ ID NO: 44713 - DNA, 25 bp, S. cerevisiae
gtgtttgcttggtcatggcacatcc

SEQ ID NO: 44714 - DNA, 25 bp, S. cerevisiae
gtgatattctatcttgcagcaattg

SEQ ID NO: 44715 - DNA, 25 bp, S. cerevisiae
gtgatgtcttatgttcagccattaa

SEQ ID NO: 44716 - DNA, 25 bp, S. cerevisiae
gtgatttgttatggtctaggtctat

SEQ ID NO: 44717 - DNA, 25 bp, S. cerevisiae
gtgatattctttgtcattggtgcaa

SEQ ID NO: 44718 - DNA, 25 bp, S. cerevisiae
gtgtccctattcttttggatgacca

SEQ ID NO: 44719 - DNA, 25 bp, S. cerevisiae
gtggcatcttttgaccggtactggt

SEQ ID NO: 44720 - DNA, 25 bp, S. cerevisiae
gtgtgtcggctgtcaaacgttactt

SEQ ID NO: 44721 - DNA, 25 bp, S. cerevisiae
gtgtcctatcaaacattctggtcgt

SEQ ID NO: 44722 - DNA, 25 bp, S. cerevisiae
gtgtcactgacaagatctcccatgt

SEQ ID NO: 44723 - DNA, 25 bp, S. cerevisiae
gtgtccaaaagaaccctgctaagaa

SEQ ID NO: 44724 - DNA, 25 bp, S. cerevisiae
gtgtccgaattgttccctctaagaa

SEQ ID NO: 44725 - DNA, 25 bp, S. cerevisiae
gtgatcctgcacagtacgccataaa

SEQ ID NO: 44726 - DNA, 25 bp, S. cerevisiae
gtgtcctgcgggaacatcgcttaac

SEQ ID NO: 44727 - DNA, 25 bp, S. cerevisiae
gtgtccgggaagtctttgaacaggc

SEQ ID NO: 44728 - DNA, 25 bp, S. cerevisiae
gtgatgcttacgtttcttctgacga

SEQ ID NO: 44729 - DNA, 25 bp, S. cerevisiae
gtgttatccagcgaactatgtactt

SEQ ID NO: 44730 - DNA, 25 bp, S. cerevisiae
gtgtataaggccaagctaggtcata

SEQ ID NO: 44731 - DNA, 25 bp, S. cerevisiae
gtgtaaaccacttgcacggcatcag

SEQ ID NO: 44732 - DNA, 25 bp, S. cerevisiae
gtgatacaatgatccgcaaagccat

SEQ ID NO: 44733 - DNA, 25 bp, S. cerevisiae
gtgtacacatgttccaaactttccc

SEQ ID NO: 44734 - DNA, 25 bp, S. cerevisiae
gtgtacaatctagaagccgctcttc

SEQ ID NO: 44735 - DNA, 25 bp, S. cerevisiae
gtggtattctagcatagcccgtgtt

SEQ ID NO: 44736 - DNA, 25 bp, S. cerevisiae
gtgttattcatgttgtaccaggcca

SEQ ID NO: 44737 - DNA, 25 bp, S. cerevisiae
gtgtcgtggcatgtgggtccaacaa

SEQ ID NO: 44738 - DNA, 25 bp, S. cerevisiae
gtggtttaaaccctcgcatggaaag

SEQ ID NO: 44739 - DNA, 25 bp, S. cerevisiae
gtgttccgataagcgccctcagaga

SEQ ID NO: 44740 - DNA, 25 bp, S. cerevisiae
gtgtcactcagaacaccgacgaagg

SEQ ID NO: 44741 - DNA, 25 bp, S. cerevisiae
gtgtcacagtcaaacctgacgagga

SEQ ID NO: 44742 - DNA, 25 bp, S. cerevisiae
gtgtcatcggtttcgcataccataa

SEQ ID NO: 44743 - DNA, 25 bp, S. cerevisiae
gtgtctcggtatgggtgccacagta

SEQ ID NO: 44744 - DNA, 25 bp, S. cerevisiae
gtgtcatctgcgaaaaggccctata

SEQ ID NO: 44745 - DNA, 25 bp, S. cerevisiae
tgtagcggcgacgaatagacctgat

SEQ ID NO: 44746 - DNA, 25 bp, S. cerevisiae
gtgttatcccttttgaatctgagtc

SEQ ID NO: 44747 - DNA, 25 bp, S. cerevisiae
gtgtattccgcaattgatgagtcgt

SEQ ID NO: 44748 - DNA, 25 bp, S. cerevisiae
gtgtaccacccattatcagttgcaa

SEQ ID NO: 44749 - DNA, 25 bp, S. cerevisiae
gtgtcagcccactactaaataacct

SEQ ID NO: 44750 - DNA, 25 bp, S. cerevisiae
gtgtcactcaacaacctttaacctt

SEQ ID NO: 44751 - DNA, 25 bp, S. cerevisiae
gtgttgctgttgtacagtttgacaa

SEQ ID NO: 44752 - DNA, 25 bp, S. cerevisiae
gtgttgccatttcctttgtacatga

SEQ ID NO: 44753 - DNA, 25 bp, S. cerevisiae
gtgttgcctcactattagctactac

SEQ ID NO: 44754 - DNA, 25 bp, S. cerevisiae
gtgtcaacaggattcaagagcgcat

SEQ ID NO: 44755 - DNA, 25 bp, S. cerevisiae
gtgtgagactgagatgcaacccatt

SEQ ID NO: 44756 - DNA, 25 bp, S. cerevisiae
gtgtcactctgattgtaaatgaatt

SEQ ID NO: 44757 - DNA, 25 bp, S. cerevisiae
gtgtgacagtgaaatgttcgcaagt

SEQ ID NO: 44758 - DNA, 25 bp, S. cerevisiae
gtgtatcagtgcactattcctggca

SEQ ID NO: 44759 - DNA, 25 bp, S. cerevisiae
gtgtccatctgcatactacctgaga

SEQ ID NO: 44760 - DNA, 25 bp, S. cerevisiae
gtgatatcattgtcgatcccactgc

SEQ ID NO: 44761 - DNA, 25 bp, S. cerevisiae
gtgtttatgccgaccaatctaagac

SEQ ID NO: 44762 - DNA, 25 bp, S. cerevisiae
gtgtcttgaccgtcatcaacgaaca

SEQ ID NO: 44763 - DNA, 25 bp, S. cerevisiae
gtgtcattggccctcatggtataaa

SEQ ID NO: 44764 - DNA, 25 bp, S. cerevisiae
gtgtatgaatcttatcgtgcaaatc

SEQ ID NO: 44765 - DNA, 25 bp, S. cerevisiae
gtgtatcggcagcagcgacaacatc

SEQ ID NO: 44766 - DNA, 25 bp, S. cerevisiae
gtgtctcgcacaccaggcaagaatc

SEQ ID NO: 44767 - DNA, 25 bp, S. cerevisiae
gtgttacaattcacaggtcatccag

SEQ ID NO: 44768 - DNA, 25 bp, S. cerevisiae
gtgtctacatctactaaagccatta

SEQ ID NO: 44769 - DNA, 25 bp, S. cerevisiae
gtgtcagtttcaatcaatcggcatt

SEQ ID NO: 44770 - DNA, 25 bp, S. cerevisiae
gtgttgtataccctccttgtagata

SEQ ID NO: 44771 - DNA, 25 bp, S. cerevisiae
gtgattaccaccctgatacttggaa

SEQ ID NO: 44772 - DNA, 25 bp, S. cerevisiae
gtgtttggcccaattttagtcatga

SEQ ID NO: 44773 - DNA, 25 bp, S. cerevisiae
gtgtattgtaccttcctattgtcat

SEQ ID NO: 44774 - DNA, 25 bp, S. cerevisiae
ttgggcttacgggactggccaagaa

SEQ ID NO: 44775 - DNA, 25 bp, S. cerevisiae
gtgatattatctttggttgtctacc

SEQ ID NO: 44776 - DNA, 25 bp, S. cerevisiae
gtgtctaacgcgagaagcatcctca

SEQ ID NO: 44777 - DNA, 25 bp, S. cerevisiae
gtgttagaccttcgaatatgttcaa

SEQ ID NO: 44778 - DNA, 25 bp, S. cerevisiae
gtgttactcgtgcatttcagtgata

SEQ ID NO: 44779 - DNA, 25 bp, S. cerevisiae
ggaggcctcgacgttatgaaagcta

SEQ ID NO: 44780 - DNA, 25 bp, S. cerevisiae
gtggtcaagaccatagtgaaagcta

SEQ ID NO: 44781 - DNA, 25 bp, S. cerevisiae
gtgtcgaacagtcaccagttaccac

SEQ ID NO: 44782 - DNA, 25 bp, S. cerevisiae
gtgtctgaactaaacttgtcttcca

SEQ ID NO: 44783 - DNA, 25 bp, S. cerevisiae
tgttgttgtcgttgtggttgttcca

SEQ ID NO: 44784 - DNA, 25 bp, S. cerevisiae
gtgtttgctggtctgatttgttcaa

SEQ ID NO: 44785 - DNA, 25 bp, S. cerevisiae
gtgatttattctccgtggcacctta

SEQ ID NO: 44786 - DNA, 25 bp, S. cerevisiae
gtgattgtgcgtgtatatgtgtgtt

SEQ ID NO: 44787 - DNA, 25 bp, S. cerevisiae
gtgattgcatagacactttggcagt

SEQ ID NO: 44788 - DNA, 25 bp, S. cerevisiae
gtggatgcatcaaacattggtcagt

SEQ ID NO: 44789 - DNA, 25 bp, S. cerevisiae
gtgtagaatatttagccctgacctg

SEQ ID NO: 44790 - DNA, 25 bp, S. cerevisiae
gtgtcaaacatcaacctcaatacgt

SEQ ID NO: 44791 - DNA, 25 bp, S. cerevisiae
gtgtacataacacgttcttgacgaa

SEQ ID NO: 44792 - DNA, 25 bp, S. cerevisiae
gggaaatgtcgagctcttgaggaac

SEQ ID NO: 44793 - DNA, 25 bp, S. cerevisiae
gtgtacctctgggacctcaatgaag

SEQ ID NO: 44794 - DNA, 25 bp, S. cerevisiae
gtgtatattcagctgatcccaatga

SEQ ID NO: 44795 - DNA, 25 bp, S. cerevisiae
gtgtttgatctgtaccgacgtttta

SEQ ID NO: 44796 - DNA, 25 bp, S. cerevisiae
gtgtgttatcggtgacgctctaaat

SEQ ID NO: 44797 - DNA, 25 bp, S. cerevisiae
gtggaccacggtttcttctaagagc

SEQ ID NO: 44798 - DNA, 25 bp, S. cerevisiae
gtgtgtattacctcttccatgtaag

SEQ ID NO: 44799 - DNA, 25 bp, S. cerevisiae
gtggtccttttattgacgttcgcga

SEQ ID NO: 44800 - DNA, 25 bp, S. cerevisiae
gtggtgggtattggaactgctcccc

SEQ ID NO: 44801 - DNA, 25 bp, S. cerevisiae
gtggttgcgtgacgaaacgtttaca

SEQ ID NO: 44802 - DNA, 25 bp, S. cerevisiae
gggcgtgcttacaaaactgtttcca

SEQ ID NO: 44803 - DNA, 25 bp, S. cerevisiae
gtgtaggttcagtcaagccatgtct

SEQ ID NO: 44804 - DNA, 25 bp, S. cerevisiae
gtgtttctacgcttacaaatgcatt

SEQ ID NO: 44805 - DNA, 25 bp, S. cerevisiae
gtgtttcgggactacaaatgttgat

SEQ ID NO: 44806 - DNA, 25 bp, S. cerevisiae
gtggtatccttggtaacaaggctca

SEQ ID NO: 44807 - DNA, 25 bp, S. cerevisiae
gtgttgccacttcctagacaagttc

SEQ ID NO: 44808 - DNA, 25 bp, S. cerevisiae
gtgttgacaccacatagcacaagag

SEQ ID NO: 44809 - DNA, 25 bp, S. cerevisiae
ggtgccttaaacctttacgatggct

SEQ ID NO: 44810 - DNA, 25 bp, S. cerevisiae
gtggtaactacgttgtcttcggtga

SEQ ID NO: 44811 - DNA, 25 bp, S. cerevisiae
gggttactaagtttcatgaccagtg

SEQ ID NO: 44812 - DNA, 25 bp, S. cerevisiae
gtggtgatttaactttccttgcgtc

SEQ ID NO: 44813 - DNA, 25 bp, S. cerevisiae
gtgtctttaacaattctccggatga

SEQ ID NO: 44814 - DNA, 25 bp, S. cerevisiae
gggctatgtcatcataacttccatg

SEQ ID NO: 44815 - DNA, 25 bp, S. cerevisiae
gtgttccattaattgcattctcctt

SEQ ID NO: 44816 - DNA, 25 bp, S. cerevisiae
gtgtagctctagatatctgcttcag

SEQ ID NO: 44817 - DNA, 25 bp, S. cerevisiae
gggctctgtgttccaatccatcatg

SEQ ID NO: 44818 - DNA, 25 bp, S. cerevisiae
gtgtgtcctgatcaatatcccatgg

SEQ ID NO: 44819 - DNA, 25 bp, S. cerevisiae
gtgtatccaacaagttccctggcaa

SEQ ID NO: 44820 - DNA, 25 bp, S. cerevisiae
gtgtcctaagaagttctccccaatt

SEQ ID NO: 44821 - DNA, 25 bp, S. cerevisiae
gtgtctaaaatctttgttccgagga

SEQ ID NO: 44822 - DNA, 25 bp, S. cerevisiae
gtgtacaaatatcttttccagtggg

SEQ ID NO: 44823 - DNA, 25 bp, S. cerevisiae
gtgtatacaagaccggattcgcaga

SEQ ID NO: 44824 - DNA, 25 bp, S. cerevisiae
gtgtgatgacttgtgggtacctatt

SEQ ID NO: 44825 - DNA, 25 bp, S. cerevisiae
gtgttaataccaacgaatcctttat

SEQ ID NO: 44826 - DNA, 25 bp, S. cerevisiae
gtgtaaatctccgtacgactggttc

SEQ ID NO: 44827 - DNA, 25 bp, S. cerevisiae
gtgtcaaatctctctacttctgtgc

SEQ ID NO: 44828 - DNA, 25 bp, S. cerevisiae
gtgtcaaattctgattctgcttttt

SEQ ID NO: 44829 - DNA, 25 bp, S. cerevisiae
gtgtcttatgtatatcttcgttatt

SEQ ID NO: 44830 - DNA, 25 bp, S. cerevisiae
gtgtcagttatttctcgttggttac

SEQ ID NO: 44831 - DNA, 25 bp, S. cerevisiae
gggcctgaagtcgagctttaccaaa

SEQ ID NO: 44832 - DNA, 25 bp, S. cerevisiae
gggccgcaagaacgcttcaaaaaag

SEQ ID NO: 44833 - DNA, 25 bp, S. cerevisiae
gggccgttagatattccagaaaatt

SEQ ID NO: 44834 - DNA, 25 bp, S. cerevisiae
gggccacttcagatttacaaaggtt

SEQ ID NO: 44835 - DNA, 25 bp, S. cerevisiae
gtgtgggcactactttgttcactta

SEQ ID NO: 44836 - DNA, 25 bp, S. cerevisiae
gtggaataaaaccttagagcagcaa

SEQ ID NO: 44837 - DNA, 25 bp, S. cerevisiae
gtggtgccctttatatattttgttc

SEQ ID NO: 44838 - DNA, 25 bp, S. cerevisiae
gggcatatccttcaaatttgtcggt

SEQ ID NO: 44839 - DNA, 25 bp, S. cerevisiae
gggcattggttaacatcatttctcg

SEQ ID NO: 44840 - DNA, 25 bp, S. cerevisiae
gtggaaggctactactatcatcccg

SEQ ID NO: 44841 - DNA, 25 bp, S. cerevisiae
gtggtcgattacttgtaaccctcca

SEQ ID NO: 44842 - DNA, 25 bp, S. cerevisiae
gggccagtccaaagtagacctctta

SEQ ID NO: 44843 - DNA, 25 bp, S. cerevisiae
gggccgtaatattgggcatcctatt

SEQ ID NO: 44844 - DNA, 25 bp, S. cerevisiae
gtggtcgtgaagaagccgccagctt

SEQ ID NO: 44845 - DNA, 25 bp, S. cerevisiae
gtggtggaggataagccgctactat

SEQ ID NO: 44846 - DNA, 25 bp, S. cerevisiae
gtgggcgagagatgatccttccttt

SEQ ID NO: 44847 - DNA, 25 bp, S. cerevisiae
gggctgtggatagcaccttacctat

SEQ ID NO: 44848 - DNA, 25 bp, S. cerevisiae
gtgtggtttctccagcaaaagctat

SEQ ID NO: 44849 - DNA, 25 bp, S. cerevisiae
gtgtggttcgcatggcttcacaaat

SEQ ID NO: 44850 - DNA, 25 bp, S. cerevisiae
gtgtgcgtgctccaaggattaccac

SEQ ID NO: 44851 - DNA, 25 bp, S. cerevisiae
gtggcaggcctcacggataccaaag

SEQ ID NO: 44852 - DNA, 25 bp, S. cerevisiae
gtgggagaatctacgagaagcctaa

SEQ ID NO: 44853 - DNA, 25 bp, S. cerevisiae
gtggtggttccaagtcatatcattg

SEQ ID NO: 44854 - DNA, 25 bp, S. cerevisiae
gtgggtggctaaagacatcattatt

SEQ ID NO: 44855 - DNA, 25 bp, S. cerevisiae
gtgtggtggcctaagatttcaatct

SEQ ID NO: 44856 - DNA, 25 bp, S. cerevisiae
gtggtggatccagctgtgcttaaca

SEQ ID NO: 44857 - DNA, 25 bp, S. cerevisiae
gtggtattgccactggtgccgaaaa

SEQ ID NO: 44858 - DNA, 25 bp, S. cerevisiae
gtggtcttcactcggttggtacaac

SEQ ID NO: 44859 - DNA, 25 bp, S. cerevisiae
gggcccatctccaatgggtatgact

SEQ ID NO: 44860 - DNA, 25 bp, S. cerevisiae
gtgggaccccgttctgtatgaacaa

SEQ ID NO: 44861 - DNA, 25 bp, S. cerevisiae
gtgtaccaggcaaattcactccttg

SEQ ID NO: 44862 - DNA, 25 bp, S. cerevisiae
gtgttatctgtttccattcatccat

SEQ ID NO: 44863 - DNA, 25 bp, S. cerevisiae
gtgttttgcattgatttcatccata

SEQ ID NO: 44864 - DNA, 25 bp, S. cerevisiae
gtgtcatggcaatattcttttcgat

SEQ ID NO: 44865 - DNA, 25 bp, S. cerevisiae
gtgtcagagcatgtcaacttttcag

SEQ ID NO: 44866 - DNA, 25 bp, S. cerevisiae
gtgtaatagttttccaggcatttct

SEQ ID NO: 44867 - DNA, 25 bp, S. cerevisiae
gtgtcccaaccaagattgccagagg

SEQ ID NO: 44868 - DNA, 25 bp, S. cerevisiae
gtgtcccaagaaacagtctcctctg

SEQ ID NO: 44869 - DNA, 25 bp, S. cerevisiae
ggtcgtagcaagtgagtctcctgta

SEQ ID NO: 44870 - DNA, 25 bp, S. cerevisiae
gtgggccacggctgctaataatgca

SEQ ID NO: 44871 - DNA, 25 bp, S. cerevisiae
gtggtcaacaggttcaacgagccaa

SEQ ID NO: 44872 - DNA, 25 bp, S. cerevisiae
gtgtgacgataccttcaatcccaaa

SEQ ID NO: 44873 - DNA, 25 bp, S. cerevisiae
gtgtgaggtcgactctaacggcaat

SEQ ID NO: 44874 - DNA, 25 bp, S. cerevisiae
gtggatggtccaatatcccgtcaat

SEQ ID NO: 44875 - DNA, 25 bp, S. cerevisiae
gtggttaaccaatccatgcctatgg

SEQ ID NO: 44876 - DNA, 25 bp, S. cerevisiae
gtgtgtgctgctttcatttggtata

SEQ ID NO: 44877 - DNA, 25 bp, S. cerevisiae
gtggagtcagcgtcatttctgattt

SEQ ID NO: 44878 - DNA, 25 bp, S. cerevisiae
gtgtgttgccattgacttttgccaa

SEQ ID NO: 44879 - DNA, 25 bp, S. cerevisiae
gtgtgttccaagttatacgctgcat

SEQ ID NO: 44880 - DNA, 25 bp, S. cerevisiae
gtgtccctcaactgatagcgtgtga

SEQ ID NO: 44881 - DNA, 25 bp, S. cerevisiae
gtgtcaactcaactggcaatggtgc

SEQ ID NO: 44882 - DNA, 25 bp, S. cerevisiae
gtgtgcgcattctctcacaaagata

SEQ ID NO: 44883 - DNA, 25 bp, S. cerevisiae
gtgtcgctgctgccccagccaccac

SEQ ID NO: 44884 - DNA, 25 bp, S. cerevisiae
ggtgtcgctgctgccccagccacca

SEQ ID NO: 44885 - DNA, 25 bp, S. cerevisiae
gtggtgctccttttgaattagccaa

SEQ ID NO: 44886 - DNA, 25 bp, S. cerevisiae
gggatcctatgaccgacgaacctga

SEQ ID NO: 44887 - DNA, 25 bp, S. cerevisiae
gtggatcgcgaacctactttgatga

SEQ ID NO: 44888 - DNA, 25 bp, S. cerevisiae
gtgggtacccgctatgctataagag

SEQ ID NO: 44889 - DNA, 25 bp, S. cerevisiae
gtggtgcaaacgtctctggcggaac

SEQ ID NO: 44890 - DNA, 25 bp, S. cerevisiae
gtggtgatcatcatagcgtcaagaa

SEQ ID NO: 44891 - DNA, 25 bp, S. cerevisiae
gtggtacactatccatccgacagat

SEQ ID NO: 44892 - DNA, 25 bp, S. cerevisiae
gtggaacttgcaccactgcgaagtg

SEQ ID NO: 44893 - DNA, 25 bp, S. cerevisiae
gtgtccacggcatcgttattggaac

SEQ ID NO: 44894 - DNA, 25 bp, S. cerevisiae
gtgtctccttgttggctttgtggaa

SEQ ID NO: 44895 - DNA, 25 bp, S. cerevisiae
gtgtcccttgtgatgtttgcttcaa

SEQ ID NO: 44896 - DNA, 25 bp, S. cerevisiae
gtggtccttgccatttgttggtgaa

SEQ ID NO: 44897 - DNA, 25 bp, S. cerevisiae
gtgtacgtaaccttgatctcttaga

SEQ ID NO: 44898 - DNA, 25 bp, S. cerevisiae
gtgtgtcagtgagctcatttctttt

SEQ ID NO: 44899 - DNA, 25 bp, S. cerevisiae
gtgtgcatcagcaaccataatgctg

SEQ ID NO: 44900 - DNA, 25 bp, S. cerevisiae
gtgtcatcgatagtaacagcggcta

SEQ ID NO: 44901 - DNA, 25 bp, S. cerevisiae
gtgtgcacgatgttcaatcctatct

SEQ ID NO: 44902 - DNA, 25 bp, S. cerevisiae
gggttatcgatcacactttggacga

SEQ ID NO: 44903 - DNA, 25 bp, S. cerevisiae
gggttcccatgtaatcagttcggga

SEQ ID NO: 44904 - DNA, 25 bp, S. cerevisiae
gtgggttctctacaagcgcacggaa

SEQ ID NO: 44905 - DNA, 25 bp, S. cerevisiae
gtggtgcctctttaaagcagccgaa

SEQ ID NO: 44906 - DNA, 25 bp, S. cerevisiae
gtggtcaccggaagagtcagcagta

SEQ ID NO: 44907 - DNA, 25 bp, S. cerevisiae
gtgggtcacagatcaaatttatcgt

SEQ ID NO: 44908 - DNA, 25 bp, S. cerevisiae
gtggaggtacctcaatttcgataca

SEQ ID NO: 44909 - DNA, 25 bp, S. cerevisiae
gtggtgttacccaagttcgtgttga

SEQ ID NO: 44910 - DNA, 25 bp, S. cerevisiae
gtgtggttaccgagatgagcgttaa

SEQ ID NO: 44911 - DNA, 25 bp, S. cerevisiae
gtgtggctcccagtgatatgatcga

SEQ ID NO: 44912 - DNA, 25 bp, S. cerevisiae
gtgtactcgcttatcttgcaaagaa

SEQ ID NO: 44913 - DNA, 25 bp, S. cerevisiae
gtgtgcctggttatcccaatactac

SEQ ID NO: 44914 - DNA, 25 bp, S. cerevisiae
gtgtgcctggtattgctaggaaatt

SEQ ID NO: 44915 - DNA, 25 bp, S. cerevisiae
gtgtgcccgtaaaaggttcttgtct

SEQ ID NO: 44916 - DNA, 25 bp, S. cerevisiae
tgggcccacaaagactgttccagtt

SEQ ID NO: 44917 - DNA, 25 bp, S. cerevisiae
gggccgttgctagaagttccaattt

SEQ ID NO: 44918 - DNA, 25 bp, S. cerevisiae
gtggtggtcccgtaatcaagattaa

SEQ ID NO: 44919 - DNA, 25 bp, S. cerevisiae
gtggtgtctaccgtcactcaaatgc

SEQ ID NO: 44920 - DNA, 25 bp, S. cerevisiae
gtgggtaatcactttctcgatcagt

SEQ ID NO: 44921 - DNA, 25 bp, S. cerevisiae
gtgggttatacctatccgatatcgg

SEQ ID NO: 44922 - DNA, 25 bp, S. cerevisiae
gtggaggccaattttccgtgtctgg

SEQ ID NO: 44923 - DNA, 25 bp, S. cerevisiae
gtggtagccaagtatcccatgggaa

SEQ ID NO: 44924 - DNA, 25 bp, S. cerevisiae
gtgtggttttcaatcctcacttaaa

SEQ ID NO: 44925 - DNA, 25 bp, S. cerevisiae
gtgggtaaaaatccctttgcatcag

SEQ ID NO: 44926 - DNA, 25 bp, S. cerevisiae
gtgggaaaaactacctctatcagat

SEQ ID NO: 44927 - DNA, 25 bp, S. cerevisiae
gtgggcacaggtctcatttattcta

SEQ ID NO: 44928 - DNA, 25 bp, S. cerevisiae
gtggaccctataccgcaaatactta

SEQ ID NO: 44929 - DNA, 25 bp, S. cerevisiae
gtggcgagtgtttcggcagccaaca

SEQ ID NO: 44930 - DNA, 25 bp, S. cerevisiae
gtggcaagctactacggcaatccgg

SEQ ID NO: 44931 - DNA, 25 bp, S. cerevisiae
gtggacaggattcaagggccctttc

SEQ ID NO: 44932 - DNA, 25 bp, S. cerevisiae
gggctcgattttcagcgaccttttc

SEQ ID NO: 44933 - DNA, 25 bp, S. cerevisiae
gggtcagattttccccatcaaagtt

SEQ ID NO: 44934 - DNA, 25 bp, S. cerevisiae
gtggcaatttgtgctacccaacgtt

SEQ ID NO: 44935 - DNA, 25 bp, S. cerevisiae
gggccaactttatgtaccgacttgc

SEQ ID NO: 44936 - DNA, 25 bp, S. cerevisiae
gggcgcaaaccctcaacaagatatt

SEQ ID NO: 44937 - DNA, 25 bp, S. cerevisiae
gggacaagcacctcgtacagggcaa

SEQ ID NO: 44938 - DNA, 25 bp, S. cerevisiae
tgcgggccagcaacgtttaacgacg

SEQ ID NO: 44939 - DNA, 25 bp, S. cerevisiae
gtgtggcttttcttatctttactga

SEQ ID NO: 44940 - DNA, 25 bp, S. cerevisiae
gtggtccttatgctagttgcccata

SEQ ID NO: 44941 - DNA, 25 bp, S. cerevisiae
gtggttgctcagagtacttcacctc

SEQ ID NO: 44942 - DNA, 25 bp, S. cerevisiae
gtgggagctcgacatattcatcaac

SEQ ID NO: 44943 - DNA, 25 bp, S. cerevisiae
gtgggagacccagatgacttgaatt

SEQ ID NO: 44944 - DNA, 25 bp, S. cerevisiae
gtgggatactcctcagtcatttcat

SEQ ID NO: 44945 - DNA, 25 bp, S. cerevisiae
gtggttaaccattttgctaagccaa

SEQ ID NO: 44946 - DNA, 25 bp, S. cerevisiae
gtggtattaactcttcttacgccgt

SEQ ID NO: 44947 - DNA, 25 bp, S. cerevisiae
gtggtttaatcgttacattagctgt

SEQ ID NO: 44948 - DNA, 25 bp, S. cerevisiae
gtggtctctacaggatctgacatta

SEQ ID NO: 44949 - DNA, 25 bp, S. cerevisiae
gtggacacataaggacttcaaatag

SEQ ID NO: 44950 - DNA, 25 bp, S. cerevisiae
gtgggtcacttcgacctttacaaat

SEQ ID NO: 44951 - DNA, 25 bp, S. cerevisiae
gtggttggtgctgtcctattataca

SEQ ID NO: 44952 - DNA, 25 bp, S. cerevisiae
gtgtccacgactctgccgaaaaagg

SEQ ID NO: 44953 - DNA, 25 bp, S. cerevisiae
gtgtcttcagagttcatgctttcga

SEQ ID NO: 44954 - DNA, 25 bp, S. cerevisiae
gtggcaccaatgcaatgcttccgag

SEQ ID NO: 44955 - DNA, 25 bp, S. cerevisiae
gtggtccacacgatgcagcaataca

SEQ ID NO: 44956 - DNA, 25 bp, S. cerevisiae
gtgggccacgccaatatgctggaca

SEQ ID NO: 44957 - DNA, 25 bp, S. cerevisiae
gtgtgcatgggccttttttacaaat

SEQ ID NO: 44958 - DNA, 25 bp, S. cerevisiae
gtgtgcagtttcatgttctttcaaa

SEQ ID NO: 44959 - DNA, 25 bp, S. cerevisiae
gtgtctcttctcctatatctttaca

SEQ ID NO: 44960 - DNA, 25 bp, S. cerevisiae
gtggcttaccaactaccaaaggatt

SEQ ID NO: 44961 - DNA, 25 bp, S. cerevisiae
gtggctgaaccagtaacggaagcta

SEQ ID NO: 44962 - DNA, 25 bp, S. cerevisiae
gtggtagcactacaactggtactat

SEQ ID NO: 44963 - DNA, 25 bp, S. cerevisiae
gtggacacctatggtacagctacaa

SEQ ID NO: 44964 - DNA, 25 bp, S. cerevisiae
gtggtatttcagagcgtcgattcat

SEQ ID NO: 44965 - DNA, 25 bp, S. cerevisiae
gtggtacctcacaagctattgttta

SEQ ID NO: 44966 - DNA, 25 bp, S. cerevisiae
gtggatctattgtttccccattagt

SEQ ID NO: 44967 - DNA, 25 bp, S. cerevisiae
gtggatgtttgtactaacgcattcc

SEQ ID NO: 44968 - DNA, 25 bp, S. cerevisiae
gtggtatcatttggcttctgcagca

SEQ ID NO: 44969 - DNA, 25 bp, S. cerevisiae
gtgtccatcatattggcgctcgtat

SEQ ID NO: 44970 - DNA, 25 bp, S. cerevisiae
gtggctccaggacagacctgtctgc

SEQ ID NO: 44971 - DNA, 25 bp, S. cerevisiae
gtgggtacacattcacagtacttgc

SEQ ID NO: 44972 - DNA, 25 bp, S. cerevisiae
gtgggcttcacaattcggatcatca

SEQ ID NO: 44973 - DNA, 25 bp, S. cerevisiae
gtgtcgcttacttttgacagcacat

SEQ ID NO: 44974 - DNA, 25 bp, S. cerevisiae
gtgtcgatcgcgtttatgttcatag

SEQ ID NO: 44975 - DNA, 25 bp, S. cerevisiae
gtgtctggctttagtaatcatcata

SEQ ID NO: 44976 - DNA, 25 bp, S. cerevisiae
gtggtctccaattatctttcctttg

SEQ ID NO: 44977 - DNA, 25 bp, S. cerevisiae
gtggttccataatcaaatgacttcg

SEQ ID NO: 44978 - DNA, 25 bp, S. cerevisiae
gtggtctctccatacgattataatc

SEQ ID NO: 44979 - DNA, 25 bp, S. cerevisiae
gtggttcggccataagctgtatact

SEQ ID NO: 44980 - DNA, 25 bp, S. cerevisiae
gtgtcctccgcaaaatcagctgttt

SEQ ID NO: 44981 - DNA, 25 bp, S. cerevisiae
gtggagcgctcgataatccgtttga

SEQ ID NO: 44982 - DNA, 25 bp, S. cerevisiae
gtggcgctagctactacaaccttag

SEQ ID NO: 44983 - DNA, 25 bp, S. cerevisiae
gggcctactgtcgttacctaattga

SEQ ID NO: 44984 - DNA, 25 bp, S. cerevisiae
gggccaaggcaagatcccagtttga

SEQ ID NO: 44985 - DNA, 25 bp, S. cerevisiae
gggacattggcatcaagtttcaagc

SEQ ID NO: 44986 - DNA, 25 bp, S. cerevisiae
gtggtcattggagtgcgacttctaa

SEQ ID NO: 44987 - DNA, 25 bp, S. cerevisiae
gtgtgctcatttacagaactgctcg

SEQ ID NO: 44988 - DNA, 25 bp, S. cerevisiae
gtggtaatcgcattagtactggcgt

SEQ ID NO: 44989 - DNA, 25 bp, S. cerevisiae
gtgtctacaagttcaggtgctgcgg

SEQ ID NO: 44990 - DNA, 25 bp, S. cerevisiae
gtgtgaaacaattcgcgtcgcgtgg

SEQ ID NO: 44991 - DNA, 25 bp, S. cerevisiae
gtggccaagaatcctcagacggtgc

SEQ ID NO: 44992 - DNA, 25 bp, S. cerevisiae
gtggccaaggattctgacgggctca

SEQ ID NO: 44993 - DNA, 25 bp, S. cerevisiae
gtggcccatttattgacgtgcgtga

SEQ ID NO: 44994 - DNA, 25 bp, S. cerevisiae
gtggttctggaactactggagcttc

SEQ ID NO: 44995 - DNA, 25 bp, S. cerevisiae
gggctggcttcattgctacatggtc

SEQ ID NO: 44996 - DNA, 25 bp, S. cerevisiae
gtggtggcttaattggctgatgaat

SEQ ID NO: 44997 - DNA, 25 bp, S. cerevisiae
gtgtctcaattcactttgatggcaa

SEQ ID NO: 44998 - DNA, 25 bp, S. cerevisiae
gtgggattctcattcatgctcatgc

SEQ ID NO: 44999 - DNA, 25 bp, S. cerevisiae
gtggtgccgcgaacagtagtgctaa

SEQ ID NO: 45000 - DNA, 25 bp, S. cerevisiae
gtggcccctgtaagatgatgcaacc

SEQ ID NO: 45001 - DNA, 25 bp, S. cerevisiae
gggcagcttgcctaaggatgttaaa

SEQ ID NO: 45002 - DNA, 25 bp, S. cerevisiae
gtggctttcccattagtgggttgct

SEQ ID NO: 45003 - DNA, 25 bp, S. cerevisiae
gtggttctcttttaatggctgtagc

SEQ ID NO: 45004 - DNA, 25 bp, S. cerevisiae
gggccagctgccagaaatggtgtca

SEQ ID NO: 45005 - DNA, 25 bp, S. cerevisiae
gggccaaggtcgtcaaggattcaat

SEQ ID NO: 45006 - DNA, 25 bp, S. cerevisiae
gggccaaagtcatacgtcaaccaat

SEQ ID NO: 45007 - DNA, 25 bp, S. cerevisiae
gggccagaagtaccgttatcacctt

SEQ ID NO: 45008 - DNA, 25 bp, S. cerevisiae
gggctctttgaaccgttcaacgtga

SEQ ID NO: 45009 - DNA, 25 bp, S. cerevisiae
tgttccccgacaatgttaagtggtt

SEQ ID NO: 45010 - DNA, 25 bp, S. cerevisiae
gtggtgccatccctgacaaaggaag

SEQ ID NO: 45011 - DNA, 25 bp, S. cerevisiae
gggagacagctcctaacaccaagca

SEQ ID NO: 45012 - DNA, 25 bp, S. cerevisiae
ggtgatgacactcgcaggacactca

SEQ ID NO: 45013 - DNA, 25 bp, S. cerevisiae
gtgtgcactacatgcggagaatcat

SEQ ID NO: 45014 - DNA, 25 bp, S. cerevisiae
gggcacattcattgcagagacgcat

SEQ ID NO: 45015 - DNA, 25 bp, S. cerevisiae
gtgtgcactgtgacgctatgtatcc

SEQ ID NO: 45016 - DNA, 25 bp, S. cerevisiae
gtggcagccccaatgcagggaacag

SEQ ID NO: 45017 - DNA, 25 bp, S. cerevisiae
gtggagtcaactacagatgcagaat

SEQ ID NO: 45018 - DNA, 25 bp, S. cerevisiae
gtgtgagctgccttaccagatgatt

SEQ ID NO: 45019 - DNA, 25 bp, S. cerevisiae
gtggctaagatcaacgacctctgtg

SEQ ID NO: 45020 - DNA, 25 bp, S. cerevisiae
gtgggatccatctttgaacttttac

SEQ ID NO: 45021 - DNA, 25 bp, S. cerevisiae
gtggctgatccaaactacaaattta

SEQ ID NO: 45022 - DNA, 25 bp, S. cerevisiae
gtggcgttcccatttcgaatttagt

SEQ ID NO: 45023 - DNA, 25 bp, S. cerevisiae
gggcgccttccaaaaacattcaaat

SEQ ID NO: 45024 - DNA, 25 bp, S. cerevisiae
gtggcgccatcactcatggaaattt

SEQ ID NO: 45025 - DNA, 25 bp, S. cerevisiae
gtggcgacatgctcgtcaaattgta

SEQ ID NO: 45026 - DNA, 25 bp, S. cerevisiae
gtggtgaagcttggtctctttgtaa

SEQ ID NO: 45027 - DNA, 25 bp, S. cerevisiae
gtggtctggctatggatcttcgtaa

SEQ ID NO: 45028 - DNA, 25 bp, S. cerevisiae
gggactggccaactcaattgcttag

SEQ ID NO: 45029 - DNA, 25 bp, S. cerevisiae
gtgggtatccaagaagtgcatcata

SEQ ID NO: 45030 - DNA, 25 bp, S. cerevisiae
gtggtggtccaaaccatatggctaa

SEQ ID NO: 45031 - DNA, 25 bp, S. cerevisiae
gtggtcttaagaacacatacctaat

SEQ ID NO: 45032 - DNA, 25 bp, S. cerevisiae
gggccacccagcgtgatttaaatta

SEQ ID NO: 45033 - DNA, 25 bp, S. cerevisiae
gggccaatgcggctgttgataataa

SEQ ID NO: 45034 - DNA, 25 bp, S. cerevisiae
gtggcagagacgtggatttcccgca

SEQ ID NO: 45035 - DNA, 25 bp, S. cerevisiae
gtggcagacctagtgaatcttcccg

SEQ ID NO: 45036 - DNA, 25 bp, S. cerevisiae
gtgtgaagcacctgaatccaatcca

SEQ ID NO: 45037 - DNA, 25 bp, S. cerevisiae
gtgtgacaaccgcaaagccatcttc

SEQ ID NO: 45038 - DNA, 25 bp, S. cerevisiae
gtggcgacaccgcaagacagtatgt

SEQ ID NO: 45039 - DNA, 25 bp, S. cerevisiae
gtggctgccccgcaagaagattgat

SEQ ID NO: 45040 - DNA, 25 bp, S. cerevisiae
gtggctgccgctggtgaagaaattt

SEQ ID NO: 45041 - DNA, 25 bp, S. cerevisiae
gtgggccttaggtgtcatactatac

SEQ ID NO: 45042 - DNA, 25 bp, S. cerevisiae
gtgggccatctagacggcatagaca

SEQ ID NO: 45043 - DNA, 25 bp, S. cerevisiae
gtggtgaactacttcggctcaagaa

SEQ ID NO: 45044 - DNA, 25 bp, S. cerevisiae
gtggcgacaatacccgttgacagta

SEQ ID NO: 45045 - DNA, 25 bp, S. cerevisiae
gtggtcaattgggtcttttcgctct

SEQ ID NO: 45046 - DNA, 25 bp, S. cerevisiae
gtggtatcagggttcttatatccat

SEQ ID NO: 45047 - DNA, 25 bp, S. cerevisiae
gtggaagacggtgcgcttgttacaa

SEQ ID NO: 45048 - DNA, 25 bp, S. cerevisiae
gtggatttagtgaccttttccaaga

SEQ ID NO: 45049 - DNA, 25 bp, S. cerevisiae
gtggtcttgcattaattctttccaa

SEQ ID NO: 45050 - DNA, 25 bp, S. cerevisiae
gtggtggtttgacttcgattccgaa

SEQ ID NO: 45051 - DNA, 25 bp, S. cerevisiae
gtggtggtttgactgtgtactctcc

SEQ ID NO: 45052 - DNA, 25 bp, S. cerevisiae
gggctggtgttgatgcttcccaacc

SEQ ID NO: 45053 - DNA, 25 bp, S. cerevisiae
gtgtgttcgtgtaacttcctctaca

SEQ ID NO: 45054 - DNA, 25 bp, S. cerevisiae
gtggtctatttgcagctgacgctaa

SEQ ID NO: 45055 - DNA, 25 bp, S. cerevisiae
gtggttcgatagtcactccattgga

SEQ ID NO: 45056 - DNA, 25 bp, S. cerevisiae
gtggtcttgcattgaactccttcga

SEQ ID NO: 45057 - DNA, 25 bp, S. cerevisiae
gtgggttgttgtatctcttgctaca

SEQ ID NO: 45058 - DNA, 25 bp, S. cerevisiae
gtggtggttgcactactaccgaaaa

SEQ ID NO: 45059 - DNA, 25 bp, S. cerevisiae
gtggtcacttgcctttcaccaaaaa

SEQ ID NO: 45060 - DNA, 25 bp, S. cerevisiae
gtgggctatcgagaagcaccaactt

SEQ ID NO: 45061 - DNA, 25 bp, S. cerevisiae
ggcgttgtgtcccaagaccaactaa

SEQ ID NO: 45062 - DNA, 25 bp, S. cerevisiae
gtggttattctcaggtccaatctaa

SEQ ID NO: 45063 - DNA, 25 bp, S. cerevisiae
gggagcattattacggttcgtcaag

SEQ ID NO: 45064 - DNA, 25 bp, S. cerevisiae
gggccagttaatccgttgcgtcgaa

SEQ ID NO: 45065 - DNA, 25 bp, S. cerevisiae
tgtgcgccagttgttgggtcccgaa

SEQ ID NO: 45066 - DNA, 25 bp, S. cerevisiae
gtggccagtgttgttttgcccgaaa

SEQ ID NO: 45067 - DNA, 25 bp, S. cerevisiae
gtggtgtgtacccaattacagtcga

SEQ ID NO: 45068 - DNA, 25 bp, S. cerevisiae
gtgggttcactccaattttgttcaa

SEQ ID NO: 45069 - DNA, 25 bp, S. cerevisiae
gtgggattcctagacgcattataca

SEQ ID NO: 45070 - DNA, 25 bp, S. cerevisiae
gggccggccaacaatcgcgtataca

SEQ ID NO: 45071 - DNA, 25 bp, S. cerevisiae
gggccaaacggcaactccaatacaa

SEQ ID NO: 45072 - DNA, 25 bp, S. cerevisiae
gggcggtacgagatcacgtattcaa

SEQ ID NO: 45073 - DNA, 25 bp, S. cerevisiae
gggcctaacagatttgaccttctca

SEQ ID NO: 45074 - DNA, 25 bp, S. cerevisiae
gggcctacacagtgaaccgttagat

SEQ ID NO: 45075 - DNA, 25 bp, S. cerevisiae
gggcctcaaacacaaacgattctaa

SEQ ID NO: 45076 - DNA, 25 bp, S. cerevisiae
gggcctatggcacaaaggtcaccaa

SEQ ID NO: 45077 - DNA, 25 bp, S. cerevisiae
gggcctcagccattaaaggtagtga

SEQ ID NO: 45078 - DNA, 25 bp, S. cerevisiae
gggcccacaagattccacgatagat

SEQ ID NO: 45079 - DNA, 25 bp, S. cerevisiae
gtgggcactcaataccatccagagt

SEQ ID NO: 45080 - DNA, 25 bp, S. cerevisiae
gtggtcggcacagtcaagaaagtct

SEQ ID NO: 45081 - DNA, 25 bp, S. cerevisiae
gtggtcaccacacctcaggaagtag

SEQ ID NO: 45082 - DNA, 25 bp, S. cerevisiae
gtgggcactataccgcgtacgtaaa

SEQ ID NO: 45083 - DNA, 25 bp, S. cerevisiae
gtggcatctttcatcgcaggaactg

SEQ ID NO: 45084 - DNA, 25 bp, S. cerevisiae
gtggaaattcgatactctgtgtgat

SEQ ID NO: 45085 - DNA, 25 bp, S. cerevisiae
gtggactatgtcattatcggtggta

SEQ ID NO: 45086 - DNA, 25 bp, S. cerevisiae
gggcctcagtcaagataccagggta

SEQ ID NO: 45087 - DNA, 25 bp, S. cerevisiae
gtggcccagctggatatcactcaag

SEQ ID NO: 45088 - DNA, 25 bp, S. cerevisiae
gtggatccagctgtaccattatgta

SEQ ID NO: 45089 - DNA, 25 bp, S. cerevisiae
gtggatagcactttgaacttcagta

SEQ ID NO: 45090 - DNA, 25 bp, S. cerevisiae
gtggatctactattgatactactgt

SEQ ID NO: 45091 - DNA, 25 bp, S. cerevisiae
gtggtgcttcttatagcgccttagc

SEQ ID NO: 45092 - DNA, 25 bp, S. cerevisiae
gtgggcttgatgtttacgcacataa

SEQ ID NO: 45093 - DNA, 25 bp, S. cerevisiae
gtggcatttgtgtgtagcccaataa

SEQ ID NO: 45094 - DNA, 25 bp, S. cerevisiae
gtggcttttcaccaacgcttataaa

SEQ ID NO: 45095 - DNA, 25 bp, S. cerevisiae
gtggatccaacaactttgaccgaag

SEQ ID NO: 45096 - DNA, 25 bp, S. cerevisiae
gtggaacttggtggtggctcaacaa

SEQ ID NO: 45097 - DNA, 25 bp, S. cerevisiae
gtgggacctcaatagctacaaagat

SEQ ID NO: 45098 - DNA, 25 bp, S. cerevisiae
gggcactttctataacctttacgat

SEQ ID NO: 45099 - DNA, 25 bp, S. cerevisiae
gtggcaacctccgaactatttaaag

SEQ ID NO: 45100 - DNA, 25 bp, S. cerevisiae
gggcccattcccacaatgaagaaaa

SEQ ID NO: 45101 - DNA, 25 bp, S. cerevisiae
gggcttttggtcactgcaacttata

SEQ ID NO: 45102 - DNA, 25 bp, S. cerevisiae
gggctgtttggtcttcatgttcttc

SEQ ID NO: 45103 - DNA, 25 bp, S. cerevisiae
gtggtgttatcttagtttttattct

SEQ ID NO: 45104 - DNA, 25 bp, S. cerevisiae
gtggttctatcttggcttctttgac

SEQ ID NO: 45105 - DNA, 25 bp, S. cerevisiae
gtggcgtttccagattaagtgactt

SEQ ID NO: 45106 - DNA, 25 bp, S. cerevisiae
gggcgttgtacctattaaagacgtg

SEQ ID NO: 45107 - DNA, 25 bp, S. cerevisiae
gggcccagtgaccatgtgctaaacg

SEQ ID NO: 45108 - DNA, 25 bp, S. cerevisiae
gggcgctgacaaaatgtccgcatgt

SEQ ID NO: 45109 - DNA, 25 bp, S. cerevisiae
gtggcggacattacttcgacattat

SEQ ID NO: 45110 - DNA, 25 bp, S. cerevisiae
gtggcttaatgaccttctacttatg

SEQ ID NO: 45111 - DNA, 25 bp, S. cerevisiae
gtggctgaatgaactatcctacgca

SEQ ID NO: 45112 - DNA, 25 bp, S. cerevisiae
gtggagcaagcggtgttcaacaaat

SEQ ID NO: 45113 - DNA, 25 bp, S. cerevisiae
gtggcaaaattttctatccctgaag

SEQ ID NO: 45114 - DNA, 25 bp, S. cerevisiae
gtggtaatttactccactctaaatc

SEQ ID NO: 45115 - DNA, 25 bp, S. cerevisiae
gggaaatgttactcgaccaagccta

SEQ ID NO: 45116 - DNA, 25 bp, S. cerevisiae
gggcacggtttaccttacaagccat

SEQ ID NO: 45117 - DNA, 25 bp, S. cerevisiae
gtggtatggctttcaccttcaagaa

SEQ ID NO: 45118 - DNA, 25 bp, S. cerevisiae
gtggtgcaagcttacatcagattaa

SEQ ID NO: 45119 - DNA, 25 bp, S. cerevisiae
gggcgttattgcctcgacaatgcaa

SEQ ID NO: 45120 - DNA, 25 bp, S. cerevisiae
gggccttgtcgccaatgaacacaaa

SEQ ID NO: 45121 - DNA, 25 bp, S. cerevisiae
gggcgctgttgacattgaaaatgaa

SEQ ID NO: 45122 - DNA, 25 bp, S. cerevisiae
gtggtggctgagactttaaaagaca

SEQ ID NO: 45123 - DNA, 25 bp, S. cerevisiae
gggcggcaacattccggaatctgaa

SEQ ID NO: 45124 - DNA, 25 bp, S. cerevisiae
gtggtggtaagctcgtgcaacataa

SEQ ID NO: 45125 - DNA, 25 bp, S. cerevisiae
gtggtcgtcaaatgcgtgttctagc

SEQ ID NO: 45126 - DNA, 25 bp, S. cerevisiae
gtggatggtcatatcggcgctttaa

SEQ ID NO: 45127 - DNA, 25 bp, S. cerevisiae
gtgggtgccacgattgattctaaga

SEQ ID NO: 45128 - DNA, 25 bp, S. cerevisiae
gtgggtctaagaacgcttcttcgaa

SEQ ID NO: 45129 - DNA, 25 bp, S. cerevisiae
gtggcgtttaattcatttttctata

SEQ ID NO: 45130 - DNA, 25 bp, S. cerevisiae
gtggtttacactgtgtgtccagcat

SEQ ID NO: 45131 - DNA, 25 bp, S. cerevisiae
gtggtgtcttatctttcggtgtaaa

SEQ ID NO: 45132 - DNA, 25 bp, S. cerevisiae
gtggtcagcgacttctttcaaggta

SEQ ID NO: 45133 - DNA, 25 bp, S. cerevisiae
gtggattcgcgctattatttaacta

SEQ ID NO: 45134 - DNA, 25 bp, S. cerevisiae
gtggatgttcacttggttctacaat

SEQ ID NO: 45135 - DNA, 25 bp, S. cerevisiae
gtggtgtcactattggatttcacat

SEQ ID NO: 45136 - DNA, 25 bp, S. cerevisiae
gggttacaggttgatatcgaccagt

SEQ ID NO: 45137 - DNA, 25 bp, S. cerevisiae
gtggttacatgcctatctatacgaa

SEQ ID NO: 45138 - DNA, 25 bp, S. cerevisiae
gtggattacagactatattccgaat

SEQ ID NO: 45139 - DNA, 25 bp, S. cerevisiae
gtggactgacactattttcacgtat

SEQ ID NO: 45140 - DNA, 25 bp, S. cerevisiae
gtggactccatcgaattatcagcct

SEQ ID NO: 45141 - DNA, 25 bp, S. cerevisiae
gtggttcttcctattctggatgttc

SEQ ID NO: 45142 - DNA, 25 bp, S. cerevisiae
gtggtgtcaagcgtatttctggttt

SEQ ID NO: 45143 - DNA, 25 bp, S. cerevisiae
gtggtccaaggtatagactcttcct

SEQ ID NO: 45144 - DNA, 25 bp, S. cerevisiae
gggcgtgtatcattgccacagaaat

SEQ ID NO: 45145 - DNA, 25 bp, S. cerevisiae
gtggcaatgccaccgctgaagaaag

SEQ ID NO: 45146 - DNA, 25 bp, S. cerevisiae
gtggccagcaacatcgacatcataa

SEQ ID NO: 45147 - DNA, 25 bp, S. cerevisiae
gtggtgctccagaaggcgcagctcc

SEQ ID NO: 45148 - DNA, 25 bp, S. cerevisiae
gtggccacaatgaagggcattccca

SEQ ID NO: 45149 - DNA, 25 bp, S. cerevisiae
gtggacttcaagttcatcgggatat

SEQ ID NO: 45150 - DNA, 25 bp, S. cerevisiae
gtggccattacacgtcactggtgaa

SEQ ID NO: 45151 - DNA, 25 bp, S. cerevisiae
gtggctttaccaccaggttctaatt

SEQ ID NO: 45152 - DNA, 25 bp, S. cerevisiae
gtggtttatcgacgcgttaacacag

SEQ ID NO: 45153 - DNA, 25 bp, S. cerevisiae
gtggtatctactccgtcttaaacaa

SEQ ID NO: 45154 - DNA, 25 bp, S. cerevisiae
gggcttcgagttggtttcaaacaat

SEQ ID NO: 45155 - DNA, 25 bp, S. cerevisiae
gtggccacatacttcatttgtcgtg

SEQ ID NO: 45156 - DNA, 25 bp, S. cerevisiae
gtggtaatgaccaatccttcggatt

SEQ ID NO: 45157 - DNA, 25 bp, S. cerevisiae
gtggtattaacaggcactctcgata

SEQ ID NO: 45158 - DNA, 25 bp, S. cerevisiae
gtggtactacatatacccgttccac

SEQ ID NO: 45159 - DNA, 25 bp, S. cerevisiae
gggcgcacatgtacctccagaaaag

SEQ ID NO: 45160 - DNA, 25 bp, S. cerevisiae
gggccatattttccacagggataca

SEQ ID NO: 45161 - DNA, 25 bp, S. cerevisiae
gggcagtggtttcaaggtatctctt

SEQ ID NO: 45162 - DNA, 25 bp, S. cerevisiae
gggctccagctaccatcgaagaaga

SEQ ID NO: 45163 - DNA, 25 bp, S. cerevisiae
gggtcccaccttctaggagaggtat

SEQ ID NO: 45164 - DNA, 25 bp, S. cerevisiae
gggtcccaccttctaggagaggtat

SEQ ID NO: 45165 - DNA, 25 bp, S. cerevisiae
gggtccttcctgaggaaagcggcta

SEQ ID NO: 45166 - DNA, 25 bp, S. cerevisiae
gggatcacctttctgcgaagttgga

SEQ ID NO: 45167 - DNA, 25 bp, S. cerevisiae
ggaatccgtcggtatcgaaatcgaa

SEQ ID NO: 45168 - DNA, 25 bp, S. cerevisiae
gggcgcccagtctagtgacgacaaa

SEQ ID NO: 45169 - DNA, 25 bp, S. cerevisiae
gggcgtggcaactgtcgtgactaaa

SEQ ID NO: 45170 - DNA, 25 bp, S. cerevisiae
gggcggattactaccgttgctaaat

SEQ ID NO: 45171 - DNA, 25 bp, S. cerevisiae
gggcggctgtacatcgtttggatac

SEQ ID NO: 45172 - DNA, 25 bp, S. cerevisiae
gggcgtcagcgtctcttttgtaagc

SEQ ID NO: 45173 - DNA, 25 bp, S. cerevisiae
gtggctcacagattcgacattttat

SEQ ID NO: 45174 - DNA, 25 bp, S. cerevisiae
gtggatccgcagcttattgctaatg

SEQ ID NO: 45175 - DNA, 25 bp, S. cerevisiae
gtggcttctgcgtgtactgatgaca

SEQ ID NO: 45176 - DNA, 25 bp, S. cerevisiae
gtggatgcgctatccttgatctact

SEQ ID NO: 45177 - DNA, 25 bp, S. cerevisiae
gtggcgctggaaacataatttctcc

SEQ ID NO: 45178 - DNA, 25 bp, S. cerevisiae
gtggccgggcatgtattaaatatat

SEQ ID NO: 45179 - DNA, 25 bp, S. cerevisiae
gggccagggtcaagttcaatatttt

SEQ ID NO: 45180 - DNA, 25 bp, S. cerevisiae
gggcccggtttaagaatggactcat

SEQ ID NO: 45181 - DNA, 25 bp, S. cerevisiae
ggccgaccggatggaagcttcgtta

SEQ ID NO: 45182 - DNA, 25 bp, S. cerevisiae
gtggcacccggacaaacatcgttat

SEQ ID NO: 45183 - DNA, 25 bp, S. cerevisiae
gtggcgttcccactaattaacattt

SEQ ID NO: 45184 - DNA, 25 bp, S. cerevisiae
gggcggtcaggtaaagctatcacat

SEQ ID NO: 45185 - DNA, 25 bp, S. cerevisiae
gtggcgagacgggtattcaatcatt

SEQ ID NO: 45186 - DNA, 25 bp, S. cerevisiae
gggcgtcacagaccttgatgaagct

SEQ ID NO: 45187 - DNA, 25 bp, S. cerevisiae
gtggagcatcgacctcattgaaagt

SEQ ID NO: 45188 - DNA, 25 bp, S. cerevisiae
gggcagctcgaccacatatatgcta

SEQ ID NO: 45189 - DNA, 25 bp, S. cerevisiae
gggcccgtcaatcgcttgatttgga

SEQ ID NO: 45190 - DNA, 25 bp, S. cerevisiae
gggcgcaggtaatgtcgatatctct

SEQ ID NO: 45191 - DNA, 25 bp, S. cerevisiae
gtggccggtcaacttcagtatgcct

SEQ ID NO: 45192 - DNA, 25 bp, S. cerevisiae
gggccggtcattctatgatacttca

SEQ ID NO: 45193 - DNA, 25 bp, S. cerevisiae
gtggccacgtttcccaatacatgga

SEQ ID NO: 45194 - DNA, 25 bp, S. cerevisiae
gggccattctggttctaaatcaggt

SEQ ID NO: 45195 - DNA, 25 bp, S. cerevisiae
ggtcctctaggctgcaacaagactt

SEQ ID NO: 45196 - DNA, 25 bp, S. cerevisiae
ggtctttagccactcgacaacaatt

SEQ ID NO: 45197 - DNA, 25 bp, S. cerevisiae
ggcgaacaaactccagttactcgta

SEQ ID NO: 45198 - DNA, 25 bp, S. cerevisiae
gggcgagaatccaaagattacttta

SEQ ID NO: 45199 - DNA, 25 bp, S. cerevisiae
gggcgaatccttcaattatctggta

SEQ ID NO: 45200 - DNA, 25 bp, S. cerevisiae
gggcgactatctgctaattactgag

SEQ ID NO: 45201 - DNA, 25 bp, S. cerevisiae
gggcgaaacacctcatctgttgtga

SEQ ID NO: 45202 - DNA, 25 bp, S. cerevisiae
gtggtaaagccttcgctcagtttaa

SEQ ID NO: 45203 - DNA, 25 bp, S. cerevisiae
gtggatctttcgttcagtttggtaa

SEQ ID NO: 45204 - DNA, 25 bp, S. cerevisiae
gtggtttgtcgcttctatttgtata

SEQ ID NO: 45205 - DNA, 25 bp, S. cerevisiae
gtggcatatactacattaactttca

SEQ ID NO: 45206 - DNA, 25 bp, S. cerevisiae
ggtctaactgacactactgttccaa

SEQ ID NO: 45207 - DNA, 25 bp, S. cerevisiae
gggctaaaactgtctattattctaa

SEQ ID NO: 45208 - DNA, 25 bp, S. cerevisiae
gggccacaagacatgtttattatat

SEQ ID NO: 45209 - DNA, 25 bp, S. cerevisiae
gtggaagccgtgaccaacaaactgg

SEQ ID NO: 45210 - DNA, 25 bp, S. cerevisiae
gtggaaccggattacaaagcgctga

SEQ ID NO: 45211 - DNA, 25 bp, S. cerevisiae
ggatgaacccgtcactaaggaaatt

SEQ ID NO: 45212 - DNA, 25 bp, S. cerevisiae
gggtaacacctatcaacctagtaca

SEQ ID NO: 45213 - DNA, 25 bp, S. cerevisiae
gtggtatttccatcacaaacacagt

SEQ ID NO: 45214 - DNA, 25 bp, S. cerevisiae
gtggaacctcgaacctcaggaatct

SEQ ID NO: 45215 - DNA, 25 bp, S. cerevisiae
gggaagaattaacacctggtcactg

SEQ ID NO: 45216 - DNA, 25 bp, S. cerevisiae
gggactaaatcccaacttatgtcgt

SEQ ID NO: 45217 - DNA, 25 bp, S. cerevisiae
gggaataacaccaccgatatacagt

SEQ ID NO: 45218 - DNA, 25 bp, S. cerevisiae
gggacaaattcgcagtcaacctttt

SEQ ID NO: 45219 - DNA, 25 bp, S. cerevisiae
gggaacacaccggagtacacgcctg

SEQ ID NO: 45220 - DNA, 25 bp, S. cerevisiae
gtggaaacaccagcagacctgcaat

SEQ ID NO: 45221 - DNA, 25 bp, S. cerevisiae
gggagacaaatcacacatcctgttc

SEQ ID NO: 45222 - DNA, 25 bp, S. cerevisiae
gggaacttatctccagactgtgtcc

SEQ ID NO: 45223 - DNA, 25 bp, S. cerevisiae
gtggttctctctcattgttataggc

SEQ ID NO: 45224 - DNA, 25 bp, S. cerevisiae
gtggatggtttactttctaccaaga

SEQ ID NO: 45225 - DNA, 25 bp, S. cerevisiae
gtggattttgccatttctaaagagc

SEQ ID NO: 45226 - DNA, 25 bp, S. cerevisiae
gtggtattgctgctatctgtcaaaa

SEQ ID NO: 45227 - DNA, 25 bp, S. cerevisiae
gtggattctgattcaccagctgtac

SEQ ID NO: 45228 - DNA, 25 bp, S. cerevisiae
gtggattgccagatcttggttcttt

SEQ ID NO: 45229 - DNA, 25 bp, S. cerevisiae
gtggattccaagtcctacattcatc

SEQ ID NO: 45230 - DNA, 25 bp, S. cerevisiae
gtggagatcacttctttgcctaatc

SEQ ID NO: 45231 - DNA, 25 bp, S. cerevisiae
gtggagttcttccttcatttacgaa

SEQ ID NO: 45232 - DNA, 25 bp, S. cerevisiae
gtggacttccatttcctatatgacg

SEQ ID NO: 45233 - DNA, 25 bp, S. cerevisiae
gggcgagatattcatccgctgcaat

SEQ ID NO: 45234 - DNA, 25 bp, S. cerevisiae
gggctatgaaagcaccagctgtaca

SEQ ID NO: 45235 - DNA, 25 bp, S. cerevisiae
gtggccgaaagcaactctgccgtaa

SEQ ID NO: 45236 - DNA, 25 bp, S. cerevisiae
gggtctagacgaacctgccgagaat

SEQ ID NO: 45237 - DNA, 25 bp, S. cerevisiae
gtggttcagacaacaccctagagtt

SEQ ID NO: 45238 - DNA, 25 bp, S. cerevisiae
gtggatctgaaggtttgctcaatat

SEQ ID NO: 45239 - DNA, 25 bp, S. cerevisiae
gtggactatcacctgttctaaattc

SEQ ID NO: 45240 - DNA, 25 bp, S. cerevisiae
gtggaagacacgatatctgaaagac

SEQ ID NO: 45241 - DNA, 25 bp, S. cerevisiae
gtggaatccagcgttgttagactag

SEQ ID NO: 45242 - DNA, 25 bp, S. cerevisiae
gtggattccatcgatttgcacgaaa

SEQ ID NO: 45243 - DNA, 25 bp, S. cerevisiae
gtggcgtacgatattgctccttgaa

SEQ ID NO: 45244 - DNA, 25 bp, S. cerevisiae
gtggctgtacgcaatttctcttatc

SEQ ID NO: 45245 - DNA, 25 bp, S. cerevisiae
gtggcttcacaattatactttcaaa

SEQ ID NO: 45246 - DNA, 25 bp, S. cerevisiae
gtggatcagcactcttacatggtaa

SEQ ID NO: 45247 - DNA, 25 bp, S. cerevisiae
gtggaaccgctaaatctgctgtatt

SEQ ID NO: 45248 - DNA, 25 bp, S. cerevisiae
gtggatacttcctattgagaccttc

SEQ ID NO: 45249 - DNA, 25 bp, S. cerevisiae
gtggaatctttcttttcgtcaagca

SEQ ID NO: 45250 - DNA, 25 bp, S. cerevisiae
gtggatcctcagtttgatccttcta

SEQ ID NO: 45251 - DNA, 25 bp, S. cerevisiae
gggcttctattacttggcggaacgt

SEQ ID NO: 45252 - DNA, 25 bp, S. cerevisiae
gggctgtccatttttatgcgaagtc

SEQ ID NO: 45253 - DNA, 25 bp, S. cerevisiae
gggcttactatttcccattcaagtt

SEQ ID NO: 45254 - DNA, 25 bp, S. cerevisiae
gggctaagaatttcgtgtcacaaat

SEQ ID NO: 45255 - DNA, 25 bp, S. cerevisiae
gggctggagaaacctgtatcgaaac

SEQ ID NO: 45256 - DNA, 25 bp, S. cerevisiae
ggcaccccaaagcttacttgaaaca

SEQ ID NO: 45257 - DNA, 25 bp, S. cerevisiae
gggcacccagaccaagtgacttaaa

SEQ ID NO: 45258 - DNA, 25 bp, S. cerevisiae
gtggagcccaattttgtacaataca

SEQ ID NO: 45259 - DNA, 25 bp, S. cerevisiae
gtggcaacagtgctttgtggatatc

SEQ ID NO: 45260 - DNA, 25 bp, S. cerevisiae
gtggcaaagttcgtgtagcgctata

SEQ ID NO: 45261 - DNA, 25 bp, S. cerevisiae
gtggcacttctttgcaatgtgacaa

SEQ ID NO: 45262 - DNA, 25 bp, S. cerevisiae
gggctctccattccaatgtaacatc

SEQ ID NO: 45263 - DNA, 25 bp, S. cerevisiae
gggccccataagaaatacacctcat

SEQ ID NO: 45264 - DNA, 25 bp, S. cerevisiae
gggctgagccatatacaataaccat

SEQ ID NO: 45265 - DNA, 25 bp, S. cerevisiae
gggctacctactatatcgaccacta

SEQ ID NO: 45266 - DNA, 25 bp, S. cerevisiae
gggcctctgggtatacgttcgaatt

SEQ ID NO: 45267 - DNA, 25 bp, S. cerevisiae
gggccaagttttggatccctcggtg

SEQ ID NO: 45268 - DNA, 25 bp, S. cerevisiae
gtggacgattctgtagaccctttat

SEQ ID NO: 45269 - DNA, 25 bp, S. cerevisiae
gggaaatacttttacgatgccttag

SEQ ID NO: 45270 - DNA, 25 bp, S. cerevisiae
gggcaactacggattctatcctgtc

SEQ ID NO: 45271 - DNA, 25 bp, S. cerevisiae
gggaactgccacgttttccaagaat

SEQ ID NO: 45272 - DNA, 25 bp, S. cerevisiae
gggcatgagttacctttaccaaaat

SEQ ID NO: 45273 - DNA, 25 bp, S. cerevisiae
gtggcattattacatttacgacaac

SEQ ID NO: 45274 - DNA, 25 bp, S. cerevisiae
gggccctggagtgaggactacaatt

SEQ ID NO: 45275 - DNA, 25 bp, S. cerevisiae
gggccctgggatgattactctatta

SEQ ID NO: 45276 - DNA, 25 bp, S. cerevisiae
gtggcccatcgaatttgaaccaatt

SEQ ID NO: 45277 - DNA, 25 bp, S. cerevisiae
gtggctacagaatgggatcctgaat

SEQ ID NO: 45278 - DNA, 25 bp, S. cerevisiae
gggccagtgttagaatccagagagt

SEQ ID NO: 45279 - DNA, 25 bp, S. cerevisiae
gggccactagtaagaacagcaatgt

SEQ ID NO: 45280 - DNA, 25 bp, S. cerevisiae
gtggcaagtggcaatcatcaacgaa

SEQ ID NO: 45281 - DNA, 25 bp, S. cerevisiae
gtggagactgccaaggattctgaaa

SEQ ID NO: 45282 - DNA, 25 bp, S. cerevisiae
gggccgatcatcttctaacaaaagc

SEQ ID NO: 45283 - DNA, 25 bp, S. cerevisiae
gtggcaacattgtcagccatgacga

SEQ ID NO: 45284 - DNA, 25 bp, S. cerevisiae
gtggcacagattcaggcagagcttc

SEQ ID NO: 45285 - DNA, 25 bp, S. cerevisiae
gtggcacaattcaggcgccttggtg

SEQ ID NO: 45286 - DNA, 25 bp, S. cerevisiae
gtggacaatcctacgaactatttga

SEQ ID NO: 45287 - DNA, 25 bp, S. cerevisiae
gtggcgaacgcatttgcaatccata

SEQ ID NO: 45288 - DNA, 25 bp, S. cerevisiae
gggcgaagcctcagacagcagagaa

SEQ ID NO: 45289 - DNA, 25 bp, S. cerevisiae
gggccagccttatacagagacatat

SEQ ID NO: 45290 - DNA, 25 bp, S. cerevisiae
gtggccacctgttctaaagactgca

SEQ ID NO: 45291 - DNA, 25 bp, S. cerevisiae
gtggctccctttcgatttaatgaag

SEQ ID NO: 45292 - DNA, 25 bp, S. cerevisiae
gtggaccgctgttcagtgtttagaa

SEQ ID NO: 45293 - DNA, 25 bp, S. cerevisiae
gtggacctcctatttttgttgacaa

SEQ ID NO: 45294 - DNA, 25 bp, S. cerevisiae
gtggcctggcctattggtgttacta

SEQ ID NO: 45295 - DNA, 25 bp, S. cerevisiae
gtggctcttgttatctatggtttct

SEQ ID NO: 45296 - DNA, 25 bp, S. cerevisiae
gggccctgttgttaatgttgttcaa

SEQ ID NO: 45297 - DNA, 25 bp, S. cerevisiae
gggccaaggtgacacttctcaattt

SEQ ID NO: 45298 - DNA, 25 bp, S. cerevisiae
gggcacgatgttcgcgatgttccaa

SEQ ID NO: 45299 - DNA, 25 bp, S. cerevisiae
gggcccatttcccatgttaataata

SEQ ID NO: 45300 - DNA, 25 bp, S. cerevisiae
gggcccataaaccttcttgagacaa

SEQ ID NO: 45301 - DNA, 25 bp, S. cerevisiae
gggcgcattccctaatcatgatgta

SEQ ID NO: 45302 - DNA, 25 bp, S. cerevisiae
gggcatacccgtggatgatgctgaa

SEQ ID NO: 45303 - DNA, 25 bp, S. cerevisiae
gggcacacgcatagacaatccatga

SEQ ID NO: 45304 - DNA, 25 bp, S. cerevisiae
gggccaagaaactatccagaactca

SEQ ID NO: 45305 - DNA, 25 bp, S. cerevisiae
gggccagagaatcagctacgacatt

SEQ ID NO: 45306 - DNA, 25 bp, S. cerevisiae
gtggaagcacaaccgcaacagagca

SEQ ID NO: 45307 - DNA, 25 bp, S. cerevisiae
gtggaatcatcaaacgacttcttgg

SEQ ID NO: 45308 - DNA, 25 bp, S. cerevisiae
gggctcgatgattgctaatgactac

SEQ ID NO: 45309 - DNA, 25 bp, S. cerevisiae
gtggctctggacttgcattccataa

SEQ ID NO: 45310 - DNA, 25 bp, S. cerevisiae
gtggaatctgaatcggcatcacatt

SEQ ID NO: 45311 - DNA, 25 bp, S. cerevisiae
gtggcatttcaatcagcacttgatg

SEQ ID NO: 45312 - DNA, 25 bp, S. cerevisiae
gggcattcaacttcccgtgatgaat

SEQ ID NO: 45313 - DNA, 25 bp, S. cerevisiae
gggcatacacagaaccacgcttaca

SEQ ID NO: 45314 - DNA, 25 bp, S. cerevisiae
ggaagccttcgcaccaaaattagtt

SEQ ID NO: 45315 - DNA, 25 bp, S. cerevisiae
gtggcaacaccagccattgcaaagt

SEQ ID NO: 45316 - DNA, 25 bp, S. cerevisiae
gtggcacaaccatccatgcttataa

SEQ ID NO: 45317 - DNA, 25 bp, S. cerevisiae
gggccaatcgaagctctttgtcaag

SEQ ID NO: 45318 - DNA, 25 bp, S. cerevisiae
gggcctatcgaagcactatctgtgg

SEQ ID NO: 45319 - DNA, 25 bp, S. cerevisiae
gggcgcatatggatccgattctgat

SEQ ID NO: 45320 - DNA, 25 bp, S. cerevisiae
gtggcgctatgggacaatgctttat

SEQ ID NO: 45321 - DNA, 25 bp, S. cerevisiae
gggcatgctaaccaaactagctcat

SEQ ID NO: 45322 - DNA, 25 bp, S. cerevisiae
ggttgggacgcaaacgactactcta

SEQ ID NO: 45323 - DNA, 25 bp, S. cerevisiae
gggctatccatctgttaaggttgat

SEQ ID NO: 45324 - DNA, 25 bp, S. cerevisiae
ggtgattaccatcatttccactctc

SEQ ID NO: 45325 - DNA, 25 bp, S. cerevisiae
gggttcaggatcttttagactctcc

SEQ ID NO: 45326 - DNA, 25 bp, S. cerevisiae
gggctgacagcgttagattagactt

SEQ ID NO: 45327 - DNA, 25 bp, S. cerevisiae
gggcttggcgcattaagttacttaa

SEQ ID NO: 45328 - DNA, 25 bp, S. cerevisiae
gggctgtatggcgtagctttactta

SEQ ID NO: 45329 - DNA, 25 bp, S. cerevisiae
gggctcttggtgtgctactttatac

SEQ ID NO: 45330 - DNA, 25 bp, S. cerevisiae
gggctctgtcgaagaggcctttcaa

SEQ ID NO: 45331 - DNA, 25 bp, S. cerevisiae
gggccgtcagacacaccttatgaaa

SEQ ID NO: 45332 - DNA, 25 bp, S. cerevisiae
gggcggtcagccacttataatgaat

SEQ ID NO: 45333 - DNA, 25 bp, S. cerevisiae
gggctggtcatcgtttttcaagcaa

SEQ ID NO: 45334 - DNA, 25 bp, S. cerevisiae
gggaacccgtttgtgattctccact

SEQ ID NO: 45335 - DNA, 25 bp, S. cerevisiae
gggaacccgtatatttcagcttcac

SEQ ID NO: 45336 - DNA, 25 bp, S. cerevisiae
gggccgataatagtgtttctacgct

SEQ ID NO: 45337 - DNA, 25 bp, S. cerevisiae
gggcgcaatttgtgataactaccat

SEQ ID NO: 45338 - DNA, 25 bp, S. cerevisiae
gggcaaaattgccttacattcatcc

SEQ ID NO: 45339 - DNA, 25 bp, S. cerevisiae
gggctggaaatccttattgtcacca

SEQ ID NO: 45340 - DNA, 25 bp, S. cerevisiae
gggcgattacatcatttgttcctac

SEQ ID NO: 45341 - DNA, 25 bp, S. cerevisiae
gggcgacgacagaattttgatccat

SEQ ID NO: 45342 - DNA, 25 bp, S. cerevisiae
gtggaagtcagtcccattcaggtat

SEQ ID NO: 45343 - DNA, 25 bp, S. cerevisiae
gggcaggattgttccatccagcgaa

SEQ ID NO: 45344 - DNA, 25 bp, S. cerevisiae
gggaggctttgcaccgcgaatgaca

SEQ ID NO: 45345 - DNA, 25 bp, S. cerevisiae
gtggctatttcataccgcagacgac

SEQ ID NO: 45346 - DNA, 25 bp, S. cerevisiae
gggcgctatgttaattccaacctta

SEQ ID NO: 45347 - DNA, 25 bp, S. cerevisiae
gggcatgttggctaactccagcaca

SEQ ID NO: 45348 - DNA, 25 bp, S. cerevisiae
gtggcatattgggtgatcatcctcc

SEQ ID NO: 45349 - DNA, 25 bp, S. cerevisiae
gggcgacagagttattcttccattc

SEQ ID NO: 45350 - DNA, 25 bp, S. cerevisiae
gtggcgccaaatttatcccaattcc

SEQ ID NO: 45351 - DNA, 25 bp, S. cerevisiae
gggcctttgattattcatcagttta

SEQ ID NO: 45352 - DNA, 25 bp, S. cerevisiae
gggcgttatatttgatttactgtta

SEQ ID NO: 45353 - DNA, 25 bp, S. cerevisiae
gggcgatatcacttggttacctgtt

SEQ ID NO: 45354 - DNA, 25 bp, S. cerevisiae
gtggcaattcactttgttcttagcg

SEQ ID NO: 45355 - DNA, 25 bp, S. cerevisiae
gtggcaatggctctatgtatctgtc

SEQ ID NO: 45356 - DNA, 25 bp, S. cerevisiae
gggaagtcccgctacattgttaatt

SEQ ID NO: 45357 - DNA, 25 bp, S. cerevisiae
gggaacttgccggacattttgtcac

SEQ ID NO: 45358 - DNA, 25 bp, S. cerevisiae
gggctctgtttatttctatgttcat

SEQ ID NO: 45359 - DNA, 25 bp, S. cerevisiae
gggccttggtcagcactattgcata

SEQ ID NO: 45360 - DNA, 25 bp, S. cerevisiae
gggccattatgggatccttctttaa

SEQ ID NO: 45361 - DNA, 25 bp, S. cerevisiae
gggcgctggaggaatctcaactgat

SEQ ID NO: 45362 - DNA, 25 bp, S. cerevisiae
ggtgcctggagggtatctactgtac

SEQ ID NO: 45363 - DNA, 25 bp, S. cerevisiae
gggcacggactagagaacgatctga

SEQ ID NO: 45364 - DNA, 25 bp, S. cerevisiae
gggcccagacggcaagagaatctat

SEQ ID NO: 45365 - DNA, 25 bp, S. cerevisiae
gggcctctgtcaccgatagaagttt

SEQ ID NO: 45366 - DNA, 25 bp, S. cerevisiae
gggccctgatcaaaccatggatttt

SEQ ID NO: 45367 - DNA, 25 bp, S. cerevisiae
gtggccacatcgaggacattgcagt

SEQ ID NO: 45368 - DNA, 25 bp, S. cerevisiae
gtggcacatcagattgcccttgcag

SEQ ID NO: 45369 - DNA, 25 bp, S. cerevisiae
gtggcacattgaccatacacttatg

SEQ ID NO: 45370 - DNA, 25 bp, S. cerevisiae
gggccatcgaagaacacgttggaga

SEQ ID NO: 45371 - DNA, 25 bp, S. cerevisiae
gggcccagtagcaaccgaagtgaaa

SEQ ID NO: 45372 - DNA, 25 bp, S. cerevisiae
gggccactttgtgccgaactcaaga

SEQ ID NO: 45373 - DNA, 25 bp, S. cerevisiae
gggccagtgtttccacaaatgccaa

SEQ ID NO: 45374 - DNA, 25 bp, S. cerevisiae
gtggcctatctttgcaaccaaacga

SEQ ID NO: 45375 - DNA, 25 bp, S. cerevisiae
gggcgcttttactactcaataatga

SEQ ID NO: 45376 - DNA, 25 bp, S. cerevisiae
ggtactacaacctccaaagctaaca

SEQ ID NO: 45377 - DNA, 25 bp, S. cerevisiae
gggacccttccatctggaggatatg

SEQ ID NO: 45378 - DNA, 25 bp, S. cerevisiae
gggaaattccaagcttctttgattt

SEQ ID NO: 45379 - DNA, 25 bp, S. cerevisiae
gggccaattgctgaactactgtttt

SEQ ID NO: 45380 - DNA, 25 bp, S. cerevisiae
gggccaaatcagtcatatctagttt

SEQ ID NO: 45381 - DNA, 25 bp, S. cerevisiae
gggccactatcggtgaccagtcaat

SEQ ID NO: 45382 - DNA, 25 bp, S. cerevisiae
gggcacactgcaagcgttcgactca

SEQ ID NO: 45383 - DNA, 25 bp, S. cerevisiae
gggcacagtcgtcttatttcttgaa

SEQ ID NO: 45384 - DNA, 25 bp, S. cerevisiae
gggactctcaaactgggccaataca

SEQ ID NO: 45385 - DNA, 25 bp, S. cerevisiae
gtggccacactaatcccgtatgagg

SEQ ID NO: 45386 - DNA, 25 bp, S. cerevisiae
gggctaaatgattcggcaattccta

SEQ ID NO: 45387 - DNA, 25 bp, S. cerevisiae
ggcgtcacgttagtggacttcccag

SEQ ID NO: 45388 - DNA, 25 bp, S. cerevisiae
gggtactggtatccaatcttacgga

SEQ ID NO: 45389 - DNA, 25 bp, S. cerevisiae
gggatggtatagagccctccttact

SEQ ID NO: 45390 - DNA, 25 bp, S. cerevisiae
gggaaccttacatgaatccttaaga

SEQ ID NO: 45391 - DNA, 25 bp, S. cerevisiae
gggccatcacctaacgaggcgttaa

SEQ ID NO: 45392 - DNA, 25 bp, S. cerevisiae
gtggctcttctatttccaaggttaa

SEQ ID NO: 45393 - DNA, 25 bp, S. cerevisiae
gggccatttaatttcggcgatgtca

SEQ ID NO: 45394 - DNA, 25 bp, S. cerevisiae
gggccatttgttttggtgctatcaa

SEQ ID NO: 45395 - DNA, 25 bp, S. cerevisiae
gggccgtatatgtcttgatgtgctt

SEQ ID NO: 45396 - DNA, 25 bp, S. cerevisiae
gggctactcaatcgcattatgtggt

SEQ ID NO: 45397 - DNA, 25 bp, S. cerevisiae
gggcatacctatcgcgtttagatac

SEQ ID NO: 45398 - DNA, 25 bp, S. cerevisiae
gggcgatttgattgaccacattgta

SEQ ID NO: 45399 - DNA, 25 bp, S. cerevisiae
gggctcgcaagatttgttatcacct

SEQ ID NO: 45400 - DNA, 25 bp, S. cerevisiae
gggcacgcaggtcatgtatatcagt

SEQ ID NO: 45401 - DNA, 25 bp, S. cerevisiae
gggcgctaggattcatgttatgcaa

SEQ ID NO: 45402 - DNA, 25 bp, S. cerevisiae
gggcccatgggaatgttatgctagt

SEQ ID NO: 45403 - DNA, 25 bp, S. cerevisiae
gggcaccgttacctatgacattgac

SEQ ID NO: 45404 - DNA, 25 bp, S. cerevisiae
gggcatccgtgtttttactagcatt

SEQ ID NO: 45405 - DNA, 25 bp, S. cerevisiae
gtggccaatgctttacaatatctaa

SEQ ID NO: 45406 - DNA, 25 bp, S. cerevisiae
gtggccaccacatacaaactcaatg

SEQ ID NO: 45407 - DNA, 25 bp, S. cerevisiae
gggaagaactttcgagaagccaaca

SEQ ID NO: 45408 - DNA, 25 bp, S. cerevisiae
gggcaatgaattaacggcaactcca

SEQ ID NO: 45409 - DNA, 25 bp, S. cerevisiae
gggacaatgttaggcagtgcacctg

SEQ ID NO: 45410 - DNA, 25 bp, S. cerevisiae
gggaaagtctttgctactctccagc

SEQ ID NO: 45411 - DNA, 25 bp, S. cerevisiae
gggaaagactttgctgtctaccaat

SEQ ID NO: 45412 - DNA, 25 bp, S. cerevisiae
gggctaacagtgtactccatcgaac

SEQ ID NO: 45413 - DNA, 25 bp, S. cerevisiae
gggctcattctgcagattgctacta

SEQ ID NO: 45414 - DNA, 25 bp, S. cerevisiae
gggcatatttccctatgctgcatta

SEQ ID NO: 45415 - DNA, 25 bp, S. cerevisiae
gggcaatattccatcctttcaatcg

SEQ ID NO: 45416 - DNA, 25 bp, S. cerevisiae
gggctactatcctcacaagattcat

SEQ ID NO: 45417 - DNA, 25 bp, S. cerevisiae
gggcatgatcataccaacggagatt

SEQ ID NO: 45418 - DNA, 25 bp, S. cerevisiae
gggataatagcctctggtgcactag

SEQ ID NO: 45419 - DNA, 25 bp, S. cerevisiae
gggatgggaccacaagctcagcttc

SEQ ID NO: 45420 - DNA, 25 bp, S. cerevisiae
gggtcagtgcaggactatttacttt

SEQ ID NO: 45421 - DNA, 25 bp, S. cerevisiae
gtggcgcagtgagacaaggtttttt

SEQ ID NO: 45422 - DNA, 25 bp, S. cerevisiae
gggccttgagcattataggtcattt

SEQ ID NO: 45423 - DNA, 25 bp, S. cerevisiae
gggctactacagattggatgcttta

SEQ ID NO: 45424 - DNA, 25 bp, S. cerevisiae
gggcaagtcaactttcgttttggat

SEQ ID NO: 45425 - DNA, 25 bp, S. cerevisiae
gggacgaatatttctcatttttgga

SEQ ID NO: 45426 - DNA, 25 bp, S. cerevisiae
gggaagctaattacccttttgcaat

SEQ ID NO: 45427 - DNA, 25 bp, S. cerevisiae
gggctttaactataccctcatcaga

SEQ ID NO: 45428 - DNA, 25 bp, S. cerevisiae
gggcgatttaggtacccttcaagat

SEQ ID NO: 45429 - DNA, 25 bp, S. cerevisiae
gggctatcgctaggttatccggaca

SEQ ID NO: 45430 - DNA, 25 bp, S. cerevisiae
gggctgtctctcagcttactttaaa

SEQ ID NO: 45431 - DNA, 25 bp, S. cerevisiae
gggctcatgcttatttaccaagtga

SEQ ID NO: 45432 - DNA, 25 bp, S. cerevisiae
gggctagcgatgatcctgacgatag

SEQ ID NO: 45433 - DNA, 25 bp, S. cerevisiae
gggcccaatattaaactactctcgt

SEQ ID NO: 45434 - DNA, 25 bp, S. cerevisiae
gggcacccgagataatgctaacttt

SEQ ID NO: 45435 - DNA, 25 bp, S. cerevisiae
gggctgttaattttgcttctacatt

SEQ ID NO: 45436 - DNA, 25 bp, S. cerevisiae
gggctgttcactctttttgatcaat

SEQ ID NO: 45437 - DNA, 25 bp, S. cerevisiae
gggcctacctagcagtattgtcaac

SEQ ID NO: 45438 - DNA, 25 bp, S. cerevisiae
gggcctaggcaaaataacatgttca

SEQ ID NO: 45439 - DNA, 25 bp, S. cerevisiae
gggcctgaggattctattgttgtaa

SEQ ID NO: 45440 - DNA, 25 bp, S. cerevisiae
gggccaatatcttcataacatctgc

SEQ ID NO: 45441 - DNA, 25 bp, S. cerevisiae
gggcctatattccattgctcagtat

SEQ ID NO: 45442 - DNA, 25 bp, S. cerevisiae
ggaactagtcggtctgccagtatta

SEQ ID NO: 45443 - DNA, 25 bp, S. cerevisiae
ggaaagttcgtccacacatgaagta

SEQ ID NO: 45444 - DNA, 25 bp, S. cerevisiae
gggcatcatgtatagcctgcacaaa

SEQ ID NO: 45445 - DNA, 25 bp, S. cerevisiae
gggacgatttacatgcactgacaca

SEQ ID NO: 45446 - DNA, 25 bp, S. cerevisiae
gggcctttgatgaccacattgacac

SEQ ID NO: 45447 - DNA, 25 bp, S. cerevisiae
gggcgctttgcaaaacattacctaa

SEQ ID NO: 45448 - DNA, 25 bp, S. cerevisiae
gggcggaatttgtactacctgagaa

SEQ ID NO: 45449 - DNA, 25 bp, S. cerevisiae
gggctcatgggttctataccactag

SEQ ID NO: 45450 - DNA, 25 bp, S. cerevisiae
gggcacgcgtagaaagtcgtctttt

SEQ ID NO: 45451 - DNA, 25 bp, S. cerevisiae
gggaggcgataataacggcgttcta

SEQ ID NO: 45452 - DNA, 25 bp, S. cerevisiae
ggaggactatacataaggacgttca

SEQ ID NO: 45453 - DNA, 25 bp, S. cerevisiae
gggaattaccaccagggacgatgct

SEQ ID NO: 45454 - DNA, 25 bp, S. cerevisiae
ggtaaatgacattacgaccctagca

SEQ ID NO: 45455 - DNA, 25 bp, S. cerevisiae
ggaagacgactttggacctaagcca

SEQ ID NO: 45456 - DNA, 25 bp, S. cerevisiae
gggcaacaagctttatattctcgac

SEQ ID NO: 45457 - DNA, 25 bp, S. cerevisiae
gggcgaaacatcaccatcatcaaga

SEQ ID NO: 45458 - DNA, 25 bp, S. cerevisiae
gggcgagacgctgtcactcaataat

SEQ ID NO: 45459 - DNA, 25 bp, S. cerevisiae
gggcgtctcatcaaatttacctggt

SEQ ID NO: 45460 - DNA, 25 bp, S. cerevisiae
gggcgttcatcatctataacattgt

SEQ ID NO: 45461 - DNA, 25 bp, S. cerevisiae
gggccagattgtccctcaagagatt

SEQ ID NO: 45462 - DNA, 25 bp, S. cerevisiae
gggacgtggattttcaagagttcat

SEQ ID NO: 45463 - DNA, 25 bp, S. cerevisiae
gggcaagtggacactaccatgtcta

SEQ ID NO: 45464 - DNA, 25 bp, S. cerevisiae
gggctagagctaaccataaccgtaa

SEQ ID NO: 45465 - DNA, 25 bp, S. cerevisiae
gggccccttattcattagtgtggtt

SEQ ID NO: 45466 - DNA, 25 bp, S. cerevisiae
gggatatacctcatcaaatacgtgg

SEQ ID NO: 45467 - DNA, 25 bp, S. cerevisiae
gggcttctacgggatacacttcagg

SEQ ID NO: 45468 - DNA, 25 bp, S. cerevisiae
gggcattcccagagtgacatttaag

SEQ ID NO: 45469 - DNA, 25 bp, S. cerevisiae
gggcgtccacaaggtcatcatttac

SEQ ID NO: 45470 - DNA, 25 bp, S. cerevisiae
gggcagtcctacagtatatcaaaga

SEQ ID NO: 45471 - DNA, 25 bp, S. cerevisiae
gggcgtcctccatgatgatgaaaat

SEQ ID NO: 45472 - DNA, 25 bp, S. cerevisiae
ggtggtccagactcagctgagaaga

SEQ ID NO: 45473 - DNA, 25 bp, S. cerevisiae
gggcttccagaccatcacaggtgaa

SEQ ID NO: 45474 - DNA, 25 bp, S. cerevisiae
gggcgactcatcataccagttgaaa

SEQ ID NO: 45475 - DNA, 25 bp, S. cerevisiae
gggctgtaacacacatggatcaaat

SEQ ID NO: 45476 - DNA, 25 bp, S. cerevisiae
tgcggtaacaacactagacgtctgt

SEQ ID NO: 45477 - DNA, 25 bp, S. cerevisiae
gggctgcaaaagaactatcaccttg

SEQ ID NO: 45478 - DNA, 25 bp, S. cerevisiae
gggatgcccaagtttatcaacggtg

SEQ ID NO: 45479 - DNA, 25 bp, S. cerevisiae
gggcatcctccacattctaaaggtt

SEQ ID NO: 45480 - DNA, 25 bp, S. cerevisiae
ggtgatatcgtactgcatctctgaa

SEQ ID NO: 45481 - DNA, 25 bp, S. cerevisiae
gggctgctgcagaagtactgtacca

SEQ ID NO: 45482 - DNA, 25 bp, S. cerevisiae
gggactccaagatcgatcatgccac

SEQ ID NO: 45483 - DNA, 25 bp, S. cerevisiae
gggacgctgaaatcctggctaagat

SEQ ID NO: 45484 - DNA, 25 bp, S. cerevisiae
gggcaaccttgtcaacttttttcat

SEQ ID NO: 45485 - DNA, 25 bp, S. cerevisiae
gggcaactcgttcaactcttttaag

SEQ ID NO: 45486 - DNA, 25 bp, S. cerevisiae
ggtgaccttcgaaaactttttgatg

SEQ ID NO: 45487 - DNA, 25 bp, S. cerevisiae
ggtgtaccagttgcacaaacctttg

SEQ ID NO: 45488 - DNA, 25 bp, S. cerevisiae
gggctaacctttacagaacctcgcg

SEQ ID NO: 45489 - DNA, 25 bp, S. cerevisiae
gggctgatacactctattgacacct

SEQ ID NO: 45490 - DNA, 25 bp, S. cerevisiae
gggctgaaccaacttataatttctg

SEQ ID NO: 45491 - DNA, 25 bp, S. cerevisiae
gggcatatccgtgtcataacattat

SEQ ID NO: 45492 - DNA, 25 bp, S. cerevisiae
gggcggctgattttatcatactatt

SEQ ID NO: 45493 - DNA, 25 bp, S. cerevisiae
gggcagcctgctgaaagtcctgaaa

SEQ ID NO: 45494 - DNA, 25 bp, S. cerevisiae
gggccgccctagaatgccacgagaa

SEQ ID NO: 45495 - DNA, 25 bp, S. cerevisiae
gggcgtgcgcagaactataccagaa

SEQ ID NO: 45496 - DNA, 25 bp, S. cerevisiae
gggcaggcccaagttgacgcaattt

SEQ ID NO: 45497 - DNA, 25 bp, S. cerevisiae
gggcctgatccgtttcaacaattat

SEQ ID NO: 45498 - DNA, 25 bp, S. cerevisiae
gggctctttggtttagtgagactat

SEQ ID NO: 45499 - DNA, 25 bp, S. cerevisiae
gggaccatatggcacaagaactttg

SEQ ID NO: 45500 - DNA, 25 bp, S. cerevisiae
gggcgcctattcacagagaacttct

SEQ ID NO: 45501 - DNA, 25 bp, S. cerevisiae
gggaccagattcacaagacagccat

SEQ ID NO: 45502 - DNA, 25 bp, S. cerevisiae
gggacacgtacattctaaaccacag

SEQ ID NO: 45503 - DNA, 25 bp, S. cerevisiae
gggcgacgagtcttctttacacaag

SEQ ID NO: 45504 - DNA, 25 bp, S. cerevisiae
gggcgacgatattccaaccaccaaa

SEQ ID NO: 45505 - DNA, 25 bp, S. cerevisiae
ggtggcaagaactacaacgactcaa

SEQ ID NO: 45506 - DNA, 25 bp, S. cerevisiae
gggactagaactgataagcaccaaa

SEQ ID NO: 45507 - DNA, 25 bp, S. cerevisiae
gggctgtcaaatacttgttccaaaa

SEQ ID NO: 45508 - DNA, 25 bp, S. cerevisiae
gggcacgtcatctctatgagtttca

SEQ ID NO: 45509 - DNA, 25 bp, S. cerevisiae
gggcgcaagaaaccagcagtattca

SEQ ID NO: 45510 - DNA, 25 bp, S. cerevisiae
gggctgcaagaactagtcttttcac

SEQ ID NO: 45511 - DNA, 25 bp, S. cerevisiae
gggcgcaagacattcgattttctca

SEQ ID NO: 45512 - DNA, 25 bp, S. cerevisiae
gggcgtcaaaaatctgctatgctat

SEQ ID NO: 45513 - DNA, 25 bp, S. cerevisiae
gggcgtgcagactcaacagcgtgtt

SEQ ID NO: 45514 - DNA, 25 bp, S. cerevisiae
gggcaatgatcctgctaagcgattt

SEQ ID NO: 45515 - DNA, 25 bp, S. cerevisiae
gggaagatcctgttgaaaggcgata

SEQ ID NO: 45516 - DNA, 25 bp, S. cerevisiae
gggcatagtccttctgatgcgaggt

SEQ ID NO: 45517 - DNA, 25 bp, S. cerevisiae
gggcaaatccatttacggttccaag

SEQ ID NO: 45518 - DNA, 25 bp, S. cerevisiae
gggaagccaccataaagtatcgtag

SEQ ID NO: 45519 - DNA, 25 bp, S. cerevisiae
gggacagccaacaccaaccgtgtca

SEQ ID NO: 45520 - DNA, 25 bp, S. cerevisiae
gggaagctatcacaccaacggaagg

SEQ ID NO: 45521 - DNA, 25 bp, S. cerevisiae
gggaggctaccatacgatcttgacg

SEQ ID NO: 45522 - DNA, 25 bp, S. cerevisiae
gggaagctaccaaacgtcatggaca

SEQ ID NO: 45523 - DNA, 25 bp, S. cerevisiae
gggaagtaccaattgcctgcaaaaa

SEQ ID NO: 45524 - DNA, 25 bp, S. cerevisiae
gggacaacccaacggatgcgtttca

SEQ ID NO: 45525 - DNA, 25 bp, S. cerevisiae
gggaaattctcaacgccatggtggt

SEQ ID NO: 45526 - DNA, 25 bp, S. cerevisiae
gggcaattatatgctggccaggatt

SEQ ID NO: 45527 - DNA, 25 bp, S. cerevisiae
gggcaatatcaattctgagctttct

SEQ ID NO: 45528 - DNA, 25 bp, S. cerevisiae
gggctactcaagtatctctttatta

SEQ ID NO: 45529 - DNA, 25 bp, S. cerevisiae
gggcacgattttacccattgtaacg

SEQ ID NO: 45530 - DNA, 25 bp, S. cerevisiae
gggcacctttggttctgcttctaac

SEQ ID NO: 45531 - DNA, 25 bp, S. cerevisiae
gggcaattttgctttctgttgctag

SEQ ID NO: 45532 - DNA, 25 bp, S. cerevisiae
gggctggttcactggttattgcatc

SEQ ID NO: 45533 - DNA, 25 bp, S. cerevisiae
gggaagttacaccagttgttcattt

SEQ ID NO: 45534 - DNA, 25 bp, S. cerevisiae
gggacacttggaacagtttccgttg

SEQ ID NO: 45535 - DNA, 25 bp, S. cerevisiae
gggaaccagctatatactttacttg

SEQ ID NO: 45536 - DNA, 25 bp, S. cerevisiae
gggaaacaccatctaccttggttag

SEQ ID NO: 45537 - DNA, 25 bp, S. cerevisiae
gggcacccgcttttacaatctggtt

SEQ ID NO: 45538 - DNA, 25 bp, S. cerevisiae
gggacaactttactcatatttggca

SEQ ID NO: 45539 - DNA, 25 bp, S. cerevisiae
gggacaactggatcgattctatcaa

SEQ ID NO: 45540 - DNA, 25 bp, S. cerevisiae
gggcaaggccataagctttgaacaa

SEQ ID NO: 45541 - DNA, 25 bp, S. cerevisiae
gggaagtcctctatcttgaacaaca

SEQ ID NO: 45542 - DNA, 25 bp, S. cerevisiae
ggtgtagatgccgtgatcgtcgata

SEQ ID NO: 45543 - DNA, 25 bp, S. cerevisiae
gggctgaagaactatctcgcatgat

SEQ ID NO: 45544 - DNA, 25 bp, S. cerevisiae
gggcacatgcaactgatttccaaag

SEQ ID NO: 45545 - DNA, 25 bp, S. cerevisiae
gggcattccagttattccaaatcct

SEQ ID NO: 45546 - DNA, 25 bp, S. cerevisiae
gggaaccgcccgtatcgagcaagaa

SEQ ID NO: 45547 - DNA, 25 bp, S. cerevisiae
gggcgatatacttttcagcaacggt

SEQ ID NO: 45548 - DNA, 25 bp, S. cerevisiae
gggcttgatgaccatttccacttgg

SEQ ID NO: 45549 - DNA, 25 bp, S. cerevisiae
gggcaacttattacagctacttatt

SEQ ID NO: 45550 - DNA, 25 bp, S. cerevisiae
gggagactatgggatcaaacttttc

SEQ ID NO: 45551 - DNA, 25 bp, S. cerevisiae
gggcagcagaataacttaccgaaat

SEQ ID NO: 45552 - DNA, 25 bp, S. cerevisiae
gggcaactccataatatccctagag

SEQ ID NO: 45553 - DNA, 25 bp, S. cerevisiae
gggctctgcctcaatatttgcagta

SEQ ID NO: 45554 - DNA, 25 bp, S. cerevisiae
gggctctgctacaatgcttatttga

SEQ ID NO: 45555 - DNA, 25 bp, S. cerevisiae
gggcattttttgactttggcgagca

SEQ ID NO: 45556 - DNA, 25 bp, S. cerevisiae
gggcatacctacaatttcccaggtt

SEQ ID NO: 45557 - DNA, 25 bp, S. cerevisiae
gggaacccaaggaacctgtagcact

SEQ ID NO: 45558 - DNA, 25 bp, S. cerevisiae
gggcaccacacgtattgaacgatct

SEQ ID NO: 45559 - DNA, 25 bp, S. cerevisiae
gggcaacgcaagtactacgctgatt

SEQ ID NO: 45560 - DNA, 25 bp, S. cerevisiae
gggaacgtagctttgtgagcatgaa

SEQ ID NO: 45561 - DNA, 25 bp, S. cerevisiae
gggaatcttttgcttcactaaatac

SEQ ID NO: 45562 - DNA, 25 bp, S. cerevisiae
gggactttctgactctaagcaaaca

SEQ ID NO: 45563 - DNA, 25 bp, S. cerevisiae
gggagtttgctccacagaatacaac

SEQ ID NO: 45564 - DNA, 25 bp, S. cerevisiae
ggcgttgatcgttctaggaaggaat

SEQ ID NO: 45565 - DNA, 25 bp, S. cerevisiae
gggtccatgggagggaacccacata

SEQ ID NO: 45566 - DNA, 25 bp, S. cerevisiae
ggtgtttggttcaagaccccactat

SEQ ID NO: 45567 - DNA, 25 bp, S. cerevisiae
gggaacaaacgataactccttcaat

SEQ ID NO: 45568 - DNA, 25 bp, S. cerevisiae
gggaaacaacaatccattactgtaa

SEQ ID NO: 45569 - DNA, 25 bp, S. cerevisiae
gggcaaacatacttgtggcttaatt

SEQ ID NO: 45570 - DNA, 25 bp, S. cerevisiae
gggcacgatgcatccatgggactaa

SEQ ID NO: 45571 - DNA, 25 bp, S. cerevisiae
gggcacgattgtgatggcacctata

SEQ ID NO: 45572 - DNA, 25 bp, S. cerevisiae
gggcggaagtctttgcaactgatat

SEQ ID NO: 45573 - DNA, 25 bp, S. cerevisiae
gggctctctatggtgtgtttaaatt

SEQ ID NO: 45574 - DNA, 25 bp, S. cerevisiae
gggcttctttgatactacagtggtt

SEQ ID NO: 45575 - DNA, 25 bp, S. cerevisiae
gggtcggtcatttcgaaccagttgt

SEQ ID NO: 45576 - DNA, 25 bp, S. cerevisiae
gggcatctggccttacaaaaattta

SEQ ID NO: 45577 - DNA, 25 bp, S. cerevisiae
gggttagagccgtcaacactggtat

SEQ ID NO: 45578 - DNA, 25 bp, S. cerevisiae
gggatcaaacggcaaatcttgttct

SEQ ID NO: 45579 - DNA, 25 bp, S. cerevisiae
gggacaccactggagaaccgtcgat

SEQ ID NO: 45580 - DNA, 25 bp, S. cerevisiae
gggaagcttcgccacaatctgaaat

SEQ ID NO: 45581 - DNA, 25 bp, S. cerevisiae
gggcaagtctgctgaaatcgatgca

SEQ ID NO: 45582 - DNA, 25 bp, S. cerevisiae
gggaaatgctgctaagaacgccaat

SEQ ID NO: 45583 - DNA, 25 bp, S. cerevisiae
gggaaccccattatcgtacactgtt

SEQ ID NO: 45584 - DNA, 25 bp, S. cerevisiae
gggaaagccctgatcatcgtacagt

SEQ ID NO: 45585 - DNA, 25 bp, S. cerevisiae
gggctcacattatcggtccaaatgc

SEQ ID NO: 45586 - DNA, 25 bp, S. cerevisiae
ggtgtcactgaacctgaaccaacat

SEQ ID NO: 45587 - DNA, 25 bp, S. cerevisiae
gggataacacatcctgcaatcaggt

SEQ ID NO: 45588 - DNA, 25 bp, S. cerevisiae
gggaacctgtcactgtacgaggcta

SEQ ID NO: 45589 - DNA, 25 bp, S. cerevisiae
gggcatcgttatacctgatctggaa

SEQ ID NO: 45590 - DNA, 25 bp, S. cerevisiae
gggcatctttgattacgtatggtac

SEQ ID NO: 45591 - DNA, 25 bp, S. cerevisiae
gggctccaattccatttgttgttaa

SEQ ID NO: 45592 - DNA, 25 bp, S. cerevisiae
gggtccaatgcgcaaagctcgttga

SEQ ID NO: 45593 - DNA, 25 bp, S. cerevisiae
gggaccaggctatgacgtcgtcaga

SEQ ID NO: 45594 - DNA, 25 bp, S. cerevisiae
gggactcagttttgatctgtcagct

SEQ ID NO: 45595 - DNA, 25 bp, S. cerevisiae
gggcagcattcacatacttgatcaa

SEQ ID NO: 45596 - DNA, 25 bp, S. cerevisiae
gggagatctcccaacattgtcaatg

SEQ ID NO: 45597 - DNA, 25 bp, S. cerevisiae
gggaatattggccacacatgtcttg

SEQ ID NO: 45598 - DNA, 25 bp, S. cerevisiae
gggctgatcaaatccactgacgtga

SEQ ID NO: 45599 - DNA, 25 bp, S. cerevisiae
gggcaaaaaccgactgacagctgag

SEQ ID NO: 45600 - DNA, 25 bp, S. cerevisiae
gggaagcacaacttatctaagctga

SEQ ID NO: 45601 - DNA, 25 bp, S. cerevisiae
gggacaaccacacatgcaagcaaga

SEQ ID NO: 45602 - DNA, 25 bp, S. cerevisiae
gggaaaacagttgcactgccccata

SEQ ID NO: 45603 - DNA, 25 bp, S. cerevisiae
gggaacaaagtcacctacactcttc

SEQ ID NO: 45604 - DNA, 25 bp, S. cerevisiae
gggatacattgactaccctacgtac

SEQ ID NO: 45605 - DNA, 25 bp, S. cerevisiae
gggatacattgctcaagttacgtgt

SEQ ID NO: 45606 - DNA, 25 bp, S. cerevisiae
gggcttgctgaattttatcatgtta

SEQ ID NO: 45607 - DNA, 25 bp, S. cerevisiae
gggcattggaactttctcatttgaa

SEQ ID NO: 45608 - DNA, 25 bp, S. cerevisiae
gggacggatccattttgcaatataa

SEQ ID NO: 45609 - DNA, 25 bp, S. cerevisiae
gggacagtcatagcggtcaattact

SEQ ID NO: 45610 - DNA, 25 bp, S. cerevisiae
gggaatgctagagccctcaacaact

SEQ ID NO: 45611 - DNA, 25 bp, S. cerevisiae
gggattatagaactgcagctgctga

SEQ ID NO: 45612 - DNA, 25 bp, S. cerevisiae
gggaattaaatctctgcgccttttt

SEQ ID NO: 45613 - DNA, 25 bp, S. cerevisiae
gggaagatttcctcttcagccattg

SEQ ID NO: 45614 - DNA, 25 bp, S. cerevisiae
gggaagtgtgcatatccattctaca

SEQ ID NO: 45615 - DNA, 25 bp, S. cerevisiae
gggctagactacgaccatttatttg

SEQ ID NO: 45616 - DNA, 25 bp, S. cerevisiae
gggcaagtttctaccattacattta

SEQ ID NO: 45617 - DNA, 25 bp, S. cerevisiae
gggaatttcccaagcttctgatatt

SEQ ID NO: 45618 - DNA, 25 bp, S. cerevisiae
gggagctttaccatctttagatagg

SEQ ID NO: 45619 - DNA, 25 bp, S. cerevisiae
gggacttattatgcccttggtacga

SEQ ID NO: 45620 - DNA, 25 bp, S. cerevisiae
gggacttttagcagtttgcctgact

SEQ ID NO: 45621 - DNA, 25 bp, S. cerevisiae
gggatgacgaaaaactacttcgcaa

SEQ ID NO: 45622 - DNA, 25 bp, S. cerevisiae
gggcttataaatttctctactccag

SEQ ID NO: 45623 - DNA, 25 bp, S. cerevisiae
gggctttaacatgtctgcgtatctg

SEQ ID NO: 45624 - DNA, 25 bp, S. cerevisiae
gggctatttcactatactctgttgg

SEQ ID NO: 45625 - DNA, 25 bp, S. cerevisiae
gggctcagtttcaaacctggtcgaa

SEQ ID NO: 45626 - DNA, 25 bp, S. cerevisiae
gggcactgactggatcactttattt

SEQ ID NO: 45627 - DNA, 25 bp, S. cerevisiae
gggcattatatctatcacttcttta

SEQ ID NO: 45628 - DNA, 25 bp, S. cerevisiae
gggaagttcgccgtttgtgatcata

SEQ ID NO: 45629 - DNA, 25 bp, S. cerevisiae
gggaaagaccgcattgttgtagact

SEQ ID NO: 45630 - DNA, 25 bp, S. cerevisiae
gggattaacgtcacagtttcaacaa

SEQ ID NO: 45631 - DNA, 25 bp, S. cerevisiae
gggaaaacgtcttatgttcataatc

SEQ ID NO: 45632 - DNA, 25 bp, S. cerevisiae
gggacagatccgtttatttcaatat

SEQ ID NO: 45633 - DNA, 25 bp, S. cerevisiae
gggacgaggagactgctttaccaaa

SEQ ID NO: 45634 - DNA, 25 bp, S. cerevisiae
gggatcgcattctaggtttaccaat

SEQ ID NO: 45635 - DNA, 25 bp, S. cerevisiae
gggttgagatctggtgtgccccaac

SEQ ID NO: 45636 - DNA, 25 bp, S. cerevisiae
gggtttgactgaagagcctgccgca

SEQ ID NO: 45637 - DNA, 25 bp, S. cerevisiae
gggaggcgaggcttatttgaacttc

SEQ ID NO: 45638 - DNA, 25 bp, S. cerevisiae
gggagcgcaggtgctattatagatc

SEQ ID NO: 45639 - DNA, 25 bp, S. cerevisiae
gggcagcacaggcatccaaaagcaa

SEQ ID NO: 45640 - DNA, 25 bp, S. cerevisiae
gggagcgcccgttcaagaagaaaca

SEQ ID NO: 45641 - DNA, 25 bp, S. cerevisiae
gggaggttccaaaaggtcaatcaag

SEQ ID NO: 45642 - DNA, 25 bp, S. cerevisiae
gggcattgttcccaatagtgtcgta

SEQ ID NO: 45643 - DNA, 25 bp, S. cerevisiae
gggctttatttctggtacctatgat

SEQ ID NO: 45644 - DNA, 25 bp, S. cerevisiae
gggcatctttttttttcacaattag

SEQ ID NO: 45645 - DNA, 25 bp, S. cerevisiae
gggcatttatcttttttctgcttgc

SEQ ID NO: 45646 - DNA, 25 bp, S. cerevisiae
gggcattgattttttaattcttgtc

SEQ ID NO: 45647 - DNA, 25 bp, S. cerevisiae
gggcagtgcaccaggtaccattaga

SEQ ID NO: 45648 - DNA, 25 bp, S. cerevisiae
gggacaactcattagattctcaaca

SEQ ID NO: 45649 - DNA, 25 bp, S. cerevisiae
gggacagtctaatgttatcgcactt

SEQ ID NO: 45650 - DNA, 25 bp, S. cerevisiae
gggaacttcaatttagacgcctact

SEQ ID NO: 45651 - DNA, 25 bp, S. cerevisiae
gggacatatactattgggccacaaa

SEQ ID NO: 45652 - DNA, 25 bp, S. cerevisiae
gggaaattccattgtgcggtaatca

SEQ ID NO: 45653 - DNA, 25 bp, S. cerevisiae
gggatgaaatcagcgccggtgccaa

SEQ ID NO: 45654 - DNA, 25 bp, S. cerevisiae
gggaagacaaccctcttgagtcgca

SEQ ID NO: 45655 - DNA, 25 bp, S. cerevisiae
gggagaataaccctgtagcatttga

SEQ ID NO: 45656 - DNA, 25 bp, S. cerevisiae
gggcttgttggtatgttgcattcat

SEQ ID NO: 45657 - DNA, 25 bp, S. cerevisiae
gggcttttcacgttttatgatggaa

SEQ ID NO: 45658 - DNA, 25 bp, S. cerevisiae
gggtagtgtaccttttcgtggacat

SEQ ID NO: 45659 - DNA, 25 bp, S. cerevisiae
gggtatgctgaagacgtccgtaaca

SEQ ID NO: 45660 - DNA, 25 bp, S. cerevisiae
gggaatgccaatggtgcgtccgctc

SEQ ID NO: 45661 - DNA, 25 bp, S. cerevisiae
gggcaatgaacctcagcagcatctg

SEQ ID NO: 45662 - DNA, 25 bp, S. cerevisiae
gggcaatagccttccagagactaaa

SEQ ID NO: 45663 - DNA, 25 bp, S. cerevisiae
gggcataccaattacagcagaacat

SEQ ID NO: 45664 - DNA, 25 bp, S. cerevisiae
gggaagcacgcatcagaaaacatct

SEQ ID NO: 45665 - DNA, 25 bp, S. cerevisiae
gggagaaggcattccttttccttat

SEQ ID NO: 45666 - DNA, 25 bp, S. cerevisiae
gggattgctgaatggctggttacct

SEQ ID NO: 45667 - DNA, 25 bp, S. cerevisiae
gggattctggagagcctggcataca

SEQ ID NO: 45668 - DNA, 25 bp, S. cerevisiae
gggtttgggtccagtcgcacaaaag

SEQ ID NO: 45669 - DNA, 25 bp, S. cerevisiae
gggacgtgctggtaaagtatctcta

SEQ ID NO: 45670 - DNA, 25 bp, S. cerevisiae
gggcagcttcggtaagccattctta

SEQ ID NO: 45671 - DNA, 25 bp, S. cerevisiae
gggactcacatgcattacacctttg

SEQ ID NO: 45672 - DNA, 25 bp, S. cerevisiae
gggaatctacttgactcacggttct

SEQ ID NO: 45673 - DNA, 25 bp, S. cerevisiae
gggacactactaatactactgggtt

SEQ ID NO: 45674 - DNA, 25 bp, S. cerevisiae
gggaattattacactatccggcaat

SEQ ID NO: 45675 - DNA, 25 bp, S. cerevisiae
gggaacgttacaccgcacttgaagt

SEQ ID NO: 45676 - DNA, 25 bp, S. cerevisiae
gggaggctcttccacctcacttaag

SEQ ID NO: 45677 - DNA, 25 bp, S. cerevisiae
gggaagcctgcagcaaccacagtat

SEQ ID NO: 45678 - DNA, 25 bp, S. cerevisiae
ggaggcgtcgaagaccacatcgcat

SEQ ID NO: 45679 - DNA, 25 bp, S. cerevisiae
gggacgtcaacggaaatcatcctga

SEQ ID NO: 45680 - DNA, 25 bp, S. cerevisiae
gggacgctaacacttactttctgaa

SEQ ID NO: 45681 - DNA, 25 bp, S. cerevisiae
gggacactatacttcatacgtttat

SEQ ID NO: 45682 - DNA, 25 bp, S. cerevisiae
gggacttgccaagaccgaaatagca

SEQ ID NO: 45683 - DNA, 25 bp, S. cerevisiae
gggacttgaacagctcctttatgga

SEQ ID NO: 45684 - DNA, 25 bp, S. cerevisiae
gggacgttgataatccgttgagaca

SEQ ID NO: 45685 - DNA, 25 bp, S. cerevisiae
gggtctagatgctaccaagttgtac

SEQ ID NO: 45686 - DNA, 25 bp, S. cerevisiae
gggacagaatgccaccagacttcat

SEQ ID NO: 45687 - DNA, 25 bp, S. cerevisiae
gggcaattatcttcgctgcaaatcc

SEQ ID NO: 45688 - DNA, 25 bp, S. cerevisiae
gggaacttacgtaccgttgcatcta

SEQ ID NO: 45689 - DNA, 25 bp, S. cerevisiae
gggaacttatacaatcctggtgttt

SEQ ID NO: 45690 - DNA, 25 bp, S. cerevisiae
gggaactttgtagtccctgtggact

SEQ ID NO: 45691 - DNA, 25 bp, S. cerevisiae
gggcaacttattttcttctttccat

SEQ ID NO: 45692 - DNA, 25 bp, S. cerevisiae
gggaagttctatcaggactttccta

SEQ ID NO: 45693 - DNA, 25 bp, S. cerevisiae
gggacgagccgttggagatctttat

SEQ ID NO: 45694 - DNA, 25 bp, S. cerevisiae
gggatctctggcgttgggtacttta

SEQ ID NO: 45695 - DNA, 25 bp, S. cerevisiae
gggcatcacttgtacctggataact

SEQ ID NO: 45696 - DNA, 25 bp, S. cerevisiae
gggcataccgaagcattacaaaagg

SEQ ID NO: 45697 - DNA, 25 bp, S. cerevisiae
gggtatccagcagccttaaaaaatg

SEQ ID NO: 45698 - DNA, 25 bp, S. cerevisiae
gggtttgaagctgccacaatgggta

SEQ ID NO: 45699 - DNA, 25 bp, S. cerevisiae
gggtatgttcaggatcccaacgcgc

SEQ ID NO: 45700 - DNA, 25 bp, S. cerevisiae
gggatctatgcgatggcgttatact

SEQ ID NO: 45701 - DNA, 25 bp, S. cerevisiae
gggcactagccacgttgattaatat

SEQ ID NO: 45702 - DNA, 25 bp, S. cerevisiae
gggaatgctgtttccttgacaacca

SEQ ID NO: 45703 - DNA, 25 bp, S. cerevisiae
gggataatcgagtcacttaacccga

SEQ ID NO: 45704 - DNA, 25 bp, S. cerevisiae
gggtgcaatgggtgctttcctaagc

SEQ ID NO: 45705 - DNA, 25 bp, S. cerevisiae
gggtctatgtggtgctggtactaac

SEQ ID NO: 45706 - DNA, 25 bp, S. cerevisiae
gggtaagtatgctcaggtcacaaac

SEQ ID NO: 45707 - DNA, 25 bp, S. cerevisiae
gggagaggttcaaatggccacaaaa

SEQ ID NO: 45708 - DNA, 25 bp, S. cerevisiae
gggagctatttatcgtcagcagcaa

SEQ ID NO: 45709 - DNA, 25 bp, S. cerevisiae
gggacttatcaaacgtgcaggcaaa

SEQ ID NO: 45710 - DNA, 25 bp, S. cerevisiae
gggagagttcagtcttggctctaaa

SEQ ID NO: 45711 - DNA, 25 bp, S. cerevisiae
gggcaactttctttgcagttcagca

SEQ ID NO: 45712 - DNA, 25 bp, S. cerevisiae
gggaattccaagtcggtccatgtac

SEQ ID NO: 45713 - DNA, 25 bp, S. cerevisiae
gggtatactgtcctatgcgacgtca

SEQ ID NO: 45714 - DNA, 25 bp, S. cerevisiae
gggatatgactaccgacgacgactt

SEQ ID NO: 45715 - DNA, 25 bp, S. cerevisiae
gggaccagactagagtggattcctt

SEQ ID NO: 45716 - DNA, 25 bp, S. cerevisiae
gggcaccgacgaatacggcatttct

SEQ ID NO: 45717 - DNA, 25 bp, S. cerevisiae
gggaattcatctactagtgccttga

SEQ ID NO: 45718 - DNA, 25 bp, S. cerevisiae
gggagttcaaaagcttctatcacat

SEQ ID NO: 45719 - DNA, 25 bp, S. cerevisiae
gggaccctacagtttttgatcacac

SEQ ID NO: 45720 - DNA, 25 bp, S. cerevisiae
gggacgcactattcttattatacta

SEQ ID NO: 45721 - DNA, 25 bp, S. cerevisiae
gggaaaatctctactttgaagcaca

SEQ ID NO: 45722 - DNA, 25 bp, S. cerevisiae
gggaagaatcttcctacttcagaat

SEQ ID NO: 45723 - DNA, 25 bp, S. cerevisiae
gggcaagccattgaattgttacgaa

SEQ ID NO: 45724 - DNA, 25 bp, S. cerevisiae
gggcaaccctagatattcagtcatt

SEQ ID NO: 45725 - DNA, 25 bp, S. cerevisiae
gggagatgcaccagttcattcgatt

SEQ ID NO: 45726 - DNA, 25 bp, S. cerevisiae
gggatggcccaaagtcagacacaga

SEQ ID NO: 45727 - DNA, 25 bp, S. cerevisiae
gggtgctgatctgttcattatgcgc

SEQ ID NO: 45728 - DNA, 25 bp, S. cerevisiae
gggacggcgaagaactctctatcta

SEQ ID NO: 45729 - DNA, 25 bp, S. cerevisiae
gggaacgcgaagacagacgtactga

SEQ ID NO: 45730 - DNA, 25 bp, S. cerevisiae
gggaatcccaaagtcactgtcctac

SEQ ID NO: 45731 - DNA, 25 bp, S. cerevisiae
gggactaccatatacagctccagag

SEQ ID NO: 45732 - DNA, 25 bp, S. cerevisiae
gggaactgttggtcagtactctaaa

SEQ ID NO: 45733 - DNA, 25 bp, S. cerevisiae
gggaatcattgtgtgcgtagccata

SEQ ID NO: 45734 - DNA, 25 bp, S. cerevisiae
gggataatcgatttcttgactaatt

SEQ ID NO: 45735 - DNA, 25 bp, S. cerevisiae
gggatgtcactatgtcttcactgga

SEQ ID NO: 45736 - DNA, 25 bp, S. cerevisiae
gggatgtccatactccaaaggtgat

SEQ ID NO: 45737 - DNA, 25 bp, S. cerevisiae
gggagagcctattccatacgacgaa

SEQ ID NO: 45738 - DNA, 25 bp, S. cerevisiae
gggagatgctttccttgtcgacgca

SEQ ID NO: 45739 - DNA, 25 bp, S. cerevisiae
gggacggtaatcgacggccataaga

SEQ ID NO: 45740 - DNA, 25 bp, S. cerevisiae
gggaaggtattgaaccgccatcaaa

SEQ ID NO: 45741 - DNA, 25 bp, S. cerevisiae
gggaaagtactcattctcgccaaag

SEQ ID NO: 45742 - DNA, 25 bp, S. cerevisiae
gggcaaattcaccatattccagcaa

SEQ ID NO: 45743 - DNA, 25 bp, S. cerevisiae
gggaaacaaggttcacatcagcaaa

SEQ ID NO: 45744 - DNA, 25 bp, S. cerevisiae
gggaatcacattcctattcaaagta

SEQ ID NO: 45745 - DNA, 25 bp, S. cerevisiae
gggaaacatttcatctatacttacc

SEQ ID NO: 45746 - DNA, 25 bp, S. cerevisiae
gggacaattattcctttactgatga

SEQ ID NO: 45747 - DNA, 25 bp, S. cerevisiae
gggaaacgcttatcaacgtgatact

SEQ ID NO: 45748 - DNA, 25 bp, S. cerevisiae
gggaatatccgaaagaccctgtatc

SEQ ID NO: 45749 - DNA, 25 bp, S. cerevisiae
gggatcccattttatttagtgctgc

SEQ ID NO: 45750 - DNA, 25 bp, S. cerevisiae
gggacttgacaggaaatacggcatc

SEQ ID NO: 45751 - DNA, 25 bp, S. cerevisiae
gggaatctcactctaatcctagctt

SEQ ID NO: 45752 - DNA, 25 bp, S. cerevisiae
gggagatctgcatccaaataatcga

SEQ ID NO: 45753 - DNA, 25 bp, S. cerevisiae
gggacactcctctcatgatgaacaa

SEQ ID NO: 45754 - DNA, 25 bp, S. cerevisiae
gggaacaccgtatgctgaagctaat

SEQ ID NO: 45755 - DNA, 25 bp, S. cerevisiae
gggtctacggtgaactgaactctgt

SEQ ID NO: 45756 - DNA, 25 bp, S. cerevisiae
gggtccccaccagatagagttttga

SEQ ID NO: 45757 - DNA, 25 bp, S. cerevisiae
gggtccatcgcgcaaaaaattcatt

SEQ ID NO: 45758 - DNA, 25 bp, S. cerevisiae
gggacctgtcacctagaaatacctt

SEQ ID NO: 45759 - DNA, 25 bp, S. cerevisiae
gggaccgaacgatttagacaattat

SEQ ID NO: 45760 - DNA, 25 bp, S. cerevisiae
ggtggctgcgttgactgcatacgac

SEQ ID NO: 45761 - DNA, 25 bp, S. cerevisiae
ggtggatgcgtggacttcatttttt

SEQ ID NO: 45762 - DNA, 25 bp, S. cerevisiae
ggtaaggcagttcccattgtatttt

SEQ ID NO: 45763 - DNA, 25 bp, S. cerevisiae
gggagtgccattatcctaatttttt

SEQ ID NO: 45764 - DNA, 25 bp, S. cerevisiae
gggacttatccaaccagacgtattt

SEQ ID NO: 45765 - DNA, 25 bp, S. cerevisiae
ggtgcccaatttgtcacaggttttg

SEQ ID NO: 45766 - DNA, 25 bp, S. cerevisiae
ggtgtaaagttcatcacggctcctt

SEQ ID NO: 45767 - DNA, 25 bp, S. cerevisiae
gggttaacacctaggtatcctcgcg

SEQ ID NO: 45768 - DNA, 25 bp, S. cerevisiae
gggttaacctcggattcatctttag

SEQ ID NO: 45769 - DNA, 25 bp, S. cerevisiae
gggttgaccccgcatttgatgagaa

SEQ ID NO: 45770 - DNA, 25 bp, S. cerevisiae
gggaatcctccacgaatttacacaa

SEQ ID NO: 45771 - DNA, 25 bp, S. cerevisiae
gggagtcgctcgagaaacagccaaa

SEQ ID NO: 45772 - DNA, 25 bp, S. cerevisiae
gggagtcgcattacaaaccaccgtc

SEQ ID NO: 45773 - DNA, 25 bp, S. cerevisiae
gggagtactttcgaaccataatgat

SEQ ID NO: 45774 - DNA, 25 bp, S. cerevisiae
gggacagcctttgcaaactgaacat

SEQ ID NO: 45775 - DNA, 25 bp, S. cerevisiae
gggaatgccttatcgattggacact

SEQ ID NO: 45776 - DNA, 25 bp, S. cerevisiae
gggaacctcaactgcattgcgaatt

SEQ ID NO: 45777 - DNA, 25 bp, S. cerevisiae
gggacaccaaacacacatcagattt

SEQ ID NO: 45778 - DNA, 25 bp, S. cerevisiae
gggaaaccactcaacaacaattgct

SEQ ID NO: 45779 - DNA, 25 bp, S. cerevisiae
gggaaccgtctcaattggcgattta

SEQ ID NO: 45780 - DNA, 25 bp, S. cerevisiae
gggaacattcaaatcataccaacaa

SEQ ID NO: 45781 - DNA, 25 bp, S. cerevisiae
gggagtcattgcaaccttcatacac

SEQ ID NO: 45782 - DNA, 25 bp, S. cerevisiae
gggagtcattgatatttctacagca

SEQ ID NO: 45783 - DNA, 25 bp, S. cerevisiae
gggagtagcgtccttgattgacaaa

SEQ ID NO: 45784 - DNA, 25 bp, S. cerevisiae
gggaagctggtatcccaggcaaaga

SEQ ID NO: 45785 - DNA, 25 bp, S. cerevisiae
gggaacatgagtttacctccaaaga

SEQ ID NO: 45786 - DNA, 25 bp, S. cerevisiae
gggaagctctcttttacatttcagg

SEQ ID NO: 45787 - DNA, 25 bp, S. cerevisiae
gggaatctgcaattctacacaattc

SEQ ID NO: 45788 - DNA, 25 bp, S. cerevisiae
gggacatatcagtactacatctgtt

SEQ ID NO: 45789 - DNA, 25 bp, S. cerevisiae
ggaatttcgaacctgtttttgccat

SEQ ID NO: 45790 - DNA, 25 bp, S. cerevisiae
ggagttattaatcagcggtttgcct

SEQ ID NO: 45791 - DNA, 25 bp, S. cerevisiae
gggttactacaccatcggtctaggt

SEQ ID NO: 45792 - DNA, 25 bp, S. cerevisiae
gggatctatccaccgttggttgaga

SEQ ID NO: 45793 - DNA, 25 bp, S. cerevisiae
gggaatgcatctaactgttcgttga

SEQ ID NO: 45794 - DNA, 25 bp, S. cerevisiae
gggacataccatttagctggtccaa

SEQ ID NO: 45795 - DNA, 25 bp, S. cerevisiae
gggacaccacaagcatagttcttct

SEQ ID NO: 45796 - DNA, 25 bp, S. cerevisiae
gggacggtctcactgaacattctat

SEQ ID NO: 45797 - DNA, 25 bp, S. cerevisiae
gggacgcccgacaatcaaaatatct

SEQ ID NO: 45798 - DNA, 25 bp, S. cerevisiae
gggaagccatcgatgcacaaacaat

SEQ ID NO: 45799 - DNA, 25 bp, S. cerevisiae
gggaagccattacgcacataaacac

SEQ ID NO: 45800 - DNA, 25 bp, S. cerevisiae
gggaagccaatactaagcaaactga

SEQ ID NO: 45801 - DNA, 25 bp, S. cerevisiae
gggtactaccaacaagaactgaaag

SEQ ID NO: 45802 - DNA, 25 bp, S. cerevisiae
gggatactaccgaggagaccgaagt

SEQ ID NO: 45803 - DNA, 25 bp, S. cerevisiae
gggatactaccgtaagggctccatt

SEQ ID NO: 45804 - DNA, 25 bp, S. cerevisiae
gggtcattaccatgggtgcttccac

SEQ ID NO: 45805 - DNA, 25 bp, S. cerevisiae
gggagcatacgtcaaacttccgcac

SEQ ID NO: 45806 - DNA, 25 bp, S. cerevisiae
gggagtacatatccgacctttcaac

SEQ ID NO: 45807 - DNA, 25 bp, S. cerevisiae
gggatttatacccacctgaacagcc

SEQ ID NO: 45808 - DNA, 25 bp, S. cerevisiae
gggtgaagatgaacatagcccttta

SEQ ID NO: 45809 - DNA, 25 bp, S. cerevisiae
gggtagcacagaacacgccgatgat

SEQ ID NO: 45810 - DNA, 25 bp, S. cerevisiae
gggatcatccagtaatcgccggagt

SEQ ID NO: 45811 - DNA, 25 bp, S. cerevisiae
ggttacccaatctgttcgtgttgaa

SEQ ID NO: 45812 - DNA, 25 bp, S. cerevisiae
ggtggcccacataaggttggtccaa

SEQ ID NO: 45813 - DNA, 25 bp, S. cerevisiae
gggaaccatgaatgtgcttccatta

SEQ ID NO: 45814 - DNA, 25 bp, S. cerevisiae
gggaaaccgccaaatgcagcttcga

SEQ ID NO: 45815 - DNA, 25 bp, S. cerevisiae
gggacagacctgcaagaagctcttg

SEQ ID NO: 45816 - DNA, 25 bp, S. cerevisiae
gggacagacgctatattatgccttc

SEQ ID NO: 45817 - DNA, 25 bp, S. cerevisiae
gggaccatcattcatttttctacga

SEQ ID NO: 45818 - DNA, 25 bp, S. cerevisiae
gggactctcagaaattttttatcat

SEQ ID NO: 45819 - DNA, 25 bp, S. cerevisiae
gggagactctgatttttctttgact

SEQ ID NO: 45820 - DNA, 25 bp, S. cerevisiae
gggacattccttttctcatattgtg

SEQ ID NO: 45821 - DNA, 25 bp, S. cerevisiae
gggatgggccatgttatccatttga

SEQ ID NO: 45822 - DNA, 25 bp, S. cerevisiae
gggatgggattctgtacctattgaa

SEQ ID NO: 45823 - DNA, 25 bp, S. cerevisiae
ggaaaggaacgcataccgactaaag

SEQ ID NO: 45824 - DNA, 25 bp, S. cerevisiae
ggaaaggaccatatccaggaacaat

SEQ ID NO: 45825 - DNA, 25 bp, S. cerevisiae
gggaggctactccatctgaaaagga

SEQ ID NO: 45826 - DNA, 25 bp, S. cerevisiae
gggatacctcctgcgaagaaactat

SEQ ID NO: 45827 - DNA, 25 bp, S. cerevisiae
gggaagcctcctacataagtcaaaa

SEQ ID NO: 45828 - DNA, 25 bp, S. cerevisiae
gggagtctcccaaccacgtcaagag

SEQ ID NO: 45829 - DNA, 25 bp, S. cerevisiae
gggagattgcccaaccatcgtcgag

SEQ ID NO: 45830 - DNA, 25 bp, S. cerevisiae
gggatgtcaattcgtaccttagacg

SEQ ID NO: 45831 - DNA, 25 bp, S. cerevisiae
gggttgctagggtcacttacgatat

SEQ ID NO: 45832 - DNA, 25 bp, S. cerevisiae
gggttgttaattgcattcagcgatt

SEQ ID NO: 45833 - DNA, 25 bp, S. cerevisiae
gggtgtttgcgcaggagtttactca

SEQ ID NO: 45834 - DNA, 25 bp, S. cerevisiae
gggatctacttcaacatcatctagt

SEQ ID NO: 45835 - DNA, 25 bp, S. cerevisiae
gggaacattctagtggccatcaaca

SEQ ID NO: 45836 - DNA, 25 bp, S. cerevisiae
gggatgagcattccttagccaaaga

SEQ ID NO: 45837 - DNA, 25 bp, S. cerevisiae
gggtactacctgctatttaattttg

SEQ ID NO: 45838 - DNA, 25 bp, S. cerevisiae
gggtgctttattttggttgttctct

SEQ ID NO: 45839 - DNA, 25 bp, S. cerevisiae
gggttgttactactggtgcttctac

SEQ ID NO: 45840 - DNA, 25 bp, S. cerevisiae
gggttgtgtagttcgtactttccag

SEQ ID NO: 45841 - DNA, 25 bp, S. cerevisiae
gggtcgtatttctagatacttggct

SEQ ID NO: 45842 - DNA, 25 bp, S. cerevisiae
gggtttgccaaatacgttcctgacg

SEQ ID NO: 45843 - DNA, 25 bp, S. cerevisiae
gggaaactccgaaacatgcgattga

SEQ ID NO: 45844 - DNA, 25 bp, S. cerevisiae
gggaaagcccatattcatcatttta

SEQ ID NO: 45845 - DNA, 25 bp, S. cerevisiae
gggaccgctgtcaaatattccgttt

SEQ ID NO: 45846 - DNA, 25 bp, S. cerevisiae
gggtcgtatcgctaagaacgccatt

SEQ ID NO: 45847 - DNA, 25 bp, S. cerevisiae
gggtcctattcctggagcgaatgat

SEQ ID NO: 45848 - DNA, 25 bp, S. cerevisiae
gggacctgcattcattcaacgtaga

SEQ ID NO: 45849 - DNA, 25 bp, S. cerevisiae
gggtccgccgagttcaacgtgaaat

SEQ ID NO: 45850 - DNA, 25 bp, S. cerevisiae
gggtgtctcggatagaattcgcgat

SEQ ID NO: 45851 - DNA, 25 bp, S. cerevisiae
gggttttcgtgatgcaattcaacta

SEQ ID NO: 45852 - DNA, 25 bp, S. cerevisiae
gggattccacatggataagattaac

SEQ ID NO: 45853 - DNA, 25 bp, S. cerevisiae
gggacatcaactcgcaaggtttcaa

SEQ ID NO: 45854 - DNA, 25 bp, S. cerevisiae
gggaacaaccctagcgatttcatca

SEQ ID NO: 45855 - DNA, 25 bp, S. cerevisiae
gggagcttacgaagtcgcattgaaa

SEQ ID NO: 45856 - DNA, 25 bp, S. cerevisiae
gggaaacagtctaccctttgacaat

SEQ ID NO: 45857 - DNA, 25 bp, S. cerevisiae
gggaacacaggtacctcctatgaat

SEQ ID NO: 45858 - DNA, 25 bp, S. cerevisiae
gggtacaaggatttctgccactgaa

SEQ ID NO: 45859 - DNA, 25 bp, S. cerevisiae
gggagttagggttctgccagtataa

SEQ ID NO: 45860 - DNA, 25 bp, S. cerevisiae
gggtttcctcctcaagatttagtct

SEQ ID NO: 45861 - DNA, 25 bp, S. cerevisiae
gggtgtcccttacacacaagaagtc

SEQ ID NO: 45862 - DNA, 25 bp, S. cerevisiae
gggtgatgcccctgtaagaagtttg

SEQ ID NO: 45863 - DNA, 25 bp, S. cerevisiae
gggttaaccgcgataaatgtgtccg

SEQ ID NO: 45864 - DNA, 25 bp, S. cerevisiae
gggttgacaccacaaagcagcattt

SEQ ID NO: 45865 - DNA, 25 bp, S. cerevisiae
gggttgtcatctctattcacatggg

SEQ ID NO: 45866 - DNA, 25 bp, S. cerevisiae
gggactattcactgacaatggcaca

SEQ ID NO: 45867 - DNA, 25 bp, S. cerevisiae
gggacgaatccttgactgtagacaa

SEQ ID NO: 45868 - DNA, 25 bp, S. cerevisiae
gggacgcattcgcagtatacgacaa

SEQ ID NO: 45869 - DNA, 25 bp, S. cerevisiae
gggacagatttcaatttgatctcac

SEQ ID NO: 45870 - DNA, 25 bp, S. cerevisiae
gggacagaatttttcatcagctaca

SEQ ID NO: 45871 - DNA, 25 bp, S. cerevisiae
gggaccacggtcttcatcagaaata

SEQ ID NO: 45872 - DNA, 25 bp, S. cerevisiae
gggatccacggcatactcattgagt

SEQ ID NO: 45873 - DNA, 25 bp, S. cerevisiae
gggtccacgcacaaagtctatcatg

SEQ ID NO: 45874 - DNA, 25 bp, S. cerevisiae
ggtgtcgccaacagaggtagctcaa

SEQ ID NO: 45875 - DNA, 25 bp, S. cerevisiae
gggtcgctcaagagggccacttaat

SEQ ID NO: 45876 - DNA, 25 bp, S. cerevisiae
gggacctccagaaagccaacttagt

SEQ ID NO: 45877 - DNA, 25 bp, S. cerevisiae
gggactcttatcttaccaacatttt

SEQ ID NO: 45878 - DNA, 25 bp, S. cerevisiae
gggacctgtgtcttggcaataattc

SEQ ID NO: 45879 - DNA, 25 bp, S. cerevisiae
gggttcttcaatggccaactggcaa

SEQ ID NO: 45880 - DNA, 25 bp, S. cerevisiae
gggagcttcatgaatctctgatttt

SEQ ID NO: 45881 - DNA, 25 bp, S. cerevisiae
gggagctttaatccattatctgctg

SEQ ID NO: 45882 - DNA, 25 bp, S. cerevisiae
gggttcgttccatagacgttctagg

SEQ ID NO: 45883 - DNA, 25 bp, S. cerevisiae
gggatttttccctgagctggtaaga

SEQ ID NO: 45884 - DNA, 25 bp, S. cerevisiae
gggtttcttccgaagaattgctgaa

SEQ ID NO: 45885 - DNA, 25 bp, S. cerevisiae
gggacgtctctccagatcagaaatc

SEQ ID NO: 45886 - DNA, 25 bp, S. cerevisiae
gggacagatctttcgataacagatt

SEQ ID NO: 45887 - DNA, 25 bp, S. cerevisiae
gggagaatcttcgagccaatgcaaa

SEQ ID NO: 45888 - DNA, 25 bp, S. cerevisiae
gggaaattctgcaactcaacctgaa

SEQ ID NO: 45889 - DNA, 25 bp, S. cerevisiae
gggatataaccgaattactcttcaa

SEQ ID NO: 45890 - DNA, 25 bp, S. cerevisiae
gggtaaagccactattgacattcta

SEQ ID NO: 45891 - DNA, 25 bp, S. cerevisiae
gggacccgacataattgcagcattt

SEQ ID NO: 45892 - DNA, 25 bp, S. cerevisiae
gggacaccgacagccacagatatgg

SEQ ID NO: 45893 - DNA, 25 bp, S. cerevisiae
gggaccaaggactcatctatcgatg

SEQ ID NO: 45894 - DNA, 25 bp, S. cerevisiae
gggtatttgtactcacttaggttgt

SEQ ID NO: 45895 - DNA, 25 bp, S. cerevisiae
ggtgttttacgatatctccaggttt

SEQ ID NO: 45896 - DNA, 25 bp, S. cerevisiae
gggttttagcgctgattactgttac

SEQ ID NO: 45897 - DNA, 25 bp, S. cerevisiae
gggatttcgttctcaatcagttact

SEQ ID NO: 45898 - DNA, 25 bp, S. cerevisiae
ggtccaaagttcagaattcctcctc

SEQ ID NO: 45899 - DNA, 25 bp, S. cerevisiae
ggtgccaagactattattttcccta

SEQ ID NO: 45900 - DNA, 25 bp, S. cerevisiae
gggtcaaactcacttataattctcc

SEQ ID NO: 45901 - DNA, 25 bp, S. cerevisiae
gggtggatattcctctatgaactca

SEQ ID NO: 45902 - DNA, 25 bp, S. cerevisiae
gggatgttacagctttgccacatat

SEQ ID NO: 45903 - DNA, 25 bp, S. cerevisiae
gggatttatgggtcctgtcatccat

SEQ ID NO: 45904 - DNA, 25 bp, S. cerevisiae
gggattcataatgccctgtcattcg

SEQ ID NO: 45905 - DNA, 25 bp, S. cerevisiae
gggagtattacgatccaagactgat

SEQ ID NO: 45906 - DNA, 25 bp, S. cerevisiae
gggaggattcaacatcagcaaactt

SEQ ID NO: 45907 - DNA, 25 bp, S. cerevisiae
gggtgaattccacgccaaagaactg

SEQ ID NO: 45908 - DNA, 25 bp, S. cerevisiae
gggatcaattcaccccaggcaaaat

SEQ ID NO: 45909 - DNA, 25 bp, S. cerevisiae
gggagaattaccatcataccttttg

SEQ ID NO: 45910 - DNA, 25 bp, S. cerevisiae
gggagatctctatatttaccgttta

SEQ ID NO: 45911 - DNA, 25 bp, S. cerevisiae
gggatgttttgaatttacctgttct

SEQ ID NO: 45912 - DNA, 25 bp, S. cerevisiae
gggatttttatctttttgcgacaga

SEQ ID NO: 45913 - DNA, 25 bp, S. cerevisiae
gggatccttcccaattttccaatga

SEQ ID NO: 45914 - DNA, 25 bp, S. cerevisiae
ggaatctccaaatgggacttcgtaa

SEQ ID NO: 45915 - DNA, 25 bp, S. cerevisiae
gggtctccaaaatttacttcggatg

SEQ ID NO: 45916 - DNA, 25 bp, S. cerevisiae
gggatctcccaagcttccaattggg

SEQ ID NO: 45917 - DNA, 25 bp, S. cerevisiae
gggtcaggtaataactcgactccta

SEQ ID NO: 45918 - DNA, 25 bp, S. cerevisiae
gggtcatttactaacggagcctctg

SEQ ID NO: 45919 - DNA, 25 bp, S. cerevisiae
gggtactttcagaccaggtttcgat

SEQ ID NO: 45920 - DNA, 25 bp, S. cerevisiae
gggtacaaatttcctcgatttcata

SEQ ID NO: 45921 - DNA, 25 bp, S. cerevisiae
gggtgatgacctactatccactagt

SEQ ID NO: 45922 - DNA, 25 bp, S. cerevisiae
gggactacttctatgtcgtcgaaaa

SEQ ID NO: 45923 - DNA, 25 bp, S. cerevisiae
gggatcacaatcctattgtcttgac

SEQ ID NO: 45924 - DNA, 25 bp, S. cerevisiae
gggtctagaccttatgtttgacgaa

SEQ ID NO: 45925 - DNA, 25 bp, S. cerevisiae
gggactggccaatttgtttgctaaa

SEQ ID NO: 45926 - DNA, 25 bp, S. cerevisiae
gggaggtccaaactgacttccacac

SEQ ID NO: 45927 - DNA, 25 bp, S. cerevisiae
gggaggactctgattatctatccaa

SEQ ID NO: 45928 - DNA, 25 bp, S. cerevisiae
gggacgttggtagctatgctcctat

SEQ ID NO: 45929 - DNA, 25 bp, S. cerevisiae
gggtatggtacggtgctatctgccc

SEQ ID NO: 45930 - DNA, 25 bp, S. cerevisiae
gggaggatgtcttaactgcatgtaa

SEQ ID NO: 45931 - DNA, 25 bp, S. cerevisiae
gggagctctgcttcactattaaaaa

SEQ ID NO: 45932 - DNA, 25 bp, S. cerevisiae
gggatgcctcttacgactataatga

SEQ ID NO: 45933 - DNA, 25 bp, S. cerevisiae
gggatgccaccgaagaccaaataaa

SEQ ID NO: 45934 - DNA, 25 bp, S. cerevisiae
ggtggtgccacgagaacagaaaact

SEQ ID NO: 45935 - DNA, 25 bp, S. cerevisiae
gggagtgccaccagaaacggatttc

SEQ ID NO: 45936 - DNA, 25 bp, S. cerevisiae
ggtggccagcccaagaaacggactt

SEQ ID NO: 45937 - DNA, 25 bp, S. cerevisiae
ggtggccccattcgacaaaagacta

SEQ ID NO: 45938 - DNA, 25 bp, S. cerevisiae
ggtgtccctactcaaaaccattgat

SEQ ID NO: 45939 - DNA, 25 bp, S. cerevisiae
gggtccataactccactaactttag

SEQ ID NO: 45940 - DNA, 25 bp, S. cerevisiae
gggattatgcgcagttctctatgga

SEQ ID NO: 45941 - DNA, 25 bp, S. cerevisiae
gggtgatatccttttcctatggaat

SEQ ID NO: 45942 - DNA, 25 bp, S. cerevisiae
gggagctcaatttgttactagtaga

SEQ ID NO: 45943 - DNA, 25 bp, S. cerevisiae
gggatccaataacttcctgcgtaaa

SEQ ID NO: 45944 - DNA, 25 bp, S. cerevisiae
gggatctgatggtctttcctcgcta

SEQ ID NO: 45945 - DNA, 25 bp, S. cerevisiae
gggatgctgtggtaaaggctcttaa

SEQ ID NO: 45946 - DNA, 25 bp, S. cerevisiae
gggttggtgaaattggccgcttaat

SEQ ID NO: 45947 - DNA, 25 bp, S. cerevisiae
gggattcgtttttggtcctcaaatg

SEQ ID NO: 45948 - DNA, 25 bp, S. cerevisiae
gggatttgctttccaggaccactaa

SEQ ID NO: 45949 - DNA, 25 bp, S. cerevisiae
gggatgaactctcacaaggtcctaa

SEQ ID NO: 45950 - DNA, 25 bp, S. cerevisiae
gggagatgacgctagaatcgaacaa

SEQ ID NO: 45951 - DNA, 25 bp, S. cerevisiae
gggagaacacaccattcttacaaag

SEQ ID NO: 45952 - DNA, 25 bp, S. cerevisiae
gggattaataccacctggcacatta

SEQ ID NO: 45953 - DNA, 25 bp, S. cerevisiae
tggttcgtaaccacccagacagagg

SEQ ID NO: 45954 - DNA, 25 bp, S. cerevisiae
ggtgtcgaaaccattgccaagtgta

SEQ ID NO: 45955 - DNA, 25 bp, S. cerevisiae
gggactgccaatctatatcacaatg

SEQ ID NO: 45956 - DNA, 25 bp, S. cerevisiae
gggatgctgaagtttctatcacatt

SEQ ID NO: 45957 - DNA, 25 bp, S. cerevisiae
gggattacacgaactatgcgataaa

SEQ ID NO: 45958 - DNA, 25 bp, S. cerevisiae
gggatgatctcatgaatctatgggt

SEQ ID NO: 45959 - DNA, 25 bp, S. cerevisiae
gggatgtctcaattcactactgcct

SEQ ID NO: 45960 - DNA, 25 bp, S. cerevisiae
gggttgctcattacaatcggcgcat

SEQ ID NO: 45961 - DNA, 25 bp, S. cerevisiae
gggttcctttgcttacttatttgca

SEQ ID NO: 45962 - DNA, 25 bp, S. cerevisiae
gggttcttttgccaatttgtactat

SEQ ID NO: 45963 - DNA, 25 bp, S. cerevisiae
gggttctgaattgcttctttaccat

SEQ ID NO: 45964 - DNA, 25 bp, S. cerevisiae
gggtttaactaccatgctgattacg

SEQ ID NO: 45965 - DNA, 25 bp, S. cerevisiae
gggatctttttaacaggcttggagg

SEQ ID NO: 45966 - DNA, 25 bp, S. cerevisiae
gggagattttcatacgtatcgtcat

SEQ ID NO: 45967 - DNA, 25 bp, S. cerevisiae
ggctactttccacaactagggtaca

SEQ ID NO: 45968 - DNA, 25 bp, S. cerevisiae
gggtggtatcctgactgacggtaaa

SEQ ID NO: 45969 - DNA, 25 bp, S. cerevisiae
gggagattttccacaacgtgactaa

SEQ ID NO: 45970 - DNA, 25 bp, S. cerevisiae
gggagatccttcgaaatacttacga

SEQ ID NO: 45971 - DNA, 25 bp, S. cerevisiae
gggagatcctgaacaagccaccaac

SEQ ID NO: 45972 - DNA, 25 bp, S. cerevisiae
gggtgtgcgctacaatgagcccaat

SEQ ID NO: 45973 - DNA, 25 bp, S. cerevisiae
ggtggtggtatcaaaaaatctggta

SEQ ID NO: 45974 - DNA, 25 bp, S. cerevisiae
gggagatgccattcttatacggtaa

SEQ ID NO: 45975 - DNA, 25 bp, S. cerevisiae
gggaggaaattctacagcattgctt

SEQ ID NO: 45976 - DNA, 25 bp, S. cerevisiae
gggatctggaattaacgagtctatt

SEQ ID NO: 45977 - DNA, 25 bp, S. cerevisiae
gggatcttccattcaacggatttat

SEQ ID NO: 45978 - DNA, 25 bp, S. cerevisiae
gggatcatctacacaaggcgttaag

SEQ ID NO: 45979 - DNA, 25 bp, S. cerevisiae
ggaggcatctacaacgacctgtcat

SEQ ID NO: 45980 - DNA, 25 bp, S. cerevisiae
gggtcacgtagacactgttgctaat

SEQ ID NO: 45981 - DNA, 25 bp, S. cerevisiae
gggatgccttaaccactgattcaga

SEQ ID NO: 45982 - DNA, 25 bp, S. cerevisiae
gggatgagctattccaatctttgag

SEQ ID NO: 45983 - DNA, 25 bp, S. cerevisiae
gggtagtcatatccctcaattaact

SEQ ID NO: 45984 - DNA, 25 bp, S. cerevisiae
ggagaagatgttccctcgagtcaac

SEQ ID NO: 45985 - DNA, 25 bp, S. cerevisiae
gggtacactttgctcctgggtaata

SEQ ID NO: 45986 - DNA, 25 bp, S. cerevisiae
gggtactacttacttcggtgtacat

SEQ ID NO: 45987 - DNA, 25 bp, S. cerevisiae
ggtttacctaagtggtgatgtccat

SEQ ID NO: 45988 - DNA, 25 bp, S. cerevisiae
ggtttgggtgttgcggctatttatc

SEQ ID NO: 45989 - DNA, 25 bp, S. cerevisiae
gggttttcatctatcttaatttcca

SEQ ID NO: 45990 - DNA, 25 bp, S. cerevisiae
gggtccacggatattgaatccactc

SEQ ID NO: 45991 - DNA, 25 bp, S. cerevisiae
gggttcactactatatcaattgcac

SEQ ID NO: 45992 - DNA, 25 bp, S. cerevisiae
gggttcctcacttcgcaaaaatgca

SEQ ID NO: 45993 - DNA, 25 bp, S. cerevisiae
gggattacacctgatctagcgagta

SEQ ID NO: 45994 - DNA, 25 bp, S. cerevisiae
gggatgtttcatcatttcaggaact

SEQ ID NO: 45995 - DNA, 25 bp, S. cerevisiae
gggtcacatgggtggtccaaagcaa

SEQ ID NO: 45996 - DNA, 25 bp, S. cerevisiae
ggatgaaacgtaccattgaacccga

SEQ ID NO: 45997 - DNA, 25 bp, S. cerevisiae
gggatattgaccaacgtagataact

SEQ ID NO: 45998 - DNA, 25 bp, S. cerevisiae
gggatactatcttccgtctgaaacc

SEQ ID NO: 45999 - DNA, 25 bp, S. cerevisiae
gggtccaactattgcgcctgcaaat

SEQ ID NO: 46000 - DNA, 25 bp, S. cerevisiae
gggttggaacctttagctgctgatt

SEQ ID NO: 46001 - DNA, 25 bp, S. cerevisiae
ggtatagccatttatcgaagtcgtt

SEQ ID NO: 46002 - DNA, 25 bp, S. cerevisiae
ggtcatgcacttcaacaaggtcggt

SEQ ID NO: 46003 - DNA, 25 bp, S. cerevisiae
ggttatcttcaacaaggacaagcca

SEQ ID NO: 46004 - DNA, 25 bp, S. cerevisiae
ggcgttcatcaccaagacaatcgag

SEQ ID NO: 46005 - DNA, 25 bp, S. cerevisiae
gggtttccaaagtcctctagaagat

SEQ ID NO: 46006 - DNA, 25 bp, S. cerevisiae
gggttaccaaaagatcgatagcatt

SEQ ID NO: 46007 - DNA, 25 bp, S. cerevisiae
gggttaccgatcaagttcgtatcat

SEQ ID NO: 46008 - DNA, 25 bp, S. cerevisiae
gggtctaaccacatgaacgtatctt

SEQ ID NO: 46009 - DNA, 25 bp, S. cerevisiae
gggttcaacactaattatgcgtacg

SEQ ID NO: 46010 - DNA, 25 bp, S. cerevisiae
gggttgctgttagttccatgattga

SEQ ID NO: 46011 - DNA, 25 bp, S. cerevisiae
gggatttgtctaggccatcaactct

SEQ ID NO: 46012 - DNA, 25 bp, S. cerevisiae
gggatttgccatttgcgtaacgttt

SEQ ID NO: 46013 - DNA, 25 bp, S. cerevisiae
gggtatctccatcaggttagtacct

SEQ ID NO: 46014 - DNA, 25 bp, S. cerevisiae
gggtgttaacgcaaattcttcctat

SEQ ID NO: 46015 - DNA, 25 bp, S. cerevisiae
ggtgttttacgcacttcatggacat

SEQ ID NO: 46016 - DNA, 25 bp, S. cerevisiae
gggatgccttgatcacttattccaa

SEQ ID NO: 46017 - DNA, 25 bp, S. cerevisiae
gggatgtcagttactcttttcaaga

SEQ ID NO: 46018 - DNA, 25 bp, S. cerevisiae
gggaggctgttaactctttagcgat

SEQ ID NO: 46019 - DNA, 25 bp, S. cerevisiae
gggaggttgctcactttatgtagaa

SEQ ID NO: 46020 - DNA, 25 bp, S. cerevisiae
gggtgcgattctattggattgataa

SEQ ID NO: 46021 - DNA, 25 bp, S. cerevisiae
gggtgctgtcatgaccgttagtgaa

SEQ ID NO: 46022 - DNA, 25 bp, S. cerevisiae
gggtagccaagagctcattcgtaag

SEQ ID NO: 46023 - DNA, 25 bp, S. cerevisiae
gggatcaccaaattccttgcttttg

SEQ ID NO: 46024 - DNA, 25 bp, S. cerevisiae
gggtccacaatttcctgtgatgggt

SEQ ID NO: 46025 - DNA, 25 bp, S. cerevisiae
gggttcgaatttgcagcgatgtcca

SEQ ID NO: 46026 - DNA, 25 bp, S. cerevisiae
gggttctgcatttaacgttatccaa

SEQ ID NO: 46027 - DNA, 25 bp, S. cerevisiae
gggttgccttgttaattgctggcca

SEQ ID NO: 46028 - DNA, 25 bp, S. cerevisiae
gggttgcaagtttgatcttcgtcca

SEQ ID NO: 46029 - DNA, 25 bp, S. cerevisiae
gggatggccatcatggctcttacaa

SEQ ID NO: 46030 - DNA, 25 bp, S. cerevisiae
gggtccatcggttatcgttacaact

SEQ ID NO: 46031 - DNA, 25 bp, S. cerevisiae
gggatcatctttaatactttcacaa

SEQ ID NO: 46032 - DNA, 25 bp, S. cerevisiae
gggatgtatgcttctaaccttcaat

SEQ ID NO: 46033 - DNA, 25 bp, S. cerevisiae
ggtggctgcctatgaatcacttggt

SEQ ID NO: 46034 - DNA, 25 bp, S. cerevisiae
gggagtgctccattgataccttgcc

SEQ ID NO: 46035 - DNA, 25 bp, S. cerevisiae
gggagtaccatttaacattgcatca

SEQ ID NO: 46036 - DNA, 25 bp, S. cerevisiae
gggagtatgcgccaaatagttttca

SEQ ID NO: 46037 - DNA, 25 bp, S. cerevisiae
gggaggcagagcacaaaccttctca

SEQ ID NO: 46038 - DNA, 25 bp, S. cerevisiae
gggatggcatgaacttagactcttt

SEQ ID NO: 46039 - DNA, 25 bp, S. cerevisiae
gggttcttctgccaaacattctcct

SEQ ID NO: 46040 - DNA, 25 bp, S. cerevisiae
gggagtgctttgctacagctatact

SEQ ID NO: 46041 - DNA, 25 bp, S. cerevisiae
gggtgtcttatgcttttgtacttta

SEQ ID NO: 46042 - DNA, 25 bp, S. cerevisiae
gggatgtctctagatttctgttctt

SEQ ID NO: 46043 - DNA, 25 bp, S. cerevisiae
gggttcacattgttggacctgccag

SEQ ID NO: 46044 - DNA, 25 bp, S. cerevisiae
gggttcacctatttgaagatcctga

SEQ ID NO: 46045 - DNA, 25 bp, S. cerevisiae
gggtacgctttctgaaattctcaaa

SEQ ID NO: 46046 - DNA, 25 bp, S. cerevisiae
gggtacgattcgcaagaacttagat

SEQ ID NO: 46047 - DNA, 25 bp, S. cerevisiae
gggttccttcgatctagagctgtaa

SEQ ID NO: 46048 - DNA, 25 bp, S. cerevisiae
gggtactaacgattttgcctactct

SEQ ID NO: 46049 - DNA, 25 bp, S. cerevisiae
gggatgccacattcacaacaaggtg

SEQ ID NO: 46050 - DNA, 25 bp, S. cerevisiae
gggatccactatgaacaccgtttaa

SEQ ID NO: 46051 - DNA, 25 bp, S. cerevisiae
gggtcacaccaacaaggccgttaag

SEQ ID NO: 46052 - DNA, 25 bp, S. cerevisiae
gggttactatccaacaatcagctgt

SEQ ID NO: 46053 - DNA, 25 bp, S. cerevisiae
gggttcacccacatcagaatggcaa

SEQ ID NO: 46054 - DNA, 25 bp, S. cerevisiae
tgggttcaggaagctctcgaggcta

SEQ ID NO: 46055 - DNA, 25 bp, S. cerevisiae
gggttagcgacaagctccaacttca

SEQ ID NO: 46056 - DNA, 25 bp, S. cerevisiae
gggttatcagctcaagtggccatat

SEQ ID NO: 46057 - DNA, 25 bp, S. cerevisiae
gggtttcgaagctagtgggctcatt

SEQ ID NO: 46058 - DNA, 25 bp, S. cerevisiae
gggatttagaagcaatacctgccat

SEQ ID NO: 46059 - DNA, 25 bp, S. cerevisiae
gggttttaccaaatacatcggcagc

SEQ ID NO: 46060 - DNA, 25 bp, S. cerevisiae
gggttcttaccgtagaccagatgac

SEQ ID NO: 46061 - DNA, 25 bp, S. cerevisiae
gggtctttcgcccagtgaagcagaa

SEQ ID NO: 46062 - DNA, 25 bp, S. cerevisiae
gggtaattccgccagtaacatcata

SEQ ID NO: 46063 - DNA, 25 bp, S. cerevisiae
gggatccggcacgttgatatgcaac

SEQ ID NO: 46064 - DNA, 25 bp, S. cerevisiae
ggccatccggcaaccaactaggtat

SEQ ID NO: 46065 - DNA, 25 bp, S. cerevisiae
gggatcctggaaaaagctagtctct

SEQ ID NO: 46066 - DNA, 25 bp, S. cerevisiae
gggatacgtctaacaactattcatt

SEQ ID NO: 46067 - DNA, 25 bp, S. cerevisiae
ggattcgcagatcaaaaccttattt

SEQ ID NO: 46068 - DNA, 25 bp, S. cerevisiae
ggcggcccaaagacaaagccacgtt

SEQ ID NO: 46069 - DNA, 25 bp, S. cerevisiae
ggtgagctccaatgtgcagcaacca

SEQ ID NO: 46070 - DNA, 25 bp, S. cerevisiae
tgctggtgctcgtggaagctccgca

SEQ ID NO: 46071 - DNA, 25 bp, S. cerevisiae
ggcatggcaagctcgaaccgtttta

SEQ ID NO: 46072 - DNA, 25 bp, S. cerevisiae
ggtggtaccttatctacattcgtta

SEQ ID NO: 46073 - DNA, 25 bp, S. cerevisiae
ggtggtacctttgctgtttacgaat

SEQ ID NO: 46074 - DNA, 25 bp, S. cerevisiae
ggtggtaagatgaagcctctaaagc

SEQ ID NO: 46075 - DNA, 25 bp, S. cerevisiae
gggttatagtgagcccagatgttat

SEQ ID NO: 46076 - DNA, 25 bp, S. cerevisiae
gggtcaaattttgcaagacgcattt

SEQ ID NO: 46077 - DNA, 25 bp, S. cerevisiae
gggttaatctttgcattggccatgt

SEQ ID NO: 46078 - DNA, 25 bp, S. cerevisiae
gggtagcaacttttcattgaacgct

SEQ ID NO: 46079 - DNA, 25 bp, S. cerevisiae
gggtatcagacctgccattaacgtt

SEQ ID NO: 46080 - DNA, 25 bp, S. cerevisiae
gggttagccgcaggtattcacacta

SEQ ID NO: 46081 - DNA, 25 bp, S. cerevisiae
gggtttctcgaggaactcatcatcg

SEQ ID NO: 46082 - DNA, 25 bp, S. cerevisiae
gggtttctcattcaactttcgagcc

SEQ ID NO: 46083 - DNA, 25 bp, S. cerevisiae
gggttcaatatacaaggcttcgttc

SEQ ID NO: 46084 - DNA, 25 bp, S. cerevisiae
gggttcgctaatcaaggtgtcgctt

SEQ ID NO: 46085 - DNA, 25 bp, S. cerevisiae
gggattactatactgccacaaattt

SEQ ID NO: 46086 - DNA, 25 bp, S. cerevisiae
gggatataccaactgctcaagaatt

SEQ ID NO: 46087 - DNA, 25 bp, S. cerevisiae
gggtacatcaattctcacaggacat

SEQ ID NO: 46088 - DNA, 25 bp, S. cerevisiae
gggtactgagagtcaattgcataga

SEQ ID NO: 46089 - DNA, 25 bp, S. cerevisiae
gggtagctatgcatgtcttgaaaat

SEQ ID NO: 46090 - DNA, 25 bp, S. cerevisiae
gggattgtagctatcctgtaccaat

SEQ ID NO: 46091 - DNA, 25 bp, S. cerevisiae
gggttgatggcttctgtaatgacaa

SEQ ID NO: 46092 - DNA, 25 bp, S. cerevisiae
gggtttggctccatcggacaaaata

SEQ ID NO: 46093 - DNA, 25 bp, S. cerevisiae
gggattatggtttcgccaatgaaaa

SEQ ID NO: 46094 - DNA, 25 bp, S. cerevisiae
gggtttttgtatgtcacttactcag

SEQ ID NO: 46095 - DNA, 25 bp, S. cerevisiae
gggtgtttcagttttctttactcag

SEQ ID NO: 46096 - DNA, 25 bp, S. cerevisiae
gggttttacacattctctttactag

SEQ ID NO: 46097 - DNA, 25 bp, S. cerevisiae
gggattttaccttctcatattcttt

SEQ ID NO: 46098 - DNA, 25 bp, S. cerevisiae
gggattttacctaccaaatctgcag

SEQ ID NO: 46099 - DNA, 25 bp, S. cerevisiae
gggtttgtacaccatcatcagaaat

SEQ ID NO: 46100 - DNA, 25 bp, S. cerevisiae
gggatcttctcctttcagcaattag

SEQ ID NO: 46101 - DNA, 25 bp, S. cerevisiae
gggttctgaacctttgattcaacag

SEQ ID NO: 46102 - DNA, 25 bp, S. cerevisiae
gggtttgatgcatctttggcaccaa

SEQ ID NO: 46103 - DNA, 25 bp, S. cerevisiae
gggatcttgtcacctttggaccaaa

SEQ ID NO: 46104 - DNA, 25 bp, S. cerevisiae
gggtactccagttaggtctgcgatg

SEQ ID NO: 46105 - DNA, 25 bp, S. cerevisiae
gggtatcctcgttcggatgtcgatg

SEQ ID NO: 46106 - DNA, 25 bp, S. cerevisiae
gggatatccgtttcaacgtgctgat

SEQ ID NO: 46107 - DNA, 25 bp, S. cerevisiae
gggattgatttttaacgctctattt

SEQ ID NO: 46108 - DNA, 25 bp, S. cerevisiae
gggatcgatgttacaaaccaccaat

SEQ ID NO: 46109 - DNA, 25 bp, S. cerevisiae
ggtgtcggcctactatgacaacgat

SEQ ID NO: 46110 - DNA, 25 bp, S. cerevisiae
ggtgatcggcacaatgtcccaagaa

SEQ ID NO: 46111 - DNA, 25 bp, S. cerevisiae
gggtatccacaaacaagacaagcgt

SEQ ID NO: 46112 - DNA, 25 bp, S. cerevisiae
ggtttgcaataacattgggcccagt

SEQ ID NO: 46113 - DNA, 25 bp, S. cerevisiae
gggattcctgaacctattggcgccg

SEQ ID NO: 46114 - DNA, 25 bp, S. cerevisiae
gggttctattatcgctattccaagg

SEQ ID NO: 46115 - DNA, 25 bp, S. cerevisiae
gggttcctgttggtatattcagtaa

SEQ ID NO: 46116 - DNA, 25 bp, S. cerevisiae
gggattccaattgctgtgggcgtaa

SEQ ID NO: 46117 - DNA, 25 bp, S. cerevisiae
ggtaattcaaatgagtcccggtaca

SEQ ID NO: 46118 - DNA, 25 bp, S. cerevisiae
ggtcaaccaaaggaggaaagctgct

SEQ ID NO: 46119 - DNA, 25 bp, S. cerevisiae
ggtcaaccagaacaggaactccaat

SEQ ID NO: 46120 - DNA, 25 bp, S. cerevisiae
gggatatccacatgaacctccatta

SEQ ID NO: 46121 - DNA, 25 bp, S. cerevisiae
gggtagcacaattgaagccattttt

SEQ ID NO: 46122 - DNA, 25 bp, S. cerevisiae
gggttacgttcgaacactcatgctg

SEQ ID NO: 46123 - DNA, 25 bp, S. cerevisiae
gggattctcgcgttgagctacaata

SEQ ID NO: 46124 - DNA, 25 bp, S. cerevisiae
gggtttgctagctcaacctttgata

SEQ ID NO: 46125 - DNA, 25 bp, S. cerevisiae
gggtctttgcagttaaccgtccaag

SEQ ID NO: 46126 - DNA, 25 bp, S. cerevisiae
gggatagtattcaccaccgataaca

SEQ ID NO: 46127 - DNA, 25 bp, S. cerevisiae
ggaagtcgttccacctttatacaag

SEQ ID NO: 46128 - DNA, 25 bp, S. cerevisiae
gggtcatgaatctccagtcaactgg

SEQ ID NO: 46129 - DNA, 25 bp, S. cerevisiae
gggtaccagatctcgatatgcttcg

SEQ ID NO: 46130 - DNA, 25 bp, S. cerevisiae
gggtaaaactggaatatgctctgca

SEQ ID NO: 46131 - DNA, 25 bp, S. cerevisiae
gggtattcaacttgtcatttctgga

SEQ ID NO: 46132 - DNA, 25 bp, S. cerevisiae
gggtatcccagcagacatatacttg

SEQ ID NO: 46133 - DNA, 25 bp, S. cerevisiae
gggtaacactgcaactccatatttc

SEQ ID NO: 46134 - DNA, 25 bp, S. cerevisiae
gggtatacctgttatggctcatata

SEQ ID NO: 46135 - DNA, 25 bp, S. cerevisiae
ggtgggttactctacgacatcaagc

SEQ ID NO: 46136 - DNA, 25 bp, S. cerevisiae
ggtctgttgaccaataatggcataa

SEQ ID NO: 46137 - DNA, 25 bp, S. cerevisiae
ggtgatgcttggcaacaactgctaa

SEQ ID NO: 46138 - DNA, 25 bp, S. cerevisiae
gggatttgcagtctcaattgtacaa

SEQ ID NO: 46139 - DNA, 25 bp, S. cerevisiae
gggatattgcaacttcaccattaaa

SEQ ID NO: 46140 - DNA, 25 bp, S. cerevisiae
gggtatctctactatcccattcaaa

SEQ ID NO: 46141 - DNA, 25 bp, S. cerevisiae
gggtattctaacaccatcagagtcg

SEQ ID NO: 46142 - DNA, 25 bp, S. cerevisiae
gggtattgcttattcccacaagtgc

SEQ ID NO: 46143 - DNA, 25 bp, S. cerevisiae
gggtcattgttctatcttcaagcag

SEQ ID NO: 46144 - DNA, 25 bp, S. cerevisiae
gggtactactttgagcttagttcaa

SEQ ID NO: 46145 - DNA, 25 bp, S. cerevisiae
gggtattactttggttgctcagtcc

SEQ ID NO: 46146 - DNA, 25 bp, S. cerevisiae
gggttctttttacttcaagtcgcat

SEQ ID NO: 46147 - DNA, 25 bp, S. cerevisiae
ggtggttacaactgcctttaataat

SEQ ID NO: 46148 - DNA, 25 bp, S. cerevisiae
gggtcttccaacaccagttttgcaa

SEQ ID NO: 46149 - DNA, 25 bp, S. cerevisiae
gggtttcgcaaagagcaagtttcaa

SEQ ID NO: 46150 - DNA, 25 bp, S. cerevisiae
gggtttccatatcgctacagatgtt

SEQ ID NO: 46151 - DNA, 25 bp, S. cerevisiae
gggtctcttcaatctaagttggtgg

SEQ ID NO: 46152 - DNA, 25 bp, S. cerevisiae
gggtacttctaaacattcatcttct

SEQ ID NO: 46153 - DNA, 25 bp, S. cerevisiae
gggtactctttaatgaatgcttcca

SEQ ID NO: 46154 - DNA, 25 bp, S. cerevisiae
gggtacactgcagtcggtatcacca

SEQ ID NO: 46155 - DNA, 25 bp, S. cerevisiae
gggtacactgctgctgtaactgcaa

SEQ ID NO: 46156 - DNA, 25 bp, S. cerevisiae
ggtggcgactaaatctactcctgtg

SEQ ID NO: 46157 - DNA, 25 bp, S. cerevisiae
gggtgaatcgtaccagtccgcagaa

SEQ ID NO: 46158 - DNA, 25 bp, S. cerevisiae
gggtaacgtcatcattctgggcaga

SEQ ID NO: 46159 - DNA, 25 bp, S. cerevisiae
gggttacgttgcaatgtcatttaga

SEQ ID NO: 46160 - DNA, 25 bp, S. cerevisiae
gggttgcccttgtatacatttcagt

SEQ ID NO: 46161 - DNA, 25 bp, S. cerevisiae
gggtaccacttgcatcatattttca

SEQ ID NO: 46162 - DNA, 25 bp, S. cerevisiae
gggtcggacctgaaagagctttgca

SEQ ID NO: 46163 - DNA, 25 bp, S. cerevisiae
ggttgctaacgtcaaggccatcgaa

SEQ ID NO: 46164 - DNA, 25 bp, S. cerevisiae
ggtggatttggatctcgatacaggt

SEQ ID NO: 46165 - DNA, 25 bp, S. cerevisiae
ggtgaatccatggacccagatgcca

SEQ ID NO: 46166 - DNA, 25 bp, S. cerevisiae
ggtaacttgcagtcattgcagcagc

SEQ ID NO: 46167 - DNA, 25 bp, S. cerevisiae
gggttgtatgcagaactctatccat

SEQ ID NO: 46168 - DNA, 25 bp, S. cerevisiae
gggttgttcctatttcaaaattgct

SEQ ID NO: 46169 - DNA, 25 bp, S. cerevisiae
gggtttcttctagtatacaagactt

SEQ ID NO: 46170 - DNA, 25 bp, S. cerevisiae
gggttctcgcctgacataatgatta

SEQ ID NO: 46171 - DNA, 25 bp, S. cerevisiae
gggtaatccgttacatctatgttcc

SEQ ID NO: 46172 - DNA, 25 bp, S. cerevisiae
gggtgttgccatcaactttgttact

SEQ ID NO: 46173 - DNA, 25 bp, S. cerevisiae
ggtgcacgtccactgaacaggttaa

SEQ ID NO: 46174 - DNA, 25 bp, S. cerevisiae
gggtctgtcacatattcatcgtgct

SEQ ID NO: 46175 - DNA, 25 bp, S. cerevisiae
gggtgcctcagcagcatttagaagt

SEQ ID NO: 46176 - DNA, 25 bp, S. cerevisiae
gggtgctgctatatcaaatgctact

SEQ ID NO: 46177 - DNA, 25 bp, S. cerevisiae
gggtcctcagcaaaccagtactaat

SEQ ID NO: 46178 - DNA, 25 bp, S. cerevisiae
gggtaagcctcatccagaaccatat

SEQ ID NO: 46179 - DNA, 25 bp, S. cerevisiae
gggtacaggctcacgcaagttgatt

SEQ ID NO: 46180 - DNA, 25 bp, S. cerevisiae
ggtcttcctgatttccaagttttcg

SEQ ID NO: 46181 - DNA, 25 bp, S. cerevisiae
ggtgcatttttatcaaaggttccag

SEQ ID NO: 46182 - DNA, 25 bp, S. cerevisiae
gggttcgttaacaagatattccatc

SEQ ID NO: 46183 - DNA, 25 bp, S. cerevisiae
gggttggcttcatctggatttccaa

SEQ ID NO: 46184 - DNA, 25 bp, S. cerevisiae
gggtatggttatatttcctcaacaa

SEQ ID NO: 46185 - DNA, 25 bp, S. cerevisiae
gggtttggctatttcattcgtttct

SEQ ID NO: 46186 - DNA, 25 bp, S. cerevisiae
gggtatccctatacaatgctctaat

SEQ ID NO: 46187 - DNA, 25 bp, S. cerevisiae
gggttcggcgcaagacactgagaaa

SEQ ID NO: 46188 - DNA, 25 bp, S. cerevisiae
gggtgttccattcagagagactcat

SEQ ID NO: 46189 - DNA, 25 bp, S. cerevisiae
gggtgaatcctaatgacgaactcat

SEQ ID NO: 46190 - DNA, 25 bp, S. cerevisiae
ggtggctagctcaactgaacaactt

SEQ ID NO: 46191 - DNA, 25 bp, S. cerevisiae
gggtgattttttgatcagccacaat

SEQ ID NO: 46192 - DNA, 25 bp, S. cerevisiae
gggtttttgcgaatgccagcatcaa

SEQ ID NO: 46193 - DNA, 25 bp, S. cerevisiae
gggttcaaggccatcatgcaatcaa

SEQ ID NO: 46194 - DNA, 25 bp, S. cerevisiae
ggtgaagtacccttacatcaaaact

SEQ ID NO: 46195 - DNA, 25 bp, S. cerevisiae
gggtttggtccagaatcatgtagtt

SEQ ID NO: 46196 - DNA, 25 bp, S. cerevisiae
gggtttgattattcgccatttgttc

SEQ ID NO: 46197 - DNA, 25 bp, S. cerevisiae
gggtttttcttcgtattgtgtctat

SEQ ID NO: 46198 - DNA, 25 bp, S. cerevisiae
gggtttatatgctctagactctatc

SEQ ID NO: 46199 - DNA, 25 bp, S. cerevisiae
gggtctaatatcttcatcttccact

SEQ ID NO: 46200 - DNA, 25 bp, S. cerevisiae
gggtccagaaagttgcgccatgcct

SEQ ID NO: 46201 - DNA, 25 bp, S. cerevisiae
gggtttaatatcgacgccatcgcta

SEQ ID NO: 46202 - DNA, 25 bp, S. cerevisiae
gggttattatgtgcctgcaactgca

SEQ ID NO: 46203 - DNA, 25 bp, S. cerevisiae
gggttcttcatgaacgctgctaagc

SEQ ID NO: 46204 - DNA, 25 bp, S. cerevisiae
gggtgatttcattagcgttagacag

SEQ ID NO: 46205 - DNA, 25 bp, S. cerevisiae
gggtctcttggtttaatgacgtcca

SEQ ID NO: 46206 - DNA, 25 bp, S. cerevisiae
gggtgcttggttatttatccttgct

SEQ ID NO: 46207 - DNA, 25 bp, S. cerevisiae
gggttctatggcgtcgtattttcaa

SEQ ID NO: 46208 - DNA, 25 bp, S. cerevisiae
ggtctgttccgttagatccgaggat

SEQ ID NO: 46209 - DNA, 25 bp, S. cerevisiae
ggcgttcccgaatatgttggtcata

SEQ ID NO: 46210 - DNA, 25 bp, S. cerevisiae
gggtatccgctattttggagttcat

SEQ ID NO: 46211 - DNA, 25 bp, S. cerevisiae
gggtactgcttttactagctgtcat

SEQ ID NO: 46212 - DNA, 25 bp, S. cerevisiae
gggtacatcatctttggtctaatca

SEQ ID NO: 46213 - DNA, 25 bp, S. cerevisiae
gggtatttacatttccagcattgct

SEQ ID NO: 46214 - DNA, 25 bp, S. cerevisiae
gggtcatttgattacgctgcgcatt

SEQ ID NO: 46215 - DNA, 25 bp, S. cerevisiae
gggtattaccagaatgatcctagaa

SEQ ID NO: 46216 - DNA, 25 bp, S. cerevisiae
gggtgattccagttttattgccaaa

SEQ ID NO: 46217 - DNA, 25 bp, S. cerevisiae
gggtatttctggattcattcaccaa

SEQ ID NO: 46218 - DNA, 25 bp, S. cerevisiae
gggtctgcttgtcatttcattcaac

SEQ ID NO: 46219 - DNA, 25 bp, S. cerevisiae
gggtcgtggctctcttatatgtcac

SEQ ID NO: 46220 - DNA, 25 bp, S. cerevisiae
gggtcatggcacagaattatgtcat

SEQ ID NO: 46221 - DNA, 25 bp, S. cerevisiae
gggttatcttatatcatcatgctgc

SEQ ID NO: 46222 - DNA, 25 bp, S. cerevisiae
gggtctatcgacatatgctggttac

SEQ ID NO: 46223 - DNA, 25 bp, S. cerevisiae
gggtgctctggcttatattggttca

SEQ ID NO: 46224 - DNA, 25 bp, S. cerevisiae
gggtactgactgtatagtggatatc

SEQ ID NO: 46225 - DNA, 25 bp, S. cerevisiae
gggtaccacagttacattgactcaa

SEQ ID NO: 46226 - DNA, 25 bp, S. cerevisiae
ggtgtacctacctacattcctaatt

SEQ ID NO: 46227 - DNA, 25 bp, S. cerevisiae
gggtcacatttcttgaatcccaaat

SEQ ID NO: 46228 - DNA, 25 bp, S. cerevisiae
gggtgctcaccaatttatcccaatt

SEQ ID NO: 46229 - DNA, 25 bp, S. cerevisiae
gggtgctaccgcttataaacatatt

SEQ ID NO: 46230 - DNA, 25 bp, S. cerevisiae
gggtctatacgcttctaagttattc

SEQ ID NO: 46231 - DNA, 25 bp, S. cerevisiae
gggtaatcacgaatctgctaatgtc

SEQ ID NO: 46232 - DNA, 25 bp, S. cerevisiae
gggtaagacgcaatcttctgagtct

SEQ ID NO: 46233 - DNA, 25 bp, S. cerevisiae
gggtgattcccaacttcatggtaca

SEQ ID NO: 46234 - DNA, 25 bp, S. cerevisiae
gggtcatatccatacttcgtggcta

SEQ ID NO: 46235 - DNA, 25 bp, S. cerevisiae
gggtgccagtaatagcctcgatgtt

SEQ ID NO: 46236 - DNA, 25 bp, S. cerevisiae
ggtccatttcaacaagccgtatctg

SEQ ID NO: 46237 - DNA, 25 bp, S. cerevisiae
ggtcgcgatagcaagaaggccgtat

SEQ ID NO: 46238 - DNA, 25 bp, S. cerevisiae
ggtggacctcgacagtgttactaat

SEQ ID NO: 46239 - DNA, 25 bp, S. cerevisiae
ggtggaccacacaagacatgactac

SEQ ID NO: 46240 - DNA, 25 bp, S. cerevisiae
ggtggatccaaaagcagtgtcatta

SEQ ID NO: 46241 - DNA, 25 bp, S. cerevisiae
ggtggtccaaacattttaagcagat

SEQ ID NO: 46242 - DNA, 25 bp, S. cerevisiae
gggtcccaaccaattcgaaagcatt

SEQ ID NO: 46243 - DNA, 25 bp, S. cerevisiae
gggtcccaaccacagaagaagaatt

SEQ ID NO: 46244 - DNA, 25 bp, S. cerevisiae
tgggttcaaacctttaagcacgata

SEQ ID NO: 46245 - DNA, 25 bp, S. cerevisiae
ggttacaacaactccaagacgaatt

SEQ ID NO: 46246 - DNA, 25 bp, S. cerevisiae
ggttggatacccaccagaacggatg

SEQ ID NO: 46247 - DNA, 25 bp, S. cerevisiae
ggtgggcacacctcaaaaactctga

SEQ ID NO: 46248 - DNA, 25 bp, S. cerevisiae
ggtgggatgacctcaatagattctt

SEQ ID NO: 46249 - DNA, 25 bp, S. cerevisiae
ggtcttgctgcaacatgctcatgac

SEQ ID NO: 46250 - DNA, 25 bp, S. cerevisiae
gggtgctgcttctatgctatgctgc

SEQ ID NO: 46251 - DNA, 25 bp, S. cerevisiae
ggtggctgcttctcatactaaaaca

SEQ ID NO: 46252 - DNA, 25 bp, S. cerevisiae
gggtatgcccaacttcaaaaacaga

SEQ ID NO: 46253 - DNA, 25 bp, S. cerevisiae
ggtcttggctaatctcaaaattaaa

SEQ ID NO: 46254 - DNA, 25 bp, S. cerevisiae
ggtcattggtaatcccttgttaaag

SEQ ID NO: 46255 - DNA, 25 bp, S. cerevisiae
gggtccgtccaacatcattttaaca

SEQ ID NO: 46256 - DNA, 25 bp, S. cerevisiae
gggtcacgtttacgatcatttttgg

SEQ ID NO: 46257 - DNA, 25 bp, S. cerevisiae
gggtacagtttcctgcatttacttt

SEQ ID NO: 46258 - DNA, 25 bp, S. cerevisiae
ggtgtctttcaaaccaaatctccgg

SEQ ID NO: 46259 - DNA, 25 bp, S. cerevisiae
ggtcgttaaggaacaaactgaggct

SEQ ID NO: 46260 - DNA, 25 bp, S. cerevisiae
ggtggttccaactctacaggtatgt

SEQ ID NO: 46261 - DNA, 25 bp, S. cerevisiae
ggtggcactacttcaatttcaggtt

SEQ ID NO: 46262 - DNA, 25 bp, S. cerevisiae
gggtaaatctccaattagcggcatt

SEQ ID NO: 46263 - DNA, 25 bp, S. cerevisiae
gggtcaacctccaatgtactcgaat

SEQ ID NO: 46264 - DNA, 25 bp, S. cerevisiae
gggtgaaccaccaagatccacaagt

SEQ ID NO: 46265 - DNA, 25 bp, S. cerevisiae
ggtgtgacactagaatcgccagaat

SEQ ID NO: 46266 - DNA, 25 bp, S. cerevisiae
ggtggtgtctacgtattcgttcatc

SEQ ID NO: 46267 - DNA, 25 bp, S. cerevisiae
gggtcaaggattttctcattcgcta

SEQ ID NO: 46268 - DNA, 25 bp, S. cerevisiae
gggtaacttatctttcaatgctgac

SEQ ID NO: 46269 - DNA, 25 bp, S. cerevisiae
ggtcgattatatcgcttccaatccc

SEQ ID NO: 46270 - DNA, 25 bp, S. cerevisiae
gggtgatgctattggttacgatcca

SEQ ID NO: 46271 - DNA, 25 bp, S. cerevisiae
gggtgtctgtaatcacgctttccat

SEQ ID NO: 46272 - DNA, 25 bp, S. cerevisiae
gggtgggatatcttcaatgctttgc

SEQ ID NO: 46273 - DNA, 25 bp, S. cerevisiae
gggtctatgacctcaatcttgatgg

SEQ ID NO: 46274 - DNA, 25 bp, S. cerevisiae
gggtgtgtaaattcgcttctatcta

SEQ ID NO: 46275 - DNA, 25 bp, S. cerevisiae
gggtactttatttttcatcacgcaa

SEQ ID NO: 46276 - DNA, 25 bp, S. cerevisiae
gggtattacttttcaattgccagaa

SEQ ID NO: 46277 - DNA, 25 bp, S. cerevisiae
ggttttcctacttcgatttgggatg

SEQ ID NO: 46278 - DNA, 25 bp, S. cerevisiae
gggtcctacatcttgacgacgtaag

SEQ ID NO: 46279 - DNA, 25 bp, S. cerevisiae
gggtgccgactcatacgctgaggaa

SEQ ID NO: 46280 - DNA, 25 bp, S. cerevisiae
gggtccgcacgattcctgtgggaac

SEQ ID NO: 46281 - DNA, 25 bp, S. cerevisiae
gggtctggtatatcttttgccctac

SEQ ID NO: 46282 - DNA, 25 bp, S. cerevisiae
ggtgtctcgatatatgattttcctg

SEQ ID NO: 46283 - DNA, 25 bp, S. cerevisiae
gggtaccattcttgttttcactgat

SEQ ID NO: 46284 - DNA, 25 bp, S. cerevisiae
gggtacaacctcgatttccatgtat

SEQ ID NO: 46285 - DNA, 25 bp, S. cerevisiae
gggtctattcccgttgatcaagttg

SEQ ID NO: 46286 - DNA, 25 bp, S. cerevisiae
gggtctatacgggttcacaaatctg

SEQ ID NO: 46287 - DNA, 25 bp, S. cerevisiae
ggtgacaataattcgttccaaatcg

SEQ ID NO: 46288 - DNA, 25 bp, S. cerevisiae
tgtctgccgtcccaagtgtccaaac

SEQ ID NO: 46289 - DNA, 25 bp, S. cerevisiae
ggtatagtgccattaggcccaaagc

SEQ ID NO: 46290 - DNA, 25 bp, S. cerevisiae
gggtcatctgctgtaactccaatac

SEQ ID NO: 46291 - DNA, 25 bp, S. cerevisiae
gggtcaagcctttatctatagatca

SEQ ID NO: 46292 - DNA, 25 bp, S. cerevisiae
gggtcaaggcatgcaatctctagga

SEQ ID NO: 46293 - DNA, 25 bp, S. cerevisiae
ggtgtcaagtttacggtcgccaaga

SEQ ID NO: 46294 - DNA, 25 bp, S. cerevisiae
gggtaacttcatgcccatactcaat

SEQ ID NO: 46295 - DNA, 25 bp, S. cerevisiae
ggtgtattcgtttcctttggtaatg

SEQ ID NO: 46296 - DNA, 25 bp, S. cerevisiae
gggtcacttctaccatgtttttgat

SEQ ID NO: 46297 - DNA, 25 bp, S. cerevisiae
gggtcctctatatggttatcaaacg

SEQ ID NO: 46298 - DNA, 25 bp, S. cerevisiae
gggtagtgacattccaaccacaaaa

SEQ ID NO: 46299 - DNA, 25 bp, S. cerevisiae
gggtatgttcttcaactccaagcaa

SEQ ID NO: 46300 - DNA, 25 bp, S. cerevisiae
gggtatgtctttcaatgcgctacaa

SEQ ID NO: 46301 - DNA, 25 bp, S. cerevisiae
gggtcttgttgttttgcgtatgcaa

SEQ ID NO: 46302 - DNA, 25 bp, S. cerevisiae
ggtgcatacttggtgaataccgcta

SEQ ID NO: 46303 - DNA, 25 bp, S. cerevisiae
ggtggtcctctagatccaagtgagt

SEQ ID NO: 46304 - DNA, 25 bp, S. cerevisiae
ggtgattcgcccaaaccagtggtgg

SEQ ID NO: 46305 - DNA, 25 bp, S. cerevisiae
ggtgacgttcaggactctaggtata

SEQ ID NO: 46306 - DNA, 25 bp, S. cerevisiae
ggtggtggcacttatacccaaactt

SEQ ID NO: 46307 - DNA, 25 bp, S. cerevisiae
ggtgttagctttaatcgcccaattt

SEQ ID NO: 46308 - DNA, 25 bp, S. cerevisiae
ggtgctttggcgttgctaacaagtt

SEQ ID NO: 46309 - DNA, 25 bp, S. cerevisiae
ggtggagtcgcgtatgcagcatata

SEQ ID NO: 46310 - DNA, 25 bp, S. cerevisiae
gggtgatgtcagatcgctgaatatc

SEQ ID NO: 46311 - DNA, 25 bp, S. cerevisiae
gggtgatgtcagaccgctaaatatt

SEQ ID NO: 46312 - DNA, 25 bp, S. cerevisiae
gggtagggccatggactatttgtct

SEQ ID NO: 46313 - DNA, 25 bp, S. cerevisiae
ggtgttaggctctgacaattttcaa

SEQ ID NO: 46314 - DNA, 25 bp, S. cerevisiae
gggtgccagttgtgtctaattctaa

SEQ ID NO: 46315 - DNA, 25 bp, S. cerevisiae
gggtctcgattctcgcgaaagctaa

SEQ ID NO: 46316 - DNA, 25 bp, S. cerevisiae
ggtggcggttctgcggataactata

SEQ ID NO: 46317 - DNA, 25 bp, S. cerevisiae
ggtggtggctttgcgaacgacaatt

SEQ ID NO: 46318 - DNA, 25 bp, S. cerevisiae
gggtgcatcctatccgaaagcacaa

SEQ ID NO: 46319 - DNA, 25 bp, S. cerevisiae
gggtcagccaaaactgatcaccaaa

SEQ ID NO: 46320 - DNA, 25 bp, S. cerevisiae
ggtgctttcaggctccatggaacca

SEQ ID NO: 46321 - DNA, 25 bp, S. cerevisiae
ggtgtattggccaaccatgttccca

SEQ ID NO: 46322 - DNA, 25 bp, S. cerevisiae
ggtggtgtccaaaacattggccaca

SEQ ID NO: 46323 - DNA, 25 bp, S. cerevisiae
ggtcaagaacgttacagggccatca

SEQ ID NO: 46324 - DNA, 25 bp, S. cerevisiae
ggtcaagaacggaaccatcgtcaag

SEQ ID NO: 46325 - DNA, 25 bp, S. cerevisiae
ggccaagaagaatacctccaacaga

SEQ ID NO: 46326 - DNA, 25 bp, S. cerevisiae
ggatccgaagaggaaactccaacta

SEQ ID NO: 46327 - DNA, 25 bp, S. cerevisiae
ggtgccaatggtcaaactaacaagt

SEQ ID NO: 46328 - DNA, 25 bp, S. cerevisiae
gggtccaggttacgacattatcaag

SEQ ID NO: 46329 - DNA, 25 bp, S. cerevisiae
gggtcctgcggtgctaatttcaaga

SEQ ID NO: 46330 - DNA, 25 bp, S. cerevisiae
gggtgcacgcccattcaatttcaag

SEQ ID NO: 46331 - DNA, 25 bp, S. cerevisiae
ggtgttccgatcatgtcctttgaag

SEQ ID NO: 46332 - DNA, 25 bp, S. cerevisiae
ggtggtacgcagaacccttatgcag

SEQ ID NO: 46333 - DNA, 25 bp, S. cerevisiae
ggtgaggtacgctatctacgaacca

SEQ ID NO: 46334 - DNA, 25 bp, S. cerevisiae
ggtgggctaccatgtatctggacca

SEQ ID NO: 46335 - DNA, 25 bp, S. cerevisiae
ggtgggcgactctaagatcatcctc

SEQ ID NO: 46336 - DNA, 25 bp, S. cerevisiae
ggtcgaagaccaaaacacctccgat

SEQ ID NO: 46337 - DNA, 25 bp, S. cerevisiae
ggtacgagcccataacacgtcggga

SEQ ID NO: 46338 - DNA, 25 bp, S. cerevisiae
ggatactacccctgacaacgggaga

SEQ ID NO: 46339 - DNA, 25 bp, S. cerevisiae
ggtgcctaccttgtgaaatcctggg

SEQ ID NO: 46340 - DNA, 25 bp, S. cerevisiae
ggtggaaactatttctcgccaaatt

SEQ ID NO: 46341 - DNA, 25 bp, S. cerevisiae
ggtgataaaaacttctccgcaatgg

SEQ ID NO: 46342 - DNA, 25 bp, S. cerevisiae
ggtgtccaaagatatcaagctcaag

SEQ ID NO: 46343 - DNA, 25 bp, S. cerevisiae
gggtcacaaccatcgaactataaat

SEQ ID NO: 46344 - DNA, 25 bp, S. cerevisiae
gggtacagccaagcaaaatcaaaat

SEQ ID NO: 46345 - DNA, 25 bp, S. cerevisiae
ggagattacccgcagaagtagaaat

SEQ ID NO: 46346 - DNA, 25 bp, S. cerevisiae
ggtggaatcccacattcgataacct

SEQ ID NO: 46347 - DNA, 25 bp, S. cerevisiae
ggtcgaatcctacaagcatgaactg

SEQ ID NO: 46348 - DNA, 25 bp, S. cerevisiae
gggtgaacctaaaagtgcaatctat

SEQ ID NO: 46349 - DNA, 25 bp, S. cerevisiae
gggtgaacagttatcgactctatct

SEQ ID NO: 46350 - DNA, 25 bp, S. cerevisiae
gggtgacaagctaatttctcctttg

SEQ ID NO: 46351 - DNA, 25 bp, S. cerevisiae
gggtaagaatatctcccctgctttc

SEQ ID NO: 46352 - DNA, 25 bp, S. cerevisiae
ggtgcttaaattcactacacttact

SEQ ID NO: 46353 - DNA, 25 bp, S. cerevisiae
gggtaacaacactgctaacgctact

SEQ ID NO: 46354 - DNA, 25 bp, S. cerevisiae
gggtgaactaccttttatggctact

SEQ ID NO: 46355 - DNA, 25 bp, S. cerevisiae
ggtgctaacccatctgctgaaggtg

SEQ ID NO: 46356 - DNA, 25 bp, S. cerevisiae
gggtaactctctctcataatagtgt

SEQ ID NO: 46357 - DNA, 25 bp, S. cerevisiae
gggtgctcatatttgtcgtgagttt

SEQ ID NO: 46358 - DNA, 25 bp, S. cerevisiae
gggtctatctttcaggtgctctcta

SEQ ID NO: 46359 - DNA, 25 bp, S. cerevisiae
ggctgtaaaactgtactccaagtgc

SEQ ID NO: 46360 - DNA, 25 bp, S. cerevisiae
ggtgttagaactgctatcccaggcc

SEQ ID NO: 46361 - DNA, 25 bp, S. cerevisiae
ggtggtttaccgcattatactattt

SEQ ID NO: 46362 - DNA, 25 bp, S. cerevisiae
ggtgtgttaccccaattaatcatcg

SEQ ID NO: 46363 - DNA, 25 bp, S. cerevisiae
gggtgacgcgccaattcattcaatt

SEQ ID NO: 46364 - DNA, 25 bp, S. cerevisiae
gggtgtcgagcattttttcaagttt

SEQ ID NO: 46365 - DNA, 25 bp, S. cerevisiae
tgttatgccgaattccgttaaattt

SEQ ID NO: 46366 - DNA, 25 bp, S. cerevisiae
ggtgatccgaatttggctctaatga

SEQ ID NO: 46367 - DNA, 25 bp, S. cerevisiae
gggtccagattaggtgcagttcaga

SEQ ID NO: 46368 - DNA, 25 bp, S. cerevisiae
ggtcggtcaatctgaagcttccttg

SEQ ID NO: 46369 - DNA, 25 bp, S. cerevisiae
ggtcgatcgacaatgccaacgtgca

SEQ ID NO: 46370 - DNA, 25 bp, S. cerevisiae
ggtgtcaaccctgcaagatctctgg

SEQ ID NO: 46371 - DNA, 25 bp, S. cerevisiae
ggtgttaccatagccatttctttat

SEQ ID NO: 46372 - DNA, 25 bp, S. cerevisiae
ggtggatttattgacgcttcgtgta

SEQ ID NO: 46373 - DNA, 25 bp, S. cerevisiae
ggtgttcttattgactccagtggta

SEQ ID NO: 46374 - DNA, 25 bp, S. cerevisiae
ggtggtgacaacgaatcctcgtcaa

SEQ ID NO: 46375 - DNA, 25 bp, S. cerevisiae
ggtggttatacaaatcctcagccta

SEQ ID NO: 46376 - DNA, 25 bp, S. cerevisiae
ggtggttcaaacaactcttcttggt

SEQ ID NO: 46377 - DNA, 25 bp, S. cerevisiae
ggtgaaccgccttacctaaatgagg

SEQ ID NO: 46378 - DNA, 25 bp, S. cerevisiae
ggtgcaacctccatacaaggtcgaa

SEQ ID NO: 46379 - DNA, 25 bp, S. cerevisiae
ggtgctacccctaaagatggtccat

SEQ ID NO: 46380 - DNA, 25 bp, S. cerevisiae
ggtggcccctctagtgtatgaagaa

SEQ ID NO: 46381 - DNA, 25 bp, S. cerevisiae
gggtcatatcctggttctacaagaa

SEQ ID NO: 46382 - DNA, 25 bp, S. cerevisiae
gggtcatatcacactcataaccaca

SEQ ID NO: 46383 - DNA, 25 bp, S. cerevisiae
gggtccaatcaatcaagtacagtgt

SEQ ID NO: 46384 - DNA, 25 bp, S. cerevisiae
gggtcacgagcatagcagcagtata

SEQ ID NO: 46385 - DNA, 25 bp, S. cerevisiae
ggtcgttttcccatttcaattagat

SEQ ID NO: 46386 - DNA, 25 bp, S. cerevisiae
gggtggacatttggcttatctcgac

SEQ ID NO: 46387 - DNA, 25 bp, S. cerevisiae
ggtcgtcctttgactcaagcggaaa

SEQ ID NO: 46388 - DNA, 25 bp, S. cerevisiae
gggtcgcactgtctccaataggaaa

SEQ ID NO: 46389 - DNA, 25 bp, S. cerevisiae
gggtccaaatttgatcaacgatcca

SEQ ID NO: 46390 - DNA, 25 bp, S. cerevisiae
gggtctcttttgctggctattgttg

SEQ ID NO: 46391 - DNA, 25 bp, S. cerevisiae
gggtcatttttatttccatttatga

SEQ ID NO: 46392 - DNA, 25 bp, S. cerevisiae
ggtgtttcaccttattcgcatacta

SEQ ID NO: 46393 - DNA, 25 bp, S. cerevisiae
ggttggtattttttcgatgactcgc

SEQ ID NO: 46394 - DNA, 25 bp, S. cerevisiae
gggtgaagtcactgccatcagaact

SEQ ID NO: 46395 - DNA, 25 bp, S. cerevisiae
gggtgtagtcactgctatgaagatt

SEQ ID NO: 46396 - DNA, 25 bp, S. cerevisiae
gggtcctccacaggctatgatttta

SEQ ID NO: 46397 - DNA, 25 bp, S. cerevisiae
gggtctttaccactttatatatctc

SEQ ID NO: 46398 - DNA, 25 bp, S. cerevisiae
ggtgcatttgaagccgtaacctcta

SEQ ID NO: 46399 - DNA, 25 bp, S. cerevisiae
ggtgcatttgtggttcctgtaccaa

SEQ ID NO: 46400 - DNA, 25 bp, S. cerevisiae
ggtgttggtcgtcgttactccaact

SEQ ID NO: 46401 - DNA, 25 bp, S. cerevisiae
ggtgttgcgtttattcaatctccac

SEQ ID NO: 46402 - DNA, 25 bp, S. cerevisiae
ggtggtcacttttttggcacgatac

SEQ ID NO: 46403 - DNA, 25 bp, S. cerevisiae
gggtgcttttctgttcgcacgaaag

SEQ ID NO: 46404 - DNA, 25 bp, S. cerevisiae
gggtcctatgtcatgttccatctga

SEQ ID NO: 46405 - DNA, 25 bp, S. cerevisiae
gggtcgatattaacagagtcactta

SEQ ID NO: 46406 - DNA, 25 bp, S. cerevisiae
ggtgaagccaattacgatgccttag

SEQ ID NO: 46407 - DNA, 25 bp, S. cerevisiae
ggtacaccaaagacagactcgttta

SEQ ID NO: 46408 - DNA, 25 bp, S. cerevisiae
ggtgacgcagtaaacaacgttccta

SEQ ID NO: 46409 - DNA, 25 bp, S. cerevisiae
ggtgccgcaacatccataagttcgc

SEQ ID NO: 46410 - DNA, 25 bp, S. cerevisiae
ggtgtccattttgctattgcggcag

SEQ ID NO: 46411 - DNA, 25 bp, S. cerevisiae
gggtgtcctttccaagatgatttcg

SEQ ID NO: 46412 - DNA, 25 bp, S. cerevisiae
ggtgttcctattggcggatgtctta

SEQ ID NO: 46413 - DNA, 25 bp, S. cerevisiae
ggtgattcttggtgtggagtcttca

SEQ ID NO: 46414 - DNA, 25 bp, S. cerevisiae
ggtgatattgttgaatggactccca

SEQ ID NO: 46415 - DNA, 25 bp, S. cerevisiae
ggtgtttaaacaggtagtcgctagt

SEQ ID NO: 46416 - DNA, 25 bp, S. cerevisiae
ggtggccactataagaactcatctc

SEQ ID NO: 46417 - DNA, 25 bp, S. cerevisiae
ggtggtgacgataaaatcttcgctt

SEQ ID NO: 46418 - DNA, 25 bp, S. cerevisiae
ggtggatctcgtggcggatcattta

SEQ ID NO: 46419 - DNA, 25 bp, S. cerevisiae
ggtggcagccagcttgtgatatcta

SEQ ID NO: 46420 - DNA, 25 bp, S. cerevisiae
ggtggtgccgctagtgctatgactc

SEQ ID NO: 46421 - DNA, 25 bp, S. cerevisiae
ggtggataccaatcttgactccgga

SEQ ID NO: 46422 - DNA, 25 bp, S. cerevisiae
ggtgttatttttgtcatcgattcca

SEQ ID NO: 46423 - DNA, 25 bp, S. cerevisiae
ggtgtttttattccagttcattcca

SEQ ID NO: 46424 - DNA, 25 bp, S. cerevisiae
ggtgttcttgtttccttgaatgacc

SEQ ID NO: 46425 - DNA, 25 bp, S. cerevisiae
ggtgttgttatctccattaaggcta

SEQ ID NO: 46426 - DNA, 25 bp, S. cerevisiae
ggtgcttagaatccatccctagtga

SEQ ID NO: 46427 - DNA, 25 bp, S. cerevisiae
ggtgatacacagcttttcaacagag

SEQ ID NO: 46428 - DNA, 25 bp, S. cerevisiae
ggtgacttcactgctggtaacggta

SEQ ID NO: 46429 - DNA, 25 bp, S. cerevisiae
ggtgactatcacacggtggcactaa

SEQ ID NO: 46430 - DNA, 25 bp, S. cerevisiae
ggtgatcaacaatcgtgctggcatc

SEQ ID NO: 46431 - DNA, 25 bp, S. cerevisiae
ggtgagatcaccatcgatgctgaac

SEQ ID NO: 46432 - DNA, 25 bp, S. cerevisiae
ggtgatgaatacttggcgcgcataa

SEQ ID NO: 46433 - DNA, 25 bp, S. cerevisiae
ggtgatggaacctgccgataccaat

SEQ ID NO: 46434 - DNA, 25 bp, S. cerevisiae
gggtggtcacctacaacactacaat

SEQ ID NO: 46435 - DNA, 25 bp, S. cerevisiae
gggtgacgcacctgtacattcaatt

SEQ ID NO: 46436 - DNA, 25 bp, S. cerevisiae
ggtggtgcggcagattgtcaatttt

SEQ ID NO: 46437 - DNA, 25 bp, S. cerevisiae
ggtggtcggattattagcatctatt

SEQ ID NO: 46438 - DNA, 25 bp, S. cerevisiae
gggtgctccgatttttacttgtcat

SEQ ID NO: 46439 - DNA, 25 bp, S. cerevisiae
ggtgtcgactcgtactttatgaaga

SEQ ID NO: 46440 - DNA, 25 bp, S. cerevisiae
ggtggtactgtctctcttggaagag

SEQ ID NO: 46441 - DNA, 25 bp, S. cerevisiae
ggtggaagcttctacttacagagca

SEQ ID NO: 46442 - DNA, 25 bp, S. cerevisiae
ggtggacgctaatttgttcagcaga

SEQ ID NO: 46443 - DNA, 25 bp, S. cerevisiae
ggtgtccatttactgggccgcagat

SEQ ID NO: 46444 - DNA, 25 bp, S. cerevisiae
ggttccattttacggccaaggtatg

SEQ ID NO: 46445 - DNA, 25 bp, S. cerevisiae
ggtggcttttgtatgatgacgaaac

SEQ ID NO: 46446 - DNA, 25 bp, S. cerevisiae
ggtggcttgccttactgtattgtaa

SEQ ID NO: 46447 - DNA, 25 bp, S. cerevisiae
ggtggctatgcctaccagtacgtaa

SEQ ID NO: 46448 - DNA, 25 bp, S. cerevisiae
ggtggtttcacagcagtcactttag

SEQ ID NO: 46449 - DNA, 25 bp, S. cerevisiae
ggtgtttccctgatgatatttttga

SEQ ID NO: 46450 - DNA, 25 bp, S. cerevisiae
ggtgtgttcacctcagtattattct

SEQ ID NO: 46451 - DNA, 25 bp, S. cerevisiae
gggtgacttcacaacagattatttc

SEQ ID NO: 46452 - DNA, 25 bp, S. cerevisiae
gggtggattcacgactattgtctta

SEQ ID NO: 46453 - DNA, 25 bp, S. cerevisiae
ggtgtagatccggattatatcacta

SEQ ID NO: 46454 - DNA, 25 bp, S. cerevisiae
gggtgatgaccacattcatattcta

SEQ ID NO: 46455 - DNA, 25 bp, S. cerevisiae
gggtgatccagtgtacattcattat

SEQ ID NO: 46456 - DNA, 25 bp, S. cerevisiae
ggtgatccccatgtgaaagcttcaa

SEQ ID NO: 46457 - DNA, 25 bp, S. cerevisiae
ggtggactccatggtctaggaaact

SEQ ID NO: 46458 - DNA, 25 bp, S. cerevisiae
ggtgtgccacctgatttgatcgata

SEQ ID NO: 46459 - DNA, 25 bp, S. cerevisiae
ggctgagcccgaatcattagtcgtt

SEQ ID NO: 46460 - DNA, 25 bp, S. cerevisiae
ggtggcccataattcttctggatta

SEQ ID NO: 46461 - DNA, 25 bp, S. cerevisiae
ggtggtctctaggtgttctaatcta

SEQ ID NO: 46462 - DNA, 25 bp, S. cerevisiae
ggtggacttgatgctatttttggaa

SEQ ID NO: 46463 - DNA, 25 bp, S. cerevisiae
ggtgggttttatcttcattagctat

SEQ ID NO: 46464 - DNA, 25 bp, S. cerevisiae
ggtggcgttcataatttacattctt

SEQ ID NO: 46465 - DNA, 25 bp, S. cerevisiae
ggtggtgtccataatttgcactcct

SEQ ID NO: 46466 - DNA, 25 bp, S. cerevisiae
ggtggtgatcctattagactcctat

SEQ ID NO: 46467 - DNA, 25 bp, S. cerevisiae
ggtggtattgcctctttgaatgatc

SEQ ID NO: 46468 - DNA, 25 bp, S. cerevisiae
ggtgaataaccagaccatgcaattg

SEQ ID NO: 46469 - DNA, 25 bp, S. cerevisiae
ggtgttcatcgcattacttttggac

SEQ ID NO: 46470 - DNA, 25 bp, S. cerevisiae
ggtggtgcagccattccatatttgg

SEQ ID NO: 46471 - DNA, 25 bp, S. cerevisiae
ggtggaagcctttcacattaatgag

SEQ ID NO: 46472 - DNA, 25 bp, S. cerevisiae
ggtgggaccatttgcatatccaata

SEQ ID NO: 46473 - DNA, 25 bp, S. cerevisiae
gggtggacaattttatggtataatc

SEQ ID NO: 46474 - DNA, 25 bp, S. cerevisiae
ggagtcggaattctgatcgcgtttt

SEQ ID NO: 46475 - DNA, 25 bp, S. cerevisiae
ggtgtcatggcctcttactggtggt

SEQ ID NO: 46476 - DNA, 25 bp, S. cerevisiae
ggtctaagtgaccttttgcgtgagt

SEQ ID NO: 46477 - DNA, 25 bp, S. cerevisiae
ggtgcactggttcaatgtgatccat

SEQ ID NO: 46478 - DNA, 25 bp, S. cerevisiae
ggtgaccttacttccattaccatgg

SEQ ID NO: 46479 - DNA, 25 bp, S. cerevisiae
ggtaccacgagtccgaaatatccct

SEQ ID NO: 46480 - DNA, 25 bp, S. cerevisiae
ggtgcccaagtggacgaagatttcc

SEQ ID NO: 46481 - DNA, 25 bp, S. cerevisiae
ggtgttacaggattgcatagcatgc

SEQ ID NO: 46482 - DNA, 25 bp, S. cerevisiae
ggtgttgctagaatttacgcttctt

SEQ ID NO: 46483 - DNA, 25 bp, S. cerevisiae
ggtgcattggctttattatcgtttt

SEQ ID NO: 46484 - DNA, 25 bp, S. cerevisiae
ggtggtaccgcattatgttcttacg

SEQ ID NO: 46485 - DNA, 25 bp, S. cerevisiae
gggtgtcatgtctctagctatgtat

SEQ ID NO: 46486 - DNA, 25 bp, S. cerevisiae
gggtgtgatgctggacgactatatt

SEQ ID NO: 46487 - DNA, 25 bp, S. cerevisiae
ggtggaattcgagcatctgatcaat

SEQ ID NO: 46488 - DNA, 25 bp, S. cerevisiae
ggtggcgattctatctcgagacaag

SEQ ID NO: 46489 - DNA, 25 bp, S. cerevisiae
ggtggcgatttcactcacagatcag

SEQ ID NO: 46490 - DNA, 25 bp, S. cerevisiae
ggtggtgttttgcaactaatcagct

SEQ ID NO: 46491 - DNA, 25 bp, S. cerevisiae
ggtgtgtatgctagcttgacccata

SEQ ID NO: 46492 - DNA, 25 bp, S. cerevisiae
ggtgtcaagaatctagccctagtta

SEQ ID NO: 46493 - DNA, 25 bp, S. cerevisiae
ggtgtcactttgcttccaatactta

SEQ ID NO: 46494 - DNA, 25 bp, S. cerevisiae
ggtggtatttccatccaatcaatta

SEQ ID NO: 46495 - DNA, 25 bp, S. cerevisiae
ggtggtgttccatacattgcagttt

SEQ ID NO: 46496 - DNA, 25 bp, S. cerevisiae
ggtggattttgacccgttgttcatc

SEQ ID NO: 46497 - DNA, 25 bp, S. cerevisiae
ggtgatttaatcagcgccatgctca

SEQ ID NO: 46498 - DNA, 25 bp, S. cerevisiae
ggtgtttcaagattcacaagctagg

SEQ ID NO: 46499 - DNA, 25 bp, S. cerevisiae
ggtgtctcaaggatagccgctagcg

SEQ ID NO: 46500 - DNA, 25 bp, S. cerevisiae
ggtgctcgtaccatagacctgggaa

SEQ ID NO: 46501 - DNA, 25 bp, S. cerevisiae
ggtgatgttactaccgtcgaactac

SEQ ID NO: 46502 - DNA, 25 bp, S. cerevisiae
ggtggatttgccatcgcaactcaag

SEQ ID NO: 46503 - DNA, 25 bp, S. cerevisiae
ggtggatttcgcctctataaagcaa

SEQ ID NO: 46504 - DNA, 25 bp, S. cerevisiae
ggtggttacagtacttccaacaact

SEQ ID NO: 46505 - DNA, 25 bp, S. cerevisiae
ggtggtcaacgtactttgcaaaaga

SEQ ID NO: 46506 - DNA, 25 bp, S. cerevisiae
ggtggcttatttgtccactcgaagc

SEQ ID NO: 46507 - DNA, 25 bp, S. cerevisiae
ggtggttgaattgtcatgccgttac

SEQ ID NO: 46508 - DNA, 25 bp, S. cerevisiae
ggtggttacagttctatggccgcta

SEQ ID NO: 46509 - DNA, 25 bp, S. cerevisiae
ggtgacatgctaaatccgcggcttt

SEQ ID NO: 46510 - DNA, 25 bp, S. cerevisiae
ggtgatgcaccaaaaccagttgtta

SEQ ID NO: 46511 - DNA, 25 bp, S. cerevisiae
ggtgtgcatgtcagcaagctaccct

SEQ ID NO: 46512 - DNA, 25 bp, S. cerevisiae
ggtgtgtccactacagaagatcctg

SEQ ID NO: 46513 - DNA, 25 bp, S. cerevisiae
ggtggtgccgttttagctagtatca

SEQ ID NO: 46514 - DNA, 25 bp, S. cerevisiae
ggtgtgcccgataaaactgtcttga

SEQ ID NO: 46515 - DNA, 25 bp, S. cerevisiae
ggtctagctgaattggctccaggta

SEQ ID NO: 46516 - DNA, 25 bp, S. cerevisiae
ggtgtagatacaataggctctgttc

SEQ ID NO: 46517 - DNA, 25 bp, S. cerevisiae
ggtgctaatgcaacaagcgctttat

SEQ ID NO: 46518 - DNA, 25 bp, S. cerevisiae
ggtgttgctgcatcacagggttcaa

SEQ ID NO: 46519 - DNA, 25 bp, S. cerevisiae
ggtgttgcaatttcagctggcgtca

SEQ ID NO: 46520 - DNA, 25 bp, S. cerevisiae
ggtgattcaatgactccttcagcat

SEQ ID NO: 46521 - DNA, 25 bp, S. cerevisiae
ggtgccatgtatttgggtccattcc

SEQ ID NO: 46522 - DNA, 25 bp, S. cerevisiae
ggtgtgactaccttggactctatta

SEQ ID NO: 46523 - DNA, 25 bp, S. cerevisiae
ggtcttttatgcgatgacggcctac

SEQ ID NO: 46524 - DNA, 25 bp, S. cerevisiae
ggtccagctgaagcgttttttcaag

SEQ ID NO: 46525 - DNA, 25 bp, S. cerevisiae
ggtggcgctagggaatctttattaa

SEQ ID NO: 46526 - DNA, 25 bp, S. cerevisiae
ggtgacgatagtgatcctgcttact

SEQ ID NO: 46527 - DNA, 25 bp, S. cerevisiae
ggtgatcaatctttactatctccag

SEQ ID NO: 46528 - DNA, 25 bp, S. cerevisiae
ggtgcagcacaacctcaattggtat

SEQ ID NO: 46529 - DNA, 25 bp, S. cerevisiae
ggtcgataagaccagactgtttatt

SEQ ID NO: 46530 - DNA, 25 bp, S. cerevisiae
ggtcatgccatttgctctggattag

SEQ ID NO: 46531 - DNA, 25 bp, S. cerevisiae
ggtgctgcctcattcttgaaggaga

SEQ ID NO: 46532 - DNA, 25 bp, S. cerevisiae
ggtgcagcattcctcactcaaagag

SEQ ID NO: 46533 - DNA, 25 bp, S. cerevisiae
ggtaccaaccatctaaggtgagctc

SEQ ID NO: 46534 - DNA, 25 bp, S. cerevisiae
ggtgaaattccatctaccttgaatg

SEQ ID NO: 46535 - DNA, 25 bp, S. cerevisiae
ggtgaacatggaactgtgccgaatc

SEQ ID NO: 46536 - DNA, 25 bp, S. cerevisiae
ggtccatcatggtgtcatttatgtc

SEQ ID NO: 46537 - DNA, 25 bp, S. cerevisiae
ggtcaaactatacactttcctagct

SEQ ID NO: 46538 - DNA, 25 bp, S. cerevisiae
ggtcgaaatttggagctttgacgat

SEQ ID NO: 46539 - DNA, 25 bp, S. cerevisiae
ggtggcacaaattccatttctacta

SEQ ID NO: 46540 - DNA, 25 bp, S. cerevisiae
ggtggaacatcctagaacgtattga

SEQ ID NO: 46541 - DNA, 25 bp, S. cerevisiae
ggtgctgccactgtcgaaggaatta

SEQ ID NO: 46542 - DNA, 25 bp, S. cerevisiae
ggtgttgcagccgtcaagggactaa

SEQ ID NO: 46543 - DNA, 25 bp, S. cerevisiae
ggtcgagcttctaccagagagcatc

SEQ ID NO: 46544 - DNA, 25 bp, S. cerevisiae
ggtgcgcgcgatttctaggagatct

SEQ ID NO: 46545 - DNA, 25 bp, S. cerevisiae
ggtgatctgtatcctgttggcacaa

SEQ ID NO: 46546 - DNA, 25 bp, S. cerevisiae
ggtggtgtcacatcttcatcaatgg

SEQ ID NO: 46547 - DNA, 25 bp, S. cerevisiae
ggtggttcaaacttatctcaagggc

SEQ ID NO: 46548 - DNA, 25 bp, S. cerevisiae
ggtgttgtgaaatatgctcccatgc

SEQ ID NO: 46549 - DNA, 25 bp, S. cerevisiae
ggtgctatgtggaacaaccctcatt

SEQ ID NO: 46550 - DNA, 25 bp, S. cerevisiae
ggtgttgctggtactaagccattta

SEQ ID NO: 46551 - DNA, 25 bp, S. cerevisiae
ggtgtttggttcttccattgtcata

SEQ ID NO: 46552 - DNA, 25 bp, S. cerevisiae
ggtgatttgttttctgctttgttat

SEQ ID NO: 46553 - DNA, 25 bp, S. cerevisiae
ggtgttatttctgttgtttcatgat

SEQ ID NO: 46554 - DNA, 25 bp, S. cerevisiae
ggtgttgaggatcctttgaccttga

SEQ ID NO: 46555 - DNA, 25 bp, S. cerevisiae
ggtgggctagtaccactagtgccat

SEQ ID NO: 46556 - DNA, 25 bp, S. cerevisiae
ggtggtcattatacagcctatgtga

SEQ ID NO: 46557 - DNA, 25 bp, S. cerevisiae
ggtggtactcataacgttgaagctt

SEQ ID NO: 46558 - DNA, 25 bp, S. cerevisiae
ggaggaaatctccacgtttggttct

SEQ ID NO: 46559 - DNA, 25 bp, S. cerevisiae
ggtggttctatccaatcatggtggt

SEQ ID NO: 46560 - DNA, 25 bp, S. cerevisiae
ggtgaaatatacgtatcggccgccc

SEQ ID NO: 46561 - DNA, 25 bp, S. cerevisiae
ggtgtcaaatacattgccgctccat

SEQ ID NO: 46562 - DNA, 25 bp, S. cerevisiae
ggtgtcaaaagattttactcctaag

SEQ ID NO: 46563 - DNA, 25 bp, S. cerevisiae
ggtgatcaaagtttcttgtacgctt

SEQ ID NO: 46564 - DNA, 25 bp, S. cerevisiae
ggtgttatttctccatacaatgcac

SEQ ID NO: 46565 - DNA, 25 bp, S. cerevisiae
ggtgatattttctacaacaactctt

SEQ ID NO: 46566 - DNA, 25 bp, S. cerevisiae
ggtgcgagtattgggccttacgaaa

SEQ ID NO: 46567 - DNA, 25 bp, S. cerevisiae
ggtgtactgttaaatgatcctcaat

SEQ ID NO: 46568 - DNA, 25 bp, S. cerevisiae
ggtggtggtttcatcattgctaaca

SEQ ID NO: 46569 - DNA, 25 bp, S. cerevisiae
ggtgagtccatatttcctggtgcaa

SEQ ID NO: 46570 - DNA, 25 bp, S. cerevisiae
ggtgatgcaaaccattacgcgcgtg

SEQ ID NO: 46571 - DNA, 25 bp, S. cerevisiae
ggtgtgttacaaagcagttttccaa

SEQ ID NO: 46572 - DNA, 25 bp, S. cerevisiae
ggtgagtttaccgtttattggaatg

SEQ ID NO: 46573 - DNA, 25 bp, S. cerevisiae
ggtggtgtagcatcctttactgtaa

SEQ ID NO: 46574 - DNA, 25 bp, S. cerevisiae
ggtgcgtacgcagccttaacaagga

SEQ ID NO: 46575 - DNA, 25 bp, S. cerevisiae
ggctctgcagacctggagttccaaa

SEQ ID NO: 46576 - DNA, 25 bp, S. cerevisiae
ggtctggcttcagtagcttcgataa

SEQ ID NO: 46577 - DNA, 25 bp, S. cerevisiae
ggtggtctctcaccagatttgaata

SEQ ID NO: 46578 - DNA, 25 bp, S. cerevisiae
ggtgaccgtacccaatctgagagag

SEQ ID NO: 46579 - DNA, 25 bp, S. cerevisiae
ggtgagccagtgtacatttctagat

SEQ ID NO: 46580 - DNA, 25 bp, S. cerevisiae
ggtgcaaagtgttatcgttcagatt

SEQ ID NO: 46581 - DNA, 25 bp, S. cerevisiae
ggtgctgcccatcataaactcaaat

SEQ ID NO: 46582 - DNA, 25 bp, S. cerevisiae
ggtgccaactggtcaaaactagctg

SEQ ID NO: 46583 - DNA, 25 bp, S. cerevisiae
ggtgctttctattatcgcgatctgg

SEQ ID NO: 46584 - DNA, 25 bp, S. cerevisiae
ggtgacttccaatggcaatgctttg

SEQ ID NO: 46585 - DNA, 25 bp, S. cerevisiae
ggtgacttctaatgttgtcctagtg

SEQ ID NO: 46586 - DNA, 25 bp, S. cerevisiae
ggtgatttcgtatctagtccgcaag

SEQ ID NO: 46587 - DNA, 25 bp, S. cerevisiae
ggtgatttcggtattgacctaggca

SEQ ID NO: 46588 - DNA, 25 bp, S. cerevisiae
ggtgtcactgctgtatatttcctag

SEQ ID NO: 46589 - DNA, 25 bp, S. cerevisiae
ggtgatcagcctttggtacaagcat

SEQ ID NO: 46590 - DNA, 25 bp, S. cerevisiae
ggtgcatcaccatctgaacattgtc

SEQ ID NO: 46591 - DNA, 25 bp, S. cerevisiae
ggtaaggactaccacactttggcta

SEQ ID NO: 46592 - DNA, 25 bp, S. cerevisiae
ggataaggaccccattgttgtgatg

SEQ ID NO: 46593 - DNA, 25 bp, S. cerevisiae
ggtaaggctctctcaggtggtgttc

SEQ ID NO: 46594 - DNA, 25 bp, S. cerevisiae
ggtaagttccgatggcggtcattac

SEQ ID NO: 46595 - DNA, 25 bp, S. cerevisiae
ggtgcaagggccacttcagatttac

SEQ ID NO: 46596 - DNA, 25 bp, S. cerevisiae
ggtgcaagagatccttcatccgatg

SEQ ID NO: 46597 - DNA, 25 bp, S. cerevisiae
ggtgcagcagagtcatccgaacgaa

SEQ ID NO: 46598 - DNA, 25 bp, S. cerevisiae
tgtccacgatcctcgacactaagtg

SEQ ID NO: 46599 - DNA, 25 bp, S. cerevisiae
ggcaccgactatcctgacgttgagg

SEQ ID NO: 46600 - DNA, 25 bp, S. cerevisiae
ggactggagctctgtgcaggttcaa

SEQ ID NO: 46601 - DNA, 25 bp, S. cerevisiae
ggtcttgcagtcatgtgatcgctta

SEQ ID NO: 46602 - DNA, 25 bp, S. cerevisiae
ggtctcacgccgctggagatacaat

SEQ ID NO: 46603 - DNA, 25 bp, S. cerevisiae
ggtctgaatggtctcaatatatcat

SEQ ID NO: 46604 - DNA, 25 bp, S. cerevisiae
ggtccagtcggcgatgatctatatc

SEQ ID NO: 46605 - DNA, 25 bp, S. cerevisiae
ggtgaattcgtccttggaaccgatt

SEQ ID NO: 46606 - DNA, 25 bp, S. cerevisiae
ggtgaagtcgccactaaaccagcat

SEQ ID NO: 46607 - DNA, 25 bp, S. cerevisiae
ggtgctgcccatagagccaatgaaa

SEQ ID NO: 46608 - DNA, 25 bp, S. cerevisiae
tggatgctgcagacaagctgccgtt

SEQ ID NO: 46609 - DNA, 25 bp, S. cerevisiae
ggtgctgctgaaagcatgccactgt

SEQ ID NO: 46610 - DNA, 25 bp, S. cerevisiae
ggtgctctagctgctgctgctatgt

SEQ ID NO: 46611 - DNA, 25 bp, S. cerevisiae
ggtgctgatcactatattgctatgt

SEQ ID NO: 46612 - DNA, 25 bp, S. cerevisiae
ggtgctgatcaactatttgattacc

SEQ ID NO: 46613 - DNA, 25 bp, S. cerevisiae
ggtgcttaccgaatcatcagtacat

SEQ ID NO: 46614 - DNA, 25 bp, S. cerevisiae
ggtcctcaaggacatcatcatccag

SEQ ID NO: 46615 - DNA, 25 bp, S. cerevisiae
ggtcgctgaagctcaattatctaat

SEQ ID NO: 46616 - DNA, 25 bp, S. cerevisiae
ggtcgcgctaggcaaatacacacag

SEQ ID NO: 46617 - DNA, 25 bp, S. cerevisiae
ggtgctcttggtgttaaatctgctg

SEQ ID NO: 46618 - DNA, 25 bp, S. cerevisiae
ggtgttgccgtcgttgaatctccag

SEQ ID NO: 46619 - DNA, 25 bp, S. cerevisiae
ggtgtcaccaagcttaatctgccaa

SEQ ID NO: 46620 - DNA, 25 bp, S. cerevisiae
ggtgtttctgatctaagtgctgcaa

SEQ ID NO: 46621 - DNA, 25 bp, S. cerevisiae
ggtgattcattctcaatggctgaca

SEQ ID NO: 46622 - DNA, 25 bp, S. cerevisiae
ggtctcctatgcagcaattcagtga

SEQ ID NO: 46623 - DNA, 25 bp, S. cerevisiae
ggtgcagaaacaatatactacagaa

SEQ ID NO: 46624 - DNA, 25 bp, S. cerevisiae
ggtgagcagacccaaggccagcaat

SEQ ID NO: 46625 - DNA, 25 bp, S. cerevisiae
ggtgaagactcttacgccagcagca

SEQ ID NO: 46626 - DNA, 25 bp, S. cerevisiae
ggtgcaagacctgacgaagctgtgt

SEQ ID NO: 46627 - DNA, 25 bp, S. cerevisiae
ggtgcacaaccctaaaactcatata

SEQ ID NO: 46628 - DNA, 25 bp, S. cerevisiae
ggtgaaaccgcggacggccaatatg

SEQ ID NO: 46629 - DNA, 25 bp, S. cerevisiae
ggaaaaggccagaacgttactatat

SEQ ID NO: 46630 - DNA, 25 bp, S. cerevisiae
ggagacaaactcctacgttgaagat

SEQ ID NO: 46631 - DNA, 25 bp, S. cerevisiae
ggtgacgtctccgaagtccatgaaa

SEQ ID NO: 46632 - DNA, 25 bp, S. cerevisiae
ggtacggtgccgcttacaaatcaac

SEQ ID NO: 46633 - DNA, 25 bp, S. cerevisiae
ggtaaacggattcttgctgcgtgaa

SEQ ID NO: 46634 - DNA, 25 bp, S. cerevisiae
ggtcacaaccttcagatcctaaact

SEQ ID NO: 46635 - DNA, 25 bp, S. cerevisiae
ggtaaatcgtcaatagtcctaaggt

SEQ ID NO: 46636 - DNA, 25 bp, S. cerevisiae
ggttttccaagtttccatgaaagct

SEQ ID NO: 46637 - DNA, 25 bp, S. cerevisiae
ggtgtttccttgtttgagttaatcg

SEQ ID NO: 46638 - DNA, 25 bp, S. cerevisiae
ggtctaacctctatcaggacatcag

SEQ ID NO: 46639 - DNA, 25 bp, S. cerevisiae
ggtgatatatgcctctctttgtata

SEQ ID NO: 46640 - DNA, 25 bp, S. cerevisiae
ggtgtcagaccctttggtgtttcac

SEQ ID NO: 46641 - DNA, 25 bp, S. cerevisiae
ggtgtcacacctatcgttcattata

SEQ ID NO: 46642 - DNA, 25 bp, S. cerevisiae
ggttacggtgggtcttcaagctcaa

SEQ ID NO: 46643 - DNA, 25 bp, S. cerevisiae
ggtttggcactaaacttcaagtcca

SEQ ID NO: 46644 - DNA, 25 bp, S. cerevisiae
ggtcagaaacctaacttcggccatt

SEQ ID NO: 46645 - DNA, 25 bp, S. cerevisiae
ggtcaaaaccgcactatatgggcaa

SEQ ID NO: 46646 - DNA, 25 bp, S. cerevisiae
ggcggaaattcccttaatgaccagt

SEQ ID NO: 46647 - DNA, 25 bp, S. cerevisiae
ggtctgaatttgtccctaaagtagt

SEQ ID NO: 46648 - DNA, 25 bp, S. cerevisiae
ggtgccaatgtcacgcctgaatatt

SEQ ID NO: 46649 - DNA, 25 bp, S. cerevisiae
ggtccgttatccactgcagctgatt

SEQ ID NO: 46650 - DNA, 25 bp, S. cerevisiae
ggtgcctttattgaagccttggaaa

SEQ ID NO: 46651 - DNA, 25 bp, S. cerevisiae
ggtctctcaagaacacgggatactg

SEQ ID NO: 46652 - DNA, 25 bp, S. cerevisiae
ggtacggtgaccagacattttagaa

SEQ ID NO: 46653 - DNA, 25 bp, S. cerevisiae
ggtctaaacctcattcacagttcaa

SEQ ID NO: 46654 - DNA, 25 bp, S. cerevisiae
ggtctacaaaccgttgtcgttgaag

SEQ ID NO: 46655 - DNA, 25 bp, S. cerevisiae
ggtgctcatccatccgttttaaagc

SEQ ID NO: 46656 - DNA, 25 bp, S. cerevisiae
ggttaacaccggttttgagcataca

SEQ ID NO: 46657 - DNA, 25 bp, S. cerevisiae
ggtctaacaacccattttcgctaga

SEQ ID NO: 46658 - DNA, 25 bp, S. cerevisiae
tgggaaagcaaatcatacgtcggtt

SEQ ID NO: 46659 - DNA, 25 bp, S. cerevisiae
ggtgcaaacaactcggcaatgggtt

SEQ ID NO: 46660 - DNA, 25 bp, S. cerevisiae
ggtacaactttttggcttcgagcat

SEQ ID NO: 46661 - DNA, 25 bp, S. cerevisiae
ggtgacgaacttttcctgactatgt

SEQ ID NO: 46662 - DNA, 25 bp, S. cerevisiae
ggtgttacaccacttttagctatgt

SEQ ID NO: 46663 - DNA, 25 bp, S. cerevisiae
ggtgttacacaacctgtctcattga

SEQ ID NO: 46664 - DNA, 25 bp, S. cerevisiae
ggtgttgaacatatcgtccttattg

SEQ ID NO: 46665 - DNA, 25 bp, S. cerevisiae
ggtcgtgcaaatatcttccgtattc

SEQ ID NO: 46666 - DNA, 25 bp, S. cerevisiae
ggtgcttcatcgaagatgttccgtt

SEQ ID NO: 46667 - DNA, 25 bp, S. cerevisiae
ggtgttatcttgacaattgccggat

SEQ ID NO: 46668 - DNA, 25 bp, S. cerevisiae
ggtgtatttttcaactctccagaaa

SEQ ID NO: 46669 - DNA, 25 bp, S. cerevisiae
ggtgtactgctaataaacccgcaag

SEQ ID NO: 46670 - DNA, 25 bp, S. cerevisiae
ggtaattatgggatgccaccaccat

SEQ ID NO: 46671 - DNA, 25 bp, S. cerevisiae
ggtaatttggtcacaccgctatgtt

SEQ ID NO: 46672 - DNA, 25 bp, S. cerevisiae
ggttattgcgccatacgtagtgatt

SEQ ID NO: 46673 - DNA, 25 bp, S. cerevisiae
ggattgtccccaaaggtggcgttga

SEQ ID NO: 46674 - DNA, 25 bp, S. cerevisiae
ggtaggcccatttattggtgcgtta

SEQ ID NO: 46675 - DNA, 25 bp, S. cerevisiae
ggtgacgcccacttttgaattgtat

SEQ ID NO: 46676 - DNA, 25 bp, S. cerevisiae
ggtgacgatcctcttggaattgata

SEQ ID NO: 46677 - DNA, 25 bp, S. cerevisiae
ggtgacactcttctctcaaatgaat

SEQ ID NO: 46678 - DNA, 25 bp, S. cerevisiae
ggtacttctagtcccaaagcagcag

SEQ ID NO: 46679 - DNA, 25 bp, S. cerevisiae
ggtgacttccactacgacgaagagt

SEQ ID NO: 46680 - DNA, 25 bp, S. cerevisiae
ggtgctatccccaagctttaaagtg

SEQ ID NO: 46681 - DNA, 25 bp, S. cerevisiae
ggtgccgtgaccactatctaaatta

SEQ ID NO: 46682 - DNA, 25 bp, S. cerevisiae
ggtcggtaaccacaatcatgctggc

SEQ ID NO: 46683 - DNA, 25 bp, S. cerevisiae
ggtcggtaattactattcgccagtt

SEQ ID NO: 46684 - DNA, 25 bp, S. cerevisiae
ggtcgacaagttatcaccctacata

SEQ ID NO: 46685 - DNA, 25 bp, S. cerevisiae
ggtctgcaccagtttcgaaaaaata

SEQ ID NO: 46686 - DNA, 25 bp, S. cerevisiae
ggtgccgccagtgccctatataata

SEQ ID NO: 46687 - DNA, 25 bp, S. cerevisiae
ggtgccaactctgtgcctagaaata

SEQ ID NO: 46688 - DNA, 25 bp, S. cerevisiae
ggtgcaccaacttcttccgaggaag

SEQ ID NO: 46689 - DNA, 25 bp, S. cerevisiae
ggtccacctttactccatagtggag

SEQ ID NO: 46690 - DNA, 25 bp, S. cerevisiae
ggtcagggatttattgtgtcgccaa

SEQ ID NO: 46691 - DNA, 25 bp, S. cerevisiae
ggtgaattatacctttctactgatt

SEQ ID NO: 46692 - DNA, 25 bp, S. cerevisiae
ggtgatattattcttgtttccttaa

SEQ ID NO: 46693 - DNA, 25 bp, S. cerevisiae
ggtgtttcaatttctgtttccttca

SEQ ID NO: 46694 - DNA, 25 bp, S. cerevisiae
ggtgctttgattgcctactacgaac

SEQ ID NO: 46695 - DNA, 25 bp, S. cerevisiae
ggtgttcttgccgactacaacatta

SEQ ID NO: 46696 - DNA, 25 bp, S. cerevisiae
ggtgatgttcaaaagcttaagccaa

SEQ ID NO: 46697 - DNA, 25 bp, S. cerevisiae
ggtgctttattcactctaagacaat

SEQ ID NO: 46698 - DNA, 25 bp, S. cerevisiae
ggtgatttatctgtattgccaacaa

SEQ ID NO: 46699 - DNA, 25 bp, S. cerevisiae
ggtgaattatgggtccacgcaataa

SEQ ID NO: 46700 - DNA, 25 bp, S. cerevisiae
ggtgcaattatatggccctcaatac

SEQ ID NO: 46701 - DNA, 25 bp, S. cerevisiae
ggtgacagatcccttgcagatgatt

SEQ ID NO: 46702 - DNA, 25 bp, S. cerevisiae
ggtgaagcacccgtcgatttgatga

SEQ ID NO: 46703 - DNA, 25 bp, S. cerevisiae
ggtgttcagcccgataatgttttag

SEQ ID NO: 46704 - DNA, 25 bp, S. cerevisiae
ggagttaatcgatcagtcagtttct

SEQ ID NO: 46705 - DNA, 25 bp, S. cerevisiae
ggtgttatactcacatttgtttcgg

SEQ ID NO: 46706 - DNA, 25 bp, S. cerevisiae
tggtcttacagtgccaacttttggc

SEQ ID NO: 46707 - DNA, 25 bp, S. cerevisiae
ggtgccatttggactcagactttgt

SEQ ID NO: 46708 - DNA, 25 bp, S. cerevisiae
ggtgacatttctccagctgatgtta

SEQ ID NO: 46709 - DNA, 25 bp, S. cerevisiae
ggtccattatgtccaatcttttctt

SEQ ID NO: 46710 - DNA, 25 bp, S. cerevisiae
ggtgctgattttaagggcgtcgcta

SEQ ID NO: 46711 - DNA, 25 bp, S. cerevisiae
ggtacccatcaaaggtcaccaagaa

SEQ ID NO: 46712 - DNA, 25 bp, S. cerevisiae
ggtgaccaagttttgattccacagt

SEQ ID NO: 46713 - DNA, 25 bp, S. cerevisiae
ggtgacaacgtatttatcgccccta

SEQ ID NO: 46714 - DNA, 25 bp, S. cerevisiae
ggtgatcacgtattttatccgtcct

SEQ ID NO: 46715 - DNA, 25 bp, S. cerevisiae
ggtgatcagttcttttatgcaggta

SEQ ID NO: 46716 - DNA, 25 bp, S. cerevisiae
ggtgctgctgcttccaacgctttgg

SEQ ID NO: 46717 - DNA, 25 bp, S. cerevisiae
ggtcgtgctgaccatatggcattat

SEQ ID NO: 46718 - DNA, 25 bp, S. cerevisiae
ggtcgtcgatgatactgccatattc

SEQ ID NO: 46719 - DNA, 25 bp, S. cerevisiae
ggtgagatcatatttactccaagct

SEQ ID NO: 46720 - DNA, 25 bp, S. cerevisiae
ggtgatttagagtaccaacatgtaa

SEQ ID NO: 46721 - DNA, 25 bp, S. cerevisiae
ggtgctaatatcatgtgccctggcc

SEQ ID NO: 46722 - DNA, 25 bp, S. cerevisiae
ggtgctaatactgctccattgggca

SEQ ID NO: 46723 - DNA, 25 bp, S. cerevisiae
ggtgaactattgtcttctttggaaa

SEQ ID NO: 46724 - DNA, 25 bp, S. cerevisiae
ggtcatacggcggttttactagctt

SEQ ID NO: 46725 - DNA, 25 bp, S. cerevisiae
ggttccgggtgtgctaatcttaata

SEQ ID NO: 46726 - DNA, 25 bp, S. cerevisiae
ggtccacacgtttgcttaggtcaaa

SEQ ID NO: 46727 - DNA, 25 bp, S. cerevisiae
tggtccatgacgcaagcccagttaa

SEQ ID NO: 46728 - DNA, 25 bp, S. cerevisiae
ggtcagccttcagatatccagattc

SEQ ID NO: 46729 - DNA, 25 bp, S. cerevisiae
ggtcaggcgttggtagtattttcac

SEQ ID NO: 46730 - DNA, 25 bp, S. cerevisiae
ggtcgggcgatttgaatctgttgaa

SEQ ID NO: 46731 - DNA, 25 bp, S. cerevisiae
ggtcgtatcggtactatcgttcaca

SEQ ID NO: 46732 - DNA, 25 bp, S. cerevisiae
ggtcgtattcgatagcgttgtccaa

SEQ ID NO: 46733 - DNA, 25 bp, S. cerevisiae
ggtccgtcatagttgtggtcgtcaa

SEQ ID NO: 46734 - DNA, 25 bp, S. cerevisiae
ggtgcctgtaactgaggtccaacaa

SEQ ID NO: 46735 - DNA, 25 bp, S. cerevisiae
ggtgacttaactatggcccacgaag

SEQ ID NO: 46736 - DNA, 25 bp, S. cerevisiae
ggtacctatattaaagtccctgaag

SEQ ID NO: 46737 - DNA, 25 bp, S. cerevisiae
ggtacgttacgttagcactacagaa

SEQ ID NO: 46738 - DNA, 25 bp, S. cerevisiae
ggtgacgattacattatccctgaaa

SEQ ID NO: 46739 - DNA, 25 bp, S. cerevisiae
ggtgacatattgacagtcttttctg

SEQ ID NO: 46740 - DNA, 25 bp, S. cerevisiae
ggtgacatacccgttcatttattta

SEQ ID NO: 46741 - DNA, 25 bp, S. cerevisiae
ggtaagctacctggcgaatgtttta

SEQ ID NO: 46742 - DNA, 25 bp, S. cerevisiae
ggtcagagatccttcctatagtttt

SEQ ID NO: 46743 - DNA, 25 bp, S. cerevisiae
ggtgaaaaccatccatcctgtgaaa

SEQ ID NO: 46744 - DNA, 25 bp, S. cerevisiae
ggtaacgttctgtgcattccaacat

SEQ ID NO: 46745 - DNA, 25 bp, S. cerevisiae
ggtgaacccttgcaagattatactt

SEQ ID NO: 46746 - DNA, 25 bp, S. cerevisiae
ggtgccacaccattaatcagtttta

SEQ ID NO: 46747 - DNA, 25 bp, S. cerevisiae
ggtccaggccaaattgttatttaca

SEQ ID NO: 46748 - DNA, 25 bp, S. cerevisiae
ggtccttatgcgatttcttggtcat

SEQ ID NO: 46749 - DNA, 25 bp, S. cerevisiae
ggtgatgctccattctaaaaacgtt

SEQ ID NO: 46750 - DNA, 25 bp, S. cerevisiae
ggtgctgctccttccaaaattgtgg

SEQ ID NO: 46751 - DNA, 25 bp, S. cerevisiae
ggtgatgagatgctattctaccatt

SEQ ID NO: 46752 - DNA, 25 bp, S. cerevisiae
ggtgagacctcaactttacggctat

SEQ ID NO: 46753 - DNA, 25 bp, S. cerevisiae
ggtgaggtctcaactttaacatatt

SEQ ID NO: 46754 - DNA, 25 bp, S. cerevisiae
ggatggacttccaaggtcgacaatg

SEQ ID NO: 46755 - DNA, 25 bp, S. cerevisiae
ggtgaaccccataaggcagcaacat

SEQ ID NO: 46756 - DNA, 25 bp, S. cerevisiae
ggtcaattccgtccattaaccagaa

SEQ ID NO: 46757 - DNA, 25 bp, S. cerevisiae
ggtgagtcttttccatatttccatg

SEQ ID NO: 46758 - DNA, 25 bp, S. cerevisiae
ggtgactctactgcaatgacatcaa

SEQ ID NO: 46759 - DNA, 25 bp, S. cerevisiae
ggtgacaccatcaaaatcgccaatg

SEQ ID NO: 46760 - DNA, 25 bp, S. cerevisiae
ggtgcaaccatttattatccttgat

SEQ ID NO: 46761 - DNA, 25 bp, S. cerevisiae
ggtgaccatttgtcgagagccatcg

SEQ ID NO: 46762 - DNA, 25 bp, S. cerevisiae
ggtgatggccataacaattcgtcga

SEQ ID NO: 46763 - DNA, 25 bp, S. cerevisiae
ggtaacgtcccatttggtgtgcaat

SEQ ID NO: 46764 - DNA, 25 bp, S. cerevisiae
ggtagacgtcgccaataccattggt

SEQ ID NO: 46765 - DNA, 25 bp, S. cerevisiae
ggtgcaggctccatgattgaatcat

SEQ ID NO: 46766 - DNA, 25 bp, S. cerevisiae
ggtgacctcgcccattatgataaag

SEQ ID NO: 46767 - DNA, 25 bp, S. cerevisiae
ggtgcccgctactttattacagagg

SEQ ID NO: 46768 - DNA, 25 bp, S. cerevisiae
ggtgccatccatgctattttacaag

SEQ ID NO: 46769 - DNA, 25 bp, S. cerevisiae
ggtgcacacttgatgtttacactga

SEQ ID NO: 46770 - DNA, 25 bp, S. cerevisiae
ggtgccgatgtttttgtgctattgc

SEQ ID NO: 46771 - DNA, 25 bp, S. cerevisiae
ggtgccaacattgatgcttgcatct

SEQ ID NO: 46772 - DNA, 25 bp, S. cerevisiae
ggtgccaccaataaattgcatattt

SEQ ID NO: 46773 - DNA, 25 bp, S. cerevisiae
ggtgccttgacattacaattccggt

SEQ ID NO: 46774 - DNA, 25 bp, S. cerevisiae
ggtgctttgtcattactattcttac

SEQ ID NO: 46775 - DNA, 25 bp, S. cerevisiae
ggtgcatcgaggcaagacattctga

SEQ ID NO: 46776 - DNA, 25 bp, S. cerevisiae
ggtgagctgtcgcaaatgattctat

SEQ ID NO: 46777 - DNA, 25 bp, S. cerevisiae
ggtgcattgaccaagcaagttgctc

SEQ ID NO: 46778 - DNA, 25 bp, S. cerevisiae
ggtgcttatcgttaatgttgcctcc

SEQ ID NO: 46779 - DNA, 25 bp, S. cerevisiae
ggtgctttcgttaagttcttgtcca

SEQ ID NO: 46780 - DNA, 25 bp, S. cerevisiae
ggtcttatggctatgtggacatttc

SEQ ID NO: 46781 - DNA, 25 bp, S. cerevisiae
ggtgaaattttgcatcccttactca

SEQ ID NO: 46782 - DNA, 25 bp, S. cerevisiae
ggtccaatttctcatgcccttgaat

SEQ ID NO: 46783 - DNA, 25 bp, S. cerevisiae
ggtgccatgtatttattccctaaga

SEQ ID NO: 46784 - DNA, 25 bp, S. cerevisiae
ggtgcggtatcattaaatccctcca

SEQ ID NO: 46785 - DNA, 25 bp, S. cerevisiae
ggtaaccttccatatgccatattgg

SEQ ID NO: 46786 - DNA, 25 bp, S. cerevisiae
ggtaacttctcaaccttggacttat

SEQ ID NO: 46787 - DNA, 25 bp, S. cerevisiae
ggtaccattccaacggttccatcgt

SEQ ID NO: 46788 - DNA, 25 bp, S. cerevisiae
ggtgaaaatcaatccgttctgtcga

SEQ ID NO: 46789 - DNA, 25 bp, S. cerevisiae
ggtgaaattctatccgtgtctcaat

SEQ ID NO: 46790 - DNA, 25 bp, S. cerevisiae
ggtgacattgttaccgttggtcaat

SEQ ID NO: 46791 - DNA, 25 bp, S. cerevisiae
ggtgacatcgttaccgtcggccaat

SEQ ID NO: 46792 - DNA, 25 bp, S. cerevisiae
ggtgaatacgtttccacggccaagt

SEQ ID NO: 46793 - DNA, 25 bp, S. cerevisiae
ggtcacttggattaacgattttgga

SEQ ID NO: 46794 - DNA, 25 bp, S. cerevisiae
ggtgccttccgcttactagttagaa

SEQ ID NO: 46795 - DNA, 25 bp, S. cerevisiae
ggtcctgccgccttaataaataaca

SEQ ID NO: 46796 - DNA, 25 bp, S. cerevisiae
ggtcctcgactctatcaacaaaaca

SEQ ID NO: 46797 - DNA, 25 bp, S. cerevisiae
ggtctgatccatgctttgtacgtga

SEQ ID NO: 46798 - DNA, 25 bp, S. cerevisiae
ggtgctcttgtcgttgctaacaaca

SEQ ID NO: 46799 - DNA, 25 bp, S. cerevisiae
ggtgcattctcggttgtagccaaag

SEQ ID NO: 46800 - DNA, 25 bp, S. cerevisiae
ggtgctgcttttttatctcaatcaa

SEQ ID NO: 46801 - DNA, 25 bp, S. cerevisiae
ggtgccttcgaactgttggtcaata

SEQ ID NO: 46802 - DNA, 25 bp, S. cerevisiae
ggtgcccaattttcaaggtcctatg

SEQ ID NO: 46803 - DNA, 25 bp, S. cerevisiae
ggtgccaaatatcaacagttgcaaa

SEQ ID NO: 46804 - DNA, 25 bp, S. cerevisiae
ggtgctgctaataccaagactggca

SEQ ID NO: 46805 - DNA, 25 bp, S. cerevisiae
ggtgcctgcaagtatagacgatgac

SEQ ID NO: 46806 - DNA, 25 bp, S. cerevisiae
ggtcccggatatgatcgtgacgaaa

SEQ ID NO: 46807 - DNA, 25 bp, S. cerevisiae
ggtgcaccagcgaataaaaggccaa

SEQ ID NO: 46808 - DNA, 25 bp, S. cerevisiae
ggtcactccagattggaacggctga

SEQ ID NO: 46809 - DNA, 25 bp, S. cerevisiae
ggaccgctgcgctagaatacgagta

SEQ ID NO: 46810 - DNA, 25 bp, S. cerevisiae
ggtgccctcggaagcatatcggtaa

SEQ ID NO: 46811 - DNA, 25 bp, S. cerevisiae
ggtgcctctatgctacagattggta

SEQ ID NO: 46812 - DNA, 25 bp, S. cerevisiae
ggtcctgctaggtcattgtcatatc

SEQ ID NO: 46813 - DNA, 25 bp, S. cerevisiae
ggtcctctatttgggtgtatctgat

SEQ ID NO: 46814 - DNA, 25 bp, S. cerevisiae
ggtgcctcaattcctgatggtgatt

SEQ ID NO: 46815 - DNA, 25 bp, S. cerevisiae
ggtgctcatctttacatgttggaac

SEQ ID NO: 46816 - DNA, 25 bp, S. cerevisiae
ggtgctgactattacatgtgctctt

SEQ ID NO: 46817 - DNA, 25 bp, S. cerevisiae
ggtctgcatctattatatggccatc

SEQ ID NO: 46818 - DNA, 25 bp, S. cerevisiae
ggtgctctaacattgattactctca

SEQ ID NO: 46819 - DNA, 25 bp, S. cerevisiae
ggtgcttatacattactactgacaa

SEQ ID NO: 46820 - DNA, 25 bp, S. cerevisiae
ggtgcaccagaattactacttaaca

SEQ ID NO: 46821 - DNA, 25 bp, S. cerevisiae
ggtgcccaaattgtttctaagcaaa

SEQ ID NO: 46822 - DNA, 25 bp, S. cerevisiae
ggtcactctaagcaacctggttgta

SEQ ID NO: 46823 - DNA, 25 bp, S. cerevisiae
ggtaccaatcgtgtcttggaattgc

SEQ ID NO: 46824 - DNA, 25 bp, S. cerevisiae
ggtccaagatcgtacttcctagacg

SEQ ID NO: 46825 - DNA, 25 bp, S. cerevisiae
ggatgccaagacctatgacccggaa

SEQ ID NO: 46826 - DNA, 25 bp, S. cerevisiae
ggtccagaagctaaggcctccagag

SEQ ID NO: 46827 - DNA, 25 bp, S. cerevisiae
ggtgccaaagctaaggctcgcgaat

SEQ ID NO: 46828 - DNA, 25 bp, S. cerevisiae
ggtccaaatcttgacaattctttgc

SEQ ID NO: 46829 - DNA, 25 bp, S. cerevisiae
ggtccaggtattgctattcgtgttc

SEQ ID NO: 46830 - DNA, 25 bp, S. cerevisiae
ggtgcaacagataattcctttacat

SEQ ID NO: 46831 - DNA, 25 bp, S. cerevisiae
ggtccaggtattttctccgacatta

SEQ ID NO: 46832 - DNA, 25 bp, S. cerevisiae
ggtccaactcaaattcacctgaatt

SEQ ID NO: 46833 - DNA, 25 bp, S. cerevisiae
ggtgctctagcctttgacaccgaga

SEQ ID NO: 46834 - DNA, 25 bp, S. cerevisiae
ggtcttccccgaaacagatagtacg

SEQ ID NO: 46835 - DNA, 25 bp, S. cerevisiae
ggtcttccgtcaaaccatatcaggt

SEQ ID NO: 46836 - DNA, 25 bp, S. cerevisiae
ggtctccacgtccaaagatgtcagg

SEQ ID NO: 46837 - DNA, 25 bp, S. cerevisiae
ggtgctcaaggtacaaaattcagaa

SEQ ID NO: 46838 - DNA, 25 bp, S. cerevisiae
ggtgcagccgctataactttcaaga

SEQ ID NO: 46839 - DNA, 25 bp, S. cerevisiae
ggtgcagcttattgctagtcttcta

SEQ ID NO: 46840 - DNA, 25 bp, S. cerevisiae
ggtcgcagctgcttacttgttgtaa

SEQ ID NO: 46841 - DNA, 25 bp, S. cerevisiae
ggtgcactggtgttgtttccaagac

SEQ ID NO: 46842 - DNA, 25 bp, S. cerevisiae
ggtcatccaggtgatcaaactacag

SEQ ID NO: 46843 - DNA, 25 bp, S. cerevisiae
ggtgctacacttttcaagactagat

SEQ ID NO: 46844 - DNA, 25 bp, S. cerevisiae
ggtgctactcttttcctgtaatgat

SEQ ID NO: 46845 - DNA, 25 bp, S. cerevisiae
ggtgcttctttatcttttattcttg

SEQ ID NO: 46846 - DNA, 25 bp, S. cerevisiae
ggtcttcatgttcttctatgttttg

SEQ ID NO: 46847 - DNA, 25 bp, S. cerevisiae
ggtcaccacgcatttgcactgggat

SEQ ID NO: 46848 - DNA, 25 bp, S. cerevisiae
ggtcgatacattaccgttgggtggt

SEQ ID NO: 46849 - DNA, 25 bp, S. cerevisiae
ggttatattacctgtcacgcgtttt

SEQ ID NO: 46850 - DNA, 25 bp, S. cerevisiae
ggtgccaaatctttatgtatcccat

SEQ ID NO: 46851 - DNA, 25 bp, S. cerevisiae
ggtgctcatagaacagtcatgaaca

SEQ ID NO: 46852 - DNA, 25 bp, S. cerevisiae
ggtctcatcatatcctcaaacattt

SEQ ID NO: 46853 - DNA, 25 bp, S. cerevisiae
ggtccacaatttaccctcaagttga

SEQ ID NO: 46854 - DNA, 25 bp, S. cerevisiae
ggtgctgaaattgtcgcccaagtta

SEQ ID NO: 46855 - DNA, 25 bp, S. cerevisiae
ggtgctgacacatgagtccctacat

SEQ ID NO: 46856 - DNA, 25 bp, S. cerevisiae
ggtccgcactatctttgatcttcaa

SEQ ID NO: 46857 - DNA, 25 bp, S. cerevisiae
ggtgctgctgtaactactgttttaa

SEQ ID NO: 46858 - DNA, 25 bp, S. cerevisiae
ggtccagttttgactgatttgccaa

SEQ ID NO: 46859 - DNA, 25 bp, S. cerevisiae
ggtcggtcttttgacggcaatcatc

SEQ ID NO: 46860 - DNA, 25 bp, S. cerevisiae
ggtcggaggtttgtcactacatcat

SEQ ID NO: 46861 - DNA, 25 bp, S. cerevisiae
ggtcctctactttgcctttaatggt

SEQ ID NO: 46862 - DNA, 25 bp, S. cerevisiae
ggtctgaattctgccacttggtaga

SEQ ID NO: 46863 - DNA, 25 bp, S. cerevisiae
ggtactaatacgtgcagacccacta

SEQ ID NO: 46864 - DNA, 25 bp, S. cerevisiae
ggtctgctgttatgtagtttacgct

SEQ ID NO: 46865 - DNA, 25 bp, S. cerevisiae
ggtccgtccacgaatatttaggcat

SEQ ID NO: 46866 - DNA, 25 bp, S. cerevisiae
ggtcggtgacccatttgatgaggaa

SEQ ID NO: 46867 - DNA, 25 bp, S. cerevisiae
ggtcggtaacagatacttggaaaag

SEQ ID NO: 46868 - DNA, 25 bp, S. cerevisiae
ggtcggtaacagatatctagaaaaa

SEQ ID NO: 46869 - DNA, 25 bp, S. cerevisiae
ggttctctaacgctgtcaggaaaaa

SEQ ID NO: 46870 - DNA, 25 bp, S. cerevisiae
ggtcacgctcacgaggattgtgcta

SEQ ID NO: 46871 - DNA, 25 bp, S. cerevisiae
ggtcatggtactggtgctgagcatt

SEQ ID NO: 46872 - DNA, 25 bp, S. cerevisiae
ggtctacttctggatgattgcatgt

SEQ ID NO: 46873 - DNA, 25 bp, S. cerevisiae
ggtctacgttcctaatgcatggccg

SEQ ID NO: 46874 - DNA, 25 bp, S. cerevisiae
ggtgctcaagtgaacatttcggcca

SEQ ID NO: 46875 - DNA, 25 bp, S. cerevisiae
ggtcaactgctgtttatggcggaaa

SEQ ID NO: 46876 - DNA, 25 bp, S. cerevisiae
ggtctcatctttttaagcgcgcaat

SEQ ID NO: 46877 - DNA, 25 bp, S. cerevisiae
ggtgctggaattcctatccaccaaa

SEQ ID NO: 46878 - DNA, 25 bp, S. cerevisiae
ggtatggttttcaccatcgaaccta

SEQ ID NO: 46879 - DNA, 25 bp, S. cerevisiae
ggtcaagttttcgttaccaccactg

SEQ ID NO: 46880 - DNA, 25 bp, S. cerevisiae
ggtaagtttatcatccccaaagtct

SEQ ID NO: 46881 - DNA, 25 bp, S. cerevisiae
ggtatagtcgtactggttcccaagt

SEQ ID NO: 46882 - DNA, 25 bp, S. cerevisiae
ggtctagctggtatggcctcccaaa

SEQ ID NO: 46883 - DNA, 25 bp, S. cerevisiae
ggtgctgaacgtaagtgcttccaca

SEQ ID NO: 46884 - DNA, 25 bp, S. cerevisiae
tgggtggtagttttcagtccccagg

SEQ ID NO: 46885 - DNA, 25 bp, S. cerevisiae
tgcgcttgttaggtttaactcccgt

SEQ ID NO: 46886 - DNA, 25 bp, S. cerevisiae
ggtccattgagtccgtcaagtcagc

SEQ ID NO: 46887 - DNA, 25 bp, S. cerevisiae
ggtcagcctaccagtgaattcatca

SEQ ID NO: 46888 - DNA, 25 bp, S. cerevisiae
ggtaagatcaccattgacagtccat

SEQ ID NO: 46889 - DNA, 25 bp, S. cerevisiae
ggtacaccaaagctcaagcatccag

SEQ ID NO: 46890 - DNA, 25 bp, S. cerevisiae
ggtacacctcaacggcagagcatgt

SEQ ID NO: 46891 - DNA, 25 bp, S. cerevisiae
ggtccaccgcaacagatgatgaatt

SEQ ID NO: 46892 - DNA, 25 bp, S. cerevisiae
ggtaacttggcatacatcgttcatg

SEQ ID NO: 46893 - DNA, 25 bp, S. cerevisiae
ggtcaagcagcaaattaactccaac

SEQ ID NO: 46894 - DNA, 25 bp, S. cerevisiae
ggtcgtggcacgatgatcactctaa

SEQ ID NO: 46895 - DNA, 25 bp, S. cerevisiae
ggtcgtgatgcacttttagcttcaa

SEQ ID NO: 46896 - DNA, 25 bp, S. cerevisiae
ggtcgatgagtctcgtggcttcaaa

SEQ ID NO: 46897 - DNA, 25 bp, S. cerevisiae
ggtctgcctttggtgctaccgaaaa

SEQ ID NO: 46898 - DNA, 25 bp, S. cerevisiae
ggtcgcttcttggtgtcatcggaat

SEQ ID NO: 46899 - DNA, 25 bp, S. cerevisiae
ggtccaacaatggtcttctggcagt

SEQ ID NO: 46900 - DNA, 25 bp, S. cerevisiae
ggtccaacaagagctattatcattc

SEQ ID NO: 46901 - DNA, 25 bp, S. cerevisiae
ggtctgatttcagcgcttatgacta

SEQ ID NO: 46902 - DNA, 25 bp, S. cerevisiae
ggtccttgctagtcgctttgatcga

SEQ ID NO: 46903 - DNA, 25 bp, S. cerevisiae
ggtcacttcaccctgagagatgaac

SEQ ID NO: 46904 - DNA, 25 bp, S. cerevisiae
ggtatgtcatcacccgaattacacg

SEQ ID NO: 46905 - DNA, 25 bp, S. cerevisiae
ggtcgttcgccaggatttcagcaaa

SEQ ID NO: 46906 - DNA, 25 bp, S. cerevisiae
ggtgctcgttccagattccaaaaat

SEQ ID NO: 46907 - DNA, 25 bp, S. cerevisiae
ggtctttattactttgatccacgat

SEQ ID NO: 46908 - DNA, 25 bp, S. cerevisiae
ggatcgtttgatccttcgtccttgt

SEQ ID NO: 46909 - DNA, 25 bp, S. cerevisiae
ggtgctgtttgttcttcagtgactt

SEQ ID NO: 46910 - DNA, 25 bp, S. cerevisiae
ggtgctgaatttggtgtcactactg

SEQ ID NO: 46911 - DNA, 25 bp, S. cerevisiae
ggtgctgataccttcttattcactg

SEQ ID NO: 46912 - DNA, 25 bp, S. cerevisiae
ggtcaggcccgaatggctgattgaa

SEQ ID NO: 46913 - DNA, 25 bp, S. cerevisiae
ggtgccggcctgaatttgataaatg

SEQ ID NO: 46914 - DNA, 25 bp, S. cerevisiae
ggtctctggcaggtattcttttgca

SEQ ID NO: 46915 - DNA, 25 bp, S. cerevisiae
ggtctcatctcggtggtatttgcca

SEQ ID NO: 46916 - DNA, 25 bp, S. cerevisiae
ggtctgcacctgattattttgtagc

SEQ ID NO: 46917 - DNA, 25 bp, S. cerevisiae
ggttccaaggtttccaagcaacaag

SEQ ID NO: 46918 - DNA, 25 bp, S. cerevisiae
ggtctcctatttatgggcgcaaacg

SEQ ID NO: 46919 - DNA, 25 bp, S. cerevisiae
ggtaactcaggctatttggccactt

SEQ ID NO: 46920 - DNA, 25 bp, S. cerevisiae
ggtctcgtcgtcaagaagcccaaag

SEQ ID NO: 46921 - DNA, 25 bp, S. cerevisiae
ggtcgtttgtcatcaagcccaagaa

SEQ ID NO: 46922 - DNA, 25 bp, S. cerevisiae
ggtctctaaagtatgtccctgaaaa

SEQ ID NO: 46923 - DNA, 25 bp, S. cerevisiae
ggttacgaaattatcctatgcggtt

SEQ ID NO: 46924 - DNA, 25 bp, S. cerevisiae
ggttccgtcaaatctttacaggtat

SEQ ID NO: 46925 - DNA, 25 bp, S. cerevisiae
ggtatttgtccctcatttacgagaa

SEQ ID NO: 46926 - DNA, 25 bp, S. cerevisiae
ggtattaccccatatttccaggtag

SEQ ID NO: 46927 - DNA, 25 bp, S. cerevisiae
ggtcgaacaccatctgttgtggctt

SEQ ID NO: 46928 - DNA, 25 bp, S. cerevisiae
ggtccccacagatatgttttcttgt

SEQ ID NO: 46929 - DNA, 25 bp, S. cerevisiae
ggtccaccagagttgagattttcta

SEQ ID NO: 46930 - DNA, 25 bp, S. cerevisiae
ggtccaaatgctatgagtttcgcta

SEQ ID NO: 46931 - DNA, 25 bp, S. cerevisiae
ggtccactgactaaattttccacag

SEQ ID NO: 46932 - DNA, 25 bp, S. cerevisiae
ggtcaaatactagactctttccatg

SEQ ID NO: 46933 - DNA, 25 bp, S. cerevisiae
ggtagaaaccagcttccattagcaa

SEQ ID NO: 46934 - DNA, 25 bp, S. cerevisiae
ggttgaaaccggttcattccgagat

SEQ ID NO: 46935 - DNA, 25 bp, S. cerevisiae
ggtaattacgctcttcatccagaag

SEQ ID NO: 46936 - DNA, 25 bp, S. cerevisiae
ggtaattgggattgttcttcagcaa

SEQ ID NO: 46937 - DNA, 25 bp, S. cerevisiae
ggtctatcattttacagcccatacg

SEQ ID NO: 46938 - DNA, 25 bp, S. cerevisiae
ggtcatcatttacacgagctcataa

SEQ ID NO: 46939 - DNA, 25 bp, S. cerevisiae
ggtacaacaccacttcgattactaa

SEQ ID NO: 46940 - DNA, 25 bp, S. cerevisiae
ggtagaataccactgatcgatcaag

SEQ ID NO: 46941 - DNA, 25 bp, S. cerevisiae
ggtacacaaagccagccgtcgataa

SEQ ID NO: 46942 - DNA, 25 bp, S. cerevisiae
ggtgccacaacccacttacaagaag

SEQ ID NO: 46943 - DNA, 25 bp, S. cerevisiae
ggtgccaaacccatcacatcaaagt

SEQ ID NO: 46944 - DNA, 25 bp, S. cerevisiae
ggtcctaagaccattcaacagattc

SEQ ID NO: 46945 - DNA, 25 bp, S. cerevisiae
ggtctccaagacgttaactcagcta

SEQ ID NO: 46946 - DNA, 25 bp, S. cerevisiae
ggttatcgaagcactacgtagttct

SEQ ID NO: 46947 - DNA, 25 bp, S. cerevisiae
ggtcacatgaattcttgccaagttt

SEQ ID NO: 46948 - DNA, 25 bp, S. cerevisiae
ggtaatgaaggtctaattttgccaa

SEQ ID NO: 46949 - DNA, 25 bp, S. cerevisiae
ggtatttcgggatactctcttgcca

SEQ ID NO: 46950 - DNA, 25 bp, S. cerevisiae
ggtatttttggtagacattcaggtc

SEQ ID NO: 46951 - DNA, 25 bp, S. cerevisiae
ggtagcgtttttagccaagcacgtt

SEQ ID NO: 46952 - DNA, 25 bp, S. cerevisiae
ggtcctttcgacttcacctatgaat

SEQ ID NO: 46953 - DNA, 25 bp, S. cerevisiae
ggtcccatctctacatgttcaagga

SEQ ID NO: 46954 - DNA, 25 bp, S. cerevisiae
ggtagtattttccaagcaacgttat

SEQ ID NO: 46955 - DNA, 25 bp, S. cerevisiae
ggtaagactacctacgaccagtcat

SEQ ID NO: 46956 - DNA, 25 bp, S. cerevisiae
ggtcctccctcgttattacaattgt

SEQ ID NO: 46957 - DNA, 25 bp, S. cerevisiae
ggtcccaccttctaggagaggtatt

SEQ ID NO: 46958 - DNA, 25 bp, S. cerevisiae
ggtcaccagcctacagagagtattt

SEQ ID NO: 46959 - DNA, 25 bp, S. cerevisiae
ggtcctctgtataattatgccgata

SEQ ID NO: 46960 - DNA, 25 bp, S. cerevisiae
ggtcgtgttcgccagagctgctaat

SEQ ID NO: 46961 - DNA, 25 bp, S. cerevisiae
ggtccatctaatttcaactccataa

SEQ ID NO: 46962 - DNA, 25 bp, S. cerevisiae
ggtaactgaaccgagcttcgctaac

SEQ ID NO: 46963 - DNA, 25 bp, S. cerevisiae
ggtacagctggatctgactctacga

SEQ ID NO: 46964 - DNA, 25 bp, S. cerevisiae
ggtccttgcttccaaatctgttata

SEQ ID NO: 46965 - DNA, 25 bp, S. cerevisiae
ggtccgcgccaaattactgttatag

SEQ ID NO: 46966 - DNA, 25 bp, S. cerevisiae
ggtcggcgccaaactattgttatcg

SEQ ID NO: 46967 - DNA, 25 bp, S. cerevisiae
ggtagacgttttcgcctttgaccag

SEQ ID NO: 46968 - DNA, 25 bp, S. cerevisiae
ggttatcacgttttggtttctccag

SEQ ID NO: 46969 - DNA, 25 bp, S. cerevisiae
ggtttccataccttagttttcatct

SEQ ID NO: 46970 - DNA, 25 bp, S. cerevisiae
ggttttacctcctaggatgggcact

SEQ ID NO: 46971 - DNA, 25 bp, S. cerevisiae
ggtatcgtcccaggcgaacggtacg

SEQ ID NO: 46972 - DNA, 25 bp, S. cerevisiae
ggtatgggcatcacagggacatgtt

SEQ ID NO: 46973 - DNA, 25 bp, S. cerevisiae
ggtctactgcactgctggctaagat

SEQ ID NO: 46974 - DNA, 25 bp, S. cerevisiae
ggtctactatcaccgactgaagaga

SEQ ID NO: 46975 - DNA, 25 bp, S. cerevisiae
ggtactactgaatctcctggtgaat

SEQ ID NO: 46976 - DNA, 25 bp, S. cerevisiae
ggtacaactggatctgcaatcccgt

SEQ ID NO: 46977 - DNA, 25 bp, S. cerevisiae
ggtagcacagctgatatccaatatt

SEQ ID NO: 46978 - DNA, 25 bp, S. cerevisiae
ggtagaaggcggtctgatctttccc

SEQ ID NO: 46979 - DNA, 25 bp, S. cerevisiae
ggtaccggcggtaagtctatctacg

SEQ ID NO: 46980 - DNA, 25 bp, S. cerevisiae
ggtacgcttcagataaacttccact

SEQ ID NO: 46981 - DNA, 25 bp, S. cerevisiae
ggtcccgtccaaaagagtctacttg

SEQ ID NO: 46982 - DNA, 25 bp, S. cerevisiae
ggtcaattgtcctcaaagttactga

SEQ ID NO: 46983 - DNA, 25 bp, S. cerevisiae
ggtcagattcatggccaaactttca

SEQ ID NO: 46984 - DNA, 25 bp, S. cerevisiae
ggtactttgcacgagaacttgtcca

SEQ ID NO: 46985 - DNA, 25 bp, S. cerevisiae
ggttgcttgtgataactcagggctt

SEQ ID NO: 46986 - DNA, 25 bp, S. cerevisiae
ggatccttggacatgtacaggtctt

SEQ ID NO: 46987 - DNA, 25 bp, S. cerevisiae
ggatgccttggacaagcacgacact

SEQ ID NO: 46988 - DNA, 25 bp, S. cerevisiae
ggatccagtggtgaacaatacgcat

SEQ ID NO: 46989 - DNA, 25 bp, S. cerevisiae
ggtcgcgccgttgcaaataccattg

SEQ ID NO: 46990 - DNA, 25 bp, S. cerevisiae
ggtacgccggtgaagtataccagat

SEQ ID NO: 46991 - DNA, 25 bp, S. cerevisiae
ggtatcccaggaaacagttgctcac

SEQ ID NO: 46992 - DNA, 25 bp, S. cerevisiae
ggtcccttgaacacagttgccatta

SEQ ID NO: 46993 - DNA, 25 bp, S. cerevisiae
ggtcggtaaagccactttgttgaca

SEQ ID NO: 46994 - DNA, 25 bp, S. cerevisiae
ggtcgataggaaacgctcttctcat

SEQ ID NO: 46995 - DNA, 25 bp, S. cerevisiae
ggttatacatttcccggtgcaggct

SEQ ID NO: 46996 - DNA, 25 bp, S. cerevisiae
ggtctaaagtcgtcagctattgcaa

SEQ ID NO: 46997 - DNA, 25 bp, S. cerevisiae
ggtcatcaacgttttatctagcttt

SEQ ID NO: 46998 - DNA, 25 bp, S. cerevisiae
ggtcaactgcgtttttcgaatgttt

SEQ ID NO: 46999 - DNA, 25 bp, S. cerevisiae
ggatgatccggacacctgggttcaa

SEQ ID NO: 47000 - DNA, 25 bp, S. cerevisiae
ggattcgcaatttgctccgggttaa

SEQ ID NO: 47001 - DNA, 25 bp, S. cerevisiae
ggtctagaatttgatccggtttcca

SEQ ID NO: 47002 - DNA, 25 bp, S. cerevisiae
ggtcacctctcatcttcgagaagaa

SEQ ID NO: 47003 - DNA, 25 bp, S. cerevisiae
ggtcaggctcttaccagcttaacta

SEQ ID NO: 47004 - DNA, 25 bp, S. cerevisiae
ggtcagagttcatcctgtcttgaaa

SEQ ID NO: 47005 - DNA, 25 bp, S. cerevisiae
ggtcgtcttacattttctcttctaa

SEQ ID NO: 47006 - DNA, 25 bp, S. cerevisiae
ggtagctgtaatggccgtaccggta

SEQ ID NO: 47007 - DNA, 25 bp, S. cerevisiae
ggtagctttgatgccgcttttggaa

SEQ ID NO: 47008 - DNA, 25 bp, S. cerevisiae
ggtacttaatgcaacctcttcaaga

SEQ ID NO: 47009 - DNA, 25 bp, S. cerevisiae
ggtcactgttttacctcttacacaa

SEQ ID NO: 47010 - DNA, 25 bp, S. cerevisiae
ggtcacaatttctttatcttttcaa

SEQ ID NO: 47011 - DNA, 25 bp, S. cerevisiae
ggctatgcagaatatcctacgtgga

SEQ ID NO: 47012 - DNA, 25 bp, S. cerevisiae
ggtaaacagggttccagtggcatct

SEQ ID NO: 47013 - DNA, 25 bp, S. cerevisiae
ggtaaaatgcctatccaagtcagat

SEQ ID NO: 47014 - DNA, 25 bp, S. cerevisiae
ggtaacagtcctaacgcagaacgtg

SEQ ID NO: 47015 - DNA, 25 bp, S. cerevisiae
ggataagcacttgtccgtcaactgc

SEQ ID NO: 47016 - DNA, 25 bp, S. cerevisiae
ggtaaatcgtccatcattaacacat

SEQ ID NO: 47017 - DNA, 25 bp, S. cerevisiae
ggtaaaccttgctacacggtcacaa

SEQ ID NO: 47018 - DNA, 25 bp, S. cerevisiae
ggtaaagccattctactgttcccac

SEQ ID NO: 47019 - DNA, 25 bp, S. cerevisiae
ggagttaacgtcttttctggtgccg

SEQ ID NO: 47020 - DNA, 25 bp, S. cerevisiae
ggtcttctccatgatttcaaggctc

SEQ ID NO: 47021 - DNA, 25 bp, S. cerevisiae
ggtctctcactaggtgttcacatta

SEQ ID NO: 47022 - DNA, 25 bp, S. cerevisiae
ggtcatgacaaagatgaacacacta

SEQ ID NO: 47023 - DNA, 25 bp, S. cerevisiae
ggtcgtcaaaacacagaatcttcct

SEQ ID NO: 47024 - DNA, 25 bp, S. cerevisiae
ggtcgtacaaacacaacatgcccta

SEQ ID NO: 47025 - DNA, 25 bp, S. cerevisiae
ggtcagtcaccgatagatttacatg

SEQ ID NO: 47026 - DNA, 25 bp, S. cerevisiae
ggtcatataccgatggaatcccgaa

SEQ ID NO: 47027 - DNA, 25 bp, S. cerevisiae
ggataccaagatctaccagccgggt

SEQ ID NO: 47028 - DNA, 25 bp, S. cerevisiae
ggtaccaagtctagatccacgcggt

SEQ ID NO: 47029 - DNA, 25 bp, S. cerevisiae
ggtactacattggaacccatcgctt

SEQ ID NO: 47030 - DNA, 25 bp, S. cerevisiae
ggtcactcaattaaaatccgcttct

SEQ ID NO: 47031 - DNA, 25 bp, S. cerevisiae
ggtacgcaattcaacgatcgcactg

SEQ ID NO: 47032 - DNA, 25 bp, S. cerevisiae
ggtactctttatccagatgtcatcg

SEQ ID NO: 47033 - DNA, 25 bp, S. cerevisiae
ggtagccgtataacaatgcactcaa

SEQ ID NO: 47034 - DNA, 25 bp, S. cerevisiae
ggtaagacatagcacaggcgcatta

SEQ ID NO: 47035 - DNA, 25 bp, S. cerevisiae
ggtcagaacttctgctaccttcaga

SEQ ID NO: 47036 - DNA, 25 bp, S. cerevisiae
ggtagtttttgggacgcattcgcag

SEQ ID NO: 47037 - DNA, 25 bp, S. cerevisiae
ggtcaagcagctctcgtcaaataat

SEQ ID NO: 47038 - DNA, 25 bp, S. cerevisiae
ggtagactcagttctaaaccaatta

SEQ ID NO: 47039 - DNA, 25 bp, S. cerevisiae
ggtacgctgatgcaatgttctatgt

SEQ ID NO: 47040 - DNA, 25 bp, S. cerevisiae
ggtcatccaatcaatacttctctgt

SEQ ID NO: 47041 - DNA, 25 bp, S. cerevisiae
ggtctcgccattgcattcacaattg

SEQ ID NO: 47042 - DNA, 25 bp, S. cerevisiae
ggtctaggcttactacacatttcaa

SEQ ID NO: 47043 - DNA, 25 bp, S. cerevisiae
ggtctaggttctgtcaatcttgata

SEQ ID NO: 47044 - DNA, 25 bp, S. cerevisiae
ggtaaccttatcaatggacactata

SEQ ID NO: 47045 - DNA, 25 bp, S. cerevisiae
ggtaacttttcttgggcttctgaag

SEQ ID NO: 47046 - DNA, 25 bp, S. cerevisiae
ggtaacatgtacaccgcatctgttt

SEQ ID NO: 47047 - DNA, 25 bp, S. cerevisiae
ggtaatgcagagaccaacccagcat

SEQ ID NO: 47048 - DNA, 25 bp, S. cerevisiae
ggtagtgagagtgccaccacaccag

SEQ ID NO: 47049 - DNA, 25 bp, S. cerevisiae
ggtttacgttcccacaagcgataag

SEQ ID NO: 47050 - DNA, 25 bp, S. cerevisiae
ggtcttttgcaaccccttgacaaat

SEQ ID NO: 47051 - DNA, 25 bp, S. cerevisiae
ggtcttatcgatcctgtcaattata

SEQ ID NO: 47052 - DNA, 25 bp, S. cerevisiae
ggtcacccaaatccaccaaatgaaa

SEQ ID NO: 47053 - DNA, 25 bp, S. cerevisiae
ggtcatcccatcgtcaacgatagtg

SEQ ID NO: 47054 - DNA, 25 bp, S. cerevisiae
ggtctatcatccgtcacaagactgt

SEQ ID NO: 47055 - DNA, 25 bp, S. cerevisiae
ggtctgccttcctaaagactgtcaa

SEQ ID NO: 47056 - DNA, 25 bp, S. cerevisiae
ggtctcaatccttttacatcagcaa

SEQ ID NO: 47057 - DNA, 25 bp, S. cerevisiae
ggtcataaacgccttcaatcagcaa

SEQ ID NO: 47058 - DNA, 25 bp, S. cerevisiae
ggtctttccgccttataatgcacaa

SEQ ID NO: 47059 - DNA, 25 bp, S. cerevisiae
ggtcttttcagtatatgcagctcca

SEQ ID NO: 47060 - DNA, 25 bp, S. cerevisiae
ggttttgctgtaattgggttcttcg

SEQ ID NO: 47061 - DNA, 25 bp, S. cerevisiae
ggtctatggcttaatacactctctt

SEQ ID NO: 47062 - DNA, 25 bp, S. cerevisiae
ggtctcgttacaccaactgtgatgg

SEQ ID NO: 47063 - DNA, 25 bp, S. cerevisiae
ggatcccgaagagcattactcctga

SEQ ID NO: 47064 - DNA, 25 bp, S. cerevisiae
ggtaccgatgaagcaatcacgtcga

SEQ ID NO: 47065 - DNA, 25 bp, S. cerevisiae
ggataccgaggcacatccggttgat

SEQ ID NO: 47066 - DNA, 25 bp, S. cerevisiae
ggtacaccagcgaattacgagttga

SEQ ID NO: 47067 - DNA, 25 bp, S. cerevisiae
ggtactggttcatcgatctactcag

SEQ ID NO: 47068 - DNA, 25 bp, S. cerevisiae
ggttcaagcttagcgatataccagc

SEQ ID NO: 47069 - DNA, 25 bp, S. cerevisiae
ggtcattgacattcacggtaccaag

SEQ ID NO: 47070 - DNA, 25 bp, S. cerevisiae
ggtcagctttatacctgtatccatt

SEQ ID NO: 47071 - DNA, 25 bp, S. cerevisiae
ggtcatatttttgctggtaatgtca

SEQ ID NO: 47072 - DNA, 25 bp, S. cerevisiae
ggtctttctatctcgctatgcagta

SEQ ID NO: 47073 - DNA, 25 bp, S. cerevisiae
ggtcaattctatgtcactgatgctt

SEQ ID NO: 47074 - DNA, 25 bp, S. cerevisiae
ggtcaatctctagtgtatcctgtaa

SEQ ID NO: 47075 - DNA, 25 bp, S. cerevisiae
ggattatcactaggtggcctgtccg

SEQ ID NO: 47076 - DNA, 25 bp, S. cerevisiae
ggtttcatgcattgagcaggccact

SEQ ID NO: 47077 - DNA, 25 bp, S. cerevisiae
ggtcatccatgctaatatcgctaca

SEQ ID NO: 47078 - DNA, 25 bp, S. cerevisiae
ggtacctgaagatcgtcacaacttt

SEQ ID NO: 47079 - DNA, 25 bp, S. cerevisiae
ggttgactgggctcgtgaacatttc

SEQ ID NO: 47080 - DNA, 25 bp, S. cerevisiae
ggtttgcgtcgctcatggaaaagtc

SEQ ID NO: 47081 - DNA, 25 bp, S. cerevisiae
ggtactacggctacggacaatgcta

SEQ ID NO: 47082 - DNA, 25 bp, S. cerevisiae
ggacctgcacggtgaggacgtacaa

SEQ ID NO: 47083 - DNA, 25 bp, S. cerevisiae
ggtactcaagttctctttcacttaa

SEQ ID NO: 47084 - DNA, 25 bp, S. cerevisiae
ggtacttgcgaatttcttcccggtg

SEQ ID NO: 47085 - DNA, 25 bp, S. cerevisiae
ggtcaaaagcaacgattctcatcaa

SEQ ID NO: 47086 - DNA, 25 bp, S. cerevisiae
ggtcttggatcatttcaatcacgaa

SEQ ID NO: 47087 - DNA, 25 bp, S. cerevisiae
ggtcatgggacagtatctttggaaa

SEQ ID NO: 47088 - DNA, 25 bp, S. cerevisiae
ggtcttgaatcactacttctggttc

SEQ ID NO: 47089 - DNA, 25 bp, S. cerevisiae
ggtctaaagcctgctagtgtcgatc

SEQ ID NO: 47090 - DNA, 25 bp, S. cerevisiae
ggtctaaacagcgtaacatgtgcag

SEQ ID NO: 47091 - DNA, 25 bp, S. cerevisiae
ggttaagatcagtgaagcattggcc

SEQ ID NO: 47092 - DNA, 25 bp, S. cerevisiae
ggttcagtgacatcctagttagccc

SEQ ID NO: 47093 - DNA, 25 bp, S. cerevisiae
ggttacgaaaacaacttgccacgat

SEQ ID NO: 47094 - DNA, 25 bp, S. cerevisiae
tggtaccagaaccaagaccccagga

SEQ ID NO: 47095 - DNA, 25 bp, S. cerevisiae
tgagtacggaaacaccagttcggaa

SEQ ID NO: 47096 - DNA, 25 bp, S. cerevisiae
ggtatccttactaacaccggacatt

SEQ ID NO: 47097 - DNA, 25 bp, S. cerevisiae
ggtacctcaattatggccgtgacat

SEQ ID NO: 47098 - DNA, 25 bp, S. cerevisiae
ggtacagctgtctacaacgtttgtc

SEQ ID NO: 47099 - DNA, 25 bp, S. cerevisiae
ggtacatctgccttacaaattcctg

SEQ ID NO: 47100 - DNA, 25 bp, S. cerevisiae
ggtactggatggagcacttttgaat

SEQ ID NO: 47101 - DNA, 25 bp, S. cerevisiae
ggtcacattgacattactctcttga

SEQ ID NO: 47102 - DNA, 25 bp, S. cerevisiae
ggtacacatcacattgacggccagg

SEQ ID NO: 47103 - DNA, 25 bp, S. cerevisiae
ggtaaatacatctccgatgctgaga

SEQ ID NO: 47104 - DNA, 25 bp, S. cerevisiae
ggtcaaattatcttctctgtcagaa

SEQ ID NO: 47105 - DNA, 25 bp, S. cerevisiae
ggtcaatagtgacaattccctctct

SEQ ID NO: 47106 - DNA, 25 bp, S. cerevisiae
ggtcaatgccagttacattcttggt

SEQ ID NO: 47107 - DNA, 25 bp, S. cerevisiae
ggtcaatccatttcactcttttgtg

SEQ ID NO: 47108 - DNA, 25 bp, S. cerevisiae
ggtcattcgctactactttctatta

SEQ ID NO: 47109 - DNA, 25 bp, S. cerevisiae
ggtcatacagctttggtcggtttat

SEQ ID NO: 47110 - DNA, 25 bp, S. cerevisiae
ggtcttgcagcctctttggttaata

SEQ ID NO: 47111 - DNA, 25 bp, S. cerevisiae
ggtttgagccgtagtccaattggta

SEQ ID NO: 47112 - DNA, 25 bp, S. cerevisiae
ggtttgcaagatatcctggactttt

SEQ ID NO: 47113 - DNA, 25 bp, S. cerevisiae
ggtcattaaaatcgcactggcctct

SEQ ID NO: 47114 - DNA, 25 bp, S. cerevisiae
ggtcaagacaagtcgtttccgctct

SEQ ID NO: 47115 - DNA, 25 bp, S. cerevisiae
ggtcttaaacatttctgttggtgaa

SEQ ID NO: 47116 - DNA, 25 bp, S. cerevisiae
ggatcgcaaaaatgcccttgaagag

SEQ ID NO: 47117 - DNA, 25 bp, S. cerevisiae
ggatgtgaacgagcgcccattatgg

SEQ ID NO: 47118 - DNA, 25 bp, S. cerevisiae
ggtctatatggtggatctttcgttc

SEQ ID NO: 47119 - DNA, 25 bp, S. cerevisiae
ggtagaacagctggtgggtcctccc

SEQ ID NO: 47120 - DNA, 25 bp, S. cerevisiae
ggtaaatgccttccagggcctgcca

SEQ ID NO: 47121 - DNA, 25 bp, S. cerevisiae
ggtaaagactgtgtggccattgcct

SEQ ID NO: 47122 - DNA, 25 bp, S. cerevisiae
ggatcagagatcaggttaccggaat

SEQ ID NO: 47123 - DNA, 25 bp, S. cerevisiae
ggtcattgggtctcttcttcaaaga

SEQ ID NO: 47124 - DNA, 25 bp, S. cerevisiae
ggtcttttgtcatctgcaggtgcca

SEQ ID NO: 47125 - DNA, 25 bp, S. cerevisiae
ggtagtgccggtactgatgacgact

SEQ ID NO: 47126 - DNA, 25 bp, S. cerevisiae
ggtactgcggttggctagttactaa

SEQ ID NO: 47127 - DNA, 25 bp, S. cerevisiae
ggtactatggtactgccgttagcca

SEQ ID NO: 47128 - DNA, 25 bp, S. cerevisiae
ggtactattgtcgatgtcggtccaa

SEQ ID NO: 47129 - DNA, 25 bp, S. cerevisiae
ggtacacttcccatctggtcaaaaa

SEQ ID NO: 47130 - DNA, 25 bp, S. cerevisiae
ggtaatgctgatgccgttggtctaa

SEQ ID NO: 47131 - DNA, 25 bp, S. cerevisiae
ggtactgcgaccaagtctgacgaag

SEQ ID NO: 47132 - DNA, 25 bp, S. cerevisiae
ggtaagtataccatcgccgatgagt

SEQ ID NO: 47133 - DNA, 25 bp, S. cerevisiae
ggtacgatgcacatgccagttactg

SEQ ID NO: 47134 - DNA, 25 bp, S. cerevisiae
ggtatcgatgccaccttcaaaaggg

SEQ ID NO: 47135 - DNA, 25 bp, S. cerevisiae
ggttcgtggcagctcattatactag

SEQ ID NO: 47136 - DNA, 25 bp, S. cerevisiae
ggtacagtagcagacttcaacgaga

SEQ ID NO: 47137 - DNA, 25 bp, S. cerevisiae
ggtacagtaccaggcattcaacgat

SEQ ID NO: 47138 - DNA, 25 bp, S. cerevisiae
ggtagcgtaccagaggatctagata

SEQ ID NO: 47139 - DNA, 25 bp, S. cerevisiae
ggtagcgtcaccataggcaagagta

SEQ ID NO: 47140 - DNA, 25 bp, S. cerevisiae
ggtcatcaagttcttctgcaagcac

SEQ ID NO: 47141 - DNA, 25 bp, S. cerevisiae
ggtcaagaggtgtattgctagcgat

SEQ ID NO: 47142 - DNA, 25 bp, S. cerevisiae
ggtacaattaacgtgaagcctgcca

SEQ ID NO: 47143 - DNA, 25 bp, S. cerevisiae
ggtacaggtcttctaacttcggatg

SEQ ID NO: 47144 - DNA, 25 bp, S. cerevisiae
ggtcaacttgttgctgcattcttca

SEQ ID NO: 47145 - DNA, 25 bp, S. cerevisiae
ggtcagtcatgctttaggctttcta

SEQ ID NO: 47146 - DNA, 25 bp, S. cerevisiae
ggtactgctgctataggctggtcaa

SEQ ID NO: 47147 - DNA, 25 bp, S. cerevisiae
ggtagctgtatgctccacagagtca

SEQ ID NO: 47148 - DNA, 25 bp, S. cerevisiae
ggtcacattatttcaccaagagatg

SEQ ID NO: 47149 - DNA, 25 bp, S. cerevisiae
ggtcagtttctttccaagcacatga

SEQ ID NO: 47150 - DNA, 25 bp, S. cerevisiae
ggattgaccatcactacgtggattt

SEQ ID NO: 47151 - DNA, 25 bp, S. cerevisiae
ggtataccagcaaccacgatagctt

SEQ ID NO: 47152 - DNA, 25 bp, S. cerevisiae
ggtagtcaaatgtcctcaaatgcca

SEQ ID NO: 47153 - DNA, 25 bp, S. cerevisiae
ggtagctcaagatccacttatgcca

SEQ ID NO: 47154 - DNA, 25 bp, S. cerevisiae
ggtaacaggacaacagccacagcca

SEQ ID NO: 47155 - DNA, 25 bp, S. cerevisiae
ggtagacgtgaaatcagccgcctag

SEQ ID NO: 47156 - DNA, 25 bp, S. cerevisiae
ggtatgaagatcaaagccgcccttg

SEQ ID NO: 47157 - DNA, 25 bp, S. cerevisiae
ggtagaagatgcatcactcccttgt

SEQ ID NO: 47158 - DNA, 25 bp, S. cerevisiae
ggtagaagcatactcgccactaggt

SEQ ID NO: 47159 - DNA, 25 bp, S. cerevisiae
ggtaaacatatcagcgcctcaattg

SEQ ID NO: 47160 - DNA, 25 bp, S. cerevisiae
ggtaatcatacatcggtggtccaga

SEQ ID NO: 47161 - DNA, 25 bp, S. cerevisiae
ggtactataacaccgtcgtcgaaag

SEQ ID NO: 47162 - DNA, 25 bp, S. cerevisiae
ggtacttacatgctagacactccaa

SEQ ID NO: 47163 - DNA, 25 bp, S. cerevisiae
ggtactaccatgttgatgcacccac

SEQ ID NO: 47164 - DNA, 25 bp, S. cerevisiae
ggtcacaactggctcatattcacca

SEQ ID NO: 47165 - DNA, 25 bp, S. cerevisiae
ggtcaaatctggctcgatgtctgaa

SEQ ID NO: 47166 - DNA, 25 bp, S. cerevisiae
ggtcaagactctctagctttgctaa

SEQ ID NO: 47167 - DNA, 25 bp, S. cerevisiae
ggtcaaatcactttatgttcgccaa

SEQ ID NO: 47168 - DNA, 25 bp, S. cerevisiae
ggtcacttcctcttatttatacaaa

SEQ ID NO: 47169 - DNA, 25 bp, S. cerevisiae
ggtactggaccggatcttcaacaaa

SEQ ID NO: 47170 - DNA, 25 bp, S. cerevisiae
ggtagaggccctcatgttcaactac

SEQ ID NO: 47171 - DNA, 25 bp, S. cerevisiae
ggtagcgggcttagtgctgtaacaa

SEQ ID NO: 47172 - DNA, 25 bp, S. cerevisiae
ggtaaagtctggatcgctggcgaac

SEQ ID NO: 47173 - DNA, 25 bp, S. cerevisiae
ggtagacacgtcatcttgttggcta

SEQ ID NO: 47174 - DNA, 25 bp, S. cerevisiae
ggtacccgtacatcttggcattcga

SEQ ID NO: 47175 - DNA, 25 bp, S. cerevisiae
ggttacgcggtgattttgacctcta

SEQ ID NO: 47176 - DNA, 25 bp, S. cerevisiae
ggttttgcaagggttatttctctgt

SEQ ID NO: 47177 - DNA, 25 bp, S. cerevisiae
ggttttctggttctgatcttacgtc

SEQ ID NO: 47178 - DNA, 25 bp, S. cerevisiae
ggttttcaggttatccttacactgg

SEQ ID NO: 47179 - DNA, 25 bp, S. cerevisiae
ggtttagaacttaccttgccaacag

SEQ ID NO: 47180 - DNA, 25 bp, S. cerevisiae
ggtcaaatcccttatactccagata

SEQ ID NO: 47181 - DNA, 25 bp, S. cerevisiae
ggtatgaacctttattgcgagaata

SEQ ID NO: 47182 - DNA, 25 bp, S. cerevisiae
ggtaaacgcgtgtctctcgagaagg

SEQ ID NO: 47183 - DNA, 25 bp, S. cerevisiae
ggtatctctgatgctgacattgcta

SEQ ID NO: 47184 - DNA, 25 bp, S. cerevisiae
ggtaacctgacgaccagtactgcat

SEQ ID NO: 47185 - DNA, 25 bp, S. cerevisiae
ggtaagcctgatactcaagtcacga

SEQ ID NO: 47186 - DNA, 25 bp, S. cerevisiae
ggtagagactgtatcggagcacgta

SEQ ID NO: 47187 - DNA, 25 bp, S. cerevisiae
ggtcaaatttctcaagccgcaaggc

SEQ ID NO: 47188 - DNA, 25 bp, S. cerevisiae
ggagttcgaattcaagcccaaggcc

SEQ ID NO: 47189 - DNA, 25 bp, S. cerevisiae
ggtagtacaagttcaacgccagtgg

SEQ ID NO: 47190 - DNA, 25 bp, S. cerevisiae
ggtagtaacgatactgactcgatta

SEQ ID NO: 47191 - DNA, 25 bp, S. cerevisiae
ggtttgcaacgcatcaatcttgagc

SEQ ID NO: 47192 - DNA, 25 bp, S. cerevisiae
ggtttgaatccagaatttcgccgat

SEQ ID NO: 47193 - DNA, 25 bp, S. cerevisiae
ggtactaccaaacttatacgctgca

SEQ ID NO: 47194 - DNA, 25 bp, S. cerevisiae
ggtaatcccatactttttcatgctg

SEQ ID NO: 47195 - DNA, 25 bp, S. cerevisiae
ggtaaggtctttatattcagctcta

SEQ ID NO: 47196 - DNA, 25 bp, S. cerevisiae
ggtagcacctttaattttcttcaca

SEQ ID NO: 47197 - DNA, 25 bp, S. cerevisiae
ggttacttcgggatctgtatgggat

SEQ ID NO: 47198 - DNA, 25 bp, S. cerevisiae
ggtattctttgggatgtctgttgta

SEQ ID NO: 47199 - DNA, 25 bp, S. cerevisiae
ggtttgttctgggattctttacaca

SEQ ID NO: 47200 - DNA, 25 bp, S. cerevisiae
ggttcagtctttgtagttcgagcga

SEQ ID NO: 47201 - DNA, 25 bp, S. cerevisiae
ggttgaagcttattctccgttaggt

SEQ ID NO: 47202 - DNA, 25 bp, S. cerevisiae
ggtcaagcgcttgtgtcattgctga

SEQ ID NO: 47203 - DNA, 25 bp, S. cerevisiae
ggtaatggttcaatccttgctgata

SEQ ID NO: 47204 - DNA, 25 bp, S. cerevisiae
ggtactgatatgtcaatcggtgtca

SEQ ID NO: 47205 - DNA, 25 bp, S. cerevisiae
ggtaatgaagccgtttccccatcaa

SEQ ID NO: 47206 - DNA, 25 bp, S. cerevisiae
ggtataatacgccattgcaactaag

SEQ ID NO: 47207 - DNA, 25 bp, S. cerevisiae
ggtcacaaaggcgttcaccaaattt

SEQ ID NO: 47208 - DNA, 25 bp, S. cerevisiae
ggtacacgaatcagccccaaagttt

SEQ ID NO: 47209 - DNA, 25 bp, S. cerevisiae
ggtacagaaacttccaatcgacatt

SEQ ID NO: 47210 - DNA, 25 bp, S. cerevisiae
ggtacaataactactcttcggattc

SEQ ID NO: 47211 - DNA, 25 bp, S. cerevisiae
ggtacaataacgaccatttttctct

SEQ ID NO: 47212 - DNA, 25 bp, S. cerevisiae
ggtactgtaaggttcatcctgtttc

SEQ ID NO: 47213 - DNA, 25 bp, S. cerevisiae
ggtatgttatggttcccactgcgtt

SEQ ID NO: 47214 - DNA, 25 bp, S. cerevisiae
ggttctgtcatttatcctactgagg

SEQ ID NO: 47215 - DNA, 25 bp, S. cerevisiae
ggtatatgtttccaactcgtagatg

SEQ ID NO: 47216 - DNA, 25 bp, S. cerevisiae
ggtactaactttaccttagcatgtc

SEQ ID NO: 47217 - DNA, 25 bp, S. cerevisiae
ggtagcgtccgtaatgtccaattct

SEQ ID NO: 47218 - DNA, 25 bp, S. cerevisiae
ggtaggttcagtacagatccctgtt

SEQ ID NO: 47219 - DNA, 25 bp, S. cerevisiae
ggtaatgttcatttctatccttgtg

SEQ ID NO: 47220 - DNA, 25 bp, S. cerevisiae
tggtaaggctaacaaacaatttgct

SEQ ID NO: 47221 - DNA, 25 bp, S. cerevisiae
ggaaagcggctacaacaaatttatt

SEQ ID NO: 47222 - DNA, 25 bp, S. cerevisiae
ggtacgactcctgatccaataattg

SEQ ID NO: 47223 - DNA, 25 bp, S. cerevisiae
ggtcaatacccagctaaaccttttg

SEQ ID NO: 47224 - DNA, 25 bp, S. cerevisiae
tggtagaccacctcaaaacgatttt

SEQ ID NO: 47225 - DNA, 25 bp, S. cerevisiae
ggtacagaccaccagaactattgtt

SEQ ID NO: 47226 - DNA, 25 bp, S. cerevisiae
ggtaataccgaccaatgcattgttt

SEQ ID NO: 47227 - DNA, 25 bp, S. cerevisiae
ggtttcccaagtcagagttgttcca

SEQ ID NO: 47228 - DNA, 25 bp, S. cerevisiae
ggtatattccatctgttcgttgttc

SEQ ID NO: 47229 - DNA, 25 bp, S. cerevisiae
ggccttttacttatcgagttttcat

SEQ ID NO: 47230 - DNA, 25 bp, S. cerevisiae
ggtaatgcctccacttatagcttag

SEQ ID NO: 47231 - DNA, 25 bp, S. cerevisiae
ggtaatgcacccaaatgtttcgatt

SEQ ID NO: 47232 - DNA, 25 bp, S. cerevisiae
ggtagctcctcccaaatatttgatg

SEQ ID NO: 47233 - DNA, 25 bp, S. cerevisiae
ggtagattcctccaaaatttcgact

SEQ ID NO: 47234 - DNA, 25 bp, S. cerevisiae
ggtacatcaacctagtcgcattcta

SEQ ID NO: 47235 - DNA, 25 bp, S. cerevisiae
ggtacaaaacagagccatgtcatag

SEQ ID NO: 47236 - DNA, 25 bp, S. cerevisiae
ggataacagaaactctcgtgtcaag

SEQ ID NO: 47237 - DNA, 25 bp, S. cerevisiae
ggtaatcgacaattcaggtgcacaa

SEQ ID NO: 47238 - DNA, 25 bp, S. cerevisiae
ggtacactacaatcagttgaccaat

SEQ ID NO: 47239 - DNA, 25 bp, S. cerevisiae
ggtattcagacaacccttaatcgag

SEQ ID NO: 47240 - DNA, 25 bp, S. cerevisiae
ggtacgcaatacctccatttattgg

SEQ ID NO: 47241 - DNA, 25 bp, S. cerevisiae
ggtaccgattctcacatggttctag

SEQ ID NO: 47242 - DNA, 25 bp, S. cerevisiae
ggtaccgatatttccattgttacgt

SEQ ID NO: 47243 - DNA, 25 bp, S. cerevisiae
ggtacagcagaaatcccattgaata

SEQ ID NO: 47244 - DNA, 25 bp, S. cerevisiae
ggtagccttgatttcttcgattatg

SEQ ID NO: 47245 - DNA, 25 bp, S. cerevisiae
ggtacttggacctttatttcctgtg

SEQ ID NO: 47246 - DNA, 25 bp, S. cerevisiae
ggtacttgggccataattgtccaat

SEQ ID NO: 47247 - DNA, 25 bp, S. cerevisiae
ggttattgggccacactttcatgac

SEQ ID NO: 47248 - DNA, 25 bp, S. cerevisiae
ggttttcggcctgccggtgctacgc

SEQ ID NO: 47249 - DNA, 25 bp, S. cerevisiae
ggttgtatccccactactttacgct

SEQ ID NO: 47250 - DNA, 25 bp, S. cerevisiae
ggtttgtttgcctctaagttgttca

SEQ ID NO: 47251 - DNA, 25 bp, S. cerevisiae
ggtatttctacctctaagattcacg

SEQ ID NO: 47252 - DNA, 25 bp, S. cerevisiae
ggtacttctactgctgctccagtta

SEQ ID NO: 47253 - DNA, 25 bp, S. cerevisiae
ggtagggtggtgtcgcaattattaa

SEQ ID NO: 47254 - DNA, 25 bp, S. cerevisiae
ggtaagcgtgccattaattatcaaa

SEQ ID NO: 47255 - DNA, 25 bp, S. cerevisiae
ggttcctttcataaatcttctgggt

SEQ ID NO: 47256 - DNA, 25 bp, S. cerevisiae
ggtacttatccatatcattgtcgca

SEQ ID NO: 47257 - DNA, 25 bp, S. cerevisiae
ggtatcgcagtctcatcattaggtt

SEQ ID NO: 47258 - DNA, 25 bp, S. cerevisiae
ggtactgcgttcaaatagaggttct

SEQ ID NO: 47259 - DNA, 25 bp, S. cerevisiae
ggttccagtatccaagagaggcgct

SEQ ID NO: 47260 - DNA, 25 bp, S. cerevisiae
ggatacctggatggcaaaactagtc

SEQ ID NO: 47261 - DNA, 25 bp, S. cerevisiae
ggccaagtagttcaagccgccattg

SEQ ID NO: 47262 - DNA, 25 bp, S. cerevisiae
ggtagattaattcacccagcctctg

SEQ ID NO: 47263 - DNA, 25 bp, S. cerevisiae
ggtacacgagatttttcttcccata

SEQ ID NO: 47264 - DNA, 25 bp, S. cerevisiae
ggtactatattccagttcattgcac

SEQ ID NO: 47265 - DNA, 25 bp, S. cerevisiae
ggtactatctttgacgtggcactgc

SEQ ID NO: 47266 - DNA, 25 bp, S. cerevisiae
ggtatttcttgaaccaatggcccga

SEQ ID NO: 47267 - DNA, 25 bp, S. cerevisiae
ggtaaacgtcacaacaagtcccaca

SEQ ID NO: 47268 - DNA, 25 bp, S. cerevisiae
ggtaacatctgtctggacatcctaa

SEQ ID NO: 47269 - DNA, 25 bp, S. cerevisiae
ggtaacattgtcaaggatccagaaa

SEQ ID NO: 47270 - DNA, 25 bp, S. cerevisiae
ggataactgttcaatccccgacgat

SEQ ID NO: 47271 - DNA, 25 bp, S. cerevisiae
ggtataaactctttccacgatggaa

SEQ ID NO: 47272 - DNA, 25 bp, S. cerevisiae
ggtactgcagttattggctttttga

SEQ ID NO: 47273 - DNA, 25 bp, S. cerevisiae
ggtacagagttgagacgccgtttaa

SEQ ID NO: 47274 - DNA, 25 bp, S. cerevisiae
ggtactttctgttagcgaggttata

SEQ ID NO: 47275 - DNA, 25 bp, S. cerevisiae
ggtactttcgtctcgcatacagtat

SEQ ID NO: 47276 - DNA, 25 bp, S. cerevisiae
ggtaccctcttctagcgtagataca

SEQ ID NO: 47277 - DNA, 25 bp, S. cerevisiae
ggtactcctaattagtcttgctaca

SEQ ID NO: 47278 - DNA, 25 bp, S. cerevisiae
ggtacgttactatgcttactcatct

SEQ ID NO: 47279 - DNA, 25 bp, S. cerevisiae
ggtacccttcaattgcgtacactag

SEQ ID NO: 47280 - DNA, 25 bp, S. cerevisiae
ggtacactttctttgcgaccaaaca

SEQ ID NO: 47281 - DNA, 25 bp, S. cerevisiae
ggtagaattactttgtcctcgagag

SEQ ID NO: 47282 - DNA, 25 bp, S. cerevisiae
ggtacaattgacttatcctcatcag

SEQ ID NO: 47283 - DNA, 25 bp, S. cerevisiae
ggtataattttttcctctgcgcttc

SEQ ID NO: 47284 - DNA, 25 bp, S. cerevisiae
ggtacacttcatttttatcgcctta

SEQ ID NO: 47285 - DNA, 25 bp, S. cerevisiae
ggtacactttattttctggactcac

SEQ ID NO: 47286 - DNA, 25 bp, S. cerevisiae
ggtacatcctctattcctggattaa

SEQ ID NO: 47287 - DNA, 25 bp, S. cerevisiae
ggtacgttggttgaaagtctatgca

SEQ ID NO: 47288 - DNA, 25 bp, S. cerevisiae
ggtaaatttgttgccaatgccaaga

SEQ ID NO: 47289 - DNA, 25 bp, S. cerevisiae
ggttgatttttatccttcgccatta

SEQ ID NO: 47290 - DNA, 25 bp, S. cerevisiae
ggttattttttacttctcattattg

SEQ ID NO: 47291 - DNA, 25 bp, S. cerevisiae
ggtttaagtgtcttcattgcgtcct

SEQ ID NO: 47292 - DNA, 25 bp, S. cerevisiae
ggtataactatttcgcacaggcttc

SEQ ID NO: 47293 - DNA, 25 bp, S. cerevisiae
ggtacaccaatatcacaagcgcatt

SEQ ID NO: 47294 - DNA, 25 bp, S. cerevisiae
ggtatagccaaagagcacgccaagt

SEQ ID NO: 47295 - DNA, 25 bp, S. cerevisiae
ggtaaatcgacacagactccaatct

SEQ ID NO: 47296 - DNA, 25 bp, S. cerevisiae
ggtagattccatcgctgtaaacaat

SEQ ID NO: 47297 - DNA, 25 bp, S. cerevisiae
ggtagagtgcacagattgctaagaa

SEQ ID NO: 47298 - DNA, 25 bp, S. cerevisiae
ggtagtgagtgacgcttttaagaaa

SEQ ID NO: 47299 - DNA, 25 bp, S. cerevisiae
ggtattgccgctattctgaagacaa

SEQ ID NO: 47300 - DNA, 25 bp, S. cerevisiae
ggtttaccaagcactagcgtcgtac

SEQ ID NO: 47301 - DNA, 25 bp, S. cerevisiae
ggttctgacccttatttggctcctg

SEQ ID NO: 47302 - DNA, 25 bp, S. cerevisiae
ggttttcaactatttattcatctct

SEQ ID NO: 47303 - DNA, 25 bp, S. cerevisiae
ggtattgcgcccatgtatcagatca

SEQ ID NO: 47304 - DNA, 25 bp, S. cerevisiae
ggtattgccggtatcaagtcaccaa

SEQ ID NO: 47305 - DNA, 25 bp, S. cerevisiae
ggtacagcgcaactttcttcaaaat

SEQ ID NO: 47306 - DNA, 25 bp, S. cerevisiae
ggttgactgctactgtaatcgtaag

SEQ ID NO: 47307 - DNA, 25 bp, S. cerevisiae
ggtagatttcatttggagtctgcaa

SEQ ID NO: 47308 - DNA, 25 bp, S. cerevisiae
ggtagcatttattccgcttctaaag

SEQ ID NO: 47309 - DNA, 25 bp, S. cerevisiae
ggtacaattcattgcattccttcaa

SEQ ID NO: 47310 - DNA, 25 bp, S. cerevisiae
ggtacaccatattacatgtcgcctg

SEQ ID NO: 47311 - DNA, 25 bp, S. cerevisiae
ggtactccatattggatggcacctg

SEQ ID NO: 47312 - DNA, 25 bp, S. cerevisiae
ggtactgcaaagactggtgcttcca

SEQ ID NO: 47313 - DNA, 25 bp, S. cerevisiae
ggttgcgccgagatggtcatgtcaa

SEQ ID NO: 47314 - DNA, 25 bp, S. cerevisiae
ggttagccattgacaagtgcattca

SEQ ID NO: 47315 - DNA, 25 bp, S. cerevisiae
ggttaccaagtatgtggccacgtag

SEQ ID NO: 47316 - DNA, 25 bp, S. cerevisiae
ggttacctcagcgacgaggacacgt

SEQ ID NO: 47317 - DNA, 25 bp, S. cerevisiae
ggatttttgcccttaagaacgatca

SEQ ID NO: 47318 - DNA, 25 bp, S. cerevisiae
ggttgtattcccttaatagcccaat

SEQ ID NO: 47319 - DNA, 25 bp, S. cerevisiae
ggtttttgttctcaatcccattatc

SEQ ID NO: 47320 - DNA, 25 bp, S. cerevisiae
ggtatcgttgttccaagaaacacta

SEQ ID NO: 47321 - DNA, 25 bp, S. cerevisiae
ggtacatgcatactcctcaagaaaa

SEQ ID NO: 47322 - DNA, 25 bp, S. cerevisiae
ggtactgtgcatgtggacctcgatc

SEQ ID NO: 47323 - DNA, 25 bp, S. cerevisiae
ggtacatccggatttatgctcgtca

SEQ ID NO: 47324 - DNA, 25 bp, S. cerevisiae
ggtacatgcccgattatgacttcat

SEQ ID NO: 47325 - DNA, 25 bp, S. cerevisiae
ggtactgcttcgaatcttatcttag

SEQ ID NO: 47326 - DNA, 25 bp, S. cerevisiae
ggtttcgagtctagaatcctcccta

SEQ ID NO: 47327 - DNA, 25 bp, S. cerevisiae
ggttacaaacatatcgagcctctaa

SEQ ID NO: 47328 - DNA, 25 bp, S. cerevisiae
ggtttccagaggattgagccctact

SEQ ID NO: 47329 - DNA, 25 bp, S. cerevisiae
ggtttgtacgaaccatgccacggtt

SEQ ID NO: 47330 - DNA, 25 bp, S. cerevisiae
ggtatcatttttgtcccattgggtt

SEQ ID NO: 47331 - DNA, 25 bp, S. cerevisiae
ggtatcacttacttgtccatcattc

SEQ ID NO: 47332 - DNA, 25 bp, S. cerevisiae
ggtactggttcgtatttctcttgaa

SEQ ID NO: 47333 - DNA, 25 bp, S. cerevisiae
ggtactgggtgcaatttcccatcaa

SEQ ID NO: 47334 - DNA, 25 bp, S. cerevisiae
ggtaccgcattgatttctccagaag

SEQ ID NO: 47335 - DNA, 25 bp, S. cerevisiae
ggtaccgtctggatcaacacataca

SEQ ID NO: 47336 - DNA, 25 bp, S. cerevisiae
ggttcattttacttgtgtggcccta

SEQ ID NO: 47337 - DNA, 25 bp, S. cerevisiae
ggtttgtataagctttctcctctat

SEQ ID NO: 47338 - DNA, 25 bp, S. cerevisiae
ggttgcttagattccacgggttcaa

SEQ ID NO: 47339 - DNA, 25 bp, S. cerevisiae
ggtttttggtccttacaggcagaat

SEQ ID NO: 47340 - DNA, 25 bp, S. cerevisiae
ggtttcctggtccttcaagattgaa

SEQ ID NO: 47341 - DNA, 25 bp, S. cerevisiae
ggtattccggtcaacacattttcaa

SEQ ID NO: 47342 - DNA, 25 bp, S. cerevisiae
ggatattcgggatttgcagttttca

SEQ ID NO: 47343 - DNA, 25 bp, S. cerevisiae
ggtagtcctaatacgctatcagaaa

SEQ ID NO: 47344 - DNA, 25 bp, S. cerevisiae
ggtatttctccaagtcaaaacaagt

SEQ ID NO: 47345 - DNA, 25 bp, S. cerevisiae
ggtttagttgcttaccatcaaaaat

SEQ ID NO: 47346 - DNA, 25 bp, S. cerevisiae
ggtttagttgcttaccatcaaaaat

SEQ ID NO: 47347 - DNA, 25 bp, S. cerevisiae
ggtttctgctttcaccaacaagagg

SEQ ID NO: 47348 - DNA, 25 bp, S. cerevisiae
ggttctgcgcttgccaaaaaggtgt

SEQ ID NO: 47349 - DNA, 25 bp, S. cerevisiae
ggtatccctcaactatttgcaagga

SEQ ID NO: 47350 - DNA, 25 bp, S. cerevisiae
ggtatccacaccgaatcattcacag

SEQ ID NO: 47351 - DNA, 25 bp, S. cerevisiae
ggtacccctttcgatttcaatggtg

SEQ ID NO: 47352 - DNA, 25 bp, S. cerevisiae
ggtttccctggacaaacacatctta

SEQ ID NO: 47353 - DNA, 25 bp, S. cerevisiae
ggttaacaataacataatactcttt

SEQ ID NO: 47354 - DNA, 25 bp, S. cerevisiae
ggtattaaaccggtctccattgcat

SEQ ID NO: 47355 - DNA, 25 bp, S. cerevisiae
ggtatggtttctcacaagactgctc

SEQ ID NO: 47356 - DNA, 25 bp, S. cerevisiae
ggtatctatttctcacgatgacctc

SEQ ID NO: 47357 - DNA, 25 bp, S. cerevisiae
ggtataattacttcctatttcacgt

SEQ ID NO: 47358 - DNA, 25 bp, S. cerevisiae
ggttacactactcccctatgtgaag

SEQ ID NO: 47359 - DNA, 25 bp, S. cerevisiae
ggatttgcacaacagtccctgaaag

SEQ ID NO: 47360 - DNA, 25 bp, S. cerevisiae
ggtactgaagcgtctggtacttcta

SEQ ID NO: 47361 - DNA, 25 bp, S. cerevisiae
ggtaccaaaacgcaatcattccatc

SEQ ID NO: 47362 - DNA, 25 bp, S. cerevisiae
ggtatccccaaccaatacaatcaac

SEQ ID NO: 47363 - DNA, 25 bp, S. cerevisiae
ggttttaacgcaagaatccctcaca

SEQ ID NO: 47364 - DNA, 25 bp, S. cerevisiae
ggatatttaaacactctggccgatg

SEQ ID NO: 47365 - DNA, 25 bp, S. cerevisiae
ggtttaatgtcaccgttgctcaatt

SEQ ID NO: 47366 - DNA, 25 bp, S. cerevisiae
ggtttgaaatcatcctgtggtatac

SEQ ID NO: 47367 - DNA, 25 bp, S. cerevisiae
ggtttgtagagctcacatggttgtg

SEQ ID NO: 47368 - DNA, 25 bp, S. cerevisiae
ggtagtgaacagtcatcaactctta

SEQ ID NO: 47369 - DNA, 25 bp, S. cerevisiae
ggtatctccacctcaggtttagatc

SEQ ID NO: 47370 - DNA, 25 bp, S. cerevisiae
ggtaccccgacatgtatttggcgaa

SEQ ID NO: 47371 - DNA, 25 bp, S. cerevisiae
ggtacctgccaacaaatatcttcca

SEQ ID NO: 47372 - DNA, 25 bp, S. cerevisiae
ggtttattgcatccgtctgagtgaa

SEQ ID NO: 47373 - DNA, 25 bp, S. cerevisiae
ggatgtaagttccttgctttacgct

SEQ ID NO: 47374 - DNA, 25 bp, S. cerevisiae
ggtagatgagttgattgcttccaag

SEQ ID NO: 47375 - DNA, 25 bp, S. cerevisiae
ggatcaaagcaagcgttttttctca

SEQ ID NO: 47376 - DNA, 25 bp, S. cerevisiae
ggtataacgcatccttagtgaatca

SEQ ID NO: 47377 - DNA, 25 bp, S. cerevisiae
ggttaagcgctgcattaagcaagtt

SEQ ID NO: 47378 - DNA, 25 bp, S. cerevisiae
ggttgtcgagctttgcaaatgcctg

SEQ ID NO: 47379 - DNA, 25 bp, S. cerevisiae
tgttgttcaatgcaccaagtcccgg

SEQ ID NO: 47380 - DNA, 25 bp, S. cerevisiae
ggtttacaggcatcaagtcctcggt

SEQ ID NO: 47381 - DNA, 25 bp, S. cerevisiae
ggtttacatgaatcagttgcccgtt

SEQ ID NO: 47382 - DNA, 25 bp, S. cerevisiae
ggttctacacaaaacttcggatgtt

SEQ ID NO: 47383 - DNA, 25 bp, S. cerevisiae
ggttcatacacagacccgtggactg

SEQ ID NO: 47384 - DNA, 25 bp, S. cerevisiae
ggttgtagaatcaagcccgtggctt

SEQ ID NO: 47385 - DNA, 25 bp, S. cerevisiae
tggtgggacaacagccattgtggct

SEQ ID NO: 47386 - DNA, 25 bp, S. cerevisiae
ggttgaatacatctgccattgcggc

SEQ ID NO: 47387 - DNA, 25 bp, S. cerevisiae
ggtttagacattggctcttcattga

SEQ ID NO: 47388 - DNA, 25 bp, S. cerevisiae
ggtttcatgctagcgtttggtgact

SEQ ID NO: 47389 - DNA, 25 bp, S. cerevisiae
ggtattatgcaatcgatttctgaga

SEQ ID NO: 47390 - DNA, 25 bp, S. cerevisiae
ggttcatcatctcatggatctgcac

SEQ ID NO: 47391 - DNA, 25 bp, S. cerevisiae
ggttcaatcgcaatttctccggaaa

SEQ ID NO: 47392 - DNA, 25 bp, S. cerevisiae
ggtatcgttgatccttttgttgaac

SEQ ID NO: 47393 - DNA, 25 bp, S. cerevisiae
ggtatgccaattctttacgtcatgt

SEQ ID NO: 47394 - DNA, 25 bp, S. cerevisiae
ggtatgccaggtcaattcatgcctc

SEQ ID NO: 47395 - DNA, 25 bp, S. cerevisiae
ggtatgtttgcgcagatggcctcca

SEQ ID NO: 47396 - DNA, 25 bp, S. cerevisiae
ggtagtagttaccatcgttacattt

SEQ ID NO: 47397 - DNA, 25 bp, S. cerevisiae
ggtagtcaatttccagatttccaaa

SEQ ID NO: 47398 - DNA, 25 bp, S. cerevisiae
ggttattgctatcgcaggtggacca

SEQ ID NO: 47399 - DNA, 25 bp, S. cerevisiae
ggtttctgtcgaaggtgtcaacgtt

SEQ ID NO: 47400 - DNA, 25 bp, S. cerevisiae
ggtatcaggatcatctccttaacgt

SEQ ID NO: 47401 - DNA, 25 bp, S. cerevisiae
ggtatcgtcacaacatttctaatgc

SEQ ID NO: 47402 - DNA, 25 bp, S. cerevisiae
ggtatgccattttcatccctaagta

SEQ ID NO: 47403 - DNA, 25 bp, S. cerevisiae
ggtatcatatttgaccctgaggtac

SEQ ID NO: 47404 - DNA, 25 bp, S. cerevisiae
ggttgctagattggccggaaagtac

SEQ ID NO: 47405 - DNA, 25 bp, S. cerevisiae
ggtttgaactctgctagaaagctac

SEQ ID NO: 47406 - DNA, 25 bp, S. cerevisiae
ggtatgtcttcctattagacccaat

SEQ ID NO: 47407 - DNA, 25 bp, S. cerevisiae
ggttgcgttctatttaacgacgagc

SEQ ID NO: 47408 - DNA, 25 bp, S. cerevisiae
ggtatcgcagtttcttctataggcc

SEQ ID NO: 47409 - DNA, 25 bp, S. cerevisiae
ggtatcacagacaacttctacagag

SEQ ID NO: 47410 - DNA, 25 bp, S. cerevisiae
ggtatctctcttggatactttccaa

SEQ ID NO: 47411 - DNA, 25 bp, S. cerevisiae
ggtacctatttgttctatatctcac

SEQ ID NO: 47412 - DNA, 25 bp, S. cerevisiae
ggttccaacttgttcaatgcctcag

SEQ ID NO: 47413 - DNA, 25 bp, S. cerevisiae
ggttccactttccaaataccggcat

SEQ ID NO: 47414 - DNA, 25 bp, S. cerevisiae
ggttacattttcattcaatccgcct

SEQ ID NO: 47415 - DNA, 25 bp, S. cerevisiae
ggttatgttcgtgttatcaccgccg

SEQ ID NO: 47416 - DNA, 25 bp, S. cerevisiae
ggtagtgctggttactatcgtccgc

SEQ ID NO: 47417 - DNA, 25 bp, S. cerevisiae
ggtatccttctaacatgtctgcgca

SEQ ID NO: 47418 - DNA, 25 bp, S. cerevisiae
ggtatgttttcaccattcgagcatg

SEQ ID NO: 47419 - DNA, 25 bp, S. cerevisiae
ggtatgatattttcgttacgctcca

SEQ ID NO: 47420 - DNA, 25 bp, S. cerevisiae
ggtagaagcacctcgattccaatca

SEQ ID NO: 47421 - DNA, 25 bp, S. cerevisiae
ggtagcgccaccttctattaatata

SEQ ID NO: 47422 - DNA, 25 bp, S. cerevisiae
ggtatagcccgtttcattaatcatt

SEQ ID NO: 47423 - DNA, 25 bp, S. cerevisiae
ggttcaccgccattgaatttaccta

SEQ ID NO: 47424 - DNA, 25 bp, S. cerevisiae
ggttacgcaacaatgactctttcct

SEQ ID NO: 47425 - DNA, 25 bp, S. cerevisiae
ggttactcaccaaagcctatttcaa

SEQ ID NO: 47426 - DNA, 25 bp, S. cerevisiae
ggtatggtgaccttatcatgctgaa

SEQ ID NO: 47427 - DNA, 25 bp, S. cerevisiae
ggtagaccattcttgtatgcgaact

SEQ ID NO: 47428 - DNA, 25 bp, S. cerevisiae
ggcttacaaagaattgcctgggttt

SEQ ID NO: 47429 - DNA, 25 bp, S. cerevisiae
ggcttacaaaccaggtgtaccgctg

SEQ ID NO: 47430 - DNA, 25 bp, S. cerevisiae
ggttattaactacgacttaccagct

SEQ ID NO: 47431 - DNA, 25 bp, S. cerevisiae
ggtattaatattttgcctgtccgca

SEQ ID NO: 47432 - DNA, 25 bp, S. cerevisiae
ggtataacatttttccctcttgtgg

SEQ ID NO: 47433 - DNA, 25 bp, S. cerevisiae
ggttgagtcaagaattcctctcccg

SEQ ID NO: 47434 - DNA, 25 bp, S. cerevisiae
ggtattactctgcagccattattta

SEQ ID NO: 47435 - DNA, 25 bp, S. cerevisiae
ggtttatagctcatggcttcgaaca

SEQ ID NO: 47436 - DNA, 25 bp, S. cerevisiae
ggttacgctagctttgggatctgta

SEQ ID NO: 47437 - DNA, 25 bp, S. cerevisiae
ggtttcagtgcttcctgggacagaa

SEQ ID NO: 47438 - DNA, 25 bp, S. cerevisiae
ggtttgcgcctatttacgaagaaat

SEQ ID NO: 47439 - DNA, 25 bp, S. cerevisiae
ggtttaccaagtgatccttcagcaa

SEQ ID NO: 47440 - DNA, 25 bp, S. cerevisiae
ggttacctctgagtggaagtccaaa

SEQ ID NO: 47441 - DNA, 25 bp, S. cerevisiae
ggtatgaccatgaatgacgccaatg

SEQ ID NO: 47442 - DNA, 25 bp, S. cerevisiae
ggttcactgcccattgttttaagct

SEQ ID NO: 47443 - DNA, 25 bp, S. cerevisiae
ggttccatggcctttttgttcatga

SEQ ID NO: 47444 - DNA, 25 bp, S. cerevisiae
ggtatagcaccttttttcttagctt

SEQ ID NO: 47445 - DNA, 25 bp, S. cerevisiae
ggtatagctctttgttttctgtcga

SEQ ID NO: 47446 - DNA, 25 bp, S. cerevisiae
ggtttggctgatcaaattcccatca

SEQ ID NO: 47447 - DNA, 25 bp, S. cerevisiae
ggttgtcagcagaggattacccaaa

SEQ ID NO: 47448 - DNA, 25 bp, S. cerevisiae
ggttatcacagattcgttcaccgaa

SEQ ID NO: 47449 - DNA, 25 bp, S. cerevisiae
ggtttcaaatcactgtattgcacga

SEQ ID NO: 47450 - DNA, 25 bp, S. cerevisiae
ggtattctgaaggtgtctgccacag

SEQ ID NO: 47451 - DNA, 25 bp, S. cerevisiae
ggtatgccaaaagtgactccacaaa

SEQ ID NO: 47452 - DNA, 25 bp, S. cerevisiae
ggtattcaagttgcttctcaaggtt

SEQ ID NO: 47453 - DNA, 25 bp, S. cerevisiae
ggtatgctcaaatgcgccaagaaga

SEQ ID NO: 47454 - DNA, 25 bp, S. cerevisiae
ggttatccagctgctaagaccagat

SEQ ID NO: 47455 - DNA, 25 bp, S. cerevisiae
ggtttgtagccactagtgacgctga

SEQ ID NO: 47456 - DNA, 25 bp, S. cerevisiae
ggtattatagctttcaggacattca

SEQ ID NO: 47457 - DNA, 25 bp, S. cerevisiae
ggtattacagttttctctccactac

SEQ ID NO: 47458 - DNA, 25 bp, S. cerevisiae
ggtttcccaagaaatgccaacgata

SEQ ID NO: 47459 - DNA, 25 bp, S. cerevisiae
ggtttcctcaaaagactgcggcaga

SEQ ID NO: 47460 - DNA, 25 bp, S. cerevisiae
ggttctatccaaaagggtatgccac

SEQ ID NO: 47461 - DNA, 25 bp, S. cerevisiae
ggtttaccacgcaatggttcacctt

SEQ ID NO: 47462 - DNA, 25 bp, S. cerevisiae
ggtttgatccccatagttcatgcct

SEQ ID NO: 47463 - DNA, 25 bp, S. cerevisiae
ggttctaccgatattaccttctggg

SEQ ID NO: 47464 - DNA, 25 bp, S. cerevisiae
ggttcatcctccagtgtaaagacga

SEQ ID NO: 47465 - DNA, 25 bp, S. cerevisiae
ggttcgcagtactgggacactacta

SEQ ID NO: 47466 - DNA, 25 bp, S. cerevisiae
ggattacgatggttccggcgtcacg

SEQ ID NO: 47467 - DNA, 25 bp, S. cerevisiae
ggttgggtctataacacctggccaa

SEQ ID NO: 47468 - DNA, 25 bp, S. cerevisiae
ggatttggctctaataccggattca

SEQ ID NO: 47469 - DNA, 25 bp, S. cerevisiae
ggtattggatacaaacgccgcgcac

SEQ ID NO: 47470 - DNA, 25 bp, S. cerevisiae
ggatgatgggcttgatatcccgaaa

SEQ ID NO: 47471 - DNA, 25 bp, S. cerevisiae
ggatgactgttgcttcgattggaat

SEQ ID NO: 47472 - DNA, 25 bp, S. cerevisiae
ggatacattagacttgttgtggaat

SEQ ID NO: 47473 - DNA, 25 bp, S. cerevisiae
ggtattgctaccactttcgatttgg

SEQ ID NO: 47474 - DNA, 25 bp, S. cerevisiae
ggtatctctaccattgttcctatgg

SEQ ID NO: 47475 - DNA, 25 bp, S. cerevisiae
ggtataattactcctaatcagttca

SEQ ID NO: 47476 - DNA, 25 bp, S. cerevisiae
ggtatactttcagccacagagttca

SEQ ID NO: 47477 - DNA, 25 bp, S. cerevisiae
ggtttgatcaaggttaatggttctc

SEQ ID NO: 47478 - DNA, 25 bp, S. cerevisiae
ggtttgatcaaggttaatggttctc

SEQ ID NO: 47479 - DNA, 25 bp, S. cerevisiae
ggtattgattgggactctagcgaat

SEQ ID NO: 47480 - DNA, 25 bp, S. cerevisiae
ggtatattctatgactctgatggca

SEQ ID NO: 47481 - DNA, 25 bp, S. cerevisiae
ggtattgactcccaagttatccttg

SEQ ID NO: 47482 - DNA, 25 bp, S. cerevisiae
ggtttggcttgtattgccattattg

SEQ ID NO: 47483 - DNA, 25 bp, S. cerevisiae
ggtttggcttgtatcgccatcattt

SEQ ID NO: 47484 - DNA, 25 bp, S. cerevisiae
ggatttggcattaacagaaccttta

SEQ ID NO: 47485 - DNA, 25 bp, S. cerevisiae
ggtatctacctctgaaaaccaaagt

SEQ ID NO: 47486 - DNA, 25 bp, S. cerevisiae
ggtttaccttaccaaagccagatga

SEQ ID NO: 47487 - DNA, 25 bp, S. cerevisiae
ggttatcccttagcaagcgcgtata

SEQ ID NO: 47488 - DNA, 25 bp, S. cerevisiae
ggtttcactccattcaaaggcgata

SEQ ID NO: 47489 - DNA, 25 bp, S. cerevisiae
ggtattgacccatgcgaaagtatat

SEQ ID NO: 47490 - DNA, 25 bp, S. cerevisiae
ggtttccaacattctgtcgcagttt

SEQ ID NO: 47491 - DNA, 25 bp, S. cerevisiae
ggtataccccgtactatttctatag

SEQ ID NO: 47492 - DNA, 25 bp, S. cerevisiae
ggttacctctcgatcttttggatag

SEQ ID NO: 47493 - DNA, 25 bp, S. cerevisiae
ggtttggctacctatgctggttaca

SEQ ID NO: 47494 - DNA, 25 bp, S. cerevisiae
ggtatcagcgtccattttgtctcct

SEQ ID NO: 47495 - DNA, 25 bp, S. cerevisiae
ggattccgaatctcttcgtgaagtg

SEQ ID NO: 47496 - DNA, 25 bp, S. cerevisiae
ggttccgaattgtctgttctacagc

SEQ ID NO: 47497 - DNA, 25 bp, S. cerevisiae
ggttccctaggctttgaatgttcat

SEQ ID NO: 47498 - DNA, 25 bp, S. cerevisiae
ggtatcgaaccttcttcagtattca

SEQ ID NO: 47499 - DNA, 25 bp, S. cerevisiae
ggttctatagtcactgtagtatcca

SEQ ID NO: 47500 - DNA, 25 bp, S. cerevisiae
ggttttgtctttttcatcgctccac

SEQ ID NO: 47501 - DNA, 25 bp, S. cerevisiae
ggtttgttatccattgttctactac

SEQ ID NO: 47502 - DNA, 25 bp, S. cerevisiae
ggtttagttgtgaccagtctgctgt

SEQ ID NO: 47503 - DNA, 25 bp, S. cerevisiae
ggtattgccatttcaacaggtacgg

SEQ ID NO: 47504 - DNA, 25 bp, S. cerevisiae
ggtattcctcttttactgtatcggt

SEQ ID NO: 47505 - DNA, 25 bp, S. cerevisiae
ggtattcttaatgtgtctgctttgg

SEQ ID NO: 47506 - DNA, 25 bp, S. cerevisiae
ggtattattaacgtttctgctagag

SEQ ID NO: 47507 - DNA, 25 bp, S. cerevisiae
ggttctaaaggccttgttccacaga

SEQ ID NO: 47508 - DNA, 25 bp, S. cerevisiae
ggatcttcaagacaatactttcacg

SEQ ID NO: 47509 - DNA, 25 bp, S. cerevisiae
ggttcaacctcagtaaagttgccaa

SEQ ID NO: 47510 - DNA, 25 bp, S. cerevisiae
ggtattcactcccaaaatttgccaa

SEQ ID NO: 47511 - DNA, 25 bp, S. cerevisiae
ggttacaccacccatttgatgaaga

SEQ ID NO: 47512 - DNA, 25 bp, S. cerevisiae
ggttcagacctccatatggcggaat

SEQ ID NO: 47513 - DNA, 25 bp, S. cerevisiae
ggttacaggctatatggcgcgtctt

SEQ ID NO: 47514 - DNA, 25 bp, S. cerevisiae
ggtttgcatttctagatgcgccgtt

SEQ ID NO: 47515 - DNA, 25 bp, S. cerevisiae
ggttgatcaatgtctctatggccga

SEQ ID NO: 47516 - DNA, 25 bp, S. cerevisiae
ggtatatccaacgtgcaggccaata

SEQ ID NO: 47517 - DNA, 25 bp, S. cerevisiae
ggtataggatcaagtcggccatttt

SEQ ID NO: 47518 - DNA, 25 bp, S. cerevisiae
ggttcagagatgtgttggcttccct

SEQ ID NO: 47519 - DNA, 25 bp, S. cerevisiae
ggtattatatttccttccccatgct

SEQ ID NO: 47520 - DNA, 25 bp, S. cerevisiae
ggttttgtttctcagaccaactgcc

SEQ ID NO: 47521 - DNA, 25 bp, S. cerevisiae
ggtttgattcttttaggcgctactc

SEQ ID NO: 47522 - DNA, 25 bp, S. cerevisiae
ggtttgattttctttgatgctccaa

SEQ ID NO: 47523 - DNA, 25 bp, S. cerevisiae
ggttactactgtatggtcggcgcca

SEQ ID NO: 47524 - DNA, 25 bp, S. cerevisiae
ggattcctatcttattcgttggcgt

SEQ ID NO: 47525 - DNA, 25 bp, S. cerevisiae
ggttccggtgagtactgccgcaaaa

SEQ ID NO: 47526 - DNA, 25 bp, S. cerevisiae
ggtttcagtctggatacgttcgtga

SEQ ID NO: 47527 - DNA, 25 bp, S. cerevisiae
ggttgtcaacatcgaaggctacgga

SEQ ID NO: 47528 - DNA, 25 bp, S. cerevisiae
ggtttttggctaatttctggacatc

SEQ ID NO: 47529 - DNA, 25 bp, S. cerevisiae
ggttatgttggtatcttcacgtttc

SEQ ID NO: 47530 - DNA, 25 bp, S. cerevisiae
ggtattttatttatgctatcgcttt

SEQ ID NO: 47531 - DNA, 25 bp, S. cerevisiae
ggttattgatcgttggcctacaaat

SEQ ID NO: 47532 - DNA, 25 bp, S. cerevisiae
ggtatattctagtgaccccgcagaa

SEQ ID NO: 47533 - DNA, 25 bp, S. cerevisiae
ggtatatttagactggcgccacaag

SEQ ID NO: 47534 - DNA, 25 bp, S. cerevisiae
ggttaatattactcaccacgaattg

SEQ ID NO: 47535 - DNA, 25 bp, S. cerevisiae
ggtatatttcatgctatccgaacta

SEQ ID NO: 47536 - DNA, 25 bp, S. cerevisiae
ggttgtactgttcacttggttccag

SEQ ID NO: 47537 - DNA, 25 bp, S. cerevisiae
ggttgctcctttcacaaactttaga

SEQ ID NO: 47538 - DNA, 25 bp, S. cerevisiae
ggattagccttcactttaacgtcac

SEQ ID NO: 47539 - DNA, 25 bp, S. cerevisiae
ggttacctcatttctttacatttca

SEQ ID NO: 47540 - DNA, 25 bp, S. cerevisiae
ggtttgcacttctattcgcaggtca

SEQ ID NO: 47541 - DNA, 25 bp, S. cerevisiae
ggttcggctgcctatatcaagagtg

SEQ ID NO: 47542 - DNA, 25 bp, S. cerevisiae
ggtttggaccacagatcagtgatga

SEQ ID NO: 47543 - DNA, 25 bp, S. cerevisiae
ggttgggcccacaagatctatcaat

SEQ ID NO: 47544 - DNA, 25 bp, S. cerevisiae
ggttgggccaaaattctaaatctgc

SEQ ID NO: 47545 - DNA, 25 bp, S. cerevisiae
ggttttctacacatgctctaagggt

SEQ ID NO: 47546 - DNA, 25 bp, S. cerevisiae
ggtttgtctcagcttttcacatgga

SEQ ID NO: 47547 - DNA, 25 bp, S. cerevisiae
ggttttcatgcatgactaggccact

SEQ ID NO: 47548 - DNA, 25 bp, S. cerevisiae
ggttctggatcacgttcactttcaa

SEQ ID NO: 47549 - DNA, 25 bp, S. cerevisiae
ggttttgcaattgagcctggtagat

SEQ ID NO: 47550 - DNA, 25 bp, S. cerevisiae
ggttatcaaccaactttggccactg

SEQ ID NO: 47551 - DNA, 25 bp, S. cerevisiae
ggattttgccagttatctcggaagt

SEQ ID NO: 47552 - DNA, 25 bp, S. cerevisiae
ggtttcccatgatatctctgttatt

SEQ ID NO: 47553 - DNA, 25 bp, S. cerevisiae
ggtattgctgaaccattgtctttac

SEQ ID NO: 47554 - DNA, 25 bp, S. cerevisiae
ggtttgccaggaaggatgctctaaa

SEQ ID NO: 47555 - DNA, 25 bp, S. cerevisiae
ggtttgcaagaactgggtccacaat

SEQ ID NO: 47556 - DNA, 25 bp, S. cerevisiae
ggtttgcgaaaccagcgatctcaaa

SEQ ID NO: 47557 - DNA, 25 bp, S. cerevisiae
ggttcaccaaaattgcgtcatccag

SEQ ID NO: 47558 - DNA, 25 bp, S. cerevisiae
ggttctccatttttggccactaaga

SEQ ID NO: 47559 - DNA, 25 bp, S. cerevisiae
ggtattccaataacggctctcttag

SEQ ID NO: 47560 - DNA, 25 bp, S. cerevisiae
ggtattccaaacgatggcctctggt

SEQ ID NO: 47561 - DNA, 25 bp, S. cerevisiae
ggtattccaaatcttgccagtgctg

SEQ ID NO: 47562 - DNA, 25 bp, S. cerevisiae
ggtattctgaacgtatctgccgttg

SEQ ID NO: 47563 - DNA, 25 bp, S. cerevisiae
ggtttagcatctcattctcatcatg

SEQ ID NO: 47564 - DNA, 25 bp, S. cerevisiae
ggttatgatgtctcttctgatgcag

SEQ ID NO: 47565 - DNA, 25 bp, S. cerevisiae
tggtctatcgtagcatccagtgcaa

SEQ ID NO: 47566 - DNA, 25 bp, S. cerevisiae
ggttgatcgatccaagccatagcag

SEQ ID NO: 47567 - DNA, 25 bp, S. cerevisiae
ggttttgctccattgtctttaatct

SEQ ID NO: 47568 - DNA, 25 bp, S. cerevisiae
ggtttgttcgagaccttcaacactg

SEQ ID NO: 47569 - DNA, 25 bp, S. cerevisiae
ggttattccgatccatatgtcgaat

SEQ ID NO: 47570 - DNA, 25 bp, S. cerevisiae
ggtttatccgatactttctcaagtt

SEQ ID NO: 47571 - DNA, 25 bp, S. cerevisiae
ggttatgtcccaactttcaggagga

SEQ ID NO: 47572 - DNA, 25 bp, S. cerevisiae
ggtttgaaccatctacctgtgcaaa

SEQ ID NO: 47573 - DNA, 25 bp, S. cerevisiae
ggattttgacttctaccttgctgac

SEQ ID NO: 47574 - DNA, 25 bp, S. cerevisiae
ggatgacttgttatttcgacgtgga

SEQ ID NO: 47575 - DNA, 25 bp, S. cerevisiae
ggatgttgcgttttggttaccagaa

SEQ ID NO: 47576 - DNA, 25 bp, S. cerevisiae
ggtttgccattgatgtttacccaag

SEQ ID NO: 47577 - DNA, 25 bp, S. cerevisiae
ggttgctctttgactttgttacgaa

SEQ ID NO: 47578 - DNA, 25 bp, S. cerevisiae
ggtttatgcgcggttacagtattat

SEQ ID NO: 47579 - DNA, 25 bp, S. cerevisiae
ggtttttcactgctctagctagtat

SEQ ID NO: 47580 - DNA, 25 bp, S. cerevisiae
ggttatgttccaactgtacttggca

SEQ ID NO: 47581 - DNA, 25 bp, S. cerevisiae
ggtttgttcgctatacccatataca

SEQ ID NO: 47582 - DNA, 25 bp, S. cerevisiae
ggtttctatgcccttatatccaaag

SEQ ID NO: 47583 - DNA, 25 bp, S. cerevisiae
ggttctcgatatccttgcaaccaaa

SEQ ID NO: 47584 - DNA, 25 bp, S. cerevisiae
ggttgctttaatctttccatggaag

SEQ ID NO: 47585 - DNA, 25 bp, S. cerevisiae
ggttttctgaaaggcgcatacttcc

SEQ ID NO: 47586 - DNA, 25 bp, S. cerevisiae
ggtttctgatgttctagatgccttt

SEQ ID NO: 47587 - DNA, 25 bp, S. cerevisiae
ggttcttcgatttcacctcgtttga

SEQ ID NO: 47588 - DNA, 25 bp, S. cerevisiae
ggtttcagcaagatcatcgtcgttg

SEQ ID NO: 47589 - DNA, 25 bp, S. cerevisiae
ggtttccatgatgtcgaatctcaag

SEQ ID NO: 47590 - DNA, 25 bp, S. cerevisiae
ggtttccatagatttgtacgcaagg

SEQ ID NO: 47591 - DNA, 25 bp, S. cerevisiae
ggtttccacgagacagtaccattgg

SEQ ID NO: 47592 - DNA, 25 bp, S. cerevisiae
ggtttcacggcttttgcaccaaaat

SEQ ID NO: 47593 - DNA, 25 bp, S. cerevisiae
ggtttacgctgttaacaccacacaa

SEQ ID NO: 47594 - DNA, 25 bp, S. cerevisiae
ggtttccttggatgacttgcaacaa

SEQ ID NO: 47595 - DNA, 25 bp, S. cerevisiae
ggttggcctcataaagtttgcgaaa

SEQ ID NO: 47596 - DNA, 25 bp, S. cerevisiae
ggttttctcatttgcgttagctcaa

SEQ ID NO: 47597 - DNA, 25 bp, S. cerevisiae
ggtttactttgggtttgctcacatt

SEQ ID NO: 47598 - DNA, 25 bp, S. cerevisiae
ggttcctctttacaagttgccttat

SEQ ID NO: 47599 - DNA, 25 bp, S. cerevisiae
ggttgcaactactccaaagtctcta

SEQ ID NO: 47600 - DNA, 25 bp, S. cerevisiae
ggttgccctacagcaaagtgagact

SEQ ID NO: 47601 - DNA, 25 bp, S. cerevisiae
ggttcccaaacctatataaatatat

SEQ ID NO: 47602 - DNA, 25 bp, S. cerevisiae
ggatcccaggtgagctctttacatt

SEQ ID NO: 47603 - DNA, 25 bp, S. cerevisiae
ggattccggtactactttgacttat

SEQ ID NO: 47604 - DNA, 25 bp, S. cerevisiae
ggatttccctactgatttaattctt

SEQ ID NO: 47605 - DNA, 25 bp, S. cerevisiae
ggttcccttccgcatattaagatta

SEQ ID NO: 47606 - DNA, 25 bp, S. cerevisiae
ggttgaggttgaacttctctccata

SEQ ID NO: 47607 - DNA, 25 bp, S. cerevisiae
ggttactttgcaaactctatccaag

SEQ ID NO: 47608 - DNA, 25 bp, S. cerevisiae
ggtttcttctcctcattattcataa

SEQ ID NO: 47609 - DNA, 25 bp, S. cerevisiae
ggtttcatcttctccgtgattgctt

SEQ ID NO: 47610 - DNA, 25 bp, S. cerevisiae
ggtttcatcttttctgttgttgcat

SEQ ID NO: 47611 - DNA, 25 bp, S. cerevisiae
ggtttactttcactgcatgttctgc

SEQ ID NO: 47612 - DNA, 25 bp, S. cerevisiae
ggtttagcagcatatgtcttttcta

SEQ ID NO: 47613 - DNA, 25 bp, S. cerevisiae
ggacttgactgcgaatggtttttta

SEQ ID NO: 47614 - DNA, 25 bp, S. cerevisiae
ggtttactgctgttaggaatttcta

SEQ ID NO: 47615 - DNA, 25 bp, S. cerevisiae
ggtttacgccatgattccattatta

SEQ ID NO: 47616 - DNA, 25 bp, S. cerevisiae
ggttctacgagagatctgccaattt

SEQ ID NO: 47617 - DNA, 25 bp, S. cerevisiae
ggattcaaggcacccaggtcaactt

SEQ ID NO: 47618 - DNA, 25 bp, S. cerevisiae
ggttaaccatccatggctcaaggat

SEQ ID NO: 47619 - DNA, 25 bp, S. cerevisiae
ggttcaaccccattttgcaaggaat

SEQ ID NO: 47620 - DNA, 25 bp, S. cerevisiae
ggttcaaccaactcttcagatccaa

SEQ ID NO: 47621 - DNA, 25 bp, S. cerevisiae
ggttccttggccgttcaatatgcaa

SEQ ID NO: 47622 - DNA, 25 bp, S. cerevisiae
ggtttatgttccgagctaatggcaa

SEQ ID NO: 47623 - DNA, 25 bp, S. cerevisiae
ggtttctctgtccagacttgagtga

SEQ ID NO: 47624 - DNA, 25 bp, S. cerevisiae
ggttatcaagagacctgtcagttca

SEQ ID NO: 47625 - DNA, 25 bp, S. cerevisiae
ggttccacaacaacatcacagttca

SEQ ID NO: 47626 - DNA, 25 bp, S. cerevisiae
ggttcctcaatcatgcctggtaaag

SEQ ID NO: 47627 - DNA, 25 bp, S. cerevisiae
ggattatatctcctgtccgtttaag

SEQ ID NO: 47628 - DNA, 25 bp, S. cerevisiae
ggattatttactcccgtggtgaact

SEQ ID NO: 47629 - DNA, 25 bp, S. cerevisiae
ggttgattttctacccgttgataat

SEQ ID NO: 47630 - DNA, 25 bp, S. cerevisiae
ggttcttatgccaccagagcttatg

SEQ ID NO: 47631 - DNA, 25 bp, S. cerevisiae
ggttgttaagcaatccagcgttatt

SEQ ID NO: 47632 - DNA, 25 bp, S. cerevisiae
ggagtttacactatgggagacagct

SEQ ID NO: 47633 - DNA, 25 bp, S. cerevisiae
ggttaaacacacgtatggatccggt

SEQ ID NO: 47634 - DNA, 25 bp, S. cerevisiae
ggttcacaatcaacttcagcgtcat

SEQ ID NO: 47635 - DNA, 25 bp, S. cerevisiae
ggttcccgccattctatgatgagaa

SEQ ID NO: 47636 - DNA, 25 bp, S. cerevisiae
ggttccacctggcaaatatgttgtt

SEQ ID NO: 47637 - DNA, 25 bp, S. cerevisiae
ggttccattgatttatgccggtgtt

SEQ ID NO: 47638 - DNA, 25 bp, S. cerevisiae
ggttccgctgctcaagttaaggctt

SEQ ID NO: 47639 - DNA, 25 bp, S. cerevisiae
ggttacgatccttgtcttattcaga

SEQ ID NO: 47640 - DNA, 25 bp, S. cerevisiae
ggttatagccttggtcatggcccaa

SEQ ID NO: 47641 - DNA, 25 bp, S. cerevisiae
ggttttcctccattcagtgatcaat

SEQ ID NO: 47642 - DNA, 25 bp, S. cerevisiae
ggttgttccaacttacatccacatg

SEQ ID NO: 47643 - DNA, 25 bp, S. cerevisiae
ggttgttacagactctaatgcccaa

SEQ ID NO: 47644 - DNA, 25 bp, S. cerevisiae
ggttataaagctgccaatgccccag

SEQ ID NO: 47645 - DNA, 25 bp, S. cerevisiae
ggttaaatactaaagatcccgatga

SEQ ID NO: 47646 - DNA, 25 bp, S. cerevisiae
ggttatcaacttttccatgcagaac

SEQ ID NO: 47647 - DNA, 25 bp, S. cerevisiae
ggttatgatatcttgagtcactcga

SEQ ID NO: 47648 - DNA, 25 bp, S. cerevisiae
ggttcatcatgtacaaatttggcaa

SEQ ID NO: 47649 - DNA, 25 bp, S. cerevisiae
ggttatgctgctgaaatttccgcca

SEQ ID NO: 47650 - DNA, 25 bp, S. cerevisiae
ggttagtgtgactgttattctatta

SEQ ID NO: 47651 - DNA, 25 bp, S. cerevisiae
ggattactctaatgcctttttcaaa

SEQ ID NO: 47652 - DNA, 25 bp, S. cerevisiae
ggattcaacaacgtattcctacccg

SEQ ID NO: 47653 - DNA, 25 bp, S. cerevisiae
ggttaagcatttttgtccttccact

SEQ ID NO: 47654 - DNA, 25 bp, S. cerevisiae
ggttacaattggtagttcctccctg

SEQ ID NO: 47655 - DNA, 25 bp, S. cerevisiae
ggttactatcgatgtttctccaatt

SEQ ID NO: 47656 - DNA, 25 bp, S. cerevisiae
ggttttctcgaaagtgactccaatt

SEQ ID NO: 47657 - DNA, 25 bp, S. cerevisiae
ggttttgttacgtccgctcagaaat

SEQ ID NO: 47658 - DNA, 25 bp, S. cerevisiae
ggttactttaagtccgccatacgag

SEQ ID NO: 47659 - DNA, 25 bp, S. cerevisiae
ggatagcttagattacgacccgaac

SEQ ID NO: 47660 - DNA, 25 bp, S. cerevisiae
ggataggcttattacttgtgacgaa

SEQ ID NO: 47661 - DNA, 25 bp, S. cerevisiae
ggattctgttatttccgtagacgaa

SEQ ID NO: 47662 - DNA, 25 bp, S. cerevisiae
ggtttttaaatcaccagctgatgaa

SEQ ID NO: 47663 - DNA, 25 bp, S. cerevisiae
ggtttattaccgaactcagatatca

SEQ ID NO: 47664 - DNA, 25 bp, S. cerevisiae
ggtttattcatcgacaacgcttcaa

SEQ ID NO: 47665 - DNA, 25 bp, S. cerevisiae
ggttctattttgaccacgcaacaga

SEQ ID NO: 47666 - DNA, 25 bp, S. cerevisiae
ggttttttatgattatgccacagca

SEQ ID NO: 47667 - DNA, 25 bp, S. cerevisiae
ggttatttatctcaatctcgcacat

SEQ ID NO: 47668 - DNA, 25 bp, S. cerevisiae
ggatctatcggttggcgtatctggc

SEQ ID NO: 47669 - DNA, 25 bp, S. cerevisiae
ggttatcgttagattctccatcaaa

SEQ ID NO: 47670 - DNA, 25 bp, S. cerevisiae
ggttccttcatgaatactgtccagt

SEQ ID NO: 47671 - DNA, 25 bp, S. cerevisiae
ggttcctatactgaagactctctaa

SEQ ID NO: 47672 - DNA, 25 bp, S. cerevisiae
ggataatgtttctactgaccctcgc

SEQ ID NO: 47673 - DNA, 25 bp, S. cerevisiae
ggttttattctttgtgtgcttatct

SEQ ID NO: 47674 - DNA, 25 bp, S. cerevisiae
ggttggataatctcttcatgttact

SEQ ID NO: 47675 - DNA, 25 bp, S. cerevisiae
tggtgggtcccaacgtatattacct

SEQ ID NO: 47676 - DNA, 25 bp, S. cerevisiae
ggttgttcgccataggatgcaattc

SEQ ID NO: 47677 - DNA, 25 bp, S. cerevisiae
ggttgttccagctgatcctgatatt

SEQ ID NO: 47678 - DNA, 25 bp, S. cerevisiae
ggttttcgcagatgtctatgttctt

SEQ ID NO: 47679 - DNA, 25 bp, S. cerevisiae
ggttcataccatttgccttatttgt

SEQ ID NO: 47680 - DNA, 25 bp, S. cerevisiae
ggttagaacaatccccatacgtatc

SEQ ID NO: 47681 - DNA, 25 bp, S. cerevisiae
ggttagaaatataccaccacattaa

SEQ ID NO: 47682 - DNA, 25 bp, S. cerevisiae
ggatatacagccgagcaggtaattt

SEQ ID NO: 47683 - DNA, 25 bp, S. cerevisiae
ggatccagacgtcatcaagtttttc

SEQ ID NO: 47684 - DNA, 25 bp, S. cerevisiae
ggctaagctcatgggcaatacgact

SEQ ID NO: 47685 - DNA, 25 bp, S. cerevisiae
ggttacatccttttgaagtggcgca

SEQ ID NO: 47686 - DNA, 25 bp, S. cerevisiae
ggttactgacgatatgcaactggaa

SEQ ID NO: 47687 - DNA, 25 bp, S. cerevisiae
ggttcctactatgatgcagactaca

SEQ ID NO: 47688 - DNA, 25 bp, S. cerevisiae
ggttctgtgtttggtgcggatatca

SEQ ID NO: 47689 - DNA, 25 bp, S. cerevisiae
ggttcgttccttggtgctgctgtaa

SEQ ID NO: 47690 - DNA, 25 bp, S. cerevisiae
ggttctgtactgatggttacactcg

SEQ ID NO: 47691 - DNA, 25 bp, S. cerevisiae
ggttctctagctcgtgctggtaaag

SEQ ID NO: 47692 - DNA, 25 bp, S. cerevisiae
ggttactagctcatcatgggtctaa

SEQ ID NO: 47693 - DNA, 25 bp, S. cerevisiae
ggttactatgccatctcagattcca

SEQ ID NO: 47694 - DNA, 25 bp, S. cerevisiae
ggttaggccccagagatttatatga

SEQ ID NO: 47695 - DNA, 25 bp, S. cerevisiae
ggttaagtcggaggattcttcttga

SEQ ID NO: 47696 - DNA, 25 bp, S. cerevisiae
ggttaacctggacaactttaacatg

SEQ ID NO: 47697 - DNA, 25 bp, S. cerevisiae
ggatttccggtctgaatttaacgct

SEQ ID NO: 47698 - DNA, 25 bp, S. cerevisiae
ggcgtcccgggcatgaatcctaagg

SEQ ID NO: 47699 - DNA, 25 bp, S. cerevisiae
ggttcaccttggaagacactgctaa

SEQ ID NO: 47700 - DNA, 25 bp, S. cerevisiae
ggttattgcttcgaattcactctat

SEQ ID NO: 47701 - DNA, 25 bp, S. cerevisiae
ggatttccattcacaatgtttgcga

SEQ ID NO: 47702 - DNA, 25 bp, S. cerevisiae
ggttcagatttattgggtcctctat

SEQ ID NO: 47703 - DNA, 25 bp, S. cerevisiae
ggttcagaagtacaagctctccacc

SEQ ID NO: 47704 - DNA, 25 bp, S. cerevisiae
ggttcgagcggaagaggactctacc

SEQ ID NO: 47705 - DNA, 25 bp, S. cerevisiae
ggttctgagggtgaccaatcttcca

SEQ ID NO: 47706 - DNA, 25 bp, S. cerevisiae
ggttctgtgaacttcccagaagtca

SEQ ID NO: 47707 - DNA, 25 bp, S. cerevisiae
ggttacataattccctcaaagctcg

SEQ ID NO: 47708 - DNA, 25 bp, S. cerevisiae
ggttctttcttgcaaagcgcacctg

SEQ ID NO: 47709 - DNA, 25 bp, S. cerevisiae
ggttctttatatcaccacagcagcc

SEQ ID NO: 47710 - DNA, 25 bp, S. cerevisiae
ggttccctatgacgaaggatccatc

SEQ ID NO: 47711 - DNA, 25 bp, S. cerevisiae
ggattgttcctcatggagcgcatta

SEQ ID NO: 47712 - DNA, 25 bp, S. cerevisiae
ggttcaggagctatgagcgccatta

SEQ ID NO: 47713 - DNA, 25 bp, S. cerevisiae
ggaatacgagagataagcaattaat

SEQ ID NO: 47714 - DNA, 25 bp, S. cerevisiae
ggttatctggcgatttcaatccttt

SEQ ID NO: 47715 - DNA, 25 bp, S. cerevisiae
ggttcatgttatcttctattccttt

SEQ ID NO: 47716 - DNA, 25 bp, S. cerevisiae
ggttcatgctcttcaatgtcgttac

SEQ ID NO: 47717 - DNA, 25 bp, S. cerevisiae
ggttgcctctgctaagggtctacaa

SEQ ID NO: 47718 - DNA, 25 bp, S. cerevisiae
ggttccttaatcctgagtgagttca

SEQ ID NO: 47719 - DNA, 25 bp, S. cerevisiae
ggttgcctcaatattgttagctctg

SEQ ID NO: 47720 - DNA, 25 bp, S. cerevisiae
ggttgtcaccaagcgattactgcga

SEQ ID NO: 47721 - DNA, 25 bp, S. cerevisiae
ggttgacctacagcgatgtcttgaa

SEQ ID NO: 47722 - DNA, 25 bp, S. cerevisiae
ggttgcccaacagagtacactgaat

SEQ ID NO: 47723 - DNA, 25 bp, S. cerevisiae
ggttccacaactatttcacaggctg

SEQ ID NO: 47724 - DNA, 25 bp, S. cerevisiae
ggttagccacatcttttacactcgt

SEQ ID NO: 47725 - DNA, 25 bp, S. cerevisiae
ggattgatccaacggtgcacaacca

SEQ ID NO: 47726 - DNA, 25 bp, S. cerevisiae
ggatctgtgctactcagggacattc

SEQ ID NO: 47727 - DNA, 25 bp, S. cerevisiae
ggattgatcctgacgcagcgaatta

SEQ ID NO: 47728 - DNA, 25 bp, S. cerevisiae
ggttatggctatatgcagcacctaa

SEQ ID NO: 47729 - DNA, 25 bp, S. cerevisiae
ggttatgcgttgatggcccagacac

SEQ ID NO: 47730 - DNA, 25 bp, S. cerevisiae
ggattacgattcatggccgaacacg

SEQ ID NO: 47731 - DNA, 25 bp, S. cerevisiae
ggatcagacgtatgattccgttgta

SEQ ID NO: 47732 - DNA, 25 bp, S. cerevisiae
ggagcagaaatacgtgcctgcctcg

SEQ ID NO: 47733 - DNA, 25 bp, S. cerevisiae
ggagaggctatacggttcctgcaca

SEQ ID NO: 47734 - DNA, 25 bp, S. cerevisiae
ggagtgctgatataggtaccgacaa

SEQ ID NO: 47735 - DNA, 25 bp, S. cerevisiae
ggttgaaccaatcgcgatctggcct

SEQ ID NO: 47736 - DNA, 25 bp, S. cerevisiae
ggttcaacctcacgtattggctata

SEQ ID NO: 47737 - DNA, 25 bp, S. cerevisiae
ggattacgagcctagattgacagac

SEQ ID NO: 47738 - DNA, 25 bp, S. cerevisiae
ggttcagctgctaaagcttctcaat

SEQ ID NO: 47739 - DNA, 25 bp, S. cerevisiae
ggttcagctgatttgagcgtctcat

SEQ ID NO: 47740 - DNA, 25 bp, S. cerevisiae
ggttcgctgaattgcagccacctaa

SEQ ID NO: 47741 - DNA, 25 bp, S. cerevisiae
ggttcggaatacttcacctgatgaa

SEQ ID NO: 47742 - DNA, 25 bp, S. cerevisiae
ggttggaaatacttgcagagcagca

SEQ ID NO: 47743 - DNA, 25 bp, S. cerevisiae
ggttcatgaccaccattgcatatgg

SEQ ID NO: 47744 - DNA, 25 bp, S. cerevisiae
ggttatgtgctagatccaaagtcaa

SEQ ID NO: 47745 - DNA, 25 bp, S. cerevisiae
ggttaagatagcctctgccaagaaa

SEQ ID NO: 47746 - DNA, 25 bp, S. cerevisiae
ggttgagcacttgaccgtgagcaca

SEQ ID NO: 47747 - DNA, 25 bp, S. cerevisiae
ggttgagtttgccaccagaactttg

SEQ ID NO: 47748 - DNA, 25 bp, S. cerevisiae
tggtccagtgacagccttaaaattg

SEQ ID NO: 47749 - DNA, 25 bp, S. cerevisiae
ggttcgagccatcccttgaaaaatt

SEQ ID NO: 47750 - DNA, 25 bp, S. cerevisiae
ggattcgttaatctctacaaatttt

SEQ ID NO: 47751 - DNA, 25 bp, S. cerevisiae
ggttgctgctttattgccgcactaa

SEQ ID NO: 47752 - DNA, 25 bp, S. cerevisiae
ggttctttgagttccatgtcactaa

SEQ ID NO: 47753 - DNA, 25 bp, S. cerevisiae
ggctttcccaaagattttctccagt

SEQ ID NO: 47754 - DNA, 25 bp, S. cerevisiae
ggatttgactccttttattgcccaa

SEQ ID NO: 47755 - DNA, 25 bp, S. cerevisiae
ggttctatccactctcaattggcta

SEQ ID NO: 47756 - DNA, 25 bp, S. cerevisiae
ggttcccaggtatgctatatgcctt

SEQ ID NO: 47757 - DNA, 25 bp, S. cerevisiae
ggttctccagatatggctcaattgc

SEQ ID NO: 47758 - DNA, 25 bp, S. cerevisiae
ggttgcttgcattatttctacagtc

SEQ ID NO: 47759 - DNA, 25 bp, S. cerevisiae
ggagggatttcccactgataatgtt

SEQ ID NO: 47760 - DNA, 25 bp, S. cerevisiae
ggattgaatctttcctttttgcgat

SEQ ID NO: 47761 - DNA, 25 bp, S. cerevisiae
ggttcggcgtcaaaatttctctgta

SEQ ID NO: 47762 - DNA, 25 bp, S. cerevisiae
ggttctgatggtaaaattgtcgtat

SEQ ID NO: 47763 - DNA, 25 bp, S. cerevisiae
ggttcgaagtgcaagtaggtccaat

SEQ ID NO: 47764 - DNA, 25 bp, S. cerevisiae
ggttcgctagcgcaaaggtctgcaa

SEQ ID NO: 47765 - DNA, 25 bp, S. cerevisiae
ggttcaatgtcggaaaggcctccat

SEQ ID NO: 47766 - DNA, 25 bp, S. cerevisiae
ggttcacatgtcgtttacaactcca

SEQ ID NO: 47767 - DNA, 25 bp, S. cerevisiae
ggattctttcgtccatcttaccgag

SEQ ID NO: 47768 - DNA, 25 bp, S. cerevisiae
ggttctattgagaccttcttccaag

SEQ ID NO: 47769 - DNA, 25 bp, S. cerevisiae
ggttccataatgctcaatatgtcca

SEQ ID NO: 47770 - DNA, 25 bp, S. cerevisiae
ggttcacttggttattcctatacgc

SEQ ID NO: 47771 - DNA, 25 bp, S. cerevisiae
ggttcgtagttattgattttccaca

SEQ ID NO: 47772 - DNA, 25 bp, S. cerevisiae
ggttcgtcaacctatattcatgtac

SEQ ID NO: 47773 - DNA, 25 bp, S. cerevisiae
ggttcgtcttcgttagtatgagccc

SEQ ID NO: 47774 - DNA, 25 bp, S. cerevisiae
ggttccttgattttacttagcgctc

SEQ ID NO: 47775 - DNA, 25 bp, S. cerevisiae
ggttaatttggcttctcacacgtac

SEQ ID NO: 47776 - DNA, 25 bp, S. cerevisiae
ggttcatatttggtctcttcatcgc

SEQ ID NO: 47777 - DNA, 25 bp, S. cerevisiae
ggttcatttatgcatcttgtcattt

SEQ ID NO: 47778 - DNA, 25 bp, S. cerevisiae
ggttcttctagcaacgatgattctt

SEQ ID NO: 47779 - DNA, 25 bp, S. cerevisiae
ggatatcattttgaccattttggct

SEQ ID NO: 47780 - DNA, 25 bp, S. cerevisiae
ggatttgatttacttccctttgagt

SEQ ID NO: 47781 - DNA, 25 bp, S. cerevisiae
ggttcgaatattcctcacactttga

SEQ ID NO: 47782 - DNA, 25 bp, S. cerevisiae
ggattccaaattccatctgatgtct

SEQ ID NO: 47783 - DNA, 25 bp, S. cerevisiae
ggttcacatcagcaaacatttctac

SEQ ID NO: 47784 - DNA, 25 bp, S. cerevisiae
ggttgcgaatctctaacttcattga

SEQ ID NO: 47785 - DNA, 25 bp, S. cerevisiae
ggttctgctccagatttgccaaaga

SEQ ID NO: 47786 - DNA, 25 bp, S. cerevisiae
ggattcctcatcgaatagtgccgag

SEQ ID NO: 47787 - DNA, 25 bp, S. cerevisiae
ggatttagttaaagctgccgcagga

SEQ ID NO: 47788 - DNA, 25 bp, S. cerevisiae
ggattgcatagttgacaccgcggcg

SEQ ID NO: 47789 - DNA, 25 bp, S. cerevisiae
ggttgaagcatcgactagcccagct

SEQ ID NO: 47790 - DNA, 25 bp, S. cerevisiae
ggttaagacattacaggccagctgc

SEQ ID NO: 47791 - DNA, 25 bp, S. cerevisiae
ggttcctgattctgtacaacttgat

SEQ ID NO: 47792 - DNA, 25 bp, S. cerevisiae
ggttcttgcactgaagactcactga

SEQ ID NO: 47793 - DNA, 25 bp, S. cerevisiae
ggttcggcaccaaatgccaagcgca

SEQ ID NO: 47794 - DNA, 25 bp, S. cerevisiae
ggttgtggacttcagagacgccatt

SEQ ID NO: 47795 - DNA, 25 bp, S. cerevisiae
ggttgctgccacattaacggctcat

SEQ ID NO: 47796 - DNA, 25 bp, S. cerevisiae
ggatctggttcctaagcgatgtcta

SEQ ID NO: 47797 - DNA, 25 bp, S. cerevisiae
ggttggcattctggatacctttaca

SEQ ID NO: 47798 - DNA, 25 bp, S. cerevisiae
ggatcaggcatacttgtaccactta

SEQ ID NO: 47799 - DNA, 25 bp, S. cerevisiae
ggttgagcaccatttcggatccaag

SEQ ID NO: 47800 - DNA, 25 bp, S. cerevisiae
ggttctcagaaaagatcgggcgtgt

SEQ ID NO: 47801 - DNA, 25 bp, S. cerevisiae
ggttcacgccaaaatcaccgcgtag

SEQ ID NO: 47802 - DNA, 25 bp, S. cerevisiae
ggttcatcgactgattttccatgta

SEQ ID NO: 47803 - DNA, 25 bp, S. cerevisiae
ggttcattacatcttgttggcggat

SEQ ID NO: 47804 - DNA, 25 bp, S. cerevisiae
ggttcagaattggtcgttagcgtta

SEQ ID NO: 47805 - DNA, 25 bp, S. cerevisiae
ggaggcaaactcaggtgtcacctta

SEQ ID NO: 47806 - DNA, 25 bp, S. cerevisiae
ggagcgttacttgggtttcctgcca

SEQ ID NO: 47807 - DNA, 25 bp, S. cerevisiae
ggatcgttgtccagaggtatttcta

SEQ ID NO: 47808 - DNA, 25 bp, S. cerevisiae
tggtagagttccacaggccagaatg

SEQ ID NO: 47809 - DNA, 25 bp, S. cerevisiae
ggttgagacaatatccatccacgga

SEQ ID NO: 47810 - DNA, 25 bp, S. cerevisiae
ggttgaacatctgtctccagctaat

SEQ ID NO: 47811 - DNA, 25 bp, S. cerevisiae
ggttccaattcctttcagtttacag

SEQ ID NO: 47812 - DNA, 25 bp, S. cerevisiae
ggctttctttcctctcaatttaagt

SEQ ID NO: 47813 - DNA, 25 bp, S. cerevisiae
ggttccttcaccttatcaacttaga

SEQ ID NO: 47814 - DNA, 25 bp, S. cerevisiae
ggttgttacactgctatccatctta

SEQ ID NO: 47815 - DNA, 25 bp, S. cerevisiae
ggattgtaccacacttccaaattac

SEQ ID NO: 47816 - DNA, 25 bp, S. cerevisiae
ggatttcccgcgatttcaattatat

SEQ ID NO: 47817 - DNA, 25 bp, S. cerevisiae
ggattgatcccctatctttatttga

SEQ ID NO: 47818 - DNA, 25 bp, S. cerevisiae
ggttgaacagtcctcctgaaatctt

SEQ ID NO: 47819 - DNA, 25 bp, S. cerevisiae
ggttgcgtcccaatcacaaagtttg

SEQ ID NO: 47820 - DNA, 25 bp, S. cerevisiae
ggttcgttcaaagatatcatgttcg

SEQ ID NO: 47821 - DNA, 25 bp, S. cerevisiae
ggttctaaacgatttgagcgccact

SEQ ID NO: 47822 - DNA, 25 bp, S. cerevisiae
ggattgtatacgcaattgctcctca

SEQ ID NO: 47823 - DNA, 25 bp, S. cerevisiae
ggttctatgccatccatcgatttcc

SEQ ID NO: 47824 - DNA, 25 bp, S. cerevisiae
ggttcttcatcatcgtcgtctatac

SEQ ID NO: 47825 - DNA, 25 bp, S. cerevisiae
ggttctacccttggatgaggatgca

SEQ ID NO: 47826 - DNA, 25 bp, S. cerevisiae
ggatttacctattgctgaccagatc

SEQ ID NO: 47827 - DNA, 25 bp, S. cerevisiae
ggattttccatgagttcaagtgcca

SEQ ID NO: 47828 - DNA, 25 bp, S. cerevisiae
ggttcttccagaattttgatctcca

SEQ ID NO: 47829 - DNA, 25 bp, S. cerevisiae
ggttgcttcacaatgtttttctcag

SEQ ID NO: 47830 - DNA, 25 bp, S. cerevisiae
ggttgcactgcattcatttttgtta

SEQ ID NO: 47831 - DNA, 25 bp, S. cerevisiae
ggattgctctcggtcaagcttttaa

SEQ ID NO: 47832 - DNA, 25 bp, S. cerevisiae
ggatttgaaggtcacgcctgccaat

SEQ ID NO: 47833 - DNA, 25 bp, S. cerevisiae
ggatgggacccataggctccaaatt

SEQ ID NO: 47834 - DNA, 25 bp, S. cerevisiae
ggataaacacgagcaaccccagata

SEQ ID NO: 47835 - DNA, 25 bp, S. cerevisiae
ggaacctccaagaaacccgcagtga

SEQ ID NO: 47836 - DNA, 25 bp, S. cerevisiae
ggattccacaacctgaaaccttgtc

SEQ ID NO: 47837 - DNA, 25 bp, S. cerevisiae
ggttcgacaatgacttgtccctgtt

SEQ ID NO: 47838 - DNA, 25 bp, S. cerevisiae
ggttgatgaagaaggccgcgccatt

SEQ ID NO: 47839 - DNA, 25 bp, S. cerevisiae
ggttgctgaattgtgactgcgctat

SEQ ID NO: 47840 - DNA, 25 bp, S. cerevisiae
ggttctgaatctgagactgatgcaa

SEQ ID NO: 47841 - DNA, 25 bp, S. cerevisiae
ggttctgatggacagcactgccaaa

SEQ ID NO: 47842 - DNA, 25 bp, S. cerevisiae
ggttctatctattgtgcctctaagt

SEQ ID NO: 47843 - DNA, 25 bp, S. cerevisiae
ggatcatctaggtgttgttgcttac

SEQ ID NO: 47844 - DNA, 25 bp, S. cerevisiae
ggttcgatcatttttctgcttttgt

SEQ ID NO: 47845 - DNA, 25 bp, S. cerevisiae
ggttctgatattctttgtcgcattt

SEQ ID NO: 47846 - DNA, 25 bp, S. cerevisiae
ggttctataatcgattagccgcata

SEQ ID NO: 47847 - DNA, 25 bp, S. cerevisiae
ggatggcgaaacgttaggctcaagt

SEQ ID NO: 47848 - DNA, 25 bp, S. cerevisiae
ggaggagaacccatacgccttttat

SEQ ID NO: 47849 - DNA, 25 bp, S. cerevisiae
ggagggaacttcatacggtgccact

SEQ ID NO: 47850 - DNA, 25 bp, S. cerevisiae
ggcggctgcgtttaaacgggtccat

SEQ ID NO: 47851 - DNA, 25 bp, S. cerevisiae
ggcgcccggcttagagttgggctaa

SEQ ID NO: 47852 - DNA, 25 bp, S. cerevisiae
ggattggtgttttgtcatacgctca

SEQ ID NO: 47853 - DNA, 25 bp, S. cerevisiae
ggttccgcattttgtcaacgcatca

SEQ ID NO: 47854 - DNA, 25 bp, S. cerevisiae
ggttctggttctttctccaagagaa

SEQ ID NO: 47855 - DNA, 25 bp, S. cerevisiae
ggatttacttcctttctcagacgag

SEQ ID NO: 47856 - DNA, 25 bp, S. cerevisiae
ggatttgactgggactggctacatt

SEQ ID NO: 47857 - DNA, 25 bp, S. cerevisiae
ggattctgccaagatcattaacatt

SEQ ID NO: 47858 - DNA, 25 bp, S. cerevisiae
ggttgcttagcgttttcatattttt

SEQ ID NO: 47859 - DNA, 25 bp, S. cerevisiae
ggttctgtgctgtcatacgttattt

SEQ ID NO: 47860 - DNA, 25 bp, S. cerevisiae
ggttctcttgccagaattgctttga

SEQ ID NO: 47861 - DNA, 25 bp, S. cerevisiae
ggattcgctaattcctaacgtgaat

SEQ ID NO: 47862 - DNA, 25 bp, S. cerevisiae
ggattttaacatttactcctgaatt

SEQ ID NO: 47863 - DNA, 25 bp, S. cerevisiae
ggttcctaactctctgaacggattt

SEQ ID NO: 47864 - DNA, 25 bp, S. cerevisiae
ggttcgcaaagataccaactggttt

SEQ ID NO: 47865 - DNA, 25 bp, S. cerevisiae
ggttgccaagaatcaccaagggtat

SEQ ID NO: 47866 - DNA, 25 bp, S. cerevisiae
ggattgctcctttacagtacaaacg

SEQ ID NO: 47867 - DNA, 25 bp, S. cerevisiae
ggatcctcgcggcaagttagaattt

SEQ ID NO: 47868 - DNA, 25 bp, S. cerevisiae
ggatcttcacttgaaaccggttgtt

SEQ ID NO: 47869 - DNA, 25 bp, S. cerevisiae
ggttctgccggtaaatcgtttgctg

SEQ ID NO: 47870 - DNA, 25 bp, S. cerevisiae
ggattctatcggttactacttagct

SEQ ID NO: 47871 - DNA, 25 bp, S. cerevisiae
ggatttacaggttctttgcaaagcg

SEQ ID NO: 47872 - DNA, 25 bp, S. cerevisiae
ggattggtacggacaaactcttcat

SEQ ID NO: 47873 - DNA, 25 bp, S. cerevisiae
ggttggtcactgctaaagatatttt

SEQ ID NO: 47874 - DNA, 25 bp, S. cerevisiae
ggttgtgcctttacataactccatc

SEQ ID NO: 47875 - DNA, 25 bp, S. cerevisiae
ggttgtcgcggatattcactcagat

SEQ ID NO: 47876 - DNA, 25 bp, S. cerevisiae
ggttgttgccagtaaaattccagta

SEQ ID NO: 47877 - DNA, 25 bp, S. cerevisiae
ggttgttccatacatacttccgtat

SEQ ID NO: 47878 - DNA, 25 bp, S. cerevisiae
ggatggctcccagaagacgtacgaa

SEQ ID NO: 47879 - DNA, 25 bp, S. cerevisiae
ggttgctagtacatgggactccatc

SEQ ID NO: 47880 - DNA, 25 bp, S. cerevisiae
ggttgcctgtagttgtgtaccacat

SEQ ID NO: 47881 - DNA, 25 bp, S. cerevisiae
ggttccagtagatcatgttgctcgt

SEQ ID NO: 47882 - DNA, 25 bp, S. cerevisiae
ggttccgcaagagagcatgctgctt

SEQ ID NO: 47883 - DNA, 25 bp, S. cerevisiae
ggttccgcagaacatcagtccgtgg

SEQ ID NO: 47884 - DNA, 25 bp, S. cerevisiae
ggatcccgcaaacatttccatgatt

SEQ ID NO: 47885 - DNA, 25 bp, S. cerevisiae
ggatacactgcttcgacaatgtcac

SEQ ID NO: 47886 - DNA, 25 bp, S. cerevisiae
ggatcacacgcttggaaatgccctt

SEQ ID NO: 47887 - DNA, 25 bp, S. cerevisiae
ggttcctattactgatccattgatg

SEQ ID NO: 47888 - DNA, 25 bp, S. cerevisiae
ggttgccctcaatacatccttgatg

SEQ ID NO: 47889 - DNA, 25 bp, S. cerevisiae
ggttccctgcatttatgttctttgc

SEQ ID NO: 47890 - DNA, 25 bp, S. cerevisiae
ggttgcgcctttattgatgtgtcaa

SEQ ID NO: 47891 - DNA, 25 bp, S. cerevisiae
ggattaccatttgtttgtctcacat

SEQ ID NO: 47892 - DNA, 25 bp, S. cerevisiae
ggattgctacttcttttgttgctgc

SEQ ID NO: 47893 - DNA, 25 bp, S. cerevisiae
ggattcgacaccagtattaagcttg

SEQ ID NO: 47894 - DNA, 25 bp, S. cerevisiae
ggttccacctctataccaatgattg

SEQ ID NO: 47895 - DNA, 25 bp, S. cerevisiae
ggattccaccatctcaacaaagact

SEQ ID NO: 47896 - DNA, 25 bp, S. cerevisiae
ggatatcccgctatacacaaagctg

SEQ ID NO: 47897 - DNA, 25 bp, S. cerevisiae
ggatacttctgatttccatgaaagc

SEQ ID NO: 47898 - DNA, 25 bp, S. cerevisiae
ggacgagcctactcctgaagaaaga

SEQ ID NO: 47899 - DNA, 25 bp, S. cerevisiae
ggttgtccgcaagtttgctcaatta

SEQ ID NO: 47900 - DNA, 25 bp, S. cerevisiae
ggcttccacaaattcactgttactg

SEQ ID NO: 47901 - DNA, 25 bp, S. cerevisiae
ggatctgaacatcaacctgtagagg

SEQ ID NO: 47902 - DNA, 25 bp, S. cerevisiae
ggatcagaaatttgcccatctaatg

SEQ ID NO: 47903 - DNA, 25 bp, S. cerevisiae
ggataaaactgctcaattgactgtt

SEQ ID NO: 47904 - DNA, 25 bp, S. cerevisiae
ggataactatcctctattgaatgaa

SEQ ID NO: 47905 - DNA, 25 bp, S. cerevisiae
ggattatttagctctcttgacaagg

SEQ ID NO: 47906 - DNA, 25 bp, S. cerevisiae
ggatactttatgtgccttaaaccaa

SEQ ID NO: 47907 - DNA, 25 bp, S. cerevisiae
ggatatcgaaaagctcttcggtcaa

SEQ ID NO: 47908 - DNA, 25 bp, S. cerevisiae
ggacttgaagaagcctacgaaccag

SEQ ID NO: 47909 - DNA, 25 bp, S. cerevisiae
ggatcctaaaaccttaccaagcgag

SEQ ID NO: 47910 - DNA, 25 bp, S. cerevisiae
ggatttaacatcctcttagtacgga

SEQ ID NO: 47911 - DNA, 25 bp, S. cerevisiae
ggttgcttaatcttttcgtacttct

SEQ ID NO: 47912 - DNA, 25 bp, S. cerevisiae
ggattattgaataccactggctctc

SEQ ID NO: 47913 - DNA, 25 bp, S. cerevisiae
ggatactgcgcaattaaagagtcaa

SEQ ID NO: 47914 - DNA, 25 bp, S. cerevisiae
ggatccatgcccaactcgggtgcta

SEQ ID NO: 47915 - DNA, 25 bp, S. cerevisiae
ggatccgccgaattgggtattccca

SEQ ID NO: 47916 - DNA, 25 bp, S. cerevisiae
ggatctcgacgatttgggattctta

SEQ ID NO: 47917 - DNA, 25 bp, S. cerevisiae
ggattccacctatgaggtatcttca

SEQ ID NO: 47918 - DNA, 25 bp, S. cerevisiae
ggatttcttgcgtacagccaagtga

SEQ ID NO: 47919 - DNA, 25 bp, S. cerevisiae
ggatttctatcccaggtatcacagg

SEQ ID NO: 47920 - DNA, 25 bp, S. cerevisiae
ggattatctgactggctttcacaag

SEQ ID NO: 47921 - DNA, 25 bp, S. cerevisiae
ggatatgactacttggttccctatg

SEQ ID NO: 47922 - DNA, 25 bp, S. cerevisiae
ggataaggccttatatgccctagag

SEQ ID NO: 47923 - DNA, 25 bp, S. cerevisiae
ggatatgttgttttttcaccagaat

SEQ ID NO: 47924 - DNA, 25 bp, S. cerevisiae
ggatatgaaacttagagccctttta

SEQ ID NO: 47925 - DNA, 25 bp, S. cerevisiae
ggatagcactgaaacaagctccttt

SEQ ID NO: 47926 - DNA, 25 bp, S. cerevisiae
ggataacgatcaaaagctgcccctt

SEQ ID NO: 47927 - DNA, 25 bp, S. cerevisiae
ggatccatcgaaaacagagcccgtt

SEQ ID NO: 47928 - DNA, 25 bp, S. cerevisiae
ggatctattgtccatgctaatcact

SEQ ID NO: 47929 - DNA, 25 bp, S. cerevisiae
ggataatattgtacgtgccgccacc

SEQ ID NO: 47930 - DNA, 25 bp, S. cerevisiae
ggatgaattagtccattactcctac

SEQ ID NO: 47931 - DNA, 25 bp, S. cerevisiae
ggatgaagtcgacattattccctaa

SEQ ID NO: 47932 - DNA, 25 bp, S. cerevisiae
ggatgaagacgactactaccctcaa

SEQ ID NO: 47933 - DNA, 25 bp, S. cerevisiae
ggttgaatccttaccaagctgtaat

SEQ ID NO: 47934 - DNA, 25 bp, S. cerevisiae
ggatatggttctcaacctccaattc

SEQ ID NO: 47935 - DNA, 25 bp, S. cerevisiae
ggattatgccaccaaactctccaag

SEQ ID NO: 47936 - DNA, 25 bp, S. cerevisiae
ggattggcatacctacactcgaaag

SEQ ID NO: 47937 - DNA, 25 bp, S. cerevisiae
ggttggttatgccacagttctcata

SEQ ID NO: 47938 - DNA, 25 bp, S. cerevisiae
ggatttttactcttttcattcttat

SEQ ID NO: 47939 - DNA, 25 bp, S. cerevisiae
ggattttacacggtcttgtctctaa

SEQ ID NO: 47940 - DNA, 25 bp, S. cerevisiae
ggttgtcgacaaggctttgattgct

SEQ ID NO: 47941 - DNA, 25 bp, S. cerevisiae
ggatattttggcctcaacagactat

SEQ ID NO: 47942 - DNA, 25 bp, S. cerevisiae
ggatttcttggctagaacggcattg

SEQ ID NO: 47943 - DNA, 25 bp, S. cerevisiae
ggatttactacagtatgcccctgag

SEQ ID NO: 47944 - DNA, 25 bp, S. cerevisiae
ggattacactattttacagcctgga

SEQ ID NO: 47945 - DNA, 25 bp, S. cerevisiae
ggataactctatcgtatataacttt

SEQ ID NO: 47946 - DNA, 25 bp, S. cerevisiae
ggatgaaccttactttatctaatgt

SEQ ID NO: 47947 - DNA, 25 bp, S. cerevisiae
ggatatatccgctgtgctctaatac

SEQ ID NO: 47948 - DNA, 25 bp, S. cerevisiae
ggatccctcagattgttcttaactt

SEQ ID NO: 47949 - DNA, 25 bp, S. cerevisiae
ggattaccttgactactatgttctt

SEQ ID NO: 47950 - DNA, 25 bp, S. cerevisiae
ggatccggcttaactggactggtta

SEQ ID NO: 47951 - DNA, 25 bp, S. cerevisiae
ggatatcgacttgctctcaaaggac

SEQ ID NO: 47952 - DNA, 25 bp, S. cerevisiae
ggttggcactgctgattttcattat

SEQ ID NO: 47953 - DNA, 25 bp, S. cerevisiae
ggttgtcctgcaaacatcttctaag

SEQ ID NO: 47954 - DNA, 25 bp, S. cerevisiae
ggttgagagcaaatcccactgacaa

SEQ ID NO: 47955 - DNA, 25 bp, S. cerevisiae
ggattggcgcgtgtactatatatat

SEQ ID NO: 47956 - DNA, 25 bp, S. cerevisiae
ggattgagcggaattcgtacactat

SEQ ID NO: 47957 - DNA, 25 bp, S. cerevisiae
ggatatcggagctttattatcgcta

SEQ ID NO: 47958 - DNA, 25 bp, S. cerevisiae
ggatctccttcataaaccatgattg

SEQ ID NO: 47959 - DNA, 25 bp, S. cerevisiae
ggatatctctactcaaagcattgct

SEQ ID NO: 47960 - DNA, 25 bp, S. cerevisiae
ggatgacgctacagagatcactcct

SEQ ID NO: 47961 - DNA, 25 bp, S. cerevisiae
ggatatttctagacgcagtgctcta

SEQ ID NO: 47962 - DNA, 25 bp, S. cerevisiae
ggatcaggcatcagactcaatgtca

SEQ ID NO: 47963 - DNA, 25 bp, S. cerevisiae
ggatcaggtccatctggcatgccag

SEQ ID NO: 47964 - DNA, 25 bp, S. cerevisiae
ggatctggtcactaaggagccgttg

SEQ ID NO: 47965 - DNA, 25 bp, S. cerevisiae
ggattattatcctgctgtactgtca

SEQ ID NO: 47966 - DNA, 25 bp, S. cerevisiae
ggattattattctctgctgccttta

SEQ ID NO: 47967 - DNA, 25 bp, S. cerevisiae
ggatctaacttctttgtcaactcta

SEQ ID NO: 47968 - DNA, 25 bp, S. cerevisiae
ggattactgctggaacggcacacta

SEQ ID NO: 47969 - DNA, 25 bp, S. cerevisiae
ggattgtattggatgacgccactaa

SEQ ID NO: 47970 - DNA, 25 bp, S. cerevisiae
ggagggtctggaagcacttaccaaa

SEQ ID NO: 47971 - DNA, 25 bp, S. cerevisiae
ggaggtttctgtaccattaccacca

SEQ ID NO: 47972 - DNA, 25 bp, S. cerevisiae
ggaggctatactttctgtgctacag

SEQ ID NO: 47973 - DNA, 25 bp, S. cerevisiae
ggatacagcagagcctcatgagata

SEQ ID NO: 47974 - DNA, 25 bp, S. cerevisiae
ggatcagttggattccgttcataat

SEQ ID NO: 47975 - DNA, 25 bp, S. cerevisiae
ggatttgctgttccatttgttgcct

SEQ ID NO: 47976 - DNA, 25 bp, S. cerevisiae
ggatcttatccgctatgatgaagtt

SEQ ID NO: 47977 - DNA, 25 bp, S. cerevisiae
ggatttccatgtggcgtgacagcac

SEQ ID NO: 47978 - DNA, 25 bp, S. cerevisiae
ggattctcctcctacaagtaatggt

SEQ ID NO: 47979 - DNA, 25 bp, S. cerevisiae
ggatacaacatctcaaccttctgtg

SEQ ID NO: 47980 - DNA, 25 bp, S. cerevisiae
ggttgtcaagctttacagcgatcaa

SEQ ID NO: 47981 - DNA, 25 bp, S. cerevisiae
ggataatccaccacaagaaggctta

SEQ ID NO: 47982 - DNA, 25 bp, S. cerevisiae
ggaaagcgaacaacccagggctggt

SEQ ID NO: 47983 - DNA, 25 bp, S. cerevisiae
ggaagactataaccctagaggttga

SEQ ID NO: 47984 - DNA, 25 bp, S. cerevisiae
ggatatttttatccccgcagattgc

SEQ ID NO: 47985 - DNA, 25 bp, S. cerevisiae
ggatttggaatctttgacagctaaa

SEQ ID NO: 47986 - DNA, 25 bp, S. cerevisiae
ggattggtgttctttgacgctccaa

SEQ ID NO: 47987 - DNA, 25 bp, S. cerevisiae
ggattacgtttcaaagcctgccaaa

SEQ ID NO: 47988 - DNA, 25 bp, S. cerevisiae
ggattccttaggtcatgatcgctta

SEQ ID NO: 47989 - DNA, 25 bp, S. cerevisiae
ggattctatctaaatgccacccaag

SEQ ID NO: 47990 - DNA, 25 bp, S. cerevisiae
ggatattcatggtttttgctgctat

SEQ ID NO: 47991 - DNA, 25 bp, S. cerevisiae
ggaccacgggatagcgcaggcaaat

SEQ ID NO: 47992 - DNA, 25 bp, S. cerevisiae
ggatgtcacggtttccagtacaatc

SEQ ID NO: 47993 - DNA, 25 bp, S. cerevisiae
ggattgccggttacttgctacatat

SEQ ID NO: 47994 - DNA, 25 bp, S. cerevisiae
ggattgccactgttttagcacacga

SEQ ID NO: 47995 - DNA, 25 bp, S. cerevisiae
ggctactacactacatttaccaaca

SEQ ID NO: 47996 - DNA, 25 bp, S. cerevisiae
ggattttgtgcagccgtgacgacag

SEQ ID NO: 47997 - DNA, 25 bp, S. cerevisiae
ggattcagagcatgttttcgattat

SEQ ID NO: 47998 - DNA, 25 bp, S. cerevisiae
ggatccacgtgagtatgttcgttat

SEQ ID NO: 47999 - DNA, 25 bp, S. cerevisiae
ggatcaccagtgactgttccaattt

SEQ ID NO: 48000 - DNA, 25 bp, S. cerevisiae
ggatcatccgtattttctccttcat

SEQ ID NO: 48001 - DNA, 25 bp, S. cerevisiae
ggattgcgcgcaaagtgtatcactt

SEQ ID NO: 48002 - DNA, 25 bp, S. cerevisiae
ggatctgtacatggaggctaactta

SEQ ID NO: 48003 - DNA, 25 bp, S. cerevisiae
ggatcagaaatgaactgtctcagct

SEQ ID NO: 48004 - DNA, 25 bp, S. cerevisiae
ggattgatactctttgttcttgcag

SEQ ID NO: 48005 - DNA, 25 bp, S. cerevisiae
ggatctactaaaacgctgaccaagc

SEQ ID NO: 48006 - DNA, 25 bp, S. cerevisiae
ggatatcatccatcaacgtgaacaa

SEQ ID NO: 48007 - DNA, 25 bp, S. cerevisiae
ggattgcatagtccaacactagaaa

SEQ ID NO: 48008 - DNA, 25 bp, S. cerevisiae
ggattcatagattacaacccagata

SEQ ID NO: 48009 - DNA, 25 bp, S. cerevisiae
ggattatcatacagcttgccaggaa

SEQ ID NO: 48010 - DNA, 25 bp, S. cerevisiae
ggatctgtgacccagttcacaagca

SEQ ID NO: 48011 - DNA, 25 bp, S. cerevisiae
ggattacatttcgacattgcagcat

SEQ ID NO: 48012 - DNA, 25 bp, S. cerevisiae
ggattgttcttccacatctgaatca

SEQ ID NO: 48013 - DNA, 25 bp, S. cerevisiae
ggatgatcttttggcatcactagga

SEQ ID NO: 48014 - DNA, 25 bp, S. cerevisiae
ggatgcggcacgttcaacgaattaa

SEQ ID NO: 48015 - DNA, 25 bp, S. cerevisiae
ggaggcgggctagacgaactacttt

SEQ ID NO: 48016 - DNA, 25 bp, S. cerevisiae
ggactgggcgtaacaccaattactt

SEQ ID NO: 48017 - DNA, 25 bp, S. cerevisiae
ggatctggttgtgtcccaattaatc

SEQ ID NO: 48018 - DNA, 25 bp, S. cerevisiae
ggatttttgccttctagtgatgcta

SEQ ID NO: 48019 - DNA, 25 bp, S. cerevisiae
ggataagtccttttcgttcacacaa

SEQ ID NO: 48020 - DNA, 25 bp, S. cerevisiae
ggataggcctctacctattatgtaa

SEQ ID NO: 48021 - DNA, 25 bp, S. cerevisiae
ggatcctcctccagtaattcgaact

SEQ ID NO: 48022 - DNA, 25 bp, S. cerevisiae
ggatctctccccaaagaacgcgagg

SEQ ID NO: 48023 - DNA, 25 bp, S. cerevisiae
ggatcctcagtgcataacataccga

SEQ ID NO: 48024 - DNA, 25 bp, S. cerevisiae
ggatcggcttcattttgaacccatt

SEQ ID NO: 48025 - DNA, 25 bp, S. cerevisiae
ggattacattcatcttaacgctcaa

SEQ ID NO: 48026 - DNA, 25 bp, S. cerevisiae
ggattcgcatttatcgacttcaaga

SEQ ID NO: 48027 - DNA, 25 bp, S. cerevisiae
ggattccatttaacggtctcacaaa

SEQ ID NO: 48028 - DNA, 25 bp, S. cerevisiae
ggattcatattttcaataccgccat

SEQ ID NO: 48029 - DNA, 25 bp, S. cerevisiae
ggattccattgttgataaaggctat

SEQ ID NO: 48030 - DNA, 25 bp, S. cerevisiae
ggattttccatgttaaaggcgccgt

SEQ ID NO: 48031 - DNA, 25 bp, S. cerevisiae
ggatttttcttacagatggcgcaag

SEQ ID NO: 48032 - DNA, 25 bp, S. cerevisiae
ggattttttctaaatgctgccaaga

SEQ ID NO: 48033 - DNA, 25 bp, S. cerevisiae
ggattcctttattaactgcccatga

SEQ ID NO: 48034 - DNA, 25 bp, S. cerevisiae
ggatctttcttattatacacccagc

SEQ ID NO: 48035 - DNA, 25 bp, S. cerevisiae
ggatttgattgactcccaccaagat

SEQ ID NO: 48036 - DNA, 25 bp, S. cerevisiae
ggagatttttcccagtcaaggtgac

SEQ ID NO: 48037 - DNA, 25 bp, S. cerevisiae
ggaggttttctccttatggtaagag

SEQ ID NO: 48038 - DNA, 25 bp, S. cerevisiae
ggaccgtattcctttatgcgaacag

SEQ ID NO: 48039 - DNA, 25 bp, S. cerevisiae
ggatgccaccttattaatgaaactg

SEQ ID NO: 48040 - DNA, 25 bp, S. cerevisiae
ggatttgccgtcattaatcaagact

SEQ ID NO: 48041 - DNA, 25 bp, S. cerevisiae
ggatatttcgatgttttcaggcctt

SEQ ID NO: 48042 - DNA, 25 bp, S. cerevisiae
ggatctttggatcttttcaaggcag

SEQ ID NO: 48043 - DNA, 25 bp, S. cerevisiae
ggatcatttagtcctttacaaagaa

SEQ ID NO: 48044 - DNA, 25 bp, S. cerevisiae
ggatttccaatcatacctcaatgca

SEQ ID NO: 48045 - DNA, 25 bp, S. cerevisiae
ggatttgctgcaacgtattgtcaac

SEQ ID NO: 48046 - DNA, 25 bp, S. cerevisiae
ggattattccatagatagtattgaa

SEQ ID NO: 48047 - DNA, 25 bp, S. cerevisiae
ggagttatagcgtcaagtggcccac

SEQ ID NO: 48048 - DNA, 25 bp, S. cerevisiae
ggaggtactctatcttgaccgtaga

SEQ ID NO: 48049 - DNA, 25 bp, S. cerevisiae
ggaggcgaccatagtgcgtacgttc

SEQ ID NO: 48050 - DNA, 25 bp, S. cerevisiae
ggattcgccagaagctcttgatttt

SEQ ID NO: 48051 - DNA, 25 bp, S. cerevisiae
ggattctcctatcagttatcaacag

SEQ ID NO: 48052 - DNA, 25 bp, S. cerevisiae
ggatttgctactcttactcaacatg

SEQ ID NO: 48053 - DNA, 25 bp, S. cerevisiae
ggatttaatgctccttaccaattgt

SEQ ID NO: 48054 - DNA, 25 bp, S. cerevisiae
ggatttagctgtccttcaggcagaa

SEQ ID NO: 48055 - DNA, 25 bp, S. cerevisiae
ggattacacaagacccatcagcgat

SEQ ID NO: 48056 - DNA, 25 bp, S. cerevisiae
ggattcaagaagacccgcatcgcat

SEQ ID NO: 48057 - DNA, 25 bp, S. cerevisiae
ggattcgcttgcaaacacagactgg

SEQ ID NO: 48058 - DNA, 25 bp, S. cerevisiae
ggattcagttcatcacgcaggtggc

SEQ ID NO: 48059 - DNA, 25 bp, S. cerevisiae
ggattcaatatttaccgcggcgctg

SEQ ID NO: 48060 - DNA, 25 bp, S. cerevisiae
ggatattttcgacgatctctcctaa

SEQ ID NO: 48061 - DNA, 25 bp, S. cerevisiae
ggattttacgacgatctctacgcat

SEQ ID NO: 48062 - DNA, 25 bp, S. cerevisiae
ggattttacgattacttcaccaagc

SEQ ID NO: 48063 - DNA, 25 bp, S. cerevisiae
ggaactattggatagccccgatttt

SEQ ID NO: 48064 - DNA, 25 bp, S. cerevisiae
ggatacgtttgataggccattgatt

SEQ ID NO: 48065 - DNA, 25 bp, S. cerevisiae
ggatatcggtctgcattggccagta

SEQ ID NO: 48066 - DNA, 25 bp, S. cerevisiae
ggatcgtgcaattatcttgcctagt

SEQ ID NO: 48067 - DNA, 25 bp, S. cerevisiae
ggatgttgatatgactggcgatgaa

SEQ ID NO: 48068 - DNA, 25 bp, S. cerevisiae
ggattctatgaaactcggtgctgat

SEQ ID NO: 48069 - DNA, 25 bp, S. cerevisiae
ggatatctacaaatggcccgtgcgg

SEQ ID NO: 48070 - DNA, 25 bp, S. cerevisiae
ggatatccgcgaaggtgaccaggct

SEQ ID NO: 48071 - DNA, 25 bp, S. cerevisiae
ggcatgtagccagcgtataccaggt

SEQ ID NO: 48072 - DNA, 25 bp, S. cerevisiae
ggatctcaaagcagtcatttggcat

SEQ ID NO: 48073 - DNA, 25 bp, S. cerevisiae
ggattctaagcacctagttgtttta

SEQ ID NO: 48074 - DNA, 25 bp, S. cerevisiae
ggataccagactttggattctttct

SEQ ID NO: 48075 - DNA, 25 bp, S. cerevisiae
ggatactactgttgggattcccatt

SEQ ID NO: 48076 - DNA, 25 bp, S. cerevisiae
ggatcgcatggaacgccaagccaaa

SEQ ID NO: 48077 - DNA, 25 bp, S. cerevisiae
ggatctgaagaactgccacgaacgc

SEQ ID NO: 48078 - DNA, 25 bp, S. cerevisiae
ggatcagcataattctgccacgaat

SEQ ID NO: 48079 - DNA, 25 bp, S. cerevisiae
ggatttgcaactagagcccacaatt

SEQ ID NO: 48080 - DNA, 25 bp, S. cerevisiae
ggatttgacccaacctacattaaga

SEQ ID NO: 48081 - DNA, 25 bp, S. cerevisiae
ggattatacccatcagtcattcatg

SEQ ID NO: 48082 - DNA, 25 bp, S. cerevisiae
ggctttacccttattggattatcca

SEQ ID NO: 48083 - DNA, 25 bp, S. cerevisiae
ggatttacccgtgatagcggtcatt

SEQ ID NO: 48084 - DNA, 25 bp, S. cerevisiae
ggataatacgcctctaaatgcttta

SEQ ID NO: 48085 - DNA, 25 bp, S. cerevisiae
ggatcgacgctgcaacacaagcata

SEQ ID NO: 48086 - DNA, 25 bp, S. cerevisiae
ggatctactggattagcccactttt

SEQ ID NO: 48087 - DNA, 25 bp, S. cerevisiae
ggatttctaatcgacctagcagagg

SEQ ID NO: 48088 - DNA, 25 bp, S. cerevisiae
ggatttgaattaataccgcttagca

SEQ ID NO: 48089 - DNA, 25 bp, S. cerevisiae
ggataccactggtctagacgctttg

SEQ ID NO: 48090 - DNA, 25 bp, S. cerevisiae
ggatcaccatctgagttacctttaa

SEQ ID NO: 48091 - DNA, 25 bp, S. cerevisiae
ggatactaccccattgatggctgat

SEQ ID NO: 48092 - DNA, 25 bp, S. cerevisiae
ggagattatcgccttatcgtggtag

SEQ ID NO: 48093 - DNA, 25 bp, S. cerevisiae
ggatattatctcctcttgggatatg

SEQ ID NO: 48094 - DNA, 25 bp, S. cerevisiae
ggatcttccatatacctattctact

SEQ ID NO: 48095 - DNA, 25 bp, S. cerevisiae
ggatacttggcaggctacacctata

SEQ ID NO: 48096 - DNA, 25 bp, S. cerevisiae
ggatctttgtgaatgctaccctatt

SEQ ID NO: 48097 - DNA, 25 bp, S. cerevisiae
ggatacttccgtaccaacgagaact

SEQ ID NO: 48098 - DNA, 25 bp, S. cerevisiae
ggatcttacacaggacgaacaggtt

SEQ ID NO: 48099 - DNA, 25 bp, S. cerevisiae
ggatccaaatgaagaggccgccttt

SEQ ID NO: 48100 - DNA, 25 bp, S. cerevisiae
ggatcctaatgatgatggccagtca

SEQ ID NO: 48101 - DNA, 25 bp, S. cerevisiae
ggatctgctggtaccagtgctacta

SEQ ID NO: 48102 - DNA, 25 bp, S. cerevisiae
ggatcctgtgctatcagacctagaa

SEQ ID NO: 48103 - DNA, 25 bp, S. cerevisiae
ggatccggagtacttacgtgagcta

SEQ ID NO: 48104 - DNA, 25 bp, S. cerevisiae
ggatcccgagtcatgtttggcaaac

SEQ ID NO: 48105 - DNA, 25 bp, S. cerevisiae
ggatccacggtcatttggtcatttt

SEQ ID NO: 48106 - DNA, 25 bp, S. cerevisiae
ggatcgcattgacgagttagtactt

SEQ ID NO: 48107 - DNA, 25 bp, S. cerevisiae
ggatcctctacgcatctagtattga

SEQ ID NO: 48108 - DNA, 25 bp, S. cerevisiae
ggatggctcagatattcggttactt

SEQ ID NO: 48109 - DNA, 25 bp, S. cerevisiae
ggctgctgcaagacgacgggttact

SEQ ID NO: 48110 - DNA, 25 bp, S. cerevisiae
ggcgtgaaactgtcgggctatacca

SEQ ID NO: 48111 - DNA, 25 bp, S. cerevisiae
tccggcttcagtttggacgaaccaa

SEQ ID NO: 48112 - DNA, 25 bp, S. cerevisiae
ggacccgttgttcttggagtcagta

SEQ ID NO: 48113 - DNA, 25 bp, S. cerevisiae
tgggacctttttgaaccaccagcgt

SEQ ID NO: 48114 - DNA, 25 bp, S. cerevisiae
ggagaccttttagatacctcaagtt

SEQ ID NO: 48115 - DNA, 25 bp, S. cerevisiae
ggattttattggacctaccagtgca

SEQ ID NO: 48116 - DNA, 25 bp, S. cerevisiae
ggatcgttgcttgctaatgacattt

SEQ ID NO: 48117 - DNA, 25 bp, S. cerevisiae
ggatctcgtgttccaacatattttg

SEQ ID NO: 48118 - DNA, 25 bp, S. cerevisiae
ggatatcacttttagccaattctct

SEQ ID NO: 48119 - DNA, 25 bp, S. cerevisiae
ggatgacacattatctgccttttgc

SEQ ID NO: 48120 - DNA, 25 bp, S. cerevisiae
ggatcaacattcattctcaagctgg

SEQ ID NO: 48121 - DNA, 25 bp, S. cerevisiae
ggatgacactgacatcttgcagcct

SEQ ID NO: 48122 - DNA, 25 bp, S. cerevisiae
ggatgccctagatttgtcagcacta

SEQ ID NO: 48123 - DNA, 25 bp, S. cerevisiae
ggatacactccattttacaattcga

SEQ ID NO: 48124 - DNA, 25 bp, S. cerevisiae
ggatagaccaagaacattacgcaca

SEQ ID NO: 48125 - DNA, 25 bp, S. cerevisiae
ggatttatcgaagctgtcaccacaa

SEQ ID NO: 48126 - DNA, 25 bp, S. cerevisiae
ggattttcatattcactgccatcac

SEQ ID NO: 48127 - DNA, 25 bp, S. cerevisiae
ggatccttgcaggtatctactacaa

SEQ ID NO: 48128 - DNA, 25 bp, S. cerevisiae
ggatgcgctatccttgatctactcc

SEQ ID NO: 48129 - DNA, 25 bp, S. cerevisiae
ggatcatcctatattaacgttacat

SEQ ID NO: 48130 - DNA, 25 bp, S. cerevisiae
ggatttactacttatacctctacaa

SEQ ID NO: 48131 - DNA, 25 bp, S. cerevisiae
ggatttcccgttcagagaacactgc

SEQ ID NO: 48132 - DNA, 25 bp, S. cerevisiae
ggatcttccgtttatttactgcttc

SEQ ID NO: 48133 - DNA, 25 bp, S. cerevisiae
ggatctctccgtagaactagttccc

SEQ ID NO: 48134 - DNA, 25 bp, S. cerevisiae
ggatcattgccgataacttttcatc

SEQ ID NO: 48135 - DNA, 25 bp, S. cerevisiae
ggatcattatccttacacttttatt

SEQ ID NO: 48136 - DNA, 25 bp, S. cerevisiae
ggatatgtatcctaggtgcatttct

SEQ ID NO: 48137 - DNA, 25 bp, S. cerevisiae
ggatagttccatttggctttcaaaa

SEQ ID NO: 48138 - DNA, 25 bp, S. cerevisiae
ggatgtggctccaacatgccattta

SEQ ID NO: 48139 - DNA, 25 bp, S. cerevisiae
ggatgtcgttcaacaggctgctaac

SEQ ID NO: 48140 - DNA, 25 bp, S. cerevisiae
ggatttttcttcaatgcgttcggtt

SEQ ID NO: 48141 - DNA, 25 bp, S. cerevisiae
ggatttttcccaagttgctcaagtg

SEQ ID NO: 48142 - DNA, 25 bp, S. cerevisiae
ggatatgccgatttctcgtgaataa

SEQ ID NO: 48143 - DNA, 25 bp, S. cerevisiae
ggatttcagaacacgatatatcgat

SEQ ID NO: 48144 - DNA, 25 bp, S. cerevisiae
tccttccaacacattttacgtttgt

SEQ ID NO: 48145 - DNA, 25 bp, S. cerevisiae
tcccgccgaacaatccttaattttg

SEQ ID NO: 48146 - DNA, 25 bp, S. cerevisiae
tggccgcaggagattacttgacgtt

SEQ ID NO: 48147 - DNA, 25 bp, S. cerevisiae
ggatcctggtccaatatttgacgtt

SEQ ID NO: 48148 - DNA, 25 bp, S. cerevisiae
ggatgaagatctggtacccttgccg

SEQ ID NO: 48149 - DNA, 25 bp, S. cerevisiae
ggatcaagccatggataaccttcac

SEQ ID NO: 48150 - DNA, 25 bp, S. cerevisiae
ggatatcccactagctatttcatta

SEQ ID NO: 48151 - DNA, 25 bp, S. cerevisiae
ggatgacgcccgatgttgacaatga

SEQ ID NO: 48152 - DNA, 25 bp, S. cerevisiae
ggataccctgtgattctgaattacc

SEQ ID NO: 48153 - DNA, 25 bp, S. cerevisiae
ggatttccttgatggactgctctaa

SEQ ID NO: 48154 - DNA, 25 bp, S. cerevisiae
ggatttacttttccacatatggcaa

SEQ ID NO: 48155 - DNA, 25 bp, S. cerevisiae
ggacgagtacaagcccattttgcaa

SEQ ID NO: 48156 - DNA, 25 bp, S. cerevisiae
ggatgaagataccactccctttaac

SEQ ID NO: 48157 - DNA, 25 bp, S. cerevisiae
ggatatcataggctaccaaactgca

SEQ ID NO: 48158 - DNA, 25 bp, S. cerevisiae
ggatacaatcagcaccaaacaatca

SEQ ID NO: 48159 - DNA, 25 bp, S. cerevisiae
ggatacagctggcaccgcaaagaca

SEQ ID NO: 48160 - DNA, 25 bp, S. cerevisiae
ggagacctcgtagacctgaaaactg

SEQ ID NO: 48161 - DNA, 25 bp, S. cerevisiae
ggagataccataaccaccgaaaagt

SEQ ID NO: 48162 - DNA, 25 bp, S. cerevisiae
ggaggctcgtattcctgcccaacat

SEQ ID NO: 48163 - DNA, 25 bp, S. cerevisiae
ggatgcgcagagtcatacccaatat

SEQ ID NO: 48164 - DNA, 25 bp, S. cerevisiae
ggatgctgcagaaccattcaaaatt

SEQ ID NO: 48165 - DNA, 25 bp, S. cerevisiae
ggatcatcttcggagttgccattaa

SEQ ID NO: 48166 - DNA, 25 bp, S. cerevisiae
ggatttgacggattctccatctgaa

SEQ ID NO: 48167 - DNA, 25 bp, S. cerevisiae
ggatctggaccgttcatcaactaag

SEQ ID NO: 48168 - DNA, 25 bp, S. cerevisiae
ggatttcctcgaactactgcgcaag

SEQ ID NO: 48169 - DNA, 25 bp, S. cerevisiae
ggatatcaaattggccagaagacta

SEQ ID NO: 48170 - DNA, 25 bp, S. cerevisiae
ggatgacattataagcgagctaaca

SEQ ID NO: 48171 - DNA, 25 bp, S. cerevisiae
ggatgatctcataacgcgtctgata

SEQ ID NO: 48172 - DNA, 25 bp, S. cerevisiae
ggatgatgctagaactgccttgaaa

SEQ ID NO: 48173 - DNA, 25 bp, S. cerevisiae
ggatatcttgagttgcttcgacaat

SEQ ID NO: 48174 - DNA, 25 bp, S. cerevisiae
ggatactatggtctgcttaaatttc

SEQ ID NO: 48175 - DNA, 25 bp, S. cerevisiae
ggatcacaagtatcacctacacagg

SEQ ID NO: 48176 - DNA, 25 bp, S. cerevisiae
ggatcaaagctctattatctgcgag

SEQ ID NO: 48177 - DNA, 25 bp, S. cerevisiae
ggatacgccgttcgatgcagctaaa

SEQ ID NO: 48178 - DNA, 25 bp, S. cerevisiae
ggatatcgccacttgcaaagctata

SEQ ID NO: 48179 - DNA, 25 bp, S. cerevisiae
ggatcacaccaattacatgagcaat

SEQ ID NO: 48180 - DNA, 25 bp, S. cerevisiae
ggatatcacactaatcagcgaccaa

SEQ ID NO: 48181 - DNA, 25 bp, S. cerevisiae
ggatgctctagaaagtgaactcaat

SEQ ID NO: 48182 - DNA, 25 bp, S. cerevisiae
ggatccatggttgctgatgttcaca

SEQ ID NO: 48183 - DNA, 25 bp, S. cerevisiae
ggatccggaatcgatggcatacact

SEQ ID NO: 48184 - DNA, 25 bp, S. cerevisiae
ggaggccaattcctggtatccagag

SEQ ID NO: 48185 - DNA, 25 bp, S. cerevisiae
ggaggcgacactgcgtatgataaac

SEQ ID NO: 48186 - DNA, 25 bp, S. cerevisiae
ggatggcgacctcgttatggacaac

SEQ ID NO: 48187 - DNA, 25 bp, S. cerevisiae
ggaggagaccttgtgtaccaaatta

SEQ ID NO: 48188 - DNA, 25 bp, S. cerevisiae
ggactatccatttggttgggcaccc

SEQ ID NO: 48189 - DNA, 25 bp, S. cerevisiae
ggatgttccaaatactgcgggccca

SEQ ID NO: 48190 - DNA, 25 bp, S. cerevisiae
ggatgctggctatagaatttctgat

SEQ ID NO: 48191 - DNA, 25 bp, S. cerevisiae
ggatccgtagaaacattgcctgcag

SEQ ID NO: 48192 - DNA, 25 bp, S. cerevisiae
ggatagttcattattgcccttggct

SEQ ID NO: 48193 - DNA, 25 bp, S. cerevisiae
ggatctcaaggaatttaccagctta

SEQ ID NO: 48194 - DNA, 25 bp, S. cerevisiae
ggataatcacgctacttaccagtta

SEQ ID NO: 48195 - DNA, 25 bp, S. cerevisiae
ggatattatcctaattcccaactga

SEQ ID NO: 48196 - DNA, 25 bp, S. cerevisiae
ggatcatattccacttcaccaatgg

SEQ ID NO: 48197 - DNA, 25 bp, S. cerevisiae
ggatatgcaacaaccaagccagtaa

SEQ ID NO: 48198 - DNA, 25 bp, S. cerevisiae
tggtcattttcccaaccgaatggtt

SEQ ID NO: 48199 - DNA, 25 bp, S. cerevisiae
ggacttatcccagatccgtagtgat

SEQ ID NO: 48200 - DNA, 25 bp, S. cerevisiae
ggagttcttacttgcttaatacctg

SEQ ID NO: 48201 - DNA, 25 bp, S. cerevisiae
ggataatttcctgtttgacttcaat

SEQ ID NO: 48202 - DNA, 25 bp, S. cerevisiae
ggatctaatcccactattaccaaaa

SEQ ID NO: 48203 - DNA, 25 bp, S. cerevisiae
ggataagacctactgtttgcaacac

SEQ ID NO: 48204 - DNA, 25 bp, S. cerevisiae
ggatatcagccctacgattgcagaa

SEQ ID NO: 48205 - DNA, 25 bp, S. cerevisiae
ggagatctctgttgagctgaaggaa

SEQ ID NO: 48206 - DNA, 25 bp, S. cerevisiae
ggatctcatttaaatttagcggcga

SEQ ID NO: 48207 - DNA, 25 bp, S. cerevisiae
ggatgatacgctcaatttactggat

SEQ ID NO: 48208 - DNA, 25 bp, S. cerevisiae
ggatgactatctatctctgttagac

SEQ ID NO: 48209 - DNA, 25 bp, S. cerevisiae
ggatggtatcccatacttaccttac

SEQ ID NO: 48210 - DNA, 25 bp, S. cerevisiae
ggatgagttccaatttttacccatg

SEQ ID NO: 48211 - DNA, 25 bp, S. cerevisiae
ggatgtattctcgtttgtataccca

SEQ ID NO: 48212 - DNA, 25 bp, S. cerevisiae
ggatgccctctttaaacaattacta

SEQ ID NO: 48213 - DNA, 25 bp, S. cerevisiae
ggatcccgtaacactgatgatttct

SEQ ID NO: 48214 - DNA, 25 bp, S. cerevisiae
ggatcacgaacatgcattcatcaag

SEQ ID NO: 48215 - DNA, 25 bp, S. cerevisiae
ggatcaggacactgttatcaacgaa

SEQ ID NO: 48216 - DNA, 25 bp, S. cerevisiae
ggatcaagcctcttattacgaagat

SEQ ID NO: 48217 - DNA, 25 bp, S. cerevisiae
ggatcaccccattttaagaaagttg

SEQ ID NO: 48218 - DNA, 25 bp, S. cerevisiae
ggactaggtgatcgccatccaagca

SEQ ID NO: 48219 - DNA, 25 bp, S. cerevisiae
ggagtacgtacctattgaaatatca

SEQ ID NO: 48220 - DNA, 25 bp, S. cerevisiae
ggatcccgcctgtgttatcgcttaa

SEQ ID NO: 48221 - DNA, 25 bp, S. cerevisiae
ggatccccgcgtataatccgtgtca

SEQ ID NO: 48222 - DNA, 25 bp, S. cerevisiae
ggcagctccccatcaaaataaggtc

SEQ ID NO: 48223 - DNA, 25 bp, S. cerevisiae
ggatgctccctctaagacagatcac

SEQ ID NO: 48224 - DNA, 25 bp, S. cerevisiae
ggatgacccatctggagcttcaagt

SEQ ID NO: 48225 - DNA, 25 bp, S. cerevisiae
ggatgactcagcgtgggacctcaat

SEQ ID NO: 48226 - DNA, 25 bp, S. cerevisiae
ggatgatcctgttgtcggcccagat

SEQ ID NO: 48227 - DNA, 25 bp, S. cerevisiae
ggagatgtctaacttctaacgtatc

SEQ ID NO: 48228 - DNA, 25 bp, S. cerevisiae
ggatgatgtcaaggctccagaaggt

SEQ ID NO: 48229 - DNA, 25 bp, S. cerevisiae
ggatcgtgaacatgctgccggtgaa

SEQ ID NO: 48230 - DNA, 25 bp, S. cerevisiae
ggatacatattaggcctcggtgata

SEQ ID NO: 48231 - DNA, 25 bp, S. cerevisiae
ggatacatatttgctgcttgcctat

SEQ ID NO: 48232 - DNA, 25 bp, S. cerevisiae
ggaggatcctaatgggcctattatc

SEQ ID NO: 48233 - DNA, 25 bp, S. cerevisiae
ggaggatgccggtgaacccgtacaa

SEQ ID NO: 48234 - DNA, 25 bp, S. cerevisiae
ggaggtccctgctgaaccggaaact

SEQ ID NO: 48235 - DNA, 25 bp, S. cerevisiae
ggagttttcttaatgaccggcacaa

SEQ ID NO: 48236 - DNA, 25 bp, S. cerevisiae
ggagatgcgctgttatcacgactac

SEQ ID NO: 48237 - DNA, 25 bp, S. cerevisiae
ggatgccactgtcgtatggtcacaa

SEQ ID NO: 48238 - DNA, 25 bp, S. cerevisiae
ggatgccgcgctagtaggaacaatt

SEQ ID NO: 48239 - DNA, 25 bp, S. cerevisiae
ggatcgcccggtcgagaacagactt

SEQ ID NO: 48240 - DNA, 25 bp, S. cerevisiae
ggatagcatcccctcaagaaacagt

SEQ ID NO: 48241 - DNA, 25 bp, S. cerevisiae
ggatgctcatattgtctctgtcata

SEQ ID NO: 48242 - DNA, 25 bp, S. cerevisiae
ggatgcatatgtcagccgtactttg

SEQ ID NO: 48243 - DNA, 25 bp, S. cerevisiae
ggatgtcttccagcgaattcttggt

SEQ ID NO: 48244 - DNA, 25 bp, S. cerevisiae
ggatgcgctcgtgacaatcggcaga

SEQ ID NO: 48245 - DNA, 25 bp, S. cerevisiae
ggatcagttttagactctccagaaa

SEQ ID NO: 48246 - DNA, 25 bp, S. cerevisiae
ggatacttctgtcccaattgtcata

SEQ ID NO: 48247 - DNA, 25 bp, S. cerevisiae
ggatactctcgttacatctcgatta

SEQ ID NO: 48248 - DNA, 25 bp, S. cerevisiae
ggagacacagtgactctaatcagca

SEQ ID NO: 48249 - DNA, 25 bp, S. cerevisiae
ggagacactggtacatcaagcggat

SEQ ID NO: 48250 - DNA, 25 bp, S. cerevisiae
ggataacgttcctaacagagatcaa

SEQ ID NO: 48251 - DNA, 25 bp, S. cerevisiae
ggatcgagcgttttcagacaaccaa

SEQ ID NO: 48252 - DNA, 25 bp, S. cerevisiae
ggatcaatcgttttagccggcacac

SEQ ID NO: 48253 - DNA, 25 bp, S. cerevisiae
ggcgtagtgaataatgtccccaagt

SEQ ID NO: 48254 - DNA, 25 bp, S. cerevisiae
ggatgatgacttccggcacttagac

SEQ ID NO: 48255 - DNA, 25 bp, S. cerevisiae
ggaggcactgagtcaagctcttggc

SEQ ID NO: 48256 - DNA, 25 bp, S. cerevisiae
ggatcctctgctatggcttacaaga

SEQ ID NO: 48257 - DNA, 25 bp, S. cerevisiae
ggatccctctgccttgtatagagaa

SEQ ID NO: 48258 - DNA, 25 bp, S. cerevisiae
ggatgccatacccttttatagaaca

SEQ ID NO: 48259 - DNA, 25 bp, S. cerevisiae
ggatgccattacctggttgaacgaa

SEQ ID NO: 48260 - DNA, 25 bp, S. cerevisiae
ggagtcgtagattgcgttgttgata

SEQ ID NO: 48261 - DNA, 25 bp, S. cerevisiae
ggatcttggatattcgaccgctaaa

SEQ ID NO: 48262 - DNA, 25 bp, S. cerevisiae
ggatctatgaaatcgctcgctatac

SEQ ID NO: 48263 - DNA, 25 bp, S. cerevisiae
ggatctcatcaaacacctttatagt

SEQ ID NO: 48264 - DNA, 25 bp, S. cerevisiae
ggatgacaaaccactctatcacgat

SEQ ID NO: 48265 - DNA, 25 bp, S. cerevisiae
ggatgcaagactacattctctatca

SEQ ID NO: 48266 - DNA, 25 bp, S. cerevisiae
ggatctggctctactttcatatatg

SEQ ID NO: 48267 - DNA, 25 bp, S. cerevisiae
ggatcttctgtgctattcatttgta

SEQ ID NO: 48268 - DNA, 25 bp, S. cerevisiae
ggatcagttgcacggtgtccattta

SEQ ID NO: 48269 - DNA, 25 bp, S. cerevisiae
ggatctgctcattaactttctgtta

SEQ ID NO: 48270 - DNA, 25 bp, S. cerevisiae
ggatcattaatgttttctgctctac

SEQ ID NO: 48271 - DNA, 25 bp, S. cerevisiae
ggatcttcacatccgattctgctaa

SEQ ID NO: 48272 - DNA, 25 bp, S. cerevisiae
ggatcttaaaccttggcagcaatag

SEQ ID NO: 48273 - DNA, 25 bp, S. cerevisiae
ggcattactaggacatgtgggcaat

SEQ ID NO: 48274 - DNA, 25 bp, S. cerevisiae
ggatgaccttggacgatgcggcaaa

SEQ ID NO: 48275 - DNA, 25 bp, S. cerevisiae
ggataacgtgccagtgagcccaagt

SEQ ID NO: 48276 - DNA, 25 bp, S. cerevisiae
ggatcatacgctggttgggcccaag

SEQ ID NO: 48277 - DNA, 25 bp, S. cerevisiae
ggatgaaactcatcatggtcagaaa

SEQ ID NO: 48278 - DNA, 25 bp, S. cerevisiae
ggataatccgctactagttgacaaa

SEQ ID NO: 48279 - DNA, 25 bp, S. cerevisiae
ggatcgttctgaagttgtagaccaa

SEQ ID NO: 48280 - DNA, 25 bp, S. cerevisiae
ggatgtttcttccacttttaataca

SEQ ID NO: 48281 - DNA, 25 bp, S. cerevisiae
ggatgttgtttatgctttgaagaga

SEQ ID NO: 48282 - DNA, 25 bp, S. cerevisiae
ggatgtgccactcttatttgaagga

SEQ ID NO: 48283 - DNA, 25 bp, S. cerevisiae
ggatgcacctatcatagaaatggct

SEQ ID NO: 48284 - DNA, 25 bp, S. cerevisiae
ggatcctcgatttacagcaatgctt

SEQ ID NO: 48285 - DNA, 25 bp, S. cerevisiae
ggatcatggcgagtcaactgaactt

SEQ ID NO: 48286 - DNA, 25 bp, S. cerevisiae
ggagtttcactttatcgcttaacga

SEQ ID NO: 48287 - DNA, 25 bp, S. cerevisiae
ggatgaggcccagtctttttgataa

SEQ ID NO: 48288 - DNA, 25 bp, S. cerevisiae
ggatggcgtccatatattttgataa

SEQ ID NO: 48289 - DNA, 25 bp, S. cerevisiae
ggatcctcccaaatttgagtggaat

SEQ ID NO: 48290 - DNA, 25 bp, S. cerevisiae
ggatcctccttgatttttgccaaag

SEQ ID NO: 48291 - DNA, 25 bp, S. cerevisiae
ggatgagatactgtcccaatcggga

SEQ ID NO: 48292 - DNA, 25 bp, S. cerevisiae
ggagcccctggtgccaatgctagga

SEQ ID NO: 48293 - DNA, 25 bp, S. cerevisiae
ggagccggctggtcaggatttaaaa

SEQ ID NO: 48294 - DNA, 25 bp, S. cerevisiae
ggatcgggtggctgttgtattataa

SEQ ID NO: 48295 - DNA, 25 bp, S. cerevisiae
ggaggtggtcactctaccatttata

SEQ ID NO: 48296 - DNA, 25 bp, S. cerevisiae
ggaggtatcccagttagacttcaat

SEQ ID NO: 48297 - DNA, 25 bp, S. cerevisiae
ggaggttcgcattacgcctatctaa

SEQ ID NO: 48298 - DNA, 25 bp, S. cerevisiae
ggatgcgattccacaaagcttggga

SEQ ID NO: 48299 - DNA, 25 bp, S. cerevisiae
ggatgccattcctcaagaagttgta

SEQ ID NO: 48300 - DNA, 25 bp, S. cerevisiae
ggaggaccacttcatcaagtttcga

SEQ ID NO: 48301 - DNA, 25 bp, S. cerevisiae
ggaggactcctactatcaatggcaa

SEQ ID NO: 48302 - DNA, 25 bp, S. cerevisiae
ggagcttttggttggacacttcgat

SEQ ID NO: 48303 - DNA, 25 bp, S. cerevisiae
ggagatcttacgttatgcaactaaa

SEQ ID NO: 48304 - DNA, 25 bp, S. cerevisiae
ggagttaccagacatcaacgacgaa

SEQ ID NO: 48305 - DNA, 25 bp, S. cerevisiae
ggagttttcagacgaccttgacgat

SEQ ID NO: 48306 - DNA, 25 bp, S. cerevisiae
ggatgacttcaatggtactttcgat

SEQ ID NO: 48307 - DNA, 25 bp, S. cerevisiae
ggagacaaaacgttactattgacat

SEQ ID NO: 48308 - DNA, 25 bp, S. cerevisiae
ggaaccaaatcctgactttagacct

SEQ ID NO: 48309 - DNA, 25 bp, S. cerevisiae
ggagaaccatgtctaatctagctag

SEQ ID NO: 48310 - DNA, 25 bp, S. cerevisiae
ggagtatccattcaaaccaccaaag

SEQ ID NO: 48311 - DNA, 25 bp, S. cerevisiae
ggagtacgttccatcctcaaagaaa

SEQ ID NO: 48312 - DNA, 25 bp, S. cerevisiae
ggagaggtattccttccgaagaaag

SEQ ID NO: 48313 - DNA, 25 bp, S. cerevisiae
ggaggcgttgactatacatctggaa

SEQ ID NO: 48314 - DNA, 25 bp, S. cerevisiae
ggatgcctttgttcaaattgtcaaa

SEQ ID NO: 48315 - DNA, 25 bp, S. cerevisiae
ggatcctttctccacaattcaaatt

SEQ ID NO: 48316 - DNA, 25 bp, S. cerevisiae
ggatcgttgtatcagttcagccaat

SEQ ID NO: 48317 - DNA, 25 bp, S. cerevisiae
ggatggttgctatcagcttcactgc

SEQ ID NO: 48318 - DNA, 25 bp, S. cerevisiae
ggatggatctttcatttcctgcttc

SEQ ID NO: 48319 - DNA, 25 bp, S. cerevisiae
ggatcccgcaattcggtatatgaaa

SEQ ID NO: 48320 - DNA, 25 bp, S. cerevisiae
ggatctatcagagccgtactcgata

SEQ ID NO: 48321 - DNA, 25 bp, S. cerevisiae
ggaggtgaactctacttttacagat

SEQ ID NO: 48322 - DNA, 25 bp, S. cerevisiae
ggaggtaacaacgaatttgcacaat

SEQ ID NO: 48323 - DNA, 25 bp, S. cerevisiae
ggaggagatttaccacatctagtac

SEQ ID NO: 48324 - DNA, 25 bp, S. cerevisiae
ggaggaaaagcaacctgcatggcta

SEQ ID NO: 48325 - DNA, 25 bp, S. cerevisiae
ggatgctacactagaaccgggtgaa

SEQ ID NO: 48326 - DNA, 25 bp, S. cerevisiae
ggatgaagcatcaggaacgcccgat

SEQ ID NO: 48327 - DNA, 25 bp, S. cerevisiae
ggaggatgacattgacccactgcac

SEQ ID NO: 48328 - DNA, 25 bp, S. cerevisiae
ggagaagtgctaccagtactggcct

SEQ ID NO: 48329 - DNA, 25 bp, S. cerevisiae
ggagacattctaccaaaccaatctt

SEQ ID NO: 48330 - DNA, 25 bp, S. cerevisiae
ggatgttgatgacccattggcgcat

SEQ ID NO: 48331 - DNA, 25 bp, S. cerevisiae
ggatgttcagacactcatggcgcta

SEQ ID NO: 48332 - DNA, 25 bp, S. cerevisiae
ggatgtgcacgtttctgataagtca

SEQ ID NO: 48333 - DNA, 25 bp, S. cerevisiae
ggatgacatctcagtgggcgattta

SEQ ID NO: 48334 - DNA, 25 bp, S. cerevisiae
ggatgccatttctgctggtatctta

SEQ ID NO: 48335 - DNA, 25 bp, S. cerevisiae
ggatcctatggcaccaaccttgaag

SEQ ID NO: 48336 - DNA, 25 bp, S. cerevisiae
ggatgccttgaaaaacgcctgtaac

SEQ ID NO: 48337 - DNA, 25 bp, S. cerevisiae
ggagccattgatatcggcaccgtac

SEQ ID NO: 48338 - DNA, 25 bp, S. cerevisiae
ggagagttcacttagcctatatcag

SEQ ID NO: 48339 - DNA, 25 bp, S. cerevisiae
ggacctacccagatttaccgtagtg

SEQ ID NO: 48340 - DNA, 25 bp, S. cerevisiae
ggaccaacccgtgctttaggagagt

SEQ ID NO: 48341 - DNA, 25 bp, S. cerevisiae
ggagaaactggaccccaacaatatt

SEQ ID NO: 48342 - DNA, 25 bp, S. cerevisiae
ggatgattccttaccactacaagat

SEQ ID NO: 48343 - DNA, 25 bp, S. cerevisiae
ggagttcactacaccaaaatcatat

SEQ ID NO: 48344 - DNA, 25 bp, S. cerevisiae
ggagaccaggaaccgcaagctagtt

SEQ ID NO: 48345 - DNA, 25 bp, S. cerevisiae
ggagagaagtgactacccctatgcc

SEQ ID NO: 48346 - DNA, 25 bp, S. cerevisiae
ggaagcgcagagaaacccctacgga

SEQ ID NO: 48347 - DNA, 25 bp, S. cerevisiae
ggagattatagatacccacgactgg

SEQ ID NO: 48348 - DNA, 25 bp, S. cerevisiae
ggagtatatcaaaaacccggctgta

SEQ ID NO: 48349 - DNA, 25 bp, S. cerevisiae
ggatcgtatcgtttcacagttacta

SEQ ID NO: 48350 - DNA, 25 bp, S. cerevisiae
ggatcctgacctaacgacttttgtt

SEQ ID NO: 48351 - DNA, 25 bp, S. cerevisiae
ggagacataccaaagtactctcttg

SEQ ID NO: 48352 - DNA, 25 bp, S. cerevisiae
ggatggattccatagatcaccattt

SEQ ID NO: 48353 - DNA, 25 bp, S. cerevisiae
ggaggaatcgtcgagaccaccatta

SEQ ID NO: 48354 - DNA, 25 bp, S. cerevisiae
ggagtaagggccaacttcaccggat

SEQ ID NO: 48355 - DNA, 25 bp, S. cerevisiae
ggagtaactttgaaattgcccgcgt

SEQ ID NO: 48356 - DNA, 25 bp, S. cerevisiae
ggagaagccgttaactcgctagcca

SEQ ID NO: 48357 - DNA, 25 bp, S. cerevisiae
ggatgttcctaaacccgttctgaat

SEQ ID NO: 48358 - DNA, 25 bp, S. cerevisiae
ggagtttgaaattcccgctatcgaa

SEQ ID NO: 48359 - DNA, 25 bp, S. cerevisiae
ggagagtttgaattcaccgctttta

SEQ ID NO: 48360 - DNA, 25 bp, S. cerevisiae
ggatgacacctatcaactctgtgtt

SEQ ID NO: 48361 - DNA, 25 bp, S. cerevisiae
ggatccacctcacaaatctctgata

SEQ ID NO: 48362 - DNA, 25 bp, S. cerevisiae
ggatccacgcccaataaatctacaa

SEQ ID NO: 48363 - DNA, 25 bp, S. cerevisiae
ggagttacccacaaacacagcagat

SEQ ID NO: 48364 - DNA, 25 bp, S. cerevisiae
tggagttttactacccaccagtcaa

SEQ ID NO: 48365 - DNA, 25 bp, S. cerevisiae
ggatgctgtggctccaggacagacc

SEQ ID NO: 48366 - DNA, 25 bp, S. cerevisiae
ggatgcactggcttcaagggcatat

SEQ ID NO: 48367 - DNA, 25 bp, S. cerevisiae
ggatcctgtgctacatgatgtgttc

SEQ ID NO: 48368 - DNA, 25 bp, S. cerevisiae
ggatccgccgtattatttcgacgaa

SEQ ID NO: 48369 - DNA, 25 bp, S. cerevisiae
ggatcctgggaagttctcgacaaga

SEQ ID NO: 48370 - DNA, 25 bp, S. cerevisiae
ggatcctaacggtcatatggccaca

SEQ ID NO: 48371 - DNA, 25 bp, S. cerevisiae
ggaggtaacgacgtcccatttggca

SEQ ID NO: 48372 - DNA, 25 bp, S. cerevisiae
ggcggtaacgacttccagcaacaaa

SEQ ID NO: 48373 - DNA, 25 bp, S. cerevisiae
ggagtcaaacttttacgttcacaat

SEQ ID NO: 48374 - DNA, 25 bp, S. cerevisiae
ggagacaacttttacgccaatcaca

SEQ ID NO: 48375 - DNA, 25 bp, S. cerevisiae
ggagcaaagtttcatctgccttcaa

SEQ ID NO: 48376 - DNA, 25 bp, S. cerevisiae
ggagacaggtttcttggtgcttaaa

SEQ ID NO: 48377 - DNA, 25 bp, S. cerevisiae
ggaccccatttgatggtacttccat

SEQ ID NO: 48378 - DNA, 25 bp, S. cerevisiae
ggagttttggtgtgctaatctatga

SEQ ID NO: 48379 - DNA, 25 bp, S. cerevisiae
ggagtttatgaatggccaacgatac

SEQ ID NO: 48380 - DNA, 25 bp, S. cerevisiae
ggatgcttccacaccagagaactgg

SEQ ID NO: 48381 - DNA, 25 bp, S. cerevisiae
ggatgtgtgcccatcaacaacttga

SEQ ID NO: 48382 - DNA, 25 bp, S. cerevisiae
ggatgagtcctcattgcctgaattc

SEQ ID NO: 48383 - DNA, 25 bp, S. cerevisiae
ggatggttctgccatttctgcagac

SEQ ID NO: 48384 - DNA, 25 bp, S. cerevisiae
ggatgagttcgccattacatagatt

SEQ ID NO: 48385 - DNA, 25 bp, S. cerevisiae
ggaggctccatcgtttcaattgctg

SEQ ID NO: 48386 - DNA, 25 bp, S. cerevisiae
ggatgacagccacaacataatcgat

SEQ ID NO: 48387 - DNA, 25 bp, S. cerevisiae
ggagactcatactcaggtatcgtac

SEQ ID NO: 48388 - DNA, 25 bp, S. cerevisiae
ggaggttatcgctattgtcacacat

SEQ ID NO: 48389 - DNA, 25 bp, S. cerevisiae
ggatgcagtccttctcaatgacaat

SEQ ID NO: 48390 - DNA, 25 bp, S. cerevisiae
ggatgcattcttttcattgaagtcg

SEQ ID NO: 48391 - DNA, 25 bp, S. cerevisiae
ggagatgtcttccagttgactgtca

SEQ ID NO: 48392 - DNA, 25 bp, S. cerevisiae
tgggcccaatttccaacttggtcaa

SEQ ID NO: 48393 - DNA, 25 bp, S. cerevisiae
ggacctacgggtcaggctgaatcaa

SEQ ID NO: 48394 - DNA, 25 bp, S. cerevisiae
tcttcgactcaaaaattacgccctc

SEQ ID NO: 48395 - DNA, 25 bp, S. cerevisiae
tgaacgttgctatacagtttccttt

SEQ ID NO: 48396 - DNA, 25 bp, S. cerevisiae
ggatgcgtttactagcgtttctcat

SEQ ID NO: 48397 - DNA, 25 bp, S. cerevisiae
ggacgcctttaaactgatattgccg

SEQ ID NO: 48398 - DNA, 25 bp, S. cerevisiae
ggaggccatttacggaaattctgca

SEQ ID NO: 48399 - DNA, 25 bp, S. cerevisiae
ggatgtcatgttttcaatacttctt

SEQ ID NO: 48400 - DNA, 25 bp, S. cerevisiae
ggatgtatttgctcctgaagatcta

SEQ ID NO: 48401 - DNA, 25 bp, S. cerevisiae
ggagcataagttcccgcaaattaaa

SEQ ID NO: 48402 - DNA, 25 bp, S. cerevisiae
ggatccactgttcccgataaaacaa

SEQ ID NO: 48403 - DNA, 25 bp, S. cerevisiae
ggaccgcgccctcatgggaaataga

SEQ ID NO: 48404 - DNA, 25 bp, S. cerevisiae
ggaccacctccagaaagcggatcga

SEQ ID NO: 48405 - DNA, 25 bp, S. cerevisiae
tggaccccaactgtaaggagccttt

SEQ ID NO: 48406 - DNA, 25 bp, S. cerevisiae
ggaggcccaagtatttggactctgt

SEQ ID NO: 48407 - DNA, 25 bp, S. cerevisiae
ggaccaccaaagagctattcctttc

SEQ ID NO: 48408 - DNA, 25 bp, S. cerevisiae
ggacaaacctaagccatgttgcgtt

SEQ ID NO: 48409 - DNA, 25 bp, S. cerevisiae
ggagtcactgccaaaaaatttcgtt

SEQ ID NO: 48410 - DNA, 25 bp, S. cerevisiae
ggatgattctcaaacttcttctgaa

SEQ ID NO: 48411 - DNA, 25 bp, S. cerevisiae
ggatgatcccagaagctccttagat

SEQ ID NO: 48412 - DNA, 25 bp, S. cerevisiae
ggatgtcctggctaagttgatcatt

SEQ ID NO: 48413 - DNA, 25 bp, S. cerevisiae
ggatgttcccaagtgtctcatatca

SEQ ID NO: 48414 - DNA, 25 bp, S. cerevisiae
ggagttaccacacgttgtgtccgac

SEQ ID NO: 48415 - DNA, 25 bp, S. cerevisiae
ggatgagattcccacttgttttcaa

SEQ ID NO: 48416 - DNA, 25 bp, S. cerevisiae
ggatgctcttgaatactgtggttta

SEQ ID NO: 48417 - DNA, 25 bp, S. cerevisiae
ggatgcttcattgaccgtgggacag

SEQ ID NO: 48418 - DNA, 25 bp, S. cerevisiae
ggatgctacattcaacgagccgcaa

SEQ ID NO: 48419 - DNA, 25 bp, S. cerevisiae
ggatgtacttgctaagcaccggcta

SEQ ID NO: 48420 - DNA, 25 bp, S. cerevisiae
ggatgattttcatgaccccattcac

SEQ ID NO: 48421 - DNA, 25 bp, S. cerevisiae
ggagtcttgtgctgattccaattca

SEQ ID NO: 48422 - DNA, 25 bp, S. cerevisiae
ggagacggcttcgattacacatttg

SEQ ID NO: 48423 - DNA, 25 bp, S. cerevisiae
ggaggctcctatagaaacatcattt

SEQ ID NO: 48424 - DNA, 25 bp, S. cerevisiae
ggagtacaataacaaccgcatagaa

SEQ ID NO: 48425 - DNA, 25 bp, S. cerevisiae
ggagatccataccttcaaataaaat

SEQ ID NO: 48426 - DNA, 25 bp, S. cerevisiae
ggagtccttcaccaagaacgaactg

SEQ ID NO: 48427 - DNA, 25 bp, S. cerevisiae
ggagtccacggatcagtccattgaa

SEQ ID NO: 48428 - DNA, 25 bp, S. cerevisiae
ggagtccaagacttttgcacaggaa

SEQ ID NO: 48429 - DNA, 25 bp, S. cerevisiae
ggagattcatggtaccagacacaat

SEQ ID NO: 48430 - DNA, 25 bp, S. cerevisiae
ggatgctaactctccaacaagacat

SEQ ID NO: 48431 - DNA, 25 bp, S. cerevisiae
ggatgatacaccttacactagagaa

SEQ ID NO: 48432 - DNA, 25 bp, S. cerevisiae
ggatggcgtcacatcttctgaagaa

SEQ ID NO: 48433 - DNA, 25 bp, S. cerevisiae
ggatggcccgcattctacgaagagg

SEQ ID NO: 48434 - DNA, 25 bp, S. cerevisiae
ggatgccccagctgctatcagaact

SEQ ID NO: 48435 - DNA, 25 bp, S. cerevisiae
ggatgctactattcctacgaatgag

SEQ ID NO: 48436 - DNA, 25 bp, S. cerevisiae
ggagatagttttccgcacgtgaccg

SEQ ID NO: 48437 - DNA, 25 bp, S. cerevisiae
ggagttgacattgtatacttgccaa

SEQ ID NO: 48438 - DNA, 25 bp, S. cerevisiae
ggaggctttagatttcttcgccaga

SEQ ID NO: 48439 - DNA, 25 bp, S. cerevisiae
ggaggccatcgtggtcgccaagaaa

SEQ ID NO: 48440 - DNA, 25 bp, S. cerevisiae
ggaggcaaggtgttcccattgaaat

SEQ ID NO: 48441 - DNA, 25 bp, S. cerevisiae
ggaggcaattatcacccactgacaa

SEQ ID NO: 48442 - DNA, 25 bp, S. cerevisiae
ggatggaactatttccccatacaaa

SEQ ID NO: 48443 - DNA, 25 bp, S. cerevisiae
ggagtattctccgacaatcaaacca

SEQ ID NO: 48444 - DNA, 25 bp, S. cerevisiae
ggaaagtctttcgaggaaacctatg

SEQ ID NO: 48445 - DNA, 25 bp, S. cerevisiae
ggagacgtcgatttgaaaccaggaa

SEQ ID NO: 48446 - DNA, 25 bp, S. cerevisiae
ggacacttcgattttatggccaaag

SEQ ID NO: 48447 - DNA, 25 bp, S. cerevisiae
ggacgccacggatattttcagaaaa

SEQ ID NO: 48448 - DNA, 25 bp, S. cerevisiae
ggacgtaccgttattctcaacgaat

SEQ ID NO: 48449 - DNA, 25 bp, S. cerevisiae
ggagattagacctaccgtcgtcaag

SEQ ID NO: 48450 - DNA, 25 bp, S. cerevisiae
ggatgatttacgtctgcaatctcag

SEQ ID NO: 48451 - DNA, 25 bp, S. cerevisiae
ggatgcagtacatactctgaccaat

SEQ ID NO: 48452 - DNA, 25 bp, S. cerevisiae
ggaggcttctagagcatccgctaag

SEQ ID NO: 48453 - DNA, 25 bp, S. cerevisiae
ggagtctttagcaagttcggcaaat

SEQ ID NO: 48454 - DNA, 25 bp, S. cerevisiae
ggagttgaaaccttgctagatattt

SEQ ID NO: 48455 - DNA, 25 bp, S. cerevisiae
tgaagggtaccgttgcttattttgt

SEQ ID NO: 48456 - DNA, 25 bp, S. cerevisiae
ggagggaacttgatcctatttcttt

SEQ ID NO: 48457 - DNA, 25 bp, S. cerevisiae
ggatgtaaccttgctgttgacttaa

SEQ ID NO: 48458 - DNA, 25 bp, S. cerevisiae
ggagaagaccgtgccttactggaaa

SEQ ID NO: 48459 - DNA, 25 bp, S. cerevisiae
ggaaaacctttgctatatgccgaaa

SEQ ID NO: 48460 - DNA, 25 bp, S. cerevisiae
ggactacgcctgatggtaaactgat

SEQ ID NO: 48461 - DNA, 25 bp, S. cerevisiae
ggagtgcagccagaggttccaactt

SEQ ID NO: 48462 - DNA, 25 bp, S. cerevisiae
ggagtctgccaagagtttcattcta

SEQ ID NO: 48463 - DNA, 25 bp, S. cerevisiae
ggcagcttccacaaatttatcgtcg

SEQ ID NO: 48464 - DNA, 25 bp, S. cerevisiae
ggagattcacaaccaatttcagtcg

SEQ ID NO: 48465 - DNA, 25 bp, S. cerevisiae
ggaggatctttccatcgtgactgga

SEQ ID NO: 48466 - DNA, 25 bp, S. cerevisiae
ggagcttttgatccacaggacgctg

SEQ ID NO: 48467 - DNA, 25 bp, S. cerevisiae
ggagcttatggattccgtggccagt

SEQ ID NO: 48468 - DNA, 25 bp, S. cerevisiae
ggagtacaggatacgcgaagccaat

SEQ ID NO: 48469 - DNA, 25 bp, S. cerevisiae
ggatgataaatttctcttcgtgcga

SEQ ID NO: 48470 - DNA, 25 bp, S. cerevisiae
ggatgtttccgtctttagaacacaa

SEQ ID NO: 48471 - DNA, 25 bp, S. cerevisiae
ggatgtttcgctttgtttgcaactc

SEQ ID NO: 48472 - DNA, 25 bp, S. cerevisiae
ggatgtctctatgcaagatttggtt

SEQ ID NO: 48473 - DNA, 25 bp, S. cerevisiae
ggatgatgtcgattctttctcattt

SEQ ID NO: 48474 - DNA, 25 bp, S. cerevisiae
ggctggtgcagatcctttcttaggg

SEQ ID NO: 48475 - DNA, 25 bp, S. cerevisiae
ggatgggcaatcttctttcattatc

SEQ ID NO: 48476 - DNA, 25 bp, S. cerevisiae
ggacggtaattctccagaatctgtt

SEQ ID NO: 48477 - DNA, 25 bp, S. cerevisiae
ggacggtccttcttcgaaaggtgca

SEQ ID NO: 48478 - DNA, 25 bp, S. cerevisiae
ggacggtccttcttcgaaaggtgca

SEQ ID NO: 48479 - DNA, 25 bp, S. cerevisiae
ggaccgtgtcttgctcgaaactatg

SEQ ID NO: 48480 - DNA, 25 bp, S. cerevisiae
ggacgccagttagatccaaacttgg

SEQ ID NO: 48481 - DNA, 25 bp, S. cerevisiae
ggaggccagcgttaattgacaatct

SEQ ID NO: 48482 - DNA, 25 bp, S. cerevisiae
ggatgatccgtttactaggaagcta

SEQ ID NO: 48483 - DNA, 25 bp, S. cerevisiae
tggcgacttccaaagcgaaacgagt

SEQ ID NO: 48484 - DNA, 25 bp, S. cerevisiae
ggatgttgcctccaacggaattgta

SEQ ID NO: 48485 - DNA, 25 bp, S. cerevisiae
ggaggaacgctttaacagcactcat

SEQ ID NO: 48486 - DNA, 25 bp, S. cerevisiae
ggcggacagctcaagttccacagga

SEQ ID NO: 48487 - DNA, 25 bp, S. cerevisiae
ggagagcatactaagcattggccag

SEQ ID NO: 48488 - DNA, 25 bp, S. cerevisiae
ggatgagaactgctgcattgcccaa

SEQ ID NO: 48489 - DNA, 25 bp, S. cerevisiae
ggaggaggtccttgatgacacaaaa

SEQ ID NO: 48490 - DNA, 25 bp, S. cerevisiae
ggatgtcaccccagagcaaatagaa

SEQ ID NO: 48491 - DNA, 25 bp, S. cerevisiae
ggaggctctgcagacatttatcaag

SEQ ID NO: 48492 - DNA, 25 bp, S. cerevisiae
ggagtctccagatctgcaacagttt

SEQ ID NO: 48493 - DNA, 25 bp, S. cerevisiae
ggagctgcccgcacagaagagtact

SEQ ID NO: 48494 - DNA, 25 bp, S. cerevisiae
ggacgccccatttgagaatgacctt

SEQ ID NO: 48495 - DNA, 25 bp, S. cerevisiae
ggacgattcaatacgggatgactca

SEQ ID NO: 48496 - DNA, 25 bp, S. cerevisiae
ggatggccagatactttttgcacag

SEQ ID NO: 48497 - DNA, 25 bp, S. cerevisiae
ggatggccattaatctttcccatat

SEQ ID NO: 48498 - DNA, 25 bp, S. cerevisiae
ggaacttttgtcctttccatgatgc

SEQ ID NO: 48499 - DNA, 25 bp, S. cerevisiae
ggagtcatatttgccgttttatcat

SEQ ID NO: 48500 - DNA, 25 bp, S. cerevisiae
ggaggtcttctattgaatgcttttc

SEQ ID NO: 48501 - DNA, 25 bp, S. cerevisiae
ggaggctcattaagcaagctcgttt

SEQ ID NO: 48502 - DNA, 25 bp, S. cerevisiae
ggaggccggaaacgctattgttatc

SEQ ID NO: 48503 - DNA, 25 bp, S. cerevisiae
ggacgattggacacattatacttgc

SEQ ID NO: 48504 - DNA, 25 bp, S. cerevisiae
ggaggatctttcatccattcattgg

SEQ ID NO: 48505 - DNA, 25 bp, S. cerevisiae
ggactgctcttgtggccaaatggat

SEQ ID NO: 48506 - DNA, 25 bp, S. cerevisiae
ggagatgcctttcgatgccaaataa

SEQ ID NO: 48507 - DNA, 25 bp, S. cerevisiae
ggaggccatattctccaagaattat

SEQ ID NO: 48508 - DNA, 25 bp, S. cerevisiae
ggacccgttgagacacggcgattat

SEQ ID NO: 48509 - DNA, 25 bp, S. cerevisiae
ggaccctagggctacaatcgattta

SEQ ID NO: 48510 - DNA, 25 bp, S. cerevisiae
ggaatcccagggtatccatggttac

SEQ ID NO: 48511 - DNA, 25 bp, S. cerevisiae
tggagactccaacttacgggttccg

SEQ ID NO: 48512 - DNA, 25 bp, S. cerevisiae
ggagcacttcaacaccgaggatttt

SEQ ID NO: 48513 - DNA, 25 bp, S. cerevisiae
ggagcatgttgttacccagttattt

SEQ ID NO: 48514 - DNA, 25 bp, S. cerevisiae
ggatgttctggaatcccatctggat

SEQ ID NO: 48515 - DNA, 25 bp, S. cerevisiae
ggatgttccgctactacttgaatga

SEQ ID NO: 48516 - DNA, 25 bp, S. cerevisiae
ggatgtttcctgatgcgttcaatga

SEQ ID NO: 48517 - DNA, 25 bp, S. cerevisiae
ggagtcgttcgtctatcaaatatta

SEQ ID NO: 48518 - DNA, 25 bp, S. cerevisiae
ggagagtcaggccttccttattaac

SEQ ID NO: 48519 - DNA, 25 bp, S. cerevisiae
ggaggctcaatcctgctagttacta

SEQ ID NO: 48520 - DNA, 25 bp, S. cerevisiae
ggagtctttacgagttcatacattt

SEQ ID NO: 48521 - DNA, 25 bp, S. cerevisiae
ggagtccattgcgaacttacaacat

SEQ ID NO: 48522 - DNA, 25 bp, S. cerevisiae
ggagttcgtcaagggtatcagcaga

SEQ ID NO: 48523 - DNA, 25 bp, S. cerevisiae
tgggtttgaaaccattcctaacatc

SEQ ID NO: 48524 - DNA, 25 bp, S. cerevisiae
ggagtatctcacacgttatgtcgct

SEQ ID NO: 48525 - DNA, 25 bp, S. cerevisiae
ggatggattctaactttatgctttc

SEQ ID NO: 48526 - DNA, 25 bp, S. cerevisiae
ggagttctgatctttttggtttcta

SEQ ID NO: 48527 - DNA, 25 bp, S. cerevisiae
ggatggttctagattcggtattcaa

SEQ ID NO: 48528 - DNA, 25 bp, S. cerevisiae
ggacgattccgagttaggctggtat

SEQ ID NO: 48529 - DNA, 25 bp, S. cerevisiae
ggactcatttcctattttccatgtg

SEQ ID NO: 48530 - DNA, 25 bp, S. cerevisiae
ggacttacttcgactttttgatggg

SEQ ID NO: 48531 - DNA, 25 bp, S. cerevisiae
ggagattaatgttcaattgctattg

SEQ ID NO: 48532 - DNA, 25 bp, S. cerevisiae
ggacctaaggtctgtgctgcatgat

SEQ ID NO: 48533 - DNA, 25 bp, S. cerevisiae
ggcacctaaggagctcatgttacag

SEQ ID NO: 48534 - DNA, 25 bp, S. cerevisiae
ggacaccctaacgtgcgttgcacag

SEQ ID NO: 48535 - DNA, 25 bp, S. cerevisiae
ggagaccatcaaccggctttgaaga

SEQ ID NO: 48536 - DNA, 25 bp, S. cerevisiae
ggagactaatgaacttggcaatcgt

SEQ ID NO: 48537 - DNA, 25 bp, S. cerevisiae
ggagattacgaacttcagtgacgat

SEQ ID NO: 48538 - DNA, 25 bp, S. cerevisiae
taagccttcaattaatggagtaaac

SEQ ID NO: 48539 - DNA, 25 bp, S. cerevisiae
tggaggcatttttaaggaaagaaca

SEQ ID NO: 48540 - DNA, 25 bp, S. cerevisiae
ggagtttctattttggcgaaggcca

SEQ ID NO: 48541 - DNA, 25 bp, S. cerevisiae
ggagcgctgcgttagcattaattga

SEQ ID NO: 48542 - DNA, 25 bp, S. cerevisiae
ggaggcatggacttcagccaaatga

SEQ ID NO: 48543 - DNA, 25 bp, S. cerevisiae
ggaaatgcgcgttcaccaggatagc

SEQ ID NO: 48544 - DNA, 25 bp, S. cerevisiae
ggagataccccgttctgttgaaaga

SEQ ID NO: 48545 - DNA, 25 bp, S. cerevisiae
ggagtgacaccgcaggatttgcaaa

SEQ ID NO: 48546 - DNA, 25 bp, S. cerevisiae
ggagggccctgaatcccattatgaa

SEQ ID NO: 48547 - DNA, 25 bp, S. cerevisiae
ggaggccccaatggcagcagttata

SEQ ID NO: 48548 - DNA, 25 bp, S. cerevisiae
ggaggcgcgctatccaaattacaaa

SEQ ID NO: 48549 - DNA, 25 bp, S. cerevisiae
ggagactccgatccctttttggaag

SEQ ID NO: 48550 - DNA, 25 bp, S. cerevisiae
ggagccgttaccgtatgtaccagaa

SEQ ID NO: 48551 - DNA, 25 bp, S. cerevisiae
ggaacagagtttactttactcgaag

SEQ ID NO: 48552 - DNA, 25 bp, S. cerevisiae
ggagctcggttgtttcttttgccaa

SEQ ID NO: 48553 - DNA, 25 bp, S. cerevisiae
ggagattcttccttatttttgcgaa

SEQ ID NO: 48554 - DNA, 25 bp, S. cerevisiae
ggagttgttgcgatgatgtatttaa

SEQ ID NO: 48555 - DNA, 25 bp, S. cerevisiae
ggaggcaacggtatttctttctaca

SEQ ID NO: 48556 - DNA, 25 bp, S. cerevisiae
ggaggcaacggtactgtcttgtcag

SEQ ID NO: 48557 - DNA, 25 bp, S. cerevisiae
ggagaagaactcactgccattgcca

SEQ ID NO: 48558 - DNA, 25 bp, S. cerevisiae
ggagaagaaccaagatgaacatcta

SEQ ID NO: 48559 - DNA, 25 bp, S. cerevisiae
ggagattattccaatgagccgttca

SEQ ID NO: 48560 - DNA, 25 bp, S. cerevisiae
ggagcaattttctgtcccatacctt

SEQ ID NO: 48561 - DNA, 25 bp, S. cerevisiae
ggactgtctagttatccctaaggaa

SEQ ID NO: 48562 - DNA, 25 bp, S. cerevisiae
ggaccatgtatttttccgctctaaa

SEQ ID NO: 48563 - DNA, 25 bp, S. cerevisiae
ggagtggttttgttccagcattgaa

SEQ ID NO: 48564 - DNA, 25 bp, S. cerevisiae
ggaggaaactttaatctgcccaatt

SEQ ID NO: 48565 - DNA, 25 bp, S. cerevisiae
ggagaattttccatactgccacagt

SEQ ID NO: 48566 - DNA, 25 bp, S. cerevisiae
ggagaagtattggttctggcccaat

SEQ ID NO: 48567 - DNA, 25 bp, S. cerevisiae
ggagtttattaattctctgccgaac

SEQ ID NO: 48568 - DNA, 25 bp, S. cerevisiae
ggaggttatttcttctcaacaatac

SEQ ID NO: 48569 - DNA, 25 bp, S. cerevisiae
ggaggaaatatttcgccccatgtcc

SEQ ID NO: 48570 - DNA, 25 bp, S. cerevisiae
ggagaaggaatcaaagccccatttt

SEQ ID NO: 48571 - DNA, 25 bp, S. cerevisiae
ggagacttaatcactgcatcgacat

SEQ ID NO: 48572 - DNA, 25 bp, S. cerevisiae
ggagagttgctaaccatttgcccaa

SEQ ID NO: 48573 - DNA, 25 bp, S. cerevisiae
ggaggatcattcatcatattccaat

SEQ ID NO: 48574 - DNA, 25 bp, S. cerevisiae
ggacgaaattactactgcatgggac

SEQ ID NO: 48575 - DNA, 25 bp, S. cerevisiae
ggactagacatgctcaacgcgtgta

SEQ ID NO: 48576 - DNA, 25 bp, S. cerevisiae
ggaccaacagttgcgtgcggaaaaa

SEQ ID NO: 48577 - DNA, 25 bp, S. cerevisiae
ggaccccatccaggctttggaaaag

SEQ ID NO: 48578 - DNA, 25 bp, S. cerevisiae
ggacgataatccattagtggcaaaa

SEQ ID NO: 48579 - DNA, 25 bp, S. cerevisiae
ggaggagcaacacccactggaaagt

SEQ ID NO: 48580 - DNA, 25 bp, S. cerevisiae
ggagatgagacctgccactggaaat

SEQ ID NO: 48581 - DNA, 25 bp, S. cerevisiae
ggaggagaccaaagcagcgtatttc

SEQ ID NO: 48582 - DNA, 25 bp, S. cerevisiae
ggagcggtccacagcatggtcatta

SEQ ID NO: 48583 - DNA, 25 bp, S. cerevisiae
ggaggtcatttcaaaagtcatcaaa

SEQ ID NO: 48584 - DNA, 25 bp, S. cerevisiae
ggaggtgatcttcctatagaccaaa

SEQ ID NO: 48585 - DNA, 25 bp, S. cerevisiae
ggaggagtcggccattccaatacct

SEQ ID NO: 48586 - DNA, 25 bp, S. cerevisiae
ggagatcgaccgcatcttcaaacgg

SEQ ID NO: 48587 - DNA, 25 bp, S. cerevisiae
ggagcccctctgaacctaaatgcgg

SEQ ID NO: 48588 - DNA, 25 bp, S. cerevisiae
ggagatcacaacgaacccacaatag

SEQ ID NO: 48589 - DNA, 25 bp, S. cerevisiae
ggagacccaggaacaacagcatatg

SEQ ID NO: 48590 - DNA, 25 bp, S. cerevisiae
ggaagaccaaactgcacaaaggcta

SEQ ID NO: 48591 - DNA, 25 bp, S. cerevisiae
ggaggagcccaagccatcaaaggat

SEQ ID NO: 48592 - DNA, 25 bp, S. cerevisiae
ggagagtcatccacatacaaacatt

SEQ ID NO: 48593 - DNA, 25 bp, S. cerevisiae
ggaggtgtcatctctaacactgttt

SEQ ID NO: 48594 - DNA, 25 bp, S. cerevisiae
ggacggcatctttacaaactttagc

SEQ ID NO: 48595 - DNA, 25 bp, S. cerevisiae
ggacggcatgcaagaccagtcaagt

SEQ ID NO: 48596 - DNA, 25 bp, S. cerevisiae
ggagctgtatgaaaccgccatgcaa

SEQ ID NO: 48597 - DNA, 25 bp, S. cerevisiae
ggagtctgatcaactacgcaagcaa

SEQ ID NO: 48598 - DNA, 25 bp, S. cerevisiae
ggagtctgacttaaacaatgctgca

SEQ ID NO: 48599 - DNA, 25 bp, S. cerevisiae
ggagattcctataaccacagctgca

SEQ ID NO: 48600 - DNA, 25 bp, S. cerevisiae
ggagtccctcagttgctcataatga

SEQ ID NO: 48601 - DNA, 25 bp, S. cerevisiae
ggaggagtccagtcatgtgcagcaa

SEQ ID NO: 48602 - DNA, 25 bp, S. cerevisiae
ggagccacttgccaaatgatgatga

SEQ ID NO: 48603 - DNA, 25 bp, S. cerevisiae
ggagcccgatgccaaatattctata

SEQ ID NO: 48604 - DNA, 25 bp, S. cerevisiae
ggaggagcgggatacatgcatctta

SEQ ID NO: 48605 - DNA, 25 bp, S. cerevisiae
ggaggaggacgatcaatgcatgttc

SEQ ID NO: 48606 - DNA, 25 bp, S. cerevisiae
ggagccaagacgtcaaagctttcca

SEQ ID NO: 48607 - DNA, 25 bp, S. cerevisiae
ggaccagatcagcacaatttttcaa

SEQ ID NO: 48608 - DNA, 25 bp, S. cerevisiae
ggagcgaatcagacgccagtctttc

SEQ ID NO: 48609 - DNA, 25 bp, S. cerevisiae
ggagcgtcaaacacgtcagcttcaa

SEQ ID NO: 48610 - DNA, 25 bp, S. cerevisiae
ggagagcttcatcctcgtttttaaa

SEQ ID NO: 48611 - DNA, 25 bp, S. cerevisiae
ggagtgtattccacgtactttgata

SEQ ID NO: 48612 - DNA, 25 bp, S. cerevisiae
ggagatcaatcccttcgtttttgaa

SEQ ID NO: 48613 - DNA, 25 bp, S. cerevisiae
ggagtctcaccagatttctttaagc

SEQ ID NO: 48614 - DNA, 25 bp, S. cerevisiae
ggagatcactgccttaagttatgca

SEQ ID NO: 48615 - DNA, 25 bp, S. cerevisiae
ggagtaccaatccaagattatcgtt

SEQ ID NO: 48616 - DNA, 25 bp, S. cerevisiae
ggaaatccacacttaacgatggcat

SEQ ID NO: 48617 - DNA, 25 bp, S. cerevisiae
ggagaaccctcatgaacaagtgcag

SEQ ID NO: 48618 - DNA, 25 bp, S. cerevisiae
ggagacctccttcaatgaaccaaac

SEQ ID NO: 48619 - DNA, 25 bp, S. cerevisiae
ggcaagaactgcaccaaacgactat

SEQ ID NO: 48620 - DNA, 25 bp, S. cerevisiae
tggaaatacgaactcaaccccgact

SEQ ID NO: 48621 - DNA, 25 bp, S. cerevisiae
ggcaaatgaagatccagaccccgct

SEQ ID NO: 48622 - DNA, 25 bp, S. cerevisiae
ggagtatgaagctactatccccact

SEQ ID NO: 48623 - DNA, 25 bp, S. cerevisiae
ggagttgtctgcaaaacccacacgt

SEQ ID NO: 48624 - DNA, 25 bp, S. cerevisiae
ggacattagcgcaaacactaccacc

SEQ ID NO: 48625 - DNA, 25 bp, S. cerevisiae
ggactggcgggaatcattaccacac

SEQ ID NO: 48626 - DNA, 25 bp, S. cerevisiae
ggagtaatagtcatcgaaccttttt

SEQ ID NO: 48627 - DNA, 25 bp, S. cerevisiae
ggagaattttgcatgctaactcttt

SEQ ID NO: 48628 - DNA, 25 bp, S. cerevisiae
ggagcttttacataaggccccgatt

SEQ ID NO: 48629 - DNA, 25 bp, S. cerevisiae
ggacaggtcgaagactccatcccat

SEQ ID NO: 48630 - DNA, 25 bp, S. cerevisiae
ggagggttgcacaaaatccttcaat

SEQ ID NO: 48631 - DNA, 25 bp, S. cerevisiae
ggagttcttgtcctagacggcatat

SEQ ID NO: 48632 - DNA, 25 bp, S. cerevisiae
ggagtcgctttcaagcatcaggcct

SEQ ID NO: 48633 - DNA, 25 bp, S. cerevisiae
ggagcacgttaaggcatctgcttga

SEQ ID NO: 48634 - DNA, 25 bp, S. cerevisiae
ggagcaatgcctttacaaacgtcat

SEQ ID NO: 48635 - DNA, 25 bp, S. cerevisiae
ggaggtggtccataaagcacttcaa

SEQ ID NO: 48636 - DNA, 25 bp, S. cerevisiae
ggagggaatctcaggacgcatcaac

SEQ ID NO: 48637 - DNA, 25 bp, S. cerevisiae
ggaccgcatgacgagtggacgctta

SEQ ID NO: 48638 - DNA, 25 bp, S. cerevisiae
ggagccggcagtggaatcaccttga

SEQ ID NO: 48639 - DNA, 25 bp, S. cerevisiae
ggagcccgcaagatctcaggttcgg

SEQ ID NO: 48640 - DNA, 25 bp, S. cerevisiae
ggaccatcgaaaacgggtgcccgct

SEQ ID NO: 48641 - DNA, 25 bp, S. cerevisiae
ggagttgcaatatgaccttcccgca

SEQ ID NO: 48642 - DNA, 25 bp, S. cerevisiae
ggacttgaagacaactttccctcag

SEQ ID NO: 48643 - DNA, 25 bp, S. cerevisiae
ggagttgcaagacattgccaaccca

SEQ ID NO: 48644 - DNA, 25 bp, S. cerevisiae
ggaattgcaagaggttgccaaccca

SEQ ID NO: 48645 - DNA, 25 bp, S. cerevisiae
tggagtcaatgacgcattctattgt

SEQ ID NO: 48646 - DNA, 25 bp, S. cerevisiae
tgtaggaagtctaccattttccctt

SEQ ID NO: 48647 - DNA, 25 bp, S. cerevisiae
ggcgaagaattgcaattttccctta

SEQ ID NO: 48648 - DNA, 25 bp, S. cerevisiae
ggctcaaattttctttggtcctaca

SEQ ID NO: 48649 - DNA, 25 bp, S. cerevisiae
ggactttcctaacttatactaccat

SEQ ID NO: 48650 - DNA, 25 bp, S. cerevisiae
ggagtttccgccaggatatggacct

SEQ ID NO: 48651 - DNA, 25 bp, S. cerevisiae
ggagtttacgcaattctgcaaggac

SEQ ID NO: 48652 - DNA, 25 bp, S. cerevisiae
ggagttccctacgatggccatttaa

SEQ ID NO: 48653 - DNA, 25 bp, S. cerevisiae
ggagtccctgtagatgtaattctta

SEQ ID NO: 48654 - DNA, 25 bp, S. cerevisiae
ggcatgcccggttacttaattgtta

SEQ ID NO: 48655 - DNA, 25 bp, S. cerevisiae
ggacccgtctaactctagtatcgat

SEQ ID NO: 48656 - DNA, 25 bp, S. cerevisiae
ggagatactctttccagtggtctag

SEQ ID NO: 48657 - DNA, 25 bp, S. cerevisiae
ggagagaccttgtctacggctataa

SEQ ID NO: 48658 - DNA, 25 bp, S. cerevisiae
ggagacccagttgagcgagcttgaa

SEQ ID NO: 48659 - DNA, 25 bp, S. cerevisiae
ggagaacccttggaagagtcagatc

SEQ ID NO: 48660 - DNA, 25 bp, S. cerevisiae
ggacgcgtcactaccaaaggcagat

SEQ ID NO: 48661 - DNA, 25 bp, S. cerevisiae
ggagagttcactaccaatcagttac

SEQ ID NO: 48662 - DNA, 25 bp, S. cerevisiae
ggacggtatgtttgctatgccaggc

SEQ ID NO: 48663 - DNA, 25 bp, S. cerevisiae
ggactggatcattcaattcgaccct

SEQ ID NO: 48664 - DNA, 25 bp, S. cerevisiae
ggacggtcttcatttacagtatgcc

SEQ ID NO: 48665 - DNA, 25 bp, S. cerevisiae
ggagggctccattaaagctcttaga

SEQ ID NO: 48666 - DNA, 25 bp, S. cerevisiae
ggagtggcctttcaaaccagatatt

SEQ ID NO: 48667 - DNA, 25 bp, S. cerevisiae
ggaatctaccggcaagttcgtctta

SEQ ID NO: 48668 - DNA, 25 bp, S. cerevisiae
ggccgcctacggaagaagtttccat

SEQ ID NO: 48669 - DNA, 25 bp, S. cerevisiae
ggactcccacgaatacaaggttgaa

SEQ ID NO: 48670 - DNA, 25 bp, S. cerevisiae
ggacccaacctctaaggctggtgaa

SEQ ID NO: 48671 - DNA, 25 bp, S. cerevisiae
ggagcctattcatatagacctggga

SEQ ID NO: 48672 - DNA, 25 bp, S. cerevisiae
ggacgctgattgtgtcatatcgcat

SEQ ID NO: 48673 - DNA, 25 bp, S. cerevisiae
ggagctcaagttttctgatatcatt

SEQ ID NO: 48674 - DNA, 25 bp, S. cerevisiae
ggagttatataacgccactttggct

SEQ ID NO: 48675 - DNA, 25 bp, S. cerevisiae
ggagacattattttccagccaccac

SEQ ID NO: 48676 - DNA, 25 bp, S. cerevisiae
ggagcaatgaacaactagcccagtt

SEQ ID NO: 48677 - DNA, 25 bp, S. cerevisiae
ggctccgacctactaggtactttag

SEQ ID NO: 48678 - DNA, 25 bp, S. cerevisiae
ggcctccgacttcgaggtatttcta

SEQ ID NO: 48679 - DNA, 25 bp, S. cerevisiae
ggaccggaactgcttatttaatgaa

SEQ ID NO: 48680 - DNA, 25 bp, S. cerevisiae
ggaccggaacttgttggatcttcaa

SEQ ID NO: 48681 - DNA, 25 bp, S. cerevisiae
ggacccagcatgtgttattgcttag

SEQ ID NO: 48682 - DNA, 25 bp, S. cerevisiae
ggagtcatcaccttctaattctata

SEQ ID NO: 48683 - DNA, 25 bp, S. cerevisiae
ggactcgctagcacctaaaattcgt

SEQ ID NO: 48684 - DNA, 25 bp, S. cerevisiae
ggactccaggttcggctacatgaag

SEQ ID NO: 48685 - DNA, 25 bp, S. cerevisiae
ggagccaaccctgttacaaatataa

SEQ ID NO: 48686 - DNA, 25 bp, S. cerevisiae
ggacggacggtgtttacttcataca

SEQ ID NO: 48687 - DNA, 25 bp, S. cerevisiae
ggagcttctttaacctacgctataa

SEQ ID NO: 48688 - DNA, 25 bp, S. cerevisiae
ggagcttttggattccagccgaaaa

SEQ ID NO: 48689 - DNA, 25 bp, S. cerevisiae
ggagtttattcattcccgctgataa

SEQ ID NO: 48690 - DNA, 25 bp, S. cerevisiae
ggcagtttccaaggccaaaataggc

SEQ ID NO: 48691 - DNA, 25 bp, S. cerevisiae
ggagctttcggtgcccacaatgaac

SEQ ID NO: 48692 - DNA, 25 bp, S. cerevisiae
tggcctctacaacgattctcacaag

SEQ ID NO: 48693 - DNA, 25 bp, S. cerevisiae
ggagatttgccactgatttcatcaa

SEQ ID NO: 48694 - DNA, 25 bp, S. cerevisiae
ggagagcattccatagtctttgaag

SEQ ID NO: 48695 - DNA, 25 bp, S. cerevisiae
tggaagaccgaagacgccgtagaat

SEQ ID NO: 48696 - DNA, 25 bp, S. cerevisiae
ggaccagaccagacacgttcaattt

SEQ ID NO: 48697 - DNA, 25 bp, S. cerevisiae
ggacttaccagagcgtaccaagtta

SEQ ID NO: 48698 - DNA, 25 bp, S. cerevisiae
ggacttacctgatagcgaccaaatt

SEQ ID NO: 48699 - DNA, 25 bp, S. cerevisiae
ggaatgcgctatcgaatatctgaag

SEQ ID NO: 48700 - DNA, 25 bp, S. cerevisiae
ggagcccatgggtcaaaatcacact

SEQ ID NO: 48701 - DNA, 25 bp, S. cerevisiae
ggagcccaatgagaacacagccctt

SEQ ID NO: 48702 - DNA, 25 bp, S. cerevisiae
ggagccaactggaaacctgaccatt

SEQ ID NO: 48703 - DNA, 25 bp, S. cerevisiae
ggagcctaggtaccatttgaacatt

SEQ ID NO: 48704 - DNA, 25 bp, S. cerevisiae
ggactgctaggtttattggttgttc

SEQ ID NO: 48705 - DNA, 25 bp, S. cerevisiae
ggaactagcgctctatatggtgtcg

SEQ ID NO: 48706 - DNA, 25 bp, S. cerevisiae
ggacctcagccggtgcatatgaagt

SEQ ID NO: 48707 - DNA, 25 bp, S. cerevisiae
ggacgacagcccctagtgataaaga

SEQ ID NO: 48708 - DNA, 25 bp, S. cerevisiae
ggagccaaatgtctctacgaacgat

SEQ ID NO: 48709 - DNA, 25 bp, S. cerevisiae
ggaccaacattgttccacggaagac

SEQ ID NO: 48710 - DNA, 25 bp, S. cerevisiae
ggacctgccagagcttacggacaga

SEQ ID NO: 48711 - DNA, 25 bp, S. cerevisiae
ggacgtgcgcagaatctacccaaaa

SEQ ID NO: 48712 - DNA, 25 bp, S. cerevisiae
ggacctgttaatgaagagcctgaaa

SEQ ID NO: 48713 - DNA, 25 bp, S. cerevisiae
ggagacgttatataagctggccaat

SEQ ID NO: 48714 - DNA, 25 bp, S. cerevisiae
ggagcaattaatcaagttggccaat

SEQ ID NO: 48715 - DNA, 25 bp, S. cerevisiae
ggagaattttcgaagccggccaagt

SEQ ID NO: 48716 - DNA, 25 bp, S. cerevisiae
ggagaacttacgatgccattgccaa

SEQ ID NO: 48717 - DNA, 25 bp, S. cerevisiae
ggagaacttattcccctgtgcctaa

SEQ ID NO: 48718 - DNA, 25 bp, S. cerevisiae
ggagaacttagaccccagagatcaa

SEQ ID NO: 48719 - DNA, 25 bp, S. cerevisiae
ggagacaaacagttcctacgtcaaa

SEQ ID NO: 48720 - DNA, 25 bp, S. cerevisiae
ggagacaatctctaccggaattttt

SEQ ID NO: 48721 - DNA, 25 bp, S. cerevisiae
ggacaggaattagcgctacttcaca

SEQ ID NO: 48722 - DNA, 25 bp, S. cerevisiae
ggaacgttgagagcgctttccatca

SEQ ID NO: 48723 - DNA, 25 bp, S. cerevisiae
ggagcaattaatactttacccgaag

SEQ ID NO: 48724 - DNA, 25 bp, S. cerevisiae
ggacgtttattacaagccacttagc

SEQ ID NO: 48725 - DNA, 25 bp, S. cerevisiae
ggaccacggtcttttattcatactg

SEQ ID NO: 48726 - DNA, 25 bp, S. cerevisiae
ggacctctcgtcatttttcaattat

SEQ ID NO: 48727 - DNA, 25 bp, S. cerevisiae
ggaagtttctttgcggactatttat

SEQ ID NO: 48728 - DNA, 25 bp, S. cerevisiae
ggagatacatcactagttggcgttt

SEQ ID NO: 48729 - DNA, 25 bp, S. cerevisiae
ggagatgactcattcactgttcaag

SEQ ID NO: 48730 - DNA, 25 bp, S. cerevisiae
ggagatatccactattcttgccaag

SEQ ID NO: 48731 - DNA, 25 bp, S. cerevisiae
ggagagtacaattctatgcttcaat

SEQ ID NO: 48732 - DNA, 25 bp, S. cerevisiae
ggaccagttgtcactgtcgcaaagt

SEQ ID NO: 48733 - DNA, 25 bp, S. cerevisiae
ggacgacttccaagattctcagact

SEQ ID NO: 48734 - DNA, 25 bp, S. cerevisiae
ggagcgatattgtcaacagtcttat

SEQ ID NO: 48735 - DNA, 25 bp, S. cerevisiae
ggacggcaagactaccgatgctgat

SEQ ID NO: 48736 - DNA, 25 bp, S. cerevisiae
ggcagcgcgcaaaaagctcagtctt

SEQ ID NO: 48737 - DNA, 25 bp, S. cerevisiae
ggagcgccaaaccatacaatctttt

SEQ ID NO: 48738 - DNA, 25 bp, S. cerevisiae
ggagcccaccaatacaatatcttta

SEQ ID NO: 48739 - DNA, 25 bp, S. cerevisiae
ggacgatggctcagttgtttacgat

SEQ ID NO: 48740 - DNA, 25 bp, S. cerevisiae
ggacgaggcagcatctttgcatttc

SEQ ID NO: 48741 - DNA, 25 bp, S. cerevisiae
ggagatatatgccttcgtagaatta

SEQ ID NO: 48742 - DNA, 25 bp, S. cerevisiae
ggagatcagatccattttccagatt

SEQ ID NO: 48743 - DNA, 25 bp, S. cerevisiae
ggacaagtcgtctaagctcgcagca

SEQ ID NO: 48744 - DNA, 25 bp, S. cerevisiae
ggaaatagtgtctggctccgattac

SEQ ID NO: 48745 - DNA, 25 bp, S. cerevisiae
ggagaacgttgaccgctgtaagaca

SEQ ID NO: 48746 - DNA, 25 bp, S. cerevisiae
ggacctcgcctcgattttaaagcaa

SEQ ID NO: 48747 - DNA, 25 bp, S. cerevisiae
ggagatgtcttttctatctagcaat

SEQ ID NO: 48748 - DNA, 25 bp, S. cerevisiae
ggagattcccttgctgaatatatct

SEQ ID NO: 48749 - DNA, 25 bp, S. cerevisiae
ggagatacctctacctacgttaatg

SEQ ID NO: 48750 - DNA, 25 bp, S. cerevisiae
ggaaagcttccccatgatcggtaaa

SEQ ID NO: 48751 - DNA, 25 bp, S. cerevisiae
ggagacgcagttctattcttaggga

SEQ ID NO: 48752 - DNA, 25 bp, S. cerevisiae
ggacgaattccttaccgatgctatg

SEQ ID NO: 48753 - DNA, 25 bp, S. cerevisiae
ggagcgattttatgcccaagttgga

SEQ ID NO: 48754 - DNA, 25 bp, S. cerevisiae
ggaccctccaattgcccaaaatgaa

SEQ ID NO: 48755 - DNA, 25 bp, S. cerevisiae
ggacctggccaattactactacatg

SEQ ID NO: 48756 - DNA, 25 bp, S. cerevisiae
ggacctagtttctattactgagctg

SEQ ID NO: 48757 - DNA, 25 bp, S. cerevisiae
ggccctgggttcaattcccagctcg

SEQ ID NO: 48758 - DNA, 25 bp, S. cerevisiae
ggagactcgaattctttgagcaact

SEQ ID NO: 48759 - DNA, 25 bp, S. cerevisiae
ggacttggcgatggacgaaacacaa

SEQ ID NO: 48760 - DNA, 25 bp, S. cerevisiae
ggagcctgaactcgacattgactca

SEQ ID NO: 48761 - DNA, 25 bp, S. cerevisiae
ggacttaacttggattactcgacgt

SEQ ID NO: 48762 - DNA, 25 bp, S. cerevisiae
ggctttagacttcaaatcgcggtgt

SEQ ID NO: 48763 - DNA, 25 bp, S. cerevisiae
ggacttgagcctttaactctcgagg

SEQ ID NO: 48764 - DNA, 25 bp, S. cerevisiae
ggagcctggatcagtcaagcccaaa

SEQ ID NO: 48765 - DNA, 25 bp, S. cerevisiae
ggagccgttgatcacaccgaaaaga

SEQ ID NO: 48766 - DNA, 25 bp, S. cerevisiae
tggaccttgggctcaccgcaaagaa

SEQ ID NO: 48767 - DNA, 25 bp, S. cerevisiae
ggagccaaaaataacccacaatgaa

SEQ ID NO: 48768 - DNA, 25 bp, S. cerevisiae
ggagacactatcatcggtgccacaa

SEQ ID NO: 48769 - DNA, 25 bp, S. cerevisiae
ggagcagcagctattcgatggcaaa

SEQ ID NO: 48770 - DNA, 25 bp, S. cerevisiae
ggagacacctttggatttattgaaa

SEQ ID NO: 48771 - DNA, 25 bp, S. cerevisiae
ggagctccttgattattggtacaga

SEQ ID NO: 48772 - DNA, 25 bp, S. cerevisiae
ggagcctctatacttgtgggttgtt

SEQ ID NO: 48773 - DNA, 25 bp, S. cerevisiae
ggaatcccaatactcaagggtgtat

SEQ ID NO: 48774 - DNA, 25 bp, S. cerevisiae
ggagctggcgaaacgatttggatta

SEQ ID NO: 48775 - DNA, 25 bp, S. cerevisiae
ggagccttatttgtatcttctggat

SEQ ID NO: 48776 - DNA, 25 bp, S. cerevisiae
ggaccgttacgaatatttcgacagt

SEQ ID NO: 48777 - DNA, 25 bp, S. cerevisiae
ggacccttcaacgatattttagcat

SEQ ID NO: 48778 - DNA, 25 bp, S. cerevisiae
ggacccaatccaaacaattctccat

SEQ ID NO: 48779 - DNA, 25 bp, S. cerevisiae
ggactccaagacaggcgattacagg

SEQ ID NO: 48780 - DNA, 25 bp, S. cerevisiae
ggaccctagacatggctgcagtcaa

SEQ ID NO: 48781 - DNA, 25 bp, S. cerevisiae
ggacctgccaggtgtgttatctgga

SEQ ID NO: 48782 - DNA, 25 bp, S. cerevisiae
ggaccatccaagatgctttatctag

SEQ ID NO: 48783 - DNA, 25 bp, S. cerevisiae
ggacctccggcttctttagcagatg

SEQ ID NO: 48784 - DNA, 25 bp, S. cerevisiae
ggagcttccggattcagtttctgat

SEQ ID NO: 48785 - DNA, 25 bp, S. cerevisiae
ggagctcaaaatgaccgacaattca

SEQ ID NO: 48786 - DNA, 25 bp, S. cerevisiae
ggactacaattaccacagccaattc

SEQ ID NO: 48787 - DNA, 25 bp, S. cerevisiae
ggacagtaccgtccctggtattatt

SEQ ID NO: 48788 - DNA, 25 bp, S. cerevisiae
ggacgttgaactccacaagcttttt

SEQ ID NO: 48789 - DNA, 25 bp, S. cerevisiae
ggacattgagcagcctccaaaatct

SEQ ID NO: 48790 - DNA, 25 bp, S. cerevisiae
ggactatggcagctacccaaatgct

SEQ ID NO: 48791 - DNA, 25 bp, S. cerevisiae
ggactagctagttttatcaccatgt

SEQ ID NO: 48792 - DNA, 25 bp, S. cerevisiae
ggagctagcaggagttcccaatgtt

SEQ ID NO: 48793 - DNA, 25 bp, S. cerevisiae
ggagacctattcctcttatatttac

SEQ ID NO: 48794 - DNA, 25 bp, S. cerevisiae
ggactctctgttagttcagttagaa

SEQ ID NO: 48795 - DNA, 25 bp, S. cerevisiae
ggacattcgataccttcttatacaa

SEQ ID NO: 48796 - DNA, 25 bp, S. cerevisiae
ggcagttcctagctagtttagcact

SEQ ID NO: 48797 - DNA, 25 bp, S. cerevisiae
ggagctaccatcagtactaagactt

SEQ ID NO: 48798 - DNA, 25 bp, S. cerevisiae
ggagaactcatcagacctacagact

SEQ ID NO: 48799 - DNA, 25 bp, S. cerevisiae
ggagctcacgggaagttgaatcact

SEQ ID NO: 48800 - DNA, 25 bp, S. cerevisiae
ggagacgtggcctgactaacatata

SEQ ID NO: 48801 - DNA, 25 bp, S. cerevisiae
ggagaaggtcccaacttcacttatt

SEQ ID NO: 48802 - DNA, 25 bp, S. cerevisiae
ggaaacgtccacaaaggcaggctat

SEQ ID NO: 48803 - DNA, 25 bp, S. cerevisiae
ggactacgaaaccacatgggccttt

SEQ ID NO: 48804 - DNA, 25 bp, S. cerevisiae
ggcagctactaagccattggagcga

SEQ ID NO: 48805 - DNA, 25 bp, S. cerevisiae
ggacctatcagcgttttggagttca

SEQ ID NO: 48806 - DNA, 25 bp, S. cerevisiae
ggaccagcatccgatatttgggcct

SEQ ID NO: 48807 - DNA, 25 bp, S. cerevisiae
ggaagggctccatctttaggtttat

SEQ ID NO: 48808 - DNA, 25 bp, S. cerevisiae
tggacgtattgtccccggagttcct

SEQ ID NO: 48809 - DNA, 25 bp, S. cerevisiae
ggagcatccactttaccttgaagaa

SEQ ID NO: 48810 - DNA, 25 bp, S. cerevisiae
ggacttcaagaacccagaatctgac

SEQ ID NO: 48811 - DNA, 25 bp, S. cerevisiae
ggactccaataatccagccttgcat

SEQ ID NO: 48812 - DNA, 25 bp, S. cerevisiae
ggctcatacgatacaaacggttgat

SEQ ID NO: 48813 - DNA, 25 bp, S. cerevisiae
ggaccatcagtaaccagagagttgt

SEQ ID NO: 48814 - DNA, 25 bp, S. cerevisiae
ggagacatccaaggtcagctttata

SEQ ID NO: 48815 - DNA, 25 bp, S. cerevisiae
ggagcactatcaagcgacactgtta

SEQ ID NO: 48816 - DNA, 25 bp, S. cerevisiae
ggagcacgatatagaccaacttaat

SEQ ID NO: 48817 - DNA, 25 bp, S. cerevisiae
ggagcacgtgactacgaacactgtg

SEQ ID NO: 48818 - DNA, 25 bp, S. cerevisiae
ggagaagcagcaataccaccactac

SEQ ID NO: 48819 - DNA, 25 bp, S. cerevisiae
ggagaagcatccaacgatatacgaa

SEQ ID NO: 48820 - DNA, 25 bp, S. cerevisiae
ggagaagccgctgccatcaaagaga

SEQ ID NO: 48821 - DNA, 25 bp, S. cerevisiae
ggagcacactcgtatggcacactaa

SEQ ID NO: 48822 - DNA, 25 bp, S. cerevisiae
ggacctggctgcaatgcttcttagt

SEQ ID NO: 48823 - DNA, 25 bp, S. cerevisiae
ggacgactgcgtgtattactttatg

SEQ ID NO: 48824 - DNA, 25 bp, S. cerevisiae
ggacgcaacgttaacccttcaagag

SEQ ID NO: 48825 - DNA, 25 bp, S. cerevisiae
ggaacatcgagtaccttccttccaa

SEQ ID NO: 48826 - DNA, 25 bp, S. cerevisiae
ggacagcacgaatccttcaattttt

SEQ ID NO: 48827 - DNA, 25 bp, S. cerevisiae
ggagcatgcacaaaacctttcattt

SEQ ID NO: 48828 - DNA, 25 bp, S. cerevisiae
ggagctgcacactaagcgttatcta

SEQ ID NO: 48829 - DNA, 25 bp, S. cerevisiae
ggagctcagcactcacggcttgaaa

SEQ ID NO: 48830 - DNA, 25 bp, S. cerevisiae
ggagcatcaacactcaaggcgagaa

SEQ ID NO: 48831 - DNA, 25 bp, S. cerevisiae
ggacatgcaccagctgatgaccaaa

SEQ ID NO: 48832 - DNA, 25 bp, S. cerevisiae
ggacgaatcatcgatgtgaccactg

SEQ ID NO: 48833 - DNA, 25 bp, S. cerevisiae
ggagcatgacctattgggttactat

SEQ ID NO: 48834 - DNA, 25 bp, S. cerevisiae
ggagctgcctacaggttgttttcag

SEQ ID NO: 48835 - DNA, 25 bp, S. cerevisiae
ggacggctacttttacattttcaat

SEQ ID NO: 48836 - DNA, 25 bp, S. cerevisiae
ggacgaatcacctgtacccttagaa

SEQ ID NO: 48837 - DNA, 25 bp, S. cerevisiae
ggacggtgcagactactttgccata

SEQ ID NO: 48838 - DNA, 25 bp, S. cerevisiae
ggcagcttgtttgctggcttgacca

SEQ ID NO: 48839 - DNA, 25 bp, S. cerevisiae
ggacttgatttcctgactgatccga

SEQ ID NO: 48840 - DNA, 25 bp, S. cerevisiae
ggactttatctacgaccacgcagaa

SEQ ID NO: 48841 - DNA, 25 bp, S. cerevisiae
ggacctaagctgtgagccgatagat

SEQ ID NO: 48842 - DNA, 25 bp, S. cerevisiae
ggaaattgagtctgcccgacagctg

SEQ ID NO: 48843 - DNA, 25 bp, S. cerevisiae
ggagaattcaccaagcccaagtcaa

SEQ ID NO: 48844 - DNA, 25 bp, S. cerevisiae
ggaagactctcgcactttactaatg

SEQ ID NO: 48845 - DNA, 25 bp, S. cerevisiae
ggagctaacagcgtcaatacatata

SEQ ID NO: 48846 - DNA, 25 bp, S. cerevisiae
ggacgtcacagtactcaattgtaga

SEQ ID NO: 48847 - DNA, 25 bp, S. cerevisiae
ggacgcacaacactcttaatggtag

SEQ ID NO: 48848 - DNA, 25 bp, S. cerevisiae
ggagcatgtccaatttcccaatgga

SEQ ID NO: 48849 - DNA, 25 bp, S. cerevisiae
ggagcattcgtgtttccatgcagaa

SEQ ID NO: 48850 - DNA, 25 bp, S. cerevisiae
ggagctggcgtcattgatggaacat

SEQ ID NO: 48851 - DNA, 25 bp, S. cerevisiae
ggagcgatcgtcattgcttggatta

SEQ ID NO: 48852 - DNA, 25 bp, S. cerevisiae
ggacgacgtggttatgatggcatct

SEQ ID NO: 48853 - DNA, 25 bp, S. cerevisiae
ggacgacactgaagttccaaccaga

SEQ ID NO: 48854 - DNA, 25 bp, S. cerevisiae
ggcacaatacatcgagttccatacc

SEQ ID NO: 48855 - DNA, 25 bp, S. cerevisiae
ggacctacattggaagatcatactc

SEQ ID NO: 48856 - DNA, 25 bp, S. cerevisiae
ggagcacatacacccaataatcacc

SEQ ID NO: 48857 - DNA, 25 bp, S. cerevisiae
ggagcaagtccgtcgccaaatctgg

SEQ ID NO: 48858 - DNA, 25 bp, S. cerevisiae
ggagcaaaccattagctctgtttaa

SEQ ID NO: 48859 - DNA, 25 bp, S. cerevisiae
ggagctaaccctactgctttagaga

SEQ ID NO: 48860 - DNA, 25 bp, S. cerevisiae
ggaccagacactgtcgttgtcgaga

SEQ ID NO: 48861 - DNA, 25 bp, S. cerevisiae
ggacaagactctgaaaaatgcaagg

SEQ ID NO: 48862 - DNA, 25 bp, S. cerevisiae
ggaccagacttcctcaaaatggcag

SEQ ID NO: 48863 - DNA, 25 bp, S. cerevisiae
ggacaaactatcctaagcctgggtt

SEQ ID NO: 48864 - DNA, 25 bp, S. cerevisiae
ggactagccttccaaaccattgttt

SEQ ID NO: 48865 - DNA, 25 bp, S. cerevisiae
ggacttggaacttgagctgcgcaac

SEQ ID NO: 48866 - DNA, 25 bp, S. cerevisiae
ggagcttccacgttgagcgatgaca

SEQ ID NO: 48867 - DNA, 25 bp, S. cerevisiae
ggaccttcactatttggttccataa

SEQ ID NO: 48868 - DNA, 25 bp, S. cerevisiae
ggacgttcactgcaggatacttcaa

SEQ ID NO: 48869 - DNA, 25 bp, S. cerevisiae
ggaccaaccgttaggagctgatatt

SEQ ID NO: 48870 - DNA, 25 bp, S. cerevisiae
ggaccaccaattgatggactacgat

SEQ ID NO: 48871 - DNA, 25 bp, S. cerevisiae
ggacctcaatttgatggagctacta

SEQ ID NO: 48872 - DNA, 25 bp, S. cerevisiae
ggacgctcatgacccttggttaatg

SEQ ID NO: 48873 - DNA, 25 bp, S. cerevisiae
ggaacaccgtttattcttttcatcg

SEQ ID NO: 48874 - DNA, 25 bp, S. cerevisiae
ggaccagctctactactatgttttt

SEQ ID NO: 48875 - DNA, 25 bp, S. cerevisiae
ggaccatgcctggtatttttggttt

SEQ ID NO: 48876 - DNA, 25 bp, S. cerevisiae
ggacccctatctaaatttgctgtca

SEQ ID NO: 48877 - DNA, 25 bp, S. cerevisiae
ggagccacgatctagtcaattacca

SEQ ID NO: 48878 - DNA, 25 bp, S. cerevisiae
ggaccaccatcgtctaataacggta

SEQ ID NO: 48879 - DNA, 25 bp, S. cerevisiae
ggaccactcaattcaaaaagcgcta

SEQ ID NO: 48880 - DNA, 25 bp, S. cerevisiae
ggaccacacgttgggaaacctgatt

SEQ ID NO: 48881 - DNA, 25 bp, S. cerevisiae
ggacaagggacatggacaaccgaat

SEQ ID NO: 48882 - DNA, 25 bp, S. cerevisiae
ggaaaactgccatataccccaaact

SEQ ID NO: 48883 - DNA, 25 bp, S. cerevisiae
ggacacactttataacctccgagac

SEQ ID NO: 48884 - DNA, 25 bp, S. cerevisiae
ggacctgcttggataatgacgacat

SEQ ID NO: 48885 - DNA, 25 bp, S. cerevisiae
ggacgtactggtataacatgcctat

SEQ ID NO: 48886 - DNA, 25 bp, S. cerevisiae
ggacttttgatcattaccgctggta

SEQ ID NO: 48887 - DNA, 25 bp, S. cerevisiae
ggaaacggtggtttgctccgatacg

SEQ ID NO: 48888 - DNA, 25 bp, S. cerevisiae
ggaatcgacggtggcagacctccca

SEQ ID NO: 48889 - DNA, 25 bp, S. cerevisiae
ggaattgttggtagcgacccctact

SEQ ID NO: 48890 - DNA, 25 bp, S. cerevisiae
ggaagagttagtggcgacccaccca

SEQ ID NO: 48891 - DNA, 25 bp, S. cerevisiae
ggaacagctaggcagcaactcgcgc

SEQ ID NO: 48892 - DNA, 25 bp, S. cerevisiae
ggacatcgtgaaaactgcatcggat

SEQ ID NO: 48893 - DNA, 25 bp, S. cerevisiae
ggactgggattccacatctgcggat

SEQ ID NO: 48894 - DNA, 25 bp, S. cerevisiae
ggacaaggtcagttcatgcttcccg

SEQ ID NO: 48895 - DNA, 25 bp, S. cerevisiae
ggaccagagctcaaattcattacaa

SEQ ID NO: 48896 - DNA, 25 bp, S. cerevisiae
ggacgccaccattgagaaactgcta

SEQ ID NO: 48897 - DNA, 25 bp, S. cerevisiae
ggacaccgtcaccaagaaggctgaa

SEQ ID NO: 48898 - DNA, 25 bp, S. cerevisiae
ggaccctgtgaccaagaaacccatg

SEQ ID NO: 48899 - DNA, 25 bp, S. cerevisiae
tgtgacggttacgaagaagcccttg

SEQ ID NO: 48900 - DNA, 25 bp, S. cerevisiae
ggaccgttttaagttcacgccatgt

SEQ ID NO: 48901 - DNA, 25 bp, S. cerevisiae
ggaccgcctgacttctaatgatgat

SEQ ID NO: 48902 - DNA, 25 bp, S. cerevisiae
ggaccccataatacgagagctactc

SEQ ID NO: 48903 - DNA, 25 bp, S. cerevisiae
ggaccccagaatacttggcaccaga

SEQ ID NO: 48904 - DNA, 25 bp, S. cerevisiae
ggaccactaacgactctgacctgag

SEQ ID NO: 48905 - DNA, 25 bp, S. cerevisiae
ggaccaaaatagcatcttccgccag

SEQ ID NO: 48906 - DNA, 25 bp, S. cerevisiae
ggacaccaaattttttcccgctgct

SEQ ID NO: 48907 - DNA, 25 bp, S. cerevisiae
ggaactacaaagtgttgcccggatt

SEQ ID NO: 48908 - DNA, 25 bp, S. cerevisiae
ggaaaaggagccagtacccgccgtg

SEQ ID NO: 48909 - DNA, 25 bp, S. cerevisiae
ggaaaaatgggctgtcgccacctct

SEQ ID NO: 48910 - DNA, 25 bp, S. cerevisiae
ggaaaccgttactggcgtttatgat

SEQ ID NO: 48911 - DNA, 25 bp, S. cerevisiae
ggaaactcgttccttggcggctttg

SEQ ID NO: 48912 - DNA, 25 bp, S. cerevisiae
ggacgcattcttccagtgtttggac

SEQ ID NO: 48913 - DNA, 25 bp, S. cerevisiae
ggactcatgttcctcaatgtcttgg

SEQ ID NO: 48914 - DNA, 25 bp, S. cerevisiae
ggactattgtcgtcatttttggcat

SEQ ID NO: 48915 - DNA, 25 bp, S. cerevisiae
ggagcctcggatttgattatgattt

SEQ ID NO: 48916 - DNA, 25 bp, S. cerevisiae
tgggcccaggtattgttagcggttt

SEQ ID NO: 48917 - DNA, 25 bp, S. cerevisiae
ggaaccgttcaaaatagtgtcttgt

SEQ ID NO: 48918 - DNA, 25 bp, S. cerevisiae
ggacatccctttattatttggtttg

SEQ ID NO: 48919 - DNA, 25 bp, S. cerevisiae
ggactattccttgttaattggcatt

SEQ ID NO: 48920 - DNA, 25 bp, S. cerevisiae
ggacgattccttgtatgaatatcat

SEQ ID NO: 48921 - DNA, 25 bp, S. cerevisiae
ggacgtcatatccacgattcaatcg

SEQ ID NO: 48922 - DNA, 25 bp, S. cerevisiae
ggacgacatactgcagtctgccaag

SEQ ID NO: 48923 - DNA, 25 bp, S. cerevisiae
ggacgagacactggatgcctcacaa

SEQ ID NO: 48924 - DNA, 25 bp, S. cerevisiae
ggacgatgcacatgctattgatcaa

SEQ ID NO: 48925 - DNA, 25 bp, S. cerevisiae
ggacaatcctcgttgaaaccgtggc

SEQ ID NO: 48926 - DNA, 25 bp, S. cerevisiae
ggacatccttggtctaataccggtg

SEQ ID NO: 48927 - DNA, 25 bp, S. cerevisiae
ggagccatttgttaatataccgtct

SEQ ID NO: 48928 - DNA, 25 bp, S. cerevisiae
ggaactacttggcttaactctgctt

SEQ ID NO: 48929 - DNA, 25 bp, S. cerevisiae
ggaagaaagacaccttacgccttat

SEQ ID NO: 48930 - DNA, 25 bp, S. cerevisiae
ggacgatagacctcgaatttatagt

SEQ ID NO: 48931 - DNA, 25 bp, S. cerevisiae
ggacccatacctaccacattaataa

SEQ ID NO: 48932 - DNA, 25 bp, S. cerevisiae
ggacagctataacatctacactaaa

SEQ ID NO: 48933 - DNA, 25 bp, S. cerevisiae
ggactctgatagattgctacagcaa

SEQ ID NO: 48934 - DNA, 25 bp, S. cerevisiae
ggagccaatcaaccgaatcatgcaa

SEQ ID NO: 48935 - DNA, 25 bp, S. cerevisiae
ggactttcagtttatgcccattcgc

SEQ ID NO: 48936 - DNA, 25 bp, S. cerevisiae
ggacgttagttacccaagctcacgg

SEQ ID NO: 48937 - DNA, 25 bp, S. cerevisiae
ggacgatatattaaccgaactagca

SEQ ID NO: 48938 - DNA, 25 bp, S. cerevisiae
ggacgtaatctaatcgccaacattt

SEQ ID NO: 48939 - DNA, 25 bp, S. cerevisiae
ggacgctgaatttgatgccgctgca

SEQ ID NO: 48940 - DNA, 25 bp, S. cerevisiae
ggacagattaagtctcgctcatatg

SEQ ID NO: 48941 - DNA, 25 bp, S. cerevisiae
ggactgtataaaccacctcgtctta

SEQ ID NO: 48942 - DNA, 25 bp, S. cerevisiae
ggacgctatacatgaggccttttta

SEQ ID NO: 48943 - DNA, 25 bp, S. cerevisiae
ggacagcgccaattgatgtgccttg

SEQ ID NO: 48944 - DNA, 25 bp, S. cerevisiae
ggagccgcagcaattatcttatttt

SEQ ID NO: 48945 - DNA, 25 bp, S. cerevisiae
ggacctctgatatttctgaatctgg

SEQ ID NO: 48946 - DNA, 25 bp, S. cerevisiae
ggaccatctgtattttcttgcttgc

SEQ ID NO: 48947 - DNA, 25 bp, S. cerevisiae
ggaccacgacatgtatgcccaatat

SEQ ID NO: 48948 - DNA, 25 bp, S. cerevisiae
ggagccactagttttcccagatgga

SEQ ID NO: 48949 - DNA, 25 bp, S. cerevisiae
ggacgcattgaactccaaagaacaa

SEQ ID NO: 48950 - DNA, 25 bp, S. cerevisiae
ggactattacacacaatcgaccaaa

SEQ ID NO: 48951 - DNA, 25 bp, S. cerevisiae
ggaccttccacccaatgtgtgaaaa

SEQ ID NO: 48952 - DNA, 25 bp, S. cerevisiae
ggacatttccagaagcaagtgttga

SEQ ID NO: 48953 - DNA, 25 bp, S. cerevisiae
ggactctaccgctgtcactaatgaa

SEQ ID NO: 48954 - DNA, 25 bp, S. cerevisiae
ggaaaatacttctcgttagcgactt

SEQ ID NO: 48955 - DNA, 25 bp, S. cerevisiae
tggtaaaacatctagtcgtggacgt

SEQ ID NO: 48956 - DNA, 25 bp, S. cerevisiae
tagaaagttaccaccacctagttcg

SEQ ID NO: 48957 - DNA, 25 bp, S. cerevisiae
ggaacgtagagtcacttcattcgaa

SEQ ID NO: 48958 - DNA, 25 bp, S. cerevisiae
ggacaagtacggcatctatctaaag

SEQ ID NO: 48959 - DNA, 25 bp, S. cerevisiae
ggacattaacggctacactccaatg

SEQ ID NO: 48960 - DNA, 25 bp, S. cerevisiae
ggaccgcaaatggaactctatgaca

SEQ ID NO: 48961 - DNA, 25 bp, S. cerevisiae
ggactccaacatatgatgtcgcatc

SEQ ID NO: 48962 - DNA, 25 bp, S. cerevisiae
ggacagccagtaaagatgtgccata

SEQ ID NO: 48963 - DNA, 25 bp, S. cerevisiae
ggaccaacatattagatgaattctt

SEQ ID NO: 48964 - DNA, 25 bp, S. cerevisiae
ggacgctacctatgttgagttgcca

SEQ ID NO: 48965 - DNA, 25 bp, S. cerevisiae
ggacgaaatctctacatctaccaaa

SEQ ID NO: 48966 - DNA, 25 bp, S. cerevisiae
ggacgaaattgctaattcattggaa

SEQ ID NO: 48967 - DNA, 25 bp, S. cerevisiae
ggacgagaattttgcccttgagata

SEQ ID NO: 48968 - DNA, 25 bp, S. cerevisiae
ggacgagacactactagctcctgaa

SEQ ID NO: 48969 - DNA, 25 bp, S. cerevisiae
ggacgatgcagccaataactcatta

SEQ ID NO: 48970 - DNA, 25 bp, S. cerevisiae
ggaaattgccaatactcctgtcaac

SEQ ID NO: 48971 - DNA, 25 bp, S. cerevisiae
ggacttaaagcaacctcgttcttca

SEQ ID NO: 48972 - DNA, 25 bp, S. cerevisiae
ggactaatatataacctccccgacg

SEQ ID NO: 48973 - DNA, 25 bp, S. cerevisiae
ggaaaccaaagatcgccccaaaatg

SEQ ID NO: 48974 - DNA, 25 bp, S. cerevisiae
ggaaccccaactgccaaagcaaaga

SEQ ID NO: 48975 - DNA, 25 bp, S. cerevisiae
ggaaacaaccccacaaggctgaaga

SEQ ID NO: 48976 - DNA, 25 bp, S. cerevisiae
ggaaaagaacccacgatactgcact

SEQ ID NO: 48977 - DNA, 25 bp, S. cerevisiae
ggacattgtagctcgggaaaccact

SEQ ID NO: 48978 - DNA, 25 bp, S. cerevisiae
ggaagttttgttattctccaatact

SEQ ID NO: 48979 - DNA, 25 bp, S. cerevisiae
ggacagtttttcgtcaagctcaaat

SEQ ID NO: 48980 - DNA, 25 bp, S. cerevisiae
ggacgttaattccatcattgtcaac

SEQ ID NO: 48981 - DNA, 25 bp, S. cerevisiae
ggacctaatgttttatctagattct

SEQ ID NO: 48982 - DNA, 25 bp, S. cerevisiae
ggacttttgttgtactctacttcta

SEQ ID NO: 48983 - DNA, 25 bp, S. cerevisiae
ggacttgtctatagccattgctttt

SEQ ID NO: 48984 - DNA, 25 bp, S. cerevisiae
ggacatgattctacctattgctaag

SEQ ID NO: 48985 - DNA, 25 bp, S. cerevisiae
ggacgatgctaactacattgctgaa

SEQ ID NO: 48986 - DNA, 25 bp, S. cerevisiae
ggacattgcaaaatactctgctcag

SEQ ID NO: 48987 - DNA, 25 bp, S. cerevisiae
ggacaatagattatgctgcccctga

SEQ ID NO: 48988 - DNA, 25 bp, S. cerevisiae
ggacgtcattctatatggctccaga

SEQ ID NO: 48989 - DNA, 25 bp, S. cerevisiae
ggacgctcttttacaaccaaataat

SEQ ID NO: 48990 - DNA, 25 bp, S. cerevisiae
ggacgatttcgctcaattcaacaaa

SEQ ID NO: 48991 - DNA, 25 bp, S. cerevisiae
ggactatttgtctatccagctaaac

SEQ ID NO: 48992 - DNA, 25 bp, S. cerevisiae
ggacgagttgcatgcacgcgttcat

SEQ ID NO: 48993 - DNA, 25 bp, S. cerevisiae
ggcatctggtacgagcaccgtttaa

SEQ ID NO: 48994 - DNA, 25 bp, S. cerevisiae
ggacgaaatcccctcagtatataat

SEQ ID NO: 48995 - DNA, 25 bp, S. cerevisiae
ggacaccgctaagtatccaactggc

SEQ ID NO: 48996 - DNA, 25 bp, S. cerevisiae
ggaaacgagaacctacgactgctgt

SEQ ID NO: 48997 - DNA, 25 bp, S. cerevisiae
ggaaaaactagagccaccgtctgct

SEQ ID NO: 48998 - DNA, 25 bp, S. cerevisiae
ggacaaacctgatctctgtgacttt

SEQ ID NO: 48999 - DNA, 25 bp, S. cerevisiae
tggcaacagccacaagcgtaggagt

SEQ ID NO: 49000 - DNA, 25 bp, S. cerevisiae
ggcaatcgacgagcagtttggcagt

SEQ ID NO: 49001 - DNA, 25 bp, S. cerevisiae
ggcgtaatcgattagcggtcgcgct

SEQ ID NO: 49002 - DNA, 25 bp, S. cerevisiae
ggaccgtgttattcgtgtagatcaa

SEQ ID NO: 49003 - DNA, 25 bp, S. cerevisiae
ggaagccctttgtttttatagagag

SEQ ID NO: 49004 - DNA, 25 bp, S. cerevisiae
ggaaagtctacacttgtgcttttat

SEQ ID NO: 49005 - DNA, 25 bp, S. cerevisiae
ggacgaattcgatgaccttttggaa

SEQ ID NO: 49006 - DNA, 25 bp, S. cerevisiae
ggacgttcaaaagccctctgatgga

SEQ ID NO: 49007 - DNA, 25 bp, S. cerevisiae
ggaacgacataatcccatcttgggt

SEQ ID NO: 49008 - DNA, 25 bp, S. cerevisiae
ggaacgaattcaacgcatttcaggc

SEQ ID NO: 49009 - DNA, 25 bp, S. cerevisiae
ggaatcgggccacactgtacattgg

SEQ ID NO: 49010 - DNA, 25 bp, S. cerevisiae
ggaacggtgccggttgtcacgctaa

SEQ ID NO: 49011 - DNA, 25 bp, S. cerevisiae
ggaatctggtgcaatttcggcccat

SEQ ID NO: 49012 - DNA, 25 bp, S. cerevisiae
ggactcacttgccattcgaacaaat

SEQ ID NO: 49013 - DNA, 25 bp, S. cerevisiae
ggacatcgtgattttcgacagcaag

SEQ ID NO: 49014 - DNA, 25 bp, S. cerevisiae
ggacattggtgttgccggtatgtct

SEQ ID NO: 49015 - DNA, 25 bp, S. cerevisiae
ggacatatgggtgccagagtttttt

SEQ ID NO: 49016 - DNA, 25 bp, S. cerevisiae
ggccagaagttggacgaccctgtgt

SEQ ID NO: 49017 - DNA, 25 bp, S. cerevisiae
ggacgaagttgtagcgcacgcgact

SEQ ID NO: 49018 - DNA, 25 bp, S. cerevisiae
ggacgatggaatttcacggccaatt

SEQ ID NO: 49019 - DNA, 25 bp, S. cerevisiae
ggacgcagccaataacgatccaatt

SEQ ID NO: 49020 - DNA, 25 bp, S. cerevisiae
ggaagcaggcttacaacgtcgagtt

SEQ ID NO: 49021 - DNA, 25 bp, S. cerevisiae
ggactgttggtttagcgatagcgat

SEQ ID NO: 49022 - DNA, 25 bp, S. cerevisiae
ggactccagtacctagcactttaat

SEQ ID NO: 49023 - DNA, 25 bp, S. cerevisiae
ggactcggtaacatgcactttttaa

SEQ ID NO: 49024 - DNA, 25 bp, S. cerevisiae
ggactgttggaaagcgcacggttaa

SEQ ID NO: 49025 - DNA, 25 bp, S. cerevisiae
ggcattgttgttgcaaagtggctca

SEQ ID NO: 49026 - DNA, 25 bp, S. cerevisiae
ggcatcatgtgctctgggaattggt

SEQ ID NO: 49027 - DNA, 25 bp, S. cerevisiae
ggacggtatccactgtaatttgact

SEQ ID NO: 49028 - DNA, 25 bp, S. cerevisiae
ggacgatttccttgaacatttgagc

SEQ ID NO: 49029 - DNA, 25 bp, S. cerevisiae
ggaccctatcctgcagaatttgatc

SEQ ID NO: 49030 - DNA, 25 bp, S. cerevisiae
tggaaattatccatcggtttgtcga

SEQ ID NO: 49031 - DNA, 25 bp, S. cerevisiae
ggaaaaatacctggctttatgtcaa

SEQ ID NO: 49032 - DNA, 25 bp, S. cerevisiae
ggaaaagccgttatgaatctaccat

SEQ ID NO: 49033 - DNA, 25 bp, S. cerevisiae
ggaaaccaggtacggctattacaga

SEQ ID NO: 49034 - DNA, 25 bp, S. cerevisiae
ggcagaactgcacatgagtaccctc

SEQ ID NO: 49035 - DNA, 25 bp, S. cerevisiae
ggcagcaaccaaaagttacctgtta

SEQ ID NO: 49036 - DNA, 25 bp, S. cerevisiae
ggacatacccaaagactacagcgag

SEQ ID NO: 49037 - DNA, 25 bp, S. cerevisiae
ggactaccacgaacacaactgcaga

SEQ ID NO: 49038 - DNA, 25 bp, S. cerevisiae
ggcactacgaaaacttgtctccaga

SEQ ID NO: 49039 - DNA, 25 bp, S. cerevisiae
ggactaatacgtttactctgcttac

SEQ ID NO: 49040 - DNA, 25 bp, S. cerevisiae
ggactataactttgtctccgtagat

SEQ ID NO: 49041 - DNA, 25 bp, S. cerevisiae
ggactacaatttcacatcccgagac

SEQ ID NO: 49042 - DNA, 25 bp, S. cerevisiae
ggactaccttttacatgacggagat

SEQ ID NO: 49043 - DNA, 25 bp, S. cerevisiae
ggacttgccactatccgacgaggaa

SEQ ID NO: 49044 - DNA, 25 bp, S. cerevisiae
ggacatccccttatatgtgggccaa

SEQ ID NO: 49045 - DNA, 25 bp, S. cerevisiae
ggacttgactccattttgggccaat

SEQ ID NO: 49046 - DNA, 25 bp, S. cerevisiae
ggcactttgaaacttggcagcggta

SEQ ID NO: 49047 - DNA, 25 bp, S. cerevisiae
ggacgattcagatgtcaccctggag

SEQ ID NO: 49048 - DNA, 25 bp, S. cerevisiae
ggacgaagcagaaaccccaggtata

SEQ ID NO: 49049 - DNA, 25 bp, S. cerevisiae
ggaaatgaaggtgcccactgacttc

SEQ ID NO: 49050 - DNA, 25 bp, S. cerevisiae
ggaaaaccgtgttccagatttctct

SEQ ID NO: 49051 - DNA, 25 bp, S. cerevisiae
ggaaagcactggctgactcagatat

SEQ ID NO: 49052 - DNA, 25 bp, S. cerevisiae
ggacaatgttggcttctatgatctt

SEQ ID NO: 49053 - DNA, 25 bp, S. cerevisiae
ggacagagttgtcgctatcttcact

SEQ ID NO: 49054 - DNA, 25 bp, S. cerevisiae
ggacactcttgctcgagcattcaaa

SEQ ID NO: 49055 - DNA, 25 bp, S. cerevisiae
ggacactattcatcttttcaaactt

SEQ ID NO: 49056 - DNA, 25 bp, S. cerevisiae
ggactttcccgaagccttgaatgta

SEQ ID NO: 49057 - DNA, 25 bp, S. cerevisiae
ggacttgttccgatcagcattacat

SEQ ID NO: 49058 - DNA, 25 bp, S. cerevisiae
ggactatgtcccaaaatcttcacaa

SEQ ID NO: 49059 - DNA, 25 bp, S. cerevisiae
ggacacgacccttatttacgatata

SEQ ID NO: 49060 - DNA, 25 bp, S. cerevisiae
ggaatgggccacgtttctaagatac

SEQ ID NO: 49061 - DNA, 25 bp, S. cerevisiae
ggaaaacccgctattcagagataag

SEQ ID NO: 49062 - DNA, 25 bp, S. cerevisiae
ggacgacttccagatcggtgtttat

SEQ ID NO: 49063 - DNA, 25 bp, S. cerevisiae
ggcacaaatttctcctttcaaaacg

SEQ ID NO: 49064 - DNA, 25 bp, S. cerevisiae
ggacaaacctgctaaagatgcctct

SEQ ID NO: 49065 - DNA, 25 bp, S. cerevisiae
ggacgatccttctaaagtgcgccta

SEQ ID NO: 49066 - DNA, 25 bp, S. cerevisiae
ggactgtcactatgacgcgttcaaa

SEQ ID NO: 49067 - DNA, 25 bp, S. cerevisiae
ggacactatgactggatggatttga

SEQ ID NO: 49068 - DNA, 25 bp, S. cerevisiae
ggacagcttattcgaagggttgcat

SEQ ID NO: 49069 - DNA, 25 bp, S. cerevisiae
ggacaatctttacgctatgaatgac

SEQ ID NO: 49070 - DNA, 25 bp, S. cerevisiae
ggaacatcgccattgctgttagaga

SEQ ID NO: 49071 - DNA, 25 bp, S. cerevisiae
ggaaacagccgcgacgaaaaagaat

SEQ ID NO: 49072 - DNA, 25 bp, S. cerevisiae
tggcaaccagttgacccatcaagag

SEQ ID NO: 49073 - DNA, 25 bp, S. cerevisiae
tggcaacacgtaacttccagaagtg

SEQ ID NO: 49074 - DNA, 25 bp, S. cerevisiae
tggaccctgtctccgctaagaagga

SEQ ID NO: 49075 - DNA, 25 bp, S. cerevisiae
ggaatactgcgctccagaagttgga

SEQ ID NO: 49076 - DNA, 25 bp, S. cerevisiae
ggaacactgagcttacgtaaccgca

SEQ ID NO: 49077 - DNA, 25 bp, S. cerevisiae
ggaaatcccagatccaatcaccgtt

SEQ ID NO: 49078 - DNA, 25 bp, S. cerevisiae
ggaagatcccaatactagacccatg

SEQ ID NO: 49079 - DNA, 25 bp, S. cerevisiae
ggaaatccccaatattatcaacggt

SEQ ID NO: 49080 - DNA, 25 bp, S. cerevisiae
ggaaaccaccaagcagttaccgcgg

SEQ ID NO: 49081 - DNA, 25 bp, S. cerevisiae
ggaaattcgttcctcaacaacgtga

SEQ ID NO: 49082 - DNA, 25 bp, S. cerevisiae
ggacatttggatacgccctaatcgg

SEQ ID NO: 49083 - DNA, 25 bp, S. cerevisiae
ggacatcttgaaactgtcagatttt

SEQ ID NO: 49084 - DNA, 25 bp, S. cerevisiae
ggactctgagagcactgatcttatg

SEQ ID NO: 49085 - DNA, 25 bp, S. cerevisiae
ggacatccagagcatctcatcaaga

SEQ ID NO: 49086 - DNA, 25 bp, S. cerevisiae
ggacattccacttcattcaggcaat

SEQ ID NO: 49087 - DNA, 25 bp, S. cerevisiae
ggacatttcattttctcgacattgg

SEQ ID NO: 49088 - DNA, 25 bp, S. cerevisiae
ggactgtctcttgctattaaattca

SEQ ID NO: 49089 - DNA, 25 bp, S. cerevisiae
ggaacactttcctactaatctatac

SEQ ID NO: 49090 - DNA, 25 bp, S. cerevisiae
ggacaaatttttcgccaatccaaca

SEQ ID NO: 49091 - DNA, 25 bp, S. cerevisiae
ggaattcaattttaccaacctacag

SEQ ID NO: 49092 - DNA, 25 bp, S. cerevisiae
ggaatccaagggtaacgccttcaag

SEQ ID NO: 49093 - DNA, 25 bp, S. cerevisiae
ggactccaatggctgaggaacttgc

SEQ ID NO: 49094 - DNA, 25 bp, S. cerevisiae
ggacaactcgaaactgctactgcta

SEQ ID NO: 49095 - DNA, 25 bp, S. cerevisiae
ggactactcgagtatgctaccgtca

SEQ ID NO: 49096 - DNA, 25 bp, S. cerevisiae
ggactcgcgcatagatttactggta

SEQ ID NO: 49097 - DNA, 25 bp, S. cerevisiae
tggaacgtacttgcaactggctagt

SEQ ID NO: 49098 - DNA, 25 bp, S. cerevisiae
ggaatgcgcgcctcaatacggtaga

SEQ ID NO: 49099 - DNA, 25 bp, S. cerevisiae
ggactgggatagtaattcctggaca

SEQ ID NO: 49100 - DNA, 25 bp, S. cerevisiae
ggacggtatgcgttttcgttggcat

SEQ ID NO: 49101 - DNA, 25 bp, S. cerevisiae
ggactcgtcaggctcattttgcaat

SEQ ID NO: 49102 - DNA, 25 bp, S. cerevisiae
ggactgcggaatttggatctctaca

SEQ ID NO: 49103 - DNA, 25 bp, S. cerevisiae
ggactctttggtggaattctctgaa

SEQ ID NO: 49104 - DNA, 25 bp, S. cerevisiae
ggacacttcggatgacgcattcgta

SEQ ID NO: 49105 - DNA, 25 bp, S. cerevisiae
ggaaatcttggaggacgaacatgtc

SEQ ID NO: 49106 - DNA, 25 bp, S. cerevisiae
ggaacacatgtagtgagcgccgatg

SEQ ID NO: 49107 - DNA, 25 bp, S. cerevisiae
ggacaccatggagagcaacgataat

SEQ ID NO: 49108 - DNA, 25 bp, S. cerevisiae
ggaaatacctccatgagtactgaca

SEQ ID NO: 49109 - DNA, 25 bp, S. cerevisiae
ggaaatccttgcctggttcaatgac

SEQ ID NO: 49110 - DNA, 25 bp, S. cerevisiae
ggcacaatccggcaacttgaaacca

SEQ ID NO: 49111 - DNA, 25 bp, S. cerevisiae
ggacaacctggctaacttcagcaac

SEQ ID NO: 49112 - DNA, 25 bp, S. cerevisiae
ggaaccacgtctcaaatagcacaac

SEQ ID NO: 49113 - DNA, 25 bp, S. cerevisiae
ggacactcggttcaacaagccgcaa

SEQ ID NO: 49114 - DNA, 25 bp, S. cerevisiae
ggacatccggcaaacaaaacctcaa

SEQ ID NO: 49115 - DNA, 25 bp, S. cerevisiae
ggacaccatgcgtagtccaaaccaa

SEQ ID NO: 49116 - DNA, 25 bp, S. cerevisiae
ggacgtcagaggtctccatttggaa

SEQ ID NO: 49117 - DNA, 25 bp, S. cerevisiae
ggaacaaagcgcttgtcagtgttag

SEQ ID NO: 49118 - DNA, 25 bp, S. cerevisiae
ggacaacacacttgtggcagcggta

SEQ ID NO: 49119 - DNA, 25 bp, S. cerevisiae
ggacttggcatttttgtcgcagcaa

SEQ ID NO: 49120 - DNA, 25 bp, S. cerevisiae
ggactatgtgtttttaggagcccat

SEQ ID NO: 49121 - DNA, 25 bp, S. cerevisiae
ggacatgtttccattgcaagacgtt

SEQ ID NO: 49122 - DNA, 25 bp, S. cerevisiae
ggacattgtaccacaactcagcgtg

SEQ ID NO: 49123 - DNA, 25 bp, S. cerevisiae
ggacatacgaacacaatatcacttg

SEQ ID NO: 49124 - DNA, 25 bp, S. cerevisiae
ggacaagagcttggccaaatcaatt

SEQ ID NO: 49125 - DNA, 25 bp, S. cerevisiae
ggacaataaatcctcactttggtta

SEQ ID NO: 49126 - DNA, 25 bp, S. cerevisiae
ggacaagcatcctcaaggccaggtt

SEQ ID NO: 49127 - DNA, 25 bp, S. cerevisiae
ggaaagcatccatgatcgcaaaggg

SEQ ID NO: 49128 - DNA, 25 bp, S. cerevisiae
ggaaagcagcgggtcttccgatgat

SEQ ID NO: 49129 - DNA, 25 bp, S. cerevisiae
ggaacagcaccgttgaacccatatc

SEQ ID NO: 49130 - DNA, 25 bp, S. cerevisiae
ggaaagcctatcttcaaacacatca

SEQ ID NO: 49131 - DNA, 25 bp, S. cerevisiae
ggaaatgctggaatccatccacacc

SEQ ID NO: 49132 - DNA, 25 bp, S. cerevisiae
ggacatttcacaattgactcttttg

SEQ ID NO: 49133 - DNA, 25 bp, S. cerevisiae
ggacattaccgcaagatccaattcc

SEQ ID NO: 49134 - DNA, 25 bp, S. cerevisiae
ggactagtacattaccagcgcatct

SEQ ID NO: 49135 - DNA, 25 bp, S. cerevisiae
ggacatttcaatattggtgcttata

SEQ ID NO: 49136 - DNA, 25 bp, S. cerevisiae
ggaaattcaacacttgcaagcatat

SEQ ID NO: 49137 - DNA, 25 bp, S. cerevisiae
ggaaatatcaccctctatccaatag

SEQ ID NO: 49138 - DNA, 25 bp, S. cerevisiae
ggaaattctggtcctgcggcaatag

SEQ ID NO: 49139 - DNA, 25 bp, S. cerevisiae
ggaacactgcaatccaggcctaatt

SEQ ID NO: 49140 - DNA, 25 bp, S. cerevisiae
ggaaatggaatcgttggcccgccac

SEQ ID NO: 49141 - DNA, 25 bp, S. cerevisiae
ggaaatcaaggcgttgacccggcca

SEQ ID NO: 49142 - DNA, 25 bp, S. cerevisiae
ggaaaattttgtctcgaggttcaca

SEQ ID NO: 49143 - DNA, 25 bp, S. cerevisiae
ggaaaatcttctgcccaaggtttat

SEQ ID NO: 49144 - DNA, 25 bp, S. cerevisiae
ggaagagactttccccgagtatctc

SEQ ID NO: 49145 - DNA, 25 bp, S. cerevisiae
ggaaaactactttcgctgtgtacat

SEQ ID NO: 49146 - DNA, 25 bp, S. cerevisiae
ggacaaggtatcttatcctcactga

SEQ ID NO: 49147 - DNA, 25 bp, S. cerevisiae
ggacaaatcccagcaatctagccaa

SEQ ID NO: 49148 - DNA, 25 bp, S. cerevisiae
ggaaacatacacacgactactcaag

SEQ ID NO: 49149 - DNA, 25 bp, S. cerevisiae
ggacaactacttgaagccaccacag

SEQ ID NO: 49150 - DNA, 25 bp, S. cerevisiae
ggaaagggtgatttgccccgcaaat

SEQ ID NO: 49151 - DNA, 25 bp, S. cerevisiae
ggcaaagggttttcaccacacgcaa

SEQ ID NO: 49152 - DNA, 25 bp, S. cerevisiae
ggaaatcgactcatacaaaattcaa

SEQ ID NO: 49153 - DNA, 25 bp, S. cerevisiae
ggacattatttcctacaacgatatc

SEQ ID NO: 49154 - DNA, 25 bp, S. cerevisiae
ggacagtctatcgttgaacacctcc

SEQ ID NO: 49155 - DNA, 25 bp, S. cerevisiae
ggacagtttctgcaagatcgcctac

SEQ ID NO: 49156 - DNA, 25 bp, S. cerevisiae
ggaaaaagatcgctttgcccacacg

SEQ ID NO: 49157 - DNA, 25 bp, S. cerevisiae
ggaacgtgttgccaagtctaaccgt

SEQ ID NO: 49158 - DNA, 25 bp, S. cerevisiae
ggaactgcatgcttggtggcatctt

SEQ ID NO: 49159 - DNA, 25 bp, S. cerevisiae
ggacaggcgttcgatcattctttaa

SEQ ID NO: 49160 - DNA, 25 bp, S. cerevisiae
ggaaaggctctccaatggacttgaa

SEQ ID NO: 49161 - DNA, 25 bp, S. cerevisiae
ggaaaagtcacctgcgcatgccgat

SEQ ID NO: 49162 - DNA, 25 bp, S. cerevisiae
ggaaatagatcatacggcgcctgaa

SEQ ID NO: 49163 - DNA, 25 bp, S. cerevisiae
ggacaacttcatagaaccaccatct

SEQ ID NO: 49164 - DNA, 25 bp, S. cerevisiae
ggacaccttaagaaccggatcacaa

SEQ ID NO: 49165 - DNA, 25 bp, S. cerevisiae
ggacactattacaaaccccaccgtg

SEQ ID NO: 49166 - DNA, 25 bp, S. cerevisiae
ggaagtgttactttgggccaccgcg

SEQ ID NO: 49167 - DNA, 25 bp, S. cerevisiae
ggaatggatttcacattggccacca

SEQ ID NO: 49168 - DNA, 25 bp, S. cerevisiae
ggaaagtttttgacctgcgttgaag

SEQ ID NO: 49169 - DNA, 25 bp, S. cerevisiae
ggacacagtggcttggcttttgcgc

SEQ ID NO: 49170 - DNA, 25 bp, S. cerevisiae
ggaacaggacttggttcttctgctc

SEQ ID NO: 49171 - DNA, 25 bp, S. cerevisiae
ggaacagggtgtattgctctcgctt

SEQ ID NO: 49172 - DNA, 25 bp, S. cerevisiae
ggaacagcggtttctttcatcctaa

SEQ ID NO: 49173 - DNA, 25 bp, S. cerevisiae
ggaactgcggacatatctattacat

SEQ ID NO: 49174 - DNA, 25 bp, S. cerevisiae
ggaacacgaacatactgcaccactt

SEQ ID NO: 49175 - DNA, 25 bp, S. cerevisiae
ggaacacaataatactggccaactt

SEQ ID NO: 49176 - DNA, 25 bp, S. cerevisiae
ggacaacttaaccaatgcgcgcgac

SEQ ID NO: 49177 - DNA, 25 bp, S. cerevisiae
ggaactacttagacatatctgacga

SEQ ID NO: 49178 - DNA, 25 bp, S. cerevisiae
ggaaataccttgcatttgccgcgat

SEQ ID NO: 49179 - DNA, 25 bp, S. cerevisiae
ggaacccaatcgcttatggaaacgt

SEQ ID NO: 49180 - DNA, 25 bp, S. cerevisiae
ggaacaatttactgacctggccaaa

SEQ ID NO: 49181 - DNA, 25 bp, S. cerevisiae
ggaaactatttctctcctagtgaac

SEQ ID NO: 49182 - DNA, 25 bp, S. cerevisiae
ggaaacctttcaaagcctggtagat

SEQ ID NO: 49183 - DNA, 25 bp, S. cerevisiae
ggacaacacagtaccatctcctggt

SEQ ID NO: 49184 - DNA, 25 bp, S. cerevisiae
ggaaaaacatcgctgatcactagat

SEQ ID NO: 49185 - DNA, 25 bp, S. cerevisiae
ggcaaaaaccggcagcagcagcagc

SEQ ID NO: 49186 - DNA, 25 bp, S. cerevisiae
ggacaactactttaacctgcagctg

SEQ ID NO: 49187 - DNA, 25 bp, S. cerevisiae
ggacaaaactatgtagcgcatacta

SEQ ID NO: 49188 - DNA, 25 bp, S. cerevisiae
ggaacagattctaccatttcagatt

SEQ ID NO: 49189 - DNA, 25 bp, S. cerevisiae
ggacatatcgtttctctggagctaa

SEQ ID NO: 49190 - DNA, 25 bp, S. cerevisiae
ggacatatatttgccacagcagcta

SEQ ID NO: 49191 - DNA, 25 bp, S. cerevisiae
ggaatataacgtccacatcatgcgt

SEQ ID NO: 49192 - DNA, 25 bp, S. cerevisiae
ggaaatgctgaccttatatcacgtt

SEQ ID NO: 49193 - DNA, 25 bp, S. cerevisiae
ggacatagctacttggaatacattc

SEQ ID NO: 49194 - DNA, 25 bp, S. cerevisiae
ggacagcgtctatcgaaacattgca

SEQ ID NO: 49195 - DNA, 25 bp, S. cerevisiae
ggacacactgtcactgaaacatgag

SEQ ID NO: 49196 - DNA, 25 bp, S. cerevisiae
ggaatgaagctttatttaccgcaaa

SEQ ID NO: 49197 - DNA, 25 bp, S. cerevisiae
ggaacaactcattgcttctaagcca

SEQ ID NO: 49198 - DNA, 25 bp, S. cerevisiae
tgccaagactttattaatcctcccc

SEQ ID NO: 49199 - DNA, 25 bp, S. cerevisiae
ggaacctttagcattactatcctga

SEQ ID NO: 49200 - DNA, 25 bp, S. cerevisiae
ggacaccaattgctcttcaattcgg

SEQ ID NO: 49201 - DNA, 25 bp, S. cerevisiae
ggacaagattgccttcttcgcggga

SEQ ID NO: 49202 - DNA, 25 bp, S. cerevisiae
ggacaaacttctacgtcatcgagga

SEQ ID NO: 49203 - DNA, 25 bp, S. cerevisiae
ggaaagacttcttgcgcaagcggaa

SEQ ID NO: 49204 - DNA, 25 bp, S. cerevisiae
ggacacagatccctacagaacgata

SEQ ID NO: 49205 - DNA, 25 bp, S. cerevisiae
ggaaggtgacctcctgaatgcagaa

SEQ ID NO: 49206 - DNA, 25 bp, S. cerevisiae
ggacaggtatcccatgctgttgcag

SEQ ID NO: 49207 - DNA, 25 bp, S. cerevisiae
ggacagcctcaaggtcaagctcaga

SEQ ID NO: 49208 - DNA, 25 bp, S. cerevisiae
ggaacttcgatcctgaagccatgga

SEQ ID NO: 49209 - DNA, 25 bp, S. cerevisiae
ggaaccactgtgaatactcaactat

SEQ ID NO: 49210 - DNA, 25 bp, S. cerevisiae
ggaaccggtattgccatgacgttaa

SEQ ID NO: 49211 - DNA, 25 bp, S. cerevisiae
ggaacttttgttgcacgagacctca

SEQ ID NO: 49212 - DNA, 25 bp, S. cerevisiae
ggaaatgttgagttggccgaccacc

SEQ ID NO: 49213 - DNA, 25 bp, S. cerevisiae
ggacacttcatcaagagggccgcca

SEQ ID NO: 49214 - DNA, 25 bp, S. cerevisiae
ggacacttcaaacgattccgctaag

SEQ ID NO: 49215 - DNA, 25 bp, S. cerevisiae
tggaaactagaaggtctccccggat

SEQ ID NO: 49216 - DNA, 25 bp, S. cerevisiae
ggaaacttgaatggtcctcctcttt

SEQ ID NO: 49217 - DNA, 25 bp, S. cerevisiae
ggaacagcaatattagcccttctcc

SEQ ID NO: 49218 - DNA, 25 bp, S. cerevisiae
ggaaccaactagtagcagcttcttc

SEQ ID NO: 49219 - DNA, 25 bp, S. cerevisiae
ggacagccaccaacattgcagtttg

SEQ ID NO: 49220 - DNA, 25 bp, S. cerevisiae
ggacagactcgagatgtgcatattt

SEQ ID NO: 49221 - DNA, 25 bp, S. cerevisiae
ggacagacctacttggtgctagcaa

SEQ ID NO: 49222 - DNA, 25 bp, S. cerevisiae
ggacaacactttcgtcactagattg

SEQ ID NO: 49223 - DNA, 25 bp, S. cerevisiae
ggacaccagtgttaacgtatatgaa

SEQ ID NO: 49224 - DNA, 25 bp, S. cerevisiae
ggacacctgtctatgtgactgataa

SEQ ID NO: 49225 - DNA, 25 bp, S. cerevisiae
ggaacgcaacgttctactggaacac

SEQ ID NO: 49226 - DNA, 25 bp, S. cerevisiae
ggaactaccgttcttgcaagagcta

SEQ ID NO: 49227 - DNA, 25 bp, S. cerevisiae
ggaacttccaataccttagaaagca

SEQ ID NO: 49228 - DNA, 25 bp, S. cerevisiae
ggaaattctagaccctgaagacaga

SEQ ID NO: 49229 - DNA, 25 bp, S. cerevisiae
ggaaattctagatactgcaggccaa

SEQ ID NO: 49230 - DNA, 25 bp, S. cerevisiae
ggaaattcattccaacctggctaaa

SEQ ID NO: 49231 - DNA, 25 bp, S. cerevisiae
ggacaatactcctgctttgtgtaaa

SEQ ID NO: 49232 - DNA, 25 bp, S. cerevisiae
ggaaatgacatcttcttttttcaag

SEQ ID NO: 49233 - DNA, 25 bp, S. cerevisiae
ggaaaggctcatcgaatttggacaa

SEQ ID NO: 49234 - DNA, 25 bp, S. cerevisiae
ggaaaagattggtatcgtcgaaatc

SEQ ID NO: 49235 - DNA, 25 bp, S. cerevisiae
ggaaagtgactccttcgttgcatag

SEQ ID NO: 49236 - DNA, 25 bp, S. cerevisiae
ggaatctaaacctaccattgaccat

SEQ ID NO: 49237 - DNA, 25 bp, S. cerevisiae
ggaactattgacgaagccatttcga

SEQ ID NO: 49238 - DNA, 25 bp, S. cerevisiae
ggaacgttacagagccattacttct

SEQ ID NO: 49239 - DNA, 25 bp, S. cerevisiae
ggacactgacaacgaattgcttttt

SEQ ID NO: 49240 - DNA, 25 bp, S. cerevisiae
ggacactgctaaagacatttttgga

SEQ ID NO: 49241 - DNA, 25 bp, S. cerevisiae
ggacactgcgtccagaattttgaag

SEQ ID NO: 49242 - DNA, 25 bp, S. cerevisiae
ggaaatcatctgcacgtatgctata

SEQ ID NO: 49243 - DNA, 25 bp, S. cerevisiae
ggacaaggtcgactctatcatcatt

SEQ ID NO: 49244 - DNA, 25 bp, S. cerevisiae
ggaacaaatcagatctggctcattt

SEQ ID NO: 49245 - DNA, 25 bp, S. cerevisiae
ggaaatacacatacccctgatagaa

SEQ ID NO: 49246 - DNA, 25 bp, S. cerevisiae
ggaaattctgtgaacccctacaatg

SEQ ID NO: 49247 - DNA, 25 bp, S. cerevisiae
ggaaaacttgaaccacctgtcaaat

SEQ ID NO: 49248 - DNA, 25 bp, S. cerevisiae
ggaaacctatgatttcacgtccaat

SEQ ID NO: 49249 - DNA, 25 bp, S. cerevisiae
ggaaaagctacatttgccgtacata

SEQ ID NO: 49250 - DNA, 25 bp, S. cerevisiae
ggaaatcttatcatgtgtcacccca

SEQ ID NO: 49251 - DNA, 25 bp, S. cerevisiae
ggaagatttaccgttacctgctact

SEQ ID NO: 49252 - DNA, 25 bp, S. cerevisiae
ggaagactttcccatttttgccata

SEQ ID NO: 49253 - DNA, 25 bp, S. cerevisiae
ggaaatctttccttttatacatcag

SEQ ID NO: 49254 - DNA, 25 bp, S. cerevisiae
ggaaatttctcccttgaataccaca

SEQ ID NO: 49255 - DNA, 25 bp, S. cerevisiae
ggaaatttctatgcttaatcaccca

SEQ ID NO: 49256 - DNA, 25 bp, S. cerevisiae
ggaactttttataccttgcccagag

SEQ ID NO: 49257 - DNA, 25 bp, S. cerevisiae
ggaagaattgtttacctcgctcggt

SEQ ID NO: 49258 - DNA, 25 bp, S. cerevisiae
ggaaagtttttcctctccttctctg

SEQ ID NO: 49259 - DNA, 25 bp, S. cerevisiae
ggaaaggatcatttcttgcccacct

SEQ ID NO: 49260 - DNA, 25 bp, S. cerevisiae
ggaaacacgaatttaccatggactt

SEQ ID NO: 49261 - DNA, 25 bp, S. cerevisiae
ggaaatcacgaagctgactcatctg

SEQ ID NO: 49262 - DNA, 25 bp, S. cerevisiae
ggaaattcttgcagctattggtata

SEQ ID NO: 49263 - DNA, 25 bp, S. cerevisiae
ggaagcgtacgacccatgtttatta

SEQ ID NO: 49264 - DNA, 25 bp, S. cerevisiae
ggaagcgtcggtggtattcttatat

SEQ ID NO: 49265 - DNA, 25 bp, S. cerevisiae
ggaacttagtctgtgggcattataa

SEQ ID NO: 49266 - DNA, 25 bp, S. cerevisiae
ggaaatcccagagttcatgcatact

SEQ ID NO: 49267 - DNA, 25 bp, S. cerevisiae
ggaacactactcattacaacgccag

SEQ ID NO: 49268 - DNA, 25 bp, S. cerevisiae
ggaaccaactactatttgaccactg

SEQ ID NO: 49269 - DNA, 25 bp, S. cerevisiae
ggacactatacttctgttgtgaaca

SEQ ID NO: 49270 - DNA, 25 bp, S. cerevisiae
ggctgaaaaggacgctgtctccgtt

SEQ ID NO: 49271 - DNA, 25 bp, S. cerevisiae
ggacaactggatttcattgataaca

SEQ ID NO: 49272 - DNA, 25 bp, S. cerevisiae
ggaaccggattgtgtgggctactca

SEQ ID NO: 49273 - DNA, 25 bp, S. cerevisiae
ggaaaccgttctggatctggacaat

SEQ ID NO: 49274 - DNA, 25 bp, S. cerevisiae
ggaaagcgcaggcattaccatctta

SEQ ID NO: 49275 - DNA, 25 bp, S. cerevisiae
ggaaatagcatgatctctacgcctt

SEQ ID NO: 49276 - DNA, 25 bp, S. cerevisiae
ggaaaagcgtcttgctaccacattc

SEQ ID NO: 49277 - DNA, 25 bp, S. cerevisiae
ggaagacgagacctaacttctttag

SEQ ID NO: 49278 - DNA, 25 bp, S. cerevisiae
ggaacacgaaccttgcatcattttt

SEQ ID NO: 49279 - DNA, 25 bp, S. cerevisiae
ggaacagtcacccatgattgtattt

SEQ ID NO: 49280 - DNA, 25 bp, S. cerevisiae
ggcagcacttaaaacctttcctgga

SEQ ID NO: 49281 - DNA, 25 bp, S. cerevisiae
ggaacatacaaacctcttggcgctg

SEQ ID NO: 49282 - DNA, 25 bp, S. cerevisiae
ggaaagagcttcacacagcatccct

SEQ ID NO: 49283 - DNA, 25 bp, S. cerevisiae
ggaaaatcccatcatgcagaccgct

SEQ ID NO: 49284 - DNA, 25 bp, S. cerevisiae
ggaaatgttcctcacagtcctgttc

SEQ ID NO: 49285 - DNA, 25 bp, S. cerevisiae
ggaactgaatccagtactgcctctt

SEQ ID NO: 49286 - DNA, 25 bp, S. cerevisiae
ggacaacaatccttcagatcgggtt

SEQ ID NO: 49287 - DNA, 25 bp, S. cerevisiae
ggacaacttgaccttatggacctct

SEQ ID NO: 49288 - DNA, 25 bp, S. cerevisiae
ggaaacctgttttatcgcacattgt

SEQ ID NO: 49289 - DNA, 25 bp, S. cerevisiae
ggacaacaccaattacagctgcaag

SEQ ID NO: 49290 - DNA, 25 bp, S. cerevisiae
ggaacacagctcattaagtcaagat

SEQ ID NO: 49291 - DNA, 25 bp, S. cerevisiae
ggaaacgcatctaatacgtcgacat

SEQ ID NO: 49292 - DNA, 25 bp, S. cerevisiae
ggaaataaattctatcgcaccgatg

SEQ ID NO: 49293 - DNA, 25 bp, S. cerevisiae
ggaaatcacctctgacaacttattg

SEQ ID NO: 49294 - DNA, 25 bp, S. cerevisiae
ggaaatctcttccaacaactggcct

SEQ ID NO: 49295 - DNA, 25 bp, S. cerevisiae
ggaaagcgtacataaccacagtgat

SEQ ID NO: 49296 - DNA, 25 bp, S. cerevisiae
ggaaacattactttaccagccgact

SEQ ID NO: 49297 - DNA, 25 bp, S. cerevisiae
ggcacactaagtacctcagctaatc

SEQ ID NO: 49298 - DNA, 25 bp, S. cerevisiae
ggcacactgcggtgcgagactgaca

SEQ ID NO: 49299 - DNA, 25 bp, S. cerevisiae
ggcatactggacgtggaagattcat

SEQ ID NO: 49300 - DNA, 25 bp, S. cerevisiae
ggaagctagcctggataagactcaa

SEQ ID NO: 49301 - DNA, 25 bp, S. cerevisiae
ggaaacgccctgaagatgcaccaaa

SEQ ID NO: 49302 - DNA, 25 bp, S. cerevisiae
ggaaacttcctatcatacaaaattg

SEQ ID NO: 49303 - DNA, 25 bp, S. cerevisiae
ggaaacgcaccttgtatgtcgtcac

SEQ ID NO: 49304 - DNA, 25 bp, S. cerevisiae
ggaaattgcccttgatgtgtctgtc

SEQ ID NO: 49305 - DNA, 25 bp, S. cerevisiae
ggaaattgatcctaagttcgctaat

SEQ ID NO: 49306 - DNA, 25 bp, S. cerevisiae
ggaaattacacttgccatttgcttt

SEQ ID NO: 49307 - DNA, 25 bp, S. cerevisiae
ggaacatcccagtgcataagttttt

SEQ ID NO: 49308 - DNA, 25 bp, S. cerevisiae
ggaactgccaccatttgacgaggat

SEQ ID NO: 49309 - DNA, 25 bp, S. cerevisiae
ggaacagctattttttgacctggaa

SEQ ID NO: 49310 - DNA, 25 bp, S. cerevisiae
ggaacgttcttgatttttgtgctaa

SEQ ID NO: 49311 - DNA, 25 bp, S. cerevisiae
ggaaccttttaccttcttgattatg

SEQ ID NO: 49312 - DNA, 25 bp, S. cerevisiae
ggaaatgatccatactccgacgata

SEQ ID NO: 49313 - DNA, 25 bp, S. cerevisiae
ggaaatgtgacaccgtccctgagta

SEQ ID NO: 49314 - DNA, 25 bp, S. cerevisiae
ggaaagagcacgtgcctcgctggat

SEQ ID NO: 49315 - DNA, 25 bp, S. cerevisiae
ggaacagcagcactagcagcaccag

SEQ ID NO: 49316 - DNA, 25 bp, S. cerevisiae
ggaaactgctgcaagagcgtcgctt

SEQ ID NO: 49317 - DNA, 25 bp, S. cerevisiae
ggaaagcctgcaaggaccatctcta

SEQ ID NO: 49318 - DNA, 25 bp, S. cerevisiae
ggaatacctgcaagacacgtaccag

SEQ ID NO: 49319 - DNA, 25 bp, S. cerevisiae
ggctagtgttcaaagttacaaggta

SEQ ID NO: 49320 - DNA, 25 bp, S. cerevisiae
ggctaagtctgctggtactcaaagt

SEQ ID NO: 49321 - DNA, 25 bp, S. cerevisiae
ggaacatttcccgaacctgaagtgc

SEQ ID NO: 49322 - DNA, 25 bp, S. cerevisiae
ggaacacattcacaaactggtactc

SEQ ID NO: 49323 - DNA, 25 bp, S. cerevisiae
ggaagagtcagatcagagattggaa

SEQ ID NO: 49324 - DNA, 25 bp, S. cerevisiae
ggaaacctacacaattgctcgtatt

SEQ ID NO: 49325 - DNA, 25 bp, S. cerevisiae
ggaaatcctaaccatcggcataatt

SEQ ID NO: 49326 - DNA, 25 bp, S. cerevisiae
tggaaggctttctgggaccgtaccg

SEQ ID NO: 49327 - DNA, 25 bp, S. cerevisiae
ggaaggcttccgtaagactaatact

SEQ ID NO: 49328 - DNA, 25 bp, S. cerevisiae
ggaacgcttcatcaataatgccaaa

SEQ ID NO: 49329 - DNA, 25 bp, S. cerevisiae
ggaaatctctgaccaaaagccaatt

SEQ ID NO: 49330 - DNA, 25 bp, S. cerevisiae
ggaaatgccttcaaaatctgtactt

SEQ ID NO: 49331 - DNA, 25 bp, S. cerevisiae
ggaaatccccttggttgcaagtaat

SEQ ID NO: 49332 - DNA, 25 bp, S. cerevisiae
ggaactatctggtgaaagcgaccta

SEQ ID NO: 49333 - DNA, 25 bp, S. cerevisiae
ggaagtaccagtcaacacggccgat

SEQ ID NO: 49334 - DNA, 25 bp, S. cerevisiae
ggaagttccatttaggccctggtat

SEQ ID NO: 49335 - DNA, 25 bp, S. cerevisiae
ggaactacactccagagcttcagta

SEQ ID NO: 49336 - DNA, 25 bp, S. cerevisiae
ggaactacacggaagctctaaagat

SEQ ID NO: 49337 - DNA, 25 bp, S. cerevisiae
ggaacggccgtgatctctaatcaaa

SEQ ID NO: 49338 - DNA, 25 bp, S. cerevisiae
ggaacattcacctcactagtatcac

SEQ ID NO: 49339 - DNA, 25 bp, S. cerevisiae
ggaaatatcctaaccaatgtcattg

SEQ ID NO: 49340 - DNA, 25 bp, S. cerevisiae
ggaaaattcataccaaaccacgcta

SEQ ID NO: 49341 - DNA, 25 bp, S. cerevisiae
ggaaacaggctctctacaataacaa

SEQ ID NO: 49342 - DNA, 25 bp, S. cerevisiae
ggaacacgcctcacgacaatataat

SEQ ID NO: 49343 - DNA, 25 bp, S. cerevisiae
ggaattctgatcgaggttaacccca

SEQ ID NO: 49344 - DNA, 25 bp, S. cerevisiae
ggccgcaaaccgaaatccaagcgcg

SEQ ID NO: 49345 - DNA, 25 bp, S. cerevisiae
ggaagatttatctctactggaacat

SEQ ID NO: 49346 - DNA, 25 bp, S. cerevisiae
ggaactatgcttccatataactctt

SEQ ID NO: 49347 - DNA, 25 bp, S. cerevisiae
ggaatctagggcctgtagacttcat

SEQ ID NO: 49348 - DNA, 25 bp, S. cerevisiae
ggaatctatgggttctctaatacta

SEQ ID NO: 49349 - DNA, 25 bp, S. cerevisiae
ggaattcatcatcaccactaaagcc

SEQ ID NO: 49350 - DNA, 25 bp, S. cerevisiae
ggaagcagctaaggccctatcacaa

SEQ ID NO: 49351 - DNA, 25 bp, S. cerevisiae
ggaagagcttacctgctttcaatga

SEQ ID NO: 49352 - DNA, 25 bp, S. cerevisiae
ggaagcgcgctagagttgacttgat

SEQ ID NO: 49353 - DNA, 25 bp, S. cerevisiae
ggaacggtctttagctattctagat

SEQ ID NO: 49354 - DNA, 25 bp, S. cerevisiae
ggaactggccttaacacagacttgt

SEQ ID NO: 49355 - DNA, 25 bp, S. cerevisiae
ggaattttctggctactggttcaga

SEQ ID NO: 49356 - DNA, 25 bp, S. cerevisiae
ggaaggtttcttcgaagcttatcta

SEQ ID NO: 49357 - DNA, 25 bp, S. cerevisiae
ggaaagtcttccctgaactgatatg

SEQ ID NO: 49358 - DNA, 25 bp, S. cerevisiae
ggcttttactctgggtttgcaacta

SEQ ID NO: 49359 - DNA, 25 bp, S. cerevisiae
ggctacttagccttgtgttacggca

SEQ ID NO: 49360 - DNA, 25 bp, S. cerevisiae
ggaacttagccagtgtatccgaaga

SEQ ID NO: 49361 - DNA, 25 bp, S. cerevisiae
ggcacacggtgatgttattcatgct

SEQ ID NO: 49362 - DNA, 25 bp, S. cerevisiae
ggcaccggtgaagattccatcgcaa

SEQ ID NO: 49363 - DNA, 25 bp, S. cerevisiae
ggcacgacctccagagggtgattca

SEQ ID NO: 49364 - DNA, 25 bp, S. cerevisiae
ggcacgtcatcttcaagggcaggtt

SEQ ID NO: 49365 - DNA, 25 bp, S. cerevisiae
ggaactgctcagtcaagggctcgtt

SEQ ID NO: 49366 - DNA, 25 bp, S. cerevisiae
ggaacactcaaaagtgactcgtttt

SEQ ID NO: 49367 - DNA, 25 bp, S. cerevisiae
ggaacatctccatgtggtctatttt

SEQ ID NO: 49368 - DNA, 25 bp, S. cerevisiae
ggaaaccccatgatgatgtgattga

SEQ ID NO: 49369 - DNA, 25 bp, S. cerevisiae
ggaaactttgccatgcattatatga

SEQ ID NO: 49370 - DNA, 25 bp, S. cerevisiae
ggaactgtgttgatggccatttgaa

SEQ ID NO: 49371 - DNA, 25 bp, S. cerevisiae
ggaacgtgttgaacagagattttga

SEQ ID NO: 49372 - DNA, 25 bp, S. cerevisiae
ggaacaatggtacgccttacagaaa

SEQ ID NO: 49373 - DNA, 25 bp, S. cerevisiae
ggaagcttcgtctccttcaattaca

SEQ ID NO: 49374 - DNA, 25 bp, S. cerevisiae
ggaacataaccagccttcaattagt

SEQ ID NO: 49375 - DNA, 25 bp, S. cerevisiae
ggaaagaactcagccgtgaaagaat

SEQ ID NO: 49376 - DNA, 25 bp, S. cerevisiae
ggaacaacccatgccggacaatgag

SEQ ID NO: 49377 - DNA, 25 bp, S. cerevisiae
ggaaagactctctactttgacaaag

SEQ ID NO: 49378 - DNA, 25 bp, S. cerevisiae
ggaactgttccgcaatgaactaact

SEQ ID NO: 49379 - DNA, 25 bp, S. cerevisiae
ggaaagctctcccaaatgatactag

SEQ ID NO: 49380 - DNA, 25 bp, S. cerevisiae
ggaacgtctctcatgaagatagcaa

SEQ ID NO: 49381 - DNA, 25 bp, S. cerevisiae
ggaacagtcgactttgaacccattt

SEQ ID NO: 49382 - DNA, 25 bp, S. cerevisiae
tggaatccgaatctgaatccgaatt

SEQ ID NO: 49383 - DNA, 25 bp, S. cerevisiae
ggaacctgaaagagccactgcgatt

SEQ ID NO: 49384 - DNA, 25 bp, S. cerevisiae
ggaaaagattcatcaactggccaaa

SEQ ID NO: 49385 - DNA, 25 bp, S. cerevisiae
ggaacacgacgatcaacgcggccaa

SEQ ID NO: 49386 - DNA, 25 bp, S. cerevisiae
ggaactaccccatatcaatgtgttg

SEQ ID NO: 49387 - DNA, 25 bp, S. cerevisiae
ggaaaaccccgaatcatttgaggca

SEQ ID NO: 49388 - DNA, 25 bp, S. cerevisiae
ggaaaacagcctggtcctgtcgaaa

SEQ ID NO: 49389 - DNA, 25 bp, S. cerevisiae
ggaacacacaccagattcgcaggaa

SEQ ID NO: 49390 - DNA, 25 bp, S. cerevisiae
ggaacagtcctatgtaagctggcaa

SEQ ID NO: 49391 - DNA, 25 bp, S. cerevisiae
ggaacagatccttttaatgcttaat

SEQ ID NO: 49392 - DNA, 25 bp, S. cerevisiae
ggaatagcaaacactcgaatgagca

SEQ ID NO: 49393 - DNA, 25 bp, S. cerevisiae
ggaaacagacccttcgactagagaa

SEQ ID NO: 49394 - DNA, 25 bp, S. cerevisiae
ggaaaatactacgtcgacttcgaca

SEQ ID NO: 49395 - DNA, 25 bp, S. cerevisiae
ggaagaagtacagccggtgctacaa

SEQ ID NO: 49396 - DNA, 25 bp, S. cerevisiae
ggaaacgttcgcctaggtcaaatga

SEQ ID NO: 49397 - DNA, 25 bp, S. cerevisiae
ggaaccgggctctgatgaacaaatt

SEQ ID NO: 49398 - DNA, 25 bp, S. cerevisiae
ggaatctcaacgcagtggccaaaat

SEQ ID NO: 49399 - DNA, 25 bp, S. cerevisiae
ggaagtatatcgagtggaccaccat

SEQ ID NO: 49400 - DNA, 25 bp, S. cerevisiae
ggaaaaggttcattgctgctagcga

SEQ ID NO: 49401 - DNA, 25 bp, S. cerevisiae
ggaaactgtttcaattcgatgccaa

SEQ ID NO: 49402 - DNA, 25 bp, S. cerevisiae
ggaatagagctcgagaaccctgaat

SEQ ID NO: 49403 - DNA, 25 bp, S. cerevisiae
ggaaacgtctagaatcctctccatt

SEQ ID NO: 49404 - DNA, 25 bp, S. cerevisiae
ggaagacggtagaacgctgtctgat

SEQ ID NO: 49405 - DNA, 25 bp, S. cerevisiae
tggaaggtcgtagcaaggatctaat

SEQ ID NO: 49406 - DNA, 25 bp, S. cerevisiae
ggaaaatagtttggcatcgtgctca

SEQ ID NO: 49407 - DNA, 25 bp, S. cerevisiae
ggaaaagagtcctgctcttccacaa

SEQ ID NO: 49408 - DNA, 25 bp, S. cerevisiae
ggaagaaactccagcgcctacaata

SEQ ID NO: 49409 - DNA, 25 bp, S. cerevisiae
ggaaaaatctcctgatcctactatt

SEQ ID NO: 49410 - DNA, 25 bp, S. cerevisiae
ggaaacatcactctcgatactttag

SEQ ID NO: 49411 - DNA, 25 bp, S. cerevisiae
ggaaacatactcttcttacatttac

SEQ ID NO: 49412 - DNA, 25 bp, S. cerevisiae
ggaaggtttctcatatacgcaggta

SEQ ID NO: 49413 - DNA, 25 bp, S. cerevisiae
ggaagttctaccaaatcacgaagct

SEQ ID NO: 49414 - DNA, 25 bp, S. cerevisiae
ggaagtggcaacctaatcagttcaa

SEQ ID NO: 49415 - DNA, 25 bp, S. cerevisiae
ggaagctaatcagggaggcctctcc

SEQ ID NO: 49416 - DNA, 25 bp, S. cerevisiae
ggaaaatgccattgacgctgcttat

SEQ ID NO: 49417 - DNA, 25 bp, S. cerevisiae
ggaaacatccacttcatctttcatg

SEQ ID NO: 49418 - DNA, 25 bp, S. cerevisiae
ggaacaatcttctcttctacacaag

SEQ ID NO: 49419 - DNA, 25 bp, S. cerevisiae
ggaagatgtctctatcactcatatg

SEQ ID NO: 49420 - DNA, 25 bp, S. cerevisiae
ggaaaatgtacagcgccaccaagat

SEQ ID NO: 49421 - DNA, 25 bp, S. cerevisiae
ggaatttgaacagggcctctcggtc

SEQ ID NO: 49422 - DNA, 25 bp, S. cerevisiae
ggaattagatagcacccaacagaag

SEQ ID NO: 49423 - DNA, 25 bp, S. cerevisiae
ggaacttccataagaccgacatgaa

SEQ ID NO: 49424 - DNA, 25 bp, S. cerevisiae
ggaacattgcctgagacgggcacta

SEQ ID NO: 49425 - DNA, 25 bp, S. cerevisiae
ggaaaatgtttaccggtgcagccgc

SEQ ID NO: 49426 - DNA, 25 bp, S. cerevisiae
ggaaaatgtttaccgatctattcga

SEQ ID NO: 49427 - DNA, 25 bp, S. cerevisiae
ggaaccgcaaacatcaagacgcata

SEQ ID NO: 49428 - DNA, 25 bp, S. cerevisiae
ggaacgccatcaaagccagagtcga

SEQ ID NO: 49429 - DNA, 25 bp, S. cerevisiae
ggaacacggcaaggctactgtcgaa

SEQ ID NO: 49430 - DNA, 25 bp, S. cerevisiae
ggaatccggaggttattgatccaaa

SEQ ID NO: 49431 - DNA, 25 bp, S. cerevisiae
ggaagcctggagagtactacaaaca

SEQ ID NO: 49432 - DNA, 25 bp, S. cerevisiae
ggaatgccttaatgaacgcttacaa

SEQ ID NO: 49433 - DNA, 25 bp, S. cerevisiae
ggaaccaattgattatcccttacaa

SEQ ID NO: 49434 - DNA, 25 bp, S. cerevisiae
ggaatcgtcatgtccgttcaagaac

SEQ ID NO: 49435 - DNA, 25 bp, S. cerevisiae
ggaagctcctgttcaaatcgttaag

SEQ ID NO: 49436 - DNA, 25 bp, S. cerevisiae
ggaagtccctgcgagatcagcttag

SEQ ID NO: 49437 - DNA, 25 bp, S. cerevisiae
ggaatgtcaattggcgacgcttggt

SEQ ID NO: 49438 - DNA, 25 bp, S. cerevisiae
ggaacagctatctttcgttatgaat

SEQ ID NO: 49439 - DNA, 25 bp, S. cerevisiae
ggaacagcagctattctctatagaa

SEQ ID NO: 49440 - DNA, 25 bp, S. cerevisiae
ggaagccagctttgttgtatctagt

SEQ ID NO: 49441 - DNA, 25 bp, S. cerevisiae
ggaactatgattctttgctcaatgc

SEQ ID NO: 49442 - DNA, 25 bp, S. cerevisiae
ggaaccagttcaatcatctgctcat

SEQ ID NO: 49443 - DNA, 25 bp, S. cerevisiae
ggaattagacaacggcgacacattt

SEQ ID NO: 49444 - DNA, 25 bp, S. cerevisiae
ggaacgagtaacacagaccagcttg

SEQ ID NO: 49445 - DNA, 25 bp, S. cerevisiae
tggaaattaaccacagaccaatctg

SEQ ID NO: 49446 - DNA, 25 bp, S. cerevisiae
ggaatgccacttgactaacacatgt

SEQ ID NO: 49447 - DNA, 25 bp, S. cerevisiae
ggaagctagcgaagcagcccacgat

SEQ ID NO: 49448 - DNA, 25 bp, S. cerevisiae
ggaagactgccaccagtaaacctgg

SEQ ID NO: 49449 - DNA, 25 bp, S. cerevisiae
ggaatagctacaacagtcaacccgg

SEQ ID NO: 49450 - DNA, 25 bp, S. cerevisiae
tgtatacccacgttttgaaccagta

SEQ ID NO: 49451 - DNA, 25 bp, S. cerevisiae
ggcactaaagccgtttttgtcaatg

SEQ ID NO: 49452 - DNA, 25 bp, S. cerevisiae
tggaaacagacgctccttatggaga

SEQ ID NO: 49453 - DNA, 25 bp, S. cerevisiae
ggcaaagtactccatcagtctgctg

SEQ ID NO: 49454 - DNA, 25 bp, S. cerevisiae
ggaagctcaagacgttgttcaagac

SEQ ID NO: 49455 - DNA, 25 bp, S. cerevisiae
ggaagccatggacgttctatcataa

SEQ ID NO: 49456 - DNA, 25 bp, S. cerevisiae
ggcaaccaggaggtctcgcaagaga

SEQ ID NO: 49457 - DNA, 25 bp, S. cerevisiae
ggaaccagggcattcaccaagtgat

SEQ ID NO: 49458 - DNA, 25 bp, S. cerevisiae
ggaaccaattgcttcaccaaaggga

SEQ ID NO: 49459 - DNA, 25 bp, S. cerevisiae
ggaacaagctcgaatacccaatggt

SEQ ID NO: 49460 - DNA, 25 bp, S. cerevisiae
ggaacaagcactattgacccagtta

SEQ ID NO: 49461 - DNA, 25 bp, S. cerevisiae
ggaactactcatcttacgttgtttg

SEQ ID NO: 49462 - DNA, 25 bp, S. cerevisiae
ggaacagttcgatcacgtgtgcttg

SEQ ID NO: 49463 - DNA, 25 bp, S. cerevisiae
ggaactgaaggatgctctctcgaat

SEQ ID NO: 49464 - DNA, 25 bp, S. cerevisiae
ggaacaaagcgaactccttgatatt

SEQ ID NO: 49465 - DNA, 25 bp, S. cerevisiae
ggaacaccggattttctgaactatt

SEQ ID NO: 49466 - DNA, 25 bp, S. cerevisiae
ggaagaccctgattttttgcagcat

SEQ ID NO: 49467 - DNA, 25 bp, S. cerevisiae
ggaacagccctctttggatatgcag

SEQ ID NO: 49468 - DNA, 25 bp, S. cerevisiae
ggaacagccactttggagtcatcaa

SEQ ID NO: 49469 - DNA, 25 bp, S. cerevisiae
ggaaaatgcccgcagatgcatctta

SEQ ID NO: 49470 - DNA, 25 bp, S. cerevisiae
ggaacaacgcgccaaaattgatgaa

SEQ ID NO: 49471 - DNA, 25 bp, S. cerevisiae
ggaacctattccgttattgaacata

SEQ ID NO: 49472 - DNA, 25 bp, S. cerevisiae
ggaacctttcacatccagagacaca

SEQ ID NO: 49473 - DNA, 25 bp, S. cerevisiae
ggaagccagtcttgaacttggacaa

SEQ ID NO: 49474 - DNA, 25 bp, S. cerevisiae
ggaagcaattctttcacgtgaacaa

SEQ ID NO: 49475 - DNA, 25 bp, S. cerevisiae
ggaactccaagctgattctgaattt

SEQ ID NO: 49476 - DNA, 25 bp, S. cerevisiae
ggaactacgactcttctattatcaa

SEQ ID NO: 49477 - DNA, 25 bp, S. cerevisiae
ggaacttctgatacctctgcaacaa

SEQ ID NO: 49478 - DNA, 25 bp, S. cerevisiae
ggaactgtttggtcttctgattttg

SEQ ID NO: 49479 - DNA, 25 bp, S. cerevisiae
ggaagctagccaactattgcctaat

SEQ ID NO: 49480 - DNA, 25 bp, S. cerevisiae
ggaactgacattgttcttatcctat

SEQ ID NO: 49481 - DNA, 25 bp, S. cerevisiae
ggaaggaatacgatctttccagatc

SEQ ID NO: 49482 - DNA, 25 bp, S. cerevisiae
ggaagtgacaccacaactacacgaa

SEQ ID NO: 49483 - DNA, 25 bp, S. cerevisiae
ggaattgaccctaaaccagcaaact

SEQ ID NO: 49484 - DNA, 25 bp, S. cerevisiae
ggaattgattgccttgaacctaagt

SEQ ID NO: 49485 - DNA, 25 bp, S. cerevisiae
ggaattgattgatgacccgctactt

SEQ ID NO: 49486 - DNA, 25 bp, S. cerevisiae
ggaactactgatagacccttggatg

SEQ ID NO: 49487 - DNA, 25 bp, S. cerevisiae
ggaagctctttatcaaacggcatgg

SEQ ID NO: 49488 - DNA, 25 bp, S. cerevisiae
ggaactcatcatcgtcattattatt

SEQ ID NO: 49489 - DNA, 25 bp, S. cerevisiae
ggaactatcagaggcagtattctaa

SEQ ID NO: 49490 - DNA, 25 bp, S. cerevisiae
ggaacgacatcgtgtatgccagcat

SEQ ID NO: 49491 - DNA, 25 bp, S. cerevisiae
ggaactggacgaaattgctgcatct

SEQ ID NO: 49492 - DNA, 25 bp, S. cerevisiae
ggaacctgaaatcatcgctgcttta

SEQ ID NO: 49493 - DNA, 25 bp, S. cerevisiae
ggaagctcaccctgcagaggaatct

SEQ ID NO: 49494 - DNA, 25 bp, S. cerevisiae
ggaagcgcctccagcagtacaagct

SEQ ID NO: 49495 - DNA, 25 bp, S. cerevisiae
ggaagcgcttttgcagttcaaggat

SEQ ID NO: 49496 - DNA, 25 bp, S. cerevisiae
ggaagaattactttggcatgcttta

SEQ ID NO: 49497 - DNA, 25 bp, S. cerevisiae
ggaagagagcgagcgccttctttca

SEQ ID NO: 49498 - DNA, 25 bp, S. cerevisiae
ggaagaacatgtgcccttgattcaa

SEQ ID NO: 49499 - DNA, 25 bp, S. cerevisiae
ggaagttatcccattattgcctaaa

SEQ ID NO: 49500 - DNA, 25 bp, S. cerevisiae
ggaagcccgtatcccagaaatctta

SEQ ID NO: 49501 - DNA, 25 bp, S. cerevisiae
ggaagtacatctaaacggccaattg

SEQ ID NO: 49502 - DNA, 25 bp, S. cerevisiae
ggaacttttctttgccgtcatttat

SEQ ID NO: 49503 - DNA, 25 bp, S. cerevisiae
ggaagttatcttttcccatcgtcca

SEQ ID NO: 49504 - DNA, 25 bp, S. cerevisiae
ggaagctatcgattttgcccaaaaa

SEQ ID NO: 49505 - DNA, 25 bp, S. cerevisiae
ggaagatttcgttcactcacatgaa

SEQ ID NO: 49506 - DNA, 25 bp, S. cerevisiae
ggaagtcgatccatcaaacatgaac

SEQ ID NO: 49507 - DNA, 25 bp, S. cerevisiae
ggcacagtccattagtaccacgaag

SEQ ID NO: 49508 - DNA, 25 bp, S. cerevisiae
ggcaagttcctacctgggcaataac

SEQ ID NO: 49509 - DNA, 25 bp, S. cerevisiae
ggaatggtacctcctctaatgggat

SEQ ID NO: 49510 - DNA, 25 bp, S. cerevisiae
ggctaggtcacctcttcatagtaat

SEQ ID NO: 49511 - DNA, 25 bp, S. cerevisiae
ggaactgtatcctctttagtaataa

SEQ ID NO: 49512 - DNA, 25 bp, S. cerevisiae
ggaatttgatgccacttttgttgaa

SEQ ID NO: 49513 - DNA, 25 bp, S. cerevisiae
ggaatcgaatcgactcttctcaaag

SEQ ID NO: 49514 - DNA, 25 bp, S. cerevisiae
ggaataatttgctctttcagactgc

SEQ ID NO: 49515 - DNA, 25 bp, S. cerevisiae
ggaacgtttgatattctaccctgat

SEQ ID NO: 49516 - DNA, 25 bp, S. cerevisiae
ggaacgtttacttactgacagctct

SEQ ID NO: 49517 - DNA, 25 bp, S. cerevisiae
ggcactcttgaggaggaattgacta

SEQ ID NO: 49518 - DNA, 25 bp, S. cerevisiae
ggcaattatggtaggctgtctcagc

SEQ ID NO: 49519 - DNA, 25 bp, S. cerevisiae
ggaaccagtgattacttctgccaaa

SEQ ID NO: 49520 - DNA, 25 bp, S. cerevisiae
ggaactcagcgatttgcatctaaca

SEQ ID NO: 49521 - DNA, 25 bp, S. cerevisiae
ggaacgcacgaaagatggctcacaa

SEQ ID NO: 49522 - DNA, 25 bp, S. cerevisiae
ggaatcctgcagattgggtcacaac

SEQ ID NO: 49523 - DNA, 25 bp, S. cerevisiae
ggaatcccagcatggcgatgtgtaa

SEQ ID NO: 49524 - DNA, 25 bp, S. cerevisiae
ggaactcctatttgcgctgtgaaaa

SEQ ID NO: 49525 - DNA, 25 bp, S. cerevisiae
ggaacccattatgcgtctatcaaag

SEQ ID NO: 49526 - DNA, 25 bp, S. cerevisiae
ggaacggagtcattctggttatcaa

SEQ ID NO: 49527 - DNA, 25 bp, S. cerevisiae
ggaagtggaccttgattccttcaaa

SEQ ID NO: 49528 - DNA, 25 bp, S. cerevisiae
ggaagatcggccatattcctgtgat

SEQ ID NO: 49529 - DNA, 25 bp, S. cerevisiae
ggaagatctgctccgaaatttggaa

SEQ ID NO: 49530 - DNA, 25 bp, S. cerevisiae
ggaagcgtgtatctgcatcattcaa

SEQ ID NO: 49531 - DNA, 25 bp, S. cerevisiae
tctgtaccgttctggttaacttact

SEQ ID NO: 49532 - DNA, 25 bp, S. cerevisiae
ggcaagattaccattccgaattttc

SEQ ID NO: 49533 - DNA, 25 bp, S. cerevisiae
ggaagactaacgtccactggatttg

SEQ ID NO: 49534 - DNA, 25 bp, S. cerevisiae
ggaagtcttacgttcattggatcat

SEQ ID NO: 49535 - DNA, 25 bp, S. cerevisiae
ggaagcattttcctatatggctaca

SEQ ID NO: 49536 - DNA, 25 bp, S. cerevisiae
ggaactatctattcttcaggctgaa

SEQ ID NO: 49537 - DNA, 25 bp, S. cerevisiae
ggaactgacaactatatgcgagcaa

SEQ ID NO: 49538 - DNA, 25 bp, S. cerevisiae
ggaattgccaacaaccgggacgagt

SEQ ID NO: 49539 - DNA, 25 bp, S. cerevisiae
ggcaattcttacaatacgatccatc

SEQ ID NO: 49540 - DNA, 25 bp, S. cerevisiae
ggccggtaagtctaggagccacttg

SEQ ID NO: 49541 - DNA, 25 bp, S. cerevisiae
ggccgtgtttctgaggagctacatt

SEQ ID NO: 49542 - DNA, 25 bp, S. cerevisiae
ggcaaagctttctgagggtacatct

SEQ ID NO: 49543 - DNA, 25 bp, S. cerevisiae
ggccaaattatctgaaggtacttct

SEQ ID NO: 49544 - DNA, 25 bp, S. cerevisiae
ggcactgagatttcccaaggtgagt

SEQ ID NO: 49545 - DNA, 25 bp, S. cerevisiae
ggcaattagctaaccaacgcaagga

SEQ ID NO: 49546 - DNA, 25 bp, S. cerevisiae
ggcacccatgccagaaaactagaga

SEQ ID NO: 49547 - DNA, 25 bp, S. cerevisiae
ggcaaccttaaaaacactagacagt

SEQ ID NO: 49548 - DNA, 25 bp, S. cerevisiae
ggaaccttctatatagccttgagca

SEQ ID NO: 49549 - DNA, 25 bp, S. cerevisiae
ggaactgttgctacagatccacaag

SEQ ID NO: 49550 - DNA, 25 bp, S. cerevisiae
ggaatcattgactcagcgcacaacc

SEQ ID NO: 49551 - DNA, 25 bp, S. cerevisiae
ggaatgcatatgtcctccggataac

SEQ ID NO: 49552 - DNA, 25 bp, S. cerevisiae
ggaatgatcgacaagcacgtcaaga

SEQ ID NO: 49553 - DNA, 25 bp, S. cerevisiae
ggaatgtcgcacacgctgatgtgga

SEQ ID NO: 49554 - DNA, 25 bp, S. cerevisiae
ggaagccctccaagataggcaacaa

SEQ ID NO: 49555 - DNA, 25 bp, S. cerevisiae
ggcaattccctctgcagtagataaa

SEQ ID NO: 49556 - DNA, 25 bp, S. cerevisiae
ggaactgcccacttcagtatagtag

SEQ ID NO: 49557 - DNA, 25 bp, S. cerevisiae
ggaactctaactacacattcttcgt

SEQ ID NO: 49558 - DNA, 25 bp, S. cerevisiae
ggaaggcaagccatccaatcgcatt

SEQ ID NO: 49559 - DNA, 25 bp, S. cerevisiae
ggaacgctagacacagacactggat

SEQ ID NO: 49560 - DNA, 25 bp, S. cerevisiae
ggcaaccttacaaccaacatggcat

SEQ ID NO: 49561 - DNA, 25 bp, S. cerevisiae
ggcaaccaattctccaatgctacta

SEQ ID NO: 49562 - DNA, 25 bp, S. cerevisiae
ggaattcaactctcaacctgactac

SEQ ID NO: 49563 - DNA, 25 bp, S. cerevisiae
ggaattcaagactggctcctaccaa

SEQ ID NO: 49564 - DNA, 25 bp, S. cerevisiae
ggaacgtaatattgtgtcacttcga

SEQ ID NO: 49565 - DNA, 25 bp, S. cerevisiae
ggaactgtttctgctgatactgtta

SEQ ID NO: 49566 - DNA, 25 bp, S. cerevisiae
ggaacgttactgagcgacttgatga

SEQ ID NO: 49567 - DNA, 25 bp, S. cerevisiae
ggcaaccttaggtgaactagctgat

SEQ ID NO: 49568 - DNA, 25 bp, S. cerevisiae
ggaaccttgaacttgaacagcgttt

SEQ ID NO: 49569 - DNA, 25 bp, S. cerevisiae
ggaacctattgtatccgctgatggt

SEQ ID NO: 49570 - DNA, 25 bp, S. cerevisiae
ggaactgcttttttcacggtagtga

SEQ ID NO: 49571 - DNA, 25 bp, S. cerevisiae
ggaagcggcgataatagcagcacta

SEQ ID NO: 49572 - DNA, 25 bp, S. cerevisiae
ggaagccgccatcaacgatgtcaat

SEQ ID NO: 49573 - DNA, 25 bp, S. cerevisiae
ggaatggattcaccaactgatgatc

SEQ ID NO: 49574 - DNA, 25 bp, S. cerevisiae
ggcagcggcttcaacatactgaaaa

SEQ ID NO: 49575 - DNA, 25 bp, S. cerevisiae
ggcacggctaactgggacaagattt

SEQ ID NO: 49576 - DNA, 25 bp, S. cerevisiae
ggcgaaactgtcaaggttcctcgtg

SEQ ID NO: 49577 - DNA, 25 bp, S. cerevisiae
ggcaggaagttcaaaagtcgtcgtt

SEQ ID NO: 49578 - DNA, 25 bp, S. cerevisiae
ggaagagacccactataatgctaca

SEQ ID NO: 49579 - DNA, 25 bp, S. cerevisiae
ggaaggaccccatcatggctagaaa

SEQ ID NO: 49580 - DNA, 25 bp, S. cerevisiae
ggaattgacctccagaatggctgaa

SEQ ID NO: 49581 - DNA, 25 bp, S. cerevisiae
ggaactggtgcaacattttctgtac

SEQ ID NO: 49582 - DNA, 25 bp, S. cerevisiae
ggaactggtaacgtcgcttcaatct

SEQ ID NO: 49583 - DNA, 25 bp, S. cerevisiae
ggaaccttcaacgtggtccagaatt

SEQ ID NO: 49584 - DNA, 25 bp, S. cerevisiae
ggaaccttctcaagatggtcctgta

SEQ ID NO: 49585 - DNA, 25 bp, S. cerevisiae
tggacagtttcaagagggcaccgat

SEQ ID NO: 49586 - DNA, 25 bp, S. cerevisiae
ggaagctcattaacgaccccaaata

SEQ ID NO: 49587 - DNA, 25 bp, S. cerevisiae
ggaagacacgatacgtccattaaat

SEQ ID NO: 49588 - DNA, 25 bp, S. cerevisiae
ggaatgaccgccaaacctaaagtag

SEQ ID NO: 49589 - DNA, 25 bp, S. cerevisiae
ggaataccccttatcttcgaagatg

SEQ ID NO: 49590 - DNA, 25 bp, S. cerevisiae
ggaaccatccacttttgttggtaga

SEQ ID NO: 49591 - DNA, 25 bp, S. cerevisiae
ggaatctaccactgttatcgacttg

SEQ ID NO: 49592 - DNA, 25 bp, S. cerevisiae
ggaagtcatcccgttaacgatggag

SEQ ID NO: 49593 - DNA, 25 bp, S. cerevisiae
ggaagccaccgttatacacgatgga

SEQ ID NO: 49594 - DNA, 25 bp, S. cerevisiae
ggaacctcttcatatccacggaatt

SEQ ID NO: 49595 - DNA, 25 bp, S. cerevisiae
ggaacgttttgttggcataccagaa

SEQ ID NO: 49596 - DNA, 25 bp, S. cerevisiae
ggaatccattttcttctcatccaaa

SEQ ID NO: 49597 - DNA, 25 bp, S. cerevisiae
ggaatccagtatatcccactattgt

SEQ ID NO: 49598 - DNA, 25 bp, S. cerevisiae
ggaacctccatagcattgattactg

SEQ ID NO: 49599 - DNA, 25 bp, S. cerevisiae
ggaaccctcgatattgattgacgtt

SEQ ID NO: 49600 - DNA, 25 bp, S. cerevisiae
ggaagccttatggagtgtcattgac

SEQ ID NO: 49601 - DNA, 25 bp, S. cerevisiae
ggaattcccgaagtgttaccaaatg

SEQ ID NO: 49602 - DNA, 25 bp, S. cerevisiae
ggaagtcctcagtgtgtacagcttt

SEQ ID NO: 49603 - DNA, 25 bp, S. cerevisiae
ggaagctgtatacactaaagtcatt

SEQ ID NO: 49604 - DNA, 25 bp, S. cerevisiae
ggaagcttaaccctatggagtctga

SEQ ID NO: 49605 - DNA, 25 bp, S. cerevisiae
ggccgttaacgcatggtggtctata

SEQ ID NO: 49606 - DNA, 25 bp, S. cerevisiae
ggcccttagaccatattgacacgtt

SEQ ID NO: 49607 - DNA, 25 bp, S. cerevisiae
ggcccaaagaccaattaccggtgct

SEQ ID NO: 49608 - DNA, 25 bp, S. cerevisiae
ggcgcccaaaccgacgaaggtgttg

SEQ ID NO: 49609 - DNA, 25 bp, S. cerevisiae
ggcacccaaccaaacaaaattgtgt

SEQ ID NO: 49610 - DNA, 25 bp, S. cerevisiae
ggaatcgccacccaacaaagttgtg

SEQ ID NO: 49611 - DNA, 25 bp, S. cerevisiae
ggcatctgggaaaccattcaagtat

SEQ ID NO: 49612 - DNA, 25 bp, S. cerevisiae
ggcagtttgataatcctacagggac

SEQ ID NO: 49613 - DNA, 25 bp, S. cerevisiae
ggaatttatgtcaccaccgttatcg

SEQ ID NO: 49614 - DNA, 25 bp, S. cerevisiae
ggaattgtactcttgccagaagtta

SEQ ID NO: 49615 - DNA, 25 bp, S. cerevisiae
ggaagccactgattatgccacaaga

SEQ ID NO: 49616 - DNA, 25 bp, S. cerevisiae
ggaatcagactatgtcaccaagcaa

SEQ ID NO: 49617 - DNA, 25 bp, S. cerevisiae
ggaagctcgaagtctatggacctaa

SEQ ID NO: 49618 - DNA, 25 bp, S. cerevisiae
ggaagtcggatttgatgccacgcaa

SEQ ID NO: 49619 - DNA, 25 bp, S. cerevisiae
ggaatcaggtctttaaacgcactaa

SEQ ID NO: 49620 - DNA, 25 bp, S. cerevisiae
ggaatttttgtcaatcactttcgaa

SEQ ID NO: 49621 - DNA, 25 bp, S. cerevisiae
ggaattctttgatgtacgctttaca

SEQ ID NO: 49622 - DNA, 25 bp, S. cerevisiae
ggaaccagctttgaagtctttgaat

SEQ ID NO: 49623 - DNA, 25 bp, S. cerevisiae
ggaagtcagctttaatcctcttttt

SEQ ID NO: 49624 - DNA, 25 bp, S. cerevisiae
ggaagttctttagccctgggtgaat

SEQ ID NO: 49625 - DNA, 25 bp, S. cerevisiae
ggaatgttctttatagcccactgct

SEQ ID NO: 49626 - DNA, 25 bp, S. cerevisiae
tggataactctagaattcccttgtt

SEQ ID NO: 49627 - DNA, 25 bp, S. cerevisiae
ggcactttttcctacaatgtcgatc

SEQ ID NO: 49628 - DNA, 25 bp, S. cerevisiae
ggcattttggtatacgatctcgctc

SEQ ID NO: 49629 - DNA, 25 bp, S. cerevisiae
ggctgactatagcacggtggacctc

SEQ ID NO: 49630 - DNA, 25 bp, S. cerevisiae
ggctacgataggtgcggcgttcatc

SEQ ID NO: 49631 - DNA, 25 bp, S. cerevisiae
ggcactacttggtgtatcgttgcaa

SEQ ID NO: 49632 - DNA, 25 bp, S. cerevisiae
ggcaaactctttgtcataggtgaag

SEQ ID NO: 49633 - DNA, 25 bp, S. cerevisiae
ggaaccatctgttaatccacttcag

SEQ ID NO: 49634 - DNA, 25 bp, S. cerevisiae
ggaaccattgccgacatgagacagt

SEQ ID NO: 49635 - DNA, 25 bp, S. cerevisiae
ggaagctgcttcaagctcgactgtt

SEQ ID NO: 49636 - DNA, 25 bp, S. cerevisiae
ggaagccattcctattctcaatatg

SEQ ID NO: 49637 - DNA, 25 bp, S. cerevisiae
ggaatccatttctacttctttgggt

SEQ ID NO: 49638 - DNA, 25 bp, S. cerevisiae
ggcaactttcaatcttcttttggta

SEQ ID NO: 49639 - DNA, 25 bp, S. cerevisiae
ggcagcactttccaactcgatttcg

SEQ ID NO: 49640 - DNA, 25 bp, S. cerevisiae
tggcagccggttacggtaagatctt

SEQ ID NO: 49641 - DNA, 25 bp, S. cerevisiae
ggcactccagttagtgggaaggtat

SEQ ID NO: 49642 - DNA, 25 bp, S. cerevisiae
ggcaatccggatatcctgaagttca

SEQ ID NO: 49643 - DNA, 25 bp, S. cerevisiae
ggaagtctggacatcctttgttgag

SEQ ID NO: 49644 - DNA, 25 bp, S. cerevisiae
ggaagtcagtactccactatggtga

SEQ ID NO: 49645 - DNA, 25 bp, S. cerevisiae
ggaagatgagtttgccccaatcgtc

SEQ ID NO: 49646 - DNA, 25 bp, S. cerevisiae
ggaagatagtgttgccccagcagtt

SEQ ID NO: 49647 - DNA, 25 bp, S. cerevisiae
ggcacgtctaattcttatggaggca

SEQ ID NO: 49648 - DNA, 25 bp, S. cerevisiae
ggaagttagacgaagctgaaatgca

SEQ ID NO: 49649 - DNA, 25 bp, S. cerevisiae
ggaattattctccatgcgagccagg

SEQ ID NO: 49650 - DNA, 25 bp, S. cerevisiae
ggaattcatcctgatagagccaaac

SEQ ID NO: 49651 - DNA, 25 bp, S. cerevisiae
ggaatctgccggtattgaccaaact

SEQ ID NO: 49652 - DNA, 25 bp, S. cerevisiae
ggaatccgccactttgaacacagtt

SEQ ID NO: 49653 - DNA, 25 bp, S. cerevisiae
ggaagccactatctggagacacgtt

SEQ ID NO: 49654 - DNA, 25 bp, S. cerevisiae
ggcaatgcccacagaggaaccgatt

SEQ ID NO: 49655 - DNA, 25 bp, S. cerevisiae
ggctacatcctcagtggactacgaa

SEQ ID NO: 49656 - DNA, 25 bp, S. cerevisiae
ggcggccttaagagatgctactgta

SEQ ID NO: 49657 - DNA, 25 bp, S. cerevisiae
ggctgaagctgtcatcggttactta

SEQ ID NO: 49658 - DNA, 25 bp, S. cerevisiae
ggcagttattgctatcaggttttta

SEQ ID NO: 49659 - DNA, 25 bp, S. cerevisiae
ggcaaggttccagacattatttacg

SEQ ID NO: 49660 - DNA, 25 bp, S. cerevisiae
ggaataccaccaaagaatttcgcag

SEQ ID NO: 49661 - DNA, 25 bp, S. cerevisiae
ggcaaacatccaatacgtaacgtac

SEQ ID NO: 49662 - DNA, 25 bp, S. cerevisiae
ggcaagtacactaagcctaccgaac

SEQ ID NO: 49663 - DNA, 25 bp, S. cerevisiae
ggaagtcccaattgctgtactcgca

SEQ ID NO: 49664 - DNA, 25 bp, S. cerevisiae
ggaagtcctcaatagtcctcaggtt

SEQ ID NO: 49665 - DNA, 25 bp, S. cerevisiae
ggcaagaaaccttctacgtgggcta

SEQ ID NO: 49666 - DNA, 25 bp, S. cerevisiae
ggcaactaagcctttactgggttca

SEQ ID NO: 49667 - DNA, 25 bp, S. cerevisiae
ggcaagaatcacctttacccttata

SEQ ID NO: 49668 - DNA, 25 bp, S. cerevisiae
ggaatcctgccattttacccaataa

SEQ ID NO: 49669 - DNA, 25 bp, S. cerevisiae
ggaatgccccagattctcaaacaag

SEQ ID NO: 49670 - DNA, 25 bp, S. cerevisiae
ggcaagggtctagaaggcgctatat

SEQ ID NO: 49671 - DNA, 25 bp, S. cerevisiae
ggaagcgtttcagctatactcaaac

SEQ ID NO: 49672 - DNA, 25 bp, S. cerevisiae
ggaatctggatcacactggaatcat

SEQ ID NO: 49673 - DNA, 25 bp, S. cerevisiae
ggaattgcaacaacagctggcccat

SEQ ID NO: 49674 - DNA, 25 bp, S. cerevisiae
ggaagatgaccaacatgctatccaa

SEQ ID NO: 49675 - DNA, 25 bp, S. cerevisiae
ggaagcatccgctaagataccaaag

SEQ ID NO: 49676 - DNA, 25 bp, S. cerevisiae
ggaagcaacagcgatcgtggccaaa

SEQ ID NO: 49677 - DNA, 25 bp, S. cerevisiae
ggaagcactcccttagattctcaaa

SEQ ID NO: 49678 - DNA, 25 bp, S. cerevisiae
ggaaggatccaaacaatctctcaaa

SEQ ID NO: 49679 - DNA, 25 bp, S. cerevisiae
ggaagctaccgagtatgcactgaat

SEQ ID NO: 49680 - DNA, 25 bp, S. cerevisiae
ggaagctactctcggaactgatcat

SEQ ID NO: 49681 - DNA, 25 bp, S. cerevisiae
ggaagacacttccagaactattgtc

SEQ ID NO: 49682 - DNA, 25 bp, S. cerevisiae
ggaagaccttttacactacatagag

SEQ ID NO: 49683 - DNA, 25 bp, S. cerevisiae
ggaagaaccttttactgccatgatc

SEQ ID NO: 49684 - DNA, 25 bp, S. cerevisiae
ggaagacactgcgttgagatttgac

SEQ ID NO: 49685 - DNA, 25 bp, S. cerevisiae
ggaataccagtcgttgtagcaatca

SEQ ID NO: 49686 - DNA, 25 bp, S. cerevisiae
ggaatcatttccatcttactttaga

SEQ ID NO: 49687 - DNA, 25 bp, S. cerevisiae
ggaagttcaccagtaatgtcgcata

SEQ ID NO: 49688 - DNA, 25 bp, S. cerevisiae
ggaagttagactacgcaccaggccc

SEQ ID NO: 49689 - DNA, 25 bp, S. cerevisiae
ggcaagttaatcaagcgaccatcct

SEQ ID NO: 49690 - DNA, 25 bp, S. cerevisiae
ggaagcttacattaccaaatcatct

SEQ ID NO: 49691 - DNA, 25 bp, S. cerevisiae
ggaaggtacatctgccatgcttcat

SEQ ID NO: 49692 - DNA, 25 bp, S. cerevisiae
ggaatggacaatctgccttgatcaa

SEQ ID NO: 49693 - DNA, 25 bp, S. cerevisiae
ggaatgaacgtcaaccatggatcta

SEQ ID NO: 49694 - DNA, 25 bp, S. cerevisiae
ggcaacattgccctggttataaatc

SEQ ID NO: 49695 - DNA, 25 bp, S. cerevisiae
ggaatcctacgttgcctccatcgaa

SEQ ID NO: 49696 - DNA, 25 bp, S. cerevisiae
ggaaggctccgaagctccacaagaa

SEQ ID NO: 49697 - DNA, 25 bp, S. cerevisiae
ggaatggtgcctaaatcccatggaa

SEQ ID NO: 49698 - DNA, 25 bp, S. cerevisiae
ggaagagctctaaaatgccatttgt

SEQ ID NO: 49699 - DNA, 25 bp, S. cerevisiae
ggaagagcttaccaacagttttgaa

SEQ ID NO: 49700 - DNA, 25 bp, S. cerevisiae
ggaagaacttcctacgtttcatgat

SEQ ID NO: 49701 - DNA, 25 bp, S. cerevisiae
ggcaagaacgtgtcaaggttcactt

SEQ ID NO: 49702 - DNA, 25 bp, S. cerevisiae
ggcacggacgtgtacatcaagctca

SEQ ID NO: 49703 - DNA, 25 bp, S. cerevisiae
ggaagaccagtttgctcaagtcact

SEQ ID NO: 49704 - DNA, 25 bp, S. cerevisiae
ggaaggcccatgtatccaagacctg

SEQ ID NO: 49705 - DNA, 25 bp, S. cerevisiae
ggaagcagccactactgcaaagaca

SEQ ID NO: 49706 - DNA, 25 bp, S. cerevisiae
ggcaaggttgcgactgagactcaaa

SEQ ID NO: 49707 - DNA, 25 bp, S. cerevisiae
ggaatgcgcaatatacacacctctt

SEQ ID NO: 49708 - DNA, 25 bp, S. cerevisiae
ggaattagcttctcaatccttcatc

SEQ ID NO: 49709 - DNA, 25 bp, S. cerevisiae
ggcaaaacattctcaaacttcgctg

SEQ ID NO: 49710 - DNA, 25 bp, S. cerevisiae
ggcaaaaactcttcagtatcctcgc

SEQ ID NO: 49711 - DNA, 25 bp, S. cerevisiae
ggcaaaataatttcgtttctcagta

SEQ ID NO: 49712 - DNA, 25 bp, S. cerevisiae
ggcaaatgtaacttgttttctgaaa

SEQ ID NO: 49713 - DNA, 25 bp, S. cerevisiae
ggcacccttgaatctcttcgaagaa

SEQ ID NO: 49714 - DNA, 25 bp, S. cerevisiae
ggaagacctatctgccatcgaagaa

SEQ ID NO: 49715 - DNA, 25 bp, S. cerevisiae
ggaagagacaatactccgttaccaa

SEQ ID NO: 49716 - DNA, 25 bp, S. cerevisiae
ggaagaagatatcccactggaacta

SEQ ID NO: 49717 - DNA, 25 bp, S. cerevisiae
ggaagaatatgaccgcctgcaagaa

SEQ ID NO: 49718 - DNA, 25 bp, S. cerevisiae
ggaagacatacctgtcccagaaaag

SEQ ID NO: 49719 - DNA, 25 bp, S. cerevisiae
ggaatgattacgtgccgctaaaaag

SEQ ID NO: 49720 - DNA, 25 bp, S. cerevisiae
ggaagattctagtcccgcgagaaga

SEQ ID NO: 49721 - DNA, 25 bp, S. cerevisiae
ggcaagactttgtaccagatgagca

SEQ ID NO: 49722 - DNA, 25 bp, S. cerevisiae
ggaagacactgttatgccatatgtt

SEQ ID NO: 49723 - DNA, 25 bp, S. cerevisiae
ggaagtgcatgtttagaagccatta

SEQ ID NO: 49724 - DNA, 25 bp, S. cerevisiae
ggaagatgctgcaatctcctaccat

SEQ ID NO: 49725 - DNA, 25 bp, S. cerevisiae
ggcagaagatgaactctggcatgaa

SEQ ID NO: 49726 - DNA, 25 bp, S. cerevisiae
ggcagatcaagtaccagttacaaca

SEQ ID NO: 49727 - DNA, 25 bp, S. cerevisiae
ggaagactcagcaaactcaacagat

SEQ ID NO: 49728 - DNA, 25 bp, S. cerevisiae
ggaattataccctcagacaatcagt

SEQ ID NO: 49729 - DNA, 25 bp, S. cerevisiae
ggaatttaactcttgtatcaccgat

SEQ ID NO: 49730 - DNA, 25 bp, S. cerevisiae
ggaattgctaatggcgttttccaga

SEQ ID NO: 49731 - DNA, 25 bp, S. cerevisiae
ggaaggctccaatctttatccgatt

SEQ ID NO: 49732 - DNA, 25 bp, S. cerevisiae
ggaaggaaaattgcccatccagctt

SEQ ID NO: 49733 - DNA, 25 bp, S. cerevisiae
ggcaaaagcaagatcccgtctacaa

SEQ ID NO: 49734 - DNA, 25 bp, S. cerevisiae
ggcaatataccagttttcccggcaa

SEQ ID NO: 49735 - DNA, 25 bp, S. cerevisiae
ggcatttcagaagtttgtccacgga

SEQ ID NO: 49736 - DNA, 25 bp, S. cerevisiae
ggaattctttgatcccgaacaagta

SEQ ID NO: 49737 - DNA, 25 bp, S. cerevisiae
ggaattcatttttactccatacagt

SEQ ID NO: 49738 - DNA, 25 bp, S. cerevisiae
tggaagcttcaataaatgcgtgact

SEQ ID NO: 49739 - DNA, 25 bp, S. cerevisiae
ggcaagctggcatcacttcggtgat

SEQ ID NO: 49740 - DNA, 25 bp, S. cerevisiae
ggaagtcctaatatcggtgatcaat

SEQ ID NO: 49741 - DNA, 25 bp, S. cerevisiae
tgtgcaataacgaaggccctaaact

SEQ ID NO: 49742 - DNA, 25 bp, S. cerevisiae
ggcatctaacggtgctagtaactct

SEQ ID NO: 49743 - DNA, 25 bp, S. cerevisiae
ggcaaacgtccatggatttcatcaa

SEQ ID NO: 49744 - DNA, 25 bp, S. cerevisiae
ggcaaaagccacacgaatcctgaag

SEQ ID NO: 49745 - DNA, 25 bp, S. cerevisiae
ggctaaccgggaaaactgatgacaa

SEQ ID NO: 49746 - DNA, 25 bp, S. cerevisiae
ggaattcactgatgcctatgatgta

SEQ ID NO: 49747 - DNA, 25 bp, S. cerevisiae
ggaagtattctgacgcacatgatga

SEQ ID NO: 49748 - DNA, 25 bp, S. cerevisiae
ggaatggacgccctaatcaatgata

SEQ ID NO: 49749 - DNA, 25 bp, S. cerevisiae
ggaatggacccttagactctgtgat

SEQ ID NO: 49750 - DNA, 25 bp, S. cerevisiae
ggaatcggaccatagactgtgtttt

SEQ ID NO: 49751 - DNA, 25 bp, S. cerevisiae
ggcagcaaacgcacgagaccaatta

SEQ ID NO: 49752 - DNA, 25 bp, S. cerevisiae
ggcaatttagctccagtaccatgat

SEQ ID NO: 49753 - DNA, 25 bp, S. cerevisiae
ggaatttatgataagccctcagatc

SEQ ID NO: 49754 - DNA, 25 bp, S. cerevisiae
ggaatgccatcgaaaccgctaacaa

SEQ ID NO: 49755 - DNA, 25 bp, S. cerevisiae
ggaattactaataccgcgaccaatg

SEQ ID NO: 49756 - DNA, 25 bp, S. cerevisiae
ggaatctcacccatgatcgttaaag

SEQ ID NO: 49757 - DNA, 25 bp, S. cerevisiae
ggaattgcttcctttcgatgagaaa

SEQ ID NO: 49758 - DNA, 25 bp, S. cerevisiae
ggaattgtacaatgctacacgtgct

SEQ ID NO: 49759 - DNA, 25 bp, S. cerevisiae
ggcaatgtaccatgacccaagtgat

SEQ ID NO: 49760 - DNA, 25 bp, S. cerevisiae
ggaatgcttcatctagcccatttat

SEQ ID NO: 49761 - DNA, 25 bp, S. cerevisiae
ggaagtgtcatatatgtcctgatat

SEQ ID NO: 49762 - DNA, 25 bp, S. cerevisiae
ggaatactaacactactactgacga

SEQ ID NO: 49763 - DNA, 25 bp, S. cerevisiae
ggaatctgtcaagtctgctgatgaa

SEQ ID NO: 49764 - DNA, 25 bp, S. cerevisiae
ggaatgtgccatatgttactctata

SEQ ID NO: 49765 - DNA, 25 bp, S. cerevisiae
ggaatgtctgatgtcttcgcttata

SEQ ID NO: 49766 - DNA, 25 bp, S. cerevisiae
ggaattggtttttcatcacattgtg

SEQ ID NO: 49767 - DNA, 25 bp, S. cerevisiae
ggaatcgatttctttaccagttgct

SEQ ID NO: 49768 - DNA, 25 bp, S. cerevisiae
ggcaataaactcaacaggcgctcca

SEQ ID NO: 49769 - DNA, 25 bp, S. cerevisiae
ggaatatgggatatcgcttctcaaa

SEQ ID NO: 49770 - DNA, 25 bp, S. cerevisiae
ggaatgtggtttccgctttatacat

SEQ ID NO: 49771 - DNA, 25 bp, S. cerevisiae
ggaatgattttaccctttttatgag

SEQ ID NO: 49772 - DNA, 25 bp, S. cerevisiae
ggaatagtcttaccatcttttttga

SEQ ID NO: 49773 - DNA, 25 bp, S. cerevisiae
ggaatcatgatcttcgttggtcttt

SEQ ID NO: 49774 - DNA, 25 bp, S. cerevisiae
ggaatttctatgctgggtccaccga

SEQ ID NO: 49775 - DNA, 25 bp, S. cerevisiae
ggcaatcactctagtgtcctttgag

SEQ ID NO: 49776 - DNA, 25 bp, S. cerevisiae
tggcagatcgtactggaccagcgaa

SEQ ID NO: 49777 - DNA, 25 bp, S. cerevisiae
ggcacagtatttccttcgacaaaga

SEQ ID NO: 49778 - DNA, 25 bp, S. cerevisiae
ggcagcattttattattcttaccca

SEQ ID NO: 49779 - DNA, 25 bp, S. cerevisiae
ggcagattttggcaagcccactgtt

SEQ ID NO: 49780 - DNA, 25 bp, S. cerevisiae
ggcagatgttacgtatgacccaact

SEQ ID NO: 49781 - DNA, 25 bp, S. cerevisiae
ggcagctgattgtgtgtatctcgag

SEQ ID NO: 49782 - DNA, 25 bp, S. cerevisiae
ggcatgtcaatgatgtgttcccaga

SEQ ID NO: 49783 - DNA, 25 bp, S. cerevisiae
ggcatacaattccagtactccacat

SEQ ID NO: 49784 - DNA, 25 bp, S. cerevisiae
ggcaacatgttcagcggatcacact

SEQ ID NO: 49785 - DNA, 25 bp, S. cerevisiae
ggcagaatttttgggatccacctca

SEQ ID NO: 49786 - DNA, 25 bp, S. cerevisiae
ggcgaactcatctgtggaaaactca

SEQ ID NO: 49787 - DNA, 25 bp, S. cerevisiae
ttgttttccattgcgggcgaccaaa

SEQ ID NO: 49788 - DNA, 25 bp, S. cerevisiae
tggtgtttggccacctggttccaaa

SEQ ID NO: 49789 - DNA, 25 bp, S. cerevisiae
ggaatctcttacttcatcaagccta

SEQ ID NO: 49790 - DNA, 25 bp, S. cerevisiae
ggcaatgttccagtgtcatgcagtt

SEQ ID NO: 49791 - DNA, 25 bp, S. cerevisiae
ggaataatccagttcgactctgaaa

SEQ ID NO: 49792 - DNA, 25 bp, S. cerevisiae
ggaatgctaacgatgaacccacaaa

SEQ ID NO: 49793 - DNA, 25 bp, S. cerevisiae
ggaattaccgataaaccacactata

SEQ ID NO: 49794 - DNA, 25 bp, S. cerevisiae
ggcaaacttcccatttcaaggcaga

SEQ ID NO: 49795 - DNA, 25 bp, S. cerevisiae
ggcaatcaggtccatactttcaaaa

SEQ ID NO: 49796 - DNA, 25 bp, S. cerevisiae
ggcactgtgcagaccattattgaag

SEQ ID NO: 49797 - DNA, 25 bp, S. cerevisiae
ggcaagcctggcgatgagattaatg

SEQ ID NO: 49798 - DNA, 25 bp, S. cerevisiae
ggcagccagctgacgatgtcattat

SEQ ID NO: 49799 - DNA, 25 bp, S. cerevisiae
ggcactgccttatggttgatggtat

SEQ ID NO: 49800 - DNA, 25 bp, S. cerevisiae
ggcagagctcgggtcgattttttat

SEQ ID NO: 49801 - DNA, 25 bp, S. cerevisiae
ggcacccggcaaccatttattaatg

SEQ ID NO: 49802 - DNA, 25 bp, S. cerevisiae
ggcaattcccacactttaatacgtt

SEQ ID NO: 49803 - DNA, 25 bp, S. cerevisiae
ggaatattgcttcgacataccagta

SEQ ID NO: 49804 - DNA, 25 bp, S. cerevisiae
ggaatctcgctacgcaaacacagaa

SEQ ID NO: 49805 - DNA, 25 bp, S. cerevisiae
ggaattgccattcaaatctcagatc

SEQ ID NO: 49806 - DNA, 25 bp, S. cerevisiae
ggcaagaccatttaaatgctctgat

SEQ ID NO: 49807 - DNA, 25 bp, S. cerevisiae
ggaatgcctcgtagaaagctttctt

SEQ ID NO: 49808 - DNA, 25 bp, S. cerevisiae
ggctagtctttttaacctgttctgc

SEQ ID NO: 49809 - DNA, 25 bp, S. cerevisiae
ggcattctttagattccaaacctct

SEQ ID NO: 49810 - DNA, 25 bp, S. cerevisiae
ggaatccttatactgtttaaccttg

SEQ ID NO: 49811 - DNA, 25 bp, S. cerevisiae
tgggaactcctttttataactaatg

SEQ ID NO: 49812 - DNA, 25 bp, S. cerevisiae
ggcaacacctcctttttaactaatg

SEQ ID NO: 49813 - DNA, 25 bp, S. cerevisiae
ggcaatacgacattcttttaagctt

SEQ ID NO: 49814 - DNA, 25 bp, S. cerevisiae
ggcaatacctgcacgttatacattt

SEQ ID NO: 49815 - DNA, 25 bp, S. cerevisiae
ggcaaggctcgcacagattcaagac

SEQ ID NO: 49816 - DNA, 25 bp, S. cerevisiae
ggcaacctcgtcaagatgcgggcaa

SEQ ID NO: 49817 - DNA, 25 bp, S. cerevisiae
ggcacaatgctcaaaccatgcggaa

SEQ ID NO: 49818 - DNA, 25 bp, S. cerevisiae
ggcacacatgccctgaatcggagtt

SEQ ID NO: 49819 - DNA, 25 bp, S. cerevisiae
ggcagcaacgcatgttagggcatat

SEQ ID NO: 49820 - DNA, 25 bp, S. cerevisiae
tggccaatccgctcaaggtttaatt

SEQ ID NO: 49821 - DNA, 25 bp, S. cerevisiae
ggaattcgccaatactgttctcaga

SEQ ID NO: 49822 - DNA, 25 bp, S. cerevisiae
ggcaatctgctcatttttggtctac

SEQ ID NO: 49823 - DNA, 25 bp, S. cerevisiae
ggcaatagtgccctttctggttctt

SEQ ID NO: 49824 - DNA, 25 bp, S. cerevisiae
ggcacgtcacgtttttgaggttcaa

SEQ ID NO: 49825 - DNA, 25 bp, S. cerevisiae
ggcagagtctgtctattggacccta

SEQ ID NO: 49826 - DNA, 25 bp, S. cerevisiae
ggcagtcatgttctttggtttctac

SEQ ID NO: 49827 - DNA, 25 bp, S. cerevisiae
ggcaccatgtggtatcctagcacaa

SEQ ID NO: 49828 - DNA, 25 bp, S. cerevisiae
ggcactcagtgccttcaagcggatc

SEQ ID NO: 49829 - DNA, 25 bp, S. cerevisiae
ggcagatgctctgcaggaaggcata

SEQ ID NO: 49830 - DNA, 25 bp, S. cerevisiae
ggcaatgcacagtcatggccatagt

SEQ ID NO: 49831 - DNA, 25 bp, S. cerevisiae
ggcaatcagcagtcggatatcgtta

SEQ ID NO: 49832 - DNA, 25 bp, S. cerevisiae
ggcaatagtcgcgaggatccttaaa

SEQ ID NO: 49833 - DNA, 25 bp, S. cerevisiae
ggcattcagacgcagtgagcacttg

SEQ ID NO: 49834 - DNA, 25 bp, S. cerevisiae
ggaatcactcccacaacaatgtcaa

SEQ ID NO: 49835 - DNA, 25 bp, S. cerevisiae
ggaatctccactatacacaattgca

SEQ ID NO: 49836 - DNA, 25 bp, S. cerevisiae
ggaatttcctatgatcaacttgcaa

SEQ ID NO: 49837 - DNA, 25 bp, S. cerevisiae
ggcaataacgcttcaacaccttcat

SEQ ID NO: 49838 - DNA, 25 bp, S. cerevisiae
ggaatagcaatgtatcccatcacct

SEQ ID NO: 49839 - DNA, 25 bp, S. cerevisiae
ggcactggcagatgtcaccaacgat

SEQ ID NO: 49840 - DNA, 25 bp, S. cerevisiae
ggcttcaagcttacacaacacggtt

SEQ ID NO: 49841 - DNA, 25 bp, S. cerevisiae
ggcattcaagttaaccattccctac

SEQ ID NO: 49842 - DNA, 25 bp, S. cerevisiae
ggaatcactttatcactggatccta

SEQ ID NO: 49843 - DNA, 25 bp, S. cerevisiae
ggaattttccaaactggatccagat

SEQ ID NO: 49844 - DNA, 25 bp, S. cerevisiae
ggaatcttcttctgagctttccaag

SEQ ID NO: 49845 - DNA, 25 bp, S. cerevisiae
ggcaacttctaatagtacggctcag

SEQ ID NO: 49846 - DNA, 25 bp, S. cerevisiae
tgtgaccttttgtggaacggctgca

SEQ ID NO: 49847 - DNA, 25 bp, S. cerevisiae
ggcaagcgcatttggtgtttcggtt

SEQ ID NO: 49848 - DNA, 25 bp, S. cerevisiae
ggcaatccattattatgtataccgt

SEQ ID NO: 49849 - DNA, 25 bp, S. cerevisiae
ggcatcacgactttcattggaggtt

SEQ ID NO: 49850 - DNA, 25 bp, S. cerevisiae
ggcaatggctataacagctctcgtt

SEQ ID NO: 49851 - DNA, 25 bp, S. cerevisiae
ggcacaagataatccttcgttcctg

SEQ ID NO: 49852 - DNA, 25 bp, S. cerevisiae
ggcacgataccagattcagaattca

SEQ ID NO: 49853 - DNA, 25 bp, S. cerevisiae
ggcactcctgcgacttttgaaaatg

SEQ ID NO: 49854 - DNA, 25 bp, S. cerevisiae
ggcaatcctgattttttgatcatca

SEQ ID NO: 49855 - DNA, 25 bp, S. cerevisiae
ggcaacctgataaagatgtttgagc

SEQ ID NO: 49856 - DNA, 25 bp, S. cerevisiae
ggcaaccatacccaacttcattggt

SEQ ID NO: 49857 - DNA, 25 bp, S. cerevisiae
ggctatgccatacctcaaaattcgg

SEQ ID NO: 49858 - DNA, 25 bp, S. cerevisiae
tggcttcggccagtcaggtattggc

SEQ ID NO: 49859 - DNA, 25 bp, S. cerevisiae
ggctttggccactgagaatttcgaa

SEQ ID NO: 49860 - DNA, 25 bp, S. cerevisiae
ggctttgaagtctgccaacttgaga

SEQ ID NO: 49861 - DNA, 25 bp, S. cerevisiae
ggaattgcaggtctactactcgaag

SEQ ID NO: 49862 - DNA, 25 bp, S. cerevisiae
ggaattggacatgctggctcaagaa

SEQ ID NO: 49863 - DNA, 25 bp, S. cerevisiae
ggcaaactccttgcacgacaggata

SEQ ID NO: 49864 - DNA, 25 bp, S. cerevisiae
ggcgccacaacgtaaaatttctttg

SEQ ID NO: 49865 - DNA, 25 bp, S. cerevisiae
ggcagttacgtctcgagctatttat

SEQ ID NO: 49866 - DNA, 25 bp, S. cerevisiae
ggcgataccgttgcagtatttggct

SEQ ID NO: 49867 - DNA, 25 bp, S. cerevisiae
ggaatatccacttctatgctctttt

SEQ ID NO: 49868 - DNA, 25 bp, S. cerevisiae
ggaattctcatcatccggttttgaa

SEQ ID NO: 49869 - DNA, 25 bp, S. cerevisiae
ggaattcatttttctctcatttcat

SEQ ID NO: 49870 - DNA, 25 bp, S. cerevisiae
ggcactctaatctatcttcagcatt

SEQ ID NO: 49871 - DNA, 25 bp, S. cerevisiae
ggcacacatttccttatattacgca

SEQ ID NO: 49872 - DNA, 25 bp, S. cerevisiae
ggcacaaccgcagctgttgacgtaa

SEQ ID NO: 49873 - DNA, 25 bp, S. cerevisiae
ggcaccatgaatgcttttttcgtgt

SEQ ID NO: 49874 - DNA, 25 bp, S. cerevisiae
ggcatctgcagaagcacctagtgct

SEQ ID NO: 49875 - DNA, 25 bp, S. cerevisiae
ggcagatatgcgcaattctcaatat

SEQ ID NO: 49876 - DNA, 25 bp, S. cerevisiae
ggcagagacgcatacccaacaggtt

SEQ ID NO: 49877 - DNA, 25 bp, S. cerevisiae
ggcattggctgctaacgaaactgca

SEQ ID NO: 49878 - DNA, 25 bp, S. cerevisiae
ggcgatggcggatttttatctccat

SEQ ID NO: 49879 - DNA, 25 bp, S. cerevisiae
ggcatgaggaaatttttgacttcaa

SEQ ID NO: 49880 - DNA, 25 bp, S. cerevisiae
ggcaaggtcaattaatcccgtcaat

SEQ ID NO: 49881 - DNA, 25 bp, S. cerevisiae
ggcagcactgtcaattttccagagt

SEQ ID NO: 49882 - DNA, 25 bp, S. cerevisiae
ggcagacatgccaccaggacagata

SEQ ID NO: 49883 - DNA, 25 bp, S. cerevisiae
ggcagactgctgacgacatcgaaat

SEQ ID NO: 49884 - DNA, 25 bp, S. cerevisiae
ggcagagtgcttgatcagctgtaac

SEQ ID NO: 49885 - DNA, 25 bp, S. cerevisiae
ggcagagtttcaacagccactgact

SEQ ID NO: 49886 - DNA, 25 bp, S. cerevisiae
ggcagaggatgaataccgcattgta

SEQ ID NO: 49887 - DNA, 25 bp, S. cerevisiae
ggcaagaggtgttctgcgcatctga

SEQ ID NO: 49888 - DNA, 25 bp, S. cerevisiae
ggcaagtttccttctgccaaacgaa

SEQ ID NO: 49889 - DNA, 25 bp, S. cerevisiae
ggctggtttgacattcccagtcggt

SEQ ID NO: 49890 - DNA, 25 bp, S. cerevisiae
ggctttttcaaaccccagctggaga

SEQ ID NO: 49891 - DNA, 25 bp, S. cerevisiae
ggcaaattctaatcgaccctggact

SEQ ID NO: 49892 - DNA, 25 bp, S. cerevisiae
tggaaattacgtgcagtcctgaaat

SEQ ID NO: 49893 - DNA, 25 bp, S. cerevisiae
ggctagctacgttgaagtccctgat

SEQ ID NO: 49894 - DNA, 25 bp, S. cerevisiae
ggctcatttggtggtctgattccca

SEQ ID NO: 49895 - DNA, 25 bp, S. cerevisiae
ggcttcttgaaggacatcaacccag

SEQ ID NO: 49896 - DNA, 25 bp, S. cerevisiae
tggcgtccaacggaaaagccggtcg

SEQ ID NO: 49897 - DNA, 25 bp, S. cerevisiae
ggcggcactacgagatacagctctg

SEQ ID NO: 49898 - DNA, 25 bp, S. cerevisiae
ggcaacatttgtttggacattctga

SEQ ID NO: 49899 - DNA, 25 bp, S. cerevisiae
ggcaacgatcgttcaatgcaaatct

SEQ ID NO: 49900 - DNA, 25 bp, S. cerevisiae
ggcgggccatgaccaagctaatcta

SEQ ID NO: 49901 - DNA, 25 bp, S. cerevisiae
ggcaatggccattgaatgacctatt

SEQ ID NO: 49902 - DNA, 25 bp, S. cerevisiae
ggcgtacgcatcgaattgctggatt

SEQ ID NO: 49903 - DNA, 25 bp, S. cerevisiae
ggcacacatggcaaacccactgtta

SEQ ID NO: 49904 - DNA, 25 bp, S. cerevisiae
ggcagccccataaacacacagtatg

SEQ ID NO: 49905 - DNA, 25 bp, S. cerevisiae
ggcacagccagtcgtaaagttttat

SEQ ID NO: 49906 - DNA, 25 bp, S. cerevisiae
ggcacaacgttcacgcagtttttat

SEQ ID NO: 49907 - DNA, 25 bp, S. cerevisiae
ggcaaacgttttcgccactttattg

SEQ ID NO: 49908 - DNA, 25 bp, S. cerevisiae
ggcaagaagatcagtgccccttcga

SEQ ID NO: 49909 - DNA, 25 bp, S. cerevisiae
ggcaacaggctgtgtccaagatcac

SEQ ID NO: 49910 - DNA, 25 bp, S. cerevisiae
ggcaccgctggcttgaacaacaata

SEQ ID NO: 49911 - DNA, 25 bp, S. cerevisiae
ggcaggatttcacagaacgcaacac

SEQ ID NO: 49912 - DNA, 25 bp, S. cerevisiae
ggctagatctgtttggaaccaccac

SEQ ID NO: 49913 - DNA, 25 bp, S. cerevisiae
ggcagaatgcttttaagcggcaaca

SEQ ID NO: 49914 - DNA, 25 bp, S. cerevisiae
ggcaatatcttgttaccacacaatg

SEQ ID NO: 49915 - DNA, 25 bp, S. cerevisiae
ggcaatccacttatatcctatttta

SEQ ID NO: 49916 - DNA, 25 bp, S. cerevisiae
ggcattcctttgctataatacttgt

SEQ ID NO: 49917 - DNA, 25 bp, S. cerevisiae
ggcaactcgttgctacagtccaaat

SEQ ID NO: 49918 - DNA, 25 bp, S. cerevisiae
ggcatggccactagttttgttcaca

SEQ ID NO: 49919 - DNA, 25 bp, S. cerevisiae
ggcatggaatccaacgtttcccata

SEQ ID NO: 49920 - DNA, 25 bp, S. cerevisiae
ggcggagttctaccatccaggtgta

SEQ ID NO: 49921 - DNA, 25 bp, S. cerevisiae
ggcttggattctttggctattggga

SEQ ID NO: 49922 - DNA, 25 bp, S. cerevisiae
ggcacattgcattttaggtatcggt

SEQ ID NO: 49923 - DNA, 25 bp, S. cerevisiae
ggaattcatctgcaaggcacagtta

SEQ ID NO: 49924 - DNA, 25 bp, S. cerevisiae
ggcaacttcattcccacaagtctgg

SEQ ID NO: 49925 - DNA, 25 bp, S. cerevisiae
ggaattgatattccctcatcatttg

SEQ ID NO: 49926 - DNA, 25 bp, S. cerevisiae
ggcagcgtaccaataaacctggcaa

SEQ ID NO: 49927 - DNA, 25 bp, S. cerevisiae
ggcatggcttaagagcaacccgaat

SEQ ID NO: 49928 - DNA, 25 bp, S. cerevisiae
ggcaggtttagttggccaacatcaa

SEQ ID NO: 49929 - DNA, 25 bp, S. cerevisiae
ggctacgttgtctacgggtcagaac

SEQ ID NO: 49930 - DNA, 25 bp, S. cerevisiae
ggctaccccgtagcaggatcaaatc

SEQ ID NO: 49931 - DNA, 25 bp, S. cerevisiae
ggcaacattcagcatatccaggtaa

SEQ ID NO: 49932 - DNA, 25 bp, S. cerevisiae
ggcaactccagcaatatcagcagca

SEQ ID NO: 49933 - DNA, 25 bp, S. cerevisiae
ggcaactagcaaaatctgtcatctc

SEQ ID NO: 49934 - DNA, 25 bp, S. cerevisiae
ggcaacacaggatatcgatactcga

SEQ ID NO: 49935 - DNA, 25 bp, S. cerevisiae
ggcacacaaggacctggttccatga

SEQ ID NO: 49936 - DNA, 25 bp, S. cerevisiae
ggcataagactacggtcatccccat

SEQ ID NO: 49937 - DNA, 25 bp, S. cerevisiae
ggctagaactccagaagacctcatg

SEQ ID NO: 49938 - DNA, 25 bp, S. cerevisiae
ggctcgtaccaaaaaggcttgcatt

SEQ ID NO: 49939 - DNA, 25 bp, S. cerevisiae
ggctgttaccaagaaggcttcactt

SEQ ID NO: 49940 - DNA, 25 bp, S. cerevisiae
ggctcttaccagcttaactacagtt

SEQ ID NO: 49941 - DNA, 25 bp, S. cerevisiae
ggcaataatcgctttcattctaatg

SEQ ID NO: 49942 - DNA, 25 bp, S. cerevisiae
ggcaatcatatcctttcaaatcacg

SEQ ID NO: 49943 - DNA, 25 bp, S. cerevisiae
ggcagcatacattctcattctcata

SEQ ID NO: 49944 - DNA, 25 bp, S. cerevisiae
ggcaaagcagcattcgtcatcaagt

SEQ ID NO: 49945 - DNA, 25 bp, S. cerevisiae
ggcaatgaagcattcagttgacgat

SEQ ID NO: 49946 - DNA, 25 bp, S. cerevisiae
ggcaatgtccttttaccagttgaac

SEQ ID NO: 49947 - DNA, 25 bp, S. cerevisiae
ggcagaattcatactccaagtccag

SEQ ID NO: 49948 - DNA, 25 bp, S. cerevisiae
ggcagttcatctatacagcagtccc

SEQ ID NO: 49949 - DNA, 25 bp, S. cerevisiae
ggcagctttctacgatagcgtcatc

SEQ ID NO: 49950 - DNA, 25 bp, S. cerevisiae
ggcacgttcaacacgcgttatcgag

SEQ ID NO: 49951 - DNA, 25 bp, S. cerevisiae
ggcactgttaaggagcctgcttaca

SEQ ID NO: 49952 - DNA, 25 bp, S. cerevisiae
ggcacaatagctattcctgcttaca

SEQ ID NO: 49953 - DNA, 25 bp, S. cerevisiae
ggcacatcaatgcatcaatccgtgt

SEQ ID NO: 49954 - DNA, 25 bp, S. cerevisiae
ggcaacaatgccgaatctggtgaaa

SEQ ID NO: 49955 - DNA, 25 bp, S. cerevisiae
ggcaatggtgcacgttcttatagaa

SEQ ID NO: 49956 - DNA, 25 bp, S. cerevisiae
tggaagatggctcactttaaagaat

SEQ ID NO: 49957 - DNA, 25 bp, S. cerevisiae
ggcacattattgaaaccctcttttt

SEQ ID NO: 49958 - DNA, 25 bp, S. cerevisiae
ggcaaagtcgaatcctccaatcatt

SEQ ID NO: 49959 - DNA, 25 bp, S. cerevisiae
ggcaaagttatcttacctcggatct

SEQ ID NO: 49960 - DNA, 25 bp, S. cerevisiae
ggcaaacgacattgtgaccctggca

SEQ ID NO: 49961 - DNA, 25 bp, S. cerevisiae
ggctaacagacaagagaccgatcga

SEQ ID NO: 49962 - DNA, 25 bp, S. cerevisiae
ggcatctcatgctcataaatcctga

SEQ ID NO: 49963 - DNA, 25 bp, S. cerevisiae
ggcattaccgcagaatagttgttgg

SEQ ID NO: 49964 - DNA, 25 bp, S. cerevisiae
ggcactactgcagagattgaagacc

SEQ ID NO: 49965 - DNA, 25 bp, S. cerevisiae
ggcactgcaccatcacattacagaa

SEQ ID NO: 49966 - DNA, 25 bp, S. cerevisiae
ggcacatgattcttcagagggcgaa

SEQ ID NO: 49967 - DNA, 25 bp, S. cerevisiae
ggctgagattctccttgatggcgaa

SEQ ID NO: 49968 - DNA, 25 bp, S. cerevisiae
ggcagatgactacctagaccattta

SEQ ID NO: 49969 - DNA, 25 bp, S. cerevisiae
ggcatggcctacaattgaccactaa

SEQ ID NO: 49970 - DNA, 25 bp, S. cerevisiae
ggcaccagcgcccttaaagcaaaag

SEQ ID NO: 49971 - DNA, 25 bp, S. cerevisiae
ggcattagagcctttggtgactata

SEQ ID NO: 49972 - DNA, 25 bp, S. cerevisiae
ggcaacatggccatttcgatcatta

SEQ ID NO: 49973 - DNA, 25 bp, S. cerevisiae
ggcattaggccaagatcctgcgcag

SEQ ID NO: 49974 - DNA, 25 bp, S. cerevisiae
ggcactgggtcaggactctagcatg

SEQ ID NO: 49975 - DNA, 25 bp, S. cerevisiae
ggcagcgggatctcagccttgcagt

SEQ ID NO: 49976 - DNA, 25 bp, S. cerevisiae
ggctgggcgaattactttcgaacaa

SEQ ID NO: 49977 - DNA, 25 bp, S. cerevisiae
ggcataacgatacacctgatggcat

SEQ ID NO: 49978 - DNA, 25 bp, S. cerevisiae
ggcaatgttgaagcgcttgacagca

SEQ ID NO: 49979 - DNA, 25 bp, S. cerevisiae
ggcaatgatcaagccgctacagcat

SEQ ID NO: 49980 - DNA, 25 bp, S. cerevisiae
ggcacaggccatggtatcggatcat

SEQ ID NO: 49981 - DNA, 25 bp, S. cerevisiae
ggcagaggccagtattcatgagaat

SEQ ID NO: 49982 - DNA, 25 bp, S. cerevisiae
ggcaggtgccagacatatatgacat

SEQ ID NO: 49983 - DNA, 25 bp, S. cerevisiae
ggcagtgctgccaacattatgatcg

SEQ ID NO: 49984 - DNA, 25 bp, S. cerevisiae
ggcatactgctcattcatagctgtc

SEQ ID NO: 49985 - DNA, 25 bp, S. cerevisiae
ggcacatgctcaattgtctagtgtt

SEQ ID NO: 49986 - DNA, 25 bp, S. cerevisiae
ggcatgtcatctttacgagcagcac

SEQ ID NO: 49987 - DNA, 25 bp, S. cerevisiae
ggcttccatatgtacggctgccaca

SEQ ID NO: 49988 - DNA, 25 bp, S. cerevisiae
ggcaagatctgactatatcctacaa

SEQ ID NO: 49989 - DNA, 25 bp, S. cerevisiae
ggcagaatatgctttccgccacaaa

SEQ ID NO: 49990 - DNA, 25 bp, S. cerevisiae
ggcaaagtatttggcgccagcatat

SEQ ID NO: 49991 - DNA, 25 bp, S. cerevisiae
ggcatataaaacgtgctcctcggaa

SEQ ID NO: 49992 - DNA, 25 bp, S. cerevisiae
ggctattttgaagtatccaccatcc

SEQ ID NO: 49993 - DNA, 25 bp, S. cerevisiae
ggctttgattgaacgttactatcca

SEQ ID NO: 49994 - DNA, 25 bp, S. cerevisiae
ggctaatatccaatcgtttttccag

SEQ ID NO: 49995 - DNA, 25 bp, S. cerevisiae
ggcagagaaccaattgttcttgtta

SEQ ID NO: 49996 - DNA, 25 bp, S. cerevisiae
ggcagcaacaacattttcgccattg

SEQ ID NO: 49997 - DNA, 25 bp, S. cerevisiae
ggctaaagagctattgaccctgtca

SEQ ID NO: 49998 - DNA, 25 bp, S. cerevisiae
ggctcgattatctttggttccttgc

SEQ ID NO: 49999 - DNA, 25 bp, S. cerevisiae
ggcactatggctttgtatgatgttt

SEQ ID NO: 50000 - DNA, 25 bp, S. cerevisiae
ggcatgtatatttaccacaaatcga

SEQ ID NO: 50001 - DNA, 25 bp, S. cerevisiae
ggcttcattggccaattccaataga

SEQ ID NO: 50002 - DNA, 25 bp, S. cerevisiae
ggcacattcctttgctattctggaa

SEQ ID NO: 50003 - DNA, 25 bp, S. cerevisiae
ggcaaatcctgatctctggtggagt

SEQ ID NO: 50004 - DNA, 25 bp, S. cerevisiae
tggcacaacctcatccggtaaatga

SEQ ID NO: 50005 - DNA, 25 bp, S. cerevisiae
ggcatgagagccacccagttaaaga

SEQ ID NO: 50006 - DNA, 25 bp, S. cerevisiae
ggctgaagccaaatccgtcaaactt

SEQ ID NO: 50007 - DNA, 25 bp, S. cerevisiae
ggctcgtgacaaactagatcctcaa

SEQ ID NO: 50008 - DNA, 25 bp, S. cerevisiae
ggcactggagcatccgtatttgcaa

SEQ ID NO: 50009 - DNA, 25 bp, S. cerevisiae
ggctacaacttcactattgggccat

SEQ ID NO: 50010 - DNA, 25 bp, S. cerevisiae
ggctaaccttatggtatccggcaat

SEQ ID NO: 50011 - DNA, 25 bp, S. cerevisiae
ggcaaactcttgtcgttacgtacta

SEQ ID NO: 50012 - DNA, 25 bp, S. cerevisiae
ggcaaacagcgaatccattacttac

SEQ ID NO: 50013 - DNA, 25 bp, S. cerevisiae
ggcgatgtaggcagtcttctattac

SEQ ID NO: 50014 - DNA, 25 bp, S. cerevisiae
ggcagacaaccagaagcggtctttt

SEQ ID NO: 50015 - DNA, 25 bp, S. cerevisiae
ggctgctattcacgctaagcgtgtt

SEQ ID NO: 50016 - DNA, 25 bp, S. cerevisiae
ggcagtgatgacaccaaggctagtc

SEQ ID NO: 50017 - DNA, 25 bp, S. cerevisiae
ggcattcattcatccaagttcagtc

SEQ ID NO: 50018 - DNA, 25 bp, S. cerevisiae
ggctacgataaccaagattcagtct

SEQ ID NO: 50019 - DNA, 25 bp, S. cerevisiae
ggccaaagaacttgagtccgtctat

SEQ ID NO: 50020 - DNA, 25 bp, S. cerevisiae
ggcaacaaggatcactggcacagtc

SEQ ID NO: 50021 - DNA, 25 bp, S. cerevisiae
ggctgatagagccactttgggccaa

SEQ ID NO: 50022 - DNA, 25 bp, S. cerevisiae
ggcagcatcataggactcatctttg

SEQ ID NO: 50023 - DNA, 25 bp, S. cerevisiae
ggcagatatcaatcactttgctgag

SEQ ID NO: 50024 - DNA, 25 bp, S. cerevisiae
ggcactgtatctccacttgatgatg

SEQ ID NO: 50025 - DNA, 25 bp, S. cerevisiae
ggcactgatcttccagtctttgaag

SEQ ID NO: 50026 - DNA, 25 bp, S. cerevisiae
ggcttacaagccgtcttatgggatc

SEQ ID NO: 50027 - DNA, 25 bp, S. cerevisiae
ggcaaacaccagaaggcgctattgt

SEQ ID NO: 50028 - DNA, 25 bp, S. cerevisiae
ggcactaactcgaacgccgttgtga

SEQ ID NO: 50029 - DNA, 25 bp, S. cerevisiae
ggcagtatttcgaattccgcatttg

SEQ ID NO: 50030 - DNA, 25 bp, S. cerevisiae
ggcatgtgatgttacctaaggccat

SEQ ID NO: 50031 - DNA, 25 bp, S. cerevisiae
ggcattggtgattcgtcaagatctt

SEQ ID NO: 50032 - DNA, 25 bp, S. cerevisiae
ggcagtttgttcgtcaatctctagg

SEQ ID NO: 50033 - DNA, 25 bp, S. cerevisiae
ggcagatccatggactctttatcat

SEQ ID NO: 50034 - DNA, 25 bp, S. cerevisiae
ggctgtctcagctactatgtgtacg

SEQ ID NO: 50035 - DNA, 25 bp, S. cerevisiae
ggctttcacttcttacgacagaacc

SEQ ID NO: 50036 - DNA, 25 bp, S. cerevisiae
ggctttcacttcttacgacagaacc

SEQ ID NO: 50037 - DNA, 25 bp, S. cerevisiae
ggcaaatgccatggttacatcccta

SEQ ID NO: 50038 - DNA, 25 bp, S. cerevisiae
ggcaaactagtagtctctccactat

SEQ ID NO: 50039 - DNA, 25 bp, S. cerevisiae
ggcaaatgcatattacttcccagtt

SEQ ID NO: 50040 - DNA, 25 bp, S. cerevisiae
ggcagtatattttcttcccagtggt

SEQ ID NO: 50041 - DNA, 25 bp, S. cerevisiae
ggcagtataatcagcttgcacacga

SEQ ID NO: 50042 - DNA, 25 bp, S. cerevisiae
ggcagttagatccttcgacgctgaa

SEQ ID NO: 50043 - DNA, 25 bp, S. cerevisiae
ggcagttttctgtatgccaactaca

SEQ ID NO: 50044 - DNA, 25 bp, S. cerevisiae
ggcatgtctgtgactacggcgacta

SEQ ID NO: 50045 - DNA, 25 bp, S. cerevisiae
ggcattgcatttaatgggcgccttc

SEQ ID NO: 50046 - DNA, 25 bp, S. cerevisiae
ggcttattactttcatcaggtgttc

SEQ ID NO: 50047 - DNA, 25 bp, S. cerevisiae
ggctgaggctgcagaattccgttat

SEQ ID NO: 50048 - DNA, 25 bp, S. cerevisiae
ggcttggatcatttgtaccgacaat

SEQ ID NO: 50049 - DNA, 25 bp, S. cerevisiae
ggcattggaacttgcttccgcagaa

SEQ ID NO: 50050 - DNA, 25 bp, S. cerevisiae
ggcatcaagttgacactatcgtaga

SEQ ID NO: 50051 - DNA, 25 bp, S. cerevisiae
ggcactttctgtttttccatgcaat

SEQ ID NO: 50052 - DNA, 25 bp, S. cerevisiae
ggcagtatttggttttccatatcta

SEQ ID NO: 50053 - DNA, 25 bp, S. cerevisiae
ggctgctggctggacaattgaccaa

SEQ ID NO: 50054 - DNA, 25 bp, S. cerevisiae
ggcttgaaggccaaacatctcacat

SEQ ID NO: 50055 - DNA, 25 bp, S. cerevisiae
ggcttaatttgacacatctactttt

SEQ ID NO: 50056 - DNA, 25 bp, S. cerevisiae
ggcgataactcacaactcgacttta

SEQ ID NO: 50057 - DNA, 25 bp, S. cerevisiae
ggcagacaagaccaaacccaagatt

SEQ ID NO: 50058 - DNA, 25 bp, S. cerevisiae
ggcggaaaacataaacagaactctg

SEQ ID NO: 50059 - DNA, 25 bp, S. cerevisiae
ggcttcgaagttccaagtgcaaatt

SEQ ID NO: 50060 - DNA, 25 bp, S. cerevisiae
ggcttctaatttcctgggcaactta

SEQ ID NO: 50061 - DNA, 25 bp, S. cerevisiae
ggcttccgagattttgggcttccaa

SEQ ID NO: 50062 - DNA, 25 bp, S. cerevisiae
ggcatcttttccaactcgtctggaa

SEQ ID NO: 50063 - DNA, 25 bp, S. cerevisiae
ggcactttactgaaacccttagacg

SEQ ID NO: 50064 - DNA, 25 bp, S. cerevisiae
ggcacttccacgagtacgcaaagag

SEQ ID NO: 50065 - DNA, 25 bp, S. cerevisiae
ggctattcctcttcaattaacgtgg

SEQ ID NO: 50066 - DNA, 25 bp, S. cerevisiae
ggctataaagcctacttacgagaag

SEQ ID NO: 50067 - DNA, 25 bp, S. cerevisiae
ggcattcaagtcgacgctgtttgta

SEQ ID NO: 50068 - DNA, 25 bp, S. cerevisiae
ggcttctatgccgatgtcgatttga

SEQ ID NO: 50069 - DNA, 25 bp, S. cerevisiae
ggcactctacgggatcgtggcgaat

SEQ ID NO: 50070 - DNA, 25 bp, S. cerevisiae
ggcaccaactggaatagctgtcgtt

SEQ ID NO: 50071 - DNA, 25 bp, S. cerevisiae
ggcaggcctccatttaatttaaatt

SEQ ID NO: 50072 - DNA, 25 bp, S. cerevisiae
ggcacaatgcaggtttgatttcaaa

SEQ ID NO: 50073 - DNA, 25 bp, S. cerevisiae
ggcacaccagtgattgatttctcat

SEQ ID NO: 50074 - DNA, 25 bp, S. cerevisiae
ggcatagcggtatcagtagcacatt

SEQ ID NO: 50075 - DNA, 25 bp, S. cerevisiae
ggcttactgacagcaatcccaattt

SEQ ID NO: 50076 - DNA, 25 bp, S. cerevisiae
ggctcaagtcggcaaaagggtcatc

SEQ ID NO: 50077 - DNA, 25 bp, S. cerevisiae
ggctccagtccgttacaaagaattc

SEQ ID NO: 50078 - DNA, 25 bp, S. cerevisiae
ggctcacaaaagtttccaaagatta

SEQ ID NO: 50079 - DNA, 25 bp, S. cerevisiae
ggcttccatgaagattccaacgatt

SEQ ID NO: 50080 - DNA, 25 bp, S. cerevisiae
ggcgtcatacctctatttttacttt

SEQ ID NO: 50081 - DNA, 25 bp, S. cerevisiae
ggcagtccacttttatatttcttat

SEQ ID NO: 50082 - DNA, 25 bp, S. cerevisiae
ggcggagcttattcgaaggctgatt

SEQ ID NO: 50083 - DNA, 25 bp, S. cerevisiae
ggcacagcttttagggagcgattac

SEQ ID NO: 50084 - DNA, 25 bp, S. cerevisiae
ggcgagaccattgtggagcgatttt

SEQ ID NO: 50085 - DNA, 25 bp, S. cerevisiae
tcccggttgcaccaaggcgtttgtt

SEQ ID NO: 50086 - DNA, 25 bp, S. cerevisiae
tgaccagggtgacaaggctttcgtt

SEQ ID NO: 50087 - DNA, 25 bp, S. cerevisiae
tgtccaaggttccaaggtttccaag

SEQ ID NO: 50088 - DNA, 25 bp, S. cerevisiae
tggctaacgttctgggctttcaaat

SEQ ID NO: 50089 - DNA, 25 bp, S. cerevisiae
tggcctactttatttggcttccagt

SEQ ID NO: 50090 - DNA, 25 bp, S. cerevisiae
ggcattatcctatttctgggtacaa

SEQ ID NO: 50091 - DNA, 25 bp, S. cerevisiae
ggcatttcgccattatttgtatcca

SEQ ID NO: 50092 - DNA, 25 bp, S. cerevisiae
ggcattcctgatttcctatattcca

SEQ ID NO: 50093 - DNA, 25 bp, S. cerevisiae
ggcatgtgttctattctacttcttt

SEQ ID NO: 50094 - DNA, 25 bp, S. cerevisiae
ggcagctcttctactttcaatttat

SEQ ID NO: 50095 - DNA, 25 bp, S. cerevisiae
ggcactcaccaatctgtccatgata

SEQ ID NO: 50096 - DNA, 25 bp, S. cerevisiae
ggctatcaccgttcatggtcatatg

SEQ ID NO: 50097 - DNA, 25 bp, S. cerevisiae
ggcattcatgctcgtagtgcacatt

SEQ ID NO: 50098 - DNA, 25 bp, S. cerevisiae
ggcagtcagctctttaattgcattt

SEQ ID NO: 50099 - DNA, 25 bp, S. cerevisiae
ggcgtcgctacagaaggctttggtt

SEQ ID NO: 50100 - DNA, 25 bp, S. cerevisiae
ggcttcgaagcccaattctttggtt

SEQ ID NO: 50101 - DNA, 25 bp, S. cerevisiae
ggctacgcacccaagtttttagatt

SEQ ID NO: 50102 - DNA, 25 bp, S. cerevisiae
ggctaccgatcctgtaattgctaga

SEQ ID NO: 50103 - DNA, 25 bp, S. cerevisiae
ggctactgccgctaagaaagctgtc

SEQ ID NO: 50104 - DNA, 25 bp, S. cerevisiae
ggcttcctcgatcctcaaatggatg

SEQ ID NO: 50105 - DNA, 25 bp, S. cerevisiae
ggcttcgattcgtattttgtttatc

SEQ ID NO: 50106 - DNA, 25 bp, S. cerevisiae
ggctagctgcatctggtactgaaaa

SEQ ID NO: 50107 - DNA, 25 bp, S. cerevisiae
ggcgacgacgtggtagcagaatttc

SEQ ID NO: 50108 - DNA, 25 bp, S. cerevisiae
ggcggccacgaagtcaggaactttt

SEQ ID NO: 50109 - DNA, 25 bp, S. cerevisiae
ggctgaccaaagttctgggaccatt

SEQ ID NO: 50110 - DNA, 25 bp, S. cerevisiae
ggctaccaaatgtattttccacgct

SEQ ID NO: 50111 - DNA, 25 bp, S. cerevisiae
ggctaccagaattgatttctcccgt

SEQ ID NO: 50112 - DNA, 25 bp, S. cerevisiae
ggctacttaaattttccgcgtgttg

SEQ ID NO: 50113 - DNA, 25 bp, S. cerevisiae
ggctattatatgcttttcaccaggt

SEQ ID NO: 50114 - DNA, 25 bp, S. cerevisiae
ggctcacgaattttttgacgcgtta

SEQ ID NO: 50115 - DNA, 25 bp, S. cerevisiae
ggcaccgtagttctgtgagcgcaat

SEQ ID NO: 50116 - DNA, 25 bp, S. cerevisiae
ggcaccgattgtattagcagctctt

SEQ ID NO: 50117 - DNA, 25 bp, S. cerevisiae
ggcaccgttattgatatccttctta

SEQ ID NO: 50118 - DNA, 25 bp, S. cerevisiae
ggctctgtgcctgcaaactggaatt

SEQ ID NO: 50119 - DNA, 25 bp, S. cerevisiae
ggcatcttgctgtccttagatttgt

SEQ ID NO: 50120 - DNA, 25 bp, S. cerevisiae
ggctggtaacccacaattagaattt

SEQ ID NO: 50121 - DNA, 25 bp, S. cerevisiae
ggcgttcaacaccattttctaaaat

SEQ ID NO: 50122 - DNA, 25 bp, S. cerevisiae
ggcttacatatccatcctacaaaac

SEQ ID NO: 50123 - DNA, 25 bp, S. cerevisiae
ggctaccagcgttacattgaaacaa

SEQ ID NO: 50124 - DNA, 25 bp, S. cerevisiae
ggcttcccttggtctgtggaacaaa

SEQ ID NO: 50125 - DNA, 25 bp, S. cerevisiae
ggctttacaatttccgaaccagatt

SEQ ID NO: 50126 - DNA, 25 bp, S. cerevisiae
ggcttaaaatcattcccagatccaa

SEQ ID NO: 50127 - DNA, 25 bp, S. cerevisiae
ggctaacacaccctgaagttttcag

SEQ ID NO: 50128 - DNA, 25 bp, S. cerevisiae
ggctgaaagtattcgtcgtttgcat

SEQ ID NO: 50129 - DNA, 25 bp, S. cerevisiae
ggctacacttactccagatttgact

SEQ ID NO: 50130 - DNA, 25 bp, S. cerevisiae
ggctacgctaacaccgattgaatta

SEQ ID NO: 50131 - DNA, 25 bp, S. cerevisiae
ggcagttctttcagaggtggatctc

SEQ ID NO: 50132 - DNA, 25 bp, S. cerevisiae
ggcatctccctactgaaggcaattc

SEQ ID NO: 50133 - DNA, 25 bp, S. cerevisiae
ggcatgtctatctaatacagccaat

SEQ ID NO: 50134 - DNA, 25 bp, S. cerevisiae
ggcatgttccagtaacagcacagat

SEQ ID NO: 50135 - DNA, 25 bp, S. cerevisiae
ggcattatccgccaagtacaatttt

SEQ ID NO: 50136 - DNA, 25 bp, S. cerevisiae
ggctactgcgccaattgatgacaat

SEQ ID NO: 50137 - DNA, 25 bp, S. cerevisiae
ggctacttgtccttgatgaccatgg

SEQ ID NO: 50138 - DNA, 25 bp, S. cerevisiae
ggctttgtcatttgttgggatttac

SEQ ID NO: 50139 - DNA, 25 bp, S. cerevisiae
ggcgattgcctttttagagtctcca

SEQ ID NO: 50140 - DNA, 25 bp, S. cerevisiae
ggcttacgttagattgactgctgac

SEQ ID NO: 50141 - DNA, 25 bp, S. cerevisiae
ggcctccgttggtttgagcatgtac

SEQ ID NO: 50142 - DNA, 25 bp, S. cerevisiae
ggcagccattgcaggtttgagtgaa

SEQ ID NO: 50143 - DNA, 25 bp, S. cerevisiae
ggcagacagaaccactttagtcgat

SEQ ID NO: 50144 - DNA, 25 bp, S. cerevisiae
ggcagtaaaggcgtttcaccatgag

SEQ ID NO: 50145 - DNA, 25 bp, S. cerevisiae
ggcatcttcagctacatctctaaat

SEQ ID NO: 50146 - DNA, 25 bp, S. cerevisiae
ggcagtctcctaatctccagaaagt

SEQ ID NO: 50147 - DNA, 25 bp, S. cerevisiae
ggcagcctcacaaaccataagaaga

SEQ ID NO: 50148 - DNA, 25 bp, S. cerevisiae
ggcattcgaaaagtcatacgcaaat

SEQ ID NO: 50149 - DNA, 25 bp, S. cerevisiae
ggcgggtggtccaagagcacctcaa

SEQ ID NO: 50150 - DNA, 25 bp, S. cerevisiae
ggctagcgtggaaccccaacttaag

SEQ ID NO: 50151 - DNA, 25 bp, S. cerevisiae
ggctttccaaactatgatttccata

SEQ ID NO: 50152 - DNA, 25 bp, S. cerevisiae
ggcatttgccacaaccaacattagc

SEQ ID NO: 50153 - DNA, 25 bp, S. cerevisiae
ggcaggtgtcctaccatacattaga

SEQ ID NO: 50154 - DNA, 25 bp, S. cerevisiae
ggcagggtacacaccagcatacaga

SEQ ID NO: 50155 - DNA, 25 bp, S. cerevisiae
ggcagggtttcattgccagtgaaaa

SEQ ID NO: 50156 - DNA, 25 bp, S. cerevisiae
ggcagatgatttcaatccattggaa

SEQ ID NO: 50157 - DNA, 25 bp, S. cerevisiae
ggcagaatttgccttcgatctacaa

SEQ ID NO: 50158 - DNA, 25 bp, S. cerevisiae
ggcttcatttatgcccgtcgtaaaa

SEQ ID NO: 50159 - DNA, 25 bp, S. cerevisiae
ggctgatattccacctttaacatta

SEQ ID NO: 50160 - DNA, 25 bp, S. cerevisiae
ggctcactttaaagaataccaagtt

SEQ ID NO: 50161 - DNA, 25 bp, S. cerevisiae
ggcgacgaaagcacaataccgagtt

SEQ ID NO: 50162 - DNA, 25 bp, S. cerevisiae
ggctttcgaagcttgtattacctcc

SEQ ID NO: 50163 - DNA, 25 bp, S. cerevisiae
ggcttctcgaagtacaacgcatagt

SEQ ID NO: 50164 - DNA, 25 bp, S. cerevisiae
ggcagatatcgcagaggccctgcaa

SEQ ID NO: 50165 - DNA, 25 bp, S. cerevisiae
ggcagcaatctctcaggatccaaag

SEQ ID NO: 50166 - DNA, 25 bp, S. cerevisiae
ggcagacatctcttctgttaatcaa

SEQ ID NO: 50167 - DNA, 25 bp, S. cerevisiae
ggcgaggccaacttataaccttaag

SEQ ID NO: 50168 - DNA, 25 bp, S. cerevisiae
ggcgagtccaaggttttctactata

SEQ ID NO: 50169 - DNA, 25 bp, S. cerevisiae
ggctgggaaaccatgcttggtccaa

SEQ ID NO: 50170 - DNA, 25 bp, S. cerevisiae
ggcagttgggtagctcatcggataa

SEQ ID NO: 50171 - DNA, 25 bp, S. cerevisiae
ggcggcggtaaggacaccagtacaa

SEQ ID NO: 50172 - DNA, 25 bp, S. cerevisiae
ggcagtacagttaagccagttttaa

SEQ ID NO: 50173 - DNA, 25 bp, S. cerevisiae
ggcttgacgctaataccgattttaa

SEQ ID NO: 50174 - DNA, 25 bp, S. cerevisiae
ggcttagcagatttacccttattaa

SEQ ID NO: 50175 - DNA, 25 bp, S. cerevisiae
ggcatgcccaccaagtgaactatta

SEQ ID NO: 50176 - DNA, 25 bp, S. cerevisiae
ggctcccactgacgtaaagactata

SEQ ID NO: 50177 - DNA, 25 bp, S. cerevisiae
ggcttatgaccttgacggaactgaa

SEQ ID NO: 50178 - DNA, 25 bp, S. cerevisiae
ggcttatcacggcacatctgaagaa

SEQ ID NO: 50179 - DNA, 25 bp, S. cerevisiae
ggcttcacaattgggtctcatttca

SEQ ID NO: 50180 - DNA, 25 bp, S. cerevisiae
ggctacaaatcttttagtttccctg

SEQ ID NO: 50181 - DNA, 25 bp, S. cerevisiae
ggcataagtgtttttatttccaccg

SEQ ID NO: 50182 - DNA, 25 bp, S. cerevisiae
tcgcgggtagtaaagctccatgcct

SEQ ID NO: 50183 - DNA, 25 bp, S. cerevisiae
ggctggtatcattgccatttacggt

SEQ ID NO: 50184 - DNA, 25 bp, S. cerevisiae
ggctgatgtcgatggtttcttggtc

SEQ ID NO: 50185 - DNA, 25 bp, S. cerevisiae
ggctgatgacgtggctgatctgatc

SEQ ID NO: 50186 - DNA, 25 bp, S. cerevisiae
ggctgattcattgcctgtacgcaag

SEQ ID NO: 50187 - DNA, 25 bp, S. cerevisiae
ggctgtatttgtgctgccatggcat

SEQ ID NO: 50188 - DNA, 25 bp, S. cerevisiae
ggcatttcatcattttcttactcat

SEQ ID NO: 50189 - DNA, 25 bp, S. cerevisiae
ggcatcttatatttttcatccccaa

SEQ ID NO: 50190 - DNA, 25 bp, S. cerevisiae
ggctaatgctgctattttatcccca

SEQ ID NO: 50191 - DNA, 25 bp, S. cerevisiae
ggctacgcgacacagtttgatggat

SEQ ID NO: 50192 - DNA, 25 bp, S. cerevisiae
ggctacctcacctgtttggatgata

SEQ ID NO: 50193 - DNA, 25 bp, S. cerevisiae
ggcttgccttactgtattgtaaaga

SEQ ID NO: 50194 - DNA, 25 bp, S. cerevisiae
ggctcctttaccctatagactaatg

SEQ ID NO: 50195 - DNA, 25 bp, S. cerevisiae
ggcccgttggccttgaagaaaatga

SEQ ID NO: 50196 - DNA, 25 bp, S. cerevisiae
tgcggcatccgctccaaagaaaaac

SEQ ID NO: 50197 - DNA, 25 bp, S. cerevisiae
ggcgcactcgcaaatcacaagggaa

SEQ ID NO: 50198 - DNA, 25 bp, S. cerevisiae
ggccaattgcaagccaacggtgctt

SEQ ID NO: 50199 - DNA, 25 bp, S. cerevisiae
ggctacaatggtgccgacgaaattc

SEQ ID NO: 50200 - DNA, 25 bp, S. cerevisiae
ggcgaacaggcagcgaatcaagcaa

SEQ ID NO: 50201 - DNA, 25 bp, S. cerevisiae
ggcgacaccggcgttgataactatt

SEQ ID NO: 50202 - DNA, 25 bp, S. cerevisiae
ggctttaccacatattgcaggctat

SEQ ID NO: 50203 - DNA, 25 bp, S. cerevisiae
ggctcttctccattttatggcctaa

SEQ ID NO: 50204 - DNA, 25 bp, S. cerevisiae
ggcatagctgccaattttgatggta

SEQ ID NO: 50205 - DNA, 25 bp, S. cerevisiae
ggcatgacatccaattacgagtgtt

SEQ ID NO: 50206 - DNA, 25 bp, S. cerevisiae
ggcatacacaaattaccatcggttt

SEQ ID NO: 50207 - DNA, 25 bp, S. cerevisiae
ggctcctccctttctgatagagttg

SEQ ID NO: 50208 - DNA, 25 bp, S. cerevisiae
ggcatcgtccgtctctaagatgatt

SEQ ID NO: 50209 - DNA, 25 bp, S. cerevisiae
ggcatcgtccgatcattacgtgaga

SEQ ID NO: 50210 - DNA, 25 bp, S. cerevisiae
ggctagctgctttgtctattcaaga

SEQ ID NO: 50211 - DNA, 25 bp, S. cerevisiae
ggctcactgctaattctttcggaat

SEQ ID NO: 50212 - DNA, 25 bp, S. cerevisiae
ggctcctgttttatactcttggcaa

SEQ ID NO: 50213 - DNA, 25 bp, S. cerevisiae
ggcatctgtgcttttattactgttg

SEQ ID NO: 50214 - DNA, 25 bp, S. cerevisiae
ggctgctggctgtaaaatcgttggt

SEQ ID NO: 50215 - DNA, 25 bp, S. cerevisiae
ggcatctttaagcaatgcggctgca

SEQ ID NO: 50216 - DNA, 25 bp, S. cerevisiae
ggctctttcattcaggcggctaaaa

SEQ ID NO: 50217 - DNA, 25 bp, S. cerevisiae
ggcatcaaatttcagtggcctaatt

SEQ ID NO: 50218 - DNA, 25 bp, S. cerevisiae
ggcataaatctgaccctgaagcaag

SEQ ID NO: 50219 - DNA, 25 bp, S. cerevisiae
ggccagttctgtgccgaaagcgatg

SEQ ID NO: 50220 - DNA, 25 bp, S. cerevisiae
ggcttggcattggtggcgattataa

SEQ ID NO: 50221 - DNA, 25 bp, S. cerevisiae
ggcattgtgcgactatgggatctaa

SEQ ID NO: 50222 - DNA, 25 bp, S. cerevisiae
ggctcttgcggtacttttaaccatt

SEQ ID NO: 50223 - DNA, 25 bp, S. cerevisiae
ggctatcggtagacttctaacccat

SEQ ID NO: 50224 - DNA, 25 bp, S. cerevisiae
ggccgcggttaatcattatgtccat

SEQ ID NO: 50225 - DNA, 25 bp, S. cerevisiae
ggccacggtaccttatttgactatc

SEQ ID NO: 50226 - DNA, 25 bp, S. cerevisiae
tgccccgttaactctggcagaaacg

SEQ ID NO: 50227 - DNA, 25 bp, S. cerevisiae
ggcccatgcaaatgaccaagtctac

SEQ ID NO: 50228 - DNA, 25 bp, S. cerevisiae
ggcttccccgctatacttaagagga

SEQ ID NO: 50229 - DNA, 25 bp, S. cerevisiae
ggcttcacgccgcagtataaagaat

SEQ ID NO: 50230 - DNA, 25 bp, S. cerevisiae
ggctctaactcccaaaacaatgaaa

SEQ ID NO: 50231 - DNA, 25 bp, S. cerevisiae
ggctatatacttccagcaccgcaaa

SEQ ID NO: 50232 - DNA, 25 bp, S. cerevisiae
ggcatgcaatgtatatggctctcat

SEQ ID NO: 50233 - DNA, 25 bp, S. cerevisiae
ggctatatcgccgatcctgaagaat

SEQ ID NO: 50234 - DNA, 25 bp, S. cerevisiae
ggctgttcccgatgactacataaga

SEQ ID NO: 50235 - DNA, 25 bp, S. cerevisiae
ggcatactacgccaagactatttta

SEQ ID NO: 50236 - DNA, 25 bp, S. cerevisiae
tgtgccgaggcccaagttactttga

SEQ ID NO: 50237 - DNA, 25 bp, S. cerevisiae
ggccgacgagctccagttcattatg

SEQ ID NO: 50238 - DNA, 25 bp, S. cerevisiae
ggctctatccaaagatggtatctac

SEQ ID NO: 50239 - DNA, 25 bp, S. cerevisiae
ggctatattcaataggtggccatga

SEQ ID NO: 50240 - DNA, 25 bp, S. cerevisiae
ggctgaatccaagcaattgtccgag

SEQ ID NO: 50241 - DNA, 25 bp, S. cerevisiae
ggctgtaccaagaaagctccctgac

SEQ ID NO: 50242 - DNA, 25 bp, S. cerevisiae
ggctatttccagaacatgctcgagg

SEQ ID NO: 50243 - DNA, 25 bp, S. cerevisiae
ggctatttacagactcagccatctg

SEQ ID NO: 50244 - DNA, 25 bp, S. cerevisiae
ggctatttatcaccctgaagagtat

SEQ ID NO: 50245 - DNA, 25 bp, S. cerevisiae
ggcggccatcccagatggatttcaa

SEQ ID NO: 50246 - DNA, 25 bp, S. cerevisiae
ggctgtgaccctcaattagttgcaa

SEQ ID NO: 50247 - DNA, 25 bp, S. cerevisiae
tgccgtcaccgttgaattcctttga

SEQ ID NO: 50248 - DNA, 25 bp, S. cerevisiae
ggcatatcacatttattcgtcctat

SEQ ID NO: 50249 - DNA, 25 bp, S. cerevisiae
ggctgcatccatactgattggttgc

SEQ ID NO: 50250 - DNA, 25 bp, S. cerevisiae
ggcttggcatataccgctgattatc

SEQ ID NO: 50251 - DNA, 25 bp, S. cerevisiae
ggcattatgctttcacacattcgat

SEQ ID NO: 50252 - DNA, 25 bp, S. cerevisiae
ggcatagacttctctttcatgacaa

SEQ ID NO: 50253 - DNA, 25 bp, S. cerevisiae
ggctaatattcagctcccagatggt

SEQ ID NO: 50254 - DNA, 25 bp, S. cerevisiae
ggctgaccttaattccacttacgaa

SEQ ID NO: 50255 - DNA, 25 bp, S. cerevisiae
ggcatcaactctattatcttctacg

SEQ ID NO: 50256 - DNA, 25 bp, S. cerevisiae
ggctcgatgtattggttctgttgac

SEQ ID NO: 50257 - DNA, 25 bp, S. cerevisiae
ggctcagatcattacagttcttgga

SEQ ID NO: 50258 - DNA, 25 bp, S. cerevisiae
ggctgcagaaaatgctcttcgtgac

SEQ ID NO: 50259 - DNA, 25 bp, S. cerevisiae
ggcttgcaatacatcgatcttcttt

SEQ ID NO: 50260 - DNA, 25 bp, S. cerevisiae
ggctttcctatgtgtcattactcta

SEQ ID NO: 50261 - DNA, 25 bp, S. cerevisiae
ggcttgtattgccattattgctacc

SEQ ID NO: 50262 - DNA, 25 bp, S. cerevisiae
ggcttgtatcgccatcatttctacc

SEQ ID NO: 50263 - DNA, 25 bp, S. cerevisiae
ggctgccattgtccaaattgatgct

SEQ ID NO: 50264 - DNA, 25 bp, S. cerevisiae
ggctactaagccttctattgagagt

SEQ ID NO: 50265 - DNA, 25 bp, S. cerevisiae
ggctaccaaggcttctcaagaatta

SEQ ID NO: 50266 - DNA, 25 bp, S. cerevisiae
ggctacagcagcatatggctcacca

SEQ ID NO: 50267 - DNA, 25 bp, S. cerevisiae
ggctacatccaattgagcagatcga

SEQ ID NO: 50268 - DNA, 25 bp, S. cerevisiae
ggctcagtacattctaatttctcat

SEQ ID NO: 50269 - DNA, 25 bp, S. cerevisiae
ggctattgactactacttgatccat

SEQ ID NO: 50270 - DNA, 25 bp, S. cerevisiae
ggctagattctactcgatttgcatc

SEQ ID NO: 50271 - DNA, 25 bp, S. cerevisiae
ggctcaacgcttgacattatgtcta

SEQ ID NO: 50272 - DNA, 25 bp, S. cerevisiae
ggcttgcctgataagacaccatgtt

SEQ ID NO: 50273 - DNA, 25 bp, S. cerevisiae
ggcttccataaaatcacgcgttgct

SEQ ID NO: 50274 - DNA, 25 bp, S. cerevisiae
ggcttgtaaagattgcacctgtggt

SEQ ID NO: 50275 - DNA, 25 bp, S. cerevisiae
ggctattttagttatcctggcgtct

SEQ ID NO: 50276 - DNA, 25 bp, S. cerevisiae
ggcgaatttatttaccgctgcccat

SEQ ID NO: 50277 - DNA, 25 bp, S. cerevisiae
ggcttgatgtctttacacttccaaa

SEQ ID NO: 50278 - DNA, 25 bp, S. cerevisiae
ggctgtgatgtaaccaacttcctga

SEQ ID NO: 50279 - DNA, 25 bp, S. cerevisiae
ggctcaaataccgaatccagctcga

SEQ ID NO: 50280 - DNA, 25 bp, S. cerevisiae
ggctaaattgcttaacgctatgcga

SEQ ID NO: 50281 - DNA, 25 bp, S. cerevisiae
ggctgaagactccaataacttgaga

SEQ ID NO: 50282 - DNA, 25 bp, S. cerevisiae
ggctggaactccgataatgtgtata

SEQ ID NO: 50283 - DNA, 25 bp, S. cerevisiae
ggcgggaacctatggtgctgcataa

SEQ ID NO: 50284 - DNA, 25 bp, S. cerevisiae
ggcgccaaagccacggtccaagagt

SEQ ID NO: 50285 - DNA, 25 bp, S. cerevisiae
ggcggcatcactaaactggcttcaa

SEQ ID NO: 50286 - DNA, 25 bp, S. cerevisiae
ggctgttacatgttggcggcgacca

SEQ ID NO: 50287 - DNA, 25 bp, S. cerevisiae
ggctgttgagcttcttgcttggaaa

SEQ ID NO: 50288 - DNA, 25 bp, S. cerevisiae
ggcgatatagcatctggtttcaact

SEQ ID NO: 50289 - DNA, 25 bp, S. cerevisiae
ggcgtatactggaagtttcaccttt

SEQ ID NO: 50290 - DNA, 25 bp, S. cerevisiae
ggctggatcccatttgttttgtatt

SEQ ID NO: 50291 - DNA, 25 bp, S. cerevisiae
ggctgtgttcttctttctaaattcc

SEQ ID NO: 50292 - DNA, 25 bp, S. cerevisiae
ggcttctattaacgacatgcttgag

SEQ ID NO: 50293 - DNA, 25 bp, S. cerevisiae
tggcaaccttaattacccgttgtgg

SEQ ID NO: 50294 - DNA, 25 bp, S. cerevisiae
ggctcgatgtcttccaagtattctt

SEQ ID NO: 50295 - DNA, 25 bp, S. cerevisiae
ggctttgagtactatcgttgtttta

SEQ ID NO: 50296 - DNA, 25 bp, S. cerevisiae
ggctctatggtagtccttcagatat

SEQ ID NO: 50297 - DNA, 25 bp, S. cerevisiae
ggcgttgggattatcatcagcatca

SEQ ID NO: 50298 - DNA, 25 bp, S. cerevisiae
ggctgttggctattatgaatcctga

SEQ ID NO: 50299 - DNA, 25 bp, S. cerevisiae
ggctgctgttggcataaaccgcaat

SEQ ID NO: 50300 - DNA, 25 bp, S. cerevisiae
ggctattatgtcgttccaaatccaa

SEQ ID NO: 50301 - DNA, 25 bp, S. cerevisiae
ggcttgagaatcgttccactggaaa

SEQ ID NO: 50302 - DNA, 25 bp, S. cerevisiae
ggctcatggttttcttggttgacaa

SEQ ID NO: 50303 - DNA, 25 bp, S. cerevisiae
ggcttattttcatttgatggtggca

SEQ ID NO: 50304 - DNA, 25 bp, S. cerevisiae
ggcttccatcctcaagactgatatt

SEQ ID NO: 50305 - DNA, 25 bp, S. cerevisiae
ggcttgtctaccttgccagaaattt

SEQ ID NO: 50306 - DNA, 25 bp, S. cerevisiae
ggctattgtattttccatgagtttt

SEQ ID NO: 50307 - DNA, 25 bp, S. cerevisiae
ggcttcagcaattgcaattacctta

SEQ ID NO: 50308 - DNA, 25 bp, S. cerevisiae
ggcttcgcaaacaatagatgccaaa

SEQ ID NO: 50309 - DNA, 25 bp, S. cerevisiae
ggcttagctcccatgatgcagaaag

SEQ ID NO: 50310 - DNA, 25 bp, S. cerevisiae
ggcgaaggccattcagatcaaccac

SEQ ID NO: 50311 - DNA, 25 bp, S. cerevisiae
tggccaagggtgtgtcaaccgcatt

SEQ ID NO: 50312 - DNA, 25 bp, S. cerevisiae
ggctcgctctaggaagcatatcgta

SEQ ID NO: 50313 - DNA, 25 bp, S. cerevisiae
tgaggcgtcctccaacaattaccta

SEQ ID NO: 50314 - DNA, 25 bp, S. cerevisiae
ggcggtaccgataaccacttgattg

SEQ ID NO: 50315 - DNA, 25 bp, S. cerevisiae
ggctggattacctaccaacttttag

SEQ ID NO: 50316 - DNA, 25 bp, S. cerevisiae
ggcgatgataaacccaaaattccta

SEQ ID NO: 50317 - DNA, 25 bp, S. cerevisiae
ggctccttaggtttgatgacttcta

SEQ ID NO: 50318 - DNA, 25 bp, S. cerevisiae
ggccgatacttgtggtactttagct

SEQ ID NO: 50319 - DNA, 25 bp, S. cerevisiae
ggctacatttcgtggctacttgata

SEQ ID NO: 50320 - DNA, 25 bp, S. cerevisiae
ggcctattattgtgagacccggttt

SEQ ID NO: 50321 - DNA, 25 bp, S. cerevisiae
ggccaatacatctgagactaactca

SEQ ID NO: 50322 - DNA, 25 bp, S. cerevisiae
ggctcacaagccaagcacgttcaaa

SEQ ID NO: 50323 - DNA, 25 bp, S. cerevisiae
ggctttggatatgcctgatcctgaa

SEQ ID NO: 50324 - DNA, 25 bp, S. cerevisiae
ggctttgccataatctctggataca

SEQ ID NO: 50325 - DNA, 25 bp, S. cerevisiae
ggctttatcttccagctgctattaa

SEQ ID NO: 50326 - DNA, 25 bp, S. cerevisiae
ggctgcctcctggtggaattattca

SEQ ID NO: 50327 - DNA, 25 bp, S. cerevisiae
ggctccagccgtatcgttttaaaga

SEQ ID NO: 50328 - DNA, 25 bp, S. cerevisiae
ggcttagctgcaaacctttttaaag

SEQ ID NO: 50329 - DNA, 25 bp, S. cerevisiae
ggctttgcagtttcttatgccctaa

SEQ ID NO: 50330 - DNA, 25 bp, S. cerevisiae
ggctattgcgattctgggaccatat

SEQ ID NO: 50331 - DNA, 25 bp, S. cerevisiae
ggctattgaatctggcttgccaatt

SEQ ID NO: 50332 - DNA, 25 bp, S. cerevisiae
ggctttaatggcctcattgctagtg

SEQ ID NO: 50333 - DNA, 25 bp, S. cerevisiae
ggctttaagagccattgcactaatt

SEQ ID NO: 50334 - DNA, 25 bp, S. cerevisiae
ggctgtttaggcatagttcaattca

SEQ ID NO: 50335 - DNA, 25 bp, S. cerevisiae
ggcgttaggtatttcttcagtatct

SEQ ID NO: 50336 - DNA, 25 bp, S. cerevisiae
ggctcctttgaatgcgactggtgat

SEQ ID NO: 50337 - DNA, 25 bp, S. cerevisiae
ggctctgttctaaaggcacatggta

SEQ ID NO: 50338 - DNA, 25 bp, S. cerevisiae
ggctctttaatatcgccaagcgtaa

SEQ ID NO: 50339 - DNA, 25 bp, S. cerevisiae
ggccgctaagtatttcttgccagaa

SEQ ID NO: 50340 - DNA, 25 bp, S. cerevisiae
ggccctaggtttgttatgactgtca

SEQ ID NO: 50341 - DNA, 25 bp, S. cerevisiae
ggcgcccaagttttatttgcctcca

SEQ ID NO: 50342 - DNA, 25 bp, S. cerevisiae
ggcccatatggtgtaacggttccac

SEQ ID NO: 50343 - DNA, 25 bp, S. cerevisiae
ggccctcagattataccggtatcta

SEQ ID NO: 50344 - DNA, 25 bp, S. cerevisiae
tgacggtggtttgtacgttcctcac

SEQ ID NO: 50345 - DNA, 25 bp, S. cerevisiae
ggcggttgttgtagaacgtctccta

SEQ ID NO: 50346 - DNA, 25 bp, S. cerevisiae
ggctttgattggcagtcctgatcca

SEQ ID NO: 50347 - DNA, 25 bp, S. cerevisiae
ggcttaggttctgatgctttgcata

SEQ ID NO: 50348 - DNA, 25 bp, S. cerevisiae
ggctcttggattctatgctttcaca

SEQ ID NO: 50349 - DNA, 25 bp, S. cerevisiae
ggctcatttagttgccttccaaaag

SEQ ID NO: 50350 - DNA, 25 bp, S. cerevisiae
ggctttcttaacatttgcacaacgt

SEQ ID NO: 50351 - DNA, 25 bp, S. cerevisiae
ggcgttactaatattagcaccacag

SEQ ID NO: 50352 - DNA, 25 bp, S. cerevisiae
ggctcttcacataattataccgtca

SEQ ID NO: 50353 - DNA, 25 bp, S. cerevisiae
ggctgccaagtttgttacatctaca

SEQ ID NO: 50354 - DNA, 25 bp, S. cerevisiae
ggctgggatgaacattacttgccaa

SEQ ID NO: 50355 - DNA, 25 bp, S. cerevisiae
ggctcacgacatgcaagcttatgat

SEQ ID NO: 50356 - DNA, 25 bp, S. cerevisiae
ggctatgctggatcaatcatttcat

SEQ ID NO: 50357 - DNA, 25 bp, S. cerevisiae
ggctgtcctgaagcatcatttcaca

SEQ ID NO: 50358 - DNA, 25 bp, S. cerevisiae
ggctgatcaagaaaactctccacta

SEQ ID NO: 50359 - DNA, 25 bp, S. cerevisiae
ggctgctatcgttgaaattatcgac

SEQ ID NO: 50360 - DNA, 25 bp, S. cerevisiae
ggctcagctctatattttgcatctt

SEQ ID NO: 50361 - DNA, 25 bp, S. cerevisiae
tggccggatcttgtaaatttcgcac

SEQ ID NO: 50362 - DNA, 25 bp, S. cerevisiae
ggctataccgatcccacaatgttga

SEQ ID NO: 50363 - DNA, 25 bp, S. cerevisiae
ggctcatagccgtacaacaaccaga

SEQ ID NO: 50364 - DNA, 25 bp, S. cerevisiae
ggctattgttctacatacgagcgaa

SEQ ID NO: 50365 - DNA, 25 bp, S. cerevisiae
ggctgaattggagcttttaatggat

SEQ ID NO: 50366 - DNA, 25 bp, S. cerevisiae
ggctgtcacttggaacttatacggc

SEQ ID NO: 50367 - DNA, 25 bp, S. cerevisiae
ggctatccatttccctatatacgaa

SEQ ID NO: 50368 - DNA, 25 bp, S. cerevisiae
ggctatcgcactttttattaatgac

SEQ ID NO: 50369 - DNA, 25 bp, S. cerevisiae
ggctcaccactaacttttattcttt

SEQ ID NO: 50370 - DNA, 25 bp, S. cerevisiae
ggctcacgaaaacgtctggttctct

SEQ ID NO: 50371 - DNA, 25 bp, S. cerevisiae
ggctcactgaaaacctctcaaatca

SEQ ID NO: 50372 - DNA, 25 bp, S. cerevisiae
ggctcctcaacagcagctacagaag

SEQ ID NO: 50373 - DNA, 25 bp, S. cerevisiae
ggctttcaacaatgcttctctaggt

SEQ ID NO: 50374 - DNA, 25 bp, S. cerevisiae
ggctttcaagaatctctctcagaag

SEQ ID NO: 50375 - DNA, 25 bp, S. cerevisiae
ggctcctcaaaattctccatcgaat

SEQ ID NO: 50376 - DNA, 25 bp, S. cerevisiae
ggctcaccagaggatttgcccgaga

SEQ ID NO: 50377 - DNA, 25 bp, S. cerevisiae
ggctctcaagtattttcccgatggt

SEQ ID NO: 50378 - DNA, 25 bp, S. cerevisiae
ggctgctaagccattcattacgtgg

SEQ ID NO: 50379 - DNA, 25 bp, S. cerevisiae
ggcccacctatacatgatccggtag

SEQ ID NO: 50380 - DNA, 25 bp, S. cerevisiae
ggctactgcctataactacggtaat

SEQ ID NO: 50381 - DNA, 25 bp, S. cerevisiae
ggctgcttggcatggttctaaatat

SEQ ID NO: 50382 - DNA, 25 bp, S. cerevisiae
ggctctgattttttgatccacttta

SEQ ID NO: 50383 - DNA, 25 bp, S. cerevisiae
ggctctgaagctattttcctggata

SEQ ID NO: 50384 - DNA, 25 bp, S. cerevisiae
ggctaagtcactcggaattgcattg

SEQ ID NO: 50385 - DNA, 25 bp, S. cerevisiae
ggctaagaactgcaaagtcctttga

SEQ ID NO: 50386 - DNA, 25 bp, S. cerevisiae
tggttagttccctatacaatttaga

SEQ ID NO: 50387 - DNA, 25 bp, S. cerevisiae
ggctcacagccagcttagcgatata

SEQ ID NO: 50388 - DNA, 25 bp, S. cerevisiae
ggctgcctccttcaagggatgtaga

SEQ ID NO: 50389 - DNA, 25 bp, S. cerevisiae
ggctgtcacctttaccgtttatgaa

SEQ ID NO: 50390 - DNA, 25 bp, S. cerevisiae
ggctgataattttccccattgtaaa

SEQ ID NO: 50391 - DNA, 25 bp, S. cerevisiae
ggcgtaaatttgacccatcatccag

SEQ ID NO: 50392 - DNA, 25 bp, S. cerevisiae
ggcctaaaccagacccaattgatgt

SEQ ID NO: 50393 - DNA, 25 bp, S. cerevisiae
ggcgtaaatctatgcccaattcttg

SEQ ID NO: 50394 - DNA, 25 bp, S. cerevisiae
tgggaacaagactcctcaggacatt

SEQ ID NO: 50395 - DNA, 25 bp, S. cerevisiae
tgcggaagtaaaacccaaccaatgc

SEQ ID NO: 50396 - DNA, 25 bp, S. cerevisiae
ggcggccagagtctattgatgcttc

SEQ ID NO: 50397 - DNA, 25 bp, S. cerevisiae
ggctatttatgtccatcgggtctat

SEQ ID NO: 50398 - DNA, 25 bp, S. cerevisiae
ggctctacaaagtggaatttccgtc

SEQ ID NO: 50399 - DNA, 25 bp, S. cerevisiae
ggccccgagaatttgcaattttcgt

SEQ ID NO: 50400 - DNA, 25 bp, S. cerevisiae
ggctgcaattgcttttgccattgga

SEQ ID NO: 50401 - DNA, 25 bp, S. cerevisiae
ggcggttgtcagcttatatgttctt

SEQ ID NO: 50402 - DNA, 25 bp, S. cerevisiae
ggcgcgttccagctgtaagtgatac

SEQ ID NO: 50403 - DNA, 25 bp, S. cerevisiae
ggctgggcacacacttctaatagac

SEQ ID NO: 50404 - DNA, 25 bp, S. cerevisiae
ggcgtcagccatgcctttacaagga

SEQ ID NO: 50405 - DNA, 25 bp, S. cerevisiae
ggctgatgaccacgcatctgttcaa

SEQ ID NO: 50406 - DNA, 25 bp, S. cerevisiae
ggctggtatcaccatgctcattgaa

SEQ ID NO: 50407 - DNA, 25 bp, S. cerevisiae
ggctcctcgtcgaccataaaaagat

SEQ ID NO: 50408 - DNA, 25 bp, S. cerevisiae
ggctcgtcccagtatatttcagaat

SEQ ID NO: 50409 - DNA, 25 bp, S. cerevisiae
ggcggattcctgttttgaccacaaa

SEQ ID NO: 50410 - DNA, 25 bp, S. cerevisiae
ggcggtgctaatgctttactccaag

SEQ ID NO: 50411 - DNA, 25 bp, S. cerevisiae
ggcggctattatggtcgaagtattc

SEQ ID NO: 50412 - DNA, 25 bp, S. cerevisiae
tggcgtccaatagcgcaagtggtac

SEQ ID NO: 50413 - DNA, 25 bp, S. cerevisiae
ggcgtgccaacaacgaatttgtagt

SEQ ID NO: 50414 - DNA, 25 bp, S. cerevisiae
ggcggatcggcatcccaagatatag

SEQ ID NO: 50415 - DNA, 25 bp, S. cerevisiae
ggcgctcttggattgcccgaaaagg

SEQ ID NO: 50416 - DNA, 25 bp, S. cerevisiae
ggccttccccagttttaagcatgaa

SEQ ID NO: 50417 - DNA, 25 bp, S. cerevisiae
tgggttccggtacttctaacaatca

SEQ ID NO: 50418 - DNA, 25 bp, S. cerevisiae
ggccgtggagtttctgagtcagcaa

SEQ ID NO: 50419 - DNA, 25 bp, S. cerevisiae
ggctccattgggttctttattactt

SEQ ID NO: 50420 - DNA, 25 bp, S. cerevisiae
ggctccagtggttcttttcatgaaa

SEQ ID NO: 50421 - DNA, 25 bp, S. cerevisiae
ggctcatgtggtatcattgttcagt

SEQ ID NO: 50422 - DNA, 25 bp, S. cerevisiae
ggcgatgtggtcgaatccttcagaa

SEQ ID NO: 50423 - DNA, 25 bp, S. cerevisiae
ggcgtcagcattgacacgttcgatt

SEQ ID NO: 50424 - DNA, 25 bp, S. cerevisiae
ggctgatccaaagtacttttcgcac

SEQ ID NO: 50425 - DNA, 25 bp, S. cerevisiae
ggctacgccaaatattctaccaaga

SEQ ID NO: 50426 - DNA, 25 bp, S. cerevisiae
ggctacgcgccaaaaatcttcacta

SEQ ID NO: 50427 - DNA, 25 bp, S. cerevisiae
ggccgatggccaaggagactcgcat

SEQ ID NO: 50428 - DNA, 25 bp, S. cerevisiae
ggctgcaacccttattagtaatatt

SEQ ID NO: 50429 - DNA, 25 bp, S. cerevisiae
ggccaagccctgctgctaataaatt

SEQ ID NO: 50430 - DNA, 25 bp, S. cerevisiae
ggcggtgccaatcctaatcaaaact

SEQ ID NO: 50431 - DNA, 25 bp, S. cerevisiae
ggcggtactacctcatcaagatata

SEQ ID NO: 50432 - DNA, 25 bp, S. cerevisiae
ggcggactgctaatgatactcgtaa

SEQ ID NO: 50433 - DNA, 25 bp, S. cerevisiae
ggcgaccgtttctccagataaagct

SEQ ID NO: 50434 - DNA, 25 bp, S. cerevisiae
ggctacggcgtttaccaaaagattg

SEQ ID NO: 50435 - DNA, 25 bp, S. cerevisiae
ggcgagcgtacaaaacccaggagtt

SEQ ID NO: 50436 - DNA, 25 bp, S. cerevisiae
tccccgtcactataactccaagtaa

SEQ ID NO: 50437 - DNA, 25 bp, S. cerevisiae
tgttcgcacttttaaacctttcaag

SEQ ID NO: 50438 - DNA, 25 bp, S. cerevisiae
tgtccgcggtttcaagatcagtttt

SEQ ID NO: 50439 - DNA, 25 bp, S. cerevisiae
ggcgacccattcgatgaatctactt

SEQ ID NO: 50440 - DNA, 25 bp, S. cerevisiae
ggcgtcccaagctgctattatgttg

SEQ ID NO: 50441 - DNA, 25 bp, S. cerevisiae
ggctgatgcagcttcgtcagtaaca

SEQ ID NO: 50442 - DNA, 25 bp, S. cerevisiae
ggcgctttaacgtcaccacaaatta

SEQ ID NO: 50443 - DNA, 25 bp, S. cerevisiae
ggccttgtctaacaccatccagcat

SEQ ID NO: 50444 - DNA, 25 bp, S. cerevisiae
ggctcttttcactaacgttccatga

SEQ ID NO: 50445 - DNA, 25 bp, S. cerevisiae
ggccttaagagcttgtccgcttcgc

SEQ ID NO: 50446 - DNA, 25 bp, S. cerevisiae
ggcgtaagaaactatgtccctcaga

SEQ ID NO: 50447 - DNA, 25 bp, S. cerevisiae
tggaagacacttcccgtaccattgt

SEQ ID NO: 50448 - DNA, 25 bp, S. cerevisiae
tgggagactcggtcgcagttccact

SEQ ID NO: 50449 - DNA, 25 bp, S. cerevisiae
ggcggtaaaatcgaatgcacatctg

SEQ ID NO: 50450 - DNA, 25 bp, S. cerevisiae
ggcggtcaaattgccatccagattt

SEQ ID NO: 50451 - DNA, 25 bp, S. cerevisiae
ggcggatgatctttcacacatggca

SEQ ID NO: 50452 - DNA, 25 bp, S. cerevisiae
ggcgtatgtcatccatgtcaatctt

SEQ ID NO: 50453 - DNA, 25 bp, S. cerevisiae
ggctcctgcagtggatcattttgat

SEQ ID NO: 50454 - DNA, 25 bp, S. cerevisiae
ggctcttcatttacatattcgtcat

SEQ ID NO: 50455 - DNA, 25 bp, S. cerevisiae
ggccattgatttgatgtctagggat

SEQ ID NO: 50456 - DNA, 25 bp, S. cerevisiae
ggctccacctcagctagagtgcgga

SEQ ID NO: 50457 - DNA, 25 bp, S. cerevisiae
ggctccacgccgttcagatttgaga

SEQ ID NO: 50458 - DNA, 25 bp, S. cerevisiae
ggctcacccatttctcaatttagta

SEQ ID NO: 50459 - DNA, 25 bp, S. cerevisiae
tggactgccctcgaactattgggat

SEQ ID NO: 50460 - DNA, 25 bp, S. cerevisiae
tggcttggttcccaggtatgctata

SEQ ID NO: 50461 - DNA, 25 bp, S. cerevisiae
ggctcttttgccaattgtgaggaaa

SEQ ID NO: 50462 - DNA, 25 bp, S. cerevisiae
tggcgtacttccaaccatgcaggaa

SEQ ID NO: 50463 - DNA, 25 bp, S. cerevisiae
tgggaattatcctagcgggccctaa

SEQ ID NO: 50464 - DNA, 25 bp, S. cerevisiae
tggtaaccaacctcaaagtcctcct

SEQ ID NO: 50465 - DNA, 25 bp, S. cerevisiae
tgttaccaaccctgctaattcgttt

SEQ ID NO: 50466 - DNA, 25 bp, S. cerevisiae
tttaagtaccctctagattcctcta

SEQ ID NO: 50467 - DNA, 25 bp, S. cerevisiae
tgttcaagtccgcaagatcagtttc

SEQ ID NO: 50468 - DNA, 25 bp, S. cerevisiae
ggcggctactcaattcaacggcttt

SEQ ID NO: 50469 - DNA, 25 bp, S. cerevisiae
ggctcacagggctttcatacaggtt

SEQ ID NO: 50470 - DNA, 25 bp, S. cerevisiae
ggctccaccgttgcattcggagata

SEQ ID NO: 50471 - DNA, 25 bp, S. cerevisiae
tgagtccttcgttgaattaggtgtc

SEQ ID NO: 50472 - DNA, 25 bp, S. cerevisiae
ggctcgctcttatacatttgttatc

SEQ ID NO: 50473 - DNA, 25 bp, S. cerevisiae
ggcgggcttgattaacgatgattca

SEQ ID NO: 50474 - DNA, 25 bp, S. cerevisiae
ggcgcagccttggaattcgagttcg

SEQ ID NO: 50475 - DNA, 25 bp, S. cerevisiae
ggccatccagtgtacgtagttgtcg

SEQ ID NO: 50476 - DNA, 25 bp, S. cerevisiae
ggctctgtcaggtacgatctttaca

SEQ ID NO: 50477 - DNA, 25 bp, S. cerevisiae
ggccgcagattccaatatactgggt

SEQ ID NO: 50478 - DNA, 25 bp, S. cerevisiae
ggctcctgagttcctagactggtta

SEQ ID NO: 50479 - DNA, 25 bp, S. cerevisiae
ggccctggtattttgcaatgcgatt

SEQ ID NO: 50480 - DNA, 25 bp, S. cerevisiae
ggcgttttctttttgtctattcact

SEQ ID NO: 50481 - DNA, 25 bp, S. cerevisiae
ggccaattgccgctattaaggaaat

SEQ ID NO: 50482 - DNA, 25 bp, S. cerevisiae
ggccctcatggtgtcattaacgttt

SEQ ID NO: 50483 - DNA, 25 bp, S. cerevisiae
ggcgccacatgtgcctcaggaaaaa

SEQ ID NO: 50484 - DNA, 25 bp, S. cerevisiae
ggctcagcttctttctcaacaacag

SEQ ID NO: 50485 - DNA, 25 bp, S. cerevisiae
ggctcctgctctcaagctgatataa

SEQ ID NO: 50486 - DNA, 25 bp, S. cerevisiae
ggctcgcaggcaaaggatcattcaa

SEQ ID NO: 50487 - DNA, 25 bp, S. cerevisiae
ggctcgcaactttctggttatcatg

SEQ ID NO: 50488 - DNA, 25 bp, S. cerevisiae
ggcgctagtagctctggtcgtagaa

SEQ ID NO: 50489 - DNA, 25 bp, S. cerevisiae
ggctccagtgaagtccaagcagctt

SEQ ID NO: 50490 - DNA, 25 bp, S. cerevisiae
ggcccctgaactgaatcgcttgaaa

SEQ ID NO: 50491 - DNA, 25 bp, S. cerevisiae
tggcccagggacaaaacgttgacga

SEQ ID NO: 50492 - DNA, 25 bp, S. cerevisiae
ggctcatcatgggaagctaaccggt

SEQ ID NO: 50493 - DNA, 25 bp, S. cerevisiae
ggctcatccggattgtatacctgat

SEQ ID NO: 50494 - DNA, 25 bp, S. cerevisiae
ggctgactctgaaatcgaaatctct

SEQ ID NO: 50495 - DNA, 25 bp, S. cerevisiae
ggctgccctgcctaaagaatatttg

SEQ ID NO: 50496 - DNA, 25 bp, S. cerevisiae
ggccaagatggcctgcaagcagcta

SEQ ID NO: 50497 - DNA, 25 bp, S. cerevisiae
ggcgcaatgtgcgttcaaagattcg

SEQ ID NO: 50498 - DNA, 25 bp, S. cerevisiae
ggctgcaattccatcatttatctgg

SEQ ID NO: 50499 - DNA, 25 bp, S. cerevisiae
ggctgcaaccacatggtttgctcaa

SEQ ID NO: 50500 - DNA, 25 bp, S. cerevisiae
ggctgaaaccgctgtcattgctgaa

SEQ ID NO: 50501 - DNA, 25 bp, S. cerevisiae
ggcgaataccgctgccgtaacagag

SEQ ID NO: 50502 - DNA, 25 bp, S. cerevisiae
ggccatttttgatgccgttacgaaa

SEQ ID NO: 50503 - DNA, 25 bp, S. cerevisiae
ggctgattttggtccgctgttagaa

SEQ ID NO: 50504 - DNA, 25 bp, S. cerevisiae
ggctcatttcaaagaataccaagtc

SEQ ID NO: 50505 - DNA, 25 bp, S. cerevisiae
ggccatttcaaagatcttcctgacg

SEQ ID NO: 50506 - DNA, 25 bp, S. cerevisiae
tcgccgtacggcacttttaacagta

SEQ ID NO: 50507 - DNA, 25 bp, S. cerevisiae
ggcggcgacggcagcattattaaca

SEQ ID NO: 50508 - DNA, 25 bp, S. cerevisiae
ggcgtggccatggaacttttgaacc

SEQ ID NO: 50509 - DNA, 25 bp, S. cerevisiae
ggctgctgacctgacatttgttaaa

SEQ ID NO: 50510 - DNA, 25 bp, S. cerevisiae
ggcgatacacgctactttggaaaag

SEQ ID NO: 50511 - DNA, 25 bp, S. cerevisiae
ggccacttaccacacttatgagatt

SEQ ID NO: 50512 - DNA, 25 bp, S. cerevisiae
ggcgctttggcttacatggagacat

SEQ ID NO: 50513 - DNA, 25 bp, S. cerevisiae
ggcgtcaagttagtcttagttgcac

SEQ ID NO: 50514 - DNA, 25 bp, S. cerevisiae
ggcgaaacctacattactaactgtt

SEQ ID NO: 50515 - DNA, 25 bp, S. cerevisiae
ggcgataattcgtctagttcttcaa

SEQ ID NO: 50516 - DNA, 25 bp, S. cerevisiae
ggcggcaaccagtagagtctttgac

SEQ ID NO: 50517 - DNA, 25 bp, S. cerevisiae
ggcgtagactttttgattgattcga

SEQ ID NO: 50518 - DNA, 25 bp, S. cerevisiae
ggccaacttcacaattcatcatgca

SEQ ID NO: 50519 - DNA, 25 bp, S. cerevisiae
tggacccctgcgaacctagtgggaa

SEQ ID NO: 50520 - DNA, 25 bp, S. cerevisiae
tgaacaacattggtactttacggaa

SEQ ID NO: 50521 - DNA, 25 bp, S. cerevisiae
tggtagccgactctcccttatgtga

SEQ ID NO: 50522 - DNA, 25 bp, S. cerevisiae
ggctgacctactatcacgttcatga

SEQ ID NO: 50523 - DNA, 25 bp, S. cerevisiae
ggctgccgaagctttcagagttgct

SEQ ID NO: 50524 - DNA, 25 bp, S. cerevisiae
ggctggctacaggattcgaatttta

SEQ ID NO: 50525 - DNA, 25 bp, S. cerevisiae
ggcgagtccagcataaatagttcta

SEQ ID NO: 50526 - DNA, 25 bp, S. cerevisiae
ggctgagactttaccactactttaa

SEQ ID NO: 50527 - DNA, 25 bp, S. cerevisiae
ggcggcctatttactctgtttgtaa

SEQ ID NO: 50528 - DNA, 25 bp, S. cerevisiae
ggccgtggctagtttcttcttaaga

SEQ ID NO: 50529 - DNA, 25 bp, S. cerevisiae
ggctgccatcttctcatactagaga

SEQ ID NO: 50530 - DNA, 25 bp, S. cerevisiae
ggctgctcacttgccaggtatggtg

SEQ ID NO: 50531 - DNA, 25 bp, S. cerevisiae
ggctggcaatggcaagttctttcaa

SEQ ID NO: 50532 - DNA, 25 bp, S. cerevisiae
ggctccattgaacagtatcctcgca

SEQ ID NO: 50533 - DNA, 25 bp, S. cerevisiae
tggtcgctggaacgtctactaagtc

SEQ ID NO: 50534 - DNA, 25 bp, S. cerevisiae
ggcgcgcggaggatctacaattgtc

SEQ ID NO: 50535 - DNA, 25 bp, S. cerevisiae
ggctccacgcagaatgccttgagaa

SEQ ID NO: 50536 - DNA, 25 bp, S. cerevisiae
ggcggagccagcagcttccagagat

SEQ ID NO: 50537 - DNA, 25 bp, S. cerevisiae
ggcgtgaatagacctgcatccaaat

SEQ ID NO: 50538 - DNA, 25 bp, S. cerevisiae
ggcgataagccaaccacgcaaatta

SEQ ID NO: 50539 - DNA, 25 bp, S. cerevisiae
ggctgaaaccatgccaatcctggaa

SEQ ID NO: 50540 - DNA, 25 bp, S. cerevisiae
tggatgtcaaatacggcaatacctg

SEQ ID NO: 50541 - DNA, 25 bp, S. cerevisiae
ggctgtatcagtaagcgccaactct

SEQ ID NO: 50542 - DNA, 25 bp, S. cerevisiae
ggctgaatcaatcatgcacgccatt

SEQ ID NO: 50543 - DNA, 25 bp, S. cerevisiae
ggctgaatcaagaactcgtcaattt

SEQ ID NO: 50544 - DNA, 25 bp, S. cerevisiae
ggctgagggtgacatcgtatttatc

SEQ ID NO: 50545 - DNA, 25 bp, S. cerevisiae
ggcgacggtataatcttgcgttcat

SEQ ID NO: 50546 - DNA, 25 bp, S. cerevisiae
ggccctcaacgctgaagacacatta

SEQ ID NO: 50547 - DNA, 25 bp, S. cerevisiae
ggcggaaacgctccaagaccagtaa

SEQ ID NO: 50548 - DNA, 25 bp, S. cerevisiae
ggcggaaattccaacaacatcatta

SEQ ID NO: 50549 - DNA, 25 bp, S. cerevisiae
ggcgcttggaaaactgcatctattg

SEQ ID NO: 50550 - DNA, 25 bp, S. cerevisiae
ggcggtagaaacacgctagcttgta

SEQ ID NO: 50551 - DNA, 25 bp, S. cerevisiae
tggcgtgtcgccttcagtgatatac

SEQ ID NO: 50552 - DNA, 25 bp, S. cerevisiae
ggctgctgtcccaagtttgattgaa

SEQ ID NO: 50553 - DNA, 25 bp, S. cerevisiae
ggcgtgcttcttacgtggctaagga

SEQ ID NO: 50554 - DNA, 25 bp, S. cerevisiae
ggcgctgttcttgttggaacactga

SEQ ID NO: 50555 - DNA, 25 bp, S. cerevisiae
ggcgcaatgtctttatttaccttgt

SEQ ID NO: 50556 - DNA, 25 bp, S. cerevisiae
ggcgaatgttgtaaggactcttgtc

SEQ ID NO: 50557 - DNA, 25 bp, S. cerevisiae
ggccgttaaaggtttcattagtcat

SEQ ID NO: 50558 - DNA, 25 bp, S. cerevisiae
tggcttttgaagtggttcctcgtac

SEQ ID NO: 50559 - DNA, 25 bp, S. cerevisiae
ggcgttcttagtatttacctctacg

SEQ ID NO: 50560 - DNA, 25 bp, S. cerevisiae
ggcgttattaatattcttcattcta

SEQ ID NO: 50561 - DNA, 25 bp, S. cerevisiae
ggctgccactgatatcaaatccttt

SEQ ID NO: 50562 - DNA, 25 bp, S. cerevisiae
ggctgccacgtcgatgaaacgtcta

SEQ ID NO: 50563 - DNA, 25 bp, S. cerevisiae
ggcggacgccgatttacatcacatt

SEQ ID NO: 50564 - DNA, 25 bp, S. cerevisiae
ggcggaagccattttcaaacatgaa

SEQ ID NO: 50565 - DNA, 25 bp, S. cerevisiae
ggcggtgacacctatccaaggagaa

SEQ ID NO: 50566 - DNA, 25 bp, S. cerevisiae
ggcccaagtccacgacatgttatgt

SEQ ID NO: 50567 - DNA, 25 bp, S. cerevisiae
ggcctcagctcatccataagatttt

SEQ ID NO: 50568 - DNA, 25 bp, S. cerevisiae
ggcggcgtcattgctaagatcatta

SEQ ID NO: 50569 - DNA, 25 bp, S. cerevisiae
ggcgacctcattggcttaggcataa

SEQ ID NO: 50570 - DNA, 25 bp, S. cerevisiae
ggcgacctctttatcttcatgaaac

SEQ ID NO: 50571 - DNA, 25 bp, S. cerevisiae
ggcgattcatatttattgccaggaa

SEQ ID NO: 50572 - DNA, 25 bp, S. cerevisiae
ggcggtttcgctatcatcacaaagt

SEQ ID NO: 50573 - DNA, 25 bp, S. cerevisiae
ggctgctattgtatgcgttaaacta

SEQ ID NO: 50574 - DNA, 25 bp, S. cerevisiae
ggcgtttgttcgcaatcatgattta

SEQ ID NO: 50575 - DNA, 25 bp, S. cerevisiae
ggcgtttattcaaccaaagttagtg

SEQ ID NO: 50576 - DNA, 25 bp, S. cerevisiae
ggcgttccattcaccgttgtaatgt

SEQ ID NO: 50577 - DNA, 25 bp, S. cerevisiae
ggcgctcgccaattcaatgggttga

SEQ ID NO: 50578 - DNA, 25 bp, S. cerevisiae
tggcgagactttttgaaccaagcaa

SEQ ID NO: 50579 - DNA, 25 bp, S. cerevisiae
ggccaagattcttctgccaacaatc

SEQ ID NO: 50580 - DNA, 25 bp, S. cerevisiae
ggccaagaatatgctcaaatcacca

SEQ ID NO: 50581 - DNA, 25 bp, S. cerevisiae
tggccaagagttgcatctaactccg

SEQ ID NO: 50582 - DNA, 25 bp, S. cerevisiae
tggcccgtggcagactaatctacga

SEQ ID NO: 50583 - DNA, 25 bp, S. cerevisiae
tggcccgggcaatgtgatttataac

SEQ ID NO: 50584 - DNA, 25 bp, S. cerevisiae
ggcggctattttacttggatcactc

SEQ ID NO: 50585 - DNA, 25 bp, S. cerevisiae
tgggcaggtactggatgttcgcatt

SEQ ID NO: 50586 - DNA, 25 bp, S. cerevisiae
ggcgaggtcaccattgcaagcattg

SEQ ID NO: 50587 - DNA, 25 bp, S. cerevisiae
ggccctcatagcctggtgtgacagt

SEQ ID NO: 50588 - DNA, 25 bp, S. cerevisiae
tggccccacctgaggtgcaagttga

SEQ ID NO: 50589 - DNA, 25 bp, S. cerevisiae
ggcgttgttcctcctgtaggaataa

SEQ ID NO: 50590 - DNA, 25 bp, S. cerevisiae
ggcggtggcactctctgtaaaatat

SEQ ID NO: 50591 - DNA, 25 bp, S. cerevisiae
ggcgggtgtctgatttaaaactcat

SEQ ID NO: 50592 - DNA, 25 bp, S. cerevisiae
ggccctgttgtcactgtaaccaaat

SEQ ID NO: 50593 - DNA, 25 bp, S. cerevisiae
ggcccattctacagttccagatgaa

SEQ ID NO: 50594 - DNA, 25 bp, S. cerevisiae
ggccaaatcattacgtgctagcagt

SEQ ID NO: 50595 - DNA, 25 bp, S. cerevisiae
ggccaacatgattacgttcatcgaa

SEQ ID NO: 50596 - DNA, 25 bp, S. cerevisiae
ggcgttgttatcatcattcattgca

SEQ ID NO: 50597 - DNA, 25 bp, S. cerevisiae
ggctgtgttctcagagtctttcaag

SEQ ID NO: 50598 - DNA, 25 bp, S. cerevisiae
ggcgttgtctgtccagtcatttgca

SEQ ID NO: 50599 - DNA, 25 bp, S. cerevisiae
ggctgtttcagctaagtcattttgc

SEQ ID NO: 50600 - DNA, 25 bp, S. cerevisiae
tggcttttcagctgcgtcattcgga

SEQ ID NO: 50601 - DNA, 25 bp, S. cerevisiae
ggcccacagccagctatttttgatg

SEQ ID NO: 50602 - DNA, 25 bp, S. cerevisiae
ggccccgatgggttatctttcaatg

SEQ ID NO: 50603 - DNA, 25 bp, S. cerevisiae
ggccttattagttcaagttctggac

SEQ ID NO: 50604 - DNA, 25 bp, S. cerevisiae
ggccttatgatactctaatttcgat

SEQ ID NO: 50605 - DNA, 25 bp, S. cerevisiae
ggctgtttatcaccaggtgcatttt

SEQ ID NO: 50606 - DNA, 25 bp, S. cerevisiae
tgttgttgaactccagggctactca

SEQ ID NO: 50607 - DNA, 25 bp, S. cerevisiae
ggcgtctgaaccaatttctactgct

SEQ ID NO: 50608 - DNA, 25 bp, S. cerevisiae
ggcggtcattacacagcggatgttt

SEQ ID NO: 50609 - DNA, 25 bp, S. cerevisiae
tggcggtctaactcacagtagtgat

SEQ ID NO: 50610 - DNA, 25 bp, S. cerevisiae
ggccggctaatgtttcctatggatg

SEQ ID NO: 50611 - DNA, 25 bp, S. cerevisiae
ggcgaagatagcatttcagaccctt

SEQ ID NO: 50612 - DNA, 25 bp, S. cerevisiae
tgggacgaagtttttggcacctact

SEQ ID NO: 50613 - DNA, 25 bp, S. cerevisiae
ggcgacgaaaatttcttccccatct

SEQ ID NO: 50614 - DNA, 25 bp, S. cerevisiae
ggcccttttgttagtgttcttggat

SEQ ID NO: 50615 - DNA, 25 bp, S. cerevisiae
tgggccttagctaaccttttgactt

SEQ ID NO: 50616 - DNA, 25 bp, S. cerevisiae
ggcctttgctttgtactgtttttga

SEQ ID NO: 50617 - DNA, 25 bp, S. cerevisiae
ggcctcttggtgtgatactggttca

SEQ ID NO: 50618 - DNA, 25 bp, S. cerevisiae
tggtccgtttttgctgaatggttgt

SEQ ID NO: 50619 - DNA, 25 bp, S. cerevisiae
ggccattgttttgttacatgccaca

SEQ ID NO: 50620 - DNA, 25 bp, S. cerevisiae
ggccttgtttcatgttccgcaatga

SEQ ID NO: 50621 - DNA, 25 bp, S. cerevisiae
ggcctatttaaacccagacttctcg

SEQ ID NO: 50622 - DNA, 25 bp, S. cerevisiae
ggccttgcgtaatcaaagtcctttc

SEQ ID NO: 50623 - DNA, 25 bp, S. cerevisiae
ggcgcattcgaaaactaagctagct

SEQ ID NO: 50624 - DNA, 25 bp, S. cerevisiae
ggctgtctcgacagactacatctat

SEQ ID NO: 50625 - DNA, 25 bp, S. cerevisiae
ggctgtcaagactggtatcgctatt

SEQ ID NO: 50626 - DNA, 25 bp, S. cerevisiae
tggtggccaagggtgttatttctaa

SEQ ID NO: 50627 - DNA, 25 bp, S. cerevisiae
ggcgacgacgacttggttatttatt

SEQ ID NO: 50628 - DNA, 25 bp, S. cerevisiae
ggcggagcagatcttgttgccaaaa

SEQ ID NO: 50629 - DNA, 25 bp, S. cerevisiae
ggcggagctgatgtcaattcacgtt

SEQ ID NO: 50630 - DNA, 25 bp, S. cerevisiae
ggccctgatccattctcgtgtgaga

SEQ ID NO: 50631 - DNA, 25 bp, S. cerevisiae
tccccatgctcctttggatttaact

SEQ ID NO: 50632 - DNA, 25 bp, S. cerevisiae
tgtcgacgtcttgaaatcttacctc

SEQ ID NO: 50633 - DNA, 25 bp, S. cerevisiae
ttgcgaagccttcaaattatgggaa

SEQ ID NO: 50634 - DNA, 25 bp, S. cerevisiae
ggccttactgccgaacgactggaag

SEQ ID NO: 50635 - DNA, 25 bp, S. cerevisiae
ggcgatttctcattctatcaaagtc

SEQ ID NO: 50636 - DNA, 25 bp, S. cerevisiae
ggcgactgtgagttcttcgtattca

SEQ ID NO: 50637 - DNA, 25 bp, S. cerevisiae
ggccaatgcaaggtggtctgtattc

SEQ ID NO: 50638 - DNA, 25 bp, S. cerevisiae
ggcgcgagcttccatggtaatcatt

SEQ ID NO: 50639 - DNA, 25 bp, S. cerevisiae
ggcgctgatgatactgacgataata

SEQ ID NO: 50640 - DNA, 25 bp, S. cerevisiae
ggcccgactataaatctaacactca

SEQ ID NO: 50641 - DNA, 25 bp, S. cerevisiae
ggcctccatatatccttaactcata

SEQ ID NO: 50642 - DNA, 25 bp, S. cerevisiae
ggccgccaagagaacccatagaatt

SEQ ID NO: 50643 - DNA, 25 bp, S. cerevisiae
ggcctgcactggaaacctcgataat

SEQ ID NO: 50644 - DNA, 25 bp, S. cerevisiae
ggcgcctttgaattccatagtagat

SEQ ID NO: 50645 - DNA, 25 bp, S. cerevisiae
ggcgcactgtctcagtctattggga

SEQ ID NO: 50646 - DNA, 25 bp, S. cerevisiae
ggcgcaagcccaagatttcgaagga

SEQ ID NO: 50647 - DNA, 25 bp, S. cerevisiae
ggcgccactcctatttctgaagagt

SEQ ID NO: 50648 - DNA, 25 bp, S. cerevisiae
ggcccaggtcctgatggtgtagtta

SEQ ID NO: 50649 - DNA, 25 bp, S. cerevisiae
ggcgctctggcttctaacaatagtg

SEQ ID NO: 50650 - DNA, 25 bp, S. cerevisiae
ggccattttggttatcaccacgtca

SEQ ID NO: 50651 - DNA, 25 bp, S. cerevisiae
ggccaaagtcctattctactgagaa

SEQ ID NO: 50652 - DNA, 25 bp, S. cerevisiae
tcgaaaatccctggttctttggtga

SEQ ID NO: 50653 - DNA, 25 bp, S. cerevisiae
tggaatacatccctcgagttcattg

SEQ ID NO: 50654 - DNA, 25 bp, S. cerevisiae
tggccaatctgccatcatggagctt

SEQ ID NO: 50655 - DNA, 25 bp, S. cerevisiae
ggccaatgctgctaagcgtgctgaa

SEQ ID NO: 50656 - DNA, 25 bp, S. cerevisiae
ggccagagtgccttcgaggaaatta

SEQ ID NO: 50657 - DNA, 25 bp, S. cerevisiae
ggccgaccacctcatggagaagtat

SEQ ID NO: 50658 - DNA, 25 bp, S. cerevisiae
ggcggtaacggcaattctcagaatt

SEQ ID NO: 50659 - DNA, 25 bp, S. cerevisiae
tgtcccaggtggtatcaagtttgaa

SEQ ID NO: 50660 - DNA, 25 bp, S. cerevisiae
ggcccacggcaaatcaaatcttaca

SEQ ID NO: 50661 - DNA, 25 bp, S. cerevisiae
ggcccaattgctgccaaatttggtg

SEQ ID NO: 50662 - DNA, 25 bp, S. cerevisiae
ggcccaaagcctgacatttctagat

SEQ ID NO: 50663 - DNA, 25 bp, S. cerevisiae
ggcgctaaatccaacaaattcagtg

SEQ ID NO: 50664 - DNA, 25 bp, S. cerevisiae
ggcggaaatcgcaactagcttcttt

SEQ ID NO: 50665 - DNA, 25 bp, S. cerevisiae
ggcggaaaacaaacgctcttctgac

SEQ ID NO: 50666 - DNA, 25 bp, S. cerevisiae
tggaagaaatttttgaagttctcaa

SEQ ID NO: 50667 - DNA, 25 bp, S. cerevisiae
tggaaaaatttgttcgaggccctca

SEQ ID NO: 50668 - DNA, 25 bp, S. cerevisiae
tggaggaagatggtgttctagcccc

SEQ ID NO: 50669 - DNA, 25 bp, S. cerevisiae
tgtggtaagtgggtcatccccgcta

SEQ ID NO: 50670 - DNA, 25 bp, S. cerevisiae
tggtttaggtgggtccgtccaacat

SEQ ID NO: 50671 - DNA, 25 bp, S. cerevisiae
ggcctggaagaagatggttacctca

SEQ ID NO: 50672 - DNA, 25 bp, S. cerevisiae
ggccggaagcccactattgatttaa

SEQ ID NO: 50673 - DNA, 25 bp, S. cerevisiae
ggccgcaaaccaagccgttagattg

SEQ ID NO: 50674 - DNA, 25 bp, S. cerevisiae
ggcctcaaggcattacacgttacga

SEQ ID NO: 50675 - DNA, 25 bp, S. cerevisiae
ggcgcaacagcgttcagactattat

SEQ ID NO: 50676 - DNA, 25 bp, S. cerevisiae
ggccaaccaatgttccctggagaaa

SEQ ID NO: 50677 - DNA, 25 bp, S. cerevisiae
ggcgtgtgccgctgaatacattcaa

SEQ ID NO: 50678 - DNA, 25 bp, S. cerevisiae
tgtcgctgctgccccagccaccact

SEQ ID NO: 50679 - DNA, 25 bp, S. cerevisiae
ggcgatgtgccgcagccactacaag

SEQ ID NO: 50680 - DNA, 25 bp, S. cerevisiae
ggcggtgcagctgatgcgactaaca

SEQ ID NO: 50681 - DNA, 25 bp, S. cerevisiae
tggccgttgctattcgtgactggag

SEQ ID NO: 50682 - DNA, 25 bp, S. cerevisiae
ggccgcattgctttctcaaaggcaa

SEQ ID NO: 50683 - DNA, 25 bp, S. cerevisiae
ggccgcacgttcagcaatttcaaaa

SEQ ID NO: 50684 - DNA, 25 bp, S. cerevisiae
tggcggccgttcatgaatcaccaaa

SEQ ID NO: 50685 - DNA, 25 bp, S. cerevisiae
ggcggtgcatttcctgattacaaaa

SEQ ID NO: 50686 - DNA, 25 bp, S. cerevisiae
ggcgaatttgtcgtcagtgacttaa

SEQ ID NO: 50687 - DNA, 25 bp, S. cerevisiae
ggcgatttactcgatcaaatgctta

SEQ ID NO: 50688 - DNA, 25 bp, S. cerevisiae
ggcgctgatttacccatcgaaaacg

SEQ ID NO: 50689 - DNA, 25 bp, S. cerevisiae
ggcccaactgccctggtatcattaa

SEQ ID NO: 50690 - DNA, 25 bp, S. cerevisiae
ggcgcgaaaccaacgctgactgatt

SEQ ID NO: 50691 - DNA, 25 bp, S. cerevisiae
ggcgaaaaagttgctgtttgtccca

SEQ ID NO: 50692 - DNA, 25 bp, S. cerevisiae
ggcgaaaaagtaccatgtcctgaac

SEQ ID NO: 50693 - DNA, 25 bp, S. cerevisiae
ggcgaagccaatacccagtacagta

SEQ ID NO: 50694 - DNA, 25 bp, S. cerevisiae
ggcgaaacattagctctgtacgata

SEQ ID NO: 50695 - DNA, 25 bp, S. cerevisiae
ggcgattattttgctctgtactgta

SEQ ID NO: 50696 - DNA, 25 bp, S. cerevisiae
ggcgatgtcattaaccctgatgttg

SEQ ID NO: 50697 - DNA, 25 bp, S. cerevisiae
ggcgattctctatcaacctgttatt

SEQ ID NO: 50698 - DNA, 25 bp, S. cerevisiae
tggctcaacgtcagaccatcattat

SEQ ID NO: 50699 - DNA, 25 bp, S. cerevisiae
ggcgatcacctctatgacaacatta

SEQ ID NO: 50700 - DNA, 25 bp, S. cerevisiae
ggcctccactattgccaagcaagta

SEQ ID NO: 50701 - DNA, 25 bp, S. cerevisiae
ggccttgactttgcccgatgtaaag

SEQ ID NO: 50702 - DNA, 25 bp, S. cerevisiae
ggccctcatctattttctcggaaaa

SEQ ID NO: 50703 - DNA, 25 bp, S. cerevisiae
ggcgccaattcttttgacgcaaaac

SEQ ID NO: 50704 - DNA, 25 bp, S. cerevisiae
ggccccagttaaatcccaagaatct

SEQ ID NO: 50705 - DNA, 25 bp, S. cerevisiae
ggccaagcctttatcaccatgagaa

SEQ ID NO: 50706 - DNA, 25 bp, S. cerevisiae
tggcacaattttcgcaatacccatt

SEQ ID NO: 50707 - DNA, 25 bp, S. cerevisiae
tgggcaatgcttctaatcgggcttt

SEQ ID NO: 50708 - DNA, 25 bp, S. cerevisiae
tggcccgatttatgactacgctttc

SEQ ID NO: 50709 - DNA, 25 bp, S. cerevisiae
tggccgcgttagtaactcttgtttt

SEQ ID NO: 50710 - DNA, 25 bp, S. cerevisiae
ggcgcctgatggagaacctgttctg

SEQ ID NO: 50711 - DNA, 25 bp, S. cerevisiae
ggcgacggcaaccaatcctatttgg

SEQ ID NO: 50712 - DNA, 25 bp, S. cerevisiae
ggcgacgacaacgacattgctgttt

SEQ ID NO: 50713 - DNA, 25 bp, S. cerevisiae
ggcgacgaccacaacaacactaaat

SEQ ID NO: 50714 - DNA, 25 bp, S. cerevisiae
ggcgttgaactgaactccactacaa

SEQ ID NO: 50715 - DNA, 25 bp, S. cerevisiae
ggcccttaataggtctgctatcatt

SEQ ID NO: 50716 - DNA, 25 bp, S. cerevisiae
ggccctcgcaaagatccaattattt

SEQ ID NO: 50717 - DNA, 25 bp, S. cerevisiae
ggccactaacaaaatcgagactctt

SEQ ID NO: 50718 - DNA, 25 bp, S. cerevisiae
ggccatttacaacaagcatcatccg

SEQ ID NO: 50719 - DNA, 25 bp, S. cerevisiae
tggatttagtcgttttcggtcgcgc

SEQ ID NO: 50720 - DNA, 25 bp, S. cerevisiae
tggccaaccaacttttatacttcga

SEQ ID NO: 50721 - DNA, 25 bp, S. cerevisiae
ggcgccacaagattatcaccggttt

SEQ ID NO: 50722 - DNA, 25 bp, S. cerevisiae
ggcccaagcattatactgcatccat

SEQ ID NO: 50723 - DNA, 25 bp, S. cerevisiae
ggcgacgagagattgctgtttctaa

SEQ ID NO: 50724 - DNA, 25 bp, S. cerevisiae
ggccggatctgaggctgatgctact

SEQ ID NO: 50725 - DNA, 25 bp, S. cerevisiae
tggcatcatggacatcggtcgactt

SEQ ID NO: 50726 - DNA, 25 bp, S. cerevisiae
ggcctggcagtattgtgctggattt

SEQ ID NO: 50727 - DNA, 25 bp, S. cerevisiae
ggcgcatgcgcaattatctagtgtt

SEQ ID NO: 50728 - DNA, 25 bp, S. cerevisiae
tggtgctgcggcatcattgatcatg

SEQ ID NO: 50729 - DNA, 25 bp, S. cerevisiae
tggcatgcgcccatgatagtacttg

SEQ ID NO: 50730 - DNA, 25 bp, S. cerevisiae
tggctgtggctaatgcgactgaatt

SEQ ID NO: 50731 - DNA, 25 bp, S. cerevisiae
tggctggatgtaactcaggctgact

SEQ ID NO: 50732 - DNA, 25 bp, S. cerevisiae
tggcattagctatgtcagcgcggaa

SEQ ID NO: 50733 - DNA, 25 bp, S. cerevisiae
tggcactcctggtacagccgagaat

SEQ ID NO: 50734 - DNA, 25 bp, S. cerevisiae
tggacgaggtgctaacgccagactc

SEQ ID NO: 50735 - DNA, 25 bp, S. cerevisiae
tggaaaagattcacggtcaccctgc

SEQ ID NO: 50736 - DNA, 25 bp, S. cerevisiae
tggtgcaagaacacaagaggttttg

SEQ ID NO: 50737 - DNA, 25 bp, S. cerevisiae
tacgtacaacgtcgatgggttcttt

SEQ ID NO: 50738 - DNA, 25 bp, S. cerevisiae
tgtccattccagcatccaagggttt

SEQ ID NO: 50739 - DNA, 25 bp, S. cerevisiae
tgtcctcaccggtttaggtattcct

SEQ ID NO: 50740 - DNA, 25 bp, S. cerevisiae
ggcccatgccggttataagtgtgtt

SEQ ID NO: 50741 - DNA, 25 bp, S. cerevisiae
tggccgtgtcgttttcaagttgtac

SEQ ID NO: 50742 - DNA, 25 bp, S. cerevisiae
ggccgcatgttgtaatgttatgtcc

SEQ ID NO: 50743 - DNA, 25 bp, S. cerevisiae
ggcgcgagaagtacgttgttagcat

SEQ ID NO: 50744 - DNA, 25 bp, S. cerevisiae
ggcgctcgaagcaactttggatact

SEQ ID NO: 50745 - DNA, 25 bp, S. cerevisiae
tgggcataaacggtgacatcgggtt

SEQ ID NO: 50746 - DNA, 25 bp, S. cerevisiae
ggcgcattaccaaatggcaaccatg

SEQ ID NO: 50747 - DNA, 25 bp, S. cerevisiae
ggcgcattaatcaatgtcggcggta

SEQ ID NO: 50748 - DNA, 25 bp, S. cerevisiae
ggcgagctatatcttcgtacagtag

SEQ ID NO: 50749 - DNA, 25 bp, S. cerevisiae
ggcgaaattcgttcctactggagga

SEQ ID NO: 50750 - DNA, 25 bp, S. cerevisiae
ggcgcaattttgttcttatctggct

SEQ ID NO: 50751 - DNA, 25 bp, S. cerevisiae
ggccgcttcttccaataacaatgta

SEQ ID NO: 50752 - DNA, 25 bp, S. cerevisiae
ggcccacatctgtcaagctgttgaa

SEQ ID NO: 50753 - DNA, 25 bp, S. cerevisiae
ggcgcaactggagatctttagattt

SEQ ID NO: 50754 - DNA, 25 bp, S. cerevisiae
ggcgcgcggtattgatgtccaacaa

SEQ ID NO: 50755 - DNA, 25 bp, S. cerevisiae
ggccgctctagaaatggtccaaaag

SEQ ID NO: 50756 - DNA, 25 bp, S. cerevisiae
ggcccgctataatggctccatacaa

SEQ ID NO: 50757 - DNA, 25 bp, S. cerevisiae
ggcgctgccgttaaaggctccgttg

SEQ ID NO: 50758 - DNA, 25 bp, S. cerevisiae
tgtatcagccgtcagtagtatccag

SEQ ID NO: 50759 - DNA, 25 bp, S. cerevisiae
tggacatccattttgaaagcacatt

SEQ ID NO: 50760 - DNA, 25 bp, S. cerevisiae
ggccatccacaaatgatccaacatc

SEQ ID NO: 50761 - DNA, 25 bp, S. cerevisiae
ggcgaattcatcttgactcatccta

SEQ ID NO: 50762 - DNA, 25 bp, S. cerevisiae
ggccatttgccgcaccaaaattgat

SEQ ID NO: 50763 - DNA, 25 bp, S. cerevisiae
ggccacttgccgacaaaatttctaa

SEQ ID NO: 50764 - DNA, 25 bp, S. cerevisiae
ggccatttctagcaaactttctcag

SEQ ID NO: 50765 - DNA, 25 bp, S. cerevisiae
ggccaattctggcaaacttattaga

SEQ ID NO: 50766 - DNA, 25 bp, S. cerevisiae
ggcgaatgctttgataactgctgat

SEQ ID NO: 50767 - DNA, 25 bp, S. cerevisiae
ggcgaagccttcatcaagtttgaca

SEQ ID NO: 50768 - DNA, 25 bp, S. cerevisiae
tggcggtcctttcaatttaacagat

SEQ ID NO: 50769 - DNA, 25 bp, S. cerevisiae
tggcggttacaagcttttcaaattt

SEQ ID NO: 50770 - DNA, 25 bp, S. cerevisiae
ggcgcgtgtactatatatattcata

SEQ ID NO: 50771 - DNA, 25 bp, S. cerevisiae
ggcgaaactgcaattactacctgaa

SEQ ID NO: 50772 - DNA, 25 bp, S. cerevisiae
tggcgaaaaatctccttctccacaa

SEQ ID NO: 50773 - DNA, 25 bp, S. cerevisiae
ggcgaattcctactccgtgtctctt

SEQ ID NO: 50774 - DNA, 25 bp, S. cerevisiae
ggccattttaatgctaggtgttgct

SEQ ID NO: 50775 - DNA, 25 bp, S. cerevisiae
ggccttattgccaacttttggtgct

SEQ ID NO: 50776 - DNA, 25 bp, S. cerevisiae
ggccaagtggatgggtcagtcttca

SEQ ID NO: 50777 - DNA, 25 bp, S. cerevisiae
ggccaagttgggttcgtctttatag

SEQ ID NO: 50778 - DNA, 25 bp, S. cerevisiae
ggccaagttggcgaactggtttcta

SEQ ID NO: 50779 - DNA, 25 bp, S. cerevisiae
ggccatatttctgacatttgtttta

SEQ ID NO: 50780 - DNA, 25 bp, S. cerevisiae
tggcgaaatttattgtttttacata

SEQ ID NO: 50781 - DNA, 25 bp, S. cerevisiae
ggccaatatggctaatgtttttact

SEQ ID NO: 50782 - DNA, 25 bp, S. cerevisiae
tggtccctaactattcttcaatcta

SEQ ID NO: 50783 - DNA, 25 bp, S. cerevisiae
ggcgccgtaggtacgttcatttcta

SEQ ID NO: 50784 - DNA, 25 bp, S. cerevisiae
tgggccccagggaggacactataaa

SEQ ID NO: 50785 - DNA, 25 bp, S. cerevisiae
tccaccccgggatcagtatcattaa

SEQ ID NO: 50786 - DNA, 25 bp, S. cerevisiae
taaccccgttgtatttgatttatca

SEQ ID NO: 50787 - DNA, 25 bp, S. cerevisiae
ggccacatttgttgtcgattctcat

SEQ ID NO: 50788 - DNA, 25 bp, S. cerevisiae
tggcagaccaagctagagattacat

SEQ ID NO: 50789 - DNA, 25 bp, S. cerevisiae
tggccaaatctctttcgacgttttc

SEQ ID NO: 50790 - DNA, 25 bp, S. cerevisiae
tggcggctgtggttcttgttctcta

SEQ ID NO: 50791 - DNA, 25 bp, S. cerevisiae
tggccgcttagattgttttttgtca

SEQ ID NO: 50792 - DNA, 25 bp, S. cerevisiae
tgatgatactgatgaggactctgag

SEQ ID NO: 50793 - DNA, 25 bp, S. cerevisiae
ggccatctattgagactgcagctgt

SEQ ID NO: 50794 - DNA, 25 bp, S. cerevisiae
ggccacatcatcaacaacgagctta

SEQ ID NO: 50795 - DNA, 25 bp, S. cerevisiae
tggaccaacgatgaaggaactgctt

SEQ ID NO: 50796 - DNA, 25 bp, S. cerevisiae
ggccacgaacttactgagcgagggt

SEQ ID NO: 50797 - DNA, 25 bp, S. cerevisiae
ggccagcatggttttctgtgctgat

SEQ ID NO: 50798 - DNA, 25 bp, S. cerevisiae
ggcgcttgatcagcagttcatcgag

SEQ ID NO: 50799 - DNA, 25 bp, S. cerevisiae
ggcgctgtgtatttgtccatggaat

SEQ ID NO: 50800 - DNA, 25 bp, S. cerevisiae
tggcgctctttatgatcccagagat

SEQ ID NO: 50801 - DNA, 25 bp, S. cerevisiae
ggccatattgccagggtcgaataat

SEQ ID NO: 50802 - DNA, 25 bp, S. cerevisiae
tggaattgcgcctttggtcggtaaa

SEQ ID NO: 50803 - DNA, 25 bp, S. cerevisiae
tggaaatgcccttcgttacgttata

SEQ ID NO: 50804 - DNA, 25 bp, S. cerevisiae
tggaaatgcaggtagccaaatctga

SEQ ID NO: 50805 - DNA, 25 bp, S. cerevisiae
tggcggacggtctaacttcatggat

SEQ ID NO: 50806 - DNA, 25 bp, S. cerevisiae
ggccctcgtgggaactatcattatg

SEQ ID NO: 50807 - DNA, 25 bp, S. cerevisiae
ggccatccttagtaaccagcttatg

SEQ ID NO: 50808 - DNA, 25 bp, S. cerevisiae
ggcctcaagtaaaatccgcttctac

SEQ ID NO: 50809 - DNA, 25 bp, S. cerevisiae
ggcctaattattcacagagttctca

SEQ ID NO: 50810 - DNA, 25 bp, S. cerevisiae
ggcctcacatacaccaaatgttctt

SEQ ID NO: 50811 - DNA, 25 bp, S. cerevisiae
ggccctatcgttacagagacgcagt

SEQ ID NO: 50812 - DNA, 25 bp, S. cerevisiae
ggccgatgcccctgacgaagaacca

SEQ ID NO: 50813 - DNA, 25 bp, S. cerevisiae
ggccttcacctcttacgacagaact

SEQ ID NO: 50814 - DNA, 25 bp, S. cerevisiae
ggcgcttcacaccaatgtggttgga

SEQ ID NO: 50815 - DNA, 25 bp, S. cerevisiae
tggctgctacccaaagagctttgtg

SEQ ID NO: 50816 - DNA, 25 bp, S. cerevisiae
ggcctatccgactgcactttatgaa

SEQ ID NO: 50817 - DNA, 25 bp, S. cerevisiae
ggcccaccggacactgtatatgata

SEQ ID NO: 50818 - DNA, 25 bp, S. cerevisiae
tggcgccatcgcaggtgtcgtagta

SEQ ID NO: 50819 - DNA, 25 bp, S. cerevisiae
tggcacgtaccatcctgaagagact

SEQ ID NO: 50820 - DNA, 25 bp, S. cerevisiae
tggcgaggacgctatattaaagact

SEQ ID NO: 50821 - DNA, 25 bp, S. cerevisiae
tgcaaaccccaatgttacaatcgcc

SEQ ID NO: 50822 - DNA, 25 bp, S. cerevisiae
tggaagcccgaatgattgaatctgc

SEQ ID NO: 50823 - DNA, 25 bp, S. cerevisiae
ggcgctattactgattgtgcaacct

SEQ ID NO: 50824 - DNA, 25 bp, S. cerevisiae
ggccaagtatattttgtcaacctgc

SEQ ID NO: 50825 - DNA, 25 bp, S. cerevisiae
ggccaggtatatcattggatctcct

SEQ ID NO: 50826 - DNA, 25 bp, S. cerevisiae
ggccaattgttgtatgcggttcact

SEQ ID NO: 50827 - DNA, 25 bp, S. cerevisiae
tggccattctatctcggtttgttaa

SEQ ID NO: 50828 - DNA, 25 bp, S. cerevisiae
ggcgctactgccttattatgttaca

SEQ ID NO: 50829 - DNA, 25 bp, S. cerevisiae
ggccaccgccttattggctaaaggt

SEQ ID NO: 50830 - DNA, 25 bp, S. cerevisiae
ggccatccgcctttttggcaaaaag

SEQ ID NO: 50831 - DNA, 25 bp, S. cerevisiae
ggcctgcatacgaaaaaccaataag

SEQ ID NO: 50832 - DNA, 25 bp, S. cerevisiae
tggcctgcaaactaaaacgcacttg

SEQ ID NO: 50833 - DNA, 25 bp, S. cerevisiae
ggccatggacccgaataccgatata

SEQ ID NO: 50834 - DNA, 25 bp, S. cerevisiae
ggcctaaccaagtataccatatgaa

SEQ ID NO: 50835 - DNA, 25 bp, S. cerevisiae
tgggtccgttagcaagatctgtgaa

SEQ ID NO: 50836 - DNA, 25 bp, S. cerevisiae
tggtactaacctcatgttgcaccca

SEQ ID NO: 50837 - DNA, 25 bp, S. cerevisiae
tggaagtgttcccatagtctaccca

SEQ ID NO: 50838 - DNA, 25 bp, S. cerevisiae
tggtaatgtttttgtcaccgcgtcc

SEQ ID NO: 50839 - DNA, 25 bp, S. cerevisiae
tggcaattattcttggtctgcccgg

SEQ ID NO: 50840 - DNA, 25 bp, S. cerevisiae
tggaactattggacgactctcctgt

SEQ ID NO: 50841 - DNA, 25 bp, S. cerevisiae
ggccacttattgagcactaccatga

SEQ ID NO: 50842 - DNA, 25 bp, S. cerevisiae
ggcctctgcttccaattgggtatgg

SEQ ID NO: 50843 - DNA, 25 bp, S. cerevisiae
tggcgctcaacaaactcaggcagat

SEQ ID NO: 50844 - DNA, 25 bp, S. cerevisiae
tggcctcagatcctcgaaggtttag

SEQ ID NO: 50845 - DNA, 25 bp, S. cerevisiae
ggccgctatcgtcgaaattattgac

SEQ ID NO: 50846 - DNA, 25 bp, S. cerevisiae
ggccgctgccgccatgttattataa

SEQ ID NO: 50847 - DNA, 25 bp, S. cerevisiae
ggccactttcagttctcattattac

SEQ ID NO: 50848 - DNA, 25 bp, S. cerevisiae
ggcccgatatatggactttatacca

SEQ ID NO: 50849 - DNA, 25 bp, S. cerevisiae
ggccctgtagatgccttgcattatg

SEQ ID NO: 50850 - DNA, 25 bp, S. cerevisiae
ggccctgtcattgcctcattaggaa

SEQ ID NO: 50851 - DNA, 25 bp, S. cerevisiae
tggaccgttggagctcatgcttaaa

SEQ ID NO: 50852 - DNA, 25 bp, S. cerevisiae
tggccactgatatgggtctcttaca

SEQ ID NO: 50853 - DNA, 25 bp, S. cerevisiae
tggcgccaattttctatcatctttg

SEQ ID NO: 50854 - DNA, 25 bp, S. cerevisiae
ggccgtatttggatcgttgtgtcta

SEQ ID NO: 50855 - DNA, 25 bp, S. cerevisiae
ggccccatccagatctgagaagtta

SEQ ID NO: 50856 - DNA, 25 bp, S. cerevisiae
tggccccgcaccactaaatgggaaa

SEQ ID NO: 50857 - DNA, 25 bp, S. cerevisiae
ggcctctcaccttactgttattaaa

SEQ ID NO: 50858 - DNA, 25 bp, S. cerevisiae
ggccaatggtcaggtgtttcaacaa

SEQ ID NO: 50859 - DNA, 25 bp, S. cerevisiae
ggccgtggttgggatcttaacataa

SEQ ID NO: 50860 - DNA, 25 bp, S. cerevisiae
tggcctctccaattcctttagaaaa

SEQ ID NO: 50861 - DNA, 25 bp, S. cerevisiae
ggccacaaacgcctctttagaagca

SEQ ID NO: 50862 - DNA, 25 bp, S. cerevisiae
tggcccaatactactctttccaagt

SEQ ID NO: 50863 - DNA, 25 bp, S. cerevisiae
tggcgaattgtttactttggtcacg

SEQ ID NO: 50864 - DNA, 25 bp, S. cerevisiae
tggccaggacggtccttcttcgaaa

SEQ ID NO: 50865 - DNA, 25 bp, S. cerevisiae
tggccacgtccaatgttgtttcagg

SEQ ID NO: 50866 - DNA, 25 bp, S. cerevisiae
ggccaccgacacttcatgttataag

SEQ ID NO: 50867 - DNA, 25 bp, S. cerevisiae
ggcctccatacggtgcaattgataa

SEQ ID NO: 50868 - DNA, 25 bp, S. cerevisiae
ggcctccatagggttattttgcaat

SEQ ID NO: 50869 - DNA, 25 bp, S. cerevisiae
tggcctccaagggtaacgctagcaa

SEQ ID NO: 50870 - DNA, 25 bp, S. cerevisiae
ggccttgcaagtctattccacagaa

SEQ ID NO: 50871 - DNA, 25 bp, S. cerevisiae
tggccttcccagcagatggtccaaa

SEQ ID NO: 50872 - DNA, 25 bp, S. cerevisiae
tggcatttacctcattggtcgctaa

SEQ ID NO: 50873 - DNA, 25 bp, S. cerevisiae
tcgcgtatgaccctattaaccggat

SEQ ID NO: 50874 - DNA, 25 bp, S. cerevisiae
tggcgttattcgaaaaccctacaat

SEQ ID NO: 50875 - DNA, 25 bp, S. cerevisiae
tggcgttgttcggaagaccttagaa

SEQ ID NO: 50876 - DNA, 25 bp, S. cerevisiae
ggccttatctcggaagtgtcttcaa

SEQ ID NO: 50877 - DNA, 25 bp, S. cerevisiae
ggccgatttgagagcctcatcgtta

SEQ ID NO: 50878 - DNA, 25 bp, S. cerevisiae
ggcctataatacatgcgcacttgct

SEQ ID NO: 50879 - DNA, 25 bp, S. cerevisiae
ggccttaataacgtgcaccatggta

SEQ ID NO: 50880 - DNA, 25 bp, S. cerevisiae
ggccattataagacttgccgctggt

SEQ ID NO: 50881 - DNA, 25 bp, S. cerevisiae
tggctcacgaaaacgtttggttctc

SEQ ID NO: 50882 - DNA, 25 bp, S. cerevisiae
ggccccaaagttgctgattgcgttt

SEQ ID NO: 50883 - DNA, 25 bp, S. cerevisiae
ggcctgccaattcatcctttttatt

SEQ ID NO: 50884 - DNA, 25 bp, S. cerevisiae
ggccgtatagtggacgcattattta

SEQ ID NO: 50885 - DNA, 25 bp, S. cerevisiae
ggccgacgcaatgagcgcatttatt

SEQ ID NO: 50886 - DNA, 25 bp, S. cerevisiae
tggcctggcctattaccatgttaat

SEQ ID NO: 50887 - DNA, 25 bp, S. cerevisiae
tggcttccctttgttgcctagtaaa

SEQ ID NO: 50888 - DNA, 25 bp, S. cerevisiae
tggctggtgtgtacgtggtcaaaac

SEQ ID NO: 50889 - DNA, 25 bp, S. cerevisiae
tggcttatctatccggttgaccaac

SEQ ID NO: 50890 - DNA, 25 bp, S. cerevisiae
tggctgcggtactggtggcaccata

SEQ ID NO: 50891 - DNA, 25 bp, S. cerevisiae
tggctcggtatctgcatgggaccaa

SEQ ID NO: 50892 - DNA, 25 bp, S. cerevisiae
tggacgagatatgctacggacttat

SEQ ID NO: 50893 - DNA, 25 bp, S. cerevisiae
tggccgaaagagctcgagcacttct

SEQ ID NO: 50894 - DNA, 25 bp, S. cerevisiae
tggaaggaatggctcgtcctgcctt

SEQ ID NO: 50895 - DNA, 25 bp, S. cerevisiae
tggaatggatattttggaagccctt

SEQ ID NO: 50896 - DNA, 25 bp, S. cerevisiae
tgaagtcggacatgttgaacacctt

SEQ ID NO: 50897 - DNA, 25 bp, S. cerevisiae
tggttcgacattgttttccctgcac

SEQ ID NO: 50898 - DNA, 25 bp, S. cerevisiae
ggcctcatggtttatttcctattat

SEQ ID NO: 50899 - DNA, 25 bp, S. cerevisiae
tggcatttgacgctggttccataat

SEQ ID NO: 50900 - DNA, 25 bp, S. cerevisiae
tggtgggatcgcttatcaacttgct

SEQ ID NO: 50901 - DNA, 25 bp, S. cerevisiae
tggccagtcatatgccagacctggt

SEQ ID NO: 50902 - DNA, 25 bp, S. cerevisiae
tggctagtcaagacaaggacggcaa

SEQ ID NO: 50903 - DNA, 25 bp, S. cerevisiae
tggctcgttaaaagaccgtgcagaa

SEQ ID NO: 50904 - DNA, 25 bp, S. cerevisiae
tggcacctataacagcagttgtcgt

SEQ ID NO: 50905 - DNA, 25 bp, S. cerevisiae
tggcctcttaacttgcatgactgaa

SEQ ID NO: 50906 - DNA, 25 bp, S. cerevisiae
tggccacttttccaagcgattaact

SEQ ID NO: 50907 - DNA, 25 bp, S. cerevisiae
ggcctttctgcaccaacctaaagaa

SEQ ID NO: 50908 - DNA, 25 bp, S. cerevisiae
ggcctggctggtttaccatcggaaa

SEQ ID NO: 50909 - DNA, 25 bp, S. cerevisiae
tgtccatatgggttgctacggcatt

SEQ ID NO: 50910 - DNA, 25 bp, S. cerevisiae
tggccatatatttgagagacgtctc

SEQ ID NO: 50911 - DNA, 25 bp, S. cerevisiae
tggccacatgtccagggactgtcaa

SEQ ID NO: 50912 - DNA, 25 bp, S. cerevisiae
tggctacgacggctatgctgacaac

SEQ ID NO: 50913 - DNA, 25 bp, S. cerevisiae
ggccaggaggtctttctgccaagat

SEQ ID NO: 50914 - DNA, 25 bp, S. cerevisiae
ggccatccaggtgcttttagatcat

SEQ ID NO: 50915 - DNA, 25 bp, S. cerevisiae
ggcctgccaagaagtactgcgatgt

SEQ ID NO: 50916 - DNA, 25 bp, S. cerevisiae
ggccatcgacgaagtcactgttgtt

SEQ ID NO: 50917 - DNA, 25 bp, S. cerevisiae
tggcgcactatccaagtctatcttg

SEQ ID NO: 50918 - DNA, 25 bp, S. cerevisiae
tggcgaccctctggttagatgacac

SEQ ID NO: 50919 - DNA, 25 bp, S. cerevisiae
ggccactgccaggttgatcgtggaa

SEQ ID NO: 50920 - DNA, 25 bp, S. cerevisiae
tggccaacgatactgaaaactcctt

SEQ ID NO: 50921 - DNA, 25 bp, S. cerevisiae
ggccatgctaaaagttatcccatct

SEQ ID NO: 50922 - DNA, 25 bp, S. cerevisiae
ggccatgttggtattgaagcgcatt

SEQ ID NO: 50923 - DNA, 25 bp, S. cerevisiae
tggccgtgtggttttgatcaagaag

SEQ ID NO: 50924 - DNA, 25 bp, S. cerevisiae
ggccatgttcgccattttcagaagg

SEQ ID NO: 50925 - DNA, 25 bp, S. cerevisiae
ggccagccgatactccatatgaaga

SEQ ID NO: 50926 - DNA, 25 bp, S. cerevisiae
ggccattgcgctctttgtagaagta

SEQ ID NO: 50927 - DNA, 25 bp, S. cerevisiae
tggcccatcgtggtctaagattcta

SEQ ID NO: 50928 - DNA, 25 bp, S. cerevisiae
ggcctcaacggcacaaaacttattc

SEQ ID NO: 50929 - DNA, 25 bp, S. cerevisiae
tggtctccaccgtgaaaactacttc

SEQ ID NO: 50930 - DNA, 25 bp, S. cerevisiae
tccggcgctaaagacagtggttcat

SEQ ID NO: 50931 - DNA, 25 bp, S. cerevisiae
ttagcggcgaacacacagggaaatc

SEQ ID NO: 50932 - DNA, 25 bp, S. cerevisiae
ttgagagggttcacaccgggcgact

SEQ ID NO: 50933 - DNA, 25 bp, S. cerevisiae
tcgaagaggttaagatccccggtct

SEQ ID NO: 50934 - DNA, 25 bp, S. cerevisiae
tggaaacaaccatatcccctttgaa

SEQ ID NO: 50935 - DNA, 25 bp, S. cerevisiae
tggttacgacccgtcccacaaatga

SEQ ID NO: 50936 - DNA, 25 bp, S. cerevisiae
tggcgataaatcctttctcccaaaa

SEQ ID NO: 50937 - DNA, 25 bp, S. cerevisiae
ggccattatgttgtggagcctaaaa

SEQ ID NO: 50938 - DNA, 25 bp, S. cerevisiae
ggccaggcagagtttccatgattaa

SEQ ID NO: 50939 - DNA, 25 bp, S. cerevisiae
ggccagtgcagagaacacgctatta

SEQ ID NO: 50940 - DNA, 25 bp, S. cerevisiae
ggcctggcacatgaatccgctaaag

SEQ ID NO: 50941 - DNA, 25 bp, S. cerevisiae
tggcctattgggtatctgcttgtca

SEQ ID NO: 50942 - DNA, 25 bp, S. cerevisiae
tggcctttgatatacgccttcatca

SEQ ID NO: 50943 - DNA, 25 bp, S. cerevisiae
tggccatgaaaacccgcagttgcta

SEQ ID NO: 50944 - DNA, 25 bp, S. cerevisiae
ggccatgtagactcaatgtgcttaa

SEQ ID NO: 50945 - DNA, 25 bp, S. cerevisiae
ggccatctgaccaacaactgcaaat

SEQ ID NO: 50946 - DNA, 25 bp, S. cerevisiae
tggagccatgggttcagagccatat

SEQ ID NO: 50947 - DNA, 25 bp, S. cerevisiae
tgtccgttaatcaagagggcacctt

SEQ ID NO: 50948 - DNA, 25 bp, S. cerevisiae
tggccgatttatgtgcagtagcacc

SEQ ID NO: 50949 - DNA, 25 bp, S. cerevisiae
tggctcatatttacgtgcaaacaaa

SEQ ID NO: 50950 - DNA, 25 bp, S. cerevisiae
tggctcacttgtacgcgcagaaatg

SEQ ID NO: 50951 - DNA, 25 bp, S. cerevisiae
tggcccttctatcagcagcatcaat

SEQ ID NO: 50952 - DNA, 25 bp, S. cerevisiae
tggccacttttgcagctgactcgaa

SEQ ID NO: 50953 - DNA, 25 bp, S. cerevisiae
ggccagtctttcatgctacatcaaa

SEQ ID NO: 50954 - DNA, 25 bp, S. cerevisiae
ggcctcaattgccttcattagacaa

SEQ ID NO: 50955 - DNA, 25 bp, S. cerevisiae
ggcctacatggacctcattgtggta

SEQ ID NO: 50956 - DNA, 25 bp, S. cerevisiae
tggctttttcccaaagtagaaggct

SEQ ID NO: 50957 - DNA, 25 bp, S. cerevisiae
tggtttcggtttggtctacaactct

SEQ ID NO: 50958 - DNA, 25 bp, S. cerevisiae
tggcatttcaacagctgtccggaat

SEQ ID NO: 50959 - DNA, 25 bp, S. cerevisiae
tggaccatttccaatattacggctg

SEQ ID NO: 50960 - DNA, 25 bp, S. cerevisiae
tggatccaatccctagaaccggtga

SEQ ID NO: 50961 - DNA, 25 bp, S. cerevisiae
tggataacattccaccacgtttgga

SEQ ID NO: 50962 - DNA, 25 bp, S. cerevisiae
tggacaatatcctctactgcattcc

SEQ ID NO: 50963 - DNA, 25 bp, S. cerevisiae
tggaatatcccatcgacgaggccat

SEQ ID NO: 50964 - DNA, 25 bp, S. cerevisiae
tggctgttatcaggttccaaaccat

SEQ ID NO: 50965 - DNA, 25 bp, S. cerevisiae
tgtgcttccatatgtgtcaaaggat

SEQ ID NO: 50966 - DNA, 25 bp, S. cerevisiae
tgtgccaacagatgattagaacgac

SEQ ID NO: 50967 - DNA, 25 bp, S. cerevisiae
tggccaccgacgttgcagcaagagg

SEQ ID NO: 50968 - DNA, 25 bp, S. cerevisiae
tggctaacagtccagtggcacatag

SEQ ID NO: 50969 - DNA, 25 bp, S. cerevisiae
tggacaatcgatgagtgcccaattc

SEQ ID NO: 50970 - DNA, 25 bp, S. cerevisiae
tggagcaacaaccactgccgaagaa

SEQ ID NO: 50971 - DNA, 25 bp, S. cerevisiae
tggactatccaacattcgaagaacg

SEQ ID NO: 50972 - DNA, 25 bp, S. cerevisiae
tggacgttcatagagtcgccgaaaa

SEQ ID NO: 50973 - DNA, 25 bp, S. cerevisiae
tggacgattatcatccccgaactta

SEQ ID NO: 50974 - DNA, 25 bp, S. cerevisiae
tggctttactaaattcaccgcaaat

SEQ ID NO: 50975 - DNA, 25 bp, S. cerevisiae
tgcgcgccctatttaacaccggaaa

SEQ ID NO: 50976 - DNA, 25 bp, S. cerevisiae
tggaatagtatttcagcacccgttc

SEQ ID NO: 50977 - DNA, 25 bp, S. cerevisiae
tggagcacgttatccagattcctct

SEQ ID NO: 50978 - DNA, 25 bp, S. cerevisiae
tggaacgagtatggccgtactttct

SEQ ID NO: 50979 - DNA, 25 bp, S. cerevisiae
tggaatgcatgtcgacaccgctagg

SEQ ID NO: 50980 - DNA, 25 bp, S. cerevisiae
tggcatcgatgaagcgcactccatg

SEQ ID NO: 50981 - DNA, 25 bp, S. cerevisiae
tggcctacaagccagcaccatggta

SEQ ID NO: 50982 - DNA, 25 bp, S. cerevisiae
tggcgaaagtcttaccacactcaag

SEQ ID NO: 50983 - DNA, 25 bp, S. cerevisiae
ggccattctagttttcacgttgcaa

SEQ ID NO: 50984 - DNA, 25 bp, S. cerevisiae
tggctctcatcctaagttggttctt

SEQ ID NO: 50985 - DNA, 25 bp, S. cerevisiae
tggacatacatgctcgttgtttccc

SEQ ID NO: 50986 - DNA, 25 bp, S. cerevisiae
tggacggcacagtcgtttcatgttc

SEQ ID NO: 50987 - DNA, 25 bp, S. cerevisiae
tggaacaccagtctcttgatgtcac

SEQ ID NO: 50988 - DNA, 25 bp, S. cerevisiae
tggaggatccttctttgcctaaaga

SEQ ID NO: 50989 - DNA, 25 bp, S. cerevisiae
tgacgcctccgatattacctagaac

SEQ ID NO: 50990 - DNA, 25 bp, S. cerevisiae
tggccgacgccatcaacgaatttaa

SEQ ID NO: 50991 - DNA, 25 bp, S. cerevisiae
tggcctaggtatgaagccctttgaa

SEQ ID NO: 50992 - DNA, 25 bp, S. cerevisiae
tggcctatgtacagacgcgtcattt

SEQ ID NO: 50993 - DNA, 25 bp, S. cerevisiae
tggctccaggacagacctgtctgct

SEQ ID NO: 50994 - DNA, 25 bp, S. cerevisiae
tggctggtgaactgtctctgtgctc

SEQ ID NO: 50995 - DNA, 25 bp, S. cerevisiae
tggccagaatcacacctatttatag

SEQ ID NO: 50996 - DNA, 25 bp, S. cerevisiae
ggccacgcaggcaatcattggatat

SEQ ID NO: 50997 - DNA, 25 bp, S. cerevisiae
tggccactggtgacatgttgagatc

SEQ ID NO: 50998 - DNA, 25 bp, S. cerevisiae
ggccactggtaatttcatcactgta

SEQ ID NO: 50999 - DNA, 25 bp, S. cerevisiae
ggccatcgttgttttctttgggaat

SEQ ID NO: 51000 - DNA, 25 bp, S. cerevisiae
tggctggactttactttctaggttt

SEQ ID NO: 51001 - DNA, 25 bp, S. cerevisiae
tggctggctttaatatcatatcaat

SEQ ID NO: 51002 - DNA, 25 bp, S. cerevisiae
tggcgatcctatcatctttgttcat

SEQ ID NO: 51003 - DNA, 25 bp, S. cerevisiae
tggtagattctctggtggttctcac

SEQ ID NO: 51004 - DNA, 25 bp, S. cerevisiae
tggaaaacctgttacgtcgttgtca

SEQ ID NO: 51005 - DNA, 25 bp, S. cerevisiae
tggtaaattccccacttttgcctga

SEQ ID NO: 51006 - DNA, 25 bp, S. cerevisiae
tggtataattacctacgggattcat

SEQ ID NO: 51007 - DNA, 25 bp, S. cerevisiae
tggctagacacttaggttccttgtt

SEQ ID NO: 51008 - DNA, 25 bp, S. cerevisiae
tggcaaaatcggttttcaatttctt

SEQ ID NO: 51009 - DNA, 25 bp, S. cerevisiae
tggtctttgggttgtacgttctata

SEQ ID NO: 51010 - DNA, 25 bp, S. cerevisiae
tggttacttgcccttttagagctaa

SEQ ID NO: 51011 - DNA, 25 bp, S. cerevisiae
tggataacaagcctctcattgcggg

SEQ ID NO: 51012 - DNA, 25 bp, S. cerevisiae
tgtgtaaacatctttgccccaggcg

SEQ ID NO: 51013 - DNA, 25 bp, S. cerevisiae
tggcggttatctacttggtgggcta

SEQ ID NO: 51014 - DNA, 25 bp, S. cerevisiae
tggcgctggttctgctattggtagt

SEQ ID NO: 51015 - DNA, 25 bp, S. cerevisiae
tggccggcctatgcatttactcaat

SEQ ID NO: 51016 - DNA, 25 bp, S. cerevisiae
tggccagttccagatattactcaag

SEQ ID NO: 51017 - DNA, 25 bp, S. cerevisiae
tggcccataccaagcataaattaag

SEQ ID NO: 51018 - DNA, 25 bp, S. cerevisiae
tggccacaggcctcagataagtgat

SEQ ID NO: 51019 - DNA, 25 bp, S. cerevisiae
tggcgccaaccaccaataatgactt

SEQ ID NO: 51020 - DNA, 25 bp, S. cerevisiae
tggcgaaatccatgaatacggtcat

SEQ ID NO: 51021 - DNA, 25 bp, S. cerevisiae
ggccaaatctgcagaagacgcgtca

SEQ ID NO: 51022 - DNA, 25 bp, S. cerevisiae
ggccaaatgcctagacaatccagac

SEQ ID NO: 51023 - DNA, 25 bp, S. cerevisiae
ggccaagaactaattcacgtgcaag

SEQ ID NO: 51024 - DNA, 25 bp, S. cerevisiae
tggccaaaagccatgtccgttgatg

SEQ ID NO: 51025 - DNA, 25 bp, S. cerevisiae
tggcaaaaagaaatcccgtcgctag

SEQ ID NO: 51026 - DNA, 25 bp, S. cerevisiae
tggaaagctcttatttgcccactac

SEQ ID NO: 51027 - DNA, 25 bp, S. cerevisiae
tggttgggctggacgttccgacata

SEQ ID NO: 51028 - DNA, 25 bp, S. cerevisiae
tggaggatcaggatgctgcatttat

SEQ ID NO: 51029 - DNA, 25 bp, S. cerevisiae
tggcgatggagtatccactggatct

SEQ ID NO: 51030 - DNA, 25 bp, S. cerevisiae
tggctagaggtaatcaaagagactt

SEQ ID NO: 51031 - DNA, 25 bp, S. cerevisiae
tggaagactggattttccctccact

SEQ ID NO: 51032 - DNA, 25 bp, S. cerevisiae
tggaaccaggacttattcgccacac

SEQ ID NO: 51033 - DNA, 25 bp, S. cerevisiae
tggcaaccaagatagttccatcaat

SEQ ID NO: 51034 - DNA, 25 bp, S. cerevisiae
tggctagagaaatcaccgacatcaa

SEQ ID NO: 51035 - DNA, 25 bp, S. cerevisiae
tggacgatgctcttgatgcctctaa

SEQ ID NO: 51036 - DNA, 25 bp, S. cerevisiae
tggccccacagaacgcaaattcatg

SEQ ID NO: 51037 - DNA, 25 bp, S. cerevisiae
tggccaagccactgacagagtgcgt

SEQ ID NO: 51038 - DNA, 25 bp, S. cerevisiae
tggcgtgttacctgacgattatcaa

SEQ ID NO: 51039 - DNA, 25 bp, S. cerevisiae
tggctaccgacgtgactactctgaa

SEQ ID NO: 51040 - DNA, 25 bp, S. cerevisiae
tgtcaagttgggtgtctactcgcaa

SEQ ID NO: 51041 - DNA, 25 bp, S. cerevisiae
tgtaagttttgttttacctgacgag

SEQ ID NO: 51042 - DNA, 25 bp, S. cerevisiae
tttaaatcgctttttagccgccagg

SEQ ID NO: 51043 - DNA, 25 bp, S. cerevisiae
tggtaaaccatttttcccaaagatg

SEQ ID NO: 51044 - DNA, 25 bp, S. cerevisiae
tggtaaccgcatccgttcaaaactg

SEQ ID NO: 51045 - DNA, 25 bp, S. cerevisiae
tggagaattccttatcttcgtcgtc

SEQ ID NO: 51046 - DNA, 25 bp, S. cerevisiae
tggaagttcctgtttcctatcgtta

SEQ ID NO: 51047 - DNA, 25 bp, S. cerevisiae
tggtatctttcctctttacatcgta

SEQ ID NO: 51048 - DNA, 25 bp, S. cerevisiae
tggcacaagtttacccttcattgac

SEQ ID NO: 51049 - DNA, 25 bp, S. cerevisiae
tggccataatatttcccctgctata

SEQ ID NO: 51050 - DNA, 25 bp, S. cerevisiae
tggcaaatgatgacttcaccggtta

SEQ ID NO: 51051 - DNA, 25 bp, S. cerevisiae
tggcatatttgcaccaatctggcgt

SEQ ID NO: 51052 - DNA, 25 bp, S. cerevisiae
tggaattatcccttaatggcctacc

SEQ ID NO: 51053 - DNA, 25 bp, S. cerevisiae
tggatgagttgaccggtttcttacc

SEQ ID NO: 51054 - DNA, 25 bp, S. cerevisiae
tggtggacgctagggattttgatct

SEQ ID NO: 51055 - DNA, 25 bp, S. cerevisiae
tggttacactactcatttgatgaaa

SEQ ID NO: 51056 - DNA, 25 bp, S. cerevisiae
tggctatatccattgttttttacag

SEQ ID NO: 51057 - DNA, 25 bp, S. cerevisiae
tggaggcgtcatttcttttcaagag

SEQ ID NO: 51058 - DNA, 25 bp, S. cerevisiae
tggcgccagccattttatttcgaat

SEQ ID NO: 51059 - DNA, 25 bp, S. cerevisiae
tggagccccatttgcaaagtcagtt

SEQ ID NO: 51060 - DNA, 25 bp, S. cerevisiae
tggccacgccttggacataatagtt

SEQ ID NO: 51061 - DNA, 25 bp, S. cerevisiae
tggactccgggaacattcatagatt

SEQ ID NO: 51062 - DNA, 25 bp, S. cerevisiae
tggccaccggtggtagtgctatcat

SEQ ID NO: 51063 - DNA, 25 bp, S. cerevisiae
tgaggaccaggacacgttgcaacag

SEQ ID NO: 51064 - DNA, 25 bp, S. cerevisiae
tggccgccagaggtatcgatgtcaa

SEQ ID NO: 51065 - DNA, 25 bp, S. cerevisiae
tggcactctgtctttttggcatggc

SEQ ID NO: 51066 - DNA, 25 bp, S. cerevisiae
tggctaactgacaaaggctacgatc

SEQ ID NO: 51067 - DNA, 25 bp, S. cerevisiae
tggctagcttacaacttgtctccat

SEQ ID NO: 51068 - DNA, 25 bp, S. cerevisiae
tggagactaacggaaccttgccttt

SEQ ID NO: 51069 - DNA, 25 bp, S. cerevisiae
tggactaagcccactgctagcagct

SEQ ID NO: 51070 - DNA, 25 bp, S. cerevisiae
tggaataatccctctgcaacggaca

SEQ ID NO: 51071 - DNA, 25 bp, S. cerevisiae
tggcaacgaccgcttcaacagagag

SEQ ID NO: 51072 - DNA, 25 bp, S. cerevisiae
tgaactcggcccctaagcaacaaga

SEQ ID NO: 51073 - DNA, 25 bp, S. cerevisiae
tgggtggccccgaacaaacagaatt

SEQ ID NO: 51074 - DNA, 25 bp, S. cerevisiae
tggcgtacctcccatgaatcaaatg

SEQ ID NO: 51075 - DNA, 25 bp, S. cerevisiae
tggcggctcctctaatactataaag

SEQ ID NO: 51076 - DNA, 25 bp, S. cerevisiae
tggattcacgacaaggctcagctgc

SEQ ID NO: 51077 - DNA, 25 bp, S. cerevisiae
tggattacgacttggacactttaca

SEQ ID NO: 51078 - DNA, 25 bp, S. cerevisiae
tgggtttgaggcctaccattttcca

SEQ ID NO: 51079 - DNA, 25 bp, S. cerevisiae
tggcgtctgattgaaccaggcgact

SEQ ID NO: 51080 - DNA, 25 bp, S. cerevisiae
tggcgtccatccagttgaactgtcg

SEQ ID NO: 51081 - DNA, 25 bp, S. cerevisiae
tggcgttctccattttgcttagatc

SEQ ID NO: 51082 - DNA, 25 bp, S. cerevisiae
tggcgtccccaattgagcatgtcag

SEQ ID NO: 51083 - DNA, 25 bp, S. cerevisiae
tggcattttccagttgatgtgctct

SEQ ID NO: 51084 - DNA, 25 bp, S. cerevisiae
tggtttgtccaggaggagcaccccg

SEQ ID NO: 51085 - DNA, 25 bp, S. cerevisiae
tggtcttacaagtgtcatggctccc

SEQ ID NO: 51086 - DNA, 25 bp, S. cerevisiae
tggcgtcacatcctggttttgggac

SEQ ID NO: 51087 - DNA, 25 bp, S. cerevisiae
tggctacaaccagggctactcagta

SEQ ID NO: 51088 - DNA, 25 bp, S. cerevisiae
tgtgctaatagcagacctagatact

SEQ ID NO: 51089 - DNA, 25 bp, S. cerevisiae
tggtagaacaggtcgtgcagcaaat

SEQ ID NO: 51090 - DNA, 25 bp, S. cerevisiae
tggaaaatatcttcgctggcaaact

SEQ ID NO: 51091 - DNA, 25 bp, S. cerevisiae
tggtaacattttcctactcaacgga

SEQ ID NO: 51092 - DNA, 25 bp, S. cerevisiae
tggtagttggtatggcgcaagccta

SEQ ID NO: 51093 - DNA, 25 bp, S. cerevisiae
tggtaccggtgataggtcagcctac

SEQ ID NO: 51094 - DNA, 25 bp, S. cerevisiae
tcgtttcagttataggatccctcgc

SEQ ID NO: 51095 - DNA, 25 bp, S. cerevisiae
tggtcttttgttaaggagccctcgt

SEQ ID NO: 51096 - DNA, 25 bp, S. cerevisiae
tggctatcttcccacaaggtgaggt

SEQ ID NO: 51097 - DNA, 25 bp, S. cerevisiae
tggctcacttcccatctaatggaaa

SEQ ID NO: 51098 - DNA, 25 bp, S. cerevisiae
tggcctgtccacgtaatgagagcaa

SEQ ID NO: 51099 - DNA, 25 bp, S. cerevisiae
tggattgtgcagtgatatcaacatc

SEQ ID NO: 51100 - DNA, 25 bp, S. cerevisiae
tggatctgccgggtatcaatcatgc

SEQ ID NO: 51101 - DNA, 25 bp, S. cerevisiae
tggctccctgctggcacataaagtc

SEQ ID NO: 51102 - DNA, 25 bp, S. cerevisiae
tggcttgggcttcaaaagctgccaa

SEQ ID NO: 51103 - DNA, 25 bp, S. cerevisiae
tggccggccttccaagagcgatcaa

SEQ ID NO: 51104 - DNA, 25 bp, S. cerevisiae
tggccgcggccgaagatgacgataa

SEQ ID NO: 51105 - DNA, 25 bp, S. cerevisiae
tggcgtgactttccccattatgaaa

SEQ ID NO: 51106 - DNA, 25 bp, S. cerevisiae
tggcgaactattacaccatccaata

SEQ ID NO: 51107 - DNA, 25 bp, S. cerevisiae
tggataactatcctgacagcccagc

SEQ ID NO: 51108 - DNA, 25 bp, S. cerevisiae
tggaagagggcttggcgcttcacac

SEQ ID NO: 51109 - DNA, 25 bp, S. cerevisiae
tggtaatgggctagattccttccgg

SEQ ID NO: 51110 - DNA, 25 bp, S. cerevisiae
tggctatggatgcttgttctctgta

SEQ ID NO: 51111 - DNA, 25 bp, S. cerevisiae
tggaatgaccttttgtcctctgaga

SEQ ID NO: 51112 - DNA, 25 bp, S. cerevisiae
tggagtttttcgtaggtcctgatgt

SEQ ID NO: 51113 - DNA, 25 bp, S. cerevisiae
tggagttgatttgcagggcccatca

SEQ ID NO: 51114 - DNA, 25 bp, S. cerevisiae
tggcagtttacggactggcactctc

SEQ ID NO: 51115 - DNA, 25 bp, S. cerevisiae
tggcagcttgtacgattggtgaccc

SEQ ID NO: 51116 - DNA, 25 bp, S. cerevisiae
tggagctctggcctgattggacaaa

SEQ ID NO: 51117 - DNA, 25 bp, S. cerevisiae
tggctgtgcaatgcggacacttcat

SEQ ID NO: 51118 - DNA, 25 bp, S. cerevisiae
tggctgctgccaacggtcatataga

SEQ ID NO: 51119 - DNA, 25 bp, S. cerevisiae
tggcgtgctatgacggctcgctaaa

SEQ ID NO: 51120 - DNA, 25 bp, S. cerevisiae
tggtatatatatagcgcacatttga

SEQ ID NO: 51121 - DNA, 25 bp, S. cerevisiae
tggatcaatcaaaccaatcaagaag

SEQ ID NO: 51122 - DNA, 25 bp, S. cerevisiae
tggtaccgaccgcatacatgaggag

SEQ ID NO: 51123 - DNA, 25 bp, S. cerevisiae
tggcagtcaggaccgtttcttgaaa

SEQ ID NO: 51124 - DNA, 25 bp, S. cerevisiae
tggaccacaactaattctcgctgat

SEQ ID NO: 51125 - DNA, 25 bp, S. cerevisiae
tggcatcgtttttgttcgggtggca

SEQ ID NO: 51126 - DNA, 25 bp, S. cerevisiae
tcgtcggttcaccattaacagtgtc

SEQ ID NO: 51127 - DNA, 25 bp, S. cerevisiae
tgttccttctatctcgagtacttac

SEQ ID NO: 51128 - DNA, 25 bp, S. cerevisiae
tgttccttcctctcgatttttaaat

SEQ ID NO: 51129 - DNA, 25 bp, S. cerevisiae
tgaccctgtccctaagtttttgaga

SEQ ID NO: 51130 - DNA, 25 bp, S. cerevisiae
tggcccaattcgtacagctttttaa

SEQ ID NO: 51131 - DNA, 25 bp, S. cerevisiae
tggacttaaccctacttggaatgac

SEQ ID NO: 51132 - DNA, 25 bp, S. cerevisiae
tggactcggacacccctgaaaataa

SEQ ID NO: 51133 - DNA, 25 bp, S. cerevisiae
tggacgcagtcattgtaccctaaat

SEQ ID NO: 51134 - DNA, 25 bp, S. cerevisiae
tggagaagtcgtatcacctgaaatt

SEQ ID NO: 51135 - DNA, 25 bp, S. cerevisiae
tggcgccgacgtcttgactgaaagc

SEQ ID NO: 51136 - DNA, 25 bp, S. cerevisiae
tggcgccaaggttcttgtctaacgt

SEQ ID NO: 51137 - DNA, 25 bp, S. cerevisiae
tggaatcaagtctaccgctttggct

SEQ ID NO: 51138 - DNA, 25 bp, S. cerevisiae
tggtgtttgccagacgttatcagct

SEQ ID NO: 51139 - DNA, 25 bp, S. cerevisiae
tggtttgtcgttttgttcatcattc

SEQ ID NO: 51140 - DNA, 25 bp, S. cerevisiae
tggctttggtttttgctttacataa

SEQ ID NO: 51141 - DNA, 25 bp, S. cerevisiae
tggctaatccttcatcttttcaaat

SEQ ID NO: 51142 - DNA, 25 bp, S. cerevisiae
tggcagaaccttacctttgtcgaga

SEQ ID NO: 51143 - DNA, 25 bp, S. cerevisiae
tggcaaccgctttttcatattcaag

SEQ ID NO: 51144 - DNA, 25 bp, S. cerevisiae
tggcaaattaatccgacttcacagt

SEQ ID NO: 51145 - DNA, 25 bp, S. cerevisiae
tggcaagatctacccgacatttatg

SEQ ID NO: 51146 - DNA, 25 bp, S. cerevisiae
tggcgatgagaaccctgacttgcta

SEQ ID NO: 51147 - DNA, 25 bp, S. cerevisiae
tggatttatcctctgtataccaata

SEQ ID NO: 51148 - DNA, 25 bp, S. cerevisiae
tggtcttgaccaatatttccagagg

SEQ ID NO: 51149 - DNA, 25 bp, S. cerevisiae
tggtcctgacccatattacgaatca

SEQ ID NO: 51150 - DNA, 25 bp, S. cerevisiae
tggtcggatcctacagattcatcga

SEQ ID NO: 51151 - DNA, 25 bp, S. cerevisiae
tggtcgccagctctagatttgcaga

SEQ ID NO: 51152 - DNA, 25 bp, S. cerevisiae
tggctctccattccacagagttatt

SEQ ID NO: 51153 - DNA, 25 bp, S. cerevisiae
tggctggttgtatttgcctctgcaa

SEQ ID NO: 51154 - DNA, 25 bp, S. cerevisiae
tggtaactaccatggtctcgcttga

SEQ ID NO: 51155 - DNA, 25 bp, S. cerevisiae
tggtcaaccaactggtgttgctgtt

SEQ ID NO: 51156 - DNA, 25 bp, S. cerevisiae
tgggaaaaacttggagccgctgctc

SEQ ID NO: 51157 - DNA, 25 bp, S. cerevisiae
tggacggccttagctttgttgataa

SEQ ID NO: 51158 - DNA, 25 bp, S. cerevisiae
tggatccggtgtattttggttaact

SEQ ID NO: 51159 - DNA, 25 bp, S. cerevisiae
tggatctcagcacctattttctggg

SEQ ID NO: 51160 - DNA, 25 bp, S. cerevisiae
tggcatgccatcacatcatttctaa

SEQ ID NO: 51161 - DNA, 25 bp, S. cerevisiae
tggcgtatctgctatcattattcaa

SEQ ID NO: 51162 - DNA, 25 bp, S. cerevisiae
tggtaatgcatctggtcttatcccg

SEQ ID NO: 51163 - DNA, 25 bp, S. cerevisiae
tggtaagctcataagggaacccgaa

SEQ ID NO: 51164 - DNA, 25 bp, S. cerevisiae
tggtccagatctaagtgcggccgta

SEQ ID NO: 51165 - DNA, 25 bp, S. cerevisiae
tggttgaattcttgtgccgccgcat

SEQ ID NO: 51166 - DNA, 25 bp, S. cerevisiae
tggtttggtcagaaagtacgactta

SEQ ID NO: 51167 - DNA, 25 bp, S. cerevisiae
tggtttggtcagaaagtacgactta

SEQ ID NO: 51168 - DNA, 25 bp, S. cerevisiae
tggtactggcatttcaggttccact

SEQ ID NO: 51169 - DNA, 25 bp, S. cerevisiae
tggtgacggaaccacgctactacgt

SEQ ID NO: 51170 - DNA, 25 bp, S. cerevisiae
tagttgggaacgtctacctatcggc

SEQ ID NO: 51171 - DNA, 25 bp, S. cerevisiae
tggactcgaaactctacctaagggc

SEQ ID NO: 51172 - DNA, 25 bp, S. cerevisiae
tggctcccaaactactcaactaaag

SEQ ID NO: 51173 - DNA, 25 bp, S. cerevisiae
tggtttgggaatgctttcgctcaat

SEQ ID NO: 51174 - DNA, 25 bp, S. cerevisiae
tggcttgtgataatccggcttgtcc

SEQ ID NO: 51175 - DNA, 25 bp, S. cerevisiae
tggcactttattggcggtttgcaaa

SEQ ID NO: 51176 - DNA, 25 bp, S. cerevisiae
tgtgcgacctcgttgccatggcgat

SEQ ID NO: 51177 - DNA, 25 bp, S. cerevisiae
tggctattgcagtttccacactaat

SEQ ID NO: 51178 - DNA, 25 bp, S. cerevisiae
tggctctattgtacacgaattcgac

SEQ ID NO: 51179 - DNA, 25 bp, S. cerevisiae
tggcactatgcacattgacacttcc

SEQ ID NO: 51180 - DNA, 25 bp, S. cerevisiae
tggattcagccaaggtgcaggtctt

SEQ ID NO: 51181 - DNA, 25 bp, S. cerevisiae
tggctccgccaaagctcaggatatt

SEQ ID NO: 51182 - DNA, 25 bp, S. cerevisiae
tggcaccggcgcaacatcaggaaag

SEQ ID NO: 51183 - DNA, 25 bp, S. cerevisiae
tggatggcgcctgaagtggtttcta

SEQ ID NO: 51184 - DNA, 25 bp, S. cerevisiae
tggactccccatctgaatttgttga

SEQ ID NO: 51185 - DNA, 25 bp, S. cerevisiae
tggcattcgacagcaacttcattga

SEQ ID NO: 51186 - DNA, 25 bp, S. cerevisiae
tggcttcgccattccatttgcagag

SEQ ID NO: 51187 - DNA, 25 bp, S. cerevisiae
tggacactttccttgatgcgaagaa

SEQ ID NO: 51188 - DNA, 25 bp, S. cerevisiae
tggaatttacctggatgccgacaat

SEQ ID NO: 51189 - DNA, 25 bp, S. cerevisiae
tggaatacaccaaagtccgccaatt

SEQ ID NO: 51190 - DNA, 25 bp, S. cerevisiae
tggaccctcgtacagaagcttattg

SEQ ID NO: 51191 - DNA, 25 bp, S. cerevisiae
tggctgacgcgcttttgatccaaaa

SEQ ID NO: 51192 - DNA, 25 bp, S. cerevisiae
tggctcaccgttcatgcgtcaacaa

SEQ ID NO: 51193 - DNA, 25 bp, S. cerevisiae
tggtagagcgttgcacttgtaatgc

SEQ ID NO: 51194 - DNA, 25 bp, S. cerevisiae
tggtcgtgccattctacatggttgg

SEQ ID NO: 51195 - DNA, 25 bp, S. cerevisiae
tggtattgctgttgaccacagacgt

SEQ ID NO: 51196 - DNA, 25 bp, S. cerevisiae
tggttccaaactcccttgacatatt

SEQ ID NO: 51197 - DNA, 25 bp, S. cerevisiae
tggactcaaacctcactagacgact

SEQ ID NO: 51198 - DNA, 25 bp, S. cerevisiae
tggcacctccactgttcataacaat

SEQ ID NO: 51199 - DNA, 25 bp, S. cerevisiae
tggctcgccaagtgcttcagatata

SEQ ID NO: 51200 - DNA, 25 bp, S. cerevisiae
tggctcgccgagtatttcaatcatt

SEQ ID NO: 51201 - DNA, 25 bp, S. cerevisiae
tggatctccagacattacccaatca

SEQ ID NO: 51202 - DNA, 25 bp, S. cerevisiae
tgtgaacagttcgaatccgtccaac

SEQ ID NO: 51203 - DNA, 25 bp, S. cerevisiae
tggaacatgttcagctccccaagaa

SEQ ID NO: 51204 - DNA, 25 bp, S. cerevisiae
tggaagacattcagctccccaaaga

SEQ ID NO: 51205 - DNA, 25 bp, S. cerevisiae
tgatagtaactatgctacgccggcc

SEQ ID NO: 51206 - DNA, 25 bp, S. cerevisiae
tgggtccatgtttatccagaaggat

SEQ ID NO: 51207 - DNA, 25 bp, S. cerevisiae
tggtattgagtgttgctggccaaac

SEQ ID NO: 51208 - DNA, 25 bp, S. cerevisiae
tggtttgattgctgccagaagaacc

SEQ ID NO: 51209 - DNA, 25 bp, S. cerevisiae
tggtacggtcgacctggattccaga

SEQ ID NO: 51210 - DNA, 25 bp, S. cerevisiae
tgggaggcaatcactgggcttcagt

SEQ ID NO: 51211 - DNA, 25 bp, S. cerevisiae
tggcttgtcacctgaggcagatttt

SEQ ID NO: 51212 - DNA, 25 bp, S. cerevisiae
tggatcattacactccaccagatgg

SEQ ID NO: 51213 - DNA, 25 bp, S. cerevisiae
tggcaatttgatgagatccagtaat

SEQ ID NO: 51214 - DNA, 25 bp, S. cerevisiae
tggcattttcatggttcgagacaat

SEQ ID NO: 51215 - DNA, 25 bp, S. cerevisiae
tggaatttcaggctcactacactca

SEQ ID NO: 51216 - DNA, 25 bp, S. cerevisiae
tggacatcgctcaaggtcacaacct

SEQ ID NO: 51217 - DNA, 25 bp, S. cerevisiae
tggacctactacatacatttaccct

SEQ ID NO: 51218 - DNA, 25 bp, S. cerevisiae
tgggtgtctgtattttcggaacttt

SEQ ID NO: 51219 - DNA, 25 bp, S. cerevisiae
tggcacttgctttatttgcggataa

SEQ ID NO: 51220 - DNA, 25 bp, S. cerevisiae
tggactggtatgtttctctgagaaa

SEQ ID NO: 51221 - DNA, 25 bp, S. cerevisiae
tggcattttatcacactgagggctg

SEQ ID NO: 51222 - DNA, 25 bp, S. cerevisiae
tggcattagcttcttcttctacaga

SEQ ID NO: 51223 - DNA, 25 bp, S. cerevisiae
tggcttcaaaattcacctcaggtaa

SEQ ID NO: 51224 - DNA, 25 bp, S. cerevisiae
tggatttagaccacataccgcttct

SEQ ID NO: 51225 - DNA, 25 bp, S. cerevisiae
tggagtatgggcaaccgacgccgtt

SEQ ID NO: 51226 - DNA, 25 bp, S. cerevisiae
tggtatcttgcgtgcccaacacgtt

SEQ ID NO: 51227 - DNA, 25 bp, S. cerevisiae
tggactcattggtttgcctaacgct

SEQ ID NO: 51228 - DNA, 25 bp, S. cerevisiae
tggttttggttcctggaacctccat

SEQ ID NO: 51229 - DNA, 25 bp, S. cerevisiae
tggtaagaccgtcatgatcgccgct

SEQ ID NO: 51230 - DNA, 25 bp, S. cerevisiae
tggttcaaggcccaagatcctactt

SEQ ID NO: 51231 - DNA, 25 bp, S. cerevisiae
tggctttcccagacgacaattcaac

SEQ ID NO: 51232 - DNA, 25 bp, S. cerevisiae
tgacgccaaagggacgaagcactga

SEQ ID NO: 51233 - DNA, 25 bp, S. cerevisiae
tgtcgcacaacgcaatggaacattg

SEQ ID NO: 51234 - DNA, 25 bp, S. cerevisiae
tggagccaccattgaacaaatctgt

SEQ ID NO: 51235 - DNA, 25 bp, S. cerevisiae
tggagaacgcaactagctgctagtg

SEQ ID NO: 51236 - DNA, 25 bp, S. cerevisiae
tggaaactgccattattcgcactgg

SEQ ID NO: 51237 - DNA, 25 bp, S. cerevisiae
tggtaacttcactttagccggtatc

SEQ ID NO: 51238 - DNA, 25 bp, S. cerevisiae
tcgttaatgaagatggcctgctgga

SEQ ID NO: 51239 - DNA, 25 bp, S. cerevisiae
tggtatataagggtcgcactcgcga

SEQ ID NO: 51240 - DNA, 25 bp, S. cerevisiae
tggtctataataaccccatcgggct

SEQ ID NO: 51241 - DNA, 25 bp, S. cerevisiae
tgctgttctaaaggccactgacggt

SEQ ID NO: 51242 - DNA, 25 bp, S. cerevisiae
tggaattcatgcaacacctccggtt

SEQ ID NO: 51243 - DNA, 25 bp, S. cerevisiae
tggtatcactggtaagtacggtgtc

SEQ ID NO: 51244 - DNA, 25 bp, S. cerevisiae
tggaactagtatcgcaaatgccttt

SEQ ID NO: 51245 - DNA, 25 bp, S. cerevisiae
tggaactcgtatcacacattgtcat

SEQ ID NO: 51246 - DNA, 25 bp, S. cerevisiae
tggatttccttaccaattgtctttg

SEQ ID NO: 51247 - DNA, 25 bp, S. cerevisiae
tgtatcttatttttcaattttttcg

SEQ ID NO: 51248 - DNA, 25 bp, S. cerevisiae
tggtaacatttcaaacgcgtccttc

SEQ ID NO: 51249 - DNA, 25 bp, S. cerevisiae
tggataacaaaaccccagtcacttt

SEQ ID NO: 51250 - DNA, 25 bp, S. cerevisiae
tggaaaacatcctcagcagcctctt

SEQ ID NO: 51251 - DNA, 25 bp, S. cerevisiae
tggaaccaccgctaaatgagtcttt

SEQ ID NO: 51252 - DNA, 25 bp, S. cerevisiae
tggaacaagctgacaaggacaccgt

SEQ ID NO: 51253 - DNA, 25 bp, S. cerevisiae
tggaaatcctggctcagcagcaacg

SEQ ID NO: 51254 - DNA, 25 bp, S. cerevisiae
tggaactcactggattcagccatga

SEQ ID NO: 51255 - DNA, 25 bp, S. cerevisiae
tggaacatatcggtgctgacgcagt

SEQ ID NO: 51256 - DNA, 25 bp, S. cerevisiae
tggtatcatccggactggccgctaa

SEQ ID NO: 51257 - DNA, 25 bp, S. cerevisiae
tggaattcggaaactacccaagaag

SEQ ID NO: 51258 - DNA, 25 bp, S. cerevisiae
tggcaaactaccatccagcttgttg

SEQ ID NO: 51259 - DNA, 25 bp, S. cerevisiae
tggcatatcctacaacacagtcttt

SEQ ID NO: 51260 - DNA, 25 bp, S. cerevisiae
tggcaagtgctcaaaatccgtctat

SEQ ID NO: 51261 - DNA, 25 bp, S. cerevisiae
tggacgctactcaaccgcaatacga

SEQ ID NO: 51262 - DNA, 25 bp, S. cerevisiae
tggagactatcagcgtgggcacgat

SEQ ID NO: 51263 - DNA, 25 bp, S. cerevisiae
tggagaatgttccagattccccagc

SEQ ID NO: 51264 - DNA, 25 bp, S. cerevisiae
tggaaccttatatctccggtcaaat

SEQ ID NO: 51265 - DNA, 25 bp, S. cerevisiae
tggtggccctctataacgggtgatt

SEQ ID NO: 51266 - DNA, 25 bp, S. cerevisiae
tggtggcggccaattaatcaatgtt

SEQ ID NO: 51267 - DNA, 25 bp, S. cerevisiae
tggtatggatccttactctcgatga

SEQ ID NO: 51268 - DNA, 25 bp, S. cerevisiae
tgggttcatctactcaaggtggctt

SEQ ID NO: 51269 - DNA, 25 bp, S. cerevisiae
tggtgaattcatatcggcggcatct

SEQ ID NO: 51270 - DNA, 25 bp, S. cerevisiae
tggtattctcaacgtgggacactct

SEQ ID NO: 51271 - DNA, 25 bp, S. cerevisiae
tggtcattccaatacctaacttgat

SEQ ID NO: 51272 - DNA, 25 bp, S. cerevisiae
tggattttccagtccgttcttacta

SEQ ID NO: 51273 - DNA, 25 bp, S. cerevisiae
tggttccagttgtttattgtcctca

SEQ ID NO: 51274 - DNA, 25 bp, S. cerevisiae
tggtatgccagctgccttcttgact

SEQ ID NO: 51275 - DNA, 25 bp, S. cerevisiae
tggtcaaccatcgtgtaggcgtcaa

SEQ ID NO: 51276 - DNA, 25 bp, S. cerevisiae
tggatcgacgacaagttggcctcta

SEQ ID NO: 51277 - DNA, 25 bp, S. cerevisiae
tggactttgctcaaatcaccactgc

SEQ ID NO: 51278 - DNA, 25 bp, S. cerevisiae
tggtctagtacaatggctttttccc

SEQ ID NO: 51279 - DNA, 25 bp, S. cerevisiae
tggagccagcctttatttttcgtaa

SEQ ID NO: 51280 - DNA, 25 bp, S. cerevisiae
tggacccattactttttctagcttg

SEQ ID NO: 51281 - DNA, 25 bp, S. cerevisiae
tggattttttcaccggcaagacact

SEQ ID NO: 51282 - DNA, 25 bp, S. cerevisiae
tggattttaacaacgcaggagactt

SEQ ID NO: 51283 - DNA, 25 bp, S. cerevisiae
tggtttaaccgctgagcaagagctt

SEQ ID NO: 51284 - DNA, 25 bp, S. cerevisiae
tggttcttcgccgtttggtactaca

SEQ ID NO: 51285 - DNA, 25 bp, S. cerevisiae
tgggtgtaccaccaaattttccaca

SEQ ID NO: 51286 - DNA, 25 bp, S. cerevisiae
tggttactcaattcaaaactgccag

SEQ ID NO: 51287 - DNA, 25 bp, S. cerevisiae
tggatcaaaacttacttccggccga

SEQ ID NO: 51288 - DNA, 25 bp, S. cerevisiae
tggattaacgcttacttcccctgga

SEQ ID NO: 51289 - DNA, 25 bp, S. cerevisiae
tgactccaacgttgtttttcttcga

SEQ ID NO: 51290 - DNA, 25 bp, S. cerevisiae
tgggcaaacaagtgtccagttctaa

SEQ ID NO: 51291 - DNA, 25 bp, S. cerevisiae
tggttattttctattgccttctacg

SEQ ID NO: 51292 - DNA, 25 bp, S. cerevisiae
tggtaactttgctctgcacccagaa

SEQ ID NO: 51293 - DNA, 25 bp, S. cerevisiae
tggagcaagatgtctttgtcccctg

SEQ ID NO: 51294 - DNA, 25 bp, S. cerevisiae
tggaagtacttccataccctgctgg

SEQ ID NO: 51295 - DNA, 25 bp, S. cerevisiae
tggacactgactactcaacctgtaa

SEQ ID NO: 51296 - DNA, 25 bp, S. cerevisiae
tggatcatccacataaggccgctaa

SEQ ID NO: 51297 - DNA, 25 bp, S. cerevisiae
tgggacgagcaaggccttccaacaa

SEQ ID NO: 51298 - DNA, 25 bp, S. cerevisiae
tggaaattttcccaatacgagctaa

SEQ ID NO: 51299 - DNA, 25 bp, S. cerevisiae
tggtaccaccatacgaaactactgt

SEQ ID NO: 51300 - DNA, 25 bp, S. cerevisiae
tggtaactcccacaagacaactaag

SEQ ID NO: 51301 - DNA, 25 bp, S. cerevisiae
tggaccgccgctctagaatatgaat

SEQ ID NO: 51302 - DNA, 25 bp, S. cerevisiae
tgagactttccactttcttcaaaac

SEQ ID NO: 51303 - DNA, 25 bp, S. cerevisiae
tggattttgcacataggtacacaca

SEQ ID NO: 51304 - DNA, 25 bp, S. cerevisiae
tggattacgcatgggaggtccacca

SEQ ID NO: 51305 - DNA, 25 bp, S. cerevisiae
tggtttctaccgctacatttttctt

SEQ ID NO: 51306 - DNA, 25 bp, S. cerevisiae
tggtttcccaaacacttctggtcaa

SEQ ID NO: 51307 - DNA, 25 bp, S. cerevisiae
tgggattccgtttccaataaggcaa

SEQ ID NO: 51308 - DNA, 25 bp, S. cerevisiae
tggatgtcaaatgcccaggttgttt

SEQ ID NO: 51309 - DNA, 25 bp, S. cerevisiae
tggtagaaaccctagcgtctttgaa

SEQ ID NO: 51310 - DNA, 25 bp, S. cerevisiae
tggtccttaggattaactcttctgg

SEQ ID NO: 51311 - DNA, 25 bp, S. cerevisiae
tggaggatgatctacgtattcgtga

SEQ ID NO: 51312 - DNA, 25 bp, S. cerevisiae
tggtgacgctcacgttatttcgcat

SEQ ID NO: 51313 - DNA, 25 bp, S. cerevisiae
tggatccctcaaattttccgtaacg

SEQ ID NO: 51314 - DNA, 25 bp, S. cerevisiae
tggaccctttcaatcgttattcaga

SEQ ID NO: 51315 - DNA, 25 bp, S. cerevisiae
tggatccccttaactttagtactct

SEQ ID NO: 51316 - DNA, 25 bp, S. cerevisiae
tggatcccgggtactttgacgaatt

SEQ ID NO: 51317 - DNA, 25 bp, S. cerevisiae
tggaccatcgtctttgttgctgaca

SEQ ID NO: 51318 - DNA, 25 bp, S. cerevisiae
tggagcttccagtatttttgatatg

SEQ ID NO: 51319 - DNA, 25 bp, S. cerevisiae
tggagttacatggtttgcgcttctg

SEQ ID NO: 51320 - DNA, 25 bp, S. cerevisiae
tggacttgaaactttgcgatggctt

SEQ ID NO: 51321 - DNA, 25 bp, S. cerevisiae
tggttcctactacgtcgaagctcaa

SEQ ID NO: 51322 - DNA, 25 bp, S. cerevisiae
tggtctgatctattacgtcccgtca

SEQ ID NO: 51323 - DNA, 25 bp, S. cerevisiae
tggatggctttaacgatcccttcgc

SEQ ID NO: 51324 - DNA, 25 bp, S. cerevisiae
tggatccttcaaagagaccgaccgc

SEQ ID NO: 51325 - DNA, 25 bp, S. cerevisiae
tggatcgctaccagatactctttct

SEQ ID NO: 51326 - DNA, 25 bp, S. cerevisiae
tggagaatccgcctataagtttgag

SEQ ID NO: 51327 - DNA, 25 bp, S. cerevisiae
tggagatttccctggcaacagtcac

SEQ ID NO: 51328 - DNA, 25 bp, S. cerevisiae
tggagttacccatggacgctatgaa

SEQ ID NO: 51329 - DNA, 25 bp, S. cerevisiae
tggagcaaatccttccaaccttgaa

SEQ ID NO: 51330 - DNA, 25 bp, S. cerevisiae
tggagtgctttggttaaatcgagac

SEQ ID NO: 51331 - DNA, 25 bp, S. cerevisiae
tggtggtccctttgacgaaattcca

SEQ ID NO: 51332 - DNA, 25 bp, S. cerevisiae
tggtttgttctattgtccgacttta

SEQ ID NO: 51333 - DNA, 25 bp, S. cerevisiae
tggttgctccaacaaaggttctttt

SEQ ID NO: 51334 - DNA, 25 bp, S. cerevisiae
tggtgcggccaacaacgttaattct

SEQ ID NO: 51335 - DNA, 25 bp, S. cerevisiae
ttatttaaacggacggcaaacatga

SEQ ID NO: 51336 - DNA, 25 bp, S. cerevisiae
tttttaaagcgacgcacaggaaaag

SEQ ID NO: 51337 - DNA, 25 bp, S. cerevisiae
tttttcaagggctccatcgcgtcaa

SEQ ID NO: 51338 - DNA, 25 bp, S. cerevisiae
tggttctacagttttcgccttagga

SEQ ID NO: 51339 - DNA, 25 bp, S. cerevisiae
tggtgctgaagctcgtgactggaac

SEQ ID NO: 51340 - DNA, 25 bp, S. cerevisiae
tggtgttggcaccagtactagcacc

SEQ ID NO: 51341 - DNA, 25 bp, S. cerevisiae
tggtttccccttttgagtgtagcat

SEQ ID NO: 51342 - DNA, 25 bp, S. cerevisiae
tggtttctacccctgaactgaagaa

SEQ ID NO: 51343 - DNA, 25 bp, S. cerevisiae
tggtcactaccttttgttggcgaaa

SEQ ID NO: 51344 - DNA, 25 bp, S. cerevisiae
tgggaaacccagcttttaagcaaag

SEQ ID NO: 51345 - DNA, 25 bp, S. cerevisiae
tggacaatgacaaccactctgattt

SEQ ID NO: 51346 - DNA, 25 bp, S. cerevisiae
tggacgcatcaaacttggctattgt

SEQ ID NO: 51347 - DNA, 25 bp, S. cerevisiae
taaacacgacggcagctgacttggc

SEQ ID NO: 51348 - DNA, 25 bp, S. cerevisiae
tagtaccgccaccaaggacgattgc

SEQ ID NO: 51349 - DNA, 25 bp, S. cerevisiae
tggtagacctcaacacaggatcttt

SEQ ID NO: 51350 - DNA, 25 bp, S. cerevisiae
tggataccctgatgcacagtacctt

SEQ ID NO: 51351 - DNA, 25 bp, S. cerevisiae
tggactcaaatgtgactgctgacga

SEQ ID NO: 51352 - DNA, 25 bp, S. cerevisiae
tggatcattctattgcgcaggctgc

SEQ ID NO: 51353 - DNA, 25 bp, S. cerevisiae
tggattgcctatgccatactggcta

SEQ ID NO: 51354 - DNA, 25 bp, S. cerevisiae
tggttccattatagtactgctgagc

SEQ ID NO: 51355 - DNA, 25 bp, S. cerevisiae
tggattccttttctttgcagcacac

SEQ ID NO: 51356 - DNA, 25 bp, S. cerevisiae
tggagctacctttatttggcagata

SEQ ID NO: 51357 - DNA, 25 bp, S. cerevisiae
tggagtcaggtttattttcagtgga

SEQ ID NO: 51358 - DNA, 25 bp, S. cerevisiae
tggagctccaccgaatgattcattc

SEQ ID NO: 51359 - DNA, 25 bp, S. cerevisiae
tggactccgcaatagatcatcattc

SEQ ID NO: 51360 - DNA, 25 bp, S. cerevisiae
tggtattccagctgaacaagtcacc

SEQ ID NO: 51361 - DNA, 25 bp, S. cerevisiae
tggtacttcactcgcaacaatgttg

SEQ ID NO: 51362 - DNA, 25 bp, S. cerevisiae
tggatactaccgtcaacagcaataa

SEQ ID NO: 51363 - DNA, 25 bp, S. cerevisiae
tggtagggtgcgtattcacaacaat

SEQ ID NO: 51364 - DNA, 25 bp, S. cerevisiae
tggaggtctctcacccatgatagag

SEQ ID NO: 51365 - DNA, 25 bp, S. cerevisiae
tgggtgataaaccagccgctataaa

SEQ ID NO: 51366 - DNA, 25 bp, S. cerevisiae
tggttagatgcatcgcaggcagcct

SEQ ID NO: 51367 - DNA, 25 bp, S. cerevisiae
tggttagatgcttcgcaagcggcct

SEQ ID NO: 51368 - DNA, 25 bp, S. cerevisiae
tggttccggttctactgtccaagaa

SEQ ID NO: 51369 - DNA, 25 bp, S. cerevisiae
tggttgctgcggaaaacgttgccaa

SEQ ID NO: 51370 - DNA, 25 bp, S. cerevisiae
tggtttcattactatatcgtgctaa

SEQ ID NO: 51371 - DNA, 25 bp, S. cerevisiae
tggtatatttcctacatccgctgaa

SEQ ID NO: 51372 - DNA, 25 bp, S. cerevisiae
tgggagcttttctacatccatgtga

SEQ ID NO: 51373 - DNA, 25 bp, S. cerevisiae
tggagcctcctgttatcaagaaaag

SEQ ID NO: 51374 - DNA, 25 bp, S. cerevisiae
tggttcctctttgagaagacaagtc

SEQ ID NO: 51375 - DNA, 25 bp, S. cerevisiae
tggatacacttctaccgcaaacggt

SEQ ID NO: 51376 - DNA, 25 bp, S. cerevisiae
tggatatacctctatcaccacatac

SEQ ID NO: 51377 - DNA, 25 bp, S. cerevisiae
tggagatttccttcaaactaccaaa

SEQ ID NO: 51378 - DNA, 25 bp, S. cerevisiae
tgggttttctggcttggtctaccaa

SEQ ID NO: 51379 - DNA, 25 bp, S. cerevisiae
tggtggttacctcggccaaaggcta

SEQ ID NO: 51380 - DNA, 25 bp, S. cerevisiae
tggtggtcgcccagtatggaagatc

SEQ ID NO: 51381 - DNA, 25 bp, S. cerevisiae
tggacgcagccctagacattactaa

SEQ ID NO: 51382 - DNA, 25 bp, S. cerevisiae
tggacctgattctaacacctcggaa

SEQ ID NO: 51383 - DNA, 25 bp, S. cerevisiae
tggatactgttggaccaccagcgtc

SEQ ID NO: 51384 - DNA, 25 bp, S. cerevisiae
tagtaagttcgagctccgcagattc

SEQ ID NO: 51385 - DNA, 25 bp, S. cerevisiae
tggtattttgcgtgcccaacatgtc

SEQ ID NO: 51386 - DNA, 25 bp, S. cerevisiae
tggatttcttggtggcaatgccttc

SEQ ID NO: 51387 - DNA, 25 bp, S. cerevisiae
tggaccttccgactggtggttcaaa

SEQ ID NO: 51388 - DNA, 25 bp, S. cerevisiae
tggacctatacggatggcatggatt

SEQ ID NO: 51389 - DNA, 25 bp, S. cerevisiae
tgggtctcatcttccaacttatgga

SEQ ID NO: 51390 - DNA, 25 bp, S. cerevisiae
tggttctaccactgatgatgacaaa

SEQ ID NO: 51391 - DNA, 25 bp, S. cerevisiae
tggaccttccactactgagaacagg

SEQ ID NO: 51392 - DNA, 25 bp, S. cerevisiae
tggtctcaacgaatacttcatcatg

SEQ ID NO: 51393 - DNA, 25 bp, S. cerevisiae
tggatattccttacactgtctcaac

SEQ ID NO: 51394 - DNA, 25 bp, S. cerevisiae
tggttcctttagttttatatcaaat

SEQ ID NO: 51395 - DNA, 25 bp, S. cerevisiae
tggttgcttcttccctttcaaaaat

SEQ ID NO: 51396 - DNA, 25 bp, S. cerevisiae
tgggttcctgtcaccttaaacttag

SEQ ID NO: 51397 - DNA, 25 bp, S. cerevisiae
tggatcaacctgtcgacttgacgtt

SEQ ID NO: 51398 - DNA, 25 bp, S. cerevisiae
tggtcataccgctggtttggttatc

SEQ ID NO: 51399 - DNA, 25 bp, S. cerevisiae
tggtgatgaccccagtatcgtcgtt

SEQ ID NO: 51400 - DNA, 25 bp, S. cerevisiae
tggtcacagaactgctccaaagtct

SEQ ID NO: 51401 - DNA, 25 bp, S. cerevisiae
tggtcttacgcctctttcgaaagta

SEQ ID NO: 51402 - DNA, 25 bp, S. cerevisiae
tggagtctcaattcagggatctgga

SEQ ID NO: 51403 - DNA, 25 bp, S. cerevisiae
tggtcccaatagtggctctgtgcca

SEQ ID NO: 51404 - DNA, 25 bp, S. cerevisiae
tggtcctcaattggctgacttgtac

SEQ ID NO: 51405 - DNA, 25 bp, S. cerevisiae
tgggtgctactatggccgctgaaga

SEQ ID NO: 51406 - DNA, 25 bp, S. cerevisiae
tggattccagaattgcccttgtagg

SEQ ID NO: 51407 - DNA, 25 bp, S. cerevisiae
tggtgtgcctgaagatgaactgttt

SEQ ID NO: 51408 - DNA, 25 bp, S. cerevisiae
tgggccctaagatagaggatctttt

SEQ ID NO: 51409 - DNA, 25 bp, S. cerevisiae
tgggcggcgaaattgaagcttcctc

SEQ ID NO: 51410 - DNA, 25 bp, S. cerevisiae
tggtgcgcgaacttgatgaagcccc

SEQ ID NO: 51411 - DNA, 25 bp, S. cerevisiae
tggtggcgaacgtagaatcatcatt

SEQ ID NO: 51412 - DNA, 25 bp, S. cerevisiae
tgtgggaacagcgacaagccaaata

SEQ ID NO: 51413 - DNA, 25 bp, S. cerevisiae
tggtctgggagatcgctcttagata

SEQ ID NO: 51414 - DNA, 25 bp, S. cerevisiae
tggtctagtggtatgattctcgctt

SEQ ID NO: 51415 - DNA, 25 bp, S. cerevisiae
tgtgactactggtttattctctggt

SEQ ID NO: 51416 - DNA, 25 bp, S. cerevisiae
tggagattctttagctgaacctggt

SEQ ID NO: 51417 - DNA, 25 bp, S. cerevisiae
tggagagtcttttcgctaagcaagt

SEQ ID NO: 51418 - DNA, 25 bp, S. cerevisiae
tgggtgtctttaccgaagcctctag

SEQ ID NO: 51419 - DNA, 25 bp, S. cerevisiae
tgaggagttaaacgcgcacctatta

SEQ ID NO: 51420 - DNA, 25 bp, S. cerevisiae
tggtgcattactgtcaaagcccctt

SEQ ID NO: 51421 - DNA, 25 bp, S. cerevisiae
tggtatgtacgccatcaaggtcgat

SEQ ID NO: 51422 - DNA, 25 bp, S. cerevisiae
ttgggtgccgaatgggccaagccat

SEQ ID NO: 51423 - DNA, 25 bp, S. cerevisiae
tttgtcccaaactcgaaaccattcg

SEQ ID NO: 51424 - DNA, 25 bp, S. cerevisiae
tcttgccaaaacaaaaaaatccatt

SEQ ID NO: 51425 - DNA, 25 bp, S. cerevisiae
tgactcctcaaacagaattccacac

SEQ ID NO: 51426 - DNA, 25 bp, S. cerevisiae
tgactccgcaaacttactacttaac

SEQ ID NO: 51427 - DNA, 25 bp, S. cerevisiae
tggttgttacaagccctccataaag

SEQ ID NO: 51428 - DNA, 25 bp, S. cerevisiae
tggttgttattattccttagcgtta

SEQ ID NO: 51429 - DNA, 25 bp, S. cerevisiae
tggttggtatttttccttgcatata

SEQ ID NO: 51430 - DNA, 25 bp, S. cerevisiae
tggataaagtcactcctcacgctaa

SEQ ID NO: 51431 - DNA, 25 bp, S. cerevisiae
tggatactagtcatgcctactcatc

SEQ ID NO: 51432 - DNA, 25 bp, S. cerevisiae
tggatacctggaagctgcaagcaat

SEQ ID NO: 51433 - DNA, 25 bp, S. cerevisiae
tggtcacgtggttatggcagctgct

SEQ ID NO: 51434 - DNA, 25 bp, S. cerevisiae
tggaggactctcttcaatttgatga

SEQ ID NO: 51435 - DNA, 25 bp, S. cerevisiae
tggtcgattctctagcaactttcac

SEQ ID NO: 51436 - DNA, 25 bp, S. cerevisiae
tggatactggtattgtgactcttgt

SEQ ID NO: 51437 - DNA, 25 bp, S. cerevisiae
tggtgtcgcgaacatatcatttcaa

SEQ ID NO: 51438 - DNA, 25 bp, S. cerevisiae
tggtccggacactaatttaaacgcg

SEQ ID NO: 51439 - DNA, 25 bp, S. cerevisiae
tggtccggtcaaagcattaataaag

SEQ ID NO: 51440 - DNA, 25 bp, S. cerevisiae
ttccccaatccaaattaaaccagtg

SEQ ID NO: 51441 - DNA, 25 bp, S. cerevisiae
tgagcaccccacttttaaaaccagt

SEQ ID NO: 51442 - DNA, 25 bp, S. cerevisiae
tggtcagtcacaaccccagtattaa

SEQ ID NO: 51443 - DNA, 25 bp, S. cerevisiae
tggtgaatccgtgtcatatttgttc

SEQ ID NO: 51444 - DNA, 25 bp, S. cerevisiae
tgggcctgccggacgggttaacata

SEQ ID NO: 51445 - DNA, 25 bp, S. cerevisiae
tggaggccacgataatcacggtaat

SEQ ID NO: 51446 - DNA, 25 bp, S. cerevisiae
tgggaccacttctacatccagttag

SEQ ID NO: 51447 - DNA, 25 bp, S. cerevisiae
tgggccggcttcaatcttatcttac

SEQ ID NO: 51448 - DNA, 25 bp, S. cerevisiae
tggtgcagacactcatcgcgaacga

SEQ ID NO: 51449 - DNA, 25 bp, S. cerevisiae
tggatagacgcccacgctgatataa

SEQ ID NO: 51450 - DNA, 25 bp, S. cerevisiae
tggaggacccaaccatcatcatgta

SEQ ID NO: 51451 - DNA, 25 bp, S. cerevisiae
tgggttttggtatccccgcaagcgg

SEQ ID NO: 51452 - DNA, 25 bp, S. cerevisiae
tgggtttttgagactaccgccaacg

SEQ ID NO: 51453 - DNA, 25 bp, S. cerevisiae
tggttattcggacccatacttaaag

SEQ ID NO: 51454 - DNA, 25 bp, S. cerevisiae
tggtttgtcggacccacagtcataa

SEQ ID NO: 51455 - DNA, 25 bp, S. cerevisiae
tggtttgaagaagtccgcgatcata

SEQ ID NO: 51456 - DNA, 25 bp, S. cerevisiae
tcttccgaaagattaccgattggcg

SEQ ID NO: 51457 - DNA, 25 bp, S. cerevisiae
tttggcgtcaagaataccgaagtat

SEQ ID NO: 51458 - DNA, 25 bp, S. cerevisiae
tggtggtttgcaagtcgccatcgac

SEQ ID NO: 51459 - DNA, 25 bp, S. cerevisiae
tggttatcaggcagtactatctaca

SEQ ID NO: 51460 - DNA, 25 bp, S. cerevisiae
tggtgtaaagccctcattttgacat

SEQ ID NO: 51461 - DNA, 25 bp, S. cerevisiae
tgtgttcaccgacccaaatgtaatg

SEQ ID NO: 51462 - DNA, 25 bp, S. cerevisiae
tggttcacctcacgctgaaatctca

SEQ ID NO: 51463 - DNA, 25 bp, S. cerevisiae
tggtaactcatccactacaacatca

SEQ ID NO: 51464 - DNA, 25 bp, S. cerevisiae
tgggacgcatccgatatcagcaacc

SEQ ID NO: 51465 - DNA, 25 bp, S. cerevisiae
tggaggtgattgcagacgaactcat

SEQ ID NO: 51466 - DNA, 25 bp, S. cerevisiae
tgtgggctttgctagacggaatcga

SEQ ID NO: 51467 - DNA, 25 bp, S. cerevisiae
tggtgatgcttttcccggtactgat

SEQ ID NO: 51468 - DNA, 25 bp, S. cerevisiae
tggttgcagcattcacattcgggaa

SEQ ID NO: 51469 - DNA, 25 bp, S. cerevisiae
tggtgtcaagaccactctgccagaa

SEQ ID NO: 51470 - DNA, 25 bp, S. cerevisiae
tggatgctgacaacgacactgaaga

SEQ ID NO: 51471 - DNA, 25 bp, S. cerevisiae
tggtgctaaacgtgctcaattcaga

SEQ ID NO: 51472 - DNA, 25 bp, S. cerevisiae
tcgtgccgaacgaactagattctat

SEQ ID NO: 51473 - DNA, 25 bp, S. cerevisiae
tggtccaaacttgcatggtatcttt

SEQ ID NO: 51474 - DNA, 25 bp, S. cerevisiae
tggatggcagaacaccggctacttg

SEQ ID NO: 51475 - DNA, 25 bp, S. cerevisiae
tggtgccacagacaagggtactatt

SEQ ID NO: 51476 - DNA, 25 bp, S. cerevisiae
tggttccaacaatgacgattcttat

SEQ ID NO: 51477 - DNA, 25 bp, S. cerevisiae
tggttctaacaacccgttcgcattg

SEQ ID NO: 51478 - DNA, 25 bp, S. cerevisiae
tggtggtatgaaagtcaaggccgac

SEQ ID NO: 51479 - DNA, 25 bp, S. cerevisiae
tggattgctcgttgatatcgtccca

SEQ ID NO: 51480 - DNA, 25 bp, S. cerevisiae
tggatcgtcgtttcaaggcacctga

SEQ ID NO: 51481 - DNA, 25 bp, S. cerevisiae
tggttgtcagtcatacatggcacct

SEQ ID NO: 51482 - DNA, 25 bp, S. cerevisiae
tggtatccaaaactggcacgcctag

SEQ ID NO: 51483 - DNA, 25 bp, S. cerevisiae
tggatgatcaattcacgttccccta

SEQ ID NO: 51484 - DNA, 25 bp, S. cerevisiae
tggtgaaaccacgatttttgctagt

SEQ ID NO: 51485 - DNA, 25 bp, S. cerevisiae
tggtcaaatccagcttcttttcaag

SEQ ID NO: 51486 - DNA, 25 bp, S. cerevisiae
tggattaccgttatctggtttataa

SEQ ID NO: 51487 - DNA, 25 bp, S. cerevisiae
tggattactagcatttctggtcaaa

SEQ ID NO: 51488 - DNA, 25 bp, S. cerevisiae
tgggcttaagtctattggccagtta

SEQ ID NO: 51489 - DNA, 25 bp, S. cerevisiae
tggtcagtaagtcaattgccgctaa

SEQ ID NO: 51490 - DNA, 25 bp, S. cerevisiae
tggtcagtgggttcaatttcggtac

SEQ ID NO: 51491 - DNA, 25 bp, S. cerevisiae
tggtcaacattggttctaccgctac

SEQ ID NO: 51492 - DNA, 25 bp, S. cerevisiae
tggttcaaggtggtaacgctgcccc

SEQ ID NO: 51493 - DNA, 25 bp, S. cerevisiae
tggtacacgcggtgacactcttctc

SEQ ID NO: 51494 - DNA, 25 bp, S. cerevisiae
tggtttggcgagtgacatttctgtc

SEQ ID NO: 51495 - DNA, 25 bp, S. cerevisiae
tgggtttgaagttgccattatctgt

SEQ ID NO: 51496 - DNA, 25 bp, S. cerevisiae
tgaggcgttgagatcgtactactta

SEQ ID NO: 51497 - DNA, 25 bp, S. cerevisiae
tgaacgattgtggacgtcgctacgt

SEQ ID NO: 51498 - DNA, 25 bp, S. cerevisiae
tgtggcgagctctgacgtcaaacgt

SEQ ID NO: 51499 - DNA, 25 bp, S. cerevisiae
tggtccttggcgcaacaaatatccc

SEQ ID NO: 51500 - DNA, 25 bp, S. cerevisiae
tgatcgtaggtatagaccggacaat

SEQ ID NO: 51501 - DNA, 25 bp, S. cerevisiae
tgcatcctgtggcaaataccggcac

SEQ ID NO: 51502 - DNA, 25 bp, S. cerevisiae
tgtcaagtagcacaacgcctagtat

SEQ ID NO: 51503 - DNA, 25 bp, S. cerevisiae
tgtgcacagtaactagacccggcgt

SEQ ID NO: 51504 - DNA, 25 bp, S. cerevisiae
tggtcaaacaggcacagcacacact

SEQ ID NO: 51505 - DNA, 25 bp, S. cerevisiae
tggtacctctagtattctccatggt

SEQ ID NO: 51506 - DNA, 25 bp, S. cerevisiae
tggtatctttggcagacactctggt

SEQ ID NO: 51507 - DNA, 25 bp, S. cerevisiae
tggtgtcaagatcttcttgcccgat

SEQ ID NO: 51508 - DNA, 25 bp, S. cerevisiae
tggttcatattctctactccttgta

SEQ ID NO: 51509 - DNA, 25 bp, S. cerevisiae
tggttcatcattgagaagacaagtt

SEQ ID NO: 51510 - DNA, 25 bp, S. cerevisiae
tggttctctctactaggctcgatta

SEQ ID NO: 51511 - DNA, 25 bp, S. cerevisiae
tggttcttctgatggtgtcgcctac

SEQ ID NO: 51512 - DNA, 25 bp, S. cerevisiae
tggttcttatgatggcaacggtaat

SEQ ID NO: 51513 - DNA, 25 bp, S. cerevisiae
tggttgctggttacaattctgccgt

SEQ ID NO: 51514 - DNA, 25 bp, S. cerevisiae
tgtcctcaatgtggcaaaggttttg

SEQ ID NO: 51515 - DNA, 25 bp, S. cerevisiae
tgtccatgagaacagcaagtgcttt

SEQ ID NO: 51516 - DNA, 25 bp, S. cerevisiae
tggtctttcaatgctaggctccgtc

SEQ ID NO: 51517 - DNA, 25 bp, S. cerevisiae
tggtgatggtcaagccactgtctcc

SEQ ID NO: 51518 - DNA, 25 bp, S. cerevisiae
tggatatgttatcgccttctccatc

SEQ ID NO: 51519 - DNA, 25 bp, S. cerevisiae
tgtcaaagtcatcctcttcaacatc

SEQ ID NO: 51520 - DNA, 25 bp, S. cerevisiae
tcttacgccgtctggaacgatgtca

SEQ ID NO: 51521 - DNA, 25 bp, S. cerevisiae
tggtaaccgattgggccagcgagtc

SEQ ID NO: 51522 - DNA, 25 bp, S. cerevisiae
tggattacctaaattgccctcagtg

SEQ ID NO: 51523 - DNA, 25 bp, S. cerevisiae
tggtttcagttcatttcttcgcagt

SEQ ID NO: 51524 - DNA, 25 bp, S. cerevisiae
tggtattatttcctttctgctagcg

SEQ ID NO: 51525 - DNA, 25 bp, S. cerevisiae
tgggagactgtattgcattttttat

SEQ ID NO: 51526 - DNA, 25 bp, S. cerevisiae
tgggatactgaataacctgttaacc

SEQ ID NO: 51527 - DNA, 25 bp, S. cerevisiae
tgggattggaatacgtcgcgcttat

SEQ ID NO: 51528 - DNA, 25 bp, S. cerevisiae
tgtgtggacagcacggaaatcctat

SEQ ID NO: 51529 - DNA, 25 bp, S. cerevisiae
tgtcgagtatgcctgcggagaacct

SEQ ID NO: 51530 - DNA, 25 bp, S. cerevisiae
tgggacttcacatggatggcatcgt

SEQ ID NO: 51531 - DNA, 25 bp, S. cerevisiae
tgtagaccacaatagctcgtcgtga

SEQ ID NO: 51532 - DNA, 25 bp, S. cerevisiae
tgttgaccggtatccccgctgacca

SEQ ID NO: 51533 - DNA, 25 bp, S. cerevisiae
tgttggctccaaaactcccggaaga

SEQ ID NO: 51534 - DNA, 25 bp, S. cerevisiae
tgttgcctcctttaacccaggttat

SEQ ID NO: 51535 - DNA, 25 bp, S. cerevisiae
tggtgccctttattagctctagtag

SEQ ID NO: 51536 - DNA, 25 bp, S. cerevisiae
tgggtacaactttgggtcctcagca

SEQ ID NO: 51537 - DNA, 25 bp, S. cerevisiae
tggtaacatcatactgtcccttttc

SEQ ID NO: 51538 - DNA, 25 bp, S. cerevisiae
tggttcagtacgctccctttctatt

SEQ ID NO: 51539 - DNA, 25 bp, S. cerevisiae
tggtttccaggatttgttcttcact

SEQ ID NO: 51540 - DNA, 25 bp, S. cerevisiae
tgggattgaccacgatctgattgac

SEQ ID NO: 51541 - DNA, 25 bp, S. cerevisiae
tgggataagcctgttgttgtcaatg

SEQ ID NO: 51542 - DNA, 25 bp, S. cerevisiae
tggttacatgcctttctacacatac

SEQ ID NO: 51543 - DNA, 25 bp, S. cerevisiae
tggttactactgttgtggcagccct

SEQ ID NO: 51544 - DNA, 25 bp, S. cerevisiae
tggattcctaccttggcgtggccta

SEQ ID NO: 51545 - DNA, 25 bp, S. cerevisiae
tggttcactgccatcgaagttcgta

SEQ ID NO: 51546 - DNA, 25 bp, S. cerevisiae
tgggctcactactgtttagcggact

SEQ ID NO: 51547 - DNA, 25 bp, S. cerevisiae
tgggtaagcagtcttttggaatctt

SEQ ID NO: 51548 - DNA, 25 bp, S. cerevisiae
tggtttaccgctttcgtaactctag

SEQ ID NO: 51549 - DNA, 25 bp, S. cerevisiae
tggtatattccacattcgctaagcc

SEQ ID NO: 51550 - DNA, 25 bp, S. cerevisiae
tggtttaaaatcacgctcaagcatc

SEQ ID NO: 51551 - DNA, 25 bp, S. cerevisiae
tgggttaaattcttcctcaagtaca

SEQ ID NO: 51552 - DNA, 25 bp, S. cerevisiae
tgggtgccaccatattttatctgat

SEQ ID NO: 51553 - DNA, 25 bp, S. cerevisiae
tgggttcccgaattgatttcttccg

SEQ ID NO: 51554 - DNA, 25 bp, S. cerevisiae
tggtttcccaggtttgattccacca

SEQ ID NO: 51555 - DNA, 25 bp, S. cerevisiae
tgttgttccaaaattcgaccccaag

SEQ ID NO: 51556 - DNA, 25 bp, S. cerevisiae
tttgtctcgtgatattccagcacct

SEQ ID NO: 51557 - DNA, 25 bp, S. cerevisiae
tgtggtcaccagagattggcaccct

SEQ ID NO: 51558 - DNA, 25 bp, S. cerevisiae
tggtctgggtgatattgccttgcct

SEQ ID NO: 51559 - DNA, 25 bp, S. cerevisiae
tgtggcatgactgccatcgtacgtt

SEQ ID NO: 51560 - DNA, 25 bp, S. cerevisiae
tgggaacacaagacctgagccgtat

SEQ ID NO: 51561 - DNA, 25 bp, S. cerevisiae
tgagggccaaaagcagagtcgttaa

SEQ ID NO: 51562 - DNA, 25 bp, S. cerevisiae
tgtgtcacaaatgcctaagccacgt

SEQ ID NO: 51563 - DNA, 25 bp, S. cerevisiae
tgggcagtcactttagacacttcga

SEQ ID NO: 51564 - DNA, 25 bp, S. cerevisiae
tggtctacactttcacaacgcctaa

SEQ ID NO: 51565 - DNA, 25 bp, S. cerevisiae
tggttagcagctatcgcaggcttga

SEQ ID NO: 51566 - DNA, 25 bp, S. cerevisiae
tggtagaccattccatcttctttta

SEQ ID NO: 51567 - DNA, 25 bp, S. cerevisiae
tgtgatagcaacaacgtcttccgtt

SEQ ID NO: 51568 - DNA, 25 bp, S. cerevisiae
tggtgatcctcttcgtttccattca

SEQ ID NO: 51569 - DNA, 25 bp, S. cerevisiae
tggttctcacgggttcttaatcggc

SEQ ID NO: 51570 - DNA, 25 bp, S. cerevisiae
tggttccacctgatgatccaaacgt

SEQ ID NO: 51571 - DNA, 25 bp, S. cerevisiae
tggttagacccaaacgaaacttctg

SEQ ID NO: 51572 - DNA, 25 bp, S. cerevisiae
tggttcaccccaaacgctaagtacg

SEQ ID NO: 51573 - DNA, 25 bp, S. cerevisiae
tggtcacccgctttacagatcagaa

SEQ ID NO: 51574 - DNA, 25 bp, S. cerevisiae
tgtagccccggtaacgtcgaagaga

SEQ ID NO: 51575 - DNA, 25 bp, S. cerevisiae
tgggtcgtatgcacagtgccggtaa

SEQ ID NO: 51576 - DNA, 25 bp, S. cerevisiae
tggttcaccatcttcgtctcaagaa

SEQ ID NO: 51577 - DNA, 25 bp, S. cerevisiae
tggtcatattcaagctcgtcgttta

SEQ ID NO: 51578 - DNA, 25 bp, S. cerevisiae
tggtcttttacctcctttggaagag

SEQ ID NO: 51579 - DNA, 25 bp, S. cerevisiae
tggtcttgaacatctccgttggtga

SEQ ID NO: 51580 - DNA, 25 bp, S. cerevisiae
tgtggcaaaccagccatattttgga

SEQ ID NO: 51581 - DNA, 25 bp, S. cerevisiae
tgggcaaatttcctctataacggta

SEQ ID NO: 51582 - DNA, 25 bp, S. cerevisiae
tgggtccctccatttacaaaactga

SEQ ID NO: 51583 - DNA, 25 bp, S. cerevisiae
tgggtcccaccttctaggagaggta

SEQ ID NO: 51584 - DNA, 25 bp, S. cerevisiae
tggtcttttgccattctttgcatac

SEQ ID NO: 51585 - DNA, 25 bp, S. cerevisiae
tgcactttgcacgtggcggagccat

SEQ ID NO: 51586 - DNA, 25 bp, S. cerevisiae
tcacattgtacagtgcttgggacga

SEQ ID NO: 51587 - DNA, 25 bp, S. cerevisiae
taatagtcaagtttgggtcccttcg

SEQ ID NO: 51588 - DNA, 25 bp, S. cerevisiae
tgaatacttacgctggtgggccttt

SEQ ID NO: 51589 - DNA, 25 bp, S. cerevisiae
tgtggcacaaggatttgggtctctt

SEQ ID NO: 51590 - DNA, 25 bp, S. cerevisiae
tgaggcacctggattagcgaatttc

SEQ ID NO: 51591 - DNA, 25 bp, S. cerevisiae
tgtgggctgcagaattggacgatat

SEQ ID NO: 51592 - DNA, 25 bp, S. cerevisiae
tggtgctcaacaattcagttctccc

SEQ ID NO: 51593 - DNA, 25 bp, S. cerevisiae
tggtctctcaattcatattcttacg

SEQ ID NO: 51594 - DNA, 25 bp, S. cerevisiae
tggttttatgtcacacattcgccct

SEQ ID NO: 51595 - DNA, 25 bp, S. cerevisiae
tggttttctatcaagtcacccctga

SEQ ID NO: 51596 - DNA, 25 bp, S. cerevisiae
tggtcttgtactaaggcacccaatg

SEQ ID NO: 51597 - DNA, 25 bp, S. cerevisiae
tggtgccttcaagagagctgttcta

SEQ ID NO: 51598 - DNA, 25 bp, S. cerevisiae
tgggcttaccgatgcaagtcactac

SEQ ID NO: 51599 - DNA, 25 bp, S. cerevisiae
tgggttaccttctatgaccactaca

SEQ ID NO: 51600 - DNA, 25 bp, S. cerevisiae
tgggagaagctcacaattccagtaa

SEQ ID NO: 51601 - DNA, 25 bp, S. cerevisiae
tgaggaggagacacacaaacttaat

SEQ ID NO: 51602 - DNA, 25 bp, S. cerevisiae
tggttttacgggtagctgtcgatca

SEQ ID NO: 51603 - DNA, 25 bp, S. cerevisiae
tgggaacttctgttaccttaactca

SEQ ID NO: 51604 - DNA, 25 bp, S. cerevisiae
tggtaccgccgctgacgagtatatc

SEQ ID NO: 51605 - DNA, 25 bp, S. cerevisiae
tggtattcccgctgatcaagtcact

SEQ ID NO: 51606 - DNA, 25 bp, S. cerevisiae
tggtattcccgctgatcaagtcact

SEQ ID NO: 51607 - DNA, 25 bp, S. cerevisiae
tcgtttcctaaatcagagtgccatt

SEQ ID NO: 51608 - DNA, 25 bp, S. cerevisiae
tggtgggcctatggttcgcagtact

SEQ ID NO: 51609 - DNA, 25 bp, S. cerevisiae
tggtggtgctccaggtggcgctgca

SEQ ID NO: 51610 - DNA, 25 bp, S. cerevisiae
ttgcggtcatcgaggacgacgaaga

SEQ ID NO: 51611 - DNA, 25 bp, S. cerevisiae
tggtgataactctcggatcctatgc

SEQ ID NO: 51612 - DNA, 25 bp, S. cerevisiae
tgtggtcgtgcattcaaggtcaaac

SEQ ID NO: 51613 - DNA, 25 bp, S. cerevisiae
tgtggagggtccgttgaacaaccta

SEQ ID NO: 51614 - DNA, 25 bp, S. cerevisiae
tgggagggttgcgtccaagttcctt

SEQ ID NO: 51615 - DNA, 25 bp, S. cerevisiae
tgggttcgtgactacaaaggttctt

SEQ ID NO: 51616 - DNA, 25 bp, S. cerevisiae
tgggttccacgataaagagctgtct

SEQ ID NO: 51617 - DNA, 25 bp, S. cerevisiae
tgggttcccctccaaagaggagcta

SEQ ID NO: 51618 - DNA, 25 bp, S. cerevisiae
tgggtttccgaccaacaagacgtat

SEQ ID NO: 51619 - DNA, 25 bp, S. cerevisiae
tgggtttcccctagcaaaattgact

SEQ ID NO: 51620 - DNA, 25 bp, S. cerevisiae
tgggttcctcccatatagtttatgt

SEQ ID NO: 51621 - DNA, 25 bp, S. cerevisiae
tgaggttacatcactttagtcttga

SEQ ID NO: 51622 - DNA, 25 bp, S. cerevisiae
tgggtttcatatgccctgttttcat

SEQ ID NO: 51623 - DNA, 25 bp, S. cerevisiae
tgattcctcccgaaaactttagcca

SEQ ID NO: 51624 - DNA, 25 bp, S. cerevisiae
tgttccgaccaaaacctttagtgag

SEQ ID NO: 51625 - DNA, 25 bp, S. cerevisiae
tggtaaagacaaaccctttcgagag

SEQ ID NO: 51626 - DNA, 25 bp, S. cerevisiae
tgggcacaccgaatgtatctctttg

SEQ ID NO: 51627 - DNA, 25 bp, S. cerevisiae
tgggagcccgcaataactatagaga

SEQ ID NO: 51628 - DNA, 25 bp, S. cerevisiae
tgtggaccctattgaccttaagata

SEQ ID NO: 51629 - DNA, 25 bp, S. cerevisiae
tgggaccccggatctctcaaatttt

SEQ ID NO: 51630 - DNA, 25 bp, S. cerevisiae
tgggacatcttccagaagctgcgaa

SEQ ID NO: 51631 - DNA, 25 bp, S. cerevisiae
tgggcacagcttactgagcctgaaa

SEQ ID NO: 51632 - DNA, 25 bp, S. cerevisiae
tggtatagcttcatctgcctggcaa

SEQ ID NO: 51633 - DNA, 25 bp, S. cerevisiae
tggtattctttccatccatgcgata

SEQ ID NO: 51634 - DNA, 25 bp, S. cerevisiae
tggtcactatcatttctgccatggg

SEQ ID NO: 51635 - DNA, 25 bp, S. cerevisiae
tggtccaataattcatccgggtcct

SEQ ID NO: 51636 - DNA, 25 bp, S. cerevisiae
tggtcaaatttgttcctctggttct

SEQ ID NO: 51637 - DNA, 25 bp, S. cerevisiae
tgggtaatcaccacttctcccgctt

SEQ ID NO: 51638 - DNA, 25 bp, S. cerevisiae
tggtgtttgtccaactttccctgtt

SEQ ID NO: 51639 - DNA, 25 bp, S. cerevisiae
tggtgcctctttaactttagtgtcc

SEQ ID NO: 51640 - DNA, 25 bp, S. cerevisiae
tgggcccgctaaaaacattctatta

SEQ ID NO: 51641 - DNA, 25 bp, S. cerevisiae
tggtactcacaagaagacgttataa

SEQ ID NO: 51642 - DNA, 25 bp, S. cerevisiae
tggtgactccagtgccaacgggaat

SEQ ID NO: 51643 - DNA, 25 bp, S. cerevisiae
tgtcgctactccacaagatgctcaa

SEQ ID NO: 51644 - DNA, 25 bp, S. cerevisiae
tgtgagtcatacttcccagaggaga

SEQ ID NO: 51645 - DNA, 25 bp, S. cerevisiae
tggtgtcatgagtacgccgatattc

SEQ ID NO: 51646 - DNA, 25 bp, S. cerevisiae
tgggtgataagaccactgctttctt

SEQ ID NO: 51647 - DNA, 25 bp, S. cerevisiae
tgtggctccaggacagacctgtctg

SEQ ID NO: 51648 - DNA, 25 bp, S. cerevisiae
taaagatgctgagccgccgttattt

SEQ ID NO: 51649 - DNA, 25 bp, S. cerevisiae
tctggagaggactcacacctactta

SEQ ID NO: 51650 - DNA, 25 bp, S. cerevisiae
tgggacaagactccccgaacttgga

SEQ ID NO: 51651 - DNA, 25 bp, S. cerevisiae
tggtgcgcaacggttcactaacgat

SEQ ID NO: 51652 - DNA, 25 bp, S. cerevisiae
tgggcgccattggatacggtcacgt

SEQ ID NO: 51653 - DNA, 25 bp, S. cerevisiae
tgggctactcagacattagggccaa

SEQ ID NO: 51654 - DNA, 25 bp, S. cerevisiae
tgggaactcagccaacagtagcgta

SEQ ID NO: 51655 - DNA, 25 bp, S. cerevisiae
tggtgaaccaccacgtaacatgata

SEQ ID NO: 51656 - DNA, 25 bp, S. cerevisiae
tgggttctcttgatgtttttacagc

SEQ ID NO: 51657 - DNA, 25 bp, S. cerevisiae
tggtggcttttacttgatgaatcgc

SEQ ID NO: 51658 - DNA, 25 bp, S. cerevisiae
tggtgagctttcgtctgtagatttt

SEQ ID NO: 51659 - DNA, 25 bp, S. cerevisiae
tggtgctctagctcgtgggactgaa

SEQ ID NO: 51660 - DNA, 25 bp, S. cerevisiae
tggtgccgctgctttgttgttgtaa

SEQ ID NO: 51661 - DNA, 25 bp, S. cerevisiae
tggtccatgctaccgtggtcaataa

SEQ ID NO: 51662 - DNA, 25 bp, S. cerevisiae
tggtcacaaatctagtatcctcgag

SEQ ID NO: 51663 - DNA, 25 bp, S. cerevisiae
tggtagcaatgctggtcgcaccgat

SEQ ID NO: 51664 - DNA, 25 bp, S. cerevisiae
tggtgttatcacctgctgggtattt

SEQ ID NO: 51665 - DNA, 25 bp, S. cerevisiae
tggtaatatcatccgctgtggcgat

SEQ ID NO: 51666 - DNA, 25 bp, S. cerevisiae
tgtggcaagtacatatgcgcctctt

SEQ ID NO: 51667 - DNA, 25 bp, S. cerevisiae
tgggtatgaatcacacgcactcagc

SEQ ID NO: 51668 - DNA, 25 bp, S. cerevisiae
tgggtatgatccagcaactgccact

SEQ ID NO: 51669 - DNA, 25 bp, S. cerevisiae
tgggtatatccaacctctatcaagt

SEQ ID NO: 51670 - DNA, 25 bp, S. cerevisiae
tggtgttccatacttttctgttcta

SEQ ID NO: 51671 - DNA, 25 bp, S. cerevisiae
tggtctgtactctatctatctttct

SEQ ID NO: 51672 - DNA, 25 bp, S. cerevisiae
tggtcctactacgatatcttctgca

SEQ ID NO: 51673 - DNA, 25 bp, S. cerevisiae
tgggactcctcgacatttaacaaat

SEQ ID NO: 51674 - DNA, 25 bp, S. cerevisiae
tggtgttgccgtccgtctagaagat

SEQ ID NO: 51675 - DNA, 25 bp, S. cerevisiae
tggtgtccacgttttgccaaagatc

SEQ ID NO: 51676 - DNA, 25 bp, S. cerevisiae
tggtgtacaacgcattccaaagaca

SEQ ID NO: 51677 - DNA, 25 bp, S. cerevisiae
tgggctaaccaagattcaactttct

SEQ ID NO: 51678 - DNA, 25 bp, S. cerevisiae
tgggctactccaaggaccaagtttt

SEQ ID NO: 51679 - DNA, 25 bp, S. cerevisiae
tggtggtacatctgtcttgcacaac

SEQ ID NO: 51680 - DNA, 25 bp, S. cerevisiae
tgctacccaagcaggtgtccgggaa

SEQ ID NO: 51681 - DNA, 25 bp, S. cerevisiae
tgtacaggtccatccttctaggaaa

SEQ ID NO: 51682 - DNA, 25 bp, S. cerevisiae
tggtgctttgatggccctactaggt

SEQ ID NO: 51683 - DNA, 25 bp, S. cerevisiae
tgtgcactcctatgccatgaattat

SEQ ID NO: 51684 - DNA, 25 bp, S. cerevisiae
tgtggccgctgaagacaaacatctg

SEQ ID NO: 51685 - DNA, 25 bp, S. cerevisiae
tgggccgatatcgtaggatcagctt

SEQ ID NO: 51686 - DNA, 25 bp, S. cerevisiae
tggtgccaagcctcaagtggtacat

SEQ ID NO: 51687 - DNA, 25 bp, S. cerevisiae
tggtgcaaatgtccccacagttaat

SEQ ID NO: 51688 - DNA, 25 bp, S. cerevisiae
tgtgacaaattccaccctttgcaag

SEQ ID NO: 51689 - DNA, 25 bp, S. cerevisiae
tgtgaaaaccgaccctactacaaag

SEQ ID NO: 51690 - DNA, 25 bp, S. cerevisiae
tgtgacgaaccttgacctggtacgt

SEQ ID NO: 51691 - DNA, 25 bp, S. cerevisiae
tgtgacgtcgtttatattggccctt

SEQ ID NO: 51692 - DNA, 25 bp, S. cerevisiae
tgggcgtcgttattgcaaactctct

SEQ ID NO: 51693 - DNA, 25 bp, S. cerevisiae
tgggtctaacggtccatccaatctt

SEQ ID NO: 51694 - DNA, 25 bp, S. cerevisiae
tgggttggaaccgacatccgactat

SEQ ID NO: 51695 - DNA, 25 bp, S. cerevisiae
tgggtatttccagaagcctcctatt

SEQ ID NO: 51696 - DNA, 25 bp, S. cerevisiae
tggggcatacgcacacggatgctac

SEQ ID NO: 51697 - DNA, 25 bp, S. cerevisiae
tgtgggcaacagtacggcaattacc

SEQ ID NO: 51698 - DNA, 25 bp, S. cerevisiae
tgacttcgcaaccttcgaggacgaa

SEQ ID NO: 51699 - DNA, 25 bp, S. cerevisiae
tgtcccgcaaacatcgaaactgtta

SEQ ID NO: 51700 - DNA, 25 bp, S. cerevisiae
tgtccactggcatcttccaaaggat

SEQ ID NO: 51701 - DNA, 25 bp, S. cerevisiae
tgggcacttgacatttcaacggcaa

SEQ ID NO: 51702 - DNA, 25 bp, S. cerevisiae
tgtcgggtttttcacacggattaat

SEQ ID NO: 51703 - DNA, 25 bp, S. cerevisiae
tgtaatgaagatgtgcaggcccctg

SEQ ID NO: 51704 - DNA, 25 bp, S. cerevisiae
tgtcagatacagtcaagaggagcct

SEQ ID NO: 51705 - DNA, 25 bp, S. cerevisiae
tggtgctatcgccaaggatgacttg

SEQ ID NO: 51706 - DNA, 25 bp, S. cerevisiae
tggtgccattggtatggtctgctgt

SEQ ID NO: 51707 - DNA, 25 bp, S. cerevisiae
tggtgctatcttcctaggcatgtat

SEQ ID NO: 51708 - DNA, 25 bp, S. cerevisiae
tggtgcgacattcctgacgtttgaa

SEQ ID NO: 51709 - DNA, 25 bp, S. cerevisiae
tggtgactgtggtagtgctctacaa

SEQ ID NO: 51710 - DNA, 25 bp, S. cerevisiae
tggtgactgtggtagcgctttgcaa

SEQ ID NO: 51711 - DNA, 25 bp, S. cerevisiae
tgggttcagagcctccatctataac

SEQ ID NO: 51712 - DNA, 25 bp, S. cerevisiae
tggtgcaggcggttcattttcaatg

SEQ ID NO: 51713 - DNA, 25 bp, S. cerevisiae
tgtcctatttccaccacagaatcga

SEQ ID NO: 51714 - DNA, 25 bp, S. cerevisiae
tggtgcttcctctattgtcattgaa

SEQ ID NO: 51715 - DNA, 25 bp, S. cerevisiae
tggtcctccctatctagtgctactg

SEQ ID NO: 51716 - DNA, 25 bp, S. cerevisiae
tggtccttcgcttactgaacatttg

SEQ ID NO: 51717 - DNA, 25 bp, S. cerevisiae
tgggccttcgtcaactactgtggtg

SEQ ID NO: 51718 - DNA, 25 bp, S. cerevisiae
tggtgccgccgctctattgttatag

SEQ ID NO: 51719 - DNA, 25 bp, S. cerevisiae
tgggtgtcaccggtttgagattcaa

SEQ ID NO: 51720 - DNA, 25 bp, S. cerevisiae
tctcgttacctggagttggacctaa

SEQ ID NO: 51721 - DNA, 25 bp, S. cerevisiae
tgtcgtacaacggaatagggctcaa

SEQ ID NO: 51722 - DNA, 25 bp, S. cerevisiae
tgtcccatacacttactgtcattgt

SEQ ID NO: 51723 - DNA, 25 bp, S. cerevisiae
tgggctaagaagattgctcaacgtg

SEQ ID NO: 51724 - DNA, 25 bp, S. cerevisiae
tgggcctaaatggtcgctcgtcgga

SEQ ID NO: 51725 - DNA, 25 bp, S. cerevisiae
tggtcgctaccaaatctcacagatt

SEQ ID NO: 51726 - DNA, 25 bp, S. cerevisiae
tgggtccccaaaatcaccttatagt

SEQ ID NO: 51727 - DNA, 25 bp, S. cerevisiae
tgggagttccatagaatgcccgaaa

SEQ ID NO: 51728 - DNA, 25 bp, S. cerevisiae
tgggattgtatggtctcaccacacc

SEQ ID NO: 51729 - DNA, 25 bp, S. cerevisiae
tggtggtatatcaattcccgaaatt

SEQ ID NO: 51730 - DNA, 25 bp, S. cerevisiae
tgggcctcaatacttctcctaatag

SEQ ID NO: 51731 - DNA, 25 bp, S. cerevisiae
tgggcgtcgggttcatcgctaagat

SEQ ID NO: 51732 - DNA, 25 bp, S. cerevisiae
tggtcctttgtcatcaagccaagaa

SEQ ID NO: 51733 - DNA, 25 bp, S. cerevisiae
tggtgcctttggactcagctactat

SEQ ID NO: 51734 - DNA, 25 bp, S. cerevisiae
tggtggtatgatccccgcaagaatt

SEQ ID NO: 51735 - DNA, 25 bp, S. cerevisiae
tggtggtttcattcctgctaggatc

SEQ ID NO: 51736 - DNA, 25 bp, S. cerevisiae
tggtcctttaggtctatcgccaaag

SEQ ID NO: 51737 - DNA, 25 bp, S. cerevisiae
tgggtctggcacactgatgcagaaa

SEQ ID NO: 51738 - DNA, 25 bp, S. cerevisiae
tgggcctctgtccagcaagatgaag

SEQ ID NO: 51739 - DNA, 25 bp, S. cerevisiae
tgggtcatctactacaagtgcgtgt

SEQ ID NO: 51740 - DNA, 25 bp, S. cerevisiae
tgggatgcacaactaagcagacagt

SEQ ID NO: 51741 - DNA, 25 bp, S. cerevisiae
tggtgacacaactcagaaagctggt

SEQ ID NO: 51742 - DNA, 25 bp, S. cerevisiae
tggtgctccagtctatctaactgct

SEQ ID NO: 51743 - DNA, 25 bp, S. cerevisiae
tggtgctccagtctacttgactgct

SEQ ID NO: 51744 - DNA, 25 bp, S. cerevisiae
tggtccaatctcttctttggtcgac

SEQ ID NO: 51745 - DNA, 25 bp, S. cerevisiae
tggtggaggctgtactttggtcaaa

SEQ ID NO: 51746 - DNA, 25 bp, S. cerevisiae
tgtgcttacgctgtggtggtccaaa

SEQ ID NO: 51747 - DNA, 25 bp, S. cerevisiae
tgggtatcccattgacaggtcctaa

SEQ ID NO: 51748 - DNA, 25 bp, S. cerevisiae
tggtgtcacccaagtccgtgtcgaa

SEQ ID NO: 51749 - DNA, 25 bp, S. cerevisiae
tggtggtatttttcgtcttcatgta

SEQ ID NO: 51750 - DNA, 25 bp, S. cerevisiae
tggtgttattttagttttcattttg

SEQ ID NO: 51751 - DNA, 25 bp, S. cerevisiae
tgtttcttgagtatttcccgtggta

SEQ ID NO: 51752 - DNA, 25 bp, S. cerevisiae
tgtctttggataacttaccgggcgt

SEQ ID NO: 51753 - DNA, 25 bp, S. cerevisiae
tgcttctatgaacacttatcccggg

SEQ ID NO: 51754 - DNA, 25 bp, S. cerevisiae
tgtgcgctagaacagttactgctcc

SEQ ID NO: 51755 - DNA, 25 bp, S. cerevisiae
tgtggcgaaattcctgtacccaatt

SEQ ID NO: 51756 - DNA, 25 bp, S. cerevisiae
tgtacgaaaatgcacctcctccaga

SEQ ID NO: 51757 - DNA, 25 bp, S. cerevisiae
tgtgaaattagtcctcaaccccaga

SEQ ID NO: 51758 - DNA, 25 bp, S. cerevisiae
tggtgaaattgtttccatcaaccaa

SEQ ID NO: 51759 - DNA, 25 bp, S. cerevisiae
tggtgcaatattcccacacacaaca

SEQ ID NO: 51760 - DNA, 25 bp, S. cerevisiae
tggtgaatttttccattgttcccca

SEQ ID NO: 51761 - DNA, 25 bp, S. cerevisiae
tgggcggctttatcgtttacgtcaa

SEQ ID NO: 51762 - DNA, 25 bp, S. cerevisiae
tgcgaagtttccgctttcggtcaaa

SEQ ID NO: 51763 - DNA, 25 bp, S. cerevisiae
tgataagttttcagttccgttacca

SEQ ID NO: 51764 - DNA, 25 bp, S. cerevisiae
tggtgaagccggtgaccccgagcat

SEQ ID NO: 51765 - DNA, 25 bp, S. cerevisiae
tggtgaagtcggtgcttccgccgcc

SEQ ID NO: 51766 - DNA, 25 bp, S. cerevisiae
tggtgaagtcggtgcctccgctgct

SEQ ID NO: 51767 - DNA, 25 bp, S. cerevisiae
tggtgtcttcggtgctgccgtcgct

SEQ ID NO: 51768 - DNA, 25 bp, S. cerevisiae
tgtggcatttcttgggctatttatc

SEQ ID NO: 51769 - DNA, 25 bp, S. cerevisiae
tgtagtgttattcagtcattcaact

SEQ ID NO: 51770 - DNA, 25 bp, S. cerevisiae
tttcatcttgtttcggacaaccctt

SEQ ID NO: 51771 - DNA, 25 bp, S. cerevisiae
tgtgtacgtgtctggtcaaatccct

SEQ ID NO: 51772 - DNA, 25 bp, S. cerevisiae
tgtgtgatgttttcggtcaacccat

SEQ ID NO: 51773 - DNA, 25 bp, S. cerevisiae
tgtgggtctgacttgcaaagcgcca

SEQ ID NO: 51774 - DNA, 25 bp, S. cerevisiae
tgtaagtgctggtgcctagcttcag

SEQ ID NO: 51775 - DNA, 25 bp, S. cerevisiae
tgtaaccatggtctcatcgctaaac

SEQ ID NO: 51776 - DNA, 25 bp, S. cerevisiae
tgtcctcgatggcttccgaaatggc

SEQ ID NO: 51777 - DNA, 25 bp, S. cerevisiae
tgtccccatggacgtccaacaatga

SEQ ID NO: 51778 - DNA, 25 bp, S. cerevisiae
tgtcctccactgacgtcaacgagaa

SEQ ID NO: 51779 - DNA, 25 bp, S. cerevisiae
tggtgcttccagacgtacagctaaa

SEQ ID NO: 51780 - DNA, 25 bp, S. cerevisiae
tgggagaccatacacaccgaattat

SEQ ID NO: 51781 - DNA, 25 bp, S. cerevisiae
tggtgactctttgggagccgttcaa

SEQ ID NO: 51782 - DNA, 25 bp, S. cerevisiae
tggtgacacttttcagtgctccgaa

SEQ ID NO: 51783 - DNA, 25 bp, S. cerevisiae
tggtgacaccgttcaattcgccgag

SEQ ID NO: 51784 - DNA, 25 bp, S. cerevisiae
tgtggccatggtgcataacaacgct

SEQ ID NO: 51785 - DNA, 25 bp, S. cerevisiae
tgtcaccgacccaagatcagatgct

SEQ ID NO: 51786 - DNA, 25 bp, S. cerevisiae
tgtctcactatccacagatgatcct

SEQ ID NO: 51787 - DNA, 25 bp, S. cerevisiae
tgggtgctgcttatcatttcatggg

SEQ ID NO: 51788 - DNA, 25 bp, S. cerevisiae
tgggttcattcttttgcttttcatc

SEQ ID NO: 51789 - DNA, 25 bp, S. cerevisiae
tgctcctcccacactggtttggtca

SEQ ID NO: 51790 - DNA, 25 bp, S. cerevisiae
tgttacaacccatgcaaactttttt

SEQ ID NO: 51791 - DNA, 25 bp, S. cerevisiae
tttactacaaatcagcaagcgaccg

SEQ ID NO: 51792 - DNA, 25 bp, S. cerevisiae
tgggctaccatttcggacctagtga

SEQ ID NO: 51793 - DNA, 25 bp, S. cerevisiae
tgggctatactatcggtgcctatat

SEQ ID NO: 51794 - DNA, 25 bp, S. cerevisiae
tgggactatttgcttcttcactctt

SEQ ID NO: 51795 - DNA, 25 bp, S. cerevisiae
tgtaactttgttctcttcctttcag

SEQ ID NO: 51796 - DNA, 25 bp, S. cerevisiae
tggtgttgtttaccatccatccaac

SEQ ID NO: 51797 - DNA, 25 bp, S. cerevisiae
tgtgcgtgcgttacttcaagcttta

SEQ ID NO: 51798 - DNA, 25 bp, S. cerevisiae
tgtgccgctgatgacttagacgcta

SEQ ID NO: 51799 - DNA, 25 bp, S. cerevisiae
tttggatgggactcggcttgacact

SEQ ID NO: 51800 - DNA, 25 bp, S. cerevisiae
tgtattctgtggtaacgccgttaat

SEQ ID NO: 51801 - DNA, 25 bp, S. cerevisiae
tgtagtcgatgtatacgccggagta

SEQ ID NO: 51802 - DNA, 25 bp, S. cerevisiae
tgtgaacactttacttacgcaactt

SEQ ID NO: 51803 - DNA, 25 bp, S. cerevisiae
tgtgcagacccattagattactacg

SEQ ID NO: 51804 - DNA, 25 bp, S. cerevisiae
tgtcagccaccttgaaagactactt

SEQ ID NO: 51805 - DNA, 25 bp, S. cerevisiae
tgtcgagacctctactactgtggaa

SEQ ID NO: 51806 - DNA, 25 bp, S. cerevisiae
tgtccaaactctaccggtgcagaat

SEQ ID NO: 51807 - DNA, 25 bp, S. cerevisiae
ttcgaaatatttgcctttggaaaca

SEQ ID NO: 51808 - DNA, 25 bp, S. cerevisiae
tggtgaccaattttccgctatgttc

SEQ ID NO: 51809 - DNA, 25 bp, S. cerevisiae
tgggtgtctcactagtgcacggctt

SEQ ID NO: 51810 - DNA, 25 bp, S. cerevisiae
tggtgatttcacaactgctgatagt

SEQ ID NO: 51811 - DNA, 25 bp, S. cerevisiae
tggtgtctacaatctcttcatcatc

SEQ ID NO: 51812 - DNA, 25 bp, S. cerevisiae
tgggtcatcacaaatttcatcatcg

SEQ ID NO: 51813 - DNA, 25 bp, S. cerevisiae
tgtgatatcattgccaagtcgctgg

SEQ ID NO: 51814 - DNA, 25 bp, S. cerevisiae
tggtgtcttgctccgaatcgtgaac

SEQ ID NO: 51815 - DNA, 25 bp, S. cerevisiae
tggtgtcgccgctgcaccagctacc

SEQ ID NO: 51816 - DNA, 25 bp, S. cerevisiae
tggtgtcgccgctgcaccagctacc

SEQ ID NO: 51817 - DNA, 25 bp, S. cerevisiae
tggtgtcgctgctgccccagccacc

SEQ ID NO: 51818 - DNA, 25 bp, S. cerevisiae
tggtgtcgctgctgccccagccacc

SEQ ID NO: 51819 - DNA, 25 bp, S. cerevisiae
tggtgtcctagagcccgtgcaaaat

SEQ ID NO: 51820 - DNA, 25 bp, S. cerevisiae
ttcgatttacctacgacggctaagt

SEQ ID NO: 51821 - DNA, 25 bp, S. cerevisiae
ttcgaggctaccaacggcgttaagg

SEQ ID NO: 51822 - DNA, 25 bp, S. cerevisiae
tgtgcagagcccaaaacgtcatgtt

SEQ ID NO: 51823 - DNA, 25 bp, S. cerevisiae
tgtgtcgtcactaaagatggcatct

SEQ ID NO: 51824 - DNA, 25 bp, S. cerevisiae
tgggctcctctatgatattgacctt

SEQ ID NO: 51825 - DNA, 25 bp, S. cerevisiae
tgtggtctgttgttattccgccaaa

SEQ ID NO: 51826 - DNA, 25 bp, S. cerevisiae
tgtccctggtttatccgcaaatgaa

SEQ ID NO: 51827 - DNA, 25 bp, S. cerevisiae
tgtcgattcgttattccatgccata

SEQ ID NO: 51828 - DNA, 25 bp, S. cerevisiae
tgctcgtggttcctacttgcgtgtt

SEQ ID NO: 51829 - DNA, 25 bp, S. cerevisiae
tgtaacagcgacgacaaatgcccct

SEQ ID NO: 51830 - DNA, 25 bp, S. cerevisiae
tgggatcagaacaacaacagaccgt

SEQ ID NO: 51831 - DNA, 25 bp, S. cerevisiae
tgtaaagagcgtcaacgacccttcg

SEQ ID NO: 51832 - DNA, 25 bp, S. cerevisiae
tgtacgacaaatgaaccgcctggcc

SEQ ID NO: 51833 - DNA, 25 bp, S. cerevisiae
tgtatctacaaagtccaagccgaag

SEQ ID NO: 51834 - DNA, 25 bp, S. cerevisiae
tgtcacagattcgacggattctcct

SEQ ID NO: 51835 - DNA, 25 bp, S. cerevisiae
tgtccgattcaaggtgggtcactgc

SEQ ID NO: 51836 - DNA, 25 bp, S. cerevisiae
tcatttcctccggtaaggactggga

SEQ ID NO: 51837 - DNA, 25 bp, S. cerevisiae
tgatttccttggttaacaacggtgt

SEQ ID NO: 51838 - DNA, 25 bp, S. cerevisiae
tgtgttacgcccacaaaccggtatg

SEQ ID NO: 51839 - DNA, 25 bp, S. cerevisiae
tgtatggtccctattggcaccgact

SEQ ID NO: 51840 - DNA, 25 bp, S. cerevisiae
tgtaactacgttttggctccagaaa

SEQ ID NO: 51841 - DNA, 25 bp, S. cerevisiae
tgtccaaggctggtaagttcccaac

SEQ ID NO: 51842 - DNA, 25 bp, S. cerevisiae
tgtcccgtgtctatatatatccatt

SEQ ID NO: 51843 - DNA, 25 bp, S. cerevisiae
tgtagccgtatctcaaccaatgttt

SEQ ID NO: 51844 - DNA, 25 bp, S. cerevisiae
tgttacccaagctcgtgttatcact

SEQ ID NO: 51845 - DNA, 25 bp, S. cerevisiae
tgttttcctaccagctttgtgtaag

SEQ ID NO: 51846 - DNA, 25 bp, S. cerevisiae
tgatacagacaataaaggtgttctt

SEQ ID NO: 51847 - DNA, 25 bp, S. cerevisiae
tgtcggccaagacacgcaaaatctt

SEQ ID NO: 51848 - DNA, 25 bp, S. cerevisiae
tgggagcacaacctagcgaaacagt

SEQ ID NO: 51849 - DNA, 25 bp, S. cerevisiae
tgtggatatcccctttgaaacgaaa

SEQ ID NO: 51850 - DNA, 25 bp, S. cerevisiae
tgtggtgttcctctatactcggaaa

SEQ ID NO: 51851 - DNA, 25 bp, S. cerevisiae
tgggaccttttggattcgaatcacg

SEQ ID NO: 51852 - DNA, 25 bp, S. cerevisiae
tgtgtagcctccatcgttcgatata

SEQ ID NO: 51853 - DNA, 25 bp, S. cerevisiae
tgaaaggaaaccagttaatcactag

SEQ ID NO: 51854 - DNA, 25 bp, S. cerevisiae
tgtcgccttggcgttgggaattcaa

SEQ ID NO: 51855 - DNA, 25 bp, S. cerevisiae
tgtccctgtggagataggtttcaaa

SEQ ID NO: 51856 - DNA, 25 bp, S. cerevisiae
tgttgaaaagattccctacccctat

SEQ ID NO: 51857 - DNA, 25 bp, S. cerevisiae
tgttgtgaaaggatactccccgtga

SEQ ID NO: 51858 - DNA, 25 bp, S. cerevisiae
tgttttaagcggagccaccctgtta

SEQ ID NO: 51859 - DNA, 25 bp, S. cerevisiae
tgggtgtcgtcaaacaggatgccgt

SEQ ID NO: 51860 - DNA, 25 bp, S. cerevisiae
tgggtccaccatatagagagccgat

SEQ ID NO: 51861 - DNA, 25 bp, S. cerevisiae
tgggttcctatattcaagagctggg

SEQ ID NO: 51862 - DNA, 25 bp, S. cerevisiae
tgggactcactagctcaaggactgg

SEQ ID NO: 51863 - DNA, 25 bp, S. cerevisiae
tgggatccaaagactcacaagttaa

SEQ ID NO: 51864 - DNA, 25 bp, S. cerevisiae
tgtgttccagttgccaatcagttca

SEQ ID NO: 51865 - DNA, 25 bp, S. cerevisiae
tgcttattctatctggaagggccca

SEQ ID NO: 51866 - DNA, 25 bp, S. cerevisiae
ttctaggttgatgaaagtcccaata

SEQ ID NO: 51867 - DNA, 25 bp, S. cerevisiae
tgttatgtcccaaaaagttcaccta

SEQ ID NO: 51868 - DNA, 25 bp, S. cerevisiae
tgttttcgccgaaaccttgaagcat

SEQ ID NO: 51869 - DNA, 25 bp, S. cerevisiae
tgtctattctgggaaaacctggctc

SEQ ID NO: 51870 - DNA, 25 bp, S. cerevisiae
tgtcttcttcagcaaaaacgggtac

SEQ ID NO: 51871 - DNA, 25 bp, S. cerevisiae
tgtttttgcacatgaaaccgtcccc

SEQ ID NO: 51872 - DNA, 25 bp, S. cerevisiae
tgtttgtccaactttccctgttgtc

SEQ ID NO: 51873 - DNA, 25 bp, S. cerevisiae
tgtctgtcgacttgggaaccggtga

SEQ ID NO: 51874 - DNA, 25 bp, S. cerevisiae
tgtgatttcaaacggaacagccttc

SEQ ID NO: 51875 - DNA, 25 bp, S. cerevisiae
tgtgttaaccacttgaaatgtcttc

SEQ ID NO: 51876 - DNA, 25 bp, S. cerevisiae
tgaggaagacgtcatgtatgcctaa

SEQ ID NO: 51877 - DNA, 25 bp, S. cerevisiae
tgggaattgccccaacatccagttc

SEQ ID NO: 51878 - DNA, 25 bp, S. cerevisiae
tgtctctttgccgattggctaacga

SEQ ID NO: 51879 - DNA, 25 bp, S. cerevisiae
tgtctctttcctatacatactgtga

SEQ ID NO: 51880 - DNA, 25 bp, S. cerevisiae
tgtttggtcttttcttacttctacg

SEQ ID NO: 51881 - DNA, 25 bp, S. cerevisiae
tgttacgacttttaccaggtgcgca

SEQ ID NO: 51882 - DNA, 25 bp, S. cerevisiae
tgtcttagacatgctcctgcctgag

SEQ ID NO: 51883 - DNA, 25 bp, S. cerevisiae
tgtggtaagagcacctgccgatgtt

SEQ ID NO: 51884 - DNA, 25 bp, S. cerevisiae
tgggtcacaacttactacgcatggt

SEQ ID NO: 51885 - DNA, 25 bp, S. cerevisiae
tgggaacacgcctactacttgcagt

SEQ ID NO: 51886 - DNA, 25 bp, S. cerevisiae
tgggcccgtggtttatcattcaaag

SEQ ID NO: 51887 - DNA, 25 bp, S. cerevisiae
tgttacgggcctttcaagcaatgta

SEQ ID NO: 51888 - DNA, 25 bp, S. cerevisiae
tgttagggtcggttactacgtgaat

SEQ ID NO: 51889 - DNA, 25 bp, S. cerevisiae
tcttctttggtggtgtttactacgt

SEQ ID NO: 51890 - DNA, 25 bp, S. cerevisiae
tgtgaagctattctcccggatgtac

SEQ ID NO: 51891 - DNA, 25 bp, S. cerevisiae
tgtagcgtgttcagcaactggccta

SEQ ID NO: 51892 - DNA, 25 bp, S. cerevisiae
tgtggacttacttgacgatgaaccc

SEQ ID NO: 51893 - DNA, 25 bp, S. cerevisiae
tgtacaacggtgtccaacaactgtt

SEQ ID NO: 51894 - DNA, 25 bp, S. cerevisiae
tgtcactattcgtaccagaaaggtt

SEQ ID NO: 51895 - DNA, 25 bp, S. cerevisiae
tgtctttatcgtcccaggtagcaat

SEQ ID NO: 51896 - DNA, 25 bp, S. cerevisiae
tgtcttctgggacccagcatgtgtt

SEQ ID NO: 51897 - DNA, 25 bp, S. cerevisiae
tgtcttatggaacaggtggcctctc

SEQ ID NO: 51898 - DNA, 25 bp, S. cerevisiae
tgtgctggaaatacgggtgaccttc

SEQ ID NO: 51899 - DNA, 25 bp, S. cerevisiae
tgtctggatctggtctatcggtatc

SEQ ID NO: 51900 - DNA, 25 bp, S. cerevisiae
ttgggattcctaccgcgtactaaga

SEQ ID NO: 51901 - DNA, 25 bp, S. cerevisiae
tgggcgagtcgttcatcttattcac

SEQ ID NO: 51902 - DNA, 25 bp, S. cerevisiae
tgggcgactcgttgttcatttacag

SEQ ID NO: 51903 - DNA, 25 bp, S. cerevisiae
tgggcctcctgttttcgttgacgaa

SEQ ID NO: 51904 - DNA, 25 bp, S. cerevisiae
tgggcctttttgactcgtgtatcga

SEQ ID NO: 51905 - DNA, 25 bp, S. cerevisiae
tgggccttttcaacaagctgtctca

SEQ ID NO: 51906 - DNA, 25 bp, S. cerevisiae
tgtcattcccctttggtagcattta

SEQ ID NO: 51907 - DNA, 25 bp, S. cerevisiae
tgtgcttccagcactttgtttgaag

SEQ ID NO: 51908 - DNA, 25 bp, S. cerevisiae
tgtgtcctggattgtttttcctcat

SEQ ID NO: 51909 - DNA, 25 bp, S. cerevisiae
tgtggcgctggttatatgtgctata

SEQ ID NO: 51910 - DNA, 25 bp, S. cerevisiae
tgtgcccatcctcgcggttagaaag

SEQ ID NO: 51911 - DNA, 25 bp, S. cerevisiae
tgtatctagtgcaagttcgagtaaa

SEQ ID NO: 51912 - DNA, 25 bp, S. cerevisiae
tgggctgccatctacgtgggtaaga

SEQ ID NO: 51913 - DNA, 25 bp, S. cerevisiae
tgggctccttccattggtagatggt

SEQ ID NO: 51914 - DNA, 25 bp, S. cerevisiae
tgtggctcacgggtttgcagcaaga

SEQ ID NO: 51915 - DNA, 25 bp, S. cerevisiae
tgggacacgaatgcatctcaaagag

SEQ ID NO: 51916 - DNA, 25 bp, S. cerevisiae
tgggcacatatacgccattaatata

SEQ ID NO: 51917 - DNA, 25 bp, S. cerevisiae
tgtggtaaaggccatctgcgattat

SEQ ID NO: 51918 - DNA, 25 bp, S. cerevisiae
tgggcacttttgtctcacatactgt

SEQ ID NO: 51919 - DNA, 25 bp, S. cerevisiae
tgggcacaaatttcacactcgcatt

SEQ ID NO: 51920 - DNA, 25 bp, S. cerevisiae
tgggccaggaattccagctgaaaca

SEQ ID NO: 51921 - DNA, 25 bp, S. cerevisiae
tgggccaaatgatcatcctacacgc

SEQ ID NO: 51922 - DNA, 25 bp, S. cerevisiae
tgtcgtttggaaggtgtcactgtct

SEQ ID NO: 51923 - DNA, 25 bp, S. cerevisiae
tgtgcagcgatacaatcagttacgt

SEQ ID NO: 51924 - DNA, 25 bp, S. cerevisiae
tgtgctgaagagtcctttctttgcc

SEQ ID NO: 51925 - DNA, 25 bp, S. cerevisiae
tgtgcaatctggtagaaggcccgtt

SEQ ID NO: 51926 - DNA, 25 bp, S. cerevisiae
tgtgctatccggtaagcccaaatat

SEQ ID NO: 51927 - DNA, 25 bp, S. cerevisiae
tgttatccgggaacctgacaagaca

SEQ ID NO: 51928 - DNA, 25 bp, S. cerevisiae
tgtttacccagtccctgaggaaata

SEQ ID NO: 51929 - DNA, 25 bp, S. cerevisiae
tgtttccagcactcacaaagacact

SEQ ID NO: 51930 - DNA, 25 bp, S. cerevisiae
tgtggttccacttcattcaagagat

SEQ ID NO: 51931 - DNA, 25 bp, S. cerevisiae
tgtcccctcccactggaaagaagat

SEQ ID NO: 51932 - DNA, 25 bp, S. cerevisiae
tgttcactctcaaaaatcccttcaa

SEQ ID NO: 51933 - DNA, 25 bp, S. cerevisiae
tgcttacgctgctagatgggttgcc

SEQ ID NO: 51934 - DNA, 25 bp, S. cerevisiae
tgatatcagcgcgatgcagccggtg

SEQ ID NO: 51935 - DNA, 25 bp, S. cerevisiae
tgtatcgacctcctgcagaaatgca

SEQ ID NO: 51936 - DNA, 25 bp, S. cerevisiae
tgtgacaccctcctcagagagagaa

SEQ ID NO: 51937 - DNA, 25 bp, S. cerevisiae
tgtcaaccagtgctccgagtgagaa

SEQ ID NO: 51938 - DNA, 25 bp, S. cerevisiae
tgatgaacacaacgcacctaatagc

SEQ ID NO: 51939 - DNA, 25 bp, S. cerevisiae
tgtaatacaattccgctcaagcata

SEQ ID NO: 51940 - DNA, 25 bp, S. cerevisiae
tgtgcactacattcccaccagatta

SEQ ID NO: 51941 - DNA, 25 bp, S. cerevisiae
tgtcatcatgacttccaatctaggt

SEQ ID NO: 51942 - DNA, 25 bp, S. cerevisiae
tgataatggtctgcgattcgatgtc

SEQ ID NO: 51943 - DNA, 25 bp, S. cerevisiae
tgtcttggttgtccatctcgatatt

SEQ ID NO: 51944 - DNA, 25 bp, S. cerevisiae
tgtcctgatgctgtgacctactata

SEQ ID NO: 51945 - DNA, 25 bp, S. cerevisiae
tgtggagctgttgcctcactacaaa

SEQ ID NO: 51946 - DNA, 25 bp, S. cerevisiae
tgtgcagagccttgtatcctttgta

SEQ ID NO: 51947 - DNA, 25 bp, S. cerevisiae
tgtgcgcatcacatattccatttgt

SEQ ID NO: 51948 - DNA, 25 bp, S. cerevisiae
tgtcaccctcaattattttcataga

SEQ ID NO: 51949 - DNA, 25 bp, S. cerevisiae
tgtgtttgtacatttggccttatag

SEQ ID NO: 51950 - DNA, 25 bp, S. cerevisiae
tgttgttctattgtgaggcctgtac

SEQ ID NO: 51951 - DNA, 25 bp, S. cerevisiae
tgtcattttatccactaccggtcat

SEQ ID NO: 51952 - DNA, 25 bp, S. cerevisiae
tgggctgatattttcctgattgcgc

SEQ ID NO: 51953 - DNA, 25 bp, S. cerevisiae
tgggctatttttgcagctgtcttag

SEQ ID NO: 51954 - DNA, 25 bp, S. cerevisiae
tgggcatttatttcgagtatctcta

SEQ ID NO: 51955 - DNA, 25 bp, S. cerevisiae
tgtgaatttgtaggcgttggtcccg

SEQ ID NO: 51956 - DNA, 25 bp, S. cerevisiae
tgaattttcggaactggaagccagt

SEQ ID NO: 51957 - DNA, 25 bp, S. cerevisiae
tgtgacttagtcattctgctagaag

SEQ ID NO: 51958 - DNA, 25 bp, S. cerevisiae
tgggcagtggccgtctctcctagat

SEQ ID NO: 51959 - DNA, 25 bp, S. cerevisiae
tgggctcggcagttactactattat

SEQ ID NO: 51960 - DNA, 25 bp, S. cerevisiae
tgtggccgcaaggttctactctgaa

SEQ ID NO: 51961 - DNA, 25 bp, S. cerevisiae
ttccggtaagcttctccgattagaa

SEQ ID NO: 51962 - DNA, 25 bp, S. cerevisiae
tgtccggtactttctacaacttgta

SEQ ID NO: 51963 - DNA, 25 bp, S. cerevisiae
tgtccgcgggcctcataagagttgt

SEQ ID NO: 51964 - DNA, 25 bp, S. cerevisiae
tgtccgccgacctacatagagaatt

SEQ ID NO: 51965 - DNA, 25 bp, S. cerevisiae
tgtacgcccaaaagtagtgactctt

SEQ ID NO: 51966 - DNA, 25 bp, S. cerevisiae
tgtaaagctactttgtctaccctct

SEQ ID NO: 51967 - DNA, 25 bp, S. cerevisiae
tgggcggacaagataccatctctgc

SEQ ID NO: 51968 - DNA, 25 bp, S. cerevisiae
tgggctccacagacatcacagaatt

SEQ ID NO: 51969 - DNA, 25 bp, S. cerevisiae
tgggctgctcaacactggacatgga

SEQ ID NO: 51970 - DNA, 25 bp, S. cerevisiae
tgtggcttcaactgcatgggatgga

SEQ ID NO: 51971 - DNA, 25 bp, S. cerevisiae
tgtcgttgaatctggcatgcgcaaa

SEQ ID NO: 51972 - DNA, 25 bp, S. cerevisiae
tgtcttttacaaatcccatccttag

SEQ ID NO: 51973 - DNA, 25 bp, S. cerevisiae
tgtgtattactgctatgccctgcga

SEQ ID NO: 51974 - DNA, 25 bp, S. cerevisiae
tgtctgttgattcgttgtcctgcac

SEQ ID NO: 51975 - DNA, 25 bp, S. cerevisiae
tgtcactgtgtacttgatggcctca

SEQ ID NO: 51976 - DNA, 25 bp, S. cerevisiae
tgtacagtggactcctcgcataaca

SEQ ID NO: 51977 - DNA, 25 bp, S. cerevisiae
tgtccactttggttcattcatcatc

SEQ ID NO: 51978 - DNA, 25 bp, S. cerevisiae
tgtctagacgttttgattacaccaa

SEQ ID NO: 51979 - DNA, 25 bp, S. cerevisiae
tgtctaccttagctttactctctag

SEQ ID NO: 51980 - DNA, 25 bp, S. cerevisiae
tgtgtaagactacctcgtacgccaa

SEQ ID NO: 51981 - DNA, 25 bp, S. cerevisiae
tgttcacgactacacgatgggccat

SEQ ID NO: 51982 - DNA, 25 bp, S. cerevisiae
tgatgttcgaactttccaatccctc

SEQ ID NO: 51983 - DNA, 25 bp, S. cerevisiae
tgtcgagctgctcgtagctattgaa

SEQ ID NO: 51984 - DNA, 25 bp, S. cerevisiae
tgtcatggcctcttactggtggtgg

SEQ ID NO: 51985 - DNA, 25 bp, S. cerevisiae
tgtgccatgccgaaacaggtgactg

SEQ ID NO: 51986 - DNA, 25 bp, S. cerevisiae
tcattgccatcataagttcgactta

SEQ ID NO: 51987 - DNA, 25 bp, S. cerevisiae
tgttggaggcatttttaaggaaaga

SEQ ID NO: 51988 - DNA, 25 bp, S. cerevisiae
tgttggaggcatttttaaggaaaga

SEQ ID NO: 51989 - DNA, 25 bp, S. cerevisiae
tgtagtggcccaatttaatgcgtca

SEQ ID NO: 51990 - DNA, 25 bp, S. cerevisiae
ttgggttcgttttggttgtcaagct

SEQ ID NO: 51991 - DNA, 25 bp, S. cerevisiae
tgttggaaccctttttctactacat

SEQ ID NO: 51992 - DNA, 25 bp, S. cerevisiae
tgtctggtaccgttctttacttgaa

SEQ ID NO: 51993 - DNA, 25 bp, S. cerevisiae
tgtgttgtcctttttcttacgaaat

SEQ ID NO: 51994 - DNA, 25 bp, S. cerevisiae
tgtgtttcctttctttactgggcat

SEQ ID NO: 51995 - DNA, 25 bp, S. cerevisiae
tgtcgcttccgttgctttcgtcgct

SEQ ID NO: 51996 - DNA, 25 bp, S. cerevisiae
tgtgttatcacgctcttatccatca

SEQ ID NO: 51997 - DNA, 25 bp, S. cerevisiae
tgttccatacgttgttacccacgat

SEQ ID NO: 51998 - DNA, 25 bp, S. cerevisiae
tgtaacgtctgcaaatgggccccaa

SEQ ID NO: 51999 - DNA, 25 bp, S. cerevisiae
tgtaccaggcggaaaggccatccta

SEQ ID NO: 52000 - DNA, 25 bp, S. cerevisiae
tgttccaagccgcacacccaactga

SEQ ID NO: 52001 - DNA, 25 bp, S. cerevisiae
tgtaaacatttcaccaagctcctct

SEQ ID NO: 52002 - DNA, 25 bp, S. cerevisiae
tgctaaattttcaccagtttccacc

SEQ ID NO: 52003 - DNA, 25 bp, S. cerevisiae
tgtacaccgttgaccgttttggccg

SEQ ID NO: 52004 - DNA, 25 bp, S. cerevisiae
ttacaattttggcagttacgtctcg

SEQ ID NO: 52005 - DNA, 25 bp, S. cerevisiae
tgtcaccattttcggctgtttcgtc

SEQ ID NO: 52006 - DNA, 25 bp, S. cerevisiae
tgtccaattattcaagttcgcgcaa

SEQ ID NO: 52007 - DNA, 25 bp, S. cerevisiae
tgttttttccggtgatgcgctagaa

SEQ ID NO: 52008 - DNA, 25 bp, S. cerevisiae
tgttcctgttcctgttccagtagaa

SEQ ID NO: 52009 - DNA, 25 bp, S. cerevisiae
tgtcatgagggttacgtctccgtat

SEQ ID NO: 52010 - DNA, 25 bp, S. cerevisiae
tgttatgggccaccgaatcattaat

SEQ ID NO: 52011 - DNA, 25 bp, S. cerevisiae
tgtgacgattgtgccgaagcttatc

SEQ ID NO: 52012 - DNA, 25 bp, S. cerevisiae
tgtgccgtttggtctgatcgtataa

SEQ ID NO: 52013 - DNA, 25 bp, S. cerevisiae
tgtcccttttccatagtagcctata

SEQ ID NO: 52014 - DNA, 25 bp, S. cerevisiae
tgtcccttttcgatggagagcccta

SEQ ID NO: 52015 - DNA, 25 bp, S. cerevisiae
tgattgtcttttcttgcaaacccca

SEQ ID NO: 52016 - DNA, 25 bp, S. cerevisiae
tgtttatattttttcacccgccgca

SEQ ID NO: 52017 - DNA, 25 bp, S. cerevisiae
tgttttactttcaagatccccagcc

SEQ ID NO: 52018 - DNA, 25 bp, S. cerevisiae
tgtcgcttagcggagtcaatgattc

SEQ ID NO: 52019 - DNA, 25 bp, S. cerevisiae
tgtcactgctatcgtgggcactgaa

SEQ ID NO: 52020 - DNA, 25 bp, S. cerevisiae
tgtactatcatggtggctactcata

SEQ ID NO: 52021 - DNA, 25 bp, S. cerevisiae
tgttttccaaaaaggccactcctca

SEQ ID NO: 52022 - DNA, 25 bp, S. cerevisiae
tgttgtcccaagaaacacaactgtt

SEQ ID NO: 52023 - DNA, 25 bp, S. cerevisiae
tgttccctaatttcccattttatca

SEQ ID NO: 52024 - DNA, 25 bp, S. cerevisiae
tgtttccttttttgctcacgattta

SEQ ID NO: 52025 - DNA, 25 bp, S. cerevisiae
tgttaacctttcatccaccatattg

SEQ ID NO: 52026 - DNA, 25 bp, S. cerevisiae
tgttacgccagattaccaccaagag

SEQ ID NO: 52027 - DNA, 25 bp, S. cerevisiae
tgtaacgccgataaccaacccaagt

SEQ ID NO: 52028 - DNA, 25 bp, S. cerevisiae
tgtgcaactggccatatacctcaat

SEQ ID NO: 52029 - DNA, 25 bp, S. cerevisiae
tgtgccactatccttatctatactt

SEQ ID NO: 52030 - DNA, 25 bp, S. cerevisiae
tgtgctcgcgatctcaattgtattt

SEQ ID NO: 52031 - DNA, 25 bp, S. cerevisiae
tgtgcctccaactatcagtctagaa

SEQ ID NO: 52032 - DNA, 25 bp, S. cerevisiae
tgtcctgctgcagactatttcagat

SEQ ID NO: 52033 - DNA, 25 bp, S. cerevisiae
tgtagctctggcaacacaagcgatt

SEQ ID NO: 52034 - DNA, 25 bp, S. cerevisiae
tgtttttcatttttcccagtttgtg

SEQ ID NO: 52035 - DNA, 25 bp, S. cerevisiae
tgtttttatttccaccgtattgctg

SEQ ID NO: 52036 - DNA, 25 bp, S. cerevisiae
tgttctttttcataccagtttgcat

SEQ ID NO: 52037 - DNA, 25 bp, S. cerevisiae
tgtccggaacaataccagtcttctt

SEQ ID NO: 52038 - DNA, 25 bp, S. cerevisiae
tgtccggaaaaccaccagtttatag

SEQ ID NO: 52039 - DNA, 25 bp, S. cerevisiae
tgtcccaaatagatcggcagttttc

SEQ ID NO: 52040 - DNA, 25 bp, S. cerevisiae
tgttccgcagacatttgacaggtga

SEQ ID NO: 52041 - DNA, 25 bp, S. cerevisiae
tgtcgtcgcttatttcaaaaaccat

SEQ ID NO: 52042 - DNA, 25 bp, S. cerevisiae
ttcgacgcctaatgaaaacgccccg

SEQ ID NO: 52043 - DNA, 25 bp, S. cerevisiae
tgtctacgccggtgaaaacttccac

SEQ ID NO: 52044 - DNA, 25 bp, S. cerevisiae
tgttttcgctggtgaaaacttccac

SEQ ID NO: 52045 - DNA, 25 bp, S. cerevisiae
tgtttttgggtttccacatcttcca

SEQ ID NO: 52046 - DNA, 25 bp, S. cerevisiae
tgtgacttcctactagacccagaga

SEQ ID NO: 52047 - DNA, 25 bp, S. cerevisiae
tgtatttttcacaggcccaggtaat

SEQ ID NO: 52048 - DNA, 25 bp, S. cerevisiae
tgaaccttacagttggcccggtagt

SEQ ID NO: 52049 - DNA, 25 bp, S. cerevisiae
tgtatggctccagatataacccttc

SEQ ID NO: 52050 - DNA, 25 bp, S. cerevisiae
tgatgggctccacattaaacgttag

SEQ ID NO: 52051 - DNA, 25 bp, S. cerevisiae
tgtccaaagattttcctccttaaca

SEQ ID NO: 52052 - DNA, 25 bp, S. cerevisiae
tgtccggatattatggcactctctc

SEQ ID NO: 52053 - DNA, 25 bp, S. cerevisiae
tgtcatcggtagtaacgccttatcc

SEQ ID NO: 52054 - DNA, 25 bp, S. cerevisiae
tgtgttgactgcgatgtgttcatcc

SEQ ID NO: 52055 - DNA, 25 bp, S. cerevisiae
tgtgttagcattcctgtatcatctg

SEQ ID NO: 52056 - DNA, 25 bp, S. cerevisiae
tgtgttacatctccatattgcaaag

SEQ ID NO: 52057 - DNA, 25 bp, S. cerevisiae
tgtgctgtccatgttcaatgcgaga

SEQ ID NO: 52058 - DNA, 25 bp, S. cerevisiae
tgtcagctcctctatcatcaatgag

SEQ ID NO: 52059 - DNA, 25 bp, S. cerevisiae
tgtactcctcctagcctaaatgata

SEQ ID NO: 52060 - DNA, 25 bp, S. cerevisiae
tgtcctctatcatcaccaacaagat

SEQ ID NO: 52061 - DNA, 25 bp, S. cerevisiae
tgagtattcaacaccttaccaaatt

SEQ ID NO: 52062 - DNA, 25 bp, S. cerevisiae
tgatcccttactgcgttaccagaat

SEQ ID NO: 52063 - DNA, 25 bp, S. cerevisiae
tgtccactctttgactgctactcaa

SEQ ID NO: 52064 - DNA, 25 bp, S. cerevisiae
tgtactgtttgcttccatatccata

SEQ ID NO: 52065 - DNA, 25 bp, S. cerevisiae
tgtcactatccccactgtggaggga

SEQ ID NO: 52066 - DNA, 25 bp, S. cerevisiae
tgtcctcatcactgctgcaatactt

SEQ ID NO: 52067 - DNA, 25 bp, S. cerevisiae
tgtgccacacacaacgaagagcatt

SEQ ID NO: 52068 - DNA, 25 bp, S. cerevisiae
tgtaagcaacatggcgtcaagatta

SEQ ID NO: 52069 - DNA, 25 bp, S. cerevisiae
tgtgaacatcatttggtgccatttt

SEQ ID NO: 52070 - DNA, 25 bp, S. cerevisiae
tgtcacaatcattacgtccgtatct

SEQ ID NO: 52071 - DNA, 25 bp, S. cerevisiae
tgtccaccaattagctctcgttatt

SEQ ID NO: 52072 - DNA, 25 bp, S. cerevisiae
tgtcgcattcgtttgccgtttatta

SEQ ID NO: 52073 - DNA, 25 bp, S. cerevisiae
tgtcgtccaggattcttctttttaa

SEQ ID NO: 52074 - DNA, 25 bp, S. cerevisiae
tgtcgcccaagatgccgtttcaaaa

SEQ ID NO: 52075 - DNA, 25 bp, S. cerevisiae
tgtccacctacttgaagatctacaa

SEQ ID NO: 52076 - DNA, 25 bp, S. cerevisiae
tgatttcccacttgaaaggacgcaa

SEQ ID NO: 52077 - DNA, 25 bp, S. cerevisiae
tgttctccatactcaacggtcgggt

SEQ ID NO: 52078 - DNA, 25 bp, S. cerevisiae
tgtttgcacaaataccgttccggta

SEQ ID NO: 52079 - DNA, 25 bp, S. cerevisiae
tgttatcgaaactccctgcgacgtt

SEQ ID NO: 52080 - DNA, 25 bp, S. cerevisiae
tgttttggagaatacctgcttcggt

SEQ ID NO: 52081 - DNA, 25 bp, S. cerevisiae
tgttttgagaagtacccgcctggcg

SEQ ID NO: 52082 - DNA, 25 bp, S. cerevisiae
tgttttcgaaaaactcgccggctat

SEQ ID NO: 52083 - DNA, 25 bp, S. cerevisiae
tgttttcgaaacagcgcgtagcact

SEQ ID NO: 52084 - DNA, 25 bp, S. cerevisiae
tgtttatcgcacacgtcgctttgac

SEQ ID NO: 52085 - DNA, 25 bp, S. cerevisiae
tgtccatcgtgtacccaagagtgtg

SEQ ID NO: 52086 - DNA, 25 bp, S. cerevisiae
tgtactgcttgaaccacacggatgg

SEQ ID NO: 52087 - DNA, 25 bp, S. cerevisiae
tgtcattcctgtgcctctgaacaag

SEQ ID NO: 52088 - DNA, 25 bp, S. cerevisiae
tgttattcttcccagcaatcattca

SEQ ID NO: 52089 - DNA, 25 bp, S. cerevisiae
tgtagatatcaaccctgacatgctt

SEQ ID NO: 52090 - DNA, 25 bp, S. cerevisiae
tgtagattcaatcttgtccaaggac

SEQ ID NO: 52091 - DNA, 25 bp, S. cerevisiae
tgtactatagtggtcttctgcctgg

SEQ ID NO: 52092 - DNA, 25 bp, S. cerevisiae
tgtactacatgcagccattcactac

SEQ ID NO: 52093 - DNA, 25 bp, S. cerevisiae
tgtccgtctcatgccaaatcattta

SEQ ID NO: 52094 - DNA, 25 bp, S. cerevisiae
tgtcgcatcctcaccaagaattata

SEQ ID NO: 52095 - DNA, 25 bp, S. cerevisiae
tgtccatccaacagaatacggcctt

SEQ ID NO: 52096 - DNA, 25 bp, S. cerevisiae
tgtactgtcagccatattccaggtt

SEQ ID NO: 52097 - DNA, 25 bp, S. cerevisiae
tgtcaattactccatgtccttgtgt

SEQ ID NO: 52098 - DNA, 25 bp, S. cerevisiae
tgacttcagggctggcgtactttat

SEQ ID NO: 52099 - DNA, 25 bp, S. cerevisiae
tgacttaggcaaaggaagacgtctt

SEQ ID NO: 52100 - DNA, 25 bp, S. cerevisiae
tgttggccaacggtgctattgacac

SEQ ID NO: 52101 - DNA, 25 bp, S. cerevisiae
tgtcgagtaccgattgctgcacgat

SEQ ID NO: 52102 - DNA, 25 bp, S. cerevisiae
tgtcagtttatgcagttttcacggt

SEQ ID NO: 52103 - DNA, 25 bp, S. cerevisiae
tgatagtttatgcttggtctccaag

SEQ ID NO: 52104 - DNA, 25 bp, S. cerevisiae
tgtcaatctttgttggttccatcga

SEQ ID NO: 52105 - DNA, 25 bp, S. cerevisiae
tgtctccttctctcgtgtcatttaa

SEQ ID NO: 52106 - DNA, 25 bp, S. cerevisiae
tgtctactgaatccgctttgtctta

SEQ ID NO: 52107 - DNA, 25 bp, S. cerevisiae
tttttagatccttctttgttagcgg

SEQ ID NO: 52108 - DNA, 25 bp, S. cerevisiae
tgtctttttgccagctttgtgtaag

SEQ ID NO: 52109 - DNA, 25 bp, S. cerevisiae
tgtttcaatgtctccttctctataa

SEQ ID NO: 52110 - DNA, 25 bp, S. cerevisiae
tcacaaattggtaacattttcctac

SEQ ID NO: 52111 - DNA, 25 bp, S. cerevisiae
tgctaacaggcgtagttttccccaa

SEQ ID NO: 52112 - DNA, 25 bp, S. cerevisiae
tgataaagtcgaaggcctagcccca

SEQ ID NO: 52113 - DNA, 25 bp, S. cerevisiae
tgttcaagtcaccttccacgggaat

SEQ ID NO: 52114 - DNA, 25 bp, S. cerevisiae
tgttccctatcgcttccagaagaat

SEQ ID NO: 52115 - DNA, 25 bp, S. cerevisiae
tgttcttttgagttgttggacccac

SEQ ID NO: 52116 - DNA, 25 bp, S. cerevisiae
tgattactactaatgtcctggcccg

SEQ ID NO: 52117 - DNA, 25 bp, S. cerevisiae
tgttaaactatcgtccacttccaaa

SEQ ID NO: 52118 - DNA, 25 bp, S. cerevisiae
tgtctgtcaacaaccaaccattcaa

SEQ ID NO: 52119 - DNA, 25 bp, S. cerevisiae
tgcttacatcccagaaccaatcaga

SEQ ID NO: 52120 - DNA, 25 bp, S. cerevisiae
tgtaatcttcttcaccgacgacaag

SEQ ID NO: 52121 - DNA, 25 bp, S. cerevisiae
tgtcgttctaatttccataaatgga

SEQ ID NO: 52122 - DNA, 25 bp, S. cerevisiae
tgtcgcttcgcgttaccacaaggga

SEQ ID NO: 52123 - DNA, 25 bp, S. cerevisiae
tgtcgcttccgtcaaacaagtcagt

SEQ ID NO: 52124 - DNA, 25 bp, S. cerevisiae
tgtcgcgttcctcgaatcacaaaag

SEQ ID NO: 52125 - DNA, 25 bp, S. cerevisiae
tgcttggtcacagggatactagggc

SEQ ID NO: 52126 - DNA, 25 bp, S. cerevisiae
tgctaagaagaggtaactacgccca

SEQ ID NO: 52127 - DNA, 25 bp, S. cerevisiae
tgtcagaaacattcgcaactcccac

SEQ ID NO: 52128 - DNA, 25 bp, S. cerevisiae
tgtcaaacacatgtaccgcctattt

SEQ ID NO: 52129 - DNA, 25 bp, S. cerevisiae
tgtcatcgttgtttccagcggaatg

SEQ ID NO: 52130 - DNA, 25 bp, S. cerevisiae
tgttccagctttacaatcgcaggtg

SEQ ID NO: 52131 - DNA, 25 bp, S. cerevisiae
tgtttcggttgcgttcttggataac

SEQ ID NO: 52132 - DNA, 25 bp, S. cerevisiae
tgtttcaggagtctctcgcgttaga

SEQ ID NO: 52133 - DNA, 25 bp, S. cerevisiae
tgttacgcgagatgcttcgtccttg

SEQ ID NO: 52134 - DNA, 25 bp, S. cerevisiae
tgttactgctattactctagccacc

SEQ ID NO: 52135 - DNA, 25 bp, S. cerevisiae
tgtcaaatcttgtgctggctattgt

SEQ ID NO: 52136 - DNA, 25 bp, S. cerevisiae
tgtcgttcagaaaaccgttcctcat

SEQ ID NO: 52137 - DNA, 25 bp, S. cerevisiae
tgtcgaatccaaaatacgatccagt

SEQ ID NO: 52138 - DNA, 25 bp, S. cerevisiae
tgtttgccccaactgtagatcaagt

SEQ ID NO: 52139 - DNA, 25 bp, S. cerevisiae
tgtccctcatcgctcaaagaacagg

SEQ ID NO: 52140 - DNA, 25 bp, S. cerevisiae
tgtcttcttgcaagcctactgtaag

SEQ ID NO: 52141 - DNA, 25 bp, S. cerevisiae
tgatccgaatcacgactctgtaatt

SEQ ID NO: 52142 - DNA, 25 bp, S. cerevisiae
tgatccgaacgctttccgtggttga

SEQ ID NO: 52143 - DNA, 25 bp, S. cerevisiae
tgtacgaaccgaacacagtgcgagt

SEQ ID NO: 52144 - DNA, 25 bp, S. cerevisiae
tgtatgatgcatacaatgatgccaa

SEQ ID NO: 52145 - DNA, 25 bp, S. cerevisiae
tgttgcatcagcaaatgcgggcatt

SEQ ID NO: 52146 - DNA, 25 bp, S. cerevisiae
tgtcaccaagggtcacggtttcgaa

SEQ ID NO: 52147 - DNA, 25 bp, S. cerevisiae
tgtcacaccttacccggctttctga

SEQ ID NO: 52148 - DNA, 25 bp, S. cerevisiae
tgtcataccttacccggctttctga

SEQ ID NO: 52149 - DNA, 25 bp, S. cerevisiae
tgtcttccgatgcatttgctgcgaa

SEQ ID NO: 52150 - DNA, 25 bp, S. cerevisiae
tgagctattccagcgcaataaagaa

SEQ ID NO: 52151 - DNA, 25 bp, S. cerevisiae
tgatgagcctcctcgaaaacgcaag

SEQ ID NO: 52152 - DNA, 25 bp, S. cerevisiae
tgaacccactggcaaaagctggcag

SEQ ID NO: 52153 - DNA, 25 bp, S. cerevisiae
tgaactccgctagaaagttgcgtgt

SEQ ID NO: 52154 - DNA, 25 bp, S. cerevisiae
tgtacctctcttgggctcacagtaa

SEQ ID NO: 52155 - DNA, 25 bp, S. cerevisiae
tgtactacccgcaaccataatagcg

SEQ ID NO: 52156 - DNA, 25 bp, S. cerevisiae
taaccaccaacttcctaaagtgctc

SEQ ID NO: 52157 - DNA, 25 bp, S. cerevisiae
tcaaccagccaacacaaaaattggt

SEQ ID NO: 52158 - DNA, 25 bp, S. cerevisiae
tgtcgattctaacgatagatcgcgt

SEQ ID NO: 52159 - DNA, 25 bp, S. cerevisiae
tgtcgatttcaactgcatgcaactg

SEQ ID NO: 52160 - DNA, 25 bp, S. cerevisiae
tgtctagcattagcgcatcgtttcg

SEQ ID NO: 52161 - DNA, 25 bp, S. cerevisiae
tgtctacattactctcttcattggc

SEQ ID NO: 52162 - DNA, 25 bp, S. cerevisiae
tgtcgacatcatcgctaccatgttt

SEQ ID NO: 52163 - DNA, 25 bp, S. cerevisiae
tgttatcaacgctcacatgggtgca

SEQ ID NO: 52164 - DNA, 25 bp, S. cerevisiae
tgtcggtattacaagcatgcttctt

SEQ ID NO: 52165 - DNA, 25 bp, S. cerevisiae
tgatcgcgtgctgacaaattactcg

SEQ ID NO: 52166 - DNA, 25 bp, S. cerevisiae
tgatgtactctaaaattcttggcgg

SEQ ID NO: 52167 - DNA, 25 bp, S. cerevisiae
tagtactgtgaacaccttcactggg

SEQ ID NO: 52168 - DNA, 25 bp, S. cerevisiae
tgagttttgcggtaccttcatgttt

SEQ ID NO: 52169 - DNA, 25 bp, S. cerevisiae
tgattactacggaactcgctctcaa

SEQ ID NO: 52170 - DNA, 25 bp, S. cerevisiae
tgtaatcttttaacgctgctcttca

SEQ ID NO: 52171 - DNA, 25 bp, S. cerevisiae
tgtattgccttaaccatgtctttcc

SEQ ID NO: 52172 - DNA, 25 bp, S. cerevisiae
tgtcttcgattcacgcaagttgctc

SEQ ID NO: 52173 - DNA, 25 bp, S. cerevisiae
tgttgccggtcatacaagttatcac

SEQ ID NO: 52174 - DNA, 25 bp, S. cerevisiae
tgttgcctcaattgcgtacgggatg

SEQ ID NO: 52175 - DNA, 25 bp, S. cerevisiae
tgttgattcagtccgattcacaaac

SEQ ID NO: 52176 - DNA, 25 bp, S. cerevisiae
tgtcagctgtcccaagtgttcaaac

SEQ ID NO: 52177 - DNA, 25 bp, S. cerevisiae
tgtcagctgtcccaagtgttcaaac

SEQ ID NO: 52178 - DNA, 25 bp, S. cerevisiae
tgtcacttccgaggcttccaaacaa

SEQ ID NO: 52179 - DNA, 25 bp, S. cerevisiae
tgtttcgtcatcaagcaattcactg

SEQ ID NO: 52180 - DNA, 25 bp, S. cerevisiae
tgtacctccatcaatgcagcatttt

SEQ ID NO: 52181 - DNA, 25 bp, S. cerevisiae
tgtcaatcccactacacacattgat

SEQ ID NO: 52182 - DNA, 25 bp, S. cerevisiae
tgtacccatcaattgacacctgagg

SEQ ID NO: 52183 - DNA, 25 bp, S. cerevisiae
tgataacaccatggcataacttgag

SEQ ID NO: 52184 - DNA, 25 bp, S. cerevisiae
tgtctgaatgctccacttttatctg

SEQ ID NO: 52185 - DNA, 25 bp, S. cerevisiae
tgtctgctgtcactagtctatctat

SEQ ID NO: 52186 - DNA, 25 bp, S. cerevisiae
tgtagcttcactggacgtcatcagt

SEQ ID NO: 52187 - DNA, 25 bp, S. cerevisiae
tgtagcttctccaatcgcattcaaa

SEQ ID NO: 52188 - DNA, 25 bp, S. cerevisiae
tgtcactgctattgccatagcttat

SEQ ID NO: 52189 - DNA, 25 bp, S. cerevisiae
tgtcactgctattgctctcctggaa

SEQ ID NO: 52190 - DNA, 25 bp, S. cerevisiae
tgtctcctttgttagtgccgctgaa

SEQ ID NO: 52191 - DNA, 25 bp, S. cerevisiae
tgttccacctattaatctcgctcaa

SEQ ID NO: 52192 - DNA, 25 bp, S. cerevisiae
tgttccaaacattactctgggccaa

SEQ ID NO: 52193 - DNA, 25 bp, S. cerevisiae
tgttccaaccatttcccaagtctaa

SEQ ID NO: 52194 - DNA, 25 bp, S. cerevisiae
tgttccaactgccttgccagaagaa

SEQ ID NO: 52195 - DNA, 25 bp, S. cerevisiae
tgttcccgaactgcagatcaattgg

SEQ ID NO: 52196 - DNA, 25 bp, S. cerevisiae
tgtttgctaagctttatcgcggtct

SEQ ID NO: 52197 - DNA, 25 bp, S. cerevisiae
tgatattgttactgtcgtccgtgtc

SEQ ID NO: 52198 - DNA, 25 bp, S. cerevisiae
tgatttgtatactgatcctggcccc

SEQ ID NO: 52199 - DNA, 25 bp, S. cerevisiae
tgtcattgacgatactgcatcccag

SEQ ID NO: 52200 - DNA, 25 bp, S. cerevisiae
tgtattcaggaaccgcatcaccgaa

SEQ ID NO: 52201 - DNA, 25 bp, S. cerevisiae
tgtttcataaaccactatacgtagt

SEQ ID NO: 52202 - DNA, 25 bp, S. cerevisiae
tgttctctacaaccttttcgcaagt

SEQ ID NO: 52203 - DNA, 25 bp, S. cerevisiae
tgtttttcaagccttctacgccaaa

SEQ ID NO: 52204 - DNA, 25 bp, S. cerevisiae
tgatttaccgccttatgaaacccca

SEQ ID NO: 52205 - DNA, 25 bp, S. cerevisiae
tgtttaccaccaacgacaagccagt

SEQ ID NO: 52206 - DNA, 25 bp, S. cerevisiae
tgttgatattatgcccggaaccaat

SEQ ID NO: 52207 - DNA, 25 bp, S. cerevisiae
tgtcttttgatatctgcggtaacca

SEQ ID NO: 52208 - DNA, 25 bp, S. cerevisiae
tgttttagaagacccagagctacgt

SEQ ID NO: 52209 - DNA, 25 bp, S. cerevisiae
tgttgcaaaatcatgaccggacgtt

SEQ ID NO: 52210 - DNA, 25 bp, S. cerevisiae
tgttggacattgatgacggtttctt

SEQ ID NO: 52211 - DNA, 25 bp, S. cerevisiae
tgtacctcatcgttgcagggctttg

SEQ ID NO: 52212 - DNA, 25 bp, S. cerevisiae
tgagccctacgattggcacagtttc

SEQ ID NO: 52213 - DNA, 25 bp, S. cerevisiae
tgagcccgcagacattgacaagtac

SEQ ID NO: 52214 - DNA, 25 bp, S. cerevisiae
tgacccgaacgactactttattatg

SEQ ID NO: 52215 - DNA, 25 bp, S. cerevisiae
tgcaacgaacggagtctctgcttaa

SEQ ID NO: 52216 - DNA, 25 bp, S. cerevisiae
tgtacagcaacacaagcttcagctt

SEQ ID NO: 52217 - DNA, 25 bp, S. cerevisiae
tgtcatactacatcaacttcatccg

SEQ ID NO: 52218 - DNA, 25 bp, S. cerevisiae
tgctaccctttcctatttagtcgat

SEQ ID NO: 52219 - DNA, 25 bp, S. cerevisiae
tgtcaaactaggcaatgtctggtct

SEQ ID NO: 52220 - DNA, 25 bp, S. cerevisiae
tgttcagaaacaaccgacgctagcg

SEQ ID NO: 52221 - DNA, 25 bp, S. cerevisiae
tgttcgaaccaaggctagcgctagt

SEQ ID NO: 52222 - DNA, 25 bp, S. cerevisiae
tgttcacccacaactgaaggctcag

SEQ ID NO: 52223 - DNA, 25 bp, S. cerevisiae
tgtcttcaaatccataccagcttac

SEQ ID NO: 52224 - DNA, 25 bp, S. cerevisiae
tgttcggaatctttgcagttgccct

SEQ ID NO: 52225 - DNA, 25 bp, S. cerevisiae
tgtacgagaacatcgcatcttcacc

SEQ ID NO: 52226 - DNA, 25 bp, S. cerevisiae
tgctatcgttaatcttttaccttcg

SEQ ID NO: 52227 - DNA, 25 bp, S. cerevisiae
tgttttaccatgacacaccatcgtt

SEQ ID NO: 52228 - DNA, 25 bp, S. cerevisiae
tgatactgtactagcaccagtccca

SEQ ID NO: 52229 - DNA, 25 bp, S. cerevisiae
tgtatttaacgatagatgcaccaaa

SEQ ID NO: 52230 - DNA, 25 bp, S. cerevisiae
tgatcttagggctcaaaccgctaat

SEQ ID NO: 52231 - DNA, 25 bp, S. cerevisiae
tgatttcttgagtacaaaaggcaaa

SEQ ID NO: 52232 - DNA, 25 bp, S. cerevisiae
tgatcattcctaccacaggtcgtgg

SEQ ID NO: 52233 - DNA, 25 bp, S. cerevisiae
tgttaacacatgcattctcctctaa

SEQ ID NO: 52234 - DNA, 25 bp, S. cerevisiae
tgttatcaacgtttctgcccaaaga

SEQ ID NO: 52235 - DNA, 25 bp, S. cerevisiae
tgttgacgccgctttaatcgaagaa

SEQ ID NO: 52236 - DNA, 25 bp, S. cerevisiae
tgttacgccctctcatatgagcaga

SEQ ID NO: 52237 - DNA, 25 bp, S. cerevisiae
tgttcaggtcttttcatcagagaga

SEQ ID NO: 52238 - DNA, 25 bp, S. cerevisiae
ttgtcaggtctggtaacggaaacga

SEQ ID NO: 52239 - DNA, 25 bp, S. cerevisiae
tgcgtgaggacgattctttaaggaa

SEQ ID NO: 52240 - DNA, 25 bp, S. cerevisiae
tctgttggaggcatttttaaggaaa

SEQ ID NO: 52241 - DNA, 25 bp, S. cerevisiae
tctgttggaggcatttttaaggaaa

SEQ ID NO: 52242 - DNA, 25 bp, S. cerevisiae
tgatttatccggctctttagtgcct

SEQ ID NO: 52243 - DNA, 25 bp, S. cerevisiae
tgtagtatccagtgccaaattttct

SEQ ID NO: 52244 - DNA, 25 bp, S. cerevisiae
tgattgagtccgtgcccattttagc

SEQ ID NO: 52245 - DNA, 25 bp, S. cerevisiae
tgattcaagtgctaatgcgtcccct

SEQ ID NO: 52246 - DNA, 25 bp, S. cerevisiae
tgttctaaattttgccatggcgctg

SEQ ID NO: 52247 - DNA, 25 bp, S. cerevisiae
tgaacacaagttctgcctcggacga

SEQ ID NO: 52248 - DNA, 25 bp, S. cerevisiae
tgaaaacgcttgctcgttgggccaa

SEQ ID NO: 52249 - DNA, 25 bp, S. cerevisiae
tgccttaggttgtggtttcgtcgaa

SEQ ID NO: 52250 - DNA, 25 bp, S. cerevisiae
tgttcacgttcataaggcgcctgat

SEQ ID NO: 52251 - DNA, 25 bp, S. cerevisiae
tgattcacggtccaaaggctcaata

SEQ ID NO: 52252 - DNA, 25 bp, S. cerevisiae
tgtaggtggttatttactcttaaga

SEQ ID NO: 52253 - DNA, 25 bp, S. cerevisiae
tgtaggtcgctaactttattaaaga

SEQ ID NO: 52254 - DNA, 25 bp, S. cerevisiae
tgtacactttggttatcaacgatgc

SEQ ID NO: 52255 - DNA, 25 bp, S. cerevisiae
tgtaactgcgtttttcaagggctta

SEQ ID NO: 52256 - DNA, 25 bp, S. cerevisiae
tgtattctggtgttttccctcctta

SEQ ID NO: 52257 - DNA, 25 bp, S. cerevisiae
tgttcatccattcaaacttcccaaa

SEQ ID NO: 52258 - DNA, 25 bp, S. cerevisiae
tgttgcccaagactaagttgcccaa

SEQ ID NO: 52259 - DNA, 25 bp, S. cerevisiae
tgttgacttcaaccaagctttcgaa

SEQ ID NO: 52260 - DNA, 25 bp, S. cerevisiae
tgttgattctcatggctttgtaaaa

SEQ ID NO: 52261 - DNA, 25 bp, S. cerevisiae
tgagctgccctctctcgttaaaaaa

SEQ ID NO: 52262 - DNA, 25 bp, S. cerevisiae
tgtttctcccaaaattcaatcccat

SEQ ID NO: 52263 - DNA, 25 bp, S. cerevisiae
tgatttacttggtaagcgccctttc

SEQ ID NO: 52264 - DNA, 25 bp, S. cerevisiae
tgtaggtccggttctgcagcagaca

SEQ ID NO: 52265 - DNA, 25 bp, S. cerevisiae
tgtagggcagcgtttccaagaacaa

SEQ ID NO: 52266 - DNA, 25 bp, S. cerevisiae
tgtattggacgaacctcagatgaaa

SEQ ID NO: 52267 - DNA, 25 bp, S. cerevisiae
tgaggcggacgaacccaaaattttg

SEQ ID NO: 52268 - DNA, 25 bp, S. cerevisiae
tgaggctggagccatcaccgtatga

SEQ ID NO: 52269 - DNA, 25 bp, S. cerevisiae
tgaggcccagcatctaggtatgagt

SEQ ID NO: 52270 - DNA, 25 bp, S. cerevisiae
tgtacccacaccaatattcaagtcc

SEQ ID NO: 52271 - DNA, 25 bp, S. cerevisiae
tgtaatactccgtcaccattcgtga

SEQ ID NO: 52272 - DNA, 25 bp, S. cerevisiae
tgtagactcttcatcggcatttcaa

SEQ ID NO: 52273 - DNA, 25 bp, S. cerevisiae
tgtagcgcagttgccggtacatcaa

SEQ ID NO: 52274 - DNA, 25 bp, S. cerevisiae
taagcggttcacaggtaacgcacct

SEQ ID NO: 52275 - DNA, 25 bp, S. cerevisiae
taaggacgtacaggttttagccaat

SEQ ID NO: 52276 - DNA, 25 bp, S. cerevisiae
tgtttccgtcccattttagccaaga

SEQ ID NO: 52277 - DNA, 25 bp, S. cerevisiae
tgttaggtgtaacgcttccatatga

SEQ ID NO: 52278 - DNA, 25 bp, S. cerevisiae
tgtaacatcgtatgctctgccacat

SEQ ID NO: 52279 - DNA, 25 bp, S. cerevisiae
tgtactacaattatatccgcctttt

SEQ ID NO: 52280 - DNA, 25 bp, S. cerevisiae
tgattccaaattaaaccccacctct

SEQ ID NO: 52281 - DNA, 25 bp, S. cerevisiae
tgttgcctgggtttgtggtatgacc

SEQ ID NO: 52282 - DNA, 25 bp, S. cerevisiae
tgttccattcgtgtcggtgttcatc

SEQ ID NO: 52283 - DNA, 25 bp, S. cerevisiae
tgttgttgaacaaactgccgaagtt

SEQ ID NO: 52284 - DNA, 25 bp, S. cerevisiae
tctgggtagctcaggcaccgaagtt

SEQ ID NO: 52285 - DNA, 25 bp, S. cerevisiae
tgcagggtccgcagtacgtcaagct

SEQ ID NO: 52286 - DNA, 25 bp, S. cerevisiae
taaggtctactacttccaaggtggt

SEQ ID NO: 52287 - DNA, 25 bp, S. cerevisiae
tgaaatttacccaccaagagttgtt

SEQ ID NO: 52288 - DNA, 25 bp, S. cerevisiae
tgtacagcttacaaccctctgtgga

SEQ ID NO: 52289 - DNA, 25 bp, S. cerevisiae
tgattatttatttcctattggtcgg

SEQ ID NO: 52290 - DNA, 25 bp, S. cerevisiae
tgatgcttttgtttcctatggtctt

SEQ ID NO: 52291 - DNA, 25 bp, S. cerevisiae
tgatttccatgtttctaagcgtagt

SEQ ID NO: 52292 - DNA, 25 bp, S. cerevisiae
tgatggaagcaacccaactttccta

SEQ ID NO: 52293 - DNA, 25 bp, S. cerevisiae
tgatgaaacagacccgaacttcgta

SEQ ID NO: 52294 - DNA, 25 bp, S. cerevisiae
tgagattgtcaagcggataatgtct

SEQ ID NO: 52295 - DNA, 25 bp, S. cerevisiae
tgagattactgagaggtcgtccgcc

SEQ ID NO: 52296 - DNA, 25 bp, S. cerevisiae
tgacttattatggagcgaccccgaa

SEQ ID NO: 52297 - DNA, 25 bp, S. cerevisiae
tgatcatcgttagagtacccctgac

SEQ ID NO: 52298 - DNA, 25 bp, S. cerevisiae
tgataacgatacatcttccggctcc

SEQ ID NO: 52299 - DNA, 25 bp, S. cerevisiae
tgtttcgttttcaatcaggcattaa

SEQ ID NO: 52300 - DNA, 25 bp, S. cerevisiae
tgtacctagatccttggcacatgtt

SEQ ID NO: 52301 - DNA, 25 bp, S. cerevisiae
tgtaccatagtcaccagcacagagt

SEQ ID NO: 52302 - DNA, 25 bp, S. cerevisiae
tatgatctacgtgaggcccaaggac

SEQ ID NO: 52303 - DNA, 25 bp, S. cerevisiae
tgagttgggcgctgcctccaaggcc

SEQ ID NO: 52304 - DNA, 25 bp, S. cerevisiae
tgacttgaagatgccctcgaaacct

SEQ ID NO: 52305 - DNA, 25 bp, S. cerevisiae
tgtagtagtacaactgccagacata

SEQ ID NO: 52306 - DNA, 25 bp, S. cerevisiae
tgtagctttagccactgctcagaga

SEQ ID NO: 52307 - DNA, 25 bp, S. cerevisiae
tgtactactgatgagcgcaatggca

SEQ ID NO: 52308 - DNA, 25 bp, S. cerevisiae
tgttaagagaggtgcagctggtatt

SEQ ID NO: 52309 - DNA, 25 bp, S. cerevisiae
tgttcaattagttcgtcctcagcca

SEQ ID NO: 52310 - DNA, 25 bp, S. cerevisiae
tgttacactctgtagctgccagcta

SEQ ID NO: 52311 - DNA, 25 bp, S. cerevisiae
tgttagcatattccaatccacttgt

SEQ ID NO: 52312 - DNA, 25 bp, S. cerevisiae
tgataactttactaccgctttaggg

SEQ ID NO: 52313 - DNA, 25 bp, S. cerevisiae
tgttgccatctggaagcacggtatt

SEQ ID NO: 52314 - DNA, 25 bp, S. cerevisiae
tgactgcagcgggaagagccttctt

SEQ ID NO: 52315 - DNA, 25 bp, S. cerevisiae
tgatgccgccaagaaggctttataa

SEQ ID NO: 52316 - DNA, 25 bp, S. cerevisiae
tgatgccgccaagaaggctttataa

SEQ ID NO: 52317 - DNA, 25 bp, S. cerevisiae
tgagccacacgataattccattaac

SEQ ID NO: 52318 - DNA, 25 bp, S. cerevisiae
tgatgataacgacggattgttctaa

SEQ ID NO: 52319 - DNA, 25 bp, S. cerevisiae
tgttagcttttttccttttatcact

SEQ ID NO: 52320 - DNA, 25 bp, S. cerevisiae
tgttgttccctattttgttgggctt

SEQ ID NO: 52321 - DNA, 25 bp, S. cerevisiae
tgaattattctaccgatccgattgg

SEQ ID NO: 52322 - DNA, 25 bp, S. cerevisiae
tgttgccaatgttcacctattcagg

SEQ ID NO: 52323 - DNA, 25 bp, S. cerevisiae
tgtttctagatgtcactggcggtat

SEQ ID NO: 52324 - DNA, 25 bp, S. cerevisiae
tgttgcttattggtgctagtggctt

SEQ ID NO: 52325 - DNA, 25 bp, S. cerevisiae
tgttgctggtgtcgctgctattgct

SEQ ID NO: 52326 - DNA, 25 bp, S. cerevisiae
tgatccctcctccaataaatgtaag

SEQ ID NO: 52327 - DNA, 25 bp, S. cerevisiae
tgttgactcgtcctctgaaccaaag

SEQ ID NO: 52328 - DNA, 25 bp, S. cerevisiae
tgttactcagtctgcgaatccacag

SEQ ID NO: 52329 - DNA, 25 bp, S. cerevisiae
tgtttgctcgatatgtacaccaccc

SEQ ID NO: 52330 - DNA, 25 bp, S. cerevisiae
tgatatttcaattttttccaccccg

SEQ ID NO: 52331 - DNA, 25 bp, S. cerevisiae
tgatggttcactaacgttcgacccc

SEQ ID NO: 52332 - DNA, 25 bp, S. cerevisiae
tgagtgtacttcagccttggattct

SEQ ID NO: 52333 - DNA, 25 bp, S. cerevisiae
tgagttaatgccaccagattcacct

SEQ ID NO: 52334 - DNA, 25 bp, S. cerevisiae
tgactatacaccaccaatgacttta

SEQ ID NO: 52335 - DNA, 25 bp, S. cerevisiae
tgatacaagtaaggccaccggtgct

SEQ ID NO: 52336 - DNA, 25 bp, S. cerevisiae
tgtatcaaatgaccctacgcggatt

SEQ ID NO: 52337 - DNA, 25 bp, S. cerevisiae
tgcattaaacccctttgctaacgcg

SEQ ID NO: 52338 - DNA, 25 bp, S. cerevisiae
tgttaataccggtttgcagaacgtt

SEQ ID NO: 52339 - DNA, 25 bp, S. cerevisiae
tgttactatccgtactagaaaggtt

SEQ ID NO: 52340 - DNA, 25 bp, S. cerevisiae
tgattactacgcctaccgacaagag

SEQ ID NO: 52341 - DNA, 25 bp, S. cerevisiae
tgtattctacggtctaccacaggaa

SEQ ID NO: 52342 - DNA, 25 bp, S. cerevisiae
tgtagatctacgcacgaccacaaat

SEQ ID NO: 52343 - DNA, 25 bp, S. cerevisiae
tgatccgtatccagctgtcttaatg

SEQ ID NO: 52344 - DNA, 25 bp, S. cerevisiae
tgttgcactggaatgactactgtca

SEQ ID NO: 52345 - DNA, 25 bp, S. cerevisiae
tgatttgtaccttcatattgtccaa

SEQ ID NO: 52346 - DNA, 25 bp, S. cerevisiae
tgttctttgtagcactttcgataaa

SEQ ID NO: 52347 - DNA, 25 bp, S. cerevisiae
tgttctcgagtacttcctttcaaga

SEQ ID NO: 52348 - DNA, 25 bp, S. cerevisiae
tgttcctttatttccctacaaagca

SEQ ID NO: 52349 - DNA, 25 bp, S. cerevisiae
tgttctatattaccgcctctacaat

SEQ ID NO: 52350 - DNA, 25 bp, S. cerevisiae
tgttaatgatggatctccctcacat

SEQ ID NO: 52351 - DNA, 25 bp, S. cerevisiae
tgtatttgaggctagcgacgcccag

SEQ ID NO: 52352 - DNA, 25 bp, S. cerevisiae
tgttatatggactagccctgcgaca

SEQ ID NO: 52353 - DNA, 25 bp, S. cerevisiae
tgttggatgctgtggctccaggaca

SEQ ID NO: 52354 - DNA, 25 bp, S. cerevisiae
tgtttctttcacttttggtcctgat

SEQ ID NO: 52355 - DNA, 25 bp, S. cerevisiae
tgttttgtatttgggctgggcacac

SEQ ID NO: 52356 - DNA, 25 bp, S. cerevisiae
tgtatcaaaattcctccacatcgtc

SEQ ID NO: 52357 - DNA, 25 bp, S. cerevisiae
tgatatcaacccatgggcgctcgaa

SEQ ID NO: 52358 - DNA, 25 bp, S. cerevisiae
tgtatatcaccagtagcggcgttga

SEQ ID NO: 52359 - DNA, 25 bp, S. cerevisiae
tgttgtccatacagccgcacttgaa

SEQ ID NO: 52360 - DNA, 25 bp, S. cerevisiae
tgaccgtccagcctatgcaacaagg

SEQ ID NO: 52361 - DNA, 25 bp, S. cerevisiae
tgttgcagcattgccattaggcgtt

SEQ ID NO: 52362 - DNA, 25 bp, S. cerevisiae
tgttctgcaggagcttactgcgaat

SEQ ID NO: 52363 - DNA, 25 bp, S. cerevisiae
tgtatatccaatagcgacgcctcaa

SEQ ID NO: 52364 - DNA, 25 bp, S. cerevisiae
tgttatcaatcaagagccgtccgat

SEQ ID NO: 52365 - DNA, 25 bp, S. cerevisiae
tgttattatcatcaccccagcatta

SEQ ID NO: 52366 - DNA, 25 bp, S. cerevisiae
tgttcatgatctaattcccctgtta

SEQ ID NO: 52367 - DNA, 25 bp, S. cerevisiae
tgttccatacaatctgcccatatca

SEQ ID NO: 52368 - DNA, 25 bp, S. cerevisiae
tgttctatctcaaattgctcctctg

SEQ ID NO: 52369 - DNA, 25 bp, S. cerevisiae
tgtatttgctatatggcggactgct

SEQ ID NO: 52370 - DNA, 25 bp, S. cerevisiae
tgttgttctttgtacactgtcgatc

SEQ ID NO: 52371 - DNA, 25 bp, S. cerevisiae
tgatatctccttaccaaatgggcat

SEQ ID NO: 52372 - DNA, 25 bp, S. cerevisiae
tgttcagccaattccaaactggatt

SEQ ID NO: 52373 - DNA, 25 bp, S. cerevisiae
tgattcactccaacctaatctggct

SEQ ID NO: 52374 - DNA, 25 bp, S. cerevisiae
tgacatactcggcttcaagatcgct

SEQ ID NO: 52375 - DNA, 25 bp, S. cerevisiae
tgattattcgatcgttcagcccgca

SEQ ID NO: 52376 - DNA, 25 bp, S. cerevisiae
tgttgaatcgaggttctgcccagca

SEQ ID NO: 52377 - DNA, 25 bp, S. cerevisiae
tgttcaatgtgctagccatctgggc

SEQ ID NO: 52378 - DNA, 25 bp, S. cerevisiae
tgttcttggccaccttgatgtgcat

SEQ ID NO: 52379 - DNA, 25 bp, S. cerevisiae
tgtattcctggtttggcgtcacaca

SEQ ID NO: 52380 - DNA, 25 bp, S. cerevisiae
tgatatttcgagaacgtggcccaat

SEQ ID NO: 52381 - DNA, 25 bp, S. cerevisiae
tgatgttttgaaccgtggcaacact

SEQ ID NO: 52382 - DNA, 25 bp, S. cerevisiae
tgattaaggtcaacggttctccaat

SEQ ID NO: 52383 - DNA, 25 bp, S. cerevisiae
tgttttccactccattttaccatca

SEQ ID NO: 52384 - DNA, 25 bp, S. cerevisiae
tgttgtgcccactcttttcaagaaa

SEQ ID NO: 52385 - DNA, 25 bp, S. cerevisiae
tgttctcccaacatcagtgtcaatg

SEQ ID NO: 52386 - DNA, 25 bp, S. cerevisiae
tgagctactgagacgccaattggaa

SEQ ID NO: 52387 - DNA, 25 bp, S. cerevisiae
tgacgatggcgcagtggagatataa

SEQ ID NO: 52388 - DNA, 25 bp, S. cerevisiae
tgacgggcgtacgaggcataatact

SEQ ID NO: 52389 - DNA, 25 bp, S. cerevisiae
taccccgtaccttgtgaattccaat

SEQ ID NO: 52390 - DNA, 25 bp, S. cerevisiae
tgatctcccacatggcgttactgta

SEQ ID NO: 52391 - DNA, 25 bp, S. cerevisiae
tgttcttctaattgctctatcggga

SEQ ID NO: 52392 - DNA, 25 bp, S. cerevisiae
tgatagctcgaaaacacgcaatgtt

SEQ ID NO: 52393 - DNA, 25 bp, S. cerevisiae
tgctacctctaatcggaatggctcc

SEQ ID NO: 52394 - DNA, 25 bp, S. cerevisiae
tgttggctctttacgtcatttgtca

SEQ ID NO: 52395 - DNA, 25 bp, S. cerevisiae
tgttgccgttggattcatctgttca

SEQ ID NO: 52396 - DNA, 25 bp, S. cerevisiae
tgcttgtcggtgatgttgctggtaa

SEQ ID NO: 52397 - DNA, 25 bp, S. cerevisiae
tgtttcacaacaattctccggcata

SEQ ID NO: 52398 - DNA, 25 bp, S. cerevisiae
tgttttcatcgctattttcgctgat

SEQ ID NO: 52399 - DNA, 25 bp, S. cerevisiae
tgaaaactgaattacaaaccgctag

SEQ ID NO: 52400 - DNA, 25 bp, S. cerevisiae
tgagggcaccaacaaggaccagcta

SEQ ID NO: 52401 - DNA, 25 bp, S. cerevisiae
tgatggacccttcaaacctagctga

SEQ ID NO: 52402 - DNA, 25 bp, S. cerevisiae
tgttggaccttcttcgataaatcgt

SEQ ID NO: 52403 - DNA, 25 bp, S. cerevisiae
tgtttacattcctcactgactatcg

SEQ ID NO: 52404 - DNA, 25 bp, S. cerevisiae
tcatttaaccgatcctcagcaagtc

SEQ ID NO: 52405 - DNA, 25 bp, S. cerevisiae
ttaatggacggtgcccacaatggct

SEQ ID NO: 52406 - DNA, 25 bp, S. cerevisiae
tatgaaggaagatgccccaccgggt

SEQ ID NO: 52407 - DNA, 25 bp, S. cerevisiae
tgagcaaattaagccaaccactgag

SEQ ID NO: 52408 - DNA, 25 bp, S. cerevisiae
tgattaacgccactccaactatggt

SEQ ID NO: 52409 - DNA, 25 bp, S. cerevisiae
tgctaaatcaggagccaacttgttt

SEQ ID NO: 52410 - DNA, 25 bp, S. cerevisiae
tgcttgaacaggaaggacgccgtat

SEQ ID NO: 52411 - DNA, 25 bp, S. cerevisiae
tgttgaacagagattttgagcgtga

SEQ ID NO: 52412 - DNA, 25 bp, S. cerevisiae
tgttgaacagagattttgagcgtga

SEQ ID NO: 52413 - DNA, 25 bp, S. cerevisiae
tgagcgcccatttgcatgtcaggtt

SEQ ID NO: 52414 - DNA, 25 bp, S. cerevisiae
tgcatcgagctttgggagacattct

SEQ ID NO: 52415 - DNA, 25 bp, S. cerevisiae
tgatttcgagggtaagcttctacaa

SEQ ID NO: 52416 - DNA, 25 bp, S. cerevisiae
tgacgttgaagatccgttcattgat

SEQ ID NO: 52417 - DNA, 25 bp, S. cerevisiae
tgagctcggtgtttccatggttatt

SEQ ID NO: 52418 - DNA, 25 bp, S. cerevisiae
tgagtccttcttacatcaatgtttt

SEQ ID NO: 52419 - DNA, 25 bp, S. cerevisiae
tgaatcctaccgactcaattttaag

SEQ ID NO: 52420 - DNA, 25 bp, S. cerevisiae
tgttcttttattagtcgctccagca

SEQ ID NO: 52421 - DNA, 25 bp, S. cerevisiae
tgatgccttcttgcgtaaatactat

SEQ ID NO: 52422 - DNA, 25 bp, S. cerevisiae
tgagatgctcatccattcagataag

SEQ ID NO: 52423 - DNA, 25 bp, S. cerevisiae
tgatgatgcatcctcagcggaactt

SEQ ID NO: 52424 - DNA, 25 bp, S. cerevisiae
tgaggctgccattgctgggatgcaa

SEQ ID NO: 52425 - DNA, 25 bp, S. cerevisiae
tgagcagtcgatggcagcaaagcaa

SEQ ID NO: 52426 - DNA, 25 bp, S. cerevisiae
tgatgatgactgtaacaacaccggt

SEQ ID NO: 52427 - DNA, 25 bp, S. cerevisiae
tgttggcgctaacacatcagcagca

SEQ ID NO: 52428 - DNA, 25 bp, S. cerevisiae
tgttgccgataacttcttcattgct

SEQ ID NO: 52429 - DNA, 25 bp, S. cerevisiae
tgatctctgcttccatatcacgaat

SEQ ID NO: 52430 - DNA, 25 bp, S. cerevisiae
tgttatgctagattgccaccaagag

SEQ ID NO: 52431 - DNA, 25 bp, S. cerevisiae
tgttgtcggataatgcctctgctgc

SEQ ID NO: 52432 - DNA, 25 bp, S. cerevisiae
tgattgccggcatatgcgtcgatgt

SEQ ID NO: 52433 - DNA, 25 bp, S. cerevisiae
tgttggtcaatcttccctatcagaa

SEQ ID NO: 52434 - DNA, 25 bp, S. cerevisiae
tgttgaaatcacacccttagcacac

SEQ ID NO: 52435 - DNA, 25 bp, S. cerevisiae
tgatctcaagccactatccacaaat

SEQ ID NO: 52436 - DNA, 25 bp, S. cerevisiae
tgttcaatcacaagctagccccaaa

SEQ ID NO: 52437 - DNA, 25 bp, S. cerevisiae
tgttgtagtatagtgccgccattat

SEQ ID NO: 52438 - DNA, 25 bp, S. cerevisiae
tgatagatttatcaccagccttccc

SEQ ID NO: 52439 - DNA, 25 bp, S. cerevisiae
tgagtaataactacggcacttcccc

SEQ ID NO: 52440 - DNA, 25 bp, S. cerevisiae
tgaattaatccgttcttaccgttct

SEQ ID NO: 52441 - DNA, 25 bp, S. cerevisiae
tgaattaaccggcattccaccagca

SEQ ID NO: 52442 - DNA, 25 bp, S. cerevisiae
tgatgaaatcccttggtattaccca

SEQ ID NO: 52443 - DNA, 25 bp, S. cerevisiae
tagactctacagtggtttacccttt

SEQ ID NO: 52444 - DNA, 25 bp, S. cerevisiae
tgaaggtgccagtggttctcacggc

SEQ ID NO: 52445 - DNA, 25 bp, S. cerevisiae
tgatgttggctttcccaaaagttta

SEQ ID NO: 52446 - DNA, 25 bp, S. cerevisiae
tgatgttggttttcctactaatttt

SEQ ID NO: 52447 - DNA, 25 bp, S. cerevisiae
tgatatctggtacatgcctgactat

SEQ ID NO: 52448 - DNA, 25 bp, S. cerevisiae
tgttcaagtcacaatgccgcagtaa

SEQ ID NO: 52449 - DNA, 25 bp, S. cerevisiae
tgaatctaatgctccgctaactgct

SEQ ID NO: 52450 - DNA, 25 bp, S. cerevisiae
tgacattagagttgccgctatccgc

SEQ ID NO: 52451 - DNA, 25 bp, S. cerevisiae
tgataagaggttccacttggccctt

SEQ ID NO: 52452 - DNA, 25 bp, S. cerevisiae
tgatcaacgatcctgaactcgcaaa

SEQ ID NO: 52453 - DNA, 25 bp, S. cerevisiae
tgataacgaccataccagcacatag

SEQ ID NO: 52454 - DNA, 25 bp, S. cerevisiae
tgatacaccatctacagacccaaag

SEQ ID NO: 52455 - DNA, 25 bp, S. cerevisiae
tgacacatccttgcaggagcagaaa

SEQ ID NO: 52456 - DNA, 25 bp, S. cerevisiae
tgatgcaacatcagcgcctcaatca

SEQ ID NO: 52457 - DNA, 25 bp, S. cerevisiae
tgttctctgatctactttaagttga

SEQ ID NO: 52458 - DNA, 25 bp, S. cerevisiae
tgatatcttgaccaccttggcttaa

SEQ ID NO: 52459 - DNA, 25 bp, S. cerevisiae
tgatgctttgaccactactactttg

SEQ ID NO: 52460 - DNA, 25 bp, S. cerevisiae
tgatgtgcttattcgctgactacct

SEQ ID NO: 52461 - DNA, 25 bp, S. cerevisiae
tgatggcagctctccgcaggatgac

SEQ ID NO: 52462 - DNA, 25 bp, S. cerevisiae
tgttcattgacacatgcccaaccat

SEQ ID NO: 52463 - DNA, 25 bp, S. cerevisiae
tgttccgggtacttatccacagtat

SEQ ID NO: 52464 - DNA, 25 bp, S. cerevisiae
tgatctatcccaagagaactcgctt

SEQ ID NO: 52465 - DNA, 25 bp, S. cerevisiae
tgatgctccacaagaagaagggctt

SEQ ID NO: 52466 - DNA, 25 bp, S. cerevisiae
tgagataccctccaaatagcgcaca

SEQ ID NO: 52467 - DNA, 25 bp, S. cerevisiae
tgatgatcacatgggcagcacagat

SEQ ID NO: 52468 - DNA, 25 bp, S. cerevisiae
tgatctcaatgcagactcgaccgga

SEQ ID NO: 52469 - DNA, 25 bp, S. cerevisiae
tgttgacaaaacctccccaatagac

SEQ ID NO: 52470 - DNA, 25 bp, S. cerevisiae
tgttgaggacagacgcttcagccga

SEQ ID NO: 52471 - DNA, 25 bp, S. cerevisiae
tgttgatggcaccattctttgccga

SEQ ID NO: 52472 - DNA, 25 bp, S. cerevisiae
tgatatcgtcacaacatctttccgc

SEQ ID NO: 52473 - DNA, 25 bp, S. cerevisiae
tgaaccccgcaatggccaaaactaa

SEQ ID NO: 52474 - DNA, 25 bp, S. cerevisiae
taaacccgccgatcaaaacgctaag

SEQ ID NO: 52475 - DNA, 25 bp, S. cerevisiae
tgatggtaccctccgtagttcaaac

SEQ ID NO: 52476 - DNA, 25 bp, S. cerevisiae
tgagtcgcacatgggcattagcatt

SEQ ID NO: 52477 - DNA, 25 bp, S. cerevisiae
tgagtccaatgtggcatccaaacgt

SEQ ID NO: 52478 - DNA, 25 bp, S. cerevisiae
tgatgatgccagtcatggtcccaac

SEQ ID NO: 52479 - DNA, 25 bp, S. cerevisiae
tgagagccagtcaatcgcagcagat

SEQ ID NO: 52480 - DNA, 25 bp, S. cerevisiae
tgatattgcaccttgtcatggccat

SEQ ID NO: 52481 - DNA, 25 bp, S. cerevisiae
tgatggtacacttgcgacagctgtc

SEQ ID NO: 52482 - DNA, 25 bp, S. cerevisiae
tgatatgtccacaagcaagccagct

SEQ ID NO: 52483 - DNA, 25 bp, S. cerevisiae
tgattgctacgtccaatacgcatcc

SEQ ID NO: 52484 - DNA, 25 bp, S. cerevisiae
tgttcttcgtatatgagctcttcaa

SEQ ID NO: 52485 - DNA, 25 bp, S. cerevisiae
tgttggcccgttttgactcttcaaa

SEQ ID NO: 52486 - DNA, 25 bp, S. cerevisiae
tgttggattcgtatttgtttgcaat

SEQ ID NO: 52487 - DNA, 25 bp, S. cerevisiae
tgatacagctatttccgggtggagt

SEQ ID NO: 52488 - DNA, 25 bp, S. cerevisiae
tgataagttttcgtggaggttgcca

SEQ ID NO: 52489 - DNA, 25 bp, S. cerevisiae
tgatcaagctggagcctagggccta

SEQ ID NO: 52490 - DNA, 25 bp, S. cerevisiae
tgatcgatgcgtatggtggagacct

SEQ ID NO: 52491 - DNA, 25 bp, S. cerevisiae
tgatcttcgttctaggaggacccgg

SEQ ID NO: 52492 - DNA, 25 bp, S. cerevisiae
tgttcctctacaataatgccccaag

SEQ ID NO: 52493 - DNA, 25 bp, S. cerevisiae
tgttctatctacatccgtgttcgga

SEQ ID NO: 52494 - DNA, 25 bp, S. cerevisiae
tgttctcactacatctttgattgga

SEQ ID NO: 52495 - DNA, 25 bp, S. cerevisiae
tgatttcgatcatttgcactgtaaa

SEQ ID NO: 52496 - DNA, 25 bp, S. cerevisiae
tgattcctgtctccgtttatgataa

SEQ ID NO: 52497 - DNA, 25 bp, S. cerevisiae
tgattactgcctctcaattgattaa

SEQ ID NO: 52498 - DNA, 25 bp, S. cerevisiae
tgatctactcccctcatctttatat

SEQ ID NO: 52499 - DNA, 25 bp, S. cerevisiae
tgttgtcacttcctatgttgtctat

SEQ ID NO: 52500 - DNA, 25 bp, S. cerevisiae
tgttgatcctatctatcttgccagt

SEQ ID NO: 52501 - DNA, 25 bp, S. cerevisiae
tgattgtgaatcttgaccctgtccc

SEQ ID NO: 52502 - DNA, 25 bp, S. cerevisiae
tgatgaggtcattgggtctttcgcc

SEQ ID NO: 52503 - DNA, 25 bp, S. cerevisiae
tgatgaggccttgggctgcatttac

SEQ ID NO: 52504 - DNA, 25 bp, S. cerevisiae
tgagggagatcatcgccattgcggc

SEQ ID NO: 52505 - DNA, 25 bp, S. cerevisiae
tgaggatggctcgaccctactaatc

SEQ ID NO: 52506 - DNA, 25 bp, S. cerevisiae
tgagactcccatcattgccatgaca

SEQ ID NO: 52507 - DNA, 25 bp, S. cerevisiae
tgagtctattctcactgccaagcaa

SEQ ID NO: 52508 - DNA, 25 bp, S. cerevisiae
tgatagcatctctgactgccaacag

SEQ ID NO: 52509 - DNA, 25 bp, S. cerevisiae
tgatcctcgtcgtctaaacgtgggt

SEQ ID NO: 52510 - DNA, 25 bp, S. cerevisiae
tgatcaaggttaatggttctccaat

SEQ ID NO: 52511 - DNA, 25 bp, S. cerevisiae
tgacccgttacaagtatccaagcct

SEQ ID NO: 52512 - DNA, 25 bp, S. cerevisiae
tgagataccctaatttgtccgacct

SEQ ID NO: 52513 - DNA, 25 bp, S. cerevisiae
tgagatgcgcggatgttttccaaaa

SEQ ID NO: 52514 - DNA, 25 bp, S. cerevisiae
tgagttagaatttttgggccaggaa

SEQ ID NO: 52515 - DNA, 25 bp, S. cerevisiae
tgagcttacgtaaccgcagcccaaa

SEQ ID NO: 52516 - DNA, 25 bp, S. cerevisiae
tgacgcttccaaactcgcaaggtaa

SEQ ID NO: 52517 - DNA, 25 bp, S. cerevisiae
tgagcctaagccatctacaaactga

SEQ ID NO: 52518 - DNA, 25 bp, S. cerevisiae
tgacgacatgtcatcttacaacgac

SEQ ID NO: 52519 - DNA, 25 bp, S. cerevisiae
tgactgccatcattgtagtgctaaa

SEQ ID NO: 52520 - DNA, 25 bp, S. cerevisiae
tgactcgcacttctgtttggactta

SEQ ID NO: 52521 - DNA, 25 bp, S. cerevisiae
tgttgcctgctttatttctggttgt

SEQ ID NO: 52522 - DNA, 25 bp, S. cerevisiae
tgcagtggcaagcttgtattctccc

SEQ ID NO: 52523 - DNA, 25 bp, S. cerevisiae
tgctggctgcatatgtttaacaccc

SEQ ID NO: 52524 - DNA, 25 bp, S. cerevisiae
tgaggcttcgttctacactgtattg

SEQ ID NO: 52525 - DNA, 25 bp, S. cerevisiae
tgttgcccagttcaaatcagtgtat

SEQ ID NO: 52526 - DNA, 25 bp, S. cerevisiae
ttggcggttttcagaagtgtccctt

SEQ ID NO: 52527 - DNA, 25 bp, S. cerevisiae
tgatataagagtacgcctggctgaa

SEQ ID NO: 52528 - DNA, 25 bp, S. cerevisiae
tgatcttaactcaagcttgcctacg

SEQ ID NO: 52529 - DNA, 25 bp, S. cerevisiae
tgattacacagagcgttagtcctaa

SEQ ID NO: 52530 - DNA, 25 bp, S. cerevisiae
tgcgtattgcaatctgttaacccag

SEQ ID NO: 52531 - DNA, 25 bp, S. cerevisiae
tgaaaggcggatttgacccgaaaat

SEQ ID NO: 52532 - DNA, 25 bp, S. cerevisiae
tgaaggccggcacttacccaaagat

SEQ ID NO: 52533 - DNA, 25 bp, S. cerevisiae
tgaacgagaagctttacgcccataa

SEQ ID NO: 52534 - DNA, 25 bp, S. cerevisiae
taacgacaggatgtcacccttacct

SEQ ID NO: 52535 - DNA, 25 bp, S. cerevisiae
ttacgcgagtcgcaagcactactca

SEQ ID NO: 52536 - DNA, 25 bp, S. cerevisiae
taatcgcggtagtgagcattacaca

SEQ ID NO: 52537 - DNA, 25 bp, S. cerevisiae
taatagggcacctggctccaatggt

SEQ ID NO: 52538 - DNA, 25 bp, S. cerevisiae
tgatgaaacagagcgttccctccat

SEQ ID NO: 52539 - DNA, 25 bp, S. cerevisiae
tgagaaaaaccggtggcgcccatga

SEQ ID NO: 52540 - DNA, 25 bp, S. cerevisiae
tgagaccattccacgtagctttatg

SEQ ID NO: 52541 - DNA, 25 bp, S. cerevisiae
tgagagccaagtcgccgtatgcatg

SEQ ID NO: 52542 - DNA, 25 bp, S. cerevisiae
tgatgaagaacccaccttccttatc

SEQ ID NO: 52543 - DNA, 25 bp, S. cerevisiae
tgatgaagcaatcctggccttggcc

SEQ ID NO: 52544 - DNA, 25 bp, S. cerevisiae
tgagattcactgctggtgccagagc

SEQ ID NO: 52545 - DNA, 25 bp, S. cerevisiae
tgagaaactagttgctgccgacagc

SEQ ID NO: 52546 - DNA, 25 bp, S. cerevisiae
tgagacaaaagcaggccgccgcaga

SEQ ID NO: 52547 - DNA, 25 bp, S. cerevisiae
tgatgaactagtcgaggccagctcc

SEQ ID NO: 52548 - DNA, 25 bp, S. cerevisiae
tgatgaacatggacggtgacactaa

SEQ ID NO: 52549 - DNA, 25 bp, S. cerevisiae
tgaccaaggaagctgccgctatcgc

SEQ ID NO: 52550 - DNA, 25 bp, S. cerevisiae
tgaccaaagaagctgccgctgttgc

SEQ ID NO: 52551 - DNA, 25 bp, S. cerevisiae
tgatgtctcctgcataatcggtgaa

SEQ ID NO: 52552 - DNA, 25 bp, S. cerevisiae
tgagcttctcagcaacacgaaatgt

SEQ ID NO: 52553 - DNA, 25 bp, S. cerevisiae
tgaccccagctccaaaaatctctta

SEQ ID NO: 52554 - DNA, 25 bp, S. cerevisiae
tgagtaccagccaactgtttacctt

SEQ ID NO: 52555 - DNA, 25 bp, S. cerevisiae
tgagcgttactgcagggttcctatt

SEQ ID NO: 52556 - DNA, 25 bp, S. cerevisiae
tgaggtttctcgtatggttcttgtt

SEQ ID NO: 52557 - DNA, 25 bp, S. cerevisiae
tgagggttcctgttccattttaggt

SEQ ID NO: 52558 - DNA, 25 bp, S. cerevisiae
tgccgtacttttacacgtgaccgta

SEQ ID NO: 52559 - DNA, 25 bp, S. cerevisiae
tgattggctatggtccacatgcttt

SEQ ID NO: 52560 - DNA, 25 bp, S. cerevisiae
tgctaacaagaacaccatcccaggt

SEQ ID NO: 52561 - DNA, 25 bp, S. cerevisiae
tgacaacaagtacctgcctgaccag

SEQ ID NO: 52562 - DNA, 25 bp, S. cerevisiae
tgataacaagatttcggtaccatta

SEQ ID NO: 52563 - DNA, 25 bp, S. cerevisiae
tgatagacaagcacctgggcgccaa

SEQ ID NO: 52564 - DNA, 25 bp, S. cerevisiae
tgagctcgagtcttcagaacgtgaa

SEQ ID NO: 52565 - DNA, 25 bp, S. cerevisiae
tgatggctccagactagttcgtaga

SEQ ID NO: 52566 - DNA, 25 bp, S. cerevisiae
tgttggctacatcctttccatagac

SEQ ID NO: 52567 - DNA, 25 bp, S. cerevisiae
tgatgggtatttgtgtccggacacc

SEQ ID NO: 52568 - DNA, 25 bp, S. cerevisiae
tgaggtgcacccaggagatgctctt

SEQ ID NO: 52569 - DNA, 25 bp, S. cerevisiae
tgaggatgacagtgacgaacgcttc

SEQ ID NO: 52570 - DNA, 25 bp, S. cerevisiae
tgatgcgtaaatcgccaagggcgtc

SEQ ID NO: 52571 - DNA, 25 bp, S. cerevisiae
tgacatattgtgactactctaggac

SEQ ID NO: 52572 - DNA, 25 bp, S. cerevisiae
tgacattgctatccgccggcaagca

SEQ ID NO: 52573 - DNA, 25 bp, S. cerevisiae
tgatcacatcaacggctctggcaaa

SEQ ID NO: 52574 - DNA, 25 bp, S. cerevisiae
tgacattcgtcatctgttagcaaat

SEQ ID NO: 52575 - DNA, 25 bp, S. cerevisiae
tgattccgctcctgttgagcaacaa

SEQ ID NO: 52576 - DNA, 25 bp, S. cerevisiae
tgattccactactctgctcgaaagt

SEQ ID NO: 52577 - DNA, 25 bp, S. cerevisiae
tgattgcgcctttgtcagctaacac

SEQ ID NO: 52578 - DNA, 25 bp, S. cerevisiae
tgatttctattccaacactttgaga

SEQ ID NO: 52579 - DNA, 25 bp, S. cerevisiae
tgatgctgttacaaccctacacgca

SEQ ID NO: 52580 - DNA, 25 bp, S. cerevisiae
tgatcatgttcatcgcctcaaacga

SEQ ID NO: 52581 - DNA, 25 bp, S. cerevisiae
tgactgtagtacccgcaataataat

SEQ ID NO: 52582 - DNA, 25 bp, S. cerevisiae
tgacgacagtcagtgggtaccagga

SEQ ID NO: 52583 - DNA, 25 bp, S. cerevisiae
tgatatgttacttccacttggcggt

SEQ ID NO: 52584 - DNA, 25 bp, S. cerevisiae
tgatggttgatttcaccctggtggg

SEQ ID NO: 52585 - DNA, 25 bp, S. cerevisiae
tgatggttttggtctagcttgggca

SEQ ID NO: 52586 - DNA, 25 bp, S. cerevisiae
tgatacaactttactgtcaggtgga

SEQ ID NO: 52587 - DNA, 25 bp, S. cerevisiae
tgatgacgaccttaattacttgctg

SEQ ID NO: 52588 - DNA, 25 bp, S. cerevisiae
tgatttgatcccgttagcttccagg

SEQ ID NO: 52589 - DNA, 25 bp, S. cerevisiae
tgattatacgccgtcaatctccgat

SEQ ID NO: 52590 - DNA, 25 bp, S. cerevisiae
tgattcgaccacatcttcacttgat

SEQ ID NO: 52591 - DNA, 25 bp, S. cerevisiae
tgattctactattcctgccacggta

SEQ ID NO: 52592 - DNA, 25 bp, S. cerevisiae
tgatcctgttactttgcatgcaccg

SEQ ID NO: 52593 - DNA, 25 bp, S. cerevisiae
tgatttactgcatttggccacctac

SEQ ID NO: 52594 - DNA, 25 bp, S. cerevisiae
tgatttactgattcttccaccaggc

SEQ ID NO: 52595 - DNA, 25 bp, S. cerevisiae
tgattgggatgcttgttacacacag

SEQ ID NO: 52596 - DNA, 25 bp, S. cerevisiae
tgaggcctatgcttgatttcaacgt

SEQ ID NO: 52597 - DNA, 25 bp, S. cerevisiae
tgagagatcatcgacaccttgtaga

SEQ ID NO: 52598 - DNA, 25 bp, S. cerevisiae
tgatgaccactgtccactctttgac

SEQ ID NO: 52599 - DNA, 25 bp, S. cerevisiae
tgactcatgtgtttggttggcggaa

SEQ ID NO: 52600 - DNA, 25 bp, S. cerevisiae
tgatctatgttgtagctgcgctggc

SEQ ID NO: 52601 - DNA, 25 bp, S. cerevisiae
tgaccatcctgcgtgacggctatta

SEQ ID NO: 52602 - DNA, 25 bp, S. cerevisiae
tgattgctttcgaactgtgctttga

SEQ ID NO: 52603 - DNA, 25 bp, S. cerevisiae
tgattacttagcttcctcagcatgg

SEQ ID NO: 52604 - DNA, 25 bp, S. cerevisiae
tgagattgcataccttttccataat

SEQ ID NO: 52605 - DNA, 25 bp, S. cerevisiae
taatccggatgacactacagttgac

SEQ ID NO: 52606 - DNA, 25 bp, S. cerevisiae
tgaatccaccgaggtcgacgttgat

SEQ ID NO: 52607 - DNA, 25 bp, S. cerevisiae
tgataagcccgactcccaagtattt

SEQ ID NO: 52608 - DNA, 25 bp, S. cerevisiae
tgagggcgcttcacttaacgacgat

SEQ ID NO: 52609 - DNA, 25 bp, S. cerevisiae
tgatcgtcattggtgtcgtgtccat

SEQ ID NO: 52610 - DNA, 25 bp, S. cerevisiae
tgacttattcgcatcgtgtatcaat

SEQ ID NO: 52611 - DNA, 25 bp, S. cerevisiae
tgacctcacctcatgagttaactgt

SEQ ID NO: 52612 - DNA, 25 bp, S. cerevisiae
tgagcctaaccactatttcaactcc

SEQ ID NO: 52613 - DNA, 25 bp, S. cerevisiae
tgacctgtggtctagtacgaataag

SEQ ID NO: 52614 - DNA, 25 bp, S. cerevisiae
tgatctgttcgtgcatcacacttag

SEQ ID NO: 52615 - DNA, 25 bp, S. cerevisiae
tgaagttagacccatcccgttttgg

SEQ ID NO: 52616 - DNA, 25 bp, S. cerevisiae
tgatggttaccatcatctccgctat

SEQ ID NO: 52617 - DNA, 25 bp, S. cerevisiae
tgatgccatcaacgaggccttgact

SEQ ID NO: 52618 - DNA, 25 bp, S. cerevisiae
tgatgccatcaatattcgcctagat

SEQ ID NO: 52619 - DNA, 25 bp, S. cerevisiae
tgatactccagcagtcgcaattagt

SEQ ID NO: 52620 - DNA, 25 bp, S. cerevisiae
tgatacccgctcttttatttacagg

SEQ ID NO: 52621 - DNA, 25 bp, S. cerevisiae
tgaaactgctttgttgacttccggc

SEQ ID NO: 52622 - DNA, 25 bp, S. cerevisiae
tgaaaagcttccttcgaaacgcgac

SEQ ID NO: 52623 - DNA, 25 bp, S. cerevisiae
tgaaaacttggcttccggagccggt

SEQ ID NO: 52624 - DNA, 25 bp, S. cerevisiae
tagaaccaagactccaggtccaggt

SEQ ID NO: 52625 - DNA, 25 bp, S. cerevisiae
tgatgaacccatttgaccaagtcga

SEQ ID NO: 52626 - DNA, 25 bp, S. cerevisiae
tgatatcatctcagctgtcaagccg

SEQ ID NO: 52627 - DNA, 25 bp, S. cerevisiae
tgatttcttgggtgacactcacgct

SEQ ID NO: 52628 - DNA, 25 bp, S. cerevisiae
tgatgcttcttacattcaccttcgt

SEQ ID NO: 52629 - DNA, 25 bp, S. cerevisiae
tgagcccttagccactattatatcg

SEQ ID NO: 52630 - DNA, 25 bp, S. cerevisiae
tgagaagcctcggaagtccaagcgt

SEQ ID NO: 52631 - DNA, 25 bp, S. cerevisiae
tgagagccaccgcaccaaaagttag

SEQ ID NO: 52632 - DNA, 25 bp, S. cerevisiae
tgatgtccctacaccatctaagtta

SEQ ID NO: 52633 - DNA, 25 bp, S. cerevisiae
tgatgtccacgatactcaccaaatc

SEQ ID NO: 52634 - DNA, 25 bp, S. cerevisiae
tgatgtaaacgctactgcctcaaat

SEQ ID NO: 52635 - DNA, 25 bp, S. cerevisiae
tgactagaacgccatcaccaacagg

SEQ ID NO: 52636 - DNA, 25 bp, S. cerevisiae
tgatagaatccacctttcgatccat

SEQ ID NO: 52637 - DNA, 25 bp, S. cerevisiae
tgaggaacccactctaaccacgatg

SEQ ID NO: 52638 - DNA, 25 bp, S. cerevisiae
tgcagcggtaccactctatagagcc

SEQ ID NO: 52639 - DNA, 25 bp, S. cerevisiae
tgagggcccgcaaggaaagatccat

SEQ ID NO: 52640 - DNA, 25 bp, S. cerevisiae
tgaggcgccgtgatctgaaaattct

SEQ ID NO: 52641 - DNA, 25 bp, S. cerevisiae
tgatgacttcgtccatagaccaagt

SEQ ID NO: 52642 - DNA, 25 bp, S. cerevisiae
tgatgagcatttctgctactgcgcc

SEQ ID NO: 52643 - DNA, 25 bp, S. cerevisiae
tgagcagcattccagctggcactga

SEQ ID NO: 52644 - DNA, 25 bp, S. cerevisiae
tgaacgtcggtaacgtcttgccatt

SEQ ID NO: 52645 - DNA, 25 bp, S. cerevisiae
tgatactgccgggaactgtgttcaa

SEQ ID NO: 52646 - DNA, 25 bp, S. cerevisiae
tgatcctggttgtcctcggttctaa

SEQ ID NO: 52647 - DNA, 25 bp, S. cerevisiae
tgaccgcgttgaccattcattgtaa

SEQ ID NO: 52648 - DNA, 25 bp, S. cerevisiae
tgaacctggtcctttagttttccat

SEQ ID NO: 52649 - DNA, 25 bp, S. cerevisiae
tgaacctctgtccttttcttttttg

SEQ ID NO: 52650 - DNA, 25 bp, S. cerevisiae
tgatatttttctttctctccttgta

SEQ ID NO: 52651 - DNA, 25 bp, S. cerevisiae
tgatcttttacaatactcttccgaa

SEQ ID NO: 52652 - DNA, 25 bp, S. cerevisiae
tgatgatttctctagtgactcttcc

SEQ ID NO: 52653 - DNA, 25 bp, S. cerevisiae
tgatacctgtcttctgtatagtgac

SEQ ID NO: 52654 - DNA, 25 bp, S. cerevisiae
tgaagggtccgtttaccacgaatgg

SEQ ID NO: 52655 - DNA, 25 bp, S. cerevisiae
tgagaggatgatgcgccaaaccaaa

SEQ ID NO: 52656 - DNA, 25 bp, S. cerevisiae
tgagacgattaccaatactggagct

SEQ ID NO: 52657 - DNA, 25 bp, S. cerevisiae
tgatgacggctacggcaacaaggat

SEQ ID NO: 52658 - DNA, 25 bp, S. cerevisiae
tgatacaggccacttgcacgtcaga

SEQ ID NO: 52659 - DNA, 25 bp, S. cerevisiae
tgagaaggaagaagctcgtcaagct

SEQ ID NO: 52660 - DNA, 25 bp, S. cerevisiae
tgataaaattgacctcccagagcta

SEQ ID NO: 52661 - DNA, 25 bp, S. cerevisiae
tgataccaacatagtttggccgtga

SEQ ID NO: 52662 - DNA, 25 bp, S. cerevisiae
tgatcgatatcgtgctccagaaata

SEQ ID NO: 52663 - DNA, 25 bp, S. cerevisiae
tgatgtgtttgctcccggtataaat

SEQ ID NO: 52664 - DNA, 25 bp, S. cerevisiae
tgataatatgactctcccactgaac

SEQ ID NO: 52665 - DNA, 25 bp, S. cerevisiae
tgagacaggacatgccccaagtggt

SEQ ID NO: 52666 - DNA, 25 bp, S. cerevisiae
tgaacagttcaaccccaagtacggc

SEQ ID NO: 52667 - DNA, 25 bp, S. cerevisiae
tgagaaatttcaccccaagtacgag

SEQ ID NO: 52668 - DNA, 25 bp, S. cerevisiae
tgatgaaaacacagccctcttaggg

SEQ ID NO: 52669 - DNA, 25 bp, S. cerevisiae
tgatgaaagcactcctgatcctcaa

SEQ ID NO: 52670 - DNA, 25 bp, S. cerevisiae
tgataatatcacacctacaccagct

SEQ ID NO: 52671 - DNA, 25 bp, S. cerevisiae
tgagaggagccgaactacccacttg

SEQ ID NO: 52672 - DNA, 25 bp, S. cerevisiae
tgatcggaatgggtctcacggcctt

SEQ ID NO: 52673 - DNA, 25 bp, S. cerevisiae
tgagatcaaatagcctacgccgcgt

SEQ ID NO: 52674 - DNA, 25 bp, S. cerevisiae
tgataaattcatgagctccgccaag

SEQ ID NO: 52675 - DNA, 25 bp, S. cerevisiae
tgataacttggctatctccgcacaa

SEQ ID NO: 52676 - DNA, 25 bp, S. cerevisiae
tgatgaactctctttcgaactctgc

SEQ ID NO: 52677 - DNA, 25 bp, S. cerevisiae
tgatgaacccagtgtaagcccttcg

SEQ ID NO: 52678 - DNA, 25 bp, S. cerevisiae
tgagttatcgtcgaagtttcccaaa

SEQ ID NO: 52679 - DNA, 25 bp, S. cerevisiae
tgagtctcttggacgttttcagaaa

SEQ ID NO: 52680 - DNA, 25 bp, S. cerevisiae
tgaccaccctgacgccgataaaaat

SEQ ID NO: 52681 - DNA, 25 bp, S. cerevisiae
tgacgacccatcctctaataagaaa

SEQ ID NO: 52682 - DNA, 25 bp, S. cerevisiae
tgatgtgcgtctgtatcccaaaaaa

SEQ ID NO: 52683 - DNA, 25 bp, S. cerevisiae
tgatgtcgccgattacaccatgaaa

SEQ ID NO: 52684 - DNA, 25 bp, S. cerevisiae
tgatgccctggatacaccggtggaa

SEQ ID NO: 52685 - DNA, 25 bp, S. cerevisiae
tgatgcctaacaaaaccgctgtgga

SEQ ID NO: 52686 - DNA, 25 bp, S. cerevisiae
tgatgcctaaccaagagccagatgt

SEQ ID NO: 52687 - DNA, 25 bp, S. cerevisiae
tgaccgatgaacagagacgcagatt

SEQ ID NO: 52688 - DNA, 25 bp, S. cerevisiae
tgacgacgtgcaacctgggagctat

SEQ ID NO: 52689 - DNA, 25 bp, S. cerevisiae
tgatcattcaagttccgcagtttcc

SEQ ID NO: 52690 - DNA, 25 bp, S. cerevisiae
tgactactctactggttctatcttg

SEQ ID NO: 52691 - DNA, 25 bp, S. cerevisiae
tgaaatcccagaaggtgttactgtc

SEQ ID NO: 52692 - DNA, 25 bp, S. cerevisiae
tgatgcaactgccaccaatgaactt

SEQ ID NO: 52693 - DNA, 25 bp, S. cerevisiae
tgatccaccttcctacgatgaatcg

SEQ ID NO: 52694 - DNA, 25 bp, S. cerevisiae
tgatgctttctctgctgatgccaac

SEQ ID NO: 52695 - DNA, 25 bp, S. cerevisiae
tgactgctgatagatggatgcccat

SEQ ID NO: 52696 - DNA, 25 bp, S. cerevisiae
tgagagtcttcaatggtggccacat

SEQ ID NO: 52697 - DNA, 25 bp, S. cerevisiae
tgacgtgttcgttatggcagccttt

SEQ ID NO: 52698 - DNA, 25 bp, S. cerevisiae
tgaccatttattcgatgcggccttt

SEQ ID NO: 52699 - DNA, 25 bp, S. cerevisiae
tgagcgttagcaatgatccctctgt

SEQ ID NO: 52700 - DNA, 25 bp, S. cerevisiae
tgaggttgccaagctagctgctgat

SEQ ID NO: 52701 - DNA, 25 bp, S. cerevisiae
tgatgttaccaatcaagcgctggac

SEQ ID NO: 52702 - DNA, 25 bp, S. cerevisiae
tgatcagtgacccaaactttgcgac

SEQ ID NO: 52703 - DNA, 25 bp, S. cerevisiae
tgatcattcaaccagaggccaccga

SEQ ID NO: 52704 - DNA, 25 bp, S. cerevisiae
tgatcatctcaaccacaaggtccat

SEQ ID NO: 52705 - DNA, 25 bp, S. cerevisiae
tgatgactcagacccaatactagtt

SEQ ID NO: 52706 - DNA, 25 bp, S. cerevisiae
tgatgcagcgcaaccgattttagct

SEQ ID NO: 52707 - DNA, 25 bp, S. cerevisiae
tgagaatagcctgtcgtccatgtta

SEQ ID NO: 52708 - DNA, 25 bp, S. cerevisiae
tgagttgacttgctggatcccatta

SEQ ID NO: 52709 - DNA, 25 bp, S. cerevisiae
tgatgttccaaacttcttctcagaa

SEQ ID NO: 52710 - DNA, 25 bp, S. cerevisiae
tgatctctcaaatccttttccagaa

SEQ ID NO: 52711 - DNA, 25 bp, S. cerevisiae
tgatgctggccataatcttttcctg

SEQ ID NO: 52712 - DNA, 25 bp, S. cerevisiae
tgatctcatctttaacttctggcga

SEQ ID NO: 52713 - DNA, 25 bp, S. cerevisiae
tcgaacatgcggctgaggacccaga

SEQ ID NO: 52714 - DNA, 25 bp, S. cerevisiae
tgagaactggtgtaggtaactgcaa

SEQ ID NO: 52715 - DNA, 25 bp, S. cerevisiae
tgcggagtggtatattggtctgaac

SEQ ID NO: 52716 - DNA, 25 bp, S. cerevisiae
tcaggactttggttcgtattaccca

SEQ ID NO: 52717 - DNA, 25 bp, S. cerevisiae
tgatgatacaaccacctcagcaggg

SEQ ID NO: 52718 - DNA, 25 bp, S. cerevisiae
tgagaaagagtccttgccaggccca

SEQ ID NO: 52719 - DNA, 25 bp, S. cerevisiae
tgatgtctgggatactgccggccaa

SEQ ID NO: 52720 - DNA, 25 bp, S. cerevisiae
tgagtctacagatctgcccggcgag

SEQ ID NO: 52721 - DNA, 25 bp, S. cerevisiae
tgatgttaataacgcgccggcaaga

SEQ ID NO: 52722 - DNA, 25 bp, S. cerevisiae
tgacaattactatcctggctggtat

SEQ ID NO: 52723 - DNA, 25 bp, S. cerevisiae
tgaactccggtatagtctacaaggt

SEQ ID NO: 52724 - DNA, 25 bp, S. cerevisiae
tgacctccggttactacttgggtga

SEQ ID NO: 52725 - DNA, 25 bp, S. cerevisiae
tgaggcacccgttttacttcaggaa

SEQ ID NO: 52726 - DNA, 25 bp, S. cerevisiae
tgaggcacagggacatatcgtttct

SEQ ID NO: 52727 - DNA, 25 bp, S. cerevisiae
tgagcgatgaaagctttgctgagtt

SEQ ID NO: 52728 - DNA, 25 bp, S. cerevisiae
tgacgacctagagttaaccaaccct

SEQ ID NO: 52729 - DNA, 25 bp, S. cerevisiae
tgacccacccgcataatcgtggaaa

SEQ ID NO: 52730 - DNA, 25 bp, S. cerevisiae
tgaccccgcctattttggtggttat

SEQ ID NO: 52731 - DNA, 25 bp, S. cerevisiae
tgagctacagttaccacgtgtcaga

SEQ ID NO: 52732 - DNA, 25 bp, S. cerevisiae
tgatgctactgtcgctcaaggtgta

SEQ ID NO: 52733 - DNA, 25 bp, S. cerevisiae
tctgctacgttgtcaatggcccatg

SEQ ID NO: 52734 - DNA, 25 bp, S. cerevisiae
tgaggacgattctaagggccagtta

SEQ ID NO: 52735 - DNA, 25 bp, S. cerevisiae
tgatgaaatttccaccgctgacttg

SEQ ID NO: 52736 - DNA, 25 bp, S. cerevisiae
tgatgcaaccacacttaacgaaatt

SEQ ID NO: 52737 - DNA, 25 bp, S. cerevisiae
tgagcaagatcccagagcctacgaa

SEQ ID NO: 52738 - DNA, 25 bp, S. cerevisiae
tgatggactccaaggcactgaatga

SEQ ID NO: 52739 - DNA, 25 bp, S. cerevisiae
tgaggactacccgacatatgattat

SEQ ID NO: 52740 - DNA, 25 bp, S. cerevisiae
tgatgagccatctgcctacttagat

SEQ ID NO: 52741 - DNA, 25 bp, S. cerevisiae
tgatgactctttatccgaagctgga

SEQ ID NO: 52742 - DNA, 25 bp, S. cerevisiae
tgagaattttccagttccaccgtcg

SEQ ID NO: 52743 - DNA, 25 bp, S. cerevisiae
tgagcgggttcttcggtctacaaaa

SEQ ID NO: 52744 - DNA, 25 bp, S. cerevisiae
tgacgaagtctttttgggcacaaca

SEQ ID NO: 52745 - DNA, 25 bp, S. cerevisiae
tgagcctttcatattgcacgttaaa

SEQ ID NO: 52746 - DNA, 25 bp, S. cerevisiae
tgaccatattttctaggttctcata

SEQ ID NO: 52747 - DNA, 25 bp, S. cerevisiae
taccaagtttttctcaaacgccaat

SEQ ID NO: 52748 - DNA, 25 bp, S. cerevisiae
tgaggcctttggttctgtaatcttc

SEQ ID NO: 52749 - DNA, 25 bp, S. cerevisiae
tgatggccttttctggtattttcct

SEQ ID NO: 52750 - DNA, 25 bp, S. cerevisiae
tgaggcctttttagactggtcccca

SEQ ID NO: 52751 - DNA, 25 bp, S. cerevisiae
tgaaccatttacagtcacctctgac

SEQ ID NO: 52752 - DNA, 25 bp, S. cerevisiae
tgagtgccaagtttgaatccggtat

SEQ ID NO: 52753 - DNA, 25 bp, S. cerevisiae
tgacgttgtttcgttggactggtcc

SEQ ID NO: 52754 - DNA, 25 bp, S. cerevisiae
tgacaccgtttctttcaagggtcct

SEQ ID NO: 52755 - DNA, 25 bp, S. cerevisiae
tgacaaactcttctccgtcagttag

SEQ ID NO: 52756 - DNA, 25 bp, S. cerevisiae
tgacaaaggtaccttcctggccaat

SEQ ID NO: 52757 - DNA, 25 bp, S. cerevisiae
tgaggacagtaacgttcaccgccaa

SEQ ID NO: 52758 - DNA, 25 bp, S. cerevisiae
tgacatgggcgatggttacactcgt

SEQ ID NO: 52759 - DNA, 25 bp, S. cerevisiae
tgaaccccaatgcttccagtaatac

SEQ ID NO: 52760 - DNA, 25 bp, S. cerevisiae
tgaggcgccaatatttccaaagctg

SEQ ID NO: 52761 - DNA, 25 bp, S. cerevisiae
tgaggccaacagatattcccgacgt

SEQ ID NO: 52762 - DNA, 25 bp, S. cerevisiae
tgatgaattcagctttccacctggg

SEQ ID NO: 52763 - DNA, 25 bp, S. cerevisiae
tgatgagccggaatatcctccactt

SEQ ID NO: 52764 - DNA, 25 bp, S. cerevisiae
tgatgacggcagtaatacccatatt

SEQ ID NO: 52765 - DNA, 25 bp, S. cerevisiae
tgaggctgaatctttggtcgctgaa

SEQ ID NO: 52766 - DNA, 25 bp, S. cerevisiae
tgatgacgcctatttatttgctaaa

SEQ ID NO: 52767 - DNA, 25 bp, S. cerevisiae
taaaagggcactcacgcacaatcag

SEQ ID NO: 52768 - DNA, 25 bp, S. cerevisiae
tgaacaaggccggtaagccattcag

SEQ ID NO: 52769 - DNA, 25 bp, S. cerevisiae
tgaacaccagccattgaacgatcca

SEQ ID NO: 52770 - DNA, 25 bp, S. cerevisiae
tgaccaacccatcagaactttctat

SEQ ID NO: 52771 - DNA, 25 bp, S. cerevisiae
tgacgcaaacgtcgatgacctgaat

SEQ ID NO: 52772 - DNA, 25 bp, S. cerevisiae
tccaaaggttgttcgtgaggctaag

SEQ ID NO: 52773 - DNA, 25 bp, S. cerevisiae
tgagactaaagctatcgccgaagat

SEQ ID NO: 52774 - DNA, 25 bp, S. cerevisiae
tgagttgccatacatcgccttgatt

SEQ ID NO: 52775 - DNA, 25 bp, S. cerevisiae
tgagatacgaatcccagactctgat

SEQ ID NO: 52776 - DNA, 25 bp, S. cerevisiae
tgactcaccagttattcccttacta

SEQ ID NO: 52777 - DNA, 25 bp, S. cerevisiae
tgagtccctgtacgaacctaatcta

SEQ ID NO: 52778 - DNA, 25 bp, S. cerevisiae
tgaacccgagagcaacatactattt

SEQ ID NO: 52779 - DNA, 25 bp, S. cerevisiae
tgacccactccctagaaacagttta

SEQ ID NO: 52780 - DNA, 25 bp, S. cerevisiae
taaggacctttatagccaagttcaa

SEQ ID NO: 52781 - DNA, 25 bp, S. cerevisiae
tgacgggtccctgctattagatttg

SEQ ID NO: 52782 - DNA, 25 bp, S. cerevisiae
tgacgtttttattcctacacaagtt

SEQ ID NO: 52783 - DNA, 25 bp, S. cerevisiae
tgatgagtttttaaccttgtaccaa

SEQ ID NO: 52784 - DNA, 25 bp, S. cerevisiae
tgaaaagtttagtcctttcccatag

SEQ ID NO: 52785 - DNA, 25 bp, S. cerevisiae
tccaactttcaatccttcctttagg

SEQ ID NO: 52786 - DNA, 25 bp, S. cerevisiae
tccaactttccctgttgtcctggga

SEQ ID NO: 52787 - DNA, 25 bp, S. cerevisiae
tgaggacacttaacggtacaacaga

SEQ ID NO: 52788 - DNA, 25 bp, S. cerevisiae
tgaggaacttcacgcttgtcgacaa

SEQ ID NO: 52789 - DNA, 25 bp, S. cerevisiae
tgaggacacctatgattacgcaaag

SEQ ID NO: 52790 - DNA, 25 bp, S. cerevisiae
tgaggacaccatactgatacctgta

SEQ ID NO: 52791 - DNA, 25 bp, S. cerevisiae
tgagcagagcggtacacacaagatt

SEQ ID NO: 52792 - DNA, 25 bp, S. cerevisiae
tgatgatgtcacttcttttcctttg

SEQ ID NO: 52793 - DNA, 25 bp, S. cerevisiae
tgatgtgccacttttattgcctaaa

SEQ ID NO: 52794 - DNA, 25 bp, S. cerevisiae
tgagctcacagtttctttccttgaa

SEQ ID NO: 52795 - DNA, 25 bp, S. cerevisiae
tgaggccaatctgccttcacgtaca

SEQ ID NO: 52796 - DNA, 25 bp, S. cerevisiae
tgatggtatcatcccttgggtctac

SEQ ID NO: 52797 - DNA, 25 bp, S. cerevisiae
tgagattaaattacagtcgctgcta

SEQ ID NO: 52798 - DNA, 25 bp, S. cerevisiae
tgagagaaaacggtcactccccatc

SEQ ID NO: 52799 - DNA, 25 bp, S. cerevisiae
tagaaagtacggaaagacacaatag

SEQ ID NO: 52800 - DNA, 25 bp, S. cerevisiae
tgaaaatggtgctgctaaggccgct

SEQ ID NO: 52801 - DNA, 25 bp, S. cerevisiae
tgagctacatagacttgcgcaaggt

SEQ ID NO: 52802 - DNA, 25 bp, S. cerevisiae
tgagcccaagagagccaagatttaa

SEQ ID NO: 52803 - DNA, 25 bp, S. cerevisiae
tgagaccagaagtcgatcacgatac

SEQ ID NO: 52804 - DNA, 25 bp, S. cerevisiae
tgagccggaatgtccagtggcatac

SEQ ID NO: 52805 - DNA, 25 bp, S. cerevisiae
tgagctctgtgctgacgcattggaa

SEQ ID NO: 52806 - DNA, 25 bp, S. cerevisiae
tgatgtgctttatccttccaacgaa

SEQ ID NO: 52807 - DNA, 25 bp, S. cerevisiae
tgatgtttattccaacttcgacgaa

SEQ ID NO: 52808 - DNA, 25 bp, S. cerevisiae
tgaacgctacttcactataggcgaa

SEQ ID NO: 52809 - DNA, 25 bp, S. cerevisiae
tgaacttactgcaaatctgcccaca

SEQ ID NO: 52810 - DNA, 25 bp, S. cerevisiae
tgaaattgacggttccaggacgatt

SEQ ID NO: 52811 - DNA, 25 bp, S. cerevisiae
tgaacttaccaaaccggaggactca

SEQ ID NO: 52812 - DNA, 25 bp, S. cerevisiae
tgagcgttaatggtgtcatcggaaa

SEQ ID NO: 52813 - DNA, 25 bp, S. cerevisiae
tgagagcccaaagttccagtgaatg

SEQ ID NO: 52814 - DNA, 25 bp, S. cerevisiae
tgaggctgccaatgcttccgagaag

SEQ ID NO: 52815 - DNA, 25 bp, S. cerevisiae
tgaggcttatctccagggccataaa

SEQ ID NO: 52816 - DNA, 25 bp, S. cerevisiae
tgaggctttttctggtgctaatgac

SEQ ID NO: 52817 - DNA, 25 bp, S. cerevisiae
tgaggcgttttcattgttcgatatg

SEQ ID NO: 52818 - DNA, 25 bp, S. cerevisiae
tgaaggcttcttctggcttggcata

SEQ ID NO: 52819 - DNA, 25 bp, S. cerevisiae
tgaagtcgtctactttctcggacat

SEQ ID NO: 52820 - DNA, 25 bp, S. cerevisiae
tgagagatctgcttactacacctgg

SEQ ID NO: 52821 - DNA, 25 bp, S. cerevisiae
tgatgtctttccctttgcagatggc

SEQ ID NO: 52822 - DNA, 25 bp, S. cerevisiae
tgacctttatgcttttgggctggct

SEQ ID NO: 52823 - DNA, 25 bp, S. cerevisiae
tgaggtagccgctttagccgctgaa

SEQ ID NO: 52824 - DNA, 25 bp, S. cerevisiae
tgaatgctatcttaactgacgtgaa

SEQ ID NO: 52825 - DNA, 25 bp, S. cerevisiae
tgagttctgaaatcgctgctgctct

SEQ ID NO: 52826 - DNA, 25 bp, S. cerevisiae
tgagtatatggaccatctgcgcccg

SEQ ID NO: 52827 - DNA, 25 bp, S. cerevisiae
tgactcatatggtcgaagccgccaa

SEQ ID NO: 52828 - DNA, 25 bp, S. cerevisiae
tgagatttgctggtgtaccgccaat

SEQ ID NO: 52829 - DNA, 25 bp, S. cerevisiae
tgacattatcctttgacgcaccagt

SEQ ID NO: 52830 - DNA, 25 bp, S. cerevisiae
tgacggaagctcttgtcgaagcagt

SEQ ID NO: 52831 - DNA, 25 bp, S. cerevisiae
tgaccagacctattatcatgaagag

SEQ ID NO: 52832 - DNA, 25 bp, S. cerevisiae
tgagctcatcattttcatctgttga

SEQ ID NO: 52833 - DNA, 25 bp, S. cerevisiae
tgagatctcaatcttcttcagcaag

SEQ ID NO: 52834 - DNA, 25 bp, S. cerevisiae
tgagcatccgtttatctctgcagca

SEQ ID NO: 52835 - DNA, 25 bp, S. cerevisiae
tgagtggtgttcatgctgctgagca

SEQ ID NO: 52836 - DNA, 25 bp, S. cerevisiae
tgagttttcatccatcgcatcttta

SEQ ID NO: 52837 - DNA, 25 bp, S. cerevisiae
tgagcttttatcgaacctccatcta

SEQ ID NO: 52838 - DNA, 25 bp, S. cerevisiae
tgagctgggctttcgaactttatga

SEQ ID NO: 52839 - DNA, 25 bp, S. cerevisiae
tgacgggctcatacggatctttgat

SEQ ID NO: 52840 - DNA, 25 bp, S. cerevisiae
tgagtagctcctttcattgtctaaa

SEQ ID NO: 52841 - DNA, 25 bp, S. cerevisiae
tgagggtcctgatcctgcagcaaaa

SEQ ID NO: 52842 - DNA, 25 bp, S. cerevisiae
tgaggaccgtgctacccaaatggac

SEQ ID NO: 52843 - DNA, 25 bp, S. cerevisiae
tgaggccacggaaatgccatttaga

SEQ ID NO: 52844 - DNA, 25 bp, S. cerevisiae
tgaccaacgtgaccatgccatttaa

SEQ ID NO: 52845 - DNA, 25 bp, S. cerevisiae
tgaccgacgaacaagtgcatgcttt

SEQ ID NO: 52846 - DNA, 25 bp, S. cerevisiae
tgaccccgcaatccaaggacattaa

SEQ ID NO: 52847 - DNA, 25 bp, S. cerevisiae
tgacgcgccaactacaatcgacatg

SEQ ID NO: 52848 - DNA, 25 bp, S. cerevisiae
tgagggagcttctatgtgcataact

SEQ ID NO: 52849 - DNA, 25 bp, S. cerevisiae
tgactctatcaacgttgccatccaa

SEQ ID NO: 52850 - DNA, 25 bp, S. cerevisiae
tgacgtctgcaaatgatgtttccaa

SEQ ID NO: 52851 - DNA, 25 bp, S. cerevisiae
tgagacgccaactccttctttaaaa

SEQ ID NO: 52852 - DNA, 25 bp, S. cerevisiae
tgagagcccaaaccaattccttaac

SEQ ID NO: 52853 - DNA, 25 bp, S. cerevisiae
tgaagaccaatacaaggcctacttg

SEQ ID NO: 52854 - DNA, 25 bp, S. cerevisiae
tgcacgatcattgttacgcgagcca

SEQ ID NO: 52855 - DNA, 25 bp, S. cerevisiae
tgcaggttctcttttagcggcaacg

SEQ ID NO: 52856 - DNA, 25 bp, S. cerevisiae
tgaggattcggttccgcacgctgaa

SEQ ID NO: 52857 - DNA, 25 bp, S. cerevisiae
tgaggaacgagctacaccctgctga

SEQ ID NO: 52858 - DNA, 25 bp, S. cerevisiae
tgaggatgactacacacgcgctgaa

SEQ ID NO: 52859 - DNA, 25 bp, S. cerevisiae
tgacgatagtactagcaccacgaat

SEQ ID NO: 52860 - DNA, 25 bp, S. cerevisiae
tgacgatgacctaacagcccaattg

SEQ ID NO: 52861 - DNA, 25 bp, S. cerevisiae
tgaccacatcacacagaccacagtt

SEQ ID NO: 52862 - DNA, 25 bp, S. cerevisiae
tgagattcatacaaggaggccctct

SEQ ID NO: 52863 - DNA, 25 bp, S. cerevisiae
tgagtctatcaatggcgggcactgc

SEQ ID NO: 52864 - DNA, 25 bp, S. cerevisiae
tgaggacaatatttctgcagctgcc

SEQ ID NO: 52865 - DNA, 25 bp, S. cerevisiae
tgagaaacaagattgctggttacac

SEQ ID NO: 52866 - DNA, 25 bp, S. cerevisiae
tgaaatacaggctagcggcgttgct

SEQ ID NO: 52867 - DNA, 25 bp, S. cerevisiae
tgaaccaggtcttgcacttggtgct

SEQ ID NO: 52868 - DNA, 25 bp, S. cerevisiae
tgagaacctctaccctattgttatc

SEQ ID NO: 52869 - DNA, 25 bp, S. cerevisiae
tgacatacttggactttggttgcgt

SEQ ID NO: 52870 - DNA, 25 bp, S. cerevisiae
tgagaagttaaaagccgaaaagacg

SEQ ID NO: 52871 - DNA, 25 bp, S. cerevisiae
tgagaggactcgacttgacaataga

SEQ ID NO: 52872 - DNA, 25 bp, S. cerevisiae
tgagatggttcgatgtacacagttc

SEQ ID NO: 52873 - DNA, 25 bp, S. cerevisiae
tgaaggctgccggttacactggtcc

SEQ ID NO: 52874 - DNA, 25 bp, S. cerevisiae
tgaacctacgaattacttggacaga

SEQ ID NO: 52875 - DNA, 25 bp, S. cerevisiae
tgcaaccccaggaaagtcggtcaga

SEQ ID NO: 52876 - DNA, 25 bp, S. cerevisiae
tgaaccctcggaaaggcctttgacg

SEQ ID NO: 52877 - DNA, 25 bp, S. cerevisiae
tgagaaaacccctcaaaggcctgtt

SEQ ID NO: 52878 - DNA, 25 bp, S. cerevisiae
tgagaaaattccatccaccagagcc

SEQ ID NO: 52879 - DNA, 25 bp, S. cerevisiae
tgagaaaacaaagtcccctgagcag

SEQ ID NO: 52880 - DNA, 25 bp, S. cerevisiae
tgagaattaccgttggaacccatga

SEQ ID NO: 52881 - DNA, 25 bp, S. cerevisiae
tgaaaccactccattgaactccaag

SEQ ID NO: 52882 - DNA, 25 bp, S. cerevisiae
tgaaaaccctgatctaagtactaag

SEQ ID NO: 52883 - DNA, 25 bp, S. cerevisiae
tgagaaaatccttcgctagggcccg

SEQ ID NO: 52884 - DNA, 25 bp, S. cerevisiae
tgagagagaacgtgccttggccgcc

SEQ ID NO: 52885 - DNA, 25 bp, S. cerevisiae
tgagggccacgatgctcaagagcat

SEQ ID NO: 52886 - DNA, 25 bp, S. cerevisiae
tgacggccaggttgctagtgactac

SEQ ID NO: 52887 - DNA, 25 bp, S. cerevisiae
tgactacaagacataccgcctcagg

SEQ ID NO: 52888 - DNA, 25 bp, S. cerevisiae
taatcttctttctgactacgaggcc

SEQ ID NO: 52889 - DNA, 25 bp, S. cerevisiae
tgaggatctctttcatagactagaa

SEQ ID NO: 52890 - DNA, 25 bp, S. cerevisiae
tgagcagtgcatcttcacaggcgac

SEQ ID NO: 52891 - DNA, 25 bp, S. cerevisiae
tgagcatctgctactcatgacactc

SEQ ID NO: 52892 - DNA, 25 bp, S. cerevisiae
tagagggtcgtaacgggtccatcac

SEQ ID NO: 52893 - DNA, 25 bp, S. cerevisiae
tgcagaggcgttgtattgggatccc

SEQ ID NO: 52894 - DNA, 25 bp, S. cerevisiae
tgaatccggatctcccaagtcttaa

SEQ ID NO: 52895 - DNA, 25 bp, S. cerevisiae
tgaaacggaactcccacgcttaata

SEQ ID NO: 52896 - DNA, 25 bp, S. cerevisiae
tgagaccttaattcactcggcttct

SEQ ID NO: 52897 - DNA, 25 bp, S. cerevisiae
tgagaaatttcttacggtgcgtgat

SEQ ID NO: 52898 - DNA, 25 bp, S. cerevisiae
tgaaatttgtgcttactgcggccgt

SEQ ID NO: 52899 - DNA, 25 bp, S. cerevisiae
tgaccactgtgggtatgctttgcca

SEQ ID NO: 52900 - DNA, 25 bp, S. cerevisiae
tgactattttggttgttcgcacact

SEQ ID NO: 52901 - DNA, 25 bp, S. cerevisiae
tgaacttttgtatgtttgccgccgt

SEQ ID NO: 52902 - DNA, 25 bp, S. cerevisiae
tgacactttcttaaaactcgcctct

SEQ ID NO: 52903 - DNA, 25 bp, S. cerevisiae
tgaaggttccatcacgacctcaatt

SEQ ID NO: 52904 - DNA, 25 bp, S. cerevisiae
tgagacctaacctagccaacttggc

SEQ ID NO: 52905 - DNA, 25 bp, S. cerevisiae
tgaacgaatacctggccactctgga

SEQ ID NO: 52906 - DNA, 25 bp, S. cerevisiae
tgaaagaaagcctacgaccatcgaa

SEQ ID NO: 52907 - DNA, 25 bp, S. cerevisiae
tgaagaacgatataggcgcatcctg

SEQ ID NO: 52908 - DNA, 25 bp, S. cerevisiae
tgacaaagaatttcatcgtcacttt

SEQ ID NO: 52909 - DNA, 25 bp, S. cerevisiae
tgaccttgtcgtgcagcgccaaaaa

SEQ ID NO: 52910 - DNA, 25 bp, S. cerevisiae
tgacacttctccactgcaaacaaaa

SEQ ID NO: 52911 - DNA, 25 bp, S. cerevisiae
tgagaagtctcagcctctaaaagat

SEQ ID NO: 52912 - DNA, 25 bp, S. cerevisiae
tgagatagatgacagctccctcgcc

SEQ ID NO: 52913 - DNA, 25 bp, S. cerevisiae
tgagagccatctttgccaccattaa

SEQ ID NO: 52914 - DNA, 25 bp, S. cerevisiae
tgagagactcattcgtcacaccaaa

SEQ ID NO: 52915 - DNA, 25 bp, S. cerevisiae
tgagcaatggttcagcaagcttgtt

SEQ ID NO: 52916 - DNA, 25 bp, S. cerevisiae
tgagagtagtatgcgcaccagtcct

SEQ ID NO: 52917 - DNA, 25 bp, S. cerevisiae
tgagatgttattgttcacggccctt

SEQ ID NO: 52918 - DNA, 25 bp, S. cerevisiae
tgagttgaaagtttcaccgccctct

SEQ ID NO: 52919 - DNA, 25 bp, S. cerevisiae
tgagttgaaaccttcccagatcttc

SEQ ID NO: 52920 - DNA, 25 bp, S. cerevisiae
tgaaagatctgggtatcgccgcctt

SEQ ID NO: 52921 - DNA, 25 bp, S. cerevisiae
tgaaaagttcgttagccccgtcgat

SEQ ID NO: 52922 - DNA, 25 bp, S. cerevisiae
tgaaaagttctttggtccgcgtaca

SEQ ID NO: 52923 - DNA, 25 bp, S. cerevisiae
tgaaaactctgccaagggtgcccac

SEQ ID NO: 52924 - DNA, 25 bp, S. cerevisiae
tgagacccctgatctttattggagt

SEQ ID NO: 52925 - DNA, 25 bp, S. cerevisiae
tgactgccccttgatattatttact

SEQ ID NO: 52926 - DNA, 25 bp, S. cerevisiae
tacccctatccttaaagtatactgg

SEQ ID NO: 52927 - DNA, 25 bp, S. cerevisiae
tgagagcgcgtggttgccaaactat

SEQ ID NO: 52928 - DNA, 25 bp, S. cerevisiae
tgaagccattactccgagaccgaag

SEQ ID NO: 52929 - DNA, 25 bp, S. cerevisiae
tgacgaagatcatgctgcggccttt

SEQ ID NO: 52930 - DNA, 25 bp, S. cerevisiae
tgacgaacacattgacttgggtatc

SEQ ID NO: 52931 - DNA, 25 bp, S. cerevisiae
tgacgatgatcctgacgttttctcc

SEQ ID NO: 52932 - DNA, 25 bp, S. cerevisiae
tgaaattgccaccacagagttaccc

SEQ ID NO: 52933 - DNA, 25 bp, S. cerevisiae
tgaaacttctttccaatcttctctc

SEQ ID NO: 52934 - DNA, 25 bp, S. cerevisiae
tgacaaagacagctccatcatttcc

SEQ ID NO: 52935 - DNA, 25 bp, S. cerevisiae
tgacggcaacacttcttatttccat

SEQ ID NO: 52936 - DNA, 25 bp, S. cerevisiae
tgacgatataccatcttttttcccc

SEQ ID NO: 52937 - DNA, 25 bp, S. cerevisiae
tgacggtgccattttttgtgtttaa

SEQ ID NO: 52938 - DNA, 25 bp, S. cerevisiae
tgagaaggccatcttcatttttgtc

SEQ ID NO: 52939 - DNA, 25 bp, S. cerevisiae
tgaaactgccatccattatttgcgg

SEQ ID NO: 52940 - DNA, 25 bp, S. cerevisiae
tgaacccaacagatttgtgcgagtt

SEQ ID NO: 52941 - DNA, 25 bp, S. cerevisiae
tgacttagaaaagcgcccagaggat

SEQ ID NO: 52942 - DNA, 25 bp, S. cerevisiae
tgcacattcaaaaacgttccaaaat

SEQ ID NO: 52943 - DNA, 25 bp, S. cerevisiae
tgaccagatatcagggccagcatcg

SEQ ID NO: 52944 - DNA, 25 bp, S. cerevisiae
tgacctatctcatgggcgcagctgt

SEQ ID NO: 52945 - DNA, 25 bp, S. cerevisiae
tgaaatagtaaacggctcaccaaga

SEQ ID NO: 52946 - DNA, 25 bp, S. cerevisiae
tgaatatagtaaagacccacccggt

SEQ ID NO: 52947 - DNA, 25 bp, S. cerevisiae
tgaaggaagaagaccccaacgaatt

SEQ ID NO: 52948 - DNA, 25 bp, S. cerevisiae
tgacaagacaaagccactcgacgtg

SEQ ID NO: 52949 - DNA, 25 bp, S. cerevisiae
tacagctaccgatgcaaatgccgcc

SEQ ID NO: 52950 - DNA, 25 bp, S. cerevisiae
tgacagctatcctaacaaaccctat

SEQ ID NO: 52951 - DNA, 25 bp, S. cerevisiae
tgaccatcgcgcatagactgaacac

SEQ ID NO: 52952 - DNA, 25 bp, S. cerevisiae
tgacagcaggtcagtctcaggtgta

SEQ ID NO: 52953 - DNA, 25 bp, S. cerevisiae
tgagacggttggttcatcactgaat

SEQ ID NO: 52954 - DNA, 25 bp, S. cerevisiae
tgacggacacacaaactctgaactt

SEQ ID NO: 52955 - DNA, 25 bp, S. cerevisiae
tgacgtattcacaagttctgaggtg

SEQ ID NO: 52956 - DNA, 25 bp, S. cerevisiae
tgacatttccaaatttctgcgggac

SEQ ID NO: 52957 - DNA, 25 bp, S. cerevisiae
tgacactaaattctttccggcagcg

SEQ ID NO: 52958 - DNA, 25 bp, S. cerevisiae
tgaagtatccttcttaccggctatg

SEQ ID NO: 52959 - DNA, 25 bp, S. cerevisiae
tgacgaatcctcatttgagccctta

SEQ ID NO: 52960 - DNA, 25 bp, S. cerevisiae
tgacggaaccacattggccacagtg

SEQ ID NO: 52961 - DNA, 25 bp, S. cerevisiae
tgaaggtttggctaacgacccagaa

SEQ ID NO: 52962 - DNA, 25 bp, S. cerevisiae
tgagcaatcctcatgggtttaccaa

SEQ ID NO: 52963 - DNA, 25 bp, S. cerevisiae
tgactacaccattcaggccattgag

SEQ ID NO: 52964 - DNA, 25 bp, S. cerevisiae
tgagccacacgaactaccattgaaa

SEQ ID NO: 52965 - DNA, 25 bp, S. cerevisiae
tgagctaaccacatcgcctatgaaa

SEQ ID NO: 52966 - DNA, 25 bp, S. cerevisiae
tgagcatagacccttctcgattgga

SEQ ID NO: 52967 - DNA, 25 bp, S. cerevisiae
tgagcatagaacttccttcacctac

SEQ ID NO: 52968 - DNA, 25 bp, S. cerevisiae
tgagactattcagcgcataactgct

SEQ ID NO: 52969 - DNA, 25 bp, S. cerevisiae
tgactctaacactattgcatccaga

SEQ ID NO: 52970 - DNA, 25 bp, S. cerevisiae
taattccaacgcttacacagagtac

SEQ ID NO: 52971 - DNA, 25 bp, S. cerevisiae
taatgacaatgacgccaaccggaac

SEQ ID NO: 52972 - DNA, 25 bp, S. cerevisiae
taatgacgatgacgccggagccgtt

SEQ ID NO: 52973 - DNA, 25 bp, S. cerevisiae
tgaatacgaccgacaaagccttctg

SEQ ID NO: 52974 - DNA, 25 bp, S. cerevisiae
tgagcaactcgactggtaccctaga

SEQ ID NO: 52975 - DNA, 25 bp, S. cerevisiae
tgacccacggtggtatcccaaagga

SEQ ID NO: 52976 - DNA, 25 bp, S. cerevisiae
tgacacccgaatatcatccacaaag

SEQ ID NO: 52977 - DNA, 25 bp, S. cerevisiae
tgaacttcgttcaccatcaaagaga

SEQ ID NO: 52978 - DNA, 25 bp, S. cerevisiae
tgaaccgcctacactacaagagatt

SEQ ID NO: 52979 - DNA, 25 bp, S. cerevisiae
tgactccttcttctcgtttttgatc

SEQ ID NO: 52980 - DNA, 25 bp, S. cerevisiae
tgacggtcacatagcctcgttattc

SEQ ID NO: 52981 - DNA, 25 bp, S. cerevisiae
tgacggcatacacccaagagatact

SEQ ID NO: 52982 - DNA, 25 bp, S. cerevisiae
tgacctgcaaatcgcttcggaatta

SEQ ID NO: 52983 - DNA, 25 bp, S. cerevisiae
tacccaaaccctgtgagatccatag

SEQ ID NO: 52984 - DNA, 25 bp, S. cerevisiae
tgacaactatgattgctccggcact

SEQ ID NO: 52985 - DNA, 25 bp, S. cerevisiae
tgaaaccggaacaagcagcagcatt

SEQ ID NO: 52986 - DNA, 25 bp, S. cerevisiae
tgagcaaccgtgtcaacaagagtgt

SEQ ID NO: 52987 - DNA, 25 bp, S. cerevisiae
tgactacaccactgactacactgta

SEQ ID NO: 52988 - DNA, 25 bp, S. cerevisiae
tgacaactatccaaacggctccaag

SEQ ID NO: 52989 - DNA, 25 bp, S. cerevisiae
tgagaagctggttccattgcccata

SEQ ID NO: 52990 - DNA, 25 bp, S. cerevisiae
tgcgaatagtttgaactccccacac

SEQ ID NO: 52991 - DNA, 25 bp, S. cerevisiae
tgagaagaccttgcggaatctcgct

SEQ ID NO: 52992 - DNA, 25 bp, S. cerevisiae
tgaagagcaaaatctgaagccgttt

SEQ ID NO: 52993 - DNA, 25 bp, S. cerevisiae
tgcacacgcaaatagcttaggccat

SEQ ID NO: 52994 - DNA, 25 bp, S. cerevisiae
tgcaacgacagctggacggtgaaaa

SEQ ID NO: 52995 - DNA, 25 bp, S. cerevisiae
tgaaagacaccgtcaccgttacgaa

SEQ ID NO: 52996 - DNA, 25 bp, S. cerevisiae
tgaaaaactgttccacgaccgtctt

SEQ ID NO: 52997 - DNA, 25 bp, S. cerevisiae
taacataatgccatccttagtcccc

SEQ ID NO: 52998 - DNA, 25 bp, S. cerevisiae
tgaagatacaccttccgtttctgac

SEQ ID NO: 52999 - DNA, 25 bp, S. cerevisiae
tgaagtacccgataatttgcagcag

SEQ ID NO: 53000 - DNA, 25 bp, S. cerevisiae
taagttgtccgattacatccctggc

SEQ ID NO: 53001 - DNA, 25 bp, S. cerevisiae
tgaaattttcccaaatcctaggcta

SEQ ID NO: 53002 - DNA, 25 bp, S. cerevisiae
tgaaatccttcataactgcccaggc

SEQ ID NO: 53003 - DNA, 25 bp, S. cerevisiae
tgactccgatctcaagttatccaac

SEQ ID NO: 53004 - DNA, 25 bp, S. cerevisiae
tgacgggatcttcagatttccaaat

SEQ ID NO: 53005 - DNA, 25 bp, S. cerevisiae
tgaccggcactttagatccaacaaa

SEQ ID NO: 53006 - DNA, 25 bp, S. cerevisiae
tgagcacgtttttaggcgaatctac

SEQ ID NO: 53007 - DNA, 25 bp, S. cerevisiae
tgaaacggcgatgctcctagaagac

SEQ ID NO: 53008 - DNA, 25 bp, S. cerevisiae
tgaaaagccagctccagtcagaacc

SEQ ID NO: 53009 - DNA, 25 bp, S. cerevisiae
tgaagaggccgctcgagtcgaaaaa

SEQ ID NO: 53010 - DNA, 25 bp, S. cerevisiae
tgaaaacctcaatgaatccgccgcc

SEQ ID NO: 53011 - DNA, 25 bp, S. cerevisiae
tgaagatacctaatgagccctcgcc

SEQ ID NO: 53012 - DNA, 25 bp, S. cerevisiae
tgaaaatctgctgtaacgccgccat

SEQ ID NO: 53013 - DNA, 25 bp, S. cerevisiae
tgaagatctcttgttgacggcggat

SEQ ID NO: 53014 - DNA, 25 bp, S. cerevisiae
tgaatttctgtacagcaaagctggt

SEQ ID NO: 53015 - DNA, 25 bp, S. cerevisiae
tgacggccttttccagatagtgagc

SEQ ID NO: 53016 - DNA, 25 bp, S. cerevisiae
tgacattgccttattcaaagccgcc

SEQ ID NO: 53017 - DNA, 25 bp, S. cerevisiae
tgaagacctactctttccctggaga

SEQ ID NO: 53018 - DNA, 25 bp, S. cerevisiae
tgacaataacttctttgccctatga

SEQ ID NO: 53019 - DNA, 25 bp, S. cerevisiae
tgaagacgagagcttaccaacccca

SEQ ID NO: 53020 - DNA, 25 bp, S. cerevisiae
tgcacaaacggaattctctcactct

SEQ ID NO: 53021 - DNA, 25 bp, S. cerevisiae
tgaaataacgaacccacctgctaag

SEQ ID NO: 53022 - DNA, 25 bp, S. cerevisiae
tgaaaagagcgaagcccctgagtct

SEQ ID NO: 53023 - DNA, 25 bp, S. cerevisiae
tgaacgtgaagtacctcccaggttt

SEQ ID NO: 53024 - DNA, 25 bp, S. cerevisiae
tgacatctgtgttgattaccccgga

SEQ ID NO: 53025 - DNA, 25 bp, S. cerevisiae
tgcaactgctatcattcaatcggag

SEQ ID NO: 53026 - DNA, 25 bp, S. cerevisiae
tgacgatggatgtttcttctggagt

SEQ ID NO: 53027 - DNA, 25 bp, S. cerevisiae
tgaagatggctctttcaccggagat

SEQ ID NO: 53028 - DNA, 25 bp, S. cerevisiae
tgcataaattcctttaagccgacta

SEQ ID NO: 53029 - DNA, 25 bp, S. cerevisiae
tgaaagatgggtccgtcacctgcat

SEQ ID NO: 53030 - DNA, 25 bp, S. cerevisiae
taagagggctttgtccgcctacatg

SEQ ID NO: 53031 - DNA, 25 bp, S. cerevisiae
taagcagggttggaccccactattt

SEQ ID NO: 53032 - DNA, 25 bp, S. cerevisiae
tgaagctaaaatctctaccactact

SEQ ID NO: 53033 - DNA, 25 bp, S. cerevisiae
tgaaccacaatactcaccatctaat

SEQ ID NO: 53034 - DNA, 25 bp, S. cerevisiae
tgaccagctaattgaatcttctttg

SEQ ID NO: 53035 - DNA, 25 bp, S. cerevisiae
tgaccgtcatgttattttcttggct

SEQ ID NO: 53036 - DNA, 25 bp, S. cerevisiae
tgaactgtacattgacttgcccggg

SEQ ID NO: 53037 - DNA, 25 bp, S. cerevisiae
tgacctgtatcattggcaagcctct

SEQ ID NO: 53038 - DNA, 25 bp, S. cerevisiae
tgacgggcgctgagcaagatcctta

SEQ ID NO: 53039 - DNA, 25 bp, S. cerevisiae
tgaccgccctaagtgcgtacattga

SEQ ID NO: 53040 - DNA, 25 bp, S. cerevisiae
tgaatctcctggtgaatatttctat

SEQ ID NO: 53041 - DNA, 25 bp, S. cerevisiae
tgaagctactggcacaattgttttg

SEQ ID NO: 53042 - DNA, 25 bp, S. cerevisiae
tgaactatccctggcaattgctatt

SEQ ID NO: 53043 - DNA, 25 bp, S. cerevisiae
tgaaattcagcctgacaccgctggt

SEQ ID NO: 53044 - DNA, 25 bp, S. cerevisiae
tgaaaactgcctaaacaacgacccg

SEQ ID NO: 53045 - DNA, 25 bp, S. cerevisiae
tgaagaaccccaaccatttaccgtg

SEQ ID NO: 53046 - DNA, 25 bp, S. cerevisiae
tgaaaacttcacctgccaatacgtc

SEQ ID NO: 53047 - DNA, 25 bp, S. cerevisiae
tgaaaaatctgcacaccattccttc

SEQ ID NO: 53048 - DNA, 25 bp, S. cerevisiae
tgacgaacgcttcagcgactctgaa

SEQ ID NO: 53049 - DNA, 25 bp, S. cerevisiae
tgacaatgtctccaatactcactaa

SEQ ID NO: 53050 - DNA, 25 bp, S. cerevisiae
tgagccatttgcaagtaccctcatc

SEQ ID NO: 53051 - DNA, 25 bp, S. cerevisiae
tgacgcatttgcaaccagaccagta

SEQ ID NO: 53052 - DNA, 25 bp, S. cerevisiae
tgaatactccgattttgcgtctgac

SEQ ID NO: 53053 - DNA, 25 bp, S. cerevisiae
tgactacttagactgcttcggtacc

SEQ ID NO: 53054 - DNA, 25 bp, S. cerevisiae
tgacctttggaactcggtgtacgct

SEQ ID NO: 53055 - DNA, 25 bp, S. cerevisiae
tgactcttgggacttgcgtagtatc

SEQ ID NO: 53056 - DNA, 25 bp, S. cerevisiae
tgcttttggaggtggatgcgctatc

SEQ ID NO: 53057 - DNA, 25 bp, S. cerevisiae
tgaatttaagttaccagcgctacaa

SEQ ID NO: 53058 - DNA, 25 bp, S. cerevisiae
tgacttctaacaaccctcaattgct

SEQ ID NO: 53059 - DNA, 25 bp, S. cerevisiae
tgaaatgctaaagccttcctctgct

SEQ ID NO: 53060 - DNA, 25 bp, S. cerevisiae
tgctacaaaagcagtttcgccctcc

SEQ ID NO: 53061 - DNA, 25 bp, S. cerevisiae
ttaaaaactactatgaccctcccat

SEQ ID NO: 53062 - DNA, 25 bp, S. cerevisiae
tttgaaaaggcctgacatgccgcct

SEQ ID NO: 53063 - DNA, 25 bp, S. cerevisiae
tctagaatgaatgcccacaaccgtc

SEQ ID NO: 53064 - DNA, 25 bp, S. cerevisiae
tgacgaatcaatgcctgacactgcc

SEQ ID NO: 53065 - DNA, 25 bp, S. cerevisiae
tgacaaattgatccctattgctaat

SEQ ID NO: 53066 - DNA, 25 bp, S. cerevisiae
tgactcaagcagacccttacttagg

SEQ ID NO: 53067 - DNA, 25 bp, S. cerevisiae
tgacacaaacccctggatcaagtat

SEQ ID NO: 53068 - DNA, 25 bp, S. cerevisiae
tgaccatttaccagccacaattaac

SEQ ID NO: 53069 - DNA, 25 bp, S. cerevisiae
tgcacttttcccagctacggaagag

SEQ ID NO: 53070 - DNA, 25 bp, S. cerevisiae
tgaaattacttcctccaagatcgcc

SEQ ID NO: 53071 - DNA, 25 bp, S. cerevisiae
tgaaattaccaccatctccaaagca

SEQ ID NO: 53072 - DNA, 25 bp, S. cerevisiae
tgaagttaccactaccacgttacac

SEQ ID NO: 53073 - DNA, 25 bp, S. cerevisiae
tgacgttaggaatcgactccaacag

SEQ ID NO: 53074 - DNA, 25 bp, S. cerevisiae
tgacaatcttggtatccgggctgat

SEQ ID NO: 53075 - DNA, 25 bp, S. cerevisiae
tgactctccatcagaattcgtcgat

SEQ ID NO: 53076 - DNA, 25 bp, S. cerevisiae
tgacactccatcaatatcccttggt

SEQ ID NO: 53077 - DNA, 25 bp, S. cerevisiae
tgactgatgctttgcgttctggaaa

SEQ ID NO: 53078 - DNA, 25 bp, S. cerevisiae
tgaagggcaaagtcctccacgataa

SEQ ID NO: 53079 - DNA, 25 bp, S. cerevisiae
tgacacgaagtttccataccctaaa

SEQ ID NO: 53080 - DNA, 25 bp, S. cerevisiae
tgacacgcaaaattcctggcctaga

SEQ ID NO: 53081 - DNA, 25 bp, S. cerevisiae
tgacgttttttactgcgccttagga

SEQ ID NO: 53082 - DNA, 25 bp, S. cerevisiae
tgaatcctcgtaacttaccgtcagt

SEQ ID NO: 53083 - DNA, 25 bp, S. cerevisiae
tgactagttactatgggccatcatc

SEQ ID NO: 53084 - DNA, 25 bp, S. cerevisiae
tgactgagtgtcttttggccaataa

SEQ ID NO: 53085 - DNA, 25 bp, S. cerevisiae
tgaccgagccatatttaatgcatag

SEQ ID NO: 53086 - DNA, 25 bp, S. cerevisiae
tgaccgcagctgacactgttatatt

SEQ ID NO: 53087 - DNA, 25 bp, S. cerevisiae
tgacactcagagacgtgacatgttt

SEQ ID NO: 53088 - DNA, 25 bp, S. cerevisiae
tgaacgttgagctatggccatacat

SEQ ID NO: 53089 - DNA, 25 bp, S. cerevisiae
tgaaggtcagaaacgctcaagctca

SEQ ID NO: 53090 - DNA, 25 bp, S. cerevisiae
tgaaagctggtcttgcgtcgaacaa

SEQ ID NO: 53091 - DNA, 25 bp, S. cerevisiae
tgaccgccactctagaactggtaag

SEQ ID NO: 53092 - DNA, 25 bp, S. cerevisiae
tgacgctccacgttaactgggacac

SEQ ID NO: 53093 - DNA, 25 bp, S. cerevisiae
tactttacattccaaccttcataca

SEQ ID NO: 53094 - DNA, 25 bp, S. cerevisiae
tgacgataacattccagacctacaa

SEQ ID NO: 53095 - DNA, 25 bp, S. cerevisiae
tgacagaagcgctctcacttggaaa

SEQ ID NO: 53096 - DNA, 25 bp, S. cerevisiae
tgacgtatcgtccatcattgtcgac

SEQ ID NO: 53097 - DNA, 25 bp, S. cerevisiae
tgaagacatcgaagaccactccacc

SEQ ID NO: 53098 - DNA, 25 bp, S. cerevisiae
tgaaatatccagcaccactcagagc

SEQ ID NO: 53099 - DNA, 25 bp, S. cerevisiae
tgaaatccgctacccttgaagatgg

SEQ ID NO: 53100 - DNA, 25 bp, S. cerevisiae
tgaattggcccttcgatctaagcta

SEQ ID NO: 53101 - DNA, 25 bp, S. cerevisiae
tgacaaggccaccacgattgacgaa

SEQ ID NO: 53102 - DNA, 25 bp, S. cerevisiae
tgaaggtgtacccatcttgatgctg

SEQ ID NO: 53103 - DNA, 25 bp, S. cerevisiae
tagggctgttaccaaatactcctcc

SEQ ID NO: 53104 - DNA, 25 bp, S. cerevisiae
tgacgactctaagacgaactccttc

SEQ ID NO: 53105 - DNA, 25 bp, S. cerevisiae
tgacggctcaaagacagacccaatt

SEQ ID NO: 53106 - DNA, 25 bp, S. cerevisiae
tgacgtgccctgttgaagatctcca

SEQ ID NO: 53107 - DNA, 25 bp, S. cerevisiae
tgactggtccattgtatctacccaa

SEQ ID NO: 53108 - DNA, 25 bp, S. cerevisiae
tgacgctgtcactattcgtaccaga

SEQ ID NO: 53109 - DNA, 25 bp, S. cerevisiae
tgaacgctgaacatggctatacaat

SEQ ID NO: 53110 - DNA, 25 bp, S. cerevisiae
tgaacgggttctccatgtccaatat

SEQ ID NO: 53111 - DNA, 25 bp, S. cerevisiae
tgaaagcgttttaccacccagaaag

SEQ ID NO: 53112 - DNA, 25 bp, S. cerevisiae
tgcaaaacataattcctagggctag

SEQ ID NO: 53113 - DNA, 25 bp, S. cerevisiae
tgaaaacgctactgctgatgagcaa

SEQ ID NO: 53114 - DNA, 25 bp, S. cerevisiae
tgaaaacgttccatgcgagcaacag

SEQ ID NO: 53115 - DNA, 25 bp, S. cerevisiae
tgacgatatcaattccacacaagtt

SEQ ID NO: 53116 - DNA, 25 bp, S. cerevisiae
tgacgatctaccgaaccaagggcta

SEQ ID NO: 53117 - DNA, 25 bp, S. cerevisiae
tgacgttgacaagaccagtgagcgc

SEQ ID NO: 53118 - DNA, 25 bp, S. cerevisiae
tgacgtttctgttcatccatggatg

SEQ ID NO: 53119 - DNA, 25 bp, S. cerevisiae
tgaaatttgctgctcacactggtgc

SEQ ID NO: 53120 - DNA, 25 bp, S. cerevisiae
tgaagtttcgcgaatgctgcttgtc

SEQ ID NO: 53121 - DNA, 25 bp, S. cerevisiae
tgaaccacgttgttgccttgatcga

SEQ ID NO: 53122 - DNA, 25 bp, S. cerevisiae
tgaaggtttatgttgggtcccgtat

SEQ ID NO: 53123 - DNA, 25 bp, S. cerevisiae
tgaaggatttctctgctttaccgga

SEQ ID NO: 53124 - DNA, 25 bp, S. cerevisiae
tgaacgttttttgcgtcacagcgga

SEQ ID NO: 53125 - DNA, 25 bp, S. cerevisiae
tgaagcgctattttatccgtggacg

SEQ ID NO: 53126 - DNA, 25 bp, S. cerevisiae
tgaagcgttgccctatgacgtgcag

SEQ ID NO: 53127 - DNA, 25 bp, S. cerevisiae
tgaataccctggtggcagactttga

SEQ ID NO: 53128 - DNA, 25 bp, S. cerevisiae
tgaagaagtccctgaacctttcacc

SEQ ID NO: 53129 - DNA, 25 bp, S. cerevisiae
tgaacgaagtacatggcccgcacta

SEQ ID NO: 53130 - DNA, 25 bp, S. cerevisiae
tgaaagtagtccaatgtcccatcct

SEQ ID NO: 53131 - DNA, 25 bp, S. cerevisiae
tgaaaaccgtgcagctgatacgccc

SEQ ID NO: 53132 - DNA, 25 bp, S. cerevisiae
tgcaaataattatcccttccctcaa

SEQ ID NO: 53133 - DNA, 25 bp, S. cerevisiae
tgcagaaaatcttgacccttccagc

SEQ ID NO: 53134 - DNA, 25 bp, S. cerevisiae
tcggcaaacgtaccgtctactgcta

SEQ ID NO: 53135 - DNA, 25 bp, S. cerevisiae
tgaagaaggacgtgctatcccaggt

SEQ ID NO: 53136 - DNA, 25 bp, S. cerevisiae
tgaacaaagaccttgtttccggcgg

SEQ ID NO: 53137 - DNA, 25 bp, S. cerevisiae
tgaacaacgttcttattaccggcgg

SEQ ID NO: 53138 - DNA, 25 bp, S. cerevisiae
tgaagacgttttgccttcggacgat

SEQ ID NO: 53139 - DNA, 25 bp, S. cerevisiae
tgaagcactttttcgatcacacgca

SEQ ID NO: 53140 - DNA, 25 bp, S. cerevisiae
taatgcaggtaccaacgcaggcgct

SEQ ID NO: 53141 - DNA, 25 bp, S. cerevisiae
tgaatgttcgcgtaaacactccacg

SEQ ID NO: 53142 - DNA, 25 bp, S. cerevisiae
tgacaagcggtatagcactccctgt

SEQ ID NO: 53143 - DNA, 25 bp, S. cerevisiae
tgcaattgaggccacatgtcacgct

SEQ ID NO: 53144 - DNA, 25 bp, S. cerevisiae
tgccatggatttgactaccggccag

SEQ ID NO: 53145 - DNA, 25 bp, S. cerevisiae
tgaagtttgttacactccttcctgg

SEQ ID NO: 53146 - DNA, 25 bp, S. cerevisiae
tgacagtatgtcaccacagctttct

SEQ ID NO: 53147 - DNA, 25 bp, S. cerevisiae
tgacatatatatacccacacactct

SEQ ID NO: 53148 - DNA, 25 bp, S. cerevisiae
tgacatatatatacccacacactct

SEQ ID NO: 53149 - DNA, 25 bp, S. cerevisiae
tgacatatatatacaccacacccac

SEQ ID NO: 53150 - DNA, 25 bp, S. cerevisiae
tgacatatatatacaccacacccac

SEQ ID NO: 53151 - DNA, 25 bp, S. cerevisiae
tgaacaagatgaccaatccgccacc

SEQ ID NO: 53152 - DNA, 25 bp, S. cerevisiae
tgaagtatatcccaatccaccattt

SEQ ID NO: 53153 - DNA, 25 bp, S. cerevisiae
tgaaactactcacctactcgatatt

SEQ ID NO: 53154 - DNA, 25 bp, S. cerevisiae
tgaaaatccatcttctcatcctgaa

SEQ ID NO: 53155 - DNA, 25 bp, S. cerevisiae
tgacaacaccgatcctgagcataat

SEQ ID NO: 53156 - DNA, 25 bp, S. cerevisiae
tgaaccaccgcattcactagatggg

SEQ ID NO: 53157 - DNA, 25 bp, S. cerevisiae
tgaacctccactgaccgagagagaa

SEQ ID NO: 53158 - DNA, 25 bp, S. cerevisiae
tgaactctgctagaaagctacgtgt

SEQ ID NO: 53159 - DNA, 25 bp, S. cerevisiae
tgaagccacaaccactactgtttct

SEQ ID NO: 53160 - DNA, 25 bp, S. cerevisiae
taagtaaacaccactggcttccgga

SEQ ID NO: 53161 - DNA, 25 bp, S. cerevisiae
tgctttgaaaccttaccactcatgg

SEQ ID NO: 53162 - DNA, 25 bp, S. cerevisiae
tgcttctacatgttcttacccattg

SEQ ID NO: 53163 - DNA, 25 bp, S. cerevisiae
tgcaactaatcagctatatcctatg

SEQ ID NO: 53164 - DNA, 25 bp, S. cerevisiae
tgaaggaatcccaattgccaagaat

SEQ ID NO: 53165 - DNA, 25 bp, S. cerevisiae
tgaacaacttgaaatggcgcacgaa

SEQ ID NO: 53166 - DNA, 25 bp, S. cerevisiae
tgaaacctctgaaattgctcaagcc

SEQ ID NO: 53167 - DNA, 25 bp, S. cerevisiae
tgaaacctgctgtagtgcgctaaac

SEQ ID NO: 53168 - DNA, 25 bp, S. cerevisiae
tgaaaccatttacctttccgagctt

SEQ ID NO: 53169 - DNA, 25 bp, S. cerevisiae
tacaaccagtatcagttgggcggct

SEQ ID NO: 53170 - DNA, 25 bp, S. cerevisiae
tcactacacgtacaaatgggctttt

SEQ ID NO: 53171 - DNA, 25 bp, S. cerevisiae
tcctactcaacggaaaagtgattgg

SEQ ID NO: 53172 - DNA, 25 bp, S. cerevisiae
tgaaccgccgttttactgtgattac

SEQ ID NO: 53173 - DNA, 25 bp, S. cerevisiae
tgacaccgccgatgaaacagtatat

SEQ ID NO: 53174 - DNA, 25 bp, S. cerevisiae
tgaacctccaacagataaccatgat

SEQ ID NO: 53175 - DNA, 25 bp, S. cerevisiae
tgcagggctacacaagcaaaccggt

SEQ ID NO: 53176 - DNA, 25 bp, S. cerevisiae
tgcagacgtaatgaccaaacctctt

SEQ ID NO: 53177 - DNA, 25 bp, S. cerevisiae
tgacacggaactgcgacaactgttt

SEQ ID NO: 53178 - DNA, 25 bp, S. cerevisiae
tgaaatgaaatcgtgcctcctgttt

SEQ ID NO: 53179 - DNA, 25 bp, S. cerevisiae
tgaagtgtacactgcgcctgcttta

SEQ ID NO: 53180 - DNA, 25 bp, S. cerevisiae
tgaagcattccctattgtatttgta

SEQ ID NO: 53181 - DNA, 25 bp, S. cerevisiae
tgacagttcttccaataattttacg

SEQ ID NO: 53182 - DNA, 25 bp, S. cerevisiae
tacaagtacccttctttgaaaggtg

SEQ ID NO: 53183 - DNA, 25 bp, S. cerevisiae
tgaagagtaccttcttttgcaagaa

SEQ ID NO: 53184 - DNA, 25 bp, S. cerevisiae
tgcaaggtatctctactttgagacc

SEQ ID NO: 53185 - DNA, 25 bp, S. cerevisiae
tgcaatcgccatttttagtaggaca

SEQ ID NO: 53186 - DNA, 25 bp, S. cerevisiae
tgccgccgccatctttattaaagaa

SEQ ID NO: 53187 - DNA, 25 bp, S. cerevisiae
tgctggcccactcgtaaaacaattg

SEQ ID NO: 53188 - DNA, 25 bp, S. cerevisiae
tgcatggtcgccagtgataacacta

SEQ ID NO: 53189 - DNA, 25 bp, S. cerevisiae
tgaattcaactctcagtcaccactt

SEQ ID NO: 53190 - DNA, 25 bp, S. cerevisiae
tgacactagcttgtttacgaccgag

SEQ ID NO: 53191 - DNA, 25 bp, S. cerevisiae
tgaagctcgctttgatcttgaccct

SEQ ID NO: 53192 - DNA, 25 bp, S. cerevisiae
tgaacatgggttcgtgggcatacac

SEQ ID NO: 53193 - DNA, 25 bp, S. cerevisiae
tgcattgggtgattctattcagcaa

SEQ ID NO: 53194 - DNA, 25 bp, S. cerevisiae
tgcacggtgtattcgccatcgcgag

SEQ ID NO: 53195 - DNA, 25 bp, S. cerevisiae
tgacaagtcgattcctcaacaggca

SEQ ID NO: 53196 - DNA, 25 bp, S. cerevisiae
tgcacaagacgccatattaacgaga

SEQ ID NO: 53197 - DNA, 25 bp, S. cerevisiae
tgaagctttgaagccagactctcaa

SEQ ID NO: 53198 - DNA, 25 bp, S. cerevisiae
tgaactgtccaaagccacctctaag

SEQ ID NO: 53199 - DNA, 25 bp, S. cerevisiae
tgaaacgacttttagcacttgctac

SEQ ID NO: 53200 - DNA, 25 bp, S. cerevisiae
tgaacaagggtccttccttgggcac

SEQ ID NO: 53201 - DNA, 25 bp, S. cerevisiae
tgaaattgttcttttgccgctggac

SEQ ID NO: 53202 - DNA, 25 bp, S. cerevisiae
tgaaattgcttctaattccctaaga

SEQ ID NO: 53203 - DNA, 25 bp, S. cerevisiae
tgaagttgaccctacatctggcgat

SEQ ID NO: 53204 - DNA, 25 bp, S. cerevisiae
tgaactgtccagaaacttgcacgat

SEQ ID NO: 53205 - DNA, 25 bp, S. cerevisiae
tgaactcttcgaatactagcaatgc

SEQ ID NO: 53206 - DNA, 25 bp, S. cerevisiae
tgacactctatcttctactgacagt

SEQ ID NO: 53207 - DNA, 25 bp, S. cerevisiae
tgaatcgtcccacttgtcgtattag

SEQ ID NO: 53208 - DNA, 25 bp, S. cerevisiae
tgaatacctctctacttttaccaaa

SEQ ID NO: 53209 - DNA, 25 bp, S. cerevisiae
tgaaacctatcatctctattcccag

SEQ ID NO: 53210 - DNA, 25 bp, S. cerevisiae
tgaaatcctacaagtctctgacatt

SEQ ID NO: 53211 - DNA, 25 bp, S. cerevisiae
tgaaactctgactttacactctgca

SEQ ID NO: 53212 - DNA, 25 bp, S. cerevisiae
tgaagattccgcttatgccattcca

SEQ ID NO: 53213 - DNA, 25 bp, S. cerevisiae
tgaaggtcccattatgtgctcctat

SEQ ID NO: 53214 - DNA, 25 bp, S. cerevisiae
tgcaatcgttgtatgactcccagat

SEQ ID NO: 53215 - DNA, 25 bp, S. cerevisiae
tgcactctttgccagtcaaggaatt

SEQ ID NO: 53216 - DNA, 25 bp, S. cerevisiae
tgaagtatctgctcacggatcggat

SEQ ID NO: 53217 - DNA, 25 bp, S. cerevisiae
tgaaactcgttcctgatgatgccac

SEQ ID NO: 53218 - DNA, 25 bp, S. cerevisiae
tgaagcacctgttctgccagataat

SEQ ID NO: 53219 - DNA, 25 bp, S. cerevisiae
tgaagagctctatctgtcacataat

SEQ ID NO: 53220 - DNA, 25 bp, S. cerevisiae
tgaaaggctaacatccattgaggac

SEQ ID NO: 53221 - DNA, 25 bp, S. cerevisiae
tgaagactggtaccgctatttgaac

SEQ ID NO: 53222 - DNA, 25 bp, S. cerevisiae
tgaatgacggtatctctgttagacg

SEQ ID NO: 53223 - DNA, 25 bp, S. cerevisiae
tgaacctctatcaccatggatttcc

SEQ ID NO: 53224 - DNA, 25 bp, S. cerevisiae
taccggaaccggctatagtcgaaat

SEQ ID NO: 53225 - DNA, 25 bp, S. cerevisiae
tagctcgcgaacttgggttttccaa

SEQ ID NO: 53226 - DNA, 25 bp, S. cerevisiae
tgaatcggaccctgagttaactcat

SEQ ID NO: 53227 - DNA, 25 bp, S. cerevisiae
tgaaactattgtcccaatgcacgaa

SEQ ID NO: 53228 - DNA, 25 bp, S. cerevisiae
tgaatagctctactcccatggaaga

SEQ ID NO: 53229 - DNA, 25 bp, S. cerevisiae
tgaaacttcaccacatgctattatg

SEQ ID NO: 53230 - DNA, 25 bp, S. cerevisiae
tgaaacttccacaacgccatcgtat

SEQ ID NO: 53231 - DNA, 25 bp, S. cerevisiae
tgaagatttaccaacccaacttgaa

SEQ ID NO: 53232 - DNA, 25 bp, S. cerevisiae
tgaagatttaccatcgccatccaag

SEQ ID NO: 53233 - DNA, 25 bp, S. cerevisiae
tgaagattttcacgctgtataccat

SEQ ID NO: 53234 - DNA, 25 bp, S. cerevisiae
tgaaaagctcttccactacatccat

SEQ ID NO: 53235 - DNA, 25 bp, S. cerevisiae
tgaaaagtctcaacctacctcaact

SEQ ID NO: 53236 - DNA, 25 bp, S. cerevisiae
tgaagaagattctgccgaggctaaa

SEQ ID NO: 53237 - DNA, 25 bp, S. cerevisiae
tgaaagaatttcctcgaccgatgaa

SEQ ID NO: 53238 - DNA, 25 bp, S. cerevisiae
tgaaagactatgtccgccaccagag

SEQ ID NO: 53239 - DNA, 25 bp, S. cerevisiae
tgcaaacaaatcatcgtcaggcggt

SEQ ID NO: 53240 - DNA, 25 bp, S. cerevisiae
tgaaaaaagcctgcgcgtgcggaaa

SEQ ID NO: 53241 - DNA, 25 bp, S. cerevisiae
tgaaaaatggcccaccttctgctgg

SEQ ID NO: 53242 - DNA, 25 bp, S. cerevisiae
tgaacaaagcgcagcagccgacgcg

SEQ ID NO: 53243 - DNA, 25 bp, S. cerevisiae
tgaacaagatcaattccgctcaccg

SEQ ID NO: 53244 - DNA, 25 bp, S. cerevisiae
tgaacaatatctttccctatcacgg

SEQ ID NO: 53245 - DNA, 25 bp, S. cerevisiae
tgaattcttccaatcgtcattccgg

SEQ ID NO: 53246 - DNA, 25 bp, S. cerevisiae
tgaacacatcttgcgaactcgtcaa

SEQ ID NO: 53247 - DNA, 25 bp, S. cerevisiae
tgaactgtattttaagcatcccaaa

SEQ ID NO: 53248 - DNA, 25 bp, S. cerevisiae
tgcaaattcgtttacagttcgccta

SEQ ID NO: 53249 - DNA, 25 bp, S. cerevisiae
tgaacttgcctgaacacattgtccc

SEQ ID NO: 53250 - DNA, 25 bp, S. cerevisiae
tgaagtcactatctcgttacgccaa

SEQ ID NO: 53251 - DNA, 25 bp, S. cerevisiae
tgcaaaacttttgggcctgtggctt

SEQ ID NO: 53252 - DNA, 25 bp, S. cerevisiae
tgaaaagctgttcagcgccgagcca

SEQ ID NO: 53253 - DNA, 25 bp, S. cerevisiae
tgaatccccacatgaacaccgagag

SEQ ID NO: 53254 - DNA, 25 bp, S. cerevisiae
tgaatgttgagataccagccgcggt

SEQ ID NO: 53255 - DNA, 25 bp, S. cerevisiae
tgaatactactccttccaagctgcc

SEQ ID NO: 53256 - DNA, 25 bp, S. cerevisiae
tgaatactactccttccaagctgcc

SEQ ID NO: 53257 - DNA, 25 bp, S. cerevisiae
tgcaatactgcacacctagagagat

SEQ ID NO: 53258 - DNA, 25 bp, S. cerevisiae
tgaacctctcgacctatacttagga

SEQ ID NO: 53259 - DNA, 25 bp, S. cerevisiae
tgaatccaccgtttttgcaaccgca

SEQ ID NO: 53260 - DNA, 25 bp, S. cerevisiae
tgaaccaagaccaatcttccgctga

SEQ ID NO: 53261 - DNA, 25 bp, S. cerevisiae
tgaagcttgtaccatcgtcctaaga

SEQ ID NO: 53262 - DNA, 25 bp, S. cerevisiae
tgcagtgttcacttcgttcgagaaa

SEQ ID NO: 53263 - DNA, 25 bp, S. cerevisiae
tgaatttcaacctttgcgccacata

SEQ ID NO: 53264 - DNA, 25 bp, S. cerevisiae
tgaattaacaccatcgcagcaacga

SEQ ID NO: 53265 - DNA, 25 bp, S. cerevisiae
tgaaacaggcgcttgtgcagacaac

SEQ ID NO: 53266 - DNA, 25 bp, S. cerevisiae
tgaaacgtgactgtgccatcgatgc

SEQ ID NO: 53267 - DNA, 25 bp, S. cerevisiae
tgaagatgcgtactgcttccgttgc

SEQ ID NO: 53268 - DNA, 25 bp, S. cerevisiae
tgaagtctgtgcttctatcaccatg

SEQ ID NO: 53269 - DNA, 25 bp, S. cerevisiae
tgaatgcattgcttctacctcgaat

SEQ ID NO: 53270 - DNA, 25 bp, S. cerevisiae
tgaagtttactgacgctggcgataa

SEQ ID NO: 53271 - DNA, 25 bp, S. cerevisiae
tgaaggttcagctgcctcggaacag

SEQ ID NO: 53272 - DNA, 25 bp, S. cerevisiae
tgaatggttccattgtaccccaatc

SEQ ID NO: 53273 - DNA, 25 bp, S. cerevisiae
tgcaaactactcttgaaccgcgtac

SEQ ID NO: 53274 - DNA, 25 bp, S. cerevisiae
tgaaacaagcctctgtgcctgctca

SEQ ID NO: 53275 - DNA, 25 bp, S. cerevisiae
tgaaaaactgtgctgtctgcgctgc

SEQ ID NO: 53276 - DNA, 25 bp, S. cerevisiae
tgaaaatagcttgtcatcgccacgc

SEQ ID NO: 53277 - DNA, 25 bp, S. cerevisiae
tgaagaccatgttttccccaatatc

SEQ ID NO: 53278 - DNA, 25 bp, S. cerevisiae
tgaagatacattaacaccgccgcta

SEQ ID NO: 53279 - DNA, 25 bp, S. cerevisiae
tgaaccagaaacaatccccgcatgg

SEQ ID NO: 53280 - DNA, 25 bp, S. cerevisiae
tgaatcacagaatctacctgctccg

SEQ ID NO: 53281 - DNA, 25 bp, S. cerevisiae
tgaacaagctgctgataccttccac

SEQ ID NO: 53282 - DNA, 25 bp, S. cerevisiae
tgaaagcccatggtttgtctcctga

SEQ ID NO: 53283 - DNA, 25 bp, S. cerevisiae
tgaagttttctctttggctttctct

SEQ ID NO: 53284 - DNA, 25 bp, S. cerevisiae
tgaagcatatcaagccatttttcct

SEQ ID NO: 53285 - DNA, 25 bp, S. cerevisiae
tgaagcatatcaagccatttttcct

SEQ ID NO: 53286 - DNA, 25 bp, S. cerevisiae
tgaagaacgtttggtcttactcccg

SEQ ID NO: 53287 - DNA, 25 bp, S. cerevisiae
tgaagaaactgctgcggcctttacc

SEQ ID NO: 53288 - DNA, 25 bp, S. cerevisiae
tgaagaatcatcctacggcctttac

SEQ ID NO: 53289 - DNA, 25 bp, S. cerevisiae
tgaaccacactcagggtacacatct

SEQ ID NO: 53290 - DNA, 25 bp, S. cerevisiae
tgaacgagtgcctatggtacccata

SEQ ID NO: 53291 - DNA, 25 bp, S. cerevisiae
tgaagcagcaatcgcattttaccaa

SEQ ID NO: 53292 - DNA, 25 bp, S. cerevisiae
tcgttaccttggatttcctactaag

SEQ ID NO: 53293 - DNA, 25 bp, S. cerevisiae
tgctttgcacgctcaaaatggtcaa

SEQ ID NO: 53294 - DNA, 25 bp, S. cerevisiae
tctttacgttcagttaggcctacct

SEQ ID NO: 53295 - DNA, 25 bp, S. cerevisiae
ttttccgtactcgtagctttactag

SEQ ID NO: 53296 - DNA, 25 bp, S. cerevisiae
tgctttgccggtattcttggtatta

SEQ ID NO: 53297 - DNA, 25 bp, S. cerevisiae
tgcttgtgccgcaagggacgcagac

SEQ ID NO: 53298 - DNA, 25 bp, S. cerevisiae
tgctaagggtttagtcgcttaccac

SEQ ID NO: 53299 - DNA, 25 bp, S. cerevisiae
tgcgtagcgtaatctcagggaacct

SEQ ID NO: 53300 - DNA, 25 bp, S. cerevisiae
tgcgtggttcatttctcagggtagt

SEQ ID NO: 53301 - DNA, 25 bp, S. cerevisiae
tgcttgtctgacttgattccactac

SEQ ID NO: 53302 - DNA, 25 bp, S. cerevisiae
tcgcaggaaacgatcggttcattga

SEQ ID NO: 53303 - DNA, 25 bp, S. cerevisiae
tgctgccagaagaaccggtttacta

SEQ ID NO: 53304 - DNA, 25 bp, S. cerevisiae
tgctcgctaatacccaatatgtcca

SEQ ID NO: 53305 - DNA, 25 bp, S. cerevisiae
tgcacgctagattactcgaaccaca

SEQ ID NO: 53306 - DNA, 25 bp, S. cerevisiae
tgccactagagtgcgttacttctgg

SEQ ID NO: 53307 - DNA, 25 bp, S. cerevisiae
tcccttaccgctttcaatgacttga

SEQ ID NO: 53308 - DNA, 25 bp, S. cerevisiae
tccgttacaacgctaagagaagaaa

SEQ ID NO: 53309 - DNA, 25 bp, S. cerevisiae
tgcggtttcccactttaaagattat

SEQ ID NO: 53310 - DNA, 25 bp, S. cerevisiae
tcttctttcgccactattattacct

SEQ ID NO: 53311 - DNA, 25 bp, S. cerevisiae
tcgtgtttgggcacttactcataca

SEQ ID NO: 53312 - DNA, 25 bp, S. cerevisiae
tgcagctattgagaacccatcctaa

SEQ ID NO: 53313 - DNA, 25 bp, S. cerevisiae
tgcagcaaccactacactatctcaa

SEQ ID NO: 53314 - DNA, 25 bp, S. cerevisiae
tgcagctaccgcagcaatcttggag

SEQ ID NO: 53315 - DNA, 25 bp, S. cerevisiae
tgcatctccttcttcaactgagcag

SEQ ID NO: 53316 - DNA, 25 bp, S. cerevisiae
tgcacttttaccctcaagcatgaaa

SEQ ID NO: 53317 - DNA, 25 bp, S. cerevisiae
tgcatccattttcgcgtggtcgaga

SEQ ID NO: 53318 - DNA, 25 bp, S. cerevisiae
tgcagccggtgaacccgaagccgtt

SEQ ID NO: 53319 - DNA, 25 bp, S. cerevisiae
tgcacgcgaggcactccaggagtca

SEQ ID NO: 53320 - DNA, 25 bp, S. cerevisiae
tgcaggccaggcaatgtcacggata

SEQ ID NO: 53321 - DNA, 25 bp, S. cerevisiae
tgaatgccaggccattagctagatt

SEQ ID NO: 53322 - DNA, 25 bp, S. cerevisiae
tgcaatccttgctttcgtaatctaa

SEQ ID NO: 53323 - DNA, 25 bp, S. cerevisiae
tgcttctaacggtttggacggtact

SEQ ID NO: 53324 - DNA, 25 bp, S. cerevisiae
tgcttctattgggactatggacgct

SEQ ID NO: 53325 - DNA, 25 bp, S. cerevisiae
tgcttttcttggttgcagtgaatcc

SEQ ID NO: 53326 - DNA, 25 bp, S. cerevisiae
tgctgttattcttcggagggcctaa

SEQ ID NO: 53327 - DNA, 25 bp, S. cerevisiae
tgaactacagactatctactacgat

SEQ ID NO: 53328 - DNA, 25 bp, S. cerevisiae
tgaactactgccattgaatatcgat

SEQ ID NO: 53329 - DNA, 25 bp, S. cerevisiae
tgaagcttcgccatatgctgcaacg

SEQ ID NO: 53330 - DNA, 25 bp, S. cerevisiae
tgaagcgtcgcagttaccacaggaa

SEQ ID NO: 53331 - DNA, 25 bp, S. cerevisiae
tgaagctatcgatgttgccaagaga

SEQ ID NO: 53332 - DNA, 25 bp, S. cerevisiae
tgcacgcttctatattccaaatggg

SEQ ID NO: 53333 - DNA, 25 bp, S. cerevisiae
tcctcgttagtccttcagaatgggt

SEQ ID NO: 53334 - DNA, 25 bp, S. cerevisiae
tcgtcgtttaccaactgaatccgtt

SEQ ID NO: 53335 - DNA, 25 bp, S. cerevisiae
tcgccggtataggtactttcaagcc

SEQ ID NO: 53336 - DNA, 25 bp, S. cerevisiae
tctccggtagaggtactgtggtcac

SEQ ID NO: 53337 - DNA, 25 bp, S. cerevisiae
tcccgtgaacactgaagactggcta

SEQ ID NO: 53338 - DNA, 25 bp, S. cerevisiae
tgcgtaccgcactataatgggccgt

SEQ ID NO: 53339 - DNA, 25 bp, S. cerevisiae
tgaacatcccatttgcagcatttaa

SEQ ID NO: 53340 - DNA, 25 bp, S. cerevisiae
tgcagacgaactcatgaagctagat

SEQ ID NO: 53341 - DNA, 25 bp, S. cerevisiae
tgaactcagacaactcactcgagat

SEQ ID NO: 53342 - DNA, 25 bp, S. cerevisiae
tgaagctgaagctctgcccagatat

SEQ ID NO: 53343 - DNA, 25 bp, S. cerevisiae
tgaagctgccactcagtacgatatt

SEQ ID NO: 53344 - DNA, 25 bp, S. cerevisiae
tgaaggccaagctgatatcgacatg

SEQ ID NO: 53345 - DNA, 25 bp, S. cerevisiae
tgaaggcaaagcattctcaaagttt

SEQ ID NO: 53346 - DNA, 25 bp, S. cerevisiae
tgaaggcccacaacatcaatgtcgt

SEQ ID NO: 53347 - DNA, 25 bp, S. cerevisiae
tgcgcccgtcaataatttcctacaa

SEQ ID NO: 53348 - DNA, 25 bp, S. cerevisiae
tcggtgcaaaaacaacgccctctta

SEQ ID NO: 53349 - DNA, 25 bp, S. cerevisiae
tcgggcaaggactcaaacgcttctg

SEQ ID NO: 53350 - DNA, 25 bp, S. cerevisiae
tcagggcaacgttcaaatatccatt

SEQ ID NO: 53351 - DNA, 25 bp, S. cerevisiae
tgcagggtccggtaaaacagcttta

SEQ ID NO: 53352 - DNA, 25 bp, S. cerevisiae
tgcacggtccctttaagccagttaa

SEQ ID NO: 53353 - DNA, 25 bp, S. cerevisiae
tgcaccgtaccattgtcatcagaag

SEQ ID NO: 53354 - DNA, 25 bp, S. cerevisiae
tgcaagcctggtttgatcagaaaat

SEQ ID NO: 53355 - DNA, 25 bp, S. cerevisiae
tgaagacggtcaccaccacaacaat

SEQ ID NO: 53356 - DNA, 25 bp, S. cerevisiae
tgaagtttaaccaagccgtgatgaa

SEQ ID NO: 53357 - DNA, 25 bp, S. cerevisiae
tgcaagaatcctcatcgctacagat

SEQ ID NO: 53358 - DNA, 25 bp, S. cerevisiae
tgaatgctacattgccctctgaatg

SEQ ID NO: 53359 - DNA, 25 bp, S. cerevisiae
tgaatgtcacattatcccagctcgt

SEQ ID NO: 53360 - DNA, 25 bp, S. cerevisiae
tgcatcaatagctaacaccctaggg

SEQ ID NO: 53361 - DNA, 25 bp, S. cerevisiae
tgcagttgtacagattgcccctcaa

SEQ ID NO: 53362 - DNA, 25 bp, S. cerevisiae
tgcagaaggtactttggccgccaag

SEQ ID NO: 53363 - DNA, 25 bp, S. cerevisiae
tgaacgtgttattagctcctctgct

SEQ ID NO: 53364 - DNA, 25 bp, S. cerevisiae
tgaagggacttctatggcatctatg

SEQ ID NO: 53365 - DNA, 25 bp, S. cerevisiae
tgcatgaatttgtcgcattgatggt

SEQ ID NO: 53366 - DNA, 25 bp, S. cerevisiae
tgcagctatgtcaattctagacgat

SEQ ID NO: 53367 - DNA, 25 bp, S. cerevisiae
tgcagcttcctcaattagtcaataa

SEQ ID NO: 53368 - DNA, 25 bp, S. cerevisiae
tgcaggaggtgctttcaggccataa

SEQ ID NO: 53369 - DNA, 25 bp, S. cerevisiae
tgcaaacttagtacgggccattcca

SEQ ID NO: 53370 - DNA, 25 bp, S. cerevisiae
tgaagcgtacaaggccaacagagtc

SEQ ID NO: 53371 - DNA, 25 bp, S. cerevisiae
tgaagcgtatagcacatccacaacc

SEQ ID NO: 53372 - DNA, 25 bp, S. cerevisiae
tgaagccatctcagtatccaaacct

SEQ ID NO: 53373 - DNA, 25 bp, S. cerevisiae
tgaagcatccataagtaaagacact

SEQ ID NO: 53374 - DNA, 25 bp, S. cerevisiae
tgcatacgccataccaaaagtcctg

SEQ ID NO: 53375 - DNA, 25 bp, S. cerevisiae
tgaattcctttgagccatttgatga

SEQ ID NO: 53376 - DNA, 25 bp, S. cerevisiae
tgaatttgttctgggcactttgcta

SEQ ID NO: 53377 - DNA, 25 bp, S. cerevisiae
tgaatattatagtcgtgcgccgcca

SEQ ID NO: 53378 - DNA, 25 bp, S. cerevisiae
tgaagcaggtgtggcaatctccgtc

SEQ ID NO: 53379 - DNA, 25 bp, S. cerevisiae
tgcttgggctctgacggtactaaaa

SEQ ID NO: 53380 - DNA, 25 bp, S. cerevisiae
tctggagccactgcgggtactataa

SEQ ID NO: 53381 - DNA, 25 bp, S. cerevisiae
tctgcgaccactccgaaggttgaaa

SEQ ID NO: 53382 - DNA, 25 bp, S. cerevisiae
tcgccaaatctggaccggtcgaaga

SEQ ID NO: 53383 - DNA, 25 bp, S. cerevisiae
tgaagtgcaggttcaaggtccacac

SEQ ID NO: 53384 - DNA, 25 bp, S. cerevisiae
tgaaggctggtcgtgctttccacaa

SEQ ID NO: 53385 - DNA, 25 bp, S. cerevisiae
tgaaggaggcttggcagttccacgt

SEQ ID NO: 53386 - DNA, 25 bp, S. cerevisiae
tgaagcccgcttacgtctctaagat

SEQ ID NO: 53387 - DNA, 25 bp, S. cerevisiae
tgaagccgactatcttgccgatgag

SEQ ID NO: 53388 - DNA, 25 bp, S. cerevisiae
tgaacctgactatcaagctccattc

SEQ ID NO: 53389 - DNA, 25 bp, S. cerevisiae
tgaatctcctggtaagaccactgat

SEQ ID NO: 53390 - DNA, 25 bp, S. cerevisiae
tgaagatccggttaaggcacttaat

SEQ ID NO: 53391 - DNA, 25 bp, S. cerevisiae
tgaagacagccgtataagcacatct

SEQ ID NO: 53392 - DNA, 25 bp, S. cerevisiae
tgaagaagcgctcgaacccagctat

SEQ ID NO: 53393 - DNA, 25 bp, S. cerevisiae
tgcaagtacactaacaggccctatc

SEQ ID NO: 53394 - DNA, 25 bp, S. cerevisiae
tgaagatctttcaccattcctggag

SEQ ID NO: 53395 - DNA, 25 bp, S. cerevisiae
tgctatggttgatcggtgcttctgc

SEQ ID NO: 53396 - DNA, 25 bp, S. cerevisiae
tgcaacgctaagactatgggcttct

SEQ ID NO: 53397 - DNA, 25 bp, S. cerevisiae
tgaatatgcaggtgccaatcccgcc

SEQ ID NO: 53398 - DNA, 25 bp, S. cerevisiae
tgaattggaatacctacctgccctt

SEQ ID NO: 53399 - DNA, 25 bp, S. cerevisiae
tgcaacgaatcaatggaaccccttt

SEQ ID NO: 53400 - DNA, 25 bp, S. cerevisiae
tgcaatatttgcttttacttctctt

SEQ ID NO: 53401 - DNA, 25 bp, S. cerevisiae
tgaacctcctgctggtgtggcttta

SEQ ID NO: 53402 - DNA, 25 bp, S. cerevisiae
tgcagcacatgttacctccgaggaa

SEQ ID NO: 53403 - DNA, 25 bp, S. cerevisiae
tcgaattacaacaacggcccatgca

SEQ ID NO: 53404 - DNA, 25 bp, S. cerevisiae
tcgatgaagccgtggaaattcctgt

SEQ ID NO: 53405 - DNA, 25 bp, S. cerevisiae
tgctgatgaagctgatgaggccgat

SEQ ID NO: 53406 - DNA, 25 bp, S. cerevisiae
tgcaataagcagcaggtccttcttt

SEQ ID NO: 53407 - DNA, 25 bp, S. cerevisiae
tgaatttcatgccaggtcacgtaat

SEQ ID NO: 53408 - DNA, 25 bp, S. cerevisiae
tgaatgctccacaaccacatctatt

SEQ ID NO: 53409 - DNA, 25 bp, S. cerevisiae
tgaagcgcgccatcgacatatacaa

SEQ ID NO: 53410 - DNA, 25 bp, S. cerevisiae
tgctaaatccactgctacattcgag

SEQ ID NO: 53411 - DNA, 25 bp, S. cerevisiae
taccaaccaaaggacttgagagcca

SEQ ID NO: 53412 - DNA, 25 bp, S. cerevisiae
tgcaccgccacaaggagatcttaca

SEQ ID NO: 53413 - DNA, 25 bp, S. cerevisiae
tgcaggtgcctttgttttccaaact

SEQ ID NO: 53414 - DNA, 25 bp, S. cerevisiae
tgaattcactacttactgcccagaa

SEQ ID NO: 53415 - DNA, 25 bp, S. cerevisiae
tgaatggacggaatcagtggccaac

SEQ ID NO: 53416 - DNA, 25 bp, S. cerevisiae
tgcatattcatttgtaccctttccc

SEQ ID NO: 53417 - DNA, 25 bp, S. cerevisiae
tgaattctttctaccttttatccct

SEQ ID NO: 53418 - DNA, 25 bp, S. cerevisiae
tgaatttgctttccggtttgactgc

SEQ ID NO: 53419 - DNA, 25 bp, S. cerevisiae
tgaagttctcaaagggttctgattg

SEQ ID NO: 53420 - DNA, 25 bp, S. cerevisiae
taatatggttcaaagggcccggtgt

SEQ ID NO: 53421 - DNA, 25 bp, S. cerevisiae
taatgagccgaccaggaaatttgtt

SEQ ID NO: 53422 - DNA, 25 bp, S. cerevisiae
tgccaagagccccaagaacatattc

SEQ ID NO: 53423 - DNA, 25 bp, S. cerevisiae
tgccaagcgtcacagaaagattcta

SEQ ID NO: 53424 - DNA, 25 bp, S. cerevisiae
tgctactgccaggtcgaggtcatga

SEQ ID NO: 53425 - DNA, 25 bp, S. cerevisiae
tccagcatgcaatacagtgacatat

SEQ ID NO: 53426 - DNA, 25 bp, S. cerevisiae
tgcagagcatgagaagatcttccat

SEQ ID NO: 53427 - DNA, 25 bp, S. cerevisiae
tgcagtgatggctacgagtctaatt

SEQ ID NO: 53428 - DNA, 25 bp, S. cerevisiae
tgcacgtggcaaagaccccatttga

SEQ ID NO: 53429 - DNA, 25 bp, S. cerevisiae
tgctcgtttcataggtcccttagta

SEQ ID NO: 53430 - DNA, 25 bp, S. cerevisiae
tgcgaagttccatccttttaaacct

SEQ ID NO: 53431 - DNA, 25 bp, S. cerevisiae
tctcaagttcccattcttttttcca

SEQ ID NO: 53432 - DNA, 25 bp, S. cerevisiae
tctactggtccgttgtttttaagtg

SEQ ID NO: 53433 - DNA, 25 bp, S. cerevisiae
ttagtgcaaccgaagctttacaaag

SEQ ID NO: 53434 - DNA, 25 bp, S. cerevisiae
tgctgtcaatccctattcctaaaaa

SEQ ID NO: 53435 - DNA, 25 bp, S. cerevisiae
tgcactaccatttgtatttccagaa

SEQ ID NO: 53436 - DNA, 25 bp, S. cerevisiae
tgcagctacccaaggattatcccgg

SEQ ID NO: 53437 - DNA, 25 bp, S. cerevisiae
tgcggagcctacagaaatcccaaga

SEQ ID NO: 53438 - DNA, 25 bp, S. cerevisiae
tgctgacgtttcaaggacaccctga

SEQ ID NO: 53439 - DNA, 25 bp, S. cerevisiae
tgcagagttagttcaggctgaccct

SEQ ID NO: 53440 - DNA, 25 bp, S. cerevisiae
tgctgcgttcgtccagggaacaaca

SEQ ID NO: 53441 - DNA, 25 bp, S. cerevisiae
tcctattggtcgggtaacagatttt

SEQ ID NO: 53442 - DNA, 25 bp, S. cerevisiae
tgcatagtccgttcttgatgggcca

SEQ ID NO: 53443 - DNA, 25 bp, S. cerevisiae
tgcatacccttacgctgtgagtgaa

SEQ ID NO: 53444 - DNA, 25 bp, S. cerevisiae
tgctgctacctttgccagtggtaaa

SEQ ID NO: 53445 - DNA, 25 bp, S. cerevisiae
tgcagttccttttcggcgtaaccaa

SEQ ID NO: 53446 - DNA, 25 bp, S. cerevisiae
tgcattgctttgaattgcccgaaat

SEQ ID NO: 53447 - DNA, 25 bp, S. cerevisiae
tgcatcattatacatcccaggtaag

SEQ ID NO: 53448 - DNA, 25 bp, S. cerevisiae
tgcaatactgtgaactcgatttatc

SEQ ID NO: 53449 - DNA, 25 bp, S. cerevisiae
tgcatttcatttatcacttcgtcaa

SEQ ID NO: 53450 - DNA, 25 bp, S. cerevisiae
tgcaccgtgctaaacaatccagtaa

SEQ ID NO: 53451 - DNA, 25 bp, S. cerevisiae
tcattacaccggtaccttggagaac

SEQ ID NO: 53452 - DNA, 25 bp, S. cerevisiae
tacttgcacttctaccggttatagg

SEQ ID NO: 53453 - DNA, 25 bp, S. cerevisiae
tgaattagacgtccctgagcaggtt

SEQ ID NO: 53454 - DNA, 25 bp, S. cerevisiae
tgcaattctactatcactgacgggt

SEQ ID NO: 53455 - DNA, 25 bp, S. cerevisiae
tgcaattgctacatctgcgggcggc

SEQ ID NO: 53456 - DNA, 25 bp, S. cerevisiae
tgaatctgccaattaccggcgaatt

SEQ ID NO: 53457 - DNA, 25 bp, S. cerevisiae
tgcgttgatattacatagcgggttc

SEQ ID NO: 53458 - DNA, 25 bp, S. cerevisiae
tgcttccatggccatttgttttgtt

SEQ ID NO: 53459 - DNA, 25 bp, S. cerevisiae
tgcaacacctcatcgttatgacgac

SEQ ID NO: 53460 - DNA, 25 bp, S. cerevisiae
tccaagctttcaaggaatctccact

SEQ ID NO: 53461 - DNA, 25 bp, S. cerevisiae
tcctcttcttcacaaaaagccgcta

SEQ ID NO: 53462 - DNA, 25 bp, S. cerevisiae
tctgctgcattttgactataaaacg

SEQ ID NO: 53463 - DNA, 25 bp, S. cerevisiae
tgcagggcatcgacacaatcaacag

SEQ ID NO: 53464 - DNA, 25 bp, S. cerevisiae
tgctagattgccaccaagagctacc

SEQ ID NO: 53465 - DNA, 25 bp, S. cerevisiae
tgaagaggccacgtccaagttcatc

SEQ ID NO: 53466 - DNA, 25 bp, S. cerevisiae
tgaaggcgtcatcctcgcagagtaa

SEQ ID NO: 53467 - DNA, 25 bp, S. cerevisiae
tgcaaacgactttcacttccaatag

SEQ ID NO: 53468 - DNA, 25 bp, S. cerevisiae
tgaatcctcttcagatgggtcttcc

SEQ ID NO: 53469 - DNA, 25 bp, S. cerevisiae
tgcagtcactatcggtggcggttat

SEQ ID NO: 53470 - DNA, 25 bp, S. cerevisiae
tgcaaacatcccatcaagtctcaaa

SEQ ID NO: 53471 - DNA, 25 bp, S. cerevisiae
tgaatctaacccactgcatatgaat

SEQ ID NO: 53472 - DNA, 25 bp, S. cerevisiae
tgaatgtttcaactccgtcatcatc

SEQ ID NO: 53473 - DNA, 25 bp, S. cerevisiae
tgaatgatgttcaagcctctaaatc

SEQ ID NO: 53474 - DNA, 25 bp, S. cerevisiae
tgaattttctcaggcatctgctaaa

SEQ ID NO: 53475 - DNA, 25 bp, S. cerevisiae
tgaatatactacatggtgccctctt

SEQ ID NO: 53476 - DNA, 25 bp, S. cerevisiae
tgaattagtcgattggttggccaca

SEQ ID NO: 53477 - DNA, 25 bp, S. cerevisiae
tgcaatagttagtgcgccatccgtc

SEQ ID NO: 53478 - DNA, 25 bp, S. cerevisiae
tgcaattctctactgtcgcttccgt

SEQ ID NO: 53479 - DNA, 25 bp, S. cerevisiae
tctccgggattcaccgtcgagaaat

SEQ ID NO: 53480 - DNA, 25 bp, S. cerevisiae
tcaacaggaagtctccgaagaggag

SEQ ID NO: 53481 - DNA, 25 bp, S. cerevisiae
tcgacggcaaggtaacagacggtga

SEQ ID NO: 53482 - DNA, 25 bp, S. cerevisiae
tgctacgagcgggaatcactacgag

SEQ ID NO: 53483 - DNA, 25 bp, S. cerevisiae
tgctatcggcgattgtaccttccac

SEQ ID NO: 53484 - DNA, 25 bp, S. cerevisiae
tgcagccccttacaagcgagtcgat

SEQ ID NO: 53485 - DNA, 25 bp, S. cerevisiae
tgcgccgccttctaaggtagtacat

SEQ ID NO: 53486 - DNA, 25 bp, S. cerevisiae
tgctcaattgttctccatttgggtt

SEQ ID NO: 53487 - DNA, 25 bp, S. cerevisiae
tgcaggctaacatactttcgcgaat

SEQ ID NO: 53488 - DNA, 25 bp, S. cerevisiae
tcggctaagttcacggcgcacagac

SEQ ID NO: 53489 - DNA, 25 bp, S. cerevisiae
tgcgagaaccaagagatccgttgtt

SEQ ID NO: 53490 - DNA, 25 bp, S. cerevisiae
tgcggaagctgaactagatttggtc

SEQ ID NO: 53491 - DNA, 25 bp, S. cerevisiae
tgcgaacaggccgaattttcagatc

SEQ ID NO: 53492 - DNA, 25 bp, S. cerevisiae
tgaatggtgatgcttcttcttctgc

SEQ ID NO: 53493 - DNA, 25 bp, S. cerevisiae
tgcaaactgctgtgtgttctgtcgc

SEQ ID NO: 53494 - DNA, 25 bp, S. cerevisiae
tccttctccgaaatagtacccttat

SEQ ID NO: 53495 - DNA, 25 bp, S. cerevisiae
tgcatttaggcggttctggcaaagt

SEQ ID NO: 53496 - DNA, 25 bp, S. cerevisiae
tgcttctaaggaaactgctccagtt

SEQ ID NO: 53497 - DNA, 25 bp, S. cerevisiae
tgcttccacacaagccactcagaag

SEQ ID NO: 53498 - DNA, 25 bp, S. cerevisiae
tgctggccactctaataaatttctc

SEQ ID NO: 53499 - DNA, 25 bp, S. cerevisiae
tgcgacgccttaattattcccggag

SEQ ID NO: 53500 - DNA, 25 bp, S. cerevisiae
tgcttcggaaaaatcattgcgccag

SEQ ID NO: 53501 - DNA, 25 bp, S. cerevisiae
tgcttccagacacgaatttgcatct

SEQ ID NO: 53502 - DNA, 25 bp, S. cerevisiae
tgctatgccatgtacggatcctcta

SEQ ID NO: 53503 - DNA, 25 bp, S. cerevisiae
tgcacgttgaattggctgagctgaa

SEQ ID NO: 53504 - DNA, 25 bp, S. cerevisiae
tgcagctttgaagcctggcatgaaa

SEQ ID NO: 53505 - DNA, 25 bp, S. cerevisiae
tgcagtcaataatcctccgaaacgt

SEQ ID NO: 53506 - DNA, 25 bp, S. cerevisiae
tgcagttaagatctctccgcataag

SEQ ID NO: 53507 - DNA, 25 bp, S. cerevisiae
tgctattcaaggtctcgcccatcaa

SEQ ID NO: 53508 - DNA, 25 bp, S. cerevisiae
tgctatctgggttcgctgccaaata

SEQ ID NO: 53509 - DNA, 25 bp, S. cerevisiae
tgctcattgcccttctttcagttgg

SEQ ID NO: 53510 - DNA, 25 bp, S. cerevisiae
tgcatatctagcagccgttccgatt

SEQ ID NO: 53511 - DNA, 25 bp, S. cerevisiae
tgcattgctagcgtctatgttccaa

SEQ ID NO: 53512 - DNA, 25 bp, S. cerevisiae
tgcattctcatcacagttctagtac

SEQ ID NO: 53513 - DNA, 25 bp, S. cerevisiae
tctttgcatctgctggacatggtgc

SEQ ID NO: 53514 - DNA, 25 bp, S. cerevisiae
tgctttgatctactggttcctggaa

SEQ ID NO: 53515 - DNA, 25 bp, S. cerevisiae
tgcttatgtgtatacttcgtccagt

SEQ ID NO: 53516 - DNA, 25 bp, S. cerevisiae
tcctttattaaagcgcgccactggg

SEQ ID NO: 53517 - DNA, 25 bp, S. cerevisiae
tgcctactttgatactagcgccagt

SEQ ID NO: 53518 - DNA, 25 bp, S. cerevisiae
tgctgtattttgttacttgcccgac

SEQ ID NO: 53519 - DNA, 25 bp, S. cerevisiae
tgctatcctcagttaagtcctcagt

SEQ ID NO: 53520 - DNA, 25 bp, S. cerevisiae
tgcatcaagctcaggatccgttcca

SEQ ID NO: 53521 - DNA, 25 bp, S. cerevisiae
tgcactatgcacagaagcccgatca

SEQ ID NO: 53522 - DNA, 25 bp, S. cerevisiae
tgcaatcacgcaactttccgaagct

SEQ ID NO: 53523 - DNA, 25 bp, S. cerevisiae
tgctacaagacgctaccagaaggga

SEQ ID NO: 53524 - DNA, 25 bp, S. cerevisiae
tctacggcggcgtcactcagtgagg

SEQ ID NO: 53525 - DNA, 25 bp, S. cerevisiae
tttctctgcagtgactactttaccg

SEQ ID NO: 53526 - DNA, 25 bp, S. cerevisiae
tgccgctactttattggttgccaca

SEQ ID NO: 53527 - DNA, 25 bp, S. cerevisiae
tgcaaccatactctttgtttccaac

SEQ ID NO: 53528 - DNA, 25 bp, S. cerevisiae
tgcaatgcaatattccttcctgttc

SEQ ID NO: 53529 - DNA, 25 bp, S. cerevisiae
tgccagagggcccaactttttattt

SEQ ID NO: 53530 - DNA, 25 bp, S. cerevisiae
tgaattatccttatgtgctgcccta

SEQ ID NO: 53531 - DNA, 25 bp, S. cerevisiae
tgaattcccattgtgtgtccatttg

SEQ ID NO: 53532 - DNA, 25 bp, S. cerevisiae
tgctgcccaacaaggtgtaccatat

SEQ ID NO: 53533 - DNA, 25 bp, S. cerevisiae
tgcggctcaatcacagttaccaaac

SEQ ID NO: 53534 - DNA, 25 bp, S. cerevisiae
tgcagaggaatagcaatgtatccca

SEQ ID NO: 53535 - DNA, 25 bp, S. cerevisiae
tgctgttcagtagccagtatcccga

SEQ ID NO: 53536 - DNA, 25 bp, S. cerevisiae
tgctgaccaatttacgttccactac

SEQ ID NO: 53537 - DNA, 25 bp, S. cerevisiae
tgctgatccaacttattttcccgaa

SEQ ID NO: 53538 - DNA, 25 bp, S. cerevisiae
tcgatccgtttcatggttctacaac

SEQ ID NO: 53539 - DNA, 25 bp, S. cerevisiae
tgctgttgccctctacgatttcgaa

SEQ ID NO: 53540 - DNA, 25 bp, S. cerevisiae
tgctaaatccgcttctgctcgtggt

SEQ ID NO: 53541 - DNA, 25 bp, S. cerevisiae
tgctaaagccttacatcctgatggt

SEQ ID NO: 53542 - DNA, 25 bp, S. cerevisiae
tgctcaagtggattcaaccgctgtt

SEQ ID NO: 53543 - DNA, 25 bp, S. cerevisiae
tgctacagattcaattccggcgctt

SEQ ID NO: 53544 - DNA, 25 bp, S. cerevisiae
tgcccaaaacattacccctgaaggt

SEQ ID NO: 53545 - DNA, 25 bp, S. cerevisiae
tgcgaaagacgctatacccctagga

SEQ ID NO: 53546 - DNA, 25 bp, S. cerevisiae
tgctattaattcctaccagcctagt

SEQ ID NO: 53547 - DNA, 25 bp, S. cerevisiae
tgccggaattcctgtcgagaacgtt

SEQ ID NO: 53548 - DNA, 25 bp, S. cerevisiae
tgcttaaattcatgggcgagatcaa

SEQ ID NO: 53549 - DNA, 25 bp, S. cerevisiae
tgccaaaaatcatgtagctgcccaa

SEQ ID NO: 53550 - DNA, 25 bp, S. cerevisiae
tgctctagaaaaagatattgcccat

SEQ ID NO: 53551 - DNA, 25 bp, S. cerevisiae
tgctgctaacaagcttaacacctct

SEQ ID NO: 53552 - DNA, 25 bp, S. cerevisiae
tgcactgcaggctaccatctaacaa

SEQ ID NO: 53553 - DNA, 25 bp, S. cerevisiae
tgcactgactgcgactctgtaaaga

SEQ ID NO: 53554 - DNA, 25 bp, S. cerevisiae
tgcagctcaagcttttacctgtctt

SEQ ID NO: 53555 - DNA, 25 bp, S. cerevisiae
tgcagccgggattgcgtctatttat

SEQ ID NO: 53556 - DNA, 25 bp, S. cerevisiae
tcctctactagcaccgtttttgaac

SEQ ID NO: 53557 - DNA, 25 bp, S. cerevisiae
tgcttcttctacaccttattcgaat

SEQ ID NO: 53558 - DNA, 25 bp, S. cerevisiae
tgcggatttcaacacttcaagcaat

SEQ ID NO: 53559 - DNA, 25 bp, S. cerevisiae
tgctcagtttggtaagcctcaacaa

SEQ ID NO: 53560 - DNA, 25 bp, S. cerevisiae
tgcagccgtcgcagcaaagcaaact

SEQ ID NO: 53561 - DNA, 25 bp, S. cerevisiae
tgcacacgtcgctagaaccaatgag

SEQ ID NO: 53562 - DNA, 25 bp, S. cerevisiae
tgcatcactcccttgtacgaagaag

SEQ ID NO: 53563 - DNA, 25 bp, S. cerevisiae
tgcacctttaggaccaacaacgtaa

SEQ ID NO: 53564 - DNA, 25 bp, S. cerevisiae
tgctgcgcttcaaggatgcctacaa

SEQ ID NO: 53565 - DNA, 25 bp, S. cerevisiae
tgcatttatcaaacaggctacagaa

SEQ ID NO: 53566 - DNA, 25 bp, S. cerevisiae
tgcagagatctaatgtcccgtatat

SEQ ID NO: 53567 - DNA, 25 bp, S. cerevisiae
tgcaggctatctggtagcgccatat

SEQ ID NO: 53568 - DNA, 25 bp, S. cerevisiae
tgcatggccatcacttccagataat

SEQ ID NO: 53569 - DNA, 25 bp, S. cerevisiae
tgcagattctgcattcaataacaat

SEQ ID NO: 53570 - DNA, 25 bp, S. cerevisiae
tgcactctcacttaccattaatttg

SEQ ID NO: 53571 - DNA, 25 bp, S. cerevisiae
tgctgccccagccaccactacttta

SEQ ID NO: 53572 - DNA, 25 bp, S. cerevisiae
tcgctgctgccccagccaccactac

SEQ ID NO: 53573 - DNA, 25 bp, S. cerevisiae
tgcattgtattctaggtcactcgga

SEQ ID NO: 53574 - DNA, 25 bp, S. cerevisiae
tgcaattttctactgtcgcttctat

SEQ ID NO: 53575 - DNA, 25 bp, S. cerevisiae
tgcacttcttttcgctgaatatcct

SEQ ID NO: 53576 - DNA, 25 bp, S. cerevisiae
tgcacttcctgttcttgacatatct

SEQ ID NO: 53577 - DNA, 25 bp, S. cerevisiae
tgcaatctcctttttacaatcatga

SEQ ID NO: 53578 - DNA, 25 bp, S. cerevisiae
tgcagcgctttctacttccaaagaa

SEQ ID NO: 53579 - DNA, 25 bp, S. cerevisiae
tgcaggcacttcatcgtccttagat

SEQ ID NO: 53580 - DNA, 25 bp, S. cerevisiae
tgcaggccaatatcactctctaaga

SEQ ID NO: 53581 - DNA, 25 bp, S. cerevisiae
tgcattgcgtgaacagcctacgtgt

SEQ ID NO: 53582 - DNA, 25 bp, S. cerevisiae
tgctcgaccagctgggcgacagatg

SEQ ID NO: 53583 - DNA, 25 bp, S. cerevisiae
tgctccatcctctgaacgtcgtgtt

SEQ ID NO: 53584 - DNA, 25 bp, S. cerevisiae
tgctcctcattcaagcgacgttgct

SEQ ID NO: 53585 - DNA, 25 bp, S. cerevisiae
tgcatactacgcttatctttctctt

SEQ ID NO: 53586 - DNA, 25 bp, S. cerevisiae
tgcaacgaatgcttcaccatcaact

SEQ ID NO: 53587 - DNA, 25 bp, S. cerevisiae
tgcacagggcagatcagactcaaat

SEQ ID NO: 53588 - DNA, 25 bp, S. cerevisiae
tgcggtaactcctatcccattttta

SEQ ID NO: 53589 - DNA, 25 bp, S. cerevisiae
tgctccactagacggtaccattttg

SEQ ID NO: 53590 - DNA, 25 bp, S. cerevisiae
tgccccagaccaagtgaccagaatg

SEQ ID NO: 53591 - DNA, 25 bp, S. cerevisiae
tgcgggcgaccttatcagacaagtg

SEQ ID NO: 53592 - DNA, 25 bp, S. cerevisiae
tctgggctcacggatacgaatctgg

SEQ ID NO: 53593 - DNA, 25 bp, S. cerevisiae
tgctgtggctccaggacagacctgt

SEQ ID NO: 53594 - DNA, 25 bp, S. cerevisiae
tgcaattcttcaaagacgcatcccc

SEQ ID NO: 53595 - DNA, 25 bp, S. cerevisiae
tctttaatcgtgcattggaccaatc

SEQ ID NO: 53596 - DNA, 25 bp, S. cerevisiae
tgcagctgcctctctagaaagtgtt

SEQ ID NO: 53597 - DNA, 25 bp, S. cerevisiae
tgctcagcagtgttaggccaagtaa

SEQ ID NO: 53598 - DNA, 25 bp, S. cerevisiae
tgcgaagtccttccaaagctgtatg

SEQ ID NO: 53599 - DNA, 25 bp, S. cerevisiae
tgcaaatttatcaccagcatgcttg

SEQ ID NO: 53600 - DNA, 25 bp, S. cerevisiae
tgcagactttatttccgcagagttt

SEQ ID NO: 53601 - DNA, 25 bp, S. cerevisiae
tgcacgctatgctatgtcaatcggg

SEQ ID NO: 53602 - DNA, 25 bp, S. cerevisiae
tgccgtatatcaatgcctcaatggg

SEQ ID NO: 53603 - DNA, 25 bp, S. cerevisiae
tgcacgtccctaccatgagtatgga

SEQ ID NO: 53604 - DNA, 25 bp, S. cerevisiae
tgcacggccaccttcaagtgagaaa

SEQ ID NO: 53605 - DNA, 25 bp, S. cerevisiae
tgctagctatcctcagtatgtctgg

SEQ ID NO: 53606 - DNA, 25 bp, S. cerevisiae
tgcagcctggccatttattatcgat

SEQ ID NO: 53607 - DNA, 25 bp, S. cerevisiae
tgcagtttgcgttcttaaatgccat

SEQ ID NO: 53608 - DNA, 25 bp, S. cerevisiae
tgcagttttattcgcagcatcctcc

SEQ ID NO: 53609 - DNA, 25 bp, S. cerevisiae
tgcagatattgccataccgcgactc

SEQ ID NO: 53610 - DNA, 25 bp, S. cerevisiae
tgcagcaactacaaccagggtctca

SEQ ID NO: 53611 - DNA, 25 bp, S. cerevisiae
tgcaccagctaccaccactttatct

SEQ ID NO: 53612 - DNA, 25 bp, S. cerevisiae
tgcaccagctaccaccactttatct

SEQ ID NO: 53613 - DNA, 25 bp, S. cerevisiae
tgcagacccgatcgtcatctaatta

SEQ ID NO: 53614 - DNA, 25 bp, S. cerevisiae
tgcaaacgcaactattccatctcta

SEQ ID NO: 53615 - DNA, 25 bp, S. cerevisiae
tgcagccatcgccaaaattctttat

SEQ ID NO: 53616 - DNA, 25 bp, S. cerevisiae
tgcactgacacacaaggttcttatt

SEQ ID NO: 53617 - DNA, 25 bp, S. cerevisiae
tgcagcctccagtcaagtttctatt

SEQ ID NO: 53618 - DNA, 25 bp, S. cerevisiae
tcctttgttggcttacctgttagta

SEQ ID NO: 53619 - DNA, 25 bp, S. cerevisiae
tcccattcctgagaacccttagatt

SEQ ID NO: 53620 - DNA, 25 bp, S. cerevisiae
tgcccacatgggtcaaacccttttt

SEQ ID NO: 53621 - DNA, 25 bp, S. cerevisiae
tgctccagcagcctgatgcaacatc

SEQ ID NO: 53622 - DNA, 25 bp, S. cerevisiae
tgcatccagcatttgtgacacttct

SEQ ID NO: 53623 - DNA, 25 bp, S. cerevisiae
tgctatcatcgaagccaacttgggt

SEQ ID NO: 53624 - DNA, 25 bp, S. cerevisiae
tgctttgaacgctaccagagctgca

SEQ ID NO: 53625 - DNA, 25 bp, S. cerevisiae
tgcttatcaaggtgccagatctcaa

SEQ ID NO: 53626 - DNA, 25 bp, S. cerevisiae
tgcatgatgcctgccatttgactaa

SEQ ID NO: 53627 - DNA, 25 bp, S. cerevisiae
tgctggtcccttgtactataattat

SEQ ID NO: 53628 - DNA, 25 bp, S. cerevisiae
tctccaagactgttagattcaacgt

SEQ ID NO: 53629 - DNA, 25 bp, S. cerevisiae
tccacaatggctggtaaggcacttg

SEQ ID NO: 53630 - DNA, 25 bp, S. cerevisiae
tgcggctgcagtgggatctaccatg

SEQ ID NO: 53631 - DNA, 25 bp, S. cerevisiae
tgcggtagcattggacaagcctatt

SEQ ID NO: 53632 - DNA, 25 bp, S. cerevisiae
tgcatctcaaattctgtccacagct

SEQ ID NO: 53633 - DNA, 25 bp, S. cerevisiae
tgctgatcagtttcaaggtcgtgac

SEQ ID NO: 53634 - DNA, 25 bp, S. cerevisiae
tgctatcgttgaaattatcgaccaa

SEQ ID NO: 53635 - DNA, 25 bp, S. cerevisiae
tgctacctatactctgggaccacaa

SEQ ID NO: 53636 - DNA, 25 bp, S. cerevisiae
tgctactggctataatgggactcct

SEQ ID NO: 53637 - DNA, 25 bp, S. cerevisiae
tgctagatgggttccatgggaccat

SEQ ID NO: 53638 - DNA, 25 bp, S. cerevisiae
tgctagtgctgggtacatggtcttt

SEQ ID NO: 53639 - DNA, 25 bp, S. cerevisiae
tgcatttcagttgtggttccagctt

SEQ ID NO: 53640 - DNA, 25 bp, S. cerevisiae
tcctgggcggtttggttactcaatt

SEQ ID NO: 53641 - DNA, 25 bp, S. cerevisiae
tgcgggtgtgtttacgttcctaatt

SEQ ID NO: 53642 - DNA, 25 bp, S. cerevisiae
tgccggtattgaaaggtacccatca

SEQ ID NO: 53643 - DNA, 25 bp, S. cerevisiae
tgccgtgaattgtcggagttcctta

SEQ ID NO: 53644 - DNA, 25 bp, S. cerevisiae
tgctgagacgattaccaatactgga

SEQ ID NO: 53645 - DNA, 25 bp, S. cerevisiae
tgcgcatcaagaagtcgaccacgtc

SEQ ID NO: 53646 - DNA, 25 bp, S. cerevisiae
tgctatcagagcattggcctcaatt

SEQ ID NO: 53647 - DNA, 25 bp, S. cerevisiae
tgctcaatgcttcagttctgccatt

SEQ ID NO: 53648 - DNA, 25 bp, S. cerevisiae
tgctatcccagaaaacgccaacgtt

SEQ ID NO: 53649 - DNA, 25 bp, S. cerevisiae
tctgaagcccaaattatcctacgtt

SEQ ID NO: 53650 - DNA, 25 bp, S. cerevisiae
tcgtaagcttacttctccatgacag

SEQ ID NO: 53651 - DNA, 25 bp, S. cerevisiae
tgcgcaatgagcaggttaccataga

SEQ ID NO: 53652 - DNA, 25 bp, S. cerevisiae
tgcagataagcaacttcacccatcg

SEQ ID NO: 53653 - DNA, 25 bp, S. cerevisiae
tcgagaagctaaaacccttgacccg

SEQ ID NO: 53654 - DNA, 25 bp, S. cerevisiae
tgcttccaccaacggtcttattgaa

SEQ ID NO: 53655 - DNA, 25 bp, S. cerevisiae
tgctggcacatatccggttttcgaa

SEQ ID NO: 53656 - DNA, 25 bp, S. cerevisiae
tgcttgcctcttgtcgaatccaata

SEQ ID NO: 53657 - DNA, 25 bp, S. cerevisiae
tgctggtcacgtttctggtgttatt

SEQ ID NO: 53658 - DNA, 25 bp, S. cerevisiae
tgctgctgtgacttacgatgcgaac

SEQ ID NO: 53659 - DNA, 25 bp, S. cerevisiae
tgctttgttactcggtgtgccacta

SEQ ID NO: 53660 - DNA, 25 bp, S. cerevisiae
tccttttgacatcggatttcctaat

SEQ ID NO: 53661 - DNA, 25 bp, S. cerevisiae
tcgttttaccaggatggaccaggtt

SEQ ID NO: 53662 - DNA, 25 bp, S. cerevisiae
tcccgccgaccaagttaccagagtt

SEQ ID NO: 53663 - DNA, 25 bp, S. cerevisiae
tccctggtgcagagaatttattgtt

SEQ ID NO: 53664 - DNA, 25 bp, S. cerevisiae
tccgcgggatcataacattacgtta

SEQ ID NO: 53665 - DNA, 25 bp, S. cerevisiae
tccgggaatcgtacaaagacctctc

SEQ ID NO: 53666 - DNA, 25 bp, S. cerevisiae
tgcggatactttgaaacagccctgt

SEQ ID NO: 53667 - DNA, 25 bp, S. cerevisiae
tgctccaaaatgctcgaacacttgt

SEQ ID NO: 53668 - DNA, 25 bp, S. cerevisiae
tgctcctcgcgggacgaaagttatc

SEQ ID NO: 53669 - DNA, 25 bp, S. cerevisiae
tgccgctatcatcacagcagtcata

SEQ ID NO: 53670 - DNA, 25 bp, S. cerevisiae
tgcagcagcttcttcgacaataacg

SEQ ID NO: 53671 - DNA, 25 bp, S. cerevisiae
tgcatccattagtcgatgaattgac

SEQ ID NO: 53672 - DNA, 25 bp, S. cerevisiae
tgcaggttttatggcagctggccct

SEQ ID NO: 53673 - DNA, 25 bp, S. cerevisiae
tgcagcggatttttcttccttgttt

SEQ ID NO: 53674 - DNA, 25 bp, S. cerevisiae
tgctcacggtgttgtcgttccaaga

SEQ ID NO: 53675 - DNA, 25 bp, S. cerevisiae
tgcttgggtgcaggtatgttccaca

SEQ ID NO: 53676 - DNA, 25 bp, S. cerevisiae
tgcttgcgtgatcctgttatcccaa

SEQ ID NO: 53677 - DNA, 25 bp, S. cerevisiae
tgctgataatatccgctcccaatta

SEQ ID NO: 53678 - DNA, 25 bp, S. cerevisiae
tgctgcagaatttcacaccgaatct

SEQ ID NO: 53679 - DNA, 25 bp, S. cerevisiae
tgccaacatcattgccgtcgaacgt

SEQ ID NO: 53680 - DNA, 25 bp, S. cerevisiae
tgccagcctcattttgcgtaatcga

SEQ ID NO: 53681 - DNA, 25 bp, S. cerevisiae
tgccatggccgcgttgactaacaac

SEQ ID NO: 53682 - DNA, 25 bp, S. cerevisiae
tgccgaggtgccttgaaaacccctt

SEQ ID NO: 53683 - DNA, 25 bp, S. cerevisiae
tgctatcggtgctttgcaagaatcc

SEQ ID NO: 53684 - DNA, 25 bp, S. cerevisiae
tgctaagttggtccgatacagccgc

SEQ ID NO: 53685 - DNA, 25 bp, S. cerevisiae
tccaatgttgtttcaggaagtacac

SEQ ID NO: 53686 - DNA, 25 bp, S. cerevisiae
tgctaacagtgttaggccgactccc

SEQ ID NO: 53687 - DNA, 25 bp, S. cerevisiae
tgcccctaacaacgctggtgaagat

SEQ ID NO: 53688 - DNA, 25 bp, S. cerevisiae
tgcatatcctgcctgttctaatgag

SEQ ID NO: 53689 - DNA, 25 bp, S. cerevisiae
tgcgatctatgttttcctcacttga

SEQ ID NO: 53690 - DNA, 25 bp, S. cerevisiae
tgcatgcagtagctttcccttggaa

SEQ ID NO: 53691 - DNA, 25 bp, S. cerevisiae
tgctgagtactgctctaccgaggaa

SEQ ID NO: 53692 - DNA, 25 bp, S. cerevisiae
tgctgcttacacatctgaaccgaat

SEQ ID NO: 53693 - DNA, 25 bp, S. cerevisiae
tgcttcatgggttccaacatctcaa

SEQ ID NO: 53694 - DNA, 25 bp, S. cerevisiae
tgcatcttgggtcccaccttctagg

SEQ ID NO: 53695 - DNA, 25 bp, S. cerevisiae
tgcatcttgggtaccaccctcaagg

SEQ ID NO: 53696 - DNA, 25 bp, S. cerevisiae
tgcatcttttttcatcgctctaatt

SEQ ID NO: 53697 - DNA, 25 bp, S. cerevisiae
tgctgctaatttcaccggttcttca

SEQ ID NO: 53698 - DNA, 25 bp, S. cerevisiae
tgcgatatttgtaacctaaccttca

SEQ ID NO: 53699 - DNA, 25 bp, S. cerevisiae
tgctgaatattggaacggcgacctt

SEQ ID NO: 53700 - DNA, 25 bp, S. cerevisiae
tgctaattatgcatccgctgggcag

SEQ ID NO: 53701 - DNA, 25 bp, S. cerevisiae
tgctattatagtagccagcggcggc

SEQ ID NO: 53702 - DNA, 25 bp, S. cerevisiae
tgctgcattacaaagcccatggctg

SEQ ID NO: 53703 - DNA, 25 bp, S. cerevisiae
tctgcttaaatgtccctcactatta

SEQ ID NO: 53704 - DNA, 25 bp, S. cerevisiae
tgcgtctaccacttctaaggactac

SEQ ID NO: 53705 - DNA, 25 bp, S. cerevisiae
tgcttccaccttactttgaactagc

SEQ ID NO: 53706 - DNA, 25 bp, S. cerevisiae
tgcccgcgagaacgatatcagacag

SEQ ID NO: 53707 - DNA, 25 bp, S. cerevisiae
tgcccgtgatgaagcctacagactg

SEQ ID NO: 53708 - DNA, 25 bp, S. cerevisiae
tgctttagttttttcatccaacgaa

SEQ ID NO: 53709 - DNA, 25 bp, S. cerevisiae
tgctcttctcgtctcgctcaaaaat

SEQ ID NO: 53710 - DNA, 25 bp, S. cerevisiae
tgcatcctttggctggtctagacaa

SEQ ID NO: 53711 - DNA, 25 bp, S. cerevisiae
tgccacctatggctgaggttcctat

SEQ ID NO: 53712 - DNA, 25 bp, S. cerevisiae
tgcattgcgcaatcacaccaaaggt

SEQ ID NO: 53713 - DNA, 25 bp, S. cerevisiae
tgcatcagcaacactcccaaaggaa

SEQ ID NO: 53714 - DNA, 25 bp, S. cerevisiae
tgcattctgtgcctcatctaaaaag

SEQ ID NO: 53715 - DNA, 25 bp, S. cerevisiae
tgcggctacccattcaatcaaagag

SEQ ID NO: 53716 - DNA, 25 bp, S. cerevisiae
tgcggtagcatttccatcataaaga

SEQ ID NO: 53717 - DNA, 25 bp, S. cerevisiae
tgctggttgcttcctctgatggtaa

SEQ ID NO: 53718 - DNA, 25 bp, S. cerevisiae
tgcttccccaaatggcgatgtctta

SEQ ID NO: 53719 - DNA, 25 bp, S. cerevisiae
tgcgaccccgaatacgtaattacat

SEQ ID NO: 53720 - DNA, 25 bp, S. cerevisiae
tgcttgctatttgcccatttgagaa

SEQ ID NO: 53721 - DNA, 25 bp, S. cerevisiae
tgcatatattaacgcgatcgagtaa

SEQ ID NO: 53722 - DNA, 25 bp, S. cerevisiae
tgctattatcagctgcgtgcaggta

SEQ ID NO: 53723 - DNA, 25 bp, S. cerevisiae
tgctctacaagcatcgctcatgagt

SEQ ID NO: 53724 - DNA, 25 bp, S. cerevisiae
tgctgaaaatgcgttgcacgtgaat

SEQ ID NO: 53725 - DNA, 25 bp, S. cerevisiae
tgcgagggacctacatgttgagcat

SEQ ID NO: 53726 - DNA, 25 bp, S. cerevisiae
tcgaaggactctcttatagcgtcgt

SEQ ID NO: 53727 - DNA, 25 bp, S. cerevisiae
tccagatcagtatggcaatccgcaa

SEQ ID NO: 53728 - DNA, 25 bp, S. cerevisiae
tgccgcatttactgcacatcctaaa

SEQ ID NO: 53729 - DNA, 25 bp, S. cerevisiae
tgctacttccactaaccctgctaaa

SEQ ID NO: 53730 - DNA, 25 bp, S. cerevisiae
tacgcggacatttaaccttggaagt

SEQ ID NO: 53731 - DNA, 25 bp, S. cerevisiae
tccaccggcttatcccgaggaagaa

SEQ ID NO: 53732 - DNA, 25 bp, S. cerevisiae
tccaccggtaaagcccttgatagtt

SEQ ID NO: 53733 - DNA, 25 bp, S. cerevisiae
tgcgaccggtccaagctttttagaa

SEQ ID NO: 53734 - DNA, 25 bp, S. cerevisiae
tgcgacggtttcactctgtttaaag

SEQ ID NO: 53735 - DNA, 25 bp, S. cerevisiae
tgcgtcggcatttttccaaagtaaa

SEQ ID NO: 53736 - DNA, 25 bp, S. cerevisiae
tgcgtcgcgattatattccaaccaa

SEQ ID NO: 53737 - DNA, 25 bp, S. cerevisiae
tgctgtcgctatgttggttacccaa

SEQ ID NO: 53738 - DNA, 25 bp, S. cerevisiae
tgctgttgcagtgtggagtcttcca

SEQ ID NO: 53739 - DNA, 25 bp, S. cerevisiae
tcctgctaacttgtgatgcttcggg

SEQ ID NO: 53740 - DNA, 25 bp, S. cerevisiae
tgcccgacccatgtggattcgtgaa

SEQ ID NO: 53741 - DNA, 25 bp, S. cerevisiae
tgctcccctccattagtttcgatta

SEQ ID NO: 53742 - DNA, 25 bp, S. cerevisiae
tgctgcctttatcgcatacatgcat

SEQ ID NO: 53743 - DNA, 25 bp, S. cerevisiae
tgcgcttgttatttacatgagtgtg

SEQ ID NO: 53744 - DNA, 25 bp, S. cerevisiae
tgctgcgttaactacaccgttggat

SEQ ID NO: 53745 - DNA, 25 bp, S. cerevisiae
tgcggtcaagattcccgtcattgca

SEQ ID NO: 53746 - DNA, 25 bp, S. cerevisiae
tgcgtacgacaacctgaccatgtgg

SEQ ID NO: 53747 - DNA, 25 bp, S. cerevisiae
tcactcgtgggttaaatagcatcaa

SEQ ID NO: 53748 - DNA, 25 bp, S. cerevisiae
tgcctccgggtaccattgaccagta

SEQ ID NO: 53749 - DNA, 25 bp, S. cerevisiae
tgctatcctcggtttcattggccaa

SEQ ID NO: 53750 - DNA, 25 bp, S. cerevisiae
tgccatcggctataatttacctcag

SEQ ID NO: 53751 - DNA, 25 bp, S. cerevisiae
tgcttccagaggctaatctcattgg

SEQ ID NO: 53752 - DNA, 25 bp, S. cerevisiae
tgctactctgttactaatccattgg

SEQ ID NO: 53753 - DNA, 25 bp, S. cerevisiae
tgctctcctggaagctagacggtaa

SEQ ID NO: 53754 - DNA, 25 bp, S. cerevisiae
tgcttccgagtccagaatcgctgaa

SEQ ID NO: 53755 - DNA, 25 bp, S. cerevisiae
ttgcttttacttctcttgtaggttt

SEQ ID NO: 53756 - DNA, 25 bp, S. cerevisiae
tcgcggttccgctgattactggtaa

SEQ ID NO: 53757 - DNA, 25 bp, S. cerevisiae
tgccggttcttctggtttgtccgaa

SEQ ID NO: 53758 - DNA, 25 bp, S. cerevisiae
tgccaaggccaattgtattctcgtt

SEQ ID NO: 53759 - DNA, 25 bp, S. cerevisiae
tgcccgggccaagttacacgatttt

SEQ ID NO: 53760 - DNA, 25 bp, S. cerevisiae
tgccgctatcgctgaaggtaagtct

SEQ ID NO: 53761 - DNA, 25 bp, S. cerevisiae
tgccgctacagctcaaagttttggt

SEQ ID NO: 53762 - DNA, 25 bp, S. cerevisiae
tgccgctaacactccagttttgaga

SEQ ID NO: 53763 - DNA, 25 bp, S. cerevisiae
tgctcaatctaatatctccgctgta

SEQ ID NO: 53764 - DNA, 25 bp, S. cerevisiae
tgctacgctagctaatgacaaagac

SEQ ID NO: 53765 - DNA, 25 bp, S. cerevisiae
tgctactgctaccactatcgaagag

SEQ ID NO: 53766 - DNA, 25 bp, S. cerevisiae
tgctgccgcatcatcaggtttgaag

SEQ ID NO: 53767 - DNA, 25 bp, S. cerevisiae
tgctcagccgtattagtaaatcaag

SEQ ID NO: 53768 - DNA, 25 bp, S. cerevisiae
tgctgctgccggtaaggccaacaag

SEQ ID NO: 53769 - DNA, 25 bp, S. cerevisiae
tgcgtctttgaaacttcccgttgaa

SEQ ID NO: 53770 - DNA, 25 bp, S. cerevisiae
tgcctttttataacagctccactac

SEQ ID NO: 53771 - DNA, 25 bp, S. cerevisiae
tgctagtgacatcgaaagtcgtctt

SEQ ID NO: 53772 - DNA, 25 bp, S. cerevisiae
tgctgttgctgatgaatcccttacc

SEQ ID NO: 53773 - DNA, 25 bp, S. cerevisiae
tgcttacgataatgctccttactct

SEQ ID NO: 53774 - DNA, 25 bp, S. cerevisiae
tcttccgttcgatatcaatgaccct

SEQ ID NO: 53775 - DNA, 25 bp, S. cerevisiae
tgccccagccaccactactttatct

SEQ ID NO: 53776 - DNA, 25 bp, S. cerevisiae
tgccccagccaccactactttatct

SEQ ID NO: 53777 - DNA, 25 bp, S. cerevisiae
ttaccatgagggtccaggttacgac

SEQ ID NO: 53778 - DNA, 25 bp, S. cerevisiae
taaccgagcgttgtggtttccacga

SEQ ID NO: 53779 - DNA, 25 bp, S. cerevisiae
taaccggttttttaatgtcatactg

SEQ ID NO: 53780 - DNA, 25 bp, S. cerevisiae
taacctggcattgttagtaccttgc

SEQ ID NO: 53781 - DNA, 25 bp, S. cerevisiae
taaccagtcattgttggagcccggc

SEQ ID NO: 53782 - DNA, 25 bp, S. cerevisiae
taagagtatttgctttggcccgggc

SEQ ID NO: 53783 - DNA, 25 bp, S. cerevisiae
tacggtcgtgccatttacactggga

SEQ ID NO: 53784 - DNA, 25 bp, S. cerevisiae
taagtggccccacgtttacattgtg

SEQ ID NO: 53785 - DNA, 25 bp, S. cerevisiae
tcgcctatccaagagtttttccatg

SEQ ID NO: 53786 - DNA, 25 bp, S. cerevisiae
ttggccaccaaatgtcgctttaatg

SEQ ID NO: 53787 - DNA, 25 bp, S. cerevisiae
ttagatatccagaacgtcctttatg

SEQ ID NO: 53788 - DNA, 25 bp, S. cerevisiae
ttagaaagtatagttccttttgaca

SEQ ID NO: 53789 - DNA, 25 bp, S. cerevisiae
ttagaaagtatagttccttttgaca

SEQ ID NO: 53790 - DNA, 25 bp, S. cerevisiae
tgctatgcaagatcgtgtccaccaa

SEQ ID NO: 53791 - DNA, 25 bp, S. cerevisiae
tgctaagaccagatcttacaactgg

SEQ ID NO: 53792 - DNA, 25 bp, S. cerevisiae
tgctgccactggtttttctattaaa

SEQ ID NO: 53793 - DNA, 25 bp, S. cerevisiae
tgccccgattttaccaggacagaca

SEQ ID NO: 53794 - DNA, 25 bp, S. cerevisiae
tgcctgatcaacctctaccaaaagt

SEQ ID NO: 53795 - DNA, 25 bp, S. cerevisiae
tgctcattctcaccatttcatgggt

SEQ ID NO: 53796 - DNA, 25 bp, S. cerevisiae
tgccatgatctacgctaaccgtgat

SEQ ID NO: 53797 - DNA, 25 bp, S. cerevisiae
tgcgtgggaacgtaggcatcctcaa

SEQ ID NO: 53798 - DNA, 25 bp, S. cerevisiae
tgctgcggtccttgcaatctcacaa

SEQ ID NO: 53799 - DNA, 25 bp, S. cerevisiae
tgctcgggatgttctggtgcagtca

SEQ ID NO: 53800 - DNA, 25 bp, S. cerevisiae
tgcccaaacaatgacgctgatgctg

SEQ ID NO: 53801 - DNA, 25 bp, S. cerevisiae
tgctcatcacattcagtctcaatta

SEQ ID NO: 53802 - DNA, 25 bp, S. cerevisiae
tgcgctatggcatctgtgcacaata

SEQ ID NO: 53803 - DNA, 25 bp, S. cerevisiae
tgcgctggctgtacgtgaccatgaa

SEQ ID NO: 53804 - DNA, 25 bp, S. cerevisiae
tccaattccaattccggttcagagt

SEQ ID NO: 53805 - DNA, 25 bp, S. cerevisiae
tgctcaagcttgtaactggatctgg

SEQ ID NO: 53806 - DNA, 25 bp, S. cerevisiae
tgctcaaggtttcatgctgatccgc

SEQ ID NO: 53807 - DNA, 25 bp, S. cerevisiae
tgctgcaccagcaaagccaccaaat

SEQ ID NO: 53808 - DNA, 25 bp, S. cerevisiae
tgctgccggtaaggccaacaagcaa

SEQ ID NO: 53809 - DNA, 25 bp, S. cerevisiae
tgcctttcctcctacagacgaaaat

SEQ ID NO: 53810 - DNA, 25 bp, S. cerevisiae
tgcgtggatttatttgcgtcattac

SEQ ID NO: 53811 - DNA, 25 bp, S. cerevisiae
tgctgtgttttgttggctctttcaa

SEQ ID NO: 53812 - DNA, 25 bp, S. cerevisiae
tgcgtgttcgatgtcccagagggat

SEQ ID NO: 53813 - DNA, 25 bp, S. cerevisiae
tgcggttccgtcacaagagcaggaa

SEQ ID NO: 53814 - DNA, 25 bp, S. cerevisiae
tgcgctgttccccaaaatgagaatg

SEQ ID NO: 53815 - DNA, 25 bp, S. cerevisiae
tcgtcacacaccactagcaatttgg

SEQ ID NO: 53816 - DNA, 25 bp, S. cerevisiae
tcgtcaacactaccaatacaactcg

SEQ ID NO: 53817 - DNA, 25 bp, S. cerevisiae
tcgtaagcacactcaacacaaggtt

SEQ ID NO: 53818 - DNA, 25 bp, S. cerevisiae
tgccaaagcttctcaagaactgtaa

SEQ ID NO: 53819 - DNA, 25 bp, S. cerevisiae
tgctaattcttcaacatctcctgct

SEQ ID NO: 53820 - DNA, 25 bp, S. cerevisiae
tgctctttagcattgttgtgcattt

SEQ ID NO: 53821 - DNA, 25 bp, S. cerevisiae
tgcctccaattttgattgcctcaac

SEQ ID NO: 53822 - DNA, 25 bp, S. cerevisiae
tgctcgcgaaaaccatctcttgaaa

SEQ ID NO: 53823 - DNA, 25 bp, S. cerevisiae
tgctcttgccaaaacaaaaaaatcc

SEQ ID NO: 53824 - DNA, 25 bp, S. cerevisiae
tgcctcatcagtaagacccgttgaa

SEQ ID NO: 53825 - DNA, 25 bp, S. cerevisiae
tgctccgccattgccaacatttagt

SEQ ID NO: 53826 - DNA, 25 bp, S. cerevisiae
tgctgacgccatagaccatgacgat

SEQ ID NO: 53827 - DNA, 25 bp, S. cerevisiae
tgctgagcaggctagaagcggctat

SEQ ID NO: 53828 - DNA, 25 bp, S. cerevisiae
tgctgaggtccgtaaggctttgctt

SEQ ID NO: 53829 - DNA, 25 bp, S. cerevisiae
tgctcgaccctgttagtgtttattt

SEQ ID NO: 53830 - DNA, 25 bp, S. cerevisiae
tgcgagtaccgatcctgattctgat

SEQ ID NO: 53831 - DNA, 25 bp, S. cerevisiae
tgcctggacctattgcacatgcaat

SEQ ID NO: 53832 - DNA, 25 bp, S. cerevisiae
tgccggatttgcaatctctgctata

SEQ ID NO: 53833 - DNA, 25 bp, S. cerevisiae
tgcggctcttcagcttacttattta

SEQ ID NO: 53834 - DNA, 25 bp, S. cerevisiae
tgccctgttccatgaaatcactagc

SEQ ID NO: 53835 - DNA, 25 bp, S. cerevisiae
tgcgtttccgcacacaagagttatc

SEQ ID NO: 53836 - DNA, 25 bp, S. cerevisiae
tgctgttttcgccgaaaccttgaag

SEQ ID NO: 53837 - DNA, 25 bp, S. cerevisiae
tgcgttttactgagcaagcctaaat

SEQ ID NO: 53838 - DNA, 25 bp, S. cerevisiae
tcgaattctaccagtacgttcactc

SEQ ID NO: 53839 - DNA, 25 bp, S. cerevisiae
tgcctcaaccgctggtgtagtagat

SEQ ID NO: 53840 - DNA, 25 bp, S. cerevisiae
tgccgtcgacgcttggtacaatgaa

SEQ ID NO: 53841 - DNA, 25 bp, S. cerevisiae
tgctcgggccactgagtgacacaaa

SEQ ID NO: 53842 - DNA, 25 bp, S. cerevisiae
tgctgctacttacggtattccaact

SEQ ID NO: 53843 - DNA, 25 bp, S. cerevisiae
tgctgtctttctgctgtcaatacca

SEQ ID NO: 53844 - DNA, 25 bp, S. cerevisiae
tgctccttatctttctgcaagaatt

SEQ ID NO: 53845 - DNA, 25 bp, S. cerevisiae
tgccatctttttggctaagaccctg

SEQ ID NO: 53846 - DNA, 25 bp, S. cerevisiae
tgcgcactttcaatggcaccagtac

SEQ ID NO: 53847 - DNA, 25 bp, S. cerevisiae
tcgccagatgagatactacaggaga

SEQ ID NO: 53848 - DNA, 25 bp, S. cerevisiae
tgccggctactgctatatcatggac

SEQ ID NO: 53849 - DNA, 25 bp, S. cerevisiae
tgcgggctctatcattgaatgtgga

SEQ ID NO: 53850 - DNA, 25 bp, S. cerevisiae
tgcgtcatcgccatcagctttagaa

SEQ ID NO: 53851 - DNA, 25 bp, S. cerevisiae
tgctgctttggccactgctttgaag

SEQ ID NO: 53852 - DNA, 25 bp, S. cerevisiae
tgctgctacttatggctggaaacta

SEQ ID NO: 53853 - DNA, 25 bp, S. cerevisiae
tgctcttaataatacgttcgctgaa

SEQ ID NO: 53854 - DNA, 25 bp, S. cerevisiae
tccattggctaagacgtccgtatta

SEQ ID NO: 53855 - DNA, 25 bp, S. cerevisiae
tcctgggtaatatctggccgtgttg

SEQ ID NO: 53856 - DNA, 25 bp, S. cerevisiae
tcgacagcatgagaacggccgtacg

SEQ ID NO: 53857 - DNA, 25 bp, S. cerevisiae
tgcgagcagtaacaacatcaacaaa

SEQ ID NO: 53858 - DNA, 25 bp, S. cerevisiae
tgctgatcccagctttttatgataa

SEQ ID NO: 53859 - DNA, 25 bp, S. cerevisiae
tgctgaaccttccttttctatcaaa

SEQ ID NO: 53860 - DNA, 25 bp, S. cerevisiae
tgcgggcaagccatggagttatgaa

SEQ ID NO: 53861 - DNA, 25 bp, S. cerevisiae
tgcgcgcctgcgaagtttccgcttt

SEQ ID NO: 53862 - DNA, 25 bp, S. cerevisiae
tcctacaccggagaacttgcaacat

SEQ ID NO: 53863 - DNA, 25 bp, S. cerevisiae
tccgaaagcggagcccaagcaagat

SEQ ID NO: 53864 - DNA, 25 bp, S. cerevisiae
tgctaacattcataccccaacaatt

SEQ ID NO: 53865 - DNA, 25 bp, S. cerevisiae
tgctcaagtctcttatgtcccagaa

SEQ ID NO: 53866 - DNA, 25 bp, S. cerevisiae
tgctgaatgcataccgacacaagat

SEQ ID NO: 53867 - DNA, 25 bp, S. cerevisiae
tgctcagttagccatagacaagatc

SEQ ID NO: 53868 - DNA, 25 bp, S. cerevisiae
tgccgaattgggactgccttcaata

SEQ ID NO: 53869 - DNA, 25 bp, S. cerevisiae
tgctgattttgccagggtcatcttt

SEQ ID NO: 53870 - DNA, 25 bp, S. cerevisiae
tgctgatcaaggcaagtgcgctttt

SEQ ID NO: 53871 - DNA, 25 bp, S. cerevisiae
tgctcccagaggtgtgcctcaaatt

SEQ ID NO: 53872 - DNA, 25 bp, S. cerevisiae
tccacgtaagaaggctatcaaactg

SEQ ID NO: 53873 - DNA, 25 bp, S. cerevisiae
tccacgaccatgctctattacaaga

SEQ ID NO: 53874 - DNA, 25 bp, S. cerevisiae
tccaccacctgcattggttgcatag

SEQ ID NO: 53875 - DNA, 25 bp, S. cerevisiae
tccaaacagccgttagattgatctt

SEQ ID NO: 53876 - DNA, 25 bp, S. cerevisiae
tgccatgaatccagttgatcaccct

SEQ ID NO: 53877 - DNA, 25 bp, S. cerevisiae
tgctgccgaatacgctcaattgttg

SEQ ID NO: 53878 - DNA, 25 bp, S. cerevisiae
tgctgccgcatatttgctcaaactg

SEQ ID NO: 53879 - DNA, 25 bp, S. cerevisiae
tgcgcagcgcaatactacatcgaat

SEQ ID NO: 53880 - DNA, 25 bp, S. cerevisiae
tgccaccagactatgtctcgaacta

SEQ ID NO: 53881 - DNA, 25 bp, S. cerevisiae
tgccaccatggcattacgtgaactc

SEQ ID NO: 53882 - DNA, 25 bp, S. cerevisiae
tccgctcaggatagtacagaaacgc

SEQ ID NO: 53883 - DNA, 25 bp, S. cerevisiae
tcggcatcggctacatcatcagaga

SEQ ID NO: 53884 - DNA, 25 bp, S. cerevisiae
tgcggttcattcacatgcggatggt

SEQ ID NO: 53885 - DNA, 25 bp, S. cerevisiae
tgcgtgtggcaaaccctgattcaga

SEQ ID NO: 53886 - DNA, 25 bp, S. cerevisiae
tgcgtctgagacaaatcctactgag

SEQ ID NO: 53887 - DNA, 25 bp, S. cerevisiae
tgctggcatagttgctggtggcttt

SEQ ID NO: 53888 - DNA, 25 bp, S. cerevisiae
tgccacagaggctactaacttgatt

SEQ ID NO: 53889 - DNA, 25 bp, S. cerevisiae
tgccgagaggcatttgatcaactga

SEQ ID NO: 53890 - DNA, 25 bp, S. cerevisiae
tgccagacggactcaagcacaatct

SEQ ID NO: 53891 - DNA, 25 bp, S. cerevisiae
tgcccatgccttgaatatgccatac

SEQ ID NO: 53892 - DNA, 25 bp, S. cerevisiae
tgcgttgtcttttatcgccacagga

SEQ ID NO: 53893 - DNA, 25 bp, S. cerevisiae
tgctgccttttccttggccgaagtt

SEQ ID NO: 53894 - DNA, 25 bp, S. cerevisiae
tgcgcaagttcctttgacgccaact

SEQ ID NO: 53895 - DNA, 25 bp, S. cerevisiae
tgctgctaattcctttaccacatat

SEQ ID NO: 53896 - DNA, 25 bp, S. cerevisiae
tgctccagccattattgaggcctat

SEQ ID NO: 53897 - DNA, 25 bp, S. cerevisiae
tgctccatgttcagtggtgccattg

SEQ ID NO: 53898 - DNA, 25 bp, S. cerevisiae
tgctcctgcattgggttttctttaa

SEQ ID NO: 53899 - DNA, 25 bp, S. cerevisiae
tgcggcatttttggctttagttgat

SEQ ID NO: 53900 - DNA, 25 bp, S. cerevisiae
tgcccgaccttgtgctatattataa

SEQ ID NO: 53901 - DNA, 25 bp, S. cerevisiae
tcctatctagatcgttggtcagcat

SEQ ID NO: 53902 - DNA, 25 bp, S. cerevisiae
tccaggtccaggtggtcaagctgct

SEQ ID NO: 53903 - DNA, 25 bp, S. cerevisiae
tgccgttctcggtggtggatctcaa

SEQ ID NO: 53904 - DNA, 25 bp, S. cerevisiae
tcgaatttcccgaagttttagacat

SEQ ID NO: 53905 - DNA, 25 bp, S. cerevisiae
tcaccggtaccgtcttagttgttga

SEQ ID NO: 53906 - DNA, 25 bp, S. cerevisiae
tcacggttacccctatagttgtaca

SEQ ID NO: 53907 - DNA, 25 bp, S. cerevisiae
tacctggtacctccgaaaggatcca

SEQ ID NO: 53908 - DNA, 25 bp, S. cerevisiae
tccattggtttcaccactggtgcta

SEQ ID NO: 53909 - DNA, 25 bp, S. cerevisiae
tgccgttgtttctcagcaatggttt

SEQ ID NO: 53910 - DNA, 25 bp, S. cerevisiae
tgccggcatttgatcgagaaggttc

SEQ ID NO: 53911 - DNA, 25 bp, S. cerevisiae
tccggatcggattcagaagcgcttt

SEQ ID NO: 53912 - DNA, 25 bp, S. cerevisiae
tcctggtgcagagaacttactgtta

SEQ ID NO: 53913 - DNA, 25 bp, S. cerevisiae
tccctggaagctgcgttgactttga

SEQ ID NO: 53914 - DNA, 25 bp, S. cerevisiae
tgccgggtgagtgtgcttctataac

SEQ ID NO: 53915 - DNA, 25 bp, S. cerevisiae
tgccagtggtggtgatgcttccgaa

SEQ ID NO: 53916 - DNA, 25 bp, S. cerevisiae
tgccgatgttttgccatttgcgagg

SEQ ID NO: 53917 - DNA, 25 bp, S. cerevisiae
tgctgctgctttatccattattgga

SEQ ID NO: 53918 - DNA, 25 bp, S. cerevisiae
tgctgctgctttagtcggttcatta

SEQ ID NO: 53919 - DNA, 25 bp, S. cerevisiae
tgctgctgcctttgctttgttataa

SEQ ID NO: 53920 - DNA, 25 bp, S. cerevisiae
tgccatgtcatgttactttcaaaga

SEQ ID NO: 53921 - DNA, 25 bp, S. cerevisiae
tgccaggtggcaaacgatgacatcg

SEQ ID NO: 53922 - DNA, 25 bp, S. cerevisiae
tgccggtggcaaagcataccatcat

SEQ ID NO: 53923 - DNA, 25 bp, S. cerevisiae
tgccaagaaaagacttcaccaccat

SEQ ID NO: 53924 - DNA, 25 bp, S. cerevisiae
tgccaagggaaacgtacagcacttt

SEQ ID NO: 53925 - DNA, 25 bp, S. cerevisiae
tccgttccatttgggtctccaaaat

SEQ ID NO: 53926 - DNA, 25 bp, S. cerevisiae
tgcgctttcgattttttctccggaa

SEQ ID NO: 53927 - DNA, 25 bp, S. cerevisiae
tgcctaagcaacatttcgtccaaag

SEQ ID NO: 53928 - DNA, 25 bp, S. cerevisiae
tgccgggctacttctatgaacacaa

SEQ ID NO: 53929 - DNA, 25 bp, S. cerevisiae
tgccgcccaagatgtccaacaaaag

SEQ ID NO: 53930 - DNA, 25 bp, S. cerevisiae
tgccctggcgttgtttggacgacag

SEQ ID NO: 53931 - DNA, 25 bp, S. cerevisiae
tgccctgacgacacagagactttgt

SEQ ID NO: 53932 - DNA, 25 bp, S. cerevisiae
tccactcacaacttggaagttccat

SEQ ID NO: 53933 - DNA, 25 bp, S. cerevisiae
tgccaccaactttgaaggttaacag

SEQ ID NO: 53934 - DNA, 25 bp, S. cerevisiae
tccaccaacgttaaggacgaaattg

SEQ ID NO: 53935 - DNA, 25 bp, S. cerevisiae
tcccttcaaacaaaccacgtgatgg

SEQ ID NO: 53936 - DNA, 25 bp, S. cerevisiae
tccttcaaaaatccacgcaggcttg

SEQ ID NO: 53937 - DNA, 25 bp, S. cerevisiae
tctgcttcagcaaaaacccgtggtg

SEQ ID NO: 53938 - DNA, 25 bp, S. cerevisiae
tccttcaatttctacatactcgggc

SEQ ID NO: 53939 - DNA, 25 bp, S. cerevisiae
tccttgcacgttgacacctatggta

SEQ ID NO: 53940 - DNA, 25 bp, S. cerevisiae
tcccgcctttacgtgtactttacag

SEQ ID NO: 53941 - DNA, 25 bp, S. cerevisiae
tgctgagaaatcaagaaccgcctct

SEQ ID NO: 53942 - DNA, 25 bp, S. cerevisiae
tcgaatagctgcaggcgatggagac

SEQ ID NO: 53943 - DNA, 25 bp, S. cerevisiae
tgccactgaagcatccactaagagt

SEQ ID NO: 53944 - DNA, 25 bp, S. cerevisiae
tgccctgccggaacctgaagatgat

SEQ ID NO: 53945 - DNA, 25 bp, S. cerevisiae
tccgtacttgtacaatggattacaa

SEQ ID NO: 53946 - DNA, 25 bp, S. cerevisiae
tccactcactatcacgacggtaaag

SEQ ID NO: 53947 - DNA, 25 bp, S. cerevisiae
tcctgctccatatgcctacggtaaa

SEQ ID NO: 53948 - DNA, 25 bp, S. cerevisiae
tccagcgctctatctgcagacggta

SEQ ID NO: 53949 - DNA, 25 bp, S. cerevisiae
tccaagagtcacacatagcggcatg

SEQ ID NO: 53950 - DNA, 25 bp, S. cerevisiae
tgctgcaaagcatgttcataaggaa

SEQ ID NO: 53951 - DNA, 25 bp, S. cerevisiae
tgctgcttcagggttccgaggaagt

SEQ ID NO: 53952 - DNA, 25 bp, S. cerevisiae
tgctgcttctgtgtatttcttcaag

SEQ ID NO: 53953 - DNA, 25 bp, S. cerevisiae
tgccttctaatctcctatacaacga

SEQ ID NO: 53954 - DNA, 25 bp, S. cerevisiae
tgccctctaggatccctatatacaa

SEQ ID NO: 53955 - DNA, 25 bp, S. cerevisiae
tgcccaaatttgaacttaccgaaga

SEQ ID NO: 53956 - DNA, 25 bp, S. cerevisiae
tgcctccaatttcttctatgcggaa

SEQ ID NO: 53957 - DNA, 25 bp, S. cerevisiae
tgcctcatgaattctcacatctcaa

SEQ ID NO: 53958 - DNA, 25 bp, S. cerevisiae
tgcccagagcgcctcaagaaaatga

SEQ ID NO: 53959 - DNA, 25 bp, S. cerevisiae
tgcgccatggtgctatacaaacagt

SEQ ID NO: 53960 - DNA, 25 bp, S. cerevisiae
tgcgccggtttttaaactcttccag

SEQ ID NO: 53961 - DNA, 25 bp, S. cerevisiae
tcgccgctttgttgggtaaatttgc

SEQ ID NO: 53962 - DNA, 25 bp, S. cerevisiae
tgctgtcgtttcacctatcaaggaa

SEQ ID NO: 53963 - DNA, 25 bp, S. cerevisiae
tgcccactgtatcccttacaaggaa

SEQ ID NO: 53964 - DNA, 25 bp, S. cerevisiae
tgccgtccccattttcagaaacaag

SEQ ID NO: 53965 - DNA, 25 bp, S. cerevisiae
tgcccatgccccagaatcatataaa

SEQ ID NO: 53966 - DNA, 25 bp, S. cerevisiae
tgcgcacgctgccaaggagagcatt

SEQ ID NO: 53967 - DNA, 25 bp, S. cerevisiae
tgctgatgccgccaagaaggcttta

SEQ ID NO: 53968 - DNA, 25 bp, S. cerevisiae
tgccagcattgaaacacctgccatg

SEQ ID NO: 53969 - DNA, 25 bp, S. cerevisiae
tgccaccgtggagcgtgctatggaa

SEQ ID NO: 53970 - DNA, 25 bp, S. cerevisiae
tgccgctcaaatcaactcgtgggtt

SEQ ID NO: 53971 - DNA, 25 bp, S. cerevisiae
tgcggcatcaggtcaaacatcggtg

SEQ ID NO: 53972 - DNA, 25 bp, S. cerevisiae
tgcgattcgctgctcaacacatgga

SEQ ID NO: 53973 - DNA, 25 bp, S. cerevisiae
tgccgaatatgcctggtatgccaaa

SEQ ID NO: 53974 - DNA, 25 bp, S. cerevisiae
tgccgattgcacatggtattgagaa

SEQ ID NO: 53975 - DNA, 25 bp, S. cerevisiae
tgccattggaacctacccggtgaga

SEQ ID NO: 53976 - DNA, 25 bp, S. cerevisiae
tgccattgattatgtaacccaggaa

SEQ ID NO: 53977 - DNA, 25 bp, S. cerevisiae
tccacgcttacaacaacctcaggaa

SEQ ID NO: 53978 - DNA, 25 bp, S. cerevisiae
tcgtaccttcaacacccatggatat

SEQ ID NO: 53979 - DNA, 25 bp, S. cerevisiae
tcagaaggttaacagcccatcgtaa

SEQ ID NO: 53980 - DNA, 25 bp, S. cerevisiae
tcaaaggttcagcaaacggcgtaat

SEQ ID NO: 53981 - DNA, 25 bp, S. cerevisiae
tcaagaagtttgctccacgggtaat

SEQ ID NO: 53982 - DNA, 25 bp, S. cerevisiae
tctagtgcgtttgttttgcctactt

SEQ ID NO: 53983 - DNA, 25 bp, S. cerevisiae
tgccgctaatcccaattattgctgt

SEQ ID NO: 53984 - DNA, 25 bp, S. cerevisiae
tgcgcgtcctcgattttgatgacag

SEQ ID NO: 53985 - DNA, 25 bp, S. cerevisiae
tgccctcattcgactcatttgtaga

SEQ ID NO: 53986 - DNA, 25 bp, S. cerevisiae
tgcgccggtctgttctgaatattat

SEQ ID NO: 53987 - DNA, 25 bp, S. cerevisiae
tgcgccgctaggtttgccattttat

SEQ ID NO: 53988 - DNA, 25 bp, S. cerevisiae
tgcccgctttcattaggtctattgc

SEQ ID NO: 53989 - DNA, 25 bp, S. cerevisiae
tgcctgactcggaaggccacttgaa

SEQ ID NO: 53990 - DNA, 25 bp, S. cerevisiae
tccaactggtggtatgaatctcaag

SEQ ID NO: 53991 - DNA, 25 bp, S. cerevisiae
tccccgatgcggtaaacacaagact

SEQ ID NO: 53992 - DNA, 25 bp, S. cerevisiae
tccccaatcgtgaagtcccaagaga

SEQ ID NO: 53993 - DNA, 25 bp, S. cerevisiae
tccggacccgattttgaagccacaa

SEQ ID NO: 53994 - DNA, 25 bp, S. cerevisiae
tccgggcccgagtggattgctgaaa

SEQ ID NO: 53995 - DNA, 25 bp, S. cerevisiae
tccagagggccgtttcaatttgaat

SEQ ID NO: 53996 - DNA, 25 bp, S. cerevisiae
tgccttcgtgtctgagaccttgaat

SEQ ID NO: 53997 - DNA, 25 bp, S. cerevisiae
tgcgcttcggtagagcagctgctaa

SEQ ID NO: 53998 - DNA, 25 bp, S. cerevisiae
tgcggacccctatgggattagcata

SEQ ID NO: 53999 - DNA, 25 bp, S. cerevisiae
tgccggtacctctgtttattataac

SEQ ID NO: 54000 - DNA, 25 bp, S. cerevisiae
tgccactaaggctgatttcgataat

SEQ ID NO: 54001 - DNA, 25 bp, S. cerevisiae
tgcgccaccggcttttattgatgaa

SEQ ID NO: 54002 - DNA, 25 bp, S. cerevisiae
tgctggctttatcattcttttacaa

SEQ ID NO: 54003 - DNA, 25 bp, S. cerevisiae
tgcgaacttaattcccgccttgaaa

SEQ ID NO: 54004 - DNA, 25 bp, S. cerevisiae
tccagtaatttcgaagccagtcagc

SEQ ID NO: 54005 - DNA, 25 bp, S. cerevisiae
tccatggtttatccaagccacgtgt

SEQ ID NO: 54006 - DNA, 25 bp, S. cerevisiae
tcgccgtttttctagcccgtgggtg

SEQ ID NO: 54007 - DNA, 25 bp, S. cerevisiae
tccaaccgtttttaccaggcagtat

SEQ ID NO: 54008 - DNA, 25 bp, S. cerevisiae
tcacacccgttagttttccaactat

SEQ ID NO: 54009 - DNA, 25 bp, S. cerevisiae
tgccctccgtaaagacccgataaag

SEQ ID NO: 54010 - DNA, 25 bp, S. cerevisiae
tgcctatccgtttcaattccgaaga

SEQ ID NO: 54011 - DNA, 25 bp, S. cerevisiae
tccatcttggtactaattccggaag

SEQ ID NO: 54012 - DNA, 25 bp, S. cerevisiae
tcctcctcggagagaatccggtggt

SEQ ID NO: 54013 - DNA, 25 bp, S. cerevisiae
tcctctacaggacttgatatcggtg

SEQ ID NO: 54014 - DNA, 25 bp, S. cerevisiae
tcctttgcaggatcaagcatcgcct

SEQ ID NO: 54015 - DNA, 25 bp, S. cerevisiae
tgccaataaccaccagctaggcttg

SEQ ID NO: 54016 - DNA, 25 bp, S. cerevisiae
tcgacaccaccacagagaacttgat

SEQ ID NO: 54017 - DNA, 25 bp, S. cerevisiae
tcggagccccggtagagacttttgt

SEQ ID NO: 54018 - DNA, 25 bp, S. cerevisiae
tccggcccagctgaaagaatttctt

SEQ ID NO: 54019 - DNA, 25 bp, S. cerevisiae
tcgggccctcttcaaaggtttggag

SEQ ID NO: 54020 - DNA, 25 bp, S. cerevisiae
tcggtccgacagtacaagaactctt

SEQ ID NO: 54021 - DNA, 25 bp, S. cerevisiae
taacgccggaaccaaagcctacaat

SEQ ID NO: 54022 - DNA, 25 bp, S. cerevisiae
tctaccaatggttccaaccgtacca

SEQ ID NO: 54023 - DNA, 25 bp, S. cerevisiae
tctacccggatttgcgacttttcaa

SEQ ID NO: 54024 - DNA, 25 bp, S. cerevisiae
tctatccagggacgaggttatttaa

SEQ ID NO: 54025 - DNA, 25 bp, S. cerevisiae
tccaccagacgctggttttgcttga

SEQ ID NO: 54026 - DNA, 25 bp, S. cerevisiae
taactttggtactttgttgaggaca

SEQ ID NO: 54027 - DNA, 25 bp, S. cerevisiae
tccggttccccatattcagattgga

SEQ ID NO: 54028 - DNA, 25 bp, S. cerevisiae
tcatgggttcccgaataccgatacg

SEQ ID NO: 54029 - DNA, 25 bp, S. cerevisiae
tcgaggtaccccaaaccgtagattg

SEQ ID NO: 54030 - DNA, 25 bp, S. cerevisiae
tcaaataagaatgtcggcggccacg

SEQ ID NO: 54031 - DNA, 25 bp, S. cerevisiae
tcaaataggtagtccggctgctgtc

SEQ ID NO: 54032 - DNA, 25 bp, S. cerevisiae
tccaaaattctcctttaactgtcca

SEQ ID NO: 54033 - DNA, 25 bp, S. cerevisiae
tccaaagaattccatgctgtccaag

SEQ ID NO: 54034 - DNA, 25 bp, S. cerevisiae
tgccaagttatttttcaccaatgtt

SEQ ID NO: 54035 - DNA, 25 bp, S. cerevisiae
tgcgccgtctggtgtagtgtcaaga

SEQ ID NO: 54036 - DNA, 25 bp, S. cerevisiae
tcctttaacctcctcgatcataata

SEQ ID NO: 54037 - DNA, 25 bp, S. cerevisiae
tcgcgttaattctcttgatcatagg

SEQ ID NO: 54038 - DNA, 25 bp, S. cerevisiae
tgccagattagatccagcctacatc

SEQ ID NO: 54039 - DNA, 25 bp, S. cerevisiae
tgccgatagagaccacgcttagaat

SEQ ID NO: 54040 - DNA, 25 bp, S. cerevisiae
tgccattgatggttactctctagaa

SEQ ID NO: 54041 - DNA, 25 bp, S. cerevisiae
tgccatttggccaagcaagcttttg

SEQ ID NO: 54042 - DNA, 25 bp, S. cerevisiae
tgccaattccacaatcacagtcatg

SEQ ID NO: 54043 - DNA, 25 bp, S. cerevisiae
tgccaaggctaccaaggcttctcaa

SEQ ID NO: 54044 - DNA, 25 bp, S. cerevisiae
tgccaaagctcaaaaccctatgcgt

SEQ ID NO: 54045 - DNA, 25 bp, S. cerevisiae
tgccgaattccatctctactgaggt

SEQ ID NO: 54046 - DNA, 25 bp, S. cerevisiae
tgccgttataagtattgcccaagtt

SEQ ID NO: 54047 - DNA, 25 bp, S. cerevisiae
tgccgatattaacatgcgctcaaga

SEQ ID NO: 54048 - DNA, 25 bp, S. cerevisiae
tgcccatagttacttggacacagta

SEQ ID NO: 54049 - DNA, 25 bp, S. cerevisiae
tgccttagcatacctgggatccgaa

SEQ ID NO: 54050 - DNA, 25 bp, S. cerevisiae
tccttcttcaattacggctgctaag

SEQ ID NO: 54051 - DNA, 25 bp, S. cerevisiae
tccgatggcgtctcattggtcaata

SEQ ID NO: 54052 - DNA, 25 bp, S. cerevisiae
tgccggtcatgctggtaatccaaca

SEQ ID NO: 54053 - DNA, 25 bp, S. cerevisiae
tgcgctattcatcagggctactcaa

SEQ ID NO: 54054 - DNA, 25 bp, S. cerevisiae
tgccaatatctttaccgattacaag

SEQ ID NO: 54055 - DNA, 25 bp, S. cerevisiae
tccatatttcaagccacatccatag

SEQ ID NO: 54056 - DNA, 25 bp, S. cerevisiae
ttactactgaggttacatgcacaag

SEQ ID NO: 54057 - DNA, 25 bp, S. cerevisiae
ttcactatttggtttataccgttgg

SEQ ID NO: 54058 - DNA, 25 bp, S. cerevisiae
tccattactgggttctaagcggtct

SEQ ID NO: 54059 - DNA, 25 bp, S. cerevisiae
tgccacgctgtatacctaagggatc

SEQ ID NO: 54060 - DNA, 25 bp, S. cerevisiae
tgcgacgccttccaattagactgtg

SEQ ID NO: 54061 - DNA, 25 bp, S. cerevisiae
tgcgatccgccttcgataatgacat

SEQ ID NO: 54062 - DNA, 25 bp, S. cerevisiae
tgccccgtttcacatatgacagttt

SEQ ID NO: 54063 - DNA, 25 bp, S. cerevisiae
tccccagttacaaataccgctttca

SEQ ID NO: 54064 - DNA, 25 bp, S. cerevisiae
tgccacctttatcctcaactgagat

SEQ ID NO: 54065 - DNA, 25 bp, S. cerevisiae
tgccctctgttttgacaacgagcca

SEQ ID NO: 54066 - DNA, 25 bp, S. cerevisiae
tgcgatgtgctcgactttcaacaat

SEQ ID NO: 54067 - DNA, 25 bp, S. cerevisiae
tctgtcgacgaaaatatcgggccgt

SEQ ID NO: 54068 - DNA, 25 bp, S. cerevisiae
tatgtccaacaacaaccggccagtt

SEQ ID NO: 54069 - DNA, 25 bp, S. cerevisiae
tccaaagaatgagacacccgctgct

SEQ ID NO: 54070 - DNA, 25 bp, S. cerevisiae
tccagaatgtatcgaaccaggcctt

SEQ ID NO: 54071 - DNA, 25 bp, S. cerevisiae
tgccaagaaagccaacccgttgttt

SEQ ID NO: 54072 - DNA, 25 bp, S. cerevisiae
tccatcgaagttccaggtgctgtca

SEQ ID NO: 54073 - DNA, 25 bp, S. cerevisiae
tcctgcgaattttgcttgtgatgta

SEQ ID NO: 54074 - DNA, 25 bp, S. cerevisiae
tccatggctggatgcacacataatt

SEQ ID NO: 54075 - DNA, 25 bp, S. cerevisiae
tcgtggctgtcataagaaacccctt

SEQ ID NO: 54076 - DNA, 25 bp, S. cerevisiae
tcccgcgatgctaaaacaaagtttt

SEQ ID NO: 54077 - DNA, 25 bp, S. cerevisiae
tgccaccaacccaaacaatactttt

SEQ ID NO: 54078 - DNA, 25 bp, S. cerevisiae
tgccccaataccaaacacaattttc

SEQ ID NO: 54079 - DNA, 25 bp, S. cerevisiae
tgccgctttccagcatactaatttt

SEQ ID NO: 54080 - DNA, 25 bp, S. cerevisiae
tgccctttctagcaatcgcttacag

SEQ ID NO: 54081 - DNA, 25 bp, S. cerevisiae
tgcccttttcagtcaacggtgtcaa

SEQ ID NO: 54082 - DNA, 25 bp, S. cerevisiae
tgccctctttctgctacggaattaa

SEQ ID NO: 54083 - DNA, 25 bp, S. cerevisiae
tccaagcttgtcattactaaattac

SEQ ID NO: 54084 - DNA, 25 bp, S. cerevisiae
tccacaaccagcttatactttccaa

SEQ ID NO: 54085 - DNA, 25 bp, S. cerevisiae
tcgcaccccgcaagaatttttcaat

SEQ ID NO: 54086 - DNA, 25 bp, S. cerevisiae
tccagcgcctggtagagattcttga

SEQ ID NO: 54087 - DNA, 25 bp, S. cerevisiae
tccagcgaggtgcaagagtctaatc

SEQ ID NO: 54088 - DNA, 25 bp, S. cerevisiae
tgccgcgcacttagacgaattcaac

SEQ ID NO: 54089 - DNA, 25 bp, S. cerevisiae
tgccccattgtgtcacggctacaaa

SEQ ID NO: 54090 - DNA, 25 bp, S. cerevisiae
tgccttcctatccttactgaatttg

SEQ ID NO: 54091 - DNA, 25 bp, S. cerevisiae
tgcctccgcttcttcattagaaatg

SEQ ID NO: 54092 - DNA, 25 bp, S. cerevisiae
tgccccatcatcagaccataaatat

SEQ ID NO: 54093 - DNA, 25 bp, S. cerevisiae
tcctcaatggacagtacaccttacc

SEQ ID NO: 54094 - DNA, 25 bp, S. cerevisiae
tttcgatgaacgcaaacctggacag

SEQ ID NO: 54095 - DNA, 25 bp, S. cerevisiae
tccactttaaggatgtcgtaactgt

SEQ ID NO: 54096 - DNA, 25 bp, S. cerevisiae
tgccccaatcttgtgtgcaggtatc

SEQ ID NO: 54097 - DNA, 25 bp, S. cerevisiae
tgcccacaatgactctgctacggaa

SEQ ID NO: 54098 - DNA, 25 bp, S. cerevisiae
tgccatttttgcctttgataccact

SEQ ID NO: 54099 - DNA, 25 bp, S. cerevisiae
tcctattttgcctattatgagaccg

SEQ ID NO: 54100 - DNA, 25 bp, S. cerevisiae
tgccattattgctaccattatctac

SEQ ID NO: 54101 - DNA, 25 bp, S. cerevisiae
tcgctcaaatgctgtcttaggacta

SEQ ID NO: 54102 - DNA, 25 bp, S. cerevisiae
tcatccccatgctgtttattggcga

SEQ ID NO: 54103 - DNA, 25 bp, S. cerevisiae
tccacccatctctattgctaggatg

SEQ ID NO: 54104 - DNA, 25 bp, S. cerevisiae
tccatcccacattgaattagttgtc

SEQ ID NO: 54105 - DNA, 25 bp, S. cerevisiae
tccacgcactcttcagatatcagat

SEQ ID NO: 54106 - DNA, 25 bp, S. cerevisiae
tgccgattcttacgctgaggagttc

SEQ ID NO: 54107 - DNA, 25 bp, S. cerevisiae
tgccgctcaaaatgtcttggctgat

SEQ ID NO: 54108 - DNA, 25 bp, S. cerevisiae
tgccgtcgaatatgtttccggtcgt

SEQ ID NO: 54109 - DNA, 25 bp, S. cerevisiae
tactgaaggtaacgttcctcaaact

SEQ ID NO: 54110 - DNA, 25 bp, S. cerevisiae
tgccgagctgagagtagttgccaat

SEQ ID NO: 54111 - DNA, 25 bp, S. cerevisiae
tgccgctgccatcaatacttttatt

SEQ ID NO: 54112 - DNA, 25 bp, S. cerevisiae
tgcgccatccaagattgccttctat

SEQ ID NO: 54113 - DNA, 25 bp, S. cerevisiae
tgcccatacggttgctgacacttta

SEQ ID NO: 54114 - DNA, 25 bp, S. cerevisiae
tgccgtacagtttcttcaggcgtat

SEQ ID NO: 54115 - DNA, 25 bp, S. cerevisiae
tgccgaacgttctattccgtgttta

SEQ ID NO: 54116 - DNA, 25 bp, S. cerevisiae
tccaaagcgttttcctcttatttag

SEQ ID NO: 54117 - DNA, 25 bp, S. cerevisiae
tcccaacttttggactttataagag

SEQ ID NO: 54118 - DNA, 25 bp, S. cerevisiae
tccaaggtccaacgcccaaataaga

SEQ ID NO: 54119 - DNA, 25 bp, S. cerevisiae
tgccaagttggctgccccagaaaat

SEQ ID NO: 54120 - DNA, 25 bp, S. cerevisiae
tgcctcatttttccctccaaagaaa

SEQ ID NO: 54121 - DNA, 25 bp, S. cerevisiae
tcgtacttgtttgctcccaggaatg

SEQ ID NO: 54122 - DNA, 25 bp, S. cerevisiae
tcgtgtttgttcttcccacaccggt

SEQ ID NO: 54123 - DNA, 25 bp, S. cerevisiae
tcggcaacgtcaacaccaacttgaa

SEQ ID NO: 54124 - DNA, 25 bp, S. cerevisiae
tgccgaaagcgctactgcaaactta

SEQ ID NO: 54125 - DNA, 25 bp, S. cerevisiae
tccagagttggtccctttcagatta

SEQ ID NO: 54126 - DNA, 25 bp, S. cerevisiae
tccggtagagatgctttccacttaa

SEQ ID NO: 54127 - DNA, 25 bp, S. cerevisiae
tccggctacgattacttcgacgtga

SEQ ID NO: 54128 - DNA, 25 bp, S. cerevisiae
tccattttggaatccttacgtcgaa

SEQ ID NO: 54129 - DNA, 25 bp, S. cerevisiae
tcctttgtggatatcgttttgtcga

SEQ ID NO: 54130 - DNA, 25 bp, S. cerevisiae
tcctccagaggacgtcaactttttc

SEQ ID NO: 54131 - DNA, 25 bp, S. cerevisiae
tccacggatattccaattgtgaact

SEQ ID NO: 54132 - DNA, 25 bp, S. cerevisiae
tgccaaggccattgattacccacaa

SEQ ID NO: 54133 - DNA, 25 bp, S. cerevisiae
tgcctacgaatcctactctcgataa

SEQ ID NO: 54134 - DNA, 25 bp, S. cerevisiae
tgcctcggaggactgccatactgat

SEQ ID NO: 54135 - DNA, 25 bp, S. cerevisiae
tgcctcgcacgagtggtatctttat

SEQ ID NO: 54136 - DNA, 25 bp, S. cerevisiae
tgcccgaaggtgactgtgctctgtt

SEQ ID NO: 54137 - DNA, 25 bp, S. cerevisiae
tgccaccaaggcctcattttattac

SEQ ID NO: 54138 - DNA, 25 bp, S. cerevisiae
tgcctccatcgaacaaactgtcact

SEQ ID NO: 54139 - DNA, 25 bp, S. cerevisiae
tgccatcaacagaaggtttgccatc

SEQ ID NO: 54140 - DNA, 25 bp, S. cerevisiae
tccaatgccctgatcttgaagacgg

SEQ ID NO: 54141 - DNA, 25 bp, S. cerevisiae
tgccacctcgctcaagtaatactgt

SEQ ID NO: 54142 - DNA, 25 bp, S. cerevisiae
tgcccgctgctacaatggacaacgt

SEQ ID NO: 54143 - DNA, 25 bp, S. cerevisiae
tgccctccatacctgagtatttggt

SEQ ID NO: 54144 - DNA, 25 bp, S. cerevisiae
tcgctaccaccggtgaatgggacaa

SEQ ID NO: 54145 - DNA, 25 bp, S. cerevisiae
tctgctaccacccaagttgcaagaa

SEQ ID NO: 54146 - DNA, 25 bp, S. cerevisiae
tccttagattcctctagcgacacaa

SEQ ID NO: 54147 - DNA, 25 bp, S. cerevisiae
tcctgtagattcaccgagtgtctca

SEQ ID NO: 54148 - DNA, 25 bp, S. cerevisiae
tccatggttgggtctccggattata

SEQ ID NO: 54149 - DNA, 25 bp, S. cerevisiae
tgccggttggtgtattcttgaggaa

SEQ ID NO: 54150 - DNA, 25 bp, S. cerevisiae
tgccgctggtcgttatacaatgaaa

SEQ ID NO: 54151 - DNA, 25 bp, S. cerevisiae
tgccgcgttggtcaagcctcataaa

SEQ ID NO: 54152 - DNA, 25 bp, S. cerevisiae
tgccagactctgttagatgacgcca

SEQ ID NO: 54153 - DNA, 25 bp, S. cerevisiae
tcgcacattctgcacgatgaggaca

SEQ ID NO: 54154 - DNA, 25 bp, S. cerevisiae
tgccacctcctcatgaaaacattga

SEQ ID NO: 54155 - DNA, 25 bp, S. cerevisiae
tcccctagtctttgacaccttagag

SEQ ID NO: 54156 - DNA, 25 bp, S. cerevisiae
tccaccatgttagagagcccttttg

SEQ ID NO: 54157 - DNA, 25 bp, S. cerevisiae
tgccgtcgatgttttgttacttgcc

SEQ ID NO: 54158 - DNA, 25 bp, S. cerevisiae
tgccgttgtctcctctgatttcttg

SEQ ID NO: 54159 - DNA, 25 bp, S. cerevisiae
tgccggtgtcgctttcttattctaa

SEQ ID NO: 54160 - DNA, 25 bp, S. cerevisiae
tccttcggtgccattggtgccagaa

SEQ ID NO: 54161 - DNA, 25 bp, S. cerevisiae
tccttgcgtctgattcgggtgaaca

SEQ ID NO: 54162 - DNA, 25 bp, S. cerevisiae
tccttgcttgggaggtatggcccat

SEQ ID NO: 54163 - DNA, 25 bp, S. cerevisiae
tccgagctttcgaggtttgactata

SEQ ID NO: 54164 - DNA, 25 bp, S. cerevisiae
tccacacttgggttccgtaaggaat

SEQ ID NO: 54165 - DNA, 25 bp, S. cerevisiae
tcacgactttggttcctttttgagt

SEQ ID NO: 54166 - DNA, 25 bp, S. cerevisiae
tcaaatcgtgggtaccttattctgg

SEQ ID NO: 54167 - DNA, 25 bp, S. cerevisiae
tagtgggccaaacctcaagaacagt

SEQ ID NO: 54168 - DNA, 25 bp, S. cerevisiae
tacgggtctaccacaagaactagtt

SEQ ID NO: 54169 - DNA, 25 bp, S. cerevisiae
tttggttctcccacccaagaagatt

SEQ ID NO: 54170 - DNA, 25 bp, S. cerevisiae
tttgttcttcccacaccggtttgat

SEQ ID NO: 54171 - DNA, 25 bp, S. cerevisiae
tttgttcttcccacaccggtttgat

SEQ ID NO: 54172 - DNA, 25 bp, S. cerevisiae
tcccttcccagacaacgtttataga

SEQ ID NO: 54173 - DNA, 25 bp, S. cerevisiae
tcccggcctaacatcaagtagcttt

SEQ ID NO: 54174 - DNA, 25 bp, S. cerevisiae
tccacggcctattctttgagtgcag

SEQ ID NO: 54175 - DNA, 25 bp, S. cerevisiae
tccactgttggattcgtagcactat

SEQ ID NO: 54176 - DNA, 25 bp, S. cerevisiae
tgccaagccggatgcgaggacgcaa

SEQ ID NO: 54177 - DNA, 25 bp, S. cerevisiae
tccagaggtggctatggtggtccaa

SEQ ID NO: 54178 - DNA, 25 bp, S. cerevisiae
tccaggttgagcttgtggccaccac

SEQ ID NO: 54179 - DNA, 25 bp, S. cerevisiae
tgccgtttgtatttatccactctgg

SEQ ID NO: 54180 - DNA, 25 bp, S. cerevisiae
tgccgggcctaaattatctgtcatc

SEQ ID NO: 54181 - DNA, 25 bp, S. cerevisiae
tgccgggcactaacatggacatttt

SEQ ID NO: 54182 - DNA, 25 bp, S. cerevisiae
tgccgatgtgcccttgatggacaac

SEQ ID NO: 54183 - DNA, 25 bp, S. cerevisiae
tgccaatgtgccatcttcgcaaaga

SEQ ID NO: 54184 - DNA, 25 bp, S. cerevisiae
tccagatgtccagtcgcggctaaat

SEQ ID NO: 54185 - DNA, 25 bp, S. cerevisiae
tgccagaaccagacttgctgctgat

SEQ ID NO: 54186 - DNA, 25 bp, S. cerevisiae
tgccagaattgctttgaggcacttg

SEQ ID NO: 54187 - DNA, 25 bp, S. cerevisiae
tgccatcggtgccttgcaagaatct

SEQ ID NO: 54188 - DNA, 25 bp, S. cerevisiae
tgccatcgcgatttcataagaccat

SEQ ID NO: 54189 - DNA, 25 bp, S. cerevisiae
tccaatggtgagttgttcatcgtgt

SEQ ID NO: 54190 - DNA, 25 bp, S. cerevisiae
tccatgttcgtcttttgttgtgctt

SEQ ID NO: 54191 - DNA, 25 bp, S. cerevisiae
tgccttgctggtctattgtttgctt

SEQ ID NO: 54192 - DNA, 25 bp, S. cerevisiae
tgccgatgttaacgccattgctgat

SEQ ID NO: 54193 - DNA, 25 bp, S. cerevisiae
tgccgatggttcttctactgcagaa

SEQ ID NO: 54194 - DNA, 25 bp, S. cerevisiae
tccatttcgttccagttcggtgata

SEQ ID NO: 54195 - DNA, 25 bp, S. cerevisiae
tgcctcttatttgggttctgttgaa

SEQ ID NO: 54196 - DNA, 25 bp, S. cerevisiae
tgccgtaagatccatcgacgcttta

SEQ ID NO: 54197 - DNA, 25 bp, S. cerevisiae
tcgccgaaaccttgaagcatgacta

SEQ ID NO: 54198 - DNA, 25 bp, S. cerevisiae
tcccttggccaatacatctgagact

SEQ ID NO: 54199 - DNA, 25 bp, S. cerevisiae
tctcctctgcccgaaagaaaactag

SEQ ID NO: 54200 - DNA, 25 bp, S. cerevisiae
tcctttcctgccaaataaacatccg

SEQ ID NO: 54201 - DNA, 25 bp, S. cerevisiae
tcagttctgcctcaatacgcaaagg

SEQ ID NO: 54202 - DNA, 25 bp, S. cerevisiae
tcccacgattttctctcgatgttga

SEQ ID NO: 54203 - DNA, 25 bp, S. cerevisiae
tccaaggctctatccaaagatggta

SEQ ID NO: 54204 - DNA, 25 bp, S. cerevisiae
tccagcaggtattgccgccggaaaa

SEQ ID NO: 54205 - DNA, 25 bp, S. cerevisiae
tcgcagggctttcagcgctggaaaa

SEQ ID NO: 54206 - DNA, 25 bp, S. cerevisiae
tgccaagggtatcgtcttggaaaaa

SEQ ID NO: 54207 - DNA, 25 bp, S. cerevisiae
tccctgtggactcgcctatggaaaa

SEQ ID NO: 54208 - DNA, 25 bp, S. cerevisiae
tgccaccatcacatcttgtgacgaa

SEQ ID NO: 54209 - DNA, 25 bp, S. cerevisiae
tcgagctattactatctgactacta

SEQ ID NO: 54210 - DNA, 25 bp, S. cerevisiae
tgccaccaccatcaagaagtagaat

SEQ ID NO: 54211 - DNA, 25 bp, S. cerevisiae
tccaccagtttcacctagcaagatg

SEQ ID NO: 54212 - DNA, 25 bp, S. cerevisiae
tccttttgatgttggttttcctact

SEQ ID NO: 54213 - DNA, 25 bp, S. cerevisiae
tccttttgatgttggctttcccaaa

SEQ ID NO: 54214 - DNA, 25 bp, S. cerevisiae
tcctcaccatttttgcgttccaaaa

SEQ ID NO: 54215 - DNA, 25 bp, S. cerevisiae
tcctcccacactggtttggtcagaa

SEQ ID NO: 54216 - DNA, 25 bp, S. cerevisiae
tcctcccacactggtttggtcagaa

SEQ ID NO: 54217 - DNA, 25 bp, S. cerevisiae
tccacaccaactagccattgggaca

SEQ ID NO: 54218 - DNA, 25 bp, S. cerevisiae
tgccaccctactacaagctgaaaag

SEQ ID NO: 54219 - DNA, 25 bp, S. cerevisiae
tccaccaatacttattccaagaagg

SEQ ID NO: 54220 - DNA, 25 bp, S. cerevisiae
tccaccaccgtacctgatgaaataa

SEQ ID NO: 54221 - DNA, 25 bp, S. cerevisiae
tccaccgtagaacccaaagcattag

SEQ ID NO: 54222 - DNA, 25 bp, S. cerevisiae
tccatcctttaactgccgaacaatt

SEQ ID NO: 54223 - DNA, 25 bp, S. cerevisiae
tcctgccctggaaacaccatacaat

SEQ ID NO: 54224 - DNA, 25 bp, S. cerevisiae
tcctcaccagcgaataactctaatc

SEQ ID NO: 54225 - DNA, 25 bp, S. cerevisiae
tccaatcatgctagtcggccttaaa

SEQ ID NO: 54226 - DNA, 25 bp, S. cerevisiae
tccaatcctcgaggctgttcaagaa

SEQ ID NO: 54227 - DNA, 25 bp, S. cerevisiae
tccaatccttaagtgatgctcaatc

SEQ ID NO: 54228 - DNA, 25 bp, S. cerevisiae
tccactcctctaaattcttatccag

SEQ ID NO: 54229 - DNA, 25 bp, S. cerevisiae
tgccttcgtgaaacagctgcttata

SEQ ID NO: 54230 - DNA, 25 bp, S. cerevisiae
tgccattggctcatacatgttttaa

SEQ ID NO: 54231 - DNA, 25 bp, S. cerevisiae
tgccttcgtttgcatatctgttaag

SEQ ID NO: 54232 - DNA, 25 bp, S. cerevisiae
tgcctttatgccttctgcagtgaat

SEQ ID NO: 54233 - DNA, 25 bp, S. cerevisiae
tccaatattgcctctggtgaagata

SEQ ID NO: 54234 - DNA, 25 bp, S. cerevisiae
tccggcaagcgcgtattcagatagt

SEQ ID NO: 54235 - DNA, 25 bp, S. cerevisiae
tccatgccatgctacagaatccgta

SEQ ID NO: 54236 - DNA, 25 bp, S. cerevisiae
tcgataacgaaattccagatctgtt

SEQ ID NO: 54237 - DNA, 25 bp, S. cerevisiae
tctatgcaggtaacgtccaactggt

SEQ ID NO: 54238 - DNA, 25 bp, S. cerevisiae
tccagaggctgaaggtccaaccgtt

SEQ ID NO: 54239 - DNA, 25 bp, S. cerevisiae
tccagtgggacctttaagccaattt

SEQ ID NO: 54240 - DNA, 25 bp, S. cerevisiae
tcaagaagggcctttttccaattct

SEQ ID NO: 54241 - DNA, 25 bp, S. cerevisiae
taccaaggtgccattttcggttcgt

SEQ ID NO: 54242 - DNA, 25 bp, S. cerevisiae
tcgaaattcgttagttccaccggat

SEQ ID NO: 54243 - DNA, 25 bp, S. cerevisiae
tccacaggctccaatacttctagaa

SEQ ID NO: 54244 - DNA, 25 bp, S. cerevisiae
tgccaagactgccaaagcttctcaa

SEQ ID NO: 54245 - DNA, 25 bp, S. cerevisiae
tgccattctccattattctttcaaa

SEQ ID NO: 54246 - DNA, 25 bp, S. cerevisiae
tgccaactcttatttgcaccagcaa

SEQ ID NO: 54247 - DNA, 25 bp, S. cerevisiae
tgccaagatttgtctattccagatt

SEQ ID NO: 54248 - DNA, 25 bp, S. cerevisiae
tgccacagtcttttacgtctattgc

SEQ ID NO: 54249 - DNA, 25 bp, S. cerevisiae
tccaagttttgaaagctgcctatgt

SEQ ID NO: 54250 - DNA, 25 bp, S. cerevisiae
tccaagttctatgcattatccgatg

SEQ ID NO: 54251 - DNA, 25 bp, S. cerevisiae
tccaagctatattccctattcaagg

SEQ ID NO: 54252 - DNA, 25 bp, S. cerevisiae
tccatggctcaatcttacttaggtg

SEQ ID NO: 54253 - DNA, 25 bp, S. cerevisiae
tccatccatcaaggcgctcatatta

SEQ ID NO: 54254 - DNA, 25 bp, S. cerevisiae
tcctctatcagggagctatatttca

SEQ ID NO: 54255 - DNA, 25 bp, S. cerevisiae
tccctatcacggctatatacacaac

SEQ ID NO: 54256 - DNA, 25 bp, S. cerevisiae
tcccggactaccctgaatttgatga

SEQ ID NO: 54257 - DNA, 25 bp, S. cerevisiae
tcctccgccgagcttgaatttagat

SEQ ID NO: 54258 - DNA, 25 bp, S. cerevisiae
tcctcgaggaggctgctttttaata

SEQ ID NO: 54259 - DNA, 25 bp, S. cerevisiae
tccctcacatcaacgttttttctaa

SEQ ID NO: 54260 - DNA, 25 bp, S. cerevisiae
tccggcgcacctattgtaaggagtc

SEQ ID NO: 54261 - DNA, 25 bp, S. cerevisiae
tccccgatcctcatttcaaacaaag

SEQ ID NO: 54262 - DNA, 25 bp, S. cerevisiae
tccctactggtccttccaaaaagag

SEQ ID NO: 54263 - DNA, 25 bp, S. cerevisiae
tccgcatttggcgagtattctgatg

SEQ ID NO: 54264 - DNA, 25 bp, S. cerevisiae
tccgcagtattggagccatattttc

SEQ ID NO: 54265 - DNA, 25 bp, S. cerevisiae
tcgactatttaaacgctgctttgcg

SEQ ID NO: 54266 - DNA, 25 bp, S. cerevisiae
tcgaatttttgaaggtctttccgca

SEQ ID NO: 54267 - DNA, 25 bp, S. cerevisiae
tcgaatgttctagaggccaatggcc

SEQ ID NO: 54268 - DNA, 25 bp, S. cerevisiae
tccagtttcttttcccagagcagag

SEQ ID NO: 54269 - DNA, 25 bp, S. cerevisiae
tccctttcttttacaccaacaactg

SEQ ID NO: 54270 - DNA, 25 bp, S. cerevisiae
tctgactgacgaagtttgggcggtt

SEQ ID NO: 54271 - DNA, 25 bp, S. cerevisiae
tcccaccagacggttcgatggagtt

SEQ ID NO: 54272 - DNA, 25 bp, S. cerevisiae
tcacccaagtccgtgtcgaattctt

SEQ ID NO: 54273 - DNA, 25 bp, S. cerevisiae
taccatacgtagttgggacatccct

SEQ ID NO: 54274 - DNA, 25 bp, S. cerevisiae
tccgcattcgtttatttaccaggct

SEQ ID NO: 54275 - DNA, 25 bp, S. cerevisiae
tccactacggtgtcttctacaagta

SEQ ID NO: 54276 - DNA, 25 bp, S. cerevisiae
tctactaaagcttcttccagcagcg

SEQ ID NO: 54277 - DNA, 25 bp, S. cerevisiae
tccattatcaaggacttccatgcag

SEQ ID NO: 54278 - DNA, 25 bp, S. cerevisiae
tgccaatccaacatcctacgaatag

SEQ ID NO: 54279 - DNA, 25 bp, S. cerevisiae
tgccaacctaccctctaatgtataa

SEQ ID NO: 54280 - DNA, 25 bp, S. cerevisiae
tccctctctccaacataaaggcttt

SEQ ID NO: 54281 - DNA, 25 bp, S. cerevisiae
tccctctaagcgctcaatacgttga

SEQ ID NO: 54282 - DNA, 25 bp, S. cerevisiae
tttgcccggcaacataaccgtagtt

SEQ ID NO: 54283 - DNA, 25 bp, S. cerevisiae
tctaaccttcaacaaacgcctttat

SEQ ID NO: 54284 - DNA, 25 bp, S. cerevisiae
tcgaatactggtgggctttgggcaa

SEQ ID NO: 54285 - DNA, 25 bp, S. cerevisiae
tccgagccgtttattgtttaccaat

SEQ ID NO: 54286 - DNA, 25 bp, S. cerevisiae
tacgctccctttctattaggaaaat

SEQ ID NO: 54287 - DNA, 25 bp, S. cerevisiae
taagcattttttcaacttggacgaa

SEQ ID NO: 54288 - DNA, 25 bp, S. cerevisiae
tatactattttacaccgtatactaa

SEQ ID NO: 54289 - DNA, 25 bp, S. cerevisiae
tatactattttacaccgtatactaa

SEQ ID NO: 54290 - DNA, 25 bp, S. cerevisiae
tccaggcctggtgctattgtcgtag

SEQ ID NO: 54291 - DNA, 25 bp, S. cerevisiae
tccaatactttggtggtccagtcag

SEQ ID NO: 54292 - DNA, 25 bp, S. cerevisiae
tgccaatggacttcaagggcgtcat

SEQ ID NO: 54293 - DNA, 25 bp, S. cerevisiae
tccagagtgctatcctgttggctat

SEQ ID NO: 54294 - DNA, 25 bp, S. cerevisiae
tccatgattatctacattttaatat

SEQ ID NO: 54295 - DNA, 25 bp, S. cerevisiae
tccatgcgtcccattttcaaaattc

SEQ ID NO: 54296 - DNA, 25 bp, S. cerevisiae
tccagtattatcgacaggtgacagt

SEQ ID NO: 54297 - DNA, 25 bp, S. cerevisiae
tccatctttgatccaagccgtgaaa

SEQ ID NO: 54298 - DNA, 25 bp, S. cerevisiae
tccactttgcacttagtcttgagat

SEQ ID NO: 54299 - DNA, 25 bp, S. cerevisiae
tccaccctcacttgtatactgatat

SEQ ID NO: 54300 - DNA, 25 bp, S. cerevisiae
tcccctgccatggtgatccggatat

SEQ ID NO: 54301 - DNA, 25 bp, S. cerevisiae
tccgagctacaacttcgcagagaat

SEQ ID NO: 54302 - DNA, 25 bp, S. cerevisiae
ttccagctcaaggtcggcgaggtaa

SEQ ID NO: 54303 - DNA, 25 bp, S. cerevisiae
ttctcgaaacgaaggcaaggcaaaa

SEQ ID NO: 54304 - DNA, 25 bp, S. cerevisiae
tacttacgacgaacgcaaggcattg

SEQ ID NO: 54305 - DNA, 25 bp, S. cerevisiae
tcattgaatcccgaactaagactag

SEQ ID NO: 54306 - DNA, 25 bp, S. cerevisiae
tcctctgagaactttcatacccttt

SEQ ID NO: 54307 - DNA, 25 bp, S. cerevisiae
tccaaggccctctaacggtacagta

SEQ ID NO: 54308 - DNA, 25 bp, S. cerevisiae
tccagaacctcactagccagaatat

SEQ ID NO: 54309 - DNA, 25 bp, S. cerevisiae
tcgctgagcgcattgagacctactc

SEQ ID NO: 54310 - DNA, 25 bp, S. cerevisiae
tccctattcaatgggctactgcaat

SEQ ID NO: 54311 - DNA, 25 bp, S. cerevisiae
tccattttcgaccagcattctacat

SEQ ID NO: 54312 - DNA, 25 bp, S. cerevisiae
tcctctttggaaggtaagggctctt

SEQ ID NO: 54313 - DNA, 25 bp, S. cerevisiae
tcgctgctccttcaggtaactataa

SEQ ID NO: 54314 - DNA, 25 bp, S. cerevisiae
tccagctacgctatctcaagaattt

SEQ ID NO: 54315 - DNA, 25 bp, S. cerevisiae
tcgcccactgcccaatagaatgaat

SEQ ID NO: 54316 - DNA, 25 bp, S. cerevisiae
tcgcaaagtcctcatgcaactgcaa

SEQ ID NO: 54317 - DNA, 25 bp, S. cerevisiae
tccttactccaatgcatctcaaatg

SEQ ID NO: 54318 - DNA, 25 bp, S. cerevisiae
tccatttcacgactccactgaagga

SEQ ID NO: 54319 - DNA, 25 bp, S. cerevisiae
tccatactactgctctcttgaagtt

SEQ ID NO: 54320 - DNA, 25 bp, S. cerevisiae
tcgaattgggtgtttacgtctccga

SEQ ID NO: 54321 - DNA, 25 bp, S. cerevisiae
tccgttgcgggtatgggtgccatca

SEQ ID NO: 54322 - DNA, 25 bp, S. cerevisiae
tccgttggtttgttggtgatactcc

SEQ ID NO: 54323 - DNA, 25 bp, S. cerevisiae
tcgactatttcgtatttggtggcat

SEQ ID NO: 54324 - DNA, 25 bp, S. cerevisiae
tccatctttctatatgttcacgcct

SEQ ID NO: 54325 - DNA, 25 bp, S. cerevisiae
tcgattcttctgaacgtcaacgcgt

SEQ ID NO: 54326 - DNA, 25 bp, S. cerevisiae
tcgaacccgcagagctttactaaac

SEQ ID NO: 54327 - DNA, 25 bp, S. cerevisiae
tcgaagtcccagaaggtgtcactgt

SEQ ID NO: 54328 - DNA, 25 bp, S. cerevisiae
tcctatcgtcgtccatttcagctaa

SEQ ID NO: 54329 - DNA, 25 bp, S. cerevisiae
tccggcgcttgcaaagtccaaagtt

SEQ ID NO: 54330 - DNA, 25 bp, S. cerevisiae
tccgctactttgcaacctgaattta

SEQ ID NO: 54331 - DNA, 25 bp, S. cerevisiae
tccgatacttctcaaacccttaaag

SEQ ID NO: 54332 - DNA, 25 bp, S. cerevisiae
tcctgcttcttcagaagagccctta

SEQ ID NO: 54333 - DNA, 25 bp, S. cerevisiae
tccagcttcgccagcaaacgttgaa

SEQ ID NO: 54334 - DNA, 25 bp, S. cerevisiae
tccagctttgtctgcataccataag

SEQ ID NO: 54335 - DNA, 25 bp, S. cerevisiae
tccactctttgactgctactcaaaa

SEQ ID NO: 54336 - DNA, 25 bp, S. cerevisiae
tccggcgggtctacctaatagatca

SEQ ID NO: 54337 - DNA, 25 bp, S. cerevisiae
tccgctgcgggactacctaaataaa

SEQ ID NO: 54338 - DNA, 25 bp, S. cerevisiae
tcatccgcggaactacctagtggga

SEQ ID NO: 54339 - DNA, 25 bp, S. cerevisiae
tcctcacggcaccttactaagtgga

SEQ ID NO: 54340 - DNA, 25 bp, S. cerevisiae
tttaaagcactacctacccagttca

SEQ ID NO: 54341 - DNA, 25 bp, S. cerevisiae
tttcaacgaaactcgggatgcccta

SEQ ID NO: 54342 - DNA, 25 bp, S. cerevisiae
ttctcggaaaacttggtggattttg

SEQ ID NO: 54343 - DNA, 25 bp, S. cerevisiae
taccgtgataaagcctggacagttt

SEQ ID NO: 54344 - DNA, 25 bp, S. cerevisiae
tcctcgttggaggtttttacgcttg

SEQ ID NO: 54345 - DNA, 25 bp, S. cerevisiae
tccaccgtcttagtttctgttaccg

SEQ ID NO: 54346 - DNA, 25 bp, S. cerevisiae
tccacgtttgctgtttcgttaacca

SEQ ID NO: 54347 - DNA, 25 bp, S. cerevisiae
tccatttatgatttcttgagtacaa

SEQ ID NO: 54348 - DNA, 25 bp, S. cerevisiae
tcctgttctgtcttcctgggaaaaa

SEQ ID NO: 54349 - DNA, 25 bp, S. cerevisiae
tccttgtccatcgaggcccaaataa

SEQ ID NO: 54350 - DNA, 25 bp, S. cerevisiae
tccttgtcaactctgtcttatatca

SEQ ID NO: 54351 - DNA, 25 bp, S. cerevisiae
tcgtcctcaaggttaacccgatcat

SEQ ID NO: 54352 - DNA, 25 bp, S. cerevisiae
tcgtcccagggttgttccaaatcaa

SEQ ID NO: 54353 - DNA, 25 bp, S. cerevisiae
tcgtctccccagttttccaacaatt

SEQ ID NO: 54354 - DNA, 25 bp, S. cerevisiae
tcctgagctcgatcgagtctgactt

SEQ ID NO: 54355 - DNA, 25 bp, S. cerevisiae
tcgtgatgacgatggcgccacatgt

SEQ ID NO: 54356 - DNA, 25 bp, S. cerevisiae
tcgcaagaggaagtcatcgcattat

SEQ ID NO: 54357 - DNA, 25 bp, S. cerevisiae
tccatgccaagtacttccttcaaat

SEQ ID NO: 54358 - DNA, 25 bp, S. cerevisiae
tccagcaccagagcatttgttcaac

SEQ ID NO: 54359 - DNA, 25 bp, S. cerevisiae
tcctcaagtgccatcgtttcaaaac

SEQ ID NO: 54360 - DNA, 25 bp, S. cerevisiae
tccagtgccaaagagcccattgata

SEQ ID NO: 54361 - DNA, 25 bp, S. cerevisiae
tccatgttgcaggaggcgtctcaag

SEQ ID NO: 54362 - DNA, 25 bp, S. cerevisiae
tcctgcagtgaggagtccttagcgt

SEQ ID NO: 54363 - DNA, 25 bp, S. cerevisiae
tcctatcatcgcagtcacttttgta

SEQ ID NO: 54364 - DNA, 25 bp, S. cerevisiae
tccttattgttgtcctttgtgtgct

SEQ ID NO: 54365 - DNA, 25 bp, S. cerevisiae
tccggattgtgtacgactcgtccaa

SEQ ID NO: 54366 - DNA, 25 bp, S. cerevisiae
tccgagggtgagttctcttggaaaa

SEQ ID NO: 54367 - DNA, 25 bp, S. cerevisiae
tcctgaaaacttccatctacctgaa

SEQ ID NO: 54368 - DNA, 25 bp, S. cerevisiae
tccgatgacggaaccagtacctaga

SEQ ID NO: 54369 - DNA, 25 bp, S. cerevisiae
tccgatcacctgcaagctttgatag

SEQ ID NO: 54370 - DNA, 25 bp, S. cerevisiae
tcgtttttgatattggttcacttcc

SEQ ID NO: 54371 - DNA, 25 bp, S. cerevisiae
tcctccctggtattatttcttttct

SEQ ID NO: 54372 - DNA, 25 bp, S. cerevisiae
tccatcgggattatagctattgtct

SEQ ID NO: 54373 - DNA, 25 bp, S. cerevisiae
tcccgctacattactactctgattt

SEQ ID NO: 54374 - DNA, 25 bp, S. cerevisiae
tcgcaagttttctctctgcattaac

SEQ ID NO: 54375 - DNA, 25 bp, S. cerevisiae
tccgactggtcgtacattcataaac

SEQ ID NO: 54376 - DNA, 25 bp, S. cerevisiae
tcctgatacttttgcagcctcttta

SEQ ID NO: 54377 - DNA, 25 bp, S. cerevisiae
tcctggccaacgttatggtgcttat

SEQ ID NO: 54378 - DNA, 25 bp, S. cerevisiae
tccggcatcaagcagtatttttatc

SEQ ID NO: 54379 - DNA, 25 bp, S. cerevisiae
tccaggctcgagcaagagttccaat

SEQ ID NO: 54380 - DNA, 25 bp, S. cerevisiae
tccatcgccgttgagttgtatttca

SEQ ID NO: 54381 - DNA, 25 bp, S. cerevisiae
tccgatgccttagatctattgacca

SEQ ID NO: 54382 - DNA, 25 bp, S. cerevisiae
tcctgctatgtatgctctggtgatt

SEQ ID NO: 54383 - DNA, 25 bp, S. cerevisiae
tcgatgatctgagcgccagcgtata

SEQ ID NO: 54384 - DNA, 25 bp, S. cerevisiae
tctcgtccacccgtgatggtatgaa

SEQ ID NO: 54385 - DNA, 25 bp, S. cerevisiae
tctgcgggacacttttagtattacc

SEQ ID NO: 54386 - DNA, 25 bp, S. cerevisiae
tcgaacgaatttagtggctcattac

SEQ ID NO: 54387 - DNA, 25 bp, S. cerevisiae
tcgacaccaaagaggcgctgcaaaa

SEQ ID NO: 54388 - DNA, 25 bp, S. cerevisiae
tccggtaccacaacgctcaaagaat

SEQ ID NO: 54389 - DNA, 25 bp, S. cerevisiae
tcctggttcccatctgaatgtgaaa

SEQ ID NO: 54390 - DNA, 25 bp, S. cerevisiae
tcctgggaacgacgctggtcaaact

SEQ ID NO: 54391 - DNA, 25 bp, S. cerevisiae
tccgtggctgtacaacctgctaata

SEQ ID NO: 54392 - DNA, 25 bp, S. cerevisiae
tcccgtggcatctagggcactgtta

SEQ ID NO: 54393 - DNA, 25 bp, S. cerevisiae
tcctgtggtgaaacggcatgtgctt

SEQ ID NO: 54394 - DNA, 25 bp, S. cerevisiae
tccgtcgatattacatctgacaata

SEQ ID NO: 54395 - DNA, 25 bp, S. cerevisiae
tcgttttctttttctcgttgttcag

SEQ ID NO: 54396 - DNA, 25 bp, S. cerevisiae
tccgtccgctgtacaaagcttttac

SEQ ID NO: 54397 - DNA, 25 bp, S. cerevisiae
tcctcccaggctaactcatttgtta

SEQ ID NO: 54398 - DNA, 25 bp, S. cerevisiae
tcgtcccagggtttatcgtgatgta

SEQ ID NO: 54399 - DNA, 25 bp, S. cerevisiae
tcctccggataactgcacttgtgat

SEQ ID NO: 54400 - DNA, 25 bp, S. cerevisiae
tccatctctagatagctcctcggaa

SEQ ID NO: 54401 - DNA, 25 bp, S. cerevisiae
tcctgtatgagattagagccctata

SEQ ID NO: 54402 - DNA, 25 bp, S. cerevisiae
tcctggcatgaggttgatggctcta

SEQ ID NO: 54403 - DNA, 25 bp, S. cerevisiae
tccgtgctcatatacttgattgtcg

SEQ ID NO: 54404 - DNA, 25 bp, S. cerevisiae
tcccagctattatcaatgtccgcga

SEQ ID NO: 54405 - DNA, 25 bp, S. cerevisiae
tccttccttattaccatttgaccaa

SEQ ID NO: 54406 - DNA, 25 bp, S. cerevisiae
tcctccgttttgtccgctttggaag

SEQ ID NO: 54407 - DNA, 25 bp, S. cerevisiae
tcctccggtgttgccagttatagaa

SEQ ID NO: 54408 - DNA, 25 bp, S. cerevisiae
tcctccagccgacaacggtgaagaa

SEQ ID NO: 54409 - DNA, 25 bp, S. cerevisiae
tcgttatgacgacaattggagacaa

SEQ ID NO: 54410 - DNA, 25 bp, S. cerevisiae
tcgttagcgccttcaccaaaagtat

SEQ ID NO: 54411 - DNA, 25 bp, S. cerevisiae
tcgttaccaccaccaactacagaat

SEQ ID NO: 54412 - DNA, 25 bp, S. cerevisiae
tcgtgttttccccaactctaaatat

SEQ ID NO: 54413 - DNA, 25 bp, S. cerevisiae
tcgttatttccctactcggtgaatt

SEQ ID NO: 54414 - DNA, 25 bp, S. cerevisiae
tcgcctacgtcccaaatcaagtttg

SEQ ID NO: 54415 - DNA, 25 bp, S. cerevisiae
tccattaccccacatgtttattgtc

SEQ ID NO: 54416 - DNA, 25 bp, S. cerevisiae
tccattacacatcccaagctttatt

SEQ ID NO: 54417 - DNA, 25 bp, S. cerevisiae
tcctttgttaggttgcgcattcatg

SEQ ID NO: 54418 - DNA, 25 bp, S. cerevisiae
tcgacattattcagcgactaccaat

SEQ ID NO: 54419 - DNA, 25 bp, S. cerevisiae
tcctgcttcttccattatctttagt

SEQ ID NO: 54420 - DNA, 25 bp, S. cerevisiae
tcccaggccatgtcaagttgcgtta

SEQ ID NO: 54421 - DNA, 25 bp, S. cerevisiae
tcctcttcgatgtccgtcggtaata

SEQ ID NO: 54422 - DNA, 25 bp, S. cerevisiae
tcctcttcacactttgccgaatagt

SEQ ID NO: 54423 - DNA, 25 bp, S. cerevisiae
tccgcaaacagactagcagctcatt

SEQ ID NO: 54424 - DNA, 25 bp, S. cerevisiae
tctcgcattcaaatcaaaaactggg

SEQ ID NO: 54425 - DNA, 25 bp, S. cerevisiae
tcctgagttcagttccaattccaat

SEQ ID NO: 54426 - DNA, 25 bp, S. cerevisiae
tccgcagtccactttcaaatctaat

SEQ ID NO: 54427 - DNA, 25 bp, S. cerevisiae
tcctctgtccaatccaagatcttat

SEQ ID NO: 54428 - DNA, 25 bp, S. cerevisiae
tcctgcgtcgttaccggatttattt

SEQ ID NO: 54429 - DNA, 25 bp, S. cerevisiae
tcgctacttgagacgtgtggttacc

SEQ ID NO: 54430 - DNA, 25 bp, S. cerevisiae
tccgcgatcgaggtgtgcactacat

SEQ ID NO: 54431 - DNA, 25 bp, S. cerevisiae
tcctgtgttgatgctgtcctagaag

SEQ ID NO: 54432 - DNA, 25 bp, S. cerevisiae
tcgttttaatcatgcgtcagtgtga

SEQ ID NO: 54433 - DNA, 25 bp, S. cerevisiae
tcctcctccagtttcaataacacag

SEQ ID NO: 54434 - DNA, 25 bp, S. cerevisiae
tcctcctccatcaaaactaacagtg

SEQ ID NO: 54435 - DNA, 25 bp, S. cerevisiae
tccggcggctcaagaatcactacga

SEQ ID NO: 54436 - DNA, 25 bp, S. cerevisiae
tccggctcctttcagactaaggtct

SEQ ID NO: 54437 - DNA, 25 bp, S. cerevisiae
tccgcctattttcaatccttcgttg

SEQ ID NO: 54438 - DNA, 25 bp, S. cerevisiae
tcgaaggttttccaaccttctgcgg

SEQ ID NO: 54439 - DNA, 25 bp, S. cerevisiae
tcgccagagtttacgaacgctgtag

SEQ ID NO: 54440 - DNA, 25 bp, S. cerevisiae
tccgcaggtctttcgcaatttatac

SEQ ID NO: 54441 - DNA, 25 bp, S. cerevisiae
tcctgggttctatctatggtatgaa

SEQ ID NO: 54442 - DNA, 25 bp, S. cerevisiae
tcctgggtttacgttgatgctgaca

SEQ ID NO: 54443 - DNA, 25 bp, S. cerevisiae
tcctgatggttttcctaggcgagct

SEQ ID NO: 54444 - DNA, 25 bp, S. cerevisiae
tcctctgcgacgtcttttgtggaga

SEQ ID NO: 54445 - DNA, 25 bp, S. cerevisiae
tcctgaacagcacccaaatgacgat

SEQ ID NO: 54446 - DNA, 25 bp, S. cerevisiae
tctgccatgggtgaagaagctgcca

SEQ ID NO: 54447 - DNA, 25 bp, S. cerevisiae
tccccggttcaattcacagacagtg

SEQ ID NO: 54448 - DNA, 25 bp, S. cerevisiae
tcctccgatttcattacagcagcag

SEQ ID NO: 54449 - DNA, 25 bp, S. cerevisiae
tcccaatttatttaccagccttatg

SEQ ID NO: 54450 - DNA, 25 bp, S. cerevisiae
tccccacataatctacaactttcaa

SEQ ID NO: 54451 - DNA, 25 bp, S. cerevisiae
tccgctcctaatggaccaacgatta

SEQ ID NO: 54452 - DNA, 25 bp, S. cerevisiae
tcccctcctttgctttgctaagaaa

SEQ ID NO: 54453 - DNA, 25 bp, S. cerevisiae
tcccctttattcctgggtaatgtca

SEQ ID NO: 54454 - DNA, 25 bp, S. cerevisiae
tcctgctcctgctgttattgaaaaa

SEQ ID NO: 54455 - DNA, 25 bp, S. cerevisiae
tctttccccgtctccaataagaaga

SEQ ID NO: 54456 - DNA, 25 bp, S. cerevisiae
tcctactaattctcctcagcaaaat

SEQ ID NO: 54457 - DNA, 25 bp, S. cerevisiae
tcctggtatattcagctctagcata

SEQ ID NO: 54458 - DNA, 25 bp, S. cerevisiae
tcctgtggttatccagctgctaaga

SEQ ID NO: 54459 - DNA, 25 bp, S. cerevisiae
tcctcagctgccattagaaacgaca

SEQ ID NO: 54460 - DNA, 25 bp, S. cerevisiae
tctcactcccgaagaacggcagaag

SEQ ID NO: 54461 - DNA, 25 bp, S. cerevisiae
tcccactcttccgagatctgataga

SEQ ID NO: 54462 - DNA, 25 bp, S. cerevisiae
tccgcagccgtttgagcacttgaaa

SEQ ID NO: 54463 - DNA, 25 bp, S. cerevisiae
tcgacccttatatggctcagagaga

SEQ ID NO: 54464 - DNA, 25 bp, S. cerevisiae
tcgaccctcctgatgatccaagaga

SEQ ID NO: 54465 - DNA, 25 bp, S. cerevisiae
tcatccttacgctcaaatgtcgtcg

SEQ ID NO: 54466 - DNA, 25 bp, S. cerevisiae
tcttggcgaaagagaagctggaaca

SEQ ID NO: 54467 - DNA, 25 bp, S. cerevisiae
tagggtcagaaaagccatgtggtac

SEQ ID NO: 54468 - DNA, 25 bp, S. cerevisiae
tcgaagacaataaccccacggactt

SEQ ID NO: 54469 - DNA, 25 bp, S. cerevisiae
tctgcaataaatttcacgcccgatg

SEQ ID NO: 54470 - DNA, 25 bp, S. cerevisiae
tctgaaatgcttagagttccctccc

SEQ ID NO: 54471 - DNA, 25 bp, S. cerevisiae
tcgtactgtacataggttagaccat

SEQ ID NO: 54472 - DNA, 25 bp, S. cerevisiae
tcctccaactcagcaggttcaatag

SEQ ID NO: 54473 - DNA, 25 bp, S. cerevisiae
tcccgatgacttggacgatttcaat

SEQ ID NO: 54474 - DNA, 25 bp, S. cerevisiae
tcccgagagtcccttattatgctat

SEQ ID NO: 54475 - DNA, 25 bp, S. cerevisiae
tcccgctggttcacatactattatg

SEQ ID NO: 54476 - DNA, 25 bp, S. cerevisiae
tcccacgccttcatcaaggttatga

SEQ ID NO: 54477 - DNA, 25 bp, S. cerevisiae
tcgaagttgttgttgcttccaacta

SEQ ID NO: 54478 - DNA, 25 bp, S. cerevisiae
tcagaacatttatctagccacgatg

SEQ ID NO: 54479 - DNA, 25 bp, S. cerevisiae
tcggcctgacggctgaagatatcaa

SEQ ID NO: 54480 - DNA, 25 bp, S. cerevisiae
tctggtcgttgggtatcatgatcat

SEQ ID NO: 54481 - DNA, 25 bp, S. cerevisiae
tcggacggtctaccaatctgaaggt

SEQ ID NO: 54482 - DNA, 25 bp, S. cerevisiae
tcctccgcctgctgataatatcatt

SEQ ID NO: 54483 - DNA, 25 bp, S. cerevisiae
tcccaggcctcttgtgataaacttt

SEQ ID NO: 54484 - DNA, 25 bp, S. cerevisiae
tcgccgtcggttctaaatcttcata

SEQ ID NO: 54485 - DNA, 25 bp, S. cerevisiae
tcccgcatgggtaccgaaatttctt

SEQ ID NO: 54486 - DNA, 25 bp, S. cerevisiae
taccgcatatgagcccgacaatttt

SEQ ID NO: 54487 - DNA, 25 bp, S. cerevisiae
tcggcgatgcagaagcgggtctaaa

SEQ ID NO: 54488 - DNA, 25 bp, S. cerevisiae
tctctcggtttggattggttgcatt

SEQ ID NO: 54489 - DNA, 25 bp, S. cerevisiae
tccgttcgatgtctattctaaaaag

SEQ ID NO: 54490 - DNA, 25 bp, S. cerevisiae
tccgtctttcctttgcctaacaata

SEQ ID NO: 54491 - DNA, 25 bp, S. cerevisiae
tccgtctttgcgacctgaatcgaaa

SEQ ID NO: 54492 - DNA, 25 bp, S. cerevisiae
tccgtttctggtgccatatggacac

SEQ ID NO: 54493 - DNA, 25 bp, S. cerevisiae
tccgtcgtccaaaccatcattaaag

SEQ ID NO: 54494 - DNA, 25 bp, S. cerevisiae
tcggatttgtcaagggccaggccca

SEQ ID NO: 54495 - DNA, 25 bp, S. cerevisiae
tcgttgctgttttgccccaaatatg

SEQ ID NO: 54496 - DNA, 25 bp, S. cerevisiae
tccggttttcgtcccagataatact

SEQ ID NO: 54497 - DNA, 25 bp, S. cerevisiae
tcacctaagtagcattctggctctc

SEQ ID NO: 54498 - DNA, 25 bp, S. cerevisiae
tcaccagaggtgttactaggcgccc

SEQ ID NO: 54499 - DNA, 25 bp, S. cerevisiae
tccccaagtattttaggcctccata

SEQ ID NO: 54500 - DNA, 25 bp, S. cerevisiae
tctaaaactgatcgagccaaggctt

SEQ ID NO: 54501 - DNA, 25 bp, S. cerevisiae
tcgctaagatccctgctcaaattta

SEQ ID NO: 54502 - DNA, 25 bp, S. cerevisiae
tcggaaccgggtacacaatagggat

SEQ ID NO: 54503 - DNA, 25 bp, S. cerevisiae
tcccctcaaaggtcacacgaactgt

SEQ ID NO: 54504 - DNA, 25 bp, S. cerevisiae
tcccagttttggtacagcgatgaca

SEQ ID NO: 54505 - DNA, 25 bp, S. cerevisiae
tctcatacagacagggacgggtcct

SEQ ID NO: 54506 - DNA, 25 bp, S. cerevisiae
ttgataaatccgcaagggccttaga

SEQ ID NO: 54507 - DNA, 25 bp, S. cerevisiae
tttaaatcctttcactccttcaatg

SEQ ID NO: 54508 - DNA, 25 bp, S. cerevisiae
taagtaccctttcttgctatacgag

SEQ ID NO: 54509 - DNA, 25 bp, S. cerevisiae
taaggccacctttgttttcttcaca

SEQ ID NO: 54510 - DNA, 25 bp, S. cerevisiae
tcacgtacacctttgtttcggtcaa

SEQ ID NO: 54511 - DNA, 25 bp, S. cerevisiae
tcacgctaacgtttccaccaaggaa

SEQ ID NO: 54512 - DNA, 25 bp, S. cerevisiae
tccgctaacctagtttcacctaaga

SEQ ID NO: 54513 - DNA, 25 bp, S. cerevisiae
tacgttatttacaggcctatcttaa

SEQ ID NO: 54514 - DNA, 25 bp, S. cerevisiae
tacgtttcccacaagggtttcattg

SEQ ID NO: 54515 - DNA, 25 bp, S. cerevisiae
tcaagttccccggtggattttcaga

SEQ ID NO: 54516 - DNA, 25 bp, S. cerevisiae
tttttccgttggtgcttattcgcta

SEQ ID NO: 54517 - DNA, 25 bp, S. cerevisiae
tcctggcacgggtttgattctgata

SEQ ID NO: 54518 - DNA, 25 bp, S. cerevisiae
tccggaactcgatgtggtgctgatt

SEQ ID NO: 54519 - DNA, 25 bp, S. cerevisiae
tccctagtggctacgttgcaatgca

SEQ ID NO: 54520 - DNA, 25 bp, S. cerevisiae
tcctgggagttgttgttgctttcat

SEQ ID NO: 54521 - DNA, 25 bp, S. cerevisiae
tcgctatattacattttcgcagtgc

SEQ ID NO: 54522 - DNA, 25 bp, S. cerevisiae
tccgtattgccctttgcattgaagc

SEQ ID NO: 54523 - DNA, 25 bp, S. cerevisiae
tccgtttctgaccttgttcaagcaa

SEQ ID NO: 54524 - DNA, 25 bp, S. cerevisiae
tccgtattcggtcctcattatatcg

SEQ ID NO: 54525 - DNA, 25 bp, S. cerevisiae
tccccatctcggtgccatataattg

SEQ ID NO: 54526 - DNA, 25 bp, S. cerevisiae
tcggccgtaatttggtgtctctgac

SEQ ID NO: 54527 - DNA, 25 bp, S. cerevisiae
tccgctagaaagttgcgtgtccaca

SEQ ID NO: 54528 - DNA, 25 bp, S. cerevisiae
tcgatttccaagatcattcctcaat

SEQ ID NO: 54529 - DNA, 25 bp, S. cerevisiae
tcgaattggcaacgtcatacttaat

SEQ ID NO: 54530 - DNA, 25 bp, S. cerevisiae
tcggattccgactcagactctggtt

SEQ ID NO: 54531 - DNA, 25 bp, S. cerevisiae
tcggaatctctatgtgcggactatg

SEQ ID NO: 54532 - DNA, 25 bp, S. cerevisiae
tcacgatgagtccatgttgtccgca

SEQ ID NO: 54533 - DNA, 25 bp, S. cerevisiae
tcctggagtccatcttggtgacgaa

SEQ ID NO: 54534 - DNA, 25 bp, S. cerevisiae
tcccacttcgaagtctcggaaaaca

SEQ ID NO: 54535 - DNA, 25 bp, S. cerevisiae
tcgctcctggagtatcgcttaatag

SEQ ID NO: 54536 - DNA, 25 bp, S. cerevisiae
tcgcacctgactccattgtggaata

SEQ ID NO: 54537 - DNA, 25 bp, S. cerevisiae
tcggcgggcccattgttagatatag

SEQ ID NO: 54538 - DNA, 25 bp, S. cerevisiae
tcgtcggctgctgttatcatgaggt

SEQ ID NO: 54539 - DNA, 25 bp, S. cerevisiae
tcccgcagtgaggtgctcttagtgt

SEQ ID NO: 54540 - DNA, 25 bp, S. cerevisiae
tcgcagatggcgctcaaacacaaca

SEQ ID NO: 54541 - DNA, 25 bp, S. cerevisiae
tcggtgcagcgacaaattcaagatt

SEQ ID NO: 54542 - DNA, 25 bp, S. cerevisiae
tcgtttcccatcttatataagggga

SEQ ID NO: 54543 - DNA, 25 bp, S. cerevisiae
tctgttaccgccttcattatgggaa

SEQ ID NO: 54544 - DNA, 25 bp, S. cerevisiae
tcgccctgggcggtgatgatattaa

SEQ ID NO: 54545 - DNA, 25 bp, S. cerevisiae
tcggactgggagatgagagcactac

SEQ ID NO: 54546 - DNA, 25 bp, S. cerevisiae
tcgagagaggatcgtgccctgacca

SEQ ID NO: 54547 - DNA, 25 bp, S. cerevisiae
tcggccatgtgtgagtacgtgcgca

SEQ ID NO: 54548 - DNA, 25 bp, S. cerevisiae
tcgggcattcggtcatcggagacga

SEQ ID NO: 54549 - DNA, 25 bp, S. cerevisiae
tcgaatttcttgtccgagatcagtc

SEQ ID NO: 54550 - DNA, 25 bp, S. cerevisiae
tcggatttcttatttggctcaccat

SEQ ID NO: 54551 - DNA, 25 bp, S. cerevisiae
tcgcttctcttggtgttgtgattag

SEQ ID NO: 54552 - DNA, 25 bp, S. cerevisiae
tcgatcgtcatttcttcggtctaaa

SEQ ID NO: 54553 - DNA, 25 bp, S. cerevisiae
ttgtgccgccttctagtaaagactc

SEQ ID NO: 54554 - DNA, 25 bp, S. cerevisiae
tctggcctccttcaaacaggaacta

SEQ ID NO: 54555 - DNA, 25 bp, S. cerevisiae
tctccaacgttggttacagtgaact

SEQ ID NO: 54556 - DNA, 25 bp, S. cerevisiae
tccctagcctctgaatatgcactaa

SEQ ID NO: 54557 - DNA, 25 bp, S. cerevisiae
tcgcctcgctttgatagacctgaag

SEQ ID NO: 54558 - DNA, 25 bp, S. cerevisiae
tcaggtctcaggatgtacggtctac

SEQ ID NO: 54559 - DNA, 25 bp, S. cerevisiae
tcgagtgtcatactgggactggttt

SEQ ID NO: 54560 - DNA, 25 bp, S. cerevisiae
tcgttgttcgtggtacatgggcatc

SEQ ID NO: 54561 - DNA, 25 bp, S. cerevisiae
tcgtggatgacggtaccatggacac

SEQ ID NO: 54562 - DNA, 25 bp, S. cerevisiae
tcccgtgccagaagttcctcaagaa

SEQ ID NO: 54563 - DNA, 25 bp, S. cerevisiae
tcggagtccagtggtttccaaaact

SEQ ID NO: 54564 - DNA, 25 bp, S. cerevisiae
tctgctagaaagctacgtgtccaca

SEQ ID NO: 54565 - DNA, 25 bp, S. cerevisiae
tctctaatgaacctatcctactcga

SEQ ID NO: 54566 - DNA, 25 bp, S. cerevisiae
tctcttctaagccaccagctaataa

SEQ ID NO: 54567 - DNA, 25 bp, S. cerevisiae
tcactaaacaccaacccaaactatt

SEQ ID NO: 54568 - DNA, 25 bp, S. cerevisiae
tattataaccctcaggcaggcacta

SEQ ID NO: 54569 - DNA, 25 bp, S. cerevisiae
tttaaccaacttacgcaggactaca

SEQ ID NO: 54570 - DNA, 25 bp, S. cerevisiae
tttcccctaccaaagagatttccat

SEQ ID NO: 54571 - DNA, 25 bp, S. cerevisiae
tatgtcccctgaaaccggttagtat

SEQ ID NO: 54572 - DNA, 25 bp, S. cerevisiae
tcgaccgggaaaaactgtactagtg

SEQ ID NO: 54573 - DNA, 25 bp, S. cerevisiae
tcgaccagtataacttcactaccac

SEQ ID NO: 54574 - DNA, 25 bp, S. cerevisiae
tcgcctttacctctgatcatattga

SEQ ID NO: 54575 - DNA, 25 bp, S. cerevisiae
tccctttggtcttgtatctttggca

SEQ ID NO: 54576 - DNA, 25 bp, S. cerevisiae
tcgccacttggcattgcatttaatg

SEQ ID NO: 54577 - DNA, 25 bp, S. cerevisiae
tcccgttacttttccgaatcagaca

SEQ ID NO: 54578 - DNA, 25 bp, S. cerevisiae
tctgacgattttgttccggttaaag

SEQ ID NO: 54579 - DNA, 25 bp, S. cerevisiae
tcgccagctccggtcttagaaaggg

SEQ ID NO: 54580 - DNA, 25 bp, S. cerevisiae
tctgtcagctgcaagactcccaaga

SEQ ID NO: 54581 - DNA, 25 bp, S. cerevisiae
tcgtgctgcaagagacttgttgaca

SEQ ID NO: 54582 - DNA, 25 bp, S. cerevisiae
tcgctgcatccgaagagcttgtaga

SEQ ID NO: 54583 - DNA, 25 bp, S. cerevisiae
tcagcagcatcgtcatcaacattat

SEQ ID NO: 54584 - DNA, 25 bp, S. cerevisiae
tcgcagccgcatccaagattttaag

SEQ ID NO: 54585 - DNA, 25 bp, S. cerevisiae
tccccagcaggcgtgtcttatagag

SEQ ID NO: 54586 - DNA, 25 bp, S. cerevisiae
tccccaggcagtttcgatgcaagag

SEQ ID NO: 54587 - DNA, 25 bp, S. cerevisiae
tcgtacgctgcggattcagaccaga

SEQ ID NO: 54588 - DNA, 25 bp, S. cerevisiae
tcggatccgcccacagatatatgat

SEQ ID NO: 54589 - DNA, 25 bp, S. cerevisiae
tcgaatccggacagtgcatatcata

SEQ ID NO: 54590 - DNA, 25 bp, S. cerevisiae
tctgccattgccgatgacgatgagg

SEQ ID NO: 54591 - DNA, 25 bp, S. cerevisiae
tcgtatgtgcgctatgatctgtgaa

SEQ ID NO: 54592 - DNA, 25 bp, S. cerevisiae
tcttcgtagtttttgtacagatcac

SEQ ID NO: 54593 - DNA, 25 bp, S. cerevisiae
tcccgctttacaacgcttctaatga

SEQ ID NO: 54594 - DNA, 25 bp, S. cerevisiae
tccccagtaaccagccattagatat

SEQ ID NO: 54595 - DNA, 25 bp, S. cerevisiae
tccctcaaaacgactctcaactaat

SEQ ID NO: 54596 - DNA, 25 bp, S. cerevisiae
tcccacacaaggtcttctcaggtaa

SEQ ID NO: 54597 - DNA, 25 bp, S. cerevisiae
tcccaacgagattccttcagagaga

SEQ ID NO: 54598 - DNA, 25 bp, S. cerevisiae
tccgaacctaacttcactgcaatat

SEQ ID NO: 54599 - DNA, 25 bp, S. cerevisiae
tcccttcaaggaaagagcggtcttt

SEQ ID NO: 54600 - DNA, 25 bp, S. cerevisiae
tcccgcttgctttgagattctgtat

SEQ ID NO: 54601 - DNA, 25 bp, S. cerevisiae
tcccgcttccagtagtgacattatg

SEQ ID NO: 54602 - DNA, 25 bp, S. cerevisiae
tcccatacatcttcataccttcaaa

SEQ ID NO: 54603 - DNA, 25 bp, S. cerevisiae
tccgccacatcaggtattgttccaa

SEQ ID NO: 54604 - DNA, 25 bp, S. cerevisiae
tcccctcgatacttttgtcaagcaa

SEQ ID NO: 54605 - DNA, 25 bp, S. cerevisiae
tccgccattgattctgttgattgca

SEQ ID NO: 54606 - DNA, 25 bp, S. cerevisiae
tccctcattcttggttgctagcaaa

SEQ ID NO: 54607 - DNA, 25 bp, S. cerevisiae
tcggctactccggtgtaaaacagga

SEQ ID NO: 54608 - DNA, 25 bp, S. cerevisiae
tcggtactcccgtctatttgaatcg

SEQ ID NO: 54609 - DNA, 25 bp, S. cerevisiae
tcgagtcgtccggtcgtttcaacaa

SEQ ID NO: 54610 - DNA, 25 bp, S. cerevisiae
tcccttcccatattctttgactaat

SEQ ID NO: 54611 - DNA, 25 bp, S. cerevisiae
tctccattccctttgcattgttgca

SEQ ID NO: 54612 - DNA, 25 bp, S. cerevisiae
tcgattattatcaggctagctctat

SEQ ID NO: 54613 - DNA, 25 bp, S. cerevisiae
tcgtccaagatcagggccgcattta

SEQ ID NO: 54614 - DNA, 25 bp, S. cerevisiae
tcgatttgaccggtaacactctgca

SEQ ID NO: 54615 - DNA, 25 bp, S. cerevisiae
tctttcataccgtccacgtcgaaaa

SEQ ID NO: 54616 - DNA, 25 bp, S. cerevisiae
taggctaccaaaataacgggaacat

SEQ ID NO: 54617 - DNA, 25 bp, S. cerevisiae
tagactgttggagaaaccggacaat

SEQ ID NO: 54618 - DNA, 25 bp, S. cerevisiae
tctattcgattatttccccgttact

SEQ ID NO: 54619 - DNA, 25 bp, S. cerevisiae
tcgctgtcgctttttacaccattta

SEQ ID NO: 54620 - DNA, 25 bp, S. cerevisiae
tcgcattaccacttaacgactttaa

SEQ ID NO: 54621 - DNA, 25 bp, S. cerevisiae
tcgcactagtcgcaggttcatttat

SEQ ID NO: 54622 - DNA, 25 bp, S. cerevisiae
tcgatatcaacgtaccactggcagg

SEQ ID NO: 54623 - DNA, 25 bp, S. cerevisiae
tcgggatccagattgcagttgcgca

SEQ ID NO: 54624 - DNA, 25 bp, S. cerevisiae
tcgattgctgttttgagtgccatga

SEQ ID NO: 54625 - DNA, 25 bp, S. cerevisiae
tcgtcgcgccttttgaactagtgaa

SEQ ID NO: 54626 - DNA, 25 bp, S. cerevisiae
tctttccctgggtcaacattcaaaa

SEQ ID NO: 54627 - DNA, 25 bp, S. cerevisiae
tctggcccgtgttagaggtggtact

SEQ ID NO: 54628 - DNA, 25 bp, S. cerevisiae
tcgttaaggccgtttctgacagagt

SEQ ID NO: 54629 - DNA, 25 bp, S. cerevisiae
tcgttattccccaattttcaagaga

SEQ ID NO: 54630 - DNA, 25 bp, S. cerevisiae
tcgagtacagcattaattccatttt

SEQ ID NO: 54631 - DNA, 25 bp, S. cerevisiae
tcaggtcatacagacattccctaag

SEQ ID NO: 54632 - DNA, 25 bp, S. cerevisiae
tcgtcttcatccattactacttcat

SEQ ID NO: 54633 - DNA, 25 bp, S. cerevisiae
tcgcaattttctactaccattcaca

SEQ ID NO: 54634 - DNA, 25 bp, S. cerevisiae
tcccggatctggtaagactagcttt

SEQ ID NO: 54635 - DNA, 25 bp, S. cerevisiae
tcgatgctgctgaccctgaaagatt

SEQ ID NO: 54636 - DNA, 25 bp, S. cerevisiae
tcgcaggtgatatcaactcagacta

SEQ ID NO: 54637 - DNA, 25 bp, S. cerevisiae
tcgggtacagtgttggatcttccat

SEQ ID NO: 54638 - DNA, 25 bp, S. cerevisiae
tcggcattatgacctcgtagttaac

SEQ ID NO: 54639 - DNA, 25 bp, S. cerevisiae
tcgaggttccgattaggtttctcaa

SEQ ID NO: 54640 - DNA, 25 bp, S. cerevisiae
tctccgcatagaacagaagcctcga

SEQ ID NO: 54641 - DNA, 25 bp, S. cerevisiae
tcagacgatataacgggactcatgg

SEQ ID NO: 54642 - DNA, 25 bp, S. cerevisiae
tcgtctctcaatccgggagcagcag

SEQ ID NO: 54643 - DNA, 25 bp, S. cerevisiae
tcggtactggtaagagattggctaa

SEQ ID NO: 54644 - DNA, 25 bp, S. cerevisiae
tcgcctacggtaataagcttgtcat

SEQ ID NO: 54645 - DNA, 25 bp, S. cerevisiae
tctcccaagggaaactctattattg

SEQ ID NO: 54646 - DNA, 25 bp, S. cerevisiae
tcgccagaggagtacgttgtcaaat

SEQ ID NO: 54647 - DNA, 25 bp, S. cerevisiae
tcgtcgttaactgcatttccattat

SEQ ID NO: 54648 - DNA, 25 bp, S. cerevisiae
tcgtcgtttcgcatgatttcagatt

SEQ ID NO: 54649 - DNA, 25 bp, S. cerevisiae
tcgtcgtctacgttacattgagtgg

SEQ ID NO: 54650 - DNA, 25 bp, S. cerevisiae
tcgccgtccacatcttctaatatgg

SEQ ID NO: 54651 - DNA, 25 bp, S. cerevisiae
tcgcccgtcaatagatctcacaatt

SEQ ID NO: 54652 - DNA, 25 bp, S. cerevisiae
tcgagcagcgccattgtcaatcaac

SEQ ID NO: 54653 - DNA, 25 bp, S. cerevisiae
tcgcagcccgagtatgagcatatct

SEQ ID NO: 54654 - DNA, 25 bp, S. cerevisiae
tctgccgacgattatgctcaatatt

SEQ ID NO: 54655 - DNA, 25 bp, S. cerevisiae
tctccaaggctctatccaaagatgg

SEQ ID NO: 54656 - DNA, 25 bp, S. cerevisiae
tctgtggtggtgtcctcaaggcatc

SEQ ID NO: 54657 - DNA, 25 bp, S. cerevisiae
tcatgtgagggcttacgcaacgcat

SEQ ID NO: 54658 - DNA, 25 bp, S. cerevisiae
tctcgtggtgcgtggtactttgaaa

SEQ ID NO: 54659 - DNA, 25 bp, S. cerevisiae
tctgttggtaagcttggtggtccct

SEQ ID NO: 54660 - DNA, 25 bp, S. cerevisiae
tctgtacgaaggtctggagtggtta

SEQ ID NO: 54661 - DNA, 25 bp, S. cerevisiae
tcgtacgacacctttgttggctaca

SEQ ID NO: 54662 - DNA, 25 bp, S. cerevisiae
tcccacagttcgctttatggtacaa

SEQ ID NO: 54663 - DNA, 25 bp, S. cerevisiae
tctctagagatgtcccagataatgg

SEQ ID NO: 54664 - DNA, 25 bp, S. cerevisiae
tctgccgccatgatcctagttaaga

SEQ ID NO: 54665 - DNA, 25 bp, S. cerevisiae
tctgccgttgattccaagcttgttg

SEQ ID NO: 54666 - DNA, 25 bp, S. cerevisiae
tcgtccattcattcagcacagtgtt

SEQ ID NO: 54667 - DNA, 25 bp, S. cerevisiae
tcgacaaattgatcacactcctcta

SEQ ID NO: 54668 - DNA, 25 bp, S. cerevisiae
tcgcctatgttacagctagacccaa

SEQ ID NO: 54669 - DNA, 25 bp, S. cerevisiae
tcgcggtcgttttctaaacaaatat

SEQ ID NO: 54670 - DNA, 25 bp, S. cerevisiae
tcgggtctcttttacagcacacaaa

SEQ ID NO: 54671 - DNA, 25 bp, S. cerevisiae
tacggtactactgcacaacaaactt

SEQ ID NO: 54672 - DNA, 25 bp, S. cerevisiae
tacaactgagtacacgccctaatat

SEQ ID NO: 54673 - DNA, 25 bp, S. cerevisiae
tcgcgctggcaatccgtatacggtg

SEQ ID NO: 54674 - DNA, 25 bp, S. cerevisiae
tcgcagtggcagtttcggaacgcta

SEQ ID NO: 54675 - DNA, 25 bp, S. cerevisiae
tcgcgtctgctgtgtcgttacagaa

SEQ ID NO: 54676 - DNA, 25 bp, S. cerevisiae
tcgcgctacgggtctgattacaaca

SEQ ID NO: 54677 - DNA, 25 bp, S. cerevisiae
tcgcctcctcacatggatattcaaa

SEQ ID NO: 54678 - DNA, 25 bp, S. cerevisiae
tctaacccacgtcgatcttattgaa

SEQ ID NO: 54679 - DNA, 25 bp, S. cerevisiae
tcgcgatccatcgaaaatcttttct

SEQ ID NO: 54680 - DNA, 25 bp, S. cerevisiae
tcgttagccgcatattctgtcattt

SEQ ID NO: 54681 - DNA, 25 bp, S. cerevisiae
tcagttcctggagattttttcattt

SEQ ID NO: 54682 - DNA, 25 bp, S. cerevisiae
tcgatggttttcttttctttcagtt

SEQ ID NO: 54683 - DNA, 25 bp, S. cerevisiae
tcgctcctcgtgtactttgatagaa

SEQ ID NO: 54684 - DNA, 25 bp, S. cerevisiae
tcgcttctatctatgccttgcaaaa

SEQ ID NO: 54685 - DNA, 25 bp, S. cerevisiae
tctgcctttggcactgatagttgtg

SEQ ID NO: 54686 - DNA, 25 bp, S. cerevisiae
tcgccatcattgtagtcgttgttgt

SEQ ID NO: 54687 - DNA, 25 bp, S. cerevisiae
tctactcatgataaggcgattgccg

SEQ ID NO: 54688 - DNA, 25 bp, S. cerevisiae
tcagatacataattccagacccggt

SEQ ID NO: 54689 - DNA, 25 bp, S. cerevisiae
tcgaaacacagcaatggtcccggat

SEQ ID NO: 54690 - DNA, 25 bp, S. cerevisiae
tctcgactttaacactttggcccaa

SEQ ID NO: 54691 - DNA, 25 bp, S. cerevisiae
tttgaaatttgtcacgtccgttccg

SEQ ID NO: 54692 - DNA, 25 bp, S. cerevisiae
ttcaaaattttctcggctgttcccg

SEQ ID NO: 54693 - DNA, 25 bp, S. cerevisiae
tctacaacattttcaggccggttcc

SEQ ID NO: 54694 - DNA, 25 bp, S. cerevisiae
tctataatttttctacggtctcctt

SEQ ID NO: 54695 - DNA, 25 bp, S. cerevisiae
tcgcatatttttgccttcgagttcc

SEQ ID NO: 54696 - DNA, 25 bp, S. cerevisiae
tcgttattccatgccatacaggtta

SEQ ID NO: 54697 - DNA, 25 bp, S. cerevisiae
tcgctgccccagtgactttgaaata

SEQ ID NO: 54698 - DNA, 25 bp, S. cerevisiae
tcaacactaggatatcttcggaaaa

SEQ ID NO: 54699 - DNA, 25 bp, S. cerevisiae
tcgaaatcggctttttcacgaacaa

SEQ ID NO: 54700 - DNA, 25 bp, S. cerevisiae
tcaccaaccttctttagttcgtaca

SEQ ID NO: 54701 - DNA, 25 bp, S. cerevisiae
tctaaactctatcttctcttggcaa

SEQ ID NO: 54702 - DNA, 25 bp, S. cerevisiae
tctgctgacaacatgcttccaaatt

SEQ ID NO: 54703 - DNA, 25 bp, S. cerevisiae
tcgctgggacatggtggccaacaat

SEQ ID NO: 54704 - DNA, 25 bp, S. cerevisiae
tcgcactgagggtggaccgtcaagt

SEQ ID NO: 54705 - DNA, 25 bp, S. cerevisiae
tcgaccggtttgtagcctgtgacag

SEQ ID NO: 54706 - DNA, 25 bp, S. cerevisiae
tcgctttgttgatgactgacccgga

SEQ ID NO: 54707 - DNA, 25 bp, S. cerevisiae
tcgacatcattaaagggtacaccat

SEQ ID NO: 54708 - DNA, 25 bp, S. cerevisiae
tcgactcttttaccgatatcctaaa

SEQ ID NO: 54709 - DNA, 25 bp, S. cerevisiae
tctgttttttacctgtaccgataca

SEQ ID NO: 54710 - DNA, 25 bp, S. cerevisiae
tcgtttgttgacctatacctctgtt

SEQ ID NO: 54711 - DNA, 25 bp, S. cerevisiae
tctgtttattttggtacttccgctt

SEQ ID NO: 54712 - DNA, 25 bp, S. cerevisiae
tcgtctttgattcatttgcgcccgt

SEQ ID NO: 54713 - DNA, 25 bp, S. cerevisiae
tcgcttctgctacctcaaatactag

SEQ ID NO: 54714 - DNA, 25 bp, S. cerevisiae
tctgttttcagacatacattctatg

SEQ ID NO: 54715 - DNA, 25 bp, S. cerevisiae
tcggtttcagaacccaatttggtgg

SEQ ID NO: 54716 - DNA, 25 bp, S. cerevisiae
tcggtttcaaaccactttatcgttg

SEQ ID NO: 54717 - DNA, 25 bp, S. cerevisiae
tcggttttcaatttctttcattttg

SEQ ID NO: 54718 - DNA, 25 bp, S. cerevisiae
tcggtattttcgttcttgctttctt

SEQ ID NO: 54719 - DNA, 25 bp, S. cerevisiae
tcgttgcattttacccttatttact

SEQ ID NO: 54720 - DNA, 25 bp, S. cerevisiae
tcgggttttccagcatgttcttgat

SEQ ID NO: 54721 - DNA, 25 bp, S. cerevisiae
tcggtgtttctcatcctggattaga

SEQ ID NO: 54722 - DNA, 25 bp, S. cerevisiae
tcagggcctgtctcttgtgttaaag

SEQ ID NO: 54723 - DNA, 25 bp, S. cerevisiae
tcgcacgccagttgcttttcaataa

SEQ ID NO: 54724 - DNA, 25 bp, S. cerevisiae
tcgcagaattaggtacgtccggttc

SEQ ID NO: 54725 - DNA, 25 bp, S. cerevisiae
tcgactttacgaacgcatacggttt

SEQ ID NO: 54726 - DNA, 25 bp, S. cerevisiae
tcgactttcatggtactaaggtttc

SEQ ID NO: 54727 - DNA, 25 bp, S. cerevisiae
tcgatttaccagaagctacctgttt

SEQ ID NO: 54728 - DNA, 25 bp, S. cerevisiae
tcgaagtctcggaaaacagaccccg

SEQ ID NO: 54729 - DNA, 25 bp, S. cerevisiae
tcgaagtcaacagtaacatcgcact

SEQ ID NO: 54730 - DNA, 25 bp, S. cerevisiae
tctacagttattgaagcagcggcac

SEQ ID NO: 54731 - DNA, 25 bp, S. cerevisiae
tcgacacttattggaatcgcgatgt

SEQ ID NO: 54732 - DNA, 25 bp, S. cerevisiae
tcgacctaatcttactcggatgcgg

SEQ ID NO: 54733 - DNA, 25 bp, S. cerevisiae
tttcctattgtccacaagggcggca

SEQ ID NO: 54734 - DNA, 25 bp, S. cerevisiae
tcttacagggttcacaggcgggctc

SEQ ID NO: 54735 - DNA, 25 bp, S. cerevisiae
tctgataacggcagcgacggtagtg

SEQ ID NO: 54736 - DNA, 25 bp, S. cerevisiae
tctgtaacgcctttgagacctcaag

SEQ ID NO: 54737 - DNA, 25 bp, S. cerevisiae
tctggtaccctacgtgttctaaaag

SEQ ID NO: 54738 - DNA, 25 bp, S. cerevisiae
tctggcgaaattaagacagtcttca

SEQ ID NO: 54739 - DNA, 25 bp, S. cerevisiae
tctgagtctaatcgccaaggcctat

SEQ ID NO: 54740 - DNA, 25 bp, S. cerevisiae
tcgttctcagaggtcaagcgcttat

SEQ ID NO: 54741 - DNA, 25 bp, S. cerevisiae
tctgacgccgatttgaacctttcga

SEQ ID NO: 54742 - DNA, 25 bp, S. cerevisiae
tctaggtgtgtctgatactcctgcc

SEQ ID NO: 54743 - DNA, 25 bp, S. cerevisiae
tcgatgctacgccatctgaggatga

SEQ ID NO: 54744 - DNA, 25 bp, S. cerevisiae
tcgcagctactgttttgtggcatat

SEQ ID NO: 54745 - DNA, 25 bp, S. cerevisiae
tcgcaggtgctggtgttatctcaat

SEQ ID NO: 54746 - DNA, 25 bp, S. cerevisiae
tcgggttttcttaccatcttggagt

SEQ ID NO: 54747 - DNA, 25 bp, S. cerevisiae
tcgttttctactttggtgctcatag

SEQ ID NO: 54748 - DNA, 25 bp, S. cerevisiae
tcgttcctcatggtttgattgccta

SEQ ID NO: 54749 - DNA, 25 bp, S. cerevisiae
tcgttgttagcgtttgtctgcgtaa

SEQ ID NO: 54750 - DNA, 25 bp, S. cerevisiae
tcgcaagcactagttacgggcatgt

SEQ ID NO: 54751 - DNA, 25 bp, S. cerevisiae
tctaagcaggaaaacggaggcattt

SEQ ID NO: 54752 - DNA, 25 bp, S. cerevisiae
tctcgacaccgaatcccgtaaatat

SEQ ID NO: 54753 - DNA, 25 bp, S. cerevisiae
tcggcaaggttcatatcgggtatat

SEQ ID NO: 54754 - DNA, 25 bp, S. cerevisiae
tcggagaggattgctgacaggttca

SEQ ID NO: 54755 - DNA, 25 bp, S. cerevisiae
tctggaacaaagatgaacgctggca

SEQ ID NO: 54756 - DNA, 25 bp, S. cerevisiae
tcatggtaaggacgccgccggcaaa

SEQ ID NO: 54757 - DNA, 25 bp, S. cerevisiae
tcggcggactagttgcatgcacaga

SEQ ID NO: 54758 - DNA, 25 bp, S. cerevisiae
tcggatggtctctctgcattaatgg

SEQ ID NO: 54759 - DNA, 25 bp, S. cerevisiae
tctatggtgtcgctttgtttggtac

SEQ ID NO: 54760 - DNA, 25 bp, S. cerevisiae
tcgtctgtatcttcgtctggttcat

SEQ ID NO: 54761 - DNA, 25 bp, S. cerevisiae
tcgtagggcttcttctgatggatat

SEQ ID NO: 54762 - DNA, 25 bp, S. cerevisiae
tcgtagcgtttccttatgtgttcaa

SEQ ID NO: 54763 - DNA, 25 bp, S. cerevisiae
tcgaggcagcgagattgctcttgtt

SEQ ID NO: 54764 - DNA, 25 bp, S. cerevisiae
tcgagccacgccaattgtctaattt

SEQ ID NO: 54765 - DNA, 25 bp, S. cerevisiae
tcgaccagcgcctatgtatattttg

SEQ ID NO: 54766 - DNA, 25 bp, S. cerevisiae
tctgcagccgcgactagtatcgata

SEQ ID NO: 54767 - DNA, 25 bp, S. cerevisiae
tcgaggtcgtgctatgttgagaaac

SEQ ID NO: 54768 - DNA, 25 bp, S. cerevisiae
tcgatatgcttcgttcattcatgaa

SEQ ID NO: 54769 - DNA, 25 bp, S. cerevisiae
tcgtctatcacttctgtgaccacaa

SEQ ID NO: 54770 - DNA, 25 bp, S. cerevisiae
tcgattacctctcctctgatgagga

SEQ ID NO: 54771 - DNA, 25 bp, S. cerevisiae
tctcctactgctaccgatataaact

SEQ ID NO: 54772 - DNA, 25 bp, S. cerevisiae
tcggctgtcgctggctttataaatc

SEQ ID NO: 54773 - DNA, 25 bp, S. cerevisiae
tcgaatggaggccttgtacacaatt

SEQ ID NO: 54774 - DNA, 25 bp, S. cerevisiae
tcgatgtggcggttagcttactaat

SEQ ID NO: 54775 - DNA, 25 bp, S. cerevisiae
tcggtgatgtttccaacttgccata

SEQ ID NO: 54776 - DNA, 25 bp, S. cerevisiae
tcggcagatttctcacctcaagaag

SEQ ID NO: 54777 - DNA, 25 bp, S. cerevisiae
tcggcttcttgttcgagcagttcaa

SEQ ID NO: 54778 - DNA, 25 bp, S. cerevisiae
tctcctgtaagacttctggtacctt

SEQ ID NO: 54779 - DNA, 25 bp, S. cerevisiae
tctcttgctgaataccgacttggaa

SEQ ID NO: 54780 - DNA, 25 bp, S. cerevisiae
tctgtgttttactacgcctacgaat

SEQ ID NO: 54781 - DNA, 25 bp, S. cerevisiae
tcgtcctgccttgatttatttttag

SEQ ID NO: 54782 - DNA, 25 bp, S. cerevisiae
tcgtccccttttttgcagatttggt

SEQ ID NO: 54783 - DNA, 25 bp, S. cerevisiae
tcttccaggcttctaccagaattgg

SEQ ID NO: 54784 - DNA, 25 bp, S. cerevisiae
tctccaccatttattcctcaattag

SEQ ID NO: 54785 - DNA, 25 bp, S. cerevisiae
tctcaaggtgctacttatcctccaa

SEQ ID NO: 54786 - DNA, 25 bp, S. cerevisiae
tataacgacgatgcatacgacctcc

SEQ ID NO: 54787 - DNA, 25 bp, S. cerevisiae
tcaaacgaaggttcctggcccctag

SEQ ID NO: 54788 - DNA, 25 bp, S. cerevisiae
tctaactaattttgccatggcctcc

SEQ ID NO: 54789 - DNA, 25 bp, S. cerevisiae
tcttcctgaatctgatgctcgttct

SEQ ID NO: 54790 - DNA, 25 bp, S. cerevisiae
tcgtttcgcacacatcttgactgaa

SEQ ID NO: 54791 - DNA, 25 bp, S. cerevisiae
tcggtattgcccctcttgaaatcaa

SEQ ID NO: 54792 - DNA, 25 bp, S. cerevisiae
tcggctactgcaacccttgagaaaa

SEQ ID NO: 54793 - DNA, 25 bp, S. cerevisiae
tcgactactcgattccattggaaaa

SEQ ID NO: 54794 - DNA, 25 bp, S. cerevisiae
tcgttcagcacatttcctatcggat

SEQ ID NO: 54795 - DNA, 25 bp, S. cerevisiae
tctcgttattgcgtatgaacccttt

SEQ ID NO: 54796 - DNA, 25 bp, S. cerevisiae
tttggcgcagatgttgattcagggt

SEQ ID NO: 54797 - DNA, 25 bp, S. cerevisiae
tcttgggcagatctttctcggagga

SEQ ID NO: 54798 - DNA, 25 bp, S. cerevisiae
tcgtttgcggtacttctgcatgaaa

SEQ ID NO: 54799 - DNA, 25 bp, S. cerevisiae
tcgtgacgggtcttatactgaattg

SEQ ID NO: 54800 - DNA, 25 bp, S. cerevisiae
tcgtcaccgttgtcggagagttgca

SEQ ID NO: 54801 - DNA, 25 bp, S. cerevisiae
tctccgttcaggcagcagtaatgat

SEQ ID NO: 54802 - DNA, 25 bp, S. cerevisiae
tctccagtattccaccttacatgaa

SEQ ID NO: 54803 - DNA, 25 bp, S. cerevisiae
tcgtcgttacattccaccttgaaaa

SEQ ID NO: 54804 - DNA, 25 bp, S. cerevisiae
tcggattaacattatcacctgataa

SEQ ID NO: 54805 - DNA, 25 bp, S. cerevisiae
tctgagcgatatgccttctttgtga

SEQ ID NO: 54806 - DNA, 25 bp, S. cerevisiae
tcggcacattggcatttcctatgac

SEQ ID NO: 54807 - DNA, 25 bp, S. cerevisiae
tcgttttcagcatttatcacagcat

SEQ ID NO: 54808 - DNA, 25 bp, S. cerevisiae
tcgtttccagattgacaccacagtc

SEQ ID NO: 54809 - DNA, 25 bp, S. cerevisiae
tctttcacccacttccaatattagt

SEQ ID NO: 54810 - DNA, 25 bp, S. cerevisiae
tctctgtccactatcgctaataatg

SEQ ID NO: 54811 - DNA, 25 bp, S. cerevisiae
tctggtgccgcatctggtataattg

SEQ ID NO: 54812 - DNA, 25 bp, S. cerevisiae
tcgttcaattcatccaacaacactc

SEQ ID NO: 54813 - DNA, 25 bp, S. cerevisiae
tcgatgtctcttctccaactgaaaa

SEQ ID NO: 54814 - DNA, 25 bp, S. cerevisiae
tcgagactcttgacccagcattaat

SEQ ID NO: 54815 - DNA, 25 bp, S. cerevisiae
tctgaacgcctgaccgctgaaaaaa

SEQ ID NO: 54816 - DNA, 25 bp, S. cerevisiae
tcttctacggatgacgtcacgtcga

SEQ ID NO: 54817 - DNA, 25 bp, S. cerevisiae
tcgtttccaatcacagttcgtcatt

SEQ ID NO: 54818 - DNA, 25 bp, S. cerevisiae
tcttgtctctaaaggcgctgttgtt

SEQ ID NO: 54819 - DNA, 25 bp, S. cerevisiae
tcttctttagcttgttggttgttcc

SEQ ID NO: 54820 - DNA, 25 bp, S. cerevisiae
tcgaggaatactccgataccatttg

SEQ ID NO: 54821 - DNA, 25 bp, S. cerevisiae
tcgtcatgagtatccgttctccaag

SEQ ID NO: 54822 - DNA, 25 bp, S. cerevisiae
tttgcagcagtatcacttgggtaac

SEQ ID NO: 54823 - DNA, 25 bp, S. cerevisiae
tcgatgtctcttgctggtcttttac

SEQ ID NO: 54824 - DNA, 25 bp, S. cerevisiae
tctgatgttaggtccttcttgcttt

SEQ ID NO: 54825 - DNA, 25 bp, S. cerevisiae
tcttcccctggaactgaaagctatc

SEQ ID NO: 54826 - DNA, 25 bp, S. cerevisiae
tctgcgcttattccgagactcaatt

SEQ ID NO: 54827 - DNA, 25 bp, S. cerevisiae
tcgtcttatctggtaactctgttga

SEQ ID NO: 54828 - DNA, 25 bp, S. cerevisiae
tcggctgctgtcaaacaacttttag

SEQ ID NO: 54829 - DNA, 25 bp, S. cerevisiae
tcggtctctgcagttcaatttcatt

SEQ ID NO: 54830 - DNA, 25 bp, S. cerevisiae
tcgaggagcccagtgcaagcattat

SEQ ID NO: 54831 - DNA, 25 bp, S. cerevisiae
tcgatgtcacatccagaatcactta

SEQ ID NO: 54832 - DNA, 25 bp, S. cerevisiae
tcagatatccattcacaatcggtga

SEQ ID NO: 54833 - DNA, 25 bp, S. cerevisiae
tcgatgcattattagcccttggtgt

SEQ ID NO: 54834 - DNA, 25 bp, S. cerevisiae
tcgtgcaaatcatgcgcagttattt

SEQ ID NO: 54835 - DNA, 25 bp, S. cerevisiae
tctggcgatatcaaggctgctgctt

SEQ ID NO: 54836 - DNA, 25 bp, S. cerevisiae
tcggcgcaatgatgagttgctcttt

SEQ ID NO: 54837 - DNA, 25 bp, S. cerevisiae
tcggctactgtatttgttcggtgca

SEQ ID NO: 54838 - DNA, 25 bp, S. cerevisiae
tcgtgcaatctgatacatgtccctc

SEQ ID NO: 54839 - DNA, 25 bp, S. cerevisiae
tcgatcaaatcgtggcagcggtacc

SEQ ID NO: 54840 - DNA, 25 bp, S. cerevisiae
tcgtcaatattttcggcggtatcgt

SEQ ID NO: 54841 - DNA, 25 bp, S. cerevisiae
tcgtggccaatccatctgggtttag

SEQ ID NO: 54842 - DNA, 25 bp, S. cerevisiae
tcggagcgtgctttgatgagaactt

SEQ ID NO: 54843 - DNA, 25 bp, S. cerevisiae
tctggacccctagtaagatcgtcat

SEQ ID NO: 54844 - DNA, 25 bp, S. cerevisiae
tctgaccgctggctatcaattgggt

SEQ ID NO: 54845 - DNA, 25 bp, S. cerevisiae
tctccttgctttcccaatttgttta

SEQ ID NO: 54846 - DNA, 25 bp, S. cerevisiae
ttagcgtattttctcgattgccctg

SEQ ID NO: 54847 - DNA, 25 bp, S. cerevisiae
tctacttttaagaataacgcgactt

SEQ ID NO: 54848 - DNA, 25 bp, S. cerevisiae
tctcgttcttaggaatcaactgcgt

SEQ ID NO: 54849 - DNA, 25 bp, S. cerevisiae
tcttcgacttcgttttcacttgtga

SEQ ID NO: 54850 - DNA, 25 bp, S. cerevisiae
tctatcgaccgtgttttccgtaacg

SEQ ID NO: 54851 - DNA, 25 bp, S. cerevisiae
tcgttaccgtgaagtttctcctgag

SEQ ID NO: 54852 - DNA, 25 bp, S. cerevisiae
tcgtcccgctactgtgtatcttttg

SEQ ID NO: 54853 - DNA, 25 bp, S. cerevisiae
tctgttcgttgccttgtttatgtgg

SEQ ID NO: 54854 - DNA, 25 bp, S. cerevisiae
tcgtccgttcgctttactgtaaatg

SEQ ID NO: 54855 - DNA, 25 bp, S. cerevisiae
tcgtccttgtctcgattttttcaac

SEQ ID NO: 54856 - DNA, 25 bp, S. cerevisiae
tcggttcctctttcgatgctttgaa

SEQ ID NO: 54857 - DNA, 25 bp, S. cerevisiae
tctagttccaggtaccgtcttgatc

SEQ ID NO: 54858 - DNA, 25 bp, S. cerevisiae
tcgtcgcttgggtcactcaaggaaa

SEQ ID NO: 54859 - DNA, 25 bp, S. cerevisiae
tcgtcgatgtcgctatcccatgtaa

SEQ ID NO: 54860 - DNA, 25 bp, S. cerevisiae
tcgttcatctctcgcttcaaagtaa

SEQ ID NO: 54861 - DNA, 25 bp, S. cerevisiae
tctgtgaatacggaacgcttcgctt

SEQ ID NO: 54862 - DNA, 25 bp, S. cerevisiae
tctagcttcaccaaattctaccttt

SEQ ID NO: 54863 - DNA, 25 bp, S. cerevisiae
tcgtctatgattataaccgccacta

SEQ ID NO: 54864 - DNA, 25 bp, S. cerevisiae
tctgatttcattttacaaggccaca

SEQ ID NO: 54865 - DNA, 25 bp, S. cerevisiae
tctcctggcgatgaagacgtacctg

SEQ ID NO: 54866 - DNA, 25 bp, S. cerevisiae
tctgcctggaggaaagctggtatat

SEQ ID NO: 54867 - DNA, 25 bp, S. cerevisiae
tctgccgtaggaaacttcttctcga

SEQ ID NO: 54868 - DNA, 25 bp, S. cerevisiae
tctgctcgctaccattgaggttatt

SEQ ID NO: 54869 - DNA, 25 bp, S. cerevisiae
tctccgcagactccaaagttcataa

SEQ ID NO: 54870 - DNA, 25 bp, S. cerevisiae
tcgtctattctgaagctgaaccaaa

SEQ ID NO: 54871 - DNA, 25 bp, S. cerevisiae
tctggctgctcaaaatgttcgtctt

SEQ ID NO: 54872 - DNA, 25 bp, S. cerevisiae
tcggtttgaaccctgacattttaga

SEQ ID NO: 54873 - DNA, 25 bp, S. cerevisiae
tcggctcttcaaccttgacatgtat

SEQ ID NO: 54874 - DNA, 25 bp, S. cerevisiae
tctgaatctgatatggacgatgcca

SEQ ID NO: 54875 - DNA, 25 bp, S. cerevisiae
tctgctatcggtaggactggccaat

SEQ ID NO: 54876 - DNA, 25 bp, S. cerevisiae
tcttaggtgtgcgtcagtgtgccaa

SEQ ID NO: 54877 - DNA, 25 bp, S. cerevisiae
tctgtacctagcgtagattccataa

SEQ ID NO: 54878 - DNA, 25 bp, S. cerevisiae
tcgtacaccagcctagatacctatg

SEQ ID NO: 54879 - DNA, 25 bp, S. cerevisiae
tcgtagggactatatcaccagactg

SEQ ID NO: 54880 - DNA, 25 bp, S. cerevisiae
tctgtcagggacatcaagccaagtt

SEQ ID NO: 54881 - DNA, 25 bp, S. cerevisiae
tcgggaaacttctggatggctctaa

SEQ ID NO: 54882 - DNA, 25 bp, S. cerevisiae
tcgtgttggacttcatcggtggtta

SEQ ID NO: 54883 - DNA, 25 bp, S. cerevisiae
tcttgtttcaagaggcatcccagat

SEQ ID NO: 54884 - DNA, 25 bp, S. cerevisiae
tctgattgagactagcggccatcca

SEQ ID NO: 54885 - DNA, 25 bp, S. cerevisiae
tctagagacaagctggctcaccatt

SEQ ID NO: 54886 - DNA, 25 bp, S. cerevisiae
tcttgatgacgttaaggtgcaacct

SEQ ID NO: 54887 - DNA, 25 bp, S. cerevisiae
tcatcagtgatgttgccagtgttgc

SEQ ID NO: 54888 - DNA, 25 bp, S. cerevisiae
tcgtgtggtcatgcattttgtggta

SEQ ID NO: 54889 - DNA, 25 bp, S. cerevisiae
tcgtttgctgctactggttggagaa

SEQ ID NO: 54890 - DNA, 25 bp, S. cerevisiae
tcgtttggtactggttccaaccacg

SEQ ID NO: 54891 - DNA, 25 bp, S. cerevisiae
tttcgggtcaacgtttagtccactg

SEQ ID NO: 54892 - DNA, 25 bp, S. cerevisiae
tcttgtgagtacttcgtttgcggca

SEQ ID NO: 54893 - DNA, 25 bp, S. cerevisiae
tctgtcatccgttacatccaagagt

SEQ ID NO: 54894 - DNA, 25 bp, S. cerevisiae
tctgtctctgatggatgcctgccaa

SEQ ID NO: 54895 - DNA, 25 bp, S. cerevisiae
tctggttctctcacccaagaagata

SEQ ID NO: 54896 - DNA, 25 bp, S. cerevisiae
tctatacttgccgaacaacagctaa

SEQ ID NO: 54897 - DNA, 25 bp, S. cerevisiae
tctgctcttgatgaaatggtcgcta

SEQ ID NO: 54898 - DNA, 25 bp, S. cerevisiae
tcgtcattactaacagatctctcta

SEQ ID NO: 54899 - DNA, 25 bp, S. cerevisiae
tcgtcgcgaaatatggtcactggca

SEQ ID NO: 54900 - DNA, 25 bp, S. cerevisiae
tcgtcagagctttcttgattgaaga

SEQ ID NO: 54901 - DNA, 25 bp, S. cerevisiae
tctgccaggatagcttttgacaatt

SEQ ID NO: 54902 - DNA, 25 bp, S. cerevisiae
tctcctatcacatcagcgtctgagc

SEQ ID NO: 54903 - DNA, 25 bp, S. cerevisiae
tctccatacgcacaagtggctgttt

SEQ ID NO: 54904 - DNA, 25 bp, S. cerevisiae
tctctgtgggagtaatcggttctgt

SEQ ID NO: 54905 - DNA, 25 bp, S. cerevisiae
tcatttacagtggtgtctgggaact

SEQ ID NO: 54906 - DNA, 25 bp, S. cerevisiae
ttagtactggtgttgatgggcaagc

SEQ ID NO: 54907 - DNA, 25 bp, S. cerevisiae
tcgtccagctggtatttttggccca

SEQ ID NO: 54908 - DNA, 25 bp, S. cerevisiae
tctacggttatcatgttcgaccacc

SEQ ID NO: 54909 - DNA, 25 bp, S. cerevisiae
tctaccggtccatttgttactcaaa

SEQ ID NO: 54910 - DNA, 25 bp, S. cerevisiae
tcggccgtgtcgttttgatcaaaaa

SEQ ID NO: 54911 - DNA, 25 bp, S. cerevisiae
tctggttctttgtgctttcgcaata

SEQ ID NO: 54912 - DNA, 25 bp, S. cerevisiae
tcggtgctcaaaacgcctacttgaa

SEQ ID NO: 54913 - DNA, 25 bp, S. cerevisiae
tctccgcctaactatgccaaggatg

SEQ ID NO: 54914 - DNA, 25 bp, S. cerevisiae
tctctgccagaacgctcgagcagcg

SEQ ID NO: 54915 - DNA, 25 bp, S. cerevisiae
tctcacctgatcaattgcgctggaa

SEQ ID NO: 54916 - DNA, 25 bp, S. cerevisiae
tctgaacagcacaatgtcctcgaca

SEQ ID NO: 54917 - DNA, 25 bp, S. cerevisiae
tctgcaagcagcaacggacatcctt

SEQ ID NO: 54918 - DNA, 25 bp, S. cerevisiae
tctgcagaaacacgatgaatccttt

SEQ ID NO: 54919 - DNA, 25 bp, S. cerevisiae
tctgatgaacagctgaactccttgg

SEQ ID NO: 54920 - DNA, 25 bp, S. cerevisiae
tctttggcttcccaagtggacgtaa

SEQ ID NO: 54921 - DNA, 25 bp, S. cerevisiae
tcttgttttctcacccagcagattt

SEQ ID NO: 54922 - DNA, 25 bp, S. cerevisiae
tctttcgtcctaggcaccggtattt

SEQ ID NO: 54923 - DNA, 25 bp, S. cerevisiae
tcacgtttctgttgttttggccaat

SEQ ID NO: 54924 - DNA, 25 bp, S. cerevisiae
tcatccagggtttggctgttggcta

SEQ ID NO: 54925 - DNA, 25 bp, S. cerevisiae
tattcagggttaccggtgacgctcc

SEQ ID NO: 54926 - DNA, 25 bp, S. cerevisiae
tcttagggattaccggtctggctac

SEQ ID NO: 54927 - DNA, 25 bp, S. cerevisiae
tctaatgggttttcgtgctctgagc

SEQ ID NO: 54928 - DNA, 25 bp, S. cerevisiae
tctagatgtcgtattggtgcctgga

SEQ ID NO: 54929 - DNA, 25 bp, S. cerevisiae
tctgctgcagcacccattttaaagg

SEQ ID NO: 54930 - DNA, 25 bp, S. cerevisiae
tcacactcgcactcggatgaaatct

SEQ ID NO: 54931 - DNA, 25 bp, S. cerevisiae
tctcccactgtgtcgatgaaccata

SEQ ID NO: 54932 - DNA, 25 bp, S. cerevisiae
tctcgtttccaaaaatgcaacacct

SEQ ID NO: 54933 - DNA, 25 bp, S. cerevisiae
tctcagttattgaagggccctccag

SEQ ID NO: 54934 - DNA, 25 bp, S. cerevisiae
tcacatgttcttcggaaggcccaag

SEQ ID NO: 54935 - DNA, 25 bp, S. cerevisiae
tcactgttcatcataaaggccgcaa

SEQ ID NO: 54936 - DNA, 25 bp, S. cerevisiae
tcacgcatacatcggaaggatcacc

SEQ ID NO: 54937 - DNA, 25 bp, S. cerevisiae
tcatcggttgtatctgtgctggcat

SEQ ID NO: 54938 - DNA, 25 bp, S. cerevisiae
tcattaccgctgtctatggaccacg

SEQ ID NO: 54939 - DNA, 25 bp, S. cerevisiae
tcttttgtgtgagctttttcggcgc

SEQ ID NO: 54940 - DNA, 25 bp, S. cerevisiae
tcttattgtgtgttgcgttttcggc

SEQ ID NO: 54941 - DNA, 25 bp, S. cerevisiae
tctggacgttttatgggcgcatgat

SEQ ID NO: 54942 - DNA, 25 bp, S. cerevisiae
tctaatatttccagcattgcacgag

SEQ ID NO: 54943 - DNA, 25 bp, S. cerevisiae
tctcaattcttcattaccactgtgc

SEQ ID NO: 54944 - DNA, 25 bp, S. cerevisiae
tctaaagctgctatccaccaatatg

SEQ ID NO: 54945 - DNA, 25 bp, S. cerevisiae
tcggacactctcataacgctattag

SEQ ID NO: 54946 - DNA, 25 bp, S. cerevisiae
tcggtgtcatcttaagtatcctttg

SEQ ID NO: 54947 - DNA, 25 bp, S. cerevisiae
tcggtgcttctgttagaatcttctt

SEQ ID NO: 54948 - DNA, 25 bp, S. cerevisiae
tcaggctgagcttggactagagtct

SEQ ID NO: 54949 - DNA, 25 bp, S. cerevisiae
tcaggagtcttggtgcttgagttgc

SEQ ID NO: 54950 - DNA, 25 bp, S. cerevisiae
tcggcgatctctctttgttggataa

SEQ ID NO: 54951 - DNA, 25 bp, S. cerevisiae
tcatgggatcatgtttgtgcgtaac

SEQ ID NO: 54952 - DNA, 25 bp, S. cerevisiae
tcatagaactgcctaatgggaacat

SEQ ID NO: 54953 - DNA, 25 bp, S. cerevisiae
tcttcacccgagaaagtactgatta

SEQ ID NO: 54954 - DNA, 25 bp, S. cerevisiae
tctacccctaatacagtggcgttta

SEQ ID NO: 54955 - DNA, 25 bp, S. cerevisiae
tctgatgcctcaagatttaaccttt

SEQ ID NO: 54956 - DNA, 25 bp, S. cerevisiae
tctccgctcaacatgctgacgaaat

SEQ ID NO: 54957 - DNA, 25 bp, S. cerevisiae
tctcctgcatcaacgtctactataa

SEQ ID NO: 54958 - DNA, 25 bp, S. cerevisiae
tctccattgcatcctataaccattt

SEQ ID NO: 54959 - DNA, 25 bp, S. cerevisiae
tctccttctacaaaaccgcttaata

SEQ ID NO: 54960 - DNA, 25 bp, S. cerevisiae
tttccctttggaacggcaagtcatg

SEQ ID NO: 54961 - DNA, 25 bp, S. cerevisiae
tttgaaagctatgaccccgtaacag

SEQ ID NO: 54962 - DNA, 25 bp, S. cerevisiae
tctaataacaacactgcccctaaag

SEQ ID NO: 54963 - DNA, 25 bp, S. cerevisiae
tctcccacttcgaagtctcggaaaa

SEQ ID NO: 54964 - DNA, 25 bp, S. cerevisiae
tctgcccatttctaaacctttacaa

SEQ ID NO: 54965 - DNA, 25 bp, S. cerevisiae
tctgcctacctttacaactttacgg

SEQ ID NO: 54966 - DNA, 25 bp, S. cerevisiae
tctactcacaacatggaagttccag

SEQ ID NO: 54967 - DNA, 25 bp, S. cerevisiae
tctgacgctgttactatccgtacta

SEQ ID NO: 54968 - DNA, 25 bp, S. cerevisiae
tctgacgctgtcactattcgtacca

SEQ ID NO: 54969 - DNA, 25 bp, S. cerevisiae
tctcaagttctcaattcgtcaaagt

SEQ ID NO: 54970 - DNA, 25 bp, S. cerevisiae
tataggcgggaaagtggagaaccct

SEQ ID NO: 54971 - DNA, 25 bp, S. cerevisiae
taagatcgcgtacagtgggcacagc

SEQ ID NO: 54972 - DNA, 25 bp, S. cerevisiae
tctagatgagattggccgtgggact

SEQ ID NO: 54973 - DNA, 25 bp, S. cerevisiae
tcataatgatattgaggcagggtat

SEQ ID NO: 54974 - DNA, 25 bp, S. cerevisiae
tctgcaggtgcttgtggtggttata

SEQ ID NO: 54975 - DNA, 25 bp, S. cerevisiae
tctgtctttagatatcgcctcgcaa

SEQ ID NO: 54976 - DNA, 25 bp, S. cerevisiae
tctgtttgaaaaccagcgccgctgg

SEQ ID NO: 54977 - DNA, 25 bp, S. cerevisiae
tctgttactctgacttggatccaaa

SEQ ID NO: 54978 - DNA, 25 bp, S. cerevisiae
tctgtgaagcatgtccggtggccaa

SEQ ID NO: 54979 - DNA, 25 bp, S. cerevisiae
tcatggcaagcgtctctcaggaggg

SEQ ID NO: 54980 - DNA, 25 bp, S. cerevisiae
tcagtggagcagagtacgacaggat

SEQ ID NO: 54981 - DNA, 25 bp, S. cerevisiae
tagtgggacagttatcgaagacgat

SEQ ID NO: 54982 - DNA, 25 bp, S. cerevisiae
tctggccatgtaattcctagcttga

SEQ ID NO: 54983 - DNA, 25 bp, S. cerevisiae
tctggccaattcaatctcgagcgga

SEQ ID NO: 54984 - DNA, 25 bp, S. cerevisiae
tctcagaaaagatcgggcgtgtggt

SEQ ID NO: 54985 - DNA, 25 bp, S. cerevisiae
tctggagaaccaacacaacttttat

SEQ ID NO: 54986 - DNA, 25 bp, S. cerevisiae
ttgggaccctcagcaatgcgtttaa

SEQ ID NO: 54987 - DNA, 25 bp, S. cerevisiae
tcggatacacctgcgaacagctatt

SEQ ID NO: 54988 - DNA, 25 bp, S. cerevisiae
tcaggcaaaccgcatgtcaagttat

SEQ ID NO: 54989 - DNA, 25 bp, S. cerevisiae
tctgggacccagcatgtgttattgc

SEQ ID NO: 54990 - DNA, 25 bp, S. cerevisiae
tctctagttccaggcactgttttga

SEQ ID NO: 54991 - DNA, 25 bp, S. cerevisiae
ttctgttggaggcatttttaaggaa

SEQ ID NO: 54992 - DNA, 25 bp, S. cerevisiae
tctctttcatctccttttaccaaat

SEQ ID NO: 54993 - DNA, 25 bp, S. cerevisiae
tcttccgcgccacgagagtagtgga

SEQ ID NO: 54994 - DNA, 25 bp, S. cerevisiae
tctgctgccgctgccgaagaagaag

SEQ ID NO: 54995 - DNA, 25 bp, S. cerevisiae
tctccagcagctgccgcaaagaaag

SEQ ID NO: 54996 - DNA, 25 bp, S. cerevisiae
tctgacataaccgacaagctgaaag

SEQ ID NO: 54997 - DNA, 25 bp, S. cerevisiae
tcatagttagccctcgagtgcacag

SEQ ID NO: 54998 - DNA, 25 bp, S. cerevisiae
tctgactacaccctcgatgatatga

SEQ ID NO: 54999 - DNA, 25 bp, S. cerevisiae
tctactgaccctcgctatgatgaag

SEQ ID NO: 55000 - DNA, 25 bp, S. cerevisiae
tcttctaagccccttttcaatttgg

SEQ ID NO: 55001 - DNA, 25 bp, S. cerevisiae
tctggcggccacgtgaattcaaatt

SEQ ID NO: 55002 - DNA, 25 bp, S. cerevisiae
tctggatatgcctcgaattggaatt

SEQ ID NO: 55003 - DNA, 25 bp, S. cerevisiae
tctccacctccggattttggagtga

SEQ ID NO: 55004 - DNA, 25 bp, S. cerevisiae
tcttaccttccttcgctatttagga

SEQ ID NO: 55005 - DNA, 25 bp, S. cerevisiae
tcatcctagttccttttcttaacgg

SEQ ID NO: 55006 - DNA, 25 bp, S. cerevisiae
tctccttttcttcgcgatttgagtt

SEQ ID NO: 55007 - DNA, 25 bp, S. cerevisiae
tcaccttttaagtcgacattcgtta

SEQ ID NO: 55008 - DNA, 25 bp, S. cerevisiae
tctattgttcactatggcccattgg

SEQ ID NO: 55009 - DNA, 25 bp, S. cerevisiae
tctagctttagactactccatcggg

SEQ ID NO: 55010 - DNA, 25 bp, S. cerevisiae
tctttgccattaaaatccgccgaga

SEQ ID NO: 55011 - DNA, 25 bp, S. cerevisiae
tctttcacgttcaaatactctgcca

SEQ ID NO: 55012 - DNA, 25 bp, S. cerevisiae
tctcaccgtctattgaagcccaaaa

SEQ ID NO: 55013 - DNA, 25 bp, S. cerevisiae
tctacgcagagctagctgagaggaa

SEQ ID NO: 55014 - DNA, 25 bp, S. cerevisiae
tctagcgcgacaccgagaagagctt

SEQ ID NO: 55015 - DNA, 25 bp, S. cerevisiae
tctaccgattgctttggaggcttct

SEQ ID NO: 55016 - DNA, 25 bp, S. cerevisiae
tctaccgaggatgatctaggcttta

SEQ ID NO: 55017 - DNA, 25 bp, S. cerevisiae
tcactccgagatgggcagcttgatc

SEQ ID NO: 55018 - DNA, 25 bp, S. cerevisiae
tctagcttggcgattctctatcaac

SEQ ID NO: 55019 - DNA, 25 bp, S. cerevisiae
tctgggctgatatttttgctaaggc

SEQ ID NO: 55020 - DNA, 25 bp, S. cerevisiae
tcagtgggactttttgctgtcgtca

SEQ ID NO: 55021 - DNA, 25 bp, S. cerevisiae
tctgggtgacactatctctaacaca

SEQ ID NO: 55022 - DNA, 25 bp, S. cerevisiae
tctggatgtcaatgtccttgtcaca

SEQ ID NO: 55023 - DNA, 25 bp, S. cerevisiae
tctctcaataatagtgccggccaca

SEQ ID NO: 55024 - DNA, 25 bp, S. cerevisiae
tctctgctgagacacatttccggat

SEQ ID NO: 55025 - DNA, 25 bp, S. cerevisiae
tcttgcgacatcatttcatccggaa

SEQ ID NO: 55026 - DNA, 25 bp, S. cerevisiae
tctgtcaactcgtttctttgtctga

SEQ ID NO: 55027 - DNA, 25 bp, S. cerevisiae
tcggcccattgctttatcattttga

SEQ ID NO: 55028 - DNA, 25 bp, S. cerevisiae
tctggcccaatgacttttgctttag

SEQ ID NO: 55029 - DNA, 25 bp, S. cerevisiae
tcggctgccattcttgaagcttttg

SEQ ID NO: 55030 - DNA, 25 bp, S. cerevisiae
tcggcctactgagccatcttatgat

SEQ ID NO: 55031 - DNA, 25 bp, S. cerevisiae
tctgacccagtagcccaattgattg

SEQ ID NO: 55032 - DNA, 25 bp, S. cerevisiae
tctgtcccagttaccgaatctaagg

SEQ ID NO: 55033 - DNA, 25 bp, S. cerevisiae
tcttaggtgccgacatccattttta

SEQ ID NO: 55034 - DNA, 25 bp, S. cerevisiae
tctcaatcggagtaatctttctggg

SEQ ID NO: 55035 - DNA, 25 bp, S. cerevisiae
tctgacttggttaaatctttgggtt

SEQ ID NO: 55036 - DNA, 25 bp, S. cerevisiae
tctgccgcacgtcaagctatttgaa

SEQ ID NO: 55037 - DNA, 25 bp, S. cerevisiae
tctgcccaagtcaagcctactttaa

SEQ ID NO: 55038 - DNA, 25 bp, S. cerevisiae
tctgcccagcgtaagccttctaaaa

SEQ ID NO: 55039 - DNA, 25 bp, S. cerevisiae
tctactctgacctctacttacataa

SEQ ID NO: 55040 - DNA, 25 bp, S. cerevisiae
tctactctacacttggtcttgagat

SEQ ID NO: 55041 - DNA, 25 bp, S. cerevisiae
tctattgttggttcttacgtcggta

SEQ ID NO: 55042 - DNA, 25 bp, S. cerevisiae
ttttgccggtcctcagcgcaacgta

SEQ ID NO: 55043 - DNA, 25 bp, S. cerevisiae
tctttccaagctgctcacccaactg

SEQ ID NO: 55044 - DNA, 25 bp, S. cerevisiae
tcttctcccgacagtttcaactata

SEQ ID NO: 55045 - DNA, 25 bp, S. cerevisiae
tctgtctcacctccagtgtttaata

SEQ ID NO: 55046 - DNA, 25 bp, S. cerevisiae
tctgccccagtcatgatatatctca

SEQ ID NO: 55047 - DNA, 25 bp, S. cerevisiae
tctgcttccagcgttattatctcaa

SEQ ID NO: 55048 - DNA, 25 bp, S. cerevisiae
tctcatccagagctttctactctaa

SEQ ID NO: 55049 - DNA, 25 bp, S. cerevisiae
tcattttgacatcacccttggtggt

SEQ ID NO: 55050 - DNA, 25 bp, S. cerevisiae
tctttttcatcctcatcttcgtctt

SEQ ID NO: 55051 - DNA, 25 bp, S. cerevisiae
tcatttggccgctgaacgtagcagt

SEQ ID NO: 55052 - DNA, 25 bp, S. cerevisiae
tcttcttggactacggtgacttcta

SEQ ID NO: 55053 - DNA, 25 bp, S. cerevisiae
tcttctggtcttagcggtggtatga

SEQ ID NO: 55054 - DNA, 25 bp, S. cerevisiae
tctgctttggaaggcgcctcgaaga

SEQ ID NO: 55055 - DNA, 25 bp, S. cerevisiae
tcttgtcaggtaactctgtcgaaga

SEQ ID NO: 55056 - DNA, 25 bp, S. cerevisiae
tcttgagcggtgagcctctggcaaa

SEQ ID NO: 55057 - DNA, 25 bp, S. cerevisiae
tcagagtccataaactagtaaaatg

SEQ ID NO: 55058 - DNA, 25 bp, S. cerevisiae
tcatggtacgagaatcacaacaaag

SEQ ID NO: 55059 - DNA, 25 bp, S. cerevisiae
tcatgcagctaggagaaacgatact

SEQ ID NO: 55060 - DNA, 25 bp, S. cerevisiae
tcttgccatgcgtcataacctacat

SEQ ID NO: 55061 - DNA, 25 bp, S. cerevisiae
tctctgcgtgcttccaaatctaatt

SEQ ID NO: 55062 - DNA, 25 bp, S. cerevisiae
tcaggaccctattctatttgcaggt

SEQ ID NO: 55063 - DNA, 25 bp, S. cerevisiae
tctagagccccttcaagtcgaaatt

SEQ ID NO: 55064 - DNA, 25 bp, S. cerevisiae
tctgtgccaaactctccgaatgatg

SEQ ID NO: 55065 - DNA, 25 bp, S. cerevisiae
tcatagccaacctcatcacgatgaa

SEQ ID NO: 55066 - DNA, 25 bp, S. cerevisiae
tcaggctacgtctgtgcacctatga

SEQ ID NO: 55067 - DNA, 25 bp, S. cerevisiae
tcagaacatcttgggcaggctctaa

SEQ ID NO: 55068 - DNA, 25 bp, S. cerevisiae
tcatctaatagaggcggtcgtaatc

SEQ ID NO: 55069 - DNA, 25 bp, S. cerevisiae
tctccggtgggctagtctacgaata

SEQ ID NO: 55070 - DNA, 25 bp, S. cerevisiae
tcaccggttacaggcgctacagaaa

SEQ ID NO: 55071 - DNA, 25 bp, S. cerevisiae
taactttcatggctccggtttggaa

SEQ ID NO: 55072 - DNA, 25 bp, S. cerevisiae
tcatttatttggctcccggtgatta

SEQ ID NO: 55073 - DNA, 25 bp, S. cerevisiae
tctgtacttgttacttcacccttaa

SEQ ID NO: 55074 - DNA, 25 bp, S. cerevisiae
tcattaatttcgcattcccaggtaa

SEQ ID NO: 55075 - DNA, 25 bp, S. cerevisiae
tcagaaaattcgcaaccaactccac

SEQ ID NO: 55076 - DNA, 25 bp, S. cerevisiae
taacgttggaggatcccgtgacggt

SEQ ID NO: 55077 - DNA, 25 bp, S. cerevisiae
taggtctcggaaattccctgggcgg

SEQ ID NO: 55078 - DNA, 25 bp, S. cerevisiae
tctccagcgctgtaaccaaatcgtt

SEQ ID NO: 55079 - DNA, 25 bp, S. cerevisiae
ttgcaatcgcatgaacaaaagtttg

SEQ ID NO: 55080 - DNA, 25 bp, S. cerevisiae
tctctcatcgcatttagaagctaat

SEQ ID NO: 55081 - DNA, 25 bp, S. cerevisiae
tctctccgtgatggctgacactaat

SEQ ID NO: 55082 - DNA, 25 bp, S. cerevisiae
tctagctttgatagtgcatacgatc

SEQ ID NO: 55083 - DNA, 25 bp, S. cerevisiae
tctagtgattatttccagtggtctg

SEQ ID NO: 55084 - DNA, 25 bp, S. cerevisiae
tctttacacagctttttaccgcaaa

SEQ ID NO: 55085 - DNA, 25 bp, S. cerevisiae
tctgctatcagaagtttgttcccta

SEQ ID NO: 55086 - DNA, 25 bp, S. cerevisiae
tctgttcatgaactttttctctgtt

SEQ ID NO: 55087 - DNA, 25 bp, S. cerevisiae
tcttcccggtgcattgaatttgttg

SEQ ID NO: 55088 - DNA, 25 bp, S. cerevisiae
tctacccacgttttattgttgttgc

SEQ ID NO: 55089 - DNA, 25 bp, S. cerevisiae
tctactccagtgctcgtttattttt

SEQ ID NO: 55090 - DNA, 25 bp, S. cerevisiae
tctcctggcgaaatttattgttttt

SEQ ID NO: 55091 - DNA, 25 bp, S. cerevisiae
tcattttgcgtaatcgagaagtttt

SEQ ID NO: 55092 - DNA, 25 bp, S. cerevisiae
taatccatgaacacgaggcttattg

SEQ ID NO: 55093 - DNA, 25 bp, S. cerevisiae
tcttagctaagccaggtaccgttaa

SEQ ID NO: 55094 - DNA, 25 bp, S. cerevisiae
tctgttcccattaggcggttcagga

SEQ ID NO: 55095 - DNA, 25 bp, S. cerevisiae
tctatgttccatttggcgggtccaa

SEQ ID NO: 55096 - DNA, 25 bp, S. cerevisiae
tctttttggctgaccctatggtaca

SEQ ID NO: 55097 - DNA, 25 bp, S. cerevisiae
tctagaagatccctccggtcaacaa

SEQ ID NO: 55098 - DNA, 25 bp, S. cerevisiae
tcaaaaatcgcgttcagggtaaaag

SEQ ID NO: 55099 - DNA, 25 bp, S. cerevisiae
tcattcgctccagacatcgaggtag

SEQ ID NO: 55100 - DNA, 25 bp, S. cerevisiae
tcagtcaatcgcacattctagcagt

SEQ ID NO: 55101 - DNA, 25 bp, S. cerevisiae
tcttgcaactgcaatggctcgtggg

SEQ ID NO: 55102 - DNA, 25 bp, S. cerevisiae
tctattatcattggtgtggctgccg

SEQ ID NO: 55103 - DNA, 25 bp, S. cerevisiae
tcttcgctattagttgggccccaat

SEQ ID NO: 55104 - DNA, 25 bp, S. cerevisiae
tcttttccaattactaatgtcctag

SEQ ID NO: 55105 - DNA, 25 bp, S. cerevisiae
tcttcaccgatactcactgttatac

SEQ ID NO: 55106 - DNA, 25 bp, S. cerevisiae
tctgctgctttaagaactcctgaac

SEQ ID NO: 55107 - DNA, 25 bp, S. cerevisiae
tctgcgattttagccatccaatgca

SEQ ID NO: 55108 - DNA, 25 bp, S. cerevisiae
tcttcttggttctctgatactcatg

SEQ ID NO: 55109 - DNA, 25 bp, S. cerevisiae
tctcatctttttttctgcaatcctt

SEQ ID NO: 55110 - DNA, 25 bp, S. cerevisiae
tctgcgtctgagattcttgccaaaa

SEQ ID NO: 55111 - DNA, 25 bp, S. cerevisiae
tctcttctggtggatcttcctcaaa

SEQ ID NO: 55112 - DNA, 25 bp, S. cerevisiae
tctctctcacgggataccagaacaa

SEQ ID NO: 55113 - DNA, 25 bp, S. cerevisiae
tctcgctattatttccaccattttt

SEQ ID NO: 55114 - DNA, 25 bp, S. cerevisiae
tcttgcaacaactaaactcctttcc

SEQ ID NO: 55115 - DNA, 25 bp, S. cerevisiae
tctacaatcttctaaagctccctgt

SEQ ID NO: 55116 - DNA, 25 bp, S. cerevisiae
tctatcctatctaatgggttcctat

SEQ ID NO: 55117 - DNA, 25 bp, S. cerevisiae
tcttctcatcctgaaggcttcttga

SEQ ID NO: 55118 - DNA, 25 bp, S. cerevisiae
tcttccaccgtgtcaagcaactatg

SEQ ID NO: 55119 - DNA, 25 bp, S. cerevisiae
tctttctagccatcatcggaggtgt

SEQ ID NO: 55120 - DNA, 25 bp, S. cerevisiae
tcatgtattacctaacggcggcact

SEQ ID NO: 55121 - DNA, 25 bp, S. cerevisiae
tacggctcaacgtgaattcgcattg

SEQ ID NO: 55122 - DNA, 25 bp, S. cerevisiae
tctttggatttttcgattgctgtgt

SEQ ID NO: 55123 - DNA, 25 bp, S. cerevisiae
tcttcattctatataccctgtttaa

SEQ ID NO: 55124 - DNA, 25 bp, S. cerevisiae
tcttcgtcgttttccagacttgata

SEQ ID NO: 55125 - DNA, 25 bp, S. cerevisiae
tcttggctcgtaaaggccatcttta

SEQ ID NO: 55126 - DNA, 25 bp, S. cerevisiae
tcttggatttcaatgggtgctgtct

SEQ ID NO: 55127 - DNA, 25 bp, S. cerevisiae
tctcgatattgttgggcggtgtctc

SEQ ID NO: 55128 - DNA, 25 bp, S. cerevisiae
tctttaggctttggcatgtgtcctc

SEQ ID NO: 55129 - DNA, 25 bp, S. cerevisiae
tctgccaggcagttacatttatcac

SEQ ID NO: 55130 - DNA, 25 bp, S. cerevisiae
tctacggcgctaaactgttcacgtg

SEQ ID NO: 55131 - DNA, 25 bp, S. cerevisiae
tcttgtccctaattctgttcacgga

SEQ ID NO: 55132 - DNA, 25 bp, S. cerevisiae
tctgcgacattttacgtactaccgt

SEQ ID NO: 55133 - DNA, 25 bp, S. cerevisiae
tctcgagctatttattataagagtc

SEQ ID NO: 55134 - DNA, 25 bp, S. cerevisiae
tcatgttgaattttctccagaggat

SEQ ID NO: 55135 - DNA, 25 bp, S. cerevisiae
tcttcttcagattccctcatggaga

SEQ ID NO: 55136 - DNA, 25 bp, S. cerevisiae
tcttcactacttgcaccattggatg

SEQ ID NO: 55137 - DNA, 25 bp, S. cerevisiae
tcattacaagatcccagcctggttc

SEQ ID NO: 55138 - DNA, 25 bp, S. cerevisiae
tctagccaatacgaggatgctgcct

SEQ ID NO: 55139 - DNA, 25 bp, S. cerevisiae
tcagtgttatcattgccccacattg

SEQ ID NO: 55140 - DNA, 25 bp, S. cerevisiae
tagctgtatataccagcgctcaata

SEQ ID NO: 55141 - DNA, 25 bp, S. cerevisiae
tcatcttatcaacagcagccatttc

SEQ ID NO: 55142 - DNA, 25 bp, S. cerevisiae
tctcctcatattctctggcatttta

SEQ ID NO: 55143 - DNA, 25 bp, S. cerevisiae
tctctccagttccttcgcaataaaa

SEQ ID NO: 55144 - DNA, 25 bp, S. cerevisiae
tctcacctgatatcttccggaataa

SEQ ID NO: 55145 - DNA, 25 bp, S. cerevisiae
tctcgcctgaattttccaagaccat

SEQ ID NO: 55146 - DNA, 25 bp, S. cerevisiae
tctgccttgagaaatttactggaca

SEQ ID NO: 55147 - DNA, 25 bp, S. cerevisiae
tcttctgctgaatctttatccgaca

SEQ ID NO: 55148 - DNA, 25 bp, S. cerevisiae
tcttctgaggagtcattcaacgcta

SEQ ID NO: 55149 - DNA, 25 bp, S. cerevisiae
tcttctagggaagtgacgcctccga

SEQ ID NO: 55150 - DNA, 25 bp, S. cerevisiae
tctttagagagatcttgggcggcga

SEQ ID NO: 55151 - DNA, 25 bp, S. cerevisiae
tctatcttagaaactgtgggcaggc

SEQ ID NO: 55152 - DNA, 25 bp, S. cerevisiae
tctccggactctacatatgtggcga

SEQ ID NO: 55153 - DNA, 25 bp, S. cerevisiae
tcttccaaaaccgtgcatatcttca

SEQ ID NO: 55154 - DNA, 25 bp, S. cerevisiae
tcttctacggactatctgtgatgtt

SEQ ID NO: 55155 - DNA, 25 bp, S. cerevisiae
tcataaatctggtggcaactgggca

SEQ ID NO: 55156 - DNA, 25 bp, S. cerevisiae
tcattgacgcggtggaatctagatt

SEQ ID NO: 55157 - DNA, 25 bp, S. cerevisiae
tcttcagtcgaagatgctcgtgcca

SEQ ID NO: 55158 - DNA, 25 bp, S. cerevisiae
tcatatcgtcgatattctgctggac

SEQ ID NO: 55159 - DNA, 25 bp, S. cerevisiae
tctatcccggtctattttcatcaat

SEQ ID NO: 55160 - DNA, 25 bp, S. cerevisiae
tctttgaccgtctctattccaataa

SEQ ID NO: 55161 - DNA, 25 bp, S. cerevisiae
tcttctatccgttccttgattcaaa

SEQ ID NO: 55162 - DNA, 25 bp, S. cerevisiae
tctacgttacatgatctccacaaag

SEQ ID NO: 55163 - DNA, 25 bp, S. cerevisiae
tcttctcctaaaaacaccaaagcgg

SEQ ID NO: 55164 - DNA, 25 bp, S. cerevisiae
tcattgtcgccaagtggtccacgag

SEQ ID NO: 55165 - DNA, 25 bp, S. cerevisiae
tactttggacgtcgtcaccggagtt

SEQ ID NO: 55166 - DNA, 25 bp, S. cerevisiae
tcatttcgcaacgacaccgatgtgg

SEQ ID NO: 55167 - DNA, 25 bp, S. cerevisiae
tcagcctgcacctgaaactgttggt

SEQ ID NO: 55168 - DNA, 25 bp, S. cerevisiae
tcacgctccctacaacagtttgtgg

SEQ ID NO: 55169 - DNA, 25 bp, S. cerevisiae
tctctccacctacaactgtttttat

SEQ ID NO: 55170 - DNA, 25 bp, S. cerevisiae
tcttaccaccagtcgccgtttttct

SEQ ID NO: 55171 - DNA, 25 bp, S. cerevisiae
tcttttgataagtaccctttcttgc

SEQ ID NO: 55172 - DNA, 25 bp, S. cerevisiae
tcatttctacgttcccacagttttt

SEQ ID NO: 55173 - DNA, 25 bp, S. cerevisiae
tatcttttcctttcgaatgggcctt

SEQ ID NO: 55174 - DNA, 25 bp, S. cerevisiae
tcattttcttttcgaatccggccta

SEQ ID NO: 55175 - DNA, 25 bp, S. cerevisiae
tctttgaagacgcaccagctggtat

SEQ ID NO: 55176 - DNA, 25 bp, S. cerevisiae
tctatagatcagtacaaccgttgtg

SEQ ID NO: 55177 - DNA, 25 bp, S. cerevisiae
tctattatcatgttccacggactgg

SEQ ID NO: 55178 - DNA, 25 bp, S. cerevisiae
tcattttccatatacgatgccttga

SEQ ID NO: 55179 - DNA, 25 bp, S. cerevisiae
tcaggctaccaccaataacacagtt

SEQ ID NO: 55180 - DNA, 25 bp, S. cerevisiae
tcatgcccctatatcacgcaaatat

SEQ ID NO: 55181 - DNA, 25 bp, S. cerevisiae
tcatcccgaatctcacatcaaattt

SEQ ID NO: 55182 - DNA, 25 bp, S. cerevisiae
tctcacgcattatgggtctattcat

SEQ ID NO: 55183 - DNA, 25 bp, S. cerevisiae
tcttgctatacgaggtggtccgata

SEQ ID NO: 55184 - DNA, 25 bp, S. cerevisiae
tactatatgatgtgaaaaccgcgga

SEQ ID NO: 55185 - DNA, 25 bp, S. cerevisiae
tcatcagtgttctggattcctgcca

SEQ ID NO: 55186 - DNA, 25 bp, S. cerevisiae
tcatttaccatgctgttgactccac

SEQ ID NO: 55187 - DNA, 25 bp, S. cerevisiae
tcttggccgtgattgctgttgtatt

SEQ ID NO: 55188 - DNA, 25 bp, S. cerevisiae
tcagccacagtggatatttgattgt

SEQ ID NO: 55189 - DNA, 25 bp, S. cerevisiae
tcaaaacttttacgaccagggagat

SEQ ID NO: 55190 - DNA, 25 bp, S. cerevisiae
taacccattctatgtaccgtcagag

SEQ ID NO: 55191 - DNA, 25 bp, S. cerevisiae
taccgacttgcctggatttccaata

SEQ ID NO: 55192 - DNA, 25 bp, S. cerevisiae
taaggcctcccataaattccaacag

SEQ ID NO: 55193 - DNA, 25 bp, S. cerevisiae
tcacaggtgaatctccaaatatggc

SEQ ID NO: 55194 - DNA, 25 bp, S. cerevisiae
tcaggcagtactttccggattgttt

SEQ ID NO: 55195 - DNA, 25 bp, S. cerevisiae
tcaggcttccatgtccgtaaagttt

SEQ ID NO: 55196 - DNA, 25 bp, S. cerevisiae
tcagaccttgctgtcggttcagaat

SEQ ID NO: 55197 - DNA, 25 bp, S. cerevisiae
tcagggctggtgtttgtgaatacaa

SEQ ID NO: 55198 - DNA, 25 bp, S. cerevisiae
tcagctgggctgacttatgtaaaca

SEQ ID NO: 55199 - DNA, 25 bp, S. cerevisiae
tttacaggcctatcttaaagttata

SEQ ID NO: 55200 - DNA, 25 bp, S. cerevisiae
tttgccgacttatcactttggttca

SEQ ID NO: 55201 - DNA, 25 bp, S. cerevisiae
tctcgccatccttttctaacagaag

SEQ ID NO: 55202 - DNA, 25 bp, S. cerevisiae
tcttccgctgaagttatgttccatg

SEQ ID NO: 55203 - DNA, 25 bp, S. cerevisiae
tctctatgctctaggcttttggata

SEQ ID NO: 55204 - DNA, 25 bp, S. cerevisiae
tcttcttctcatggcttagtggtga

SEQ ID NO: 55205 - DNA, 25 bp, S. cerevisiae
tctagtaactctgaccggatcgatg

SEQ ID NO: 55206 - DNA, 25 bp, S. cerevisiae
ttagctaagctaaggcctggtcaag

SEQ ID NO: 55207 - DNA, 25 bp, S. cerevisiae
tctactgagattatgtcccttccca

SEQ ID NO: 55208 - DNA, 25 bp, S. cerevisiae
tctatggaagttttgcgcacgtcgc

SEQ ID NO: 55209 - DNA, 25 bp, S. cerevisiae
tctataggtttgttgctgaggacgc

SEQ ID NO: 55210 - DNA, 25 bp, S. cerevisiae
tcatcaacgtttccgctcaaagaga

SEQ ID NO: 55211 - DNA, 25 bp, S. cerevisiae
tcaagactattccaagctttcgaga

SEQ ID NO: 55212 - DNA, 25 bp, S. cerevisiae
taaggccttgcctacatggaaggat

SEQ ID NO: 55213 - DNA, 25 bp, S. cerevisiae
tcatcctactttgtccgaagcattt

SEQ ID NO: 55214 - DNA, 25 bp, S. cerevisiae
ttcgtcaaaattgcccggatgcttt

SEQ ID NO: 55215 - DNA, 25 bp, S. cerevisiae
tcacccaaactttccgtggtgttgt

SEQ ID NO: 55216 - DNA, 25 bp, S. cerevisiae
tcaagtgcaaacaccggtgcttttc

SEQ ID NO: 55217 - DNA, 25 bp, S. cerevisiae
tcatacccagactccaatgtcgtat

SEQ ID NO: 55218 - DNA, 25 bp, S. cerevisiae
tcatgcacaatttacctaaggtcca

SEQ ID NO: 55219 - DNA, 25 bp, S. cerevisiae
tctaccatttgcactctagcttcaa

SEQ ID NO: 55220 - DNA, 25 bp, S. cerevisiae
tctagattccttacctatgctacca

SEQ ID NO: 55221 - DNA, 25 bp, S. cerevisiae
tctaactgatcttgactctccatca

SEQ ID NO: 55222 - DNA, 25 bp, S. cerevisiae
tcatcaagctgacgcaagccctaag

SEQ ID NO: 55223 - DNA, 25 bp, S. cerevisiae
tagcaactggcgaacctggtagcgg

SEQ ID NO: 55224 - DNA, 25 bp, S. cerevisiae
tcatgggctcgaaagaaggaacctt

SEQ ID NO: 55225 - DNA, 25 bp, S. cerevisiae
tatggctttggcgagggaaatccct

SEQ ID NO: 55226 - DNA, 25 bp, S. cerevisiae
tcattgatgcctggcttctggacat

SEQ ID NO: 55227 - DNA, 25 bp, S. cerevisiae
tcattgacttagattccactccagc

SEQ ID NO: 55228 - DNA, 25 bp, S. cerevisiae
tcattcatggatatacctgccccaa

SEQ ID NO: 55229 - DNA, 25 bp, S. cerevisiae
tctttgaatctttctccccaaaaag

SEQ ID NO: 55230 - DNA, 25 bp, S. cerevisiae
tcaacattaccctcgtcattaactt

SEQ ID NO: 55231 - DNA, 25 bp, S. cerevisiae
tttttggaacctagctggtcgtcgt

SEQ ID NO: 55232 - DNA, 25 bp, S. cerevisiae
tcatgtgtacagacgccaaatttgg

SEQ ID NO: 55233 - DNA, 25 bp, S. cerevisiae
tcatcctgatcgagcccaattattg

SEQ ID NO: 55234 - DNA, 25 bp, S. cerevisiae
tcatgaactcgcaagcccaatgttg

SEQ ID NO: 55235 - DNA, 25 bp, S. cerevisiae
tcacgtcagcgcagtaatggatgtt

SEQ ID NO: 55236 - DNA, 25 bp, S. cerevisiae
tcagctggacctgtcaaagcgcaga

SEQ ID NO: 55237 - DNA, 25 bp, S. cerevisiae
tcagcggagcgctatccttagagaa

SEQ ID NO: 55238 - DNA, 25 bp, S. cerevisiae
tctagcgagctcttgcccaataaaa

SEQ ID NO: 55239 - DNA, 25 bp, S. cerevisiae
tcttgttcccaagaaaatcaacttg

SEQ ID NO: 55240 - DNA, 25 bp, S. cerevisiae
tcttgtgcacccactgaaacaggtt

SEQ ID NO: 55241 - DNA, 25 bp, S. cerevisiae
tcatgttttccaacgataccggtat

SEQ ID NO: 55242 - DNA, 25 bp, S. cerevisiae
taattaatccgcagtacttggtaaa

SEQ ID NO: 55243 - DNA, 25 bp, S. cerevisiae
tctattgaaccccttacgactgtaa

SEQ ID NO: 55244 - DNA, 25 bp, S. cerevisiae
taaggaacgcccacattttaacaag

SEQ ID NO: 55245 - DNA, 25 bp, S. cerevisiae
ttcggcgaacccctttaatgacaat

SEQ ID NO: 55246 - DNA, 25 bp, S. cerevisiae
ttccggtacccgtgatatggcacaa

SEQ ID NO: 55247 - DNA, 25 bp, S. cerevisiae
tcatccgggaccttagaggcttaca

SEQ ID NO: 55248 - DNA, 25 bp, S. cerevisiae
tacggtggcacctaaattcattaag

SEQ ID NO: 55249 - DNA, 25 bp, S. cerevisiae
tctaattccctcgatgtctttacaa

SEQ ID NO: 55250 - DNA, 25 bp, S. cerevisiae
tctttccctccaatattctacatga

SEQ ID NO: 55251 - DNA, 25 bp, S. cerevisiae
tcttgactcctgacgatattcggct

SEQ ID NO: 55252 - DNA, 25 bp, S. cerevisiae
tctagacggcagtcgaccttagcag

SEQ ID NO: 55253 - DNA, 25 bp, S. cerevisiae
tcaagctcggactcagactcttcag

SEQ ID NO: 55254 - DNA, 25 bp, S. cerevisiae
tcaactccctgcgtaacaaagtggt

SEQ ID NO: 55255 - DNA, 25 bp, S. cerevisiae
tctactacctcattatcctcaaata

SEQ ID NO: 55256 - DNA, 25 bp, S. cerevisiae
tctatctaactgctgtcttagaata

SEQ ID NO: 55257 - DNA, 25 bp, S. cerevisiae
tcatcttcggcatcaggtctatcaa

SEQ ID NO: 55258 - DNA, 25 bp, S. cerevisiae
tcaggctatgggataagttctcaac

SEQ ID NO: 55259 - DNA, 25 bp, S. cerevisiae
ttccacaggttctcgttctaaagtc

SEQ ID NO: 55260 - DNA, 25 bp, S. cerevisiae
tctacacatagatcccgctagcaag

SEQ ID NO: 55261 - DNA, 25 bp, S. cerevisiae
tctagccttaatttctcatattggg

SEQ ID NO: 55262 - DNA, 25 bp, S. cerevisiae
tcatacctttatttactcttcggaa

SEQ ID NO: 55263 - DNA, 25 bp, S. cerevisiae
tctaccttttcctaatttccaacat

SEQ ID NO: 55264 - DNA, 25 bp, S. cerevisiae
tctttcttcccattagcgctaaaca

SEQ ID NO: 55265 - DNA, 25 bp, S. cerevisiae
tctaccctctgacatggctgaatat

SEQ ID NO: 55266 - DNA, 25 bp, S. cerevisiae
tctacaccatctcctacgtggtata

SEQ ID NO: 55267 - DNA, 25 bp, S. cerevisiae
tctaaccatgttaactgtgcgtatt

SEQ ID NO: 55268 - DNA, 25 bp, S. cerevisiae
tcatggacgttttcacgtggtcctt

SEQ ID NO: 55269 - DNA, 25 bp, S. cerevisiae
tcatatcacagttagcccagttctc

SEQ ID NO: 55270 - DNA, 25 bp, S. cerevisiae
tcagacaagaattgggcgttccctt

SEQ ID NO: 55271 - DNA, 25 bp, S. cerevisiae
tctaagcggcatttcgtctagcgat

SEQ ID NO: 55272 - DNA, 25 bp, S. cerevisiae
tcaggtggcatgtcacttattcgcc

SEQ ID NO: 55273 - DNA, 25 bp, S. cerevisiae
ttgactggaggacagcaacctactg

SEQ ID NO: 55274 - DNA, 25 bp, S. cerevisiae
tctatctgcagacggtatctacact

SEQ ID NO: 55275 - DNA, 25 bp, S. cerevisiae
tcattaaccgtttctcgtgagcaat

SEQ ID NO: 55276 - DNA, 25 bp, S. cerevisiae
tctttccctattcattctgcaacat

SEQ ID NO: 55277 - DNA, 25 bp, S. cerevisiae
tcatacccatataaatcgccattcc

SEQ ID NO: 55278 - DNA, 25 bp, S. cerevisiae
tcttcaaggctttccaatctgctta

SEQ ID NO: 55279 - DNA, 25 bp, S. cerevisiae
tctaaatacacttctgccttctggg

SEQ ID NO: 55280 - DNA, 25 bp, S. cerevisiae
tcatcacttcaattgtggccttcgg

SEQ ID NO: 55281 - DNA, 25 bp, S. cerevisiae
tcatcgctgcctagtgaagatccct

SEQ ID NO: 55282 - DNA, 25 bp, S. cerevisiae
tcaccccataattacatactcgcag

SEQ ID NO: 55283 - DNA, 25 bp, S. cerevisiae
tcacctacatcaacaactattccgg

SEQ ID NO: 55284 - DNA, 25 bp, S. cerevisiae
tcattgctaactccacatctattca

SEQ ID NO: 55285 - DNA, 25 bp, S. cerevisiae
tcatcttcattcaccgtatccagta

SEQ ID NO: 55286 - DNA, 25 bp, S. cerevisiae
tcttttggtcctaaatcctgatgaa

SEQ ID NO: 55287 - DNA, 25 bp, S. cerevisiae
tcttttcgccatactattcctgata

SEQ ID NO: 55288 - DNA, 25 bp, S. cerevisiae
tctacttgtggtacttcatcgttca

SEQ ID NO: 55289 - DNA, 25 bp, S. cerevisiae
tcttcccctcttaattgatgaccag

SEQ ID NO: 55290 - DNA, 25 bp, S. cerevisiae
tcttctggacctgcatgtttgacaa

SEQ ID NO: 55291 - DNA, 25 bp, S. cerevisiae
tcatttggctttcttggacctcgaa

SEQ ID NO: 55292 - DNA, 25 bp, S. cerevisiae
tcattaacttctcttgttgctctgg

SEQ ID NO: 55293 - DNA, 25 bp, S. cerevisiae
tcttcattttctcttttgccattac

SEQ ID NO: 55294 - DNA, 25 bp, S. cerevisiae
tcttttgcccttttttgcctattat

SEQ ID NO: 55295 - DNA, 25 bp, S. cerevisiae
tcatttccctttggtttcctacgca

SEQ ID NO: 55296 - DNA, 25 bp, S. cerevisiae
tatattccagtttcgggaccaacct

SEQ ID NO: 55297 - DNA, 25 bp, S. cerevisiae
tctttctcagttgccacagacgaac

SEQ ID NO: 55298 - DNA, 25 bp, S. cerevisiae
tcatctttagatgcctcaggaaata

SEQ ID NO: 55299 - DNA, 25 bp, S. cerevisiae
tcttctttggctcctcaagagatat

SEQ ID NO: 55300 - DNA, 25 bp, S. cerevisiae
tcttctgctctgtgtcgacaagtta

SEQ ID NO: 55301 - DNA, 25 bp, S. cerevisiae
tcatttgaggtaccagccggacggc

SEQ ID NO: 55302 - DNA, 25 bp, S. cerevisiae
tcattagacgtttcctccgacagaa

SEQ ID NO: 55303 - DNA, 25 bp, S. cerevisiae
tcttgcaacgtttcacttggcgcaa

SEQ ID NO: 55304 - DNA, 25 bp, S. cerevisiae
tcattcggcaacaagttcttccagc

SEQ ID NO: 55305 - DNA, 25 bp, S. cerevisiae
tctatccgcagacggtatctacact

SEQ ID NO: 55306 - DNA, 25 bp, S. cerevisiae
tctaccctgatgtttattcgctgca

SEQ ID NO: 55307 - DNA, 25 bp, S. cerevisiae
tcatacatcgtaactttccccaaga

SEQ ID NO: 55308 - DNA, 25 bp, S. cerevisiae
tcatcaacgctatgtttaccgacgc

SEQ ID NO: 55309 - DNA, 25 bp, S. cerevisiae
tcacaaatccagtattcaacccacg

SEQ ID NO: 55310 - DNA, 25 bp, S. cerevisiae
tcatcagtttcacattatacccaat

SEQ ID NO: 55311 - DNA, 25 bp, S. cerevisiae
tcagcaacttgaccttatcttcaca

SEQ ID NO: 55312 - DNA, 25 bp, S. cerevisiae
tcagcgtagccaggatgccattgcg

SEQ ID NO: 55313 - DNA, 25 bp, S. cerevisiae
tcaggaagccgcatcgctatggaat

SEQ ID NO: 55314 - DNA, 25 bp, S. cerevisiae
tcaggtgcccgaatctcaggtgaaa

SEQ ID NO: 55315 - DNA, 25 bp, S. cerevisiae
tcaggcgccgatatccaggcaatgt

SEQ ID NO: 55316 - DNA, 25 bp, S. cerevisiae
tcagaagctcagttaagcgttgcaa

SEQ ID NO: 55317 - DNA, 25 bp, S. cerevisiae
tcatgatggtcacggcacagttctt

SEQ ID NO: 55318 - DNA, 25 bp, S. cerevisiae
taatgctatgctgggcactgtccat

SEQ ID NO: 55319 - DNA, 25 bp, S. cerevisiae
taatggatgggccaccagctcaatc

SEQ ID NO: 55320 - DNA, 25 bp, S. cerevisiae
tcaggtcgacgaaattgccagaaaa

SEQ ID NO: 55321 - DNA, 25 bp, S. cerevisiae
tcagttctgacgagctttgcgacat

SEQ ID NO: 55322 - DNA, 25 bp, S. cerevisiae
tcagtctcgagaaggatttggcaat

SEQ ID NO: 55323 - DNA, 25 bp, S. cerevisiae
tcagttcaaaacgttctgccagaat

SEQ ID NO: 55324 - DNA, 25 bp, S. cerevisiae
tcatgtacggtgttagatgatgaca

SEQ ID NO: 55325 - DNA, 25 bp, S. cerevisiae
tcatacacaagatgtcattcgacga

SEQ ID NO: 55326 - DNA, 25 bp, S. cerevisiae
ttaaaagtcgtcaccacgacggcag

SEQ ID NO: 55327 - DNA, 25 bp, S. cerevisiae
taaagtactagatcctactggcggg

SEQ ID NO: 55328 - DNA, 25 bp, S. cerevisiae
tactaagtaaagtcgtgccgcccgt

SEQ ID NO: 55329 - DNA, 25 bp, S. cerevisiae
taaccgtagaattctggccgcggca

SEQ ID NO: 55330 - DNA, 25 bp, S. cerevisiae
taacgaaccaaataaccgcccattg

SEQ ID NO: 55331 - DNA, 25 bp, S. cerevisiae
ttgaaaactaccgtaaggcctatgg

SEQ ID NO: 55332 - DNA, 25 bp, S. cerevisiae
tcagtagtgtgcttcgggttgactc

SEQ ID NO: 55333 - DNA, 25 bp, S. cerevisiae
tcaggatggatgttcatggcgtatt

SEQ ID NO: 55334 - DNA, 25 bp, S. cerevisiae
tcatttgctatggatcagacgttta

SEQ ID NO: 55335 - DNA, 25 bp, S. cerevisiae
tcttgatgccacagatgacgtcttt

SEQ ID NO: 55336 - DNA, 25 bp, S. cerevisiae
tcttgatttctggtacggcttttta

SEQ ID NO: 55337 - DNA, 25 bp, S. cerevisiae
tcttgatacagccttgagtccttat

SEQ ID NO: 55338 - DNA, 25 bp, S. cerevisiae
tcttgaatgtccctgttctagcata

SEQ ID NO: 55339 - DNA, 25 bp, S. cerevisiae
tctatgcatagttttgtccctgata

SEQ ID NO: 55340 - DNA, 25 bp, S. cerevisiae
tctttgagactctttctgcacttta

SEQ ID NO: 55341 - DNA, 25 bp, S. cerevisiae
tcatcactgtcgttcttttactttc

SEQ ID NO: 55342 - DNA, 25 bp, S. cerevisiae
tcacctttttatcagtactctttgg

SEQ ID NO: 55343 - DNA, 25 bp, S. cerevisiae
tacctttccgagcttgaatctttgt

SEQ ID NO: 55344 - DNA, 25 bp, S. cerevisiae
tcaacgtagacgaggccttttatag

SEQ ID NO: 55345 - DNA, 25 bp, S. cerevisiae
tcatgggtacgggtggcagcttctt

SEQ ID NO: 55346 - DNA, 25 bp, S. cerevisiae
tagcaaagtcttacggttttccagt

SEQ ID NO: 55347 - DNA, 25 bp, S. cerevisiae
tcagaatttctttaggtttaccagt

SEQ ID NO: 55348 - DNA, 25 bp, S. cerevisiae
tcatactgtgggacactgcgggaca

SEQ ID NO: 55349 - DNA, 25 bp, S. cerevisiae
tcaaagaattcttaccgtggctaac

SEQ ID NO: 55350 - DNA, 25 bp, S. cerevisiae
tcaaagtttcgttggctgtcttaaa

SEQ ID NO: 55351 - DNA, 25 bp, S. cerevisiae
tcaaagattccgatcgcgttccaat

SEQ ID NO: 55352 - DNA, 25 bp, S. cerevisiae
tcaagtttagcggtcctggtaacat

SEQ ID NO: 55353 - DNA, 25 bp, S. cerevisiae
tcactgttcaacctgactctggtaa

SEQ ID NO: 55354 - DNA, 25 bp, S. cerevisiae
tcactagtcttcatcaccatgggta

SEQ ID NO: 55355 - DNA, 25 bp, S. cerevisiae
tcattgttttcgttaccatcgcgtt

SEQ ID NO: 55356 - DNA, 25 bp, S. cerevisiae
tcatttgcttactgtgacgcctggc

SEQ ID NO: 55357 - DNA, 25 bp, S. cerevisiae
tttaatggtaagagccttctgaggc

SEQ ID NO: 55358 - DNA, 25 bp, S. cerevisiae
tttccttccaagagtccacgaggga

SEQ ID NO: 55359 - DNA, 25 bp, S. cerevisiae
tcttctttccaattacctccgggag

SEQ ID NO: 55360 - DNA, 25 bp, S. cerevisiae
tcattctttctagttaaccatcggg

SEQ ID NO: 55361 - DNA, 25 bp, S. cerevisiae
tcttttgttgcactactactgaccc

SEQ ID NO: 55362 - DNA, 25 bp, S. cerevisiae
tctttacccatacttaatctactcc

SEQ ID NO: 55363 - DNA, 25 bp, S. cerevisiae
tcttcttctcacgacgttgctaaga

SEQ ID NO: 55364 - DNA, 25 bp, S. cerevisiae
tcatctactattaagcctccttcaa

SEQ ID NO: 55365 - DNA, 25 bp, S. cerevisiae
tcatcgccatgaataccccagtaga

SEQ ID NO: 55366 - DNA, 25 bp, S. cerevisiae
tcagcttctgtttgagttgcaacca

SEQ ID NO: 55367 - DNA, 25 bp, S. cerevisiae
tcatttctggtattgttcacgacgt

SEQ ID NO: 55368 - DNA, 25 bp, S. cerevisiae
tcttctctagcagattctactacaa

SEQ ID NO: 55369 - DNA, 25 bp, S. cerevisiae
tctttctacacacttccaggacatt

SEQ ID NO: 55370 - DNA, 25 bp, S. cerevisiae
tctttcactagaattgccacactct

SEQ ID NO: 55371 - DNA, 25 bp, S. cerevisiae
tcatttgccaaatacaccctctggt

SEQ ID NO: 55372 - DNA, 25 bp, S. cerevisiae
tcttaccgaaaaatctgcccagcgt

SEQ ID NO: 55373 - DNA, 25 bp, S. cerevisiae
tctttattctttcaaccagctcgag

SEQ ID NO: 55374 - DNA, 25 bp, S. cerevisiae
tcagtaactgctttcaacctgacgc

SEQ ID NO: 55375 - DNA, 25 bp, S. cerevisiae
tcagccacggtactaaagcctgcgt

SEQ ID NO: 55376 - DNA, 25 bp, S. cerevisiae
tcagccatagagtcagatagcaaca

SEQ ID NO: 55377 - DNA, 25 bp, S. cerevisiae
tcactctcagagcaacacaccatgg

SEQ ID NO: 55378 - DNA, 25 bp, S. cerevisiae
tcatgctccatacactcactggaag

SEQ ID NO: 55379 - DNA, 25 bp, S. cerevisiae
taacctcaacggctttcactaaggc

SEQ ID NO: 55380 - DNA, 25 bp, S. cerevisiae
taagtctaacccctatttcaaagat

SEQ ID NO: 55381 - DNA, 25 bp, S. cerevisiae
taatgggccgttccgttatgtccaa

SEQ ID NO: 55382 - DNA, 25 bp, S. cerevisiae
tcagctggccctaaacgtttttaag

SEQ ID NO: 55383 - DNA, 25 bp, S. cerevisiae
tcacgactacaatacgcttttaacc

SEQ ID NO: 55384 - DNA, 25 bp, S. cerevisiae
tcattgtcagagtaagaggtccgct

SEQ ID NO: 55385 - DNA, 25 bp, S. cerevisiae
tcatccttacaaaccgcttcatggg

SEQ ID NO: 55386 - DNA, 25 bp, S. cerevisiae
tcatcctttcaaacccttggctaaa

SEQ ID NO: 55387 - DNA, 25 bp, S. cerevisiae
tcagcgttttaatgtacttctctac

SEQ ID NO: 55388 - DNA, 25 bp, S. cerevisiae
tcaggcgtaaaattgataccctcga

SEQ ID NO: 55389 - DNA, 25 bp, S. cerevisiae
tcagcgcaataagctccgattggaa

SEQ ID NO: 55390 - DNA, 25 bp, S. cerevisiae
tcatgctggcactatggagagtcat

SEQ ID NO: 55391 - DNA, 25 bp, S. cerevisiae
tcatcagcgtgccatgattgaccaa

SEQ ID NO: 55392 - DNA, 25 bp, S. cerevisiae
tcatcgatgagccatttgcagccat

SEQ ID NO: 55393 - DNA, 25 bp, S. cerevisiae
tcatcaatagcattaccgacaccgg

SEQ ID NO: 55394 - DNA, 25 bp, S. cerevisiae
tcacttcatgattcctgacgtcgac

SEQ ID NO: 55395 - DNA, 25 bp, S. cerevisiae
tcttctcattccgttgtcatcaaca

SEQ ID NO: 55396 - DNA, 25 bp, S. cerevisiae
tcttccaacacttctgcgatagcaa

SEQ ID NO: 55397 - DNA, 25 bp, S. cerevisiae
tcttgagaacatccgcgtgaaccag

SEQ ID NO: 55398 - DNA, 25 bp, S. cerevisiae
tcatttctgccatctctgtcttcgg

SEQ ID NO: 55399 - DNA, 25 bp, S. cerevisiae
tcattcccgctaagtcaattccaaa

SEQ ID NO: 55400 - DNA, 25 bp, S. cerevisiae
tcatttccgcgtggttttgaagaat

SEQ ID NO: 55401 - DNA, 25 bp, S. cerevisiae
tcatttcctgcttcgttcatttcga

SEQ ID NO: 55402 - DNA, 25 bp, S. cerevisiae
tcatcttcctgtgttggtttgccaa

SEQ ID NO: 55403 - DNA, 25 bp, S. cerevisiae
tcatccaacggttttcttccggtga

SEQ ID NO: 55404 - DNA, 25 bp, S. cerevisiae
tcatcaacccgttaatcttaccgta

SEQ ID NO: 55405 - DNA, 25 bp, S. cerevisiae
tttccctaatgtgccaaatacgctt

SEQ ID NO: 55406 - DNA, 25 bp, S. cerevisiae
tcttccccatcatcatcgtataaat

SEQ ID NO: 55407 - DNA, 25 bp, S. cerevisiae
tcttctgacagcttcgtttcgttaa

SEQ ID NO: 55408 - DNA, 25 bp, S. cerevisiae
tcattcgccactgcatcttgtgtga

SEQ ID NO: 55409 - DNA, 25 bp, S. cerevisiae
tcatgtcatgtcgtcccgtgaaaaa

SEQ ID NO: 55410 - DNA, 25 bp, S. cerevisiae
tcattattcagcaatttacgccaaa

SEQ ID NO: 55411 - DNA, 25 bp, S. cerevisiae
tcacttttgtctcatcccaaggatg

SEQ ID NO: 55412 - DNA, 25 bp, S. cerevisiae
tcatctctactgtcctttcaaaggt

SEQ ID NO: 55413 - DNA, 25 bp, S. cerevisiae
tactccaacaaacacggattctcct

SEQ ID NO: 55414 - DNA, 25 bp, S. cerevisiae
tagtccaaaagtcgccagggttcca

SEQ ID NO: 55415 - DNA, 25 bp, S. cerevisiae
tcagtttgaaaaagcgccggttcct

SEQ ID NO: 55416 - DNA, 25 bp, S. cerevisiae
tcaggatctgcacttgccgctagaa

SEQ ID NO: 55417 - DNA, 25 bp, S. cerevisiae
tcaggatgctacctccagtggagta

SEQ ID NO: 55418 - DNA, 25 bp, S. cerevisiae
tcaagcatatcgactccgggcagga

SEQ ID NO: 55419 - DNA, 25 bp, S. cerevisiae
tcaacccactggtgccaacgaagat

SEQ ID NO: 55420 - DNA, 25 bp, S. cerevisiae
taattaaggcttaccaacgaagcat

SEQ ID NO: 55421 - DNA, 25 bp, S. cerevisiae
tcatatctaagacttccatccgtgc

SEQ ID NO: 55422 - DNA, 25 bp, S. cerevisiae
tcattgataatgatcccacggccgt

SEQ ID NO: 55423 - DNA, 25 bp, S. cerevisiae
tcagttttcaaagagttcgatccaa

SEQ ID NO: 55424 - DNA, 25 bp, S. cerevisiae
tcagtgcttctgtagacggttcaat

SEQ ID NO: 55425 - DNA, 25 bp, S. cerevisiae
tcatgctgtttatggcgcttgcgaa

SEQ ID NO: 55426 - DNA, 25 bp, S. cerevisiae
tcacttagcccaatactacatgttc

SEQ ID NO: 55427 - DNA, 25 bp, S. cerevisiae
tcaccggccacaatgcagacgatat

SEQ ID NO: 55428 - DNA, 25 bp, S. cerevisiae
tcatatctaccgtatgaagcgctga

SEQ ID NO: 55429 - DNA, 25 bp, S. cerevisiae
tcagttcttttttaccagtcgccaa

SEQ ID NO: 55430 - DNA, 25 bp, S. cerevisiae
tcaggttggttctcaacagggccaa

SEQ ID NO: 55431 - DNA, 25 bp, S. cerevisiae
tcaatgatggtttcccaacgggcgc

SEQ ID NO: 55432 - DNA, 25 bp, S. cerevisiae
tcatcgaattattagccaacggcgc

SEQ ID NO: 55433 - DNA, 25 bp, S. cerevisiae
tcagcgatactaaagcagcaccggt

SEQ ID NO: 55434 - DNA, 25 bp, S. cerevisiae
tatcgatactaaggcttccaagggt

SEQ ID NO: 55435 - DNA, 25 bp, S. cerevisiae
tcacatgtccacctacttgaagatc

SEQ ID NO: 55436 - DNA, 25 bp, S. cerevisiae
tacttccacgtcaatgtcatcgatg

SEQ ID NO: 55437 - DNA, 25 bp, S. cerevisiae
tcatgcttcccgcaatatgtgaata

SEQ ID NO: 55438 - DNA, 25 bp, S. cerevisiae
tcatgtgcatgatcggtggtcttat

SEQ ID NO: 55439 - DNA, 25 bp, S. cerevisiae
taccaatacctattaccttcgggtg

SEQ ID NO: 55440 - DNA, 25 bp, S. cerevisiae
tcactcaagcctacttaaccatggg

SEQ ID NO: 55441 - DNA, 25 bp, S. cerevisiae
tacccattagcgtccaaatctgcca

SEQ ID NO: 55442 - DNA, 25 bp, S. cerevisiae
tacggttcagtagcacttggcggtc

SEQ ID NO: 55443 - DNA, 25 bp, S. cerevisiae
taaggtggacattcccttggaagtt

SEQ ID NO: 55444 - DNA, 25 bp, S. cerevisiae
tcactggtttagtttccatccgtgg

SEQ ID NO: 55445 - DNA, 25 bp, S. cerevisiae
tcaccgctttacttttaccgctata

SEQ ID NO: 55446 - DNA, 25 bp, S. cerevisiae
tcaagccatttttccttttctgttg

SEQ ID NO: 55447 - DNA, 25 bp, S. cerevisiae
tcagtgtgtttgtgttcccctacaa

SEQ ID NO: 55448 - DNA, 25 bp, S. cerevisiae
tcacgatcgccttcttttgtttaaa

SEQ ID NO: 55449 - DNA, 25 bp, S. cerevisiae
tcatcgtgtgagagccattggtgtc

SEQ ID NO: 55450 - DNA, 25 bp, S. cerevisiae
tcatcggtggacattctggtattac

SEQ ID NO: 55451 - DNA, 25 bp, S. cerevisiae
tcaccagtctcagcaggcattacaa

SEQ ID NO: 55452 - DNA, 25 bp, S. cerevisiae
tcagccactaactacgaggtcacgg

SEQ ID NO: 55453 - DNA, 25 bp, S. cerevisiae
tcacaaatactatagcggccatcgg

SEQ ID NO: 55454 - DNA, 25 bp, S. cerevisiae
tcaggaatgcaataatcggcgatat

SEQ ID NO: 55455 - DNA, 25 bp, S. cerevisiae
taaaaaattggctcgtgcgggaaat

SEQ ID NO: 55456 - DNA, 25 bp, S. cerevisiae
tcataactgcgggtctttttgtaca

SEQ ID NO: 55457 - DNA, 25 bp, S. cerevisiae
tcatgagcgaatgtagtgagccaat

SEQ ID NO: 55458 - DNA, 25 bp, S. cerevisiae
tcatgcatccattgcctcgtgtaaa

SEQ ID NO: 55459 - DNA, 25 bp, S. cerevisiae
tcatatgctcatattcctggaatag

SEQ ID NO: 55460 - DNA, 25 bp, S. cerevisiae
tcatctgcttctcgtactaatctag

SEQ ID NO: 55461 - DNA, 25 bp, S. cerevisiae
tcatttatttaaccttcgcaccatc

SEQ ID NO: 55462 - DNA, 25 bp, S. cerevisiae
tacgtttactgtagggtccaccaat

SEQ ID NO: 55463 - DNA, 25 bp, S. cerevisiae
taatgttaagccttggaacccacca

SEQ ID NO: 55464 - DNA, 25 bp, S. cerevisiae
tcaatcgttggctcggacggcagaa

SEQ ID NO: 55465 - DNA, 25 bp, S. cerevisiae
tcatacgggtgcttacgtcgcggaa

SEQ ID NO: 55466 - DNA, 25 bp, S. cerevisiae
tcaagggcctgttacgttgttggtc

SEQ ID NO: 55467 - DNA, 25 bp, S. cerevisiae
tcacctaccagacctctttaatttt

SEQ ID NO: 55468 - DNA, 25 bp, S. cerevisiae
tcaactactgaaccacttctttgtt

SEQ ID NO: 55469 - DNA, 25 bp, S. cerevisiae
tcaacgtcggaaacttcttctccta

SEQ ID NO: 55470 - DNA, 25 bp, S. cerevisiae
tcaccaacccagctagaattgctac

SEQ ID NO: 55471 - DNA, 25 bp, S. cerevisiae
tcagttgacccatatgacttgaaga

SEQ ID NO: 55472 - DNA, 25 bp, S. cerevisiae
taattccgactcacaatggtttcaa

SEQ ID NO: 55473 - DNA, 25 bp, S. cerevisiae
taacggatttcggtttttgcgctca

SEQ ID NO: 55474 - DNA, 25 bp, S. cerevisiae
taactttccctgatctttggactaa

SEQ ID NO: 55475 - DNA, 25 bp, S. cerevisiae
tcaaggacccggtattccaccaaga

SEQ ID NO: 55476 - DNA, 25 bp, S. cerevisiae
tacggacccgactagttgccaacaa

SEQ ID NO: 55477 - DNA, 25 bp, S. cerevisiae
taagtgggtccacatttccttcaat

SEQ ID NO: 55478 - DNA, 25 bp, S. cerevisiae
taatcgggttgctttttgcctttat

SEQ ID NO: 55479 - DNA, 25 bp, S. cerevisiae
tcactgcgagtgatgctgttgttgc

SEQ ID NO: 55480 - DNA, 25 bp, S. cerevisiae
tcagctggcgtcattcaattatctt

SEQ ID NO: 55481 - DNA, 25 bp, S. cerevisiae
tcagcgaggcgccattcaatgttta

SEQ ID NO: 55482 - DNA, 25 bp, S. cerevisiae
tcaggagacaccatcttctgttcaa

SEQ ID NO: 55483 - DNA, 25 bp, S. cerevisiae
tcacggcaacgattttttacaacat

SEQ ID NO: 55484 - DNA, 25 bp, S. cerevisiae
tcaacgccagcgagcagtctattgt

SEQ ID NO: 55485 - DNA, 25 bp, S. cerevisiae
tcagacgtttctggcgttgttgaaa

SEQ ID NO: 55486 - DNA, 25 bp, S. cerevisiae
tcagcaattggttggctgcccgtaa

SEQ ID NO: 55487 - DNA, 25 bp, S. cerevisiae
tcagatctaagttggctgccggtat

SEQ ID NO: 55488 - DNA, 25 bp, S. cerevisiae
tcatgggccctaccaggtcgtataa

SEQ ID NO: 55489 - DNA, 25 bp, S. cerevisiae
taagggcgcaaccaggtcgtaaacg

SEQ ID NO: 55490 - DNA, 25 bp, S. cerevisiae
tatagaggccaaagtcgtcggaata

SEQ ID NO: 55491 - DNA, 25 bp, S. cerevisiae
tcacaaggcctctgtcgttgaagac

SEQ ID NO: 55492 - DNA, 25 bp, S. cerevisiae
tcacaaacattcttgacagactaaa

SEQ ID NO: 55493 - DNA, 25 bp, S. cerevisiae
tcaaagatacactgccccgaaatgg

SEQ ID NO: 55494 - DNA, 25 bp, S. cerevisiae
tcacgaaaattctctctctataatg

SEQ ID NO: 55495 - DNA, 25 bp, S. cerevisiae
tcagcagcaaactcaccgttgaagt

SEQ ID NO: 55496 - DNA, 25 bp, S. cerevisiae
tcagcagcaaatacccacttcagta

SEQ ID NO: 55497 - DNA, 25 bp, S. cerevisiae
tcatgacaatagaccaatttacaag

SEQ ID NO: 55498 - DNA, 25 bp, S. cerevisiae
tcagacaatggcaaactttacggtt

SEQ ID NO: 55499 - DNA, 25 bp, S. cerevisiae
tcagaaagcatttcctctctaggaa

SEQ ID NO: 55500 - DNA, 25 bp, S. cerevisiae
tcagaccttcccaactatcaaaatg

SEQ ID NO: 55501 - DNA, 25 bp, S. cerevisiae
tcatttgttctccattcatgcgcat

SEQ ID NO: 55502 - DNA, 25 bp, S. cerevisiae
tcatttgtctgttcatactgtgcta

SEQ ID NO: 55503 - DNA, 25 bp, S. cerevisiae
tcacttgatctaataaatggttctc

SEQ ID NO: 55504 - DNA, 25 bp, S. cerevisiae
tcattagtgcatattccgagttcaa

SEQ ID NO: 55505 - DNA, 25 bp, S. cerevisiae
tcatctactcattgttgcgggtggc

SEQ ID NO: 55506 - DNA, 25 bp, S. cerevisiae
taagtcaagtacgacgcgtggagac

SEQ ID NO: 55507 - DNA, 25 bp, S. cerevisiae
tcatccgatgcttacagagactcta

SEQ ID NO: 55508 - DNA, 25 bp, S. cerevisiae
tcaccacccacctggatgtatatga

SEQ ID NO: 55509 - DNA, 25 bp, S. cerevisiae
tcaccgctaagcctgaagatgccat

SEQ ID NO: 55510 - DNA, 25 bp, S. cerevisiae
tcaccaccaggcagagaaccaattg

SEQ ID NO: 55511 - DNA, 25 bp, S. cerevisiae
tcacctcagggcttggatacacgta

SEQ ID NO: 55512 - DNA, 25 bp, S. cerevisiae
tcaacaagatggtcggtaacagata

SEQ ID NO: 55513 - DNA, 25 bp, S. cerevisiae
taacgagctgaatgcgccacacgat

SEQ ID NO: 55514 - DNA, 25 bp, S. cerevisiae
tcactggccattttttcactgctaa

SEQ ID NO: 55515 - DNA, 25 bp, S. cerevisiae
tcaaagaacctaccgtttgttgcgt

SEQ ID NO: 55516 - DNA, 25 bp, S. cerevisiae
tcagaaaagttacctggtcccctca

SEQ ID NO: 55517 - DNA, 25 bp, S. cerevisiae
tagacaacggtaccggtcgtactgg

SEQ ID NO: 55518 - DNA, 25 bp, S. cerevisiae
tcacaaaccaactgccggctgaaag

SEQ ID NO: 55519 - DNA, 25 bp, S. cerevisiae
tcacgacccaaaagctgccttgaga

SEQ ID NO: 55520 - DNA, 25 bp, S. cerevisiae
tcatccacataactcagatccatct

SEQ ID NO: 55521 - DNA, 25 bp, S. cerevisiae
tcacgccatcaacagttcctaatat

SEQ ID NO: 55522 - DNA, 25 bp, S. cerevisiae
tcatccttatcatcatcttctttca

SEQ ID NO: 55523 - DNA, 25 bp, S. cerevisiae
tcagccattacttcggataccattc

SEQ ID NO: 55524 - DNA, 25 bp, S. cerevisiae
tcagacattcaccacacttactatt

SEQ ID NO: 55525 - DNA, 25 bp, S. cerevisiae
tcatgagatttccaagtgccactag

SEQ ID NO: 55526 - DNA, 25 bp, S. cerevisiae
taatattgatgcctcgatccctgaa

SEQ ID NO: 55527 - DNA, 25 bp, S. cerevisiae
tcacatgttgtggtagccgacgaaa

SEQ ID NO: 55528 - DNA, 25 bp, S. cerevisiae
tcatccttcaattttgtggcatata

SEQ ID NO: 55529 - DNA, 25 bp, S. cerevisiae
tcatgcctccaatgttctatggtgt

SEQ ID NO: 55530 - DNA, 25 bp, S. cerevisiae
tcatatccgcaatttgtttgcccca

SEQ ID NO: 55531 - DNA, 25 bp, S. cerevisiae
tcaatcatttctctctttcttacaa

SEQ ID NO: 55532 - DNA, 25 bp, S. cerevisiae
tcagagccccatctagaatcttcta

SEQ ID NO: 55533 - DNA, 25 bp, S. cerevisiae
tcatgttgtgcccatttgaagctat

SEQ ID NO: 55534 - DNA, 25 bp, S. cerevisiae
tcacgttgctggtttgttgacctac

SEQ ID NO: 55535 - DNA, 25 bp, S. cerevisiae
tcaggtatgcttattcgtatctcta

SEQ ID NO: 55536 - DNA, 25 bp, S. cerevisiae
taatttagctttgccatttttcggt

SEQ ID NO: 55537 - DNA, 25 bp, S. cerevisiae
taattctggcttagtcgtacgatac

SEQ ID NO: 55538 - DNA, 25 bp, S. cerevisiae
tcacttctgagggttctaaagcaac

SEQ ID NO: 55539 - DNA, 25 bp, S. cerevisiae
tcacctcttgtcctatcgaacagaa

SEQ ID NO: 55540 - DNA, 25 bp, S. cerevisiae
tcataccctgacatcgctgtagagg

SEQ ID NO: 55541 - DNA, 25 bp, S. cerevisiae
tcacccctgaagatgctgacgaaga

SEQ ID NO: 55542 - DNA, 25 bp, S. cerevisiae
tcacaccactgaagactgcgggatt

SEQ ID NO: 55543 - DNA, 25 bp, S. cerevisiae
tcacatctgatgtatggtcacttgg

SEQ ID NO: 55544 - DNA, 25 bp, S. cerevisiae
tagtatatgaagcatctttagcggg

SEQ ID NO: 55545 - DNA, 25 bp, S. cerevisiae
tcagtattgccctgagtggcaccaa

SEQ ID NO: 55546 - DNA, 25 bp, S. cerevisiae
tcagaacttcgctggatcgcacaag

SEQ ID NO: 55547 - DNA, 25 bp, S. cerevisiae
tcatcaacctcactcagatacagac

SEQ ID NO: 55548 - DNA, 25 bp, S. cerevisiae
tcacacatcctgttcgataaggcag

SEQ ID NO: 55549 - DNA, 25 bp, S. cerevisiae
tcatatccgtttcatgcaagccata

SEQ ID NO: 55550 - DNA, 25 bp, S. cerevisiae
tcacaccgtttgttcaacagagcat

SEQ ID NO: 55551 - DNA, 25 bp, S. cerevisiae
tcacactcttatacgcctacaagtt

SEQ ID NO: 55552 - DNA, 25 bp, S. cerevisiae
tcatcatttcttttgggttcccatg

SEQ ID NO: 55553 - DNA, 25 bp, S. cerevisiae
tcaatcccttaacggactttgctgg

SEQ ID NO: 55554 - DNA, 25 bp, S. cerevisiae
tcagacccttacatgcttgttgagc

SEQ ID NO: 55555 - DNA, 25 bp, S. cerevisiae
tcacggattcggtcagttctgttgc

SEQ ID NO: 55556 - DNA, 25 bp, S. cerevisiae
tcacggaccgatgtgcttcgttgaa

SEQ ID NO: 55557 - DNA, 25 bp, S. cerevisiae
tcagggagcctgatcttccgaggaa

SEQ ID NO: 55558 - DNA, 25 bp, S. cerevisiae
tcatgtggtctcttatgctatgccg

SEQ ID NO: 55559 - DNA, 25 bp, S. cerevisiae
taaaggccggcaaagcaatgggcgc

SEQ ID NO: 55560 - DNA, 25 bp, S. cerevisiae
taaacgccggagtcgtcggtgctgc

SEQ ID NO: 55561 - DNA, 25 bp, S. cerevisiae
tcaagtcgtcggtgctaagggtcat

SEQ ID NO: 55562 - DNA, 25 bp, S. cerevisiae
tcaagtcctcggtcctaagtttgaa

SEQ ID NO: 55563 - DNA, 25 bp, S. cerevisiae
tcagtaagcactcccgttaatcatt

SEQ ID NO: 55564 - DNA, 25 bp, S. cerevisiae
taaaaggtcgactggcaccacgggt

SEQ ID NO: 55565 - DNA, 25 bp, S. cerevisiae
tcaaaaggacgctgtttccgccatt

SEQ ID NO: 55566 - DNA, 25 bp, S. cerevisiae
taaattgaaggagcttttccccagg

SEQ ID NO: 55567 - DNA, 25 bp, S. cerevisiae
taaattacaggtccctttccgctgc

SEQ ID NO: 55568 - DNA, 25 bp, S. cerevisiae
tcaaaatccggttttagctgccgtc

SEQ ID NO: 55569 - DNA, 25 bp, S. cerevisiae
tattaaatttctttaatgatccttc

SEQ ID NO: 55570 - DNA, 25 bp, S. cerevisiae
tcaaatcacgcaaaggccatcactg

SEQ ID NO: 55571 - DNA, 25 bp, S. cerevisiae
tcatccccatgttatccaggtcatg

SEQ ID NO: 55572 - DNA, 25 bp, S. cerevisiae
tcatctcccgagaatcagcaggacg

SEQ ID NO: 55573 - DNA, 25 bp, S. cerevisiae
taatggcgtagttagccctaaacct

SEQ ID NO: 55574 - DNA, 25 bp, S. cerevisiae
taccggtattttcccagcaaactat

SEQ ID NO: 55575 - DNA, 25 bp, S. cerevisiae
tcatcagtggttattcccgctaaat

SEQ ID NO: 55576 - DNA, 25 bp, S. cerevisiae
tcacgtccagcaatggcaatccgga

SEQ ID NO: 55577 - DNA, 25 bp, S. cerevisiae
tcactggtgccaatgtattatcgag

SEQ ID NO: 55578 - DNA, 25 bp, S. cerevisiae
tcatgggtccattggttgtctcaac

SEQ ID NO: 55579 - DNA, 25 bp, S. cerevisiae
tcaaggtaccagatgttctccactt

SEQ ID NO: 55580 - DNA, 25 bp, S. cerevisiae
tcaaggtacgcatttgtgcctcaat

SEQ ID NO: 55581 - DNA, 25 bp, S. cerevisiae
tacaggtagcggtgggaaatcatat

SEQ ID NO: 55582 - DNA, 25 bp, S. cerevisiae
tcagcaagatttgacggcaccgact

SEQ ID NO: 55583 - DNA, 25 bp, S. cerevisiae
tcaaatgtttgataaggaccctatt

SEQ ID NO: 55584 - DNA, 25 bp, S. cerevisiae
tcaagatttcgacctagatggcccc

SEQ ID NO: 55585 - DNA, 25 bp, S. cerevisiae
tcaaatgtcctatcattatcgtcta

SEQ ID NO: 55586 - DNA, 25 bp, S. cerevisiae
tcaggctgctcttaacttcattatg

SEQ ID NO: 55587 - DNA, 25 bp, S. cerevisiae
taattgttcaagattcattcataat

SEQ ID NO: 55588 - DNA, 25 bp, S. cerevisiae
taattggtcgtacttctgttgaatg

SEQ ID NO: 55589 - DNA, 25 bp, S. cerevisiae
tcaccatctttttccgcgtatcaga

SEQ ID NO: 55590 - DNA, 25 bp, S. cerevisiae
tcagcctatcgatcccttagatgat

SEQ ID NO: 55591 - DNA, 25 bp, S. cerevisiae
tcatgtgttctgtcttctcacgaca

SEQ ID NO: 55592 - DNA, 25 bp, S. cerevisiae
tcatgtacttcaaagctcatccctt

SEQ ID NO: 55593 - DNA, 25 bp, S. cerevisiae
tttactttacgtacgccttggcagt

SEQ ID NO: 55594 - DNA, 25 bp, S. cerevisiae
tcactttcggcggttttctcttctt

SEQ ID NO: 55595 - DNA, 25 bp, S. cerevisiae
tcacgcaggtggctctattgtacac

SEQ ID NO: 55596 - DNA, 25 bp, S. cerevisiae
tcacgccttggcaatcttttatcag

SEQ ID NO: 55597 - DNA, 25 bp, S. cerevisiae
tcaacaagctcctgtgtgatgtctt

SEQ ID NO: 55598 - DNA, 25 bp, S. cerevisiae
tcaagcacctcctcagggaaatggt

SEQ ID NO: 55599 - DNA, 25 bp, S. cerevisiae
tcaagactttaaccggtaagactat

SEQ ID NO: 55600 - DNA, 25 bp, S. cerevisiae
tcaaaccttttgaccctgaactgtt

SEQ ID NO: 55601 - DNA, 25 bp, S. cerevisiae
taagttgcacgctgtcaccattgac

SEQ ID NO: 55602 - DNA, 25 bp, S. cerevisiae
tcaacttttggatgctaccgaaata

SEQ ID NO: 55603 - DNA, 25 bp, S. cerevisiae
tcaaccgtgggaggacatccgacaa

SEQ ID NO: 55604 - DNA, 25 bp, S. cerevisiae
tcaagactagttctactccgacaac

SEQ ID NO: 55605 - DNA, 25 bp, S. cerevisiae
tcaaagccgcttctgaatccatcaa

SEQ ID NO: 55606 - DNA, 25 bp, S. cerevisiae
tcaaggctgcccaggaagcggaaat

SEQ ID NO: 55607 - DNA, 25 bp, S. cerevisiae
tcagaagcaccgaggagagttccaa

SEQ ID NO: 55608 - DNA, 25 bp, S. cerevisiae
tcaacaaccccgtcaagttcaatga

SEQ ID NO: 55609 - DNA, 25 bp, S. cerevisiae
tacaaggccccagaagtgctttttg

SEQ ID NO: 55610 - DNA, 25 bp, S. cerevisiae
taagatccccattgttccagtggtt

SEQ ID NO: 55611 - DNA, 25 bp, S. cerevisiae
ttagatcttcgccagactcgagcga

SEQ ID NO: 55612 - DNA, 25 bp, S. cerevisiae
taagacagtagaccctgcgagcgca

SEQ ID NO: 55613 - DNA, 25 bp, S. cerevisiae
tcaaacgtgcctccaaggctttgat

SEQ ID NO: 55614 - DNA, 25 bp, S. cerevisiae
taagaaggctgaagaaactattgct

SEQ ID NO: 55615 - DNA, 25 bp, S. cerevisiae
tcaagacaagagacgcatgcccatt

SEQ ID NO: 55616 - DNA, 25 bp, S. cerevisiae
tcatgatgatgctaggagggaccaa

SEQ ID NO: 55617 - DNA, 25 bp, S. cerevisiae
taaaacaggattcctccgacggtga

SEQ ID NO: 55618 - DNA, 25 bp, S. cerevisiae
taagcctagtaaacctgaatcgtcg

SEQ ID NO: 55619 - DNA, 25 bp, S. cerevisiae
taatgtcatgagcaacccaaacgtt

SEQ ID NO: 55620 - DNA, 25 bp, S. cerevisiae
taagtggcggaactacaacgcttaa

SEQ ID NO: 55621 - DNA, 25 bp, S. cerevisiae
taagggagggaaccaccgctcaaga

SEQ ID NO: 55622 - DNA, 25 bp, S. cerevisiae
tcaagttcagggttggacctgccaa

SEQ ID NO: 55623 - DNA, 25 bp, S. cerevisiae
tcagaattggcgcagggagtgttaa

SEQ ID NO: 55624 - DNA, 25 bp, S. cerevisiae
tcaggtcttccgtagcggtatctaa

SEQ ID NO: 55625 - DNA, 25 bp, S. cerevisiae
tcacgtcaagccagtgagatgtgtt

SEQ ID NO: 55626 - DNA, 25 bp, S. cerevisiae
tcactgatcataggtgcgggttcac

SEQ ID NO: 55627 - DNA, 25 bp, S. cerevisiae
tcacttttgaagatgcgttcgccgt

SEQ ID NO: 55628 - DNA, 25 bp, S. cerevisiae
taccccgctatacaaggccacgata

SEQ ID NO: 55629 - DNA, 25 bp, S. cerevisiae
tagcgaccccaacttggtggacgaa

SEQ ID NO: 55630 - DNA, 25 bp, S. cerevisiae
tatcgaccctaatagcggacctaga

SEQ ID NO: 55631 - DNA, 25 bp, S. cerevisiae
tacggtctaagttacaggatcccaa

SEQ ID NO: 55632 - DNA, 25 bp, S. cerevisiae
tcaagattccgaggcacgtttctgg

SEQ ID NO: 55633 - DNA, 25 bp, S. cerevisiae
tcaatggccgcgtgtcatgagagtg

SEQ ID NO: 55634 - DNA, 25 bp, S. cerevisiae
tcaatgtagcgcttggtccaggtac

SEQ ID NO: 55635 - DNA, 25 bp, S. cerevisiae
tcaatggcagctgcttgatgcgcaa

SEQ ID NO: 55636 - DNA, 25 bp, S. cerevisiae
tcatgtaccatgttgctgcaggaca

SEQ ID NO: 55637 - DNA, 25 bp, S. cerevisiae
tcatgattacttcttctgcacacaa

SEQ ID NO: 55638 - DNA, 25 bp, S. cerevisiae
tcagaatgtcttatggctcgcatga

SEQ ID NO: 55639 - DNA, 25 bp, S. cerevisiae
tcacagtatgctatgccacactatc

SEQ ID NO: 55640 - DNA, 25 bp, S. cerevisiae
tcagagttagttccagaccatccac

SEQ ID NO: 55641 - DNA, 25 bp, S. cerevisiae
tcagcgtaagtttgccatggaccat

SEQ ID NO: 55642 - DNA, 25 bp, S. cerevisiae
tcagcggcaatgttcctttcgagaa

SEQ ID NO: 55643 - DNA, 25 bp, S. cerevisiae
tcaccgcattgcacgtttctgatga

SEQ ID NO: 55644 - DNA, 25 bp, S. cerevisiae
taatcgccttcggtttcgttagagg

SEQ ID NO: 55645 - DNA, 25 bp, S. cerevisiae
tcaagtcgcattgccttttctggag

SEQ ID NO: 55646 - DNA, 25 bp, S. cerevisiae
tcaagtgccttggtactcttctaga

SEQ ID NO: 55647 - DNA, 25 bp, S. cerevisiae
tcaagttcaatgacgaccccagact

SEQ ID NO: 55648 - DNA, 25 bp, S. cerevisiae
tcagaatgggtattgacccctccgt

SEQ ID NO: 55649 - DNA, 25 bp, S. cerevisiae
taggcacgttagtaggcccaccgat

SEQ ID NO: 55650 - DNA, 25 bp, S. cerevisiae
tcaacaattgatgctaacgtcgaag

SEQ ID NO: 55651 - DNA, 25 bp, S. cerevisiae
taacactctacccaatcgtaaaccg

SEQ ID NO: 55652 - DNA, 25 bp, S. cerevisiae
taaccagaacccaagtgaatacctc

SEQ ID NO: 55653 - DNA, 25 bp, S. cerevisiae
taatctccgccgctgagttgaaaca

SEQ ID NO: 55654 - DNA, 25 bp, S. cerevisiae
taatcctagcttcactccaaaatct

SEQ ID NO: 55655 - DNA, 25 bp, S. cerevisiae
taatttacattcttacgaaaagcgt

SEQ ID NO: 55656 - DNA, 25 bp, S. cerevisiae
taagattggaacttcccaccgtcga

SEQ ID NO: 55657 - DNA, 25 bp, S. cerevisiae
tcaaccatcaacctgtccaagaagt

SEQ ID NO: 55658 - DNA, 25 bp, S. cerevisiae
tcaaccagccaacaccaagatcggt

SEQ ID NO: 55659 - DNA, 25 bp, S. cerevisiae
tcaaatactctatcgctcaaggcgg

SEQ ID NO: 55660 - DNA, 25 bp, S. cerevisiae
tcagaattttacaagcaaaagcgct

SEQ ID NO: 55661 - DNA, 25 bp, S. cerevisiae
tcagcatttagcaccaccaagattt

SEQ ID NO: 55662 - DNA, 25 bp, S. cerevisiae
tcaattgattgaaccaccatttttg

SEQ ID NO: 55663 - DNA, 25 bp, S. cerevisiae
tcaatttctgatctttccaccttat

SEQ ID NO: 55664 - DNA, 25 bp, S. cerevisiae
tcaagtttagtaggatccccttcac

SEQ ID NO: 55665 - DNA, 25 bp, S. cerevisiae
tcacaatcttttgcgatcccttata

SEQ ID NO: 55666 - DNA, 25 bp, S. cerevisiae
tcaaatatgtttccacacccgtgat

SEQ ID NO: 55667 - DNA, 25 bp, S. cerevisiae
taatctatttaacccgcacagtcac

SEQ ID NO: 55668 - DNA, 25 bp, S. cerevisiae
tcaatcctttacatatcgatcccac

SEQ ID NO: 55669 - DNA, 25 bp, S. cerevisiae
tcacaactgggctgccaaggcaaag

SEQ ID NO: 55670 - DNA, 25 bp, S. cerevisiae
tcactagtgagcacgcctaaactcg

SEQ ID NO: 55671 - DNA, 25 bp, S. cerevisiae
tttagctggcccattacatggtcgt

SEQ ID NO: 55672 - DNA, 25 bp, S. cerevisiae
taatgaccacttccaacaacaacag

SEQ ID NO: 55673 - DNA, 25 bp, S. cerevisiae
tcaatcatctcgcatcgcaacaaaa

SEQ ID NO: 55674 - DNA, 25 bp, S. cerevisiae
tcagagctcatcgtggtatcagaca

SEQ ID NO: 55675 - DNA, 25 bp, S. cerevisiae
taattgcatgcggtgatatcagaca

SEQ ID NO: 55676 - DNA, 25 bp, S. cerevisiae
tcactgtacatgaagcctctacggc

SEQ ID NO: 55677 - DNA, 25 bp, S. cerevisiae
tcactatatcctggctctatgaatg

SEQ ID NO: 55678 - DNA, 25 bp, S. cerevisiae
tcaggtctcctcgtgctataaaaaa

SEQ ID NO: 55679 - DNA, 25 bp, S. cerevisiae
tcagcttcacggatgatttccaggg

SEQ ID NO: 55680 - DNA, 25 bp, S. cerevisiae
tcactagccgtttatccctttgcgt

SEQ ID NO: 55681 - DNA, 25 bp, S. cerevisiae
tcaactaactttggcgtcatcgtct

SEQ ID NO: 55682 - DNA, 25 bp, S. cerevisiae
tcaacaaactttccggtccatgttc

SEQ ID NO: 55683 - DNA, 25 bp, S. cerevisiae
tcaagccaactccagaaacgccatt

SEQ ID NO: 55684 - DNA, 25 bp, S. cerevisiae
tcaacggctatcgagtggactaaca

SEQ ID NO: 55685 - DNA, 25 bp, S. cerevisiae
taccacctcttttgacgaaacgcct

SEQ ID NO: 55686 - DNA, 25 bp, S. cerevisiae
taatgacactatatccttaaacgga

SEQ ID NO: 55687 - DNA, 25 bp, S. cerevisiae
taagggtaacgctttcaaacacaag

SEQ ID NO: 55688 - DNA, 25 bp, S. cerevisiae
tcaccattattattttctcttccgc

SEQ ID NO: 55689 - DNA, 25 bp, S. cerevisiae
tcagtatttcttctttttcccttca

SEQ ID NO: 55690 - DNA, 25 bp, S. cerevisiae
tcagtttgtttcgtttttcctcatt

SEQ ID NO: 55691 - DNA, 25 bp, S. cerevisiae
tacttgggtgactatttcggcatcc

SEQ ID NO: 55692 - DNA, 25 bp, S. cerevisiae
tcacgtggcctggtttgtcaactac

SEQ ID NO: 55693 - DNA, 25 bp, S. cerevisiae
tcacattggccggtttacacactaa

SEQ ID NO: 55694 - DNA, 25 bp, S. cerevisiae
taatattccgttgttgcccggcgaa

SEQ ID NO: 55695 - DNA, 25 bp, S. cerevisiae
tcaaaatcgtttggttctactccgg

SEQ ID NO: 55696 - DNA, 25 bp, S. cerevisiae
tcagaattcgttggtgtcggctcta

SEQ ID NO: 55697 - DNA, 25 bp, S. cerevisiae
tcaagttcgttccatctaagccaat

SEQ ID NO: 55698 - DNA, 25 bp, S. cerevisiae
tcacttccgagtctgctattgtaac

SEQ ID NO: 55699 - DNA, 25 bp, S. cerevisiae
tcactaccgaggagttcattgacgc

SEQ ID NO: 55700 - DNA, 25 bp, S. cerevisiae
tcactactcagggacacttcaagac

SEQ ID NO: 55701 - DNA, 25 bp, S. cerevisiae
tcaaggccaatgctgctggtgccaa

SEQ ID NO: 55702 - DNA, 25 bp, S. cerevisiae
tcaagcactacttagatggcctctt

SEQ ID NO: 55703 - DNA, 25 bp, S. cerevisiae
tcaccaatgctgacacctagcggaa

SEQ ID NO: 55704 - DNA, 25 bp, S. cerevisiae
tcaagagatcattacgctagggcga

SEQ ID NO: 55705 - DNA, 25 bp, S. cerevisiae
tcaatcaatcattcgtcggcagtgg

SEQ ID NO: 55706 - DNA, 25 bp, S. cerevisiae
tcaataattcctggcgggtacgcgc

SEQ ID NO: 55707 - DNA, 25 bp, S. cerevisiae
tcaagaaatcctgtactgctacgag

SEQ ID NO: 55708 - DNA, 25 bp, S. cerevisiae
tcacaagtctacatcctctttgttg

SEQ ID NO: 55709 - DNA, 25 bp, S. cerevisiae
tcacgtctttccttcatattttcaa

SEQ ID NO: 55710 - DNA, 25 bp, S. cerevisiae
tcaccatctggtgggatatttttcc

SEQ ID NO: 55711 - DNA, 25 bp, S. cerevisiae
tcacgagctctgctggagattcaat

SEQ ID NO: 55712 - DNA, 25 bp, S. cerevisiae
tcaagagctctgctgctggtaacac

SEQ ID NO: 55713 - DNA, 25 bp, S. cerevisiae
tcaagatgtctgttctcggtactca

SEQ ID NO: 55714 - DNA, 25 bp, S. cerevisiae
tcaagattccattcactattctccg

SEQ ID NO: 55715 - DNA, 25 bp, S. cerevisiae
taaaatctttatcttccgctttgcc

SEQ ID NO: 55716 - DNA, 25 bp, S. cerevisiae
taattatttcctccttatcgttcca

SEQ ID NO: 55717 - DNA, 25 bp, S. cerevisiae
taagtttcaccgatttgcctgtcaa

SEQ ID NO: 55718 - DNA, 25 bp, S. cerevisiae
tcaaggtttacctaagctgccaaat

SEQ ID NO: 55719 - DNA, 25 bp, S. cerevisiae
tcaatcccaatgacccgaagctaaa

SEQ ID NO: 55720 - DNA, 25 bp, S. cerevisiae
tcaactagaaggtggcgttcataat

SEQ ID NO: 55721 - DNA, 25 bp, S. cerevisiae
taatgctaaaggtggcctagccaaa

SEQ ID NO: 55722 - DNA, 25 bp, S. cerevisiae
taactacaacccagccatatcaaaa

SEQ ID NO: 55723 - DNA, 25 bp, S. cerevisiae
tcagcatttccccaggacgatgaag

SEQ ID NO: 55724 - DNA, 25 bp, S. cerevisiae
taatttccacgatagcagcgagagc

SEQ ID NO: 55725 - DNA, 25 bp, S. cerevisiae
taaccaatccgttcttgtttaagat

SEQ ID NO: 55726 - DNA, 25 bp, S. cerevisiae
tatcaaaacgaccaacttcctacca

SEQ ID NO: 55727 - DNA, 25 bp, S. cerevisiae
taaaaatgccccaattaccgaccat

SEQ ID NO: 55728 - DNA, 25 bp, S. cerevisiae
taaccctcgtccaaaacgcgaagat

SEQ ID NO: 55729 - DNA, 25 bp, S. cerevisiae
taagcgttggtgattattctgggca

SEQ ID NO: 55730 - DNA, 25 bp, S. cerevisiae
taaggactggtgtctatccggcaaa

SEQ ID NO: 55731 - DNA, 25 bp, S. cerevisiae
tcaagacctggttcatatcgacgag

SEQ ID NO: 55732 - DNA, 25 bp, S. cerevisiae
tcaagccagctttctctgggtctaa

SEQ ID NO: 55733 - DNA, 25 bp, S. cerevisiae
tcaacgtcggtggaatggcagcaaa

SEQ ID NO: 55734 - DNA, 25 bp, S. cerevisiae
tcaacgtcctgcttggtcgaataat

SEQ ID NO: 55735 - DNA, 25 bp, S. cerevisiae
tcaacgattctagcagtcgataatt

SEQ ID NO: 55736 - DNA, 25 bp, S. cerevisiae
tcaagctctctctagacgttatcaa

SEQ ID NO: 55737 - DNA, 25 bp, S. cerevisiae
tcacatctgccattaacttctacta

SEQ ID NO: 55738 - DNA, 25 bp, S. cerevisiae
tcacatctcagaaccactatcatac

SEQ ID NO: 55739 - DNA, 25 bp, S. cerevisiae
tcacctctgggttcatatcatgcat

SEQ ID NO: 55740 - DNA, 25 bp, S. cerevisiae
tcaccactgaagcaactcacaactt

SEQ ID NO: 55741 - DNA, 25 bp, S. cerevisiae
tcacgcggcacttctcataataaaa

SEQ ID NO: 55742 - DNA, 25 bp, S. cerevisiae
tcaagcggcagtttcaaagaacaat

SEQ ID NO: 55743 - DNA, 25 bp, S. cerevisiae
tcaacgcggctttgccaggaacaat

SEQ ID NO: 55744 - DNA, 25 bp, S. cerevisiae
tcaacaaatgcttgcgctcatccaa

SEQ ID NO: 55745 - DNA, 25 bp, S. cerevisiae
tcaaagaatgctgcccaaccaattg

SEQ ID NO: 55746 - DNA, 25 bp, S. cerevisiae
tcaaaggtttcctattcccattggt

SEQ ID NO: 55747 - DNA, 25 bp, S. cerevisiae
taaaccgtacgctttaactgcagtt

SEQ ID NO: 55748 - DNA, 25 bp, S. cerevisiae
tcacaatactttcttccatactact

SEQ ID NO: 55749 - DNA, 25 bp, S. cerevisiae
tcaaagaccaagattcaacagagaa

SEQ ID NO: 55750 - DNA, 25 bp, S. cerevisiae
tcaaagaccaagattcaacagagaa

SEQ ID NO: 55751 - DNA, 25 bp, S. cerevisiae
tcaacaacctcgacttcatcaaatg

SEQ ID NO: 55752 - DNA, 25 bp, S. cerevisiae
tcaattgttgctggtgtcgctgcta

SEQ ID NO: 55753 - DNA, 25 bp, S. cerevisiae
tcaatttcttttacggtgactcctt

SEQ ID NO: 55754 - DNA, 25 bp, S. cerevisiae
taagcggatatatcgggtcaggccc

SEQ ID NO: 55755 - DNA, 25 bp, S. cerevisiae
taatcaatgatttacccgtgggccc

SEQ ID NO: 55756 - DNA, 25 bp, S. cerevisiae
tcaaaggcagaaagtcaccccgttc

SEQ ID NO: 55757 - DNA, 25 bp, S. cerevisiae
taatggtccaaagggcccatcacaa

SEQ ID NO: 55758 - DNA, 25 bp, S. cerevisiae
tcaaagttctaagttctccaagcaa

SEQ ID NO: 55759 - DNA, 25 bp, S. cerevisiae
tcaatggttgttcttcctatggcac

SEQ ID NO: 55760 - DNA, 25 bp, S. cerevisiae
tcacatggtcattatgggtcctaag

SEQ ID NO: 55761 - DNA, 25 bp, S. cerevisiae
tacatcgtctaacggtactgacgtt

SEQ ID NO: 55762 - DNA, 25 bp, S. cerevisiae
tcaattacctgaccccaagacaaat

SEQ ID NO: 55763 - DNA, 25 bp, S. cerevisiae
tcaccacaaccattaccatgacatt

SEQ ID NO: 55764 - DNA, 25 bp, S. cerevisiae
tcaaggaacataacggtgcagccaa

SEQ ID NO: 55765 - DNA, 25 bp, S. cerevisiae
tcaaggagcatgtttcgggcactaa

SEQ ID NO: 55766 - DNA, 25 bp, S. cerevisiae
tcaacgagatgatccacggcctcaa

SEQ ID NO: 55767 - DNA, 25 bp, S. cerevisiae
taatctggctcatccgatggacaag

SEQ ID NO: 55768 - DNA, 25 bp, S. cerevisiae
tcaaagcgcatctcctgtagtcaag

SEQ ID NO: 55769 - DNA, 25 bp, S. cerevisiae
tcaactgattatccagatcctgatt

SEQ ID NO: 55770 - DNA, 25 bp, S. cerevisiae
taatctcatcctacagatcctgtat

SEQ ID NO: 55771 - DNA, 25 bp, S. cerevisiae
taattacccaatgccgtatcatcct

SEQ ID NO: 55772 - DNA, 25 bp, S. cerevisiae
taaatcatcggaaccttcttacctt

SEQ ID NO: 55773 - DNA, 25 bp, S. cerevisiae
tcaagagacgtgttcctttggacct

SEQ ID NO: 55774 - DNA, 25 bp, S. cerevisiae
tcaaaagacttctcgcatcgcgtaa

SEQ ID NO: 55775 - DNA, 25 bp, S. cerevisiae
ttagggactctatctcacggtaacg

SEQ ID NO: 55776 - DNA, 25 bp, S. cerevisiae
tatacgagactcaggctacgcgaca

SEQ ID NO: 55777 - DNA, 25 bp, S. cerevisiae
tcaagatatactggcgcttccggac

SEQ ID NO: 55778 - DNA, 25 bp, S. cerevisiae
tcaactaatggatcgtgcagctaac

SEQ ID NO: 55779 - DNA, 25 bp, S. cerevisiae
taattttgagattgcgcggctaagc

SEQ ID NO: 55780 - DNA, 25 bp, S. cerevisiae
taattctggcaaactctggcctggt

SEQ ID NO: 55781 - DNA, 25 bp, S. cerevisiae
tcaatgttagcgacagattggcctg

SEQ ID NO: 55782 - DNA, 25 bp, S. cerevisiae
tcaagcttcttgacgttggcaataa

SEQ ID NO: 55783 - DNA, 25 bp, S. cerevisiae
tcaagctccgatttctcaacgtcaa

SEQ ID NO: 55784 - DNA, 25 bp, S. cerevisiae
tcaattcctgtctcctacgaataag

SEQ ID NO: 55785 - DNA, 25 bp, S. cerevisiae
tcaagatccctaccacaactttaat

SEQ ID NO: 55786 - DNA, 25 bp, S. cerevisiae
tcaccgcccagaacaagactgtttt

SEQ ID NO: 55787 - DNA, 25 bp, S. cerevisiae
tcaagtccacgtccaagaagcctaa

SEQ ID NO: 55788 - DNA, 25 bp, S. cerevisiae
tcaagcatccaaccctaaatttcta

SEQ ID NO: 55789 - DNA, 25 bp, S. cerevisiae
taatctaactccctcacaatctgta

SEQ ID NO: 55790 - DNA, 25 bp, S. cerevisiae
taattcacctctgcaaattgctgtt

SEQ ID NO: 55791 - DNA, 25 bp, S. cerevisiae
tcaacccggtgatcgattcatcatt

SEQ ID NO: 55792 - DNA, 25 bp, S. cerevisiae
taatgccactggtagggtctcggtt

SEQ ID NO: 55793 - DNA, 25 bp, S. cerevisiae
taatagcactgcaaagggcctgaag

SEQ ID NO: 55794 - DNA, 25 bp, S. cerevisiae
tcaaaactgcagtggctctcgcaaa

SEQ ID NO: 55795 - DNA, 25 bp, S. cerevisiae
taattggatcagagccttacgtagc

SEQ ID NO: 55796 - DNA, 25 bp, S. cerevisiae
tcaagtcctggatattctagagatg

SEQ ID NO: 55797 - DNA, 25 bp, S. cerevisiae
taaatcctacctacttccaatcctt

SEQ ID NO: 55798 - DNA, 25 bp, S. cerevisiae
tcaaagtcgacttggatgccgcaat

SEQ ID NO: 55799 - DNA, 25 bp, S. cerevisiae
tcaacagcagcgttactatcctcaa

SEQ ID NO: 55800 - DNA, 25 bp, S. cerevisiae
tcacaaacttctacttatcctggtc

SEQ ID NO: 55801 - DNA, 25 bp, S. cerevisiae
taatgtttctcagcgaaccgttcgt

SEQ ID NO: 55802 - DNA, 25 bp, S. cerevisiae
taatcttcttggcagtgacacctac

SEQ ID NO: 55803 - DNA, 25 bp, S. cerevisiae
taactgtttgcagattccacacctt

SEQ ID NO: 55804 - DNA, 25 bp, S. cerevisiae
taaggctaaggtgtccgattccggt

SEQ ID NO: 55805 - DNA, 25 bp, S. cerevisiae
taaaacgaacgctacagcttttccg

SEQ ID NO: 55806 - DNA, 25 bp, S. cerevisiae
taacccaggaggttgagttcgagaa

SEQ ID NO: 55807 - DNA, 25 bp, S. cerevisiae
taatcacgaggatggctttatcgaa

SEQ ID NO: 55808 - DNA, 25 bp, S. cerevisiae
taattgcatcacaagcacccggtac

SEQ ID NO: 55809 - DNA, 25 bp, S. cerevisiae
tcaagtccaacttggcccatgggat

SEQ ID NO: 55810 - DNA, 25 bp, S. cerevisiae
tcaattagctactttggccaaggat

SEQ ID NO: 55811 - DNA, 25 bp, S. cerevisiae
taattcgctacatatcccacaggat

SEQ ID NO: 55812 - DNA, 25 bp, S. cerevisiae
taattccgacttacaggcacagacc

SEQ ID NO: 55813 - DNA, 25 bp, S. cerevisiae
taatattccgcactttgccactgaa

SEQ ID NO: 55814 - DNA, 25 bp, S. cerevisiae
taattggtgcagtcattggctctcc

SEQ ID NO: 55815 - DNA, 25 bp, S. cerevisiae
taaggcggagagtggttccctatct

SEQ ID NO: 55816 - DNA, 25 bp, S. cerevisiae
ttatgttacggtgggtccgctggta

SEQ ID NO: 55817 - DNA, 25 bp, S. cerevisiae
taactgtcacggtttgtacgctggt

SEQ ID NO: 55818 - DNA, 25 bp, S. cerevisiae
taatcagccgttattggtcattcca

SEQ ID NO: 55819 - DNA, 25 bp, S. cerevisiae
tcaatatctctccaatacaccagtt

SEQ ID NO: 55820 - DNA, 25 bp, S. cerevisiae
tcacacagccttttgaccgatgtta

SEQ ID NO: 55821 - DNA, 25 bp, S. cerevisiae
tcaacacctttatctggagctgctt

SEQ ID NO: 55822 - DNA, 25 bp, S. cerevisiae
tcaaggcttttttctacgcgggcta

SEQ ID NO: 55823 - DNA, 25 bp, S. cerevisiae
taaggctctttatgccggcttagta

SEQ ID NO: 55824 - DNA, 25 bp, S. cerevisiae
taatctgggtgtgtccggctttatc

SEQ ID NO: 55825 - DNA, 25 bp, S. cerevisiae
tcaacgttgttggttcaggcagata

SEQ ID NO: 55826 - DNA, 25 bp, S. cerevisiae
tcaaggtggcttgatgatcgccgat

SEQ ID NO: 55827 - DNA, 25 bp, S. cerevisiae
tactcagagacttttgctcagccgt

SEQ ID NO: 55828 - DNA, 25 bp, S. cerevisiae
tcaaggagagcatcttctgcagccg

SEQ ID NO: 55829 - DNA, 25 bp, S. cerevisiae
taagatgtgactatgttgccctggg

SEQ ID NO: 55830 - DNA, 25 bp, S. cerevisiae
taattcattatcatcgccacttggc

SEQ ID NO: 55831 - DNA, 25 bp, S. cerevisiae
taaactaagcctgccactatggtta

SEQ ID NO: 55832 - DNA, 25 bp, S. cerevisiae
tcaatcagattttcgaaaccgtaag

SEQ ID NO: 55833 - DNA, 25 bp, S. cerevisiae
tcaatatcttcttccaaactctgtc

SEQ ID NO: 55834 - DNA, 25 bp, S. cerevisiae
taatgagtttagcacaaccccacca

SEQ ID NO: 55835 - DNA, 25 bp, S. cerevisiae
tcaatgttattaatgcgggcgtcgt

SEQ ID NO: 55836 - DNA, 25 bp, S. cerevisiae
tcaatcttatcttactgcgcgtcct

SEQ ID NO: 55837 - DNA, 25 bp, S. cerevisiae
tcaacttcatcatcttcacgatctt

SEQ ID NO: 55838 - DNA, 25 bp, S. cerevisiae
tcaatactactctttccaagctgct

SEQ ID NO: 55839 - DNA, 25 bp, S. cerevisiae
tcaaagttcttcttctgcacctaga

SEQ ID NO: 55840 - DNA, 25 bp, S. cerevisiae
tcaagttggctgtcttgtcctacta

SEQ ID NO: 55841 - DNA, 25 bp, S. cerevisiae
tcaaaggacactggtttacaaacat

SEQ ID NO: 55842 - DNA, 25 bp, S. cerevisiae
tcaagggtattggtttcacaaacac

SEQ ID NO: 55843 - DNA, 25 bp, S. cerevisiae
tacgggtccaagattgtctacagat

SEQ ID NO: 55844 - DNA, 25 bp, S. cerevisiae
taaggccccaagaaagcaattagct

SEQ ID NO: 55845 - DNA, 25 bp, S. cerevisiae
taaggcgcccagacaagatattact

SEQ ID NO: 55846 - DNA, 25 bp, S. cerevisiae
taaggtatgagaaactgtcatggaa

SEQ ID NO: 55847 - DNA, 25 bp, S. cerevisiae
taatgctttgatgctcacttatgga

SEQ ID NO: 55848 - DNA, 25 bp, S. cerevisiae
taagccggtttgcacaatgggaact

SEQ ID NO: 55849 - DNA, 25 bp, S. cerevisiae
taaacgtgctctatacaatttcggt

SEQ ID NO: 55850 - DNA, 25 bp, S. cerevisiae
tagaagcgtctttggaaaatgtccc

SEQ ID NO: 55851 - DNA, 25 bp, S. cerevisiae
tagaagatgttgtggcaaattgccc

SEQ ID NO: 55852 - DNA, 25 bp, S. cerevisiae
taataagcctgacggcacagtggcc

SEQ ID NO: 55853 - DNA, 25 bp, S. cerevisiae
tcaatgaacctcaaacggctttgtt

SEQ ID NO: 55854 - DNA, 25 bp, S. cerevisiae
taagtacgggtctggcttgtgtgtt

SEQ ID NO: 55855 - DNA, 25 bp, S. cerevisiae
tcaagacatcggctgtaggtcgcta

SEQ ID NO: 55856 - DNA, 25 bp, S. cerevisiae
tcaagaggtggtgctcggactgtac

SEQ ID NO: 55857 - DNA, 25 bp, S. cerevisiae
tcaaaggtgtcttctgggacccagc

SEQ ID NO: 55858 - DNA, 25 bp, S. cerevisiae
tcaaaggtgcttacgtgcttgctaa

SEQ ID NO: 55859 - DNA, 25 bp, S. cerevisiae
tacaaaggctgttgcgctaattaac

SEQ ID NO: 55860 - DNA, 25 bp, S. cerevisiae
tcaaaatggttgtcctttcccacaa

SEQ ID NO: 55861 - DNA, 25 bp, S. cerevisiae
tcaaattggtgtcccgcattcttaa

SEQ ID NO: 55862 - DNA, 25 bp, S. cerevisiae
tcaaatgtcagaataccctaggtaa

SEQ ID NO: 55863 - DNA, 25 bp, S. cerevisiae
taatctgccaatttcttcaggaaga

SEQ ID NO: 55864 - DNA, 25 bp, S. cerevisiae
taattgcggagcttcctgaggaatt

SEQ ID NO: 55865 - DNA, 25 bp, S. cerevisiae
tcaaatcctgtacgcctgatggcaa

SEQ ID NO: 55866 - DNA, 25 bp, S. cerevisiae
tcaacatcattcacccctgatgaag

SEQ ID NO: 55867 - DNA, 25 bp, S. cerevisiae
taatatcaagcacaccacatggaag

SEQ ID NO: 55868 - DNA, 25 bp, S. cerevisiae
tcacacaaacaccacgacattcaaa

SEQ ID NO: 55869 - DNA, 25 bp, S. cerevisiae
taagatagcacaagacgaagtccaa

SEQ ID NO: 55870 - DNA, 25 bp, S. cerevisiae
tcaacatgtgcagtggaaaccttaa

SEQ ID NO: 55871 - DNA, 25 bp, S. cerevisiae
tcaatcgtcattggaaaactctgaa

SEQ ID NO: 55872 - DNA, 25 bp, S. cerevisiae
tcaattgctgctcctgaagttaatg

SEQ ID NO: 55873 - DNA, 25 bp, S. cerevisiae
tcaattctgcatactacgcttatct

SEQ ID NO: 55874 - DNA, 25 bp, S. cerevisiae
tcaagctcaagactcgggatcacag

SEQ ID NO: 55875 - DNA, 25 bp, S. cerevisiae
tacaatgcacatgtcgtggtccagc

SEQ ID NO: 55876 - DNA, 25 bp, S. cerevisiae
taattagcttctttacatgcggccc

SEQ ID NO: 55877 - DNA, 25 bp, S. cerevisiae
taattttagtaaagcgcgccctgtg

SEQ ID NO: 55878 - DNA, 25 bp, S. cerevisiae
taattgtgtccatttcgtttgcggc

SEQ ID NO: 55879 - DNA, 25 bp, S. cerevisiae
taattgttcacttatcgagatccac

SEQ ID NO: 55880 - DNA, 25 bp, S. cerevisiae
taattagcaagctctcgcgatgcca

SEQ ID NO: 55881 - DNA, 25 bp, S. cerevisiae
taatgctaatcacttctcgccatac

SEQ ID NO: 55882 - DNA, 25 bp, S. cerevisiae
taagctccatgacttcgatgaccac

SEQ ID NO: 55883 - DNA, 25 bp, S. cerevisiae
taatgatcacaagtccaatggcaga

SEQ ID NO: 55884 - DNA, 25 bp, S. cerevisiae
tcaattgattgattctgccgccatg

SEQ ID NO: 55885 - DNA, 25 bp, S. cerevisiae
tcaacgtattcttggctgacatgaa

SEQ ID NO: 55886 - DNA, 25 bp, S. cerevisiae
tcaacttgctttgcgctacccaaaa

SEQ ID NO: 55887 - DNA, 25 bp, S. cerevisiae
tttgtttttaccgttgcgccagact

SEQ ID NO: 55888 - DNA, 25 bp, S. cerevisiae
taatggaccatcgactggtttccgc

SEQ ID NO: 55889 - DNA, 25 bp, S. cerevisiae
taaggacgcctacggtatctcgcag

SEQ ID NO: 55890 - DNA, 25 bp, S. cerevisiae
taaggacaggtgctggttcctctgt

SEQ ID NO: 55891 - DNA, 25 bp, S. cerevisiae
tcaacgacgttcctggatggcgcac

SEQ ID NO: 55892 - DNA, 25 bp, S. cerevisiae
taatcatgttttttggtggcgcacc

SEQ ID NO: 55893 - DNA, 25 bp, S. cerevisiae
tattttcccttcctacgcagaaaga

SEQ ID NO: 55894 - DNA, 25 bp, S. cerevisiae
tattcttaccttgtacgcccaaaag

SEQ ID NO: 55895 - DNA, 25 bp, S. cerevisiae
tacgccttcttatgtagcgcccgaa

SEQ ID NO: 55896 - DNA, 25 bp, S. cerevisiae
taacttacttaaaggcgccgctact

SEQ ID NO: 55897 - DNA, 25 bp, S. cerevisiae
ttagctcttacggaacaggttcagc

SEQ ID NO: 55898 - DNA, 25 bp, S. cerevisiae
taaccttgatcatccaatggtccct

SEQ ID NO: 55899 - DNA, 25 bp, S. cerevisiae
tcaagattttccatatccgcaaaga

SEQ ID NO: 55900 - DNA, 25 bp, S. cerevisiae
tcaatgggttccactccgcaattac

SEQ ID NO: 55901 - DNA, 25 bp, S. cerevisiae
taatcggtgtttgtgcccaatacgc

SEQ ID NO: 55902 - DNA, 25 bp, S. cerevisiae
taatcggtattgtttcccacaaggg

SEQ ID NO: 55903 - DNA, 25 bp, S. cerevisiae
taatcggtctggatactcaacaagt

SEQ ID NO: 55904 - DNA, 25 bp, S. cerevisiae
taacatttcggatttcgccaaagat

SEQ ID NO: 55905 - DNA, 25 bp, S. cerevisiae
tcaagttttggaaacggcacgtcat

SEQ ID NO: 55906 - DNA, 25 bp, S. cerevisiae
tcaattggtggtctacgtccagtat

SEQ ID NO: 55907 - DNA, 25 bp, S. cerevisiae
tcaagccatgtcaactactgcatcg

SEQ ID NO: 55908 - DNA, 25 bp, S. cerevisiae
tcaactcgtgcaattcatcatctgg

SEQ ID NO: 55909 - DNA, 25 bp, S. cerevisiae
taatctggctgctattcacgctaag

SEQ ID NO: 55910 - DNA, 25 bp, S. cerevisiae
taattctcagaaaccctatggattg

SEQ ID NO: 55911 - DNA, 25 bp, S. cerevisiae
tcaacctgttattccaattcttata

SEQ ID NO: 55912 - DNA, 25 bp, S. cerevisiae
tcaacgttctactcaatttctcact

SEQ ID NO: 55913 - DNA, 25 bp, S. cerevisiae
taatgtttaccacgacagtcttgaa

SEQ ID NO: 55914 - DNA, 25 bp, S. cerevisiae
taattatgatttgccctccgacatc

SEQ ID NO: 55915 - DNA, 25 bp, S. cerevisiae
taacgttgtggtaccgtgctcctga

SEQ ID NO: 55916 - DNA, 25 bp, S. cerevisiae
taaggctttttcacttgccacatgc

SEQ ID NO: 55917 - DNA, 25 bp, S. cerevisiae
taaggctggtttgacattcccagtc

SEQ ID NO: 55918 - DNA, 25 bp, S. cerevisiae
tcaaacggtactggaattcgccaaa

SEQ ID NO: 55919 - DNA, 25 bp, S. cerevisiae
ttatcttcgggccaaaactctgggt

SEQ ID NO: 55920 - DNA, 25 bp, S. cerevisiae
taatgttaccgttaagacttccgat

SEQ ID NO: 55921 - DNA, 25 bp, S. cerevisiae
taatgctttgggtttaggctgttcc

SEQ ID NO: 55922 - DNA, 25 bp, S. cerevisiae
taagtctagttgcttcaggtgctgg

SEQ ID NO: 55923 - DNA, 25 bp, S. cerevisiae
taatgtccaccgcttcagctcaatt

SEQ ID NO: 55924 - DNA, 25 bp, S. cerevisiae
taattattcctgcatgtgtctccat

SEQ ID NO: 55925 - DNA, 25 bp, S. cerevisiae
taatgtactagctctttccggtggc

SEQ ID NO: 55926 - DNA, 25 bp, S. cerevisiae
taatgatactgctggttccgcttgc

SEQ ID NO: 55927 - DNA, 25 bp, S. cerevisiae
taaacaagctttgcccggtattcct

SEQ ID NO: 55928 - DNA, 25 bp, S. cerevisiae
taatacggctttgcaacgattttga

SEQ ID NO: 55929 - DNA, 25 bp, S. cerevisiae
tagatctgcagtttggacgacgtgt

SEQ ID NO: 55930 - DNA, 25 bp, S. cerevisiae
taacatgcagtaacgcacggcgggc

SEQ ID NO: 55931 - DNA, 25 bp, S. cerevisiae
taagcatcgtgaagctagaggcttg

SEQ ID NO: 55932 - DNA, 25 bp, S. cerevisiae
taactcgactcctagaagctttgcc

SEQ ID NO: 55933 - DNA, 25 bp, S. cerevisiae
taatctcgctccgtcaaacttacga

SEQ ID NO: 55934 - DNA, 25 bp, S. cerevisiae
taatccctccataaatacaaacccg

SEQ ID NO: 55935 - DNA, 25 bp, S. cerevisiae
ttcttacccattttcaggaacccag

SEQ ID NO: 55936 - DNA, 25 bp, S. cerevisiae
tattaaaacagtctcccaagcagga

SEQ ID NO: 55937 - DNA, 25 bp, S. cerevisiae
taagaagaacgacataccaagcatt

SEQ ID NO: 55938 - DNA, 25 bp, S. cerevisiae
taagaacaaacgcaagggccgccac

SEQ ID NO: 55939 - DNA, 25 bp, S. cerevisiae
taaaaccataaaagacgccaccgat

SEQ ID NO: 55940 - DNA, 25 bp, S. cerevisiae
tcaaaatacaaattccactgcccct

SEQ ID NO: 55941 - DNA, 25 bp, S. cerevisiae
tactagtaccaagtttcatcccgct

SEQ ID NO: 55942 - DNA, 25 bp, S. cerevisiae
tattttgcaaacctctgtaagacag

SEQ ID NO: 55943 - DNA, 25 bp, S. cerevisiae
taattgtaaagccattaaggtcgta

SEQ ID NO: 55944 - DNA, 25 bp, S. cerevisiae
tatacgtcggaccatttcgagttgt

SEQ ID NO: 55945 - DNA, 25 bp, S. cerevisiae
taacgacaacactacttgcgtttgt

SEQ ID NO: 55946 - DNA, 25 bp, S. cerevisiae
taagtcctcgtcagggaatgatgtc

SEQ ID NO: 55947 - DNA, 25 bp, S. cerevisiae
taatctaccgccaagtggtcgagga

SEQ ID NO: 55948 - DNA, 25 bp, S. cerevisiae
taatgtagccgtcgatggttctgtg

SEQ ID NO: 55949 - DNA, 25 bp, S. cerevisiae
taaccaagtggtcgcccaagttgat

SEQ ID NO: 55950 - DNA, 25 bp, S. cerevisiae
taaggccaagccaatttcaaatata

SEQ ID NO: 55951 - DNA, 25 bp, S. cerevisiae
taagtgccggcagtgatttacctca

SEQ ID NO: 55952 - DNA, 25 bp, S. cerevisiae
taatcgctggtggtggtgctccaga

SEQ ID NO: 55953 - DNA, 25 bp, S. cerevisiae
tcaatcagctggtaacgtcttcgtt

SEQ ID NO: 55954 - DNA, 25 bp, S. cerevisiae
tcaagagagtcatcactttgccaga

SEQ ID NO: 55955 - DNA, 25 bp, S. cerevisiae
tcaagaaacaccctggctgcatcaa

SEQ ID NO: 55956 - DNA, 25 bp, S. cerevisiae
tcaagaaactgttgcctggtgcccg

SEQ ID NO: 55957 - DNA, 25 bp, S. cerevisiae
tcaagtgaacctgcctgctaagtca

SEQ ID NO: 55958 - DNA, 25 bp, S. cerevisiae
taacgttaccactgctactgtcagc

SEQ ID NO: 55959 - DNA, 25 bp, S. cerevisiae
taaggtcaacggttctccaatcact

SEQ ID NO: 55960 - DNA, 25 bp, S. cerevisiae
taagattgccacagttattgaacca

SEQ ID NO: 55961 - DNA, 25 bp, S. cerevisiae
taaattgacattcggctttggtgcc

SEQ ID NO: 55962 - DNA, 25 bp, S. cerevisiae
tacatataccaacggttcggtccca

SEQ ID NO: 55963 - DNA, 25 bp, S. cerevisiae
taatagataccccaatccatactcc

SEQ ID NO: 55964 - DNA, 25 bp, S. cerevisiae
taagactattactgctactaacggt

SEQ ID NO: 55965 - DNA, 25 bp, S. cerevisiae
taaactctcaacctcaagtcaacgg

SEQ ID NO: 55966 - DNA, 25 bp, S. cerevisiae
taaaaatagttcacccgaccagatc

SEQ ID NO: 55967 - DNA, 25 bp, S. cerevisiae
taatagttttgttcctcttaccaga

SEQ ID NO: 55968 - DNA, 25 bp, S. cerevisiae
taatcattttaaggccgtttcagaa

SEQ ID NO: 55969 - DNA, 25 bp, S. cerevisiae
taatggcgatcttggaagcttttgc

SEQ ID NO: 55970 - DNA, 25 bp, S. cerevisiae
taatgtgcagtttagggcttggcgc

SEQ ID NO: 55971 - DNA, 25 bp, S. cerevisiae
taatcgagcctctggaccctaagga

SEQ ID NO: 55972 - DNA, 25 bp, S. cerevisiae
taataccgacattcagcagctagac

SEQ ID NO: 55973 - DNA, 25 bp, S. cerevisiae
tcaatggcctaattcataccccagt

SEQ ID NO: 55974 - DNA, 25 bp, S. cerevisiae
taattgctcctatcaaatcccgttg

SEQ ID NO: 55975 - DNA, 25 bp, S. cerevisiae
tacgaaaccgttcttgacatgcaaa

SEQ ID NO: 55976 - DNA, 25 bp, S. cerevisiae
tacaaacccctacgttcaaagatcg

SEQ ID NO: 55977 - DNA, 25 bp, S. cerevisiae
taaacgaaccgtcaagccgcaaaat

SEQ ID NO: 55978 - DNA, 25 bp, S. cerevisiae
tcaagccgcggcagttaaccccaat

SEQ ID NO: 55979 - DNA, 25 bp, S. cerevisiae
taacgtagttggtttaccgctcaat

SEQ ID NO: 55980 - DNA, 25 bp, S. cerevisiae
taatggatatattggttctaccgaa

SEQ ID NO: 55981 - DNA, 25 bp, S. cerevisiae
taatgctacgaatgttcctccgaat

SEQ ID NO: 55982 - DNA, 25 bp, S. cerevisiae
tcaaccaatctatagtgtccttctt

SEQ ID NO: 55983 - DNA, 25 bp, S. cerevisiae
taaccaatcgaatttgccacctcta

SEQ ID NO: 55984 - DNA, 25 bp, S. cerevisiae
taacgcacggttatgcagcaacatt

SEQ ID NO: 55985 - DNA, 25 bp, S. cerevisiae
taaactggatttaggcgagcactgt

SEQ ID NO: 55986 - DNA, 25 bp, S. cerevisiae
taattctactcattcagccgagcac

SEQ ID NO: 55987 - DNA, 25 bp, S. cerevisiae
taatccgaaggtttctattctggaa

SEQ ID NO: 55988 - DNA, 25 bp, S. cerevisiae
taagtgcgaatctgaccatagtcta

SEQ ID NO: 55989 - DNA, 25 bp, S. cerevisiae
tcaagctcttcattagatgctcaaa

SEQ ID NO: 55990 - DNA, 25 bp, S. cerevisiae
tcaagctgcattttgggctcaacaa

SEQ ID NO: 55991 - DNA, 25 bp, S. cerevisiae
taagcagcatagtcacgttagggaa

SEQ ID NO: 55992 - DNA, 25 bp, S. cerevisiae
taaccaacgcatcggtagcggcatt

SEQ ID NO: 55993 - DNA, 25 bp, S. cerevisiae
taacgtcctaaactccaagatcggc

SEQ ID NO: 55994 - DNA, 25 bp, S. cerevisiae
taacgcactcgaccttatggacatg

SEQ ID NO: 55995 - DNA, 25 bp, S. cerevisiae
taagttgcacgaattcacagggaga

SEQ ID NO: 55996 - DNA, 25 bp, S. cerevisiae
taattggcgggcattctggcgagac

SEQ ID NO: 55997 - DNA, 25 bp, S. cerevisiae
tcaatggtccgccttttgggataaa

SEQ ID NO: 55998 - DNA, 25 bp, S. cerevisiae
taattcacccttttattgacccact

SEQ ID NO: 55999 - DNA, 25 bp, S. cerevisiae
taattaacctatgttgtgacgtttt

SEQ ID NO: 56000 - DNA, 25 bp, S. cerevisiae
tcaatttaccgagcatgtgtcactt

SEQ ID NO: 56001 - DNA, 25 bp, S. cerevisiae
taatttcagggagcggtacttcaat

SEQ ID NO: 56002 - DNA, 25 bp, S. cerevisiae
taagtcggtggattggtggtctcta

SEQ ID NO: 56003 - DNA, 25 bp, S. cerevisiae
taagatccggttacgggatgcccag

SEQ ID NO: 56004 - DNA, 25 bp, S. cerevisiae
taagggtattccaggcgatgccaag

SEQ ID NO: 56005 - DNA, 25 bp, S. cerevisiae
taatggaaacgcaccagcgacacct

SEQ ID NO: 56006 - DNA, 25 bp, S. cerevisiae
taatagaggacgacccggacgtatt

SEQ ID NO: 56007 - DNA, 25 bp, S. cerevisiae
taaagggacaacttcaggaaacact

SEQ ID NO: 56008 - DNA, 25 bp, S. cerevisiae
taagcgggtcgggtaccaacaacat

SEQ ID NO: 56009 - DNA, 25 bp, S. cerevisiae
taaggtttcgataatcccaccacct

SEQ ID NO: 56010 - DNA, 25 bp, S. cerevisiae
taatttcaacagtgctccttcttac

SEQ ID NO: 56011 - DNA, 25 bp, S. cerevisiae
taatttgactagtgctgccgctgct

SEQ ID NO: 56012 - DNA, 25 bp, S. cerevisiae
taatattccgaaggcacctgcatta

SEQ ID NO: 56013 - DNA, 25 bp, S. cerevisiae
tcaatcaacctaacctctcatgctt

SEQ ID NO: 56014 - DNA, 25 bp, S. cerevisiae
taatctaagttacctgatacaagaa

SEQ ID NO: 56015 - DNA, 25 bp, S. cerevisiae
taatgccaataactctgctcacatc

SEQ ID NO: 56016 - DNA, 25 bp, S. cerevisiae
taatgcggtaacttctcacatccag

SEQ ID NO: 56017 - DNA, 25 bp, S. cerevisiae
tcaatggtgttagctttgctgccgc

SEQ ID NO: 56018 - DNA, 25 bp, S. cerevisiae
taatggtacttctcaattgcgacaa

SEQ ID NO: 56019 - DNA, 25 bp, S. cerevisiae
taattgtacctctaaattcgatcct

SEQ ID NO: 56020 - DNA, 25 bp, S. cerevisiae
taattatactacttccgctactcaa

SEQ ID NO: 56021 - DNA, 25 bp, S. cerevisiae
taataatgcagcctcttctttacca

SEQ ID NO: 56022 - DNA, 25 bp, S. cerevisiae
tcaatcacatcatccttaacagcag

SEQ ID NO: 56023 - DNA, 25 bp, S. cerevisiae
taaccgattccgaccacaaatccgg

SEQ ID NO: 56024 - DNA, 25 bp, S. cerevisiae
taaggcgttagcgaggatcaagacc

SEQ ID NO: 56025 - DNA, 25 bp, S. cerevisiae
tcaagtgccattgcgcgtacagaga

SEQ ID NO: 56026 - DNA, 25 bp, S. cerevisiae
tcaagatcttcactcctgatcagat

SEQ ID NO: 56027 - DNA, 25 bp, S. cerevisiae
tcaagatcattgctcctccagaaag

SEQ ID NO: 56028 - DNA, 25 bp, S. cerevisiae
taatgcatattggatcgctggcgat

SEQ ID NO: 56029 - DNA, 25 bp, S. cerevisiae
tcaatgctttgaacagtgccacaga

SEQ ID NO: 56030 - DNA, 25 bp, S. cerevisiae
taatttggtggcatctttagcgaag

SEQ ID NO: 56031 - DNA, 25 bp, S. cerevisiae
taacaatagctctgccacttttacc

SEQ ID NO: 56032 - DNA, 25 bp, S. cerevisiae
taagtgaagcccgtaccttatggcc

SEQ ID NO: 56033 - DNA, 25 bp, S. cerevisiae
taatccatccgaggtaccgaatcaa

SEQ ID NO: 56034 - DNA, 25 bp, S. cerevisiae
taatcctctaacatcacctgttgcg

SEQ ID NO: 56035 - DNA, 25 bp, S. cerevisiae
taatccttcgaaaagttgcctcgca

SEQ ID NO: 56036 - DNA, 25 bp, S. cerevisiae
taatccctatgactttttcccagaa

SEQ ID NO: 56037 - DNA, 25 bp, S. cerevisiae
taattctccgattacgtcttcgcaa

SEQ ID NO: 56038 - DNA, 25 bp, S. cerevisiae
taattcctcagtgcgatgttatcct

SEQ ID NO: 56039 - DNA, 25 bp, S. cerevisiae
taattgcctacccactgttgatttt

SEQ ID NO: 56040 - DNA, 25 bp, S. cerevisiae
taattctatacccaagcgtgcttct

SEQ ID NO: 56041 - DNA, 25 bp, S. cerevisiae
taattctatggcatgggctgactat

SEQ ID NO: 56042 - DNA, 25 bp, S. cerevisiae
taattttgtcatgtggctgccattt

SEQ ID NO: 56043 - DNA, 25 bp, S. cerevisiae
taatgctagcgatattgttccaccg

SEQ ID NO: 56044 - DNA, 25 bp, S. cerevisiae
taattgaggctctcctttcacagat

SEQ ID NO: 56045 - DNA, 25 bp, S. cerevisiae
taagtgccagtgaagtctccaaaga

SEQ ID NO: 56046 - DNA, 25 bp, S. cerevisiae
taattctgttgggtcaagccgatca

SEQ ID NO: 56047 - DNA, 25 bp, S. cerevisiae
taattctgtcgggtctatgtcgtct

SEQ ID NO: 56048 - DNA, 25 bp, S. cerevisiae
taataaatactcaccttcttctcct

SEQ ID NO: 56049 - DNA, 25 bp, S. cerevisiae
taatacagggctacaccgttttctt

SEQ ID NO: 56050 - DNA, 25 bp, S. cerevisiae
taatcaagggctccactcattatgc

SEQ ID NO: 56051 - DNA, 25 bp, S. cerevisiae
taatcaagggcctcttctgggatcc

SEQ ID NO: 56052 - DNA, 25 bp, S. cerevisiae
tacaagggttctgtcaagttttcgt

SEQ ID NO: 56053 - DNA, 25 bp, S. cerevisiae
tacgggtttcttcacaggattccaa

SEQ ID NO: 56054 - DNA, 25 bp, S. cerevisiae
tagcggcatcgttttggacaggttt

SEQ ID NO: 56055 - DNA, 25 bp, S. cerevisiae
taatcattggatgtgcgtacgacca

SEQ ID NO: 56056 - DNA, 25 bp, S. cerevisiae
taatcgatgctgtcttggaaggtac

SEQ ID NO: 56057 - DNA, 25 bp, S. cerevisiae
taagcctccaaacaatcctgaattt

SEQ ID NO: 56058 - DNA, 25 bp, S. cerevisiae
ttgggcataccgcagttgaacttta

SEQ ID NO: 56059 - DNA, 25 bp, S. cerevisiae
taggaaaccgtactataagctttat

SEQ ID NO: 56060 - DNA, 25 bp, S. cerevisiae
taagaccgccactgttaagattaac

SEQ ID NO: 56061 - DNA, 25 bp, S. cerevisiae
taagaccccatcctgctttgaaaag

SEQ ID NO: 56062 - DNA, 25 bp, S. cerevisiae
taaggatttggcttcggccttgaaa

SEQ ID NO: 56063 - DNA, 25 bp, S. cerevisiae
taacgaactactgcgagccttataa

SEQ ID NO: 56064 - DNA, 25 bp, S. cerevisiae
tcaatcgtcactagggccgcctttc

SEQ ID NO: 56065 - DNA, 25 bp, S. cerevisiae
taatagtccgttgccggtattacca

SEQ ID NO: 56066 - DNA, 25 bp, S. cerevisiae
taataggcccttgtacgttcaacca

SEQ ID NO: 56067 - DNA, 25 bp, S. cerevisiae
taagaggcccgtttatcgattatga

SEQ ID NO: 56068 - DNA, 25 bp, S. cerevisiae
taatgacgtccgtagtgtcgttgct

SEQ ID NO: 56069 - DNA, 25 bp, S. cerevisiae
taatggttcatccaagggtgctggt

SEQ ID NO: 56070 - DNA, 25 bp, S. cerevisiae
tacacgtaacgactatgagcgcgaa

SEQ ID NO: 56071 - DNA, 25 bp, S. cerevisiae
taactatcaagacatggcgcgcgga

SEQ ID NO: 56072 - DNA, 25 bp, S. cerevisiae
taatacagcaaatgattcctcgact

SEQ ID NO: 56073 - DNA, 25 bp, S. cerevisiae
taatgacaccaatttgtcctcgctc

SEQ ID NO: 56074 - DNA, 25 bp, S. cerevisiae
taattccatcatcttgtccgcagac

SEQ ID NO: 56075 - DNA, 25 bp, S. cerevisiae
taattcgccaattgtgtgtgctcaa

SEQ ID NO: 56076 - DNA, 25 bp, S. cerevisiae
taatgtcgacgatgatggctatcaa

SEQ ID NO: 56077 - DNA, 25 bp, S. cerevisiae
taatgtgcgatcgtgccatcgggaa

SEQ ID NO: 56078 - DNA, 25 bp, S. cerevisiae
taatagcggccatgctcgcttatat

SEQ ID NO: 56079 - DNA, 25 bp, S. cerevisiae
ttaagggcttggtgctataaacgaa

SEQ ID NO: 56080 - DNA, 25 bp, S. cerevisiae
taatatcgtacaacccacattccag

SEQ ID NO: 56081 - DNA, 25 bp, S. cerevisiae
taatgaggatactccccaggctaaa

SEQ ID NO: 56082 - DNA, 25 bp, S. cerevisiae
taagggcctaaaccgagcagtaaat

SEQ ID NO: 56083 - DNA, 25 bp, S. cerevisiae
taagttgcctaagccggcatctttt

SEQ ID NO: 56084 - DNA, 25 bp, S. cerevisiae
taatgttggtaacgcccgatgagtt

SEQ ID NO: 56085 - DNA, 25 bp, S. cerevisiae
taagtgtcgaacatcctcctaggaa

SEQ ID NO: 56086 - DNA, 25 bp, S. cerevisiae
taatcctggttctatgtcttcttca

SEQ ID NO: 56087 - DNA, 25 bp, S. cerevisiae
taatggcggttctacaagatcctcc

SEQ ID NO: 56088 - DNA, 25 bp, S. cerevisiae
taagtgaggaatctctgtccccatc

SEQ ID NO: 56089 - DNA, 25 bp, S. cerevisiae
taataattggttcgctcttccttct

SEQ ID NO: 56090 - DNA, 25 bp, S. cerevisiae
taataatattgacccaccttctgct

SEQ ID NO: 56091 - DNA, 25 bp, S. cerevisiae
taatatatcttcctcaacctaccaa

SEQ ID NO: 56092 - DNA, 25 bp, S. cerevisiae
taatattcttcccatgacgtaccta

SEQ ID NO: 56093 - DNA, 25 bp, S. cerevisiae
taataaccataccatgacctctcct

SEQ ID NO: 56094 - DNA, 25 bp, S. cerevisiae
taaggacgcatacgaaccactctat

SEQ ID NO: 56095 - DNA, 25 bp, S. cerevisiae
taattgcccattcagatcacctcat

SEQ ID NO: 56096 - DNA, 25 bp, S. cerevisiae
taatatgtgttttgccagcttaccc

SEQ ID NO: 56097 - DNA, 25 bp, S. cerevisiae
taattcattttatagctccacgcac

SEQ ID NO: 56098 - DNA, 25 bp, S. cerevisiae
taatttctttgcctcttctaagcca

SEQ ID NO: 56099 - DNA, 25 bp, S. cerevisiae
taattagttggcacccgctgcgaaa

SEQ ID NO: 56100 - DNA, 25 bp, S. cerevisiae
taatgtcattgagccctcgttcggt

SEQ ID NO: 56101 - DNA, 25 bp, S. cerevisiae
taatgttgactcatactcgcagaaa

SEQ ID NO: 56102 - DNA, 25 bp, S. cerevisiae
taatgtttctcactatctttcaata

SEQ ID NO: 56103 - DNA, 25 bp, S. cerevisiae
taagggtcttggctgcttactcgca

SEQ ID NO: 56104 - DNA, 25 bp, S. cerevisiae
taaggctgtgctagtgcgtggttcc

SEQ ID NO: 56105 - DNA, 25 bp, S. cerevisiae
tatagcgttctattggaaagtccac

SEQ ID NO: 56106 - DNA, 25 bp, S. cerevisiae
taagctttcgcatgaggtggatcca

SEQ ID NO: 56107 - DNA, 25 bp, S. cerevisiae
taaccaatcggatcacttacgcatt

SEQ ID NO: 56108 - DNA, 25 bp, S. cerevisiae
taatgcccaatcaatctctaaccag

SEQ ID NO: 56109 - DNA, 25 bp, S. cerevisiae
taatgaactatccatcgctacgccg

SEQ ID NO: 56110 - DNA, 25 bp, S. cerevisiae
taaactctcagccatcatcgatagc

SEQ ID NO: 56111 - DNA, 25 bp, S. cerevisiae
taggtcttccgagcgataggtgttc

SEQ ID NO: 56112 - DNA, 25 bp, S. cerevisiae
taaggtacgcagtgccaagggtctc

SEQ ID NO: 56113 - DNA, 25 bp, S. cerevisiae
taagtgatcccgttgacttgggttc

SEQ ID NO: 56114 - DNA, 25 bp, S. cerevisiae
taagtacccctccacatgttggtgt

SEQ ID NO: 56115 - DNA, 25 bp, S. cerevisiae
taacgccgttctagggtttctcgag

SEQ ID NO: 56116 - DNA, 25 bp, S. cerevisiae
taagccctgggatgaatttttcgag

SEQ ID NO: 56117 - DNA, 25 bp, S. cerevisiae
taagcaggtggtgcagttccttaaa

SEQ ID NO: 56118 - DNA, 25 bp, S. cerevisiae
taatcggtttccctatcatttatag

SEQ ID NO: 56119 - DNA, 25 bp, S. cerevisiae
taaaatcgacgccacttcatcttta

SEQ ID NO: 56120 - DNA, 25 bp, S. cerevisiae
tagaaaggacctccagcgactttac

SEQ ID NO: 56121 - DNA, 25 bp, S. cerevisiae
taaggcgtttgcacgtcaacatgat

SEQ ID NO: 56122 - DNA, 25 bp, S. cerevisiae
taatggctcatttctacgatgctaa

SEQ ID NO: 56123 - DNA, 25 bp, S. cerevisiae
taatggatgctgacttgccgggagt

SEQ ID NO: 56124 - DNA, 25 bp, S. cerevisiae
taagcatcacttggtcactgaggag

SEQ ID NO: 56125 - DNA, 25 bp, S. cerevisiae
taattcatgcaagctccgtggagca

SEQ ID NO: 56126 - DNA, 25 bp, S. cerevisiae
taatcaagcatctgtacctccacaa

SEQ ID NO: 56127 - DNA, 25 bp, S. cerevisiae
taatgacagcactgatacgaccgcc

SEQ ID NO: 56128 - DNA, 25 bp, S. cerevisiae
taatactgagctcaaggacgcccca

SEQ ID NO: 56129 - DNA, 25 bp, S. cerevisiae
taataccagccaatcaggagcctca

SEQ ID NO: 56130 - DNA, 25 bp, S. cerevisiae
taatcccatcctagagaatcctgcc

SEQ ID NO: 56131 - DNA, 25 bp, S. cerevisiae
taatgagtacagaccccatcagtcc

SEQ ID NO: 56132 - DNA, 25 bp, S. cerevisiae
taatgaaaagcaatcctccaccgcc

SEQ ID NO: 56133 - DNA, 25 bp, S. cerevisiae
taatatgatgtccaacacctcaccg

SEQ ID NO: 56134 - DNA, 25 bp, S. cerevisiae
taaggctctcagtatcgatctaacg

SEQ ID NO: 56135 - DNA, 25 bp, S. cerevisiae
taagggcgcagaacagatcatcaca

SEQ ID NO: 56136 - DNA, 25 bp, S. cerevisiae
taattttgcacctccgttgaacgaa

SEQ ID NO: 56137 - DNA, 25 bp, S. cerevisiae
taaggtgtacccagagtcgcgcaaa

SEQ ID NO: 56138 - DNA, 25 bp, S. cerevisiae
taatgatcctactttaatgtcgcca

SEQ ID NO: 56139 - DNA, 25 bp, S. cerevisiae
taagtttgtcattgcttgcttcctg

SEQ ID NO: 56140 - DNA, 25 bp, S. cerevisiae
taatcatgtttcacaggatctggca

SEQ ID NO: 56141 - DNA, 25 bp, S. cerevisiae
taagatgcgcagtttccgttgactc

SEQ ID NO: 56142 - DNA, 25 bp, S. cerevisiae
taatgacgctgatctgcctgtcgat

SEQ ID NO: 56143 - DNA, 25 bp, S. cerevisiae
taaggtttgagcctgcaagcaacaa

SEQ ID NO: 56144 - DNA, 25 bp, S. cerevisiae
taaggctaccatctgcaagcgacaa

SEQ ID NO: 56145 - DNA, 25 bp, S. cerevisiae
taaggcaccatctccaatggaccag

SEQ ID NO: 56146 - DNA, 25 bp, S. cerevisiae
taagcaacttatcctcgtgggccag

SEQ ID NO: 56147 - DNA, 25 bp, S. cerevisiae
taatgatccgttttggttccccgat

SEQ ID NO: 56148 - DNA, 25 bp, S. cerevisiae
taaccgcactatttaataccctaga

SEQ ID NO: 56149 - DNA, 25 bp, S. cerevisiae
taatcgccaccaagtttaccactga

SEQ ID NO: 56150 - DNA, 25 bp, S. cerevisiae
taactccaaccatagttccttctat

SEQ ID NO: 56151 - DNA, 25 bp, S. cerevisiae
taacggcaaccagaaccgctactga

SEQ ID NO: 56152 - DNA, 25 bp, S. cerevisiae
taacccagctcaaccgtttggtaat

SEQ ID NO: 56153 - DNA, 25 bp, S. cerevisiae
taaagtacctcgaggagccctacaa

SEQ ID NO: 56154 - DNA, 25 bp, S. cerevisiae
taagtgtacccgatagacagtcaat

SEQ ID NO: 56155 - DNA, 25 bp, S. cerevisiae
taacgttacctgtaagggcctacat

SEQ ID NO: 56156 - DNA, 25 bp, S. cerevisiae
taatggttcaccactaagccctgag

SEQ ID NO: 56157 - DNA, 25 bp, S. cerevisiae
taatggcgtcccacgaagaacaggt

SEQ ID NO: 56158 - DNA, 25 bp, S. cerevisiae
tttgtggtccaagctaaaactgcag

SEQ ID NO: 56159 - DNA, 25 bp, S. cerevisiae
ttcctgaggaaagcggctacaacaa

SEQ ID NO: 56160 - DNA, 25 bp, S. cerevisiae
ttatcggtcggagaggctacaacaa

SEQ ID NO: 56161 - DNA, 25 bp, S. cerevisiae
ttaacccaggagcaactacaagtgt

SEQ ID NO: 56162 - DNA, 25 bp, S. cerevisiae
taaatcccaggaagatgccgaaaag

SEQ ID NO: 56163 - DNA, 25 bp, S. cerevisiae
taagtcatccttacatacatgtcag

SEQ ID NO: 56164 - DNA, 25 bp, S. cerevisiae
taatccggcgctatacagtgacact

SEQ ID NO: 56165 - DNA, 25 bp, S. cerevisiae
taatcagcggctcgttatacagtcc

SEQ ID NO: 56166 - DNA, 25 bp, S. cerevisiae
taactgtggcgattgctgttcagca

SEQ ID NO: 56167 - DNA, 25 bp, S. cerevisiae
taatcattactgactcttctgaccc

SEQ ID NO: 56168 - DNA, 25 bp, S. cerevisiae
taatccatggcccttcctatttatg

SEQ ID NO: 56169 - DNA, 25 bp, S. cerevisiae
taatctcaggtattattgcgcgtct

SEQ ID NO: 56170 - DNA, 25 bp, S. cerevisiae
taaccaggatacatcatcgtcatct

SEQ ID NO: 56171 - DNA, 25 bp, S. cerevisiae
taatagttcactctaccttctagcc

SEQ ID NO: 56172 - DNA, 25 bp, S. cerevisiae
taatagcaacaacacgcctttacca

SEQ ID NO: 56173 - DNA, 25 bp, S. cerevisiae
taacaaatgccattgtcatctcccg

SEQ ID NO: 56174 - DNA, 25 bp, S. cerevisiae
taactcagatcctttcacatacgtc

SEQ ID NO: 56175 - DNA, 25 bp, S. cerevisiae
taagcgactccattaagaacgtatt

SEQ ID NO: 56176 - DNA, 25 bp, S. cerevisiae
taagcgagactcacaggtaggttat

SEQ ID NO: 56177 - DNA, 25 bp, S. cerevisiae
taagacggagttgtgagcccaatgt

SEQ ID NO: 56178 - DNA, 25 bp, S. cerevisiae
taaacgaggtgtgctagctaccggt

SEQ ID NO: 56179 - DNA, 25 bp, S. cerevisiae
taatatggccagtttcatccctcaa

SEQ ID NO: 56180 - DNA, 25 bp, S. cerevisiae
taagtactttggtggtcattctgac

SEQ ID NO: 56181 - DNA, 25 bp, S. cerevisiae
taagatccccggtcttgacatttga

SEQ ID NO: 56182 - DNA, 25 bp, S. cerevisiae
taatacatctgtctttgcttccacc

SEQ ID NO: 56183 - DNA, 25 bp, S. cerevisiae
taatatatcttctacttcttccgct

SEQ ID NO: 56184 - DNA, 25 bp, S. cerevisiae
taaatcatctgacaccctaggtttg

SEQ ID NO: 56185 - DNA, 25 bp, S. cerevisiae
taaacctgtccctgtcgttttgaca

SEQ ID NO: 56186 - DNA, 25 bp, S. cerevisiae
taataatgttaatgcggcgcctatc

SEQ ID NO: 56187 - DNA, 25 bp, S. cerevisiae
tattaagtttgatggcgctgtcgct

SEQ ID NO: 56188 - DNA, 25 bp, S. cerevisiae
taatgcggtttgagggcttcgattc

SEQ ID NO: 56189 - DNA, 25 bp, S. cerevisiae
taacggattttctggcatatctgca

SEQ ID NO: 56190 - DNA, 25 bp, S. cerevisiae
taagtggtccttgcgttatcagcca

SEQ ID NO: 56191 - DNA, 25 bp, S. cerevisiae
tatggttggccttttacttcggata

SEQ ID NO: 56192 - DNA, 25 bp, S. cerevisiae
ttcaaaggactgtagtacccggtag

SEQ ID NO: 56193 - DNA, 25 bp, S. cerevisiae
taaggtcgaaacaagagtgcccgtt

SEQ ID NO: 56194 - DNA, 25 bp, S. cerevisiae
taaatgagcgattaaagggcccttc

SEQ ID NO: 56195 - DNA, 25 bp, S. cerevisiae
taaataacttcaaacgccagccttc

SEQ ID NO: 56196 - DNA, 25 bp, S. cerevisiae
taatgatgaccaaattccgcccctt

SEQ ID NO: 56197 - DNA, 25 bp, S. cerevisiae
taagtgtaaacaagctcgtccctgc

SEQ ID NO: 56198 - DNA, 25 bp, S. cerevisiae
taagcctgatagacccattatcccg

SEQ ID NO: 56199 - DNA, 25 bp, S. cerevisiae
tataccgtcgatcgttttggtcgtc

SEQ ID NO: 56200 - DNA, 25 bp, S. cerevisiae
taacgtccaggattgtcgcatggcc

SEQ ID NO: 56201 - DNA, 25 bp, S. cerevisiae
taacgtccagagaattgctgcctat

SEQ ID NO: 56202 - DNA, 25 bp, S. cerevisiae
taatgaccgcgtcacgaacgtgggc

SEQ ID NO: 56203 - DNA, 25 bp, S. cerevisiae
tagtataagcgctgacggcactggc

SEQ ID NO: 56204 - DNA, 25 bp, S. cerevisiae
taatgttttgggtgatgcctcttta

SEQ ID NO: 56205 - DNA, 25 bp, S. cerevisiae
taatacttttggacgaggctacttc

SEQ ID NO: 56206 - DNA, 25 bp, S. cerevisiae
taagactatagtgctggcccgtatt

SEQ ID NO: 56207 - DNA, 25 bp, S. cerevisiae
taatgaccagggtgtccggttttcg

SEQ ID NO: 56208 - DNA, 25 bp, S. cerevisiae
tactacgacagtttccggattttga

SEQ ID NO: 56209 - DNA, 25 bp, S. cerevisiae
tacgtcggagttaccggacatcagt

SEQ ID NO: 56210 - DNA, 25 bp, S. cerevisiae
taagatcatggtatcctgtccgcgt

SEQ ID NO: 56211 - DNA, 25 bp, S. cerevisiae
taatgcgctgttatcgttgctgcca

SEQ ID NO: 56212 - DNA, 25 bp, S. cerevisiae
taatgagcaggccacactgttctct

SEQ ID NO: 56213 - DNA, 25 bp, S. cerevisiae
taagagaatgcaacagcgccccagc

SEQ ID NO: 56214 - DNA, 25 bp, S. cerevisiae
taagatcaagacaaggctcgccatg

SEQ ID NO: 56215 - DNA, 25 bp, S. cerevisiae
taatcatcggaatgagctgcgctca

SEQ ID NO: 56216 - DNA, 25 bp, S. cerevisiae
taatactccagtaatgccacctcag

SEQ ID NO: 56217 - DNA, 25 bp, S. cerevisiae
taaggacgattctgccatcaaggcc

SEQ ID NO: 56218 - DNA, 25 bp, S. cerevisiae
taaggagaacttaccatcagatgtg

SEQ ID NO: 56219 - DNA, 25 bp, S. cerevisiae
taaggtttcctttgctcatttcgtc

SEQ ID NO: 56220 - DNA, 25 bp, S. cerevisiae
taaggtgttcttgaggcctctggta

SEQ ID NO: 56221 - DNA, 25 bp, S. cerevisiae
taaaggttcgtatcgtcggcctagc

SEQ ID NO: 56222 - DNA, 25 bp, S. cerevisiae
taaagactttggttcaaggcccaag

SEQ ID NO: 56223 - DNA, 25 bp, S. cerevisiae
taaagtttgggtagccggccagcaa

SEQ ID NO: 56224 - DNA, 25 bp, S. cerevisiae
taataaggtcaagtcatccgcctcc

SEQ ID NO: 56225 - DNA, 25 bp, S. cerevisiae
taatacaaggccttctcattctctc

SEQ ID NO: 56226 - DNA, 25 bp, S. cerevisiae
taataaatctgcaatcccatctcct

SEQ ID NO: 56227 - DNA, 25 bp, S. cerevisiae
taataacactttgcctgctatgcca

SEQ ID NO: 56228 - DNA, 25 bp, S. cerevisiae
taaagatttggattccctaccggat

SEQ ID NO: 56229 - DNA, 25 bp, S. cerevisiae
taaggagttgagagctcaatacggt

SEQ ID NO: 56230 - DNA, 25 bp, S. cerevisiae
taacaagtacattagccgctacggg

SEQ ID NO: 56231 - DNA, 25 bp, S. cerevisiae
taacgatgaacttaacagctggact

SEQ ID NO: 56232 - DNA, 25 bp, S. cerevisiae
taacgttagcatttcgtctctccta

SEQ ID NO: 56233 - DNA, 25 bp, S. cerevisiae
taatggtgctgtaccatcccatttg

SEQ ID NO: 56234 - DNA, 25 bp, S. cerevisiae
tagtagcacctgagatgcccctaac

SEQ ID NO: 56235 - DNA, 25 bp, S. cerevisiae
taatgaagcacctggagctcgccaa

SEQ ID NO: 56236 - DNA, 25 bp, S. cerevisiae
taagatatgccttgtagtcgccacc

SEQ ID NO: 56237 - DNA, 25 bp, S. cerevisiae
taatggagttttaggcgcagcagct

SEQ ID NO: 56238 - DNA, 25 bp, S. cerevisiae
taatgcgcaaccaacggcgaacgac

SEQ ID NO: 56239 - DNA, 25 bp, S. cerevisiae
taatgcgaaccatccggaacaccag

SEQ ID NO: 56240 - DNA, 25 bp, S. cerevisiae
taatggatcccattcgtggaaacga

SEQ ID NO: 56241 - DNA, 25 bp, S. cerevisiae
taaggaccctattattgtatacgag

SEQ ID NO: 56242 - DNA, 25 bp, S. cerevisiae
tagaggactgccattgggtattgca

SEQ ID NO: 56243 - DNA, 25 bp, S. cerevisiae
tagaaaatccactggtggtaaagcc

SEQ ID NO: 56244 - DNA, 25 bp, S. cerevisiae
taaaaacgccatgggtggtgtcata

SEQ ID NO: 56245 - DNA, 25 bp, S. cerevisiae
taaaaaatccatgcccgttaagaag

SEQ ID NO: 56246 - DNA, 25 bp, S. cerevisiae
taatcaaacctatacgccgacagaa

SEQ ID NO: 56247 - DNA, 25 bp, S. cerevisiae
taaacaagcttttaaccggatggat

SEQ ID NO: 56248 - DNA, 25 bp, S. cerevisiae
taaccaatgttttcaaccgcataag

SEQ ID NO: 56249 - DNA, 25 bp, S. cerevisiae
taacaccttttgctatcacgctgaa

SEQ ID NO: 56250 - DNA, 25 bp, S. cerevisiae
taatccaaacgtcttccgcgatgaa

SEQ ID NO: 56251 - DNA, 25 bp, S. cerevisiae
taaccaaactactttcccaacagat

SEQ ID NO: 56252 - DNA, 25 bp, S. cerevisiae
taaccggacaactaacgccagcaag

SEQ ID NO: 56253 - DNA, 25 bp, S. cerevisiae
taagcctttcaagaagcccaagagg

SEQ ID NO: 56254 - DNA, 25 bp, S. cerevisiae
taagcacaacttcaactgcctctgt

SEQ ID NO: 56255 - DNA, 25 bp, S. cerevisiae
taagcaccagttttacgccttctgt

SEQ ID NO: 56256 - DNA, 25 bp, S. cerevisiae
taatcgcaacgttagtccattcgga

SEQ ID NO: 56257 - DNA, 25 bp, S. cerevisiae
taatggaattatgcgctcactccca

SEQ ID NO: 56258 - DNA, 25 bp, S. cerevisiae
taacccagaagctttagccccattg

SEQ ID NO: 56259 - DNA, 25 bp, S. cerevisiae
taacctctactgtggaggcacccaa

SEQ ID NO: 56260 - DNA, 25 bp, S. cerevisiae
taactgtccctctgtaaatagccca

SEQ ID NO: 56261 - DNA, 25 bp, S. cerevisiae
taacggctcgccctttatgaaccaa

SEQ ID NO: 56262 - DNA, 25 bp, S. cerevisiae
taaagtccgcccattggaggaacag

SEQ ID NO: 56263 - DNA, 25 bp, S. cerevisiae
taatggccttgttatttaatggtaa

SEQ ID NO: 56264 - DNA, 25 bp, S. cerevisiae
taagcggcgtcgtcatccatatggg

SEQ ID NO: 56265 - DNA, 25 bp, S. cerevisiae
taaggacgccgccatatcaagagct

SEQ ID NO: 56266 - DNA, 25 bp, S. cerevisiae
taaggccactcccaaagggcgaata

SEQ ID NO: 56267 - DNA, 25 bp, S. cerevisiae
taatgaccccttgagctggagtgaa

SEQ ID NO: 56268 - DNA, 25 bp, S. cerevisiae
taatgctgcctgtaactgtttatgg

SEQ ID NO: 56269 - DNA, 25 bp, S. cerevisiae
tagtgtatctgatccggttaagtcg

SEQ ID NO: 56270 - DNA, 25 bp, S. cerevisiae
taatgttcgggccaggattacctgc

SEQ ID NO: 56271 - DNA, 25 bp, S. cerevisiae
taagttcgatgtctgggataccgca

SEQ ID NO: 56272 - DNA, 25 bp, S. cerevisiae
ttaggtatcattctggtaactccca

SEQ ID NO: 56273 - DNA, 25 bp, S. cerevisiae
tacggtactttgatttgggccacgg

SEQ ID NO: 56274 - DNA, 25 bp, S. cerevisiae
taagagtaccttactttgacccaag

SEQ ID NO: 56275 - DNA, 25 bp, S. cerevisiae
taaaattgcaactctcgtcacccaa

SEQ ID NO: 56276 - DNA, 25 bp, S. cerevisiae
tacggagaccactttagtaacgcca

SEQ ID NO: 56277 - DNA, 25 bp, S. cerevisiae
taaagtactcgcagttacacccgaa

SEQ ID NO: 56278 - DNA, 25 bp, S. cerevisiae
taggcctacctgatggtaaccgcat

SEQ ID NO: 56279 - DNA, 25 bp, S. cerevisiae
taactttgaatttggtaacgctgat

SEQ ID NO: 56280 - DNA, 25 bp, S. cerevisiae
taagtttgcagatcgttcccagcta

SEQ ID NO: 56281 - DNA, 25 bp, S. cerevisiae
taagctatcctctacttctactgaa

SEQ ID NO: 56282 - DNA, 25 bp, S. cerevisiae
tagcagtgatgaccaaggctttgtc

SEQ ID NO: 56283 - DNA, 25 bp, S. cerevisiae
taacgacattgccatcgcttgcgtc

SEQ ID NO: 56284 - DNA, 25 bp, S. cerevisiae
tactcccactgtcggttttaacgtg

SEQ ID NO: 56285 - DNA, 25 bp, S. cerevisiae
taatccccgaagacttagtaactgt

SEQ ID NO: 56286 - DNA, 25 bp, S. cerevisiae
taacctcattataccttgccactta

SEQ ID NO: 56287 - DNA, 25 bp, S. cerevisiae
taagtcagttcggtatcaaggtttt

SEQ ID NO: 56288 - DNA, 25 bp, S. cerevisiae
taaccatttagagcgcaagggcctt

SEQ ID NO: 56289 - DNA, 25 bp, S. cerevisiae
taacgccttcaagcacaagagagct

SEQ ID NO: 56290 - DNA, 25 bp, S. cerevisiae
tacacggctgcagtcagcctattga

SEQ ID NO: 56291 - DNA, 25 bp, S. cerevisiae
taatgcatggcggtagcgttatcaa

SEQ ID NO: 56292 - DNA, 25 bp, S. cerevisiae
taagcatatcgatccagcaagacaa

SEQ ID NO: 56293 - DNA, 25 bp, S. cerevisiae
taacataccttcgatgtcaagcaat

SEQ ID NO: 56294 - DNA, 25 bp, S. cerevisiae
taagttcgtctttgcgttcaagtgc

SEQ ID NO: 56295 - DNA, 25 bp, S. cerevisiae
tacgaattgctaccctttaagtcct

SEQ ID NO: 56296 - DNA, 25 bp, S. cerevisiae
taagacttcgcacgccggtaagata

SEQ ID NO: 56297 - DNA, 25 bp, S. cerevisiae
taagacttccatccgtgctttatta

SEQ ID NO: 56298 - DNA, 25 bp, S. cerevisiae
taagcatcctttcccagatttttct

SEQ ID NO: 56299 - DNA, 25 bp, S. cerevisiae
taagacctgatttccctgtgtttgg

SEQ ID NO: 56300 - DNA, 25 bp, S. cerevisiae
taagtgctcttatgctcccttttgt

SEQ ID NO: 56301 - DNA, 25 bp, S. cerevisiae
taagttcatcacacctcttttgagg

SEQ ID NO: 56302 - DNA, 25 bp, S. cerevisiae
taaggctcaaggtgttgctgttcaa

SEQ ID NO: 56303 - DNA, 25 bp, S. cerevisiae
taacttcgagcctggtgttgtacac

SEQ ID NO: 56304 - DNA, 25 bp, S. cerevisiae
taacttctcagtacggttcgcaaca

SEQ ID NO: 56305 - DNA, 25 bp, S. cerevisiae
taaccgcctacgtattctccaagaa

SEQ ID NO: 56306 - DNA, 25 bp, S. cerevisiae
taagcagagctttcccatgttcaat

SEQ ID NO: 56307 - DNA, 25 bp, S. cerevisiae
taacgctctgctgccagggttataa

SEQ ID NO: 56308 - DNA, 25 bp, S. cerevisiae
taatggataccacttctgcgctcaa

SEQ ID NO: 56309 - DNA, 25 bp, S. cerevisiae
taatgcccggcttggcttattatgc

SEQ ID NO: 56310 - DNA, 25 bp, S. cerevisiae
taatgtcgccattgaagtctttcgc

SEQ ID NO: 56311 - DNA, 25 bp, S. cerevisiae
taatgatcgcgagcaagcctttact

SEQ ID NO: 56312 - DNA, 25 bp, S. cerevisiae
taatgtctgtggcagagccttttcc

SEQ ID NO: 56313 - DNA, 25 bp, S. cerevisiae
tactcactggaggtaccggtttgcc

SEQ ID NO: 56314 - DNA, 25 bp, S. cerevisiae
taaggccgctgtctcattgcgttat

SEQ ID NO: 56315 - DNA, 25 bp, S. cerevisiae
taaggcagtctgatgtagagcgttt

SEQ ID NO: 56316 - DNA, 25 bp, S. cerevisiae
taatgtctttccctgaagctatcgc

SEQ ID NO: 56317 - DNA, 25 bp, S. cerevisiae
taagcctgaggcaaagaccgtgttt

SEQ ID NO: 56318 - DNA, 25 bp, S. cerevisiae
taagttcagccaatcacacccgtta

SEQ ID NO: 56319 - DNA, 25 bp, S. cerevisiae
taagaacgtcaagcatagcggtaac

SEQ ID NO: 56320 - DNA, 25 bp, S. cerevisiae
taagaaggtcgtcctcagcggttta

SEQ ID NO: 56321 - DNA, 25 bp, S. cerevisiae
taagacggtctccagcaactaaaaa

SEQ ID NO: 56322 - DNA, 25 bp, S. cerevisiae
taagaaggccgccaacgccaaacaa

SEQ ID NO: 56323 - DNA, 25 bp, S. cerevisiae
taaggtcaccaaaggctccggatgc

SEQ ID NO: 56324 - DNA, 25 bp, S. cerevisiae
taatgagtccctatggcccagtgta

SEQ ID NO: 56325 - DNA, 25 bp, S. cerevisiae
taagagtgcaactaggcccgactat

SEQ ID NO: 56326 - DNA, 25 bp, S. cerevisiae
taagagctcaattaggatcccgtgt

SEQ ID NO: 56327 - DNA, 25 bp, S. cerevisiae
taacatttacaattcctgagggcat

SEQ ID NO: 56328 - DNA, 25 bp, S. cerevisiae
taaccgtcaccgtaggattgagcat

SEQ ID NO: 56329 - DNA, 25 bp, S. cerevisiae
taagagcccgactaaggccacgaat

SEQ ID NO: 56330 - DNA, 25 bp, S. cerevisiae
taatggccactgaaaagcatgcgaa

SEQ ID NO: 56331 - DNA, 25 bp, S. cerevisiae
taagtgtcattagtgccgtcttcgg

SEQ ID NO: 56332 - DNA, 25 bp, S. cerevisiae
taagctgtcatagtgatcctgattt

SEQ ID NO: 56333 - DNA, 25 bp, S. cerevisiae
taatgcacctgcaattgccgttaga

SEQ ID NO: 56334 - DNA, 25 bp, S. cerevisiae
taactcgctctgtagggttaggcgg

SEQ ID NO: 56335 - DNA, 25 bp, S. cerevisiae
taaccgcttaaaagttcaggatgct

SEQ ID NO: 56336 - DNA, 25 bp, S. cerevisiae
taaacgttcacgaaggacccatggg

SEQ ID NO: 56337 - DNA, 25 bp, S. cerevisiae
taaacgtaaatctggaacctgctcc

SEQ ID NO: 56338 - DNA, 25 bp, S. cerevisiae
taatgactgtactacccgcaaccat

SEQ ID NO: 56339 - DNA, 25 bp, S. cerevisiae
taatgactgtagtacccgcaataat

SEQ ID NO: 56340 - DNA, 25 bp, S. cerevisiae
taatgtctgacctccacgtgataat

SEQ ID NO: 56341 - DNA, 25 bp, S. cerevisiae
taaggtcaccttggccgatgataat

SEQ ID NO: 56342 - DNA, 25 bp, S. cerevisiae
taatgggcaccatgctgcacgaatt

SEQ ID NO: 56343 - DNA, 25 bp, S. cerevisiae
taatggcaggccatcgctcaggatg

SEQ ID NO: 56344 - DNA, 25 bp, S. cerevisiae
tacttcatgtccatcgtactggtgg

SEQ ID NO: 56345 - DNA, 25 bp, S. cerevisiae
tactcacttccgtagacacttgatg

SEQ ID NO: 56346 - DNA, 25 bp, S. cerevisiae
taacctgattttagccgcattgaga

SEQ ID NO: 56347 - DNA, 25 bp, S. cerevisiae
taagattagtatttgccgccatcaa

SEQ ID NO: 56348 - DNA, 25 bp, S. cerevisiae
taagcctagcgtctgggatttattc

SEQ ID NO: 56349 - DNA, 25 bp, S. cerevisiae
taagctcagctgatggtattttgcc

SEQ ID NO: 56350 - DNA, 25 bp, S. cerevisiae
taagtgtgtcgacgttttcgcccca

SEQ ID NO: 56351 - DNA, 25 bp, S. cerevisiae
taaggtcgctggttgtttcgtctcc

SEQ ID NO: 56352 - DNA, 25 bp, S. cerevisiae
taaggttggctgacccactcaataa

SEQ ID NO: 56353 - DNA, 25 bp, S. cerevisiae
taaggattctgcgagaccatctaat

SEQ ID NO: 56354 - DNA, 25 bp, S. cerevisiae
taatggatgcttatactctgtacaa

SEQ ID NO: 56355 - DNA, 25 bp, S. cerevisiae
taatggcctgaagaacctctcatct

SEQ ID NO: 56356 - DNA, 25 bp, S. cerevisiae
taagagccttctgaggccaatctgc

SEQ ID NO: 56357 - DNA, 25 bp, S. cerevisiae
tagaggacttcgaagccaccaagct

SEQ ID NO: 56358 - DNA, 25 bp, S. cerevisiae
taaccacttgggttctatgaaagtt

SEQ ID NO: 56359 - DNA, 25 bp, S. cerevisiae
taaccattggcctctgctcaaaaat

SEQ ID NO: 56360 - DNA, 25 bp, S. cerevisiae
taaggctttggctgctgccaagaaa

SEQ ID NO: 56361 - DNA, 25 bp, S. cerevisiae
taacttcactactccttatggtcta

SEQ ID NO: 56362 - DNA, 25 bp, S. cerevisiae
taagaaactgcaccgcgctaacaaa

SEQ ID NO: 56363 - DNA, 25 bp, S. cerevisiae
taacgggcactctcccagatatgga

SEQ ID NO: 56364 - DNA, 25 bp, S. cerevisiae
taacgagactactggcgctgatgat

SEQ ID NO: 56365 - DNA, 25 bp, S. cerevisiae
taagggtatcgctgctggtgatgat

SEQ ID NO: 56366 - DNA, 25 bp, S. cerevisiae
taacttggcatctggtggtgctgct

SEQ ID NO: 56367 - DNA, 25 bp, S. cerevisiae
taacgacgaattggtgctgcacaac

SEQ ID NO: 56368 - DNA, 25 bp, S. cerevisiae
taagctgagcgccttggacgaagaa

SEQ ID NO: 56369 - DNA, 25 bp, S. cerevisiae
taagccaggcgatgagattgatgac

SEQ ID NO: 56370 - DNA, 25 bp, S. cerevisiae
taacgaagcgcacagatggacctaa

SEQ ID NO: 56371 - DNA, 25 bp, S. cerevisiae
taaccaactgcggaagctgctgcat

SEQ ID NO: 56372 - DNA, 25 bp, S. cerevisiae
taaaccactcgataggcacaaccta

SEQ ID NO: 56373 - DNA, 25 bp, S. cerevisiae
taaagccactcttcaagggagccca

SEQ ID NO: 56374 - DNA, 25 bp, S. cerevisiae
tagggtcattgttcaaaggctgcgg

SEQ ID NO: 56375 - DNA, 25 bp, S. cerevisiae
taagagctgctgcttccaaagctgc

SEQ ID NO: 56376 - DNA, 25 bp, S. cerevisiae
taagcctgtattgccaagactgcga

SEQ ID NO: 56377 - DNA, 25 bp, S. cerevisiae
taaggatacggcgttgactccactt

SEQ ID NO: 56378 - DNA, 25 bp, S. cerevisiae
taacgaacactggttatttcctggt

SEQ ID NO: 56379 - DNA, 25 bp, S. cerevisiae
taacgtatcccgtattgttgcttgg

SEQ ID NO: 56380 - DNA, 25 bp, S. cerevisiae
taacgcactcaaggtttttggccga

SEQ ID NO: 56381 - DNA, 25 bp, S. cerevisiae
taaggtctctggtgtctccttgttg

SEQ ID NO: 56382 - DNA, 25 bp, S. cerevisiae
taagggtttacgaatctcttggcgg

SEQ ID NO: 56383 - DNA, 25 bp, S. cerevisiae
taacgaaaatcttcagcggcgactc

SEQ ID NO: 56384 - DNA, 25 bp, S. cerevisiae
taaggaaacctatcgctgcaagcta

SEQ ID NO: 56385 - DNA, 25 bp, S. cerevisiae
taatggtgaattgttgcctcaacta

SEQ ID NO: 56386 - DNA, 25 bp, S. cerevisiae
taagcagcaatgacgtcggtgtact

SEQ ID NO: 56387 - DNA, 25 bp, S. cerevisiae
ttcagctcaattcgtcggaaactaa

SEQ ID NO: 56388 - DNA, 25 bp, S. cerevisiae
ttgactgggatgctccgaggaccaa

SEQ ID NO: 56389 - DNA, 25 bp, S. cerevisiae
tactacatgttccaagccgcacacc

SEQ ID NO: 56390 - DNA, 25 bp, S. cerevisiae
tactacgactcgaagcaagatgctg

SEQ ID NO: 56391 - DNA, 25 bp, S. cerevisiae
tacaacgatcttcatgaacagcatg

SEQ ID NO: 56392 - DNA, 25 bp, S. cerevisiae
taagatcgtcgacaccaacggtgct

SEQ ID NO: 56393 - DNA, 25 bp, S. cerevisiae
taagcccacaattcaccaacggtta

SEQ ID NO: 56394 - DNA, 25 bp, S. cerevisiae
taagtaacgcatttccaacggacta

SEQ ID NO: 56395 - DNA, 25 bp, S. cerevisiae
taaggcgtccattttaacgaaatct

SEQ ID NO: 56396 - DNA, 25 bp, S. cerevisiae
taacctgtgcgcttttgaggatgaa

SEQ ID NO: 56397 - DNA, 25 bp, S. cerevisiae
taacctggcagcattcgatagtaat

SEQ ID NO: 56398 - DNA, 25 bp, S. cerevisiae
taaggcttgaccatggtgctaacaa

SEQ ID NO: 56399 - DNA, 25 bp, S. cerevisiae
taactttgactcataatgtagcaca

SEQ ID NO: 56400 - DNA, 25 bp, S. cerevisiae
taacgttctccccattcattatgac

SEQ ID NO: 56401 - DNA, 25 bp, S. cerevisiae
taacgcctgttttgcttcattagtc

SEQ ID NO: 56402 - DNA, 25 bp, S. cerevisiae
taacgcgcagattgccgctgataat

SEQ ID NO: 56403 - DNA, 25 bp, S. cerevisiae
taacacggtgtgtgcgccatattaa

SEQ ID NO: 56404 - DNA, 25 bp, S. cerevisiae
taagaaggctgtgtcgcctggtaga

SEQ ID NO: 56405 - DNA, 25 bp, S. cerevisiae
taagctatgatatcgctgccttaca

SEQ ID NO: 56406 - DNA, 25 bp, S. cerevisiae
taagttgctgtgtgccttggacaat

SEQ ID NO: 56407 - DNA, 25 bp, S. cerevisiae
ttaaacctagacctggatttgccgt

SEQ ID NO: 56408 - DNA, 25 bp, S. cerevisiae
tataacggcacatagggtcttacct

SEQ ID NO: 56409 - DNA, 25 bp, S. cerevisiae
tagatactacacacaaaacttactt

SEQ ID NO: 56410 - DNA, 25 bp, S. cerevisiae
tacgttaccaacaaaattctatcta

SEQ ID NO: 56411 - DNA, 25 bp, S. cerevisiae
taagcgtcacaacaaatctcacacc

SEQ ID NO: 56412 - DNA, 25 bp, S. cerevisiae
taactgctcaaactatactgcccac

SEQ ID NO: 56413 - DNA, 25 bp, S. cerevisiae
taagatccaaacatctcatgcccag

SEQ ID NO: 56414 - DNA, 25 bp, S. cerevisiae
taagctccttctatcattggccatg

SEQ ID NO: 56415 - DNA, 25 bp, S. cerevisiae
taagccgtctgcgaatcattcgttg

SEQ ID NO: 56416 - DNA, 25 bp, S. cerevisiae
taagcggtctcatttcattcggtta

SEQ ID NO: 56417 - DNA, 25 bp, S. cerevisiae
tacttggacctcgtctggattttta

SEQ ID NO: 56418 - DNA, 25 bp, S. cerevisiae
tacttattccccaaggatcacgttc

SEQ ID NO: 56419 - DNA, 25 bp, S. cerevisiae
tacaacttcgtctgataagccccta

SEQ ID NO: 56420 - DNA, 25 bp, S. cerevisiae
taagcgcccgtgacctggtgaaaga

SEQ ID NO: 56421 - DNA, 25 bp, S. cerevisiae
taacatgccatcttcaaacgctgaa

SEQ ID NO: 56422 - DNA, 25 bp, S. cerevisiae
taacgcctccgcaaaagctgacaaa

SEQ ID NO: 56423 - DNA, 25 bp, S. cerevisiae
taacgcacctctgtcgactggcaag

SEQ ID NO: 56424 - DNA, 25 bp, S. cerevisiae
taacgcagcctccttaatcggaaca

SEQ ID NO: 56425 - DNA, 25 bp, S. cerevisiae
taaggagccgttagaactcgaagat

SEQ ID NO: 56426 - DNA, 25 bp, S. cerevisiae
taagggcacgtacgaagctccacaa

SEQ ID NO: 56427 - DNA, 25 bp, S. cerevisiae
taaggtatcgtacaggccctgcaat

SEQ ID NO: 56428 - DNA, 25 bp, S. cerevisiae
tactcggatccaatcgtttctttaa

SEQ ID NO: 56429 - DNA, 25 bp, S. cerevisiae
taacggaccttcttccacatttgaa

SEQ ID NO: 56430 - DNA, 25 bp, S. cerevisiae
taagaagcttctttcccatcaaaag

SEQ ID NO: 56431 - DNA, 25 bp, S. cerevisiae
taaggttatccttcatcgttgctaa

SEQ ID NO: 56432 - DNA, 25 bp, S. cerevisiae
tactggtaatctcacagctactgat

SEQ ID NO: 56433 - DNA, 25 bp, S. cerevisiae
tactggtgaaatgatccgtcttcta

SEQ ID NO: 56434 - DNA, 25 bp, S. cerevisiae
tactggtgaaagaagcgccgctact

SEQ ID NO: 56435 - DNA, 25 bp, S. cerevisiae
tacggtaacgactctcagctagcta

SEQ ID NO: 56436 - DNA, 25 bp, S. cerevisiae
taacctatacttttctacatttctc

SEQ ID NO: 56437 - DNA, 25 bp, S. cerevisiae
tacagccttaccattaagcgttccg

SEQ ID NO: 56438 - DNA, 25 bp, S. cerevisiae
taactcttccaacttcaaggcgagc

SEQ ID NO: 56439 - DNA, 25 bp, S. cerevisiae
taaagcatgggctcgtactctggcg

SEQ ID NO: 56440 - DNA, 25 bp, S. cerevisiae
taagatggaggctgctctttgtcct

SEQ ID NO: 56441 - DNA, 25 bp, S. cerevisiae
taagagtcagagtccatcctttcca

SEQ ID NO: 56442 - DNA, 25 bp, S. cerevisiae
tagagcaattttgaccaggtaccat

SEQ ID NO: 56443 - DNA, 25 bp, S. cerevisiae
taagcttttataccactgaccacac

SEQ ID NO: 56444 - DNA, 25 bp, S. cerevisiae
taactttttagcattagccacgtct

SEQ ID NO: 56445 - DNA, 25 bp, S. cerevisiae
tagaaaccctagtagtcccagactc

SEQ ID NO: 56446 - DNA, 25 bp, S. cerevisiae
taaggatctctgtttccatgccatc

SEQ ID NO: 56447 - DNA, 25 bp, S. cerevisiae
taagactgtcgttcttctgggtgac

SEQ ID NO: 56448 - DNA, 25 bp, S. cerevisiae
taaagttttgaagcctactacggag

SEQ ID NO: 56449 - DNA, 25 bp, S. cerevisiae
taacggtgttgtacggtccagattt

SEQ ID NO: 56450 - DNA, 25 bp, S. cerevisiae
taagggatgcctttgctgaacgctt

SEQ ID NO: 56451 - DNA, 25 bp, S. cerevisiae
taacgctagccttagctgatgccgg

SEQ ID NO: 56452 - DNA, 25 bp, S. cerevisiae
taacaacgctgaaaagaccggtaag

SEQ ID NO: 56453 - DNA, 25 bp, S. cerevisiae
taacacaagttacgcgcccgttcaa

SEQ ID NO: 56454 - DNA, 25 bp, S. cerevisiae
taaagaatggtaccggcctgttgta

SEQ ID NO: 56455 - DNA, 25 bp, S. cerevisiae
taaaactgatccaaacgagcccgct

SEQ ID NO: 56456 - DNA, 25 bp, S. cerevisiae
taaaacagtacacttctgggcccca

SEQ ID NO: 56457 - DNA, 25 bp, S. cerevisiae
taaaaagctttctgctgacgccact

SEQ ID NO: 56458 - DNA, 25 bp, S. cerevisiae
taaagaagtaccgtcctcccagtgt

SEQ ID NO: 56459 - DNA, 25 bp, S. cerevisiae
taacaaaatatgactgctcctccgc

SEQ ID NO: 56460 - DNA, 25 bp, S. cerevisiae
taagcaattgcaagacctcctgtcg

SEQ ID NO: 56461 - DNA, 25 bp, S. cerevisiae
taacaacgctggtgtctctgtggaa

SEQ ID NO: 56462 - DNA, 25 bp, S. cerevisiae
taaccggcctgaagtttgtcgctat

SEQ ID NO: 56463 - DNA, 25 bp, S. cerevisiae
taagataccagagtccttgtccctg

SEQ ID NO: 56464 - DNA, 25 bp, S. cerevisiae
taagacccgacactctggaatctga

SEQ ID NO: 56465 - DNA, 25 bp, S. cerevisiae
taagatcaccggaatgcccagttgg

SEQ ID NO: 56466 - DNA, 25 bp, S. cerevisiae
taagttatctagacccgctcatgta

SEQ ID NO: 56467 - DNA, 25 bp, S. cerevisiae
taagtcttctagctctgccaagtct

SEQ ID NO: 56468 - DNA, 25 bp, S. cerevisiae
tacagtttcaagttcgagcggttac

SEQ ID NO: 56469 - DNA, 25 bp, S. cerevisiae
taagctcttctacatcggtggtttc

SEQ ID NO: 56470 - DNA, 25 bp, S. cerevisiae
taagtgtactggtgccgttgtttct

SEQ ID NO: 56471 - DNA, 25 bp, S. cerevisiae
taaactactggttccccaatgtggg

SEQ ID NO: 56472 - DNA, 25 bp, S. cerevisiae
tacaccagaagattcgttaacgtta

SEQ ID NO: 56473 - DNA, 25 bp, S. cerevisiae
taagccagcaggttctttcagaagt

SEQ ID NO: 56474 - DNA, 25 bp, S. cerevisiae
taagcatgccgtttcttcatctaaa

SEQ ID NO: 56475 - DNA, 25 bp, S. cerevisiae
taagctctgcgtcgatttaccaaat

SEQ ID NO: 56476 - DNA, 25 bp, S. cerevisiae
taagcttatatcagcactaacaaac

SEQ ID NO: 56477 - DNA, 25 bp, S. cerevisiae
taagcttatcatatgtgcagacaca

SEQ ID NO: 56478 - DNA, 25 bp, S. cerevisiae
taagcatcatcccatttaaagcagg

SEQ ID NO: 56479 - DNA, 25 bp, S. cerevisiae
taacagctctgaattcggtctaggt

SEQ ID NO: 56480 - DNA, 25 bp, S. cerevisiae
taagcgtttgcctttgcgtagatgt

SEQ ID NO: 56481 - DNA, 25 bp, S. cerevisiae
taaaggtacctctatgcagcctacg

SEQ ID NO: 56482 - DNA, 25 bp, S. cerevisiae
taaacttacttcttgccgatgacgc

SEQ ID NO: 56483 - DNA, 25 bp, S. cerevisiae
tacaacattactctgggtgacctga

SEQ ID NO: 56484 - DNA, 25 bp, S. cerevisiae
taagaaaggtgatcgcgctggtgcc

SEQ ID NO: 56485 - DNA, 25 bp, S. cerevisiae
tacgaagaggtatcccctggagcca

SEQ ID NO: 56486 - DNA, 25 bp, S. cerevisiae
tacaaagaggccgagtcccgtagac

SEQ ID NO: 56487 - DNA, 25 bp, S. cerevisiae
taagacacccttacctggcaatgta

SEQ ID NO: 56488 - DNA, 25 bp, S. cerevisiae
taaccctcctgttcgtggcgaaaat

SEQ ID NO: 56489 - DNA, 25 bp, S. cerevisiae
taaccccactgttcgtataccaaga

SEQ ID NO: 56490 - DNA, 25 bp, S. cerevisiae
taaatcagtaaggaccccaccgaag

SEQ ID NO: 56491 - DNA, 25 bp, S. cerevisiae
taggaattacagaacccaacaagat

SEQ ID NO: 56492 - DNA, 25 bp, S. cerevisiae
taagagaatttcaaccgcaacaggt

SEQ ID NO: 56493 - DNA, 25 bp, S. cerevisiae
taacagaactctgaccgagcaagaa

SEQ ID NO: 56494 - DNA, 25 bp, S. cerevisiae
taactgtatagaaacgttcgtggcg

SEQ ID NO: 56495 - DNA, 25 bp, S. cerevisiae
taacgtcaacttaccaatcggcgag

SEQ ID NO: 56496 - DNA, 25 bp, S. cerevisiae
taaaatctacttatcctgggccacg

SEQ ID NO: 56497 - DNA, 25 bp, S. cerevisiae
taacaaaaccatcgtccttggacca

SEQ ID NO: 56498 - DNA, 25 bp, S. cerevisiae
taacgatttgccagtcggtagaaac

SEQ ID NO: 56499 - DNA, 25 bp, S. cerevisiae
taacgatttgaactctgcggtaaca

SEQ ID NO: 56500 - DNA, 25 bp, S. cerevisiae
taaatttctcacctgctgcagtgga

SEQ ID NO: 56501 - DNA, 25 bp, S. cerevisiae
taagattatctcaagcgctagcaaa

SEQ ID NO: 56502 - DNA, 25 bp, S. cerevisiae
taagcatatatcctcacgtgacaca

SEQ ID NO: 56503 - DNA, 25 bp, S. cerevisiae
taagataacttctgctgctccaagc

SEQ ID NO: 56504 - DNA, 25 bp, S. cerevisiae
taagataatctcactggcggccatc

SEQ ID NO: 56505 - DNA, 25 bp, S. cerevisiae
tagatttaccttagtcggctacgac

SEQ ID NO: 56506 - DNA, 25 bp, S. cerevisiae
taaagccaccttatcaagtactgat

SEQ ID NO: 56507 - DNA, 25 bp, S. cerevisiae
taagagatcgccatttcctgttttc

SEQ ID NO: 56508 - DNA, 25 bp, S. cerevisiae
taaaagaggccctatttattctcca

SEQ ID NO: 56509 - DNA, 25 bp, S. cerevisiae
taaaaaagcactctttccactccta

SEQ ID NO: 56510 - DNA, 25 bp, S. cerevisiae
taacggccacgttatcggtgacgat

SEQ ID NO: 56511 - DNA, 25 bp, S. cerevisiae
taacaacctggtttcggtgacagaa

SEQ ID NO: 56512 - DNA, 25 bp, S. cerevisiae
taacaaagcatggtatggcgcggaa

SEQ ID NO: 56513 - DNA, 25 bp, S. cerevisiae
taacaaactggttggctccgtacaa

SEQ ID NO: 56514 - DNA, 25 bp, S. cerevisiae
taaccacctggttgttcatcagaaa

SEQ ID NO: 56515 - DNA, 25 bp, S. cerevisiae
taaccccacgttagatcatccagat

SEQ ID NO: 56516 - DNA, 25 bp, S. cerevisiae
taacctctctgatcgatgacctgaa

SEQ ID NO: 56517 - DNA, 25 bp, S. cerevisiae
taactctctcgagggtagccgcaaa

SEQ ID NO: 56518 - DNA, 25 bp, S. cerevisiae
taccgctttccgatgacttttactc

SEQ ID NO: 56519 - DNA, 25 bp, S. cerevisiae
taccgttgttactgttgtttccact

SEQ ID NO: 56520 - DNA, 25 bp, S. cerevisiae
tacaccttttagtggttcttctact

SEQ ID NO: 56521 - DNA, 25 bp, S. cerevisiae
taaactctttggtctggatgactca

SEQ ID NO: 56522 - DNA, 25 bp, S. cerevisiae
taacgtccttgatgtcgtactcaga

SEQ ID NO: 56523 - DNA, 25 bp, S. cerevisiae
taacccaccatcaaatcgtcgttga

SEQ ID NO: 56524 - DNA, 25 bp, S. cerevisiae
taaccctatattcgtgttgccactt

SEQ ID NO: 56525 - DNA, 25 bp, S. cerevisiae
taacccattatgatgtggtgcaaat

SEQ ID NO: 56526 - DNA, 25 bp, S. cerevisiae
taactcgcatttatccttgaactat

SEQ ID NO: 56527 - DNA, 25 bp, S. cerevisiae
taagccgctactatccaagaaggaa

SEQ ID NO: 56528 - DNA, 25 bp, S. cerevisiae
tagatcccacccatccaaaagtaat

SEQ ID NO: 56529 - DNA, 25 bp, S. cerevisiae
taactcctcctcatccttaaggaat

SEQ ID NO: 56530 - DNA, 25 bp, S. cerevisiae
taacaccacgtcatcgataccggaa

SEQ ID NO: 56531 - DNA, 25 bp, S. cerevisiae
taacgaaattcttcgatccacggaa

SEQ ID NO: 56532 - DNA, 25 bp, S. cerevisiae
taagttgttcttatgacgggagaga

SEQ ID NO: 56533 - DNA, 25 bp, S. cerevisiae
taagttggtcttagctgccggtaca

SEQ ID NO: 56534 - DNA, 25 bp, S. cerevisiae
ttcgaaggccctaaaagagaagcta

SEQ ID NO: 56535 - DNA, 25 bp, S. cerevisiae
taaagggcccttctgtggcaagcta

SEQ ID NO: 56536 - DNA, 25 bp, S. cerevisiae
ttaacggccgttcaatgggaatcat

SEQ ID NO: 56537 - DNA, 25 bp, S. cerevisiae
ttatagcccctgataccgagggacg

SEQ ID NO: 56538 - DNA, 25 bp, S. cerevisiae
tagtttcgagtgatcaacctggtga

SEQ ID NO: 56539 - DNA, 25 bp, S. cerevisiae
tagggccaagagatccaacggtgca

SEQ ID NO: 56540 - DNA, 25 bp, S. cerevisiae
tagtggctactggttccgaagtgtc

SEQ ID NO: 56541 - DNA, 25 bp, S. cerevisiae
tagagtccctgttttaaagtaccat

SEQ ID NO: 56542 - DNA, 25 bp, S. cerevisiae
tacgtcctttcttaatcaacccaag

SEQ ID NO: 56543 - DNA, 25 bp, S. cerevisiae
taagaagttcgccaagttacacatg

SEQ ID NO: 56544 - DNA, 25 bp, S. cerevisiae
taaaaattccattaggtcagcctgc

SEQ ID NO: 56545 - DNA, 25 bp, S. cerevisiae
taacttctttgtgcccagtcagtga

SEQ ID NO: 56546 - DNA, 25 bp, S. cerevisiae
taacgtttctatgccctgtgatgat

SEQ ID NO: 56547 - DNA, 25 bp, S. cerevisiae
taagattttcactctgcctgaggat

SEQ ID NO: 56548 - DNA, 25 bp, S. cerevisiae
tagaggttacgctccatcgcaaagc

SEQ ID NO: 56549 - DNA, 25 bp, S. cerevisiae
taagacggaaatcgcctctgaccat

SEQ ID NO: 56550 - DNA, 25 bp, S. cerevisiae
taactgggacagagccattggcaca

SEQ ID NO: 56551 - DNA, 25 bp, S. cerevisiae
taacggtgctaccagcttcgacaga

SEQ ID NO: 56552 - DNA, 25 bp, S. cerevisiae
taactggcacataccctctaggaat

SEQ ID NO: 56553 - DNA, 25 bp, S. cerevisiae
ttgatcggacgggaaacggtgcttt

SEQ ID NO: 56554 - DNA, 25 bp, S. cerevisiae
taacgcgaaggctcccggtgcttaa

SEQ ID NO: 56555 - DNA, 25 bp, S. cerevisiae
taaaggcaaggttttcggtgacagg

SEQ ID NO: 56556 - DNA, 25 bp, S. cerevisiae
taaaggccggagtctttggtggcaa

SEQ ID NO: 56557 - DNA, 25 bp, S. cerevisiae
tacagacttcggtttttgtgtggaa

SEQ ID NO: 56558 - DNA, 25 bp, S. cerevisiae
taaacaatctggtttcggtggtcaa

SEQ ID NO: 56559 - DNA, 25 bp, S. cerevisiae
taaccgttcaatccgagagagcttt

SEQ ID NO: 56560 - DNA, 25 bp, S. cerevisiae
taacggtgctgcttgcctgtgtaat

SEQ ID NO: 56561 - DNA, 25 bp, S. cerevisiae
taaaagtgcacaagcctgggaatta

SEQ ID NO: 56562 - DNA, 25 bp, S. cerevisiae
taacaagtcctacgattatgatgat

SEQ ID NO: 56563 - DNA, 25 bp, S. cerevisiae
taagcaattcacatgccgcaataga

SEQ ID NO: 56564 - DNA, 25 bp, S. cerevisiae
taaaccttccctcgatatacttatc

SEQ ID NO: 56565 - DNA, 25 bp, S. cerevisiae
taaagccctccgcagcattaagtac

SEQ ID NO: 56566 - DNA, 25 bp, S. cerevisiae
taaagcctccaactggagattagtc

SEQ ID NO: 56567 - DNA, 25 bp, S. cerevisiae
taaagccgccacatgggttttcaac

SEQ ID NO: 56568 - DNA, 25 bp, S. cerevisiae
taacgcttccaagaatgccggtgat

SEQ ID NO: 56569 - DNA, 25 bp, S. cerevisiae
taagctccaaatccatgtgtggtga

SEQ ID NO: 56570 - DNA, 25 bp, S. cerevisiae
taagcgccacagtactggtcacgaa

SEQ ID NO: 56571 - DNA, 25 bp, S. cerevisiae
tagagggacagctgggctccgaaat

SEQ ID NO: 56572 - DNA, 25 bp, S. cerevisiae
taacccggcaaggtcttctatggat

SEQ ID NO: 56573 - DNA, 25 bp, S. cerevisiae
taagcacttgtttaatcccgatgaa

SEQ ID NO: 56574 - DNA, 25 bp, S. cerevisiae
taagcgtgctgagttggatccggat

SEQ ID NO: 56575 - DNA, 25 bp, S. cerevisiae
taacactcagatccttgtactgtaa

SEQ ID NO: 56576 - DNA, 25 bp, S. cerevisiae
tacctctaagccagtccattcacag

SEQ ID NO: 56577 - DNA, 25 bp, S. cerevisiae
tacgtaactggactgcttctatcac

SEQ ID NO: 56578 - DNA, 25 bp, S. cerevisiae
taaccgctgtgtggcctttgagtga

SEQ ID NO: 56579 - DNA, 25 bp, S. cerevisiae
taacgtttatacctcctgatggaaa

SEQ ID NO: 56580 - DNA, 25 bp, S. cerevisiae
taagcggtttacgtactatcctcaa

SEQ ID NO: 56581 - DNA, 25 bp, S. cerevisiae
taacggtcatggttgtcttcctcta

SEQ ID NO: 56582 - DNA, 25 bp, S. cerevisiae
taaaagtatggaggcctgtcttccc

SEQ ID NO: 56583 - DNA, 25 bp, S. cerevisiae
taaaggagcttattttgcaacccca

SEQ ID NO: 56584 - DNA, 25 bp, S. cerevisiae
taagctggtgtccatattcgccaaa

SEQ ID NO: 56585 - DNA, 25 bp, S. cerevisiae
taacagcagagtccatattagccat

SEQ ID NO: 56586 - DNA, 25 bp, S. cerevisiae
taacctggtcgaattaggtgtctac

SEQ ID NO: 56587 - DNA, 25 bp, S. cerevisiae
taacctttccgacagagttccaaat

SEQ ID NO: 56588 - DNA, 25 bp, S. cerevisiae
taaaaatgatcctctacgacctctg

SEQ ID NO: 56589 - DNA, 25 bp, S. cerevisiae
taaaaggcccttttcgttcatcaat

SEQ ID NO: 56590 - DNA, 25 bp, S. cerevisiae
taaagggccgattacatccgttaga

SEQ ID NO: 56591 - DNA, 25 bp, S. cerevisiae
taacagcaagtcataccccggtgtc

SEQ ID NO: 56592 - DNA, 25 bp, S. cerevisiae
taaagccgttgttaccaccgttcag

SEQ ID NO: 56593 - DNA, 25 bp, S. cerevisiae
taagcactgtgccaagaccgggcta

SEQ ID NO: 56594 - DNA, 25 bp, S. cerevisiae
taaactcgccgggaggtctgcttca

SEQ ID NO: 56595 - DNA, 25 bp, S. cerevisiae
taaacctacagctttattgccagag

SEQ ID NO: 56596 - DNA, 25 bp, S. cerevisiae
taacgtcccatcatttggccaagat

SEQ ID NO: 56597 - DNA, 25 bp, S. cerevisiae
tatacagcaacatcgcaaggatcgc

SEQ ID NO: 56598 - DNA, 25 bp, S. cerevisiae
taaccacatcattgctccagaatac

SEQ ID NO: 56599 - DNA, 25 bp, S. cerevisiae
taaaactctcatggcgcagacatat

SEQ ID NO: 56600 - DNA, 25 bp, S. cerevisiae
taacagtcttcttgccgatcatcat

SEQ ID NO: 56601 - DNA, 25 bp, S. cerevisiae
taaagactatccgttatctccacct

SEQ ID NO: 56602 - DNA, 25 bp, S. cerevisiae
taaaagttctaaaattcccgcatgg

SEQ ID NO: 56603 - DNA, 25 bp, S. cerevisiae
ttgaacgattcagagggcatttttg

SEQ ID NO: 56604 - DNA, 25 bp, S. cerevisiae
taaaatctccactagcctcattttc

SEQ ID NO: 56605 - DNA, 25 bp, S. cerevisiae
taaacatacttaccagactgtgcgt

SEQ ID NO: 56606 - DNA, 25 bp, S. cerevisiae
taaaccgcataagacagctggctgt

SEQ ID NO: 56607 - DNA, 25 bp, S. cerevisiae
taaatcctgataatgaacctgcaca

SEQ ID NO: 56608 - DNA, 25 bp, S. cerevisiae
taaatccgttcccatcgtcaaaaat

SEQ ID NO: 56609 - DNA, 25 bp, S. cerevisiae
taaaacaaggactactttcagaaag

SEQ ID NO: 56610 - DNA, 25 bp, S. cerevisiae
taacccaggtgttgtcttccaaaat

SEQ ID NO: 56611 - DNA, 25 bp, S. cerevisiae
taacgccggaaaattttgccaatat

SEQ ID NO: 56612 - DNA, 25 bp, S. cerevisiae
taactcgccggcaagttgagcgtgc

SEQ ID NO: 56613 - DNA, 25 bp, S. cerevisiae
taaaattctggccactcataccgat

SEQ ID NO: 56614 - DNA, 25 bp, S. cerevisiae
taaagatgctcagtgccagtctcca

SEQ ID NO: 56615 - DNA, 25 bp, S. cerevisiae
tacaagcactaactcaggcaccatg

SEQ ID NO: 56616 - DNA, 25 bp, S. cerevisiae
taaagttcggtcgtattgacgcaac

SEQ ID NO: 56617 - DNA, 25 bp, S. cerevisiae
taaaattgccgcctgtacgtaacct

SEQ ID NO: 56618 - DNA, 25 bp, S. cerevisiae
taaattacctcctaacgtgaagcca

SEQ ID NO: 56619 - DNA, 25 bp, S. cerevisiae
tacattttactcctaccagtttcca

SEQ ID NO: 56620 - DNA, 25 bp, S. cerevisiae
taaatttgaccgtgtggacttccac

SEQ ID NO: 56621 - DNA, 25 bp, S. cerevisiae
tatagaacgttccaggtcgacccca

SEQ ID NO: 56622 - DNA, 25 bp, S. cerevisiae
taacgtcggcaaacagctcagtaat

SEQ ID NO: 56623 - DNA, 25 bp, S. cerevisiae
taaactcggcattttcgcataggat

SEQ ID NO: 56624 - DNA, 25 bp, S. cerevisiae
taacctctggtgtttcctgagaaat

SEQ ID NO: 56625 - DNA, 25 bp, S. cerevisiae
taacttctgacgtttctcaaccttt

SEQ ID NO: 56626 - DNA, 25 bp, S. cerevisiae
tactgggtgaccattccaactttgt

SEQ ID NO: 56627 - DNA, 25 bp, S. cerevisiae
taacgttttcagctcacactggtgg

SEQ ID NO: 56628 - DNA, 25 bp, S. cerevisiae
taaacttttcaaccatctctgtgcc

SEQ ID NO: 56629 - DNA, 25 bp, S. cerevisiae
taacagttctaacagctcaagctca

SEQ ID NO: 56630 - DNA, 25 bp, S. cerevisiae
taacgatatccctcagtcaagcaat

SEQ ID NO: 56631 - DNA, 25 bp, S. cerevisiae
taacgcattccatacagcccagaat

SEQ ID NO: 56632 - DNA, 25 bp, S. cerevisiae
taaccattaagccatcatacatcga

SEQ ID NO: 56633 - DNA, 25 bp, S. cerevisiae
taactcccaattccatgacatcaga

SEQ ID NO: 56634 - DNA, 25 bp, S. cerevisiae
taagcccataacatctctgactaat

SEQ ID NO: 56635 - DNA, 25 bp, S. cerevisiae
taagcctatcccacttcatgaatat

SEQ ID NO: 56636 - DNA, 25 bp, S. cerevisiae
taacagcgagtcttcgggatcacca

SEQ ID NO: 56637 - DNA, 25 bp, S. cerevisiae
tatacagcaagtgtggcagcgtcca

SEQ ID NO: 56638 - DNA, 25 bp, S. cerevisiae
taactcagctgaagatgggtatcca

SEQ ID NO: 56639 - DNA, 25 bp, S. cerevisiae
taactacggtgcaaggtgtcccaga

SEQ ID NO: 56640 - DNA, 25 bp, S. cerevisiae
taaccaaagtgtcaggctatccaat

SEQ ID NO: 56641 - DNA, 25 bp, S. cerevisiae
taaaagtcacttcgagtactccaaa

SEQ ID NO: 56642 - DNA, 25 bp, S. cerevisiae
taaatgttacgccagattaccacca

SEQ ID NO: 56643 - DNA, 25 bp, S. cerevisiae
tacggatttcgccaagtaccaaggt

SEQ ID NO: 56644 - DNA, 25 bp, S. cerevisiae
taagcgcgatctctacgataccaag

SEQ ID NO: 56645 - DNA, 25 bp, S. cerevisiae
tatacgacacatctagaatacacga

SEQ ID NO: 56646 - DNA, 25 bp, S. cerevisiae
tacaagaaccaaggccaacgcggaa

SEQ ID NO: 56647 - DNA, 25 bp, S. cerevisiae
taaagcttcagcaaacctacggtaa

SEQ ID NO: 56648 - DNA, 25 bp, S. cerevisiae
taaacgtgagaattcccctgacaaa

SEQ ID NO: 56649 - DNA, 25 bp, S. cerevisiae
taacgattggaattccgcctactct

SEQ ID NO: 56650 - DNA, 25 bp, S. cerevisiae
taaagagtttaggttctgccgttct

SEQ ID NO: 56651 - DNA, 25 bp, S. cerevisiae
tacaagaacttaccagtcaccgttg

SEQ ID NO: 56652 - DNA, 25 bp, S. cerevisiae
taacggtgcttccaagttcaaaaat

SEQ ID NO: 56653 - DNA, 25 bp, S. cerevisiae
taaaggtgttcttgcgttagaaaag

SEQ ID NO: 56654 - DNA, 25 bp, S. cerevisiae
taaaactatcaagcgtccagagtgc

SEQ ID NO: 56655 - DNA, 25 bp, S. cerevisiae
ttggcacttggttacggtacgaccg

SEQ ID NO: 56656 - DNA, 25 bp, S. cerevisiae
tagaactgctcgtggcggaaagacc

SEQ ID NO: 56657 - DNA, 25 bp, S. cerevisiae
taaactcaacatatcacctcatgga

SEQ ID NO: 56658 - DNA, 25 bp, S. cerevisiae
tagaacttcaagataacctcgaaag

SEQ ID NO: 56659 - DNA, 25 bp, S. cerevisiae
taaatgacttcggttaccaccaaga

SEQ ID NO: 56660 - DNA, 25 bp, S. cerevisiae
taaagggtagttccaccgccaatgg

SEQ ID NO: 56661 - DNA, 25 bp, S. cerevisiae
taaagacattaaagccaccggcaat

SEQ ID NO: 56662 - DNA, 25 bp, S. cerevisiae
taaagccattgtatccaccgggttg

SEQ ID NO: 56663 - DNA, 25 bp, S. cerevisiae
taaaggacgctacttacacgggtat

SEQ ID NO: 56664 - DNA, 25 bp, S. cerevisiae
taacagtaccatttctacagcaagg

SEQ ID NO: 56665 - DNA, 25 bp, S. cerevisiae
taactctcccagcacggacaacgat

SEQ ID NO: 56666 - DNA, 25 bp, S. cerevisiae
taaatccccgtgtcttgaagacctg

SEQ ID NO: 56667 - DNA, 25 bp, S. cerevisiae
tacaacccatcgagccaaagaatct

SEQ ID NO: 56668 - DNA, 25 bp, S. cerevisiae
taacaccacaagaaccaaagcacat

SEQ ID NO: 56669 - DNA, 25 bp, S. cerevisiae
taactctaaagaccctgatccaact

SEQ ID NO: 56670 - DNA, 25 bp, S. cerevisiae
taactcaaatagtcctctacagcag

SEQ ID NO: 56671 - DNA, 25 bp, S. cerevisiae
taaacggcgagcgattctttggtaa

SEQ ID NO: 56672 - DNA, 25 bp, S. cerevisiae
taaatgttttcgctcgtttatcgag

SEQ ID NO: 56673 - DNA, 25 bp, S. cerevisiae
taacggtgctttttcgcttttcaag

SEQ ID NO: 56674 - DNA, 25 bp, S. cerevisiae
taacgcctattatttctgatgatat

SEQ ID NO: 56675 - DNA, 25 bp, S. cerevisiae
tacaccgaattctcatgctctgaag

SEQ ID NO: 56676 - DNA, 25 bp, S. cerevisiae
tacacctgcagattcaaagcctttg

SEQ ID NO: 56677 - DNA, 25 bp, S. cerevisiae
tacaccagcatgttgagaagcacct

SEQ ID NO: 56678 - DNA, 25 bp, S. cerevisiae
tacagcgcccttcaacatactaatg

SEQ ID NO: 56679 - DNA, 25 bp, S. cerevisiae
tacgccagattaccaccaagagcta

SEQ ID NO: 56680 - DNA, 25 bp, S. cerevisiae
tacagcatgcaagagccacttcgag

SEQ ID NO: 56681 - DNA, 25 bp, S. cerevisiae
taacgccatctacgcatcatatcaa

SEQ ID NO: 56682 - DNA, 25 bp, S. cerevisiae
tacagcgtcctcagcatcaagaaat

SEQ ID NO: 56683 - DNA, 25 bp, S. cerevisiae
taccgatcccgttcaagattatgtg

SEQ ID NO: 56684 - DNA, 25 bp, S. cerevisiae
taactgaccctcacaatatcggtgc

SEQ ID NO: 56685 - DNA, 25 bp, S. cerevisiae
taaataccctcagcaacttcggtgg

SEQ ID NO: 56686 - DNA, 25 bp, S. cerevisiae
taaaaggcaccatgaacagtctcat

SEQ ID NO: 56687 - DNA, 25 bp, S. cerevisiae
tagagaagggaagaacgatgagatc

SEQ ID NO: 56688 - DNA, 25 bp, S. cerevisiae
tagaaagggccactaactttatcga

SEQ ID NO: 56689 - DNA, 25 bp, S. cerevisiae
taaaggcttccataatttctatcga

SEQ ID NO: 56690 - DNA, 25 bp, S. cerevisiae
taaagtgtggcttaactccccagga

SEQ ID NO: 56691 - DNA, 25 bp, S. cerevisiae
taaaatggatcctttccctcacgga

SEQ ID NO: 56692 - DNA, 25 bp, S. cerevisiae
taaacatgttttcactggcgtctat

SEQ ID NO: 56693 - DNA, 25 bp, S. cerevisiae
taacttggctacattttgctataat

SEQ ID NO: 56694 - DNA, 25 bp, S. cerevisiae
taaccgcagcccaaagatactttct

SEQ ID NO: 56695 - DNA, 25 bp, S. cerevisiae
tactgtaccgggaaaatgcttcttt

SEQ ID NO: 56696 - DNA, 25 bp, S. cerevisiae
taactcccgaagaaaagcctcctca

SEQ ID NO: 56697 - DNA, 25 bp, S. cerevisiae
taaaccctgttggtgttccaaatga

SEQ ID NO: 56698 - DNA, 25 bp, S. cerevisiae
taaccgctcctgtgcaattcgacaa

SEQ ID NO: 56699 - DNA, 25 bp, S. cerevisiae
taaaggctactgtcgaaccagcatc

SEQ ID NO: 56700 - DNA, 25 bp, S. cerevisiae
taacgagcaaggtgaacgcgatcaa

SEQ ID NO: 56701 - DNA, 25 bp, S. cerevisiae
taacggcacgcttctagaccttgaa

SEQ ID NO: 56702 - DNA, 25 bp, S. cerevisiae
taacggcaccgttcgacaccataaa

SEQ ID NO: 56703 - DNA, 25 bp, S. cerevisiae
tagaaacgccgtacgaaccaccaat

SEQ ID NO: 56704 - DNA, 25 bp, S. cerevisiae
tagaacgaagggtccggctaagaat

SEQ ID NO: 56705 - DNA, 25 bp, S. cerevisiae
taaattctcagggtacaggctacaa

SEQ ID NO: 56706 - DNA, 25 bp, S. cerevisiae
taaattctattgacccagccttaat

SEQ ID NO: 56707 - DNA, 25 bp, S. cerevisiae
ttaaggacccaagcgacttcgaatt

SEQ ID NO: 56708 - DNA, 25 bp, S. cerevisiae
taacaggtctttagcatccacatct

SEQ ID NO: 56709 - DNA, 25 bp, S. cerevisiae
taaagtcagttgctctgcgggtgcc

SEQ ID NO: 56710 - DNA, 25 bp, S. cerevisiae
taaagtcatttgcagcggagcggca

SEQ ID NO: 56711 - DNA, 25 bp, S. cerevisiae
taaagtgagtatcctgtgtacgcag

SEQ ID NO: 56712 - DNA, 25 bp, S. cerevisiae
tatacattgaaaaaggtcaccgaaa

SEQ ID NO: 56713 - DNA, 25 bp, S. cerevisiae
tagaccaaactttttgaacttactg

SEQ ID NO: 56714 - DNA, 25 bp, S. cerevisiae
taacccactcacattgcagaatctt

SEQ ID NO: 56715 - DNA, 25 bp, S. cerevisiae
taacgcagcgatctcttcttcaaat

SEQ ID NO: 56716 - DNA, 25 bp, S. cerevisiae
taaagcaagatctcataccctccat

SEQ ID NO: 56717 - DNA, 25 bp, S. cerevisiae
taacaagaacgttatcccactcgtc

SEQ ID NO: 56718 - DNA, 25 bp, S. cerevisiae
taaataatctaagttacctgataca

SEQ ID NO: 56719 - DNA, 25 bp, S. cerevisiae
taacgatatctttttccgtgcaaga

SEQ ID NO: 56720 - DNA, 25 bp, S. cerevisiae
taaagattcacccaacttgtcaccc

SEQ ID NO: 56721 - DNA, 25 bp, S. cerevisiae
taaagtttcggcaaatcctctctcc

SEQ ID NO: 56722 - DNA, 25 bp, S. cerevisiae
taaagagcactttgggttgcccacc

SEQ ID NO: 56723 - DNA, 25 bp, S. cerevisiae
taaaagccgttagattcgtacgcaa

SEQ ID NO: 56724 - DNA, 25 bp, S. cerevisiae
taaaatgcccaagctcactgagagt

SEQ ID NO: 56725 - DNA, 25 bp, S. cerevisiae
taaatgtgaccatcctcacggtggt

SEQ ID NO: 56726 - DNA, 25 bp, S. cerevisiae
taaacatgaccatagcggacgccgg

SEQ ID NO: 56727 - DNA, 25 bp, S. cerevisiae
taaagatcaacctgagagccccgtt

SEQ ID NO: 56728 - DNA, 25 bp, S. cerevisiae
taacgatgcctttgccaatgtcgca

SEQ ID NO: 56729 - DNA, 25 bp, S. cerevisiae
taaacccgtggaacatccgccagta

SEQ ID NO: 56730 - DNA, 25 bp, S. cerevisiae
taaaaccgtacatgcacacgtcgct

SEQ ID NO: 56731 - DNA, 25 bp, S. cerevisiae
taaaactagaaatgcccagtccgtt

SEQ ID NO: 56732 - DNA, 25 bp, S. cerevisiae
taaaactagcgctatggccgcaact

SEQ ID NO: 56733 - DNA, 25 bp, S. cerevisiae
taacatacgattccagcgacccaga

SEQ ID NO: 56734 - DNA, 25 bp, S. cerevisiae
taaatgaagcattcgcggcccaagc

SEQ ID NO: 56735 - DNA, 25 bp, S. cerevisiae
taacacagcgcgtggtgccgtgata

SEQ ID NO: 56736 - DNA, 25 bp, S. cerevisiae
taacacctcagatttgccattacct

SEQ ID NO: 56737 - DNA, 25 bp, S. cerevisiae
taacgatgcaattgtaccctacatt

SEQ ID NO: 56738 - DNA, 25 bp, S. cerevisiae
taacgtcgaagaacaggctactttt

SEQ ID NO: 56739 - DNA, 25 bp, S. cerevisiae
taacttctacaacagagggcatttt

SEQ ID NO: 56740 - DNA, 25 bp, S. cerevisiae
taacgtttgctccaagggtcactat

SEQ ID NO: 56741 - DNA, 25 bp, S. cerevisiae
taacgtgtctgttacgggtatcctt

SEQ ID NO: 56742 - DNA, 25 bp, S. cerevisiae
taaacaacgtttattctctagagaa

SEQ ID NO: 56743 - DNA, 25 bp, S. cerevisiae
tactaccacatgcttcaagacctat

SEQ ID NO: 56744 - DNA, 25 bp, S. cerevisiae
taactgttttctgcccatgagtaaa

SEQ ID NO: 56745 - DNA, 25 bp, S. cerevisiae
tacactgaccagataacggagtaca

SEQ ID NO: 56746 - DNA, 25 bp, S. cerevisiae
taaaggcccaatatctccctggtaa

SEQ ID NO: 56747 - DNA, 25 bp, S. cerevisiae
taaacgcctctaactttccggctat

SEQ ID NO: 56748 - DNA, 25 bp, S. cerevisiae
taaatggcactttaccaccagttcc

SEQ ID NO: 56749 - DNA, 25 bp, S. cerevisiae
taaattacactctcgttggtttgcg

SEQ ID NO: 56750 - DNA, 25 bp, S. cerevisiae
taaaaagccgaagaccactcagagt

SEQ ID NO: 56751 - DNA, 25 bp, S. cerevisiae
taaaaaccatacgttgcgcctcgag

SEQ ID NO: 56752 - DNA, 25 bp, S. cerevisiae
taaaaactcttattggccctcgcat

SEQ ID NO: 56753 - DNA, 25 bp, S. cerevisiae
taaagaacgtcttaacccaccatca

SEQ ID NO: 56754 - DNA, 25 bp, S. cerevisiae
taaacccgctcaaaccaaggcatat

SEQ ID NO: 56755 - DNA, 25 bp, S. cerevisiae
taaatgccatcgtcaaaccaatcct

SEQ ID NO: 56756 - DNA, 25 bp, S. cerevisiae
taaaatcatcagactcacccaagcc

SEQ ID NO: 56757 - DNA, 25 bp, S. cerevisiae
taaatgatgtcgatgcagcccaaaa

SEQ ID NO: 56758 - DNA, 25 bp, S. cerevisiae
tacaagagaatgttcagcaccaaat

SEQ ID NO: 56759 - DNA, 25 bp, S. cerevisiae
taaacaagctgtcctcacgcaaaga

SEQ ID NO: 56760 - DNA, 25 bp, S. cerevisiae
taaagacacgtttgcgctctctggg

SEQ ID NO: 56761 - DNA, 25 bp, S. cerevisiae
taaatatttcctccattctacactc

SEQ ID NO: 56762 - DNA, 25 bp, S. cerevisiae
taaagatcccacagtatcgtctcac

SEQ ID NO: 56763 - DNA, 25 bp, S. cerevisiae
taaagctcctactgttgcggctgat

SEQ ID NO: 56764 - DNA, 25 bp, S. cerevisiae
taactatattatttggtgcgccatt

SEQ ID NO: 56765 - DNA, 25 bp, S. cerevisiae
tacccacggtttttgtctacaggca

SEQ ID NO: 56766 - DNA, 25 bp, S. cerevisiae
taaacacccttgctccatttttgaa

SEQ ID NO: 56767 - DNA, 25 bp, S. cerevisiae
taaacacccttgcttgttctctttt

SEQ ID NO: 56768 - DNA, 25 bp, S. cerevisiae
taaacccgcctgatttccttctaag

SEQ ID NO: 56769 - DNA, 25 bp, S. cerevisiae
taaaggccccagatttactcactca

SEQ ID NO: 56770 - DNA, 25 bp, S. cerevisiae
taaacggtctccttactataccaag

SEQ ID NO: 56771 - DNA, 25 bp, S. cerevisiae
tactatccgtactagaaaggttatc

SEQ ID NO: 56772 - DNA, 25 bp, S. cerevisiae
tacagtcccgccatatagcagttac

SEQ ID NO: 56773 - DNA, 25 bp, S. cerevisiae
tactctcatccagcattgcaagcag

SEQ ID NO: 56774 - DNA, 25 bp, S. cerevisiae
taacactttgaccaaggctgccatt

SEQ ID NO: 56775 - DNA, 25 bp, S. cerevisiae
taacaagttgcaattaggctccatt

SEQ ID NO: 56776 - DNA, 25 bp, S. cerevisiae
taactttgtactggtccgcttctaa

SEQ ID NO: 56777 - DNA, 25 bp, S. cerevisiae
taactacggtctgggtcccttagag

SEQ ID NO: 56778 - DNA, 25 bp, S. cerevisiae
tacactttttctacgtttcacgaag

SEQ ID NO: 56779 - DNA, 25 bp, S. cerevisiae
tactttatttttggttttcgcagat

SEQ ID NO: 56780 - DNA, 25 bp, S. cerevisiae
tacatttttgttgagctttcccaca

SEQ ID NO: 56781 - DNA, 25 bp, S. cerevisiae
taaagacaccaacacctctagttct

SEQ ID NO: 56782 - DNA, 25 bp, S. cerevisiae
taactcagttcgcatcttgaccaag

SEQ ID NO: 56783 - DNA, 25 bp, S. cerevisiae
taactgcgcaggcttgactcaagaa

SEQ ID NO: 56784 - DNA, 25 bp, S. cerevisiae
taacattgggtttactcatcgaaaa

SEQ ID NO: 56785 - DNA, 25 bp, S. cerevisiae
taaactctgttttgtgcccgaacca

SEQ ID NO: 56786 - DNA, 25 bp, S. cerevisiae
taacagttcttctagtagctgcgaa

SEQ ID NO: 56787 - DNA, 25 bp, S. cerevisiae
taaaaatcctctttgcactgcagaa

SEQ ID NO: 56788 - DNA, 25 bp, S. cerevisiae
taaagcgcccttcacaattgggaag

SEQ ID NO: 56789 - DNA, 25 bp, S. cerevisiae
tactgtctccgttaccaagtgttta

SEQ ID NO: 56790 - DNA, 25 bp, S. cerevisiae
taacatcggcgttccaaacaacaat

SEQ ID NO: 56791 - DNA, 25 bp, S. cerevisiae
taaatcgcagctatcaacaaccaaa

SEQ ID NO: 56792 - DNA, 25 bp, S. cerevisiae
tacaatctcaatccttacacacaaa

SEQ ID NO: 56793 - DNA, 25 bp, S. cerevisiae
taacatctcttgtttatcccatcca

SEQ ID NO: 56794 - DNA, 25 bp, S. cerevisiae
taacaccgttgtgggcatttcaggt

SEQ ID NO: 56795 - DNA, 25 bp, S. cerevisiae
tacacattggttacggactttggtt

SEQ ID NO: 56796 - DNA, 25 bp, S. cerevisiae
tacaaaccgccgtcacgatgaggca

SEQ ID NO: 56797 - DNA, 25 bp, S. cerevisiae
taaatctaggcgaaagtgatgagga

SEQ ID NO: 56798 - DNA, 25 bp, S. cerevisiae
taaacgtgggaccagcagccgtacg

SEQ ID NO: 56799 - DNA, 25 bp, S. cerevisiae
taaaatggtcatttgccgtggcata

SEQ ID NO: 56800 - DNA, 25 bp, S. cerevisiae
taaacagatcgaccttcaagccaac

SEQ ID NO: 56801 - DNA, 25 bp, S. cerevisiae
taacacgtcggctactaaccaatta

SEQ ID NO: 56802 - DNA, 25 bp, S. cerevisiae
taccgcgtctgtgcaatactactat

SEQ ID NO: 56803 - DNA, 25 bp, S. cerevisiae
tacaccgatggtctctttacactag

SEQ ID NO: 56804 - DNA, 25 bp, S. cerevisiae
taacagcgggtgtttctttcaacaa

SEQ ID NO: 56805 - DNA, 25 bp, S. cerevisiae
taaacaactggatctttctcaaaat

SEQ ID NO: 56806 - DNA, 25 bp, S. cerevisiae
taaacaatctgtgggcaagtctgca

SEQ ID NO: 56807 - DNA, 25 bp, S. cerevisiae
taaaatctcagtttgggtcgcccta

SEQ ID NO: 56808 - DNA, 25 bp, S. cerevisiae
taaacgcccgtgtgtcgttgagata

SEQ ID NO: 56809 - DNA, 25 bp, S. cerevisiae
taacaacgccggtgtatctgcagaa

SEQ ID NO: 56810 - DNA, 25 bp, S. cerevisiae
taaacacgcctgtggtcattcatgc

SEQ ID NO: 56811 - DNA, 25 bp, S. cerevisiae
taaaactctctatctctcatgcaat

SEQ ID NO: 56812 - DNA, 25 bp, S. cerevisiae
taaaactatctaccatccattctgc

SEQ ID NO: 56813 - DNA, 25 bp, S. cerevisiae
taacatccaatcatgttcttcgcct

SEQ ID NO: 56814 - DNA, 25 bp, S. cerevisiae
taaatagctggccaacgctttacga

SEQ ID NO: 56815 - DNA, 25 bp, S. cerevisiae
taaatttgcgtcaacagggtaccaa

SEQ ID NO: 56816 - DNA, 25 bp, S. cerevisiae
taaatttgcctccaacgtggtcgaa

SEQ ID NO: 56817 - DNA, 25 bp, S. cerevisiae
taaagtcgtcgctgtcgtcgtggaa

SEQ ID NO: 56818 - DNA, 25 bp, S. cerevisiae
taaagtattcactgttcctgggaaa

SEQ ID NO: 56819 - DNA, 25 bp, S. cerevisiae
taaacgaacacgcttcctcgttagt

SEQ ID NO: 56820 - DNA, 25 bp, S. cerevisiae
tacaccggacgtctagattatgcta

SEQ ID NO: 56821 - DNA, 25 bp, S. cerevisiae
taaaacatcctccttcttctaacaa

SEQ ID NO: 56822 - DNA, 25 bp, S. cerevisiae
taaaacatcctcttcctctttaagg

SEQ ID NO: 56823 - DNA, 25 bp, S. cerevisiae
taaagatagctacctccattttggg

SEQ ID NO: 56824 - DNA, 25 bp, S. cerevisiae
taaattacaaccttcgcttatggcg

SEQ ID NO: 56825 - DNA, 25 bp, S. cerevisiae
taaatctacacacgttcctgttggc

SEQ ID NO: 56826 - DNA, 25 bp, S. cerevisiae
tacagacggaattttccctatttgt

SEQ ID NO: 56827 - DNA, 25 bp, S. cerevisiae
tacacacttagtttttccgactggt

SEQ ID NO: 56828 - DNA, 25 bp, S. cerevisiae
taaaagcacctgttcatatagcaag

SEQ ID NO: 56829 - DNA, 25 bp, S. cerevisiae
tacaccacccatttgatgaagagaa

SEQ ID NO: 56830 - DNA, 25 bp, S. cerevisiae
taacacctgaattcttagctacatg

SEQ ID NO: 56831 - DNA, 25 bp, S. cerevisiae
tacagcccagaattctcagcgcaat

SEQ ID NO: 56832 - DNA, 25 bp, S. cerevisiae
tacacaccgacgactgcgaaatctg

SEQ ID NO: 56833 - DNA, 25 bp, S. cerevisiae
taaactggcagtcgcttaaatccgt

SEQ ID NO: 56834 - DNA, 25 bp, S. cerevisiae
taaactgcgcatttttgtatcccgg

SEQ ID NO: 56835 - DNA, 25 bp, S. cerevisiae
tacagcggttttgttctccaaggca

SEQ ID NO: 56836 - DNA, 25 bp, S. cerevisiae
tacacgtattttaactccggcagat

SEQ ID NO: 56837 - DNA, 25 bp, S. cerevisiae
tacacctttggtttcatggcgaaat

SEQ ID NO: 56838 - DNA, 25 bp, S. cerevisiae
taaaatattaccttccgctatcgca

SEQ ID NO: 56839 - DNA, 25 bp, S. cerevisiae
taaatttgagtggtccctcaccttc

SEQ ID NO: 56840 - DNA, 25 bp, S. cerevisiae
taaagtggacgagtcccgaccttag

SEQ ID NO: 56841 - DNA, 25 bp, S. cerevisiae
tatcaagaggactgtgcccggccaa

SEQ ID NO: 56842 - DNA, 25 bp, S. cerevisiae
taaaagtgtcattttgccgacgaaa

SEQ ID NO: 56843 - DNA, 25 bp, S. cerevisiae
taaaagttgcctattctgatctgaa

SEQ ID NO: 56844 - DNA, 25 bp, S. cerevisiae
taaattacgccttttcgatggatga

SEQ ID NO: 56845 - DNA, 25 bp, S. cerevisiae
taaatcccgtacaactcgagctgct

SEQ ID NO: 56846 - DNA, 25 bp, S. cerevisiae
taaatcttccattctaagccgccat

SEQ ID NO: 56847 - DNA, 25 bp, S. cerevisiae
taaacttactttcacacccagcata

SEQ ID NO: 56848 - DNA, 25 bp, S. cerevisiae
taaactttctttatctctccaggac

SEQ ID NO: 56849 - DNA, 25 bp, S. cerevisiae
taaataagttcgcatcctctcctgg

SEQ ID NO: 56850 - DNA, 25 bp, S. cerevisiae
taaattcaagtttgttcctcctggg

SEQ ID NO: 56851 - DNA, 25 bp, S. cerevisiae
taaatctgaagaagagccctcctct

SEQ ID NO: 56852 - DNA, 25 bp, S. cerevisiae
taaatacattggtgagtctgctcgt

SEQ ID NO: 56853 - DNA, 25 bp, S. cerevisiae
taaacttacaattcgcagccatcaa

SEQ ID NO: 56854 - DNA, 25 bp, S. cerevisiae
taaaatcacctttcgtgcacgctaa

SEQ ID NO: 56855 - DNA, 25 bp, S. cerevisiae
taaagccattgctgatcttgccgtt

SEQ ID NO: 56856 - DNA, 25 bp, S. cerevisiae
tacaacaacctttagcacccgcttt

SEQ ID NO: 56857 - DNA, 25 bp, S. cerevisiae
taaaaactcattaccaccagctctg

SEQ ID NO: 56858 - DNA, 25 bp, S. cerevisiae
taaactctcttaacatacggccgta

SEQ ID NO: 56859 - DNA, 25 bp, S. cerevisiae
taaactcttcaatatcatcgccggc

SEQ ID NO: 56860 - DNA, 25 bp, S. cerevisiae
taaaatcttctgtttgcatggaggt

SEQ ID NO: 56861 - DNA, 25 bp, S. cerevisiae
tacaacagcttctgcttctagcgtg

SEQ ID NO: 56862 - DNA, 25 bp, S. cerevisiae
taaaatgtctgcctctgatccgaat

SEQ ID NO: 56863 - DNA, 25 bp, S. cerevisiae
taaaatgccatggtcgtcgccaaga

SEQ ID NO: 56864 - DNA, 25 bp, S. cerevisiae
taaagacaccgaagatctccgaggt

SEQ ID NO: 56865 - DNA, 25 bp, S. cerevisiae
taaagaaacggcgtctgcacctctg

SEQ ID NO: 56866 - DNA, 25 bp, S. cerevisiae
tacaagtagactgctttgctcactc

SEQ ID NO: 56867 - DNA, 25 bp, S. cerevisiae
taaatggtacgctttcttcaccacg

SEQ ID NO: 56868 - DNA, 25 bp, S. cerevisiae
tacgtagtagcggttttcggcctgc

SEQ ID NO: 56869 - DNA, 25 bp, S. cerevisiae
tacggtcctgcgagacgtctagata

SEQ ID NO: 56870 - DNA, 25 bp, S. cerevisiae
taccgatccaaacgagcgcctaata

SEQ ID NO: 56871 - DNA, 25 bp, S. cerevisiae
tactcactacaacgataccctatta

SEQ ID NO: 56872 - DNA, 25 bp, S. cerevisiae
ttcttttccgacgagtttcacaccg

SEQ ID NO: 56873 - DNA, 25 bp, S. cerevisiae
tacgttaccgctgaaaaggctgcca

SEQ ID NO: 56874 - DNA, 25 bp, S. cerevisiae
taaatttcggctgcaaacgttccct

SEQ ID NO: 56875 - DNA, 25 bp, S. cerevisiae
taaagccattttaccctgttacgag

SEQ ID NO: 56876 - DNA, 25 bp, S. cerevisiae
tacataccgtattacccgttagcac

SEQ ID NO: 56877 - DNA, 25 bp, S. cerevisiae
tacaaactacctaccaatgacaaag

SEQ ID NO: 56878 - DNA, 25 bp, S. cerevisiae
taaaacacttgcttcctcatcagtc

SEQ ID NO: 56879 - DNA, 25 bp, S. cerevisiae
taaacaatttgattcctccgtcttt

SEQ ID NO: 56880 - DNA, 25 bp, S. cerevisiae
taaacattctgttcatcccctaatt

SEQ ID NO: 56881 - DNA, 25 bp, S. cerevisiae
taaacttctaatggctcctctggat

SEQ ID NO: 56882 - DNA, 25 bp, S. cerevisiae
taaagcctacatgcactccagaatg

SEQ ID NO: 56883 - DNA, 25 bp, S. cerevisiae
taaacgctacaccaactgcagaatt

SEQ ID NO: 56884 - DNA, 25 bp, S. cerevisiae
tacagtcagaagtcgatccacaaac

SEQ ID NO: 56885 - DNA, 25 bp, S. cerevisiae
tactgaaagtcgtctgcctggattt

SEQ ID NO: 56886 - DNA, 25 bp, S. cerevisiae
tactgacgttggttggtggtacgtt

SEQ ID NO: 56887 - DNA, 25 bp, S. cerevisiae
tacttccttggctgtgttgatacgt

SEQ ID NO: 56888 - DNA, 25 bp, S. cerevisiae
tacttgctttggtgattctaacggc

SEQ ID NO: 56889 - DNA, 25 bp, S. cerevisiae
tacttttactaccattcaccacggt

SEQ ID NO: 56890 - DNA, 25 bp, S. cerevisiae
tacagttattcgcagaggtgtcacg

SEQ ID NO: 56891 - DNA, 25 bp, S. cerevisiae
tacagttaccgtatgtgactccgcc

SEQ ID NO: 56892 - DNA, 25 bp, S. cerevisiae
tactttcactgactttgtttccggc

SEQ ID NO: 56893 - DNA, 25 bp, S. cerevisiae
tactttgctatgcagggctaacctt

SEQ ID NO: 56894 - DNA, 25 bp, S. cerevisiae
tacttacttgaaggtctacaaggtt

SEQ ID NO: 56895 - DNA, 25 bp, S. cerevisiae
tactgacatctaccaagttcctgag

SEQ ID NO: 56896 - DNA, 25 bp, S. cerevisiae
taaagtgttcagttcggacgatcct

SEQ ID NO: 56897 - DNA, 25 bp, S. cerevisiae
tagaatgggtcactccggtgcaatt

SEQ ID NO: 56898 - DNA, 25 bp, S. cerevisiae
taaagggttcttctgctgcattagg

SEQ ID NO: 56899 - DNA, 25 bp, S. cerevisiae
taaaggttcctcctggcatacgggt

SEQ ID NO: 56900 - DNA, 25 bp, S. cerevisiae
tacagaaaagccctggagttcccgc

SEQ ID NO: 56901 - DNA, 25 bp, S. cerevisiae
tacaattggagaagggatttgcccc

SEQ ID NO: 56902 - DNA, 25 bp, S. cerevisiae
tagaatgctaggactggcgttgtgt

SEQ ID NO: 56903 - DNA, 25 bp, S. cerevisiae
tagaatgatttgcagcggtggtaaa

SEQ ID NO: 56904 - DNA, 25 bp, S. cerevisiae
tagaactattgatcggtggtattgc

SEQ ID NO: 56905 - DNA, 25 bp, S. cerevisiae
taaactgatcgttgctggtggtggt

SEQ ID NO: 56906 - DNA, 25 bp, S. cerevisiae
tacaagttcctttggtggctggtac

SEQ ID NO: 56907 - DNA, 25 bp, S. cerevisiae
taccgttagctttgggatcgcgtgt

SEQ ID NO: 56908 - DNA, 25 bp, S. cerevisiae
taaagcctttgcagagtttgaatca

SEQ ID NO: 56909 - DNA, 25 bp, S. cerevisiae
taaaccttcggtagcgctgcaaaag

SEQ ID NO: 56910 - DNA, 25 bp, S. cerevisiae
taaactctaagtttgcgcccgaaga

SEQ ID NO: 56911 - DNA, 25 bp, S. cerevisiae
taaacccaagtttgctgtgctcgac

SEQ ID NO: 56912 - DNA, 25 bp, S. cerevisiae
tactcaggtgattagattcggaaca

SEQ ID NO: 56913 - DNA, 25 bp, S. cerevisiae
tacatgaattcaagaccgcggacag

SEQ ID NO: 56914 - DNA, 25 bp, S. cerevisiae
tacgataccgttacccgaggacatt

SEQ ID NO: 56915 - DNA, 25 bp, S. cerevisiae
taaattaccatctccagtgcacgaa

SEQ ID NO: 56916 - DNA, 25 bp, S. cerevisiae
taaatctctctttcacttcagcaaa

SEQ ID NO: 56917 - DNA, 25 bp, S. cerevisiae
taaacatgctcttcatctgcttaaa

SEQ ID NO: 56918 - DNA, 25 bp, S. cerevisiae
tacacttcatttttatcgccttacg

SEQ ID NO: 56919 - DNA, 25 bp, S. cerevisiae
tacagcttagccttcgtaataacga

SEQ ID NO: 56920 - DNA, 25 bp, S. cerevisiae
tactgtctacttaactaacccgtct

SEQ ID NO: 56921 - DNA, 25 bp, S. cerevisiae
tactccataacaaaagatccccgct

SEQ ID NO: 56922 - DNA, 25 bp, S. cerevisiae
tatggtctgggcaaacaacaaactc

SEQ ID NO: 56923 - DNA, 25 bp, S. cerevisiae
tagactcgggcatacaactagtgga

SEQ ID NO: 56924 - DNA, 25 bp, S. cerevisiae
tacaacgcggtgtcctcaaaggtaa

SEQ ID NO: 56925 - DNA, 25 bp, S. cerevisiae
tactacccgcaaccataatagcgct

SEQ ID NO: 56926 - DNA, 25 bp, S. cerevisiae
tatcattcccgatgcagtaatagac

SEQ ID NO: 56927 - DNA, 25 bp, S. cerevisiae
tacacttcggcggtaactgctgcaa

SEQ ID NO: 56928 - DNA, 25 bp, S. cerevisiae
tacctatcggcggtaccttaatcgg

SEQ ID NO: 56929 - DNA, 25 bp, S. cerevisiae
tatcaaatgcgtcaaattccccggg

SEQ ID NO: 56930 - DNA, 25 bp, S. cerevisiae
tacaagtcctggtcattttaaccct

SEQ ID NO: 56931 - DNA, 25 bp, S. cerevisiae
tactaatgccggctttcaaagatgt

SEQ ID NO: 56932 - DNA, 25 bp, S. cerevisiae
taggtggcgcggcaactataaagta

SEQ ID NO: 56933 - DNA, 25 bp, S. cerevisiae
taggcggccgcacaagtaagaagtc

SEQ ID NO: 56934 - DNA, 25 bp, S. cerevisiae
tagtcgtccaccgtatctaaggaac

SEQ ID NO: 56935 - DNA, 25 bp, S. cerevisiae
tactttccacactttccaaggtatc

SEQ ID NO: 56936 - DNA, 25 bp, S. cerevisiae
tacagtttaatctattcgacggcaa

SEQ ID NO: 56937 - DNA, 25 bp, S. cerevisiae
taaatctaccatgcgtcaatccaac

SEQ ID NO: 56938 - DNA, 25 bp, S. cerevisiae
tacagttccgatgcgaagatccaag

SEQ ID NO: 56939 - DNA, 25 bp, S. cerevisiae
taaatctgcctgtgctaggtcgcta

SEQ ID NO: 56940 - DNA, 25 bp, S. cerevisiae
taaatcgcagtctttgggctctgtc

SEQ ID NO: 56941 - DNA, 25 bp, S. cerevisiae
taaacgctattatcggctcttcaac

SEQ ID NO: 56942 - DNA, 25 bp, S. cerevisiae
taaaggcatatatggcccgcttccc

SEQ ID NO: 56943 - DNA, 25 bp, S. cerevisiae
taaagagtatctgggccggcttgcc

SEQ ID NO: 56944 - DNA, 25 bp, S. cerevisiae
taaagccgcgctgtccagatttaca

SEQ ID NO: 56945 - DNA, 25 bp, S. cerevisiae
taaagactcctttccaattgtgcag

SEQ ID NO: 56946 - DNA, 25 bp, S. cerevisiae
taaaggagggctacagcgatcttaa

SEQ ID NO: 56947 - DNA, 25 bp, S. cerevisiae
taaagcagaacgttccaccatggaa

SEQ ID NO: 56948 - DNA, 25 bp, S. cerevisiae
taaagcacaacgttccgatgattag

SEQ ID NO: 56949 - DNA, 25 bp, S. cerevisiae
tataaaaccgcttccgaaatcgcca

SEQ ID NO: 56950 - DNA, 25 bp, S. cerevisiae
taaactacctctaccaaatatccgc

SEQ ID NO: 56951 - DNA, 25 bp, S. cerevisiae
taaattacctctcccgtatatgcag

SEQ ID NO: 56952 - DNA, 25 bp, S. cerevisiae
taaagatgcttcgtacgcgtactta

SEQ ID NO: 56953 - DNA, 25 bp, S. cerevisiae
taaaggtagctttcaaggcacttga

SEQ ID NO: 56954 - DNA, 25 bp, S. cerevisiae
taaagtgttctttggcaggcctaca

SEQ ID NO: 56955 - DNA, 25 bp, S. cerevisiae
taaagtgtttacctggagcccacca

SEQ ID NO: 56956 - DNA, 25 bp, S. cerevisiae
tagaagagtttttaccaccgatcga

SEQ ID NO: 56957 - DNA, 25 bp, S. cerevisiae
tacaactttgttatggacccggaga

SEQ ID NO: 56958 - DNA, 25 bp, S. cerevisiae
tacaacgaacttttggaccttggat

SEQ ID NO: 56959 - DNA, 25 bp, S. cerevisiae
tacaactcaaccattgctagctctt

SEQ ID NO: 56960 - DNA, 25 bp, S. cerevisiae
tacaaccgactctactgatacatct

SEQ ID NO: 56961 - DNA, 25 bp, S. cerevisiae
tacagagctaccatccaaggtttat

SEQ ID NO: 56962 - DNA, 25 bp, S. cerevisiae
tacaagcaaaacctggtcaccctgt

SEQ ID NO: 56963 - DNA, 25 bp, S. cerevisiae
tacaaagaaatcacctaccagcagt

SEQ ID NO: 56964 - DNA, 25 bp, S. cerevisiae
taaatcaaccacacagctacgcaag

SEQ ID NO: 56965 - DNA, 25 bp, S. cerevisiae
taaatcttcaagaccagcggcgaac

SEQ ID NO: 56966 - DNA, 25 bp, S. cerevisiae
tacacagttcggatcctcagcgtag

SEQ ID NO: 56967 - DNA, 25 bp, S. cerevisiae
taaagttcctttgcttgctgataag

SEQ ID NO: 56968 - DNA, 25 bp, S. cerevisiae
taaagattctccacctggtatagtg

SEQ ID NO: 56969 - DNA, 25 bp, S. cerevisiae
taaagtccgttatgagtctactctg

SEQ ID NO: 56970 - DNA, 25 bp, S. cerevisiae
taaaggcactttttgtcacactaaa

SEQ ID NO: 56971 - DNA, 25 bp, S. cerevisiae
taaagaccgctgctactgtccagaa

SEQ ID NO: 56972 - DNA, 25 bp, S. cerevisiae
taaagacgccgccaagctacaggaa

SEQ ID NO: 56973 - DNA, 25 bp, S. cerevisiae
tactacattgaagacgtcggcggag

SEQ ID NO: 56974 - DNA, 25 bp, S. cerevisiae
tatcctattggatcacgggcgacgg

SEQ ID NO: 56975 - DNA, 25 bp, S. cerevisiae
ttcgcctcaatttacggtggacgtt

SEQ ID NO: 56976 - DNA, 25 bp, S. cerevisiae
tacaatcgcaatttactggaggcac

SEQ ID NO: 56977 - DNA, 25 bp, S. cerevisiae
tacattgctggttcagcgggtacct

SEQ ID NO: 56978 - DNA, 25 bp, S. cerevisiae
taaagcattttccaacgcaagcagt

SEQ ID NO: 56979 - DNA, 25 bp, S. cerevisiae
taaagcattcttccaaacacgagag

SEQ ID NO: 56980 - DNA, 25 bp, S. cerevisiae
tacaagaccttgaaacccgcagaac

SEQ ID NO: 56981 - DNA, 25 bp, S. cerevisiae
ttccaaattctaaaccgctacagcc

SEQ ID NO: 56982 - DNA, 25 bp, S. cerevisiae
tactaactctgctaacaccgttcaa

SEQ ID NO: 56983 - DNA, 25 bp, S. cerevisiae
taaatgacgctaccatctttgccac

SEQ ID NO: 56984 - DNA, 25 bp, S. cerevisiae
taaatgcaagctttctctatccgag

SEQ ID NO: 56985 - DNA, 25 bp, S. cerevisiae
taaagcagacactcatcacactcga

SEQ ID NO: 56986 - DNA, 25 bp, S. cerevisiae
taaatactgctcaaacaccactagg

SEQ ID NO: 56987 - DNA, 25 bp, S. cerevisiae
taaagcagcccaaagtccagaacat

SEQ ID NO: 56988 - DNA, 25 bp, S. cerevisiae
taaagagccgagtgatcctgattat

SEQ ID NO: 56989 - DNA, 25 bp, S. cerevisiae
taaagccagccatctccagtgctct

SEQ ID NO: 56990 - DNA, 25 bp, S. cerevisiae
taaatgctcacgaatcccaagttgt

SEQ ID NO: 56991 - DNA, 25 bp, S. cerevisiae
tacaatccaaagttcttcctccgaa

SEQ ID NO: 56992 - DNA, 25 bp, S. cerevisiae
tacttcctgaaattgcttccactta

SEQ ID NO: 56993 - DNA, 25 bp, S. cerevisiae
tacaggtctggatactacagcccca

SEQ ID NO: 56994 - DNA, 25 bp, S. cerevisiae
tacaggtgtcgatacatggtccatc

SEQ ID NO: 56995 - DNA, 25 bp, S. cerevisiae
taggtttcggtgcaggttcatttac

SEQ ID NO: 56996 - DNA, 25 bp, S. cerevisiae
tacatgtttggtttcctctttttct

SEQ ID NO: 56997 - DNA, 25 bp, S. cerevisiae
taaattctggcctgtctttattgac

SEQ ID NO: 56998 - DNA, 25 bp, S. cerevisiae
taaacccaccttatcatcagcagat

SEQ ID NO: 56999 - DNA, 25 bp, S. cerevisiae
tacaacgccagtctattgagacaat

SEQ ID NO: 57000 - DNA, 25 bp, S. cerevisiae
tacatccatgtcttcattacctgat

SEQ ID NO: 57001 - DNA, 25 bp, S. cerevisiae
tactggcggtgaggttgctgccaat

SEQ ID NO: 57002 - DNA, 25 bp, S. cerevisiae
tactagcggatagtcctctggacga

SEQ ID NO: 57003 - DNA, 25 bp, S. cerevisiae
taaatggaacgtgttgaacagagat

SEQ ID NO: 57004 - DNA, 25 bp, S. cerevisiae
taggacaaggcctcttgttcggcaa

SEQ ID NO: 57005 - DNA, 25 bp, S. cerevisiae
taccgctagaggtgctatttgtgtc

SEQ ID NO: 57006 - DNA, 25 bp, S. cerevisiae
taaagtctcgttcgctcattttgtc

SEQ ID NO: 57007 - DNA, 25 bp, S. cerevisiae
taaagtggcctgtacgtttttgtgc

SEQ ID NO: 57008 - DNA, 25 bp, S. cerevisiae
tacataccagggaacgtgtcgctta

SEQ ID NO: 57009 - DNA, 25 bp, S. cerevisiae
tactatccaggaatgacgttcgtga

SEQ ID NO: 57010 - DNA, 25 bp, S. cerevisiae
taaatcagggcagtcgcttacgtcg

SEQ ID NO: 57011 - DNA, 25 bp, S. cerevisiae
tacaaacatgtcatccgtgagcgcc

SEQ ID NO: 57012 - DNA, 25 bp, S. cerevisiae
taaagagctgtcttctacaaccgcg

SEQ ID NO: 57013 - DNA, 25 bp, S. cerevisiae
taaagtctgcattgatttcgctaca

SEQ ID NO: 57014 - DNA, 25 bp, S. cerevisiae
taaagtgctgcaattctctcaagaa

SEQ ID NO: 57015 - DNA, 25 bp, S. cerevisiae
tacaaactgtcttctactctggcgt

SEQ ID NO: 57016 - DNA, 25 bp, S. cerevisiae
tactagcattttatccgttctttct

SEQ ID NO: 57017 - DNA, 25 bp, S. cerevisiae
tagtcaatgatataccgggtggtgt

SEQ ID NO: 57018 - DNA, 25 bp, S. cerevisiae
tagtcaaaacaaacgtggttgtaga

SEQ ID NO: 57019 - DNA, 25 bp, S. cerevisiae
taccaaaccaatacggcggctttca

SEQ ID NO: 57020 - DNA, 25 bp, S. cerevisiae
tacgtactcaagctcgtttcttcca

SEQ ID NO: 57021 - DNA, 25 bp, S. cerevisiae
taccgaaatacttggaatacgctgc

SEQ ID NO: 57022 - DNA, 25 bp, S. cerevisiae
taaagtactactgggactctcgttc

SEQ ID NO: 57023 - DNA, 25 bp, S. cerevisiae
tacaactggttcatggttctttagt

SEQ ID NO: 57024 - DNA, 25 bp, S. cerevisiae
tacgatccaaaatatgtttcagcat

SEQ ID NO: 57025 - DNA, 25 bp, S. cerevisiae
tacttccagaaccatttttacattt

SEQ ID NO: 57026 - DNA, 25 bp, S. cerevisiae
tactaccaccactttggactgtgaa

SEQ ID NO: 57027 - DNA, 25 bp, S. cerevisiae
tactaaattacatttggacaaggac

SEQ ID NO: 57028 - DNA, 25 bp, S. cerevisiae
ttggaagctaacttctggaccgccg

SEQ ID NO: 57029 - DNA, 25 bp, S. cerevisiae
tagaggttttacgttccccatcagg

SEQ ID NO: 57030 - DNA, 25 bp, S. cerevisiae
tacggtttgaaccacgttgttgcct

SEQ ID NO: 57031 - DNA, 25 bp, S. cerevisiae
tacccgtgtttattcgaacctaatg

SEQ ID NO: 57032 - DNA, 25 bp, S. cerevisiae
tacaccggtgtttatagaagctctt

SEQ ID NO: 57033 - DNA, 25 bp, S. cerevisiae
tataccggaggttacgacagatatt

SEQ ID NO: 57034 - DNA, 25 bp, S. cerevisiae
taccgggaggaatccacgaattctt

SEQ ID NO: 57035 - DNA, 25 bp, S. cerevisiae
tacaaggtatttccactttgagacc

SEQ ID NO: 57036 - DNA, 25 bp, S. cerevisiae
tacagttcgtcgttgcctattagaa

SEQ ID NO: 57037 - DNA, 25 bp, S. cerevisiae
ttaattctccttacgggcaagctgg

SEQ ID NO: 57038 - DNA, 25 bp, S. cerevisiae
taaaggccgccatcagagatccaaa

SEQ ID NO: 57039 - DNA, 25 bp, S. cerevisiae
taaaggcaccgatgacgaggctgta

SEQ ID NO: 57040 - DNA, 25 bp, S. cerevisiae
tacaagtaccagtgaagagcgcatc

SEQ ID NO: 57041 - DNA, 25 bp, S. cerevisiae
tatgctctttggcaagtagggtcat

SEQ ID NO: 57042 - DNA, 25 bp, S. cerevisiae
tacattcggcacaacacttactggt

SEQ ID NO: 57043 - DNA, 25 bp, S. cerevisiae
taaatgcattaactactctccacca

SEQ ID NO: 57044 - DNA, 25 bp, S. cerevisiae
taaatctactagtatcctccaccaa

SEQ ID NO: 57045 - DNA, 25 bp, S. cerevisiae
taaattcgcagaggccaggcgcgag

SEQ ID NO: 57046 - DNA, 25 bp, S. cerevisiae
taaataccgcaacgaggcccttgat

SEQ ID NO: 57047 - DNA, 25 bp, S. cerevisiae
taaatacgtcgctgaggccactggt

SEQ ID NO: 57048 - DNA, 25 bp, S. cerevisiae
tacaataggtagtgggcctggcagt

SEQ ID NO: 57049 - DNA, 25 bp, S. cerevisiae
tacaactattttggtcgctctgggc

SEQ ID NO: 57050 - DNA, 25 bp, S. cerevisiae
tacaaaatgcttcatcttctccggc

SEQ ID NO: 57051 - DNA, 25 bp, S. cerevisiae
tacaatgaacgtcactgggctgcca

SEQ ID NO: 57052 - DNA, 25 bp, S. cerevisiae
taaaggatggtgaattcggcgcaat

SEQ ID NO: 57053 - DNA, 25 bp, S. cerevisiae
tacaatgaggtccaccctgaaggtg

SEQ ID NO: 57054 - DNA, 25 bp, S. cerevisiae
taccggtgccaagcgtgctcaattc

SEQ ID NO: 57055 - DNA, 25 bp, S. cerevisiae
tacagcgatgatgccggtgtgccaa

SEQ ID NO: 57056 - DNA, 25 bp, S. cerevisiae
tacaggcgactatggtgctgagcca

SEQ ID NO: 57057 - DNA, 25 bp, S. cerevisiae
tactgtggtttcattagatagataa

SEQ ID NO: 57058 - DNA, 25 bp, S. cerevisiae
tacttcaattatcggtagtcgcatt

SEQ ID NO: 57059 - DNA, 25 bp, S. cerevisiae
tacttctattgatggtaggtgttcc

SEQ ID NO: 57060 - DNA, 25 bp, S. cerevisiae
tacatttctatcttggtgggcgtca

SEQ ID NO: 57061 - DNA, 25 bp, S. cerevisiae
tacttgacattcatgcgtggtttca

SEQ ID NO: 57062 - DNA, 25 bp, S. cerevisiae
tacttgcagcttaccggacgttgaa

SEQ ID NO: 57063 - DNA, 25 bp, S. cerevisiae
tacaacaggaccagcagcagcggtt

SEQ ID NO: 57064 - DNA, 25 bp, S. cerevisiae
tagcataagtactgtcgcaaggcat

SEQ ID NO: 57065 - DNA, 25 bp, S. cerevisiae
tacataggtggctgtctgctgcaga

SEQ ID NO: 57066 - DNA, 25 bp, S. cerevisiae
tacaagttgccgctatcgagttcgc

SEQ ID NO: 57067 - DNA, 25 bp, S. cerevisiae
tacagcagtgggacagtagagccat

SEQ ID NO: 57068 - DNA, 25 bp, S. cerevisiae
tacagaatcgtccaagaatgccatg

SEQ ID NO: 57069 - DNA, 25 bp, S. cerevisiae
taaattcatccacctgaagccatca

SEQ ID NO: 57070 - DNA, 25 bp, S. cerevisiae
taaatattccgtcttcaactgctca

SEQ ID NO: 57071 - DNA, 25 bp, S. cerevisiae
tatactaccgttacgtacacaccat

SEQ ID NO: 57072 - DNA, 25 bp, S. cerevisiae
tacggaccatttacgcaaaactcat

SEQ ID NO: 57073 - DNA, 25 bp, S. cerevisiae
tacaccaagccggttgtcaattcgt

SEQ ID NO: 57074 - DNA, 25 bp, S. cerevisiae
tacacatattgcttccgtctcagaa

SEQ ID NO: 57075 - DNA, 25 bp, S. cerevisiae
tacacagagtgaacctgctgcctgg

SEQ ID NO: 57076 - DNA, 25 bp, S. cerevisiae
tacatcaggtattgccttctctggc

SEQ ID NO: 57077 - DNA, 25 bp, S. cerevisiae
tatcaggtctaagccttttttctgg

SEQ ID NO: 57078 - DNA, 25 bp, S. cerevisiae
tacggccattaggttcgtttgtttg

SEQ ID NO: 57079 - DNA, 25 bp, S. cerevisiae
tacaaacagttggtctcgtcgattg

SEQ ID NO: 57080 - DNA, 25 bp, S. cerevisiae
tacagaaatcctactcttgccgttg

SEQ ID NO: 57081 - DNA, 25 bp, S. cerevisiae
tacaccagttattcgctgaagccat

SEQ ID NO: 57082 - DNA, 25 bp, S. cerevisiae
tacagcgagctttactgccgacgaa

SEQ ID NO: 57083 - DNA, 25 bp, S. cerevisiae
tacatcaactgatcctgtcgaagat

SEQ ID NO: 57084 - DNA, 25 bp, S. cerevisiae
tactgccactggttactcaatggtg

SEQ ID NO: 57085 - DNA, 25 bp, S. cerevisiae
tacaacgctgatgacctaatgcatg

SEQ ID NO: 57086 - DNA, 25 bp, S. cerevisiae
tacattcctgatcactctatatggg

SEQ ID NO: 57087 - DNA, 25 bp, S. cerevisiae
tacaagggcatactcgcttcatagc

SEQ ID NO: 57088 - DNA, 25 bp, S. cerevisiae
tacatcattttacaacaccttcggc

SEQ ID NO: 57089 - DNA, 25 bp, S. cerevisiae
taaatttctttaatgatccttccgc

SEQ ID NO: 57090 - DNA, 25 bp, S. cerevisiae
tacgtatttaattcatgacctcccc

SEQ ID NO: 57091 - DNA, 25 bp, S. cerevisiae
tacaatactttttgacacttcccgc

SEQ ID NO: 57092 - DNA, 25 bp, S. cerevisiae
tacttggtaccatttcgcaggcaga

SEQ ID NO: 57093 - DNA, 25 bp, S. cerevisiae
tactttatctccctctgacgaaaga

SEQ ID NO: 57094 - DNA, 25 bp, S. cerevisiae
tacttcaaccaacccagctaaatct

SEQ ID NO: 57095 - DNA, 25 bp, S. cerevisiae
tacttcccattacccagtaatactt

SEQ ID NO: 57096 - DNA, 25 bp, S. cerevisiae
tagcttcccttacggactactggta

SEQ ID NO: 57097 - DNA, 25 bp, S. cerevisiae
tacattaccttctgaacccttggat

SEQ ID NO: 57098 - DNA, 25 bp, S. cerevisiae
tactaaagcccaaaaccctatgcgt

SEQ ID NO: 57099 - DNA, 25 bp, S. cerevisiae
tatttctatcctaaattccccatcg

SEQ ID NO: 57100 - DNA, 25 bp, S. cerevisiae
tactttatccaaccttccggtagat

SEQ ID NO: 57101 - DNA, 25 bp, S. cerevisiae
tacatttaagaaacttccgcctaca

SEQ ID NO: 57102 - DNA, 25 bp, S. cerevisiae
tatatttaggtgctgcttccggtac

SEQ ID NO: 57103 - DNA, 25 bp, S. cerevisiae
taaattcaatataacctcctcgctc

SEQ ID NO: 57104 - DNA, 25 bp, S. cerevisiae
taaatccacaaaaagcactccgtcc

SEQ ID NO: 57105 - DNA, 25 bp, S. cerevisiae
taaattttgccatttccatcctcaa

SEQ ID NO: 57106 - DNA, 25 bp, S. cerevisiae
taaattgggcaactctccatcagac

SEQ ID NO: 57107 - DNA, 25 bp, S. cerevisiae
tacatgagactccattgccggtgat

SEQ ID NO: 57108 - DNA, 25 bp, S. cerevisiae
tacaagatcccagcctggttcttaa

SEQ ID NO: 57109 - DNA, 25 bp, S. cerevisiae
tactagaagttctcctcaaggattt

SEQ ID NO: 57110 - DNA, 25 bp, S. cerevisiae
tacaagttgctttacctgaaggtct

SEQ ID NO: 57111 - DNA, 25 bp, S. cerevisiae
tacttttttcttgagtgccgtgttc

SEQ ID NO: 57112 - DNA, 25 bp, S. cerevisiae
ttggttttccctgattacgataaat

SEQ ID NO: 57113 - DNA, 25 bp, S. cerevisiae
ttggtcactacccttttgaggaaga

SEQ ID NO: 57114 - DNA, 25 bp, S. cerevisiae
taggtcgctaactttattaaagaat

SEQ ID NO: 57115 - DNA, 25 bp, S. cerevisiae
tacagacaggtcttctttgtgaaaa

SEQ ID NO: 57116 - DNA, 25 bp, S. cerevisiae
tacagaagtgtggatcgtgcaggca

SEQ ID NO: 57117 - DNA, 25 bp, S. cerevisiae
tacaaggttggatgtcggcgacctc

SEQ ID NO: 57118 - DNA, 25 bp, S. cerevisiae
tacaatgaaaattcctccggctcca

SEQ ID NO: 57119 - DNA, 25 bp, S. cerevisiae
tacattgacaagattatcccacccc

SEQ ID NO: 57120 - DNA, 25 bp, S. cerevisiae
tagcggtgatggtgaattggtcttc

SEQ ID NO: 57121 - DNA, 25 bp, S. cerevisiae
tacacggcggaaacacggttagacg

SEQ ID NO: 57122 - DNA, 25 bp, S. cerevisiae
tactacgcccaaaacgatgttggac

SEQ ID NO: 57123 - DNA, 25 bp, S. cerevisiae
tactaagcccttagttcttccgaag

SEQ ID NO: 57124 - DNA, 25 bp, S. cerevisiae
tactaaaccatcagattcacccaaa

SEQ ID NO: 57125 - DNA, 25 bp, S. cerevisiae
tactcttccgaatttccctatgaac

SEQ ID NO: 57126 - DNA, 25 bp, S. cerevisiae
tacttttccgaatcagacagtgttt

SEQ ID NO: 57127 - DNA, 25 bp, S. cerevisiae
tagtcttttcgcaaacgaaggcctt

SEQ ID NO: 57128 - DNA, 25 bp, S. cerevisiae
taaattctggcctactgtcgctaga

SEQ ID NO: 57129 - DNA, 25 bp, S. cerevisiae
taaatcaggaggcttcacgtagaga

SEQ ID NO: 57130 - DNA, 25 bp, S. cerevisiae
taccagctgcaagttttagcgggaa

SEQ ID NO: 57131 - DNA, 25 bp, S. cerevisiae
tactggataagtctctggtgcgcga

SEQ ID NO: 57132 - DNA, 25 bp, S. cerevisiae
tacctgatatttctcgtgcggttat

SEQ ID NO: 57133 - DNA, 25 bp, S. cerevisiae
taccattggtaactcttcacttaag

SEQ ID NO: 57134 - DNA, 25 bp, S. cerevisiae
tacaatatttgacgcactccgatgc

SEQ ID NO: 57135 - DNA, 25 bp, S. cerevisiae
tacaaggttgagcatcccttcttcg

SEQ ID NO: 57136 - DNA, 25 bp, S. cerevisiae
tacaagcgcttgtgttcgttgcatt

SEQ ID NO: 57137 - DNA, 25 bp, S. cerevisiae
tacacgtagatgagctatcgatttt

SEQ ID NO: 57138 - DNA, 25 bp, S. cerevisiae
tacacgcatcagaatcgccatcgaa

SEQ ID NO: 57139 - DNA, 25 bp, S. cerevisiae
tacacgctagaacctctcattgaag

SEQ ID NO: 57140 - DNA, 25 bp, S. cerevisiae
tacgtttgcggtaagattggccatt

SEQ ID NO: 57141 - DNA, 25 bp, S. cerevisiae
tactgtggtttataataggctcgca

SEQ ID NO: 57142 - DNA, 25 bp, S. cerevisiae
tacactccaaactccaacagatcga

SEQ ID NO: 57143 - DNA, 25 bp, S. cerevisiae
tacatccctaggaatgtcacccaag

SEQ ID NO: 57144 - DNA, 25 bp, S. cerevisiae
tacagctgttgaactgggacctcag

SEQ ID NO: 57145 - DNA, 25 bp, S. cerevisiae
tacaattggatactacggagctatg

SEQ ID NO: 57146 - DNA, 25 bp, S. cerevisiae
tacacggttcatctaggagccataa

SEQ ID NO: 57147 - DNA, 25 bp, S. cerevisiae
tacatgcggacaaatcgggcacatt

SEQ ID NO: 57148 - DNA, 25 bp, S. cerevisiae
tacgccaacatcttgcgggatatcg

SEQ ID NO: 57149 - DNA, 25 bp, S. cerevisiae
tactttgacgtcagggatgcttcca

SEQ ID NO: 57150 - DNA, 25 bp, S. cerevisiae
tacactgtcagaactttcggtatca

SEQ ID NO: 57151 - DNA, 25 bp, S. cerevisiae
tactattcgaccttcctggatatca

SEQ ID NO: 57152 - DNA, 25 bp, S. cerevisiae
tactcttcggagtctctggtttatt

SEQ ID NO: 57153 - DNA, 25 bp, S. cerevisiae
tacctagtcaccattggttctgatg

SEQ ID NO: 57154 - DNA, 25 bp, S. cerevisiae
tacaccaaaccattatctttgcctc

SEQ ID NO: 57155 - DNA, 25 bp, S. cerevisiae
tacgccaagactattttattctcag

SEQ ID NO: 57156 - DNA, 25 bp, S. cerevisiae
tactactgtgggttgtcgtcgtgta

SEQ ID NO: 57157 - DNA, 25 bp, S. cerevisiae
tactatggtagtactgtcgcttccg

SEQ ID NO: 57158 - DNA, 25 bp, S. cerevisiae
tacttttttggttggcctagactct

SEQ ID NO: 57159 - DNA, 25 bp, S. cerevisiae
tactcgtagatatcgcacactggtt

SEQ ID NO: 57160 - DNA, 25 bp, S. cerevisiae
tacatcctcacaatggcagcactat

SEQ ID NO: 57161 - DNA, 25 bp, S. cerevisiae
tacatcatcacaatcagctgcgcag

SEQ ID NO: 57162 - DNA, 25 bp, S. cerevisiae
tacacatatcattttctgcacaagg

SEQ ID NO: 57163 - DNA, 25 bp, S. cerevisiae
tacatcattccccatatcattcaag

SEQ ID NO: 57164 - DNA, 25 bp, S. cerevisiae
tacagctccactagtcaccaagtat

SEQ ID NO: 57165 - DNA, 25 bp, S. cerevisiae
tagtacccgcaataataatagcgct

SEQ ID NO: 57166 - DNA, 25 bp, S. cerevisiae
tactacatgggctccaattccttat

SEQ ID NO: 57167 - DNA, 25 bp, S. cerevisiae
tagtctggccgctaacatttttcta

SEQ ID NO: 57168 - DNA, 25 bp, S. cerevisiae
tactaccgtctaacattgtcgccaa

SEQ ID NO: 57169 - DNA, 25 bp, S. cerevisiae
tactgaccttcaaccactgtacgaa

SEQ ID NO: 57170 - DNA, 25 bp, S. cerevisiae
tactatgtcagtcaggtattgagaa

SEQ ID NO: 57171 - DNA, 25 bp, S. cerevisiae
tacactgtcaagaaggctttggcta

SEQ ID NO: 57172 - DNA, 25 bp, S. cerevisiae
taccttcaaaggacatcattgccga

SEQ ID NO: 57173 - DNA, 25 bp, S. cerevisiae
tactctgtccaagaaggcagccgat

SEQ ID NO: 57174 - DNA, 25 bp, S. cerevisiae
tacatctcgagaatacttgggccaa

SEQ ID NO: 57175 - DNA, 25 bp, S. cerevisiae
tacattccaggaactcttcgacaac

SEQ ID NO: 57176 - DNA, 25 bp, S. cerevisiae
tacatcaccggatctgcttggaaag

SEQ ID NO: 57177 - DNA, 25 bp, S. cerevisiae
tacaggcccgtttgttttcatatgc

SEQ ID NO: 57178 - DNA, 25 bp, S. cerevisiae
tacaggcggccttattaattactgc

SEQ ID NO: 57179 - DNA, 25 bp, S. cerevisiae
tacagaaggccaacttattcgattg

SEQ ID NO: 57180 - DNA, 25 bp, S. cerevisiae
tacggagcccaacttactagcaatg

SEQ ID NO: 57181 - DNA, 25 bp, S. cerevisiae
tacggttccaagttcgctgacgaaa

SEQ ID NO: 57182 - DNA, 25 bp, S. cerevisiae
taccgttcaaagttcatcatgggat

SEQ ID NO: 57183 - DNA, 25 bp, S. cerevisiae
tactcagttcaagatccaattgcga

SEQ ID NO: 57184 - DNA, 25 bp, S. cerevisiae
tactcagtgatcgtttccatttggg

SEQ ID NO: 57185 - DNA, 25 bp, S. cerevisiae
tactctgttcgtgatgtttctgcat

SEQ ID NO: 57186 - DNA, 25 bp, S. cerevisiae
tactttggcgattggctgatttcat

SEQ ID NO: 57187 - DNA, 25 bp, S. cerevisiae
tactacatgtgtcaacgcagctctc

SEQ ID NO: 57188 - DNA, 25 bp, S. cerevisiae
tactaggtgctgattcacgtaccac

SEQ ID NO: 57189 - DNA, 25 bp, S. cerevisiae
tactagtgtggcttcttctaacgaa

SEQ ID NO: 57190 - DNA, 25 bp, S. cerevisiae
tacaacggtctctttgccattgaag

SEQ ID NO: 57191 - DNA, 25 bp, S. cerevisiae
tacaccgggtttccctctgaataat

SEQ ID NO: 57192 - DNA, 25 bp, S. cerevisiae
tacacccctgttgccgttgtaatgt

SEQ ID NO: 57193 - DNA, 25 bp, S. cerevisiae
tacacgccagttatcccaattaatg

SEQ ID NO: 57194 - DNA, 25 bp, S. cerevisiae
tacaaaactctcattctctcatttc

SEQ ID NO: 57195 - DNA, 25 bp, S. cerevisiae
tagataaatccggtcctctgtataa

SEQ ID NO: 57196 - DNA, 25 bp, S. cerevisiae
tagtcaaatcgtctcctctgtttag

SEQ ID NO: 57197 - DNA, 25 bp, S. cerevisiae
tacaaactctggtaggaactcctgg

SEQ ID NO: 57198 - DNA, 25 bp, S. cerevisiae
tacacgacctgatggtaacacctca

SEQ ID NO: 57199 - DNA, 25 bp, S. cerevisiae
tacaggaatctgttttcgaccatat

SEQ ID NO: 57200 - DNA, 25 bp, S. cerevisiae
tacacgcaattgttttggcgccaat

SEQ ID NO: 57201 - DNA, 25 bp, S. cerevisiae
tacaagctacactttttcccaatgc

SEQ ID NO: 57202 - DNA, 25 bp, S. cerevisiae
tacagcaccgaatacctcttagata

SEQ ID NO: 57203 - DNA, 25 bp, S. cerevisiae
tacaacgccttacctatctcaagaa

SEQ ID NO: 57204 - DNA, 25 bp, S. cerevisiae
tacaaagctattaacttcgacgaag

SEQ ID NO: 57205 - DNA, 25 bp, S. cerevisiae
tacagcaactattaactccgggaag

SEQ ID NO: 57206 - DNA, 25 bp, S. cerevisiae
tagcacgaataatgagcctttgttt

SEQ ID NO: 57207 - DNA, 25 bp, S. cerevisiae
tagcaatgcaagaacgtcctctaat

SEQ ID NO: 57208 - DNA, 25 bp, S. cerevisiae
tacaacatcactgcttcgaacgcaa

SEQ ID NO: 57209 - DNA, 25 bp, S. cerevisiae
tacattgctcctgatcctaacaaca

SEQ ID NO: 57210 - DNA, 25 bp, S. cerevisiae
tacaactctgttgccgaagctaaga

SEQ ID NO: 57211 - DNA, 25 bp, S. cerevisiae
tacaagctctttgcccaacgataga

SEQ ID NO: 57212 - DNA, 25 bp, S. cerevisiae
tacacagttattgcccagattgaat

SEQ ID NO: 57213 - DNA, 25 bp, S. cerevisiae
tacacaattcttacgcggatctaat

SEQ ID NO: 57214 - DNA, 25 bp, S. cerevisiae
tacacagtctccttcggtatcagaa

SEQ ID NO: 57215 - DNA, 25 bp, S. cerevisiae
tacacgttctacctcttcagaagat

SEQ ID NO: 57216 - DNA, 25 bp, S. cerevisiae
tacggctgtagggtcattcaaagat

SEQ ID NO: 57217 - DNA, 25 bp, S. cerevisiae
tacaggtcgaccttttagacatgaa

SEQ ID NO: 57218 - DNA, 25 bp, S. cerevisiae
tacattgtcgcccaattaagaggaa

SEQ ID NO: 57219 - DNA, 25 bp, S. cerevisiae
tactggtacatacacccgaaagagt

SEQ ID NO: 57220 - DNA, 25 bp, S. cerevisiae
tacgttctagccgaccctgtgaagg

SEQ ID NO: 57221 - DNA, 25 bp, S. cerevisiae
tacatcttagatcctcacacagctg

SEQ ID NO: 57222 - DNA, 25 bp, S. cerevisiae
tacattgtgatgtccgcactgtctg

SEQ ID NO: 57223 - DNA, 25 bp, S. cerevisiae
tacacacatttcacatcacctatta

SEQ ID NO: 57224 - DNA, 25 bp, S. cerevisiae
tacagaatggtcacagcgttacttg

SEQ ID NO: 57225 - DNA, 25 bp, S. cerevisiae
tataattcctacacggagcctgaag

SEQ ID NO: 57226 - DNA, 25 bp, S. cerevisiae
tacattctccaaaccagcagacgtg

SEQ ID NO: 57227 - DNA, 25 bp, S. cerevisiae
tacagtcgtggtttcctgttcagaa

SEQ ID NO: 57228 - DNA, 25 bp, S. cerevisiae
tacagccgggattgtccgagattaa

SEQ ID NO: 57229 - DNA, 25 bp, S. cerevisiae
tacagactgtggttgtcatcggtat

SEQ ID NO: 57230 - DNA, 25 bp, S. cerevisiae
tactacttgggttgattggcatgat

SEQ ID NO: 57231 - DNA, 25 bp, S. cerevisiae
tacaacatgagccaccattgcctat

SEQ ID NO: 57232 - DNA, 25 bp, S. cerevisiae
tacattgtcaaaccctggcattgtt

SEQ ID NO: 57233 - DNA, 25 bp, S. cerevisiae
tacatcttgatgaacaccgccgtgt

SEQ ID NO: 57234 - DNA, 25 bp, S. cerevisiae
tacactgctgtcaaacagaccgtat

SEQ ID NO: 57235 - DNA, 25 bp, S. cerevisiae
tacacccagcaggtttactgatttt

SEQ ID NO: 57236 - DNA, 25 bp, S. cerevisiae
tacacccgaggctatttctgttttc

SEQ ID NO: 57237 - DNA, 25 bp, S. cerevisiae
taccatcctggacgaagactttttg

SEQ ID NO: 57238 - DNA, 25 bp, S. cerevisiae
tactcccgggagatactcttatcga

SEQ ID NO: 57239 - DNA, 25 bp, S. cerevisiae
tagtcaccggtgatgaactcctttt

SEQ ID NO: 57240 - DNA, 25 bp, S. cerevisiae
tactgtggtcactggtcgtgtggaa

SEQ ID NO: 57241 - DNA, 25 bp, S. cerevisiae
tactgtcgtaggcactccggaatac

SEQ ID NO: 57242 - DNA, 25 bp, S. cerevisiae
tactaaatacgcaccccgataaact

SEQ ID NO: 57243 - DNA, 25 bp, S. cerevisiae
tactagcaatgaaacctcgccgaaa

SEQ ID NO: 57244 - DNA, 25 bp, S. cerevisiae
tactaccggaacctctactgaagct

SEQ ID NO: 57245 - DNA, 25 bp, S. cerevisiae
tacgttgttctagcttttgtcccat

SEQ ID NO: 57246 - DNA, 25 bp, S. cerevisiae
tacacagactccaaactttttccac

SEQ ID NO: 57247 - DNA, 25 bp, S. cerevisiae
tacacaatctctaatactttccctc

SEQ ID NO: 57248 - DNA, 25 bp, S. cerevisiae
tacgattgcgtctcttgcataccaa

SEQ ID NO: 57249 - DNA, 25 bp, S. cerevisiae
tacagtggtgtagtgcccttgacaa

SEQ ID NO: 57250 - DNA, 25 bp, S. cerevisiae
tacatcggtgtatttcgctctggag

SEQ ID NO: 57251 - DNA, 25 bp, S. cerevisiae
tactccttgtatctaatattctgac

SEQ ID NO: 57252 - DNA, 25 bp, S. cerevisiae
tacaccatttacgtcaaggcctcat

SEQ ID NO: 57253 - DNA, 25 bp, S. cerevisiae
tacttatttagctatttccccacaa

SEQ ID NO: 57254 - DNA, 25 bp, S. cerevisiae
tactttgtatgagttctatcccgaa

SEQ ID NO: 57255 - DNA, 25 bp, S. cerevisiae
tacacgctcgatttctgtttaccaa

SEQ ID NO: 57256 - DNA, 25 bp, S. cerevisiae
tacacttcaaaatttctgctcaatg

SEQ ID NO: 57257 - DNA, 25 bp, S. cerevisiae
tacttaacaatgacaacccctacac

SEQ ID NO: 57258 - DNA, 25 bp, S. cerevisiae
tacaccaaatttggcccattttcat

SEQ ID NO: 57259 - DNA, 25 bp, S. cerevisiae
tacactgctattatcggccttgttt

SEQ ID NO: 57260 - DNA, 25 bp, S. cerevisiae
tacatcatctttatcgccgttattt

SEQ ID NO: 57261 - DNA, 25 bp, S. cerevisiae
tacaccatttactttgcgctatcat

SEQ ID NO: 57262 - DNA, 25 bp, S. cerevisiae
tacacctttccagttgtcatccgaa

SEQ ID NO: 57263 - DNA, 25 bp, S. cerevisiae
tacaccttggtttttgccattctag

SEQ ID NO: 57264 - DNA, 25 bp, S. cerevisiae
tactgccccaactacgttaacaatt

SEQ ID NO: 57265 - DNA, 25 bp, S. cerevisiae
tactgtgcccaagaagaataccgaa

SEQ ID NO: 57266 - DNA, 25 bp, S. cerevisiae
tacatgttccaagccgcacacccaa

SEQ ID NO: 57267 - DNA, 25 bp, S. cerevisiae
tacattaaattctgcgagagccgct

SEQ ID NO: 57268 - DNA, 25 bp, S. cerevisiae
tacagtaaactccatcgtacccata

SEQ ID NO: 57269 - DNA, 25 bp, S. cerevisiae
tacagttatgactgccgtctcggca

SEQ ID NO: 57270 - DNA, 25 bp, S. cerevisiae
tacggtcgtattgcgccaaggtcag

SEQ ID NO: 57271 - DNA, 25 bp, S. cerevisiae
tactgatttgtttgccgattacgtc

SEQ ID NO: 57272 - DNA, 25 bp, S. cerevisiae
tacagttcatatcagcatacctcct

SEQ ID NO: 57273 - DNA, 25 bp, S. cerevisiae
tacagacgatactacattccgccat

SEQ ID NO: 57274 - DNA, 25 bp, S. cerevisiae
tacaggcgctactacaatctccaga

SEQ ID NO: 57275 - DNA, 25 bp, S. cerevisiae
tacagtggttcgaagactctggaaa

SEQ ID NO: 57276 - DNA, 25 bp, S. cerevisiae
tacaggcctaagatactcgttacaa

SEQ ID NO: 57277 - DNA, 25 bp, S. cerevisiae
tacaggccattgaggaccgtatcaa

SEQ ID NO: 57278 - DNA, 25 bp, S. cerevisiae
tacacccattgtcagtacgtatgct

SEQ ID NO: 57279 - DNA, 25 bp, S. cerevisiae
tacagccttctttatttgctattga

SEQ ID NO: 57280 - DNA, 25 bp, S. cerevisiae
tacttcccaggtggttccattgcaa

SEQ ID NO: 57281 - DNA, 25 bp, S. cerevisiae
tacatgtacgatgcttgttccacca

SEQ ID NO: 57282 - DNA, 25 bp, S. cerevisiae
tacgtacatgactttttcgccagag

SEQ ID NO: 57283 - DNA, 25 bp, S. cerevisiae
tacagatacgtctctgtttccgttt

SEQ ID NO: 57284 - DNA, 25 bp, S. cerevisiae
tacagttctgtctctgcatcttcat

SEQ ID NO: 57285 - DNA, 25 bp, S. cerevisiae
tacatcaggtgtcgcaaaagtcatc

SEQ ID NO: 57286 - DNA, 25 bp, S. cerevisiae
taccaggtgccgaggactgtcaatt

SEQ ID NO: 57287 - DNA, 25 bp, S. cerevisiae
tacggagtatccatcggacgtgcca

SEQ ID NO: 57288 - DNA, 25 bp, S. cerevisiae
tactaggtatctcactcaacgctgt

SEQ ID NO: 57289 - DNA, 25 bp, S. cerevisiae
tactcagagattcaaccacaggcaa

SEQ ID NO: 57290 - DNA, 25 bp, S. cerevisiae
tacagctttgcatacgccaactcaa

SEQ ID NO: 57291 - DNA, 25 bp, S. cerevisiae
tacatcatttcaggcaaggactcga

SEQ ID NO: 57292 - DNA, 25 bp, S. cerevisiae
tactctttagcagatcgtctcagca

SEQ ID NO: 57293 - DNA, 25 bp, S. cerevisiae
tacattttacacacatctcacgcag

SEQ ID NO: 57294 - DNA, 25 bp, S. cerevisiae
tactatacactcatacatccgctca

SEQ ID NO: 57295 - DNA, 25 bp, S. cerevisiae
tactacgaatccaaatcctccagtt

SEQ ID NO: 57296 - DNA, 25 bp, S. cerevisiae
tactatcgagatttaaccactggtt

SEQ ID NO: 57297 - DNA, 25 bp, S. cerevisiae
tactagggtttttccctggtctgat

SEQ ID NO: 57298 - DNA, 25 bp, S. cerevisiae
tactagttgttaactccgcctggag

SEQ ID NO: 57299 - DNA, 25 bp, S. cerevisiae
tacatcgttgttggaatcctcgcgc

SEQ ID NO: 57300 - DNA, 25 bp, S. cerevisiae
tacttgggtcttcctgctttcaagc

SEQ ID NO: 57301 - DNA, 25 bp, S. cerevisiae
taccgggtcccagcgtgttcgagaa

SEQ ID NO: 57302 - DNA, 25 bp, S. cerevisiae
taccgggacgaaactcttcctgaag

SEQ ID NO: 57303 - DNA, 25 bp, S. cerevisiae
taccgtggatgataggtctcccgaa

SEQ ID NO: 57304 - DNA, 25 bp, S. cerevisiae
tactgtctgtcgctggtaaccttag

SEQ ID NO: 57305 - DNA, 25 bp, S. cerevisiae
tacattgccatctcatgttcagaac

SEQ ID NO: 57306 - DNA, 25 bp, S. cerevisiae
tacattatcaatccttgcgtttcag

SEQ ID NO: 57307 - DNA, 25 bp, S. cerevisiae
tactgaatctcctggtgaatatttc

SEQ ID NO: 57308 - DNA, 25 bp, S. cerevisiae
tacatttctgtcaaggtgtgccaat

SEQ ID NO: 57309 - DNA, 25 bp, S. cerevisiae
tacttatatgacaaaggctgccaaa

SEQ ID NO: 57310 - DNA, 25 bp, S. cerevisiae
tacttcattcgatcaagatgtggac

SEQ ID NO: 57311 - DNA, 25 bp, S. cerevisiae
tacgatgctgatgcaatagatcatg

SEQ ID NO: 57312 - DNA, 25 bp, S. cerevisiae
tacagactatcctatttgcagcttt

SEQ ID NO: 57313 - DNA, 25 bp, S. cerevisiae
tacggtgccacggtgtcaattgact

SEQ ID NO: 57314 - DNA, 25 bp, S. cerevisiae
tactgcagtgaaggcgctaaacgaa

SEQ ID NO: 57315 - DNA, 25 bp, S. cerevisiae
tactgcactcataggaatagatact

SEQ ID NO: 57316 - DNA, 25 bp, S. cerevisiae
tacagttatgggatacagcaggtca

SEQ ID NO: 57317 - DNA, 25 bp, S. cerevisiae
tacttctagagggtattggacgcca

SEQ ID NO: 57318 - DNA, 25 bp, S. cerevisiae
tacttctgcgggtattatggaccat

SEQ ID NO: 57319 - DNA, 25 bp, S. cerevisiae
tacagtatgcggtgattaagcccat

SEQ ID NO: 57320 - DNA, 25 bp, S. cerevisiae
tacgcagagcatgttggtaaaccat

SEQ ID NO: 57321 - DNA, 25 bp, S. cerevisiae
tacagagagcactttttagacagtt

SEQ ID NO: 57322 - DNA, 25 bp, S. cerevisiae
tatccactggcgctaggctagaagg

SEQ ID NO: 57323 - DNA, 25 bp, S. cerevisiae
tactccgatgattatttgcgcgatg

SEQ ID NO: 57324 - DNA, 25 bp, S. cerevisiae
tacaggagctgtcattctggctgct

SEQ ID NO: 57325 - DNA, 25 bp, S. cerevisiae
tacagggccgacttcttgattattt

SEQ ID NO: 57326 - DNA, 25 bp, S. cerevisiae
tacgctggccttcatgacgaattgt

SEQ ID NO: 57327 - DNA, 25 bp, S. cerevisiae
tactgtgacccaaatactgcctatt

SEQ ID NO: 57328 - DNA, 25 bp, S. cerevisiae
tactaaaaccactgctgctgctgtt

SEQ ID NO: 57329 - DNA, 25 bp, S. cerevisiae
tactgctcagaacccacgaatgatg

SEQ ID NO: 57330 - DNA, 25 bp, S. cerevisiae
tagctgctgcagtatccaagaatga

SEQ ID NO: 57331 - DNA, 25 bp, S. cerevisiae
tactccgcgatactatgcctaaact

SEQ ID NO: 57332 - DNA, 25 bp, S. cerevisiae
tactgccgcgacatatctctgagag

SEQ ID NO: 57333 - DNA, 25 bp, S. cerevisiae
tactgccgtattctctctgatatag

SEQ ID NO: 57334 - DNA, 25 bp, S. cerevisiae
tactgccactgttactcaatgtgat

SEQ ID NO: 57335 - DNA, 25 bp, S. cerevisiae
tacagtctcatttgacctcatcatt

SEQ ID NO: 57336 - DNA, 25 bp, S. cerevisiae
tacagtgtgttgcatctcacccaga

SEQ ID NO: 57337 - DNA, 25 bp, S. cerevisiae
tacagtgtttttgccctcatggtaa

SEQ ID NO: 57338 - DNA, 25 bp, S. cerevisiae
tacagtgaaccgttcccttggtatg

SEQ ID NO: 57339 - DNA, 25 bp, S. cerevisiae
taggtggtttagctactggtgcctt

SEQ ID NO: 57340 - DNA, 25 bp, S. cerevisiae
tacctgttggtacctacggtcgtat

SEQ ID NO: 57341 - DNA, 25 bp, S. cerevisiae
taccgtttagaagagggcctgccat

SEQ ID NO: 57342 - DNA, 25 bp, S. cerevisiae
tacctggtttgataagttcgatgcc

SEQ ID NO: 57343 - DNA, 25 bp, S. cerevisiae
taccgcagttggtttagtatcgcca

SEQ ID NO: 57344 - DNA, 25 bp, S. cerevisiae
tactttgttctttggatggctcgtc

SEQ ID NO: 57345 - DNA, 25 bp, S. cerevisiae
tactggtcactcatctttcgttatg

SEQ ID NO: 57346 - DNA, 25 bp, S. cerevisiae
tacatgcgtacctattttcgacctt

SEQ ID NO: 57347 - DNA, 25 bp, S. cerevisiae
tactagctcattgtatacctgccaa

SEQ ID NO: 57348 - DNA, 25 bp, S. cerevisiae
tacttgagaaattcgcatctgcccg

SEQ ID NO: 57349 - DNA, 25 bp, S. cerevisiae
tacttggacccattagcccgtgtat

SEQ ID NO: 57350 - DNA, 25 bp, S. cerevisiae
tacttggcctacgaacacgttttgg

SEQ ID NO: 57351 - DNA, 25 bp, S. cerevisiae
tacgttacttgaacggcgcagctcc

SEQ ID NO: 57352 - DNA, 25 bp, S. cerevisiae
tacttgtttaggtctggcagccaaa

SEQ ID NO: 57353 - DNA, 25 bp, S. cerevisiae
tacttggtggactgtgtctccaaca

SEQ ID NO: 57354 - DNA, 25 bp, S. cerevisiae
tacgggccagagttattcttcaaga

SEQ ID NO: 57355 - DNA, 25 bp, S. cerevisiae
tacttctccgatgtacaccataaca

SEQ ID NO: 57356 - DNA, 25 bp, S. cerevisiae
tacgtcaccaagttacagcccaacg

SEQ ID NO: 57357 - DNA, 25 bp, S. cerevisiae
tacggcccaattactagcatacttg

SEQ ID NO: 57358 - DNA, 25 bp, S. cerevisiae
tattttagtcataccccaacattcc

SEQ ID NO: 57359 - DNA, 25 bp, S. cerevisiae
tacgcttctttcaacgatactttcg

SEQ ID NO: 57360 - DNA, 25 bp, S. cerevisiae
tactcacatcgccatcgttggtaaa

SEQ ID NO: 57361 - DNA, 25 bp, S. cerevisiae
tactcgcactctttggctcatgaat

SEQ ID NO: 57362 - DNA, 25 bp, S. cerevisiae
tactctactcctctactgattggaa

SEQ ID NO: 57363 - DNA, 25 bp, S. cerevisiae
tactctttccaagctgctcacccaa

SEQ ID NO: 57364 - DNA, 25 bp, S. cerevisiae
tactctttccaagtcgctcatccaa

SEQ ID NO: 57365 - DNA, 25 bp, S. cerevisiae
tacttgtttcaagcagctcatccaa

SEQ ID NO: 57366 - DNA, 25 bp, S. cerevisiae
tacggtcgggaccatgcttaacact

SEQ ID NO: 57367 - DNA, 25 bp, S. cerevisiae
tagcagcgtcggaaacagcaacaac

SEQ ID NO: 57368 - DNA, 25 bp, S. cerevisiae
taccggtggtactagaaccaagact

SEQ ID NO: 57369 - DNA, 25 bp, S. cerevisiae
tacgggcgttcctgagtccatagac

SEQ ID NO: 57370 - DNA, 25 bp, S. cerevisiae
ttcgggccttcgttggatttacaag

SEQ ID NO: 57371 - DNA, 25 bp, S. cerevisiae
taccagcagcgggaaggtttcgtac

SEQ ID NO: 57372 - DNA, 25 bp, S. cerevisiae
taccacgggtaaaaattttgcatcg

SEQ ID NO: 57373 - DNA, 25 bp, S. cerevisiae
tacgacggtgctctggactgtttga

SEQ ID NO: 57374 - DNA, 25 bp, S. cerevisiae
tactatatgcgttcttctttgcctt

SEQ ID NO: 57375 - DNA, 25 bp, S. cerevisiae
tacattatgcgctgtgattcctgtc

SEQ ID NO: 57376 - DNA, 25 bp, S. cerevisiae
tactctatatgctgtgcgtgccaac

SEQ ID NO: 57377 - DNA, 25 bp, S. cerevisiae
tacttatagcatagcgcctggtgaa

SEQ ID NO: 57378 - DNA, 25 bp, S. cerevisiae
tacattataaacctgatgcggagac

SEQ ID NO: 57379 - DNA, 25 bp, S. cerevisiae
tacattgccaattctctacctgagt

SEQ ID NO: 57380 - DNA, 25 bp, S. cerevisiae
tacggacgagtgtcgagccctcatc

SEQ ID NO: 57381 - DNA, 25 bp, S. cerevisiae
tactggaggatgtcacgcggcactt

SEQ ID NO: 57382 - DNA, 25 bp, S. cerevisiae
taccgtggaaacaggccattgctct

SEQ ID NO: 57383 - DNA, 25 bp, S. cerevisiae
taccggtactaaggtcaatggcagt

SEQ ID NO: 57384 - DNA, 25 bp, S. cerevisiae
tacgggttctacgaggaatgcctga

SEQ ID NO: 57385 - DNA, 25 bp, S. cerevisiae
tactgtcgtcctggttggtatgcca

SEQ ID NO: 57386 - DNA, 25 bp, S. cerevisiae
tactatcgtctggtgttggtgttac

SEQ ID NO: 57387 - DNA, 25 bp, S. cerevisiae
tactccttactacttttattgcgaa

SEQ ID NO: 57388 - DNA, 25 bp, S. cerevisiae
tactcccaagctttcctgtaatagc

SEQ ID NO: 57389 - DNA, 25 bp, S. cerevisiae
tacgtttatcgctactgctgcagtg

SEQ ID NO: 57390 - DNA, 25 bp, S. cerevisiae
tacggtttactactgtcacattatt

SEQ ID NO: 57391 - DNA, 25 bp, S. cerevisiae
tacggtggctcattcatgccatact

SEQ ID NO: 57392 - DNA, 25 bp, S. cerevisiae
tacgtagtgatgatatatgcgccaa

SEQ ID NO: 57393 - DNA, 25 bp, S. cerevisiae
tacattagctagttcattgaccatt

SEQ ID NO: 57394 - DNA, 25 bp, S. cerevisiae
tactttggattcagtcattgccccg

SEQ ID NO: 57395 - DNA, 25 bp, S. cerevisiae
tacgtacacttctaccttttgctat

SEQ ID NO: 57396 - DNA, 25 bp, S. cerevisiae
tacctctttacttatgtcgtttgga

SEQ ID NO: 57397 - DNA, 25 bp, S. cerevisiae
tatcgaagccaattgctcctttcac

SEQ ID NO: 57398 - DNA, 25 bp, S. cerevisiae
tactgaccctcatctggctcatcta

SEQ ID NO: 57399 - DNA, 25 bp, S. cerevisiae
tactcactcaattatctggctccaa

SEQ ID NO: 57400 - DNA, 25 bp, S. cerevisiae
tactgcagttgcctattggtgccat

SEQ ID NO: 57401 - DNA, 25 bp, S. cerevisiae
tactgcgaagcgactctttggatga

SEQ ID NO: 57402 - DNA, 25 bp, S. cerevisiae
tactcgcaggcgttctcatatggaa

SEQ ID NO: 57403 - DNA, 25 bp, S. cerevisiae
tactgaaccaggtcttgcgcaggat

SEQ ID NO: 57404 - DNA, 25 bp, S. cerevisiae
tacttattctgttttgccactacct

SEQ ID NO: 57405 - DNA, 25 bp, S. cerevisiae
tacgttccgggaagtgcttgcaaac

SEQ ID NO: 57406 - DNA, 25 bp, S. cerevisiae
tacgaaccccgaagtgctacagatg

SEQ ID NO: 57407 - DNA, 25 bp, S. cerevisiae
tactcaaaatgaggcagttgctact

SEQ ID NO: 57408 - DNA, 25 bp, S. cerevisiae
tactcaaaatgctagcgtgcgcgcc

SEQ ID NO: 57409 - DNA, 25 bp, S. cerevisiae
tactactattgccagcattgctgct

SEQ ID NO: 57410 - DNA, 25 bp, S. cerevisiae
tactgacccgtctgtcatggaacga

SEQ ID NO: 57411 - DNA, 25 bp, S. cerevisiae
tactgaatcctgcattgtcattgaa

SEQ ID NO: 57412 - DNA, 25 bp, S. cerevisiae
tactggtggctgcttcatgcatggc

SEQ ID NO: 57413 - DNA, 25 bp, S. cerevisiae
tagtccccgtttgctgttcagaaaa

SEQ ID NO: 57414 - DNA, 25 bp, S. cerevisiae
tagtacccggtagcccttcagataa

SEQ ID NO: 57415 - DNA, 25 bp, S. cerevisiae
tactgtcgttgttaccttctttgaa

SEQ ID NO: 57416 - DNA, 25 bp, S. cerevisiae
tacgtctttattttcttctaggtca

SEQ ID NO: 57417 - DNA, 25 bp, S. cerevisiae
tactcacctttactactcgtcaaga

SEQ ID NO: 57418 - DNA, 25 bp, S. cerevisiae
tactgtcgagggttctaccactatt

SEQ ID NO: 57419 - DNA, 25 bp, S. cerevisiae
tacgctacagaatcgggctcatgga

SEQ ID NO: 57420 - DNA, 25 bp, S. cerevisiae
taccagaagacacttggctcacgcg

SEQ ID NO: 57421 - DNA, 25 bp, S. cerevisiae
tagctgggccacttacgacgacgag

SEQ ID NO: 57422 - DNA, 25 bp, S. cerevisiae
tagcgggtcctttgcatgggttagc

SEQ ID NO: 57423 - DNA, 25 bp, S. cerevisiae
tacgggtccatcacagaattttgct

SEQ ID NO: 57424 - DNA, 25 bp, S. cerevisiae
tagcggtttactgaatgccctggat

SEQ ID NO: 57425 - DNA, 25 bp, S. cerevisiae
tacgggttactttgagcacacggct

SEQ ID NO: 57426 - DNA, 25 bp, S. cerevisiae
tacggaggttcattagaccctggtt

SEQ ID NO: 57427 - DNA, 25 bp, S. cerevisiae
tacgactgtgtatttggatcacccc

SEQ ID NO: 57428 - DNA, 25 bp, S. cerevisiae
tacgttgcttctttggtatctgcca

SEQ ID NO: 57429 - DNA, 25 bp, S. cerevisiae
tactgttgctagaacgtctgacttg

SEQ ID NO: 57430 - DNA, 25 bp, S. cerevisiae
taccgagaccttcccataaaagaca

SEQ ID NO: 57431 - DNA, 25 bp, S. cerevisiae
tactagaagacgacaccaagataaa

SEQ ID NO: 57432 - DNA, 25 bp, S. cerevisiae
tactgaaaagcttcccagagggaga

SEQ ID NO: 57433 - DNA, 25 bp, S. cerevisiae
tactaaaacttgtctcatcggctgg

SEQ ID NO: 57434 - DNA, 25 bp, S. cerevisiae
tactaaagctcttgtttccggtgaa

SEQ ID NO: 57435 - DNA, 25 bp, S. cerevisiae
tactgctatatctttcttcaccgaa

SEQ ID NO: 57436 - DNA, 25 bp, S. cerevisiae
tacttatacatgtacctcacccgga

SEQ ID NO: 57437 - DNA, 25 bp, S. cerevisiae
tagtaatatcggtcctcaaccgcag

SEQ ID NO: 57438 - DNA, 25 bp, S. cerevisiae
tacttaccagctcatttaatcgcgt

SEQ ID NO: 57439 - DNA, 25 bp, S. cerevisiae
taggtaccctcacttgaaacctgtg

SEQ ID NO: 57440 - DNA, 25 bp, S. cerevisiae
tagggcactacaactaaaaccttct

SEQ ID NO: 57441 - DNA, 25 bp, S. cerevisiae
tagagtccgatagcgacgaacccct

SEQ ID NO: 57442 - DNA, 25 bp, S. cerevisiae
taggagacgttacattgggccccat

SEQ ID NO: 57443 - DNA, 25 bp, S. cerevisiae
tagttacagtgttttcggctcccaa

SEQ ID NO: 57444 - DNA, 25 bp, S. cerevisiae
tacgggctgttatcactatcgagac

SEQ ID NO: 57445 - DNA, 25 bp, S. cerevisiae
tagccaacctgaagtctttgactct

SEQ ID NO: 57446 - DNA, 25 bp, S. cerevisiae
tactactggctggtgtcctttggca

SEQ ID NO: 57447 - DNA, 25 bp, S. cerevisiae
tactactgggttgtcttctagcaaa

SEQ ID NO: 57448 - DNA, 25 bp, S. cerevisiae
tactacccgtccgtatatctatgag

SEQ ID NO: 57449 - DNA, 25 bp, S. cerevisiae
tactacgccattcccttaatgaggg

SEQ ID NO: 57450 - DNA, 25 bp, S. cerevisiae
tactccctcccgaatgtgcatatag

SEQ ID NO: 57451 - DNA, 25 bp, S. cerevisiae
tacgtgcctgcctcgcaaaagaaag

SEQ ID NO: 57452 - DNA, 25 bp, S. cerevisiae
tacgcttatatcactgacggcgcgg

SEQ ID NO: 57453 - DNA, 25 bp, S. cerevisiae
tatgttgattaagcagacgggcctg

SEQ ID NO: 57454 - DNA, 25 bp, S. cerevisiae
tagattgttaattgacccacctttt

SEQ ID NO: 57455 - DNA, 25 bp, S. cerevisiae
tagccattattaacagacccgtctc

SEQ ID NO: 57456 - DNA, 25 bp, S. cerevisiae
tactgttgttttgaccattatcggc

SEQ ID NO: 57457 - DNA, 25 bp, S. cerevisiae
tacgttggtattgccaatggtctgt

SEQ ID NO: 57458 - DNA, 25 bp, S. cerevisiae
tacggtggctactccagaggcggat

SEQ ID NO: 57459 - DNA, 25 bp, S. cerevisiae
tacggtggctattccagaggtggct

SEQ ID NO: 57460 - DNA, 25 bp, S. cerevisiae
taccgcttgtgcatctcaagggtat

SEQ ID NO: 57461 - DNA, 25 bp, S. cerevisiae
tacgtcagttctcacagttgcatac

SEQ ID NO: 57462 - DNA, 25 bp, S. cerevisiae
tactgtccactctaaatctagaact

SEQ ID NO: 57463 - DNA, 25 bp, S. cerevisiae
tacgttcaccttttctggcatactt

SEQ ID NO: 57464 - DNA, 25 bp, S. cerevisiae
tactgttctcatatctactggctat

SEQ ID NO: 57465 - DNA, 25 bp, S. cerevisiae
tactcttccacttctgatgcatttt

SEQ ID NO: 57466 - DNA, 25 bp, S. cerevisiae
tactcaccaaactgcaccaaggact

SEQ ID NO: 57467 - DNA, 25 bp, S. cerevisiae
tactacgaagctgccgccaaggaag

SEQ ID NO: 57468 - DNA, 25 bp, S. cerevisiae
tactctcatttatcatagcgcttca

SEQ ID NO: 57469 - DNA, 25 bp, S. cerevisiae
taccaggctgccagtaaacctaaga

SEQ ID NO: 57470 - DNA, 25 bp, S. cerevisiae
tacggttcctgtatttcgttctaga

SEQ ID NO: 57471 - DNA, 25 bp, S. cerevisiae
taccctgttacgagtgagttttcaa

SEQ ID NO: 57472 - DNA, 25 bp, S. cerevisiae
tactccaggagggttctgcggctaa

SEQ ID NO: 57473 - DNA, 25 bp, S. cerevisiae
taccggagacggattcgacgaattt

SEQ ID NO: 57474 - DNA, 25 bp, S. cerevisiae
taccgatgatggctggttccgtacc

SEQ ID NO: 57475 - DNA, 25 bp, S. cerevisiae
tactcctcttaccttacttaagctg

SEQ ID NO: 57476 - DNA, 25 bp, S. cerevisiae
taccaggtcttagcagtacttccac

SEQ ID NO: 57477 - DNA, 25 bp, S. cerevisiae
tactaaatttctctctcatctgttg

SEQ ID NO: 57478 - DNA, 25 bp, S. cerevisiae
tacgccttttatggccaggaaactg

SEQ ID NO: 57479 - DNA, 25 bp, S. cerevisiae
tacctgattattgctccttacgttc

SEQ ID NO: 57480 - DNA, 25 bp, S. cerevisiae
taccgatttcatgtcttggatgcag

SEQ ID NO: 57481 - DNA, 25 bp, S. cerevisiae
tactccatttcactctcacataaaa

SEQ ID NO: 57482 - DNA, 25 bp, S. cerevisiae
taccacctctagtctcaaaaccaaa

SEQ ID NO: 57483 - DNA, 25 bp, S. cerevisiae
taccaccttggcgacaataatccta

SEQ ID NO: 57484 - DNA, 25 bp, S. cerevisiae
tactcttttggcgaaaccactcttc

SEQ ID NO: 57485 - DNA, 25 bp, S. cerevisiae
tacccttatatatttcaccgccagt

SEQ ID NO: 57486 - DNA, 25 bp, S. cerevisiae
tacgcagctgggttcagtttctatc

SEQ ID NO: 57487 - DNA, 25 bp, S. cerevisiae
tacgcgtatgtattgagttctctga

SEQ ID NO: 57488 - DNA, 25 bp, S. cerevisiae
tatcgcggagataagacccttgccc

SEQ ID NO: 57489 - DNA, 25 bp, S. cerevisiae
tacgcagaacatttaaaggccacat

SEQ ID NO: 57490 - DNA, 25 bp, S. cerevisiae
tacgaacgatattaagcttgcccta

SEQ ID NO: 57491 - DNA, 25 bp, S. cerevisiae
tactgctactattgggccccataaa

SEQ ID NO: 57492 - DNA, 25 bp, S. cerevisiae
tactgctattaagcgccactttaac

SEQ ID NO: 57493 - DNA, 25 bp, S. cerevisiae
tagcctttaattcccgttatctacg

SEQ ID NO: 57494 - DNA, 25 bp, S. cerevisiae
tactgcttctaaatcccctatcatt

SEQ ID NO: 57495 - DNA, 25 bp, S. cerevisiae
tactgccattgttactttcggtgaa

SEQ ID NO: 57496 - DNA, 25 bp, S. cerevisiae
tactccattgttcttagcgtgctac

SEQ ID NO: 57497 - DNA, 25 bp, S. cerevisiae
tactccctttgtcattgcagcaggt

SEQ ID NO: 57498 - DNA, 25 bp, S. cerevisiae
tacctcgttattatcgcctttctaa

SEQ ID NO: 57499 - DNA, 25 bp, S. cerevisiae
tacccgtataccaacctgctaatta

SEQ ID NO: 57500 - DNA, 25 bp, S. cerevisiae
tacgttgtcgtccaaaagccagcaa

SEQ ID NO: 57501 - DNA, 25 bp, S. cerevisiae
tacgaaatttcgcaacgccgcatga

SEQ ID NO: 57502 - DNA, 25 bp, S. cerevisiae
tactggaattcttggcaacgccgat

SEQ ID NO: 57503 - DNA, 25 bp, S. cerevisiae
taggtttgtttgatacggccggtca

SEQ ID NO: 57504 - DNA, 25 bp, S. cerevisiae
tacgttattttgactacttctgcgg

SEQ ID NO: 57505 - DNA, 25 bp, S. cerevisiae
tacgtctattattaccagcaaggct

SEQ ID NO: 57506 - DNA, 25 bp, S. cerevisiae
tacgatttcatcatactccatacct

SEQ ID NO: 57507 - DNA, 25 bp, S. cerevisiae
tacgttgtttgtatcatcccacgat

SEQ ID NO: 57508 - DNA, 25 bp, S. cerevisiae
tacgtgatgttatgttctcccgcaa

SEQ ID NO: 57509 - DNA, 25 bp, S. cerevisiae
tacgagcgtctgcagttcttacaaa

SEQ ID NO: 57510 - DNA, 25 bp, S. cerevisiae
tactgagcgtccgacttttcgataa

SEQ ID NO: 57511 - DNA, 25 bp, S. cerevisiae
tatccgagctaagagttcaccaact

SEQ ID NO: 57512 - DNA, 25 bp, S. cerevisiae
taccgcagattctagtcgatcctaa

SEQ ID NO: 57513 - DNA, 25 bp, S. cerevisiae
tacggagacatttctggttctgaat

SEQ ID NO: 57514 - DNA, 25 bp, S. cerevisiae
tacgcttacttgactggtatcagag

SEQ ID NO: 57515 - DNA, 25 bp, S. cerevisiae
tacgtactagcgtttgccactatgc

SEQ ID NO: 57516 - DNA, 25 bp, S. cerevisiae
tactgctactacttcatcattcact

SEQ ID NO: 57517 - DNA, 25 bp, S. cerevisiae
tactgaagcttcttctgctgctact

SEQ ID NO: 57518 - DNA, 25 bp, S. cerevisiae
tactgaagctcctagcgctgctaat

SEQ ID NO: 57519 - DNA, 25 bp, S. cerevisiae
tacgtgatgacggaccaggaataat

SEQ ID NO: 57520 - DNA, 25 bp, S. cerevisiae
taccgatggacgcacaggaacaatt

SEQ ID NO: 57521 - DNA, 25 bp, S. cerevisiae
taccgaaatgcgcaagctggacgat

SEQ ID NO: 57522 - DNA, 25 bp, S. cerevisiae
taccgaattggacagcagtgctact

SEQ ID NO: 57523 - DNA, 25 bp, S. cerevisiae
taccaagattggttgcggtctacaa

SEQ ID NO: 57524 - DNA, 25 bp, S. cerevisiae
taccaggttgcgtggtcatcggact

SEQ ID NO: 57525 - DNA, 25 bp, S. cerevisiae
taccaggattccttaagacgtgatc

SEQ ID NO: 57526 - DNA, 25 bp, S. cerevisiae
tagtcggattcctcagtatctgcgt

SEQ ID NO: 57527 - DNA, 25 bp, S. cerevisiae
tactcatctcactcaaaactatcac

SEQ ID NO: 57528 - DNA, 25 bp, S. cerevisiae
tactcaaatcattccgcaacttcaa

SEQ ID NO: 57529 - DNA, 25 bp, S. cerevisiae
tacgtatatgctcatgacacaccat

SEQ ID NO: 57530 - DNA, 25 bp, S. cerevisiae
tacgtatattgccttcacatgccgt

SEQ ID NO: 57531 - DNA, 25 bp, S. cerevisiae
tactgtattggctcagatacccgct

SEQ ID NO: 57532 - DNA, 25 bp, S. cerevisiae
tacgttatatcccttgtctcatttg

SEQ ID NO: 57533 - DNA, 25 bp, S. cerevisiae
tacgttctagtatatcctgatggtc

SEQ ID NO: 57534 - DNA, 25 bp, S. cerevisiae
tacgttcttggaaatcctggctgcc

SEQ ID NO: 57535 - DNA, 25 bp, S. cerevisiae
tactgttctgtggtgagtccttcaa

SEQ ID NO: 57536 - DNA, 25 bp, S. cerevisiae
taccgttcttcaaggctgtattcaa

SEQ ID NO: 57537 - DNA, 25 bp, S. cerevisiae
taccgaatgttcagctgctacccaa

SEQ ID NO: 57538 - DNA, 25 bp, S. cerevisiae
taccccacagagtgttgcaacagct

SEQ ID NO: 57539 - DNA, 25 bp, S. cerevisiae
tagtcccagccctatgattgaacca

SEQ ID NO: 57540 - DNA, 25 bp, S. cerevisiae
tactcccctcatctttatatgtcat

SEQ ID NO: 57541 - DNA, 25 bp, S. cerevisiae
tactctgtcgttatggaggtataga

SEQ ID NO: 57542 - DNA, 25 bp, S. cerevisiae
tactcattctgtttctgctgggtta

SEQ ID NO: 57543 - DNA, 25 bp, S. cerevisiae
tatcgaatccatgggcgagcctcat

SEQ ID NO: 57544 - DNA, 25 bp, S. cerevisiae
tagctgtgtgcagaggagcgcctca

SEQ ID NO: 57545 - DNA, 25 bp, S. cerevisiae
tactgctgcagtggcatcttacttt

SEQ ID NO: 57546 - DNA, 25 bp, S. cerevisiae
taccatgattcagcaatactttttt

SEQ ID NO: 57547 - DNA, 25 bp, S. cerevisiae
taccttgccacggtcagattttggt

SEQ ID NO: 57548 - DNA, 25 bp, S. cerevisiae
tacgttccaccttcaaatggcgagt

SEQ ID NO: 57549 - DNA, 25 bp, S. cerevisiae
tacgtgctagcagtcatctaaatgc

SEQ ID NO: 57550 - DNA, 25 bp, S. cerevisiae
tagcgcatgctatctccaaaattag

SEQ ID NO: 57551 - DNA, 25 bp, S. cerevisiae
taccgtaatatcgaaggaagaaggt

SEQ ID NO: 57552 - DNA, 25 bp, S. cerevisiae
tactgcccatattccaagccaagaa

SEQ ID NO: 57553 - DNA, 25 bp, S. cerevisiae
taccgctcacaaccaaaccagaaag

SEQ ID NO: 57554 - DNA, 25 bp, S. cerevisiae
tagcacccaaacgaagagccacttg

SEQ ID NO: 57555 - DNA, 25 bp, S. cerevisiae
tactgcgacaagtgagccaacttca

SEQ ID NO: 57556 - DNA, 25 bp, S. cerevisiae
tactccaagagatacgacgctcgct

SEQ ID NO: 57557 - DNA, 25 bp, S. cerevisiae
taccctacagtgtaaaagcctcctt

SEQ ID NO: 57558 - DNA, 25 bp, S. cerevisiae
tacgcctgtcggtaatgtacctcaa

SEQ ID NO: 57559 - DNA, 25 bp, S. cerevisiae
taccctgacgaaccatgcctgattt

SEQ ID NO: 57560 - DNA, 25 bp, S. cerevisiae
taccgtggttcgcatgggatcatta

SEQ ID NO: 57561 - DNA, 25 bp, S. cerevisiae
tactgcagcaccttatgaacggcgt

SEQ ID NO: 57562 - DNA, 25 bp, S. cerevisiae
tactggaagatattgacgcggcgtt

SEQ ID NO: 57563 - DNA, 25 bp, S. cerevisiae
tactgaaatggaaccgctggcgttt

SEQ ID NO: 57564 - DNA, 25 bp, S. cerevisiae
taccccacaaaactacctgattcat

SEQ ID NO: 57565 - DNA, 25 bp, S. cerevisiae
tactccgcgaagtattaacgttaca

SEQ ID NO: 57566 - DNA, 25 bp, S. cerevisiae
tacccgaaggttatagcgcgtcatt

SEQ ID NO: 57567 - DNA, 25 bp, S. cerevisiae
tactccgatgaagcttctgctcaaa

SEQ ID NO: 57568 - DNA, 25 bp, S. cerevisiae
tacgcttctttcttgcaaagacaag

SEQ ID NO: 57569 - DNA, 25 bp, S. cerevisiae
tacgttctctgtttctcaagcatca

SEQ ID NO: 57570 - DNA, 25 bp, S. cerevisiae
tacctctaccaaagtctccgtggaa

SEQ ID NO: 57571 - DNA, 25 bp, S. cerevisiae
taccaaaccctgatacccttgatga

SEQ ID NO: 57572 - DNA, 25 bp, S. cerevisiae
tacgcggatacagagaaccctttat

SEQ ID NO: 57573 - DNA, 25 bp, S. cerevisiae
taccgagaaacgttatccctggctt

SEQ ID NO: 57574 - DNA, 25 bp, S. cerevisiae
tacgctgagggagcctttccaggta

SEQ ID NO: 57575 - DNA, 25 bp, S. cerevisiae
tactgtttgttgacttaatttctag

SEQ ID NO: 57576 - DNA, 25 bp, S. cerevisiae
taggtcacgttggtttcggacagcc

SEQ ID NO: 57577 - DNA, 25 bp, S. cerevisiae
tacgagcttttcttttctaatactt

SEQ ID NO: 57578 - DNA, 25 bp, S. cerevisiae
tacgttgcctccatcgaacaaactg

SEQ ID NO: 57579 - DNA, 25 bp, S. cerevisiae
ttagatctacttcccaaaaacctgt

SEQ ID NO: 57580 - DNA, 25 bp, S. cerevisiae
ttagactactcccaaagtactttgg

SEQ ID NO: 57581 - DNA, 25 bp, S. cerevisiae
ttacctacccgatctgtggcgttga

SEQ ID NO: 57582 - DNA, 25 bp, S. cerevisiae
tatacggacgaagccaatggattca

SEQ ID NO: 57583 - DNA, 25 bp, S. cerevisiae
ttgccggtcctcagcgcaacgtata

SEQ ID NO: 57584 - DNA, 25 bp, S. cerevisiae
tacgctcgcaaatacaacaccagat

SEQ ID NO: 57585 - DNA, 25 bp, S. cerevisiae
tactgctggattttacggcctgaaa

SEQ ID NO: 57586 - DNA, 25 bp, S. cerevisiae
tactgcctcattctacaggcctaag

SEQ ID NO: 57587 - DNA, 25 bp, S. cerevisiae
tacgatcgggatttcttcttcaaga

SEQ ID NO: 57588 - DNA, 25 bp, S. cerevisiae
tagcacaagtggtctttacctccat

SEQ ID NO: 57589 - DNA, 25 bp, S. cerevisiae
taccaaggtgctgtggaccctcacg

SEQ ID NO: 57590 - DNA, 25 bp, S. cerevisiae
tacctgaagctacttcaaccgtcac

SEQ ID NO: 57591 - DNA, 25 bp, S. cerevisiae
taccgataatgggtcagtcctgcca

SEQ ID NO: 57592 - DNA, 25 bp, S. cerevisiae
tacgcgagaatgttgctcttccatg

SEQ ID NO: 57593 - DNA, 25 bp, S. cerevisiae
tactgggccgcaagctttatgataa

SEQ ID NO: 57594 - DNA, 25 bp, S. cerevisiae
tactgtgggccaatccttataaatt

SEQ ID NO: 57595 - DNA, 25 bp, S. cerevisiae
tagggactacgtctacggagcccaa

SEQ ID NO: 57596 - DNA, 25 bp, S. cerevisiae
taccactcttccttttttatttgca

SEQ ID NO: 57597 - DNA, 25 bp, S. cerevisiae
tactgctttgccattgcctgatgaa

SEQ ID NO: 57598 - DNA, 25 bp, S. cerevisiae
tatcctttccatccgccaatgatta

SEQ ID NO: 57599 - DNA, 25 bp, S. cerevisiae
taccatttcgagtctaagctgttaa

SEQ ID NO: 57600 - DNA, 25 bp, S. cerevisiae
taccacttcatctccaactataata

SEQ ID NO: 57601 - DNA, 25 bp, S. cerevisiae
taccagttcatacctgatacggaag

SEQ ID NO: 57602 - DNA, 25 bp, S. cerevisiae
taccacttttgccaacatcagtaag

SEQ ID NO: 57603 - DNA, 25 bp, S. cerevisiae
tacctcaggcgttaacagatgttca

SEQ ID NO: 57604 - DNA, 25 bp, S. cerevisiae
tagcacggcacctactacttttaaa

SEQ ID NO: 57605 - DNA, 25 bp, S. cerevisiae
taccagaacttagcggtgttaacac

SEQ ID NO: 57606 - DNA, 25 bp, S. cerevisiae
taccaaatctggacctgcgggagag

SEQ ID NO: 57607 - DNA, 25 bp, S. cerevisiae
taccataatttgacgcacaacgcgg

SEQ ID NO: 57608 - DNA, 25 bp, S. cerevisiae
tacgcccatactggaatcttcttca

SEQ ID NO: 57609 - DNA, 25 bp, S. cerevisiae
tacggccttgtctaacaccatccag

SEQ ID NO: 57610 - DNA, 25 bp, S. cerevisiae
tacggccttgtctaacaccatccag

SEQ ID NO: 57611 - DNA, 25 bp, S. cerevisiae
tacggccttgtctaacaccatccag

SEQ ID NO: 57612 - DNA, 25 bp, S. cerevisiae
tactggcctgccgatagtgattcct

SEQ ID NO: 57613 - DNA, 25 bp, S. cerevisiae
taccgcgccgcctgctaatataaag

SEQ ID NO: 57614 - DNA, 25 bp, S. cerevisiae
taccaccaatgcctacgtcaaaaga

SEQ ID NO: 57615 - DNA, 25 bp, S. cerevisiae
tacccgattgtcgatgagtcagaat

SEQ ID NO: 57616 - DNA, 25 bp, S. cerevisiae
tacctagaggcgctgttgcagaatt

SEQ ID NO: 57617 - DNA, 25 bp, S. cerevisiae
tagctacatgcgatgccaaggatct

SEQ ID NO: 57618 - DNA, 25 bp, S. cerevisiae
tactggatgcgctagacggaaccat

SEQ ID NO: 57619 - DNA, 25 bp, S. cerevisiae
tactggctcgccgacgggcaagcag

SEQ ID NO: 57620 - DNA, 25 bp, S. cerevisiae
tagcatggcagcgacgctatcgcaa

SEQ ID NO: 57621 - DNA, 25 bp, S. cerevisiae
taggtacctagtgagcgggataaac

SEQ ID NO: 57622 - DNA, 25 bp, S. cerevisiae
tactgtgaccaactgctcaggtgga

SEQ ID NO: 57623 - DNA, 25 bp, S. cerevisiae
tacgatgacatctctgccgcaattg

SEQ ID NO: 57624 - DNA, 25 bp, S. cerevisiae
tactgattcacagcttgcgcaggtc

SEQ ID NO: 57625 - DNA, 25 bp, S. cerevisiae
tagcggaccaattacgtggctcgtt

SEQ ID NO: 57626 - DNA, 25 bp, S. cerevisiae
tacgagaatgctacaccaggtacta

SEQ ID NO: 57627 - DNA, 25 bp, S. cerevisiae
tacgcttatctttctcttgtagtat

SEQ ID NO: 57628 - DNA, 25 bp, S. cerevisiae
tacgcccataggtgttttgcaggac

SEQ ID NO: 57629 - DNA, 25 bp, S. cerevisiae
tacgccgccaccagttttgaggagg

SEQ ID NO: 57630 - DNA, 25 bp, S. cerevisiae
tactgtcgctaattcctattgtagg

SEQ ID NO: 57631 - DNA, 25 bp, S. cerevisiae
tacgtctcgagctatttattataag

SEQ ID NO: 57632 - DNA, 25 bp, S. cerevisiae
tacccagtttataccacgatattgt

SEQ ID NO: 57633 - DNA, 25 bp, S. cerevisiae
tacctacgcatgctcctaaatacga

SEQ ID NO: 57634 - DNA, 25 bp, S. cerevisiae
tacctccgtggtttccaagagctat

SEQ ID NO: 57635 - DNA, 25 bp, S. cerevisiae
taccgccgggttaaaagatctgatg

SEQ ID NO: 57636 - DNA, 25 bp, S. cerevisiae
taccgctgggtattatcaaattcta

SEQ ID NO: 57637 - DNA, 25 bp, S. cerevisiae
tactggctaggtttgatcgtgtgat

SEQ ID NO: 57638 - DNA, 25 bp, S. cerevisiae
tacctgtaggtagtgtcgattgcca

SEQ ID NO: 57639 - DNA, 25 bp, S. cerevisiae
taccgattttgggttttgcgccaga

SEQ ID NO: 57640 - DNA, 25 bp, S. cerevisiae
taggtgacctaactactttggccaa

SEQ ID NO: 57641 - DNA, 25 bp, S. cerevisiae
tagttaaccaacgtgctgttgccct

SEQ ID NO: 57642 - DNA, 25 bp, S. cerevisiae
tagaattggttctgctgtcggttcc

SEQ ID NO: 57643 - DNA, 25 bp, S. cerevisiae
tagacatcggtttagctttggcttc

SEQ ID NO: 57644 - DNA, 25 bp, S. cerevisiae
tagaacccctgtatttgctgttgca

SEQ ID NO: 57645 - DNA, 25 bp, S. cerevisiae
tagaaacctcgaacttccactatgc

SEQ ID NO: 57646 - DNA, 25 bp, S. cerevisiae
tagagaaatattccccattcgaccc

SEQ ID NO: 57647 - DNA, 25 bp, S. cerevisiae
tagctattttttccagtcggcaaaa

SEQ ID NO: 57648 - DNA, 25 bp, S. cerevisiae
tacccagggatcttctagtgcaaat

SEQ ID NO: 57649 - DNA, 25 bp, S. cerevisiae
tacgccaaggtctttgctgctgaaa

SEQ ID NO: 57650 - DNA, 25 bp, S. cerevisiae
tactggagacggtttctcgcgcaaa

SEQ ID NO: 57651 - DNA, 25 bp, S. cerevisiae
tacggtgtcattatgtggccgataa

SEQ ID NO: 57652 - DNA, 25 bp, S. cerevisiae
ttcgtaaacgaacatctggtgcagc

SEQ ID NO: 57653 - DNA, 25 bp, S. cerevisiae
tatggaaagatgtcaaggctcgaat

SEQ ID NO: 57654 - DNA, 25 bp, S. cerevisiae
tacgatgaggatccactaccgagac

SEQ ID NO: 57655 - DNA, 25 bp, S. cerevisiae
tacgcatcagattccattaactcag

SEQ ID NO: 57656 - DNA, 25 bp, S. cerevisiae
tacgctctgcgctgtgctacgaagt

SEQ ID NO: 57657 - DNA, 25 bp, S. cerevisiae
tacgccatggctatgcaacagcagc

SEQ ID NO: 57658 - DNA, 25 bp, S. cerevisiae
tagcgcaattgcaaaaacgactggt

SEQ ID NO: 57659 - DNA, 25 bp, S. cerevisiae
tacgcacttgatttagaggccggct

SEQ ID NO: 57660 - DNA, 25 bp, S. cerevisiae
tacccatggtggtcatatgctcggt

SEQ ID NO: 57661 - DNA, 25 bp, S. cerevisiae
taccttcgtttcccatcttatataa

SEQ ID NO: 57662 - DNA, 25 bp, S. cerevisiae
tacgtttctctaaccacttctaact

SEQ ID NO: 57663 - DNA, 25 bp, S. cerevisiae
tacgatcttttgagcaagttcgcaa

SEQ ID NO: 57664 - DNA, 25 bp, S. cerevisiae
tacgcccgttgtacaattttgaatc

SEQ ID NO: 57665 - DNA, 25 bp, S. cerevisiae
tacgtgcccgtatcaaccagctggg

SEQ ID NO: 57666 - DNA, 25 bp, S. cerevisiae
tatctgttgcagctccgcaaccagc

SEQ ID NO: 57667 - DNA, 25 bp, S. cerevisiae
tacgatgtggatgggctgttctata

SEQ ID NO: 57668 - DNA, 25 bp, S. cerevisiae
tagcgaatgggcgtcatggactcaa

SEQ ID NO: 57669 - DNA, 25 bp, S. cerevisiae
taccagatagtagttgtcctccaaa

SEQ ID NO: 57670 - DNA, 25 bp, S. cerevisiae
taccaaataattatgcgcccaccac

SEQ ID NO: 57671 - DNA, 25 bp, S. cerevisiae
tagccaaaacattgttccaacaggg

SEQ ID NO: 57672 - DNA, 25 bp, S. cerevisiae
taccttcagactaccaaagaccttg

SEQ ID NO: 57673 - DNA, 25 bp, S. cerevisiae
tacgctaccattaccaaacccttat

SEQ ID NO: 57674 - DNA, 25 bp, S. cerevisiae
tagagcaccaagcttgtgacctttg

SEQ ID NO: 57675 - DNA, 25 bp, S. cerevisiae
tagccgcgagagctaaaatgcgttc

SEQ ID NO: 57676 - DNA, 25 bp, S. cerevisiae
tacccggtgcatcaagaatactcca

SEQ ID NO: 57677 - DNA, 25 bp, S. cerevisiae
taccctggtaaactcaattcctaat

SEQ ID NO: 57678 - DNA, 25 bp, S. cerevisiae
tacgctcttggtatcggtactgttc

SEQ ID NO: 57679 - DNA, 25 bp, S. cerevisiae
tacctctacgccaacgagtacgaag

SEQ ID NO: 57680 - DNA, 25 bp, S. cerevisiae
tacgacagacccatcgaggaagaat

SEQ ID NO: 57681 - DNA, 25 bp, S. cerevisiae
tacgccagccactgcttgcaaaaaa

SEQ ID NO: 57682 - DNA, 25 bp, S. cerevisiae
tacccagcccagtgaccaagagaga

SEQ ID NO: 57683 - DNA, 25 bp, S. cerevisiae
tatcaacgtttctgcccaaagagac

SEQ ID NO: 57684 - DNA, 25 bp, S. cerevisiae
tatcaaggtcaccaacccaaagggt

SEQ ID NO: 57685 - DNA, 25 bp, S. cerevisiae
tatcatcggtcacaacccagacgaa

SEQ ID NO: 57686 - DNA, 25 bp, S. cerevisiae
tatgcaactaatgaccccaatgggc

SEQ ID NO: 57687 - DNA, 25 bp, S. cerevisiae
tagaaatatacttgccgactacagt

SEQ ID NO: 57688 - DNA, 25 bp, S. cerevisiae
tatatttaggcattccggatacgga

SEQ ID NO: 57689 - DNA, 25 bp, S. cerevisiae
tagaaattattgtacgtcccgcgaa

SEQ ID NO: 57690 - DNA, 25 bp, S. cerevisiae
tagacatattgctacaaaccccgcg

SEQ ID NO: 57691 - DNA, 25 bp, S. cerevisiae
tagaagagcacagcaattcccaccg

SEQ ID NO: 57692 - DNA, 25 bp, S. cerevisiae
tagactagaaaagccgaaccctcat

SEQ ID NO: 57693 - DNA, 25 bp, S. cerevisiae
tagaacataaagagccggaccacct

SEQ ID NO: 57694 - DNA, 25 bp, S. cerevisiae
tagaacacagttattcggaccggct

SEQ ID NO: 57695 - DNA, 25 bp, S. cerevisiae
tagaatgaagtttgtccgtcccggt

SEQ ID NO: 57696 - DNA, 25 bp, S. cerevisiae
tagccgccaagttaattttccgaat

SEQ ID NO: 57697 - DNA, 25 bp, S. cerevisiae
tacctctcgtggttcttcggtacaa

SEQ ID NO: 57698 - DNA, 25 bp, S. cerevisiae
tacggtggccataccatttgtgttg

SEQ ID NO: 57699 - DNA, 25 bp, S. cerevisiae
tacggtactcctatcatcaattcac

SEQ ID NO: 57700 - DNA, 25 bp, S. cerevisiae
tacgttcactcctaatatatccacc

SEQ ID NO: 57701 - DNA, 25 bp, S. cerevisiae
tacgtccccagcatatttcaacaaa

SEQ ID NO: 57702 - DNA, 25 bp, S. cerevisiae
tacgacctctcgctttctgaagaag

SEQ ID NO: 57703 - DNA, 25 bp, S. cerevisiae
tacgaccaccgatgttccagataca

SEQ ID NO: 57704 - DNA, 25 bp, S. cerevisiae
taccaccactttatctccatctgac

SEQ ID NO: 57705 - DNA, 25 bp, S. cerevisiae
taccaccactttatctccatctgac

SEQ ID NO: 57706 - DNA, 25 bp, S. cerevisiae
taccgccgttaggatctgctattga

SEQ ID NO: 57707 - DNA, 25 bp, S. cerevisiae
tagtagccgactctgatccaattga

SEQ ID NO: 57708 - DNA, 25 bp, S. cerevisiae
tagctgacgccatcaacaccaagta

SEQ ID NO: 57709 - DNA, 25 bp, S. cerevisiae
tagtgccactactcgtgacaaactt

SEQ ID NO: 57710 - DNA, 25 bp, S. cerevisiae
taggttccggtgttactgaactcct

SEQ ID NO: 57711 - DNA, 25 bp, S. cerevisiae
taggttgtacaatagggccgtctct

SEQ ID NO: 57712 - DNA, 25 bp, S. cerevisiae
tagttttcaattttccccataatgg

SEQ ID NO: 57713 - DNA, 25 bp, S. cerevisiae
tacctttaaattacccctctgaatg

SEQ ID NO: 57714 - DNA, 25 bp, S. cerevisiae
tagcgttaaaatcagcccgtctttg

SEQ ID NO: 57715 - DNA, 25 bp, S. cerevisiae
tacctaaagaagaagcccgtgcatt

SEQ ID NO: 57716 - DNA, 25 bp, S. cerevisiae
tacctcaaggacatacccggtgatg

SEQ ID NO: 57717 - DNA, 25 bp, S. cerevisiae
tacgcttcttacatacagtccaggg

SEQ ID NO: 57718 - DNA, 25 bp, S. cerevisiae
tacgcctttggcacgcaattatatc

SEQ ID NO: 57719 - DNA, 25 bp, S. cerevisiae
taccaatttggtcagcagcagtcaa

SEQ ID NO: 57720 - DNA, 25 bp, S. cerevisiae
taccatgcagttggacaaggcgccc

SEQ ID NO: 57721 - DNA, 25 bp, S. cerevisiae
tacgacctctgcgacaatgtgacca

SEQ ID NO: 57722 - DNA, 25 bp, S. cerevisiae
tagcgacctcgttaatctgcagaga

SEQ ID NO: 57723 - DNA, 25 bp, S. cerevisiae
taccttcccgaagtttgatcaagtg

SEQ ID NO: 57724 - DNA, 25 bp, S. cerevisiae
tacctgtcacgcgttttactaaagt

SEQ ID NO: 57725 - DNA, 25 bp, S. cerevisiae
taccgccaccgacatatactgaaat

SEQ ID NO: 57726 - DNA, 25 bp, S. cerevisiae
taccgccaccacctggatttgaatt

SEQ ID NO: 57727 - DNA, 25 bp, S. cerevisiae
taccaggtgctaactctagggcttt

SEQ ID NO: 57728 - DNA, 25 bp, S. cerevisiae
tacccgttatacaatgtttcctcgt

SEQ ID NO: 57729 - DNA, 25 bp, S. cerevisiae
tacgacttcctcgaattttagccat

SEQ ID NO: 57730 - DNA, 25 bp, S. cerevisiae
tacgttataccactttttcaccatc

SEQ ID NO: 57731 - DNA, 25 bp, S. cerevisiae
tacgttatactattttacaccgtat

SEQ ID NO: 57732 - DNA, 25 bp, S. cerevisiae
tacgttatactattttacaccgtat

SEQ ID NO: 57733 - DNA, 25 bp, S. cerevisiae
tagactttatagttttacctccgat

SEQ ID NO: 57734 - DNA, 25 bp, S. cerevisiae
tacgtgttggctatctgtgtgtttc

SEQ ID NO: 57735 - DNA, 25 bp, S. cerevisiae
tagctgtggtttgttgtgggcctcc

SEQ ID NO: 57736 - DNA, 25 bp, S. cerevisiae
taggccgtcttcatcgttgtatttt

SEQ ID NO: 57737 - DNA, 25 bp, S. cerevisiae
taccaaaggccaccgtttcaattct

SEQ ID NO: 57738 - DNA, 25 bp, S. cerevisiae
taccgaaaccgcttgcaatgacttt

SEQ ID NO: 57739 - DNA, 25 bp, S. cerevisiae
taccgatgaacccttatacccaata

SEQ ID NO: 57740 - DNA, 25 bp, S. cerevisiae
tatccacgattttgacggcgagaaa

SEQ ID NO: 57741 - DNA, 25 bp, S. cerevisiae
tagcccagtgctgacaattcttact

SEQ ID NO: 57742 - DNA, 25 bp, S. cerevisiae
taccgggcttttaatgtccattcca

SEQ ID NO: 57743 - DNA, 25 bp, S. cerevisiae
tacgctggagtgattttccttctat

SEQ ID NO: 57744 - DNA, 25 bp, S. cerevisiae
taccaagttattggccgtcgtttgc

SEQ ID NO: 57745 - DNA, 25 bp, S. cerevisiae
taccgatttttgtagccgatggact

SEQ ID NO: 57746 - DNA, 25 bp, S. cerevisiae
taccgtgaaggtactgccaagccaa

SEQ ID NO: 57747 - DNA, 25 bp, S. cerevisiae
taccagttgggtacgtcgaacgcat

SEQ ID NO: 57748 - DNA, 25 bp, S. cerevisiae
taccgttgcagccttctttagaggt

SEQ ID NO: 57749 - DNA, 25 bp, S. cerevisiae
taccatgatgccgtttgggatcgaa

SEQ ID NO: 57750 - DNA, 25 bp, S. cerevisiae
taccatcatcccattgatttcgcaa

SEQ ID NO: 57751 - DNA, 25 bp, S. cerevisiae
taccttcaagcatctagtatcgcat

SEQ ID NO: 57752 - DNA, 25 bp, S. cerevisiae
taccttaaactccactatcctgatg

SEQ ID NO: 57753 - DNA, 25 bp, S. cerevisiae
tacgttaaaccaatctcatcctttc

SEQ ID NO: 57754 - DNA, 25 bp, S. cerevisiae
tacccgtaaactgtccatatgcatc

SEQ ID NO: 57755 - DNA, 25 bp, S. cerevisiae
tacgaagataaaatgctcccgctac

SEQ ID NO: 57756 - DNA, 25 bp, S. cerevisiae
tatgaggagaacgaggcccggtact

SEQ ID NO: 57757 - DNA, 25 bp, S. cerevisiae
tagaggaagacgcaccgggctacaa

SEQ ID NO: 57758 - DNA, 25 bp, S. cerevisiae
tagcggtaatctcatcaagtcccac

SEQ ID NO: 57759 - DNA, 25 bp, S. cerevisiae
tatcggagaattggccactatgaga

SEQ ID NO: 57760 - DNA, 25 bp, S. cerevisiae
tacgctggtgacatcgctttgagac

SEQ ID NO: 57761 - DNA, 25 bp, S. cerevisiae
tacgaactgttttgtggcgcacgaa

SEQ ID NO: 57762 - DNA, 25 bp, S. cerevisiae
tacgaacagctctcagtgggaacca

SEQ ID NO: 57763 - DNA, 25 bp, S. cerevisiae
tagcagatacgttcctggaggacat

SEQ ID NO: 57764 - DNA, 25 bp, S. cerevisiae
taccatactgttcatgctagtgttg

SEQ ID NO: 57765 - DNA, 25 bp, S. cerevisiae
tacctccaagagactacgccaatag

SEQ ID NO: 57766 - DNA, 25 bp, S. cerevisiae
tatcttagatagacagtacgccaag

SEQ ID NO: 57767 - DNA, 25 bp, S. cerevisiae
tatctttgacaccagaacctttgag

SEQ ID NO: 57768 - DNA, 25 bp, S. cerevisiae
tacgttgtcatctcaacctcttgat

SEQ ID NO: 57769 - DNA, 25 bp, S. cerevisiae
tacgatataccttcagacccagatg

SEQ ID NO: 57770 - DNA, 25 bp, S. cerevisiae
tacgattatttaacagcccatctaa

SEQ ID NO: 57771 - DNA, 25 bp, S. cerevisiae
tagcgaattttcttctacgaatata

SEQ ID NO: 57772 - DNA, 25 bp, S. cerevisiae
tacgaaatatttgctcctgatgaca

SEQ ID NO: 57773 - DNA, 25 bp, S. cerevisiae
tacgatccatatgtgcctccagagg

SEQ ID NO: 57774 - DNA, 25 bp, S. cerevisiae
taccggattccccatctatagagaa

SEQ ID NO: 57775 - DNA, 25 bp, S. cerevisiae
tacctggtgttgacgtttcagctga

SEQ ID NO: 57776 - DNA, 25 bp, S. cerevisiae
tatgcgatggtcataccgtggcgaa

SEQ ID NO: 57777 - DNA, 25 bp, S. cerevisiae
tagctgggctacaaggtatcctacc

SEQ ID NO: 57778 - DNA, 25 bp, S. cerevisiae
tagccctattagaagtgcgaacagc

SEQ ID NO: 57779 - DNA, 25 bp, S. cerevisiae
tacgcattatgcaacagcttcggat

SEQ ID NO: 57780 - DNA, 25 bp, S. cerevisiae
tacctgtgacatgcttgccggaaag

SEQ ID NO: 57781 - DNA, 25 bp, S. cerevisiae
tagaagagtttattgtggccagaca

SEQ ID NO: 57782 - DNA, 25 bp, S. cerevisiae
tagaagtggttcatgtggcggacat

SEQ ID NO: 57783 - DNA, 25 bp, S. cerevisiae
tagacaggtttcactgccagctagt

SEQ ID NO: 57784 - DNA, 25 bp, S. cerevisiae
taccgcctgctttatcaactgacaa

SEQ ID NO: 57785 - DNA, 25 bp, S. cerevisiae
tagaattattggcaccatccctcac

SEQ ID NO: 57786 - DNA, 25 bp, S. cerevisiae
tagagtcaatggaggtcaccccgtg

SEQ ID NO: 57787 - DNA, 25 bp, S. cerevisiae
tagaatcacaggaggcgcaagcacg

SEQ ID NO: 57788 - DNA, 25 bp, S. cerevisiae
tagttccttttgacatcggatttcc

SEQ ID NO: 57789 - DNA, 25 bp, S. cerevisiae
tagtcctttttgtcccagttccagc

SEQ ID NO: 57790 - DNA, 25 bp, S. cerevisiae
tagagctaacttccaacctgaacca

SEQ ID NO: 57791 - DNA, 25 bp, S. cerevisiae
taggtacgttacgagctctgtactc

SEQ ID NO: 57792 - DNA, 25 bp, S. cerevisiae
tagctgctactgatgcagtcgctgc

SEQ ID NO: 57793 - DNA, 25 bp, S. cerevisiae
tacgctgtgcgcaagctgctaagtt

SEQ ID NO: 57794 - DNA, 25 bp, S. cerevisiae
taccaatggcaatttcagatcaatg

SEQ ID NO: 57795 - DNA, 25 bp, S. cerevisiae
tacctgagtgaatttgcattgctac

SEQ ID NO: 57796 - DNA, 25 bp, S. cerevisiae
tacccagtcgaagttgctgaagccg

SEQ ID NO: 57797 - DNA, 25 bp, S. cerevisiae
tatgtgccacgccagcagttggaag

SEQ ID NO: 57798 - DNA, 25 bp, S. cerevisiae
taccgcggcgctgatattattaaat

SEQ ID NO: 57799 - DNA, 25 bp, S. cerevisiae
tacccgactgtactgtttgttcaaa

SEQ ID NO: 57800 - DNA, 25 bp, S. cerevisiae
taccgattgccgtggaggtcatcaa

SEQ ID NO: 57801 - DNA, 25 bp, S. cerevisiae
tagctcagcatcgtcttcggatagt

SEQ ID NO: 57802 - DNA, 25 bp, S. cerevisiae
tagctacagacatcagtgacaacga

SEQ ID NO: 57803 - DNA, 25 bp, S. cerevisiae
taccgcgtccactatcatcaagaag

SEQ ID NO: 57804 - DNA, 25 bp, S. cerevisiae
tagacatgctcgttctcatattatg

SEQ ID NO: 57805 - DNA, 25 bp, S. cerevisiae
tagatcttgagactgtgcattatag

SEQ ID NO: 57806 - DNA, 25 bp, S. cerevisiae
tagctgctgcaatggccaatgttgt

SEQ ID NO: 57807 - DNA, 25 bp, S. cerevisiae
tatggttttcgcctacttctacgtt

SEQ ID NO: 57808 - DNA, 25 bp, S. cerevisiae
taggttattccatagctgttgtagc

SEQ ID NO: 57809 - DNA, 25 bp, S. cerevisiae
taggtttaccagttggtgctatcat

SEQ ID NO: 57810 - DNA, 25 bp, S. cerevisiae
tagctgactctactggtgacgttaa

SEQ ID NO: 57811 - DNA, 25 bp, S. cerevisiae
tagcatacttaacagcattggcgtc

SEQ ID NO: 57812 - DNA, 25 bp, S. cerevisiae
taccctaaacctcaagtgaacctgc

SEQ ID NO: 57813 - DNA, 25 bp, S. cerevisiae
taccccatacgctatccaatattta

SEQ ID NO: 57814 - DNA, 25 bp, S. cerevisiae
taccgcacccagtaacaagtctttg

SEQ ID NO: 57815 - DNA, 25 bp, S. cerevisiae
tacccaccagagtactgcgagtttt

SEQ ID NO: 57816 - DNA, 25 bp, S. cerevisiae
taccgtcagaggtagtgcgagagat

SEQ ID NO: 57817 - DNA, 25 bp, S. cerevisiae
tacctgttgcgtagatgttatgcca

SEQ ID NO: 57818 - DNA, 25 bp, S. cerevisiae
taccgatgtggtgctttgtgcgaga

SEQ ID NO: 57819 - DNA, 25 bp, S. cerevisiae
tagctgcgacggtttacaacatcat

SEQ ID NO: 57820 - DNA, 25 bp, S. cerevisiae
tagccaaatgtcaaactcaaatagt

SEQ ID NO: 57821 - DNA, 25 bp, S. cerevisiae
tatccacgcaaagaccaaggttttt

SEQ ID NO: 57822 - DNA, 25 bp, S. cerevisiae
taccacgcgaagaccctaggttcaa

SEQ ID NO: 57823 - DNA, 25 bp, S. cerevisiae
tattgagcggtacccttagcggcta

SEQ ID NO: 57824 - DNA, 25 bp, S. cerevisiae
tattggcgaatctctttaccccatt

SEQ ID NO: 57825 - DNA, 25 bp, S. cerevisiae
tttgcggaacccatcgaatttcact

SEQ ID NO: 57826 - DNA, 25 bp, S. cerevisiae
ttgggtaataccacgccagattcac

SEQ ID NO: 57827 - DNA, 25 bp, S. cerevisiae
tatcgatgacagcaccattgactcc

SEQ ID NO: 57828 - DNA, 25 bp, S. cerevisiae
tacgctgacgctgtgtacggcaagt

SEQ ID NO: 57829 - DNA, 25 bp, S. cerevisiae
tagcactgaaacctactgaccctaa

SEQ ID NO: 57830 - DNA, 25 bp, S. cerevisiae
tacgccttggtatatcattggtgtt

SEQ ID NO: 57831 - DNA, 25 bp, S. cerevisiae
tacctcttgggttgtgtttgctttt

SEQ ID NO: 57832 - DNA, 25 bp, S. cerevisiae
tagcttgggctgttgtcgatttacc

SEQ ID NO: 57833 - DNA, 25 bp, S. cerevisiae
tagcgtccagctatcgaattctaac

SEQ ID NO: 57834 - DNA, 25 bp, S. cerevisiae
tagcgaatcatctttccgagtggat

SEQ ID NO: 57835 - DNA, 25 bp, S. cerevisiae
tagcatattctccatggcacaggca

SEQ ID NO: 57836 - DNA, 25 bp, S. cerevisiae
tagatcacatgcaaactacctggcc

SEQ ID NO: 57837 - DNA, 25 bp, S. cerevisiae
tagacaagccagtccccatgattag

SEQ ID NO: 57838 - DNA, 25 bp, S. cerevisiae
tagacggcggtctaccaattatatg

SEQ ID NO: 57839 - DNA, 25 bp, S. cerevisiae
tatcaccagcggttaccaagtattt

SEQ ID NO: 57840 - DNA, 25 bp, S. cerevisiae
tataccatctctctcacaaagtttc

SEQ ID NO: 57841 - DNA, 25 bp, S. cerevisiae
tagccttgaaggtcgaagatttctt

SEQ ID NO: 57842 - DNA, 25 bp, S. cerevisiae
taccagtgggttggtttctaaagca

SEQ ID NO: 57843 - DNA, 25 bp, S. cerevisiae
taccagtgggtgatgcttttctaga

SEQ ID NO: 57844 - DNA, 25 bp, S. cerevisiae
tagacacgggtgttgcgttttgcaa

SEQ ID NO: 57845 - DNA, 25 bp, S. cerevisiae
tagaacagggtgtcggtcataccga

SEQ ID NO: 57846 - DNA, 25 bp, S. cerevisiae
tagagtaggcggttcttcactggga

SEQ ID NO: 57847 - DNA, 25 bp, S. cerevisiae
tataggatggtgctctcccagcgag

SEQ ID NO: 57848 - DNA, 25 bp, S. cerevisiae
tagacctgatcggactgaacaaaga

SEQ ID NO: 57849 - DNA, 25 bp, S. cerevisiae
tagtgtcggccccataaaaagaaag

SEQ ID NO: 57850 - DNA, 25 bp, S. cerevisiae
tattccacctccatacgacaaaaag

SEQ ID NO: 57851 - DNA, 25 bp, S. cerevisiae
tatcggcctctatttataaaaaacg

SEQ ID NO: 57852 - DNA, 25 bp, S. cerevisiae
tagtgtttctacattcaacctcccg

SEQ ID NO: 57853 - DNA, 25 bp, S. cerevisiae
taggtgttacgtattcgtctcccac

SEQ ID NO: 57854 - DNA, 25 bp, S. cerevisiae
tagcggtcggtttcatcttttctgt

SEQ ID NO: 57855 - DNA, 25 bp, S. cerevisiae
taggtgtcgtgaagtactttcgctt

SEQ ID NO: 57856 - DNA, 25 bp, S. cerevisiae
taccaatgtgtatcctttatcccct

SEQ ID NO: 57857 - DNA, 25 bp, S. cerevisiae
tagacgaatgtccttgcttccaaga

SEQ ID NO: 57858 - DNA, 25 bp, S. cerevisiae
tacccattgattctgccattacaca

SEQ ID NO: 57859 - DNA, 25 bp, S. cerevisiae
tacccataaattccatgattatcta

SEQ ID NO: 57860 - DNA, 25 bp, S. cerevisiae
tagactcaaattcctctgcgtcatc

SEQ ID NO: 57861 - DNA, 25 bp, S. cerevisiae
tagcgtcatcgttcacagacttgtt

SEQ ID NO: 57862 - DNA, 25 bp, S. cerevisiae
tagcgagcagctaagcgaacactgt

SEQ ID NO: 57863 - DNA, 25 bp, S. cerevisiae
tatcgacagatttgcgacagtctct

SEQ ID NO: 57864 - DNA, 25 bp, S. cerevisiae
tacctccaggccgtggtgatggcga

SEQ ID NO: 57865 - DNA, 25 bp, S. cerevisiae
taccaccgctgctattgtaagctca

SEQ ID NO: 57866 - DNA, 25 bp, S. cerevisiae
tagaccatgtcttcacgtactgtgc

SEQ ID NO: 57867 - DNA, 25 bp, S. cerevisiae
tagcgatgtcaaggccggattactc

SEQ ID NO: 57868 - DNA, 25 bp, S. cerevisiae
tagtttcatcaagcatcagttacac

SEQ ID NO: 57869 - DNA, 25 bp, S. cerevisiae
tagcggaaacggtaccattcatgat

SEQ ID NO: 57870 - DNA, 25 bp, S. cerevisiae
tataggttcccataggcggtctcaa

SEQ ID NO: 57871 - DNA, 25 bp, S. cerevisiae
tagagacttcaaatgggtttcacca

SEQ ID NO: 57872 - DNA, 25 bp, S. cerevisiae
tagaaggctcacagggtctgatccc

SEQ ID NO: 57873 - DNA, 25 bp, S. cerevisiae
tatgcgagactgacttgggtggaca

SEQ ID NO: 57874 - DNA, 25 bp, S. cerevisiae
tagagatactacgtggtttgaccaa

SEQ ID NO: 57875 - DNA, 25 bp, S. cerevisiae
taggtctagatgttcacgatgtgcc

SEQ ID NO: 57876 - DNA, 25 bp, S. cerevisiae
tagagagcgcgtaagcacagtggac

SEQ ID NO: 57877 - DNA, 25 bp, S. cerevisiae
tagaagagcactccacacggtcatg

SEQ ID NO: 57878 - DNA, 25 bp, S. cerevisiae
tagaagaacatgctctccggcgggt

SEQ ID NO: 57879 - DNA, 25 bp, S. cerevisiae
tagcaatgtatcccatcacctatga

SEQ ID NO: 57880 - DNA, 25 bp, S. cerevisiae
taccatgtttactactcttgctgaa

SEQ ID NO: 57881 - DNA, 25 bp, S. cerevisiae
tagcgccgattcaaattattccatt

SEQ ID NO: 57882 - DNA, 25 bp, S. cerevisiae
taccatcctctctaaatgcatctac

SEQ ID NO: 57883 - DNA, 25 bp, S. cerevisiae
taccaatcccttctagataccgtag

SEQ ID NO: 57884 - DNA, 25 bp, S. cerevisiae
tattcgtcggttttgttacatctta

SEQ ID NO: 57885 - DNA, 25 bp, S. cerevisiae
taccgtatggttaatttatctcttg

SEQ ID NO: 57886 - DNA, 25 bp, S. cerevisiae
taccagtatctgtttatcgatgact

SEQ ID NO: 57887 - DNA, 25 bp, S. cerevisiae
tagccgttgtgttcattggttgcca

SEQ ID NO: 57888 - DNA, 25 bp, S. cerevisiae
tagctctgtcgggattttgttccat

SEQ ID NO: 57889 - DNA, 25 bp, S. cerevisiae
tagctgcggccctatttttaactat

SEQ ID NO: 57890 - DNA, 25 bp, S. cerevisiae
tagttgtccccacttttaacgatct

SEQ ID NO: 57891 - DNA, 25 bp, S. cerevisiae
tagaggtcccacatcttttaacgtt

SEQ ID NO: 57892 - DNA, 25 bp, S. cerevisiae
tagtcagtcccgagttactttcgac

SEQ ID NO: 57893 - DNA, 25 bp, S. cerevisiae
tagtgattccggtagttactataca

SEQ ID NO: 57894 - DNA, 25 bp, S. cerevisiae
tattttccggaactgataggtactt

SEQ ID NO: 57895 - DNA, 25 bp, S. cerevisiae
tagaagcctatataccagcgtggtt

SEQ ID NO: 57896 - DNA, 25 bp, S. cerevisiae
tagatatcctggtctgacaccgggt

SEQ ID NO: 57897 - DNA, 25 bp, S. cerevisiae
tagagttggtcgtacagcaagggcc

SEQ ID NO: 57898 - DNA, 25 bp, S. cerevisiae
tagtttccctgattccaagggcggc

SEQ ID NO: 57899 - DNA, 25 bp, S. cerevisiae
tagctcacatccgatcactttgaaa

SEQ ID NO: 57900 - DNA, 25 bp, S. cerevisiae
tagccaaccttccagatctatacaa

SEQ ID NO: 57901 - DNA, 25 bp, S. cerevisiae
tagcgaaaccgccatgttgattcaa

SEQ ID NO: 57902 - DNA, 25 bp, S. cerevisiae
tagggatgacctctgcgatgacaca

SEQ ID NO: 57903 - DNA, 25 bp, S. cerevisiae
tagcggttcctcacaagatcacaaa

SEQ ID NO: 57904 - DNA, 25 bp, S. cerevisiae
tagaggtatcaaagccaagaaggca

SEQ ID NO: 57905 - DNA, 25 bp, S. cerevisiae
tagtgagcccgttccaattgagtgg

SEQ ID NO: 57906 - DNA, 25 bp, S. cerevisiae
tagatacggcagttccacattggac

SEQ ID NO: 57907 - DNA, 25 bp, S. cerevisiae
tatgcatgaccagggtcccgtgaac

SEQ ID NO: 57908 - DNA, 25 bp, S. cerevisiae
tagcagaccgcaataccagaagaac

SEQ ID NO: 57909 - DNA, 25 bp, S. cerevisiae
tagaacagtcatgaacagaaacaag

SEQ ID NO: 57910 - DNA, 25 bp, S. cerevisiae
tagccaagtcaggtatcgaattcaa

SEQ ID NO: 57911 - DNA, 25 bp, S. cerevisiae
tagccacgatgggtacagaaacttc

SEQ ID NO: 57912 - DNA, 25 bp, S. cerevisiae
tatcgccaaggccaccaaggaattc

SEQ ID NO: 57913 - DNA, 25 bp, S. cerevisiae
tagacgcttatcacaaggcggcaga

SEQ ID NO: 57914 - DNA, 25 bp, S. cerevisiae
tagactggcctgcagtgctcacggt

SEQ ID NO: 57915 - DNA, 25 bp, S. cerevisiae
tagaccgatcatcagttccctgtat

SEQ ID NO: 57916 - DNA, 25 bp, S. cerevisiae
tagaaaactacgctcactctttgaa

SEQ ID NO: 57917 - DNA, 25 bp, S. cerevisiae
tagaaaactagcttccccttcaaat

SEQ ID NO: 57918 - DNA, 25 bp, S. cerevisiae
tagtaaggccggtcaagtttcaaat

SEQ ID NO: 57919 - DNA, 25 bp, S. cerevisiae
tagtacgtgggatttagcttccaaa

SEQ ID NO: 57920 - DNA, 25 bp, S. cerevisiae
tagtacctttttaacttcctcaatg

SEQ ID NO: 57921 - DNA, 25 bp, S. cerevisiae
taccactttgtatacgacgctgtct

SEQ ID NO: 57922 - DNA, 25 bp, S. cerevisiae
tagcttctaggttcgatgaaatcgt

SEQ ID NO: 57923 - DNA, 25 bp, S. cerevisiae
tagcttccgctgcatacataaacga

SEQ ID NO: 57924 - DNA, 25 bp, S. cerevisiae
tagctaccgctgtgatcttgcaagc

SEQ ID NO: 57925 - DNA, 25 bp, S. cerevisiae
taccagcaaagtcatctcaccaatt

SEQ ID NO: 57926 - DNA, 25 bp, S. cerevisiae
taccacagcaactcctattcaattt

SEQ ID NO: 57927 - DNA, 25 bp, S. cerevisiae
taccaactgccttcctaatgcagaa

SEQ ID NO: 57928 - DNA, 25 bp, S. cerevisiae
tagacgacacggacgctgacacaga

SEQ ID NO: 57929 - DNA, 25 bp, S. cerevisiae
tagaccacctcctttacagacaaaa

SEQ ID NO: 57930 - DNA, 25 bp, S. cerevisiae
tagactcggatcaaagtaccccata

SEQ ID NO: 57931 - DNA, 25 bp, S. cerevisiae
tagtggctccgaagttactcaagtg

SEQ ID NO: 57932 - DNA, 25 bp, S. cerevisiae
tagactccgcgaagttactaaccat

SEQ ID NO: 57933 - DNA, 25 bp, S. cerevisiae
tagaccaaggtttcaactattccgg

SEQ ID NO: 57934 - DNA, 25 bp, S. cerevisiae
tacctccatccctacagaagattga

SEQ ID NO: 57935 - DNA, 25 bp, S. cerevisiae
taccaccatctctccgaagaagaag

SEQ ID NO: 57936 - DNA, 25 bp, S. cerevisiae
tagagcggtcactcctacaggaaaa

SEQ ID NO: 57937 - DNA, 25 bp, S. cerevisiae
ttgacgtttcctctccaactgaaaa

SEQ ID NO: 57938 - DNA, 25 bp, S. cerevisiae
tagacgtttcctccgacagaagaaa

SEQ ID NO: 57939 - DNA, 25 bp, S. cerevisiae
tagacgttccgcgttgcctggagtt

SEQ ID NO: 57940 - DNA, 25 bp, S. cerevisiae
tagcctggactgttactgtcacatc

SEQ ID NO: 57941 - DNA, 25 bp, S. cerevisiae
tagactgcgaaaaacctcactctca

SEQ ID NO: 57942 - DNA, 25 bp, S. cerevisiae
tagagctgcaaagtcaacccaccga

SEQ ID NO: 57943 - DNA, 25 bp, S. cerevisiae
tagatctgcgactctttcaaacgat

SEQ ID NO: 57944 - DNA, 25 bp, S. cerevisiae
tagagtggactccttcaccaatgcg

SEQ ID NO: 57945 - DNA, 25 bp, S. cerevisiae
tatgggtacaccttcttcaaacggg

SEQ ID NO: 57946 - DNA, 25 bp, S. cerevisiae
tatgggtacaagaactattaacgaa

SEQ ID NO: 57947 - DNA, 25 bp, S. cerevisiae
tatggcgccaaaaccggtaaggata

SEQ ID NO: 57948 - DNA, 25 bp, S. cerevisiae
tagcgctccaccaccaggatatgaa

SEQ ID NO: 57949 - DNA, 25 bp, S. cerevisiae
tagcgccaacgaacccgaagaggat

SEQ ID NO: 57950 - DNA, 25 bp, S. cerevisiae
tagaaacaccttttccatcggttgc

SEQ ID NO: 57951 - DNA, 25 bp, S. cerevisiae
tagaaataccttcttccggtcacaa

SEQ ID NO: 57952 - DNA, 25 bp, S. cerevisiae
tagtttacgcttctgttggtgtcac

SEQ ID NO: 57953 - DNA, 25 bp, S. cerevisiae
tagatttgacattcggtagttcctt

SEQ ID NO: 57954 - DNA, 25 bp, S. cerevisiae
tatgagccgcaacgctagtatttcc

SEQ ID NO: 57955 - DNA, 25 bp, S. cerevisiae
tagcacagtcaccaagtctgctgct

SEQ ID NO: 57956 - DNA, 25 bp, S. cerevisiae
taccagtgccattagattgtcatcg

SEQ ID NO: 57957 - DNA, 25 bp, S. cerevisiae
tagacgcatccttagatcagccaca

SEQ ID NO: 57958 - DNA, 25 bp, S. cerevisiae
tatgacgttgtacctgaccttatga

SEQ ID NO: 57959 - DNA, 25 bp, S. cerevisiae
tagagcacggatgggaggccttata

SEQ ID NO: 57960 - DNA, 25 bp, S. cerevisiae
tagatgccgctcgtggcggtgtaaa

SEQ ID NO: 57961 - DNA, 25 bp, S. cerevisiae
tagacttcaaatcgcggtgtaaaaa

SEQ ID NO: 57962 - DNA, 25 bp, S. cerevisiae
tagaacatcgcagtcacaatctctc

SEQ ID NO: 57963 - DNA, 25 bp, S. cerevisiae
tagtgaatctgcatccaatatcccc

SEQ ID NO: 57964 - DNA, 25 bp, S. cerevisiae
tagtcaatcatgtggcgttcagccc

SEQ ID NO: 57965 - DNA, 25 bp, S. cerevisiae
tagtagttggtgtcggtggcacttc

SEQ ID NO: 57966 - DNA, 25 bp, S. cerevisiae
tagaggcttaagtaggtccagttca

SEQ ID NO: 57967 - DNA, 25 bp, S. cerevisiae
tatgacgttaactcctccgttgaag

SEQ ID NO: 57968 - DNA, 25 bp, S. cerevisiae
tagagatcaacgctttcccagactt

SEQ ID NO: 57969 - DNA, 25 bp, S. cerevisiae
tagaaaccctcaatccagtagccag

SEQ ID NO: 57970 - DNA, 25 bp, S. cerevisiae
tagcgtcttctaaggcagtcacaag

SEQ ID NO: 57971 - DNA, 25 bp, S. cerevisiae
tagccagtgtctttggtgctgcaga

SEQ ID NO: 57972 - DNA, 25 bp, S. cerevisiae
tagccattgctctttgtatcttgtt

SEQ ID NO: 57973 - DNA, 25 bp, S. cerevisiae
tagccttcatcgacttgaactgtga

SEQ ID NO: 57974 - DNA, 25 bp, S. cerevisiae
taccattcatcgagtccagtgctaa

SEQ ID NO: 57975 - DNA, 25 bp, S. cerevisiae
tacctaccgggtggagtcacaattt

SEQ ID NO: 57976 - DNA, 25 bp, S. cerevisiae
taccttcccggattagccacaaatt

SEQ ID NO: 57977 - DNA, 25 bp, S. cerevisiae
taccttcgcctggtttgaccaaaga

SEQ ID NO: 57978 - DNA, 25 bp, S. cerevisiae
taccattcccattttctacgcaaga

SEQ ID NO: 57979 - DNA, 25 bp, S. cerevisiae
taccaagtctgcatttcaacgcacg

SEQ ID NO: 57980 - DNA, 25 bp, S. cerevisiae
tagagcaagattcccacttgggcgc

SEQ ID NO: 57981 - DNA, 25 bp, S. cerevisiae
taccaattggtgcttatctgtccga

SEQ ID NO: 57982 - DNA, 25 bp, S. cerevisiae
taccatgaatgcacgtgtcgctgtc

SEQ ID NO: 57983 - DNA, 25 bp, S. cerevisiae
taccatacagaagagctagcgtcca

SEQ ID NO: 57984 - DNA, 25 bp, S. cerevisiae
tagatcattaaaagccttaaccgga

SEQ ID NO: 57985 - DNA, 25 bp, S. cerevisiae
tagctcttctaaatgctctaccggc

SEQ ID NO: 57986 - DNA, 25 bp, S. cerevisiae
tagcagctcttcctcggattcagat

SEQ ID NO: 57987 - DNA, 25 bp, S. cerevisiae
tagcggcattgtcttcactgtcaaa

SEQ ID NO: 57988 - DNA, 25 bp, S. cerevisiae
tagctggcatttccgttgtgtaaga

SEQ ID NO: 57989 - DNA, 25 bp, S. cerevisiae
tagccgccaggataaaatgactcaa

SEQ ID NO: 57990 - DNA, 25 bp, S. cerevisiae
ttcccaagtggtgaaccctcgacaa

SEQ ID NO: 57991 - DNA, 25 bp, S. cerevisiae
ttcccacttttttatccgttgaatg

SEQ ID NO: 57992 - DNA, 25 bp, S. cerevisiae
tttccgtttagttcccgaatatgat

SEQ ID NO: 57993 - DNA, 25 bp, S. cerevisiae
tagctaccgtcatgtaccagcgaag

SEQ ID NO: 57994 - DNA, 25 bp, S. cerevisiae
tagcctttatcaacaatcctcatca

SEQ ID NO: 57995 - DNA, 25 bp, S. cerevisiae
taccaaacttactctactggcattg

SEQ ID NO: 57996 - DNA, 25 bp, S. cerevisiae
taccaccattgttccctatcgagaa

SEQ ID NO: 57997 - DNA, 25 bp, S. cerevisiae
tagcgcacgttgactggactacgaa

SEQ ID NO: 57998 - DNA, 25 bp, S. cerevisiae
tagcgccagtttctgacacactgta

SEQ ID NO: 57999 - DNA, 25 bp, S. cerevisiae
tagagctcgatggacctgatcgcac

SEQ ID NO: 58000 - DNA, 25 bp, S. cerevisiae
tatgcatgccggtcacgctgaagaa

SEQ ID NO: 58001 - DNA, 25 bp, S. cerevisiae
tagatgccaactcttcgacaactgc

SEQ ID NO: 58002 - DNA, 25 bp, S. cerevisiae
tagacgatggctcttcggaaatctt

SEQ ID NO: 58003 - DNA, 25 bp, S. cerevisiae
tagacatgtgcactgccttgcagaa

SEQ ID NO: 58004 - DNA, 25 bp, S. cerevisiae
tagcaagcattcctctgtgacagat

SEQ ID NO: 58005 - DNA, 25 bp, S. cerevisiae
tagcttctgggcgtgtttgtttaat

SEQ ID NO: 58006 - DNA, 25 bp, S. cerevisiae
tagtacacaataacgccgacgaaaa

SEQ ID NO: 58007 - DNA, 25 bp, S. cerevisiae
tagatttatatggtcccggtggtaa

SEQ ID NO: 58008 - DNA, 25 bp, S. cerevisiae
tagctgtattatcatctgccctgtt

SEQ ID NO: 58009 - DNA, 25 bp, S. cerevisiae
tagtgatgtaacagcgcccttgtgg

SEQ ID NO: 58010 - DNA, 25 bp, S. cerevisiae
tagaggattggtcgcgcactaaatt

SEQ ID NO: 58011 - DNA, 25 bp, S. cerevisiae
tagagtgcttgccatgatgccacat

SEQ ID NO: 58012 - DNA, 25 bp, S. cerevisiae
tagaatgctctccataccgctattg

SEQ ID NO: 58013 - DNA, 25 bp, S. cerevisiae
tagctatccttctcacgttgttgaa

SEQ ID NO: 58014 - DNA, 25 bp, S. cerevisiae
tagcattcttggcttcagtggcatg

SEQ ID NO: 58015 - DNA, 25 bp, S. cerevisiae
tagcatattctgtgttcatggtgga

SEQ ID NO: 58016 - DNA, 25 bp, S. cerevisiae
tatgcacggctgttgctatcggtat

SEQ ID NO: 58017 - DNA, 25 bp, S. cerevisiae
taccagagctgctgcttccgaataa

SEQ ID NO: 58018 - DNA, 25 bp, S. cerevisiae
tatctacactgctgttccaaactaa

SEQ ID NO: 58019 - DNA, 25 bp, S. cerevisiae
tatgctacaccccttcataacaaag

SEQ ID NO: 58020 - DNA, 25 bp, S. cerevisiae
tagctctttgccattgaccgttgtt

SEQ ID NO: 58021 - DNA, 25 bp, S. cerevisiae
tagcgacattatgcttagcccattt

SEQ ID NO: 58022 - DNA, 25 bp, S. cerevisiae
tagcgacgatattaccatgaccaaa

SEQ ID NO: 58023 - DNA, 25 bp, S. cerevisiae
tagagacacatatcaccgacaacca

SEQ ID NO: 58024 - DNA, 25 bp, S. cerevisiae
tagaactctatctgactacaacatc

SEQ ID NO: 58025 - DNA, 25 bp, S. cerevisiae
tagaaccttccgtatatgctcagtc

SEQ ID NO: 58026 - DNA, 25 bp, S. cerevisiae
tagcgcctgcatactacgacttaag

SEQ ID NO: 58027 - DNA, 25 bp, S. cerevisiae
tagagtggctataccccagggatga

SEQ ID NO: 58028 - DNA, 25 bp, S. cerevisiae
tagagggtaacgtcttggatgtcaa

SEQ ID NO: 58029 - DNA, 25 bp, S. cerevisiae
tatgagggccaaccacaggatattt

SEQ ID NO: 58030 - DNA, 25 bp, S. cerevisiae
taggctggcgcattacgaaaatttt

SEQ ID NO: 58031 - DNA, 25 bp, S. cerevisiae
tagcatagtttcttcggccccaatt

SEQ ID NO: 58032 - DNA, 25 bp, S. cerevisiae
tagattttgtcgtgactgcaacaat

SEQ ID NO: 58033 - DNA, 25 bp, S. cerevisiae
tagaattgtgtagaattgcagattc

SEQ ID NO: 58034 - DNA, 25 bp, S. cerevisiae
tagccctttgaagatattactctgg

SEQ ID NO: 58035 - DNA, 25 bp, S. cerevisiae
taggatcggatgcttccacgctaaa

SEQ ID NO: 58036 - DNA, 25 bp, S. cerevisiae
tagctccagcggcagtttgcagcaa

SEQ ID NO: 58037 - DNA, 25 bp, S. cerevisiae
tagcaaccctcacgcttagcgaaga

SEQ ID NO: 58038 - DNA, 25 bp, S. cerevisiae
tagcaccttgttccctacgtttgta

SEQ ID NO: 58039 - DNA, 25 bp, S. cerevisiae
tagtggcttttctcaaggttcgata

SEQ ID NO: 58040 - DNA, 25 bp, S. cerevisiae
tagaagcctttctccaggctgcaaa

SEQ ID NO: 58041 - DNA, 25 bp, S. cerevisiae
tagaagactttcaatcagacccaga

SEQ ID NO: 58042 - DNA, 25 bp, S. cerevisiae
tagagagcctttccatgttgcccga

SEQ ID NO: 58043 - DNA, 25 bp, S. cerevisiae
tagaaccttcgaagcttaccgaatt

SEQ ID NO: 58044 - DNA, 25 bp, S. cerevisiae
tatttcactccgtgttaccgaaaag

SEQ ID NO: 58045 - DNA, 25 bp, S. cerevisiae
tatcttactttatcttcagccgaaa

SEQ ID NO: 58046 - DNA, 25 bp, S. cerevisiae
tagcttccactttcacataccatat

SEQ ID NO: 58047 - DNA, 25 bp, S. cerevisiae
tagttccgctataaacacgtcacct

SEQ ID NO: 58048 - DNA, 25 bp, S. cerevisiae
tagcactgagacaagcccagattca

SEQ ID NO: 58049 - DNA, 25 bp, S. cerevisiae
tagacaagctcaagccgctgttgca

SEQ ID NO: 58050 - DNA, 25 bp, S. cerevisiae
tagacatgactaatgacggtgccat

SEQ ID NO: 58051 - DNA, 25 bp, S. cerevisiae
tagactctcctgaccgtgaagactg

SEQ ID NO: 58052 - DNA, 25 bp, S. cerevisiae
tagactacagtcacaggaaatgcat

SEQ ID NO: 58053 - DNA, 25 bp, S. cerevisiae
tagccctgcgttcatggcatcaaat

SEQ ID NO: 58054 - DNA, 25 bp, S. cerevisiae
tagcgcctgtgttggatcctcaaaa

SEQ ID NO: 58055 - DNA, 25 bp, S. cerevisiae
tagcaactcctttttggatttaaat

SEQ ID NO: 58056 - DNA, 25 bp, S. cerevisiae
tagcagccggccatttggttcaaag

SEQ ID NO: 58057 - DNA, 25 bp, S. cerevisiae
tagctcgcaggcaagtctgggtgaa

SEQ ID NO: 58058 - DNA, 25 bp, S. cerevisiae
tagcgcgtgcagtaattctgatcag

SEQ ID NO: 58059 - DNA, 25 bp, S. cerevisiae
tagctcgtcgtactgatgctccatt

SEQ ID NO: 58060 - DNA, 25 bp, S. cerevisiae
tagccttcaatggtgattctgcctt

SEQ ID NO: 58061 - DNA, 25 bp, S. cerevisiae
tagctttgtgctttgcttctctaaa

SEQ ID NO: 58062 - DNA, 25 bp, S. cerevisiae
tatgcggctttctttcaggatgact

SEQ ID NO: 58063 - DNA, 25 bp, S. cerevisiae
tatgtaccaaagagcgacgatccgt

SEQ ID NO: 58064 - DNA, 25 bp, S. cerevisiae
tagttgccgcagatagcgactacat

SEQ ID NO: 58065 - DNA, 25 bp, S. cerevisiae
tagttgccgataccacggtagataa

SEQ ID NO: 58066 - DNA, 25 bp, S. cerevisiae
tagcaagcacctttctagtaagcat

SEQ ID NO: 58067 - DNA, 25 bp, S. cerevisiae
tagccgtaagctcccaatcagatga

SEQ ID NO: 58068 - DNA, 25 bp, S. cerevisiae
tatccggagacaacgagaccttact

SEQ ID NO: 58069 - DNA, 25 bp, S. cerevisiae
tatcctcgagaaactatgtacgtca

SEQ ID NO: 58070 - DNA, 25 bp, S. cerevisiae
tagtcaactttaccttagatagctt

SEQ ID NO: 58071 - DNA, 25 bp, S. cerevisiae
tagcggctacatgacacctgaggtt

SEQ ID NO: 58072 - DNA, 25 bp, S. cerevisiae
tatgcggcataataccctcaagctc

SEQ ID NO: 58073 - DNA, 25 bp, S. cerevisiae
tagcttcaaagctccgatggctgat

SEQ ID NO: 58074 - DNA, 25 bp, S. cerevisiae
tagcttcctgtgatcatggtgttgt

SEQ ID NO: 58075 - DNA, 25 bp, S. cerevisiae
tagcagcttcaactagtcctttcag

SEQ ID NO: 58076 - DNA, 25 bp, S. cerevisiae
tagagctgctagattgtccgtttgt

SEQ ID NO: 58077 - DNA, 25 bp, S. cerevisiae
tagagctgatcgtcttgtcggtcaa

SEQ ID NO: 58078 - DNA, 25 bp, S. cerevisiae
tagcagctttgtttgtggtgctcct

SEQ ID NO: 58079 - DNA, 25 bp, S. cerevisiae
tagaatggctactctgctgttcgca

SEQ ID NO: 58080 - DNA, 25 bp, S. cerevisiae
taggtcgaacgcagaatacagccaa

SEQ ID NO: 58081 - DNA, 25 bp, S. cerevisiae
tagagaccctcgtgaatactgcatc

SEQ ID NO: 58082 - DNA, 25 bp, S. cerevisiae
tagaacccgctaccaagccagatat

SEQ ID NO: 58083 - DNA, 25 bp, S. cerevisiae
tagtgcctccgagcgatgtatttat

SEQ ID NO: 58084 - DNA, 25 bp, S. cerevisiae
tagacgctacggtcgttcaattgac

SEQ ID NO: 58085 - DNA, 25 bp, S. cerevisiae
tagaccgatcattttcccattatcc

SEQ ID NO: 58086 - DNA, 25 bp, S. cerevisiae
tagtttggtgtccacttctatgggc

SEQ ID NO: 58087 - DNA, 25 bp, S. cerevisiae
tatgcttcggtgacgtctattatga

SEQ ID NO: 58088 - DNA, 25 bp, S. cerevisiae
tagccgccgctgagtttttgatgaa

SEQ ID NO: 58089 - DNA, 25 bp, S. cerevisiae
taggcgatcctattcctgatttgag

SEQ ID NO: 58090 - DNA, 25 bp, S. cerevisiae
tagtgcagtgcagttcatgccagat

SEQ ID NO: 58091 - DNA, 25 bp, S. cerevisiae
tagcatcgtcacaactactaccgaa

SEQ ID NO: 58092 - DNA, 25 bp, S. cerevisiae
tagcatcaacctacttgtactcgat

SEQ ID NO: 58093 - DNA, 25 bp, S. cerevisiae
tagaaaggcctcatgatgcactaat

SEQ ID NO: 58094 - DNA, 25 bp, S. cerevisiae
tatcgcgggcctcagaaatattcca

SEQ ID NO: 58095 - DNA, 25 bp, S. cerevisiae
tatcgcggctgctctaggaagttca

SEQ ID NO: 58096 - DNA, 25 bp, S. cerevisiae
ttggccaagccctggaattatccat

SEQ ID NO: 58097 - DNA, 25 bp, S. cerevisiae
ttgtctcaagtacgcggaggttcct

SEQ ID NO: 58098 - DNA, 25 bp, S. cerevisiae
tagtcaccgatacggagggtctcat

SEQ ID NO: 58099 - DNA, 25 bp, S. cerevisiae
tagaacaggctgaggcggctgcctc

SEQ ID NO: 58100 - DNA, 25 bp, S. cerevisiae
tagaacagagctaagtcaccccgac

SEQ ID NO: 58101 - DNA, 25 bp, S. cerevisiae
tagaaaggctgaagcttccggtgaa

SEQ ID NO: 58102 - DNA, 25 bp, S. cerevisiae
tagatgaacgatttgcttcccgtgt

SEQ ID NO: 58103 - DNA, 25 bp, S. cerevisiae
tagattcggtggacggctcctgcga

SEQ ID NO: 58104 - DNA, 25 bp, S. cerevisiae
tagttgcggattaccagccaccgac

SEQ ID NO: 58105 - DNA, 25 bp, S. cerevisiae
tagtacggttcttggccacgacgca

SEQ ID NO: 58106 - DNA, 25 bp, S. cerevisiae
ttgacgggtactttccataacttgg

SEQ ID NO: 58107 - DNA, 25 bp, S. cerevisiae
ttgaacgttactatccaaagttgac

SEQ ID NO: 58108 - DNA, 25 bp, S. cerevisiae
tagaactgttgactattcccacggc

SEQ ID NO: 58109 - DNA, 25 bp, S. cerevisiae
tagaaaaggcactcctccaggttga

SEQ ID NO: 58110 - DNA, 25 bp, S. cerevisiae
tagatactaaggctcgcactcttgg

SEQ ID NO: 58111 - DNA, 25 bp, S. cerevisiae
ttggcatccaaatcttacttacgac

SEQ ID NO: 58112 - DNA, 25 bp, S. cerevisiae
tagacccaaattcattctcgcgatc

SEQ ID NO: 58113 - DNA, 25 bp, S. cerevisiae
tagactgccacatgggttccacgaa

SEQ ID NO: 58114 - DNA, 25 bp, S. cerevisiae
tagcgtagcactttgttgttccatg

SEQ ID NO: 58115 - DNA, 25 bp, S. cerevisiae
tatgcaactgcactactttctattc

SEQ ID NO: 58116 - DNA, 25 bp, S. cerevisiae
tagctactgctttggtggacattgt

SEQ ID NO: 58117 - DNA, 25 bp, S. cerevisiae
tagtggcgccattggtggcaacatt

SEQ ID NO: 58118 - DNA, 25 bp, S. cerevisiae
tagtatacttcatgaccttccaaga

SEQ ID NO: 58119 - DNA, 25 bp, S. cerevisiae
tagttcatcgtcagacagcgtcgaa

SEQ ID NO: 58120 - DNA, 25 bp, S. cerevisiae
tatgagtccaactgaagtaccgctg

SEQ ID NO: 58121 - DNA, 25 bp, S. cerevisiae
tagaccgtcgtttcaagagccctga

SEQ ID NO: 58122 - DNA, 25 bp, S. cerevisiae
tatgttttccggatccgggtctgat

SEQ ID NO: 58123 - DNA, 25 bp, S. cerevisiae
tatgggtcccgtttcaagcattgaa

SEQ ID NO: 58124 - DNA, 25 bp, S. cerevisiae
tagtgagttgccgtggaactggctt

SEQ ID NO: 58125 - DNA, 25 bp, S. cerevisiae
tagtgactttccaggtcttgtctga

SEQ ID NO: 58126 - DNA, 25 bp, S. cerevisiae
taggagtcttccaggtgtggtcaga

SEQ ID NO: 58127 - DNA, 25 bp, S. cerevisiae
tagagttgccttaacatcgatccca

SEQ ID NO: 58128 - DNA, 25 bp, S. cerevisiae
tagcaggtgccatgtcagctgggct

SEQ ID NO: 58129 - DNA, 25 bp, S. cerevisiae
tagagagtcaaagtcacgccgcttc

SEQ ID NO: 58130 - DNA, 25 bp, S. cerevisiae
tagatcgctactttgccatcggaga

SEQ ID NO: 58131 - DNA, 25 bp, S. cerevisiae
tagaattatccaaacctcatcaaag

SEQ ID NO: 58132 - DNA, 25 bp, S. cerevisiae
tagagtgctctgcaaacccacaaga

SEQ ID NO: 58133 - DNA, 25 bp, S. cerevisiae
tagcatgtgctattgataacccaga

SEQ ID NO: 58134 - DNA, 25 bp, S. cerevisiae
tagcatgccgttcatgtccatatga

SEQ ID NO: 58135 - DNA, 25 bp, S. cerevisiae
tagatatttctagtccttgtgcaag

SEQ ID NO: 58136 - DNA, 25 bp, S. cerevisiae
tagaaatggccactactttccagcc

SEQ ID NO: 58137 - DNA, 25 bp, S. cerevisiae
tagcatacgtgcgagaggtctccac

SEQ ID NO: 58138 - DNA, 25 bp, S. cerevisiae
tagaaggtctgattggatcctccct

SEQ ID NO: 58139 - DNA, 25 bp, S. cerevisiae
tagaagtcatcctaggcaaccccat

SEQ ID NO: 58140 - DNA, 25 bp, S. cerevisiae
tagacagtactcttcgtacaccttc

SEQ ID NO: 58141 - DNA, 25 bp, S. cerevisiae
tagaatgcccctagatcatgaatat

SEQ ID NO: 58142 - DNA, 25 bp, S. cerevisiae
tagagtcacctacgttcatcattac

SEQ ID NO: 58143 - DNA, 25 bp, S. cerevisiae
tagagtctcccacaactataaccaa

SEQ ID NO: 58144 - DNA, 25 bp, S. cerevisiae
taggttcaacgatcctgaaggccaa

SEQ ID NO: 58145 - DNA, 25 bp, S. cerevisiae
taggttctcaccttcaggaattaaa

SEQ ID NO: 58146 - DNA, 25 bp, S. cerevisiae
taggctctcccgcaggatgaattac

SEQ ID NO: 58147 - DNA, 25 bp, S. cerevisiae
tagctcttaccatgtttcagcgttg

SEQ ID NO: 58148 - DNA, 25 bp, S. cerevisiae
tagttctttcagaggaggccgtggt

SEQ ID NO: 58149 - DNA, 25 bp, S. cerevisiae
tagaatcgctctacacttttataga

SEQ ID NO: 58150 - DNA, 25 bp, S. cerevisiae
tagaaggatcgttgctttggaagaa

SEQ ID NO: 58151 - DNA, 25 bp, S. cerevisiae
tagaagtccatatccaaccgaaaat

SEQ ID NO: 58152 - DNA, 25 bp, S. cerevisiae
tagaacccatataccaagcaacaag

SEQ ID NO: 58153 - DNA, 25 bp, S. cerevisiae
tagaacatcctatcaacagccacat

SEQ ID NO: 58154 - DNA, 25 bp, S. cerevisiae
tagaaatcctggtccataccactca

SEQ ID NO: 58155 - DNA, 25 bp, S. cerevisiae
tagagagttcatgagccttccacaa

SEQ ID NO: 58156 - DNA, 25 bp, S. cerevisiae
tagcatgtccatatgtccatctggc

SEQ ID NO: 58157 - DNA, 25 bp, S. cerevisiae
tagattgctatgagctcgctggtga

SEQ ID NO: 58158 - DNA, 25 bp, S. cerevisiae
tagatgctaatgacatgcccggaga

SEQ ID NO: 58159 - DNA, 25 bp, S. cerevisiae
tagagccagagacgatgccgacgaa

SEQ ID NO: 58160 - DNA, 25 bp, S. cerevisiae
tagaacctgttgtcacttcctatgt

SEQ ID NO: 58161 - DNA, 25 bp, S. cerevisiae
tagaatcgactctgtctctcaacta

SEQ ID NO: 58162 - DNA, 25 bp, S. cerevisiae
tagaagcgaatccactgtccaactg

SEQ ID NO: 58163 - DNA, 25 bp, S. cerevisiae
tatgcaaaactccattgtacacagg

SEQ ID NO: 58164 - DNA, 25 bp, S. cerevisiae
tagagaacctcgcattacagctgtg

SEQ ID NO: 58165 - DNA, 25 bp, S. cerevisiae
tagcaatactggtgtcggctttgac

SEQ ID NO: 58166 - DNA, 25 bp, S. cerevisiae
tagatatacatattcctcaggtttg

SEQ ID NO: 58167 - DNA, 25 bp, S. cerevisiae
tagtttgggctcatcacagccatca

SEQ ID NO: 58168 - DNA, 25 bp, S. cerevisiae
tagaatttggctactacgcacctct

SEQ ID NO: 58169 - DNA, 25 bp, S. cerevisiae
tagtttaactactaccacctctact

SEQ ID NO: 58170 - DNA, 25 bp, S. cerevisiae
tagttttgccaataccacagctcca

SEQ ID NO: 58171 - DNA, 25 bp, S. cerevisiae
ttctgtttcaaatgagtcaacggca

SEQ ID NO: 58172 - DNA, 25 bp, S. cerevisiae
tatcttcccaaataaccagtgctgc

SEQ ID NO: 58173 - DNA, 25 bp, S. cerevisiae
tattaggcccaatatcggcagtcat

SEQ ID NO: 58174 - DNA, 25 bp, S. cerevisiae
tagggtcggcgatatctggattctc

SEQ ID NO: 58175 - DNA, 25 bp, S. cerevisiae
ttacgtgcttatttccaaccttttg

SEQ ID NO: 58176 - DNA, 25 bp, S. cerevisiae
tatgtgggaacatcgctgcaggcgc

SEQ ID NO: 58177 - DNA, 25 bp, S. cerevisiae
tatcgcaacagatgtcgtctatgga

SEQ ID NO: 58178 - DNA, 25 bp, S. cerevisiae
tatgcacatacatcggccttctgat

SEQ ID NO: 58179 - DNA, 25 bp, S. cerevisiae
tagttgtgttgtttctagcggtcgg

SEQ ID NO: 58180 - DNA, 25 bp, S. cerevisiae
tagtctctacttttgcatacgtcgg

SEQ ID NO: 58181 - DNA, 25 bp, S. cerevisiae
tagatccagcacttttgagacccgg

SEQ ID NO: 58182 - DNA, 25 bp, S. cerevisiae
tagttcaaaatcttcggagctggga

SEQ ID NO: 58183 - DNA, 25 bp, S. cerevisiae
tagtctacccatcgtgggaggtcca

SEQ ID NO: 58184 - DNA, 25 bp, S. cerevisiae
taggtcaatttctcgttttccaaat

SEQ ID NO: 58185 - DNA, 25 bp, S. cerevisiae
tagagaaacctctcgttgttcctgt

SEQ ID NO: 58186 - DNA, 25 bp, S. cerevisiae
ttgggattcgctcaatgaactaaaa

SEQ ID NO: 58187 - DNA, 25 bp, S. cerevisiae
tagagggttatttctctcctagaaa

SEQ ID NO: 58188 - DNA, 25 bp, S. cerevisiae
tagggttttcttcccaagatggtga

SEQ ID NO: 58189 - DNA, 25 bp, S. cerevisiae
taggcgaatttcacccactttgtaa

SEQ ID NO: 58190 - DNA, 25 bp, S. cerevisiae
tagagtgtttgtctgtctggctatc

SEQ ID NO: 58191 - DNA, 25 bp, S. cerevisiae
tagtgtgggatcctttttcggcaac

SEQ ID NO: 58192 - DNA, 25 bp, S. cerevisiae
taggtgtaactgtcttcttgccaat

SEQ ID NO: 58193 - DNA, 25 bp, S. cerevisiae
tagcaggaatactcttccccatgat

SEQ ID NO: 58194 - DNA, 25 bp, S. cerevisiae
tagagtctcgttccactatcaagtc

SEQ ID NO: 58195 - DNA, 25 bp, S. cerevisiae
tagagcatctagacaccgctatcaa

SEQ ID NO: 58196 - DNA, 25 bp, S. cerevisiae
tattgcattatgtacgtcttcgaac

SEQ ID NO: 58197 - DNA, 25 bp, S. cerevisiae
tagggtctgcctccagcaagagtaa

SEQ ID NO: 58198 - DNA, 25 bp, S. cerevisiae
tagaacctggttttgcgaatgaaca

SEQ ID NO: 58199 - DNA, 25 bp, S. cerevisiae
tagatgactatgctttcgtgagaat

SEQ ID NO: 58200 - DNA, 25 bp, S. cerevisiae
tagtgactaccttggtgctggtggt

SEQ ID NO: 58201 - DNA, 25 bp, S. cerevisiae
tagatttaatcctatacgtctctgg

SEQ ID NO: 58202 - DNA, 25 bp, S. cerevisiae
tagcatgaacaatgtttctccccgg

SEQ ID NO: 58203 - DNA, 25 bp, S. cerevisiae
tagcaaccaaagtcctatctccgga

SEQ ID NO: 58204 - DNA, 25 bp, S. cerevisiae
tatactatggtaaagtcggtgccga

SEQ ID NO: 58205 - DNA, 25 bp, S. cerevisiae
tagagatttgtctggactttcacaa

SEQ ID NO: 58206 - DNA, 25 bp, S. cerevisiae
taggaaacttccgtggcatctttgc

SEQ ID NO: 58207 - DNA, 25 bp, S. cerevisiae
taggtcaagctttactggatcaatt

SEQ ID NO: 58208 - DNA, 25 bp, S. cerevisiae
tatggtgtaaccttccctattctac

SEQ ID NO: 58209 - DNA, 25 bp, S. cerevisiae
tatggtaacgaactctccctttcaa

SEQ ID NO: 58210 - DNA, 25 bp, S. cerevisiae
taggtcccgtcaacttccaggtaat

SEQ ID NO: 58211 - DNA, 25 bp, S. cerevisiae
tagagccctccgttagactggaagt

SEQ ID NO: 58212 - DNA, 25 bp, S. cerevisiae
tagagctccctccagatagcagtga

SEQ ID NO: 58213 - DNA, 25 bp, S. cerevisiae
tagagatacctccaacagcgcgttg

SEQ ID NO: 58214 - DNA, 25 bp, S. cerevisiae
tagagaacccaatccgtttgttcca

SEQ ID NO: 58215 - DNA, 25 bp, S. cerevisiae
tagagtaccacaaagccgatcattt

SEQ ID NO: 58216 - DNA, 25 bp, S. cerevisiae
tagagccaccaaatacgcgaagttt

SEQ ID NO: 58217 - DNA, 25 bp, S. cerevisiae
tagagctgctacttgcggcggacta

SEQ ID NO: 58218 - DNA, 25 bp, S. cerevisiae
tagatgctggatcagtgagcgcctt

SEQ ID NO: 58219 - DNA, 25 bp, S. cerevisiae
tagtgcagcaggcaaggtcctctat

SEQ ID NO: 58220 - DNA, 25 bp, S. cerevisiae
tagagcaagctgacaaggacgctgt

SEQ ID NO: 58221 - DNA, 25 bp, S. cerevisiae
tatctaagctggtggaagtggttcc

SEQ ID NO: 58222 - DNA, 25 bp, S. cerevisiae
tatcggtttgccaagtacgccttaa

SEQ ID NO: 58223 - DNA, 25 bp, S. cerevisiae
ttaccttggttttgggagcactaca

SEQ ID NO: 58224 - DNA, 25 bp, S. cerevisiae
tatccatttacgatgagcttcacga

SEQ ID NO: 58225 - DNA, 25 bp, S. cerevisiae
tatcgaataacgatggcttccccgc

SEQ ID NO: 58226 - DNA, 25 bp, S. cerevisiae
tatcacgaatgagctcccactttta

SEQ ID NO: 58227 - DNA, 25 bp, S. cerevisiae
tatcctggagagactacatgactgt

SEQ ID NO: 58228 - DNA, 25 bp, S. cerevisiae
tagcaagctgaactccacatatggt

SEQ ID NO: 58229 - DNA, 25 bp, S. cerevisiae
tagaatgctacacacaacgtgctgt

SEQ ID NO: 58230 - DNA, 25 bp, S. cerevisiae
tagatgtctacaatgccacaccgtg

SEQ ID NO: 58231 - DNA, 25 bp, S. cerevisiae
tagaattacctccaaacctgcggtg

SEQ ID NO: 58232 - DNA, 25 bp, S. cerevisiae
taggtaacactttagcactgctggg

SEQ ID NO: 58233 - DNA, 25 bp, S. cerevisiae
tagaatgcagcggatccttgggatt

SEQ ID NO: 58234 - DNA, 25 bp, S. cerevisiae
tagttgcatgcttctttttctggtt

SEQ ID NO: 58235 - DNA, 25 bp, S. cerevisiae
tagtgaattttcattttctgtacga

SEQ ID NO: 58236 - DNA, 25 bp, S. cerevisiae
ttccactgggatttaacgacgggca

SEQ ID NO: 58237 - DNA, 25 bp, S. cerevisiae
ttctacggttttaaagtcaggcaat

SEQ ID NO: 58238 - DNA, 25 bp, S. cerevisiae
ttctgacgccttggtaacgggacga

SEQ ID NO: 58239 - DNA, 25 bp, S. cerevisiae
tatctacgccggttatgacgataga

SEQ ID NO: 58240 - DNA, 25 bp, S. cerevisiae
tattcaccgcactggcaacgacaag

SEQ ID NO: 58241 - DNA, 25 bp, S. cerevisiae
tattgccccttcagaacgacaacga

SEQ ID NO: 58242 - DNA, 25 bp, S. cerevisiae
tataacgtgtttcgccaacatacct

SEQ ID NO: 58243 - DNA, 25 bp, S. cerevisiae
tagacacagtagaagcgcaactagt

SEQ ID NO: 58244 - DNA, 25 bp, S. cerevisiae
tagaacaatctttgcgcgtccagtt

SEQ ID NO: 58245 - DNA, 25 bp, S. cerevisiae
tagagaaatttccaggctacgatct

SEQ ID NO: 58246 - DNA, 25 bp, S. cerevisiae
tatcgaattttccaccaacgttaag

SEQ ID NO: 58247 - DNA, 25 bp, S. cerevisiae
tatgggttttccacacacggtaact

SEQ ID NO: 58248 - DNA, 25 bp, S. cerevisiae
taggcgcttcttttgcagaaagttc

SEQ ID NO: 58249 - DNA, 25 bp, S. cerevisiae
tagagagtgtacctggatgcaacaa

SEQ ID NO: 58250 - DNA, 25 bp, S. cerevisiae
tagagctgtctgcatgctatccaac

SEQ ID NO: 58251 - DNA, 25 bp, S. cerevisiae
tagagctattcttttggcaacttaa

SEQ ID NO: 58252 - DNA, 25 bp, S. cerevisiae
taggtactggtttggcaccattcaa

SEQ ID NO: 58253 - DNA, 25 bp, S. cerevisiae
tagtgttgggtgtcatcggccatta

SEQ ID NO: 58254 - DNA, 25 bp, S. cerevisiae
tagtgggtccaaacatgcgtagatc

SEQ ID NO: 58255 - DNA, 25 bp, S. cerevisiae
taggtctccctacaccatggaagta

SEQ ID NO: 58256 - DNA, 25 bp, S. cerevisiae
taggttcttattccacacgcggtaa

SEQ ID NO: 58257 - DNA, 25 bp, S. cerevisiae
tagtattttcattgcctccctatta

SEQ ID NO: 58258 - DNA, 25 bp, S. cerevisiae
taggtatctggcaaactgtcttcat

SEQ ID NO: 58259 - DNA, 25 bp, S. cerevisiae
tagggttagagacctgccttcagga

SEQ ID NO: 58260 - DNA, 25 bp, S. cerevisiae
tatgggatctagtaccgctttcaac

SEQ ID NO: 58261 - DNA, 25 bp, S. cerevisiae
ttgcgtctgactttggcgttttaaa

SEQ ID NO: 58262 - DNA, 25 bp, S. cerevisiae
tatgttccaatctgaggtgtatagc

SEQ ID NO: 58263 - DNA, 25 bp, S. cerevisiae
tagataaccgctactctgtggaaag

SEQ ID NO: 58264 - DNA, 25 bp, S. cerevisiae
tagtaagtccatatttgatccaaac

SEQ ID NO: 58265 - DNA, 25 bp, S. cerevisiae
tatgcggacccaattttcccggact

SEQ ID NO: 58266 - DNA, 25 bp, S. cerevisiae
taggtgactttgatttcccggcaga

SEQ ID NO: 58267 - DNA, 25 bp, S. cerevisiae
taggtgacaacgctgttttcgctgg

SEQ ID NO: 58268 - DNA, 25 bp, S. cerevisiae
taggtatcaacctgaccgcagctga

SEQ ID NO: 58269 - DNA, 25 bp, S. cerevisiae
tagtgtaattcctgatctctccatg

SEQ ID NO: 58270 - DNA, 25 bp, S. cerevisiae
tagaggctttcaccactttgactga

SEQ ID NO: 58271 - DNA, 25 bp, S. cerevisiae
taggttcttcccaaccgatgagttg

SEQ ID NO: 58272 - DNA, 25 bp, S. cerevisiae
tagggtcttacctgccagtgatgat

SEQ ID NO: 58273 - DNA, 25 bp, S. cerevisiae
taggtgtttcgccaggattgacaat

SEQ ID NO: 58274 - DNA, 25 bp, S. cerevisiae
tagagcgtatcgtagggcttcttct

SEQ ID NO: 58275 - DNA, 25 bp, S. cerevisiae
taggagcttgttttggcagtccact

SEQ ID NO: 58276 - DNA, 25 bp, S. cerevisiae
tagtcccttttggtgctgaatctgg

SEQ ID NO: 58277 - DNA, 25 bp, S. cerevisiae
tagtcccttcttcgtgctggacgaa

SEQ ID NO: 58278 - DNA, 25 bp, S. cerevisiae
tagaggccttttgatgttagcagaa

SEQ ID NO: 58279 - DNA, 25 bp, S. cerevisiae
tatggacggtttgctttcgcaggat

SEQ ID NO: 58280 - DNA, 25 bp, S. cerevisiae
tagagtcggtgttttatccgaagat

SEQ ID NO: 58281 - DNA, 25 bp, S. cerevisiae
tagaccagggtcatttatcgccatt

SEQ ID NO: 58282 - DNA, 25 bp, S. cerevisiae
tagacttgtggtcgtttgggacaat

SEQ ID NO: 58283 - DNA, 25 bp, S. cerevisiae
taggattgggcccttctgaaaaaat

SEQ ID NO: 58284 - DNA, 25 bp, S. cerevisiae
tagaacaaggccctgtgcggacaaa

SEQ ID NO: 58285 - DNA, 25 bp, S. cerevisiae
tatggaagggccttgtacccgcact

SEQ ID NO: 58286 - DNA, 25 bp, S. cerevisiae
ttaacgaggcctttgagatcatcag

SEQ ID NO: 58287 - DNA, 25 bp, S. cerevisiae
tttacaagtggtttcgatcatcggg

SEQ ID NO: 58288 - DNA, 25 bp, S. cerevisiae
tagacaatctttcaatcgccatcgt

SEQ ID NO: 58289 - DNA, 25 bp, S. cerevisiae
tatgatccctttgcaaccaccgtaa

SEQ ID NO: 58290 - DNA, 25 bp, S. cerevisiae
tagtaggtcgtttagcttccgttgt

SEQ ID NO: 58291 - DNA, 25 bp, S. cerevisiae
tatgacggtggttactcttccagtt

SEQ ID NO: 58292 - DNA, 25 bp, S. cerevisiae
tagacggctgacaccatcaacaagt

SEQ ID NO: 58293 - DNA, 25 bp, S. cerevisiae
tagtccaccattgccatttttcaat

SEQ ID NO: 58294 - DNA, 25 bp, S. cerevisiae
tagttcctctagttgccattgacgc

SEQ ID NO: 58295 - DNA, 25 bp, S. cerevisiae
tagtccgttcagatacattgagtgg

SEQ ID NO: 58296 - DNA, 25 bp, S. cerevisiae
tagatgccgatctacaaggctttgg

SEQ ID NO: 58297 - DNA, 25 bp, S. cerevisiae
tagactacagagttgcgtcagcaat

SEQ ID NO: 58298 - DNA, 25 bp, S. cerevisiae
tagagcattctataagggcacacat

SEQ ID NO: 58299 - DNA, 25 bp, S. cerevisiae
taggcaatctaagggtgtccattca

SEQ ID NO: 58300 - DNA, 25 bp, S. cerevisiae
tagaccatcaaaccgtgtccaagat

SEQ ID NO: 58301 - DNA, 25 bp, S. cerevisiae
tagacccagaacttttccatgatat

SEQ ID NO: 58302 - DNA, 25 bp, S. cerevisiae
tagtcgccgccccattatatgtttt

SEQ ID NO: 58303 - DNA, 25 bp, S. cerevisiae
tagtcaaagctgtccattttttccg

SEQ ID NO: 58304 - DNA, 25 bp, S. cerevisiae
tagtcagcgtgatccatttttatga

SEQ ID NO: 58305 - DNA, 25 bp, S. cerevisiae
tagacgtctgtcatttgggtaaaat

SEQ ID NO: 58306 - DNA, 25 bp, S. cerevisiae
tatgatcaggacaccgcaacagagt

SEQ ID NO: 58307 - DNA, 25 bp, S. cerevisiae
tagtaacactccttaccagatctca

SEQ ID NO: 58308 - DNA, 25 bp, S. cerevisiae
tagtatttgaagacgctccagcagg

SEQ ID NO: 58309 - DNA, 25 bp, S. cerevisiae
tatgtagtcgaacagcccgatggaa

SEQ ID NO: 58310 - DNA, 25 bp, S. cerevisiae
tatccgcacgaagttgtcaggacga

SEQ ID NO: 58311 - DNA, 25 bp, S. cerevisiae
taggcccaacactttagatccagct

SEQ ID NO: 58312 - DNA, 25 bp, S. cerevisiae
tagacgtcccaccattagactactt

SEQ ID NO: 58313 - DNA, 25 bp, S. cerevisiae
taggttcgacgccaattgttacatt

SEQ ID NO: 58314 - DNA, 25 bp, S. cerevisiae
tagttctcggagtcaatggttacat

SEQ ID NO: 58315 - DNA, 25 bp, S. cerevisiae
tagactctcgagaaacaggcggatt

SEQ ID NO: 58316 - DNA, 25 bp, S. cerevisiae
tatgtagctattgtcgagtcgtccg

SEQ ID NO: 58317 - DNA, 25 bp, S. cerevisiae
tatgtactccaaccggtggtaaggc

SEQ ID NO: 58318 - DNA, 25 bp, S. cerevisiae
tatgtattaatacctgcgggaattt

SEQ ID NO: 58319 - DNA, 25 bp, S. cerevisiae
tatgttctaatcttcctggcgtata

SEQ ID NO: 58320 - DNA, 25 bp, S. cerevisiae
tagttccatagcttctcccgagaaa

SEQ ID NO: 58321 - DNA, 25 bp, S. cerevisiae
tagataccataatttccttgcagga

SEQ ID NO: 58322 - DNA, 25 bp, S. cerevisiae
tagagagcacctcatgtcctacaat

SEQ ID NO: 58323 - DNA, 25 bp, S. cerevisiae
taggacgccatgctgtctcaaacaa

SEQ ID NO: 58324 - DNA, 25 bp, S. cerevisiae
tagagccgccagattcatctcagaa

SEQ ID NO: 58325 - DNA, 25 bp, S. cerevisiae
tagacgctggcgtttgtgacggaat

SEQ ID NO: 58326 - DNA, 25 bp, S. cerevisiae
taggtcaccattacctccgttgtag

SEQ ID NO: 58327 - DNA, 25 bp, S. cerevisiae
tagtgccctttagctccagtgaaag

SEQ ID NO: 58328 - DNA, 25 bp, S. cerevisiae
tagtcgcctctacagaccacattta

SEQ ID NO: 58329 - DNA, 25 bp, S. cerevisiae
tagtctttctgatcgcagtagcatt

SEQ ID NO: 58330 - DNA, 25 bp, S. cerevisiae
tagtatctactttctgcttcttgtg

SEQ ID NO: 58331 - DNA, 25 bp, S. cerevisiae
tagatgactccgaactttctgtgct

SEQ ID NO: 58332 - DNA, 25 bp, S. cerevisiae
tagagactccatcattcttccgtat

SEQ ID NO: 58333 - DNA, 25 bp, S. cerevisiae
tagagagtcatcctattcgtccttt

SEQ ID NO: 58334 - DNA, 25 bp, S. cerevisiae
tttgatgctcaaacgggttccgatc

SEQ ID NO: 58335 - DNA, 25 bp, S. cerevisiae
taggtctaaaaagatactgctgtag

SEQ ID NO: 58336 - DNA, 25 bp, S. cerevisiae
tatgggatcctagcaaacatcttaa

SEQ ID NO: 58337 - DNA, 25 bp, S. cerevisiae
taggagctatacgtctgatacatgt

SEQ ID NO: 58338 - DNA, 25 bp, S. cerevisiae
taggcccatcacgtctagacgttta

SEQ ID NO: 58339 - DNA, 25 bp, S. cerevisiae
taggaccataccgaacaagttcaac

SEQ ID NO: 58340 - DNA, 25 bp, S. cerevisiae
taggacacatcagcaagagaacttg

SEQ ID NO: 58341 - DNA, 25 bp, S. cerevisiae
taggtcatgccttcaagaaagctgg

SEQ ID NO: 58342 - DNA, 25 bp, S. cerevisiae
tagggcaccatgtggtatactctgt

SEQ ID NO: 58343 - DNA, 25 bp, S. cerevisiae
taggacaccatgtcgtgtattctgt

SEQ ID NO: 58344 - DNA, 25 bp, S. cerevisiae
tagtgaagtcgctgctttgtctggc

SEQ ID NO: 58345 - DNA, 25 bp, S. cerevisiae
tagtgtcatccttgatcgcatatcc

SEQ ID NO: 58346 - DNA, 25 bp, S. cerevisiae
tagagatattatccggtcatgacat

SEQ ID NO: 58347 - DNA, 25 bp, S. cerevisiae
taggaattaccgacgctccatttgg

SEQ ID NO: 58348 - DNA, 25 bp, S. cerevisiae
tagtcaatgtactccagtccacttg

SEQ ID NO: 58349 - DNA, 25 bp, S. cerevisiae
tatgtggaccaaaccgaacctgtta

SEQ ID NO: 58350 - DNA, 25 bp, S. cerevisiae
ttggctactaccagtgaacgtgtta

SEQ ID NO: 58351 - DNA, 25 bp, S. cerevisiae
ttcctacgaccttgtttactttcat

SEQ ID NO: 58352 - DNA, 25 bp, S. cerevisiae
tttctccccaggtgtaccaggtatt

SEQ ID NO: 58353 - DNA, 25 bp, S. cerevisiae
taggcgaaggttacactaccggcca

SEQ ID NO: 58354 - DNA, 25 bp, S. cerevisiae
tagtggaagtgtttcaacggctggc

SEQ ID NO: 58355 - DNA, 25 bp, S. cerevisiae
tagagaacgttcttgccatcggcat

SEQ ID NO: 58356 - DNA, 25 bp, S. cerevisiae
taggatattgtttcccacgcagcaa

SEQ ID NO: 58357 - DNA, 25 bp, S. cerevisiae
tagttgctttgatgagtgacccaga

SEQ ID NO: 58358 - DNA, 25 bp, S. cerevisiae
tagttgcttctgttgacgaactcaa

SEQ ID NO: 58359 - DNA, 25 bp, S. cerevisiae
tagttgcgatcgtctacaggaccga

SEQ ID NO: 58360 - DNA, 25 bp, S. cerevisiae
tatgtattactttttgccgcagcgg

SEQ ID NO: 58361 - DNA, 25 bp, S. cerevisiae
tatgtctatacaatcgtctccctcg

SEQ ID NO: 58362 - DNA, 25 bp, S. cerevisiae
tatgccctaaggttctatcacaatg

SEQ ID NO: 58363 - DNA, 25 bp, S. cerevisiae
tatgtgactcaagcttccatccaag

SEQ ID NO: 58364 - DNA, 25 bp, S. cerevisiae
tagagatgtcaagctacctcggcat

SEQ ID NO: 58365 - DNA, 25 bp, S. cerevisiae
tagagagactgaactacacccgcac

SEQ ID NO: 58366 - DNA, 25 bp, S. cerevisiae
tatttttacctagcggtagctcgtc

SEQ ID NO: 58367 - DNA, 25 bp, S. cerevisiae
ttattgcttacccaacttgtttcgg

SEQ ID NO: 58368 - DNA, 25 bp, S. cerevisiae
ttaaatcagaccacctttttcagcg

SEQ ID NO: 58369 - DNA, 25 bp, S. cerevisiae
ttagaacgaccacccttattaagag

SEQ ID NO: 58370 - DNA, 25 bp, S. cerevisiae
tttcaaaaacacacgccgattggtc

SEQ ID NO: 58371 - DNA, 25 bp, S. cerevisiae
ttagtcacaaaaagtccctgagggt

SEQ ID NO: 58372 - DNA, 25 bp, S. cerevisiae
ttttacatgaagacgttccgggctt

SEQ ID NO: 58373 - DNA, 25 bp, S. cerevisiae
tttctacggaactttaatggcgaat

SEQ ID NO: 58374 - DNA, 25 bp, S. cerevisiae
tatacgtgacactcgtattcacctc

SEQ ID NO: 58375 - DNA, 25 bp, S. cerevisiae
tagggcaaggttggcctctacttac

SEQ ID NO: 58376 - DNA, 25 bp, S. cerevisiae
tagggcggaatcttaccatgactta

SEQ ID NO: 58377 - DNA, 25 bp, S. cerevisiae
taggactggaacttacgctttgtag

SEQ ID NO: 58378 - DNA, 25 bp, S. cerevisiae
tagattgctcataacaggtgtcaca

SEQ ID NO: 58379 - DNA, 25 bp, S. cerevisiae
tagattatcattacagcagccacat

SEQ ID NO: 58380 - DNA, 25 bp, S. cerevisiae
tagatataccgctacagacacataa

SEQ ID NO: 58381 - DNA, 25 bp, S. cerevisiae
tatgttttcgaaagagtaccgtcaa

SEQ ID NO: 58382 - DNA, 25 bp, S. cerevisiae
tattatactcgcaaaaggaccctag

SEQ ID NO: 58383 - DNA, 25 bp, S. cerevisiae
tatgtcaacgcgcaggatggattcc

SEQ ID NO: 58384 - DNA, 25 bp, S. cerevisiae
tatctactgcgctgatttggactcg

SEQ ID NO: 58385 - DNA, 25 bp, S. cerevisiae
tagattctgcgcttattaatacgga

SEQ ID NO: 58386 - DNA, 25 bp, S. cerevisiae
tagatcatgcgccttaccttaagtg

SEQ ID NO: 58387 - DNA, 25 bp, S. cerevisiae
tagatatcgccgactggtccacagt

SEQ ID NO: 58388 - DNA, 25 bp, S. cerevisiae
tagattctcaatcctggtccatgac

SEQ ID NO: 58389 - DNA, 25 bp, S. cerevisiae
tagtattcacagacgctattgatga

SEQ ID NO: 58390 - DNA, 25 bp, S. cerevisiae
taggtctagccccagaaggttccaa

SEQ ID NO: 58391 - DNA, 25 bp, S. cerevisiae
tagggctggccccacaagagttaag

SEQ ID NO: 58392 - DNA, 25 bp, S. cerevisiae
taggtattccaccaattgagttaga

SEQ ID NO: 58393 - DNA, 25 bp, S. cerevisiae
taggagtggccaattgttcagtcaa

SEQ ID NO: 58394 - DNA, 25 bp, S. cerevisiae
tatggagtggtgtaagttcgctgct

SEQ ID NO: 58395 - DNA, 25 bp, S. cerevisiae
tagggtgcgtacttgcttatggctt

SEQ ID NO: 58396 - DNA, 25 bp, S. cerevisiae
taggaatggctatcgtacgtctatt

SEQ ID NO: 58397 - DNA, 25 bp, S. cerevisiae
tagatttggtaacttccctgctcaa

SEQ ID NO: 58398 - DNA, 25 bp, S. cerevisiae
tagatgcgccatgatgctttacctg

SEQ ID NO: 58399 - DNA, 25 bp, S. cerevisiae
tagttgtcggatggcaatccattat

SEQ ID NO: 58400 - DNA, 25 bp, S. cerevisiae
taggaataccatcatcgtctcatca

SEQ ID NO: 58401 - DNA, 25 bp, S. cerevisiae
tagtagcaaccctgatatttccacc

SEQ ID NO: 58402 - DNA, 25 bp, S. cerevisiae
tagtcagccaaacgtttatcccatg

SEQ ID NO: 58403 - DNA, 25 bp, S. cerevisiae
taggcactcaatggtttgaacgcaa

SEQ ID NO: 58404 - DNA, 25 bp, S. cerevisiae
taggcacagacaatgtttgcgccct

SEQ ID NO: 58405 - DNA, 25 bp, S. cerevisiae
tagtaatagcgagtcgtccgcgcaa

SEQ ID NO: 58406 - DNA, 25 bp, S. cerevisiae
tatgctactaatggacggactggat

SEQ ID NO: 58407 - DNA, 25 bp, S. cerevisiae
tagataccaacgttgccacatcgac

SEQ ID NO: 58408 - DNA, 25 bp, S. cerevisiae
tagtttctcctgctccagaatacaa

SEQ ID NO: 58409 - DNA, 25 bp, S. cerevisiae
tagtgcattccatgacgacgaacag

SEQ ID NO: 58410 - DNA, 25 bp, S. cerevisiae
tagtgcttctcacgagtccgattta

SEQ ID NO: 58411 - DNA, 25 bp, S. cerevisiae
tatgtctttattctggtggtgtccc

SEQ ID NO: 58412 - DNA, 25 bp, S. cerevisiae
tagttttaatgcttttggcgctcta

SEQ ID NO: 58413 - DNA, 25 bp, S. cerevisiae
tagtttcttatgttttccgcagcaa

SEQ ID NO: 58414 - DNA, 25 bp, S. cerevisiae
tagggttgttcccattccagagcaa

SEQ ID NO: 58415 - DNA, 25 bp, S. cerevisiae
tagaggtctaccatactcactggat

SEQ ID NO: 58416 - DNA, 25 bp, S. cerevisiae
taggtttcaccttgaatgacagagt

SEQ ID NO: 58417 - DNA, 25 bp, S. cerevisiae
taggttacacacttgttagcgcatg

SEQ ID NO: 58418 - DNA, 25 bp, S. cerevisiae
tagtgttccgctatccattaatgaa

SEQ ID NO: 58419 - DNA, 25 bp, S. cerevisiae
tagtggttctgtagcccttgcaaga

SEQ ID NO: 58420 - DNA, 25 bp, S. cerevisiae
taggatctcctatcccgggtgaatc

SEQ ID NO: 58421 - DNA, 25 bp, S. cerevisiae
tagtaacagcaatccgggctcacat

SEQ ID NO: 58422 - DNA, 25 bp, S. cerevisiae
tagtgctaccttatcgatggcccat

SEQ ID NO: 58423 - DNA, 25 bp, S. cerevisiae
tagattcagcttcgtcctacaataa

SEQ ID NO: 58424 - DNA, 25 bp, S. cerevisiae
tagatccagattttcccttgcaaac

SEQ ID NO: 58425 - DNA, 25 bp, S. cerevisiae
tataccactttttcaccatctacta

SEQ ID NO: 58426 - DNA, 25 bp, S. cerevisiae
tatggcccgaatttattcctcctga

SEQ ID NO: 58427 - DNA, 25 bp, S. cerevisiae
tagtgaagatcctcaaatccgggaa

SEQ ID NO: 58428 - DNA, 25 bp, S. cerevisiae
taggcaagccctatacatctcgatg

SEQ ID NO: 58429 - DNA, 25 bp, S. cerevisiae
tagtcaagctatgggatacctcctg

SEQ ID NO: 58430 - DNA, 25 bp, S. cerevisiae
tagatgcatcacttgggttggctcc

SEQ ID NO: 58431 - DNA, 25 bp, S. cerevisiae
tagtcaatcatcacacctcagcgat

SEQ ID NO: 58432 - DNA, 25 bp, S. cerevisiae
tagatcatgatcgtccacctgtgta

SEQ ID NO: 58433 - DNA, 25 bp, S. cerevisiae
tagtaaaatgctgtactccaccgcc

SEQ ID NO: 58434 - DNA, 25 bp, S. cerevisiae
tttatcccaggtgagaacgtttctt

SEQ ID NO: 58435 - DNA, 25 bp, S. cerevisiae
tatatacccgtcaacccaattcttt

SEQ ID NO: 58436 - DNA, 25 bp, S. cerevisiae
ttgtgaaggcgtttaccacggaatt

SEQ ID NO: 58437 - DNA, 25 bp, S. cerevisiae
ttacgactcgataaacccggacttg

SEQ ID NO: 58438 - DNA, 25 bp, S. cerevisiae
tagtgctcctaaagcatcccaagcg

SEQ ID NO: 58439 - DNA, 25 bp, S. cerevisiae
tagatccgcaggatggcctggtatt

SEQ ID NO: 58440 - DNA, 25 bp, S. cerevisiae
tattcccagtatgcgcctgcaaaag

SEQ ID NO: 58441 - DNA, 25 bp, S. cerevisiae
tatggcccatggaccctgtggtgaa

SEQ ID NO: 58442 - DNA, 25 bp, S. cerevisiae
taggccactagagctttgtccaata

SEQ ID NO: 58443 - DNA, 25 bp, S. cerevisiae
ttagcggacgtgtgtatggtcccta

SEQ ID NO: 58444 - DNA, 25 bp, S. cerevisiae
ttgaccagtttttggacgacccatg

SEQ ID NO: 58445 - DNA, 25 bp, S. cerevisiae
ttgaacgaactagagaccaccctgg

SEQ ID NO: 58446 - DNA, 25 bp, S. cerevisiae
tagttctgccagtgctaggtcaatc

SEQ ID NO: 58447 - DNA, 25 bp, S. cerevisiae
taggtggccataaccggatttccat

SEQ ID NO: 58448 - DNA, 25 bp, S. cerevisiae
taggtggcacactactcgttttgag

SEQ ID NO: 58449 - DNA, 25 bp, S. cerevisiae
taggacgactgtaccgtttctgaaa

SEQ ID NO: 58450 - DNA, 25 bp, S. cerevisiae
taggagaacactccgactcttctga

SEQ ID NO: 58451 - DNA, 25 bp, S. cerevisiae
tatggtgcaaagcttcttcctccat

SEQ ID NO: 58452 - DNA, 25 bp, S. cerevisiae
ttggtaacattttcctactcaacgg

SEQ ID NO: 58453 - DNA, 25 bp, S. cerevisiae
tatggtttctgtttgcctaccaacg

SEQ ID NO: 58454 - DNA, 25 bp, S. cerevisiae
tatcttctaactttcctttcgttca

SEQ ID NO: 58455 - DNA, 25 bp, S. cerevisiae
tatcctatccctatccttttttgaa

SEQ ID NO: 58456 - DNA, 25 bp, S. cerevisiae
tagtcagcgtccctaggcgttccgt

SEQ ID NO: 58457 - DNA, 25 bp, S. cerevisiae
taggcgagctaggtgaccgttcaca

SEQ ID NO: 58458 - DNA, 25 bp, S. cerevisiae
taggtgtctatgtttccgatatcag

SEQ ID NO: 58459 - DNA, 25 bp, S. cerevisiae
taggctgtctggtttttgcatactt

SEQ ID NO: 58460 - DNA, 25 bp, S. cerevisiae
tagtgggcgtgcattatgtgcaaga

SEQ ID NO: 58461 - DNA, 25 bp, S. cerevisiae
tagtgcgtcttcctctgttgaagaa

SEQ ID NO: 58462 - DNA, 25 bp, S. cerevisiae
tatgggtttccctatcaaagattga

SEQ ID NO: 58463 - DNA, 25 bp, S. cerevisiae
tagggtttcaacatctcacaatcag

SEQ ID NO: 58464 - DNA, 25 bp, S. cerevisiae
taggtgtttatgtttccgatatcag

SEQ ID NO: 58465 - DNA, 25 bp, S. cerevisiae
tatgagctcttgcaatcgttaggtg

SEQ ID NO: 58466 - DNA, 25 bp, S. cerevisiae
taggtttgatacgtctgcgcagtca

SEQ ID NO: 58467 - DNA, 25 bp, S. cerevisiae
taggtggtgcattccttgccaacaa

SEQ ID NO: 58468 - DNA, 25 bp, S. cerevisiae
tatggacaggcgttacatgcaagat

SEQ ID NO: 58469 - DNA, 25 bp, S. cerevisiae
taggcaccagtgttgatgatcgaat

SEQ ID NO: 58470 - DNA, 25 bp, S. cerevisiae
taggccatgatgagcttgacgtcaa

SEQ ID NO: 58471 - DNA, 25 bp, S. cerevisiae
tagtggtgatgcctccaatgctcaa

SEQ ID NO: 58472 - DNA, 25 bp, S. cerevisiae
tagtctttcgctcctatctgaacat

SEQ ID NO: 58473 - DNA, 25 bp, S. cerevisiae
tagtttctgcgttgctattgttcat

SEQ ID NO: 58474 - DNA, 25 bp, S. cerevisiae
tagtttccacattgtttgccatcac

SEQ ID NO: 58475 - DNA, 25 bp, S. cerevisiae
tagattacgagaacgtccccagcgt

SEQ ID NO: 58476 - DNA, 25 bp, S. cerevisiae
tatgacgacgaaacgttccctcgat

SEQ ID NO: 58477 - DNA, 25 bp, S. cerevisiae
tatgacgtcaggaggttctaccgat

SEQ ID NO: 58478 - DNA, 25 bp, S. cerevisiae
tatgacagttggattccgcgtccga

SEQ ID NO: 58479 - DNA, 25 bp, S. cerevisiae
tatgacgcttgtattttggccaaaa

SEQ ID NO: 58480 - DNA, 25 bp, S. cerevisiae
tatgcaggtttacttacttccagaa

SEQ ID NO: 58481 - DNA, 25 bp, S. cerevisiae
tatcaaattctttccaacgtcaagg

SEQ ID NO: 58482 - DNA, 25 bp, S. cerevisiae
tatgtgacttcttccaatactggta

SEQ ID NO: 58483 - DNA, 25 bp, S. cerevisiae
tagtgccaattagcgcagcctcaaa

SEQ ID NO: 58484 - DNA, 25 bp, S. cerevisiae
taggcatatacatcactggttcaaa

SEQ ID NO: 58485 - DNA, 25 bp, S. cerevisiae
taggctacaacgagcttgtcaaatc

SEQ ID NO: 58486 - DNA, 25 bp, S. cerevisiae
tatgggtcacaggagctatcttttt

SEQ ID NO: 58487 - DNA, 25 bp, S. cerevisiae
tatggcttcgcctagtaccgataat

SEQ ID NO: 58488 - DNA, 25 bp, S. cerevisiae
tagggctagccttgcatacgaaaat

SEQ ID NO: 58489 - DNA, 25 bp, S. cerevisiae
tagtcaccgctttgaaccctaagat

SEQ ID NO: 58490 - DNA, 25 bp, S. cerevisiae
tagtaccgcacttagacccaataga

SEQ ID NO: 58491 - DNA, 25 bp, S. cerevisiae
tagtgacaagcagcgcgccgagtac

SEQ ID NO: 58492 - DNA, 25 bp, S. cerevisiae
tatgcacaggctcacggacgctgat

SEQ ID NO: 58493 - DNA, 25 bp, S. cerevisiae
tatgactacattgcaggacaggttt

SEQ ID NO: 58494 - DNA, 25 bp, S. cerevisiae
tagtgtgtattattgcggccgtttt

SEQ ID NO: 58495 - DNA, 25 bp, S. cerevisiae
tatgtggtattttccccttgttagt

SEQ ID NO: 58496 - DNA, 25 bp, S. cerevisiae
tatcaagttagatccatcgggcagc

SEQ ID NO: 58497 - DNA, 25 bp, S. cerevisiae
ttacagcctggatcgttggaactaa

SEQ ID NO: 58498 - DNA, 25 bp, S. cerevisiae
tatcctatattctcagtgttgggct

SEQ ID NO: 58499 - DNA, 25 bp, S. cerevisiae
tatcgtatttgctgcgttctacgct

SEQ ID NO: 58500 - DNA, 25 bp, S. cerevisiae
tatgccttttcaacagtagtacctg

SEQ ID NO: 58501 - DNA, 25 bp, S. cerevisiae
tatgaatctggcacctgtgaaggca

SEQ ID NO: 58502 - DNA, 25 bp, S. cerevisiae
tatgcattcgacacgatccaaggtt

SEQ ID NO: 58503 - DNA, 25 bp, S. cerevisiae
tatggtaagcctagaaacggacttg

SEQ ID NO: 58504 - DNA, 25 bp, S. cerevisiae
tatgcgtcaagcttataataccctt

SEQ ID NO: 58505 - DNA, 25 bp, S. cerevisiae
tatctgctaagcgtaacgacccagc

SEQ ID NO: 58506 - DNA, 25 bp, S. cerevisiae
tatgctggcagtgacgagatcgtta

SEQ ID NO: 58507 - DNA, 25 bp, S. cerevisiae
tatcctgcagtgaggagtccttagc

SEQ ID NO: 58508 - DNA, 25 bp, S. cerevisiae
tatctcggtgagcagcaattccaat

SEQ ID NO: 58509 - DNA, 25 bp, S. cerevisiae
tatccaagtagttgcttactcctcc

SEQ ID NO: 58510 - DNA, 25 bp, S. cerevisiae
tatcacagtcctatctcaagctaag

SEQ ID NO: 58511 - DNA, 25 bp, S. cerevisiae
tatgaactgctctttggatacggcc

SEQ ID NO: 58512 - DNA, 25 bp, S. cerevisiae
tatcacactcatatccgtttcaggg

SEQ ID NO: 58513 - DNA, 25 bp, S. cerevisiae
tatccgtccttctgtttcaaacaag

SEQ ID NO: 58514 - DNA, 25 bp, S. cerevisiae
tatcattcccatcgcatctagcaaa

SEQ ID NO: 58515 - DNA, 25 bp, S. cerevisiae
tatgctctccattgcatgggttttg

SEQ ID NO: 58516 - DNA, 25 bp, S. cerevisiae
tatctctccaggacaggccaattgg

SEQ ID NO: 58517 - DNA, 25 bp, S. cerevisiae
tatgcagccttttatgccctcggta

SEQ ID NO: 58518 - DNA, 25 bp, S. cerevisiae
taggccctacaatcatcctgaattg

SEQ ID NO: 58519 - DNA, 25 bp, S. cerevisiae
taggtccactaatttcacgcaattt

SEQ ID NO: 58520 - DNA, 25 bp, S. cerevisiae
taggccatcccatcattacgagata

SEQ ID NO: 58521 - DNA, 25 bp, S. cerevisiae
taggctccgtcgtcacattaggtac

SEQ ID NO: 58522 - DNA, 25 bp, S. cerevisiae
tatgatgtgcatggtcctgtgatac

SEQ ID NO: 58523 - DNA, 25 bp, S. cerevisiae
tatgcgtgacgcctttgatattggt

SEQ ID NO: 58524 - DNA, 25 bp, S. cerevisiae
taggcatacgagattgctgcattat

SEQ ID NO: 58525 - DNA, 25 bp, S. cerevisiae
taggtctagctattatcccgtttat

SEQ ID NO: 58526 - DNA, 25 bp, S. cerevisiae
tatatggaagtgagcgcaccgcctg

SEQ ID NO: 58527 - DNA, 25 bp, S. cerevisiae
ttatcagaatgtcagcgccgaacgg

SEQ ID NO: 58528 - DNA, 25 bp, S. cerevisiae
tatagcacagtctcacaagtcttag

SEQ ID NO: 58529 - DNA, 25 bp, S. cerevisiae
tatgaagcaggcgacatccactcat

SEQ ID NO: 58530 - DNA, 25 bp, S. cerevisiae
tagtatgtgcgcaagcatccctatt

SEQ ID NO: 58531 - DNA, 25 bp, S. cerevisiae
tatgcccacctttgttcttggcaag

SEQ ID NO: 58532 - DNA, 25 bp, S. cerevisiae
tatgcccgtcatcgagtactttgaa

SEQ ID NO: 58533 - DNA, 25 bp, S. cerevisiae
taggcaaactttccagctacagaag

SEQ ID NO: 58534 - DNA, 25 bp, S. cerevisiae
taggtcgcccagacttttatcgtta

SEQ ID NO: 58535 - DNA, 25 bp, S. cerevisiae
tatggttgcatgtagttttttcgtc

SEQ ID NO: 58536 - DNA, 25 bp, S. cerevisiae
taggttatgttcatgcccttgctca

SEQ ID NO: 58537 - DNA, 25 bp, S. cerevisiae
taggtctagctttgaatttctccgt

SEQ ID NO: 58538 - DNA, 25 bp, S. cerevisiae
tatgacggttgcactttttgccatg

SEQ ID NO: 58539 - DNA, 25 bp, S. cerevisiae
tatgaagttattcgccttttacggg

SEQ ID NO: 58540 - DNA, 25 bp, S. cerevisiae
tatggtgtgcttacgtcatttgtaa

SEQ ID NO: 58541 - DNA, 25 bp, S. cerevisiae
taggtgctgcttacggtactgctaa

SEQ ID NO: 58542 - DNA, 25 bp, S. cerevisiae
taggtcgcttatcggtgtgccacac

SEQ ID NO: 58543 - DNA, 25 bp, S. cerevisiae
taggtattatccagatgcccatgcc

SEQ ID NO: 58544 - DNA, 25 bp, S. cerevisiae
tatggtgtagcaaccgccgaaggct

SEQ ID NO: 58545 - DNA, 25 bp, S. cerevisiae
tatgggtggtcaatcggctgctagc

SEQ ID NO: 58546 - DNA, 25 bp, S. cerevisiae
taggtctggttctatcggtactcta

SEQ ID NO: 58547 - DNA, 25 bp, S. cerevisiae
tagtctctttatttgaagataccaa

SEQ ID NO: 58548 - DNA, 25 bp, S. cerevisiae
tagtctctttgtttgaagacactaa

SEQ ID NO: 58549 - DNA, 25 bp, S. cerevisiae
tatgcttccgctttggaaacactag

SEQ ID NO: 58550 - DNA, 25 bp, S. cerevisiae
tatgtatgcggcgtttgtttccatt

SEQ ID NO: 58551 - DNA, 25 bp, S. cerevisiae
tagtacaggtattctctcgaggaca

SEQ ID NO: 58552 - DNA, 25 bp, S. cerevisiae
tatgtccctggctgtctctgaggaa

SEQ ID NO: 58553 - DNA, 25 bp, S. cerevisiae
taggatcacaggacagttccgatgt

SEQ ID NO: 58554 - DNA, 25 bp, S. cerevisiae
tatagagccggccagtttcgttaaa

SEQ ID NO: 58555 - DNA, 25 bp, S. cerevisiae
tatggaatgggccagctatccctta

SEQ ID NO: 58556 - DNA, 25 bp, S. cerevisiae
tttgcataaggaccatggctatttc

SEQ ID NO: 58557 - DNA, 25 bp, S. cerevisiae
tttcataacgtctaggcaactcaag

SEQ ID NO: 58558 - DNA, 25 bp, S. cerevisiae
tattcagacatcctccaggcagagt

SEQ ID NO: 58559 - DNA, 25 bp, S. cerevisiae
tatctccactttcaggcgatccaat

SEQ ID NO: 58560 - DNA, 25 bp, S. cerevisiae
tatcccaggccatgttcaacaaggt

SEQ ID NO: 58561 - DNA, 25 bp, S. cerevisiae
tatggcagcccgtcttggaattgaa

SEQ ID NO: 58562 - DNA, 25 bp, S. cerevisiae
tatgatttaatcaaagctgctgctg

SEQ ID NO: 58563 - DNA, 25 bp, S. cerevisiae
taggtttgacaacgctgatgctgag

SEQ ID NO: 58564 - DNA, 25 bp, S. cerevisiae
tatggatttgaccacgtctgcagtg

SEQ ID NO: 58565 - DNA, 25 bp, S. cerevisiae
tatggaaggagcaacgcacgccgtt

SEQ ID NO: 58566 - DNA, 25 bp, S. cerevisiae
tatggaaggcagaaaagacaccgct

SEQ ID NO: 58567 - DNA, 25 bp, S. cerevisiae
tatggaaccaccaaatgacttcagc

SEQ ID NO: 58568 - DNA, 25 bp, S. cerevisiae
tatgggaccactcgcgtacttaaaa

SEQ ID NO: 58569 - DNA, 25 bp, S. cerevisiae
tatggtataatcaagcgtatttaga

SEQ ID NO: 58570 - DNA, 25 bp, S. cerevisiae
taggtacactcaactgccatatgga

SEQ ID NO: 58571 - DNA, 25 bp, S. cerevisiae
tatggctacacaacgtgctcaaggt

SEQ ID NO: 58572 - DNA, 25 bp, S. cerevisiae
tatgacctacaaactacagcttctg

SEQ ID NO: 58573 - DNA, 25 bp, S. cerevisiae
tagtgatgcaactcgattcagtgat

SEQ ID NO: 58574 - DNA, 25 bp, S. cerevisiae
tatgccagcccgagatttgagcttg

SEQ ID NO: 58575 - DNA, 25 bp, S. cerevisiae
tatgccaacactaaaatttctgctg

SEQ ID NO: 58576 - DNA, 25 bp, S. cerevisiae
tatgctcagggtacaaattgctcgt

SEQ ID NO: 58577 - DNA, 25 bp, S. cerevisiae
tttcttcccttatggttaagcccat

SEQ ID NO: 58578 - DNA, 25 bp, S. cerevisiae
tatgtccgagtacttgacgaaccca

SEQ ID NO: 58579 - DNA, 25 bp, S. cerevisiae
tatgtcggacggctgggaaaccaaa

SEQ ID NO: 58580 - DNA, 25 bp, S. cerevisiae
tatgtttaccgacgccgaagaccaa

SEQ ID NO: 58581 - DNA, 25 bp, S. cerevisiae
tagggaagccaactgccgcaagatc

SEQ ID NO: 58582 - DNA, 25 bp, S. cerevisiae
taggcgacccagtatgcatgccgaa

SEQ ID NO: 58583 - DNA, 25 bp, S. cerevisiae
tatgacaatcatgggctctacgggc

SEQ ID NO: 58584 - DNA, 25 bp, S. cerevisiae
tatacaaccaaatttcccaagcctt

SEQ ID NO: 58585 - DNA, 25 bp, S. cerevisiae
tatgtatcacaccaaattcgctaag

SEQ ID NO: 58586 - DNA, 25 bp, S. cerevisiae
tatggctgatctatactgctcctaa

SEQ ID NO: 58587 - DNA, 25 bp, S. cerevisiae
tagtctgtcttttcaatgcgatgga

SEQ ID NO: 58588 - DNA, 25 bp, S. cerevisiae
tagtgcttgcttgtgtgaggatgaa

SEQ ID NO: 58589 - DNA, 25 bp, S. cerevisiae
taggtagtgcctctcatgatatgac

SEQ ID NO: 58590 - DNA, 25 bp, S. cerevisiae
tatgtacatgcccttctgtagaaga

SEQ ID NO: 58591 - DNA, 25 bp, S. cerevisiae
tatgtggctgttatgcgctatacga

SEQ ID NO: 58592 - DNA, 25 bp, S. cerevisiae
taggccccactgtatacactatcaa

SEQ ID NO: 58593 - DNA, 25 bp, S. cerevisiae
ttcctacaagttctggtcccttaat

SEQ ID NO: 58594 - DNA, 25 bp, S. cerevisiae
ttcgtacggttgtggtcagtcgttt

SEQ ID NO: 58595 - DNA, 25 bp, S. cerevisiae
tagtccactatttctatatcattaa

SEQ ID NO: 58596 - DNA, 25 bp, S. cerevisiae
tagtggcactcacactacgcactag

SEQ ID NO: 58597 - DNA, 25 bp, S. cerevisiae
tatggcgttccaaagaccgacagcg

SEQ ID NO: 58598 - DNA, 25 bp, S. cerevisiae
tatggttatccaagccgccaaatgg

SEQ ID NO: 58599 - DNA, 25 bp, S. cerevisiae
tatggatcgtacaaccgccggagtc

SEQ ID NO: 58600 - DNA, 25 bp, S. cerevisiae
tatggtgcttaaacagtggcgaaat

SEQ ID NO: 58601 - DNA, 25 bp, S. cerevisiae
tatggtcttttgtcctcgctttaaa

SEQ ID NO: 58602 - DNA, 25 bp, S. cerevisiae
tatggtattagttcttccgtcttaa

SEQ ID NO: 58603 - DNA, 25 bp, S. cerevisiae
taggatctatcggtttttctgttaa

SEQ ID NO: 58604 - DNA, 25 bp, S. cerevisiae
taggtttcgcttatctccttttgat

SEQ ID NO: 58605 - DNA, 25 bp, S. cerevisiae
taggcgctttttctatcgtctctta

SEQ ID NO: 58606 - DNA, 25 bp, S. cerevisiae
tatgcctttcttttatttgtttcgt

SEQ ID NO: 58607 - DNA, 25 bp, S. cerevisiae
tatggtgccctatgatcaaccggag

SEQ ID NO: 58608 - DNA, 25 bp, S. cerevisiae
tatggtgcagccaaggactatcgct

SEQ ID NO: 58609 - DNA, 25 bp, S. cerevisiae
taggtgccacaagagcttctgttga

SEQ ID NO: 58610 - DNA, 25 bp, S. cerevisiae
tatggtaaaagttggcgctgttgca

SEQ ID NO: 58611 - DNA, 25 bp, S. cerevisiae
taggtaatagtattgccgcgggcaa

SEQ ID NO: 58612 - DNA, 25 bp, S. cerevisiae
tagtgattctcatttctcatgggat

SEQ ID NO: 58613 - DNA, 25 bp, S. cerevisiae
taggatctgctcaactccatggagt

SEQ ID NO: 58614 - DNA, 25 bp, S. cerevisiae
tatggtgatgcgacaacttggaatc

SEQ ID NO: 58615 - DNA, 25 bp, S. cerevisiae
tatagtatcgcttcgcaaccaagaa

SEQ ID NO: 58616 - DNA, 25 bp, S. cerevisiae
tatggtagccatgcgttctacagaa

SEQ ID NO: 58617 - DNA, 25 bp, S. cerevisiae
tatgaggacccggtactcgaggacc

SEQ ID NO: 58618 - DNA, 25 bp, S. cerevisiae
tatcgatatcgattctgaccgccgg

SEQ ID NO: 58619 - DNA, 25 bp, S. cerevisiae
tatcgaactttctgccgaagcgttg

SEQ ID NO: 58620 - DNA, 25 bp, S. cerevisiae
tatccgacgttaacagaaagggtat

SEQ ID NO: 58621 - DNA, 25 bp, S. cerevisiae
ttagaggcggccgacgacgacgatt

SEQ ID NO: 58622 - DNA, 25 bp, S. cerevisiae
tatggaggtttctcgtatgccaaac

SEQ ID NO: 58623 - DNA, 25 bp, S. cerevisiae
tatggtgatgttcctgacgagttct

SEQ ID NO: 58624 - DNA, 25 bp, S. cerevisiae
tatgcgattacggagtttccctgca

SEQ ID NO: 58625 - DNA, 25 bp, S. cerevisiae
tatccaaagcctggtattgccgcac

SEQ ID NO: 58626 - DNA, 25 bp, S. cerevisiae
tatccaagagctgggtttctcgcca

SEQ ID NO: 58627 - DNA, 25 bp, S. cerevisiae
tatcgaaagccggttcttacgaggt

SEQ ID NO: 58628 - DNA, 25 bp, S. cerevisiae
tattgaacccgattccttcgaaggt

SEQ ID NO: 58629 - DNA, 25 bp, S. cerevisiae
tatgttgaccggtatccccgctgac

SEQ ID NO: 58630 - DNA, 25 bp, S. cerevisiae
tatgttgaccggtatccccgctgac

SEQ ID NO: 58631 - DNA, 25 bp, S. cerevisiae
taggattcctggttattccgcagac

SEQ ID NO: 58632 - DNA, 25 bp, S. cerevisiae
taggtttcaatgatcttcccagcac

SEQ ID NO: 58633 - DNA, 25 bp, S. cerevisiae
tatgttttagagaattcttcgaccg

SEQ ID NO: 58634 - DNA, 25 bp, S. cerevisiae
tatgtcgatgccacatgcagagtgc

SEQ ID NO: 58635 - DNA, 25 bp, S. cerevisiae
tatggcataggcacacggatgctac

SEQ ID NO: 58636 - DNA, 25 bp, S. cerevisiae
tatgaaactcccctaattgaattgt

SEQ ID NO: 58637 - DNA, 25 bp, S. cerevisiae
tttttcgtaccactactgtcggaga

SEQ ID NO: 58638 - DNA, 25 bp, S. cerevisiae
tatccccgtggatatttacccaaca

SEQ ID NO: 58639 - DNA, 25 bp, S. cerevisiae
tatccctgtggattggacctttgtc

SEQ ID NO: 58640 - DNA, 25 bp, S. cerevisiae
tatccccatggactagggcatatgt

SEQ ID NO: 58641 - DNA, 25 bp, S. cerevisiae
tatggccacgaggtagcagagctat

SEQ ID NO: 58642 - DNA, 25 bp, S. cerevisiae
tatgatgccctagatcaaactgatc

SEQ ID NO: 58643 - DNA, 25 bp, S. cerevisiae
tatgctggccaaactagagactgaa

SEQ ID NO: 58644 - DNA, 25 bp, S. cerevisiae
tatcttgcacactactcgaacgagg

SEQ ID NO: 58645 - DNA, 25 bp, S. cerevisiae
tatgcagctgtctctcctgagaaac

SEQ ID NO: 58646 - DNA, 25 bp, S. cerevisiae
tatagcgaacctccgaatgtcaaga

SEQ ID NO: 58647 - DNA, 25 bp, S. cerevisiae
tatgtcatcccagcaggttatcacg

SEQ ID NO: 58648 - DNA, 25 bp, S. cerevisiae
tatgtatactgttgctttatccgct

SEQ ID NO: 58649 - DNA, 25 bp, S. cerevisiae
tatgtcttgttccttctctaaccaa

SEQ ID NO: 58650 - DNA, 25 bp, S. cerevisiae
taggctggtctacttcttatcaaac

SEQ ID NO: 58651 - DNA, 25 bp, S. cerevisiae
taggtggtctattacttcagagttt

SEQ ID NO: 58652 - DNA, 25 bp, S. cerevisiae
taggccagttatatccatcttccac

SEQ ID NO: 58653 - DNA, 25 bp, S. cerevisiae
tatggctcactttatttgacgacca

SEQ ID NO: 58654 - DNA, 25 bp, S. cerevisiae
taggcgctgtcactcgttagatgaa

SEQ ID NO: 58655 - DNA, 25 bp, S. cerevisiae
tatgcatctacggttgcattgccct

SEQ ID NO: 58656 - DNA, 25 bp, S. cerevisiae
tatgagcgacggtgatatgcctgac

SEQ ID NO: 58657 - DNA, 25 bp, S. cerevisiae
ttccaagggtgccatgctcatgaga

SEQ ID NO: 58658 - DNA, 25 bp, S. cerevisiae
tattaaagccgttcaaatcctccac

SEQ ID NO: 58659 - DNA, 25 bp, S. cerevisiae
tatgctcgaggtcatatttcctccg

SEQ ID NO: 58660 - DNA, 25 bp, S. cerevisiae
tatggcgggtcgttttcccaacgat

SEQ ID NO: 58661 - DNA, 25 bp, S. cerevisiae
taggcgtcgaatgtttccaacccat

SEQ ID NO: 58662 - DNA, 25 bp, S. cerevisiae
tatcaatccgatagcgttcccgaag

SEQ ID NO: 58663 - DNA, 25 bp, S. cerevisiae
tatcaacctgacaatttgcccgtta

SEQ ID NO: 58664 - DNA, 25 bp, S. cerevisiae
tatgacgaccactattaccagctgt

SEQ ID NO: 58665 - DNA, 25 bp, S. cerevisiae
tatgacagctccagtataccagggc

SEQ ID NO: 58666 - DNA, 25 bp, S. cerevisiae
tatcaattccgagatgcaccacgac

SEQ ID NO: 58667 - DNA, 25 bp, S. cerevisiae
tatgttttctgggagtccactcact

SEQ ID NO: 58668 - DNA, 25 bp, S. cerevisiae
tatgtcctaatgctgaatcccatgc

SEQ ID NO: 58669 - DNA, 25 bp, S. cerevisiae
tatgtcttcgatgctgtacctatgt

SEQ ID NO: 58670 - DNA, 25 bp, S. cerevisiae
tttcgtccaattctacgccgacttg

SEQ ID NO: 58671 - DNA, 25 bp, S. cerevisiae
ttgagcgtaaactgttccggacctg

SEQ ID NO: 58672 - DNA, 25 bp, S. cerevisiae
ttgggtgaaaacctgtccgccctat

SEQ ID NO: 58673 - DNA, 25 bp, S. cerevisiae
tttggtgaaacctacgccgttggat

SEQ ID NO: 58674 - DNA, 25 bp, S. cerevisiae
tattagaaccctcacctttttcaga

SEQ ID NO: 58675 - DNA, 25 bp, S. cerevisiae
taggcgatgcctcagaacgtgctac

SEQ ID NO: 58676 - DNA, 25 bp, S. cerevisiae
tatgggtcccaatttcattctgcac

SEQ ID NO: 58677 - DNA, 25 bp, S. cerevisiae
taggtctcaccatttttgctctgat

SEQ ID NO: 58678 - DNA, 25 bp, S. cerevisiae
taggtgtgctcctttttatgctcat

SEQ ID NO: 58679 - DNA, 25 bp, S. cerevisiae
tatggagcctgtcaacgaattcgaa

SEQ ID NO: 58680 - DNA, 25 bp, S. cerevisiae
taggccacgtaggatccgttcagat

SEQ ID NO: 58681 - DNA, 25 bp, S. cerevisiae
tatggcagctcagttttccgtttat

SEQ ID NO: 58682 - DNA, 25 bp, S. cerevisiae
tatggatggcgggtcctctgaaact

SEQ ID NO: 58683 - DNA, 25 bp, S. cerevisiae
tatggttatggccaccgttaagaag

SEQ ID NO: 58684 - DNA, 25 bp, S. cerevisiae
tatggcctgttctcctttgaagaga

SEQ ID NO: 58685 - DNA, 25 bp, S. cerevisiae
tatgccttggttgtcgttggtgaca

SEQ ID NO: 58686 - DNA, 25 bp, S. cerevisiae
tatgctctttttgaactgctggtaa

SEQ ID NO: 58687 - DNA, 25 bp, S. cerevisiae
ttcgatttggtgaaacgcagttcct

SEQ ID NO: 58688 - DNA, 25 bp, S. cerevisiae
ttagttgcgagtaaagtcgggcatt

SEQ ID NO: 58689 - DNA, 25 bp, S. cerevisiae
tttgcctggcagaataaaccgcgtt

SEQ ID NO: 58690 - DNA, 25 bp, S. cerevisiae
ttaacatggccaaggaatccggtgc

SEQ ID NO: 58691 - DNA, 25 bp, S. cerevisiae
tatgacactcatgaacaggccgctg

SEQ ID NO: 58692 - DNA, 25 bp, S. cerevisiae
tatgacatccaaaccagtgcactat

SEQ ID NO: 58693 - DNA, 25 bp, S. cerevisiae
tatgactatcattcctatcgcaaag

SEQ ID NO: 58694 - DNA, 25 bp, S. cerevisiae
taggcttatcgcttgcgaccacgaa

SEQ ID NO: 58695 - DNA, 25 bp, S. cerevisiae
taggttacctgccaaggacgacggt

SEQ ID NO: 58696 - DNA, 25 bp, S. cerevisiae
ttgtaggcccaatggtactgtcgtc

SEQ ID NO: 58697 - DNA, 25 bp, S. cerevisiae
tttgaactccgctagaaagttgcgt

SEQ ID NO: 58698 - DNA, 25 bp, S. cerevisiae
tttgaaaccccatgaactcgagtgt

SEQ ID NO: 58699 - DNA, 25 bp, S. cerevisiae
tttaaacctggctgaatcgtacatt

SEQ ID NO: 58700 - DNA, 25 bp, S. cerevisiae
tatagcggccaatcaacggcgacct

SEQ ID NO: 58701 - DNA, 25 bp, S. cerevisiae
tatagcggccaatgcggccacgaat

SEQ ID NO: 58702 - DNA, 25 bp, S. cerevisiae
taggcgctgacacttgggccactta

SEQ ID NO: 58703 - DNA, 25 bp, S. cerevisiae
taggcggaagttgggcgttcatcat

SEQ ID NO: 58704 - DNA, 25 bp, S. cerevisiae
tatgtcggttgtacgggttctcccg

SEQ ID NO: 58705 - DNA, 25 bp, S. cerevisiae
tattcggcctttcgtgacttctcac

SEQ ID NO: 58706 - DNA, 25 bp, S. cerevisiae
tatactggctggtgcgggttccaaa

SEQ ID NO: 58707 - DNA, 25 bp, S. cerevisiae
tatagctcagtggtacgggattcaa

SEQ ID NO: 58708 - DNA, 25 bp, S. cerevisiae
tatagcgatgtgatacctgaatact

SEQ ID NO: 58709 - DNA, 25 bp, S. cerevisiae
tatatgcacgctctttccaaagctc

SEQ ID NO: 58710 - DNA, 25 bp, S. cerevisiae
tataacgggttgtcttgttggcctg

SEQ ID NO: 58711 - DNA, 25 bp, S. cerevisiae
tataacaacagtcccttattgcccg

SEQ ID NO: 58712 - DNA, 25 bp, S. cerevisiae
tataccaactagctttcattcctct

SEQ ID NO: 58713 - DNA, 25 bp, S. cerevisiae
tataacgaagttatggcccactcta

SEQ ID NO: 58714 - DNA, 25 bp, S. cerevisiae
tataggaaacttgacgctcccctag

SEQ ID NO: 58715 - DNA, 25 bp, S. cerevisiae
tatgggatagcagatctccgtccgc

SEQ ID NO: 58716 - DNA, 25 bp, S. cerevisiae
tatggcaccaacaaccgtagcgaca

SEQ ID NO: 58717 - DNA, 25 bp, S. cerevisiae
tatggaccaattgccagtgtcttca

SEQ ID NO: 58718 - DNA, 25 bp, S. cerevisiae
tatggccaaacagctgacgtcttct

SEQ ID NO: 58719 - DNA, 25 bp, S. cerevisiae
tatggttcgaacctacgactttgtt

SEQ ID NO: 58720 - DNA, 25 bp, S. cerevisiae
tatgaatgccggtgtcttacctcgt

SEQ ID NO: 58721 - DNA, 25 bp, S. cerevisiae
tatcaccttcatcttcgttagcttc

SEQ ID NO: 58722 - DNA, 25 bp, S. cerevisiae
tatcacgtacctttggtcttcttta

SEQ ID NO: 58723 - DNA, 25 bp, S. cerevisiae
tatacgctgagcctgagaacttttt

SEQ ID NO: 58724 - DNA, 25 bp, S. cerevisiae
tatgaatgttctaccgcaatctccc

SEQ ID NO: 58725 - DNA, 25 bp, S. cerevisiae
tatgaaatgcttgccggatacactc

SEQ ID NO: 58726 - DNA, 25 bp, S. cerevisiae
tatgatgaattgtcctcgctgtcaa

SEQ ID NO: 58727 - DNA, 25 bp, S. cerevisiae
tatggcgtatcaacttttcactaag

SEQ ID NO: 58728 - DNA, 25 bp, S. cerevisiae
tatccgtctttgttttcttgggaca

SEQ ID NO: 58729 - DNA, 25 bp, S. cerevisiae
tatcccctctatcgttttgggaaca

SEQ ID NO: 58730 - DNA, 25 bp, S. cerevisiae
ttgaccgccgaaggttatggtaaca

SEQ ID NO: 58731 - DNA, 25 bp, S. cerevisiae
tatggatgcgtctcgtgctttagaa

SEQ ID NO: 58732 - DNA, 25 bp, S. cerevisiae
taggatctgacaacgctgctgtaca

SEQ ID NO: 58733 - DNA, 25 bp, S. cerevisiae
tatggcgcatatggtattcagttga

SEQ ID NO: 58734 - DNA, 25 bp, S. cerevisiae
taggacaaatagtctcagcttggag

SEQ ID NO: 58735 - DNA, 25 bp, S. cerevisiae
tatggtcatctacgcctctgttggt

SEQ ID NO: 58736 - DNA, 25 bp, S. cerevisiae
tttgtctttcccagttggtttcaag

SEQ ID NO: 58737 - DNA, 25 bp, S. cerevisiae
tatggtttttccagttttctagaag

SEQ ID NO: 58738 - DNA, 25 bp, S. cerevisiae
tatctaatctcctcattcgacattc

SEQ ID NO: 58739 - DNA, 25 bp, S. cerevisiae
tatcgaccctgatttcttgcaaaca

SEQ ID NO: 58740 - DNA, 25 bp, S. cerevisiae
tatgaactgaccactttaagcacac

SEQ ID NO: 58741 - DNA, 25 bp, S. cerevisiae
tatgaccattgagcttctacctcac

SEQ ID NO: 58742 - DNA, 25 bp, S. cerevisiae
tatgtcccgcagattcttgtaagaa

SEQ ID NO: 58743 - DNA, 25 bp, S. cerevisiae
tatgaccctgtcaacatggctaaaa

SEQ ID NO: 58744 - DNA, 25 bp, S. cerevisiae
tatcactgttgatgccttaagagat

SEQ ID NO: 58745 - DNA, 25 bp, S. cerevisiae
tatggttgccaaatagcgataagct

SEQ ID NO: 58746 - DNA, 25 bp, S. cerevisiae
tatggttcactatagccttgagaaa

SEQ ID NO: 58747 - DNA, 25 bp, S. cerevisiae
tatggttgactgtgtcttcgcagat

SEQ ID NO: 58748 - DNA, 25 bp, S. cerevisiae
tatggttcaacgctgatccgagcat

SEQ ID NO: 58749 - DNA, 25 bp, S. cerevisiae
tatggtggtgatcttgacgcagaca

SEQ ID NO: 58750 - DNA, 25 bp, S. cerevisiae
tatgttctggtcaatctgccggtat

SEQ ID NO: 58751 - DNA, 25 bp, S. cerevisiae
tatgtttgcagagatcgccctgtgt

SEQ ID NO: 58752 - DNA, 25 bp, S. cerevisiae
tttgtcaatggcatgcagccctgag

SEQ ID NO: 58753 - DNA, 25 bp, S. cerevisiae
ttttcatatcaccatgcgcacatag

SEQ ID NO: 58754 - DNA, 25 bp, S. cerevisiae
tatgccacgattcagcaacactgct

SEQ ID NO: 58755 - DNA, 25 bp, S. cerevisiae
tatgccaaatcccagtacagcttaa

SEQ ID NO: 58756 - DNA, 25 bp, S. cerevisiae
tatcatcagtgacaggtgccatttg

SEQ ID NO: 58757 - DNA, 25 bp, S. cerevisiae
tataggtctcgcaagttcggataca

SEQ ID NO: 58758 - DNA, 25 bp, S. cerevisiae
tatcgtgcttggtggtcttgcatac

SEQ ID NO: 58759 - DNA, 25 bp, S. cerevisiae
tatgtgtctttgttggtgccatggc

SEQ ID NO: 58760 - DNA, 25 bp, S. cerevisiae
tatgcctccgaaatttacaccagta

SEQ ID NO: 58761 - DNA, 25 bp, S. cerevisiae
tatgcctggcggctttagatcagca

SEQ ID NO: 58762 - DNA, 25 bp, S. cerevisiae
tatcctggcgcatttttgaattcaa

SEQ ID NO: 58763 - DNA, 25 bp, S. cerevisiae
tatggacgtatttacctgcgggacc

SEQ ID NO: 58764 - DNA, 25 bp, S. cerevisiae
tatggactgtatcaacttctgggca

SEQ ID NO: 58765 - DNA, 25 bp, S. cerevisiae
tatagcttgcatggcgtacacgagt

SEQ ID NO: 58766 - DNA, 25 bp, S. cerevisiae
tatacaagggcgcaactggagatct

SEQ ID NO: 58767 - DNA, 25 bp, S. cerevisiae
tatcaaaggtgtcttctgggaccca

SEQ ID NO: 58768 - DNA, 25 bp, S. cerevisiae
tatcgaagagttattagcaggcatt

SEQ ID NO: 58769 - DNA, 25 bp, S. cerevisiae
tatcccatggtttcctagctcaaat

SEQ ID NO: 58770 - DNA, 25 bp, S. cerevisiae
tatgcagtcgacttgggcagagcca

SEQ ID NO: 58771 - DNA, 25 bp, S. cerevisiae
tatcccgatgacatttccatgcaac

SEQ ID NO: 58772 - DNA, 25 bp, S. cerevisiae
tatctccaaggctctatccaaagat

SEQ ID NO: 58773 - DNA, 25 bp, S. cerevisiae
tatctccaaggctctatccaaggac

SEQ ID NO: 58774 - DNA, 25 bp, S. cerevisiae
tatcatccaaacgtgtatccaagtg

SEQ ID NO: 58775 - DNA, 25 bp, S. cerevisiae
tatctcgtatatatgcatccaatgc

SEQ ID NO: 58776 - DNA, 25 bp, S. cerevisiae
tatctggtacgaatgcagtcttgga

SEQ ID NO: 58777 - DNA, 25 bp, S. cerevisiae
tatggtagacagttacctcgctcca

SEQ ID NO: 58778 - DNA, 25 bp, S. cerevisiae
tatcggtgacatcaactctcatctt

SEQ ID NO: 58779 - DNA, 25 bp, S. cerevisiae
tatcaggctacccaatcgactttat

SEQ ID NO: 58780 - DNA, 25 bp, S. cerevisiae
tattgcctcggtaacgacgttgaac

SEQ ID NO: 58781 - DNA, 25 bp, S. cerevisiae
tatatcgtccgtatctgatcactgg

SEQ ID NO: 58782 - DNA, 25 bp, S. cerevisiae
tatcgtccaatgtcacatccatgcg

SEQ ID NO: 58783 - DNA, 25 bp, S. cerevisiae
tatggtccttgctactgcaatcagt

SEQ ID NO: 58784 - DNA, 25 bp, S. cerevisiae
tatcgccatttctgcagcatctaat

SEQ ID NO: 58785 - DNA, 25 bp, S. cerevisiae
tatgcgcacatggtaggactcttat

SEQ ID NO: 58786 - DNA, 25 bp, S. cerevisiae
tatcccgcagtgaggtgctcttagt

SEQ ID NO: 58787 - DNA, 25 bp, S. cerevisiae
tatctgccgggacagagctggtatt

SEQ ID NO: 58788 - DNA, 25 bp, S. cerevisiae
tatcccattcgaccaacctgtattg

SEQ ID NO: 58789 - DNA, 25 bp, S. cerevisiae
tatactacacttccttacgatttta

SEQ ID NO: 58790 - DNA, 25 bp, S. cerevisiae
ttacggtttcggtgccatttctaag

SEQ ID NO: 58791 - DNA, 25 bp, S. cerevisiae
ttacggttccggtttagctgcatct

SEQ ID NO: 58792 - DNA, 25 bp, S. cerevisiae
ttacgccttgcacagtttaggttgc

SEQ ID NO: 58793 - DNA, 25 bp, S. cerevisiae
ttgacgactcgacaggtctacgtga

SEQ ID NO: 58794 - DNA, 25 bp, S. cerevisiae
tatgactactccctagacttatggt

SEQ ID NO: 58795 - DNA, 25 bp, S. cerevisiae
tatggatctccatgcttcacaaatt

SEQ ID NO: 58796 - DNA, 25 bp, S. cerevisiae
tatgtgcaagtcctaatatctcaat

SEQ ID NO: 58797 - DNA, 25 bp, S. cerevisiae
tatgaccgtcgtatatgtgcagata

SEQ ID NO: 58798 - DNA, 25 bp, S. cerevisiae
tatcccatgggtagcaagtgaacaa

SEQ ID NO: 58799 - DNA, 25 bp, S. cerevisiae
tttgttgttgcccaagtgaagacaa

SEQ ID NO: 58800 - DNA, 25 bp, S. cerevisiae
tatcgtttgaagtcgtcactcagga

SEQ ID NO: 58801 - DNA, 25 bp, S. cerevisiae
tatggattgtttccccattcagggt

SEQ ID NO: 58802 - DNA, 25 bp, S. cerevisiae
tatttgcccttttcgaattttggag

SEQ ID NO: 58803 - DNA, 25 bp, S. cerevisiae
tatcttccaatatatccggtctcga

SEQ ID NO: 58804 - DNA, 25 bp, S. cerevisiae
tatggatgttttcacctggtcacta

SEQ ID NO: 58805 - DNA, 25 bp, S. cerevisiae
tatggttctgttggacgggctacta

SEQ ID NO: 58806 - DNA, 25 bp, S. cerevisiae
tatgggttgtttacgggttcatcat

SEQ ID NO: 58807 - DNA, 25 bp, S. cerevisiae
tatggccgctttggatgctgagaaa

SEQ ID NO: 58808 - DNA, 25 bp, S. cerevisiae
tatggcattgcattctcagtatgag

SEQ ID NO: 58809 - DNA, 25 bp, S. cerevisiae
tatggttgctactgatgtggccgcc

SEQ ID NO: 58810 - DNA, 25 bp, S. cerevisiae
tatcgttgctatctgtcgttcgcca

SEQ ID NO: 58811 - DNA, 25 bp, S. cerevisiae
tattttggttatgttcccctctcaa

SEQ ID NO: 58812 - DNA, 25 bp, S. cerevisiae
tttttggatttgtgtcagccttccc

SEQ ID NO: 58813 - DNA, 25 bp, S. cerevisiae
tattttattgacatcgtcgccccaa

SEQ ID NO: 58814 - DNA, 25 bp, S. cerevisiae
tatgtgtctaccagatggatcccgg

SEQ ID NO: 58815 - DNA, 25 bp, S. cerevisiae
tatgattcgcctttgagtggcaccg

SEQ ID NO: 58816 - DNA, 25 bp, S. cerevisiae
tataacgtcgcagctatccatggtg

SEQ ID NO: 58817 - DNA, 25 bp, S. cerevisiae
tatcacatcaaggaacttttggagg

SEQ ID NO: 58818 - DNA, 25 bp, S. cerevisiae
tataaccaggacgttcttgatgaac

SEQ ID NO: 58819 - DNA, 25 bp, S. cerevisiae
tataaagttaccgagcgctattgcg

SEQ ID NO: 58820 - DNA, 25 bp, S. cerevisiae
tatccagaatggttcgcagggtcaa

SEQ ID NO: 58821 - DNA, 25 bp, S. cerevisiae
tatactactgatttcgacggccaag

SEQ ID NO: 58822 - DNA, 25 bp, S. cerevisiae
tatcgttgaagtagacggtcgccta

SEQ ID NO: 58823 - DNA, 25 bp, S. cerevisiae
tatggcttaggtacctggcatgcgc

SEQ ID NO: 58824 - DNA, 25 bp, S. cerevisiae
tatgcgggctacttgactactgaat

SEQ ID NO: 58825 - DNA, 25 bp, S. cerevisiae
tatctgcaggtacgcttcttaaagg

SEQ ID NO: 58826 - DNA, 25 bp, S. cerevisiae
tataccccacgtgaatttgaaccat

SEQ ID NO: 58827 - DNA, 25 bp, S. cerevisiae
tatgcatgcgttattggtcccggta

SEQ ID NO: 58828 - DNA, 25 bp, S. cerevisiae
tatccaatatgtgtcctcaagtagg

SEQ ID NO: 58829 - DNA, 25 bp, S. cerevisiae
tatgactacgtattccatcaagtgg

SEQ ID NO: 58830 - DNA, 25 bp, S. cerevisiae
tatgtattatctacctgcacgcagg

SEQ ID NO: 58831 - DNA, 25 bp, S. cerevisiae
tatccgatccagtcgaacgtgacgt

SEQ ID NO: 58832 - DNA, 25 bp, S. cerevisiae
tatccacggcaatgaccctgtgaaa

SEQ ID NO: 58833 - DNA, 25 bp, S. cerevisiae
tatgtcccagcttagtctgcggcta

SEQ ID NO: 58834 - DNA, 25 bp, S. cerevisiae
tatgcacgggcaaagcactggcgaa

SEQ ID NO: 58835 - DNA, 25 bp, S. cerevisiae
tatgcactagttgcactaggcgcaa

SEQ ID NO: 58836 - DNA, 25 bp, S. cerevisiae
tatgattcgtttggctgaggcgcac

SEQ ID NO: 58837 - DNA, 25 bp, S. cerevisiae
tatacgccgcaagagatccaggaaa

SEQ ID NO: 58838 - DNA, 25 bp, S. cerevisiae
tataagcccattaaaccgcgaattg

SEQ ID NO: 58839 - DNA, 25 bp, S. cerevisiae
tatcttctcgagtgcaatggtctaa

SEQ ID NO: 58840 - DNA, 25 bp, S. cerevisiae
tatcctatgatgatggctctgaaca

SEQ ID NO: 58841 - DNA, 25 bp, S. cerevisiae
tatccatctgagtggcaacgaattc

SEQ ID NO: 58842 - DNA, 25 bp, S. cerevisiae
tatcccataggctgtacgaatctct

SEQ ID NO: 58843 - DNA, 25 bp, S. cerevisiae
tatcccatagtctcccaaatgtttg

SEQ ID NO: 58844 - DNA, 25 bp, S. cerevisiae
tatccccgtccaaaagcttgtttat

SEQ ID NO: 58845 - DNA, 25 bp, S. cerevisiae
tatcgccttacgaagcatgcgtttt

SEQ ID NO: 58846 - DNA, 25 bp, S. cerevisiae
tatgtgaaaacgctgctctttatca

SEQ ID NO: 58847 - DNA, 25 bp, S. cerevisiae
tatcagattcatttgtccagcctca

SEQ ID NO: 58848 - DNA, 25 bp, S. cerevisiae
tatatatcttactgttccggcctag

SEQ ID NO: 58849 - DNA, 25 bp, S. cerevisiae
tatgttgttactaggagcggcgtga

SEQ ID NO: 58850 - DNA, 25 bp, S. cerevisiae
ttttgttatcttctctactgtcggt

SEQ ID NO: 58851 - DNA, 25 bp, S. cerevisiae
tatcttttggttcgtcttcgttagt

SEQ ID NO: 58852 - DNA, 25 bp, S. cerevisiae
tatgcttattggctctgttatttta

SEQ ID NO: 58853 - DNA, 25 bp, S. cerevisiae
tatccgtttgtccgtttttcttcat

SEQ ID NO: 58854 - DNA, 25 bp, S. cerevisiae
tatctcccgtggatgacattaccaa

SEQ ID NO: 58855 - DNA, 25 bp, S. cerevisiae
tatgatgccacccatgaaccaacag

SEQ ID NO: 58856 - DNA, 25 bp, S. cerevisiae
tatgatgcacacgaggacaactttg

SEQ ID NO: 58857 - DNA, 25 bp, S. cerevisiae
tatatggcaccagaagcactagttg

SEQ ID NO: 58858 - DNA, 25 bp, S. cerevisiae
tatgatgccactgacaagcctttct

SEQ ID NO: 58859 - DNA, 25 bp, S. cerevisiae
tatgctgcacctgaagtccttggtg

SEQ ID NO: 58860 - DNA, 25 bp, S. cerevisiae
tatggtgtttccatcactgatgctt

SEQ ID NO: 58861 - DNA, 25 bp, S. cerevisiae
tatggtctccttactgagtggcttt

SEQ ID NO: 58862 - DNA, 25 bp, S. cerevisiae
tatggtccataaactaatctcttag

SEQ ID NO: 58863 - DNA, 25 bp, S. cerevisiae
tatggtcgcatctatacttggtgtg

SEQ ID NO: 58864 - DNA, 25 bp, S. cerevisiae
tatctctctcccattatggcagaca

SEQ ID NO: 58865 - DNA, 25 bp, S. cerevisiae
tatccattgccggtgccttgaagaa

SEQ ID NO: 58866 - DNA, 25 bp, S. cerevisiae
tatcatcggtggtacttccagaggt

SEQ ID NO: 58867 - DNA, 25 bp, S. cerevisiae
tatgaaggcggtatctccagcgtgt

SEQ ID NO: 58868 - DNA, 25 bp, S. cerevisiae
tatgttgtcgttaagcatgccgctt

SEQ ID NO: 58869 - DNA, 25 bp, S. cerevisiae
tatgcgtcaaactttagcgccatat

SEQ ID NO: 58870 - DNA, 25 bp, S. cerevisiae
tatgcaataaactcaggcgccaggt

SEQ ID NO: 58871 - DNA, 25 bp, S. cerevisiae
tatcacaataacaccgcacaagctt

SEQ ID NO: 58872 - DNA, 25 bp, S. cerevisiae
tatcgaccaaaaccacaacgtgctg

SEQ ID NO: 58873 - DNA, 25 bp, S. cerevisiae
tattggtagaccacttgaccgaccc

SEQ ID NO: 58874 - DNA, 25 bp, S. cerevisiae
tatgtggtgaacgatacggctccga

SEQ ID NO: 58875 - DNA, 25 bp, S. cerevisiae
tatgccttctattccattggtacca

SEQ ID NO: 58876 - DNA, 25 bp, S. cerevisiae
tatgcacttcttctcattttcccga

SEQ ID NO: 58877 - DNA, 25 bp, S. cerevisiae
tatgctaccaccaagttactcggac

SEQ ID NO: 58878 - DNA, 25 bp, S. cerevisiae
tatgtaccgcagttattcactccga

SEQ ID NO: 58879 - DNA, 25 bp, S. cerevisiae
tatgatgaactcacagtccccaagg

SEQ ID NO: 58880 - DNA, 25 bp, S. cerevisiae
tatgtacactttgtctgcccaagat

SEQ ID NO: 58881 - DNA, 25 bp, S. cerevisiae
tatgctgtactttggatatgctgtt

SEQ ID NO: 58882 - DNA, 25 bp, S. cerevisiae
tatgatttgctttctacgtgtgata

SEQ ID NO: 58883 - DNA, 25 bp, S. cerevisiae
tatgtcaagctttccaatggtgcaa

SEQ ID NO: 58884 - DNA, 25 bp, S. cerevisiae
tatatctcgctcagaaatggtgcat

SEQ ID NO: 58885 - DNA, 25 bp, S. cerevisiae
ttaaccgacggttgcaaacaacaat

SEQ ID NO: 58886 - DNA, 25 bp, S. cerevisiae
ttaaacgacagggtaagccgccaat

SEQ ID NO: 58887 - DNA, 25 bp, S. cerevisiae
ttaaagccctacgttaacgcaaatg

SEQ ID NO: 58888 - DNA, 25 bp, S. cerevisiae
ttttacgatctacgctttttgaaat

SEQ ID NO: 58889 - DNA, 25 bp, S. cerevisiae
tatttgggagcttggttctttgcaa

SEQ ID NO: 58890 - DNA, 25 bp, S. cerevisiae
tatgttgcggaccacctattttcgt

SEQ ID NO: 58891 - DNA, 25 bp, S. cerevisiae
tatctctgggctggaagttttcgac

SEQ ID NO: 58892 - DNA, 25 bp, S. cerevisiae
tatcctcgtttctgtttctctacat

SEQ ID NO: 58893 - DNA, 25 bp, S. cerevisiae
ttccttttgacatcggatttcctaa

SEQ ID NO: 58894 - DNA, 25 bp, S. cerevisiae
ttgacttttcactgggtatccctat

SEQ ID NO: 58895 - DNA, 25 bp, S. cerevisiae
ttgacttaaccaacggcgaaccatt

SEQ ID NO: 58896 - DNA, 25 bp, S. cerevisiae
ttacttacaccccagtcagacatgg

SEQ ID NO: 58897 - DNA, 25 bp, S. cerevisiae
tatgatcaataaccctaatgacgtt

SEQ ID NO: 58898 - DNA, 25 bp, S. cerevisiae
tatgatgctttctgtccaatttgga

SEQ ID NO: 58899 - DNA, 25 bp, S. cerevisiae
tatgttctcttgcatcctctaagga

SEQ ID NO: 58900 - DNA, 25 bp, S. cerevisiae
tatgctcccttttgtgcttcagagg

SEQ ID NO: 58901 - DNA, 25 bp, S. cerevisiae
tatgctgctcctctttttcaaacga

SEQ ID NO: 58902 - DNA, 25 bp, S. cerevisiae
tatcatccggagctgttcttagaca

SEQ ID NO: 58903 - DNA, 25 bp, S. cerevisiae
tttccttgaccgcactatcagagag

SEQ ID NO: 58904 - DNA, 25 bp, S. cerevisiae
ttttgcgtacgtgactgacggtgct

SEQ ID NO: 58905 - DNA, 25 bp, S. cerevisiae
tattatggtgcctttactgacgaag

SEQ ID NO: 58906 - DNA, 25 bp, S. cerevisiae
tatctaggtctctcccttagaagag

SEQ ID NO: 58907 - DNA, 25 bp, S. cerevisiae
tatgttcctaatacctgtgtgtttg

SEQ ID NO: 58908 - DNA, 25 bp, S. cerevisiae
tattccctttgagttcctgtttgga

SEQ ID NO: 58909 - DNA, 25 bp, S. cerevisiae
tataccttttgcatagcccatttgt

SEQ ID NO: 58910 - DNA, 25 bp, S. cerevisiae
tatgcgctctttattataccgtatg

SEQ ID NO: 58911 - DNA, 25 bp, S. cerevisiae
tatcgtcactgctttcatctggaaa

SEQ ID NO: 58912 - DNA, 25 bp, S. cerevisiae
tatgctgtcctcattatctcgatga

SEQ ID NO: 58913 - DNA, 25 bp, S. cerevisiae
tatgcgggctctatcattgaatgtg

SEQ ID NO: 58914 - DNA, 25 bp, S. cerevisiae
tatgtctgccggtctactagagtta

SEQ ID NO: 58915 - DNA, 25 bp, S. cerevisiae
tatgattgctcatggtgctgcctca

SEQ ID NO: 58916 - DNA, 25 bp, S. cerevisiae
ttgctagcgatgcagagctgactga

SEQ ID NO: 58917 - DNA, 25 bp, S. cerevisiae
tattgagcagaccatgcactcgcta

SEQ ID NO: 58918 - DNA, 25 bp, S. cerevisiae
tatgatcgcaacctgaatcgtgatg

SEQ ID NO: 58919 - DNA, 25 bp, S. cerevisiae
tatgttcaagcgctacggtgcctaa

SEQ ID NO: 58920 - DNA, 25 bp, S. cerevisiae
tatgtacaacagctcaccgtcagta

SEQ ID NO: 58921 - DNA, 25 bp, S. cerevisiae
tatcatctgggtgtaggcggcttat

SEQ ID NO: 58922 - DNA, 25 bp, S. cerevisiae
tatatctgggagttgggctcgcttc

SEQ ID NO: 58923 - DNA, 25 bp, S. cerevisiae
tatgatacccatgcttgctcttttg

SEQ ID NO: 58924 - DNA, 25 bp, S. cerevisiae
tatccactctacctcacaataattg

SEQ ID NO: 58925 - DNA, 25 bp, S. cerevisiae
tatcatcttctaccatcccaaagta

SEQ ID NO: 58926 - DNA, 25 bp, S. cerevisiae
tatgcttgatggtttgttacaggcc

SEQ ID NO: 58927 - DNA, 25 bp, S. cerevisiae
tattgtgtcgtttttcgaggttttg

SEQ ID NO: 58928 - DNA, 25 bp, S. cerevisiae
tttttcttaagttccgtcgttcatg

SEQ ID NO: 58929 - DNA, 25 bp, S. cerevisiae
tttggaactcccgaattgaccgact

SEQ ID NO: 58930 - DNA, 25 bp, S. cerevisiae
tatgaggaacccagaatcccctata

SEQ ID NO: 58931 - DNA, 25 bp, S. cerevisiae
tataggaaccgttgtctccccatat

SEQ ID NO: 58932 - DNA, 25 bp, S. cerevisiae
tatccgagactaaaggtggcccaat

SEQ ID NO: 58933 - DNA, 25 bp, S. cerevisiae
ttgcgtattacgttgggagcttccg

SEQ ID NO: 58934 - DNA, 25 bp, S. cerevisiae
tatcgggttgtctgtgcatgagcac

SEQ ID NO: 58935 - DNA, 25 bp, S. cerevisiae
tatctctagcgctctatccgcagac

SEQ ID NO: 58936 - DNA, 25 bp, S. cerevisiae
tatctctagcgctctatccgcagac

SEQ ID NO: 58937 - DNA, 25 bp, S. cerevisiae
tatcatcattggtcacaacccagat

SEQ ID NO: 58938 - DNA, 25 bp, S. cerevisiae
tatagaattgtgtagaattgcagat

SEQ ID NO: 58939 - DNA, 25 bp, S. cerevisiae
tatagactctagctcgttgaacaaa

SEQ ID NO: 58940 - DNA, 25 bp, S. cerevisiae
ttggccctagattcgtctggacaag

SEQ ID NO: 58941 - DNA, 25 bp, S. cerevisiae
tatcgtttgattgcatggctaatac

SEQ ID NO: 58942 - DNA, 25 bp, S. cerevisiae
tatccttgatttgaagccatcttta

SEQ ID NO: 58943 - DNA, 25 bp, S. cerevisiae
tatccctggtatgttcgtctttttc

SEQ ID NO: 58944 - DNA, 25 bp, S. cerevisiae
tatcgattggtttttcggttgcctt

SEQ ID NO: 58945 - DNA, 25 bp, S. cerevisiae
ttccattggtttcacagtcggcgct

SEQ ID NO: 58946 - DNA, 25 bp, S. cerevisiae
tttcacgacttttaagccagggcta

SEQ ID NO: 58947 - DNA, 25 bp, S. cerevisiae
ttccagaactttcggtcaaagggct

SEQ ID NO: 58948 - DNA, 25 bp, S. cerevisiae
tatgccaccaataagaggacctaag

SEQ ID NO: 58949 - DNA, 25 bp, S. cerevisiae
tatccactagtgagggagctgcata

SEQ ID NO: 58950 - DNA, 25 bp, S. cerevisiae
tatgctactgataacgagtggcgat

SEQ ID NO: 58951 - DNA, 25 bp, S. cerevisiae
tatgccagtgtgaccgctgtcaaaa

SEQ ID NO: 58952 - DNA, 25 bp, S. cerevisiae
tatgcgagtatcttgcgcttgataa

SEQ ID NO: 58953 - DNA, 25 bp, S. cerevisiae
tatgaaagccctcccaaaaggtcct

SEQ ID NO: 58954 - DNA, 25 bp, S. cerevisiae
tttcaatgccctacaaaagccggtt

SEQ ID NO: 58955 - DNA, 25 bp, S. cerevisiae
tttgatggacctgggaaacgggctt

SEQ ID NO: 58956 - DNA, 25 bp, S. cerevisiae
ttgggaactcggaaagcacggtatt

SEQ ID NO: 58957 - DNA, 25 bp, S. cerevisiae
ttgggccaaggcgaagtaattaaag

SEQ ID NO: 58958 - DNA, 25 bp, S. cerevisiae
tatgcctccacagccaagagattta

SEQ ID NO: 58959 - DNA, 25 bp, S. cerevisiae
tatgctattcattctcaaaggtttg

SEQ ID NO: 58960 - DNA, 25 bp, S. cerevisiae
tatctactgcacttatacgggttaa

SEQ ID NO: 58961 - DNA, 25 bp, S. cerevisiae
tatcccgtgttaacgcgtttaggca

SEQ ID NO: 58962 - DNA, 25 bp, S. cerevisiae
tatttgggaagacggttcaacctca

SEQ ID NO: 58963 - DNA, 25 bp, S. cerevisiae
tattaaataatctaagttacctgat

SEQ ID NO: 58964 - DNA, 25 bp, S. cerevisiae
tattcaaacacctcactatatcctg

SEQ ID NO: 58965 - DNA, 25 bp, S. cerevisiae
tttcaagccaaaccctgaactgcag

SEQ ID NO: 58966 - DNA, 25 bp, S. cerevisiae
ttacacacaataggcgacgtttact

SEQ ID NO: 58967 - DNA, 25 bp, S. cerevisiae
ttcaaacaaaccacgtgatggtcta

SEQ ID NO: 58968 - DNA, 25 bp, S. cerevisiae
ttgagatacaaacctccctggtgag

SEQ ID NO: 58969 - DNA, 25 bp, S. cerevisiae
tatagaatgtttcccgtcttcgact

SEQ ID NO: 58970 - DNA, 25 bp, S. cerevisiae
tataccatgtttgcattccgtaagg

SEQ ID NO: 58971 - DNA, 25 bp, S. cerevisiae
tatactgtgtttgagatgccgatat

SEQ ID NO: 58972 - DNA, 25 bp, S. cerevisiae
tatgctatttttgcggtagccgtcg

SEQ ID NO: 58973 - DNA, 25 bp, S. cerevisiae
tatctcattgataggctctgcactc

SEQ ID NO: 58974 - DNA, 25 bp, S. cerevisiae
tatgctagtgatcacatttccctaa

SEQ ID NO: 58975 - DNA, 25 bp, S. cerevisiae
tatgctgctttgctgtgtttgcctc

SEQ ID NO: 58976 - DNA, 25 bp, S. cerevisiae
tatctatctcatccttttgtgctgg

SEQ ID NO: 58977 - DNA, 25 bp, S. cerevisiae
tatcgtggccgttctttaagcaggg

SEQ ID NO: 58978 - DNA, 25 bp, S. cerevisiae
tatgctcgaagttagggttctaccc

SEQ ID NO: 58979 - DNA, 25 bp, S. cerevisiae
tatgcatcaaagtacaggcgctgtc

SEQ ID NO: 58980 - DNA, 25 bp, S. cerevisiae
ttgaaaaggacaccgaggccacatt

SEQ ID NO: 58981 - DNA, 25 bp, S. cerevisiae
tatgcacaattttccccgttaacaa

SEQ ID NO: 58982 - DNA, 25 bp, S. cerevisiae
tatagttttgtctgtgggtccacca

SEQ ID NO: 58983 - DNA, 25 bp, S. cerevisiae
tataacaattgtttggccaccctcc

SEQ ID NO: 58984 - DNA, 25 bp, S. cerevisiae
tatagtccgcgcacttttaccaata

SEQ ID NO: 58985 - DNA, 25 bp, S. cerevisiae
tatagtcattcctggtatcatcaca

SEQ ID NO: 58986 - DNA, 25 bp, S. cerevisiae
tatcagtttacccttatcccataag

SEQ ID NO: 58987 - DNA, 25 bp, S. cerevisiae
tatgcccttgtcctttactttgaat

SEQ ID NO: 58988 - DNA, 25 bp, S. cerevisiae
tatgcccgcattgtgctgagtgtac

SEQ ID NO: 58989 - DNA, 25 bp, S. cerevisiae
tatgccttgcttggtgatgatgtaa

SEQ ID NO: 58990 - DNA, 25 bp, S. cerevisiae
tatctctttgcctttcagcaatgct

SEQ ID NO: 58991 - DNA, 25 bp, S. cerevisiae
tatctcgctgacgtttacagtgctt

SEQ ID NO: 58992 - DNA, 25 bp, S. cerevisiae
tatccaatgcaccaattatcactgt

SEQ ID NO: 58993 - DNA, 25 bp, S. cerevisiae
tatgacaatgctccttatgctcctg

SEQ ID NO: 58994 - DNA, 25 bp, S. cerevisiae
tatccaggactgaattgcccatttc

SEQ ID NO: 58995 - DNA, 25 bp, S. cerevisiae
tatactatgttggtcttggcttaat

SEQ ID NO: 58996 - DNA, 25 bp, S. cerevisiae
tatccttggtgattccttcttgaga

SEQ ID NO: 58997 - DNA, 25 bp, S. cerevisiae
tatcctgtggcctctttgttcgaaa

SEQ ID NO: 58998 - DNA, 25 bp, S. cerevisiae
tatccgtggcactcttttgggaaac

SEQ ID NO: 58999 - DNA, 25 bp, S. cerevisiae
tatcggactctaccatatcaaagga

SEQ ID NO: 59000 - DNA, 25 bp, S. cerevisiae
ttctcgtatacctgtcaacgggttt

SEQ ID NO: 59001 - DNA, 25 bp, S. cerevisiae
tttggttacgatatcagcgccggtt

SEQ ID NO: 59002 - DNA, 25 bp, S. cerevisiae
tatttcttatttggcgtcggatttg

SEQ ID NO: 59003 - DNA, 25 bp, S. cerevisiae
tttagtgacccctcgggagatatcg

SEQ ID NO: 59004 - DNA, 25 bp, S. cerevisiae
tatttccggcccattgttacctctt

SEQ ID NO: 59005 - DNA, 25 bp, S. cerevisiae
tatcgtttctgttcgttgtttacct

SEQ ID NO: 59006 - DNA, 25 bp, S. cerevisiae
tatgccgacttctaccacgaataag

SEQ ID NO: 59007 - DNA, 25 bp, S. cerevisiae
tatccgactttactatgcagaccag

SEQ ID NO: 59008 - DNA, 25 bp, S. cerevisiae
tatcctgaaccgttactacagcagc

SEQ ID NO: 59009 - DNA, 25 bp, S. cerevisiae
tatccatacccgtttctagacgtga

SEQ ID NO: 59010 - DNA, 25 bp, S. cerevisiae
tatcgcccgatttacatgacatgaa

SEQ ID NO: 59011 - DNA, 25 bp, S. cerevisiae
tatccaaatttgtcttctctcttaa

SEQ ID NO: 59012 - DNA, 25 bp, S. cerevisiae
tatccacctacattcggctttcata

SEQ ID NO: 59013 - DNA, 25 bp, S. cerevisiae
tatcccgcatactcgtctatttaaa

SEQ ID NO: 59014 - DNA, 25 bp, S. cerevisiae
tatcccacatactagagctcaactt

SEQ ID NO: 59015 - DNA, 25 bp, S. cerevisiae
tatccctcaggttatcagcgatggc

SEQ ID NO: 59016 - DNA, 25 bp, S. cerevisiae
tatcgtgtaatgtccattcccaggc

SEQ ID NO: 59017 - DNA, 25 bp, S. cerevisiae
tatctgttgacgagacgatcactaa

SEQ ID NO: 59018 - DNA, 25 bp, S. cerevisiae
tttgggctcttttgcaaagcggaag

SEQ ID NO: 59019 - DNA, 25 bp, S. cerevisiae
tatcgccgatagatgtctgccaaga

SEQ ID NO: 59020 - DNA, 25 bp, S. cerevisiae
tatccctactgtcgtggtggtattt

SEQ ID NO: 59021 - DNA, 25 bp, S. cerevisiae
tatcccatggtttgcgtgggctttt

SEQ ID NO: 59022 - DNA, 25 bp, S. cerevisiae
tatcaacggtgttcggagcggtttc

SEQ ID NO: 59023 - DNA, 25 bp, S. cerevisiae
tatagtcgcgcaatccgtgtcgtta

SEQ ID NO: 59024 - DNA, 25 bp, S. cerevisiae
tatcatgtgtcggtacttggcagtt

SEQ ID NO: 59025 - DNA, 25 bp, S. cerevisiae
tatcaagactacaaccaccacatat

SEQ ID NO: 59026 - DNA, 25 bp, S. cerevisiae
tatttccactcgacatgttatcatg

SEQ ID NO: 59027 - DNA, 25 bp, S. cerevisiae
tatccaccctcacttgtatactgat

SEQ ID NO: 59028 - DNA, 25 bp, S. cerevisiae
tatgcgtacgcagattcgaatcctc

SEQ ID NO: 59029 - DNA, 25 bp, S. cerevisiae
tatcgtagccttttagagaccccaa

SEQ ID NO: 59030 - DNA, 25 bp, S. cerevisiae
tatttgcaggcagtttgcggccaaa

SEQ ID NO: 59031 - DNA, 25 bp, S. cerevisiae
tatttatacgctttggctgcagaaa

SEQ ID NO: 59032 - DNA, 25 bp, S. cerevisiae
tttcttccacgaccctaaattcatt

SEQ ID NO: 59033 - DNA, 25 bp, S. cerevisiae
tattcccagacgatcctaaggctag

SEQ ID NO: 59034 - DNA, 25 bp, S. cerevisiae
ttcttcgcagtattggaaaacctag

SEQ ID NO: 59035 - DNA, 25 bp, S. cerevisiae
tttttcgtattgctaaactcgggca

SEQ ID NO: 59036 - DNA, 25 bp, S. cerevisiae
tttacacgtttccttaactcgatcg

SEQ ID NO: 59037 - DNA, 25 bp, S. cerevisiae
tattgaacgctgctggtaacacccc

SEQ ID NO: 59038 - DNA, 25 bp, S. cerevisiae
tatcgcaaacttcggtaccaccaaa

SEQ ID NO: 59039 - DNA, 25 bp, S. cerevisiae
tatccaagtcattcggtttagccgg

SEQ ID NO: 59040 - DNA, 25 bp, S. cerevisiae
ttcagcattgtctctttggtggcac

SEQ ID NO: 59041 - DNA, 25 bp, S. cerevisiae
tatctcgcagtagcgtgtgcctggt

SEQ ID NO: 59042 - DNA, 25 bp, S. cerevisiae
tatcatcggttgtgtggttggcata

SEQ ID NO: 59043 - DNA, 25 bp, S. cerevisiae
tatcatcgccacttggcattgcatt

SEQ ID NO: 59044 - DNA, 25 bp, S. cerevisiae
tatacaccaacaggcatcgagcatg

SEQ ID NO: 59045 - DNA, 25 bp, S. cerevisiae
tatacccattcaagatagcctaccc

SEQ ID NO: 59046 - DNA, 25 bp, S. cerevisiae
tatactgcaattacgtgacggcccc

SEQ ID NO: 59047 - DNA, 25 bp, S. cerevisiae
tatcatctgtacacttgccgggcaa

SEQ ID NO: 59048 - DNA, 25 bp, S. cerevisiae
tatactggagagactttctgcctga

SEQ ID NO: 59049 - DNA, 25 bp, S. cerevisiae
tatttgggaccgacgcatgacgcag

SEQ ID NO: 59050 - DNA, 25 bp, S. cerevisiae
tatctggtgagtgtgtcgctactgc

SEQ ID NO: 59051 - DNA, 25 bp, S. cerevisiae
tttggcatgggcgttgaaattcctt

SEQ ID NO: 59052 - DNA, 25 bp, S. cerevisiae
tattgaggttacacggacccttcaa

SEQ ID NO: 59053 - DNA, 25 bp, S. cerevisiae
tattaagtgtactccagaccgccta

SEQ ID NO: 59054 - DNA, 25 bp, S. cerevisiae
ttgtctgagttaggagccaacccct

SEQ ID NO: 59055 - DNA, 25 bp, S. cerevisiae
tatttgctcttgtggaactggcgtt

SEQ ID NO: 59056 - DNA, 25 bp, S. cerevisiae
tatttgcttttacttctcttgtagg

SEQ ID NO: 59057 - DNA, 25 bp, S. cerevisiae
tatatccgattaccttgctactttg

SEQ ID NO: 59058 - DNA, 25 bp, S. cerevisiae
tttgcaagctaaagggtcagtatcc

SEQ ID NO: 59059 - DNA, 25 bp, S. cerevisiae
ttaaacgagaactgtgccccaggct

SEQ ID NO: 59060 - DNA, 25 bp, S. cerevisiae
tatcaaggcatatctagccgcccgt

SEQ ID NO: 59061 - DNA, 25 bp, S. cerevisiae
tatcagcggatcgacatgtgcggcg

SEQ ID NO: 59062 - DNA, 25 bp, S. cerevisiae
tatgctggaaatgttgctgacgcgc

SEQ ID NO: 59063 - DNA, 25 bp, S. cerevisiae
ttcggcgctagatacgacggttctt

SEQ ID NO: 59064 - DNA, 25 bp, S. cerevisiae
tatcgaggccaataccactgacttg

SEQ ID NO: 59065 - DNA, 25 bp, S. cerevisiae
tatcggaaaagctccaccacaatgg

SEQ ID NO: 59066 - DNA, 25 bp, S. cerevisiae
tatccgataaacctctagaacctgt

SEQ ID NO: 59067 - DNA, 25 bp, S. cerevisiae
ttatccctcctataacttgaaggct

SEQ ID NO: 59068 - DNA, 25 bp, S. cerevisiae
tttcccaccaagatgacgctaagtt

SEQ ID NO: 59069 - DNA, 25 bp, S. cerevisiae
tatttaggtgccaagtctacttcta

SEQ ID NO: 59070 - DNA, 25 bp, S. cerevisiae
tataattctgcttcggatccactgg

SEQ ID NO: 59071 - DNA, 25 bp, S. cerevisiae
tatctttctgctctcgcacaaggag

SEQ ID NO: 59072 - DNA, 25 bp, S. cerevisiae
tatctcttcctatcaatcaaccaat

SEQ ID NO: 59073 - DNA, 25 bp, S. cerevisiae
tattcactggtacacgcgacaatgc

SEQ ID NO: 59074 - DNA, 25 bp, S. cerevisiae
tttatcagttacaagcatgggcaag

SEQ ID NO: 59075 - DNA, 25 bp, S. cerevisiae
tatatcactgtctctagcgaagatg

SEQ ID NO: 59076 - DNA, 25 bp, S. cerevisiae
tatccacagtatgctgctgcgcaat

SEQ ID NO: 59077 - DNA, 25 bp, S. cerevisiae
tatcgctacaaaccatgctcaagag

SEQ ID NO: 59078 - DNA, 25 bp, S. cerevisiae
tatctttcaagacatgccacgctgt

SEQ ID NO: 59079 - DNA, 25 bp, S. cerevisiae
tatcatttccacattcacatcgtta

SEQ ID NO: 59080 - DNA, 25 bp, S. cerevisiae
tattctgcaagaaaattcgcggatg

SEQ ID NO: 59081 - DNA, 25 bp, S. cerevisiae
tattgccaggatccgattcgcagtt

SEQ ID NO: 59082 - DNA, 25 bp, S. cerevisiae
tatttcatgagattgctgcattcgg

SEQ ID NO: 59083 - DNA, 25 bp, S. cerevisiae
tatcgtgcatggtgagtgtcggctc

SEQ ID NO: 59084 - DNA, 25 bp, S. cerevisiae
tatagccaatgctgatctgtccgct

SEQ ID NO: 59085 - DNA, 25 bp, S. cerevisiae
tatccagttttaaccttcttgagtt

SEQ ID NO: 59086 - DNA, 25 bp, S. cerevisiae
tatcaactcttatctatccattcct

SEQ ID NO: 59087 - DNA, 25 bp, S. cerevisiae
tatatcaccatgtgcccatagttgg

SEQ ID NO: 59088 - DNA, 25 bp, S. cerevisiae
tatcacctgaagatgctcacgtttt

SEQ ID NO: 59089 - DNA, 25 bp, S. cerevisiae
tatccgcattagcttcagtgttata

SEQ ID NO: 59090 - DNA, 25 bp, S. cerevisiae
tatcggatttgcctgaagttgccaa

SEQ ID NO: 59091 - DNA, 25 bp, S. cerevisiae
tatctaggtacggaatggtgccata

SEQ ID NO: 59092 - DNA, 25 bp, S. cerevisiae
tatcagggtgtcgaacttggccgtt

SEQ ID NO: 59093 - DNA, 25 bp, S. cerevisiae
tataggcgctatcatctttggccac

SEQ ID NO: 59094 - DNA, 25 bp, S. cerevisiae
tatactgtctttgccagtggagcat

SEQ ID NO: 59095 - DNA, 25 bp, S. cerevisiae
tatacttctctatcgcaactgcaat

SEQ ID NO: 59096 - DNA, 25 bp, S. cerevisiae
tatagactcctatggcggcgcaatt

SEQ ID NO: 59097 - DNA, 25 bp, S. cerevisiae
tataatcagctcgtggtttgcctta

SEQ ID NO: 59098 - DNA, 25 bp, S. cerevisiae
tatagaactacgtcgctgggcggat

SEQ ID NO: 59099 - DNA, 25 bp, S. cerevisiae
tataaatctcaagtcggtgtctggg

SEQ ID NO: 59100 - DNA, 25 bp, S. cerevisiae
tatagtgagtcaatgccggctcctg

SEQ ID NO: 59101 - DNA, 25 bp, S. cerevisiae
tatttgaaactgatggactccgtag

SEQ ID NO: 59102 - DNA, 25 bp, S. cerevisiae
tatttgcgaagtatgacccacgtcc

SEQ ID NO: 59103 - DNA, 25 bp, S. cerevisiae
tatttccaagttagcaacaacgaca

SEQ ID NO: 59104 - DNA, 25 bp, S. cerevisiae
tttggccacgacaacctatggacag

SEQ ID NO: 59105 - DNA, 25 bp, S. cerevisiae
tttggaccaactacctcgagaaaga

SEQ ID NO: 59106 - DNA, 25 bp, S. cerevisiae
tttggcaaaacgaggctgatggcat

SEQ ID NO: 59107 - DNA, 25 bp, S. cerevisiae
ttagagtcacttgtcggtcccaaat

SEQ ID NO: 59108 - DNA, 25 bp, S. cerevisiae
ttggcctcacgttgcgggtgagtta

SEQ ID NO: 59109 - DNA, 25 bp, S. cerevisiae
tatataccactttgcgaggccttta

SEQ ID NO: 59110 - DNA, 25 bp, S. cerevisiae
tattatgcggtctcgtctttgtcaa

SEQ ID NO: 59111 - DNA, 25 bp, S. cerevisiae
tatcggcagctcaatttcttttcag

SEQ ID NO: 59112 - DNA, 25 bp, S. cerevisiae
tatcctgtcactgtgggatctgcat

SEQ ID NO: 59113 - DNA, 25 bp, S. cerevisiae
tatacctgcccagttgcttagggat

SEQ ID NO: 59114 - DNA, 25 bp, S. cerevisiae
tatacccgatcattggctccaacgt

SEQ ID NO: 59115 - DNA, 25 bp, S. cerevisiae
tattatccatgaacatagccccaag

SEQ ID NO: 59116 - DNA, 25 bp, S. cerevisiae
tatctacactgaagtcaacgccgca

SEQ ID NO: 59117 - DNA, 25 bp, S. cerevisiae
tatcgaactctcaatacacctgcca

SEQ ID NO: 59118 - DNA, 25 bp, S. cerevisiae
tatcgaaaccaatcctgctgctaga

SEQ ID NO: 59119 - DNA, 25 bp, S. cerevisiae
tatcaaagaccatccgcatattcca

SEQ ID NO: 59120 - DNA, 25 bp, S. cerevisiae
tatagaatcaccatcctcaccaagt

SEQ ID NO: 59121 - DNA, 25 bp, S. cerevisiae
tttggaaagccgctgtgacactcgt

SEQ ID NO: 59122 - DNA, 25 bp, S. cerevisiae
tatttatcaccctaggcgtcctttt

SEQ ID NO: 59123 - DNA, 25 bp, S. cerevisiae
tatagatcctagtgagttgtccgac

SEQ ID NO: 59124 - DNA, 25 bp, S. cerevisiae
tatttcgcattgtggcattgcccat

SEQ ID NO: 59125 - DNA, 25 bp, S. cerevisiae
tttgacttctctatgggacgaatcc

SEQ ID NO: 59126 - DNA, 25 bp, S. cerevisiae
tttacctattattggcaaccccacg

SEQ ID NO: 59127 - DNA, 25 bp, S. cerevisiae
tatcatagatttgctctcgactctc

SEQ ID NO: 59128 - DNA, 25 bp, S. cerevisiae
ttatcatcgtgtccgcatgtgcgaa

SEQ ID NO: 59129 - DNA, 25 bp, S. cerevisiae
tatagccgatttgccctggattaaa

SEQ ID NO: 59130 - DNA, 25 bp, S. cerevisiae
tatcagccgcagatcctaaggagtt

SEQ ID NO: 59131 - DNA, 25 bp, S. cerevisiae
tatcgatgatgacaagccaaaacca

SEQ ID NO: 59132 - DNA, 25 bp, S. cerevisiae
tatcgtggacactaggcagaatttt

SEQ ID NO: 59133 - DNA, 25 bp, S. cerevisiae
tatcgtaacaataggccaattcatg

SEQ ID NO: 59134 - DNA, 25 bp, S. cerevisiae
tatctgtattcactaccctgattcg

SEQ ID NO: 59135 - DNA, 25 bp, S. cerevisiae
tattttccaaaccactgttctcggg

SEQ ID NO: 59136 - DNA, 25 bp, S. cerevisiae
tattttcccaaccatctagttcagc

SEQ ID NO: 59137 - DNA, 25 bp, S. cerevisiae
tatcatttccttactggtttccctt

SEQ ID NO: 59138 - DNA, 25 bp, S. cerevisiae
tattttgaggccaggtccgatgtgt

SEQ ID NO: 59139 - DNA, 25 bp, S. cerevisiae
ttttcggaccgtgtcttatggctaa

SEQ ID NO: 59140 - DNA, 25 bp, S. cerevisiae
tataataacgctccgggtctgcgaa

SEQ ID NO: 59141 - DNA, 25 bp, S. cerevisiae
tatataatacctccgcagaatcctg

SEQ ID NO: 59142 - DNA, 25 bp, S. cerevisiae
tataacgtcgtgtcgcagttcctga

SEQ ID NO: 59143 - DNA, 25 bp, S. cerevisiae
tatatacgtagtgcgctttcattga

SEQ ID NO: 59144 - DNA, 25 bp, S. cerevisiae
tattacttgagcagtcttcaggctg

SEQ ID NO: 59145 - DNA, 25 bp, S. cerevisiae
tatttcttactgttccggttggtgt

SEQ ID NO: 59146 - DNA, 25 bp, S. cerevisiae
tatactttggcggatcttataccag

SEQ ID NO: 59147 - DNA, 25 bp, S. cerevisiae
ttcagtttgccggttttatcaagga

SEQ ID NO: 59148 - DNA, 25 bp, S. cerevisiae
ttcgtttcccatcttatataagggg

SEQ ID NO: 59149 - DNA, 25 bp, S. cerevisiae
tttgttgccgcctccaaaaaggaag

SEQ ID NO: 59150 - DNA, 25 bp, S. cerevisiae
tttatcgtcgcctccaaagaagtgg

SEQ ID NO: 59151 - DNA, 25 bp, S. cerevisiae
tattcgcctggtgcttactgatata

SEQ ID NO: 59152 - DNA, 25 bp, S. cerevisiae
tatctgcgagcggtggttacataaa

SEQ ID NO: 59153 - DNA, 25 bp, S. cerevisiae
tatcgcggtcttacttacgttacca

SEQ ID NO: 59154 - DNA, 25 bp, S. cerevisiae
ttacgcgtcttcatctactagtacc

SEQ ID NO: 59155 - DNA, 25 bp, S. cerevisiae
tatactttcttggttatggcgttcc

SEQ ID NO: 59156 - DNA, 25 bp, S. cerevisiae
tataccgtcttcttggtgtgtgtct

SEQ ID NO: 59157 - DNA, 25 bp, S. cerevisiae
tttgcaccgcttatatatgggtatg

SEQ ID NO: 59158 - DNA, 25 bp, S. cerevisiae
tataatccacgcaagagactctctc

SEQ ID NO: 59159 - DNA, 25 bp, S. cerevisiae
tataacaacgccattcatgcagcct

SEQ ID NO: 59160 - DNA, 25 bp, S. cerevisiae
tataccttacgtgggcatgtccagc

SEQ ID NO: 59161 - DNA, 25 bp, S. cerevisiae
ttaataacacgtgccttccaggatt

SEQ ID NO: 59162 - DNA, 25 bp, S. cerevisiae
tataaaaaagccgtcaccctggatt

SEQ ID NO: 59163 - DNA, 25 bp, S. cerevisiae
ttttattaccactgttccttcacct

SEQ ID NO: 59164 - DNA, 25 bp, S. cerevisiae
tattctgtcacaaaatctacggagt

SEQ ID NO: 59165 - DNA, 25 bp, S. cerevisiae
tatatctctcagatttggacaggga

SEQ ID NO: 59166 - DNA, 25 bp, S. cerevisiae
tatcagtgcatccattgtcttcttg

SEQ ID NO: 59167 - DNA, 25 bp, S. cerevisiae
tatcatggtccatttgcgaacgcat

SEQ ID NO: 59168 - DNA, 25 bp, S. cerevisiae
tttggtgccttgatgaacgagtctc

SEQ ID NO: 59169 - DNA, 25 bp, S. cerevisiae
tttggtactggtaaaagattggcca

SEQ ID NO: 59170 - DNA, 25 bp, S. cerevisiae
ttgggtaccctacacgtatgcggaa

SEQ ID NO: 59171 - DNA, 25 bp, S. cerevisiae
tttattgcaaatccaacgccacggc

SEQ ID NO: 59172 - DNA, 25 bp, S. cerevisiae
tattttgaaacctcggctggcctaa

SEQ ID NO: 59173 - DNA, 25 bp, S. cerevisiae
tattttgcagaacagatggactcca

SEQ ID NO: 59174 - DNA, 25 bp, S. cerevisiae
tatctttctatttacaggcagtcct

SEQ ID NO: 59175 - DNA, 25 bp, S. cerevisiae
tataatgtcagctagttttgcgcct

SEQ ID NO: 59176 - DNA, 25 bp, S. cerevisiae
tataatgtggaaactcctgcgcctg

SEQ ID NO: 59177 - DNA, 25 bp, S. cerevisiae
tattgcttgtgatgggttacgccca

SEQ ID NO: 59178 - DNA, 25 bp, S. cerevisiae
tatatgctcgcataacgggtgccca

SEQ ID NO: 59179 - DNA, 25 bp, S. cerevisiae
tatactgtttctactgcagctgccg

SEQ ID NO: 59180 - DNA, 25 bp, S. cerevisiae
tataattttgctgcggatgtatcct

SEQ ID NO: 59181 - DNA, 25 bp, S. cerevisiae
tattaattctttcgttacggcgacg

SEQ ID NO: 59182 - DNA, 25 bp, S. cerevisiae
tataagatacttagggtccgggcca

SEQ ID NO: 59183 - DNA, 25 bp, S. cerevisiae
ttgaagaactttgacgacggcgccg

SEQ ID NO: 59184 - DNA, 25 bp, S. cerevisiae
ttaagaactttatcgcaggacactg

SEQ ID NO: 59185 - DNA, 25 bp, S. cerevisiae
tttaaacttcatgacacctacccaa

SEQ ID NO: 59186 - DNA, 25 bp, S. cerevisiae
tttaaccaacgcgactgcagctacg

SEQ ID NO: 59187 - DNA, 25 bp, S. cerevisiae
tatcaggtggatttgcaacagttca

SEQ ID NO: 59188 - DNA, 25 bp, S. cerevisiae
tattactgaagaaggcatactacgc

SEQ ID NO: 59189 - DNA, 25 bp, S. cerevisiae
tatacaacaaagtctcaacccgcgt

SEQ ID NO: 59190 - DNA, 25 bp, S. cerevisiae
ttatggactccgataacccctttag

SEQ ID NO: 59191 - DNA, 25 bp, S. cerevisiae
tatatgattccttgtccagtactcc

SEQ ID NO: 59192 - DNA, 25 bp, S. cerevisiae
tatcatatcgccattcctggattca

SEQ ID NO: 59193 - DNA, 25 bp, S. cerevisiae
tataccttgagactttgatgcacat

SEQ ID NO: 59194 - DNA, 25 bp, S. cerevisiae
tattggtaacctgctagatcgtaaa

SEQ ID NO: 59195 - DNA, 25 bp, S. cerevisiae
tatcagtgcgaattcctcgggatat

SEQ ID NO: 59196 - DNA, 25 bp, S. cerevisiae
tatcgtcagaactctctggtctcaa

SEQ ID NO: 59197 - DNA, 25 bp, S. cerevisiae
ttctgaaaggaaaccagttaatcac

SEQ ID NO: 59198 - DNA, 25 bp, S. cerevisiae
ttatgacgttaagccagttttcagc

SEQ ID NO: 59199 - DNA, 25 bp, S. cerevisiae
tatagatgaacctcaggtgccctcc

SEQ ID NO: 59200 - DNA, 25 bp, S. cerevisiae
tatataccactctcaagttacccta

SEQ ID NO: 59201 - DNA, 25 bp, S. cerevisiae
tattttgttctatttttacaccaga

SEQ ID NO: 59202 - DNA, 25 bp, S. cerevisiae
tatattatcccttttcttaccacca

SEQ ID NO: 59203 - DNA, 25 bp, S. cerevisiae
tattgccatgtgctgcaggcatgtc

SEQ ID NO: 59204 - DNA, 25 bp, S. cerevisiae
tttgctatgccaggcgcagctgcag

SEQ ID NO: 59205 - DNA, 25 bp, S. cerevisiae
tttgctgtgctcgacgaatgtacat

SEQ ID NO: 59206 - DNA, 25 bp, S. cerevisiae
tttgctgggcagtgactttgaaact

SEQ ID NO: 59207 - DNA, 25 bp, S. cerevisiae
tatttgctccgctcaagtcagggaa

SEQ ID NO: 59208 - DNA, 25 bp, S. cerevisiae
tatatttccaagacacttcggcaga

SEQ ID NO: 59209 - DNA, 25 bp, S. cerevisiae
tatcttggccaaaccattcacgagg

SEQ ID NO: 59210 - DNA, 25 bp, S. cerevisiae
tatttcctattggtcgggtaacaga

SEQ ID NO: 59211 - DNA, 25 bp, S. cerevisiae
tatattccgtatctgcggctgtgac

SEQ ID NO: 59212 - DNA, 25 bp, S. cerevisiae
tatactgctctgtgttacttcttcc

SEQ ID NO: 59213 - DNA, 25 bp, S. cerevisiae
tatactcctcaagtttttccaacaa

SEQ ID NO: 59214 - DNA, 25 bp, S. cerevisiae
tatatttatacccttcgtgccaaac

SEQ ID NO: 59215 - DNA, 25 bp, S. cerevisiae
tatttaacccaccatatgtgccagc

SEQ ID NO: 59216 - DNA, 25 bp, S. cerevisiae
tattttgccagctcctcgtatgaat

SEQ ID NO: 59217 - DNA, 25 bp, S. cerevisiae
tatctcaactcccaatttctatcaa

SEQ ID NO: 59218 - DNA, 25 bp, S. cerevisiae
tatctaccccagaacagttatcgat

SEQ ID NO: 59219 - DNA, 25 bp, S. cerevisiae
tattaccccagtttaacatcagagg

SEQ ID NO: 59220 - DNA, 25 bp, S. cerevisiae
tattcaccctatctatcatatcaag

SEQ ID NO: 59221 - DNA, 25 bp, S. cerevisiae
tattcatcgtcatacttctacatag

SEQ ID NO: 59222 - DNA, 25 bp, S. cerevisiae
tatactcgttactgtctcaatcgga

SEQ ID NO: 59223 - DNA, 25 bp, S. cerevisiae
ttcctcggtagctagttcaactttg

SEQ ID NO: 59224 - DNA, 25 bp, S. cerevisiae
tattgatcggtataactgccttcgt

SEQ ID NO: 59225 - DNA, 25 bp, S. cerevisiae
tattagctctgacgaacttggcatc

SEQ ID NO: 59226 - DNA, 25 bp, S. cerevisiae
tataactgtgggaatgccggtcatt

SEQ ID NO: 59227 - DNA, 25 bp, S. cerevisiae
tataccgttggttccggtcttctgg

SEQ ID NO: 59228 - DNA, 25 bp, S. cerevisiae
ttacgggtatgcctggtgatctcgt

SEQ ID NO: 59229 - DNA, 25 bp, S. cerevisiae
tatatttggtgcgaatgctgcctct

SEQ ID NO: 59230 - DNA, 25 bp, S. cerevisiae
tatattatctgacggtgctgctgct

SEQ ID NO: 59231 - DNA, 25 bp, S. cerevisiae
tatctataccagagctgctgcttcc

SEQ ID NO: 59232 - DNA, 25 bp, S. cerevisiae
tatctacaccagagctactgcttct

SEQ ID NO: 59233 - DNA, 25 bp, S. cerevisiae
tatctaacaaaccagcaccttctaa

SEQ ID NO: 59234 - DNA, 25 bp, S. cerevisiae
tatagcacatccacaacccttcaaa

SEQ ID NO: 59235 - DNA, 25 bp, S. cerevisiae
tatacgattctttgaccattacaca

SEQ ID NO: 59236 - DNA, 25 bp, S. cerevisiae
tatatctacatgcttacctttcctg

SEQ ID NO: 59237 - DNA, 25 bp, S. cerevisiae
tattgctcagagttttccgttcact

SEQ ID NO: 59238 - DNA, 25 bp, S. cerevisiae
tatctatttggaattcccctggctc

SEQ ID NO: 59239 - DNA, 25 bp, S. cerevisiae
tattctttggtttcccaatggtcct

SEQ ID NO: 59240 - DNA, 25 bp, S. cerevisiae
tataggctcagtctttcttatctga

SEQ ID NO: 59241 - DNA, 25 bp, S. cerevisiae
tatcagttcaggtcatctttctagc

SEQ ID NO: 59242 - DNA, 25 bp, S. cerevisiae
tataggcatcatcaccattaccaac

SEQ ID NO: 59243 - DNA, 25 bp, S. cerevisiae
tataagctagcacctgttgacaaga

SEQ ID NO: 59244 - DNA, 25 bp, S. cerevisiae
ttaacggtcaatccgcccaagggat

SEQ ID NO: 59245 - DNA, 25 bp, S. cerevisiae
tataacgtttataccaccagatggg

SEQ ID NO: 59246 - DNA, 25 bp, S. cerevisiae
tattacgtattatttcccgattggg

SEQ ID NO: 59247 - DNA, 25 bp, S. cerevisiae
tttccattccgaaaagtattccgcg

SEQ ID NO: 59248 - DNA, 25 bp, S. cerevisiae
tattcatcatttttatacgtccgag

SEQ ID NO: 59249 - DNA, 25 bp, S. cerevisiae
tattattttccttcccatccaatca

SEQ ID NO: 59250 - DNA, 25 bp, S. cerevisiae
tatacttccttcaacaccaacgagg

SEQ ID NO: 59251 - DNA, 25 bp, S. cerevisiae
tatagggcttccatacgaacggctc

SEQ ID NO: 59252 - DNA, 25 bp, S. cerevisiae
ttgcctggtttgcaacctacgaaat

SEQ ID NO: 59253 - DNA, 25 bp, S. cerevisiae
ttctgggttcggtgcctacatggaa

SEQ ID NO: 59254 - DNA, 25 bp, S. cerevisiae
ttaggtgctaaatcgcgtaaggaac

SEQ ID NO: 59255 - DNA, 25 bp, S. cerevisiae
ttaggctctaaaccttatccaggac

SEQ ID NO: 59256 - DNA, 25 bp, S. cerevisiae
tatagagctgcatctaccgacaggc

SEQ ID NO: 59257 - DNA, 25 bp, S. cerevisiae
tatactcacatgaaccaccattgga

SEQ ID NO: 59258 - DNA, 25 bp, S. cerevisiae
tatatgtcattttccacctcttacg

SEQ ID NO: 59259 - DNA, 25 bp, S. cerevisiae
tatttgtactaccatgacccatctg

SEQ ID NO: 59260 - DNA, 25 bp, S. cerevisiae
tttgcgtttgtaaagcccggcgaga

SEQ ID NO: 59261 - DNA, 25 bp, S. cerevisiae
tattcggtatcatcggtacacctca

SEQ ID NO: 59262 - DNA, 25 bp, S. cerevisiae
tattcaaagatcacggtaccccaat

SEQ ID NO: 59263 - DNA, 25 bp, S. cerevisiae
tattccgatgatatgggtgcacgtc

SEQ ID NO: 59264 - DNA, 25 bp, S. cerevisiae
tattatcgtttacaaggtctttctg

SEQ ID NO: 59265 - DNA, 25 bp, S. cerevisiae
tattacgatattggcgataagctct

SEQ ID NO: 59266 - DNA, 25 bp, S. cerevisiae
tatattccgtctggtgtagcagtcg

SEQ ID NO: 59267 - DNA, 25 bp, S. cerevisiae
tatcaatgccatttttgctcatccc

SEQ ID NO: 59268 - DNA, 25 bp, S. cerevisiae
tatcaaccattttctgctacttctg

SEQ ID NO: 59269 - DNA, 25 bp, S. cerevisiae
tatatgacagcaacctacccttatc

SEQ ID NO: 59270 - DNA, 25 bp, S. cerevisiae
tatagtccgttttatcagcttccac

SEQ ID NO: 59271 - DNA, 25 bp, S. cerevisiae
tatagacccttattcatcaatccca

SEQ ID NO: 59272 - DNA, 25 bp, S. cerevisiae
tatcatcttcccaacggcatataac

SEQ ID NO: 59273 - DNA, 25 bp, S. cerevisiae
tattttcctgctcaattcctggctt

SEQ ID NO: 59274 - DNA, 25 bp, S. cerevisiae
tttccttgaaccagcatggccttta

SEQ ID NO: 59275 - DNA, 25 bp, S. cerevisiae
tttccggttcgacatcacctattat

SEQ ID NO: 59276 - DNA, 25 bp, S. cerevisiae
tttacggtatctcggtacgcaactt

SEQ ID NO: 59277 - DNA, 25 bp, S. cerevisiae
tatatgaggcgcttgggttctaccg

SEQ ID NO: 59278 - DNA, 25 bp, S. cerevisiae
ttatgaagtacgacagttctggccg

SEQ ID NO: 59279 - DNA, 25 bp, S. cerevisiae
tattatagtagccagcggcggcgcc

SEQ ID NO: 59280 - DNA, 25 bp, S. cerevisiae
tatttggtgcagctgggatgatggc

SEQ ID NO: 59281 - DNA, 25 bp, S. cerevisiae
tatttggttggactgctcgagtgca

SEQ ID NO: 59282 - DNA, 25 bp, S. cerevisiae
tatatgtgtgttggcgtgtgtggta

SEQ ID NO: 59283 - DNA, 25 bp, S. cerevisiae
tatattggctgcatgcttgtacaca

SEQ ID NO: 59284 - DNA, 25 bp, S. cerevisiae
tatatgggccattccgtgatgctgc

SEQ ID NO: 59285 - DNA, 25 bp, S. cerevisiae
tattgcctacattcctggtgtgaca

SEQ ID NO: 59286 - DNA, 25 bp, S. cerevisiae
tatatctgaccttctcgggatgcaa

SEQ ID NO: 59287 - DNA, 25 bp, S. cerevisiae
tatattatgccttcggcggctgcca

SEQ ID NO: 59288 - DNA, 25 bp, S. cerevisiae
tatactgacgatggtgtgcttgttt

SEQ ID NO: 59289 - DNA, 25 bp, S. cerevisiae
tatttgaagcgcctcgtatgccatt

SEQ ID NO: 59290 - DNA, 25 bp, S. cerevisiae
tatttgctattcctttatgcgctct

SEQ ID NO: 59291 - DNA, 25 bp, S. cerevisiae
ttatgacgttccaggatcgtctcag

SEQ ID NO: 59292 - DNA, 25 bp, S. cerevisiae
ttgagcacgatgttcggtttcgcca

SEQ ID NO: 59293 - DNA, 25 bp, S. cerevisiae
tattttctacaggtggatcgacgct

SEQ ID NO: 59294 - DNA, 25 bp, S. cerevisiae
tttatttggcggtgcagcgactgca

SEQ ID NO: 59295 - DNA, 25 bp, S. cerevisiae
tttgtggccgatgtggtatttttcc

SEQ ID NO: 59296 - DNA, 25 bp, S. cerevisiae
tatagggcgcctgagctgcttcttt

SEQ ID NO: 59297 - DNA, 25 bp, S. cerevisiae
tatagggatgccagacaggtcttat

SEQ ID NO: 59298 - DNA, 25 bp, S. cerevisiae
ttaagggacgtgtgcggccccacag

SEQ ID NO: 59299 - DNA, 25 bp, S. cerevisiae
tataagggacgtaatcgccttccca

SEQ ID NO: 59300 - DNA, 25 bp, S. cerevisiae
tatcaagttacactacacgcgttcc

SEQ ID NO: 59301 - DNA, 25 bp, S. cerevisiae
tattgaatttgagacgcccaccttt

SEQ ID NO: 59302 - DNA, 25 bp, S. cerevisiae
tatatgttttgaccacccaagcctt

SEQ ID NO: 59303 - DNA, 25 bp, S. cerevisiae
tatattttgaagtcacccgtcctct

SEQ ID NO: 59304 - DNA, 25 bp, S. cerevisiae
tttctattccaacactttgagacat

SEQ ID NO: 59305 - DNA, 25 bp, S. cerevisiae
tttccaaccaatcacatttgcgcag

SEQ ID NO: 59306 - DNA, 25 bp, S. cerevisiae
tattacaaacgcttggcatgttcca

SEQ ID NO: 59307 - DNA, 25 bp, S. cerevisiae
tattactactcgttgtacttcgcca

SEQ ID NO: 59308 - DNA, 25 bp, S. cerevisiae
tattaccttttattcctgcgggcca

SEQ ID NO: 59309 - DNA, 25 bp, S. cerevisiae
tattacctttctttcccggaatcag

SEQ ID NO: 59310 - DNA, 25 bp, S. cerevisiae
tattacctctactcccactaataag

SEQ ID NO: 59311 - DNA, 25 bp, S. cerevisiae
tattgacagcttacggccacactaa

SEQ ID NO: 59312 - DNA, 25 bp, S. cerevisiae
tattagtccagcaaaggcaggcaat

SEQ ID NO: 59313 - DNA, 25 bp, S. cerevisiae
tatttgatgtcatgctacaagccaa

SEQ ID NO: 59314 - DNA, 25 bp, S. cerevisiae
tatttgcgaagctcatccagatgtt

SEQ ID NO: 59315 - DNA, 25 bp, S. cerevisiae
tattttgaagcatatcaagccattt

SEQ ID NO: 59316 - DNA, 25 bp, S. cerevisiae
tattttgaagcatatcaagccattt

SEQ ID NO: 59317 - DNA, 25 bp, S. cerevisiae
tatatcgtacgctaaacgcctctag

SEQ ID NO: 59318 - DNA, 25 bp, S. cerevisiae
tatacccacacactctctcacatct

SEQ ID NO: 59319 - DNA, 25 bp, S. cerevisiae
tatacccacacactctctcacatct

SEQ ID NO: 59320 - DNA, 25 bp, S. cerevisiae
tataccaggcaaatttccatctccc

SEQ ID NO: 59321 - DNA, 25 bp, S. cerevisiae
tatacgactactaatgccgactcca

SEQ ID NO: 59322 - DNA, 25 bp, S. cerevisiae
tatatggcaatcgtactcttcctcc

SEQ ID NO: 59323 - DNA, 25 bp, S. cerevisiae
tatttgaactctatcttccatcgcg

SEQ ID NO: 59324 - DNA, 25 bp, S. cerevisiae
tatttgttcacccatgctccagtat

SEQ ID NO: 59325 - DNA, 25 bp, S. cerevisiae
tataccttcactaggccaagcaatc

SEQ ID NO: 59326 - DNA, 25 bp, S. cerevisiae
tatttgtcctctctccaacgtgaag

SEQ ID NO: 59327 - DNA, 25 bp, S. cerevisiae
tatttgctttacttggtcatctcct

SEQ ID NO: 59328 - DNA, 25 bp, S. cerevisiae
tttatcttgtacgtgcatgtatgcg

SEQ ID NO: 59329 - DNA, 25 bp, S. cerevisiae
tatattcagtgctacccacaaggcc

SEQ ID NO: 59330 - DNA, 25 bp, S. cerevisiae
tatagtaggcattccccaatatggg

SEQ ID NO: 59331 - DNA, 25 bp, S. cerevisiae
tataaaggcgtctccgtgtggcgaa

SEQ ID NO: 59332 - DNA, 25 bp, S. cerevisiae
tttgtacaatgttcaccgtgactgg

SEQ ID NO: 59333 - DNA, 25 bp, S. cerevisiae
tatttccctttcaacggcagacagg

SEQ ID NO: 59334 - DNA, 25 bp, S. cerevisiae
tataaccctattactgatggcaaag

SEQ ID NO: 59335 - DNA, 25 bp, S. cerevisiae
tataaccgtgttaagcagagctggg

SEQ ID NO: 59336 - DNA, 25 bp, S. cerevisiae
ttaagcgccgctcaagctgaattgg

SEQ ID NO: 59337 - DNA, 25 bp, S. cerevisiae
tataagagccaccaacgccaatacg

SEQ ID NO: 59338 - DNA, 25 bp, S. cerevisiae
tataaaaaccaagctaccaccaggg

SEQ ID NO: 59339 - DNA, 25 bp, S. cerevisiae
tatactaaaccaacctgcaacaccg

SEQ ID NO: 59340 - DNA, 25 bp, S. cerevisiae
tataatttaccaatcactgtcgccc

SEQ ID NO: 59341 - DNA, 25 bp, S. cerevisiae
tatagtcgtactctcagtgaggcca

SEQ ID NO: 59342 - DNA, 25 bp, S. cerevisiae
tatagtctgtttcgctttactggca

SEQ ID NO: 59343 - DNA, 25 bp, S. cerevisiae
tattcaggcctactccgaagacaaa

SEQ ID NO: 59344 - DNA, 25 bp, S. cerevisiae
tattacctgtggacctgataagaac

SEQ ID NO: 59345 - DNA, 25 bp, S. cerevisiae
tattggtctggcctccgcaaatgaa

SEQ ID NO: 59346 - DNA, 25 bp, S. cerevisiae
tttggatcccctggccgaagaagac

SEQ ID NO: 59347 - DNA, 25 bp, S. cerevisiae
tattgatcagtatgcattccgtgga

SEQ ID NO: 59348 - DNA, 25 bp, S. cerevisiae
tattatcagatcttgcttcgcctac

SEQ ID NO: 59349 - DNA, 25 bp, S. cerevisiae
tattgatgcgaatgccaaggctact

SEQ ID NO: 59350 - DNA, 25 bp, S. cerevisiae
tattggcgacttgcgagagtactct

SEQ ID NO: 59351 - DNA, 25 bp, S. cerevisiae
tttgggacttactatgggtgcttaa

SEQ ID NO: 59352 - DNA, 25 bp, S. cerevisiae
tatactgtcttttgcacttcaagga

SEQ ID NO: 59353 - DNA, 25 bp, S. cerevisiae
tatacgatcttttcgatggcatgtt

SEQ ID NO: 59354 - DNA, 25 bp, S. cerevisiae
tatttctctgtcaggattcctcgca

SEQ ID NO: 59355 - DNA, 25 bp, S. cerevisiae
tatagatctggtcagccttcacctg

SEQ ID NO: 59356 - DNA, 25 bp, S. cerevisiae
tatagatcgacaccaggttccgcga

SEQ ID NO: 59357 - DNA, 25 bp, S. cerevisiae
tatatgactacacaggacagccgga

SEQ ID NO: 59358 - DNA, 25 bp, S. cerevisiae
tattactccaagaagccatccagcg

SEQ ID NO: 59359 - DNA, 25 bp, S. cerevisiae
tatagactaccaaatccactcagat

SEQ ID NO: 59360 - DNA, 25 bp, S. cerevisiae
tatatcacagatataccacctcctc

SEQ ID NO: 59361 - DNA, 25 bp, S. cerevisiae
tattaaatgtatccgcaagcccact

SEQ ID NO: 59362 - DNA, 25 bp, S. cerevisiae
tataaaatcgcaccccaacaatctg

SEQ ID NO: 59363 - DNA, 25 bp, S. cerevisiae
tataactaacctacagaccctttcg

SEQ ID NO: 59364 - DNA, 25 bp, S. cerevisiae
tattactaaactacagacctctgga

SEQ ID NO: 59365 - DNA, 25 bp, S. cerevisiae
ttgttgaaaatctgtccccttagcg

SEQ ID NO: 59366 - DNA, 25 bp, S. cerevisiae
tattttgtcgtccaagctgtccaac

SEQ ID NO: 59367 - DNA, 25 bp, S. cerevisiae
tttggcttccatggcaagttcctac

SEQ ID NO: 59368 - DNA, 25 bp, S. cerevisiae
tattaccattgacagcatgttggct

SEQ ID NO: 59369 - DNA, 25 bp, S. cerevisiae
tatacatatgacagttgctgatctg

SEQ ID NO: 59370 - DNA, 25 bp, S. cerevisiae
tatagagtttcacctcatgcttcca

SEQ ID NO: 59371 - DNA, 25 bp, S. cerevisiae
tatattgcacattcatcctgctcga

SEQ ID NO: 59372 - DNA, 25 bp, S. cerevisiae
tatattgcaaggacagccacagaat

SEQ ID NO: 59373 - DNA, 25 bp, S. cerevisiae
tattaatatgggttccgctggtgaa

SEQ ID NO: 59374 - DNA, 25 bp, S. cerevisiae
tattattgcggtgacgctgctggga

SEQ ID NO: 59375 - DNA, 25 bp, S. cerevisiae
tattttggttatttgcgtgcgcgtt

SEQ ID NO: 59376 - DNA, 25 bp, S. cerevisiae
tatttttcctagttggtgccttctt

SEQ ID NO: 59377 - DNA, 25 bp, S. cerevisiae
tattattagccctttactctccgga

SEQ ID NO: 59378 - DNA, 25 bp, S. cerevisiae
tattgttatccctgtctacaccgga

SEQ ID NO: 59379 - DNA, 25 bp, S. cerevisiae
ttgttttgaggctcactacccggaa

SEQ ID NO: 59380 - DNA, 25 bp, S. cerevisiae
ttttctggaggcacaaagctttgga

SEQ ID NO: 59381 - DNA, 25 bp, S. cerevisiae
tattttgggccttaccattttcgca

SEQ ID NO: 59382 - DNA, 25 bp, S. cerevisiae
tattttttcactttctgcctatccg

SEQ ID NO: 59383 - DNA, 25 bp, S. cerevisiae
tattctattaccttcacatttgcat

SEQ ID NO: 59384 - DNA, 25 bp, S. cerevisiae
tatattttcatcgactgccattctc

SEQ ID NO: 59385 - DNA, 25 bp, S. cerevisiae
tatattttcacaacacacttctggg

SEQ ID NO: 59386 - DNA, 25 bp, S. cerevisiae
tattacgatcattcctcattcagtt

SEQ ID NO: 59387 - DNA, 25 bp, S. cerevisiae
tattacagtcttacaactcgcttgt

SEQ ID NO: 59388 - DNA, 25 bp, S. cerevisiae
tattttcgaccttagacctttgcaa

SEQ ID NO: 59389 - DNA, 25 bp, S. cerevisiae
tatttgttgcacttttcctctttaa

SEQ ID NO: 59390 - DNA, 25 bp, S. cerevisiae
tatttggctacctttctatccttag

SEQ ID NO: 59391 - DNA, 25 bp, S. cerevisiae
tatacatgatctacaggtttccaag

SEQ ID NO: 59392 - DNA, 25 bp, S. cerevisiae
tattttatgcctagatcctccagag

SEQ ID NO: 59393 - DNA, 25 bp, S. cerevisiae
tattggacccatttttgaagcaagg

SEQ ID NO: 59394 - DNA, 25 bp, S. cerevisiae
tttgtggcctagctatatgcatcga

SEQ ID NO: 59395 - DNA, 25 bp, S. cerevisiae
tataggatcctctgtcatttcaaat

SEQ ID NO: 59396 - DNA, 25 bp, S. cerevisiae
tatacgcctcttcattttcatctaa

SEQ ID NO: 59397 - DNA, 25 bp, S. cerevisiae
tatacctcacctattgtcgctctaa

SEQ ID NO: 59398 - DNA, 25 bp, S. cerevisiae
tatatagaccctagactttctgtgg

SEQ ID NO: 59399 - DNA, 25 bp, S. cerevisiae
tataccgccagacgacagtgatact

SEQ ID NO: 59400 - DNA, 25 bp, S. cerevisiae
tataccaacgacgaagctgcttctt

SEQ ID NO: 59401 - DNA, 25 bp, S. cerevisiae
tatacgcaacgtggcagagacttta

SEQ ID NO: 59402 - DNA, 25 bp, S. cerevisiae
tattaaacctctaccatgtcgctaa

SEQ ID NO: 59403 - DNA, 25 bp, S. cerevisiae
ttattgctggaatggtaccctggat

SEQ ID NO: 59404 - DNA, 25 bp, S. cerevisiae
ttcgtagtgaagtgtccaacccacc

SEQ ID NO: 59405 - DNA, 25 bp, S. cerevisiae
tatttctggaagaggccgaccaaat

SEQ ID NO: 59406 - DNA, 25 bp, S. cerevisiae
tatttctccaaatgtgccggtcaac

SEQ ID NO: 59407 - DNA, 25 bp, S. cerevisiae
tattttccaattacactctaaccag

SEQ ID NO: 59408 - DNA, 25 bp, S. cerevisiae
tatttccacaacagcatctgtgcag

SEQ ID NO: 59409 - DNA, 25 bp, S. cerevisiae
tatttcatcaaagccatctgttggt

SEQ ID NO: 59410 - DNA, 25 bp, S. cerevisiae
tatttatcacttgcgatgccttggt

SEQ ID NO: 59411 - DNA, 25 bp, S. cerevisiae
tattattcatgttccgaccgttgta

SEQ ID NO: 59412 - DNA, 25 bp, S. cerevisiae
tttggccctatattaactgtttacg

SEQ ID NO: 59413 - DNA, 25 bp, S. cerevisiae
tattgccaccaaattccggtatttt

SEQ ID NO: 59414 - DNA, 25 bp, S. cerevisiae
tattgaaactccatacgagcctcct

SEQ ID NO: 59415 - DNA, 25 bp, S. cerevisiae
tatttcaacttcaaggcgaccagcc

SEQ ID NO: 59416 - DNA, 25 bp, S. cerevisiae
tattttcacattaagcagcaggcta

SEQ ID NO: 59417 - DNA, 25 bp, S. cerevisiae
tattgtctactatcgcatcaggtcc

SEQ ID NO: 59418 - DNA, 25 bp, S. cerevisiae
tatttccatgatccccataggtact

SEQ ID NO: 59419 - DNA, 25 bp, S. cerevisiae
tatagaggcgctttccagtggtgtt

SEQ ID NO: 59420 - DNA, 25 bp, S. cerevisiae
tattgctggtgtcatttgcgcggat

SEQ ID NO: 59421 - DNA, 25 bp, S. cerevisiae
tattgcagggccattgctagggcag

SEQ ID NO: 59422 - DNA, 25 bp, S. cerevisiae
tattgttgagtgcacctttaggacc

SEQ ID NO: 59423 - DNA, 25 bp, S. cerevisiae
tattgttgttgttccatactgggcc

SEQ ID NO: 59424 - DNA, 25 bp, S. cerevisiae
tatttatgattctttccgccgactt

SEQ ID NO: 59425 - DNA, 25 bp, S. cerevisiae
tatattatgtccacgtctcaagcct

SEQ ID NO: 59426 - DNA, 25 bp, S. cerevisiae
tatatctattcggttctccaagcca

SEQ ID NO: 59427 - DNA, 25 bp, S. cerevisiae
tttcaatacagcgtccatcttagga

SEQ ID NO: 59428 - DNA, 25 bp, S. cerevisiae
tttcaaacgataccccactattcag

SEQ ID NO: 59429 - DNA, 25 bp, S. cerevisiae
ttctcaaactgattcgaccacttca

SEQ ID NO: 59430 - DNA, 25 bp, S. cerevisiae
tttaacgtgggatcacctgccatga

SEQ ID NO: 59431 - DNA, 25 bp, S. cerevisiae
tatatacacgtgagcaccagcggcc

SEQ ID NO: 59432 - DNA, 25 bp, S. cerevisiae
tatatcccgcatatgatctgccgaa

SEQ ID NO: 59433 - DNA, 25 bp, S. cerevisiae
tattgcgccaatacccatgcctaag

SEQ ID NO: 59434 - DNA, 25 bp, S. cerevisiae
tattagcgcagatggcctcacatac

SEQ ID NO: 59435 - DNA, 25 bp, S. cerevisiae
tttcatgctggaacctacaaacccg

SEQ ID NO: 59436 - DNA, 25 bp, S. cerevisiae
tatatctaccaaaacaccagcaccg

SEQ ID NO: 59437 - DNA, 25 bp, S. cerevisiae
tatatatacccacacactctctcac

SEQ ID NO: 59438 - DNA, 25 bp, S. cerevisiae
tattatacccaatacacatccacgc

SEQ ID NO: 59439 - DNA, 25 bp, S. cerevisiae
tatttacgtttgtagcagccaccgc

SEQ ID NO: 59440 - DNA, 25 bp, S. cerevisiae
tttcgattccgacaagaccattttc

SEQ ID NO: 59441 - DNA, 25 bp, S. cerevisiae
tttcgcctcaccaaaaaccattatt

SEQ ID NO: 59442 - DNA, 25 bp, S. cerevisiae
tattatcctcctgtgaaaccgcaag

SEQ ID NO: 59443 - DNA, 25 bp, S. cerevisiae
tattcgattctgacttatctacaaa

SEQ ID NO: 59444 - DNA, 25 bp, S. cerevisiae
tattgtggaagccatgaccgctctg

SEQ ID NO: 59445 - DNA, 25 bp, S. cerevisiae
tattgcgcaatactcatggccgttt

SEQ ID NO: 59446 - DNA, 25 bp, S. cerevisiae
tattgcagctgctacggcgtccttt

SEQ ID NO: 59447 - DNA, 25 bp, S. cerevisiae
tatatgtcgaatgcctcttctttgg

SEQ ID NO: 59448 - DNA, 25 bp, S. cerevisiae
tatttgacagtaacatcccctcttc

SEQ ID NO: 59449 - DNA, 25 bp, S. cerevisiae
tttgtagctcacgaaaggttggccg

SEQ ID NO: 59450 - DNA, 25 bp, S. cerevisiae
ttattccccgatttcgatagtgccg

SEQ ID NO: 59451 - DNA, 25 bp, S. cerevisiae
tattacagcggcacaagtggccaat

SEQ ID NO: 59452 - DNA, 25 bp, S. cerevisiae
tattacgctggtcatcaccgtcaat

SEQ ID NO: 59453 - DNA, 25 bp, S. cerevisiae
tattagccattgacgatacctacaa

SEQ ID NO: 59454 - DNA, 25 bp, S. cerevisiae
tatttggccggtatccacgagcaat

SEQ ID NO: 59455 - DNA, 25 bp, S. cerevisiae
tattggtgccatgctgcgttacaaa

SEQ ID NO: 59456 - DNA, 25 bp, S. cerevisiae
ttgggtgccaacgatgcatgctcag

SEQ ID NO: 59457 - DNA, 25 bp, S. cerevisiae
tatttccatctcttgaattcgtaca

SEQ ID NO: 59458 - DNA, 25 bp, S. cerevisiae
tatatcccctacaacaatcgctaga

SEQ ID NO: 59459 - DNA, 25 bp, S. cerevisiae
tattcccgccaaacaagctcaaaat

SEQ ID NO: 59460 - DNA, 25 bp, S. cerevisiae
tattcctggagggacttatcacaag

SEQ ID NO: 59461 - DNA, 25 bp, S. cerevisiae
tattagctgaacacggtatcgccgg

SEQ ID NO: 59462 - DNA, 25 bp, S. cerevisiae
tattatctacagaatggctttccaa

SEQ ID NO: 59463 - DNA, 25 bp, S. cerevisiae
tattttaacaatcctcatctgtcgg

SEQ ID NO: 59464 - DNA, 25 bp, S. cerevisiae
tatttcctaataactctgctgccat

SEQ ID NO: 59465 - DNA, 25 bp, S. cerevisiae
tatatacccacacactctctcacat

SEQ ID NO: 59466 - DNA, 25 bp, S. cerevisiae
tatatacccacacactctctcacat

SEQ ID NO: 59467 - DNA, 25 bp, S. cerevisiae
tattcccagataacaggcttgccac

SEQ ID NO: 59468 - DNA, 25 bp, S. cerevisiae
tatatcaccgtattttctgctggct

SEQ ID NO: 59469 - DNA, 25 bp, S. cerevisiae
tatattgccctatttcttttggaga

SEQ ID NO: 59470 - DNA, 25 bp, S. cerevisiae
tattcacctccagtactgttcgata

SEQ ID NO: 59471 - DNA, 25 bp, S. cerevisiae
tattatcaccgtacgatttcgctga

SEQ ID NO: 59472 - DNA, 25 bp, S. cerevisiae
tattggccgtcgcaggtactataga

SEQ ID NO: 59473 - DNA, 25 bp, S. cerevisiae
tatttcctgatccagaggccactaa

SEQ ID NO: 59474 - DNA, 25 bp, S. cerevisiae
tatttccgccgtcgatacgattttt

SEQ ID NO: 59475 - DNA, 25 bp, S. cerevisiae
tatttcctccgcgtaaaacttcatt

SEQ ID NO: 59476 - DNA, 25 bp, S. cerevisiae
tttcccgatgggtactatgtcttta

SEQ ID NO: 59477 - DNA, 25 bp, S. cerevisiae
ttaccggttggtttgcatgacattc

SEQ ID NO: 59478 - DNA, 25 bp, S. cerevisiae
ttacctggtcctatacttcattctg

SEQ ID NO: 59479 - DNA, 25 bp, S. cerevisiae
tatatgccttccagtgcaagctacg

SEQ ID NO: 59480 - DNA, 25 bp, S. cerevisiae
tttgctggtccattaccgtggtgac

SEQ ID NO: 59481 - DNA, 25 bp, S. cerevisiae
ttgctgccagaagaaccggtttact

SEQ ID NO: 59482 - DNA, 25 bp, S. cerevisiae
tattatatcagcgttcccctatgtt

SEQ ID NO: 59483 - DNA, 25 bp, S. cerevisiae
tattgttaagccttccactttctac

SEQ ID NO: 59484 - DNA, 25 bp, S. cerevisiae
tttgattctgaacctgtctctattt

SEQ ID NO: 59485 - DNA, 25 bp, S. cerevisiae
tattgcgatggctagtctgtacttg

SEQ ID NO: 59486 - DNA, 25 bp, S. cerevisiae
tttgttgcgtttttcgtcgaagcta

SEQ ID NO: 59487 - DNA, 25 bp, S. cerevisiae
tttgtttttgtctacgttgattccg

SEQ ID NO: 59488 - DNA, 25 bp, S. cerevisiae
tttggtgtttgtccaactttccctg

SEQ ID NO: 59489 - DNA, 25 bp, S. cerevisiae
tattgggtccttcccagttttacag

SEQ ID NO: 59490 - DNA, 25 bp, S. cerevisiae
tttggcgtcatcgtacaatttttga

SEQ ID NO: 59491 - DNA, 25 bp, S. cerevisiae
tattccgacctaaattttttgcaat

SEQ ID NO: 59492 - DNA, 25 bp, S. cerevisiae
tatatcgctggtgtctttttctact

SEQ ID NO: 59493 - DNA, 25 bp, S. cerevisiae
tattcaatttatcgaccaggcacaa

SEQ ID NO: 59494 - DNA, 25 bp, S. cerevisiae
tatttttctttgtagcaggccaggt

SEQ ID NO: 59495 - DNA, 25 bp, S. cerevisiae
tttgctgctatttggtttggactgg

SEQ ID NO: 59496 - DNA, 25 bp, S. cerevisiae
tttgtcatattgtcgaagtggtcac

SEQ ID NO: 59497 - DNA, 25 bp, S. cerevisiae
tttgcgccttcggatgctgcatcaa

SEQ ID NO: 59498 - DNA, 25 bp, S. cerevisiae
tttggcctgccgacgttaagagtac

SEQ ID NO: 59499 - DNA, 25 bp, S. cerevisiae
tatttatatgacctcaccagcagcg

SEQ ID NO: 59500 - DNA, 25 bp, S. cerevisiae
tattcctagcgccttcaatgggtag

SEQ ID NO: 59501 - DNA, 25 bp, S. cerevisiae
tatttgatgacgaccatactgggaa

SEQ ID NO: 59502 - DNA, 25 bp, S. cerevisiae
tattaggtctatttgccgctgcgat

SEQ ID NO: 59503 - DNA, 25 bp, S. cerevisiae
tattcgtcacgaaaaggcgcagatt

SEQ ID NO: 59504 - DNA, 25 bp, S. cerevisiae
tatttcacccataacggcaactttg

SEQ ID NO: 59505 - DNA, 25 bp, S. cerevisiae
tattcaacaccaagacgccgactat

SEQ ID NO: 59506 - DNA, 25 bp, S. cerevisiae
tattatcgccgctagcagatgtttt

SEQ ID NO: 59507 - DNA, 25 bp, S. cerevisiae
tattatgtgtctctgggtgccttcg

SEQ ID NO: 59508 - DNA, 25 bp, S. cerevisiae
tatattcatatgtcgtgtgtttgta

SEQ ID NO: 59509 - DNA, 25 bp, S. cerevisiae
tattctctcattctagaccgtcatg

SEQ ID NO: 59510 - DNA, 25 bp, S. cerevisiae
tatttcctaggattcatcgccacga

SEQ ID NO: 59511 - DNA, 25 bp, S. cerevisiae
tatttccgaggctattctggccaca

SEQ ID NO: 59512 - DNA, 25 bp, S. cerevisiae
tattatcctcgtttctgtttctcta

SEQ ID NO: 59513 - DNA, 25 bp, S. cerevisiae
tatttcccagaagtctatgtctatt

SEQ ID NO: 59514 - DNA, 25 bp, S. cerevisiae
tattcacagcaccatggatactttg

SEQ ID NO: 59515 - DNA, 25 bp, S. cerevisiae
tattgaggcaccacaactacccatt

SEQ ID NO: 59516 - DNA, 25 bp, S. cerevisiae
tttcagcgcctaaaagtcgtcgtac

SEQ ID NO: 59517 - DNA, 25 bp, S. cerevisiae
tttacgtgaaactccatcctcttgt

SEQ ID NO: 59518 - DNA, 25 bp, S. cerevisiae
tattatgtagcttcctccagagacg

SEQ ID NO: 59519 - DNA, 25 bp, S. cerevisiae
tttggcagttacgtctcgagctatt

SEQ ID NO: 59520 - DNA, 25 bp, S. cerevisiae
tttggtctctacgtcggatcatgaa

SEQ ID NO: 59521 - DNA, 25 bp, S. cerevisiae
tattctgatgcttacgtcggtgtta

SEQ ID NO: 59522 - DNA, 25 bp, S. cerevisiae
tattctctcgtaggtctgttgcttc

SEQ ID NO: 59523 - DNA, 25 bp, S. cerevisiae
tattcttccttgttgtcctgattca

SEQ ID NO: 59524 - DNA, 25 bp, S. cerevisiae
tattactttcaggtaacaccaccct

SEQ ID NO: 59525 - DNA, 25 bp, S. cerevisiae
ttctttcctaggacgctttccaaat

SEQ ID NO: 59526 - DNA, 25 bp, S. cerevisiae
tattattactggtgcttcctctttg

SEQ ID NO: 59527 - DNA, 25 bp, S. cerevisiae
tttggatacggctcctctgttcaga

SEQ ID NO: 59528 - DNA, 25 bp, S. cerevisiae
tttggtcacggatcctacttacaga

SEQ ID NO: 59529 - DNA, 25 bp, S. cerevisiae
tttgggcacgtttggctatcttaaa

SEQ ID NO: 59530 - DNA, 25 bp, S. cerevisiae
tattgggatggtggttgctattcgt

SEQ ID NO: 59531 - DNA, 25 bp, S. cerevisiae
tattggttggcttccattttggtaa

SEQ ID NO: 59532 - DNA, 25 bp, S. cerevisiae
tttggacggcaaacttgtatggtaa

SEQ ID NO: 59533 - DNA, 25 bp, S. cerevisiae
tattttctacaatggcctctacgac

SEQ ID NO: 59534 - DNA, 25 bp, S. cerevisiae
tatttttataagtcgccgtcaccct

SEQ ID NO: 59535 - DNA, 25 bp, S. cerevisiae
tattgtttgctacttggctgtggta

SEQ ID NO: 59536 - DNA, 25 bp, S. cerevisiae
tattcgcaacacaggcaacagcatt

SEQ ID NO: 59537 - DNA, 25 bp, S. cerevisiae
ttttcaacatgaaggaccgctacaa

SEQ ID NO: 59538 - DNA, 25 bp, S. cerevisiae
tttcttacagaaccctcctacaaag

SEQ ID NO: 59539 - DNA, 25 bp, S. cerevisiae
tttcggaaaccaaactgtcatcatt

SEQ ID NO: 59540 - DNA, 25 bp, S. cerevisiae
tttgtcaaacctagcatccttctac

SEQ ID NO: 59541 - DNA, 25 bp, S. cerevisiae
tttgaaaaagcgcaccccgatgttt

SEQ ID NO: 59542 - DNA, 25 bp, S. cerevisiae
tttgaaagtcgcgattattccgagt

SEQ ID NO: 59543 - DNA, 25 bp, S. cerevisiae
tttgaaggacccacagaccgatgct

SEQ ID NO: 59544 - DNA, 25 bp, S. cerevisiae
tttgaagggtccaacgtgagcatac

SEQ ID NO: 59545 - DNA, 25 bp, S. cerevisiae
tttgcaaagcagtcattcacctaca

SEQ ID NO: 59546 - DNA, 25 bp, S. cerevisiae
tattcaatgtgctcaaccagctcac

SEQ ID NO: 59547 - DNA, 25 bp, S. cerevisiae
tattcgatgatggtgcaagggccac

SEQ ID NO: 59548 - DNA, 25 bp, S. cerevisiae
tattgtgctgtggtcacggccatca

SEQ ID NO: 59549 - DNA, 25 bp, S. cerevisiae
tattctggctgtaggctctagtgaa

SEQ ID NO: 59550 - DNA, 25 bp, S. cerevisiae
tattgtgcaggtggcgatctattca

SEQ ID NO: 59551 - DNA, 25 bp, S. cerevisiae
tattgtggagcagtcagcatctaat

SEQ ID NO: 59552 - DNA, 25 bp, S. cerevisiae
tattggcgcatcgtaacatcgttac

SEQ ID NO: 59553 - DNA, 25 bp, S. cerevisiae
tattggcagcgcaaaaaggcttcaa

SEQ ID NO: 59554 - DNA, 25 bp, S. cerevisiae
tattcgatgcctttaatgcgtccac

SEQ ID NO: 59555 - DNA, 25 bp, S. cerevisiae
tattaagccatactcaacagcgcct

SEQ ID NO: 59556 - DNA, 25 bp, S. cerevisiae
tattagacgacttcttgcaaccacc

SEQ ID NO: 59557 - DNA, 25 bp, S. cerevisiae
tattcatactatttctcgctaccac

SEQ ID NO: 59558 - DNA, 25 bp, S. cerevisiae
tattgcaatagcacagcctccacag

SEQ ID NO: 59559 - DNA, 25 bp, S. cerevisiae
tattgatatagtccggtcacagccc

SEQ ID NO: 59560 - DNA, 25 bp, S. cerevisiae
tattatgataaccttgctcaagtca

SEQ ID NO: 59561 - DNA, 25 bp, S. cerevisiae
tattctagaaatccctgcaatgtca

SEQ ID NO: 59562 - DNA, 25 bp, S. cerevisiae
tattcataaaattcctgccgttctt

SEQ ID NO: 59563 - DNA, 25 bp, S. cerevisiae
tattgtttgttaccgccattacttg

SEQ ID NO: 59564 - DNA, 25 bp, S. cerevisiae
tatttttcttgaatacgttcctggg

SEQ ID NO: 59565 - DNA, 25 bp, S. cerevisiae
tattttgtgtgatcctccatatggt

SEQ ID NO: 59566 - DNA, 25 bp, S. cerevisiae
tttgtgtctacagcgtcttcaggaa

SEQ ID NO: 59567 - DNA, 25 bp, S. cerevisiae
tattaaatgctctaaccgttggtga

SEQ ID NO: 59568 - DNA, 25 bp, S. cerevisiae
tttgctatgtacaacgcatgctgga

SEQ ID NO: 59569 - DNA, 25 bp, S. cerevisiae
tttgctatcaactcgactccaatat

SEQ ID NO: 59570 - DNA, 25 bp, S. cerevisiae
tttgaagcaagctgccactccagaa

SEQ ID NO: 59571 - DNA, 25 bp, S. cerevisiae
tattgcttgcctcgactacggtgat

SEQ ID NO: 59572 - DNA, 25 bp, S. cerevisiae
tattgtctgcctcgcactgacggat

SEQ ID NO: 59573 - DNA, 25 bp, S. cerevisiae
tttgttgcctgctatgttcaattga

SEQ ID NO: 59574 - DNA, 25 bp, S. cerevisiae
ttcgaccccggatgcaagatacttg

SEQ ID NO: 59575 - DNA, 25 bp, S. cerevisiae
tattttgcccgtttcttaggtgtca

SEQ ID NO: 59576 - DNA, 25 bp, S. cerevisiae
tattgccattgtcttttcttcgaaa

SEQ ID NO: 59577 - DNA, 25 bp, S. cerevisiae
tttgcgttccggaatttgccacgat

SEQ ID NO: 59578 - DNA, 25 bp, S. cerevisiae
tttggctttccgctcgtgataaaaa

SEQ ID NO: 59579 - DNA, 25 bp, S. cerevisiae
tattggtcttttcccctatgaatga

SEQ ID NO: 59580 - DNA, 25 bp, S. cerevisiae
tattggatattctcccgccttgaga

SEQ ID NO: 59581 - DNA, 25 bp, S. cerevisiae
tattgttaaagcctccaactggaga

SEQ ID NO: 59582 - DNA, 25 bp, S. cerevisiae
tattgttaaactaccacttcggata

SEQ ID NO: 59583 - DNA, 25 bp, S. cerevisiae
tattattacaagaagcggccctgcg

SEQ ID NO: 59584 - DNA, 25 bp, S. cerevisiae
tttgggtgccttcttagcctggtca

SEQ ID NO: 59585 - DNA, 25 bp, S. cerevisiae
tatttttgcatgcaccgtgatcctg

SEQ ID NO: 59586 - DNA, 25 bp, S. cerevisiae
tattctgtttggaagcgcgcaactg

SEQ ID NO: 59587 - DNA, 25 bp, S. cerevisiae
tttgccatgtggttcgcactaacat

SEQ ID NO: 59588 - DNA, 25 bp, S. cerevisiae
tttgccattgaatcccaacacattg

SEQ ID NO: 59589 - DNA, 25 bp, S. cerevisiae
tattcattgatgaggcggtgctgcg

SEQ ID NO: 59590 - DNA, 25 bp, S. cerevisiae
tattttgtttgtggtgctgtgtgcg

SEQ ID NO: 59591 - DNA, 25 bp, S. cerevisiae
tattttggtcacttggttgtcgcct

SEQ ID NO: 59592 - DNA, 25 bp, S. cerevisiae
tattggtcgctattgggctctttat

SEQ ID NO: 59593 - DNA, 25 bp, S. cerevisiae
tattgcactcgtagtattcctcgga

SEQ ID NO: 59594 - DNA, 25 bp, S. cerevisiae
tattaccgtcattatgtgcctcagc

SEQ ID NO: 59595 - DNA, 25 bp, S. cerevisiae
tattagcgggcatgaggctcatagc

SEQ ID NO: 59596 - DNA, 25 bp, S. cerevisiae
tattcacgaggatcagctgtccacc

SEQ ID NO: 59597 - DNA, 25 bp, S. cerevisiae
tattccggtgaatagtgcccctggc

SEQ ID NO: 59598 - DNA, 25 bp, S. cerevisiae
tattccctggaatggacctcctgag

SEQ ID NO: 59599 - DNA, 25 bp, S. cerevisiae
tattgcctctgatgatggaaccttc

SEQ ID NO: 59600 - DNA, 25 bp, S. cerevisiae
tattccaaaatctgcatccccggtt

SEQ ID NO: 59601 - DNA, 25 bp, S. cerevisiae
tttgtacaaaatggcccacacggtt

SEQ ID NO: 59602 - DNA, 25 bp, S. cerevisiae
tattccgccaactattttcctttca

SEQ ID NO: 59603 - DNA, 25 bp, S. cerevisiae
tttgttatgatattcgctttcccga

SEQ ID NO: 59604 - DNA, 25 bp, S. cerevisiae
tattacggtgaagatcccaaagata

SEQ ID NO: 59605 - DNA, 25 bp, S. cerevisiae
tttggagtggttgctgtgccacact

SEQ ID NO: 59606 - DNA, 25 bp, S. cerevisiae
tttgatcgggtttttcacaccattc

SEQ ID NO: 59607 - DNA, 25 bp, S. cerevisiae
tttcatggcaggatgtgcttgcaca

SEQ ID NO: 59608 - DNA, 25 bp, S. cerevisiae
tttgttcaggatttgctcatcaagc

SEQ ID NO: 59609 - DNA, 25 bp, S. cerevisiae
tttggaggtcttccacacaatccta

SEQ ID NO: 59610 - DNA, 25 bp, S. cerevisiae
tttaaggtcattcaacgtcccggag

SEQ ID NO: 59611 - DNA, 25 bp, S. cerevisiae
tattagatctgtcccaaatgctttg

SEQ ID NO: 59612 - DNA, 25 bp, S. cerevisiae
tattcttccaccgaagcgtgctaaa

SEQ ID NO: 59613 - DNA, 25 bp, S. cerevisiae
tattcctcacaacacagcagcaatt

SEQ ID NO: 59614 - DNA, 25 bp, S. cerevisiae
tattgactggtcgaccactggagat

SEQ ID NO: 59615 - DNA, 25 bp, S. cerevisiae
tattcgctggcggtgacaatggtgt

SEQ ID NO: 59616 - DNA, 25 bp, S. cerevisiae
ttacgggtacgctaacttgatctgg

SEQ ID NO: 59617 - DNA, 25 bp, S. cerevisiae
ttacgattttccaactgttcctgca

SEQ ID NO: 59618 - DNA, 25 bp, S. cerevisiae
tattatgcgcctactacttctttga

SEQ ID NO: 59619 - DNA, 25 bp, S. cerevisiae
tattacaattcttctgcttctgcat

SEQ ID NO: 59620 - DNA, 25 bp, S. cerevisiae
tattccagaatcttccatactcttc

SEQ ID NO: 59621 - DNA, 25 bp, S. cerevisiae
tattctatggaccttgttctgcctg

SEQ ID NO: 59622 - DNA, 25 bp, S. cerevisiae
tattctctttcgacttgacggctga

SEQ ID NO: 59623 - DNA, 25 bp, S. cerevisiae
tattctcttacggtccacatattca

SEQ ID NO: 59624 - DNA, 25 bp, S. cerevisiae
tattccttcctgttcaattgttgat

SEQ ID NO: 59625 - DNA, 25 bp, S. cerevisiae
tttgggccatgacatgtcagcctta

SEQ ID NO: 59626 - DNA, 25 bp, S. cerevisiae
tttgggcactatcgttggcgcatgc

SEQ ID NO: 59627 - DNA, 25 bp, S. cerevisiae
tattctacagcttctacttaatgag

SEQ ID NO: 59628 - DNA, 25 bp, S. cerevisiae
tattctcaacattcatccattcagg

SEQ ID NO: 59629 - DNA, 25 bp, S. cerevisiae
tttcgcagaatgtatccgtcgtgat

SEQ ID NO: 59630 - DNA, 25 bp, S. cerevisiae
tattcgagccgattccaggagcatt

SEQ ID NO: 59631 - DNA, 25 bp, S. cerevisiae
tattctagtcaatccagtgccattc

SEQ ID NO: 59632 - DNA, 25 bp, S. cerevisiae
tattgtaccaaatcatgctccatta

SEQ ID NO: 59633 - DNA, 25 bp, S. cerevisiae
tattgctcacagtacgatcgttctt

SEQ ID NO: 59634 - DNA, 25 bp, S. cerevisiae
tattgtcaaggcttttcatcccgat

SEQ ID NO: 59635 - DNA, 25 bp, S. cerevisiae
tattcaacggcagcttcctcttata

SEQ ID NO: 59636 - DNA, 25 bp, S. cerevisiae
tattcactgggttccgttagacaat

SEQ ID NO: 59637 - DNA, 25 bp, S. cerevisiae
tattcgaaattgttagcccacctat

SEQ ID NO: 59638 - DNA, 25 bp, S. cerevisiae
tattctcaatttcccaacttttcgc

SEQ ID NO: 59639 - DNA, 25 bp, S. cerevisiae
tattccaatattcagcggcctttac

SEQ ID NO: 59640 - DNA, 25 bp, S. cerevisiae
tattccacatcaaaacggcctcatg

SEQ ID NO: 59641 - DNA, 25 bp, S. cerevisiae
tattccacacacaaaggtccgatct

SEQ ID NO: 59642 - DNA, 25 bp, S. cerevisiae
tattcccgagaatttgacaggcatt

SEQ ID NO: 59643 - DNA, 25 bp, S. cerevisiae
tttccaacattggtgtcgattgctt

SEQ ID NO: 59644 - DNA, 25 bp, S. cerevisiae
tttggccacatttttcagaacttct

SEQ ID NO: 59645 - DNA, 25 bp, S. cerevisiae
tttgggcactttactcaatcctatc

SEQ ID NO: 59646 - DNA, 25 bp, S. cerevisiae
tattagtcgcgtgcaatcctgtagc

SEQ ID NO: 59647 - DNA, 25 bp, S. cerevisiae
tattcagtcggtaacatcccatgag

SEQ ID NO: 59648 - DNA, 25 bp, S. cerevisiae
tattctggtgattttgtcgccaaga

SEQ ID NO: 59649 - DNA, 25 bp, S. cerevisiae
tattctgtatgtaactgtccctaag

SEQ ID NO: 59650 - DNA, 25 bp, S. cerevisiae
tattcttctgtttcttctcgtaggt

SEQ ID NO: 59651 - DNA, 25 bp, S. cerevisiae
tattgcccatgttccaaactcagac

SEQ ID NO: 59652 - DNA, 25 bp, S. cerevisiae
tattcgatgtttgttaccgcagacg

SEQ ID NO: 59653 - DNA, 25 bp, S. cerevisiae
tattctagtgttcttgactcccaca

SEQ ID NO: 59654 - DNA, 25 bp, S. cerevisiae
tttgctaaggctttggacggccaaa

SEQ ID NO: 59655 - DNA, 25 bp, S. cerevisiae
tttccacttgggacattgccgacaa

SEQ ID NO: 59656 - DNA, 25 bp, S. cerevisiae
tattccttattacccacttacaatc

SEQ ID NO: 59657 - DNA, 25 bp, S. cerevisiae
tttctgcccttgttcaacttgcaaa

SEQ ID NO: 59658 - DNA, 25 bp, S. cerevisiae
tttcctccacatataattcccttga

SEQ ID NO: 59659 - DNA, 25 bp, S. cerevisiae
tttcccgaagtttatgagcctactg

SEQ ID NO: 59660 - DNA, 25 bp, S. cerevisiae
tttaccgactgatagtgaactccca

SEQ ID NO: 59661 - DNA, 25 bp, S. cerevisiae
tttacccaaattttcaacaccgcag

SEQ ID NO: 59662 - DNA, 25 bp, S. cerevisiae
ttttccttattcactcaagtcctgg

SEQ ID NO: 59663 - DNA, 25 bp, S. cerevisiae
tttaagccttcaaactgaccccaat

SEQ ID NO: 59664 - DNA, 25 bp, S. cerevisiae
tttgcagcacacactaaaggcgcca

SEQ ID NO: 59665 - DNA, 25 bp, S. cerevisiae
tttggccaactcttaaggacgcata

SEQ ID NO: 59666 - DNA, 25 bp, S. cerevisiae
tttctgcatgcatttcgtccggatc

SEQ ID NO: 59667 - DNA, 25 bp, S. cerevisiae
tattcagtcaagtatcaacctcgat

SEQ ID NO: 59668 - DNA, 25 bp, S. cerevisiae
tattctggaatcctgttgtcaacag

SEQ ID NO: 59669 - DNA, 25 bp, S. cerevisiae
tattgtggactcctctattcagagc

SEQ ID NO: 59670 - DNA, 25 bp, S. cerevisiae
tttggactaacacatgctgctctca

SEQ ID NO: 59671 - DNA, 25 bp, S. cerevisiae
tattggtgtcctgattggtgtggca

SEQ ID NO: 59672 - DNA, 25 bp, S. cerevisiae
tttgaatacccgatggtcttctcca

SEQ ID NO: 59673 - DNA, 25 bp, S. cerevisiae
tttaaaccgttttgtgtatcattca

SEQ ID NO: 59674 - DNA, 25 bp, S. cerevisiae
tttgaaacctgcatttggcccacca

SEQ ID NO: 59675 - DNA, 25 bp, S. cerevisiae
tattgacaagtggttcttcatctcc

SEQ ID NO: 59676 - DNA, 25 bp, S. cerevisiae
tttgggcgacagtatttcaagacga

SEQ ID NO: 59677 - DNA, 25 bp, S. cerevisiae
tattggtcaacttcagcgctggtgc

SEQ ID NO: 59678 - DNA, 25 bp, S. cerevisiae
ttggatccaccacgcaagggctgtg

SEQ ID NO: 59679 - DNA, 25 bp, S. cerevisiae
tttgggtgacagtaaccgcctacca

SEQ ID NO: 59680 - DNA, 25 bp, S. cerevisiae
ttcatggggaaagctatccctccac

SEQ ID NO: 59681 - DNA, 25 bp, S. cerevisiae
tttggacttgtctcgttctaacggt

SEQ ID NO: 59682 - DNA, 25 bp, S. cerevisiae
tattggtatgttcccgtttaagttg

SEQ ID NO: 59683 - DNA, 25 bp, S. cerevisiae
tttgcttttacttctcttgtaggtt

SEQ ID NO: 59684 - DNA, 25 bp, S. cerevisiae
tttgccctactgtgtattgtcgttt

SEQ ID NO: 59685 - DNA, 25 bp, S. cerevisiae
tttgactgctactcaaaagactgtt

SEQ ID NO: 59686 - DNA, 25 bp, S. cerevisiae
tttattgcacaaatcggtaccccga

SEQ ID NO: 59687 - DNA, 25 bp, S. cerevisiae
tattggcaacatggtgaagctcgtg

SEQ ID NO: 59688 - DNA, 25 bp, S. cerevisiae
tattgtgcaccatttttcgtctgaa

SEQ ID NO: 59689 - DNA, 25 bp, S. cerevisiae
tattgatgatgtagactccattatc

SEQ ID NO: 59690 - DNA, 25 bp, S. cerevisiae
tattgagtgcgaacccagtcattcc

SEQ ID NO: 59691 - DNA, 25 bp, S. cerevisiae
tattcgccaatctctctctattgtt

SEQ ID NO: 59692 - DNA, 25 bp, S. cerevisiae
tattcgccaaatattctagcctctg

SEQ ID NO: 59693 - DNA, 25 bp, S. cerevisiae
tattggccaactatttgacctctgc

SEQ ID NO: 59694 - DNA, 25 bp, S. cerevisiae
tttgtgcacgtcgactgggccattt

SEQ ID NO: 59695 - DNA, 25 bp, S. cerevisiae
tttcgtcgctttggctaactttgtt

SEQ ID NO: 59696 - DNA, 25 bp, S. cerevisiae
tttcaggccttgacagtactggttt

SEQ ID NO: 59697 - DNA, 25 bp, S. cerevisiae
tttacttgtgatccctgaagacgtg

SEQ ID NO: 59698 - DNA, 25 bp, S. cerevisiae
ttttccttggacttaaatgccttga

SEQ ID NO: 59699 - DNA, 25 bp, S. cerevisiae
tttgccggtcatcttctaaatcatc

SEQ ID NO: 59700 - DNA, 25 bp, S. cerevisiae
tattccgtacttgtacaatggatta

SEQ ID NO: 59701 - DNA, 25 bp, S. cerevisiae
tattgcccttcaaatgttcttgtag

SEQ ID NO: 59702 - DNA, 25 bp, S. cerevisiae
tttccactgccaagttctctggtaa

SEQ ID NO: 59703 - DNA, 25 bp, S. cerevisiae
tattgtgacgaatgttgcggtttac

SEQ ID NO: 59704 - DNA, 25 bp, S. cerevisiae
tattcgacgtttcatgtatagctaa

SEQ ID NO: 59705 - DNA, 25 bp, S. cerevisiae
tttctgggatgtcgtgctctttcac

SEQ ID NO: 59706 - DNA, 25 bp, S. cerevisiae
tttgattatgggtccttttgccgtg

SEQ ID NO: 59707 - DNA, 25 bp, S. cerevisiae
tttgctgctatgaaggatggcgctt

SEQ ID NO: 59708 - DNA, 25 bp, S. cerevisiae
tttgctttttggtactcacaagaag

SEQ ID NO: 59709 - DNA, 25 bp, S. cerevisiae
tttggtgctttctgcgccaagagaa

SEQ ID NO: 59710 - DNA, 25 bp, S. cerevisiae
tattgggcagtacttttcgttggcg

SEQ ID NO: 59711 - DNA, 25 bp, S. cerevisiae
tattgcggaaccattgtccttgcac

SEQ ID NO: 59712 - DNA, 25 bp, S. cerevisiae
tattcggaaccgctgttggtactga

SEQ ID NO: 59713 - DNA, 25 bp, S. cerevisiae
tattccaccttctaatgactgtact

SEQ ID NO: 59714 - DNA, 25 bp, S. cerevisiae
tattgccgtctttgaaactgctcgt

SEQ ID NO: 59715 - DNA, 25 bp, S. cerevisiae
tttgctgcaactaagaaccatcctg

SEQ ID NO: 59716 - DNA, 25 bp, S. cerevisiae
tttggatatcacctgatacgcccct

SEQ ID NO: 59717 - DNA, 25 bp, S. cerevisiae
tttggcattatctgtaccatccggc

SEQ ID NO: 59718 - DNA, 25 bp, S. cerevisiae
tttgagattatctgcggcctacgtg

SEQ ID NO: 59719 - DNA, 25 bp, S. cerevisiae
ttatcggtcctaatgtcaccatcgg

SEQ ID NO: 59720 - DNA, 25 bp, S. cerevisiae
tattgggtcctcaattgtccaaggc

SEQ ID NO: 59721 - DNA, 25 bp, S. cerevisiae
tattctggtccagcagggcaaggtc

SEQ ID NO: 59722 - DNA, 25 bp, S. cerevisiae
tattctggtccagcagggcaaggtc

SEQ ID NO: 59723 - DNA, 25 bp, S. cerevisiae
tttgggcccaacaagagcaagcgtc

SEQ ID NO: 59724 - DNA, 25 bp, S. cerevisiae
tttgtcgcccagtacaagcgagtat

SEQ ID NO: 59725 - DNA, 25 bp, S. cerevisiae
tttgatcacatgcagctaaccggta

SEQ ID NO: 59726 - DNA, 25 bp, S. cerevisiae
tattcgtgattttctattgctcaga

SEQ ID NO: 59727 - DNA, 25 bp, S. cerevisiae
tttcggcaatgtttgtgagctagac

SEQ ID NO: 59728 - DNA, 25 bp, S. cerevisiae
tattccaacactttgagacattgtg

SEQ ID NO: 59729 - DNA, 25 bp, S. cerevisiae
tattgctaacgctactgggattttt

SEQ ID NO: 59730 - DNA, 25 bp, S. cerevisiae
tttctgcacaaggacaacgactttg

SEQ ID NO: 59731 - DNA, 25 bp, S. cerevisiae
tttcgagaacaagatcatgccctat

SEQ ID NO: 59732 - DNA, 25 bp, S. cerevisiae
tttcggtgacaaccaagcctcataa

SEQ ID NO: 59733 - DNA, 25 bp, S. cerevisiae
tttcgggtacgagagtccatcaaaa

SEQ ID NO: 59734 - DNA, 25 bp, S. cerevisiae
tttgttgcgggtgtctcgcacggca

SEQ ID NO: 59735 - DNA, 25 bp, S. cerevisiae
ttgtgtcggtggacgtacccatgaa

SEQ ID NO: 59736 - DNA, 25 bp, S. cerevisiae
tttgccggtgattctgtaccacaac

SEQ ID NO: 59737 - DNA, 25 bp, S. cerevisiae
tttccattggattctgtaccgtatc

SEQ ID NO: 59738 - DNA, 25 bp, S. cerevisiae
tattgttcttgctaccatgggtgct

SEQ ID NO: 59739 - DNA, 25 bp, S. cerevisiae
tattgtgccccatctatgctggtta

SEQ ID NO: 59740 - DNA, 25 bp, S. cerevisiae
tttcgactacggtccttagatcttc

SEQ ID NO: 59741 - DNA, 25 bp, S. cerevisiae
tattcgagaccgctttgttgacttc

SEQ ID NO: 59742 - DNA, 25 bp, S. cerevisiae
tttgctcgtacttattgtgacttca

SEQ ID NO: 59743 - DNA, 25 bp, S. cerevisiae
tattgccgccaaaaagtgacttgtt

SEQ ID NO: 59744 - DNA, 25 bp, S. cerevisiae
tttccggaatatgaggatgatcgtt

SEQ ID NO: 59745 - DNA, 25 bp, S. cerevisiae
tattccgaacaatccaatcactggt

SEQ ID NO: 59746 - DNA, 25 bp, S. cerevisiae
tttggccaaacattacaccttagag

SEQ ID NO: 59747 - DNA, 25 bp, S. cerevisiae
ttattgcccgaacacatccgtgagg

SEQ ID NO: 59748 - DNA, 25 bp, S. cerevisiae
tttgcttccgatgctgaaaagacga

SEQ ID NO: 59749 - DNA, 25 bp, S. cerevisiae
tattgcatcccaccactggaagaag

SEQ ID NO: 59750 - DNA, 25 bp, S. cerevisiae
tttgcattcctccttttagacagtg

SEQ ID NO: 59751 - DNA, 25 bp, S. cerevisiae
tattgctactctacctgcagacgat

SEQ ID NO: 59752 - DNA, 25 bp, S. cerevisiae
tttgatcggctttcctctagtgaaa

SEQ ID NO: 59753 - DNA, 25 bp, S. cerevisiae
tttgaattgcttcacggcagggaat

SEQ ID NO: 59754 - DNA, 25 bp, S. cerevisiae
tattccactgtatacggaggatagt

SEQ ID NO: 59755 - DNA, 25 bp, S. cerevisiae
tattcccagattccatcaggtcgta

SEQ ID NO: 59756 - DNA, 25 bp, S. cerevisiae
tattcccaagatcggcagtgtcatt

SEQ ID NO: 59757 - DNA, 25 bp, S. cerevisiae
tattcctccagtggctgttctatat

SEQ ID NO: 59758 - DNA, 25 bp, S. cerevisiae
tattgcctcgccatggaagtgtaca

SEQ ID NO: 59759 - DNA, 25 bp, S. cerevisiae
tttgctatctttgttgttgcgtgga

SEQ ID NO: 59760 - DNA, 25 bp, S. cerevisiae
tattgctgctgctttgtttttgcca

SEQ ID NO: 59761 - DNA, 25 bp, S. cerevisiae
tttggttgctggaaatactgccgaa

SEQ ID NO: 59762 - DNA, 25 bp, S. cerevisiae
tttggtcgcgaacaatctattcaag

SEQ ID NO: 59763 - DNA, 25 bp, S. cerevisiae
tttggtcccaaatgtcaagtaacag

SEQ ID NO: 59764 - DNA, 25 bp, S. cerevisiae
tttgtctccaaaatcctacgtgtac

SEQ ID NO: 59765 - DNA, 25 bp, S. cerevisiae
tttggtcttgatggaatctgaacgt

SEQ ID NO: 59766 - DNA, 25 bp, S. cerevisiae
tttggtggttcgctaaagtgtccct

SEQ ID NO: 59767 - DNA, 25 bp, S. cerevisiae
tttcggtttccctagaagtgtcgca

SEQ ID NO: 59768 - DNA, 25 bp, S. cerevisiae
tttgggtttattccacaggtgccgc

SEQ ID NO: 59769 - DNA, 25 bp, S. cerevisiae
tttgttgccgctgaatccgctgccg

SEQ ID NO: 59770 - DNA, 25 bp, S. cerevisiae
tattgttgtcaaaacacctgctccc

SEQ ID NO: 59771 - DNA, 25 bp, S. cerevisiae
tttggattccgatggcaatgtgctc

SEQ ID NO: 59772 - DNA, 25 bp, S. cerevisiae
tttggcatacatcgacaggcacatt

SEQ ID NO: 59773 - DNA, 25 bp, S. cerevisiae
tttggcaaatcgttgagcctgtttt

SEQ ID NO: 59774 - DNA, 25 bp, S. cerevisiae
tattggaaatctactggccgtgctc

SEQ ID NO: 59775 - DNA, 25 bp, S. cerevisiae
tttggcataacattgggctcagctt

SEQ ID NO: 59776 - DNA, 25 bp, S. cerevisiae
tttccaaaccggctctgcttctaag

SEQ ID NO: 59777 - DNA, 25 bp, S. cerevisiae
tttcccacccggtatattctatgaa

SEQ ID NO: 59778 - DNA, 25 bp, S. cerevisiae
tttcgttccgcccaaatattgtgct

SEQ ID NO: 59779 - DNA, 25 bp, S. cerevisiae
tttgcgtaatcgagaagttttgttc

SEQ ID NO: 59780 - DNA, 25 bp, S. cerevisiae
tttggtattctgctttcctttgtta

SEQ ID NO: 59781 - DNA, 25 bp, S. cerevisiae
tttcaaaaccgatttgtcctcctcg

SEQ ID NO: 59782 - DNA, 25 bp, S. cerevisiae
tttgtacacccctcgtaaggcgcgt

SEQ ID NO: 59783 - DNA, 25 bp, S. cerevisiae
tttcgacaacccagcctataagcag

SEQ ID NO: 59784 - DNA, 25 bp, S. cerevisiae
tttgaagatccttgccgacgctgtc

SEQ ID NO: 59785 - DNA, 25 bp, S. cerevisiae
tattgacgcattcattgctggctgc

SEQ ID NO: 59786 - DNA, 25 bp, S. cerevisiae
tttgatgtcgctccagactgggaat

SEQ ID NO: 59787 - DNA, 25 bp, S. cerevisiae
tttggcatctcttatgacatggcaa

SEQ ID NO: 59788 - DNA, 25 bp, S. cerevisiae
tattgccatggctactgacagcgac

SEQ ID NO: 59789 - DNA, 25 bp, S. cerevisiae
tttgaatcttcctacactactgcat

SEQ ID NO: 59790 - DNA, 25 bp, S. cerevisiae
tttggattatgctgattccgccgca

SEQ ID NO: 59791 - DNA, 25 bp, S. cerevisiae
tattgcgaagaagattgccaccgtc

SEQ ID NO: 59792 - DNA, 25 bp, S. cerevisiae
tttcctatgtaagccaacttccatc

SEQ ID NO: 59793 - DNA, 25 bp, S. cerevisiae
tattggcaatttctagtctttcgca

SEQ ID NO: 59794 - DNA, 25 bp, S. cerevisiae
tttggcattgttttagttctttgga

SEQ ID NO: 59795 - DNA, 25 bp, S. cerevisiae
tttggttatatctttcgtgctgtta

SEQ ID NO: 59796 - DNA, 25 bp, S. cerevisiae
tttggcttgtatcgccatcatttct

SEQ ID NO: 59797 - DNA, 25 bp, S. cerevisiae
tttggctgaatactactctttctaa

SEQ ID NO: 59798 - DNA, 25 bp, S. cerevisiae
tttcagcaggcccaaacgttcggaa

SEQ ID NO: 59799 - DNA, 25 bp, S. cerevisiae
tattgaaacttcgtgcactgtgctg

SEQ ID NO: 59800 - DNA, 25 bp, S. cerevisiae
tttcctgggaactacgtgcaactca

SEQ ID NO: 59801 - DNA, 25 bp, S. cerevisiae
tttgtcgagagtacagcctgtccaa

SEQ ID NO: 59802 - DNA, 25 bp, S. cerevisiae
tttgtctcagcaatacacacttcca

SEQ ID NO: 59803 - DNA, 25 bp, S. cerevisiae
tattgctccttctcctatgtataat

SEQ ID NO: 59804 - DNA, 25 bp, S. cerevisiae
tattgacccctctttgacttggaaa

SEQ ID NO: 59805 - DNA, 25 bp, S. cerevisiae
tttgagtcctttttgtctaggaaca

SEQ ID NO: 59806 - DNA, 25 bp, S. cerevisiae
ttttcaggttcaggatcctcgggat

SEQ ID NO: 59807 - DNA, 25 bp, S. cerevisiae
tttgtcggtaacatcactccggatg

SEQ ID NO: 59808 - DNA, 25 bp, S. cerevisiae
tttgggctacttctggtggcctatc

SEQ ID NO: 59809 - DNA, 25 bp, S. cerevisiae
tttgggtatcttcatcggtatcttc

SEQ ID NO: 59810 - DNA, 25 bp, S. cerevisiae
tttgggtacttatctactgcactta

SEQ ID NO: 59811 - DNA, 25 bp, S. cerevisiae
tttgtccttcttttctatctttcta

SEQ ID NO: 59812 - DNA, 25 bp, S. cerevisiae
tttgctcaaccatttttcactttct

SEQ ID NO: 59813 - DNA, 25 bp, S. cerevisiae
tttgaactaggccttgtccctgata

SEQ ID NO: 59814 - DNA, 25 bp, S. cerevisiae
tttgcggcagccaggagttcacgaa

SEQ ID NO: 59815 - DNA, 25 bp, S. cerevisiae
tttcccgatgaagtggttgccgcaa

SEQ ID NO: 59816 - DNA, 25 bp, S. cerevisiae
tttggcatgctttatctccgtccta

SEQ ID NO: 59817 - DNA, 25 bp, S. cerevisiae
tttgatttggtcatctgctgtcagc

SEQ ID NO: 59818 - DNA, 25 bp, S. cerevisiae
tttggtacattgatggtgctcacac

SEQ ID NO: 59819 - DNA, 25 bp, S. cerevisiae
tattggtttctttgctgtctgtttt

SEQ ID NO: 59820 - DNA, 25 bp, S. cerevisiae
tttcgattatttcttctactttctt

SEQ ID NO: 59821 - DNA, 25 bp, S. cerevisiae
ttaccagcgaccatataggccatat

SEQ ID NO: 59822 - DNA, 25 bp, S. cerevisiae
tttggattggtgcttgcaacccgat

SEQ ID NO: 59823 - DNA, 25 bp, S. cerevisiae
tttggaagttcttggcactcccgat

SEQ ID NO: 59824 - DNA, 25 bp, S. cerevisiae
tattggctgccgaagacagactcct

SEQ ID NO: 59825 - DNA, 25 bp, S. cerevisiae
tttcctgcacaacacgagatctttc

SEQ ID NO: 59826 - DNA, 25 bp, S. cerevisiae
tttgatactcaaattcgtgccccac

SEQ ID NO: 59827 - DNA, 25 bp, S. cerevisiae
tttgatagctcatatttccgaccct

SEQ ID NO: 59828 - DNA, 25 bp, S. cerevisiae
tttgatcttcggaactgcggacacc

SEQ ID NO: 59829 - DNA, 25 bp, S. cerevisiae
tttgatatgggaacaccgccacacg

SEQ ID NO: 59830 - DNA, 25 bp, S. cerevisiae
tttgacgtcgtgtacgtgcagcact

SEQ ID NO: 59831 - DNA, 25 bp, S. cerevisiae
ttgtactttgtataggttggcttcc

SEQ ID NO: 59832 - DNA, 25 bp, S. cerevisiae
tattgggcgttctaaatggtactat

SEQ ID NO: 59833 - DNA, 25 bp, S. cerevisiae
tttgtggcccgtacactgtgtgaaa

SEQ ID NO: 59834 - DNA, 25 bp, S. cerevisiae
tttggccagatcctgcaacgttgaa

SEQ ID NO: 59835 - DNA, 25 bp, S. cerevisiae
tttggctcagttgggatgctctaga

SEQ ID NO: 59836 - DNA, 25 bp, S. cerevisiae
tttgagcgcaggtagaatgcttaca

SEQ ID NO: 59837 - DNA, 25 bp, S. cerevisiae
tttgcagcatgctctccaatcttaa

SEQ ID NO: 59838 - DNA, 25 bp, S. cerevisiae
tttgcacgccgcacaattattgatt

SEQ ID NO: 59839 - DNA, 25 bp, S. cerevisiae
tttccggctcatgaaatatcgcttc

SEQ ID NO: 59840 - DNA, 25 bp, S. cerevisiae
tttggtctaacgatattctgtgctt

SEQ ID NO: 59841 - DNA, 25 bp, S. cerevisiae
ttacgccttatctcatttcgggttc

SEQ ID NO: 59842 - DNA, 25 bp, S. cerevisiae
ttagtcctttcaccttacggcaatt

SEQ ID NO: 59843 - DNA, 25 bp, S. cerevisiae
ttcggcctttgcaacgatttgtaat

SEQ ID NO: 59844 - DNA, 25 bp, S. cerevisiae
tttgtgccttcatcgctacgttgat

SEQ ID NO: 59845 - DNA, 25 bp, S. cerevisiae
tttgccacctactgcggcgttgatg

SEQ ID NO: 59846 - DNA, 25 bp, S. cerevisiae
tttgccagactacccaggtgtggat

SEQ ID NO: 59847 - DNA, 25 bp, S. cerevisiae
tttgctctatcgctgtcagatgacc

SEQ ID NO: 59848 - DNA, 25 bp, S. cerevisiae
tttgctgctggtggagttgctactc

SEQ ID NO: 59849 - DNA, 25 bp, S. cerevisiae
tttgcacttagtcttgagattgaga

SEQ ID NO: 59850 - DNA, 25 bp, S. cerevisiae
ttaccttagggtttgatcttgacga

SEQ ID NO: 59851 - DNA, 25 bp, S. cerevisiae
ttaggtgtgggactgcttactgtac

SEQ ID NO: 59852 - DNA, 25 bp, S. cerevisiae
tttggagctaggttctccacttgca

SEQ ID NO: 59853 - DNA, 25 bp, S. cerevisiae
tttgcggcaaggttatcacagatct

SEQ ID NO: 59854 - DNA, 25 bp, S. cerevisiae
tttggccgaagtagatcatgcgatt

SEQ ID NO: 59855 - DNA, 25 bp, S. cerevisiae
tttggttcattgttccgcaggttgt

SEQ ID NO: 59856 - DNA, 25 bp, S. cerevisiae
ttagacctttttgcgccaactttat

SEQ ID NO: 59857 - DNA, 25 bp, S. cerevisiae
ttttcctttttctgcaacctagttg

SEQ ID NO: 59858 - DNA, 25 bp, S. cerevisiae
ttctggaccaacttcgaaatcggct

SEQ ID NO: 59859 - DNA, 25 bp, S. cerevisiae
tttggaaaagcattcgccgaggcgt

SEQ ID NO: 59860 - DNA, 25 bp, S. cerevisiae
tttgcagagaactcttcccttagct

SEQ ID NO: 59861 - DNA, 25 bp, S. cerevisiae
tttgcgcaagagatctacacctttt

SEQ ID NO: 59862 - DNA, 25 bp, S. cerevisiae
tttgcccagtatcgatgaccaacgt

SEQ ID NO: 59863 - DNA, 25 bp, S. cerevisiae
tattggccgtcgtttgccaactgaa

SEQ ID NO: 59864 - DNA, 25 bp, S. cerevisiae
tttccaagtcgctcatccaactgaa

SEQ ID NO: 59865 - DNA, 25 bp, S. cerevisiae
ttatccaaggccatccgttcaaaat

SEQ ID NO: 59866 - DNA, 25 bp, S. cerevisiae
ttaccggaccgttgcatcttaaaga

SEQ ID NO: 59867 - DNA, 25 bp, S. cerevisiae
tttgccgcgcgacatagtcgtgaat

SEQ ID NO: 59868 - DNA, 25 bp, S. cerevisiae
tttccaatttcatacctggctgtga

SEQ ID NO: 59869 - DNA, 25 bp, S. cerevisiae
tttcctatcggataccggcctagaa

SEQ ID NO: 59870 - DNA, 25 bp, S. cerevisiae
tttacatcaccaaaagccggtcgtt

SEQ ID NO: 59871 - DNA, 25 bp, S. cerevisiae
tttcaatactgctcaaccggcttta

SEQ ID NO: 59872 - DNA, 25 bp, S. cerevisiae
tttcgccgccgatgatactgattta

SEQ ID NO: 59873 - DNA, 25 bp, S. cerevisiae
tttgagcaaccttttcttcctgaac

SEQ ID NO: 59874 - DNA, 25 bp, S. cerevisiae
tttgatcaacgtttcgaatcctccc

SEQ ID NO: 59875 - DNA, 25 bp, S. cerevisiae
tttgattttcctagcaacctttcgc

SEQ ID NO: 59876 - DNA, 25 bp, S. cerevisiae
tttgctgccttttcagctgcaattg

SEQ ID NO: 59877 - DNA, 25 bp, S. cerevisiae
tattggccttgacgcagctatctgg

SEQ ID NO: 59878 - DNA, 25 bp, S. cerevisiae
tttggcttccgcttcattgattaca

SEQ ID NO: 59879 - DNA, 25 bp, S. cerevisiae
tttgatctcaatccaatttccgcac

SEQ ID NO: 59880 - DNA, 25 bp, S. cerevisiae
tttgcctagtctctgaaatgccatc

SEQ ID NO: 59881 - DNA, 25 bp, S. cerevisiae
tttgagcgatgaggtgtgttcacac

SEQ ID NO: 59882 - DNA, 25 bp, S. cerevisiae
tttgacagatgctttgctcgcgcaa

SEQ ID NO: 59883 - DNA, 25 bp, S. cerevisiae
tttgccctaccactatttaggcatt

SEQ ID NO: 59884 - DNA, 25 bp, S. cerevisiae
ttggcctaaccaatcaattgcgaat

SEQ ID NO: 59885 - DNA, 25 bp, S. cerevisiae
tttcttgcaccggttatgtcgtaac

SEQ ID NO: 59886 - DNA, 25 bp, S. cerevisiae
tttcttgcgtggctttactgtaaac

SEQ ID NO: 59887 - DNA, 25 bp, S. cerevisiae
tttagccctagcagatgtctccaaa

SEQ ID NO: 59888 - DNA, 25 bp, S. cerevisiae
tttccctcaggaacctccagtatta

SEQ ID NO: 59889 - DNA, 25 bp, S. cerevisiae
tttacccagacaaaccgacttctag

SEQ ID NO: 59890 - DNA, 25 bp, S. cerevisiae
tttaccctgatctaactaactttgg

SEQ ID NO: 59891 - DNA, 25 bp, S. cerevisiae
tttcacttcttacgacagaaccttg

SEQ ID NO: 59892 - DNA, 25 bp, S. cerevisiae
tttcacttcttacgacagaaccttg

SEQ ID NO: 59893 - DNA, 25 bp, S. cerevisiae
tttacacgagctcataaagaagcga

SEQ ID NO: 59894 - DNA, 25 bp, S. cerevisiae
tttcaaccctctacatctgatggat

SEQ ID NO: 59895 - DNA, 25 bp, S. cerevisiae
tttctgagttaagtgactgcccctt

SEQ ID NO: 59896 - DNA, 25 bp, S. cerevisiae
tttggagttcaatacacctgccttc

SEQ ID NO: 59897 - DNA, 25 bp, S. cerevisiae
tttggagaatgcaacccagtgggtt

SEQ ID NO: 59898 - DNA, 25 bp, S. cerevisiae
tttcgataacgacgccaaaggctct

SEQ ID NO: 59899 - DNA, 25 bp, S. cerevisiae
tttgtagaatcctcgacagatggtc

SEQ ID NO: 59900 - DNA, 25 bp, S. cerevisiae
tttgaagattccacactgctgaagt

SEQ ID NO: 59901 - DNA, 25 bp, S. cerevisiae
tttggtcaccatcacttcttgtgaa

SEQ ID NO: 59902 - DNA, 25 bp, S. cerevisiae
ttgctggtacgcgtatcatcggtag

SEQ ID NO: 59903 - DNA, 25 bp, S. cerevisiae
tttggtatcaactgatgggtccatg

SEQ ID NO: 59904 - DNA, 25 bp, S. cerevisiae
ttagatccgataacgacgcctttac

SEQ ID NO: 59905 - DNA, 25 bp, S. cerevisiae
tttgtcggcaagaaacagcgtttac

SEQ ID NO: 59906 - DNA, 25 bp, S. cerevisiae
tttagcccaagtttcacgtttcact

SEQ ID NO: 59907 - DNA, 25 bp, S. cerevisiae
ttgcgccgtttaggattttgtactc

SEQ ID NO: 59908 - DNA, 25 bp, S. cerevisiae
tttcccttaggcttttattcacaga

SEQ ID NO: 59909 - DNA, 25 bp, S. cerevisiae
tttggtttaccattttgtgcaacaa

SEQ ID NO: 59910 - DNA, 25 bp, S. cerevisiae
tttggtggtgtctactattgtgccc

SEQ ID NO: 59911 - DNA, 25 bp, S. cerevisiae
ttatggccgtagatgcttcttcgaa

SEQ ID NO: 59912 - DNA, 25 bp, S. cerevisiae
tttgagccgaagaactttaccaatg

SEQ ID NO: 59913 - DNA, 25 bp, S. cerevisiae
tttaccgacacatttctttccttgg

SEQ ID NO: 59914 - DNA, 25 bp, S. cerevisiae
tttacgcgcaaactgtttcccacag

SEQ ID NO: 59915 - DNA, 25 bp, S. cerevisiae
tttacgatgctgctagaatccctgc

SEQ ID NO: 59916 - DNA, 25 bp, S. cerevisiae
tttacgatcggcgaaacctgcagca

SEQ ID NO: 59917 - DNA, 25 bp, S. cerevisiae
tttacaccaggcgtggattctgatg

SEQ ID NO: 59918 - DNA, 25 bp, S. cerevisiae
tttgatgaccactgtccactctttg

SEQ ID NO: 59919 - DNA, 25 bp, S. cerevisiae
tttggacggcgtacaaccttggctg

SEQ ID NO: 59920 - DNA, 25 bp, S. cerevisiae
tttgaggccatcactcagctgagat

SEQ ID NO: 59921 - DNA, 25 bp, S. cerevisiae
tttggtcatatcacacgctggaacg

SEQ ID NO: 59922 - DNA, 25 bp, S. cerevisiae
tttcatgttctcagcacgggttcga

SEQ ID NO: 59923 - DNA, 25 bp, S. cerevisiae
tttcaattctgcatactacgcttat

SEQ ID NO: 59924 - DNA, 25 bp, S. cerevisiae
tttcacaatgactcttctcctttaa

SEQ ID NO: 59925 - DNA, 25 bp, S. cerevisiae
tttgctgactattacttacctttta

SEQ ID NO: 59926 - DNA, 25 bp, S. cerevisiae
ttctgaccttggaaatcccagcatt

SEQ ID NO: 59927 - DNA, 25 bp, S. cerevisiae
tttgcttcaagctaaacagtactct

SEQ ID NO: 59928 - DNA, 25 bp, S. cerevisiae
ttttgaaccgttaaaattcgcattg

SEQ ID NO: 59929 - DNA, 25 bp, S. cerevisiae
tttctaaccgcttctaacttaattg

SEQ ID NO: 59930 - DNA, 25 bp, S. cerevisiae
tttccagttccttccagattatttc

SEQ ID NO: 59931 - DNA, 25 bp, S. cerevisiae
tttcatcagtgcacttcgttcctaa

SEQ ID NO: 59932 - DNA, 25 bp, S. cerevisiae
tttgcgaaattaatgctgcttgggc

SEQ ID NO: 59933 - DNA, 25 bp, S. cerevisiae
ttggtgggattagtttcggcctgac

SEQ ID NO: 59934 - DNA, 25 bp, S. cerevisiae
ttgtccggaaatgttcgatgcctaa

SEQ ID NO: 59935 - DNA, 25 bp, S. cerevisiae
tttgccggtaactttagtgcagcag

SEQ ID NO: 59936 - DNA, 25 bp, S. cerevisiae
tttccggtgggctttaccagcagaa

SEQ ID NO: 59937 - DNA, 25 bp, S. cerevisiae
tttgccagttggtcgtacttgaggt

SEQ ID NO: 59938 - DNA, 25 bp, S. cerevisiae
tttcctttggaacccttgcaagtgg

SEQ ID NO: 59939 - DNA, 25 bp, S. cerevisiae
tttctcaactgcatagctccgtgaa

SEQ ID NO: 59940 - DNA, 25 bp, S. cerevisiae
tttgctcagggcgtattctcggaaa

SEQ ID NO: 59941 - DNA, 25 bp, S. cerevisiae
tttcgctggcttaaattctggtgac

SEQ ID NO: 59942 - DNA, 25 bp, S. cerevisiae
tttcctgccaattcaatttggtact

SEQ ID NO: 59943 - DNA, 25 bp, S. cerevisiae
tttgcctccactttctttagtttgt

SEQ ID NO: 59944 - DNA, 25 bp, S. cerevisiae
ttatcggccacaacgttcctaatgg

SEQ ID NO: 59945 - DNA, 25 bp, S. cerevisiae
tttcgagaggaaaacaccggcagtg

SEQ ID NO: 59946 - DNA, 25 bp, S. cerevisiae
tttcgaagaaagacaccaagctggt

SEQ ID NO: 59947 - DNA, 25 bp, S. cerevisiae
tttaaagaaagatccccgtgtcata

SEQ ID NO: 59948 - DNA, 25 bp, S. cerevisiae
tttgaacagttacgcaagccccatt

SEQ ID NO: 59949 - DNA, 25 bp, S. cerevisiae
ttatgtaggcttaccaaccaccggt

SEQ ID NO: 59950 - DNA, 25 bp, S. cerevisiae
tttgatttcttgatcacccacgagc

SEQ ID NO: 59951 - DNA, 25 bp, S. cerevisiae
tttgcgtgtcgatttccccatagag

SEQ ID NO: 59952 - DNA, 25 bp, S. cerevisiae
tttcgatgcttggttgacccacaga

SEQ ID NO: 59953 - DNA, 25 bp, S. cerevisiae
ttttggctgagcacataccgaagtc

SEQ ID NO: 59954 - DNA, 25 bp, S. cerevisiae
ttttagctgcaaagcacccagaggt

SEQ ID NO: 59955 - DNA, 25 bp, S. cerevisiae
tttgcacaaggacacaccagctttg

SEQ ID NO: 59956 - DNA, 25 bp, S. cerevisiae
tttgcaacccataacagccagcttt

SEQ ID NO: 59957 - DNA, 25 bp, S. cerevisiae
ttacctgtatctaaccgaaagttca

SEQ ID NO: 59958 - DNA, 25 bp, S. cerevisiae
tttccttcctcaactgacatgaatg

SEQ ID NO: 59959 - DNA, 25 bp, S. cerevisiae
ttcgccggcggcaagctaatacgat

SEQ ID NO: 59960 - DNA, 25 bp, S. cerevisiae
tttgcctccggaatgtgaaacctgt

SEQ ID NO: 59961 - DNA, 25 bp, S. cerevisiae
tttcgctccgtaaggatctaccaga

SEQ ID NO: 59962 - DNA, 25 bp, S. cerevisiae
tttcgcatcgcgcttgggatataaa

SEQ ID NO: 59963 - DNA, 25 bp, S. cerevisiae
tttgctcacggactcggcgaattaa

SEQ ID NO: 59964 - DNA, 25 bp, S. cerevisiae
ttatgccacgcttatgcaagacgtt

SEQ ID NO: 59965 - DNA, 25 bp, S. cerevisiae
tttcggtgctgttgttgcaggtgca

SEQ ID NO: 59966 - DNA, 25 bp, S. cerevisiae
tttgcggtgttcatccaggtggtaa

SEQ ID NO: 59967 - DNA, 25 bp, S. cerevisiae
ttttgggccgttccattgggtatga

SEQ ID NO: 59968 - DNA, 25 bp, S. cerevisiae
tttaggttctgacccattggaccca

SEQ ID NO: 59969 - DNA, 25 bp, S. cerevisiae
tttcttgttatcagccagttggttt

SEQ ID NO: 59970 - DNA, 25 bp, S. cerevisiae
ttacctggttttgcagtctttttgt

SEQ ID NO: 59971 - DNA, 25 bp, S. cerevisiae
tttcctttccctgttttggattgag

SEQ ID NO: 59972 - DNA, 25 bp, S. cerevisiae
tttgcctctatcactgggttggaat

SEQ ID NO: 59973 - DNA, 25 bp, S. cerevisiae
tttgcccatggcaattagtgtgtgg

SEQ ID NO: 59974 - DNA, 25 bp, S. cerevisiae
tttgcgcactccaagacaattgatg

SEQ ID NO: 59975 - DNA, 25 bp, S. cerevisiae
tttactgtggtgacggtgtttctga

SEQ ID NO: 59976 - DNA, 25 bp, S. cerevisiae
ttttctccatactctaacgctggta

SEQ ID NO: 59977 - DNA, 25 bp, S. cerevisiae
tttatcccgacaccataacgtttga

SEQ ID NO: 59978 - DNA, 25 bp, S. cerevisiae
ttttccctgaagaactaggcgtcga

SEQ ID NO: 59979 - DNA, 25 bp, S. cerevisiae
ttttggcctggacaaagacgccgat

SEQ ID NO: 59980 - DNA, 25 bp, S. cerevisiae
ttcttaccgcgacaaagtgcaggaa

SEQ ID NO: 59981 - DNA, 25 bp, S. cerevisiae
tttccatcagcaaatcgaccgtcaa

SEQ ID NO: 59982 - DNA, 25 bp, S. cerevisiae
tttccatcgccagtcgaaacacaat

SEQ ID NO: 59983 - DNA, 25 bp, S. cerevisiae
tttcctcctctgtcgaatcaaaact

SEQ ID NO: 59984 - DNA, 25 bp, S. cerevisiae
ttttacctccaccaactcataatga

SEQ ID NO: 59985 - DNA, 25 bp, S. cerevisiae
tttgtctcgtcgtttcacaatgaca

SEQ ID NO: 59986 - DNA, 25 bp, S. cerevisiae
tttgtgggctggtcttgcaactgaa

SEQ ID NO: 59987 - DNA, 25 bp, S. cerevisiae
tttcgccgaaaccttgaagcatgac

SEQ ID NO: 59988 - DNA, 25 bp, S. cerevisiae
tttgattctgtttttggtgcccaac

SEQ ID NO: 59989 - DNA, 25 bp, S. cerevisiae
tttcgccagtccatgtttcagtgaa

SEQ ID NO: 59990 - DNA, 25 bp, S. cerevisiae
tttgcctgctgttgatggctttcaa

SEQ ID NO: 59991 - DNA, 25 bp, S. cerevisiae
tttgcgcttgtggtggtagctcaat

SEQ ID NO: 59992 - DNA, 25 bp, S. cerevisiae
tttacttcaacaaactacgcgacat

SEQ ID NO: 59993 - DNA, 25 bp, S. cerevisiae
tttatggaacactccctactacttt

SEQ ID NO: 59994 - DNA, 25 bp, S. cerevisiae
tttcagtaatccttcctcatactcg

SEQ ID NO: 59995 - DNA, 25 bp, S. cerevisiae
tttcgaatactaacgccacacacat

SEQ ID NO: 59996 - DNA, 25 bp, S. cerevisiae
tttccatatcacaaagacccacatt

SEQ ID NO: 59997 - DNA, 25 bp, S. cerevisiae
tttcacctatttcggcatgctatgc

SEQ ID NO: 59998 - DNA, 25 bp, S. cerevisiae
tttacctgatgttatgcctgagcaa

SEQ ID NO: 59999 - DNA, 25 bp, S. cerevisiae
tttaccggtgctgggctggcataca

SEQ ID NO: 60000 - DNA, 25 bp, S. cerevisiae
tttcctattggtcgggtaacagatt

SEQ ID NO: 60001 - DNA, 25 bp, S. cerevisiae
tttcctactcaacggaaaagtgatt

SEQ ID NO: 60002 - DNA, 25 bp, S. cerevisiae
tttcctactaattttatcggtgatg

SEQ ID NO: 60003 - DNA, 25 bp, S. cerevisiae
tttcattttggtcggtttggcttgt

SEQ ID NO: 60004 - DNA, 25 bp, S. cerevisiae
ttacccaagttcgtgttgagttctt

SEQ ID NO: 60005 - DNA, 25 bp, S. cerevisiae
tttctccaaatccaggttaccatct

SEQ ID NO: 60006 - DNA, 25 bp, S. cerevisiae
ttttactgcgccaacctggttaaat

SEQ ID NO: 60007 - DNA, 25 bp, S. cerevisiae
tttgatccattccatatttgtcccc

SEQ ID NO: 60008 - DNA, 25 bp, S. cerevisiae
tttgcttcattccagattctttcca

SEQ ID NO: 60009 - DNA, 25 bp, S. cerevisiae
tttgatgtgggccattacgttcctt

SEQ ID NO: 60010 - DNA, 25 bp, S. cerevisiae
tttttggcggcatcagggacctgtc

SEQ ID NO: 60011 - DNA, 25 bp, S. cerevisiae
tttacttcagaagcaggacacctgt

SEQ ID NO: 60012 - DNA, 25 bp, S. cerevisiae
tttcaccacgtattcctctttaaag

SEQ ID NO: 60013 - DNA, 25 bp, S. cerevisiae
tttaaaggatttagcggcggcccat

SEQ ID NO: 60014 - DNA, 25 bp, S. cerevisiae
tttaattgtcactaatgccgctggt

SEQ ID NO: 60015 - DNA, 25 bp, S. cerevisiae
tttcgacggccaagatgatcacaat

SEQ ID NO: 60016 - DNA, 25 bp, S. cerevisiae
tttcagctggttagacgagcttcca

SEQ ID NO: 60017 - DNA, 25 bp, S. cerevisiae
tttccagctttgcaaggttccacga

SEQ ID NO: 60018 - DNA, 25 bp, S. cerevisiae
tttgctccatttacaaagctctcct

SEQ ID NO: 60019 - DNA, 25 bp, S. cerevisiae
tttgcagccatccttccagagttta

SEQ ID NO: 60020 - DNA, 25 bp, S. cerevisiae
tttcggtaactatctttctgactta

SEQ ID NO: 60021 - DNA, 25 bp, S. cerevisiae
tttcgggttcttcgctattggattt

SEQ ID NO: 60022 - DNA, 25 bp, S. cerevisiae
tttgctatgctaaatcctgcctact

SEQ ID NO: 60023 - DNA, 25 bp, S. cerevisiae
tttgctattgctatcctgcacgagg

SEQ ID NO: 60024 - DNA, 25 bp, S. cerevisiae
tttcttctcgtaggtggtggtgttt

SEQ ID NO: 60025 - DNA, 25 bp, S. cerevisiae
tttctccgtataggtctgtgtttat

SEQ ID NO: 60026 - DNA, 25 bp, S. cerevisiae
ttttgccgcatctttgttggactat

SEQ ID NO: 60027 - DNA, 25 bp, S. cerevisiae
tttcctcgctatttcttgaacatgt

SEQ ID NO: 60028 - DNA, 25 bp, S. cerevisiae
ttgattctactttcccgcaaaaggg

SEQ ID NO: 60029 - DNA, 25 bp, S. cerevisiae
ttttcaacttccatcctacaaacag

SEQ ID NO: 60030 - DNA, 25 bp, S. cerevisiae
tttaaaattcccattacctcacaga

SEQ ID NO: 60031 - DNA, 25 bp, S. cerevisiae
tttacggttaccatctactgatcaa

SEQ ID NO: 60032 - DNA, 25 bp, S. cerevisiae
tttaggtttaactccatctgccaat

SEQ ID NO: 60033 - DNA, 25 bp, S. cerevisiae
ttatcttgggttcttcttaccagaa

SEQ ID NO: 60034 - DNA, 25 bp, S. cerevisiae
ttcaagttttgtattatccacggca

SEQ ID NO: 60035 - DNA, 25 bp, S. cerevisiae
tttgatctttttgcttgccccaata

SEQ ID NO: 60036 - DNA, 25 bp, S. cerevisiae
tttacgatttcctacgaacactgcc

SEQ ID NO: 60037 - DNA, 25 bp, S. cerevisiae
tttaccaatggatgcgttgacgcta

SEQ ID NO: 60038 - DNA, 25 bp, S. cerevisiae
tttacaacaaaaactctcggatctg

SEQ ID NO: 60039 - DNA, 25 bp, S. cerevisiae
tttatcgggtacctcaatggcttcc

SEQ ID NO: 60040 - DNA, 25 bp, S. cerevisiae
tttcttggtgtctgtcttggattac

SEQ ID NO: 60041 - DNA, 25 bp, S. cerevisiae
tttgcttcaatttttcctgccattt

SEQ ID NO: 60042 - DNA, 25 bp, S. cerevisiae
tttgcttcagatatggtgcccaagt

SEQ ID NO: 60043 - DNA, 25 bp, S. cerevisiae
tttcgatttcgatattgatgaccta

SEQ ID NO: 60044 - DNA, 25 bp, S. cerevisiae
tttgcctgttgctatcgttgatgac

SEQ ID NO: 60045 - DNA, 25 bp, S. cerevisiae
tttgctaagcacattcatactcctg

SEQ ID NO: 60046 - DNA, 25 bp, S. cerevisiae
tttgaactctgctagaaagctacgt

SEQ ID NO: 60047 - DNA, 25 bp, S. cerevisiae
tttatccggtaaaatcaatgccagt

SEQ ID NO: 60048 - DNA, 25 bp, S. cerevisiae
tttgcaccgagtcttatccacgatt

SEQ ID NO: 60049 - DNA, 25 bp, S. cerevisiae
tttgaagccgttttgatctcatctt

SEQ ID NO: 60050 - DNA, 25 bp, S. cerevisiae
tttgaattctttttcctgctctcga

SEQ ID NO: 60051 - DNA, 25 bp, S. cerevisiae
ttttctacgttttggccaagtacag

SEQ ID NO: 60052 - DNA, 25 bp, S. cerevisiae
tttagtctcgttcctgtcaaagtaa

SEQ ID NO: 60053 - DNA, 25 bp, S. cerevisiae
tttagtaccactcaacaagttgtct

SEQ ID NO: 60054 - DNA, 25 bp, S. cerevisiae
tttgaagacaccaacgtccaccgat

SEQ ID NO: 60055 - DNA, 25 bp, S. cerevisiae
tttcaacaacgctttgagccaccaa

SEQ ID NO: 60056 - DNA, 25 bp, S. cerevisiae
tttccaatagattttcccagccaac

SEQ ID NO: 60057 - DNA, 25 bp, S. cerevisiae
tttcccatattagatttcgccaagc

SEQ ID NO: 60058 - DNA, 25 bp, S. cerevisiae
tttccccttgtcagattcggcggac

SEQ ID NO: 60059 - DNA, 25 bp, S. cerevisiae
tttacaccatttgtcgttgcctcaa

SEQ ID NO: 60060 - DNA, 25 bp, S. cerevisiae
ttgtagcactttgaacggcgcctca

SEQ ID NO: 60061 - DNA, 25 bp, S. cerevisiae
tttcagaatttcaaagcgccgtccc

SEQ ID NO: 60062 - DNA, 25 bp, S. cerevisiae
tttgaactgttaaagccgcgtgcat

SEQ ID NO: 60063 - DNA, 25 bp, S. cerevisiae
tttccagtcggcaaaaatcggtata

SEQ ID NO: 60064 - DNA, 25 bp, S. cerevisiae
ttattaggcgcgaaaattgggctga

SEQ ID NO: 60065 - DNA, 25 bp, S. cerevisiae
tttcccttactacgttcatacgatc

SEQ ID NO: 60066 - DNA, 25 bp, S. cerevisiae
tttgcgtctttgttcttctgcacaa

SEQ ID NO: 60067 - DNA, 25 bp, S. cerevisiae
tttcacagtccggtcttcaatataa

SEQ ID NO: 60068 - DNA, 25 bp, S. cerevisiae
tttctcacaccggatatgtatcaag

SEQ ID NO: 60069 - DNA, 25 bp, S. cerevisiae
tttcccaccttgatggatgctctga

SEQ ID NO: 60070 - DNA, 25 bp, S. cerevisiae
tttgcatctactgtggttgatccat

SEQ ID NO: 60071 - DNA, 25 bp, S. cerevisiae
ttatcactgagtctggttggccatc

SEQ ID NO: 60072 - DNA, 25 bp, S. cerevisiae
tttgcagctgattttgttctaggtc

SEQ ID NO: 60073 - DNA, 25 bp, S. cerevisiae
tttccttatctttatcacaggcata

SEQ ID NO: 60074 - DNA, 25 bp, S. cerevisiae
tttgccttacttcatttggctgaac

SEQ ID NO: 60075 - DNA, 25 bp, S. cerevisiae
tttccttgggtggttatgtcttcca

SEQ ID NO: 60076 - DNA, 25 bp, S. cerevisiae
tttccattgggtactttcttggcaa

SEQ ID NO: 60077 - DNA, 25 bp, S. cerevisiae
ttacctggcggtttcacttgtgaag

SEQ ID NO: 60078 - DNA, 25 bp, S. cerevisiae
tttgcctgtttgttgcccgttaaat

SEQ ID NO: 60079 - DNA, 25 bp, S. cerevisiae
tttgcgttcctatcactcgtaaatt

SEQ ID NO: 60080 - DNA, 25 bp, S. cerevisiae
tttcgccattttacctcatcatttg

SEQ ID NO: 60081 - DNA, 25 bp, S. cerevisiae
tttcgccaagttattctgcactagg

SEQ ID NO: 60082 - DNA, 25 bp, S. cerevisiae
tttgcaaagaacatcgagaacccat

SEQ ID NO: 60083 - DNA, 25 bp, S. cerevisiae
tttagaaagacctcccgctgctgta

SEQ ID NO: 60084 - DNA, 25 bp, S. cerevisiae
tttcgaaaggacttgcccacattgt

SEQ ID NO: 60085 - DNA, 25 bp, S. cerevisiae
ttttccaaggtgctcaaacatctga

SEQ ID NO: 60086 - DNA, 25 bp, S. cerevisiae
ttttacaatcgccaaccatatcatc

SEQ ID NO: 60087 - DNA, 25 bp, S. cerevisiae
tttcccaatggatacaaacgccctt

SEQ ID NO: 60088 - DNA, 25 bp, S. cerevisiae
ttacgagggagctcaatcttttatg

SEQ ID NO: 60089 - DNA, 25 bp, S. cerevisiae
ttttcgtacgaaatgccggatctga

SEQ ID NO: 60090 - DNA, 25 bp, S. cerevisiae
tttttgagacgaaacctggttcagg

SEQ ID NO: 60091 - DNA, 25 bp, S. cerevisiae
tttaactggtgaacactcgtcctcg

SEQ ID NO: 60092 - DNA, 25 bp, S. cerevisiae
tttatattgagtgcgatcctgtccc

SEQ ID NO: 60093 - DNA, 25 bp, S. cerevisiae
tttcagttttgatttggttcccaga

SEQ ID NO: 60094 - DNA, 25 bp, S. cerevisiae
tttgctgctttgacaaccgtgttca

SEQ ID NO: 60095 - DNA, 25 bp, S. cerevisiae
tttatccaagccacgtgtgctacct

SEQ ID NO: 60096 - DNA, 25 bp, S. cerevisiae
tttctacaatgacccagtgtcttcc

SEQ ID NO: 60097 - DNA, 25 bp, S. cerevisiae
ttttatcgagagaccggcctaacca

SEQ ID NO: 60098 - DNA, 25 bp, S. cerevisiae
tttttggtagtttggcccatgccca

SEQ ID NO: 60099 - DNA, 25 bp, S. cerevisiae
ttttttgatttgaaggccctacgcg

SEQ ID NO: 60100 - DNA, 25 bp, S. cerevisiae
tttttattctagtcggtttggcttg

SEQ ID NO: 60101 - DNA, 25 bp, S. cerevisiae
ttttcattttggtcggtttggcttg

SEQ ID NO: 60102 - DNA, 25 bp, S. cerevisiae
ttttgctctttgctacgtttggaga

SEQ ID NO: 60103 - DNA, 25 bp, S. cerevisiae
tttcctcttcttcatactttggaga

SEQ ID NO: 60104 - DNA, 25 bp, S. cerevisiae
tttgctccaggtttgattcgtgatt

SEQ ID NO: 60105 - DNA, 25 bp, S. cerevisiae
tttgctctaggtataattgcctttg

SEQ ID NO: 60106 - DNA, 25 bp, S. cerevisiae
tttccacggatattccaattgtgaa

SEQ ID NO: 60107 - DNA, 25 bp, S. cerevisiae
tttcagaagggcttaccacgtccaa

SEQ ID NO: 60108 - DNA, 25 bp, S. cerevisiae
ttttagaagccattgcccttatctc

SEQ ID NO: 60109 - DNA, 25 bp, S. cerevisiae
ttttcccaacagtccggtcaaacag

SEQ ID NO: 60110 - DNA, 25 bp, S. cerevisiae
tttcctcctcacttttacttagatg

SEQ ID NO: 60111 - DNA, 25 bp, S. cerevisiae
tttaccgaggattctgaagttcatc

SEQ ID NO: 60112 - DNA, 25 bp, S. cerevisiae
tttacccataaattccatgattatc

SEQ ID NO: 60113 - DNA, 25 bp, S. cerevisiae
tttctcaccgaaatgtctgccaaga

SEQ ID NO: 60114 - DNA, 25 bp, S. cerevisiae
tttacatttctcatggcatccaaga

SEQ ID NO: 60115 - DNA, 25 bp, S. cerevisiae
ttctaaaccgtttcatcgactggaa

SEQ ID NO: 60116 - DNA, 25 bp, S. cerevisiae
tttcagggcttattatcggaccaaa

SEQ ID NO: 60117 - DNA, 25 bp, S. cerevisiae
tttttacaaggtcgcgacacctcca

SEQ ID NO: 60118 - DNA, 25 bp, S. cerevisiae
ttttaaaatcgtcgcacccgttgct

SEQ ID NO: 60119 - DNA, 25 bp, S. cerevisiae
tttagagaattcttcgaccgagttg

SEQ ID NO: 60120 - DNA, 25 bp, S. cerevisiae
tttcatagtttctctggtcgcttta

SEQ ID NO: 60121 - DNA, 25 bp, S. cerevisiae
tttcttcaggtcactacattgccca

SEQ ID NO: 60122 - DNA, 25 bp, S. cerevisiae
tttttacgactacttgggcgactct

SEQ ID NO: 60123 - DNA, 25 bp, S. cerevisiae
ttttgcaacaactgccatggacgtt

SEQ ID NO: 60124 - DNA, 25 bp, S. cerevisiae
tttcgctacagcttatccaggattt

SEQ ID NO: 60125 - DNA, 25 bp, S. cerevisiae
tttcgcttaatattacccttcatcc

SEQ ID NO: 60126 - DNA, 25 bp, S. cerevisiae
tttacgctcgttttttgttaagcag

SEQ ID NO: 60127 - DNA, 25 bp, S. cerevisiae
ttaacctggtctatttctaacaaca

SEQ ID NO: 60128 - DNA, 25 bp, S. cerevisiae
ttttatcgagcgcaatttcaccccg

SEQ ID NO: 60129 - DNA, 25 bp, S. cerevisiae
ttctttgcgggctaatttactcgac

SEQ ID NO: 60130 - DNA, 25 bp, S. cerevisiae
tttatcggcaggcttttcaacgggc

SEQ ID NO: 60131 - DNA, 25 bp, S. cerevisiae
tttccgccagctatagtcaacttag

SEQ ID NO: 60132 - DNA, 25 bp, S. cerevisiae
ttatctcccaatagtagtaacccag

SEQ ID NO: 60133 - DNA, 25 bp, S. cerevisiae
tttagttcagcataccaggacacac

SEQ ID NO: 60134 - DNA, 25 bp, S. cerevisiae
tttagatctcaacagggtccaccga

SEQ ID NO: 60135 - DNA, 25 bp, S. cerevisiae
tttaactcaagtcggttcaggccca

SEQ ID NO: 60136 - DNA, 25 bp, S. cerevisiae
tttataccacggcaccattttacac

SEQ ID NO: 60137 - DNA, 25 bp, S. cerevisiae
tttcattcccctttacgtagtagcg

SEQ ID NO: 60138 - DNA, 25 bp, S. cerevisiae
tttacaatcctaactatcagcctgg

SEQ ID NO: 60139 - DNA, 25 bp, S. cerevisiae
ttattacattgaaacaccggtccat

SEQ ID NO: 60140 - DNA, 25 bp, S. cerevisiae
tttatggttcaactagcgctaggga

SEQ ID NO: 60141 - DNA, 25 bp, S. cerevisiae
ttttttctgcataccaagcaagttt

SEQ ID NO: 60142 - DNA, 25 bp, S. cerevisiae
tttcttgccgcatcatactgatatt

SEQ ID NO: 60143 - DNA, 25 bp, S. cerevisiae
tttagatgtctcctatccgcaattt

SEQ ID NO: 60144 - DNA, 25 bp, S. cerevisiae
tttacgttccatcctgtggatgcat

SEQ ID NO: 60145 - DNA, 25 bp, S. cerevisiae
tttacaattttgttgcgggctcagc

SEQ ID NO: 60146 - DNA, 25 bp, S. cerevisiae
tttacaggttatgtcggtgccgcat

SEQ ID NO: 60147 - DNA, 25 bp, S. cerevisiae
tttccgacggatgttgatgacccat

SEQ ID NO: 60148 - DNA, 25 bp, S. cerevisiae
tttccagacgtaaattgatgcccca

SEQ ID NO: 60149 - DNA, 25 bp, S. cerevisiae
tttccttttctcattgttctcatat

SEQ ID NO: 60150 - DNA, 25 bp, S. cerevisiae
tttcctgttttctattcctcatcaa

SEQ ID NO: 60151 - DNA, 25 bp, S. cerevisiae
tttctccagacgacaaatattcaag

SEQ ID NO: 60152 - DNA, 25 bp, S. cerevisiae
ttttcgcaacggaccaattccagtg

SEQ ID NO: 60153 - DNA, 25 bp, S. cerevisiae
tttctcgaaggatgccaaaccatgg

SEQ ID NO: 60154 - DNA, 25 bp, S. cerevisiae
tttactgccagctgatttcgtcaag

SEQ ID NO: 60155 - DNA, 25 bp, S. cerevisiae
tttcgggcggcaatatagtgtcaca

SEQ ID NO: 60156 - DNA, 25 bp, S. cerevisiae
ttttgaggcgcctgtggtgatgcca

SEQ ID NO: 60157 - DNA, 25 bp, S. cerevisiae
tttccgaatcagacagtgttttggt

SEQ ID NO: 60158 - DNA, 25 bp, S. cerevisiae
tttcgccaggttcattacagctatt

SEQ ID NO: 60159 - DNA, 25 bp, S. cerevisiae
tttagccaaggtcatcaaagtttta

SEQ ID NO: 60160 - DNA, 25 bp, S. cerevisiae
tttagccggtgtagaaacgttcatt

SEQ ID NO: 60161 - DNA, 25 bp, S. cerevisiae
ttttccgaatgatgaaccgtcactt

SEQ ID NO: 60162 - DNA, 25 bp, S. cerevisiae
tttcagtttgattgtacctccagga

SEQ ID NO: 60163 - DNA, 25 bp, S. cerevisiae
tttcatgtatatttggatccaccac

SEQ ID NO: 60164 - DNA, 25 bp, S. cerevisiae
tttcaaggacatgtgggcgctgcta

SEQ ID NO: 60165 - DNA, 25 bp, S. cerevisiae
tttagcattgttcacgggtcatccg

SEQ ID NO: 60166 - DNA, 25 bp, S. cerevisiae
tttactgttgaatccgtcaccagaa

SEQ ID NO: 60167 - DNA, 25 bp, S. cerevisiae
tttcagcttatatgtctggcaaggc

SEQ ID NO: 60168 - DNA, 25 bp, S. cerevisiae
tttcctgtggcaagattggcaagct

SEQ ID NO: 60169 - DNA, 25 bp, S. cerevisiae
tttccggcgcacctattgtaaggag

SEQ ID NO: 60170 - DNA, 25 bp, S. cerevisiae
tttccgggactctggcttggataga

SEQ ID NO: 60171 - DNA, 25 bp, S. cerevisiae
tttccggcatgtacttgggtgagct

SEQ ID NO: 60172 - DNA, 25 bp, S. cerevisiae
tttcaatggtgtacctggccaggct

SEQ ID NO: 60173 - DNA, 25 bp, S. cerevisiae
ttgtttgggtttggtgccatggttt

SEQ ID NO: 60174 - DNA, 25 bp, S. cerevisiae
tttctgtttatcactgtctggtcca

SEQ ID NO: 60175 - DNA, 25 bp, S. cerevisiae
tttcgttttctactttggtgctcat

SEQ ID NO: 60176 - DNA, 25 bp, S. cerevisiae
ttctcgttgagcctacttggttcaa

SEQ ID NO: 60177 - DNA, 25 bp, S. cerevisiae
tttcgtacatgcatggccgttttac

SEQ ID NO: 60178 - DNA, 25 bp, S. cerevisiae
tttctttcagccctacagtatttaa

SEQ ID NO: 60179 - DNA, 25 bp, S. cerevisiae
tttctctttcctcctattaactttg

SEQ ID NO: 60180 - DNA, 25 bp, S. cerevisiae
tttcatttgtctgtccaactgagat

SEQ ID NO: 60181 - DNA, 25 bp, S. cerevisiae
ttttttgtcacctcaacggtctact

SEQ ID NO: 60182 - DNA, 25 bp, S. cerevisiae
ttttttgtcacctcagaatgctgct

SEQ ID NO: 60183 - DNA, 25 bp, S. cerevisiae
ttttttccttgctaaatgcccttga

SEQ ID NO: 60184 - DNA, 25 bp, S. cerevisiae
tttcaaatacctttccacctacgat

SEQ ID NO: 60185 - DNA, 25 bp, S. cerevisiae
tttacttaccttttcacctacaatg

SEQ ID NO: 60186 - DNA, 25 bp, S. cerevisiae
tttttacttaacttgccacgcaggg

SEQ ID NO: 60187 - DNA, 25 bp, S. cerevisiae
ttttctcatgctcaaactgctgtca

SEQ ID NO: 60188 - DNA, 25 bp, S. cerevisiae
tttttactgggctgctcttcagcag

SEQ ID NO: 60189 - DNA, 25 bp, S. cerevisiae
tttcgctatctgtcgcgggtgaaga

SEQ ID NO: 60190 - DNA, 25 bp, S. cerevisiae
tttagccctgacctggaggaagaac

SEQ ID NO: 60191 - DNA, 25 bp, S. cerevisiae
ttatgcaaagctatacggtactgac

SEQ ID NO: 60192 - DNA, 25 bp, S. cerevisiae
tttaaggctccaaaggctccattca

SEQ ID NO: 60193 - DNA, 25 bp, S. cerevisiae
ttatgaagcgtctagccgattaccc

SEQ ID NO: 60194 - DNA, 25 bp, S. cerevisiae
ttcgaatcgtcctcaaaactcgcag

SEQ ID NO: 60195 - DNA, 25 bp, S. cerevisiae
tttcttcaatcctcaagacaccgag

SEQ ID NO: 60196 - DNA, 25 bp, S. cerevisiae
tttctgggttggttcatggctttga

SEQ ID NO: 60197 - DNA, 25 bp, S. cerevisiae
tttatcgcttcgttaatgactttga

SEQ ID NO: 60198 - DNA, 25 bp, S. cerevisiae
ttttcacttggaaactgcacttttc

SEQ ID NO: 60199 - DNA, 25 bp, S. cerevisiae
ttaggttcggtggtcattatgtaca

SEQ ID NO: 60200 - DNA, 25 bp, S. cerevisiae
ttaggtccctgtgtcaaagtcagaa

SEQ ID NO: 60201 - DNA, 25 bp, S. cerevisiae
ttatttcctattggtcgggtaacag

SEQ ID NO: 60202 - DNA, 25 bp, S. cerevisiae
ttctggacctttctgcacggataaa

SEQ ID NO: 60203 - DNA, 25 bp, S. cerevisiae
ttgaagcttcgtgcatggagggcca

SEQ ID NO: 60204 - DNA, 25 bp, S. cerevisiae
ttaaatgttgccgtcgaggcccaat

SEQ ID NO: 60205 - DNA, 25 bp, S. cerevisiae
ttctaaatcccagttggtgcccaaa

SEQ ID NO: 60206 - DNA, 25 bp, S. cerevisiae
tttaaatacgccatggctgtcgcgc

SEQ ID NO: 60207 - DNA, 25 bp, S. cerevisiae
tttacatatcaccaaaaggacacta

SEQ ID NO: 60208 - DNA, 25 bp, S. cerevisiae
tttctcctcctatgagccagaattg

SEQ ID NO: 60209 - DNA, 25 bp, S. cerevisiae
tttacattcgtacacaggctccaag

SEQ ID NO: 60210 - DNA, 25 bp, S. cerevisiae
tttacaccgtagcttggtcaccaaa

SEQ ID NO: 60211 - DNA, 25 bp, S. cerevisiae
tttaccattttcagattagcggagt

SEQ ID NO: 60212 - DNA, 25 bp, S. cerevisiae
ttttccttttctgttggaggcattt

SEQ ID NO: 60213 - DNA, 25 bp, S. cerevisiae
ttttccacgggagatgttgcattta

SEQ ID NO: 60214 - DNA, 25 bp, S. cerevisiae
ttggtaccggaggagtttgtctctt

SEQ ID NO: 60215 - DNA, 25 bp, S. cerevisiae
tttttccccaaaagctcgcaatgtt

SEQ ID NO: 60216 - DNA, 25 bp, S. cerevisiae
tttctttctctatactacctaactc

SEQ ID NO: 60217 - DNA, 25 bp, S. cerevisiae
ttttgaattctccttctcatttgcc

SEQ ID NO: 60218 - DNA, 25 bp, S. cerevisiae
ttaaatattcacacgggtctctaaa

SEQ ID NO: 60219 - DNA, 25 bp, S. cerevisiae
ttcaatagaaaggattacgataccc

SEQ ID NO: 60220 - DNA, 25 bp, S. cerevisiae
ttatacaaattccttcacgaccacc

SEQ ID NO: 60221 - DNA, 25 bp, S. cerevisiae
tttaattccggacgcttccaagcaa

SEQ ID NO: 60222 - DNA, 25 bp, S. cerevisiae
tttatgtatccactgacgctatcgc

SEQ ID NO: 60223 - DNA, 25 bp, S. cerevisiae
ttatagtagccagcggcggcgccag

SEQ ID NO: 60224 - DNA, 25 bp, S. cerevisiae
ttttttgtctcagatgtgggcacag

SEQ ID NO: 60225 - DNA, 25 bp, S. cerevisiae
tttcttgatgacgacacattccaaa

SEQ ID NO: 60226 - DNA, 25 bp, S. cerevisiae
tttcggcagccatagacgctcagaa

SEQ ID NO: 60227 - DNA, 25 bp, S. cerevisiae
tttcagcggccttaacagattgtac

SEQ ID NO: 60228 - DNA, 25 bp, S. cerevisiae
ttttgcgcgcctgcgaagtttccgc

SEQ ID NO: 60229 - DNA, 25 bp, S. cerevisiae
ttttcacctcaaatcatcggcttag

SEQ ID NO: 60230 - DNA, 25 bp, S. cerevisiae
ttttcagccatttcgagccgttcag

SEQ ID NO: 60231 - DNA, 25 bp, S. cerevisiae
tttcacgctgtataccatgattcag

SEQ ID NO: 60232 - DNA, 25 bp, S. cerevisiae
tttaccgccatgtactatgctatgt

SEQ ID NO: 60233 - DNA, 25 bp, S. cerevisiae
tttacctccgatacttgtcattcat

SEQ ID NO: 60234 - DNA, 25 bp, S. cerevisiae
tttcggcgtcattgcttttgttgca

SEQ ID NO: 60235 - DNA, 25 bp, S. cerevisiae
tttctagaagtgtacgcctcaggca

SEQ ID NO: 60236 - DNA, 25 bp, S. cerevisiae
ttttcaaacatgtcagccaccgtat

SEQ ID NO: 60237 - DNA, 25 bp, S. cerevisiae
ttttcgccgaaaccttgaagcatga

SEQ ID NO: 60238 - DNA, 25 bp, S. cerevisiae
tttttggcataactacctacccact

SEQ ID NO: 60239 - DNA, 25 bp, S. cerevisiae
ttttgtggttactcgatacctcatc

SEQ ID NO: 60240 - DNA, 25 bp, S. cerevisiae
ttaagaaattactccaacgcgaaga

SEQ ID NO: 60241 - DNA, 25 bp, S. cerevisiae
ttaaggaagtactctcccgacgcca

SEQ ID NO: 60242 - DNA, 25 bp, S. cerevisiae
ttagggtatgtaaccgccacgacca

SEQ ID NO: 60243 - DNA, 25 bp, S. cerevisiae
tttcgttcgttatcaacaccagcca

SEQ ID NO: 60244 - DNA, 25 bp, S. cerevisiae
tttcttccgttgttccacgaactga

SEQ ID NO: 60245 - DNA, 25 bp, S. cerevisiae
tttagtttgtcttctgccccaaaat

SEQ ID NO: 60246 - DNA, 25 bp, S. cerevisiae
ttttcttttcatcattcgacggact

SEQ ID NO: 60247 - DNA, 25 bp, S. cerevisiae
tttatttttggcactcttcacctac

SEQ ID NO: 60248 - DNA, 25 bp, S. cerevisiae
tttttgtttagcatcaatcaaccta

SEQ ID NO: 60249 - DNA, 25 bp, S. cerevisiae
ttcttccggcgaaacaaccgattca

SEQ ID NO: 60250 - DNA, 25 bp, S. cerevisiae
tttatccaccgtagaacccaaagca

SEQ ID NO: 60251 - DNA, 25 bp, S. cerevisiae
tttatctagcgggtcaacgccgaaa

SEQ ID NO: 60252 - DNA, 25 bp, S. cerevisiae
ttattaccttcaatcgacttgggcg

SEQ ID NO: 60253 - DNA, 25 bp, S. cerevisiae
tttctcacaagggttttattactga

SEQ ID NO: 60254 - DNA, 25 bp, S. cerevisiae
tttatagccagatacctctttgagg

SEQ ID NO: 60255 - DNA, 25 bp, S. cerevisiae
tttaactgcatcaaacctcttcgag

SEQ ID NO: 60256 - DNA, 25 bp, S. cerevisiae
tttctttgtggctggcgccgcagtg

SEQ ID NO: 60257 - DNA, 25 bp, S. cerevisiae
tttttacagctaacgccaaacttgg

SEQ ID NO: 60258 - DNA, 25 bp, S. cerevisiae
ttttttacatattcccacaccttgg

SEQ ID NO: 60259 - DNA, 25 bp, S. cerevisiae
ttttgttattaagcaacgccttgtt

SEQ ID NO: 60260 - DNA, 25 bp, S. cerevisiae
ttttgttccatgcagtaaggcgcgt

SEQ ID NO: 60261 - DNA, 25 bp, S. cerevisiae
ttatctcacagagctagagcgctga

SEQ ID NO: 60262 - DNA, 25 bp, S. cerevisiae
tttaagggtcattacgctcaacgtc

SEQ ID NO: 60263 - DNA, 25 bp, S. cerevisiae
ttcaagacgagatgcataagtattc

SEQ ID NO: 60264 - DNA, 25 bp, S. cerevisiae
ttagaccgcgtccaaagagcattcc

SEQ ID NO: 60265 - DNA, 25 bp, S. cerevisiae
ttacccgcagatgaaatactaactt

SEQ ID NO: 60266 - DNA, 25 bp, S. cerevisiae
ttatcccgcagtgaggtgctcttag

SEQ ID NO: 60267 - DNA, 25 bp, S. cerevisiae
ttttggccgtcgtaactgtttgatg

SEQ ID NO: 60268 - DNA, 25 bp, S. cerevisiae
ttttcaccgtcgtcgtcagaatgga

SEQ ID NO: 60269 - DNA, 25 bp, S. cerevisiae
tttattccgtacttgtacaatggat

SEQ ID NO: 60270 - DNA, 25 bp, S. cerevisiae
tttcttcccctcgttaagtgtgcat

SEQ ID NO: 60271 - DNA, 25 bp, S. cerevisiae
ttttggccaccctcaaatgatgtct

SEQ ID NO: 60272 - DNA, 25 bp, S. cerevisiae
ttgtatggcaatccctagattcggt

SEQ ID NO: 60273 - DNA, 25 bp, S. cerevisiae
ttatgatggcgatgtccagtctgac

SEQ ID NO: 60274 - DNA, 25 bp, S. cerevisiae
tttcaggatgtgttacgatgcagac

SEQ ID NO: 60275 - DNA, 25 bp, S. cerevisiae
tttcaaattattctgcatggcacca

SEQ ID NO: 60276 - DNA, 25 bp, S. cerevisiae
tttaaaatcattccgtccaccatat

SEQ ID NO: 60277 - DNA, 25 bp, S. cerevisiae
tttctacatacttggatatcctgga

SEQ ID NO: 60278 - DNA, 25 bp, S. cerevisiae
ttttctgcataccaagcaagtttac

SEQ ID NO: 60279 - DNA, 25 bp, S. cerevisiae
tttctttctcctacttttggcatac

SEQ ID NO: 60280 - DNA, 25 bp, S. cerevisiae
tttactctacctactggttcactac

SEQ ID NO: 60281 - DNA, 25 bp, S. cerevisiae
tttcagttacttctggttctgctaa

SEQ ID NO: 60282 - DNA, 25 bp, S. cerevisiae
tttcaacataattcggcgtccgtcg

SEQ ID NO: 60283 - DNA, 25 bp, S. cerevisiae
tttcaaatgtgttcacacgccctgt

SEQ ID NO: 60284 - DNA, 25 bp, S. cerevisiae
ttattctggcggcaaactacctcaa

SEQ ID NO: 60285 - DNA, 25 bp, S. cerevisiae
ttttccggcgctaagatctacccag

SEQ ID NO: 60286 - DNA, 25 bp, S. cerevisiae
ttttcatataccacattctacccaa

SEQ ID NO: 60287 - DNA, 25 bp, S. cerevisiae
ttttttcccatgacagataacccac

SEQ ID NO: 60288 - DNA, 25 bp, S. cerevisiae
tttcagatcatcctttggtagcaaa

SEQ ID NO: 60289 - DNA, 25 bp, S. cerevisiae
ttatgatgtcttccatttgtgcaag

SEQ ID NO: 60290 - DNA, 25 bp, S. cerevisiae
ttatcccaccaccacgtgatatgaa

SEQ ID NO: 60291 - DNA, 25 bp, S. cerevisiae
ttatcacccacaggccagcggtaaa

SEQ ID NO: 60292 - DNA, 25 bp, S. cerevisiae
ttacaagctgcaggtggcggactaa

SEQ ID NO: 60293 - DNA, 25 bp, S. cerevisiae
tttaagtgcagagtgtcgggctaac

SEQ ID NO: 60294 - DNA, 25 bp, S. cerevisiae
tttagcagtgtctttctcatgggaa

SEQ ID NO: 60295 - DNA, 25 bp, S. cerevisiae
ttttgttccagtcccatctttggct

SEQ ID NO: 60296 - DNA, 25 bp, S. cerevisiae
ttactgccataggattgggcctgct

SEQ ID NO: 60297 - DNA, 25 bp, S. cerevisiae
ttagctcctgcggtatgtgcggtgc

SEQ ID NO: 60298 - DNA, 25 bp, S. cerevisiae
ttagactctccaaatccaaattccc

SEQ ID NO: 60299 - DNA, 25 bp, S. cerevisiae
ttagactacacaacctacgttaccg

SEQ ID NO: 60300 - DNA, 25 bp, S. cerevisiae
ttcaactggaaagcccgtcaattgg

SEQ ID NO: 60301 - DNA, 25 bp, S. cerevisiae
ttaccaatgttcctaacgggagcgt

SEQ ID NO: 60302 - DNA, 25 bp, S. cerevisiae
ttatcccaagattcaatacccgacg

SEQ ID NO: 60303 - DNA, 25 bp, S. cerevisiae
ttatcccaaacacaaaccgacttag

SEQ ID NO: 60304 - DNA, 25 bp, S. cerevisiae
tttcatttccattgtatcagtcttc

SEQ ID NO: 60305 - DNA, 25 bp, S. cerevisiae
tttaattacatgtctctcgccattc

SEQ ID NO: 60306 - DNA, 25 bp, S. cerevisiae
tttactatacatttctgcagccggg

SEQ ID NO: 60307 - DNA, 25 bp, S. cerevisiae
tttagtcaagttgggcactcctggc

SEQ ID NO: 60308 - DNA, 25 bp, S. cerevisiae
ttattcaaaggtgctcctaccgtca

SEQ ID NO: 60309 - DNA, 25 bp, S. cerevisiae
tttaaagatatacacgcacgcacat

SEQ ID NO: 60310 - DNA, 25 bp, S. cerevisiae
tttactcagataaacgcaactgcga

SEQ ID NO: 60311 - DNA, 25 bp, S. cerevisiae
ttttgacggcttggccaaatggcct

SEQ ID NO: 60312 - DNA, 25 bp, S. cerevisiae
ttttacctccaactttttcagcatc

SEQ ID NO: 60313 - DNA, 25 bp, S. cerevisiae
tttattacactctctttcatccttt

SEQ ID NO: 60314 - DNA, 25 bp, S. cerevisiae
tttatacgcccatagagtcctcgta

SEQ ID NO: 60315 - DNA, 25 bp, S. cerevisiae
ttcttgggtaagttggttcgcgaca

SEQ ID NO: 60316 - DNA, 25 bp, S. cerevisiae
ttttgttctggattctagttcggat

SEQ ID NO: 60317 - DNA, 25 bp, S. cerevisiae
ttgtttgctgagaggccggtacgtt

SEQ ID NO: 60318 - DNA, 25 bp, S. cerevisiae
ttttgtttgacatggcgacacaccc

SEQ ID NO: 60319 - DNA, 25 bp, S. cerevisiae
tttttatgctacttggtgtggcccc

SEQ ID NO: 60320 - DNA, 25 bp, S. cerevisiae
tttaaaggacgtggattctgcacca

SEQ ID NO: 60321 - DNA, 25 bp, S. cerevisiae
tttacaacagagagaccctgccgct

SEQ ID NO: 60322 - DNA, 25 bp, S. cerevisiae
ttttgccaatagataaccgcccttc

SEQ ID NO: 60323 - DNA, 25 bp, S. cerevisiae
ttttttggctgggaaccattctctc

SEQ ID NO: 60324 - DNA, 25 bp, S. cerevisiae
tttttggtcctcaacttttcgatga

SEQ ID NO: 60325 - DNA, 25 bp, S. cerevisiae
tttttacctgcctggattgttcaaa

SEQ ID NO: 60326 - DNA, 25 bp, S. cerevisiae
ttagacactcagcttattaccttat

SEQ ID NO: 60327 - DNA, 25 bp, S. cerevisiae
tttaccaactttactcatgcctgtt

SEQ ID NO: 60328 - DNA, 25 bp, S. cerevisiae
tttaccatgctgttgactccaccat

SEQ ID NO: 60329 - DNA, 25 bp, S. cerevisiae
tttactttgcggtactgagggccaa

SEQ ID NO: 60330 - DNA, 25 bp, S. cerevisiae
tttacaaagcggttccagggacatc

SEQ ID NO: 60331 - DNA, 25 bp, S. cerevisiae
ttttcataagagatcctagggtcat

SEQ ID NO: 60332 - DNA, 25 bp, S. cerevisiae
ttttcaagagatctccgggcaactc

SEQ ID NO: 60333 - DNA, 25 bp, S. cerevisiae
ttattcccattttccgtatacaaca

SEQ ID NO: 60334 - DNA, 25 bp, S. cerevisiae
tttagcccgaactggagtgcacaca

SEQ ID NO: 60335 - DNA, 25 bp, S. cerevisiae
tttacgccaaacaaagagctgccat

SEQ ID NO: 60336 - DNA, 25 bp, S. cerevisiae
tttagacccatggtggaaccctagt

SEQ ID NO: 60337 - DNA, 25 bp, S. cerevisiae
tttaacctcgataatgaaccactgg

SEQ ID NO: 60338 - DNA, 25 bp, S. cerevisiae
tttcaagacgaaatgctagccctca

SEQ ID NO: 60339 - DNA, 25 bp, S. cerevisiae
tttaagcctgaaagctctgcaccga

SEQ ID NO: 60340 - DNA, 25 bp, S. cerevisiae
tttagagtatgcctactgctgccac

SEQ ID NO: 60341 - DNA, 25 bp, S. cerevisiae
tttatgatgttgatgcaggcaccgc

SEQ ID NO: 60342 - DNA, 25 bp, S. cerevisiae
tttaatctcaacaactgccgcacta

SEQ ID NO: 60343 - DNA, 25 bp, S. cerevisiae
tttcaatcacatcttctacacacaa

SEQ ID NO: 60344 - DNA, 25 bp, S. cerevisiae
tttagtgcatcgagtcttacaacat

SEQ ID NO: 60345 - DNA, 25 bp, S. cerevisiae
tttaggtcgtttcctacctcattga

SEQ ID NO: 60346 - DNA, 25 bp, S. cerevisiae
tttttccatgaccattccaacgatg

SEQ ID NO: 60347 - DNA, 25 bp, S. cerevisiae
ttcatctgtcccgtcttaaaggagg

SEQ ID NO: 60348 - DNA, 25 bp, S. cerevisiae
ttttcacgcaagatcaactggagtc

SEQ ID NO: 60349 - DNA, 25 bp, S. cerevisiae
ttttcctcgtccacaattttctcaa

SEQ ID NO: 60350 - DNA, 25 bp, S. cerevisiae
ttatggccccaaattatgtcccgca

SEQ ID NO: 60351 - DNA, 25 bp, S. cerevisiae
ttttctccggtaaattcgctgtctc

SEQ ID NO: 60352 - DNA, 25 bp, S. cerevisiae
ttaatctacgaaagtctggaccctg

SEQ ID NO: 60353 - DNA, 25 bp, S. cerevisiae
tttatacacgttaacggcccaccag

SEQ ID NO: 60354 - DNA, 25 bp, S. cerevisiae
ttttcaacgtttactgggtcctgca

SEQ ID NO: 60355 - DNA, 25 bp, S. cerevisiae
ttattctttgctctccaggtttcta

SEQ ID NO: 60356 - DNA, 25 bp, S. cerevisiae
tttcaagaggattcggttctgtcat

SEQ ID NO: 60357 - DNA, 25 bp, S. cerevisiae
tttacgtttaaattctccctcagca

SEQ ID NO: 60358 - DNA, 25 bp, S. cerevisiae
tttacgctattaaatcccctcgaca

SEQ ID NO: 60359 - DNA, 25 bp, S. cerevisiae
tttaaccttggttatctccacgagc

SEQ ID NO: 60360 - DNA, 25 bp, S. cerevisiae
tttatgggtgggatccatcgtctgc

SEQ ID NO: 60361 - DNA, 25 bp, S. cerevisiae
ttatttcttttcttctccaaacagg

SEQ ID NO: 60362 - DNA, 25 bp, S. cerevisiae
tttatcgccagcacacagctttgaa

SEQ ID NO: 60363 - DNA, 25 bp, S. cerevisiae
ttttgcccttcctcaacggcatgat

SEQ ID NO: 60364 - DNA, 25 bp, S. cerevisiae
tttttccattcccaaacttgcgatg

SEQ ID NO: 60365 - DNA, 25 bp, S. cerevisiae
ttgtcaagtctatctccattgtcgg

SEQ ID NO: 60366 - DNA, 25 bp, S. cerevisiae
tttacacagattttcccgcttgttg

SEQ ID NO: 60367 - DNA, 25 bp, S. cerevisiae
ttttcaattggctcagcaccatctg

SEQ ID NO: 60368 - DNA, 25 bp, S. cerevisiae
ttttccattggcaaaagcgatttca

SEQ ID NO: 60369 - DNA, 25 bp, S. cerevisiae
tttatcgtagtctaaacggtggcaa

SEQ ID NO: 60370 - DNA, 25 bp, S. cerevisiae
ttttcggtgctctaaagggtgcttc

SEQ ID NO: 60371 - DNA, 25 bp, S. cerevisiae
ttattctggtggtcaatctggcgtc

SEQ ID NO: 60372 - DNA, 25 bp, S. cerevisiae
ttatttgcacgttcatcattggagt

SEQ ID NO: 60373 - DNA, 25 bp, S. cerevisiae
ttttatgctgcaccttatctaagta

SEQ ID NO: 60374 - DNA, 25 bp, S. cerevisiae
ttttttccgctttctcaatgttaca

SEQ ID NO: 60375 - DNA, 25 bp, S. cerevisiae
ttttgtcccggatgtacatgttaca

SEQ ID NO: 60376 - DNA, 25 bp, S. cerevisiae
ttttgttccggacgtgattgcgact

SEQ ID NO: 60377 - DNA, 25 bp, S. cerevisiae
ttttgttcctcgtcagtgaagtcgt

SEQ ID NO: 60378 - DNA, 25 bp, S. cerevisiae
ttctaggtctcctcgaaggttacgg

SEQ ID NO: 60379 - DNA, 25 bp, S. cerevisiae
tttagtactggcttgcgacggtata

SEQ ID NO: 60380 - DNA, 25 bp, S. cerevisiae
tttagatgcattatcgtccgctcac

SEQ ID NO: 60381 - DNA, 25 bp, S. cerevisiae
ttttgccctgtgaaatagtcccttt

SEQ ID NO: 60382 - DNA, 25 bp, S. cerevisiae
tttaatatcattgctagcgccatag

SEQ ID NO: 60383 - DNA, 25 bp, S. cerevisiae
tttaatgatgttgcccgctatctag

SEQ ID NO: 60384 - DNA, 25 bp, S. cerevisiae
ttcttgcccgatgccgaaacagagg

SEQ ID NO: 60385 - DNA, 25 bp, S. cerevisiae
ttttgtatcgatgacgacgcaggca

SEQ ID NO: 60386 - DNA, 25 bp, S. cerevisiae
tttagctgatcaaacaccccatgac

SEQ ID NO: 60387 - DNA, 25 bp, S. cerevisiae
tttatgaacagctcacatccgctac

SEQ ID NO: 60388 - DNA, 25 bp, S. cerevisiae
tttatcgacgatcctatgcatgcat

SEQ ID NO: 60389 - DNA, 25 bp, S. cerevisiae
tttacagaccatatcacgctacgac

SEQ ID NO: 60390 - DNA, 25 bp, S. cerevisiae
ttttcgacactggaccgctatggac

SEQ ID NO: 60391 - DNA, 25 bp, S. cerevisiae
ttttctactgtgtcaacgcattgga

SEQ ID NO: 60392 - DNA, 25 bp, S. cerevisiae
tttactctgcttacatcaccggatt

SEQ ID NO: 60393 - DNA, 25 bp, S. cerevisiae
ttataccacctaatgagccggaatt

SEQ ID NO: 60394 - DNA, 25 bp, S. cerevisiae
ttcggcctcgctactagcgtaaatg

SEQ ID NO: 60395 - DNA, 25 bp, S. cerevisiae
ttcaagacacgtcaactgtagcaaa

SEQ ID NO: 60396 - DNA, 25 bp, S. cerevisiae
ttataacactgtccgctcttatagg

SEQ ID NO: 60397 - DNA, 25 bp, S. cerevisiae
tttatttctatatcggtccactggc

SEQ ID NO: 60398 - DNA, 25 bp, S. cerevisiae
tttttattaacagccaccacagtcg

SEQ ID NO: 60399 - DNA, 25 bp, S. cerevisiae
ttttagtttcaagcctcccatgaga

SEQ ID NO: 60400 - DNA, 25 bp, S. cerevisiae
tttatactactctgtcctctctaag

SEQ ID NO: 60401 - DNA, 25 bp, S. cerevisiae
tttattctactctgttgccctatga

SEQ ID NO: 60402 - DNA, 25 bp, S. cerevisiae
tttttcgtcatttcatccggatatt

SEQ ID NO: 60403 - DNA, 25 bp, S. cerevisiae
tttacatgcggagttccaccagaat

SEQ ID NO: 60404 - DNA, 25 bp, S. cerevisiae
tttagcaatggtgcatccaccgcta

SEQ ID NO: 60405 - DNA, 25 bp, S. cerevisiae
ttttcattgtagacaccccgcaaag

SEQ ID NO: 60406 - DNA, 25 bp, S. cerevisiae
ttttgttgatgcagaagcctcgcaa

SEQ ID NO: 60407 - DNA, 25 bp, S. cerevisiae
ttttattgactccatgacgcctgat

SEQ ID NO: 60408 - DNA, 25 bp, S. cerevisiae
ttattttcaccggatgggccatgtc

SEQ ID NO: 60409 - DNA, 25 bp, S. cerevisiae
ttttgactcaactacaggacgcgat

SEQ ID NO: 60410 - DNA, 25 bp, S. cerevisiae
ttctaagccaggtcagcatgctgca

SEQ ID NO: 60411 - DNA, 25 bp, S. cerevisiae
tttacagcctgggttgccacacaaa

SEQ ID NO: 60412 - DNA, 25 bp, S. cerevisiae
ttttcagtgctgtgtttaccaaaga

SEQ ID NO: 60413 - DNA, 25 bp, S. cerevisiae
ttctaccttgacttttgcccaaaga

SEQ ID NO: 60414 - DNA, 25 bp, S. cerevisiae
tttaccattccttttctgccaaaga

SEQ ID NO: 60415 - DNA, 25 bp, S. cerevisiae
tttatcgctgctgtgggtgagtttt

SEQ ID NO: 60416 - DNA, 25 bp, S. cerevisiae
ttaatctgttgttgcggtggttctt

SEQ ID NO: 60417 - DNA, 25 bp, S. cerevisiae
ttttgctgattgtccggttgttcca

SEQ ID NO: 60418 - DNA, 25 bp, S. cerevisiae
ttttgtttgtgctgtttgttgccgc

SEQ ID NO: 60419 - DNA, 25 bp, S. cerevisiae
tttacattttctgcttttcctgcac

SEQ ID NO: 60420 - DNA, 25 bp, S. cerevisiae
ttttcgttacgctccattacacaaa

SEQ ID NO: 60421 - DNA, 25 bp, S. cerevisiae
ttttctttaccatttttgacacaat

SEQ ID NO: 60422 - DNA, 25 bp, S. cerevisiae
ttttcttttctgtttttggcgtatg

SEQ ID NO: 60423 - DNA, 25 bp, S. cerevisiae
ttttactgtcgttgcttttcaccca

SEQ ID NO: 60424 - DNA, 25 bp, S. cerevisiae
tttaccggctgatttgctgccgatt

SEQ ID NO: 60425 - DNA, 25 bp, S. cerevisiae
tttacttccgcatttcttacgcaat

SEQ ID NO: 60426 - DNA, 25 bp, S. cerevisiae
tttactatagatttctggctaccat

SEQ ID NO: 60427 - DNA, 25 bp, S. cerevisiae
ttttttcaccagtatcggcctctat

SEQ ID NO: 60428 - DNA, 25 bp, S. cerevisiae
tttattcgataaagcgtcccaagca

SEQ ID NO: 60429 - DNA, 25 bp, S. cerevisiae
tttagatcagcatcaagctctccca

SEQ ID NO: 60430 - DNA, 25 bp, S. cerevisiae
ttttgtcaagaccatttgcgccatt

SEQ ID NO: 60431 - DNA, 25 bp, S. cerevisiae
ttctcttgaaagcagtgccgtcacg

SEQ ID NO: 60432 - DNA, 25 bp, S. cerevisiae
tttagcaggcctcccataatagatg

SEQ ID NO: 60433 - DNA, 25 bp, S. cerevisiae
tttagcgatcgcctacatgaataag

SEQ ID NO: 60434 - DNA, 25 bp, S. cerevisiae
tttacgctctctgccagtattagtg

SEQ ID NO: 60435 - DNA, 25 bp, S. cerevisiae
tttacctctctctcagatatacagg

SEQ ID NO: 60436 - DNA, 25 bp, S. cerevisiae
ttttcctacctataaagagctgcga

SEQ ID NO: 60437 - DNA, 25 bp, S. cerevisiae
ttttcgtttctttgaaagtcgcgat

SEQ ID NO: 60438 - DNA, 25 bp, S. cerevisiae
tttagactttctatgccgcctttaa

SEQ ID NO: 60439 - DNA, 25 bp, S. cerevisiae
tttaccttcgtttcccatcttatat

SEQ ID NO: 60440 - DNA, 25 bp, S. cerevisiae
tttacctttgccaccatgaagactg

SEQ ID NO: 60441 - DNA, 25 bp, S. cerevisiae
ttttccaaacagttccaggtgacga

SEQ ID NO: 60442 - DNA, 25 bp, S. cerevisiae
ttattcaataaacctccttccacga

SEQ ID NO: 60443 - DNA, 25 bp, S. cerevisiae
tttatttccaccgtattgctggcaa

SEQ ID NO: 60444 - DNA, 25 bp, S. cerevisiae
ttttttcacgtccaattacgtcgca

SEQ ID NO: 60445 - DNA, 25 bp, S. cerevisiae
tttttgctagttgctttgacgatat

SEQ ID NO: 60446 - DNA, 25 bp, S. cerevisiae
ttttccccaaggcatgcagcagaat

SEQ ID NO: 60447 - DNA, 25 bp, S. cerevisiae
tttactgtagaactgtgggtgcgct

SEQ ID NO: 60448 - DNA, 25 bp, S. cerevisiae
tttactacttgttttgtcgtgagac

SEQ ID NO: 60449 - DNA, 25 bp, S. cerevisiae
ttttttcttatgtggctcatcaggt

SEQ ID NO: 60450 - DNA, 25 bp, S. cerevisiae
tttttgtgcctttggtgccgattta

SEQ ID NO: 60451 - DNA, 25 bp, S. cerevisiae
ttttcgtctaaatttgcctctgctt

SEQ ID NO: 60452 - DNA, 25 bp, S. cerevisiae
tttttcccaaattggcacttgtttg

SEQ ID NO: 60453 - DNA, 25 bp, S. cerevisiae
tttttccacgaactgtctttgcatc

SEQ ID NO: 60454 - DNA, 25 bp, S. cerevisiae
tttttccagtgagcattatcccacc

SEQ ID NO: 60455 - DNA, 25 bp, S. cerevisiae
ttattaccatgttccatttcactcc

SEQ ID NO: 60456 - DNA, 25 bp, S. cerevisiae
ttttatttccgctcttgttggtaag

SEQ ID NO: 60457 - DNA, 25 bp, S. cerevisiae
ttcttgaagcatagcgaacgtgtag

SEQ ID NO: 60458 - DNA, 25 bp, S. cerevisiae
ttctgcatgaagttggtgacctaaa

SEQ ID NO: 60459 - DNA, 25 bp, S. cerevisiae
ttttccatttggttctcctgaagat

SEQ ID NO: 60460 - DNA, 25 bp, S. cerevisiae
ttttatggtccaagctgtcacccag

SEQ ID NO: 60461 - DNA, 25 bp, S. cerevisiae
ttttttatctcaatatggccaccga

SEQ ID NO: 60462 - DNA, 25 bp, S. cerevisiae
tttagtccccatagatcccatatat

SEQ ID NO: 60463 - DNA, 25 bp, S. cerevisiae
tttaccagcctctgacagcaaaaca

SEQ ID NO: 60464 - DNA, 25 bp, S. cerevisiae
tttacgccgcccaacagaaaatctt

SEQ ID NO: 60465 - DNA, 25 bp, S. cerevisiae
tttacgagctgttcccaaagacctt

SEQ ID NO: 60466 - DNA, 25 bp, S. cerevisiae
ttttcacgtataccccagtagttca

SEQ ID NO: 60467 - DNA, 25 bp, S. cerevisiae
ttatttaccaccacgataccatgac

SEQ ID NO: 60468 - DNA, 25 bp, S. cerevisiae
ttttttccaccctaacaatatacat

SEQ ID NO: 60469 - DNA, 25 bp, S. cerevisiae
tttttctccttccaatactatatcg

SEQ ID NO: 60470 - DNA, 25 bp, S. cerevisiae
ttattgtctttgtcggtagcttacc

SEQ ID NO: 60471 - DNA, 25 bp, S. cerevisiae
ttatcttctttggtggttgcatctg

SEQ ID NO: 60472 - DNA, 25 bp, S. cerevisiae
ttaatacgcagatccgtcgcgaaat

SEQ ID NO: 60473 - DNA, 25 bp, S. cerevisiae
ttttggtagtaactcccctatgcca

SEQ ID NO: 60474 - DNA, 25 bp, S. cerevisiae
ttttcttttaactactgcaggctat

SEQ ID NO: 60475 - DNA, 25 bp, S. cerevisiae
ttgtggccgttttaattgcaggtaa

SEQ ID NO: 60476 - DNA, 25 bp, S. cerevisiae
ttttgctagcgatccagcgatgcga

SEQ ID NO: 60477 - DNA, 25 bp, S. cerevisiae
ttttgaagcatatcaagccattttt

SEQ ID NO: 60478 - DNA, 25 bp, S. cerevisiae
tttagtgccgaaaaaccagatccga

SEQ ID NO: 60479 - DNA, 25 bp, S. cerevisiae
tttaggcctacaaaaccgcaaccag

SEQ ID NO: 60480 - DNA, 25 bp, S. cerevisiae
tttatgggctactttcaccgcaatc

SEQ ID NO: 60481 - DNA, 25 bp, S. cerevisiae
tttattctcagcacttgtcctacgt

SEQ ID NO: 60482 - DNA, 25 bp, S. cerevisiae
tttattccaatcctattcctgtcag

SEQ ID NO: 60483 - DNA, 25 bp, S. cerevisiae
tttatgtctttctttctttgccgca

SEQ ID NO: 60484 - DNA, 25 bp, S. cerevisiae
ttttcattttcagttgcttctccca

SEQ ID NO: 60485 - DNA, 25 bp, S. cerevisiae
ttttcccttattaatgacgctttag

SEQ ID NO: 60486 - DNA, 25 bp, S. cerevisiae
ttatctacgcttcctacagacagta

SEQ ID NO: 60487 - DNA, 25 bp, S. cerevisiae
ttttggatgcctctgcttcaagccg

SEQ ID NO: 60488 - DNA, 25 bp, S. cerevisiae
ttatcacgtttgttcttttcccacg

SEQ ID NO: 60489 - DNA, 25 bp, S. cerevisiae
ttttacgcaataggtcacagccctg

SEQ ID NO: 60490 - DNA, 25 bp, S. cerevisiae
ttttaccaataaccaccatgccagt

SEQ ID NO: 60491 - DNA, 25 bp, S. cerevisiae
ttttcaagcaaactacgccagccgg

SEQ ID NO: 60492 - DNA, 25 bp, S. cerevisiae
ttttgttgtgaatatggccggatgc

SEQ ID NO: 60493 - DNA, 25 bp, S. cerevisiae
tttttgcgattctattacgccctaa

SEQ ID NO: 60494 - DNA, 25 bp, S. cerevisiae
tttatcagaacacagtcgacgcgcc

SEQ ID NO: 60495 - DNA, 25 bp, S. cerevisiae
ttttgacgcaaaacccagatctatt

SEQ ID NO: 60496 - DNA, 25 bp, S. cerevisiae
ttaggcacgaaaccttcaacttctc

SEQ ID NO: 60497 - DNA, 25 bp, S. cerevisiae
ttacccgaggagtctaaattgttca

SEQ ID NO: 60498 - DNA, 25 bp, S. cerevisiae
ttcagttggcctcaaattgttcttt

SEQ ID NO: 60499 - DNA, 25 bp, S. cerevisiae
tttttaccaaggatctgctcattaa

SEQ ID NO: 60500 - DNA, 25 bp, S. cerevisiae
tttttgccgcaaagtgtcctgataa

SEQ ID NO: 60501 - DNA, 25 bp, S. cerevisiae
tttttccgcaacctatcaacgatag

SEQ ID NO: 60502 - DNA, 25 bp, S. cerevisiae
ttatgtgtcgcatccattgttaggt

SEQ ID NO: 60503 - DNA, 25 bp, S. cerevisiae
ttatctgcgctgcaaaaatctccag

SEQ ID NO: 60504 - DNA, 25 bp, S. cerevisiae
ttatctccgtcctatagttgccgat

SEQ ID NO: 60505 - DNA, 25 bp, S. cerevisiae
ttataacgatttccaccacgcagtt

SEQ ID NO: 60506 - DNA, 25 bp, S. cerevisiae
ttttatgcaattggccacactccag

SEQ ID NO: 60507 - DNA, 25 bp, S. cerevisiae
ttttttgctgaaacggtcgcttcta

SEQ ID NO: 60508 - DNA, 25 bp, S. cerevisiae
ttttttctcacaattttcagtttga

SEQ ID NO: 60509 - DNA, 25 bp, S. cerevisiae
ttttttccaccattcttgcaggttc

SEQ ID NO: 60510 - DNA, 25 bp, S. cerevisiae
tttattgtagatccgagctgctccg

SEQ ID NO: 60511 - DNA, 25 bp, S. cerevisiae
tttattgaagaactgtgctcccggg

SEQ ID NO: 60512 - DNA, 25 bp, S. cerevisiae
ttatcctttaagaacagcgtcactg

SEQ ID NO: 60513 - DNA, 25 bp, S. cerevisiae
ttttggcttgggtttggaccgcatt

SEQ ID NO: 60514 - DNA, 25 bp, S. cerevisiae
ttttagggcagtaccagcaaacgct

SEQ ID NO: 60515 - DNA, 25 bp, S. cerevisiae
ttttcttccaatactgccattacgg

SEQ ID NO: 60516 - DNA, 25 bp, S. cerevisiae
ttttcctccactacgacaatgcaag

SEQ ID NO: 60517 - DNA, 25 bp, S. cerevisiae
ttttgcgtgcccaacatgtcaagaa

SEQ ID NO: 60518 - DNA, 25 bp, S. cerevisiae
ttttgctgctgtcatcatgcgtatt

SEQ ID NO: 60519 - DNA, 25 bp, S. cerevisiae
tttatttgattgttgccgggattgc

SEQ ID NO: 60520 - DNA, 25 bp, S. cerevisiae
ttttcattatccgatgccatctctg

SEQ ID NO: 60521 - DNA, 25 bp, S. cerevisiae
ttgacacgtcaaccaactgagggta

SEQ ID NO: 60522 - DNA, 25 bp, S. cerevisiae
ttgcctcggcacaacaaatcgggta

SEQ ID NO: 60523 - DNA, 25 bp, S. cerevisiae
ttccgaagaaagtaagaccgagaag

SEQ ID NO: 60524 - DNA, 25 bp, S. cerevisiae
ttccgccagaaagagagccctagtg

SEQ ID NO: 60525 - DNA, 25 bp, S. cerevisiae
ttgtccaagaagagggccacccatg

SEQ ID NO: 60526 - DNA, 25 bp, S. cerevisiae
ttgttaggaacttctaccaccgctg

SEQ ID NO: 60527 - DNA, 25 bp, S. cerevisiae
ttttgaaatctttacccagcttgga

SEQ ID NO: 60528 - DNA, 25 bp, S. cerevisiae
ttattgaaagttcggcaccaccacc

SEQ ID NO: 60529 - DNA, 25 bp, S. cerevisiae
ttttatacttgtctgcactgctaac

SEQ ID NO: 60530 - DNA, 25 bp, S. cerevisiae
ttttagaattgggtgctgctgctgc

SEQ ID NO: 60531 - DNA, 25 bp, S. cerevisiae
ttttgagatgtgttcgttgcacccc

SEQ ID NO: 60532 - DNA, 25 bp, S. cerevisiae
ttagcgatgattttgcagggcacgt

SEQ ID NO: 60533 - DNA, 25 bp, S. cerevisiae
ttaccattagatgcggcgatcacct

SEQ ID NO: 60534 - DNA, 25 bp, S. cerevisiae
ttatccgtggagagcgcgtcaagca

SEQ ID NO: 60535 - DNA, 25 bp, S. cerevisiae
ttatctcagggaatagcgaacggca

SEQ ID NO: 60536 - DNA, 25 bp, S. cerevisiae
ttttggtttgctttcctttgtggca

SEQ ID NO: 60537 - DNA, 25 bp, S. cerevisiae
ttgttaacttcgttgcctttggcaa

SEQ ID NO: 60538 - DNA, 25 bp, S. cerevisiae
ttttaacttcagctactccttgcaa

SEQ ID NO: 60539 - DNA, 25 bp, S. cerevisiae
ttttgacaataaagcgatccccggc

SEQ ID NO: 60540 - DNA, 25 bp, S. cerevisiae
ttattacgtaagaccttccgcgact

SEQ ID NO: 60541 - DNA, 25 bp, S. cerevisiae
ttcatttactaaacccacaccggag

SEQ ID NO: 60542 - DNA, 25 bp, S. cerevisiae
tttttcagatgacacccttattggt

SEQ ID NO: 60543 - DNA, 25 bp, S. cerevisiae
ttctttagacacctcgccgaaacgt

SEQ ID NO: 60544 - DNA, 25 bp, S. cerevisiae
ttcgcttaaagctaccctaaacgca

SEQ ID NO: 60545 - DNA, 25 bp, S. cerevisiae
ttcttgcaaagacaggttggcctct

SEQ ID NO: 60546 - DNA, 25 bp, S. cerevisiae
ttattcaatccaagcaggttcccca

SEQ ID NO: 60547 - DNA, 25 bp, S. cerevisiae
ttatcgagatccagggtttcccagg

SEQ ID NO: 60548 - DNA, 25 bp, S. cerevisiae
ttatcaacgcaaatctggctttccc

SEQ ID NO: 60549 - DNA, 25 bp, S. cerevisiae
ttatcacacaccattacgttcctat

SEQ ID NO: 60550 - DNA, 25 bp, S. cerevisiae
ttttcactttataacaggctccgat

SEQ ID NO: 60551 - DNA, 25 bp, S. cerevisiae
tttatatcatttttccaggctcctt

SEQ ID NO: 60552 - DNA, 25 bp, S. cerevisiae
ttttatcttggattggcgcttcctt

SEQ ID NO: 60553 - DNA, 25 bp, S. cerevisiae
ttttatccctcactatgcctttctt

SEQ ID NO: 60554 - DNA, 25 bp, S. cerevisiae
ttttttgcatctgcaggccacggta

SEQ ID NO: 60555 - DNA, 25 bp, S. cerevisiae
ttttgttgctcagtcatgtgctgca

SEQ ID NO: 60556 - DNA, 25 bp, S. cerevisiae
ttaggttgtgcaggattctcgggtt

SEQ ID NO: 60557 - DNA, 25 bp, S. cerevisiae
ttaatttaggtctcctgccttcaag

SEQ ID NO: 60558 - DNA, 25 bp, S. cerevisiae
ttattacaagtatggcacgctctgg

SEQ ID NO: 60559 - DNA, 25 bp, S. cerevisiae
ttatgaagggtgtcgactcctctgg

SEQ ID NO: 60560 - DNA, 25 bp, S. cerevisiae
ttttcaccagtaaatcaaggagcaa

SEQ ID NO: 60561 - DNA, 25 bp, S. cerevisiae
ttagttgccgaaaccgaggatcgca

SEQ ID NO: 60562 - DNA, 25 bp, S. cerevisiae
ttaagcgaggccttgacgggatttg

SEQ ID NO: 60563 - DNA, 25 bp, S. cerevisiae
ttaggagaggtttgccggagccatt

SEQ ID NO: 60564 - DNA, 25 bp, S. cerevisiae
ttagcgagtttttgccttgtccgga

SEQ ID NO: 60565 - DNA, 25 bp, S. cerevisiae
ttttgtctttgcaaccaggttctga

SEQ ID NO: 60566 - DNA, 25 bp, S. cerevisiae
ttttaccaatcaaagggcgtctcat

SEQ ID NO: 60567 - DNA, 25 bp, S. cerevisiae
tttttccaagataacggcctctcag

SEQ ID NO: 60568 - DNA, 25 bp, S. cerevisiae
ttatttccagcgtaacttccctaat

SEQ ID NO: 60569 - DNA, 25 bp, S. cerevisiae
ttattgatgccacaagctcattccc

SEQ ID NO: 60570 - DNA, 25 bp, S. cerevisiae
tttttccagaaacttgcacccttga

SEQ ID NO: 60571 - DNA, 25 bp, S. cerevisiae
ttttttcagtactttgcccgttgca

SEQ ID NO: 60572 - DNA, 25 bp, S. cerevisiae
ttttttcagtgcgtttgccgtttgt

SEQ ID NO: 60573 - DNA, 25 bp, S. cerevisiae
ttttgagatggtgccgatcccaatt

SEQ ID NO: 60574 - DNA, 25 bp, S. cerevisiae
ttttacaaactcaacaccacttcca

SEQ ID NO: 60575 - DNA, 25 bp, S. cerevisiae
ttatttaccacttgcacccaacttt

SEQ ID NO: 60576 - DNA, 25 bp, S. cerevisiae
ttttctttgctattgaccacacttt

SEQ ID NO: 60577 - DNA, 25 bp, S. cerevisiae
ttgttcttccacataaagcggctgt

SEQ ID NO: 60578 - DNA, 25 bp, S. cerevisiae
ttgttcatcatcgacccaaagggtg

SEQ ID NO: 60579 - DNA, 25 bp, S. cerevisiae
ttgctgctatcaccactactaaggg

SEQ ID NO: 60580 - DNA, 25 bp, S. cerevisiae
ttttatcagctctttgtcaaggtgc

SEQ ID NO: 60581 - DNA, 25 bp, S. cerevisiae
ttattcacggccttaagagcttgtc

SEQ ID NO: 60582 - DNA, 25 bp, S. cerevisiae
ttttaactaccacgctatgtccctt

SEQ ID NO: 60583 - DNA, 25 bp, S. cerevisiae
ttttctggtcaactgcaattccctg

SEQ ID NO: 60584 - DNA, 25 bp, S. cerevisiae
ttactctgcgtacgttcgtcaagaa

SEQ ID NO: 60585 - DNA, 25 bp, S. cerevisiae
ttatctcccttcctatttgctacta

SEQ ID NO: 60586 - DNA, 25 bp, S. cerevisiae
ttttcatccagagcttgctgacagt

SEQ ID NO: 60587 - DNA, 25 bp, S. cerevisiae
ttttctgtcgattcaacgaccccaa

SEQ ID NO: 60588 - DNA, 25 bp, S. cerevisiae
ttttcagacgcatcaaaggccccaa

SEQ ID NO: 60589 - DNA, 25 bp, S. cerevisiae
ttattcgagacttgcacgtggaccc

SEQ ID NO: 60590 - DNA, 25 bp, S. cerevisiae
ttttctgcgacttctcgagtgagaa

SEQ ID NO: 60591 - DNA, 25 bp, S. cerevisiae
ttttctggtcttgcatcaacactag

SEQ ID NO: 60592 - DNA, 25 bp, S. cerevisiae
ttatttgggttggtccagcttcagc

SEQ ID NO: 60593 - DNA, 25 bp, S. cerevisiae
ttattgcagggagctttatcgtcag

SEQ ID NO: 60594 - DNA, 25 bp, S. cerevisiae
ttttgcagggcacgtttactctttt

SEQ ID NO: 60595 - DNA, 25 bp, S. cerevisiae
ttttcctattttttcatccttcaat

SEQ ID NO: 60596 - DNA, 25 bp, S. cerevisiae
ttattagcagtctttctcccttgga

SEQ ID NO: 60597 - DNA, 25 bp, S. cerevisiae
ttattaacgttttggctcttcggcg

SEQ ID NO: 60598 - DNA, 25 bp, S. cerevisiae
ttttttgctcttgtcccaatcataa

SEQ ID NO: 60599 - DNA, 25 bp, S. cerevisiae
ttattatctccaagtgtgacacagt

SEQ ID NO: 60600 - DNA, 25 bp, S. cerevisiae
ttactattccaacttacccaactgg

SEQ ID NO: 60601 - DNA, 25 bp, S. cerevisiae
ttttgtttcatctactgcacctttc

SEQ ID NO: 60602 - DNA, 25 bp, S. cerevisiae
ttttggtcatactaagctgcgcatt

SEQ ID NO: 60603 - DNA, 25 bp, S. cerevisiae
ttttgctgtaactgacggatccacc

SEQ ID NO: 60604 - DNA, 25 bp, S. cerevisiae
ttttgatctatcttgcgcggtatgc

SEQ ID NO: 60605 - DNA, 25 bp, S. cerevisiae
ttttacaacagtggcgtcagtccta

SEQ ID NO: 60606 - DNA, 25 bp, S. cerevisiae
ttattacaccacagcgatcgttctt

SEQ ID NO: 60607 - DNA, 25 bp, S. cerevisiae
ttttactccacttcaagcgtttttg

SEQ ID NO: 60608 - DNA, 25 bp, S. cerevisiae
ttatgtcctcactccaagcttttta

SEQ ID NO: 60609 - DNA, 25 bp, S. cerevisiae
ttatctcagacaatgcaccaagttt

SEQ ID NO: 60610 - DNA, 25 bp, S. cerevisiae
ttatcactcaatacaccacctggtg

SEQ ID NO: 60611 - DNA, 25 bp, S. cerevisiae
ttataccattacttcatcacgttga

SEQ ID NO: 60612 - DNA, 25 bp, S. cerevisiae
ttttctcattgttctcatatcttaa

SEQ ID NO: 60613 - DNA, 25 bp, S. cerevisiae
ttattcctgatgtaccaatggctga

SEQ ID NO: 60614 - DNA, 25 bp, S. cerevisiae
ttttctcggcataccactgggaatt

SEQ ID NO: 60615 - DNA, 25 bp, S. cerevisiae
ttttgggcgatgctcttggcaacat

SEQ ID NO: 60616 - DNA, 25 bp, S. cerevisiae
ttttaatctgtcaactgccactcat

SEQ ID NO: 60617 - DNA, 25 bp, S. cerevisiae
ttttatccttggatttggctgccaa

SEQ ID NO: 60618 - DNA, 25 bp, S. cerevisiae
ttttacaccccaactagacagcgaa

SEQ ID NO: 60619 - DNA, 25 bp, S. cerevisiae
ttattgaagcccgtactgcgtgtaa

SEQ ID NO: 60620 - DNA, 25 bp, S. cerevisiae
ttttgtcaccgcgtccagggataaa

SEQ ID NO: 60621 - DNA, 25 bp, S. cerevisiae
ttttgatcccgcgttcaagaaagaa

SEQ ID NO: 60622 - DNA, 25 bp, S. cerevisiae
ttttcacctgcggtccagatgaagt

SEQ ID NO: 60623 - DNA, 25 bp, S. cerevisiae
ttttcaccatcagggcggaattttt

SEQ ID NO: 60624 - DNA, 25 bp, S. cerevisiae
ttttcacgtcagtggctacagcatt

SEQ ID NO: 60625 - DNA, 25 bp, S. cerevisiae
ttttacctcggaacatagctcctac

SEQ ID NO: 60626 - DNA, 25 bp, S. cerevisiae
tttttaccgagaaatcagccgttgg

SEQ ID NO: 60627 - DNA, 25 bp, S. cerevisiae
ttattgtacaccagaagattcgtta

SEQ ID NO: 60628 - DNA, 25 bp, S. cerevisiae
ttttctctgctgtcttattctatcg

SEQ ID NO: 60629 - DNA, 25 bp, S. cerevisiae
ttttcatctgtgtcatcgtctttca

SEQ ID NO: 60630 - DNA, 25 bp, S. cerevisiae
ttattcactggtttggctgttgcct

SEQ ID NO: 60631 - DNA, 25 bp, S. cerevisiae
ttataccggtgatttcttgtctgct

SEQ ID NO: 60632 - DNA, 25 bp, S. cerevisiae
ttttgccttgctcgtcatgagaacg

SEQ ID NO: 60633 - DNA, 25 bp, S. cerevisiae
ttttcgattcgagtgctgagccaga

SEQ ID NO: 60634 - DNA, 25 bp, S. cerevisiae
ttttctgacctggtgatagcacaca

SEQ ID NO: 60635 - DNA, 25 bp, S. cerevisiae
ttaggtgccgctggcgctacaaaaa

SEQ ID NO: 60636 - DNA, 25 bp, S. cerevisiae
ttaggtgcacgtggcgccgtagaaa

SEQ ID NO: 60637 - DNA, 25 bp, S. cerevisiae
ttatcttaagcaccccagctgtgaa

SEQ ID NO: 60638 - DNA, 25 bp, S. cerevisiae
ttattgatcggctccatcatcggaa

SEQ ID NO: 60639 - DNA, 25 bp, S. cerevisiae
ttacgaggctgcttccacgagaaaa

SEQ ID NO: 60640 - DNA, 25 bp, S. cerevisiae
ttattagagctttcttgatcgaaga

SEQ ID NO: 60641 - DNA, 25 bp, S. cerevisiae
ttttcggcaatgtctgtgaactgga

SEQ ID NO: 60642 - DNA, 25 bp, S. cerevisiae
ttagtgggccatccggatacagcga

SEQ ID NO: 60643 - DNA, 25 bp, S. cerevisiae
ttattattctacaccattcgtcaag

SEQ ID NO: 60644 - DNA, 25 bp, S. cerevisiae
ttaggtgtcaccaggcaactccaag

SEQ ID NO: 60645 - DNA, 25 bp, S. cerevisiae
ttttctagccaaatctccgaggtat

SEQ ID NO: 60646 - DNA, 25 bp, S. cerevisiae
ttttcaagccccttcactcgagaaa

SEQ ID NO: 60647 - DNA, 25 bp, S. cerevisiae
ttttaagtgcgcctaccctgaatta

SEQ ID NO: 60648 - DNA, 25 bp, S. cerevisiae
ttttgaagtccgaagcagcacagtt

SEQ ID NO: 60649 - DNA, 25 bp, S. cerevisiae
ttttgaccaggccaaggacgcttca

SEQ ID NO: 60650 - DNA, 25 bp, S. cerevisiae
ttatatggcccgcagaggatgccct

SEQ ID NO: 60651 - DNA, 25 bp, S. cerevisiae
ttcttgcagttcttcgcttttggaa

SEQ ID NO: 60652 - DNA, 25 bp, S. cerevisiae
ttatgaccatcctttctggtgtggt

SEQ ID NO: 60653 - DNA, 25 bp, S. cerevisiae
ttatcaactctcaaacagggtccgc

SEQ ID NO: 60654 - DNA, 25 bp, S. cerevisiae
ttagaatctatatgggccgatgccc

SEQ ID NO: 60655 - DNA, 25 bp, S. cerevisiae
ttaggtgtaagaggcccgcatgcta

SEQ ID NO: 60656 - DNA, 25 bp, S. cerevisiae
ttattggtggagtcgcttttgccgt

SEQ ID NO: 60657 - DNA, 25 bp, S. cerevisiae
ttattaaatttctttaatgatcctt

SEQ ID NO: 60658 - DNA, 25 bp, S. cerevisiae
ttatgttacttttttcctgtccctg

SEQ ID NO: 60659 - DNA, 25 bp, S. cerevisiae
ttttcgctcttctgtttactcttaa

SEQ ID NO: 60660 - DNA, 25 bp, S. cerevisiae
ttttcccacgtcatttccagacaaa

SEQ ID NO: 60661 - DNA, 25 bp, S. cerevisiae
ttattggccagggtttacaagacaa

SEQ ID NO: 60662 - DNA, 25 bp, S. cerevisiae
ttatttcgcagccttttccaagaac

SEQ ID NO: 60663 - DNA, 25 bp, S. cerevisiae
ttatattcctgttttggccacgaga

SEQ ID NO: 60664 - DNA, 25 bp, S. cerevisiae
ttttgattaggccattgccccatca

SEQ ID NO: 60665 - DNA, 25 bp, S. cerevisiae
ttttacgtgatattaggaccatcca

SEQ ID NO: 60666 - DNA, 25 bp, S. cerevisiae
ttattcaaaacacccgggatcattt

SEQ ID NO: 60667 - DNA, 25 bp, S. cerevisiae
ttgcattcaaacttggccgtggtga

SEQ ID NO: 60668 - DNA, 25 bp, S. cerevisiae
ttatgcgtcaatacattcctgtgga

SEQ ID NO: 60669 - DNA, 25 bp, S. cerevisiae
ttatcgaaagttacgctggatgcag

SEQ ID NO: 60670 - DNA, 25 bp, S. cerevisiae
ttcatgcgccagctgttggctgaat

SEQ ID NO: 60671 - DNA, 25 bp, S. cerevisiae
ttatgagcgcgcatcttggacagat

SEQ ID NO: 60672 - DNA, 25 bp, S. cerevisiae
ttatcggctttctgaagtggctcgc

SEQ ID NO: 60673 - DNA, 25 bp, S. cerevisiae
ttctcgagtaactgaaactgcgcca

SEQ ID NO: 60674 - DNA, 25 bp, S. cerevisiae
ttccggtgaagctgctgaagaagcc

SEQ ID NO: 60675 - DNA, 25 bp, S. cerevisiae
ttgcctttactctgcatggaaactg

SEQ ID NO: 60676 - DNA, 25 bp, S. cerevisiae
ttcgccttatcctgtggagaccact

SEQ ID NO: 60677 - DNA, 25 bp, S. cerevisiae
ttcgggtacttctaaacagacggat

SEQ ID NO: 60678 - DNA, 25 bp, S. cerevisiae
ttatcagggttcctagatgctcagg

SEQ ID NO: 60679 - DNA, 25 bp, S. cerevisiae
ttaagagaacctttggtcttggcta

SEQ ID NO: 60680 - DNA, 25 bp, S. cerevisiae
ttaaacggcgcctcacaaaggagat

SEQ ID NO: 60681 - DNA, 25 bp, S. cerevisiae
ttatatctcagttccttaaaagggt

SEQ ID NO: 60682 - DNA, 25 bp, S. cerevisiae
ttattccgtacttgtacaatggatt

SEQ ID NO: 60683 - DNA, 25 bp, S. cerevisiae
ttattctcttactccaagtcgttgg

SEQ ID NO: 60684 - DNA, 25 bp, S. cerevisiae
ttattgtatatatcccgtctccttc

SEQ ID NO: 60685 - DNA, 25 bp, S. cerevisiae
ttactgttgacaacccgttcgctaa

SEQ ID NO: 60686 - DNA, 25 bp, S. cerevisiae
ttgatttctgcacgctttggtacga

SEQ ID NO: 60687 - DNA, 25 bp, S. cerevisiae
ttatatttgtttctcctcaggacac

SEQ ID NO: 60688 - DNA, 25 bp, S. cerevisiae
ttatttatttgtctgccggtgcttc

SEQ ID NO: 60689 - DNA, 25 bp, S. cerevisiae
ttttgcctttgatagttgcgacgaa

SEQ ID NO: 60690 - DNA, 25 bp, S. cerevisiae
ttttgtcgaaagcagcatcggcgct

SEQ ID NO: 60691 - DNA, 25 bp, S. cerevisiae
ttttgcacgaattgaagctggccca

SEQ ID NO: 60692 - DNA, 25 bp, S. cerevisiae
ttcttccataccagttgacggcaga

SEQ ID NO: 60693 - DNA, 25 bp, S. cerevisiae
ttttccaccgataaagcccaagact

SEQ ID NO: 60694 - DNA, 25 bp, S. cerevisiae
ttttccacggatattccaattgtga

SEQ ID NO: 60695 - DNA, 25 bp, S. cerevisiae
ttgacccacggtacttcagttttat

SEQ ID NO: 60696 - DNA, 25 bp, S. cerevisiae
ttatcactcgcttgaaccacttttt

SEQ ID NO: 60697 - DNA, 25 bp, S. cerevisiae
ttatgagaactgtcacagcctccca

SEQ ID NO: 60698 - DNA, 25 bp, S. cerevisiae
ttatcgacactgacaagcccacaag

SEQ ID NO: 60699 - DNA, 25 bp, S. cerevisiae
ttgaagaacagcgagagcccaaact

SEQ ID NO: 60700 - DNA, 25 bp, S. cerevisiae
ttatggtcaagcaggcgcgaacact

SEQ ID NO: 60701 - DNA, 25 bp, S. cerevisiae
ttatggtcggcatgatactctcggc

SEQ ID NO: 60702 - DNA, 25 bp, S. cerevisiae
ttaggtcgtgacgtgactgactggt

SEQ ID NO: 60703 - DNA, 25 bp, S. cerevisiae
ttaggtctagaagacagcagctagt

SEQ ID NO: 60704 - DNA, 25 bp, S. cerevisiae
ttcggaaatgaaccacagcttagat

SEQ ID NO: 60705 - DNA, 25 bp, S. cerevisiae
ttttgccacttatgatctgccgaca

SEQ ID NO: 60706 - DNA, 25 bp, S. cerevisiae
ttttggctgctagatgggctcgtga

SEQ ID NO: 60707 - DNA, 25 bp, S. cerevisiae
ttttcgcatgttgttgagcacgtac

SEQ ID NO: 60708 - DNA, 25 bp, S. cerevisiae
ttttggagcattgtctggcactgcc

SEQ ID NO: 60709 - DNA, 25 bp, S. cerevisiae
ttttcattttgtttgctagcacctg

SEQ ID NO: 60710 - DNA, 25 bp, S. cerevisiae
ttagccgagttggttcagcagatga

SEQ ID NO: 60711 - DNA, 25 bp, S. cerevisiae
ttagattcccacacgcaatcaggtg

SEQ ID NO: 60712 - DNA, 25 bp, S. cerevisiae
ttacttgatccgctaatacgtccac

SEQ ID NO: 60713 - DNA, 25 bp, S. cerevisiae
ttttgttgcctctaagaacgatcca

SEQ ID NO: 60714 - DNA, 25 bp, S. cerevisiae
ttttcagtgcctcgagcgcaacgat

SEQ ID NO: 60715 - DNA, 25 bp, S. cerevisiae
ttgtgtattgcactcgggatagcga

SEQ ID NO: 60716 - DNA, 25 bp, S. cerevisiae
ttgtgcatatgctacgggtgacgga

SEQ ID NO: 60717 - DNA, 25 bp, S. cerevisiae
ttgctgcttatagagcgggcgcgat

SEQ ID NO: 60718 - DNA, 25 bp, S. cerevisiae
ttcagtatcaatgagcacgggcgta

SEQ ID NO: 60719 - DNA, 25 bp, S. cerevisiae
ttatccaaggtaatccactaatgta

SEQ ID NO: 60720 - DNA, 25 bp, S. cerevisiae
ttatccacggtaccctatggtcata

SEQ ID NO: 60721 - DNA, 25 bp, S. cerevisiae
ttagcaaaggttccaaatgcggctt

SEQ ID NO: 60722 - DNA, 25 bp, S. cerevisiae
ttagacacgtgccttcaggactact

SEQ ID NO: 60723 - DNA, 25 bp, S. cerevisiae
ttggcgaagatctaccggattcctt

SEQ ID NO: 60724 - DNA, 25 bp, S. cerevisiae
ttcaagggatcgatctgactcgcga

SEQ ID NO: 60725 - DNA, 25 bp, S. cerevisiae
ttattgtaccgccattcagctaaag

SEQ ID NO: 60726 - DNA, 25 bp, S. cerevisiae
ttattgtaccgccatccagttgaag

SEQ ID NO: 60727 - DNA, 25 bp, S. cerevisiae
ttttcctcattctctggctttagac

SEQ ID NO: 60728 - DNA, 25 bp, S. cerevisiae
ttttctttttccttgttctctctcg

SEQ ID NO: 60729 - DNA, 25 bp, S. cerevisiae
ttttcgtttcatcatatttccctct

SEQ ID NO: 60730 - DNA, 25 bp, S. cerevisiae
ttttccgtgaatttgactccttgac

SEQ ID NO: 60731 - DNA, 25 bp, S. cerevisiae
ttaacggttcgcttcgtagaatcgc

SEQ ID NO: 60732 - DNA, 25 bp, S. cerevisiae
ttaacgagtttgtccactgtttcct

SEQ ID NO: 60733 - DNA, 25 bp, S. cerevisiae
ttacaaccgttgtacactgttcctc

SEQ ID NO: 60734 - DNA, 25 bp, S. cerevisiae
ttaagacgccaagctcacgaacaaa

SEQ ID NO: 60735 - DNA, 25 bp, S. cerevisiae
ttatagaacaaagacagccaccatt

SEQ ID NO: 60736 - DNA, 25 bp, S. cerevisiae
ttttgattcaactaagcccaccgtt

SEQ ID NO: 60737 - DNA, 25 bp, S. cerevisiae
ttaccagtcaccttagaccaggagt

SEQ ID NO: 60738 - DNA, 25 bp, S. cerevisiae
ttacctactaggttaccagcttttg

SEQ ID NO: 60739 - DNA, 25 bp, S. cerevisiae
ttacctacgggatatcctgatctga

SEQ ID NO: 60740 - DNA, 25 bp, S. cerevisiae
ttacttgcacaacaccattggtagc

SEQ ID NO: 60741 - DNA, 25 bp, S. cerevisiae
ttatcttcctgagacaatctggccc

SEQ ID NO: 60742 - DNA, 25 bp, S. cerevisiae
ttttgatactcatctactcgagccc

SEQ ID NO: 60743 - DNA, 25 bp, S. cerevisiae
ttatttgcacaagctgcccaaggcg

SEQ ID NO: 60744 - DNA, 25 bp, S. cerevisiae
ttatttcacctgtatgtccatcatg

SEQ ID NO: 60745 - DNA, 25 bp, S. cerevisiae
ttatttgtgcctgagcatgccataa

SEQ ID NO: 60746 - DNA, 25 bp, S. cerevisiae
ttattactatcaccccatgcaatac

SEQ ID NO: 60747 - DNA, 25 bp, S. cerevisiae
ttatcgagatataccctctggcact

SEQ ID NO: 60748 - DNA, 25 bp, S. cerevisiae
ttatgtcaagaaacgcctagcactg

SEQ ID NO: 60749 - DNA, 25 bp, S. cerevisiae
ttagctcaacggaggctgacacgtt

SEQ ID NO: 60750 - DNA, 25 bp, S. cerevisiae
ttaagggcgctattactgcggcggt

SEQ ID NO: 60751 - DNA, 25 bp, S. cerevisiae
ttcatgaagcccgaagacgtccgtt

SEQ ID NO: 60752 - DNA, 25 bp, S. cerevisiae
ttagtgaaggcctactctgttcttt

SEQ ID NO: 60753 - DNA, 25 bp, S. cerevisiae
ttaggtcctaacttttatgctccag

SEQ ID NO: 60754 - DNA, 25 bp, S. cerevisiae
ttatttactacccattttcccatgc

SEQ ID NO: 60755 - DNA, 25 bp, S. cerevisiae
ttagtgacgctgactcatgggttcc

SEQ ID NO: 60756 - DNA, 25 bp, S. cerevisiae
ttatgtgacgcagccttagttacgg

SEQ ID NO: 60757 - DNA, 25 bp, S. cerevisiae
ttattctcctacatctccatcatac

SEQ ID NO: 60758 - DNA, 25 bp, S. cerevisiae
ttattcacttccagccccatgaaaa

SEQ ID NO: 60759 - DNA, 25 bp, S. cerevisiae
ttatcagcagttattctcccatcag

SEQ ID NO: 60760 - DNA, 25 bp, S. cerevisiae
ttatacgcaattagccgcccatatg

SEQ ID NO: 60761 - DNA, 25 bp, S. cerevisiae
ttatataatgatacgcacacaccat

SEQ ID NO: 60762 - DNA, 25 bp, S. cerevisiae
ttatcagattttgaccagcatgaga

SEQ ID NO: 60763 - DNA, 25 bp, S. cerevisiae
ttatcaactaatgtgcctctggcga

SEQ ID NO: 60764 - DNA, 25 bp, S. cerevisiae
ttaccatcaactgtccattgcacaa

SEQ ID NO: 60765 - DNA, 25 bp, S. cerevisiae
ttaccttcctactactgtgtatcgg

SEQ ID NO: 60766 - DNA, 25 bp, S. cerevisiae
ttatgcctccgtatacgtgatgacg

SEQ ID NO: 60767 - DNA, 25 bp, S. cerevisiae
ttacatttggaatacgcagcagcat

SEQ ID NO: 60768 - DNA, 25 bp, S. cerevisiae
ttatctttggacgacatctgggcct

SEQ ID NO: 60769 - DNA, 25 bp, S. cerevisiae
ttactggcccagatgttaaaccttg

SEQ ID NO: 60770 - DNA, 25 bp, S. cerevisiae
ttattggcccaaacggataacacgt

SEQ ID NO: 60771 - DNA, 25 bp, S. cerevisiae
ttattagacccttccaattctcttg

SEQ ID NO: 60772 - DNA, 25 bp, S. cerevisiae
ttatgggatcaacagcagcttcaac

SEQ ID NO: 60773 - DNA, 25 bp, S. cerevisiae
ttatcccatgggtcaaggctttgtt

SEQ ID NO: 60774 - DNA, 25 bp, S. cerevisiae
ttacctgagggcaattggctacaac

SEQ ID NO: 60775 - DNA, 25 bp, S. cerevisiae
ttagctcgtggtattgacttcaaag

SEQ ID NO: 60776 - DNA, 25 bp, S. cerevisiae
ttacggtcatcatcttggctggaag

SEQ ID NO: 60777 - DNA, 25 bp, S. cerevisiae
ttatcaggtgaatctgtcgcggcag

SEQ ID NO: 60778 - DNA, 25 bp, S. cerevisiae
ttatcacctgataaagatcatgagg

SEQ ID NO: 60779 - DNA, 25 bp, S. cerevisiae
ttaccaattggctactcaatctggg

SEQ ID NO: 60780 - DNA, 25 bp, S. cerevisiae
ttcatccttgcgctaccaacggaat

SEQ ID NO: 60781 - DNA, 25 bp, S. cerevisiae
ttgccgccagaagaactggtttgtt

SEQ ID NO: 60782 - DNA, 25 bp, S. cerevisiae
ttgccactgaaagaacctacctgtc

SEQ ID NO: 60783 - DNA, 25 bp, S. cerevisiae
ttaactgcagacataaagccccggc

SEQ ID NO: 60784 - DNA, 25 bp, S. cerevisiae
ttcaactgtaaccaaaccggccaca

SEQ ID NO: 60785 - DNA, 25 bp, S. cerevisiae
ttagtagtataccaacccgaggaga

SEQ ID NO: 60786 - DNA, 25 bp, S. cerevisiae
ttcgaaagaacccagcccaagtaca

SEQ ID NO: 60787 - DNA, 25 bp, S. cerevisiae
ttcattcaagaactggcccctagta

SEQ ID NO: 60788 - DNA, 25 bp, S. cerevisiae
ttagatcgacgatgtcttccccaga

SEQ ID NO: 60789 - DNA, 25 bp, S. cerevisiae
ttatactcaaaaccttctgcccaga

SEQ ID NO: 60790 - DNA, 25 bp, S. cerevisiae
ttagagttgaatcgcaaggcccctg

SEQ ID NO: 60791 - DNA, 25 bp, S. cerevisiae
ttagcatgtattttgatggccatca

SEQ ID NO: 60792 - DNA, 25 bp, S. cerevisiae
ttattgaagcatgggatcgtccgaa

SEQ ID NO: 60793 - DNA, 25 bp, S. cerevisiae
ttagccgcctccaaattacttttga

SEQ ID NO: 60794 - DNA, 25 bp, S. cerevisiae
ttccccaatcatctagattcctgtg

SEQ ID NO: 60795 - DNA, 25 bp, S. cerevisiae
ttatcgccatttcttgattccttgc

SEQ ID NO: 60796 - DNA, 25 bp, S. cerevisiae
ttatattgccttttaggtctcccgc

SEQ ID NO: 60797 - DNA, 25 bp, S. cerevisiae
ttatactgtgatacttgcccttgct

SEQ ID NO: 60798 - DNA, 25 bp, S. cerevisiae
ttttgtgcaaaaatccctcgctggt

SEQ ID NO: 60799 - DNA, 25 bp, S. cerevisiae
ttactgaacagggactccgcgagag

SEQ ID NO: 60800 - DNA, 25 bp, S. cerevisiae
ttagctgaaagtggagtgggctcct

SEQ ID NO: 60801 - DNA, 25 bp, S. cerevisiae
ttaggaaagcccttaactcgctctg

SEQ ID NO: 60802 - DNA, 25 bp, S. cerevisiae
ttagccaaaccgtatgaaccgttat

SEQ ID NO: 60803 - DNA, 25 bp, S. cerevisiae
ttcaaggaagctgctagaaccgatt

SEQ ID NO: 60804 - DNA, 25 bp, S. cerevisiae
ttaaggctattttggaatccgtcgg

SEQ ID NO: 60805 - DNA, 25 bp, S. cerevisiae
ttattgtgcttctggcaaacgcggg

SEQ ID NO: 60806 - DNA, 25 bp, S. cerevisiae
ttattgactatcaccaaggccgctg

SEQ ID NO: 60807 - DNA, 25 bp, S. cerevisiae
ttatttctccatttgacagccatcc

SEQ ID NO: 60808 - DNA, 25 bp, S. cerevisiae
ttattcttcctcttagcagtgacct

SEQ ID NO: 60809 - DNA, 25 bp, S. cerevisiae
ttattttctcacgatcatggcgatc

SEQ ID NO: 60810 - DNA, 25 bp, S. cerevisiae
ttattcttctcaatcaacaccgcaa

SEQ ID NO: 60811 - DNA, 25 bp, S. cerevisiae
ttatcaacgatgctggtaaggctaa

SEQ ID NO: 60812 - DNA, 25 bp, S. cerevisiae
ttacaggtcggtgctaaggctacaa

SEQ ID NO: 60813 - DNA, 25 bp, S. cerevisiae
ttagtggaggcgtttgcggttcatc

SEQ ID NO: 60814 - DNA, 25 bp, S. cerevisiae
ttagcttctaagattcatcccgatg

SEQ ID NO: 60815 - DNA, 25 bp, S. cerevisiae
ttcaggtgccaaaatctacccaggc

SEQ ID NO: 60816 - DNA, 25 bp, S. cerevisiae
ttagccatgaagaaattccccaccc

SEQ ID NO: 60817 - DNA, 25 bp, S. cerevisiae
ttacgagttcacgttgtccgagttt

SEQ ID NO: 60818 - DNA, 25 bp, S. cerevisiae
ttagggattcacacttccaagatga

SEQ ID NO: 60819 - DNA, 25 bp, S. cerevisiae
ttaggcgttcacaatcgtccaattc

SEQ ID NO: 60820 - DNA, 25 bp, S. cerevisiae
ttatgacgaacacacctgccaagta

SEQ ID NO: 60821 - DNA, 25 bp, S. cerevisiae
ttattcgctaacacctgcacaattg

SEQ ID NO: 60822 - DNA, 25 bp, S. cerevisiae
ttgttccaattccacagtccaaatc

SEQ ID NO: 60823 - DNA, 25 bp, S. cerevisiae
ttttgacatttccaacctcacagac

SEQ ID NO: 60824 - DNA, 25 bp, S. cerevisiae
ttagatcctgttcaaagcccgacga

SEQ ID NO: 60825 - DNA, 25 bp, S. cerevisiae
ttataagccttctacgcaagacgta

SEQ ID NO: 60826 - DNA, 25 bp, S. cerevisiae
ttgaccgatctttatgccaatgccg

SEQ ID NO: 60827 - DNA, 25 bp, S. cerevisiae
ttatccgacatcaattccagtcagg

SEQ ID NO: 60828 - DNA, 25 bp, S. cerevisiae
ttatttgactctttggcagctctgt

SEQ ID NO: 60829 - DNA, 25 bp, S. cerevisiae
ttatgttggttctatgggtctgctt

SEQ ID NO: 60830 - DNA, 25 bp, S. cerevisiae
ttttgggcagtgttatcggctctgt

SEQ ID NO: 60831 - DNA, 25 bp, S. cerevisiae
ttattgcgacttcatgacgactcat

SEQ ID NO: 60832 - DNA, 25 bp, S. cerevisiae
ttattgcaattttcattcctccctt

SEQ ID NO: 60833 - DNA, 25 bp, S. cerevisiae
ttcccagggaattggttggtcgatc

SEQ ID NO: 60834 - DNA, 25 bp, S. cerevisiae
ttatttctgaatacgggctgcctga

SEQ ID NO: 60835 - DNA, 25 bp, S. cerevisiae
ttttgtggctgattgcttacccaac

SEQ ID NO: 60836 - DNA, 25 bp, S. cerevisiae
ttattggtgcaattctgtcaacgaa

SEQ ID NO: 60837 - DNA, 25 bp, S. cerevisiae
ttttggtaccagatgccctattaat

SEQ ID NO: 60838 - DNA, 25 bp, S. cerevisiae
ttttggctttgttggtctctttaat

SEQ ID NO: 60839 - DNA, 25 bp, S. cerevisiae
ttattggcagttacctcacttttca

SEQ ID NO: 60840 - DNA, 25 bp, S. cerevisiae
ttattaatagtactcacctgctccc

SEQ ID NO: 60841 - DNA, 25 bp, S. cerevisiae
ttattagatttcaccagctccgaca

SEQ ID NO: 60842 - DNA, 25 bp, S. cerevisiae
ttattatttccacctacccaatcaa

SEQ ID NO: 60843 - DNA, 25 bp, S. cerevisiae
ttattattttcacctgatggccaga

SEQ ID NO: 60844 - DNA, 25 bp, S. cerevisiae
ttatttgtcccaattgcagatcccc

SEQ ID NO: 60845 - DNA, 25 bp, S. cerevisiae
ttatttcataccactgcagtaccct

SEQ ID NO: 60846 - DNA, 25 bp, S. cerevisiae
ttatggtatgagtaaagctgctgac

SEQ ID NO: 60847 - DNA, 25 bp, S. cerevisiae
ttaactttcccattgactgtggagg

SEQ ID NO: 60848 - DNA, 25 bp, S. cerevisiae
ttattcttatgcaactacctttccc

SEQ ID NO: 60849 - DNA, 25 bp, S. cerevisiae
ttatatccgcatcaaactcttcttc

SEQ ID NO: 60850 - DNA, 25 bp, S. cerevisiae
ttatattcaaccatcacacacgtct

SEQ ID NO: 60851 - DNA, 25 bp, S. cerevisiae
ttatcattattacctcccactgatc

SEQ ID NO: 60852 - DNA, 25 bp, S. cerevisiae
ttatattcaaggtctgccccagtac

SEQ ID NO: 60853 - DNA, 25 bp, S. cerevisiae
ttacgcatatagtttctgtcggtga

SEQ ID NO: 60854 - DNA, 25 bp, S. cerevisiae
ttatcttcacacctacacatagcga

SEQ ID NO: 60855 - DNA, 25 bp, S. cerevisiae
ttaggcctaccagtgattcaaaagt

SEQ ID NO: 60856 - DNA, 25 bp, S. cerevisiae
ttagaggaccccaatatcaactcgc

SEQ ID NO: 60857 - DNA, 25 bp, S. cerevisiae
ttatacataccgctcattcgcaagg

SEQ ID NO: 60858 - DNA, 25 bp, S. cerevisiae
ttcatccaaatcctctttgcatggg

SEQ ID NO: 60859 - DNA, 25 bp, S. cerevisiae
ttctaacattaattctgctccaagg

SEQ ID NO: 60860 - DNA, 25 bp, S. cerevisiae
ttataccttggatcgtcagcaaagc

SEQ ID NO: 60861 - DNA, 25 bp, S. cerevisiae
ttatattcggccatctatccacaca

SEQ ID NO: 60862 - DNA, 25 bp, S. cerevisiae
ttagcgtgcccgtgatataccttta

SEQ ID NO: 60863 - DNA, 25 bp, S. cerevisiae
ttatgggcccagtaatcttcacctc

SEQ ID NO: 60864 - DNA, 25 bp, S. cerevisiae
ttaagggccagtctgcatggaccac

SEQ ID NO: 60865 - DNA, 25 bp, S. cerevisiae
ttatgatgccgtggtctttagcgcc

SEQ ID NO: 60866 - DNA, 25 bp, S. cerevisiae
ttaggcctgtatgcattcgatctct

SEQ ID NO: 60867 - DNA, 25 bp, S. cerevisiae
ttatcccgtaccttgaagatccagc

SEQ ID NO: 60868 - DNA, 25 bp, S. cerevisiae
ttatcctcctcttttacactagttg

SEQ ID NO: 60869 - DNA, 25 bp, S. cerevisiae
ttattcgttttaatcatgcgtcagt

SEQ ID NO: 60870 - DNA, 25 bp, S. cerevisiae
ttacgagtgttttcatagctgcaaa

SEQ ID NO: 60871 - DNA, 25 bp, S. cerevisiae
ttacgggttccctatgtacaagtag

SEQ ID NO: 60872 - DNA, 25 bp, S. cerevisiae
ttacttgacaagaccattgcccagc

SEQ ID NO: 60873 - DNA, 25 bp, S. cerevisiae
ttatctacagattacgcattgcgca

SEQ ID NO: 60874 - DNA, 25 bp, S. cerevisiae
ttattcgatcatcaagagccccatc

SEQ ID NO: 60875 - DNA, 25 bp, S. cerevisiae
ttatccagatcatacgacgcatcct

SEQ ID NO: 60876 - DNA, 25 bp, S. cerevisiae
ttaccactaaaccacttgcgcttgt

SEQ ID NO: 60877 - DNA, 25 bp, S. cerevisiae
ttatgcaaacccttcatctggagtt

SEQ ID NO: 60878 - DNA, 25 bp, S. cerevisiae
ttatcattgacccacgcttgctgcg

SEQ ID NO: 60879 - DNA, 25 bp, S. cerevisiae
ttatatcgaccgtgctggtaggcca

SEQ ID NO: 60880 - DNA, 25 bp, S. cerevisiae
ttattcgcccgtagttaccaacgat

SEQ ID NO: 60881 - DNA, 25 bp, S. cerevisiae
ttatctatccttcccacttgttatg

SEQ ID NO: 60882 - DNA, 25 bp, S. cerevisiae
ttatctatcatcttgtccgttcttc

SEQ ID NO: 60883 - DNA, 25 bp, S. cerevisiae
ttactgttaatcttcctgagtctaa

SEQ ID NO: 60884 - DNA, 25 bp, S. cerevisiae
ttattatacgctatcacccgctgaa

SEQ ID NO: 60885 - DNA, 25 bp, S. cerevisiae
ttaacgaaaacaccccagaacaatg

SEQ ID NO: 60886 - DNA, 25 bp, S. cerevisiae
ttaacggaagaccacccatgggtag

SEQ ID NO: 60887 - DNA, 25 bp, S. cerevisiae
ttcactgggcgatatagatgacctt

SEQ ID NO: 60888 - DNA, 25 bp, S. cerevisiae
ttacgttcgcagcaagaggccatgt

SEQ ID NO: 60889 - DNA, 25 bp, S. cerevisiae
ttaacgttgggagaggcacatgcat

SEQ ID NO: 60890 - DNA, 25 bp, S. cerevisiae
ttaacttcagggacacaggcgatat

SEQ ID NO: 60891 - DNA, 25 bp, S. cerevisiae
ttattattgtcttgtcctcgctggg

SEQ ID NO: 60892 - DNA, 25 bp, S. cerevisiae
ttatcgtcctctctttctatgaaag

SEQ ID NO: 60893 - DNA, 25 bp, S. cerevisiae
ttacgcaacgctatttccgataacg

SEQ ID NO: 60894 - DNA, 25 bp, S. cerevisiae
ttagagataacctcgtcgcttgggt

SEQ ID NO: 60895 - DNA, 25 bp, S. cerevisiae
ttacattcgaacactgccggtggtg

SEQ ID NO: 60896 - DNA, 25 bp, S. cerevisiae
ttaaccgcaagtttgttggcatcga

SEQ ID NO: 60897 - DNA, 25 bp, S. cerevisiae
ttaccaagctggtcagtttaccgtt

SEQ ID NO: 60898 - DNA, 25 bp, S. cerevisiae
ttaacctctttattattgccctgtc

SEQ ID NO: 60899 - DNA, 25 bp, S. cerevisiae
ttaactgacatatgggcctccttta

SEQ ID NO: 60900 - DNA, 25 bp, S. cerevisiae
ttgaactacactttggtcccatttg

SEQ ID NO: 60901 - DNA, 25 bp, S. cerevisiae
ttaggcaatgggacttacgttccgg

SEQ ID NO: 60902 - DNA, 25 bp, S. cerevisiae
ttagctggtatttccgttcctccaa

SEQ ID NO: 60903 - DNA, 25 bp, S. cerevisiae
ttaggtgtggttgccattccaccaa

SEQ ID NO: 60904 - DNA, 25 bp, S. cerevisiae
ttaccaaagctaaacgtgtccgccg

SEQ ID NO: 60905 - DNA, 25 bp, S. cerevisiae
ttatagatcacgttctgcggctttc

SEQ ID NO: 60906 - DNA, 25 bp, S. cerevisiae
ttatagacactcatcgctgcagcat

SEQ ID NO: 60907 - DNA, 25 bp, S. cerevisiae
ttagcagcgatgtcaatcctagcat

SEQ ID NO: 60908 - DNA, 25 bp, S. cerevisiae
ttagcagcatgtctccgtacatgac

SEQ ID NO: 60909 - DNA, 25 bp, S. cerevisiae
ttagcagctcatcagcgtgaactgg

SEQ ID NO: 60910 - DNA, 25 bp, S. cerevisiae
ttgcatcgtgatgataccaagaagt

SEQ ID NO: 60911 - DNA, 25 bp, S. cerevisiae
ttacgctaactggtcaaaactcatt

SEQ ID NO: 60912 - DNA, 25 bp, S. cerevisiae
ttcgagttacttgagagggcccaat

SEQ ID NO: 60913 - DNA, 25 bp, S. cerevisiae
ttgtcagaaacgtgaagggcccagt

SEQ ID NO: 60914 - DNA, 25 bp, S. cerevisiae
ttacaaatacgtttcagggcctgat

SEQ ID NO: 60915 - DNA, 25 bp, S. cerevisiae
ttagcagaatctggaacgtccccgt

SEQ ID NO: 60916 - DNA, 25 bp, S. cerevisiae
ttgatggattgaccaacgccaccca

SEQ ID NO: 60917 - DNA, 25 bp, S. cerevisiae
ttagagaggtgccaacagcccattc

SEQ ID NO: 60918 - DNA, 25 bp, S. cerevisiae
ttatccagttgccacaccacaaaag

SEQ ID NO: 60919 - DNA, 25 bp, S. cerevisiae
ttaccgcagcgagagataccacatg

SEQ ID NO: 60920 - DNA, 25 bp, S. cerevisiae
ttaggccagtcgcagatacctcagt

SEQ ID NO: 60921 - DNA, 25 bp, S. cerevisiae
ttaggccaagcccacacagaagcag

SEQ ID NO: 60922 - DNA, 25 bp, S. cerevisiae
ttaccaaggccgtcaagcatgtcag

SEQ ID NO: 60923 - DNA, 25 bp, S. cerevisiae
ttaccaactctacccagacttgtat

SEQ ID NO: 60924 - DNA, 25 bp, S. cerevisiae
ttagccgactctcttagactcgatt

SEQ ID NO: 60925 - DNA, 25 bp, S. cerevisiae
ttacctacccatatggaagcgcttg

SEQ ID NO: 60926 - DNA, 25 bp, S. cerevisiae
ttatctccacatgatttccaacggt

SEQ ID NO: 60927 - DNA, 25 bp, S. cerevisiae
ttatcgtcagatggtggtgccttcg

SEQ ID NO: 60928 - DNA, 25 bp, S. cerevisiae
ttatgcgtcatttttcgccttcgta

SEQ ID NO: 60929 - DNA, 25 bp, S. cerevisiae
ttacttctcttgtaggtttgttaat

SEQ ID NO: 60930 - DNA, 25 bp, S. cerevisiae
ttcaacgttgaatactttgccaagg

SEQ ID NO: 60931 - DNA, 25 bp, S. cerevisiae
ttccgccgataaaggtttcccattg

SEQ ID NO: 60932 - DNA, 25 bp, S. cerevisiae
ttccgcccaaatattgtgctagcca

SEQ ID NO: 60933 - DNA, 25 bp, S. cerevisiae
ttccaccgtcggcttcaaatatgaa

SEQ ID NO: 60934 - DNA, 25 bp, S. cerevisiae
ttcacgtttcggtggtcaaagagct

SEQ ID NO: 60935 - DNA, 25 bp, S. cerevisiae
ttaccttccgttatttgtgctttga

SEQ ID NO: 60936 - DNA, 25 bp, S. cerevisiae
ttaccagcgacccttttgttaatat

SEQ ID NO: 60937 - DNA, 25 bp, S. cerevisiae
ttgactaactcgcttacgtccagta

SEQ ID NO: 60938 - DNA, 25 bp, S. cerevisiae
ttagctacctacaattcacgtcatc

SEQ ID NO: 60939 - DNA, 25 bp, S. cerevisiae
ttagccaattacaaaaccgatcccg

SEQ ID NO: 60940 - DNA, 25 bp, S. cerevisiae
ttatctgccattcaaaaccttccac

SEQ ID NO: 60941 - DNA, 25 bp, S. cerevisiae
ttggctgccattcacgccaagcgtg

SEQ ID NO: 60942 - DNA, 25 bp, S. cerevisiae
ttgactgctgttcacgacaaggttt

SEQ ID NO: 60943 - DNA, 25 bp, S. cerevisiae
ttactagccgccgaagaggaagctt

SEQ ID NO: 60944 - DNA, 25 bp, S. cerevisiae
ttactacacgtagatgagctatcga

SEQ ID NO: 60945 - DNA, 25 bp, S. cerevisiae
ttacaagcacctaaacctacggcaa

SEQ ID NO: 60946 - DNA, 25 bp, S. cerevisiae
ttagatgcccaactaaccgaaggtg

SEQ ID NO: 60947 - DNA, 25 bp, S. cerevisiae
ttacagctccaacaagaaggcaggt

SEQ ID NO: 60948 - DNA, 25 bp, S. cerevisiae
ttgagctctctaagcaggagaacga

SEQ ID NO: 60949 - DNA, 25 bp, S. cerevisiae
ttagggcaatctcacacacattatg

SEQ ID NO: 60950 - DNA, 25 bp, S. cerevisiae
ttagacggactgtatcaatcgatca

SEQ ID NO: 60951 - DNA, 25 bp, S. cerevisiae
ttatgtcggcgatgtgcttgttgat

SEQ ID NO: 60952 - DNA, 25 bp, S. cerevisiae
ttatgtgcccaaaatctcgtgtgta

SEQ ID NO: 60953 - DNA, 25 bp, S. cerevisiae
ttcatgggccagttactgcgggatt

SEQ ID NO: 60954 - DNA, 25 bp, S. cerevisiae
ttatgccgccgattacgaattgagt

SEQ ID NO: 60955 - DNA, 25 bp, S. cerevisiae
ttaccagccgactcagaagctagga

SEQ ID NO: 60956 - DNA, 25 bp, S. cerevisiae
ttatgtgcgccatcaggagaacttg

SEQ ID NO: 60957 - DNA, 25 bp, S. cerevisiae
ttatgaatgccatgcgccagaacca

SEQ ID NO: 60958 - DNA, 25 bp, S. cerevisiae
ttcacccacttttcaaaaacacacg

SEQ ID NO: 60959 - DNA, 25 bp, S. cerevisiae
ttgacgaaattagaaccagacgttt

SEQ ID NO: 60960 - DNA, 25 bp, S. cerevisiae
ttagctaaattacgcgaacagggtt

SEQ ID NO: 60961 - DNA, 25 bp, S. cerevisiae
ttaggtcgatcgtcagagctgttga

SEQ ID NO: 60962 - DNA, 25 bp, S. cerevisiae
ttcaggatcggccacaggtacagct

SEQ ID NO: 60963 - DNA, 25 bp, S. cerevisiae
ttatcgtgttaaattccttgactca

SEQ ID NO: 60964 - DNA, 25 bp, S. cerevisiae
ttatcggaggtttctctcagggtgc

SEQ ID NO: 60965 - DNA, 25 bp, S. cerevisiae
ttagctctggagttcgtcaatggcg

SEQ ID NO: 60966 - DNA, 25 bp, S. cerevisiae
ttatgctcgggttctcacgatggta

SEQ ID NO: 60967 - DNA, 25 bp, S. cerevisiae
ttaagcagcagtattcccgttgaat

SEQ ID NO: 60968 - DNA, 25 bp, S. cerevisiae
ttcagcggcagtttacccaagtaat

SEQ ID NO: 60969 - DNA, 25 bp, S. cerevisiae
ttctggcgcgaatcacggcaacgaa

SEQ ID NO: 60970 - DNA, 25 bp, S. cerevisiae
ttagcaactggacacgcgatcctta

SEQ ID NO: 60971 - DNA, 25 bp, S. cerevisiae
ttatgattttcctaatgctcctcca

SEQ ID NO: 60972 - DNA, 25 bp, S. cerevisiae
ttatagatcatcatgcggccatccg

SEQ ID NO: 60973 - DNA, 25 bp, S. cerevisiae
ttagtagtttaccttatgctgttat

SEQ ID NO: 60974 - DNA, 25 bp, S. cerevisiae
ttaggagttgtacgttccccattgc

SEQ ID NO: 60975 - DNA, 25 bp, S. cerevisiae
ttaggcctctttggatgttcattct

SEQ ID NO: 60976 - DNA, 25 bp, S. cerevisiae
ttagagcctgctgtagagaccttaa

SEQ ID NO: 60977 - DNA, 25 bp, S. cerevisiae
ttatgatgccgagttcagaaccaag

SEQ ID NO: 60978 - DNA, 25 bp, S. cerevisiae
ttaacgccgttgaatccctgaagga

SEQ ID NO: 60979 - DNA, 25 bp, S. cerevisiae
ttatcaaggctttgcaatccttgac

SEQ ID NO: 60980 - DNA, 25 bp, S. cerevisiae
ttatcaaggctttgcaatccttgac

SEQ ID NO: 60981 - DNA, 25 bp, S. cerevisiae
ttatagacactttgcaccatttccc

SEQ ID NO: 60982 - DNA, 25 bp, S. cerevisiae
ttataaccctgaatctcctatccaa

SEQ ID NO: 60983 - DNA, 25 bp, S. cerevisiae
ttataaacttcaacacgccacctgg

SEQ ID NO: 60984 - DNA, 25 bp, S. cerevisiae
ttaaagaagatcagagcccaccgtg

SEQ ID NO: 60985 - DNA, 25 bp, S. cerevisiae
ttaccagaccacaggcccagaaatt

SEQ ID NO: 60986 - DNA, 25 bp, S. cerevisiae
ttatctcttggtggagacccaaatt

SEQ ID NO: 60987 - DNA, 25 bp, S. cerevisiae
ttactgtctgctggttgattgctgc

SEQ ID NO: 60988 - DNA, 25 bp, S. cerevisiae
ttactggaccacctgcaactgatga

SEQ ID NO: 60989 - DNA, 25 bp, S. cerevisiae
ttaggtcaacacttgctactatgaa

SEQ ID NO: 60990 - DNA, 25 bp, S. cerevisiae
ttatcgcctggagtggctcgcaata

SEQ ID NO: 60991 - DNA, 25 bp, S. cerevisiae
ttatcccaggatgatgacgcactga

SEQ ID NO: 60992 - DNA, 25 bp, S. cerevisiae
ttagcgccagaagagcagccatcca

SEQ ID NO: 60993 - DNA, 25 bp, S. cerevisiae
ttgaatgaaacagcggcatggccag

SEQ ID NO: 60994 - DNA, 25 bp, S. cerevisiae
ttatcaataacatcacgcttcctct

SEQ ID NO: 60995 - DNA, 25 bp, S. cerevisiae
ttcgaaatcgaaaacagccagggct

SEQ ID NO: 60996 - DNA, 25 bp, S. cerevisiae
ttcggatacgcaaaaacctctctgg

SEQ ID NO: 60997 - DNA, 25 bp, S. cerevisiae
ttaggaacactctacaaccgcaggg

SEQ ID NO: 60998 - DNA, 25 bp, S. cerevisiae
ttgaggaacacccaaccgtggtaga

SEQ ID NO: 60999 - DNA, 25 bp, S. cerevisiae
ttatggaacaacgacccgatgctgt

SEQ ID NO: 61000 - DNA, 25 bp, S. cerevisiae
ttgatgaaaaacgacgaacctttgt

SEQ ID NO: 61001 - DNA, 25 bp, S. cerevisiae
ttaataggcccgtgattcccaacga

SEQ ID NO: 61002 - DNA, 25 bp, S. cerevisiae
ttaatcggccacattgttcccgaag

SEQ ID NO: 61003 - DNA, 25 bp, S. cerevisiae
ttatgacaacccactgttcgtccaa

SEQ ID NO: 61004 - DNA, 25 bp, S. cerevisiae
ttagaaattgccttcgacgttgaaa

SEQ ID NO: 61005 - DNA, 25 bp, S. cerevisiae
ttagtgtatctcaacagcctcgtgg

SEQ ID NO: 61006 - DNA, 25 bp, S. cerevisiae
ttatctgattgctatcctcaacgct

SEQ ID NO: 61007 - DNA, 25 bp, S. cerevisiae
ttagtgatgctttcctcaaattcgg

SEQ ID NO: 61008 - DNA, 25 bp, S. cerevisiae
ttaggctctgttccacatgagaaag

SEQ ID NO: 61009 - DNA, 25 bp, S. cerevisiae
ttactgatagttccatcgcgtatag

SEQ ID NO: 61010 - DNA, 25 bp, S. cerevisiae
ttatgcgttgttcgttgcgtgatat

SEQ ID NO: 61011 - DNA, 25 bp, S. cerevisiae
ttatccattgatggccattcggcag

SEQ ID NO: 61012 - DNA, 25 bp, S. cerevisiae
ttcatcgctctgtgatttcattcag

SEQ ID NO: 61013 - DNA, 25 bp, S. cerevisiae
ttctaagtgatgacgcacacggcgt

SEQ ID NO: 61014 - DNA, 25 bp, S. cerevisiae
ttatctaggatgctgcaccgtggca

SEQ ID NO: 61015 - DNA, 25 bp, S. cerevisiae
ttagggagagatcctcctgcttcat

SEQ ID NO: 61016 - DNA, 25 bp, S. cerevisiae
ttagccgcatataatccagccaaga

SEQ ID NO: 61017 - DNA, 25 bp, S. cerevisiae
ttatctgcgcttggtgcatcaggga

SEQ ID NO: 61018 - DNA, 25 bp, S. cerevisiae
ttgactccttgacatcgttggtagc

SEQ ID NO: 61019 - DNA, 25 bp, S. cerevisiae
ttagccgcttgggacgtcgcagaag

SEQ ID NO: 61020 - DNA, 25 bp, S. cerevisiae
ttaccagcactgagttcccgaatga

SEQ ID NO: 61021 - DNA, 25 bp, S. cerevisiae
ttatcactgataaagctccacccat

SEQ ID NO: 61022 - DNA, 25 bp, S. cerevisiae
ttaccatggcaaagtcacagccgcc

SEQ ID NO: 61023 - DNA, 25 bp, S. cerevisiae
ttacctgacaatggcaacgcatggc

SEQ ID NO: 61024 - DNA, 25 bp, S. cerevisiae
ttaccatccgaggaagcagcttgtt

SEQ ID NO: 61025 - DNA, 25 bp, S. cerevisiae
ttgtcaccaatccaagcgcaaactt

SEQ ID NO: 61026 - DNA, 25 bp, S. cerevisiae
ttgtccctctggcagcaaagtcaaa

SEQ ID NO: 61027 - DNA, 25 bp, S. cerevisiae
ttgtccgacaggttccaagacgcaa

SEQ ID NO: 61028 - DNA, 25 bp, S. cerevisiae
ttatccgagggaatcaaagagctaa

SEQ ID NO: 61029 - DNA, 25 bp, S. cerevisiae
ttatcctagtgtccttaaagcttga

SEQ ID NO: 61030 - DNA, 25 bp, S. cerevisiae
ttaactgtgttcgacaaacccgtat

SEQ ID NO: 61031 - DNA, 25 bp, S. cerevisiae
ttacgtcgtaaccaacgcggtgaag

SEQ ID NO: 61032 - DNA, 25 bp, S. cerevisiae
ttacccgctaacagtcagctggtta

SEQ ID NO: 61033 - DNA, 25 bp, S. cerevisiae
ttgccgccgtttatggtctggttac

SEQ ID NO: 61034 - DNA, 25 bp, S. cerevisiae
ttcccgatatttttggtagccttga

SEQ ID NO: 61035 - DNA, 25 bp, S. cerevisiae
ttcgacgttttcatggaccaggtta

SEQ ID NO: 61036 - DNA, 25 bp, S. cerevisiae
ttggactgctattcaaagtaccatg

SEQ ID NO: 61037 - DNA, 25 bp, S. cerevisiae
ttcgacgctgaaccaagatacaatg

SEQ ID NO: 61038 - DNA, 25 bp, S. cerevisiae
ttagccaagagcttcgtgccataat

SEQ ID NO: 61039 - DNA, 25 bp, S. cerevisiae
ttacacgaagatctttccatgcctc

SEQ ID NO: 61040 - DNA, 25 bp, S. cerevisiae
ttaccactgggcgaagtagcacaac

SEQ ID NO: 61041 - DNA, 25 bp, S. cerevisiae
ttatcgctatatactgttcaggctg

SEQ ID NO: 61042 - DNA, 25 bp, S. cerevisiae
ttcacagtagcatctgttctgccgg

SEQ ID NO: 61043 - DNA, 25 bp, S. cerevisiae
ttcacaacagactattccatccgga

SEQ ID NO: 61044 - DNA, 25 bp, S. cerevisiae
ttacagaggtcactatctctccgga

SEQ ID NO: 61045 - DNA, 25 bp, S. cerevisiae
ttcaagcactggctcatcttcaagc

SEQ ID NO: 61046 - DNA, 25 bp, S. cerevisiae
ttagcgcttatggtacagtgggttt

SEQ ID NO: 61047 - DNA, 25 bp, S. cerevisiae
ttaccccatctaaagtgccgcattg

SEQ ID NO: 61048 - DNA, 25 bp, S. cerevisiae
ttacattcgtttttagattctgcgc

SEQ ID NO: 61049 - DNA, 25 bp, S. cerevisiae
ttatctctgagtcgtatcccttaag

SEQ ID NO: 61050 - DNA, 25 bp, S. cerevisiae
ttatgctatcaaattcacccggctc

SEQ ID NO: 61051 - DNA, 25 bp, S. cerevisiae
ttagctcaacaaacaacactcctgc

SEQ ID NO: 61052 - DNA, 25 bp, S. cerevisiae
ttaccgaaatcaaggactccgcttc

SEQ ID NO: 61053 - DNA, 25 bp, S. cerevisiae
ttagctgctgaaacgactaccaata

SEQ ID NO: 61054 - DNA, 25 bp, S. cerevisiae
ttaggacatgcttttggacccgaca

SEQ ID NO: 61055 - DNA, 25 bp, S. cerevisiae
ttatggctgttagagctacccgaca

SEQ ID NO: 61056 - DNA, 25 bp, S. cerevisiae
ttagtgtttcattgtcaacccgata

SEQ ID NO: 61057 - DNA, 25 bp, S. cerevisiae
ttaggtgcaatactttcgtccgtca

SEQ ID NO: 61058 - DNA, 25 bp, S. cerevisiae
ttactaagatctttcccagccaatg

SEQ ID NO: 61059 - DNA, 25 bp, S. cerevisiae
ttagttatagcttactgccctccat

SEQ ID NO: 61060 - DNA, 25 bp, S. cerevisiae
ttcagattatgtcaagggcctccat

SEQ ID NO: 61061 - DNA, 25 bp, S. cerevisiae
ttagattgattgacacgggcgcatt

SEQ ID NO: 61062 - DNA, 25 bp, S. cerevisiae
ttatgactgcaattcactctcccga

SEQ ID NO: 61063 - DNA, 25 bp, S. cerevisiae
ttatggctcaatcatctaccgcatg

SEQ ID NO: 61064 - DNA, 25 bp, S. cerevisiae
ttagccatcattccacaagatccag

SEQ ID NO: 61065 - DNA, 25 bp, S. cerevisiae
ttaccacgcagcttccgagggaaat

SEQ ID NO: 61066 - DNA, 25 bp, S. cerevisiae
ttacgacgcagctgcttcatgggaa

SEQ ID NO: 61067 - DNA, 25 bp, S. cerevisiae
ttaatgggccgcactgtgggaacca

SEQ ID NO: 61068 - DNA, 25 bp, S. cerevisiae
ttagcgcaatttctttcccatatgg

SEQ ID NO: 61069 - DNA, 25 bp, S. cerevisiae
ttaggcaatattgatcattccgatg

SEQ ID NO: 61070 - DNA, 25 bp, S. cerevisiae
ttcagtcctaaccatattgcatcgg

SEQ ID NO: 61071 - DNA, 25 bp, S. cerevisiae
ttaccaaaacgtcctcacggtgatg

SEQ ID NO: 61072 - DNA, 25 bp, S. cerevisiae
ttaaaacacagcctccaacgggtgt

SEQ ID NO: 61073 - DNA, 25 bp, S. cerevisiae
ttaaaatcaaagagcccggcgtctg

SEQ ID NO: 61074 - DNA, 25 bp, S. cerevisiae
ttatgaagtctcttttcccgatgac

SEQ ID NO: 61075 - DNA, 25 bp, S. cerevisiae
ttaacggtcaacgacgacagcacta

SEQ ID NO: 61076 - DNA, 25 bp, S. cerevisiae
ttagcccagctaaataatgtcaaat

SEQ ID NO: 61077 - DNA, 25 bp, S. cerevisiae
ttatcccagcattcgaaccatcaag

SEQ ID NO: 61078 - DNA, 25 bp, S. cerevisiae
ttaaccagtacgtcacccaaatcga

SEQ ID NO: 61079 - DNA, 25 bp, S. cerevisiae
ttaccgccttcactagacgaactga

SEQ ID NO: 61080 - DNA, 25 bp, S. cerevisiae
ttacctcctataccgaccagagatg

SEQ ID NO: 61081 - DNA, 25 bp, S. cerevisiae
ttacgtcgcattatgggccaagttt

SEQ ID NO: 61082 - DNA, 25 bp, S. cerevisiae
ttaggacgcttttttggctcatggt

SEQ ID NO: 61083 - DNA, 25 bp, S. cerevisiae
ttcaggcttgctaaaatgacgttcc

SEQ ID NO: 61084 - DNA, 25 bp, S. cerevisiae
ttatccatggatttcctcactgcat

SEQ ID NO: 61085 - DNA, 25 bp, S. cerevisiae
ttatccaggtgtattttgcgtgcga

SEQ ID NO: 61086 - DNA, 25 bp, S. cerevisiae
ttaaccacgtcaggcccattgatga

SEQ ID NO: 61087 - DNA, 25 bp, S. cerevisiae
ttaccgcagttaacactgtcacgtt

SEQ ID NO: 61088 - DNA, 25 bp, S. cerevisiae
ttaacaggttcagacgcgactgcct

SEQ ID NO: 61089 - DNA, 25 bp, S. cerevisiae
ttagaaagcttcacggctgaccctg

SEQ ID NO: 61090 - DNA, 25 bp, S. cerevisiae
ttagtgcggctgacattgttcctat

SEQ ID NO: 61091 - DNA, 25 bp, S. cerevisiae
ttagccatggatccaggagtttcac

SEQ ID NO: 61092 - DNA, 25 bp, S. cerevisiae
ttagctgcatgtacggagcgttctc

SEQ ID NO: 61093 - DNA, 25 bp, S. cerevisiae
ttctctggcattttagtgatagttc

SEQ ID NO: 61094 - DNA, 25 bp, S. cerevisiae
ttaaatgctactcaccaagaccact

SEQ ID NO: 61095 - DNA, 25 bp, S. cerevisiae
ttaacgtcaccaatgatagctgatg

SEQ ID NO: 61096 - DNA, 25 bp, S. cerevisiae
ttaggtgccgtactatcgcgtgcca

SEQ ID NO: 61097 - DNA, 25 bp, S. cerevisiae
ttacgtcaattcgtgatgccttctc

SEQ ID NO: 61098 - DNA, 25 bp, S. cerevisiae
ttaactttcaccattccatccaata

SEQ ID NO: 61099 - DNA, 25 bp, S. cerevisiae
ttagaagacactccacccaagtttg

SEQ ID NO: 61100 - DNA, 25 bp, S. cerevisiae
ttagaagacatttcatgcccatcgt

SEQ ID NO: 61101 - DNA, 25 bp, S. cerevisiae
ttcaaagaagttgccgccgtcccaa

SEQ ID NO: 61102 - DNA, 25 bp, S. cerevisiae
ttaactctacaaagccaacggtctt

SEQ ID NO: 61103 - DNA, 25 bp, S. cerevisiae
ttacaatctcaacctcttaccaaaa

SEQ ID NO: 61104 - DNA, 25 bp, S. cerevisiae
ttcactggacccttggaacagcaat

SEQ ID NO: 61105 - DNA, 25 bp, S. cerevisiae
ttagtgccccagttgcagacaaata

SEQ ID NO: 61106 - DNA, 25 bp, S. cerevisiae
ttggccctcacgtggataaataaca

SEQ ID NO: 61107 - DNA, 25 bp, S. cerevisiae
ttagccgcttcgtctgatgtagaaa

SEQ ID NO: 61108 - DNA, 25 bp, S. cerevisiae
ttagacctgccctttgtacaaagtg

SEQ ID NO: 61109 - DNA, 25 bp, S. cerevisiae
ttagaccccatcgttaacaaagctc

SEQ ID NO: 61110 - DNA, 25 bp, S. cerevisiae
ttaacgatcctggtttcacaaacac

SEQ ID NO: 61111 - DNA, 25 bp, S. cerevisiae
ttaacttctctgttttcccaggtca

SEQ ID NO: 61112 - DNA, 25 bp, S. cerevisiae
ttaacttgggttgtgctactggtca

SEQ ID NO: 61113 - DNA, 25 bp, S. cerevisiae
ttactgttgaggacagccaccgcga

SEQ ID NO: 61114 - DNA, 25 bp, S. cerevisiae
ttaacgcggctggttctcaaggaac

SEQ ID NO: 61115 - DNA, 25 bp, S. cerevisiae
ttacctcccggtacgaaagatcaca

SEQ ID NO: 61116 - DNA, 25 bp, S. cerevisiae
ttgtacccaccacatatattcgcat

SEQ ID NO: 61117 - DNA, 25 bp, S. cerevisiae
ttacagaactcgctgatcgggctgc

SEQ ID NO: 61118 - DNA, 25 bp, S. cerevisiae
ttacctcttttggagatgacacaca

SEQ ID NO: 61119 - DNA, 25 bp, S. cerevisiae
ttacacctgatttagaagatcctag

SEQ ID NO: 61120 - DNA, 25 bp, S. cerevisiae
ttaacccttttgaagatgcctgaag

SEQ ID NO: 61121 - DNA, 25 bp, S. cerevisiae
ttaataccggtataggccagcaaga

SEQ ID NO: 61122 - DNA, 25 bp, S. cerevisiae
ttacaaacgccaatgaagaccaaat

SEQ ID NO: 61123 - DNA, 25 bp, S. cerevisiae
ttagacaactctacgaaacacaaga

SEQ ID NO: 61124 - DNA, 25 bp, S. cerevisiae
ttagacgacttaaccgcacaacaga

SEQ ID NO: 61125 - DNA, 25 bp, S. cerevisiae
ttagtcaactgtatcctcagcacgc

SEQ ID NO: 61126 - DNA, 25 bp, S. cerevisiae
ttaccagaagatgctccagaagatg

SEQ ID NO: 61127 - DNA, 25 bp, S. cerevisiae
ttagaagggtgcctttgccacctat

SEQ ID NO: 61128 - DNA, 25 bp, S. cerevisiae
ttaacaagggcattggtccgccaat

SEQ ID NO: 61129 - DNA, 25 bp, S. cerevisiae
ttgaacgacttgttggttggccaaa

SEQ ID NO: 61130 - DNA, 25 bp, S. cerevisiae
ttaccgatcgtgtggttcattacaa

SEQ ID NO: 61131 - DNA, 25 bp, S. cerevisiae
ttagaatcccatacagctcctgttg

SEQ ID NO: 61132 - DNA, 25 bp, S. cerevisiae
ttaggacaccaaacatcgctcatta

SEQ ID NO: 61133 - DNA, 25 bp, S. cerevisiae
ttaggtgacatggttatggccactg

SEQ ID NO: 61134 - DNA, 25 bp, S. cerevisiae
ttaggatactgctttttgcctctgt

SEQ ID NO: 61135 - DNA, 25 bp, S. cerevisiae
ttaccatattgttctactgctcctg

SEQ ID NO: 61136 - DNA, 25 bp, S. cerevisiae
ttacctgttctgattggctagctgc

SEQ ID NO: 61137 - DNA, 25 bp, S. cerevisiae
ttagggcttctgtatctcctagttc

SEQ ID NO: 61138 - DNA, 25 bp, S. cerevisiae
ttgccaaatttgtatccccacggta

SEQ ID NO: 61139 - DNA, 25 bp, S. cerevisiae
ttggctagaggacagtacccgtgtt

SEQ ID NO: 61140 - DNA, 25 bp, S. cerevisiae
ttacaagacgacgactacgacgatg

SEQ ID NO: 61141 - DNA, 25 bp, S. cerevisiae
ttaaagactaccactcggccatgag

SEQ ID NO: 61142 - DNA, 25 bp, S. cerevisiae
ttaaaatatgccaacccggcgtcga

SEQ ID NO: 61143 - DNA, 25 bp, S. cerevisiae
ttgattatttatttcctattggtcg

SEQ ID NO: 61144 - DNA, 25 bp, S. cerevisiae
ttgacaccttctgccggttgggaat

SEQ ID NO: 61145 - DNA, 25 bp, S. cerevisiae
ttacgccgccttgattttggctgac

SEQ ID NO: 61146 - DNA, 25 bp, S. cerevisiae
ttacaggtcctaaactttgatccag

SEQ ID NO: 61147 - DNA, 25 bp, S. cerevisiae
ttaccaatcccaaatgctcgttact

SEQ ID NO: 61148 - DNA, 25 bp, S. cerevisiae
ttacgcgtccgattatgccagttac

SEQ ID NO: 61149 - DNA, 25 bp, S. cerevisiae
ttacgtttaaacatcgacctcgaca

SEQ ID NO: 61150 - DNA, 25 bp, S. cerevisiae
ttaccttctagaaactcgatcccag

SEQ ID NO: 61151 - DNA, 25 bp, S. cerevisiae
ttaccgacttatgacatggccacca

SEQ ID NO: 61152 - DNA, 25 bp, S. cerevisiae
ttaagaccttttgcggaatccaacg

SEQ ID NO: 61153 - DNA, 25 bp, S. cerevisiae
ttaaataatctaagttacctgatac

SEQ ID NO: 61154 - DNA, 25 bp, S. cerevisiae
ttaaatttctttaatgatccttccg

SEQ ID NO: 61155 - DNA, 25 bp, S. cerevisiae
ttcaacaagtagtttccccattctc

SEQ ID NO: 61156 - DNA, 25 bp, S. cerevisiae
ttaaccagactgtttcccaatccag

SEQ ID NO: 61157 - DNA, 25 bp, S. cerevisiae
ttaacgtaccatattctgaacacag

SEQ ID NO: 61158 - DNA, 25 bp, S. cerevisiae
ttacccttctaatttgccaatccaa

SEQ ID NO: 61159 - DNA, 25 bp, S. cerevisiae
ttgaccttgttatttttccccaatg

SEQ ID NO: 61160 - DNA, 25 bp, S. cerevisiae
ttcaccagaggttattttcccgaag

SEQ ID NO: 61161 - DNA, 25 bp, S. cerevisiae
ttaccgagtgcttgatttctcctga

SEQ ID NO: 61162 - DNA, 25 bp, S. cerevisiae
ttctgccggcagtggattaggagta

SEQ ID NO: 61163 - DNA, 25 bp, S. cerevisiae
ttcggcagcgacatggttagggtcc

SEQ ID NO: 61164 - DNA, 25 bp, S. cerevisiae
ttcccaaacatttgacgacggtccg

SEQ ID NO: 61165 - DNA, 25 bp, S. cerevisiae
ttcccaaaatttctaagccgcgtcg

SEQ ID NO: 61166 - DNA, 25 bp, S. cerevisiae
ttcaaaaaatttatatgcgccggtt

SEQ ID NO: 61167 - DNA, 25 bp, S. cerevisiae
ttcaaaaactggtctacatttcggt

SEQ ID NO: 61168 - DNA, 25 bp, S. cerevisiae
ttacaacaacgcatcaaattcccct

SEQ ID NO: 61169 - DNA, 25 bp, S. cerevisiae
ttaagacagcctctttattgccacc

SEQ ID NO: 61170 - DNA, 25 bp, S. cerevisiae
ttaagcaccaccactaattccaaaa

SEQ ID NO: 61171 - DNA, 25 bp, S. cerevisiae
ttacggcctgcgagatgtgatgtgt

SEQ ID NO: 61172 - DNA, 25 bp, S. cerevisiae
ttcaggccatctaatccgacgtttg

SEQ ID NO: 61173 - DNA, 25 bp, S. cerevisiae
ttaggctccaggtccaacatgttat

SEQ ID NO: 61174 - DNA, 25 bp, S. cerevisiae
ttaccatacagcgtccaaacattat

SEQ ID NO: 61175 - DNA, 25 bp, S. cerevisiae
ttgtcaagaacagtccatgggtcgt

SEQ ID NO: 61176 - DNA, 25 bp, S. cerevisiae
ttgctcaagtcaaaccagggttccc

SEQ ID NO: 61177 - DNA, 25 bp, S. cerevisiae
ttgccgaaacaaacgtggtctacta

SEQ ID NO: 61178 - DNA, 25 bp, S. cerevisiae
ttgggataccagaacgtccttgcct

SEQ ID NO: 61179 - DNA, 25 bp, S. cerevisiae
ttaagcgtaagaccacacattcccg

SEQ ID NO: 61180 - DNA, 25 bp, S. cerevisiae
ttagacgaaatgaccaccttgcgaa

SEQ ID NO: 61181 - DNA, 25 bp, S. cerevisiae
ttaactgccggtgccattgctggta

SEQ ID NO: 61182 - DNA, 25 bp, S. cerevisiae
ttaagctctgctggtgtcaattcgg

SEQ ID NO: 61183 - DNA, 25 bp, S. cerevisiae
ttaattcatgacaggccagctccat

SEQ ID NO: 61184 - DNA, 25 bp, S. cerevisiae
ttacccctaattacgacatgctcta

SEQ ID NO: 61185 - DNA, 25 bp, S. cerevisiae
ttacctgtcacatccgaagatcttc

SEQ ID NO: 61186 - DNA, 25 bp, S. cerevisiae
ttacgttccaagaaaatgttctgct

SEQ ID NO: 61187 - DNA, 25 bp, S. cerevisiae
ttccgggtggtttcattttcaatat

SEQ ID NO: 61188 - DNA, 25 bp, S. cerevisiae
ttccggtgacttcagctttctagct

SEQ ID NO: 61189 - DNA, 25 bp, S. cerevisiae
ttaccagccgcctctttaggtgaca

SEQ ID NO: 61190 - DNA, 25 bp, S. cerevisiae
ttacccactcctgttctagaagatg

SEQ ID NO: 61191 - DNA, 25 bp, S. cerevisiae
ttaaattacgctcttcttctttggc

SEQ ID NO: 61192 - DNA, 25 bp, S. cerevisiae
ttacccttggacaataacctcagcg

SEQ ID NO: 61193 - DNA, 25 bp, S. cerevisiae
ttacccacgtgatcaaagactcctg

SEQ ID NO: 61194 - DNA, 25 bp, S. cerevisiae
ttaccctcgctttaatagatgccgg

SEQ ID NO: 61195 - DNA, 25 bp, S. cerevisiae
ttaccgctggtactgaaaatgatga

SEQ ID NO: 61196 - DNA, 25 bp, S. cerevisiae
ttacgccagtttcccctaacatgtt

SEQ ID NO: 61197 - DNA, 25 bp, S. cerevisiae
ttagcttccggtcctaatcttcgtg

SEQ ID NO: 61198 - DNA, 25 bp, S. cerevisiae
ttggtgccaccgacgtcattttcgt

SEQ ID NO: 61199 - DNA, 25 bp, S. cerevisiae
ttagcataccctgcagtttattctg

SEQ ID NO: 61200 - DNA, 25 bp, S. cerevisiae
ttagctgcactcaaagatcctcaag

SEQ ID NO: 61201 - DNA, 25 bp, S. cerevisiae
ttagctcgttgatcgcttcaagcca

SEQ ID NO: 61202 - DNA, 25 bp, S. cerevisiae
ttaccagatggcacgttagatccag

SEQ ID NO: 61203 - DNA, 25 bp, S. cerevisiae
ttaccagatggttcctttgaggact

SEQ ID NO: 61204 - DNA, 25 bp, S. cerevisiae
ttagatcccgaagtcattgagtcat

SEQ ID NO: 61205 - DNA, 25 bp, S. cerevisiae
ttacagcaccaaaacagccctataa

SEQ ID NO: 61206 - DNA, 25 bp, S. cerevisiae
ttaactctctgcagccgactacgag

SEQ ID NO: 61207 - DNA, 25 bp, S. cerevisiae
ttacagaccctattaggagcccggc

SEQ ID NO: 61208 - DNA, 25 bp, S. cerevisiae
ttctagacgagtgcaagttgggacc

SEQ ID NO: 61209 - DNA, 25 bp, S. cerevisiae
ttagcgacttcaatggcgccattat

SEQ ID NO: 61210 - DNA, 25 bp, S. cerevisiae
ttactatcgaattctctactaacgt

SEQ ID NO: 61211 - DNA, 25 bp, S. cerevisiae
ttcaccgcggttttcagagacaaat

SEQ ID NO: 61212 - DNA, 25 bp, S. cerevisiae
ttagcccgtatatgtcacccagaag

SEQ ID NO: 61213 - DNA, 25 bp, S. cerevisiae
ttacccactattttctcccaagatt

SEQ ID NO: 61214 - DNA, 25 bp, S. cerevisiae
ttagcccaatactacatgttccaag

SEQ ID NO: 61215 - DNA, 25 bp, S. cerevisiae
ttcgccaaaacccaggacgcatagc

SEQ ID NO: 61216 - DNA, 25 bp, S. cerevisiae
ttaaacttacaattggcccaggctg

SEQ ID NO: 61217 - DNA, 25 bp, S. cerevisiae
ttaatgactctatagctaccggcca

SEQ ID NO: 61218 - DNA, 25 bp, S. cerevisiae
ttaagcaaagtactgccaccggcac

SEQ ID NO: 61219 - DNA, 25 bp, S. cerevisiae
ttactagccttgtctgggttgtcat

SEQ ID NO: 61220 - DNA, 25 bp, S. cerevisiae
ttacaagggtgttttgagcgtcatt

SEQ ID NO: 61221 - DNA, 25 bp, S. cerevisiae
ttagctgctccagtcaacactacaa

SEQ ID NO: 61222 - DNA, 25 bp, S. cerevisiae
ttagctgccatagtctctactgtca

SEQ ID NO: 61223 - DNA, 25 bp, S. cerevisiae
ttactgcacaagtccgtgttcaggg

SEQ ID NO: 61224 - DNA, 25 bp, S. cerevisiae
ttaagccgtttccttctgcaggcag

SEQ ID NO: 61225 - DNA, 25 bp, S. cerevisiae
ttacgtgggttcagcacttgcgtat

SEQ ID NO: 61226 - DNA, 25 bp, S. cerevisiae
ttaagcagacacagcacccttggta

SEQ ID NO: 61227 - DNA, 25 bp, S. cerevisiae
ttaaaaacttgaggcgtgtagctaa

SEQ ID NO: 61228 - DNA, 25 bp, S. cerevisiae
ttcaaggtggttcccgcttcaaaca

SEQ ID NO: 61229 - DNA, 25 bp, S. cerevisiae
ttaaacctgtttccctcaaagcctg

SEQ ID NO: 61230 - DNA, 25 bp, S. cerevisiae
ttacaagttttaccaccacaatcct

SEQ ID NO: 61231 - DNA, 25 bp, S. cerevisiae
ttagcaacgacgacattccccagat

SEQ ID NO: 61232 - DNA, 25 bp, S. cerevisiae
ttacaaaacgtatcctcctcttcat

SEQ ID NO: 61233 - DNA, 25 bp, S. cerevisiae
ttacttaattgtccaccacccttat

SEQ ID NO: 61234 - DNA, 25 bp, S. cerevisiae
ttgacgtcatattgatcgccgaccc

SEQ ID NO: 61235 - DNA, 25 bp, S. cerevisiae
ttagctgtcaaattggccaacccaa

SEQ ID NO: 61236 - DNA, 25 bp, S. cerevisiae
ttacgtcacaactcacaattcacca

SEQ ID NO: 61237 - DNA, 25 bp, S. cerevisiae
ttagcgtccaaatctgccaacacca

SEQ ID NO: 61238 - DNA, 25 bp, S. cerevisiae
ttacgctcaaaatcgctgccaacaa

SEQ ID NO: 61239 - DNA, 25 bp, S. cerevisiae
ttaccccagaatacgcagcagagaa

SEQ ID NO: 61240 - DNA, 25 bp, S. cerevisiae
ttaccgctaaataccacgcatcaag

SEQ ID NO: 61241 - DNA, 25 bp, S. cerevisiae
ttaacgccattttagcaactcaagt

SEQ ID NO: 61242 - DNA, 25 bp, S. cerevisiae
ttaatacctactcgacaactgcaga

SEQ ID NO: 61243 - DNA, 25 bp, S. cerevisiae
ttcaatacgtcactggtacctccaa

SEQ ID NO: 61244 - DNA, 25 bp, S. cerevisiae
ttgatttctattccaacactttgag

SEQ ID NO: 61245 - DNA, 25 bp, S. cerevisiae
ttgcatttgaactaaacccttggag

SEQ ID NO: 61246 - DNA, 25 bp, S. cerevisiae
ttcaattccgaagaaccgtcaacat

SEQ ID NO: 61247 - DNA, 25 bp, S. cerevisiae
ttaactccccaggaatccgagaaga

SEQ ID NO: 61248 - DNA, 25 bp, S. cerevisiae
ttgaagaactcctacggcgtattcc

SEQ ID NO: 61249 - DNA, 25 bp, S. cerevisiae
ttgaagtactccaaacctgctttgc

SEQ ID NO: 61250 - DNA, 25 bp, S. cerevisiae
ttaccctcctcatattatcgctgtt

SEQ ID NO: 61251 - DNA, 25 bp, S. cerevisiae
ttaagcacacccttgcagtttaaaa

SEQ ID NO: 61252 - DNA, 25 bp, S. cerevisiae
ttaagagaccatccagtgcgtgtaa

SEQ ID NO: 61253 - DNA, 25 bp, S. cerevisiae
ttacaatgctcaaagccacaccttt

SEQ ID NO: 61254 - DNA, 25 bp, S. cerevisiae
ttctcaagctagaacggcaactttg

SEQ ID NO: 61255 - DNA, 25 bp, S. cerevisiae
ttacgagtgagccaccagcagatat

SEQ ID NO: 61256 - DNA, 25 bp, S. cerevisiae
ttacgatgctgacgccatagaccat

SEQ ID NO: 61257 - DNA, 25 bp, S. cerevisiae
ttactttggcatgctttatctccgt

SEQ ID NO: 61258 - DNA, 25 bp, S. cerevisiae
ttctgttggatttgtgagggcccct

SEQ ID NO: 61259 - DNA, 25 bp, S. cerevisiae
ttcatttggattttgccggtacctc

SEQ ID NO: 61260 - DNA, 25 bp, S. cerevisiae
ttactttataacctcgatctttctg

SEQ ID NO: 61261 - DNA, 25 bp, S. cerevisiae
ttacccaatcaacctcttcatattc

SEQ ID NO: 61262 - DNA, 25 bp, S. cerevisiae
ttcccttccaagcactatttcaaac

SEQ ID NO: 61263 - DNA, 25 bp, S. cerevisiae
ttagcacacttatttattattacaa

SEQ ID NO: 61264 - DNA, 25 bp, S. cerevisiae
ttaccagttggtgctatcatgaact

SEQ ID NO: 61265 - DNA, 25 bp, S. cerevisiae
ttacttgttggtgatgtctctctct

SEQ ID NO: 61266 - DNA, 25 bp, S. cerevisiae
ttacctctcagggaatgtctcagtt

SEQ ID NO: 61267 - DNA, 25 bp, S. cerevisiae
ttacgctgctaaccacagattcagt

SEQ ID NO: 61268 - DNA, 25 bp, S. cerevisiae
ttaagccaagatacaccattagcgt

SEQ ID NO: 61269 - DNA, 25 bp, S. cerevisiae
ttaagaaatggaccgcagtggcgtt

SEQ ID NO: 61270 - DNA, 25 bp, S. cerevisiae
ttaaatgctgcagtcgctctctcaa

SEQ ID NO: 61271 - DNA, 25 bp, S. cerevisiae
ttcataatctcagtgctctcagcat

SEQ ID NO: 61272 - DNA, 25 bp, S. cerevisiae
ttcatctgaatctagctctgctgca

SEQ ID NO: 61273 - DNA, 25 bp, S. cerevisiae
ttctcctctatgcacactacagcaa

SEQ ID NO: 61274 - DNA, 25 bp, S. cerevisiae
ttcccctctggtctaagaatcggta

SEQ ID NO: 61275 - DNA, 25 bp, S. cerevisiae
ttacctgttcgtcgtaaggcttact

SEQ ID NO: 61276 - DNA, 25 bp, S. cerevisiae
ttcaacgttttcgaagaggcacctg

SEQ ID NO: 61277 - DNA, 25 bp, S. cerevisiae
ttaatcgtattctcacaagggctgt

SEQ ID NO: 61278 - DNA, 25 bp, S. cerevisiae
ttaatcgtcttttccaagggccaat

SEQ ID NO: 61279 - DNA, 25 bp, S. cerevisiae
ttaaccttcctgtccaagtggagaa

SEQ ID NO: 61280 - DNA, 25 bp, S. cerevisiae
ttaacgcgatcacctggctcgaatc

SEQ ID NO: 61281 - DNA, 25 bp, S. cerevisiae
ttaacagtaacggatgcacatctag

SEQ ID NO: 61282 - DNA, 25 bp, S. cerevisiae
ttcttaaaacaggacctctggccgg

SEQ ID NO: 61283 - DNA, 25 bp, S. cerevisiae
ttaactgctgaatgtactcctccta

SEQ ID NO: 61284 - DNA, 25 bp, S. cerevisiae
ttagccttgaagtttccctccagaa

SEQ ID NO: 61285 - DNA, 25 bp, S. cerevisiae
ttagcgttgattctgaacctctgtc

SEQ ID NO: 61286 - DNA, 25 bp, S. cerevisiae
ttacgtctgcctatcaaactttctt

SEQ ID NO: 61287 - DNA, 25 bp, S. cerevisiae
ttaccacgccagcattcacgagaaa

SEQ ID NO: 61288 - DNA, 25 bp, S. cerevisiae
ttactagcgccatactcaccagaga

SEQ ID NO: 61289 - DNA, 25 bp, S. cerevisiae
ttcactcagggttgcaccatcacag

SEQ ID NO: 61290 - DNA, 25 bp, S. cerevisiae
ttacatgccgatgctatccacagag

SEQ ID NO: 61291 - DNA, 25 bp, S. cerevisiae
ttacacacgcaccatcatacaagtt

SEQ ID NO: 61292 - DNA, 25 bp, S. cerevisiae
ttaccagcaccacatcacatattat

SEQ ID NO: 61293 - DNA, 25 bp, S. cerevisiae
ttacccataaattccatgattatct

SEQ ID NO: 61294 - DNA, 25 bp, S. cerevisiae
ttacctctatactcctattgatgcc

SEQ ID NO: 61295 - DNA, 25 bp, S. cerevisiae
ttactgtgtttctaccattttgcga

SEQ ID NO: 61296 - DNA, 25 bp, S. cerevisiae
ttactatgctcaccaaacagtttgc

SEQ ID NO: 61297 - DNA, 25 bp, S. cerevisiae
ttaccttcgtttcccatcttatata

SEQ ID NO: 61298 - DNA, 25 bp, S. cerevisiae
ttacttgagtgtttcccctgtggaa

SEQ ID NO: 61299 - DNA, 25 bp, S. cerevisiae
ttactgtcacgttctgtacttggcg

SEQ ID NO: 61300 - DNA, 25 bp, S. cerevisiae
ttcagcctacccatttttacattta

SEQ ID NO: 61301 - DNA, 25 bp, S. cerevisiae
ttctcaatattgcaccttctttctt

SEQ ID NO: 61302 - DNA, 25 bp, S. cerevisiae
ttacaaatgctctccaattccgtat

SEQ ID NO: 61303 - DNA, 25 bp, S. cerevisiae
ttaagagagctgatcctcacttccc

SEQ ID NO: 61304 - DNA, 25 bp, S. cerevisiae
ttacaataattaccaccaccgtgag

SEQ ID NO: 61305 - DNA, 25 bp, S. cerevisiae
ttggacaaggttacccatcgtcggt

SEQ ID NO: 61306 - DNA, 25 bp, S. cerevisiae
ttgaaccacgataaccctggttggt

SEQ ID NO: 61307 - DNA, 25 bp, S. cerevisiae
ttactctctgaagcaaactcgtttg

SEQ ID NO: 61308 - DNA, 25 bp, S. cerevisiae
ttcactccaaacaaaaggcgtttat

SEQ ID NO: 61309 - DNA, 25 bp, S. cerevisiae
ttcggcactaacacaacgcggtttg

SEQ ID NO: 61310 - DNA, 25 bp, S. cerevisiae
ttacaagaattggtcacaggcgaaa

SEQ ID NO: 61311 - DNA, 25 bp, S. cerevisiae
ttacgaacagtttgctcatgagcta

SEQ ID NO: 61312 - DNA, 25 bp, S. cerevisiae
ttcagcagaatccttggccaagcgt

SEQ ID NO: 61313 - DNA, 25 bp, S. cerevisiae
ttaatgggctgtatccgagcgtagc

SEQ ID NO: 61314 - DNA, 25 bp, S. cerevisiae
ttaagtgtggatgtcgtcagttgcg

SEQ ID NO: 61315 - DNA, 25 bp, S. cerevisiae
ttaaccattcagcacatcgcagcgg

SEQ ID NO: 61316 - DNA, 25 bp, S. cerevisiae
ttaccactttggattcactgattta

SEQ ID NO: 61317 - DNA, 25 bp, S. cerevisiae
ttaaacatacatcctattccttccg

SEQ ID NO: 61318 - DNA, 25 bp, S. cerevisiae
ttaaatcaccgacttctaccaacca

SEQ ID NO: 61319 - DNA, 25 bp, S. cerevisiae
ttaagtcccgactctgaagaccgct

SEQ ID NO: 61320 - DNA, 25 bp, S. cerevisiae
ttaacgtcatggcagattctcaagg

SEQ ID NO: 61321 - DNA, 25 bp, S. cerevisiae
ttaacattgcttcagtcctcggaga

SEQ ID NO: 61322 - DNA, 25 bp, S. cerevisiae
ttaaccgcaccactaacagaagatt

SEQ ID NO: 61323 - DNA, 25 bp, S. cerevisiae
ttaaaccattctttcgcgacaatat

SEQ ID NO: 61324 - DNA, 25 bp, S. cerevisiae
ttacgttcgattttgagcgacgcga

SEQ ID NO: 61325 - DNA, 25 bp, S. cerevisiae
ttcagtttcattggaggacctcgag

SEQ ID NO: 61326 - DNA, 25 bp, S. cerevisiae
ttctttgtagttgatgacgtcggac

SEQ ID NO: 61327 - DNA, 25 bp, S. cerevisiae
ttctttgattttggctgacgacagt

SEQ ID NO: 61328 - DNA, 25 bp, S. cerevisiae
ttctcttttttacctcaacagagga

SEQ ID NO: 61329 - DNA, 25 bp, S. cerevisiae
ttcatcgattttaatgcctccgcag

SEQ ID NO: 61330 - DNA, 25 bp, S. cerevisiae
ttacattgttgtagcgttccgcgag

SEQ ID NO: 61331 - DNA, 25 bp, S. cerevisiae
ttcacattcattttgcagacgtagc

SEQ ID NO: 61332 - DNA, 25 bp, S. cerevisiae
ttacacagcagttacatgggttcct

SEQ ID NO: 61333 - DNA, 25 bp, S. cerevisiae
ttaacaagttaaccagctctccagt

SEQ ID NO: 61334 - DNA, 25 bp, S. cerevisiae
ttgaattatgaagacctgcccaccg

SEQ ID NO: 61335 - DNA, 25 bp, S. cerevisiae
ttcacagggacttttgtcagccacg

SEQ ID NO: 61336 - DNA, 25 bp, S. cerevisiae
ttactgggcatttgtattcgctctc

SEQ ID NO: 61337 - DNA, 25 bp, S. cerevisiae
ttcactgggcctcgttctactacca

SEQ ID NO: 61338 - DNA, 25 bp, S. cerevisiae
ttcctggtgacttggaccctgaaaa

SEQ ID NO: 61339 - DNA, 25 bp, S. cerevisiae
ttacggttcacattgcagacatttt

SEQ ID NO: 61340 - DNA, 25 bp, S. cerevisiae
ttacggtgctcttttcaacaatcct

SEQ ID NO: 61341 - DNA, 25 bp, S. cerevisiae
ttaatgggcgccttccaaaaacatt

SEQ ID NO: 61342 - DNA, 25 bp, S. cerevisiae
ttacaaagcgccttgctcaggagac

SEQ ID NO: 61343 - DNA, 25 bp, S. cerevisiae
ttaaagatgccctaccatcagtcac

SEQ ID NO: 61344 - DNA, 25 bp, S. cerevisiae
ttcaagtgttctttcgccacaacat

SEQ ID NO: 61345 - DNA, 25 bp, S. cerevisiae
ttaagataccgacgcaacccacagt

SEQ ID NO: 61346 - DNA, 25 bp, S. cerevisiae
ttaagaacccaattaccgatcacct

SEQ ID NO: 61347 - DNA, 25 bp, S. cerevisiae
ttaatgagacccacttcactgtcac

SEQ ID NO: 61348 - DNA, 25 bp, S. cerevisiae
ttacgcttcgccagaacttctaaga

SEQ ID NO: 61349 - DNA, 25 bp, S. cerevisiae
ttaccttcacgataatgcttccaaa

SEQ ID NO: 61350 - DNA, 25 bp, S. cerevisiae
ttacgcaacttttcatccgagtcta

SEQ ID NO: 61351 - DNA, 25 bp, S. cerevisiae
ttacgctactggtttgttgatcgcc

SEQ ID NO: 61352 - DNA, 25 bp, S. cerevisiae
ttcacctaccctgcatttatgttga

SEQ ID NO: 61353 - DNA, 25 bp, S. cerevisiae
ttaaggcggttcaccagtttaagtg

SEQ ID NO: 61354 - DNA, 25 bp, S. cerevisiae
ttaataggagatgacccagcggtaa

SEQ ID NO: 61355 - DNA, 25 bp, S. cerevisiae
ttaatcccagattatccgcagccgt

SEQ ID NO: 61356 - DNA, 25 bp, S. cerevisiae
ttacttcctgtttgctgtggccaga

SEQ ID NO: 61357 - DNA, 25 bp, S. cerevisiae
ttacatctacctttactctcgctgt

SEQ ID NO: 61358 - DNA, 25 bp, S. cerevisiae
ttaacgcacgtttacagattttcca

SEQ ID NO: 61359 - DNA, 25 bp, S. cerevisiae
ttacaggatgataggtggcgcactt

SEQ ID NO: 61360 - DNA, 25 bp, S. cerevisiae
ttaagacttctggatgctgctgccc

SEQ ID NO: 61361 - DNA, 25 bp, S. cerevisiae
ttaagatcatattctcagcccgcat

SEQ ID NO: 61362 - DNA, 25 bp, S. cerevisiae
ttcagatgatctacctatggccggc

SEQ ID NO: 61363 - DNA, 25 bp, S. cerevisiae
ttacctccgccgcattatgagaata

SEQ ID NO: 61364 - DNA, 25 bp, S. cerevisiae
ttcactctcccacgaaattgacgat

SEQ ID NO: 61365 - DNA, 25 bp, S. cerevisiae
ttactacttggacccagaagctgcc

SEQ ID NO: 61366 - DNA, 25 bp, S. cerevisiae
ttacttactaggtgcgaatgcgcca

SEQ ID NO: 61367 - DNA, 25 bp, S. cerevisiae
ttacttattcaactggtgggagcaa

SEQ ID NO: 61368 - DNA, 25 bp, S. cerevisiae
ttacattacgacttggctgccgaac

SEQ ID NO: 61369 - DNA, 25 bp, S. cerevisiae
ttcaatgcctggatatggtaccgat

SEQ ID NO: 61370 - DNA, 25 bp, S. cerevisiae
ttcacaggcgaagttggcgtcacta

SEQ ID NO: 61371 - DNA, 25 bp, S. cerevisiae
ttctcccgaggttagcagctcgata

SEQ ID NO: 61372 - DNA, 25 bp, S. cerevisiae
ttacacctgggtcaagctggaactt

SEQ ID NO: 61373 - DNA, 25 bp, S. cerevisiae
ttgaacctggtgtggatgtcgaagt

SEQ ID NO: 61374 - DNA, 25 bp, S. cerevisiae
ttaacccctcatatcatctcaaaga

SEQ ID NO: 61375 - DNA, 25 bp, S. cerevisiae
ttacaccacttctatacattccaaa

SEQ ID NO: 61376 - DNA, 25 bp, S. cerevisiae
ttacacaactaaccctatcgcaggt

SEQ ID NO: 61377 - DNA, 25 bp, S. cerevisiae
ttccaatcaatcagccgtaagaggt

SEQ ID NO: 61378 - DNA, 25 bp, S. cerevisiae
ttctacataagatccgttgcaacgg

SEQ ID NO: 61379 - DNA, 25 bp, S. cerevisiae
ttacaagaaaggtgctgcttccaac

SEQ ID NO: 61380 - DNA, 25 bp, S. cerevisiae
ttaaaagctggtggcgcttctggta

SEQ ID NO: 61381 - DNA, 25 bp, S. cerevisiae
ttaagagattggttggccccattaa

SEQ ID NO: 61382 - DNA, 25 bp, S. cerevisiae
ttgtcgactctaccgtcctctatgt

SEQ ID NO: 61383 - DNA, 25 bp, S. cerevisiae
ttgatcaagcttatcggtcctacct

SEQ ID NO: 61384 - DNA, 25 bp, S. cerevisiae
ttacaactctttacgctacattcac

SEQ ID NO: 61385 - DNA, 25 bp, S. cerevisiae
ttcaaagcactttacctccaataca

SEQ ID NO: 61386 - DNA, 25 bp, S. cerevisiae
ttaaacaatttcttgctcgcctgtg

SEQ ID NO: 61387 - DNA, 25 bp, S. cerevisiae
ttcaagtcaattccattggcggtgt

SEQ ID NO: 61388 - DNA, 25 bp, S. cerevisiae
ttcagggtgttttcgccaagttcta

SEQ ID NO: 61389 - DNA, 25 bp, S. cerevisiae
ttcagttgttcgaatcacccgtttt

SEQ ID NO: 61390 - DNA, 25 bp, S. cerevisiae
ttcgacaataacgtagaccccttca

SEQ ID NO: 61391 - DNA, 25 bp, S. cerevisiae
ttcggaaattccttcggctactgca

SEQ ID NO: 61392 - DNA, 25 bp, S. cerevisiae
ttcggaagcttttgccggcggctaa

SEQ ID NO: 61393 - DNA, 25 bp, S. cerevisiae
ttcaacaagttcttcgctgatgccg

SEQ ID NO: 61394 - DNA, 25 bp, S. cerevisiae
ttacgatttccaacggtgtcaaaat

SEQ ID NO: 61395 - DNA, 25 bp, S. cerevisiae
ttacgacttcctctgttggcaagaa

SEQ ID NO: 61396 - DNA, 25 bp, S. cerevisiae
ttaagagcttgtccgcttcgcccca

SEQ ID NO: 61397 - DNA, 25 bp, S. cerevisiae
ttgtcacgttctaaaccattgccgc

SEQ ID NO: 61398 - DNA, 25 bp, S. cerevisiae
ttctatccttctaaaacgcagccgg

SEQ ID NO: 61399 - DNA, 25 bp, S. cerevisiae
ttaaccttagacatcagcggcttag

SEQ ID NO: 61400 - DNA, 25 bp, S. cerevisiae
ttacgccgttacatcaagacttcaa

SEQ ID NO: 61401 - DNA, 25 bp, S. cerevisiae
ttcaatctttttgttgctcccaact

SEQ ID NO: 61402 - DNA, 25 bp, S. cerevisiae
ttctttgcagtgtaggtttcggtca

SEQ ID NO: 61403 - DNA, 25 bp, S. cerevisiae
ttaagtcagtggtgtcgtcgtgtcc

SEQ ID NO: 61404 - DNA, 25 bp, S. cerevisiae
ttaaccatgaggagttgtttgcccc

SEQ ID NO: 61405 - DNA, 25 bp, S. cerevisiae
ttacaaggtaacgatgattcccatc

SEQ ID NO: 61406 - DNA, 25 bp, S. cerevisiae
ttaagagatggcaccactcctctag

SEQ ID NO: 61407 - DNA, 25 bp, S. cerevisiae
ttaaacttgaaccactccatgtctg

SEQ ID NO: 61408 - DNA, 25 bp, S. cerevisiae
ttcaacacttaacaccagcatggct

SEQ ID NO: 61409 - DNA, 25 bp, S. cerevisiae
ttacccactttgattgaatgcactc

SEQ ID NO: 61410 - DNA, 25 bp, S. cerevisiae
ttcttcaccgctggaaaatacgccg

SEQ ID NO: 61411 - DNA, 25 bp, S. cerevisiae
ttaaaccaactattccatgcttcca

SEQ ID NO: 61412 - DNA, 25 bp, S. cerevisiae
ttaatgaccacagttattccaccca

SEQ ID NO: 61413 - DNA, 25 bp, S. cerevisiae
ttaagatccagcctataacctacca

SEQ ID NO: 61414 - DNA, 25 bp, S. cerevisiae
ttggcacgggtcatgaatttcccat

SEQ ID NO: 61415 - DNA, 25 bp, S. cerevisiae
ttacagaggcgttggtatttctcca

SEQ ID NO: 61416 - DNA, 25 bp, S. cerevisiae
ttaagggccttggtagtgtgctctc

SEQ ID NO: 61417 - DNA, 25 bp, S. cerevisiae
ttcagggaaagtcggctctgttctc

SEQ ID NO: 61418 - DNA, 25 bp, S. cerevisiae
ttcctcattgcgaaggcgatggcat

SEQ ID NO: 61419 - DNA, 25 bp, S. cerevisiae
ttcccatagcggcagcgtgaacgaa

SEQ ID NO: 61420 - DNA, 25 bp, S. cerevisiae
ttacacactacatccaatgcgactt

SEQ ID NO: 61421 - DNA, 25 bp, S. cerevisiae
ttgcagaagtactacgacgcgtttc

SEQ ID NO: 61422 - DNA, 25 bp, S. cerevisiae
ttgagctataatgaccctgccttgg

SEQ ID NO: 61423 - DNA, 25 bp, S. cerevisiae
ttactgatgaacaacagcccgcttt

SEQ ID NO: 61424 - DNA, 25 bp, S. cerevisiae
ttactgatgaaagtacccctctgcc

SEQ ID NO: 61425 - DNA, 25 bp, S. cerevisiae
ttaatgatgaaattcccgccaccac

SEQ ID NO: 61426 - DNA, 25 bp, S. cerevisiae
ttaagcgaaattcctgttccgcaaa

SEQ ID NO: 61427 - DNA, 25 bp, S. cerevisiae
ttaactgttcatgacgattcgcctt

SEQ ID NO: 61428 - DNA, 25 bp, S. cerevisiae
ttaacttcaagcaccagtccatctt

SEQ ID NO: 61429 - DNA, 25 bp, S. cerevisiae
ttacatttcaactgctgcttccatt

SEQ ID NO: 61430 - DNA, 25 bp, S. cerevisiae
ttacgctattcagatgctagtgcat

SEQ ID NO: 61431 - DNA, 25 bp, S. cerevisiae
ttacacgcattctactacatcacaa

SEQ ID NO: 61432 - DNA, 25 bp, S. cerevisiae
ttacaggcccagctatcggagttaa

SEQ ID NO: 61433 - DNA, 25 bp, S. cerevisiae
ttccggtcgtgtccacggtgaagaa

SEQ ID NO: 61434 - DNA, 25 bp, S. cerevisiae
ttccgtgacgacactttcggcaaga

SEQ ID NO: 61435 - DNA, 25 bp, S. cerevisiae
ttactgggccgcacttttggattgc

SEQ ID NO: 61436 - DNA, 25 bp, S. cerevisiae
ttaatggttctcacgtttccttcaa

SEQ ID NO: 61437 - DNA, 25 bp, S. cerevisiae
ttcaacctatcaatcaacaatccct

SEQ ID NO: 61438 - DNA, 25 bp, S. cerevisiae
ttcatcccgagctcaaagtccaata

SEQ ID NO: 61439 - DNA, 25 bp, S. cerevisiae
ttccagtccctccaaaggttaacat

SEQ ID NO: 61440 - DNA, 25 bp, S. cerevisiae
ttcttctccattctctcaaaagggt

SEQ ID NO: 61441 - DNA, 25 bp, S. cerevisiae
ttcaccaagcgttttccaaacctat

SEQ ID NO: 61442 - DNA, 25 bp, S. cerevisiae
ttccatcgcgttattcctaacttca

SEQ ID NO: 61443 - DNA, 25 bp, S. cerevisiae
ttggcaggttggcttttgctacgaa

SEQ ID NO: 61444 - DNA, 25 bp, S. cerevisiae
ttcaatcgccgctggtgtcgctgcc

SEQ ID NO: 61445 - DNA, 25 bp, S. cerevisiae
ttaaagccagccatctccagtgctc

SEQ ID NO: 61446 - DNA, 25 bp, S. cerevisiae
ttaaagccagctatctccaaggctc

SEQ ID NO: 61447 - DNA, 25 bp, S. cerevisiae
ttaacgccagtaacttcttcatcca

SEQ ID NO: 61448 - DNA, 25 bp, S. cerevisiae
ttaactccattgacctttgctctac

SEQ ID NO: 61449 - DNA, 25 bp, S. cerevisiae
ttgaaggcactggaacgacacatct

SEQ ID NO: 61450 - DNA, 25 bp, S. cerevisiae
ttaacgccagcttacagacaatctc

SEQ ID NO: 61451 - DNA, 25 bp, S. cerevisiae
ttcaagcctcagttggagaatttca

SEQ ID NO: 61452 - DNA, 25 bp, S. cerevisiae
ttcaaaccagtttcggcattccatg

SEQ ID NO: 61453 - DNA, 25 bp, S. cerevisiae
ttaagctcggttcccttatacagag

SEQ ID NO: 61454 - DNA, 25 bp, S. cerevisiae
ttcaatgtcgaatactttgctaagg

SEQ ID NO: 61455 - DNA, 25 bp, S. cerevisiae
ttcaaacgagtcatgttccccttgg

SEQ ID NO: 61456 - DNA, 25 bp, S. cerevisiae
ttcatatacgttatttacaggccta

SEQ ID NO: 61457 - DNA, 25 bp, S. cerevisiae
ttacatgaatgtttcctggaggcgt

SEQ ID NO: 61458 - DNA, 25 bp, S. cerevisiae
ttccatgtatgttgccattcgggtt

SEQ ID NO: 61459 - DNA, 25 bp, S. cerevisiae
ttacagtttgatgctgtccgcgggc

SEQ ID NO: 61460 - DNA, 25 bp, S. cerevisiae
ttacatatttgtttcatccgcggaa

SEQ ID NO: 61461 - DNA, 25 bp, S. cerevisiae
ttactattgaaacagcccggtgctt

SEQ ID NO: 61462 - DNA, 25 bp, S. cerevisiae
ttacaaggtaactcagccgccgtat

SEQ ID NO: 61463 - DNA, 25 bp, S. cerevisiae
ttacattccttatatacctcgagag

SEQ ID NO: 61464 - DNA, 25 bp, S. cerevisiae
ttacttccaagctttcatctgtcta

SEQ ID NO: 61465 - DNA, 25 bp, S. cerevisiae
ttcaggtttccacgtaatcgtttag

SEQ ID NO: 61466 - DNA, 25 bp, S. cerevisiae
ttggatttccccatagaagttcagg

SEQ ID NO: 61467 - DNA, 25 bp, S. cerevisiae
ttaagcttctcacacaggcaacatc

SEQ ID NO: 61468 - DNA, 25 bp, S. cerevisiae
ttcaactactcttactctacacata

SEQ ID NO: 61469 - DNA, 25 bp, S. cerevisiae
ttacatctttcatccgcaacatgct

SEQ ID NO: 61470 - DNA, 25 bp, S. cerevisiae
ttactcacttatgtagtccatctac

SEQ ID NO: 61471 - DNA, 25 bp, S. cerevisiae
ttgatttcggaccatctgaggatgc

SEQ ID NO: 61472 - DNA, 25 bp, S. cerevisiae
ttacttctggtaaatggcttcccct

SEQ ID NO: 61473 - DNA, 25 bp, S. cerevisiae
ttcagaccaactttgctacgagtga

SEQ ID NO: 61474 - DNA, 25 bp, S. cerevisiae
ttcagaggcggtttctccagaggcg

SEQ ID NO: 61475 - DNA, 25 bp, S. cerevisiae
ttcatcgtaacgttcctggtgtttt

SEQ ID NO: 61476 - DNA, 25 bp, S. cerevisiae
ttctagttctgatgtttctggacga

SEQ ID NO: 61477 - DNA, 25 bp, S. cerevisiae
ttaacggtgttccagctgagctttt

SEQ ID NO: 61478 - DNA, 25 bp, S. cerevisiae
ttaaaactgtcccaggcagctcatt

SEQ ID NO: 61479 - DNA, 25 bp, S. cerevisiae
ttgaaaccgagtttgcggataccat

SEQ ID NO: 61480 - DNA, 25 bp, S. cerevisiae
ttgttacctgttgtggcgaacgtct

SEQ ID NO: 61481 - DNA, 25 bp, S. cerevisiae
ttgatgtacactttgggcccagacg

SEQ ID NO: 61482 - DNA, 25 bp, S. cerevisiae
ttctgctaacaacggtacccacatt

SEQ ID NO: 61483 - DNA, 25 bp, S. cerevisiae
ttgacattagactaccttccggcaa

SEQ ID NO: 61484 - DNA, 25 bp, S. cerevisiae
ttctttggtcccttcaaggaaagag

SEQ ID NO: 61485 - DNA, 25 bp, S. cerevisiae
ttcgttggttccgaccgagaagatt

SEQ ID NO: 61486 - DNA, 25 bp, S. cerevisiae
ttcgtgtcgacaaggatcccaactt

SEQ ID NO: 61487 - DNA, 25 bp, S. cerevisiae
ttacttactcggtactcctaattag

SEQ ID NO: 61488 - DNA, 25 bp, S. cerevisiae
ttactttgccagcagaccctgaata

SEQ ID NO: 61489 - DNA, 25 bp, S. cerevisiae
ttaatccaccacaaagccctaataa

SEQ ID NO: 61490 - DNA, 25 bp, S. cerevisiae
ttcaaacccacagacaccaattaga

SEQ ID NO: 61491 - DNA, 25 bp, S. cerevisiae
ttaatttccgcgatggacgccgatg

SEQ ID NO: 61492 - DNA, 25 bp, S. cerevisiae
ttaagatacgcccaagttgcgccat

SEQ ID NO: 61493 - DNA, 25 bp, S. cerevisiae
ttacaccagcgctaatttctcctat

SEQ ID NO: 61494 - DNA, 25 bp, S. cerevisiae
ttaaccaagcaagtcttccaatgtg

SEQ ID NO: 61495 - DNA, 25 bp, S. cerevisiae
ttaaccaccatgttcttgcctaatg

SEQ ID NO: 61496 - DNA, 25 bp, S. cerevisiae
ttaaaatttgattccgcgtgcctgg

SEQ ID NO: 61497 - DNA, 25 bp, S. cerevisiae
ttgcacaaggttaagaaggcttctg

SEQ ID NO: 61498 - DNA, 25 bp, S. cerevisiae
ttcaagggcttgaaggaggtccgtc

SEQ ID NO: 61499 - DNA, 25 bp, S. cerevisiae
ttcaagccgatatcttaggtccctg

SEQ ID NO: 61500 - DNA, 25 bp, S. cerevisiae
ttctatcctcatccgaaagtctttg

SEQ ID NO: 61501 - DNA, 25 bp, S. cerevisiae
ttctatggacatctcagccgtttat

SEQ ID NO: 61502 - DNA, 25 bp, S. cerevisiae
ttccagtagctaccgtcgctattaa

SEQ ID NO: 61503 - DNA, 25 bp, S. cerevisiae
ttctcagtacgatttggtgtcccta

SEQ ID NO: 61504 - DNA, 25 bp, S. cerevisiae
ttctttaaattctgatgaccccgcc

SEQ ID NO: 61505 - DNA, 25 bp, S. cerevisiae
ttgcttccgaaaccttatttcctga

SEQ ID NO: 61506 - DNA, 25 bp, S. cerevisiae
ttcttcgggaacgtcttcttcgcat

SEQ ID NO: 61507 - DNA, 25 bp, S. cerevisiae
ttaacagtcgattccagaagccatg

SEQ ID NO: 61508 - DNA, 25 bp, S. cerevisiae
ttacatttcgatcctcatattcctc

SEQ ID NO: 61509 - DNA, 25 bp, S. cerevisiae
ttcatctttagacagcaatgccgct

SEQ ID NO: 61510 - DNA, 25 bp, S. cerevisiae
ttacaagtaataacagcagcgtcgg

SEQ ID NO: 61511 - DNA, 25 bp, S. cerevisiae
ttcttagggagcctctaccatgcag

SEQ ID NO: 61512 - DNA, 25 bp, S. cerevisiae
ttcttcacggacgactgactctaat

SEQ ID NO: 61513 - DNA, 25 bp, S. cerevisiae
ttctcacacggaacaccactaatgg

SEQ ID NO: 61514 - DNA, 25 bp, S. cerevisiae
ttctcagaccgaatcaaacaatgat

SEQ ID NO: 61515 - DNA, 25 bp, S. cerevisiae
ttcaagccactcctgctgtgaaaaa

SEQ ID NO: 61516 - DNA, 25 bp, S. cerevisiae
ttaacttctctgacgtccagcataa

SEQ ID NO: 61517 - DNA, 25 bp, S. cerevisiae
ttaagctcttttacatcaggatgga

SEQ ID NO: 61518 - DNA, 25 bp, S. cerevisiae
ttaactctgctattgacgcgaatga

SEQ ID NO: 61519 - DNA, 25 bp, S. cerevisiae
ttctgtttcccgtatcgtggtggaa

SEQ ID NO: 61520 - DNA, 25 bp, S. cerevisiae
ttcaccagacttgcctcgaaaactt

SEQ ID NO: 61521 - DNA, 25 bp, S. cerevisiae
ttcaccgactaccatccaattaaat

SEQ ID NO: 61522 - DNA, 25 bp, S. cerevisiae
ttcccaaaacgatcactctcatagt

SEQ ID NO: 61523 - DNA, 25 bp, S. cerevisiae
ttccaccagaactgacttccgatga

SEQ ID NO: 61524 - DNA, 25 bp, S. cerevisiae
ttgaagccgaagaacgctacgcgcg

SEQ ID NO: 61525 - DNA, 25 bp, S. cerevisiae
ttgtcactaaagaccccacaggagt

SEQ ID NO: 61526 - DNA, 25 bp, S. cerevisiae
ttcgccccaaaagcctaattgctta

SEQ ID NO: 61527 - DNA, 25 bp, S. cerevisiae
ttctctgaacaatacccacaagctg

SEQ ID NO: 61528 - DNA, 25 bp, S. cerevisiae
ttctttgcatagtacaaccacaggt

SEQ ID NO: 61529 - DNA, 25 bp, S. cerevisiae
ttctatgccaagtgacaccagcggt

SEQ ID NO: 61530 - DNA, 25 bp, S. cerevisiae
ttctactcaagtggccaacaaggtc

SEQ ID NO: 61531 - DNA, 25 bp, S. cerevisiae
ttctgccaagggtctacaaactgtt

SEQ ID NO: 61532 - DNA, 25 bp, S. cerevisiae
ttggccctggactattcatgaacta

SEQ ID NO: 61533 - DNA, 25 bp, S. cerevisiae
ttcactgttgaaccatcatccttac

SEQ ID NO: 61534 - DNA, 25 bp, S. cerevisiae
ttccttcagaagagcaccagttgtc

SEQ ID NO: 61535 - DNA, 25 bp, S. cerevisiae
ttggcggcaagaaccaccatgttcg

SEQ ID NO: 61536 - DNA, 25 bp, S. cerevisiae
ttgtcgttgcaatccggttccgaat

SEQ ID NO: 61537 - DNA, 25 bp, S. cerevisiae
ttgcggacgatctcatcgattacgt

SEQ ID NO: 61538 - DNA, 25 bp, S. cerevisiae
ttaatgacagttttcagtgctccaa

SEQ ID NO: 61539 - DNA, 25 bp, S. cerevisiae
ttaagagcgttccatcatttccact

SEQ ID NO: 61540 - DNA, 25 bp, S. cerevisiae
ttcaaagtttgccatcaggtctcct

SEQ ID NO: 61541 - DNA, 25 bp, S. cerevisiae
ttcaaggcttatcatccggcatcac

SEQ ID NO: 61542 - DNA, 25 bp, S. cerevisiae
ttaaggctcatatctcctggagagt

SEQ ID NO: 61543 - DNA, 25 bp, S. cerevisiae
ttcgcagtgctaaacatccatgggt

SEQ ID NO: 61544 - DNA, 25 bp, S. cerevisiae
ttcactgcctagtaagccattgagt

SEQ ID NO: 61545 - DNA, 25 bp, S. cerevisiae
ttgtatgccaagtacgccatcggta

SEQ ID NO: 61546 - DNA, 25 bp, S. cerevisiae
ttctcaacttgtgttgccggtggtt

SEQ ID NO: 61547 - DNA, 25 bp, S. cerevisiae
ttcaaagatcttgctataccgtagt

SEQ ID NO: 61548 - DNA, 25 bp, S. cerevisiae
ttcaatgacggctattgctgctggt

SEQ ID NO: 61549 - DNA, 25 bp, S. cerevisiae
ttaagagtggctcgtgcctctgtac

SEQ ID NO: 61550 - DNA, 25 bp, S. cerevisiae
ttcatacctggcaagttactggagt

SEQ ID NO: 61551 - DNA, 25 bp, S. cerevisiae
ttacactgcgcttgttatctctggt

SEQ ID NO: 61552 - DNA, 25 bp, S. cerevisiae
ttgaacttactgtctccgttaccaa

SEQ ID NO: 61553 - DNA, 25 bp, S. cerevisiae
ttaactttcccgtctgattatccat

SEQ ID NO: 61554 - DNA, 25 bp, S. cerevisiae
ttaacctctaccctctgaaatttgg

SEQ ID NO: 61555 - DNA, 25 bp, S. cerevisiae
ttgcgacacctagaatggactacgg

SEQ ID NO: 61556 - DNA, 25 bp, S. cerevisiae
ttcgcagatccttccagtgatacta

SEQ ID NO: 61557 - DNA, 25 bp, S. cerevisiae
ttaaatgttcattcccaactgagga

SEQ ID NO: 61558 - DNA, 25 bp, S. cerevisiae
ttaatatgtttttctgccgccaagc

SEQ ID NO: 61559 - DNA, 25 bp, S. cerevisiae
ttaaagccgctaacgatcaagatat

SEQ ID NO: 61560 - DNA, 25 bp, S. cerevisiae
ttaagagccgaaattgacatgaagt

SEQ ID NO: 61561 - DNA, 25 bp, S. cerevisiae
ttcaaggccgaccactacagatatt

SEQ ID NO: 61562 - DNA, 25 bp, S. cerevisiae
ttcaaggcttgacgactggtacagt

SEQ ID NO: 61563 - DNA, 25 bp, S. cerevisiae
ttcaattcagcgttaatggcggcag

SEQ ID NO: 61564 - DNA, 25 bp, S. cerevisiae
ttaactacagttgatcggacgggaa

SEQ ID NO: 61565 - DNA, 25 bp, S. cerevisiae
ttgtcattcaaggtgccggtgccgg

SEQ ID NO: 61566 - DNA, 25 bp, S. cerevisiae
ttcattatgcaggttcggcggctaa

SEQ ID NO: 61567 - DNA, 25 bp, S. cerevisiae
ttcaggagcatgttccaggtccaaa

SEQ ID NO: 61568 - DNA, 25 bp, S. cerevisiae
ttcaaggctcttgcggttgccataa

SEQ ID NO: 61569 - DNA, 25 bp, S. cerevisiae
ttctactgactcactggccatttga

SEQ ID NO: 61570 - DNA, 25 bp, S. cerevisiae
ttcacactactggatatggctctta

SEQ ID NO: 61571 - DNA, 25 bp, S. cerevisiae
ttaaaagctatgcaggctcctcgtc

SEQ ID NO: 61572 - DNA, 25 bp, S. cerevisiae
ttcaacattctcaagtcatctccgg

SEQ ID NO: 61573 - DNA, 25 bp, S. cerevisiae
ttctcacttttattttagcggccgt

SEQ ID NO: 61574 - DNA, 25 bp, S. cerevisiae
ttctcatttttactttgaccccaat

SEQ ID NO: 61575 - DNA, 25 bp, S. cerevisiae
ttcggcattgctgcagacgtcttaa

SEQ ID NO: 61576 - DNA, 25 bp, S. cerevisiae
ttcggaatccggtggcattatccta

SEQ ID NO: 61577 - DNA, 25 bp, S. cerevisiae
ttggtggtcccttgctcgattacct

SEQ ID NO: 61578 - DNA, 25 bp, S. cerevisiae
ttgcaggacctgacggctcaagaac

SEQ ID NO: 61579 - DNA, 25 bp, S. cerevisiae
ttcataccgatgacgagccgacaat

SEQ ID NO: 61580 - DNA, 25 bp, S. cerevisiae
ttaacaatgatcctgatgcccctat

SEQ ID NO: 61581 - DNA, 25 bp, S. cerevisiae
ttgaacggtcaccactacacgacta

SEQ ID NO: 61582 - DNA, 25 bp, S. cerevisiae
ttgaacgatgactccaatccaacta

SEQ ID NO: 61583 - DNA, 25 bp, S. cerevisiae
ttaacgctgaagacgaatccaagga

SEQ ID NO: 61584 - DNA, 25 bp, S. cerevisiae
ttcaaatagcacatccattccttcg

SEQ ID NO: 61585 - DNA, 25 bp, S. cerevisiae
ttcagagtaacaggccacccattag

SEQ ID NO: 61586 - DNA, 25 bp, S. cerevisiae
ttcacgtacacaaccaccttgttag

SEQ ID NO: 61587 - DNA, 25 bp, S. cerevisiae
ttctcctacggccaagacttggaaa

SEQ ID NO: 61588 - DNA, 25 bp, S. cerevisiae
ttcacctaccgcaacaacggatgaa

SEQ ID NO: 61589 - DNA, 25 bp, S. cerevisiae
ttaagtgccgcttactctggaagct

SEQ ID NO: 61590 - DNA, 25 bp, S. cerevisiae
ttcatcgttgtcttcgggactgtat

SEQ ID NO: 61591 - DNA, 25 bp, S. cerevisiae
ttcaccctgattaccatgaggctta

SEQ ID NO: 61592 - DNA, 25 bp, S. cerevisiae
ttcttcgagagttatctggctgccc

SEQ ID NO: 61593 - DNA, 25 bp, S. cerevisiae
ttcttcgataaaattgccgccgcat

SEQ ID NO: 61594 - DNA, 25 bp, S. cerevisiae
ttccaagtccactagctcggtttag

SEQ ID NO: 61595 - DNA, 25 bp, S. cerevisiae
ttcagaaaccagtgctgcccctaag

SEQ ID NO: 61596 - DNA, 25 bp, S. cerevisiae
ttcaacataagaagggcgccgctat

SEQ ID NO: 61597 - DNA, 25 bp, S. cerevisiae
ttctcctgagagtttcggtttgacc

SEQ ID NO: 61598 - DNA, 25 bp, S. cerevisiae
ttcagccttgagattttggacgagc

SEQ ID NO: 61599 - DNA, 25 bp, S. cerevisiae
ttcatactatttcttcgccattggc

SEQ ID NO: 61600 - DNA, 25 bp, S. cerevisiae
ttaattacttctaccagcaatctgt

SEQ ID NO: 61601 - DNA, 25 bp, S. cerevisiae
ttgagactagttcatctgccttctt

SEQ ID NO: 61602 - DNA, 25 bp, S. cerevisiae
ttaatcttctggtatccgcttctaa

SEQ ID NO: 61603 - DNA, 25 bp, S. cerevisiae
ttgaaatctgggatactgctggtca

SEQ ID NO: 61604 - DNA, 25 bp, S. cerevisiae
ttcattacttgcagactaacgctcc

SEQ ID NO: 61605 - DNA, 25 bp, S. cerevisiae
ttcaatctttactttcttcttcacc

SEQ ID NO: 61606 - DNA, 25 bp, S. cerevisiae
ttcaacttgccctatggtgactgga

SEQ ID NO: 61607 - DNA, 25 bp, S. cerevisiae
ttcaattttcgctatgggtctatgt

SEQ ID NO: 61608 - DNA, 25 bp, S. cerevisiae
ttcacgatgtgcctaaagtttccag

SEQ ID NO: 61609 - DNA, 25 bp, S. cerevisiae
ttcacggccttaagagcttgtccgc

SEQ ID NO: 61610 - DNA, 25 bp, S. cerevisiae
ttctatttgatcgaccctgaaggac

SEQ ID NO: 61611 - DNA, 25 bp, S. cerevisiae
ttaatgttcatgtcatcacctacaa

SEQ ID NO: 61612 - DNA, 25 bp, S. cerevisiae
ttcaagtccagaacgcctacagatg

SEQ ID NO: 61613 - DNA, 25 bp, S. cerevisiae
ttcataaatttaccgccactagctt

SEQ ID NO: 61614 - DNA, 25 bp, S. cerevisiae
ttgcatcaattttcgcgtggactag

SEQ ID NO: 61615 - DNA, 25 bp, S. cerevisiae
ttcacagactcttctggtgcctgga

SEQ ID NO: 61616 - DNA, 25 bp, S. cerevisiae
ttcaaacccagatgtcttgcagatg

SEQ ID NO: 61617 - DNA, 25 bp, S. cerevisiae
ttcaatactcacaaacctgccagat

SEQ ID NO: 61618 - DNA, 25 bp, S. cerevisiae
ttcacaaacagcaaacactccgagt

SEQ ID NO: 61619 - DNA, 25 bp, S. cerevisiae
ttcacgtcagagcatcaacccgaga

SEQ ID NO: 61620 - DNA, 25 bp, S. cerevisiae
ttcttccgtctgctaacatttttga

SEQ ID NO: 61621 - DNA, 25 bp, S. cerevisiae
ttcttcgggtgctttaccttgacta

SEQ ID NO: 61622 - DNA, 25 bp, S. cerevisiae
ttcttcatcgatgcgagaaccaaga

SEQ ID NO: 61623 - DNA, 25 bp, S. cerevisiae
ttcggtatggatttctatgtcgtca

SEQ ID NO: 61624 - DNA, 25 bp, S. cerevisiae
ttcggtaagtttatcgcaatcacaa

SEQ ID NO: 61625 - DNA, 25 bp, S. cerevisiae
ttcagtttgagtttcttcggtatac

SEQ ID NO: 61626 - DNA, 25 bp, S. cerevisiae
ttcttttgcctttttcaggttgact

SEQ ID NO: 61627 - DNA, 25 bp, S. cerevisiae
ttctttgccccttattcagtattag

SEQ ID NO: 61628 - DNA, 25 bp, S. cerevisiae
ttcattttgcatttttacgggccag

SEQ ID NO: 61629 - DNA, 25 bp, S. cerevisiae
ttaatcatcacttatttggctcctg

SEQ ID NO: 61630 - DNA, 25 bp, S. cerevisiae
ttaatcatcctactgtgcctatact

SEQ ID NO: 61631 - DNA, 25 bp, S. cerevisiae
ttgaagacactgtttcctccttaac

SEQ ID NO: 61632 - DNA, 25 bp, S. cerevisiae
ttaatgcatccttttgtccttccaa

SEQ ID NO: 61633 - DNA, 25 bp, S. cerevisiae
ttcaattgccagatcctttaccatt

SEQ ID NO: 61634 - DNA, 25 bp, S. cerevisiae
ttctggtactgctgcgattgtttct

SEQ ID NO: 61635 - DNA, 25 bp, S. cerevisiae
ttcagggatgattgtcgtcgtttac

SEQ ID NO: 61636 - DNA, 25 bp, S. cerevisiae
ttcaccgtgatttctgtcgtttcaa

SEQ ID NO: 61637 - DNA, 25 bp, S. cerevisiae
ttcaccacgatgcatttgcgttcac

SEQ ID NO: 61638 - DNA, 25 bp, S. cerevisiae
ttcccacctgttgatggttaccgta

SEQ ID NO: 61639 - DNA, 25 bp, S. cerevisiae
ttcctcacgctaacctatcgttgat

SEQ ID NO: 61640 - DNA, 25 bp, S. cerevisiae
ttcccatggcgcaccaaacttgaaa

SEQ ID NO: 61641 - DNA, 25 bp, S. cerevisiae
ttcctcattggcagcgaacagtcta

SEQ ID NO: 61642 - DNA, 25 bp, S. cerevisiae
ttgagacattgtgagaccctccgtt

SEQ ID NO: 61643 - DNA, 25 bp, S. cerevisiae
ttcatatgggcggtgggccacaaca

SEQ ID NO: 61644 - DNA, 25 bp, S. cerevisiae
ttgcaaggccagaggtggaacccac

SEQ ID NO: 61645 - DNA, 25 bp, S. cerevisiae
ttctgcataccaagcaagtttacct

SEQ ID NO: 61646 - DNA, 25 bp, S. cerevisiae
ttcctaccggtaccaatatcactgt

SEQ ID NO: 61647 - DNA, 25 bp, S. cerevisiae
ttcgctaccgcgttgaaaattcctg

SEQ ID NO: 61648 - DNA, 25 bp, S. cerevisiae
ttggacatcattaagggctcctccc

SEQ ID NO: 61649 - DNA, 25 bp, S. cerevisiae
ttgccactactgaagggtcctacgg

SEQ ID NO: 61650 - DNA, 25 bp, S. cerevisiae
ttgccctagcaaatggttctttcgg

SEQ ID NO: 61651 - DNA, 25 bp, S. cerevisiae
ttgatcctagatctgcagcctctat

SEQ ID NO: 61652 - DNA, 25 bp, S. cerevisiae
ttcatcctcaatcccgcgatgctaa

SEQ ID NO: 61653 - DNA, 25 bp, S. cerevisiae
ttcatggccagaaacgttgcgcaat

SEQ ID NO: 61654 - DNA, 25 bp, S. cerevisiae
ttcagcgttgaactccacataccta

SEQ ID NO: 61655 - DNA, 25 bp, S. cerevisiae
ttcagcattagaagacccagccact

SEQ ID NO: 61656 - DNA, 25 bp, S. cerevisiae
ttaatgctgcaatacccgctaatgg

SEQ ID NO: 61657 - DNA, 25 bp, S. cerevisiae
ttcttttgggtgcaacagcctgttt

SEQ ID NO: 61658 - DNA, 25 bp, S. cerevisiae
ttcttcgttgcaggtgttgcgttta

SEQ ID NO: 61659 - DNA, 25 bp, S. cerevisiae
ttctcggtacacgtattgcttttga

SEQ ID NO: 61660 - DNA, 25 bp, S. cerevisiae
ttctaggccccgtactgaatgttgc

SEQ ID NO: 61661 - DNA, 25 bp, S. cerevisiae
ttcgagggcctcgtaggaatgtgta

SEQ ID NO: 61662 - DNA, 25 bp, S. cerevisiae
ttccgtgtcggttgttccatattaa

SEQ ID NO: 61663 - DNA, 25 bp, S. cerevisiae
ttcctgtccgacttcatcgttaata

SEQ ID NO: 61664 - DNA, 25 bp, S. cerevisiae
ttcactaccaaccttcttattatca

SEQ ID NO: 61665 - DNA, 25 bp, S. cerevisiae
ttcccgtaccttcatttgtggttga

SEQ ID NO: 61666 - DNA, 25 bp, S. cerevisiae
ttccgcgttttacttctatggttat

SEQ ID NO: 61667 - DNA, 25 bp, S. cerevisiae
ttggttaggtcaattatcgcgtttg

SEQ ID NO: 61668 - DNA, 25 bp, S. cerevisiae
ttcagatcgattttccctgcaggta

SEQ ID NO: 61669 - DNA, 25 bp, S. cerevisiae
ttaatcgcgtgcttattctcaggag

SEQ ID NO: 61670 - DNA, 25 bp, S. cerevisiae
ttaatccagctgttctattccatcg

SEQ ID NO: 61671 - DNA, 25 bp, S. cerevisiae
ttcaatgccagattttactccaaga

SEQ ID NO: 61672 - DNA, 25 bp, S. cerevisiae
ttctacatctccacaacgttcaaaa

SEQ ID NO: 61673 - DNA, 25 bp, S. cerevisiae
ttcactctcttcataaagttgctaa

SEQ ID NO: 61674 - DNA, 25 bp, S. cerevisiae
ttcactcctaatttggtcttgtaat

SEQ ID NO: 61675 - DNA, 25 bp, S. cerevisiae
ttctccgatcgtggtggtgctttca

SEQ ID NO: 61676 - DNA, 25 bp, S. cerevisiae
ttcattcgtcgtttttgtttccata

SEQ ID NO: 61677 - DNA, 25 bp, S. cerevisiae
ttcttcggcgtctttggtatactat

SEQ ID NO: 61678 - DNA, 25 bp, S. cerevisiae
ttctgccgccgaactacttaacaaa

SEQ ID NO: 61679 - DNA, 25 bp, S. cerevisiae
ttgctggtgccgacgttttaactga

SEQ ID NO: 61680 - DNA, 25 bp, S. cerevisiae
ttctgtaccgttctttacatctgca

SEQ ID NO: 61681 - DNA, 25 bp, S. cerevisiae
ttcaacccgttggtttactgcggca

SEQ ID NO: 61682 - DNA, 25 bp, S. cerevisiae
ttcagtggcccaattgatgaacaat

SEQ ID NO: 61683 - DNA, 25 bp, S. cerevisiae
ttcaatgccctttttggagcagact

SEQ ID NO: 61684 - DNA, 25 bp, S. cerevisiae
ttcaaaccgctgttagattgatctt

SEQ ID NO: 61685 - DNA, 25 bp, S. cerevisiae
ttctggcggcaataacaacactact

SEQ ID NO: 61686 - DNA, 25 bp, S. cerevisiae
ttcgctgtcgcaaaaaacacccgtt

SEQ ID NO: 61687 - DNA, 25 bp, S. cerevisiae
ttcggcatcttagcaggcttctttg

SEQ ID NO: 61688 - DNA, 25 bp, S. cerevisiae
ttctcctctcactaataacatccgg

SEQ ID NO: 61689 - DNA, 25 bp, S. cerevisiae
ttctgctacattcaaagaccgcgtt

SEQ ID NO: 61690 - DNA, 25 bp, S. cerevisiae
ttccttgtttagtgacgccgttcaa

SEQ ID NO: 61691 - DNA, 25 bp, S. cerevisiae
ttccggtttaatcagctcggctaaa

SEQ ID NO: 61692 - DNA, 25 bp, S. cerevisiae
ttcccacgttactcctcgagataag

SEQ ID NO: 61693 - DNA, 25 bp, S. cerevisiae
ttcatccaggttctcgacatcgaaa

SEQ ID NO: 61694 - DNA, 25 bp, S. cerevisiae
ttcactccgcttctgaacctgagaa

SEQ ID NO: 61695 - DNA, 25 bp, S. cerevisiae
ttcattcatcccattacaaccaaag

SEQ ID NO: 61696 - DNA, 25 bp, S. cerevisiae
ttcacaactgtcagtgacaaccaaa

SEQ ID NO: 61697 - DNA, 25 bp, S. cerevisiae
ttcacgatgtccagctaacaccaaa

SEQ ID NO: 61698 - DNA, 25 bp, S. cerevisiae
ttgcgtcgtcataccattcgaacac

SEQ ID NO: 61699 - DNA, 25 bp, S. cerevisiae
ttgcgatcatttaggacaggaacat

SEQ ID NO: 61700 - DNA, 25 bp, S. cerevisiae
ttctaggattcacttgcttcaacat

SEQ ID NO: 61701 - DNA, 25 bp, S. cerevisiae
ttcaagtgtcattccactgtgcagc

SEQ ID NO: 61702 - DNA, 25 bp, S. cerevisiae
ttcaagtccgattcacatgtcgcca

SEQ ID NO: 61703 - DNA, 25 bp, S. cerevisiae
ttcaggatccgttcacagacaacag

SEQ ID NO: 61704 - DNA, 25 bp, S. cerevisiae
ttcgtgcactgcgttcaagaataca

SEQ ID NO: 61705 - DNA, 25 bp, S. cerevisiae
ttctgtgccgttcctaaagctcaaa

SEQ ID NO: 61706 - DNA, 25 bp, S. cerevisiae
ttctggtggttggacctggatacta

SEQ ID NO: 61707 - DNA, 25 bp, S. cerevisiae
ttctgccggtgccaacaaggatgac

SEQ ID NO: 61708 - DNA, 25 bp, S. cerevisiae
ttctgcctggctctaatgggtacaa

SEQ ID NO: 61709 - DNA, 25 bp, S. cerevisiae
ttgactccggagctcatataaatgt

SEQ ID NO: 61710 - DNA, 25 bp, S. cerevisiae
ttcactccggagcacatattgtata

SEQ ID NO: 61711 - DNA, 25 bp, S. cerevisiae
ttggtgcacacgttatttgggtccc

SEQ ID NO: 61712 - DNA, 25 bp, S. cerevisiae
ttcacgacggtcaactgcgtttttc

SEQ ID NO: 61713 - DNA, 25 bp, S. cerevisiae
ttctggttcttctacgcaagctgct

SEQ ID NO: 61714 - DNA, 25 bp, S. cerevisiae
ttctcgaaggagtcacgcaggtgct

SEQ ID NO: 61715 - DNA, 25 bp, S. cerevisiae
ttcattgggcgattccagcagcagt

SEQ ID NO: 61716 - DNA, 25 bp, S. cerevisiae
ttgaagcaggcgttcacagggtgca

SEQ ID NO: 61717 - DNA, 25 bp, S. cerevisiae
ttcggcaggcgaacaagttgtcatt

SEQ ID NO: 61718 - DNA, 25 bp, S. cerevisiae
ttcgagcggccgagtttcagaactg

SEQ ID NO: 61719 - DNA, 25 bp, S. cerevisiae
ttcgacaaccgccagtttgcaaatt

SEQ ID NO: 61720 - DNA, 25 bp, S. cerevisiae
ttctccagtcccttttacaaatgtt

SEQ ID NO: 61721 - DNA, 25 bp, S. cerevisiae
ttcgttccagcgtttaccattagta

SEQ ID NO: 61722 - DNA, 25 bp, S. cerevisiae
ttgcggtagccgtcgttacaccact

SEQ ID NO: 61723 - DNA, 25 bp, S. cerevisiae
ttctgtaccactccgaaaagccaag

SEQ ID NO: 61724 - DNA, 25 bp, S. cerevisiae
ttcccaccaaacgaaagagcttcag

SEQ ID NO: 61725 - DNA, 25 bp, S. cerevisiae
ttccggccgctacaataatgcttag

SEQ ID NO: 61726 - DNA, 25 bp, S. cerevisiae
ttctcgtgccgcattaatcaagcaa

SEQ ID NO: 61727 - DNA, 25 bp, S. cerevisiae
ttgccggaattctgtactgtttgtt

SEQ ID NO: 61728 - DNA, 25 bp, S. cerevisiae
ttcatgccaatctctgctatagtct

SEQ ID NO: 61729 - DNA, 25 bp, S. cerevisiae
ttctgaaaagcactgggttacatcc

SEQ ID NO: 61730 - DNA, 25 bp, S. cerevisiae
ttccaaagatcgtggtgtcctgttt

SEQ ID NO: 61731 - DNA, 25 bp, S. cerevisiae
ttaatctacattgccttgcctcaaa

SEQ ID NO: 61732 - DNA, 25 bp, S. cerevisiae
ttgcaattgaacaccgtcctgaatc

SEQ ID NO: 61733 - DNA, 25 bp, S. cerevisiae
ttctctctgcccaaagatcctaaag

SEQ ID NO: 61734 - DNA, 25 bp, S. cerevisiae
ttctgtctcgccaaatgttttccaa

SEQ ID NO: 61735 - DNA, 25 bp, S. cerevisiae
ttctggctatcctttttattcgcaa

SEQ ID NO: 61736 - DNA, 25 bp, S. cerevisiae
ttcatgcattcaagattttttccgc

SEQ ID NO: 61737 - DNA, 25 bp, S. cerevisiae
ttcatttcagtaatcttctcatcga

SEQ ID NO: 61738 - DNA, 25 bp, S. cerevisiae
ttcatatctctaaacttcctcatca

SEQ ID NO: 61739 - DNA, 25 bp, S. cerevisiae
ttctattgggactatggacgctgat

SEQ ID NO: 61740 - DNA, 25 bp, S. cerevisiae
ttctttggaagcgagtgcagccgat

SEQ ID NO: 61741 - DNA, 25 bp, S. cerevisiae
ttgcttttgcaacagtacaggtcca

SEQ ID NO: 61742 - DNA, 25 bp, S. cerevisiae
ttcatccgtgaactagccaaagctt

SEQ ID NO: 61743 - DNA, 25 bp, S. cerevisiae
ttcgcgggacttttgcaaactctgt

SEQ ID NO: 61744 - DNA, 25 bp, S. cerevisiae
ttccgggcgtattacaatccactgt

SEQ ID NO: 61745 - DNA, 25 bp, S. cerevisiae
ttccttgggtgtttgttcgactaat

SEQ ID NO: 61746 - DNA, 25 bp, S. cerevisiae
ttgctttgtcggtgtagtgccgata

SEQ ID NO: 61747 - DNA, 25 bp, S. cerevisiae
ttctattgttgggagtgctgccgct

SEQ ID NO: 61748 - DNA, 25 bp, S. cerevisiae
ttctatttcagagagcgctgttgct

SEQ ID NO: 61749 - DNA, 25 bp, S. cerevisiae
ttcgccagctccaaaggacacatag

SEQ ID NO: 61750 - DNA, 25 bp, S. cerevisiae
ttcacgcgcttgaaattctcaatag

SEQ ID NO: 61751 - DNA, 25 bp, S. cerevisiae
ttcccctataacttcggatatggtg

SEQ ID NO: 61752 - DNA, 25 bp, S. cerevisiae
ttcggttattcttttggcgttctat

SEQ ID NO: 61753 - DNA, 25 bp, S. cerevisiae
ttccgaattctttaccaccgatttg

SEQ ID NO: 61754 - DNA, 25 bp, S. cerevisiae
ttccgagatccttgaatccagttag

SEQ ID NO: 61755 - DNA, 25 bp, S. cerevisiae
ttcgcgcttggcaaagttcctaagg

SEQ ID NO: 61756 - DNA, 25 bp, S. cerevisiae
ttcgcgagctgattacactaaccgt

SEQ ID NO: 61757 - DNA, 25 bp, S. cerevisiae
ttcgctccagaaccctttttatagt

SEQ ID NO: 61758 - DNA, 25 bp, S. cerevisiae
ttcgtgccaccacaactttggaagt

SEQ ID NO: 61759 - DNA, 25 bp, S. cerevisiae
ttcttccagggaaactgaggctaag

SEQ ID NO: 61760 - DNA, 25 bp, S. cerevisiae
ttcatcaccgggtatattggcctgc

SEQ ID NO: 61761 - DNA, 25 bp, S. cerevisiae
ttgggccaggtcacataatcgtagt

SEQ ID NO: 61762 - DNA, 25 bp, S. cerevisiae
ttccggcgcacctattgtaaggagt

SEQ ID NO: 61763 - DNA, 25 bp, S. cerevisiae
ttcatcggcgtcctattttcaaggt

SEQ ID NO: 61764 - DNA, 25 bp, S. cerevisiae
ttcactaccaagaaaaccgctgatg

SEQ ID NO: 61765 - DNA, 25 bp, S. cerevisiae
ttcacctgccattgtttcgacggcc

SEQ ID NO: 61766 - DNA, 25 bp, S. cerevisiae
ttcatcttccactttgtcaactgat

SEQ ID NO: 61767 - DNA, 25 bp, S. cerevisiae
ttcgtcatcgcggaactaaattcat

SEQ ID NO: 61768 - DNA, 25 bp, S. cerevisiae
ttcagcacctcatcctgtacaaaat

SEQ ID NO: 61769 - DNA, 25 bp, S. cerevisiae
ttcacaacatcaaagctaaccaata

SEQ ID NO: 61770 - DNA, 25 bp, S. cerevisiae
ttcagccagctaacgtcaactacaa

SEQ ID NO: 61771 - DNA, 25 bp, S. cerevisiae
ttctcgcagatgaatactacgccat

SEQ ID NO: 61772 - DNA, 25 bp, S. cerevisiae
ttccgcgatgttcccatacatgcaa

SEQ ID NO: 61773 - DNA, 25 bp, S. cerevisiae
ttctccacatttccaagtggcggaa

SEQ ID NO: 61774 - DNA, 25 bp, S. cerevisiae
ttctagacctatctcattgagcctc

SEQ ID NO: 61775 - DNA, 25 bp, S. cerevisiae
ttctggaccctatcaagaccatcgt

SEQ ID NO: 61776 - DNA, 25 bp, S. cerevisiae
ttcatgaagcccaaccaaattccgg

SEQ ID NO: 61777 - DNA, 25 bp, S. cerevisiae
ttcaagacccaaacgttgtacgctt

SEQ ID NO: 61778 - DNA, 25 bp, S. cerevisiae
ttgaagagcctcaattggatttact

SEQ ID NO: 61779 - DNA, 25 bp, S. cerevisiae
ttcaagctcgcgataactctcaagt

SEQ ID NO: 61780 - DNA, 25 bp, S. cerevisiae
ttgaactccgctagaaagttgcgtg

SEQ ID NO: 61781 - DNA, 25 bp, S. cerevisiae
ttcagcctcccaagagaaggtgctt

SEQ ID NO: 61782 - DNA, 25 bp, S. cerevisiae
ttcgcacggcaatagaaggtcttct

SEQ ID NO: 61783 - DNA, 25 bp, S. cerevisiae
ttctccgatgattccagagcggttt

SEQ ID NO: 61784 - DNA, 25 bp, S. cerevisiae
ttcttactcggcaacagcgcattta

SEQ ID NO: 61785 - DNA, 25 bp, S. cerevisiae
ttcatacacctacacctgcaaatac

SEQ ID NO: 61786 - DNA, 25 bp, S. cerevisiae
ttccagatcctaaggtgccaaccct

SEQ ID NO: 61787 - DNA, 25 bp, S. cerevisiae
ttccacattcgaaggtgccaatcag

SEQ ID NO: 61788 - DNA, 25 bp, S. cerevisiae
ttcccaatgccatactgaaacaggt

SEQ ID NO: 61789 - DNA, 25 bp, S. cerevisiae
ttccgcggtgtcagcgaaagctcga

SEQ ID NO: 61790 - DNA, 25 bp, S. cerevisiae
ttgctaatgagtaccccaagcctac

SEQ ID NO: 61791 - DNA, 25 bp, S. cerevisiae
ttcagatcgtatataacccctcacc

SEQ ID NO: 61792 - DNA, 25 bp, S. cerevisiae
ttgcacatgcgttcgatatacccca

SEQ ID NO: 61793 - DNA, 25 bp, S. cerevisiae
ttcactgtggccgatatacctggaa

SEQ ID NO: 61794 - DNA, 25 bp, S. cerevisiae
ttcacaccgcacctaattatcaata

SEQ ID NO: 61795 - DNA, 25 bp, S. cerevisiae
ttcagccctgctgcaagaggtagga

SEQ ID NO: 61796 - DNA, 25 bp, S. cerevisiae
ttcaggctctgctaacagggcttga

SEQ ID NO: 61797 - DNA, 25 bp, S. cerevisiae
ttctgggctcctactttgaaatggg

SEQ ID NO: 61798 - DNA, 25 bp, S. cerevisiae
ttcttttgtgactagcgaggccagc

SEQ ID NO: 61799 - DNA, 25 bp, S. cerevisiae
ttcattttgtcacgaggctggccac

SEQ ID NO: 61800 - DNA, 25 bp, S. cerevisiae
ttcttgtgctgatagtggtgctcct

SEQ ID NO: 61801 - DNA, 25 bp, S. cerevisiae
ttcaacagcttctagggtgcatcct

SEQ ID NO: 61802 - DNA, 25 bp, S. cerevisiae
ttcaccaagttttcaggcacatcgc

SEQ ID NO: 61803 - DNA, 25 bp, S. cerevisiae
ttctaaagctttaaccgatactgat

SEQ ID NO: 61804 - DNA, 25 bp, S. cerevisiae
ttcgaatacattgacgaccacagat

SEQ ID NO: 61805 - DNA, 25 bp, S. cerevisiae
ttcaacacttacaaatccacaccaa

SEQ ID NO: 61806 - DNA, 25 bp, S. cerevisiae
ttcatctccctttctttattcacgg

SEQ ID NO: 61807 - DNA, 25 bp, S. cerevisiae
ttctctggcaacgttgattggtctg

SEQ ID NO: 61808 - DNA, 25 bp, S. cerevisiae
ttcattttatcccaatcatgctgcc

SEQ ID NO: 61809 - DNA, 25 bp, S. cerevisiae
ttcagtactcagacgacacattcca

SEQ ID NO: 61810 - DNA, 25 bp, S. cerevisiae
ttcgatgaccaattgaaggaattgc

SEQ ID NO: 61811 - DNA, 25 bp, S. cerevisiae
ttcgagaccaaagcactgacattta

SEQ ID NO: 61812 - DNA, 25 bp, S. cerevisiae
ttcactgaccaatcaactgcttttc

SEQ ID NO: 61813 - DNA, 25 bp, S. cerevisiae
ttcttttcttgttcttggagcctaa

SEQ ID NO: 61814 - DNA, 25 bp, S. cerevisiae
ttgccgtccctagcaggttaattga

SEQ ID NO: 61815 - DNA, 25 bp, S. cerevisiae
ttccaatacgctagacaggttaaag

SEQ ID NO: 61816 - DNA, 25 bp, S. cerevisiae
ttcgacttcgaagcagcgtctgagt

SEQ ID NO: 61817 - DNA, 25 bp, S. cerevisiae
ttcaccgactacttctacaatggcg

SEQ ID NO: 61818 - DNA, 25 bp, S. cerevisiae
ttctacggtgaattctgccaatgag

SEQ ID NO: 61819 - DNA, 25 bp, S. cerevisiae
ttctcacggcaatgtctgcgcagat

SEQ ID NO: 61820 - DNA, 25 bp, S. cerevisiae
ttctgctcgtgaacagtcgctagac

SEQ ID NO: 61821 - DNA, 25 bp, S. cerevisiae
ttctgccttagacgagctgctgaaa

SEQ ID NO: 61822 - DNA, 25 bp, S. cerevisiae
ttcttcccaaattccttcgacaagg

SEQ ID NO: 61823 - DNA, 25 bp, S. cerevisiae
ttcgttcaatttatactctttcaag

SEQ ID NO: 61824 - DNA, 25 bp, S. cerevisiae
ttcgctttcattttcgttttctact

SEQ ID NO: 61825 - DNA, 25 bp, S. cerevisiae
ttctggtatttctctcgttttattg

SEQ ID NO: 61826 - DNA, 25 bp, S. cerevisiae
ttgctttcccaaatgctgcacatgt

SEQ ID NO: 61827 - DNA, 25 bp, S. cerevisiae
ttgttggtcaaaacgctccagagat

SEQ ID NO: 61828 - DNA, 25 bp, S. cerevisiae
ttctccttaatcgaccaactgacaa

SEQ ID NO: 61829 - DNA, 25 bp, S. cerevisiae
ttcccattattcgaggcagtctacc

SEQ ID NO: 61830 - DNA, 25 bp, S. cerevisiae
ttctgtttccgcttatggtcaatcg

SEQ ID NO: 61831 - DNA, 25 bp, S. cerevisiae
ttcctgttaagcttatatcagcact

SEQ ID NO: 61832 - DNA, 25 bp, S. cerevisiae
ttctctgctcgctgaagaatggcac

SEQ ID NO: 61833 - DNA, 25 bp, S. cerevisiae
ttcatcatgccctagatagattcgt

SEQ ID NO: 61834 - DNA, 25 bp, S. cerevisiae
ttctttccattcgaattccaccaga

SEQ ID NO: 61835 - DNA, 25 bp, S. cerevisiae
ttctctctctttgtgtttggccaga

SEQ ID NO: 61836 - DNA, 25 bp, S. cerevisiae
ttctcatttcctgctcttttggata

SEQ ID NO: 61837 - DNA, 25 bp, S. cerevisiae
ttgttgtggcagcaattggtccgtt

SEQ ID NO: 61838 - DNA, 25 bp, S. cerevisiae
ttcacctttgttgatgagtccgcca

SEQ ID NO: 61839 - DNA, 25 bp, S. cerevisiae
ttcgccttcgtagggttgatatcct

SEQ ID NO: 61840 - DNA, 25 bp, S. cerevisiae
ttctcgtcgggattctttaaacaat

SEQ ID NO: 61841 - DNA, 25 bp, S. cerevisiae
ttctatgtctggcaacttctgatga

SEQ ID NO: 61842 - DNA, 25 bp, S. cerevisiae
ttctcatatcgtcccagtgttgatt

SEQ ID NO: 61843 - DNA, 25 bp, S. cerevisiae
ttgttatcgatctcagtaccttccg

SEQ ID NO: 61844 - DNA, 25 bp, S. cerevisiae
ttcttatatctaccattaccttcca

SEQ ID NO: 61845 - DNA, 25 bp, S. cerevisiae
ttgcagctcagtcacgacgacgtaa

SEQ ID NO: 61846 - DNA, 25 bp, S. cerevisiae
ttcatctcagaaccgggccagtaca

SEQ ID NO: 61847 - DNA, 25 bp, S. cerevisiae
ttcatgctggaaccctcgacagtaa

SEQ ID NO: 61848 - DNA, 25 bp, S. cerevisiae
ttcctgtccgaatgatcttactacg

SEQ ID NO: 61849 - DNA, 25 bp, S. cerevisiae
ttcttcaccggatacttcatatacc

SEQ ID NO: 61850 - DNA, 25 bp, S. cerevisiae
ttctcacacgcccaaactgcagtta

SEQ ID NO: 61851 - DNA, 25 bp, S. cerevisiae
ttcctcctcggaagacgcactagat

SEQ ID NO: 61852 - DNA, 25 bp, S. cerevisiae
ttcttcccgaattatcaccttgttg

SEQ ID NO: 61853 - DNA, 25 bp, S. cerevisiae
ttcttgcaccaatattacccgttat

SEQ ID NO: 61854 - DNA, 25 bp, S. cerevisiae
ttcctgccaatatggtccaccttta

SEQ ID NO: 61855 - DNA, 25 bp, S. cerevisiae
ttctctgccgatattgttactctat

SEQ ID NO: 61856 - DNA, 25 bp, S. cerevisiae
ttcctccctgagtgtaatttaacgt

SEQ ID NO: 61857 - DNA, 25 bp, S. cerevisiae
ttccaccctggatttgcgtttaaag

SEQ ID NO: 61858 - DNA, 25 bp, S. cerevisiae
ttctatcctccacctgtttttaaga

SEQ ID NO: 61859 - DNA, 25 bp, S. cerevisiae
ttcgtgccaattccttcttcaagaa

SEQ ID NO: 61860 - DNA, 25 bp, S. cerevisiae
ttcagtacttattaggctttgccgc

SEQ ID NO: 61861 - DNA, 25 bp, S. cerevisiae
ttcgttagcttcatccgacgctaat

SEQ ID NO: 61862 - DNA, 25 bp, S. cerevisiae
ttggaaaccttgaccatgcacacca

SEQ ID NO: 61863 - DNA, 25 bp, S. cerevisiae
ttgcaagggcttattgacgacgaca

SEQ ID NO: 61864 - DNA, 25 bp, S. cerevisiae
ttcataggccttattgggattccgt

SEQ ID NO: 61865 - DNA, 25 bp, S. cerevisiae
ttccgttttgggtatcgaagctgca

SEQ ID NO: 61866 - DNA, 25 bp, S. cerevisiae
ttcgcgaatccggacgcaaattgtt

SEQ ID NO: 61867 - DNA, 25 bp, S. cerevisiae
ttcgcctcacggtatccagaatttt

SEQ ID NO: 61868 - DNA, 25 bp, S. cerevisiae
ttctaccactgttaggagctgcact

SEQ ID NO: 61869 - DNA, 25 bp, S. cerevisiae
ttccctaaattggatgatacagaca

SEQ ID NO: 61870 - DNA, 25 bp, S. cerevisiae
ttcgccgaaaccttgaagcatgact

SEQ ID NO: 61871 - DNA, 25 bp, S. cerevisiae
ttcagccggtcattcttgtagcata

SEQ ID NO: 61872 - DNA, 25 bp, S. cerevisiae
ttcaggcgagccgatttatgcaact

SEQ ID NO: 61873 - DNA, 25 bp, S. cerevisiae
ttcaggctgagcacatcaaagaatt

SEQ ID NO: 61874 - DNA, 25 bp, S. cerevisiae
ttcagatgctgaattgcgtcgttat

SEQ ID NO: 61875 - DNA, 25 bp, S. cerevisiae
ttccttgattgtggtcgattctgtt

SEQ ID NO: 61876 - DNA, 25 bp, S. cerevisiae
ttccgatggttgcacagtttctgtt

SEQ ID NO: 61877 - DNA, 25 bp, S. cerevisiae
ttcgctgctggtactaaggctttgt

SEQ ID NO: 61878 - DNA, 25 bp, S. cerevisiae
ttctttctcaagtagtggcggctct

SEQ ID NO: 61879 - DNA, 25 bp, S. cerevisiae
ttcattttatggtctgtggccgctt

SEQ ID NO: 61880 - DNA, 25 bp, S. cerevisiae
ttctttacagattttggccgactaa

SEQ ID NO: 61881 - DNA, 25 bp, S. cerevisiae
ttcttcttcgcttttacaggaccaa

SEQ ID NO: 61882 - DNA, 25 bp, S. cerevisiae
ttcggtaactccattagactcgtct

SEQ ID NO: 61883 - DNA, 25 bp, S. cerevisiae
ttctgtccaccccattaaaatttca

SEQ ID NO: 61884 - DNA, 25 bp, S. cerevisiae
ttctactccacccttaaatcaatta

SEQ ID NO: 61885 - DNA, 25 bp, S. cerevisiae
ttctacccacctttactgagatcag

SEQ ID NO: 61886 - DNA, 25 bp, S. cerevisiae
ttctattccaacactttgagacatt

SEQ ID NO: 61887 - DNA, 25 bp, S. cerevisiae
ttccgcttccacagcgtatgagaag

SEQ ID NO: 61888 - DNA, 25 bp, S. cerevisiae
ttcccattccccagatattatcagt

SEQ ID NO: 61889 - DNA, 25 bp, S. cerevisiae
ttctcctttttcaagactttagttg

SEQ ID NO: 61890 - DNA, 25 bp, S. cerevisiae
ttcgtcctcttcttgtatacttcct

SEQ ID NO: 61891 - DNA, 25 bp, S. cerevisiae
ttcggattttgctttgatgacgttg

SEQ ID NO: 61892 - DNA, 25 bp, S. cerevisiae
ttccgctggtatccttcaagatgtc

SEQ ID NO: 61893 - DNA, 25 bp, S. cerevisiae
ttctgtcgccaagctgttcaagtga

SEQ ID NO: 61894 - DNA, 25 bp, S. cerevisiae
ttctgtcactgctagttccgatgaa

SEQ ID NO: 61895 - DNA, 25 bp, S. cerevisiae
ttcttcgctcgtttcaagctgagaa

SEQ ID NO: 61896 - DNA, 25 bp, S. cerevisiae
ttcatctacctgtgtaggccgcaat

SEQ ID NO: 61897 - DNA, 25 bp, S. cerevisiae
ttcctcccttagcagtctggctaaa

SEQ ID NO: 61898 - DNA, 25 bp, S. cerevisiae
ttcccgcttgtttgagttccgaaag

SEQ ID NO: 61899 - DNA, 25 bp, S. cerevisiae
ttcccacgttgtatcattgctgtat

SEQ ID NO: 61900 - DNA, 25 bp, S. cerevisiae
ttcatccagcccttttcatagtaga

SEQ ID NO: 61901 - DNA, 25 bp, S. cerevisiae
ttcattgcgtccttattgctggcaa

SEQ ID NO: 61902 - DNA, 25 bp, S. cerevisiae
ttcatcatcgttgctgttgtcttag

SEQ ID NO: 61903 - DNA, 25 bp, S. cerevisiae
ttctctggtgctgatttactctata

SEQ ID NO: 61904 - DNA, 25 bp, S. cerevisiae
ttctcgagtcatttctagcaccaat

SEQ ID NO: 61905 - DNA, 25 bp, S. cerevisiae
ttgccagaacttttatcgccaatcc

SEQ ID NO: 61906 - DNA, 25 bp, S. cerevisiae
ttccgcatcgtcaattactggcaac

SEQ ID NO: 61907 - DNA, 25 bp, S. cerevisiae
ttccgcacgcatattcaagctagct

SEQ ID NO: 61908 - DNA, 25 bp, S. cerevisiae
ttccccatcgtttggatcatatttg

SEQ ID NO: 61909 - DNA, 25 bp, S. cerevisiae
ttgacgcttctagttgtggttcttt

SEQ ID NO: 61910 - DNA, 25 bp, S. cerevisiae
ttgtggtggacgacccagagtctaa

SEQ ID NO: 61911 - DNA, 25 bp, S. cerevisiae
ttccatggttttcttcccagtgaag

SEQ ID NO: 61912 - DNA, 25 bp, S. cerevisiae
ttccggtttttcgacattattgaag

SEQ ID NO: 61913 - DNA, 25 bp, S. cerevisiae
ttccagttattcactaatccatcag

SEQ ID NO: 61914 - DNA, 25 bp, S. cerevisiae
ttccagttcatcaagcgccaataaa

SEQ ID NO: 61915 - DNA, 25 bp, S. cerevisiae
ttgccggctctcaaggtcaattcga

SEQ ID NO: 61916 - DNA, 25 bp, S. cerevisiae
ttcatcggagtcaaggagcaacctg

SEQ ID NO: 61917 - DNA, 25 bp, S. cerevisiae
ttgccgcaagattacgattaccgtc

SEQ ID NO: 61918 - DNA, 25 bp, S. cerevisiae
ttcctaggcgcggattcagtagaca

SEQ ID NO: 61919 - DNA, 25 bp, S. cerevisiae
ttcctatggcgcttgcattaatcat

SEQ ID NO: 61920 - DNA, 25 bp, S. cerevisiae
ttcgttgcctgcttcgaatgcaaga

SEQ ID NO: 61921 - DNA, 25 bp, S. cerevisiae
ttgcgctgggagttaccccatctaa

SEQ ID NO: 61922 - DNA, 25 bp, S. cerevisiae
ttcctggagatgttcggcaccgcta

SEQ ID NO: 61923 - DNA, 25 bp, S. cerevisiae
ttcctgggtgtgtccgaatatcttt

SEQ ID NO: 61924 - DNA, 25 bp, S. cerevisiae
ttccgggtgttccattaatccattt

SEQ ID NO: 61925 - DNA, 25 bp, S. cerevisiae
ttgcgtaccgtgaccatggcggaat

SEQ ID NO: 61926 - DNA, 25 bp, S. cerevisiae
ttcgcaaccgtgctctctgttttca

SEQ ID NO: 61927 - DNA, 25 bp, S. cerevisiae
ttctcccgagaaacctttgtctgat

SEQ ID NO: 61928 - DNA, 25 bp, S. cerevisiae
ttccacttcggctctgaattattga

SEQ ID NO: 61929 - DNA, 25 bp, S. cerevisiae
ttccccatcgcattatcgtggcata

SEQ ID NO: 61930 - DNA, 25 bp, S. cerevisiae
ttccgccgccgtcagtgagaagaag

SEQ ID NO: 61931 - DNA, 25 bp, S. cerevisiae
ttcccacaccggtttgatcagaaag

SEQ ID NO: 61932 - DNA, 25 bp, S. cerevisiae
ttcccacaccggtttgatcagaaag

SEQ ID NO: 61933 - DNA, 25 bp, S. cerevisiae
ttcctttcaggatttcgagtctcta

SEQ ID NO: 61934 - DNA, 25 bp, S. cerevisiae
ttcgctgtactggactttgatcttt

SEQ ID NO: 61935 - DNA, 25 bp, S. cerevisiae
ttcgctgtatgggtcgtgggtaatc

SEQ ID NO: 61936 - DNA, 25 bp, S. cerevisiae
ttgcgtgttgatgatgctaatgcgt

SEQ ID NO: 61937 - DNA, 25 bp, S. cerevisiae
ttcccacttgtgataagcaacgaga

SEQ ID NO: 61938 - DNA, 25 bp, S. cerevisiae
ttccaaaattggacaataccgataa

SEQ ID NO: 61939 - DNA, 25 bp, S. cerevisiae
ttccgacactattgacaacgtcaaa

SEQ ID NO: 61940 - DNA, 25 bp, S. cerevisiae
ttccgctaccttacaaactcaaatt

SEQ ID NO: 61941 - DNA, 25 bp, S. cerevisiae
ttctggatacccttaacactactac

SEQ ID NO: 61942 - DNA, 25 bp, S. cerevisiae
ttctgataaagatgacggcgataac

SEQ ID NO: 61943 - DNA, 25 bp, S. cerevisiae
ttccaacagagacagcaggcttcca

SEQ ID NO: 61944 - DNA, 25 bp, S. cerevisiae
ttgccaacgatgactacccttatat

SEQ ID NO: 61945 - DNA, 25 bp, S. cerevisiae
ttctgctaaggctacttctgcttaa

SEQ ID NO: 61946 - DNA, 25 bp, S. cerevisiae
ttgctaaaatgcctcttgtgcccac

SEQ ID NO: 61947 - DNA, 25 bp, S. cerevisiae
ttcttgtattgtgcatctggacccc

SEQ ID NO: 61948 - DNA, 25 bp, S. cerevisiae
ttgctttgactgatttggactcccc

SEQ ID NO: 61949 - DNA, 25 bp, S. cerevisiae
ttctcttgtgctttctacgtttatg

SEQ ID NO: 61950 - DNA, 25 bp, S. cerevisiae
ttctttctctgctctatctgtgtta

SEQ ID NO: 61951 - DNA, 25 bp, S. cerevisiae
ttctctcgccaaatttaccatactg

SEQ ID NO: 61952 - DNA, 25 bp, S. cerevisiae
ttctcatccacaaattaccccatat

SEQ ID NO: 61953 - DNA, 25 bp, S. cerevisiae
ttctaccaaccatcctgactatgat

SEQ ID NO: 61954 - DNA, 25 bp, S. cerevisiae
ttcttctacaagttcacaggtggct

SEQ ID NO: 61955 - DNA, 25 bp, S. cerevisiae
ttgatcacgttggacaggttgtact

SEQ ID NO: 61956 - DNA, 25 bp, S. cerevisiae
ttgcattgtcctgaaggtgctaccc

SEQ ID NO: 61957 - DNA, 25 bp, S. cerevisiae
ttcgatgcaaggtcgctcggtagat

SEQ ID NO: 61958 - DNA, 25 bp, S. cerevisiae
ttctgagaagattcccgtcgatccc

SEQ ID NO: 61959 - DNA, 25 bp, S. cerevisiae
ttcggcgagctatttgctcacgagc

SEQ ID NO: 61960 - DNA, 25 bp, S. cerevisiae
ttgacgcggctattagtatcagtgc

SEQ ID NO: 61961 - DNA, 25 bp, S. cerevisiae
ttgacagcacgctactatgcaaagg

SEQ ID NO: 61962 - DNA, 25 bp, S. cerevisiae
ttcgccgctaatacacacgcaaagt

SEQ ID NO: 61963 - DNA, 25 bp, S. cerevisiae
ttgtccgctaaaaacgagcaactcg

SEQ ID NO: 61964 - DNA, 25 bp, S. cerevisiae
ttcgtcagcttaataacccctatac

SEQ ID NO: 61965 - DNA, 25 bp, S. cerevisiae
ttgacgtttctttattccacacctt

SEQ ID NO: 61966 - DNA, 25 bp, S. cerevisiae
ttccagttcacgtttccccagcttt

SEQ ID NO: 61967 - DNA, 25 bp, S. cerevisiae
ttcgaactactaagaccggctgatt

SEQ ID NO: 61968 - DNA, 25 bp, S. cerevisiae
ttccaattactaatgtcctagaatg

SEQ ID NO: 61969 - DNA, 25 bp, S. cerevisiae
ttcctgatggaaactcttactacgt

SEQ ID NO: 61970 - DNA, 25 bp, S. cerevisiae
ttccatcgagattattcctattttg

SEQ ID NO: 61971 - DNA, 25 bp, S. cerevisiae
ttgtcccttcgagtggttccattat

SEQ ID NO: 61972 - DNA, 25 bp, S. cerevisiae
ttgtcccattggctttttcatttgt

SEQ ID NO: 61973 - DNA, 25 bp, S. cerevisiae
ttccccattgcgctattgatatttg

SEQ ID NO: 61974 - DNA, 25 bp, S. cerevisiae
ttctacaaggcgctttctatgtggg

SEQ ID NO: 61975 - DNA, 25 bp, S. cerevisiae
ttctacaaactccattgcatccatt

SEQ ID NO: 61976 - DNA, 25 bp, S. cerevisiae
ttctacgcatcatttattgccctct

SEQ ID NO: 61977 - DNA, 25 bp, S. cerevisiae
ttctactgcagaagctcattccgct

SEQ ID NO: 61978 - DNA, 25 bp, S. cerevisiae
ttctacacatggttcttctgcacat

SEQ ID NO: 61979 - DNA, 25 bp, S. cerevisiae
ttccggttctgcttctatatcaaca

SEQ ID NO: 61980 - DNA, 25 bp, S. cerevisiae
ttcccgtcatcgctgagttattgga

SEQ ID NO: 61981 - DNA, 25 bp, S. cerevisiae
ttctcaccaacttttccattttcta

SEQ ID NO: 61982 - DNA, 25 bp, S. cerevisiae
ttccgaagctcgattggtcgtctat

SEQ ID NO: 61983 - DNA, 25 bp, S. cerevisiae
ttccagaagacgattccgccattat

SEQ ID NO: 61984 - DNA, 25 bp, S. cerevisiae
ttccaactacggttcatccaacaat

SEQ ID NO: 61985 - DNA, 25 bp, S. cerevisiae
ttcgaaccaaatcctagcccaaact

SEQ ID NO: 61986 - DNA, 25 bp, S. cerevisiae
ttctgcaaccattataccatctcca

SEQ ID NO: 61987 - DNA, 25 bp, S. cerevisiae
ttctctacatgctatccgccattaa

SEQ ID NO: 61988 - DNA, 25 bp, S. cerevisiae
ttctatatcatgttccaccttgtca

SEQ ID NO: 61989 - DNA, 25 bp, S. cerevisiae
ttccgcaatttacaaggtcgccctt

SEQ ID NO: 61990 - DNA, 25 bp, S. cerevisiae
ttcgggtggtgttcatggagccaac

SEQ ID NO: 61991 - DNA, 25 bp, S. cerevisiae
ttctgtccccgcttcgaataacaat

SEQ ID NO: 61992 - DNA, 25 bp, S. cerevisiae
ttgcttcccgtgtggcactaaacaa

SEQ ID NO: 61993 - DNA, 25 bp, S. cerevisiae
ttcgctactgttgccgctgtccaag

SEQ ID NO: 61994 - DNA, 25 bp, S. cerevisiae
ttcggagcggcttcaatgatggctt

SEQ ID NO: 61995 - DNA, 25 bp, S. cerevisiae
ttcgaacccgcttctagattacaag

SEQ ID NO: 61996 - DNA, 25 bp, S. cerevisiae
ttcgaacgccgcttaagcttcaaaa

SEQ ID NO: 61997 - DNA, 25 bp, S. cerevisiae
ttcgaacacgctttggacatcatca

SEQ ID NO: 61998 - DNA, 25 bp, S. cerevisiae
ttctgattcaccagctgtacagcaa

SEQ ID NO: 61999 - DNA, 25 bp, S. cerevisiae
ttcctgctgaagatggttccggtgc

SEQ ID NO: 62000 - DNA, 25 bp, S. cerevisiae
ttctctcataaaaggactcgggtct

SEQ ID NO: 62001 - DNA, 25 bp, S. cerevisiae
ttctgacgaatcaacaacgcggtat

SEQ ID NO: 62002 - DNA, 25 bp, S. cerevisiae
ttctgcctgaaatcatacctactca

SEQ ID NO: 62003 - DNA, 25 bp, S. cerevisiae
ttctggtacatcttcatagccttta

SEQ ID NO: 62004 - DNA, 25 bp, S. cerevisiae
ttcgtttctcagtaccgaaatgacg

SEQ ID NO: 62005 - DNA, 25 bp, S. cerevisiae
ttctcctttgtcttcttcgacagaa

SEQ ID NO: 62006 - DNA, 25 bp, S. cerevisiae
ttgtaccgtctctctgacaacaagt

SEQ ID NO: 62007 - DNA, 25 bp, S. cerevisiae
ttgaaaatgctcctccgcaaaccag

SEQ ID NO: 62008 - DNA, 25 bp, S. cerevisiae
ttgagcaaagctgtcttacaaccag

SEQ ID NO: 62009 - DNA, 25 bp, S. cerevisiae
ttgaagccgcctgtaaacacaattg

SEQ ID NO: 62010 - DNA, 25 bp, S. cerevisiae
ttgccaccgcctcacataagataat

SEQ ID NO: 62011 - DNA, 25 bp, S. cerevisiae
ttccacgccagtctcattgatcaat

SEQ ID NO: 62012 - DNA, 25 bp, S. cerevisiae
ttcgcactgctggtccttggattaa

SEQ ID NO: 62013 - DNA, 25 bp, S. cerevisiae
ttccaggctccttcgtgattgaaag

SEQ ID NO: 62014 - DNA, 25 bp, S. cerevisiae
ttctgggtcgctgtgcttgtgaaaa

SEQ ID NO: 62015 - DNA, 25 bp, S. cerevisiae
ttctgcccatttgccagtagacaag

SEQ ID NO: 62016 - DNA, 25 bp, S. cerevisiae
ttccgattgctatgggtgtgctcat

SEQ ID NO: 62017 - DNA, 25 bp, S. cerevisiae
ttccggatgcattgctgctttggat

SEQ ID NO: 62018 - DNA, 25 bp, S. cerevisiae
ttccttggaggcctaagcgattctt

SEQ ID NO: 62019 - DNA, 25 bp, S. cerevisiae
ttccagtttgaatctatccacctac

SEQ ID NO: 62020 - DNA, 25 bp, S. cerevisiae
ttcctacccttgttatcaattccag

SEQ ID NO: 62021 - DNA, 25 bp, S. cerevisiae
ttcgttcctctcatacatcatgttt

SEQ ID NO: 62022 - DNA, 25 bp, S. cerevisiae
ttcgtcgtcttctaacatttcttca

SEQ ID NO: 62023 - DNA, 25 bp, S. cerevisiae
ttcggctgttcctgtaattccagaa

SEQ ID NO: 62024 - DNA, 25 bp, S. cerevisiae
ttcggtgctaccttggaattcatca

SEQ ID NO: 62025 - DNA, 25 bp, S. cerevisiae
ttcgagcctcatctatccaattcaa

SEQ ID NO: 62026 - DNA, 25 bp, S. cerevisiae
ttctcaggctgatttgtcactacta

SEQ ID NO: 62027 - DNA, 25 bp, S. cerevisiae
ttctgcccaatttgactctgctaaa

SEQ ID NO: 62028 - DNA, 25 bp, S. cerevisiae
ttctgccccatatgaagcgccaaaa

SEQ ID NO: 62029 - DNA, 25 bp, S. cerevisiae
ttctgaagctcctgaagccacaacc

SEQ ID NO: 62030 - DNA, 25 bp, S. cerevisiae
ttctaagttctccaagcaacaagct

SEQ ID NO: 62031 - DNA, 25 bp, S. cerevisiae
ttgcgtacttcaccaaagagtccca

SEQ ID NO: 62032 - DNA, 25 bp, S. cerevisiae
ttgctattttcgcagacgttgccac

SEQ ID NO: 62033 - DNA, 25 bp, S. cerevisiae
ttggcattccaagcgatggttcaaa

SEQ ID NO: 62034 - DNA, 25 bp, S. cerevisiae
ttggttcgggatcaggtatcgtcac

SEQ ID NO: 62035 - DNA, 25 bp, S. cerevisiae
ttggaattggttcagcgttcctcca

SEQ ID NO: 62036 - DNA, 25 bp, S. cerevisiae
ttgcagaagggtggaagtgttttaa

SEQ ID NO: 62037 - DNA, 25 bp, S. cerevisiae
ttcgagtgaaagtaaccgtgccgct

SEQ ID NO: 62038 - DNA, 25 bp, S. cerevisiae
ttcgttacaaattagctgcggccct

SEQ ID NO: 62039 - DNA, 25 bp, S. cerevisiae
ttgcgttccatgacgagcgctggac

SEQ ID NO: 62040 - DNA, 25 bp, S. cerevisiae
ttgcgcctgaaatcgttgtcttcaa

SEQ ID NO: 62041 - DNA, 25 bp, S. cerevisiae
ttgaggcaatactgggagtttacac

SEQ ID NO: 62042 - DNA, 25 bp, S. cerevisiae
ttcctgcactactggtgtgtattac

SEQ ID NO: 62043 - DNA, 25 bp, S. cerevisiae
ttcgtttacttcttggtcttcgtca

SEQ ID NO: 62044 - DNA, 25 bp, S. cerevisiae
ttgccatgggagaccgtctggtcaa

SEQ ID NO: 62045 - DNA, 25 bp, S. cerevisiae
ttccggctctccaatgtgtggtgaa

SEQ ID NO: 62046 - DNA, 25 bp, S. cerevisiae
ttgaacgctgctaatgatgggacca

SEQ ID NO: 62047 - DNA, 25 bp, S. cerevisiae
ttccacgctgtgttgtcggtgagaa

SEQ ID NO: 62048 - DNA, 25 bp, S. cerevisiae
ttgccattgccccaattggtggagg

SEQ ID NO: 62049 - DNA, 25 bp, S. cerevisiae
ttcctatggcctctcatgtagatca

SEQ ID NO: 62050 - DNA, 25 bp, S. cerevisiae
ttccctgtgctcagatcattcgtaa

SEQ ID NO: 62051 - DNA, 25 bp, S. cerevisiae
ttctctcaatctccaaattcgtcaa

SEQ ID NO: 62052 - DNA, 25 bp, S. cerevisiae
ttgctccaagccgtagttcagaatc

SEQ ID NO: 62053 - DNA, 25 bp, S. cerevisiae
ttgccgaagcatcaaacatcaacga

SEQ ID NO: 62054 - DNA, 25 bp, S. cerevisiae
ttccaaagtaatcagcatccctcag

SEQ ID NO: 62055 - DNA, 25 bp, S. cerevisiae
ttccagcaactttgaaggtcctcag

SEQ ID NO: 62056 - DNA, 25 bp, S. cerevisiae
ttcgcacccattccaagagtttctg

SEQ ID NO: 62057 - DNA, 25 bp, S. cerevisiae
ttgcctctacttgcagaattttatg

SEQ ID NO: 62058 - DNA, 25 bp, S. cerevisiae
ttgacgataggcgacaaaacccaag

SEQ ID NO: 62059 - DNA, 25 bp, S. cerevisiae
ttgcacgtcagagataaccaccgat

SEQ ID NO: 62060 - DNA, 25 bp, S. cerevisiae
ttgcacattctgaaataacgccggg

SEQ ID NO: 62061 - DNA, 25 bp, S. cerevisiae
ttccattgtatgttatcgcagcagc

SEQ ID NO: 62062 - DNA, 25 bp, S. cerevisiae
ttctctatttgtatcgcatgcgcgg

SEQ ID NO: 62063 - DNA, 25 bp, S. cerevisiae
ttccttgtttgttttgttgcgtttg

SEQ ID NO: 62064 - DNA, 25 bp, S. cerevisiae
ttgccgtttaatttatttcgacact

SEQ ID NO: 62065 - DNA, 25 bp, S. cerevisiae
ttccttttgatgtcggatttcccac

SEQ ID NO: 62066 - DNA, 25 bp, S. cerevisiae
ttccatttctatttggtgccttcca

SEQ ID NO: 62067 - DNA, 25 bp, S. cerevisiae
ttctgcttcttgtgtttattctaac

SEQ ID NO: 62068 - DNA, 25 bp, S. cerevisiae
ttgccccggtgttgcattcatctag

SEQ ID NO: 62069 - DNA, 25 bp, S. cerevisiae
ttgccaaaggcccaattcactctgg

SEQ ID NO: 62070 - DNA, 25 bp, S. cerevisiae
ttccgtacacgcaaaatcttctcaa

SEQ ID NO: 62071 - DNA, 25 bp, S. cerevisiae
ttccgtacttgtacaatggattaca

SEQ ID NO: 62072 - DNA, 25 bp, S. cerevisiae
ttgcctcattcatcccacattagga

SEQ ID NO: 62073 - DNA, 25 bp, S. cerevisiae
ttgccggtaacccacaattggagtt

SEQ ID NO: 62074 - DNA, 25 bp, S. cerevisiae
ttctctggtaccatccaatctggaa

SEQ ID NO: 62075 - DNA, 25 bp, S. cerevisiae
ttcgcaccatcctttatcattttga

SEQ ID NO: 62076 - DNA, 25 bp, S. cerevisiae
ttgcgatccctgagaacctacgaaa

SEQ ID NO: 62077 - DNA, 25 bp, S. cerevisiae
ttcctatcggtttgaaacggtctca

SEQ ID NO: 62078 - DNA, 25 bp, S. cerevisiae
ttctcgccaggcaatttagactatt

SEQ ID NO: 62079 - DNA, 25 bp, S. cerevisiae
ttccggcaggctagttcagttcata

SEQ ID NO: 62080 - DNA, 25 bp, S. cerevisiae
ttctgctccggaagctgacttgaat

SEQ ID NO: 62081 - DNA, 25 bp, S. cerevisiae
ttcccggcatcatccattatattga

SEQ ID NO: 62082 - DNA, 25 bp, S. cerevisiae
ttccacggatattccaattgtgaac

SEQ ID NO: 62083 - DNA, 25 bp, S. cerevisiae
ttcccttattttgatctgtgcgtgc

SEQ ID NO: 62084 - DNA, 25 bp, S. cerevisiae
ttcgtcttcatgcttcagtcgtaat

SEQ ID NO: 62085 - DNA, 25 bp, S. cerevisiae
ttcgctatagcttttcagccactaa

SEQ ID NO: 62086 - DNA, 25 bp, S. cerevisiae
ttgggaactccatctttcgaagact

SEQ ID NO: 62087 - DNA, 25 bp, S. cerevisiae
ttgggtacgaagtcctacgaacaat

SEQ ID NO: 62088 - DNA, 25 bp, S. cerevisiae
ttggcggcaatataactactaaact

SEQ ID NO: 62089 - DNA, 25 bp, S. cerevisiae
ttgccagcagtttggcacctgtcta

SEQ ID NO: 62090 - DNA, 25 bp, S. cerevisiae
ttccacatttcacgacggtcaactg

SEQ ID NO: 62091 - DNA, 25 bp, S. cerevisiae
ttggctgccgcacctgtaaaatata

SEQ ID NO: 62092 - DNA, 25 bp, S. cerevisiae
ttgccgctggacgtgttgaagatta

SEQ ID NO: 62093 - DNA, 25 bp, S. cerevisiae
ttcgcggatgatatttgagaataaa

SEQ ID NO: 62094 - DNA, 25 bp, S. cerevisiae
ttcgctgctggtacttcatggttaa

SEQ ID NO: 62095 - DNA, 25 bp, S. cerevisiae
ttcggctgcgtcatcaattttaact

SEQ ID NO: 62096 - DNA, 25 bp, S. cerevisiae
ttgccagcaggtgttattgatgttc

SEQ ID NO: 62097 - DNA, 25 bp, S. cerevisiae
ttgccgtcgttgttccatgagattc

SEQ ID NO: 62098 - DNA, 25 bp, S. cerevisiae
ttcctctgctgtggctgaagtctaa

SEQ ID NO: 62099 - DNA, 25 bp, S. cerevisiae
ttcctggtgcgcatgacagttcaga

SEQ ID NO: 62100 - DNA, 25 bp, S. cerevisiae
ttgttctgcgactttcattccgtta

SEQ ID NO: 62101 - DNA, 25 bp, S. cerevisiae
ttgttggtaacttcacctccttgaa

SEQ ID NO: 62102 - DNA, 25 bp, S. cerevisiae
ttgattgcctactgttgaccaccaa

SEQ ID NO: 62103 - DNA, 25 bp, S. cerevisiae
ttgattcagctagcgttagccatga

SEQ ID NO: 62104 - DNA, 25 bp, S. cerevisiae
ttctgcatactacgcttatctttct

SEQ ID NO: 62105 - DNA, 25 bp, S. cerevisiae
ttgctaagccatctttttctttttt

SEQ ID NO: 62106 - DNA, 25 bp, S. cerevisiae
ttctgttgctttctttctctttttt

SEQ ID NO: 62107 - DNA, 25 bp, S. cerevisiae
ttcggtatcccaattgctgctatat

SEQ ID NO: 62108 - DNA, 25 bp, S. cerevisiae
ttgtcattcccctctatagtacaga

SEQ ID NO: 62109 - DNA, 25 bp, S. cerevisiae
ttcgcaaccaactccacgtaagaag

SEQ ID NO: 62110 - DNA, 25 bp, S. cerevisiae
ttcccatccaactctagctgaaaga

SEQ ID NO: 62111 - DNA, 25 bp, S. cerevisiae
ttcccctcattctgcaactttagat

SEQ ID NO: 62112 - DNA, 25 bp, S. cerevisiae
ttcgttctcttctgcaagtgatatt

SEQ ID NO: 62113 - DNA, 25 bp, S. cerevisiae
ttcgccctttgttccatttcatcat

SEQ ID NO: 62114 - DNA, 25 bp, S. cerevisiae
ttcggactttgaaccatatcaagct

SEQ ID NO: 62115 - DNA, 25 bp, S. cerevisiae
ttcggacccaaatgcatcaacagta

SEQ ID NO: 62116 - DNA, 25 bp, S. cerevisiae
ttccagctgaacaagtcaccagagt

SEQ ID NO: 62117 - DNA, 25 bp, S. cerevisiae
ttccatgcagaattgagcaccccac

SEQ ID NO: 62118 - DNA, 25 bp, S. cerevisiae
ttgtgatccagcaagagactcccct

SEQ ID NO: 62119 - DNA, 25 bp, S. cerevisiae
ttgctaccagaagacatccccgaag

SEQ ID NO: 62120 - DNA, 25 bp, S. cerevisiae
ttgattccagaagatcccaacgagg

SEQ ID NO: 62121 - DNA, 25 bp, S. cerevisiae
ttgattcctcaataccgctaacggg

SEQ ID NO: 62122 - DNA, 25 bp, S. cerevisiae
ttgaatttgttcttacgtgccccaa

SEQ ID NO: 62123 - DNA, 25 bp, S. cerevisiae
ttcgtttgctttaacattgccgcca

SEQ ID NO: 62124 - DNA, 25 bp, S. cerevisiae
ttcctcacagtttcgatccggacaa

SEQ ID NO: 62125 - DNA, 25 bp, S. cerevisiae
ttccctatctgcacttcgtgaggaa

SEQ ID NO: 62126 - DNA, 25 bp, S. cerevisiae
ttgccgctactgctcttgctgagag

SEQ ID NO: 62127 - DNA, 25 bp, S. cerevisiae
ttccatgtattgtttctcctttagg

SEQ ID NO: 62128 - DNA, 25 bp, S. cerevisiae
ttctgttgcgtgttattgtctctgt

SEQ ID NO: 62129 - DNA, 25 bp, S. cerevisiae
ttctggtgcattttttgcgcacgat

SEQ ID NO: 62130 - DNA, 25 bp, S. cerevisiae
ttcgggatgatctattacgctatgt

SEQ ID NO: 62131 - DNA, 25 bp, S. cerevisiae
ttgcgcgcctgcgaagtttccgctt

SEQ ID NO: 62132 - DNA, 25 bp, S. cerevisiae
ttcggctcccaactattgtggtgaa

SEQ ID NO: 62133 - DNA, 25 bp, S. cerevisiae
ttccctggccaccagatggaggtaa

SEQ ID NO: 62134 - DNA, 25 bp, S. cerevisiae
ttccacgtgcatccaaaccagtaga

SEQ ID NO: 62135 - DNA, 25 bp, S. cerevisiae
ttgccagagagccaaacaccgttgt

SEQ ID NO: 62136 - DNA, 25 bp, S. cerevisiae
ttgcctgacaagtgggccaattcta

SEQ ID NO: 62137 - DNA, 25 bp, S. cerevisiae
ttgtctcaccgatgggatcacctaa

SEQ ID NO: 62138 - DNA, 25 bp, S. cerevisiae
ttgttcccagaagttgacgccgaat

SEQ ID NO: 62139 - DNA, 25 bp, S. cerevisiae
ttctgtcgaagctcttgacgctgaa

SEQ ID NO: 62140 - DNA, 25 bp, S. cerevisiae
ttcgcgtttccttcgcaattaaaat

SEQ ID NO: 62141 - DNA, 25 bp, S. cerevisiae
ttgccgattatcaatgtcccagtta

SEQ ID NO: 62142 - DNA, 25 bp, S. cerevisiae
ttcgagcgacatacgcggcgacatc

SEQ ID NO: 62143 - DNA, 25 bp, S. cerevisiae
ttccagctggccattgtgtgcacga

SEQ ID NO: 62144 - DNA, 25 bp, S. cerevisiae
ttccactatccattgtcttcacaga

SEQ ID NO: 62145 - DNA, 25 bp, S. cerevisiae
ttccctgtccagtctttgattccaa

SEQ ID NO: 62146 - DNA, 25 bp, S. cerevisiae
ttcctcatgatggtgtggcttttcc

SEQ ID NO: 62147 - DNA, 25 bp, S. cerevisiae
ttctgtctgcatggaggactttccc

SEQ ID NO: 62148 - DNA, 25 bp, S. cerevisiae
ttgcttctgcacgtggcgatgataa

SEQ ID NO: 62149 - DNA, 25 bp, S. cerevisiae
ttgctatgcatactgcgggacattc

SEQ ID NO: 62150 - DNA, 25 bp, S. cerevisiae
ttgcattgatttcgttagcccctaa

SEQ ID NO: 62151 - DNA, 25 bp, S. cerevisiae
ttccttgccgagcttgatttcgata

SEQ ID NO: 62152 - DNA, 25 bp, S. cerevisiae
ttgcgcaggtcggtgatgattctat

SEQ ID NO: 62153 - DNA, 25 bp, S. cerevisiae
ttggtcttggtggtatcggcagtat

SEQ ID NO: 62154 - DNA, 25 bp, S. cerevisiae
ttgccaatgccgctcttttggatgc

SEQ ID NO: 62155 - DNA, 25 bp, S. cerevisiae
ttccacacaagccactcagaaggat

SEQ ID NO: 62156 - DNA, 25 bp, S. cerevisiae
ttgcccaagcaggactactagagta

SEQ ID NO: 62157 - DNA, 25 bp, S. cerevisiae
ttcgccatacgctaccagaaacgat

SEQ ID NO: 62158 - DNA, 25 bp, S. cerevisiae
ttcgccttatttgcacaacattctt

SEQ ID NO: 62159 - DNA, 25 bp, S. cerevisiae
ttcgcctctatcttcatcatcaaat

SEQ ID NO: 62160 - DNA, 25 bp, S. cerevisiae
ttcccactgccaatgtacctataaa

SEQ ID NO: 62161 - DNA, 25 bp, S. cerevisiae
ttcctgatcctctttccattattaa

SEQ ID NO: 62162 - DNA, 25 bp, S. cerevisiae
ttcgttcctgccactcgatattgaa

SEQ ID NO: 62163 - DNA, 25 bp, S. cerevisiae
ttcggtttcctccatgctgaataat

SEQ ID NO: 62164 - DNA, 25 bp, S. cerevisiae
ttgagaccacttcttgaacgacctt

SEQ ID NO: 62165 - DNA, 25 bp, S. cerevisiae
ttgaaccactttttatgccaagccc

SEQ ID NO: 62166 - DNA, 25 bp, S. cerevisiae
ttccacctttggttctctacagaag

SEQ ID NO: 62167 - DNA, 25 bp, S. cerevisiae
ttgtcaaggcttctaactggagatt

SEQ ID NO: 62168 - DNA, 25 bp, S. cerevisiae
ttcggtgctatatacatcccttggt

SEQ ID NO: 62169 - DNA, 25 bp, S. cerevisiae
ttgccgcaaataccagatcacctgt

SEQ ID NO: 62170 - DNA, 25 bp, S. cerevisiae
ttgttgtcaacatccttggacgctt

SEQ ID NO: 62171 - DNA, 25 bp, S. cerevisiae
ttgtatgatcagtttcctccagggt

SEQ ID NO: 62172 - DNA, 25 bp, S. cerevisiae
ttgactaacgcctttggttctgcaa

SEQ ID NO: 62173 - DNA, 25 bp, S. cerevisiae
ttgactttctccattggtggccaaa

SEQ ID NO: 62174 - DNA, 25 bp, S. cerevisiae
ttgcctttggctattccatggaata

SEQ ID NO: 62175 - DNA, 25 bp, S. cerevisiae
ttcctatgatttagttcctgctcct

SEQ ID NO: 62176 - DNA, 25 bp, S. cerevisiae
ttccgtgaattttccaagcttgctg

SEQ ID NO: 62177 - DNA, 25 bp, S. cerevisiae
ttccagtcttttgcaagccttgcga

SEQ ID NO: 62178 - DNA, 25 bp, S. cerevisiae
ttgccatacaagcatgtccccatag

SEQ ID NO: 62179 - DNA, 25 bp, S. cerevisiae
ttgcatcccagaacctgttcggaat

SEQ ID NO: 62180 - DNA, 25 bp, S. cerevisiae
ttgccatcctacttgactatcgtca

SEQ ID NO: 62181 - DNA, 25 bp, S. cerevisiae
ttgccacctgatctatctttgatcg

SEQ ID NO: 62182 - DNA, 25 bp, S. cerevisiae
ttgctgtccttgctactttggcgat

SEQ ID NO: 62183 - DNA, 25 bp, S. cerevisiae
ttggttcaacggtcattcatgggca

SEQ ID NO: 62184 - DNA, 25 bp, S. cerevisiae
ttggctatgccagggtcattgtacc

SEQ ID NO: 62185 - DNA, 25 bp, S. cerevisiae
ttgattgcactttatgtcggctaca

SEQ ID NO: 62186 - DNA, 25 bp, S. cerevisiae
ttgtgcatgcactgggtcggtactg

SEQ ID NO: 62187 - DNA, 25 bp, S. cerevisiae
ttgctatgagcttgggacgtggttt

SEQ ID NO: 62188 - DNA, 25 bp, S. cerevisiae
ttgcatatggtgttctagactctaa

SEQ ID NO: 62189 - DNA, 25 bp, S. cerevisiae
ttgcataatgtcttcatttcacgaa

SEQ ID NO: 62190 - DNA, 25 bp, S. cerevisiae
ttgcccagcacacccaatgaggata

SEQ ID NO: 62191 - DNA, 25 bp, S. cerevisiae
ttggccttggtggacgaaaacttgc

SEQ ID NO: 62192 - DNA, 25 bp, S. cerevisiae
ttcgctatcgccaaatatgctacat

SEQ ID NO: 62193 - DNA, 25 bp, S. cerevisiae
ttgccactccacaagaagctcaatt

SEQ ID NO: 62194 - DNA, 25 bp, S. cerevisiae
ttgcacaggaatcgtgtgggcccca

SEQ ID NO: 62195 - DNA, 25 bp, S. cerevisiae
ttggcgttggtgtaggtcaccactc

SEQ ID NO: 62196 - DNA, 25 bp, S. cerevisiae
ttgggactgttggaaacaccacctc

SEQ ID NO: 62197 - DNA, 25 bp, S. cerevisiae
ttggtgaattcgttaacacactacg

SEQ ID NO: 62198 - DNA, 25 bp, S. cerevisiae
ttgggagtaccaatcacccctattg

SEQ ID NO: 62199 - DNA, 25 bp, S. cerevisiae
ttgggtgataaagtcgcccctatcg

SEQ ID NO: 62200 - DNA, 25 bp, S. cerevisiae
ttgatgaacttcaccagacagcttg

SEQ ID NO: 62201 - DNA, 25 bp, S. cerevisiae
ttgatggtaatgatccgaacttggg

SEQ ID NO: 62202 - DNA, 25 bp, S. cerevisiae
ttgatcattcctttggtttccagtg

SEQ ID NO: 62203 - DNA, 25 bp, S. cerevisiae
ttgaataccgtgttgtttctggtgg

SEQ ID NO: 62204 - DNA, 25 bp, S. cerevisiae
ttgtacaccttgttctctggtccaa

SEQ ID NO: 62205 - DNA, 25 bp, S. cerevisiae
ttgtacacatctctccttggtttat

SEQ ID NO: 62206 - DNA, 25 bp, S. cerevisiae
ttgcccggcgaagtgttcacttgga

SEQ ID NO: 62207 - DNA, 25 bp, S. cerevisiae
ttgaaaaacgttcctactccatctc

SEQ ID NO: 62208 - DNA, 25 bp, S. cerevisiae
ttgaaaatccgttatcttccccatc

SEQ ID NO: 62209 - DNA, 25 bp, S. cerevisiae
ttccaaaccggttctgctaaggcta

SEQ ID NO: 62210 - DNA, 25 bp, S. cerevisiae
ttcgccaatctcaactttgctatgg

SEQ ID NO: 62211 - DNA, 25 bp, S. cerevisiae
ttcgcaaacatcaacttctccttaa

SEQ ID NO: 62212 - DNA, 25 bp, S. cerevisiae
ttcgataacatcaacacactctcat

SEQ ID NO: 62213 - DNA, 25 bp, S. cerevisiae
ttgctcgatatgcttacgggcggtc

SEQ ID NO: 62214 - DNA, 25 bp, S. cerevisiae
ttgctttacgcttacggcgatgtgc

SEQ ID NO: 62215 - DNA, 25 bp, S. cerevisiae
ttgttctaccaacctgggcagccaa

SEQ ID NO: 62216 - DNA, 25 bp, S. cerevisiae
ttgttcaaacctcctgtggcagtaa

SEQ ID NO: 62217 - DNA, 25 bp, S. cerevisiae
ttggtgccaacccagcggctattaa

SEQ ID NO: 62218 - DNA, 25 bp, S. cerevisiae
ttgttccaccgccaaactggatgaa

SEQ ID NO: 62219 - DNA, 25 bp, S. cerevisiae
ttgattcagcaagccacggatccat

SEQ ID NO: 62220 - DNA, 25 bp, S. cerevisiae
ttgaatcaagacctacccattctgg

SEQ ID NO: 62221 - DNA, 25 bp, S. cerevisiae
ttgctgattcatgtgctatttcaat

SEQ ID NO: 62222 - DNA, 25 bp, S. cerevisiae
ttcgcattcacgttcattatcacac

SEQ ID NO: 62223 - DNA, 25 bp, S. cerevisiae
ttgcattgttgccattgttttctgg

SEQ ID NO: 62224 - DNA, 25 bp, S. cerevisiae
ttgccagtcctcgaattacacggta

SEQ ID NO: 62225 - DNA, 25 bp, S. cerevisiae
ttccatatcccggttgacaacctat

SEQ ID NO: 62226 - DNA, 25 bp, S. cerevisiae
ttccagatccttgttactgatgccg

SEQ ID NO: 62227 - DNA, 25 bp, S. cerevisiae
ttccactacaagtcgatcgcggaca

SEQ ID NO: 62228 - DNA, 25 bp, S. cerevisiae
ttcgagcaagaattcacctctgcgc

SEQ ID NO: 62229 - DNA, 25 bp, S. cerevisiae
ttgaggcaactattaccgatgacgg

SEQ ID NO: 62230 - DNA, 25 bp, S. cerevisiae
ttgccgataccacttccggaagtga

SEQ ID NO: 62231 - DNA, 25 bp, S. cerevisiae
ttcgccttatgtatctccgcagcaa

SEQ ID NO: 62232 - DNA, 25 bp, S. cerevisiae
ttccacttatgtctcttcgagcaag

SEQ ID NO: 62233 - DNA, 25 bp, S. cerevisiae
ttgcacaccactagctatcgttaag

SEQ ID NO: 62234 - DNA, 25 bp, S. cerevisiae
ttgcagatcgctcagctgactttga

SEQ ID NO: 62235 - DNA, 25 bp, S. cerevisiae
ttgcaatcagggttagtcacgacta

SEQ ID NO: 62236 - DNA, 25 bp, S. cerevisiae
ttggaagctggtgactctgatatct

SEQ ID NO: 62237 - DNA, 25 bp, S. cerevisiae
ttgctaacacgccaactatgattat

SEQ ID NO: 62238 - DNA, 25 bp, S. cerevisiae
ttgtcattccgaccactgattttgc

SEQ ID NO: 62239 - DNA, 25 bp, S. cerevisiae
ttccctccatgatgcactatgtgtt

SEQ ID NO: 62240 - DNA, 25 bp, S. cerevisiae
ttcgccatctcaattgctgtagtgc

SEQ ID NO: 62241 - DNA, 25 bp, S. cerevisiae
ttgcagggcccatcaagttgtggaa

SEQ ID NO: 62242 - DNA, 25 bp, S. cerevisiae
ttggcggcccaaaatattgtataac

SEQ ID NO: 62243 - DNA, 25 bp, S. cerevisiae
ttgaccacctttgacatgaaccgac

SEQ ID NO: 62244 - DNA, 25 bp, S. cerevisiae
ttgcaccatttttccctacaaagag

SEQ ID NO: 62245 - DNA, 25 bp, S. cerevisiae
ttgcacggtgtctccttcaagaaga

SEQ ID NO: 62246 - DNA, 25 bp, S. cerevisiae
ttcccctgctgatgccgccaagaag

SEQ ID NO: 62247 - DNA, 25 bp, S. cerevisiae
ttgcctgttctactcggtatacaag

SEQ ID NO: 62248 - DNA, 25 bp, S. cerevisiae
ttccaatttggctactgcgtatgca

SEQ ID NO: 62249 - DNA, 25 bp, S. cerevisiae
ttcctcttctataaacaccctggta

SEQ ID NO: 62250 - DNA, 25 bp, S. cerevisiae
ttccatctcccttaacaaaacgtga

SEQ ID NO: 62251 - DNA, 25 bp, S. cerevisiae
ttcctctacttcttacgctatcaag

SEQ ID NO: 62252 - DNA, 25 bp, S. cerevisiae
ttcctctttctaatccgcttgaatc

SEQ ID NO: 62253 - DNA, 25 bp, S. cerevisiae
ttgggtgtttcagccatcaagctta

SEQ ID NO: 62254 - DNA, 25 bp, S. cerevisiae
ttggagttgctgtcatggcctacac

SEQ ID NO: 62255 - DNA, 25 bp, S. cerevisiae
ttgcacagttgtccatgcacagcat

SEQ ID NO: 62256 - DNA, 25 bp, S. cerevisiae
ttgaatacatcgatgaccacagatc

SEQ ID NO: 62257 - DNA, 25 bp, S. cerevisiae
ttgaaacggagcgacaagcgaccat

SEQ ID NO: 62258 - DNA, 25 bp, S. cerevisiae
ttgttggcggcactgacatcgcata

SEQ ID NO: 62259 - DNA, 25 bp, S. cerevisiae
ttgatgttgctgatcgctacaatgc

SEQ ID NO: 62260 - DNA, 25 bp, S. cerevisiae
ttgtgttgctttggctagggcacca

SEQ ID NO: 62261 - DNA, 25 bp, S. cerevisiae
ttgacttccttgatgacggttcaga

SEQ ID NO: 62262 - DNA, 25 bp, S. cerevisiae
ttggcttggtctgctgacggtcaaa

SEQ ID NO: 62263 - DNA, 25 bp, S. cerevisiae
ttgaatagtgttggcttcggcgcta

SEQ ID NO: 62264 - DNA, 25 bp, S. cerevisiae
ttgacagatttggtgcctccggtaa

SEQ ID NO: 62265 - DNA, 25 bp, S. cerevisiae
ttgctcttttgtacttcggcgataa

SEQ ID NO: 62266 - DNA, 25 bp, S. cerevisiae
ttgcatttggtgttcccgacgatat

SEQ ID NO: 62267 - DNA, 25 bp, S. cerevisiae
ttgtattgccattattgctaccatt

SEQ ID NO: 62268 - DNA, 25 bp, S. cerevisiae
ttgccatcgcacaaatgtcaaccgt

SEQ ID NO: 62269 - DNA, 25 bp, S. cerevisiae
ttggttaccaagaagatgccgccct

SEQ ID NO: 62270 - DNA, 25 bp, S. cerevisiae
ttggttactcaggtcagatacgatc

SEQ ID NO: 62271 - DNA, 25 bp, S. cerevisiae
ttcgcattccttgacgtcattcaaa

SEQ ID NO: 62272 - DNA, 25 bp, S. cerevisiae
ttccttgttggactgcttaccgata

SEQ ID NO: 62273 - DNA, 25 bp, S. cerevisiae
ttccatattcaccacgtttgtcgta

SEQ ID NO: 62274 - DNA, 25 bp, S. cerevisiae
ttgcctcctaccgtcgtagatcaaa

SEQ ID NO: 62275 - DNA, 25 bp, S. cerevisiae
ttgctgccggtcacctggtacaaag

SEQ ID NO: 62276 - DNA, 25 bp, S. cerevisiae
ttgtctcgttctaacggtgttttga

SEQ ID NO: 62277 - DNA, 25 bp, S. cerevisiae
ttggcgctctatcaaaggtcttttg

SEQ ID NO: 62278 - DNA, 25 bp, S. cerevisiae
ttgctggtgtatttgaagtcttttc

SEQ ID NO: 62279 - DNA, 25 bp, S. cerevisiae
ttgcgaccgttctctatcatttaca

SEQ ID NO: 62280 - DNA, 25 bp, S. cerevisiae
ttgacacctttggacaagcttctgc

SEQ ID NO: 62281 - DNA, 25 bp, S. cerevisiae
ttgaacctgtcttagttgcttctgc

SEQ ID NO: 62282 - DNA, 25 bp, S. cerevisiae
ttgatattacctggcgttgctttcg

SEQ ID NO: 62283 - DNA, 25 bp, S. cerevisiae
ttgatatcataactgcgagcttgga

SEQ ID NO: 62284 - DNA, 25 bp, S. cerevisiae
ttgcatacttatcaccatggcgcta

SEQ ID NO: 62285 - DNA, 25 bp, S. cerevisiae
ttggcttcggtctttattgaggcac

SEQ ID NO: 62286 - DNA, 25 bp, S. cerevisiae
ttggctttcgtccatctagttgaac

SEQ ID NO: 62287 - DNA, 25 bp, S. cerevisiae
ttgcattcgactatccaacggtggt

SEQ ID NO: 62288 - DNA, 25 bp, S. cerevisiae
ttgcatttagtgaaccgatcggtga

SEQ ID NO: 62289 - DNA, 25 bp, S. cerevisiae
ttgccgataggaacactcacgacga

SEQ ID NO: 62290 - DNA, 25 bp, S. cerevisiae
ttggatcaacatttctgggtagctc

SEQ ID NO: 62291 - DNA, 25 bp, S. cerevisiae
ttggattacccaagtcaaccgctga

SEQ ID NO: 62292 - DNA, 25 bp, S. cerevisiae
ttgcatttcccgtaataccaggctg

SEQ ID NO: 62293 - DNA, 25 bp, S. cerevisiae
ttgtgccttttatccaacgacacgg

SEQ ID NO: 62294 - DNA, 25 bp, S. cerevisiae
ttgcctattatcatactggacgcga

SEQ ID NO: 62295 - DNA, 25 bp, S. cerevisiae
ttgttggctgattgtactggcctgc

SEQ ID NO: 62296 - DNA, 25 bp, S. cerevisiae
ttgcctgactatattgttccaccac

SEQ ID NO: 62297 - DNA, 25 bp, S. cerevisiae
ttgtcgaggtttatgtccaacacat

SEQ ID NO: 62298 - DNA, 25 bp, S. cerevisiae
ttgccgctgaggagattgaccccaa

SEQ ID NO: 62299 - DNA, 25 bp, S. cerevisiae
ttgctcacggttgttacatctccaa

SEQ ID NO: 62300 - DNA, 25 bp, S. cerevisiae
ttgctccgtgcaaggtcttttggaa

SEQ ID NO: 62301 - DNA, 25 bp, S. cerevisiae
ttgccctcgaatactatttcatcag

SEQ ID NO: 62302 - DNA, 25 bp, S. cerevisiae
ttgccactctatccactaaatctat

SEQ ID NO: 62303 - DNA, 25 bp, S. cerevisiae
ttccttctattgtcgaacatctgat

SEQ ID NO: 62304 - DNA, 25 bp, S. cerevisiae
ttgcctctgctcttcaaaattggga

SEQ ID NO: 62305 - DNA, 25 bp, S. cerevisiae
ttcccgcttgatgcagaattgtggt

SEQ ID NO: 62306 - DNA, 25 bp, S. cerevisiae
ttgacccaagcgcagatcatcagtg

SEQ ID NO: 62307 - DNA, 25 bp, S. cerevisiae
ttgaagccaggcgatggatcatcct

SEQ ID NO: 62308 - DNA, 25 bp, S. cerevisiae
ttgaagccaagcaaggactttccgc

SEQ ID NO: 62309 - DNA, 25 bp, S. cerevisiae
ttgcaactcaaggtcgttttctcta

SEQ ID NO: 62310 - DNA, 25 bp, S. cerevisiae
ttgccactatgggtgagtctttttc

SEQ ID NO: 62311 - DNA, 25 bp, S. cerevisiae
ttgtattcacagaaggatggcctaa

SEQ ID NO: 62312 - DNA, 25 bp, S. cerevisiae
ttgctactacgcttgacaatgtcgg

SEQ ID NO: 62313 - DNA, 25 bp, S. cerevisiae
ttgcatttcttttgatgggcggctt

SEQ ID NO: 62314 - DNA, 25 bp, S. cerevisiae
ttgcgatgctaatggtgactctaac

SEQ ID NO: 62315 - DNA, 25 bp, S. cerevisiae
ttgcagattggatcgggcctacact

SEQ ID NO: 62316 - DNA, 25 bp, S. cerevisiae
ttgctgagagtatcaccaccaccat

SEQ ID NO: 62317 - DNA, 25 bp, S. cerevisiae
ttgcgattgcttacaccacaactag

SEQ ID NO: 62318 - DNA, 25 bp, S. cerevisiae
ttgccatttccaattccaatatcag

SEQ ID NO: 62319 - DNA, 25 bp, S. cerevisiae
ttggtttctcaattggattcatcga

SEQ ID NO: 62320 - DNA, 25 bp, S. cerevisiae
ttggtatttccattgagcctcgaga

SEQ ID NO: 62321 - DNA, 25 bp, S. cerevisiae
ttgggcgacttcctgcctaaacagg

SEQ ID NO: 62322 - DNA, 25 bp, S. cerevisiae
ttgaacgccttctgcatcatacaaa

SEQ ID NO: 62323 - DNA, 25 bp, S. cerevisiae
ttgccattgggttctgtcccagaag

SEQ ID NO: 62324 - DNA, 25 bp, S. cerevisiae
ttccagcacatctctatctacaata

SEQ ID NO: 62325 - DNA, 25 bp, S. cerevisiae
ttgcaagacacatctttccagttcc

SEQ ID NO: 62326 - DNA, 25 bp, S. cerevisiae
ttggaacgacacattatttttggcc

SEQ ID NO: 62327 - DNA, 25 bp, S. cerevisiae
ttgggtcaagttgtcttaactccat

SEQ ID NO: 62328 - DNA, 25 bp, S. cerevisiae
ttggttagagacaccttcaacgcct

SEQ ID NO: 62329 - DNA, 25 bp, S. cerevisiae
ttggccgaagtttcctatgcaacag

SEQ ID NO: 62330 - DNA, 25 bp, S. cerevisiae
ttgctgcgcaaactgtccctgataa

SEQ ID NO: 62331 - DNA, 25 bp, S. cerevisiae
ttggacaattttgccaccacagttg

SEQ ID NO: 62332 - DNA, 25 bp, S. cerevisiae
ttgccacatgccttcttacataacg

SEQ ID NO: 62333 - DNA, 25 bp, S. cerevisiae
ttgccaagccatttttatatcacca

SEQ ID NO: 62334 - DNA, 25 bp, S. cerevisiae
ttggctgccatatcagaaccatcct

SEQ ID NO: 62335 - DNA, 25 bp, S. cerevisiae
ttgcccatatacctgaattcatcct

SEQ ID NO: 62336 - DNA, 25 bp, S. cerevisiae
ttgcccttatctataatgacctcct

SEQ ID NO: 62337 - DNA, 25 bp, S. cerevisiae
ttgattggtttgctattcccactag

SEQ ID NO: 62338 - DNA, 25 bp, S. cerevisiae
ttggttttactagctcttttgtgag

SEQ ID NO: 62339 - DNA, 25 bp, S. cerevisiae
ttgggtatcactcaagtcttttggg

SEQ ID NO: 62340 - DNA, 25 bp, S. cerevisiae
ttgctgataacgacactctgacttt

SEQ ID NO: 62341 - DNA, 25 bp, S. cerevisiae
ttgctagagctgcacctgtggcaat

SEQ ID NO: 62342 - DNA, 25 bp, S. cerevisiae
ttgtacgtgatcagctgtcatccat

SEQ ID NO: 62343 - DNA, 25 bp, S. cerevisiae
ttgctctcataatttttctggccag

SEQ ID NO: 62344 - DNA, 25 bp, S. cerevisiae
ttgggcgctcagtcgattgtggcta

SEQ ID NO: 62345 - DNA, 25 bp, S. cerevisiae
ttgcctcctgttgttacttcaagcg

SEQ ID NO: 62346 - DNA, 25 bp, S. cerevisiae
ttgcctggcgttcccaaaatcagag

SEQ ID NO: 62347 - DNA, 25 bp, S. cerevisiae
ttgccgttgccatccaaaatgagct

SEQ ID NO: 62348 - DNA, 25 bp, S. cerevisiae
ttgttgccctggacccataaagtta

SEQ ID NO: 62349 - DNA, 25 bp, S. cerevisiae
ttgatcgacccaaccgctaagattt

SEQ ID NO: 62350 - DNA, 25 bp, S. cerevisiae
ttgacagctaaattaatccagggtt

SEQ ID NO: 62351 - DNA, 25 bp, S. cerevisiae
ttgccactcaacaaaccaaggatgt

SEQ ID NO: 62352 - DNA, 25 bp, S. cerevisiae
ttgcgcaaccatcgataacttactt

SEQ ID NO: 62353 - DNA, 25 bp, S. cerevisiae
ttggcttgccaacgaacgtacattt

SEQ ID NO: 62354 - DNA, 25 bp, S. cerevisiae
ttggctcgccaatgaacgtacattc

SEQ ID NO: 62355 - DNA, 25 bp, S. cerevisiae
ttgttctggattttgtaccccactg

SEQ ID NO: 62356 - DNA, 25 bp, S. cerevisiae
ttgtccttgcaaattggcacccaac

SEQ ID NO: 62357 - DNA, 25 bp, S. cerevisiae
ttccgattcattatatgctcccaga

SEQ ID NO: 62358 - DNA, 25 bp, S. cerevisiae
ttgccaattctctcttactggtatt

SEQ ID NO: 62359 - DNA, 25 bp, S. cerevisiae
ttgaattagctgatgctgctcctcc

SEQ ID NO: 62360 - DNA, 25 bp, S. cerevisiae
ttgtattggtgcttggcatccagcc

SEQ ID NO: 62361 - DNA, 25 bp, S. cerevisiae
ttgtatgtggatttggccgcggatc

SEQ ID NO: 62362 - DNA, 25 bp, S. cerevisiae
ttgatttatcaactccaccgccttt

SEQ ID NO: 62363 - DNA, 25 bp, S. cerevisiae
ttgcccgaaatagtgcgacctctta

SEQ ID NO: 62364 - DNA, 25 bp, S. cerevisiae
ttgccgccagaaatccagaacctat

SEQ ID NO: 62365 - DNA, 25 bp, S. cerevisiae
ttcctcgatatccaacacactaatt

SEQ ID NO: 62366 - DNA, 25 bp, S. cerevisiae
ttgccacgataccacaaacttgttc

SEQ ID NO: 62367 - DNA, 25 bp, S. cerevisiae
ttgctgcatctctggaaaacttgtg

SEQ ID NO: 62368 - DNA, 25 bp, S. cerevisiae
ttgactttcagtacgtgaccgggaa

SEQ ID NO: 62369 - DNA, 25 bp, S. cerevisiae
ttgtctataggtacgatactccgga

SEQ ID NO: 62370 - DNA, 25 bp, S. cerevisiae
ttgatcacacttctaagccttcaga

SEQ ID NO: 62371 - DNA, 25 bp, S. cerevisiae
ttgcaccaatatctagtctttctga

SEQ ID NO: 62372 - DNA, 25 bp, S. cerevisiae
ttgccattattgctaccattatcta

SEQ ID NO: 62373 - DNA, 25 bp, S. cerevisiae
ttgccggcaaggaagtcaagcacta

SEQ ID NO: 62374 - DNA, 25 bp, S. cerevisiae
ttgtcaacgagccttcaccaagatt

SEQ ID NO: 62375 - DNA, 25 bp, S. cerevisiae
ttccgtccccaccatagtgatgtaa

SEQ ID NO: 62376 - DNA, 25 bp, S. cerevisiae
ttgactgtcactgcccaatggattg

SEQ ID NO: 62377 - DNA, 25 bp, S. cerevisiae
ttgtcgcagacgaaccaagtgtcca

SEQ ID NO: 62378 - DNA, 25 bp, S. cerevisiae
ttgaatcatccatgcaccaatgtcc

SEQ ID NO: 62379 - DNA, 25 bp, S. cerevisiae
ttgaaattcagggtgcagtgcgctc

SEQ ID NO: 62380 - DNA, 25 bp, S. cerevisiae
ttgaccaattgatgaggcagaggcc

SEQ ID NO: 62381 - DNA, 25 bp, S. cerevisiae
ttgaatttcgatggtttctgccctt

SEQ ID NO: 62382 - DNA, 25 bp, S. cerevisiae
ttgacttacagagttacttcccata

SEQ ID NO: 62383 - DNA, 25 bp, S. cerevisiae
ttgcacagcacacagatgacacttt

SEQ ID NO: 62384 - DNA, 25 bp, S. cerevisiae
ttgccggcactcacatagcttatgg

SEQ ID NO: 62385 - DNA, 25 bp, S. cerevisiae
ttgtgcattaagctgccaatctgaa

SEQ ID NO: 62386 - DNA, 25 bp, S. cerevisiae
ttgtacgattatttgccggcctatt

SEQ ID NO: 62387 - DNA, 25 bp, S. cerevisiae
ttgctaaacaatgtcccgcactcaa

SEQ ID NO: 62388 - DNA, 25 bp, S. cerevisiae
ttgatgatccaagacctgccgtgaa

SEQ ID NO: 62389 - DNA, 25 bp, S. cerevisiae
ttggatccaactaacgacgacgaca

SEQ ID NO: 62390 - DNA, 25 bp, S. cerevisiae
ttgccacctcactttaacatcaaga

SEQ ID NO: 62391 - DNA, 25 bp, S. cerevisiae
ttgggcctgccctcatatataaata

SEQ ID NO: 62392 - DNA, 25 bp, S. cerevisiae
ttgaccctgtcggacattatgctag

SEQ ID NO: 62393 - DNA, 25 bp, S. cerevisiae
ttgcttacggtgttggatcttgcgc

SEQ ID NO: 62394 - DNA, 25 bp, S. cerevisiae
ttggtttagccggtgtgcattttaa

SEQ ID NO: 62395 - DNA, 25 bp, S. cerevisiae
ttgatactttgccttttgtctccac

SEQ ID NO: 62396 - DNA, 25 bp, S. cerevisiae
ttgaagtttcctaccttacctgagg

SEQ ID NO: 62397 - DNA, 25 bp, S. cerevisiae
ttgtctacttcgatcttgtacctga

SEQ ID NO: 62398 - DNA, 25 bp, S. cerevisiae
ttgcattcgtttacattccctattg

SEQ ID NO: 62399 - DNA, 25 bp, S. cerevisiae
ttgcatacacacattattccacgtt

SEQ ID NO: 62400 - DNA, 25 bp, S. cerevisiae
ttccaacagagctctatcgactatg

SEQ ID NO: 62401 - DNA, 25 bp, S. cerevisiae
ttgccaccaagatatgctgacactg

SEQ ID NO: 62402 - DNA, 25 bp, S. cerevisiae
ttccatcgacagtgttgagatgtaa

SEQ ID NO: 62403 - DNA, 25 bp, S. cerevisiae
ttgccatcgaagtcgctttgttaaa

SEQ ID NO: 62404 - DNA, 25 bp, S. cerevisiae
ttgcgctccaaaggctgtcgttaaa

SEQ ID NO: 62405 - DNA, 25 bp, S. cerevisiae
ttgttatcaacatcgccctggaaag

SEQ ID NO: 62406 - DNA, 25 bp, S. cerevisiae
ttgatcagaaactccggtgaaaaga

SEQ ID NO: 62407 - DNA, 25 bp, S. cerevisiae
ttgcccacacctacgagttcaaaaa

SEQ ID NO: 62408 - DNA, 25 bp, S. cerevisiae
ttgagggattgcctatgccaaccac

SEQ ID NO: 62409 - DNA, 25 bp, S. cerevisiae
ttggtggttctcttgccagaattgc

SEQ ID NO: 62410 - DNA, 25 bp, S. cerevisiae
ttgcgtttgcttttccagagtttac

SEQ ID NO: 62411 - DNA, 25 bp, S. cerevisiae
ttgcattttcttttccaattactaa

SEQ ID NO: 62412 - DNA, 25 bp, S. cerevisiae
ttgttttgtgcaactccaccatcaa

SEQ ID NO: 62413 - DNA, 25 bp, S. cerevisiae
ttgggaatgcacacgatacgctatt

SEQ ID NO: 62414 - DNA, 25 bp, S. cerevisiae
ttgacggagacaacgttactttatc

SEQ ID NO: 62415 - DNA, 25 bp, S. cerevisiae
ttggctgttgaaaatcctttggcta

SEQ ID NO: 62416 - DNA, 25 bp, S. cerevisiae
ttggcttctttatcctatatggtga

SEQ ID NO: 62417 - DNA, 25 bp, S. cerevisiae
ttggttgcgccattatcagacgtaa

SEQ ID NO: 62418 - DNA, 25 bp, S. cerevisiae
ttgactcttgtcattcgggtacagt

SEQ ID NO: 62419 - DNA, 25 bp, S. cerevisiae
ttgattccttttccggcgctaagat

SEQ ID NO: 62420 - DNA, 25 bp, S. cerevisiae
ttgttgccaactttcggtgctaagg

SEQ ID NO: 62421 - DNA, 25 bp, S. cerevisiae
ttggtcatcaagttatcgcggctgc

SEQ ID NO: 62422 - DNA, 25 bp, S. cerevisiae
ttgctctctgcaaactctggattag

SEQ ID NO: 62423 - DNA, 25 bp, S. cerevisiae
ttgctgtcgctatcctgagattgat

SEQ ID NO: 62424 - DNA, 25 bp, S. cerevisiae
ttgcatctgtccaccgacagcaata

SEQ ID NO: 62425 - DNA, 25 bp, S. cerevisiae
ttgatcatcccaggccaggcaggta

SEQ ID NO: 62426 - DNA, 25 bp, S. cerevisiae
ttgtccaacgacgagcagcaacttt

SEQ ID NO: 62427 - DNA, 25 bp, S. cerevisiae
ttgcggcctcgatgagcaacagcag

SEQ ID NO: 62428 - DNA, 25 bp, S. cerevisiae
ttgcagccaccggtagatacagcgt

SEQ ID NO: 62429 - DNA, 25 bp, S. cerevisiae
ttgttaccgttggtcaatgtagacc

SEQ ID NO: 62430 - DNA, 25 bp, S. cerevisiae
ttgttgaccggttatcctgatgaac

SEQ ID NO: 62431 - DNA, 25 bp, S. cerevisiae
ttgacgatgtcgcacaatccttgaa

SEQ ID NO: 62432 - DNA, 25 bp, S. cerevisiae
ttgagcgtctctacattcatcacgt

SEQ ID NO: 62433 - DNA, 25 bp, S. cerevisiae
ttgatggatccaactggcaccgctg

SEQ ID NO: 62434 - DNA, 25 bp, S. cerevisiae
ttgatgagtatgagggcactgccca

SEQ ID NO: 62435 - DNA, 25 bp, S. cerevisiae
ttgatgcacttgatggtacacccac

SEQ ID NO: 62436 - DNA, 25 bp, S. cerevisiae
ttgagcactctttctggaacagacc

SEQ ID NO: 62437 - DNA, 25 bp, S. cerevisiae
ttggcaattctttcgaaacctcacc

SEQ ID NO: 62438 - DNA, 25 bp, S. cerevisiae
ttggctacggtaaagtgcatcctga

SEQ ID NO: 62439 - DNA, 25 bp, S. cerevisiae
ttggtcgtggttcaagcatcgctga

SEQ ID NO: 62440 - DNA, 25 bp, S. cerevisiae
ttgcgtactttccaatatcagtgcg

SEQ ID NO: 62441 - DNA, 25 bp, S. cerevisiae
ttgaatggtttcacgagcctggcca

SEQ ID NO: 62442 - DNA, 25 bp, S. cerevisiae
ttgtctccaatgctacttcaatagt

SEQ ID NO: 62443 - DNA, 25 bp, S. cerevisiae
ttgttacgcagttagcttcgaggct

SEQ ID NO: 62444 - DNA, 25 bp, S. cerevisiae
ttgctggtatctttccatttggctc

SEQ ID NO: 62445 - DNA, 25 bp, S. cerevisiae
ttgcttgtgtttttgttggccatga

SEQ ID NO: 62446 - DNA, 25 bp, S. cerevisiae
ttgtgcatgtgggtacttgggccat

SEQ ID NO: 62447 - DNA, 25 bp, S. cerevisiae
ttggcatcggtggtattgggcatat

SEQ ID NO: 62448 - DNA, 25 bp, S. cerevisiae
ttggcatggcctggttgtcaactat

SEQ ID NO: 62449 - DNA, 25 bp, S. cerevisiae
ttggatgggccatgctgctgatttc

SEQ ID NO: 62450 - DNA, 25 bp, S. cerevisiae
ttgtcaggacttgtatcttccccaa

SEQ ID NO: 62451 - DNA, 25 bp, S. cerevisiae
ttgtcagtaattgcggttctcaccc

SEQ ID NO: 62452 - DNA, 25 bp, S. cerevisiae
ttgaaatccattctaccttgcacac

SEQ ID NO: 62453 - DNA, 25 bp, S. cerevisiae
ttgaaaatgcgccagctaacccttc

SEQ ID NO: 62454 - DNA, 25 bp, S. cerevisiae
ttgtgtacaactagccaactctgcg

SEQ ID NO: 62455 - DNA, 25 bp, S. cerevisiae
ttgatggaagatgccgctactgcgg

SEQ ID NO: 62456 - DNA, 25 bp, S. cerevisiae
ttgaaaggtgctctgatttgcggcc

SEQ ID NO: 62457 - DNA, 25 bp, S. cerevisiae
ttgaaaattgatctttccccgtctc

SEQ ID NO: 62458 - DNA, 25 bp, S. cerevisiae
ttccaaactgtatttgatactgcta

SEQ ID NO: 62459 - DNA, 25 bp, S. cerevisiae
ttccaatggagcaaattcaacgcga

SEQ ID NO: 62460 - DNA, 25 bp, S. cerevisiae
ttgactccaccatgtctcctaagaa

SEQ ID NO: 62461 - DNA, 25 bp, S. cerevisiae
ttgtctaacaccatccagcatgcaa

SEQ ID NO: 62462 - DNA, 25 bp, S. cerevisiae
ttgatcacatcaaggccaatggccc

SEQ ID NO: 62463 - DNA, 25 bp, S. cerevisiae
ttgagctatgacaccaatctgccgc

SEQ ID NO: 62464 - DNA, 25 bp, S. cerevisiae
ttgcaagaggcttccagatcaccgg

SEQ ID NO: 62465 - DNA, 25 bp, S. cerevisiae
ttgtttattcgtagatgatatggta

SEQ ID NO: 62466 - DNA, 25 bp, S. cerevisiae
ttggttatatcctttgcacggcatc

SEQ ID NO: 62467 - DNA, 25 bp, S. cerevisiae
ttgcctgatattgatgtcgacgact

SEQ ID NO: 62468 - DNA, 25 bp, S. cerevisiae
ttgccagaatctgctgtccaagctg

SEQ ID NO: 62469 - DNA, 25 bp, S. cerevisiae
ttgtacatacgtgctattcaggaaa

SEQ ID NO: 62470 - DNA, 25 bp, S. cerevisiae
ttggaccatataggacactcggcat

SEQ ID NO: 62471 - DNA, 25 bp, S. cerevisiae
ttggaattgcattggcagcccggcg

SEQ ID NO: 62472 - DNA, 25 bp, S. cerevisiae
ttgatgccatgaaagctgtcgctga

SEQ ID NO: 62473 - DNA, 25 bp, S. cerevisiae
ttgctattcttactcctcaggacaa

SEQ ID NO: 62474 - DNA, 25 bp, S. cerevisiae
ttgatcatactttttataggccaaa

SEQ ID NO: 62475 - DNA, 25 bp, S. cerevisiae
ttgaaactgttttcgctggccaaaa

SEQ ID NO: 62476 - DNA, 25 bp, S. cerevisiae
ttgaaaagcgcgctcgttgccaata

SEQ ID NO: 62477 - DNA, 25 bp, S. cerevisiae
ttgtaacgctgtcttgttgcctcat

SEQ ID NO: 62478 - DNA, 25 bp, S. cerevisiae
ttgtggacacgtcgctgtttgctta

SEQ ID NO: 62479 - DNA, 25 bp, S. cerevisiae
ttgagctcaagtactttggtcgtta

SEQ ID NO: 62480 - DNA, 25 bp, S. cerevisiae
ttgcgtccctttcatcgtcgtatat

SEQ ID NO: 62481 - DNA, 25 bp, S. cerevisiae
ttgcaccccgccattatgttaagaa

SEQ ID NO: 62482 - DNA, 25 bp, S. cerevisiae
ttggtcgcccgttaggtaagataag

SEQ ID NO: 62483 - DNA, 25 bp, S. cerevisiae
ttgccgcgattctcttctctaaaat

SEQ ID NO: 62484 - DNA, 25 bp, S. cerevisiae
ttgccggcatgtgcgttggcgaaaa

SEQ ID NO: 62485 - DNA, 25 bp, S. cerevisiae
ttgcctggtgctggtgctaccgaaa

SEQ ID NO: 62486 - DNA, 25 bp, S. cerevisiae
ttgtagctgcgctggcggcatgtaa

SEQ ID NO: 62487 - DNA, 25 bp, S. cerevisiae
ttgttcgcgataggctcggtgatta

SEQ ID NO: 62488 - DNA, 25 bp, S. cerevisiae
ttgtagattctacgccggtgttaat

SEQ ID NO: 62489 - DNA, 25 bp, S. cerevisiae
ttgggttcttggtcgttcatcaaac

SEQ ID NO: 62490 - DNA, 25 bp, S. cerevisiae
ttggtttttggttgtggtccacacg

SEQ ID NO: 62491 - DNA, 25 bp, S. cerevisiae
ttgtttttggaatcttgtgccccgt

SEQ ID NO: 62492 - DNA, 25 bp, S. cerevisiae
ttgcttttagtaactcgccagcgtt

SEQ ID NO: 62493 - DNA, 25 bp, S. cerevisiae
ttgattgttagcaataccgccggtt

SEQ ID NO: 62494 - DNA, 25 bp, S. cerevisiae
ttgatcgtcactacaaaccctaact

SEQ ID NO: 62495 - DNA, 25 bp, S. cerevisiae
ttgttgggctatttccaatgcctct

SEQ ID NO: 62496 - DNA, 25 bp, S. cerevisiae
ttgttcgtgagtctcgcacagcaac

SEQ ID NO: 62497 - DNA, 25 bp, S. cerevisiae
ttgagtttcagacccatcatcttac

SEQ ID NO: 62498 - DNA, 25 bp, S. cerevisiae
ttgtatcttagaccagcatctgcaa

SEQ ID NO: 62499 - DNA, 25 bp, S. cerevisiae
ttgtttctcagaccaactgccgttc

SEQ ID NO: 62500 - DNA, 25 bp, S. cerevisiae
ttgtctgatatcgtccataactgga

SEQ ID NO: 62501 - DNA, 25 bp, S. cerevisiae
ttgtactatctctcatatactgtgg

SEQ ID NO: 62502 - DNA, 25 bp, S. cerevisiae
ttgatgagccacgttattacttata

SEQ ID NO: 62503 - DNA, 25 bp, S. cerevisiae
ttgaagccacgactcactacgataa

SEQ ID NO: 62504 - DNA, 25 bp, S. cerevisiae
ttgaagccgggcatctgcacgaaat

SEQ ID NO: 62505 - DNA, 25 bp, S. cerevisiae
ttgacgcctgtggtgtccaagacaa

SEQ ID NO: 62506 - DNA, 25 bp, S. cerevisiae
ttgacgcaggtcatgataacagaga

SEQ ID NO: 62507 - DNA, 25 bp, S. cerevisiae
ttgtctccttcacaacagctggaat

SEQ ID NO: 62508 - DNA, 25 bp, S. cerevisiae
ttgcaagtaatcactgccgctgtgt

SEQ ID NO: 62509 - DNA, 25 bp, S. cerevisiae
ttgcacctgctgtaacttcttttaa

SEQ ID NO: 62510 - DNA, 25 bp, S. cerevisiae
ttgagctctgcttataccgatccat

SEQ ID NO: 62511 - DNA, 25 bp, S. cerevisiae
ttgttcagctccttcgaatggtgat

SEQ ID NO: 62512 - DNA, 25 bp, S. cerevisiae
ttgttactacacgtagatgagctat

SEQ ID NO: 62513 - DNA, 25 bp, S. cerevisiae
ttgcccatttcctatctgtcagaaa

SEQ ID NO: 62514 - DNA, 25 bp, S. cerevisiae
ttggtttatgccttctctacacaaa

SEQ ID NO: 62515 - DNA, 25 bp, S. cerevisiae
ttgcactgtcaagagcggtaactat

SEQ ID NO: 62516 - DNA, 25 bp, S. cerevisiae
ttgctggtgccatcagagctggtat

SEQ ID NO: 62517 - DNA, 25 bp, S. cerevisiae
ttgggtcaaccacattctttggcca

SEQ ID NO: 62518 - DNA, 25 bp, S. cerevisiae
ttgagcgcatgtgccgtttccgaga

SEQ ID NO: 62519 - DNA, 25 bp, S. cerevisiae
ttgcctgccttgtattttgcactga

SEQ ID NO: 62520 - DNA, 25 bp, S. cerevisiae
ttgatcaccctcacggtggtggtaa

SEQ ID NO: 62521 - DNA, 25 bp, S. cerevisiae
ttgttccgttcctattggtgtggaa

SEQ ID NO: 62522 - DNA, 25 bp, S. cerevisiae
ttgcccttgcttaacatgttctgta

SEQ ID NO: 62523 - DNA, 25 bp, S. cerevisiae
ttgactttgagtacgcaggccctaa

SEQ ID NO: 62524 - DNA, 25 bp, S. cerevisiae
ttggcctttgtttcattgcctacaa

SEQ ID NO: 62525 - DNA, 25 bp, S. cerevisiae
ttggccccgctagtcaagttagcaa

SEQ ID NO: 62526 - DNA, 25 bp, S. cerevisiae
ttgtatccacgtttcagcggtagat

SEQ ID NO: 62527 - DNA, 25 bp, S. cerevisiae
ttggtgacgccagacgggtatcctc

SEQ ID NO: 62528 - DNA, 25 bp, S. cerevisiae
ttgggagactctaacgtggtacgtg

SEQ ID NO: 62529 - DNA, 25 bp, S. cerevisiae
ttggaaatgcccacgttgatgacgt

SEQ ID NO: 62530 - DNA, 25 bp, S. cerevisiae
ttggaaatccgcttatttggccatg

SEQ ID NO: 62531 - DNA, 25 bp, S. cerevisiae
ttggtaactccatattagccgcttg

SEQ ID NO: 62532 - DNA, 25 bp, S. cerevisiae
ttggatatcaccgtaagtaccgccc

SEQ ID NO: 62533 - DNA, 25 bp, S. cerevisiae
ttggttcccataagatgttccccga

SEQ ID NO: 62534 - DNA, 25 bp, S. cerevisiae
ttgagtatctcgtacaagttcccca

SEQ ID NO: 62535 - DNA, 25 bp, S. cerevisiae
ttggttctcttagcgatacccatca

SEQ ID NO: 62536 - DNA, 25 bp, S. cerevisiae
ttgtcttatttagctcatcacggaa

SEQ ID NO: 62537 - DNA, 25 bp, S. cerevisiae
ttgttgttgcattccatttaagtag

SEQ ID NO: 62538 - DNA, 25 bp, S. cerevisiae
ttgcagcttcgtgtactacccggag

SEQ ID NO: 62539 - DNA, 25 bp, S. cerevisiae
ttgccgtcgttatgaacccatggga

SEQ ID NO: 62540 - DNA, 25 bp, S. cerevisiae
ttgccgccatcctaatcaagacaaa

SEQ ID NO: 62541 - DNA, 25 bp, S. cerevisiae
ttgacaccgccttcatacagacagt

SEQ ID NO: 62542 - DNA, 25 bp, S. cerevisiae
ttgcgaatctgcgaaaacctgttac

SEQ ID NO: 62543 - DNA, 25 bp, S. cerevisiae
ttggtttctcaggacagtgcttcgc

SEQ ID NO: 62544 - DNA, 25 bp, S. cerevisiae
ttgctacggctttggatcagtgact

SEQ ID NO: 62545 - DNA, 25 bp, S. cerevisiae
ttgctccggatttcgcatagttgtc

SEQ ID NO: 62546 - DNA, 25 bp, S. cerevisiae
ttgttcgagataccgcatgcgtttc

SEQ ID NO: 62547 - DNA, 25 bp, S. cerevisiae
ttgcagctgctacggcgtcctttca

SEQ ID NO: 62548 - DNA, 25 bp, S. cerevisiae
ttgcagctcctttggtatctttcaa

SEQ ID NO: 62549 - DNA, 25 bp, S. cerevisiae
ttgctgttgccgataacttcttcat

SEQ ID NO: 62550 - DNA, 25 bp, S. cerevisiae
ttgattgtccaggtattgtgccgcc

SEQ ID NO: 62551 - DNA, 25 bp, S. cerevisiae
ttgtttctgagttaagcttccaaag

SEQ ID NO: 62552 - DNA, 25 bp, S. cerevisiae
ttgttgtctgatgcttacgacgcta

SEQ ID NO: 62553 - DNA, 25 bp, S. cerevisiae
ttgcaatttttaacgggatctccca

SEQ ID NO: 62554 - DNA, 25 bp, S. cerevisiae
ttggtttggaacaaggcgtgccctt

SEQ ID NO: 62555 - DNA, 25 bp, S. cerevisiae
ttgcgtctacgttcttgactatgtt

SEQ ID NO: 62556 - DNA, 25 bp, S. cerevisiae
ttggcgagaagacggctctgccttt

SEQ ID NO: 62557 - DNA, 25 bp, S. cerevisiae
ttgagtatggccacaccgcagtata

SEQ ID NO: 62558 - DNA, 25 bp, S. cerevisiae
ttgatgttttcaacggtcccaaaag

SEQ ID NO: 62559 - DNA, 25 bp, S. cerevisiae
ttggattatccaaaggccccaataa

SEQ ID NO: 62560 - DNA, 25 bp, S. cerevisiae
ttgggatacacagcgtgccttcgat

SEQ ID NO: 62561 - DNA, 25 bp, S. cerevisiae
ttgagggcacttacgcaacagcttt

SEQ ID NO: 62562 - DNA, 25 bp, S. cerevisiae
ttgaatggacctaatgtacactttg

SEQ ID NO: 62563 - DNA, 25 bp, S. cerevisiae
ttggatataccgaatgtcacacatg

SEQ ID NO: 62564 - DNA, 25 bp, S. cerevisiae
ttgcccacacgagttgagccaaaag

SEQ ID NO: 62565 - DNA, 25 bp, S. cerevisiae
ttgtctgtcagtcctttgccaagaa

SEQ ID NO: 62566 - DNA, 25 bp, S. cerevisiae
ttgtcagcactttcgttccagaaca

SEQ ID NO: 62567 - DNA, 25 bp, S. cerevisiae
ttgaaacgctagcttacaactccct

SEQ ID NO: 62568 - DNA, 25 bp, S. cerevisiae
ttgaaaacagagaccctccaagtgc

SEQ ID NO: 62569 - DNA, 25 bp, S. cerevisiae
ttgaaaacagcatgcgcctccagag

SEQ ID NO: 62570 - DNA, 25 bp, S. cerevisiae
ttgactgaacagattgcccgcgaga

SEQ ID NO: 62571 - DNA, 25 bp, S. cerevisiae
ttgacgaaagtctccctgctatatg

SEQ ID NO: 62572 - DNA, 25 bp, S. cerevisiae
ttgacgaaatttcccaggacactgg

SEQ ID NO: 62573 - DNA, 25 bp, S. cerevisiae
ttgcgccagactttgacattttcac

SEQ ID NO: 62574 - DNA, 25 bp, S. cerevisiae
ttgcccagcattctgaagactctca

SEQ ID NO: 62575 - DNA, 25 bp, S. cerevisiae
ttgcgcgcgattgtataactgggac

SEQ ID NO: 62576 - DNA, 25 bp, S. cerevisiae
ttgccgcgaagttaagactgcctct

SEQ ID NO: 62577 - DNA, 25 bp, S. cerevisiae
ttgacccagagttcacaacagcttc

SEQ ID NO: 62578 - DNA, 25 bp, S. cerevisiae
ttgacccagttacaaatctcccaaa

SEQ ID NO: 62579 - DNA, 25 bp, S. cerevisiae
ttgatctttctagtcgttccattaa

SEQ ID NO: 62580 - DNA, 25 bp, S. cerevisiae
ttgttctctgtagcctttttcaatg

SEQ ID NO: 62581 - DNA, 25 bp, S. cerevisiae
ttgcgggattacaacatgtcatttc

SEQ ID NO: 62582 - DNA, 25 bp, S. cerevisiae
ttggccgttcgcaatcatcctgttg

SEQ ID NO: 62583 - DNA, 25 bp, S. cerevisiae
ttgctgctgctttcggtaactgtca

SEQ ID NO: 62584 - DNA, 25 bp, S. cerevisiae
ttgctagtccgaattatgtctgtac

SEQ ID NO: 62585 - DNA, 25 bp, S. cerevisiae
ttgctaataccattcttaggcctgt

SEQ ID NO: 62586 - DNA, 25 bp, S. cerevisiae
ttgttgcccgcatcatcattatgaa

SEQ ID NO: 62587 - DNA, 25 bp, S. cerevisiae
ttgttgccgcagtaatccttataat

SEQ ID NO: 62588 - DNA, 25 bp, S. cerevisiae
ttgggccactgggtagattctaatg

SEQ ID NO: 62589 - DNA, 25 bp, S. cerevisiae
ttgtcccttgtgctagattctatcg

SEQ ID NO: 62590 - DNA, 25 bp, S. cerevisiae
ttgctctccttatataatccttcag

SEQ ID NO: 62591 - DNA, 25 bp, S. cerevisiae
ttgtctaccctcttccaagaattga

SEQ ID NO: 62592 - DNA, 25 bp, S. cerevisiae
ttgaacctctttcccaatgaattgt

SEQ ID NO: 62593 - DNA, 25 bp, S. cerevisiae
ttgaagcttccttaccaatggttat

SEQ ID NO: 62594 - DNA, 25 bp, S. cerevisiae
ttgcgccaactttatccgacgttaa

SEQ ID NO: 62595 - DNA, 25 bp, S. cerevisiae
ttgcccaccatatacagaaccttag

SEQ ID NO: 62596 - DNA, 25 bp, S. cerevisiae
ttgcccaacaagaaagcgtcgcgta

SEQ ID NO: 62597 - DNA, 25 bp, S. cerevisiae
ttgtccaaccaattggcgacctgga

SEQ ID NO: 62598 - DNA, 25 bp, S. cerevisiae
ttggtcccattattatccctggagt

SEQ ID NO: 62599 - DNA, 25 bp, S. cerevisiae
ttgggtgccattgcttctccagaag

SEQ ID NO: 62600 - DNA, 25 bp, S. cerevisiae
ttgagtatttttccttgccaattgt

SEQ ID NO: 62601 - DNA, 25 bp, S. cerevisiae
ttgagttcctttccatatccatcta

SEQ ID NO: 62602 - DNA, 25 bp, S. cerevisiae
ttgaactttagctctgatgcgacag

SEQ ID NO: 62603 - DNA, 25 bp, S. cerevisiae
ttgaggtcaatgatcccgcctttta

SEQ ID NO: 62604 - DNA, 25 bp, S. cerevisiae
ttgtatgtacaagccacgcacttta

SEQ ID NO: 62605 - DNA, 25 bp, S. cerevisiae
ttgtcatcaactagtctacgcctgt

SEQ ID NO: 62606 - DNA, 25 bp, S. cerevisiae
ttggaacaaagattctgcctcctct

SEQ ID NO: 62607 - DNA, 25 bp, S. cerevisiae
ttgatgtccgaagtttcctctctta

SEQ ID NO: 62608 - DNA, 25 bp, S. cerevisiae
ttgattctcacacgtcttccatttt

SEQ ID NO: 62609 - DNA, 25 bp, S. cerevisiae
ttgatcctggcactgttgttgttta

SEQ ID NO: 62610 - DNA, 25 bp, S. cerevisiae
ttgctgcactactcgatggatttgt

SEQ ID NO: 62611 - DNA, 25 bp, S. cerevisiae
ttgtcctactacaaggtcgatgctg

SEQ ID NO: 62612 - DNA, 25 bp, S. cerevisiae
ttggcttgtgtggacgcgtttttaa

SEQ ID NO: 62613 - DNA, 25 bp, S. cerevisiae
ttgagcaccccaactgtgaacattt

SEQ ID NO: 62614 - DNA, 25 bp, S. cerevisiae
ttggtgtcgccaacgtcatgaatac

SEQ ID NO: 62615 - DNA, 25 bp, S. cerevisiae
ttgattgagcctaaccttggtgttg

SEQ ID NO: 62616 - DNA, 25 bp, S. cerevisiae
ttgcgagcgcaatgccaactgctga

SEQ ID NO: 62617 - DNA, 25 bp, S. cerevisiae
ttggacatccaacctactgctgaag

SEQ ID NO: 62618 - DNA, 25 bp, S. cerevisiae
ttggccacacaacagacacatgaat

SEQ ID NO: 62619 - DNA, 25 bp, S. cerevisiae
ttgcaagcaaagtccttttcaggat

SEQ ID NO: 62620 - DNA, 25 bp, S. cerevisiae
ttggccaagcagacaggcaccattg

SEQ ID NO: 62621 - DNA, 25 bp, S. cerevisiae
ttgacgaacgtcatcatcacaggat

SEQ ID NO: 62622 - DNA, 25 bp, S. cerevisiae
ttggctttggcgtatgacacattga

SEQ ID NO: 62623 - DNA, 25 bp, S. cerevisiae
ttggcttcggcactcttgcaattca

SEQ ID NO: 62624 - DNA, 25 bp, S. cerevisiae
ttggctccacgcatgacgaattcag

SEQ ID NO: 62625 - DNA, 25 bp, S. cerevisiae
ttggctcaagctactacgacttcta

SEQ ID NO: 62626 - DNA, 25 bp, S. cerevisiae
ttgctgctaataaatcacgccttgg

SEQ ID NO: 62627 - DNA, 25 bp, S. cerevisiae
ttgctgccagatatttccctcatta

SEQ ID NO: 62628 - DNA, 25 bp, S. cerevisiae
ttgctgctagtcttttccttcatta

SEQ ID NO: 62629 - DNA, 25 bp, S. cerevisiae
ttgctccagatatatatgccttctt

SEQ ID NO: 62630 - DNA, 25 bp, S. cerevisiae
ttgcaaaattctacatcatctcccg

SEQ ID NO: 62631 - DNA, 25 bp, S. cerevisiae
ttgcaagaattgatctccctcatcg

SEQ ID NO: 62632 - DNA, 25 bp, S. cerevisiae
ttgaacaacataaccacctcgcatg

SEQ ID NO: 62633 - DNA, 25 bp, S. cerevisiae
ttgtagcatactcaccaccggaagg

SEQ ID NO: 62634 - DNA, 25 bp, S. cerevisiae
ttggaatacactatgaccgagactg

SEQ ID NO: 62635 - DNA, 25 bp, S. cerevisiae
ttgggataaccctagcgccaatgca

SEQ ID NO: 62636 - DNA, 25 bp, S. cerevisiae
ttgggaatgcacagacgcgccataa

SEQ ID NO: 62637 - DNA, 25 bp, S. cerevisiae
ttgtccttcgccctaattcataaag

SEQ ID NO: 62638 - DNA, 25 bp, S. cerevisiae
ttgtccatcttgtgaggatctttat

SEQ ID NO: 62639 - DNA, 25 bp, S. cerevisiae
ttgtctacgagtttgtttcctcaaa

SEQ ID NO: 62640 - DNA, 25 bp, S. cerevisiae
ttgagtatcatcctcatgctcttgc

SEQ ID NO: 62641 - DNA, 25 bp, S. cerevisiae
ttggtatcaatgactgctttcagct

SEQ ID NO: 62642 - DNA, 25 bp, S. cerevisiae
ttggcaattataattcttctacacc

SEQ ID NO: 62643 - DNA, 25 bp, S. cerevisiae
ttgttgcctctttcctattaggttg

SEQ ID NO: 62644 - DNA, 25 bp, S. cerevisiae
ttgtccatcaaaccggagcctgtta

SEQ ID NO: 62645 - DNA, 25 bp, S. cerevisiae
ttgtgtctaatctcatgggccgtaa

SEQ ID NO: 62646 - DNA, 25 bp, S. cerevisiae
ttgagaccgtgctctatggccgtga

SEQ ID NO: 62647 - DNA, 25 bp, S. cerevisiae
ttgctcacaacatctccgctaagaa

SEQ ID NO: 62648 - DNA, 25 bp, S. cerevisiae
ttgcagcaaaacttcccggtcataa

SEQ ID NO: 62649 - DNA, 25 bp, S. cerevisiae
ttggcgataccttgccacggtcaga

SEQ ID NO: 62650 - DNA, 25 bp, S. cerevisiae
ttgggttctctggttaagcatggta

SEQ ID NO: 62651 - DNA, 25 bp, S. cerevisiae
ttgggctttcgatgctaagacgtcc

SEQ ID NO: 62652 - DNA, 25 bp, S. cerevisiae
ttggtcctaccatgctaagagctgc

SEQ ID NO: 62653 - DNA, 25 bp, S. cerevisiae
ttgtgtctgttgcaacagccgtcag

SEQ ID NO: 62654 - DNA, 25 bp, S. cerevisiae
ttgatgccattgctaagttcgctcc

SEQ ID NO: 62655 - DNA, 25 bp, S. cerevisiae
ttgctgacaagaccaagttcgcttt

SEQ ID NO: 62656 - DNA, 25 bp, S. cerevisiae
ttgagacattttccggtcacattta

SEQ ID NO: 62657 - DNA, 25 bp, S. cerevisiae
ttgaacatttttcgagaccttttct

SEQ ID NO: 62658 - DNA, 25 bp, S. cerevisiae
ttgtgccgcttttaatcttttgttc

SEQ ID NO: 62659 - DNA, 25 bp, S. cerevisiae
ttggattccaaacccttctgaggat

SEQ ID NO: 62660 - DNA, 25 bp, S. cerevisiae
ttgggtggtcattcagatcttctta

SEQ ID NO: 62661 - DNA, 25 bp, S. cerevisiae
ttggtcgcattcctgtgagcacata

SEQ ID NO: 62662 - DNA, 25 bp, S. cerevisiae
ttggcgacatatcaatgagcagcat

SEQ ID NO: 62663 - DNA, 25 bp, S. cerevisiae
ttgggtcatatgaatgcagcggcat

SEQ ID NO: 62664 - DNA, 25 bp, S. cerevisiae
ttgatggcttagactcgcatggctt

SEQ ID NO: 62665 - DNA, 25 bp, S. cerevisiae
ttgtgtcattaactccagcgctatt

SEQ ID NO: 62666 - DNA, 25 bp, S. cerevisiae
ttgagtttgaatcagcgcgactact

SEQ ID NO: 62667 - DNA, 25 bp, S. cerevisiae
ttggcgcccgcatgcagaggaaata

SEQ ID NO: 62668 - DNA, 25 bp, S. cerevisiae
ttgggcctgctcacagaggacatga

SEQ ID NO: 62669 - DNA, 25 bp, S. cerevisiae
ttggcctcgccaacaaggatgagag

SEQ ID NO: 62670 - DNA, 25 bp, S. cerevisiae
ttggtatgcccaaccgtcaatgcaa

SEQ ID NO: 62671 - DNA, 25 bp, S. cerevisiae
ttggttcctccaccgtcatgatggg

SEQ ID NO: 62672 - DNA, 25 bp, S. cerevisiae
ttgtgggtatcatttcaccatgggt

SEQ ID NO: 62673 - DNA, 25 bp, S. cerevisiae
ttgagaatttccgtatccatgccat

SEQ ID NO: 62674 - DNA, 25 bp, S. cerevisiae
ttggttgttttggtcagctctgtta

SEQ ID NO: 62675 - DNA, 25 bp, S. cerevisiae
ttggttcttggccagctattggatt

SEQ ID NO: 62676 - DNA, 25 bp, S. cerevisiae
ttggttgctgtttactacggattcc

SEQ ID NO: 62677 - DNA, 25 bp, S. cerevisiae
ttgctctagctggtgctttggcctt

SEQ ID NO: 62678 - DNA, 25 bp, S. cerevisiae
ttgatctatccttctacgagacgca

SEQ ID NO: 62679 - DNA, 25 bp, S. cerevisiae
ttggtgctgccattgttgtttgtat

SEQ ID NO: 62680 - DNA, 25 bp, S. cerevisiae
ttgttaccttttcttactccatttg

SEQ ID NO: 62681 - DNA, 25 bp, S. cerevisiae
ttgtgccaactttttcttctactac

SEQ ID NO: 62682 - DNA, 25 bp, S. cerevisiae
ttgaagcatatcaagccatttttcc

SEQ ID NO: 62683 - DNA, 25 bp, S. cerevisiae
ttgtgccagaatggacactattaca

SEQ ID NO: 62684 - DNA, 25 bp, S. cerevisiae
ttgtgcgagactggccgatgactaa

SEQ ID NO: 62685 - DNA, 25 bp, S. cerevisiae
ttgaaaacttcacgtctcctaacac

SEQ ID NO: 62686 - DNA, 25 bp, S. cerevisiae
ttgaaagatttccatctccctcaac

SEQ ID NO: 62687 - DNA, 25 bp, S. cerevisiae
ttgataagctcttcagacttcctgc

SEQ ID NO: 62688 - DNA, 25 bp, S. cerevisiae
ttgtacatgtgcatcagccataccc

SEQ ID NO: 62689 - DNA, 25 bp, S. cerevisiae
ttgtagcattgaccgcatctaactc

SEQ ID NO: 62690 - DNA, 25 bp, S. cerevisiae
ttgctacaatatctgcctctacatc

SEQ ID NO: 62691 - DNA, 25 bp, S. cerevisiae
ttggcgtgagcaacaacttgatcat

SEQ ID NO: 62692 - DNA, 25 bp, S. cerevisiae
ttgggcccaatcaacattccattgt

SEQ ID NO: 62693 - DNA, 25 bp, S. cerevisiae
ttgtgccctcaaatatcattcttag

SEQ ID NO: 62694 - DNA, 25 bp, S. cerevisiae
ttgtcctctcaattgaatgctttaa

SEQ ID NO: 62695 - DNA, 25 bp, S. cerevisiae
ttgttgctatgtcgtctatgcctct

SEQ ID NO: 62696 - DNA, 25 bp, S. cerevisiae
ttgatgtttgctcgtattgcccaac

SEQ ID NO: 62697 - DNA, 25 bp, S. cerevisiae
ttgtttttcctaatgctccagagct

SEQ ID NO: 62698 - DNA, 25 bp, S. cerevisiae
ttggttgaccacaaactggacgcta

SEQ ID NO: 62699 - DNA, 25 bp, S. cerevisiae
ttggttgcccaacatcgtgaacaaa

SEQ ID NO: 62700 - DNA, 25 bp, S. cerevisiae
ttggtttggcaactaccgaaaagca

SEQ ID NO: 62701 - DNA, 25 bp, S. cerevisiae
ttggcaggcgaagttcacggaaaac

SEQ ID NO: 62702 - DNA, 25 bp, S. cerevisiae
ttgacgcctaacaatcacggtgaaa

SEQ ID NO: 62703 - DNA, 25 bp, S. cerevisiae
ttggccattcaagatccaggtgatg

SEQ ID NO: 62704 - DNA, 25 bp, S. cerevisiae
ttggaatccaaccactcaagtgact

SEQ ID NO: 62705 - DNA, 25 bp, S. cerevisiae
ttggcctactacactcaaacgttga

SEQ ID NO: 62706 - DNA, 25 bp, S. cerevisiae
ttggcctcactagcgcttaacgata

SEQ ID NO: 62707 - DNA, 25 bp, S. cerevisiae
ttgtgcctcacatgcgactgtaaat

SEQ ID NO: 62708 - DNA, 25 bp, S. cerevisiae
ttgtctccatcatctactgcagcaa

SEQ ID NO: 62709 - DNA, 25 bp, S. cerevisiae
ttgttaggtcctcccgataaaagat

SEQ ID NO: 62710 - DNA, 25 bp, S. cerevisiae
ttgattccattctatccaatttcga

SEQ ID NO: 62711 - DNA, 25 bp, S. cerevisiae
ttgatgaccactgtccactctttga

SEQ ID NO: 62712 - DNA, 25 bp, S. cerevisiae
ttgcagtcctcaaccatgacgttaa

SEQ ID NO: 62713 - DNA, 25 bp, S. cerevisiae
ttggctccatcttccatgaaggtca

SEQ ID NO: 62714 - DNA, 25 bp, S. cerevisiae
ttggctcctttcctgatagatgatc

SEQ ID NO: 62715 - DNA, 25 bp, S. cerevisiae
ttgttgcactttcttggatatctaa

SEQ ID NO: 62716 - DNA, 25 bp, S. cerevisiae
ttgcaactgcgcaaagttcctcatt

SEQ ID NO: 62717 - DNA, 25 bp, S. cerevisiae
ttgcaagctatttaacgtcctggtt

SEQ ID NO: 62718 - DNA, 25 bp, S. cerevisiae
ttggctgctctatagtaacgggctt

SEQ ID NO: 62719 - DNA, 25 bp, S. cerevisiae
ttggtccttgatgaagcaacggctt

SEQ ID NO: 62720 - DNA, 25 bp, S. cerevisiae
ttgtgttcccatgaagatccggtta

SEQ ID NO: 62721 - DNA, 25 bp, S. cerevisiae
ttgtttcccataacaaccgttgcct

SEQ ID NO: 62722 - DNA, 25 bp, S. cerevisiae
ttgttccctcaaaagaccgtggctg

SEQ ID NO: 62723 - DNA, 25 bp, S. cerevisiae
ttgtctcgagccaaaagtcgctatt

SEQ ID NO: 62724 - DNA, 25 bp, S. cerevisiae
ttgtccaatatccttactccttaga

SEQ ID NO: 62725 - DNA, 25 bp, S. cerevisiae
ttgtcatccaatctttcttctctaa

SEQ ID NO: 62726 - DNA, 25 bp, S. cerevisiae
ttgtatcgccatcatttctaccatt

SEQ ID NO: 62727 - DNA, 25 bp, S. cerevisiae
ttgtttttgcacacttaccatcacg

SEQ ID NO: 62728 - DNA, 25 bp, S. cerevisiae
ttgtgtttggccaagttaccgccgg

SEQ ID NO: 62729 - DNA, 25 bp, S. cerevisiae
ttggtgttgccagaatctacgcctc

SEQ ID NO: 62730 - DNA, 25 bp, S. cerevisiae
ttgtatttgtcactggcaatgccaa

SEQ ID NO: 62731 - DNA, 25 bp, S. cerevisiae
ttgtatctcttccagaccaggtcaa

SEQ ID NO: 62732 - DNA, 25 bp, S. cerevisiae
ttgacactatcacagagccggccaa

SEQ ID NO: 62733 - DNA, 25 bp, S. cerevisiae
ttgatccttgctaaggccttgccta

SEQ ID NO: 62734 - DNA, 25 bp, S. cerevisiae
ttgatcaccttgattcctatggcgc

SEQ ID NO: 62735 - DNA, 25 bp, S. cerevisiae
ttgcaactctactcactctatttat

SEQ ID NO: 62736 - DNA, 25 bp, S. cerevisiae
ttggtgcccataatcttacaggtgt

SEQ ID NO: 62737 - DNA, 25 bp, S. cerevisiae
ttggtcatctctatctgtatcggta

SEQ ID NO: 62738 - DNA, 25 bp, S. cerevisiae
ttggatcacatctctttacgctatt

SEQ ID NO: 62739 - DNA, 25 bp, S. cerevisiae
ttgagatactctgcgttgggtttgg

SEQ ID NO: 62740 - DNA, 25 bp, S. cerevisiae
ttggtactgctgtgttgtgtttaac

SEQ ID NO: 62741 - DNA, 25 bp, S. cerevisiae
ttggacgccgtacgtgtctattgtg

SEQ ID NO: 62742 - DNA, 25 bp, S. cerevisiae
ttggccgacagttggttttttgatt

SEQ ID NO: 62743 - DNA, 25 bp, S. cerevisiae
ttgtcctgcaccaagcgatagcgaa

SEQ ID NO: 62744 - DNA, 25 bp, S. cerevisiae
ttggccgcatccaacttagcaaggg

SEQ ID NO: 62745 - DNA, 25 bp, S. cerevisiae
ttggcgcagccactaaattcaaagg

SEQ ID NO: 62746 - DNA, 25 bp, S. cerevisiae
ttgggcgcgcttggtattcaatgaa

SEQ ID NO: 62747 - DNA, 25 bp, S. cerevisiae
ttggcgccagcgattcatatcaaga

SEQ ID NO: 62748 - DNA, 25 bp, S. cerevisiae
ttggccccatttactatcaaaagtt

SEQ ID NO: 62749 - DNA, 25 bp, S. cerevisiae
ttggccctattcatccgtgacgaga

SEQ ID NO: 62750 - DNA, 25 bp, S. cerevisiae
ttggcttcttcatccaggatttcga

SEQ ID NO: 62751 - DNA, 25 bp, S. cerevisiae
ttggtttacttccatggtctcctaa

SEQ ID NO: 62752 - DNA, 25 bp, S. cerevisiae
ttggtcctcgctactatttgtctaa

SEQ ID NO: 62753 - DNA, 25 bp, S. cerevisiae
ttggacccgatgactttcaatctca

SEQ ID NO: 62754 - DNA, 25 bp, S. cerevisiae
ttggtagctgtttcaattccaccgc

SEQ ID NO: 62755 - DNA, 25 bp, S. cerevisiae
ttgatttctttccacaaacgcacca

SEQ ID NO: 62756 - DNA, 25 bp, S. cerevisiae
ttgtgtgtctttggcagtaactgaa

SEQ ID NO: 62757 - DNA, 25 bp, S. cerevisiae
ttggtgtttatgtgtggagcccgaa

SEQ ID NO: 62758 - DNA, 25 bp, S. cerevisiae
ttgttatttttacttcctggcgaag

SEQ ID NO: 62759 - DNA, 25 bp, S. cerevisiae
ttggtctctttaagttccgccgaag

SEQ ID NO: 62760 - DNA, 25 bp, S. cerevisiae
ttgaagaggctcgtatgctggctcg

SEQ ID NO: 62761 - DNA, 25 bp, S. cerevisiae
ttgaactctgctagaaagctacgtg

SEQ ID NO: 62762 - DNA, 25 bp, S. cerevisiae
ttgatgctttggctacggagtctac

SEQ ID NO: 62763 - DNA, 25 bp, S. cerevisiae
ttgatgtctactctatcgtcgttac

SEQ ID NO: 62764 - DNA, 25 bp, S. cerevisiae
ttggcgtaccagtatgttcgtgctc

SEQ ID NO: 62765 - DNA, 25 bp, S. cerevisiae
ttggactgtcttttctgtggtcttt

SEQ ID NO: 62766 - DNA, 25 bp, S. cerevisiae
ttgggctggcttttcaggctattat

SEQ ID NO: 62767 - DNA, 25 bp, S. cerevisiae
ttgagagggcgtttcaggcactgat

SEQ ID NO: 62768 - DNA, 25 bp, S. cerevisiae
ttgggctacgtatggtcttgtgcac

SEQ ID NO: 62769 - DNA, 25 bp, S. cerevisiae
ttggccatcaccttcggtattgtga

SEQ ID NO: 62770 - DNA, 25 bp, S. cerevisiae
ttgtttcccttgtctttggatgcat

SEQ ID NO: 62771 - DNA, 25 bp, S. cerevisiae
ttgtcttgtcaggtaactctgtcga

SEQ ID NO: 62772 - DNA, 25 bp, S. cerevisiae
ttgaatgtttatttcctggatgtac

SEQ ID NO: 62773 - DNA, 25 bp, S. cerevisiae
ttggaaacctccttacaactattag

SEQ ID NO: 62774 - DNA, 25 bp, S. cerevisiae
ttggatgatatgacctttggcgaaa

SEQ ID NO: 62775 - DNA, 25 bp, S. cerevisiae
ttgagtgcaagaactttcggtactt

SEQ ID NO: 62776 - DNA, 25 bp, S. cerevisiae
ttgggaaggccagatcgcgtacact

SEQ ID NO: 62777 - DNA, 25 bp, S. cerevisiae
ttggttatgccatccagctctggat

SEQ ID NO: 62778 - DNA, 25 bp, S. cerevisiae
ttggagtacctcgatcaaatccgat

SEQ ID NO: 62779 - DNA, 25 bp, S. cerevisiae
ttgggtactgccttcaagtcttctc

SEQ ID NO: 62780 - DNA, 25 bp, S. cerevisiae
ttggttacgccatcaagttgattca

SEQ ID NO: 62781 - DNA, 25 bp, S. cerevisiae
ttgggtgacccaacaaatcatgcat

SEQ ID NO: 62782 - DNA, 25 bp, S. cerevisiae
ttggtgtaccgctagaatcactgat

SEQ ID NO: 62783 - DNA, 25 bp, S. cerevisiae
ttgggacatccctatggtatctgat

SEQ ID NO: 62784 - DNA, 25 bp, S. cerevisiae
ttggacacaccctaggtgcaggtat

SEQ ID NO: 62785 - DNA, 25 bp, S. cerevisiae
ttggcaaccccatggctcatagaat

SEQ ID NO: 62786 - DNA, 25 bp, S. cerevisiae
ttgagaaccccaggctctagagttg

SEQ ID NO: 62787 - DNA, 25 bp, S. cerevisiae
ttggaacttcaaggcccagaggctt

SEQ ID NO: 62788 - DNA, 25 bp, S. cerevisiae
ttgaaacagttacgtccacaccggt

SEQ ID NO: 62789 - DNA, 25 bp, S. cerevisiae
ttgaactaccattatgtccctactg

SEQ ID NO: 62790 - DNA, 25 bp, S. cerevisiae
ttgaccaatctataccacctactga

SEQ ID NO: 62791 - DNA, 25 bp, S. cerevisiae
ttggctgaattgtctcctttatcct

SEQ ID NO: 62792 - DNA, 25 bp, S. cerevisiae
ttgaagaatcttccgagtggctcct

SEQ ID NO: 62793 - DNA, 25 bp, S. cerevisiae
ttgtgtgcgattttgcgaacctctc

SEQ ID NO: 62794 - DNA, 25 bp, S. cerevisiae
ttggcctgcgtcatgaatacacttt

SEQ ID NO: 62795 - DNA, 25 bp, S. cerevisiae
ttggccggtttggaagactctcagt

SEQ ID NO: 62796 - DNA, 25 bp, S. cerevisiae
ttggccaagtgtaagaaacctgatt

SEQ ID NO: 62797 - DNA, 25 bp, S. cerevisiae
ttggcattctatgtcaaacgattag

SEQ ID NO: 62798 - DNA, 25 bp, S. cerevisiae
ttggcagccattatcatatccgtta

SEQ ID NO: 62799 - DNA, 25 bp, S. cerevisiae
ttggcactgttacctatcactttag

SEQ ID NO: 62800 - DNA, 25 bp, S. cerevisiae
ttgggcgttagccacaactttctac

SEQ ID NO: 62801 - DNA, 25 bp, S. cerevisiae
ttgtggagttcgcagacactgtctt

SEQ ID NO: 62802 - DNA, 25 bp, S. cerevisiae
ttgaggttatctccgatactgtccc

SEQ ID NO: 62803 - DNA, 25 bp, S. cerevisiae
ttgaacccgcttagagactccgaaa

SEQ ID NO: 62804 - DNA, 25 bp, S. cerevisiae
ttgatgtccccaacaaacttattaa

SEQ ID NO: 62805 - DNA, 25 bp, S. cerevisiae
ttgtgtccaagaaagcccttcctaa

SEQ ID NO: 62806 - DNA, 25 bp, S. cerevisiae
ttgatctcacaattatacccttata

SEQ ID NO: 62807 - DNA, 25 bp, S. cerevisiae
ttggttcgtccttccacctgaaaag

SEQ ID NO: 62808 - DNA, 25 bp, S. cerevisiae
ttgagcgagcccgttaaccatgcat

SEQ ID NO: 62809 - DNA, 25 bp, S. cerevisiae
ttgggaacaccatcgcagaaagtag

SEQ ID NO: 62810 - DNA, 25 bp, S. cerevisiae
ttggctatacaatacccgcggagag

SEQ ID NO: 62811 - DNA, 25 bp, S. cerevisiae
ttggaatcacaatcgcaaacgctga

SEQ ID NO: 62812 - DNA, 25 bp, S. cerevisiae
ttggaaatccaacaacacgctagat

SEQ ID NO: 62813 - DNA, 25 bp, S. cerevisiae
ttgtttatccaactacgcctgctaa

SEQ ID NO: 62814 - DNA, 25 bp, S. cerevisiae
ttggtaagccattcttctcctctaa

SEQ ID NO: 62815 - DNA, 25 bp, S. cerevisiae
ttggcctacttttcctcagttatat

SEQ ID NO: 62816 - DNA, 25 bp, S. cerevisiae
ttgggctcctttttatcgttcgtcg

SEQ ID NO: 62817 - DNA, 25 bp, S. cerevisiae
ttggttcctcttttgattagcgtat

SEQ ID NO: 62818 - DNA, 25 bp, S. cerevisiae
ttgaggttctttcacttgctgtaac

SEQ ID NO: 62819 - DNA, 25 bp, S. cerevisiae
ttgtcctcatcaagtcaaatggcga

SEQ ID NO: 62820 - DNA, 25 bp, S. cerevisiae
ttgtcctatttgaagagagccgcca

SEQ ID NO: 62821 - DNA, 25 bp, S. cerevisiae
ttggtcatccaaattctcccttatg

SEQ ID NO: 62822 - DNA, 25 bp, S. cerevisiae
ttggtctcaagttgtctccttccag

SEQ ID NO: 62823 - DNA, 25 bp, S. cerevisiae
ttgggtgcaagttgggccttcatca

SEQ ID NO: 62824 - DNA, 25 bp, S. cerevisiae
ttggctgaagaactgggccttgtca

SEQ ID NO: 62825 - DNA, 25 bp, S. cerevisiae
ttgtgccactccatctttgaaagat

SEQ ID NO: 62826 - DNA, 25 bp, S. cerevisiae
ttgagtcctcatattccgacaatgt

SEQ ID NO: 62827 - DNA, 25 bp, S. cerevisiae
ttggtgcacgatatcgccgaatctt

SEQ ID NO: 62828 - DNA, 25 bp, S. cerevisiae
ttggctaagacattccgcacgcata

SEQ ID NO: 62829 - DNA, 25 bp, S. cerevisiae
ttggtacggaatctgagctgctatc

SEQ ID NO: 62830 - DNA, 25 bp, S. cerevisiae
ttggtgattgtttcgaggctgctat

SEQ ID NO: 62831 - DNA, 25 bp, S. cerevisiae
ttgtgctgcattcctcatcaagtgg

SEQ ID NO: 62832 - DNA, 25 bp, S. cerevisiae
ttggctcatacttggcatctgggaa

SEQ ID NO: 62833 - DNA, 25 bp, S. cerevisiae
ttggcacacctgctgctgattctat

SEQ ID NO: 62834 - DNA, 25 bp, S. cerevisiae
ttggctcaggagcatcgcatgttat

SEQ ID NO: 62835 - DNA, 25 bp, S. cerevisiae
ttggctgaactgcaccatatcattg

SEQ ID NO: 62836 - DNA, 25 bp, S. cerevisiae
ttggccacacaggaccatatctggg

SEQ ID NO: 62837 - DNA, 25 bp, S. cerevisiae
ttgaccaacagatctcttgaagcgt

SEQ ID NO: 62838 - DNA, 25 bp, S. cerevisiae
ttggcacaaagggtcgtcacgcagt

SEQ ID NO: 62839 - DNA, 25 bp, S. cerevisiae
ttggaccaatggcttgcacacctga

SEQ ID NO: 62840 - DNA, 25 bp, S. cerevisiae
ttgagaccagtgagacgccacttga

SEQ ID NO: 62841 - DNA, 25 bp, S. cerevisiae
ttgaccacgatgacgactggacttt

SEQ ID NO: 62842 - DNA, 25 bp, S. cerevisiae
ttgactcctacaacagtggctcttg

SEQ ID NO: 62843 - DNA, 25 bp, S. cerevisiae
ttggcttctcaaacaggtgctcgta

SEQ ID NO: 62844 - DNA, 25 bp, S. cerevisiae
ttgggcgtgacaatggttgctctaa

SEQ ID NO: 62845 - DNA, 25 bp, S. cerevisiae
ttgggcgcgaagacttattcataca

SEQ ID NO: 62846 - DNA, 25 bp, S. cerevisiae
ttgggcacgaaagttcatgcactac

SEQ ID NO: 62847 - DNA, 25 bp, S. cerevisiae
ttgagcaaagttggccaccgcagta

SEQ ID NO: 62848 - DNA, 25 bp, S. cerevisiae
ttgtcccaatgaacacatccgcaag

SEQ ID NO: 62849 - DNA, 25 bp, S. cerevisiae
ttgtgagcaaaaactctcctgcaga

SEQ ID NO: 62850 - DNA, 25 bp, S. cerevisiae
ttgtgaaaacagaacctagcgaagc

SEQ ID NO: 62851 - DNA, 25 bp, S. cerevisiae
ttgggttggccatgaatacgaaaaa

SEQ ID NO: 62852 - DNA, 25 bp, S. cerevisiae
ttgggcatagataaagtctccggtt

SEQ ID NO: 62853 - DNA, 25 bp, S. cerevisiae
ttgtgtagaattgcagattcccttt

SEQ ID NO: 62854 - DNA, 25 bp, S. cerevisiae
ttggttctatctgctgttgccgcta

SEQ ID NO: 62855 - DNA, 25 bp, S. cerevisiae
ttggtacgatgttgtctctggagct

SEQ ID NO: 62856 - DNA, 25 bp, S. cerevisiae
ttgtcgaccatgttgccgtaagagc

SEQ ID NO: 62857 - DNA, 25 bp, S. cerevisiae
ttgggactatggacgctgataaaga

SEQ ID NO: 62858 - DNA, 25 bp, S. cerevisiae
ttggcgttatctacatctttcatcg

SEQ ID NO: 62859 - DNA, 25 bp, S. cerevisiae
ttgggtttcccaatctgataggttt

SEQ ID NO: 62860 - DNA, 25 bp, S. cerevisiae
ttgggtttccccaatgatctggcat

SEQ ID NO: 62861 - DNA, 25 bp, S. cerevisiae
ttgtggcatcaaaacctgtggcggt

SEQ ID NO: 62862 - DNA, 25 bp, S. cerevisiae
ttggcacaaagttccatgctcgctt

SEQ ID NO: 62863 - DNA, 25 bp, S. cerevisiae
ttggccaaggcatctcagaacaaac

SEQ ID NO: 62864 - DNA, 25 bp, S. cerevisiae
ttgtcaacaggcacatcgagcacga

SEQ ID NO: 62865 - DNA, 25 bp, S. cerevisiae
ttgagataatgtccaccgcttcagc

SEQ ID NO: 62866 - DNA, 25 bp, S. cerevisiae
ttggcccagttagtcgttcgcgatg

SEQ ID NO: 62867 - DNA, 25 bp, S. pombe
agtcctgacggagcaactttagcct

SEQ ID NO: 62868 - DNA, 25 bp, S. pombe
gtagtcccctcgaggcgttttgaag

SEQ ID NO: 62869 - DNA, 25 bp, S. pombe
agacgttaagttctctagcccttgt

SEQ ID NO: 62870 - DNA, 25 bp, S. pombe
ggaagttccctctgttgttttcgct

SEQ ID NO: 62871 - DNA, 25 bp, S. pombe
atgccgttaaggatcgtattgttcg

SEQ ID NO: 62872 - DNA, 25 bp, S. pombe
agacgcgttaaccacaattagcttg

SEQ ID NO: 62873 - DNA, 25 bp, S. pombe
aggcgagtcgcagaaccgtagtcga

SEQ ID NO: 62874 - DNA, 25 bp, S. pombe
aaaggcccgggctcttcgtggagca

SEQ ID NO: 62875 - DNA, 25 bp, S. pombe
agttaaatccttgtcccgggatgca

SEQ ID NO: 62876 - DNA, 25 bp, S. pombe
aggttggtccttcagcttcttttat

SEQ ID NO: 62877 - DNA, 25 bp, S. pombe
aggtaaccccgatgttcttgattca

SEQ ID NO: 62878 - DNA, 25 bp, S. pombe
gcgttactacggtgacttgcaaggt

SEQ ID NO: 62879 - DNA, 25 bp, S. pombe
gtaccgccaaggaggtttctgccta

SEQ ID NO: 62880 - DNA, 25 bp, S. pombe
tctacgggaaacactcggtcgaagt

SEQ ID NO: 62881 - DNA, 25 bp, S. pombe
aaaccgtaccttctgcattaattgc

SEQ ID NO: 62882 - DNA, 25 bp, S. pombe
caaaccttggctcaactaagttggg

SEQ ID NO: 62883 - DNA, 25 bp, S. pombe
ggttacccggtcaggatttgaggca

SEQ ID NO: 62884 - DNA, 25 bp, S. pombe
gtttacggtccgagactttcgagat

SEQ ID NO: 62885 - DNA, 25 bp, S. pombe
aactttcccggacaagaaggcgatg

SEQ ID NO: 62886 - DNA, 25 bp, S. pombe
cggtttggccggtgtagtcaattat

SEQ ID NO: 62887 - DNA, 25 bp, S. pombe
ataaaactactatacttccccgctg

SEQ ID NO: 62888 - DNA, 25 bp, S. pombe
ggacgttgcttctgtaaaccggaag

SEQ ID NO: 62889 - DNA, 25 bp, S. pombe
ccaccaaaaggtaaacaagtctctg

SEQ ID NO: 62890 - DNA, 25 bp, S. pombe
aacttaatccctcaagacgtcttgg

SEQ ID NO: 62891 - DNA, 25 bp, S. pombe
aaagttccaggacaagacgtaccag

SEQ ID NO: 62892 - DNA, 25 bp, S. pombe
aaccccgttagagcttactgacact

SEQ ID NO: 62893 - DNA, 25 bp, S. pombe
aacgacgtttttgaaagtgcagaca

SEQ ID NO: 62894 - DNA, 25 bp, S. pombe
atgcgggttcgtaaatcaatttcca

SEQ ID NO: 62895 - DNA, 25 bp, S. pombe
atcgacgttaatgaccctttagctc

SEQ ID NO: 62896 - DNA, 25 bp, S. pombe
ataccattttcgcttcaaacccttg

SEQ ID NO: 62897 - DNA, 25 bp, S. pombe
accggtttgcgtctaattacttgtg

SEQ ID NO: 62898 - DNA, 25 bp, S. pombe
tgttttggtaattccgcaacgggcg

SEQ ID NO: 62899 - DNA, 25 bp, S. pombe
tgccaaaatttaagggccctggact

SEQ ID NO: 62900 - DNA, 25 bp, S. pombe
tcctttttagttatccccttcaatg

SEQ ID NO: 62901 - DNA, 25 bp, S. pombe
gctgccgtaatcaatggtgcggtac

SEQ ID NO: 62902 - DNA, 25 bp, S. pombe
ttgttcgaacagtgggcggtattac

SEQ ID NO: 62903 - DNA, 25 bp, S. pombe
aggtggaagcgtgcctacttttgac

SEQ ID NO: 62904 - DNA, 25 bp, S. pombe
ggcccctaaacctggatcaacgatc

SEQ ID NO: 62905 - DNA, 25 bp, S. pombe
ggcaggttctgagcggttaagttac

SEQ ID NO: 62906 - DNA, 25 bp, S. pombe
tttgggaccggcatacgttccgtca

SEQ ID NO: 62907 - DNA, 25 bp, S. pombe
tttgccaaccgtggtaccgtcgaag

SEQ ID NO: 62908 - DNA, 25 bp, S. pombe
gcgaacgtacgtctagttggcttat

SEQ ID NO: 62909 - DNA, 25 bp, S. pombe
aaacaggtggtctccaacttacgat

SEQ ID NO: 62910 - DNA, 25 bp, S. pombe
ctattcggcggactagggataaatt

SEQ ID NO: 62911 - DNA, 25 bp, S. pombe
acggctttccggcaacttgtaaatg

SEQ ID NO: 62912 - DNA, 25 bp, S. pombe
agccctttccggctgaaattcaagt

SEQ ID NO: 62913 - DNA, 25 bp, S. pombe
ttccgggccatatcaggtttactat

SEQ ID NO: 62914 - DNA, 25 bp, S. pombe
ttagttgtacgaacgggttgtcctg

SEQ ID NO: 62915 - DNA, 25 bp, S. pombe
agggtgaatcggtgtcctcggactt

SEQ ID NO: 62916 - DNA, 25 bp, S. pombe
aggaggttcgacttccggcaaacat

SEQ ID NO: 62917 - DNA, 25 bp, S. pombe
tcgtggtttgggtcctaaattggca

SEQ ID NO: 62918 - DNA, 25 bp, S. pombe
cgtggtgttccacaaatcgaggtca

SEQ ID NO: 62919 - DNA, 25 bp, S. pombe
agtcgttggacgcaaggttcctacg

SEQ ID NO: 62920 - DNA, 25 bp, S. pombe
agccgccgtacgcaaggtcttggat

SEQ ID NO: 62921 - DNA, 25 bp, S. pombe
accaaacgacgagccttctatagga

SEQ ID NO: 62922 - DNA, 25 bp, S. pombe
ttgggttaaaccatacatccctccg

SEQ ID NO: 62923 - DNA, 25 bp, S. pombe
tatgggttaccctgttattccttgg

SEQ ID NO: 62924 - DNA, 25 bp, S. pombe
gtaaacgatactcaacggttggcca

SEQ ID NO: 62925 - DNA, 25 bp, S. pombe
aaatctggaactcaacgttctcccg

SEQ ID NO: 62926 - DNA, 25 bp, S. pombe
aaattacgggaatctcttactgagt

SEQ ID NO: 62927 - DNA, 25 bp, S. pombe
accttcgggtaatgccttagcgtat

SEQ ID NO: 62928 - DNA, 25 bp, S. pombe
aactggtgggatgcacccgtttggt

SEQ ID NO: 62929 - DNA, 25 bp, S. pombe
tcaattaacaggaggttccccgtag

SEQ ID NO: 62930 - DNA, 25 bp, S. pombe
cgtactactaacttgggaccaggat

SEQ ID NO: 62931 - DNA, 25 bp, S. pombe
cggtagagtacgctggttccaaatt

SEQ ID NO: 62932 - DNA, 25 bp, S. pombe
aggccgagtacgagtgggatcaaac

SEQ ID NO: 62933 - DNA, 25 bp, S. pombe
tcggcggaacgactcaagggtcaat

SEQ ID NO: 62934 - DNA, 25 bp, S. pombe
ctacgggagcacctgaattggcaca

SEQ ID NO: 62935 - DNA, 25 bp, S. pombe
ttaaaactacgatgcccgacgacca

SEQ ID NO: 62936 - DNA, 25 bp, S. pombe
gccgtttccaaatattaccctcaat

SEQ ID NO: 62937 - DNA, 25 bp, S. pombe
ccctcaacgtgatcaaatccctgaa

SEQ ID NO: 62938 - DNA, 25 bp, S. pombe
attccaaacttttcctttgccattg

SEQ ID NO: 62939 - DNA, 25 bp, S. pombe
attccaatatcgatacctacccaaa

SEQ ID NO: 62940 - DNA, 25 bp, S. pombe
ttgtaaatgcaagaccggctaactt

SEQ ID NO: 62941 - DNA, 25 bp, S. pombe
atcaagttgccttttcggacaagcc

SEQ ID NO: 62942 - DNA, 25 bp, S. pombe
atagagttgccgctaacgacggacc

SEQ ID NO: 62943 - DNA, 25 bp, S. pombe
atacgcttcctacatacgggtacgc

SEQ ID NO: 62944 - DNA, 25 bp, S. pombe
aacctatattagcaacgggcggcga

SEQ ID NO: 62945 - DNA, 25 bp, S. pombe
accttcgtttaatctcgggagctca

SEQ ID NO: 62946 - DNA, 25 bp, S. pombe
cgaatgggcaaatactaaactagga

SEQ ID NO: 62947 - DNA, 25 bp, S. pombe
acatcccggaatctttgtggtccta

SEQ ID NO: 62948 - DNA, 25 bp, S. pombe
atatctcctaaatactatgaagccg

SEQ ID NO: 62949 - DNA, 25 bp, S. pombe
gggaaaaggtggtgctaagcgtcac

SEQ ID NO: 62950 - DNA, 25 bp, S. pombe
tcccttaaacttgaactccacttgg

SEQ ID NO: 62951 - DNA, 25 bp, S. pombe
tcccttaaccttttttgagcaccag

SEQ ID NO: 62952 - DNA, 25 bp, S. pombe
ggccttaaaagatattctactccta

SEQ ID NO: 62953 - DNA, 25 bp, S. pombe
ctttccccatttcaacagagaccaa

SEQ ID NO: 62954 - DNA, 25 bp, S. pombe
ttagacgttatacaacctccaaccg

SEQ ID NO: 62955 - DNA, 25 bp, S. pombe
ttcaagtacgtacaaccggacccat

SEQ ID NO: 62956 - DNA, 25 bp, S. pombe
tactttcgggaatatcctgggtcca

SEQ ID NO: 62957 - DNA, 25 bp, S. pombe
accgttcgagatatgtcccgttaca

SEQ ID NO: 62958 - DNA, 25 bp, S. pombe
aaaggccgaaggctctaccttgaag

SEQ ID NO: 62959 - DNA, 25 bp, S. pombe
attttggtaacgcatcttcctctac

SEQ ID NO: 62960 - DNA, 25 bp, S. pombe
gagtacttaaaatccctcgggccag

SEQ ID NO: 62961 - DNA, 25 bp, S. pombe
ggtacgtaaaaacaagaggcatcac

SEQ ID NO: 62962 - DNA, 25 bp, S. pombe
gccgatcgaaaagagctaacgccca

SEQ ID NO: 62963 - DNA, 25 bp, S. pombe
cttcacgtaggtcagctcgagttag

SEQ ID NO: 62964 - DNA, 25 bp, S. pombe
gggctataacgatacccagttctcg

SEQ ID NO: 62965 - DNA, 25 bp, S. pombe
aacggtgaccgctgtttggtactgc

SEQ ID NO: 62966 - DNA, 25 bp, S. pombe
aacaagttcgtgcagtcctttatcc

SEQ ID NO: 62967 - DNA, 25 bp, S. pombe
aaagttttagttgctagactcacgc

SEQ ID NO: 62968 - DNA, 25 bp, S. pombe
aggttcccaactctatggcccaata

SEQ ID NO: 62969 - DNA, 25 bp, S. pombe
ccgactaggaggtttagggaatgca

SEQ ID NO: 62970 - DNA, 25 bp, S. pombe
cggtcaggaacgttatcgggccatt

SEQ ID NO: 62971 - DNA, 25 bp, S. pombe
agtttattagtgcacgggccgcagc

SEQ ID NO: 62972 - DNA, 25 bp, S. pombe
gcttggaaagtcactccgttacgta

SEQ ID NO: 62973 - DNA, 25 bp, S. pombe
tctttcgggactctttttagcttat

SEQ ID NO: 62974 - DNA, 25 bp, S. pombe
cataatcccaaagccgtaattccta

SEQ ID NO: 62975 - DNA, 25 bp, S. pombe
atgaatatccagaggccggaccttt

SEQ ID NO: 62976 - DNA, 25 bp, S. pombe
atgaggttcaaactcgggacttgtt

SEQ ID NO: 62977 - DNA, 25 bp, S. pombe
tctccgggtaactgcaaaactgtcc

SEQ ID NO: 62978 - DNA, 25 bp, S. pombe
gccttttagggcaccagaactgttt

SEQ ID NO: 62979 - DNA, 25 bp, S. pombe
gccttggtaaagagtttccctgtga

SEQ ID NO: 62980 - DNA, 25 bp, S. pombe
gccttcttaaatattcgtaccttgg

SEQ ID NO: 62981 - DNA, 25 bp, S. pombe
accttccggagtatggtacttgtgc

SEQ ID NO: 62982 - DNA, 25 bp, S. pombe
aggattactgggtacgggacgcatt

SEQ ID NO: 62983 - DNA, 25 bp, S. pombe
attaacctacgctgaagagggtcaa

SEQ ID NO: 62984 - DNA, 25 bp, S. pombe
atccaaagtcccaaagaatcccaag

SEQ ID NO: 62985 - DNA, 25 bp, S. pombe
ctttaattccagctttaatcttaat

SEQ ID NO: 62986 - DNA, 25 bp, S. pombe
cttccttgcctatttttggtcgtat

SEQ ID NO: 62987 - DNA, 25 bp, S. pombe
agtccttcgggtgagtttttgtatg

SEQ ID NO: 62988 - DNA, 25 bp, S. pombe
ttagtagtcgactccatttttgggt

SEQ ID NO: 62989 - DNA, 25 bp, S. pombe
aagctagacgtttcttttactggcg

SEQ ID NO: 62990 - DNA, 25 bp, S. pombe
atcctggaaacctgacgcgggtact

SEQ ID NO: 62991 - DNA, 25 bp, S. pombe
atttgattcaactctttaacgacga

SEQ ID NO: 62992 - DNA, 25 bp, S. pombe
atttgttccccgcttggagaatcaa

SEQ ID NO: 62993 - DNA, 25 bp, S. pombe
attactcctgaaaaatctaccggtg

SEQ ID NO: 62994 - DNA, 25 bp, S. pombe
attcctttaggtcatgctttgggta

SEQ ID NO: 62995 - DNA, 25 bp, S. pombe
atatttttccttctttgggtgctcg

SEQ ID NO: 62996 - DNA, 25 bp, S. pombe
aaatctcgggcttcagtaacgcaac

SEQ ID NO: 62997 - DNA, 25 bp, S. pombe
aaatttaagccctgaagctaccgct

SEQ ID NO: 62998 - DNA, 25 bp, S. pombe
attttgtaccctatgaacttgccga

SEQ ID NO: 62999 - DNA, 25 bp, S. pombe
ctggccttttcctcaaagtttaatg

SEQ ID NO: 63000 - DNA, 25 bp, S. pombe
ttgaccccggaagccactagcgaaa

SEQ ID NO: 63001 - DNA, 25 bp, S. pombe
atacgatcccaccactggtaagggt

SEQ ID NO: 63002 - DNA, 25 bp, S. pombe
aaggaactggaacatccgactccct

SEQ ID NO: 63003 - DNA, 25 bp, S. pombe
agccgaagtcaatctcctgaagttc

SEQ ID NO: 63004 - DNA, 25 bp, S. pombe
acctaatgaccacacacgattcttg

SEQ ID NO: 63005 - DNA, 25 bp, S. pombe
acggaagacccatacgcttgtagta

SEQ ID NO: 63006 - DNA, 25 bp, S. pombe
aggtggcggttctcccgaaattgag

SEQ ID NO: 63007 - DNA, 25 bp, S. pombe
agctaaccctttgtcggaaatcgca

SEQ ID NO: 63008 - DNA, 25 bp, S. pombe
attactccaagtgctttagaattaa

SEQ ID NO: 63009 - DNA, 25 bp, S. pombe
catcaaggccgttgagaaggttgcc

SEQ ID NO: 63010 - DNA, 25 bp, S. pombe
acgttatagacggtggcagggccat

SEQ ID NO: 63011 - DNA, 25 bp, S. pombe
acattaatagacacggaagttaccg

SEQ ID NO: 63012 - DNA, 25 bp, S. pombe
aattaccgtcctcaaagtttctatg

SEQ ID NO: 63013 - DNA, 25 bp, S. pombe
ctacgaaatcagagagcgaaccaat

SEQ ID NO: 63014 - DNA, 25 bp, S. pombe
ctgtcgtcaacgctggcaacaagcc

SEQ ID NO: 63015 - DNA, 25 bp, S. pombe
ttagttaagtttgccaacgccctcg

SEQ ID NO: 63016 - DNA, 25 bp, S. pombe
aggtacagattttgcccgggttgtg

SEQ ID NO: 63017 - DNA, 25 bp, S. pombe
cccgatttactagctaccgatttgg

SEQ ID NO: 63018 - DNA, 25 bp, S. pombe
gctttacttacttccaaccaatttg

SEQ ID NO: 63019 - DNA, 25 bp, S. pombe
atcaaccaaattattacccagccca

SEQ ID NO: 63020 - DNA, 25 bp, S. pombe
attaccaaatttacgaaccatggtg

SEQ ID NO: 63021 - DNA, 25 bp, S. pombe
tttcccaaaagcatcgaacccttgt

SEQ ID NO: 63022 - DNA, 25 bp, S. pombe
cctacccgtctctcgaaagtattat

SEQ ID NO: 63023 - DNA, 25 bp, S. pombe
acccggcgcttctgagaacgttgaa

SEQ ID NO: 63024 - DNA, 25 bp, S. pombe
atctcgggccccattaattttggag

SEQ ID NO: 63025 - DNA, 25 bp, S. pombe
atcccagacccactagaattttcgt

SEQ ID NO: 63026 - DNA, 25 bp, S. pombe
gtggtaccctttcaacttgtttatg

SEQ ID NO: 63027 - DNA, 25 bp, S. pombe
cggataccggttcccacaaatgtgg

SEQ ID NO: 63028 - DNA, 25 bp, S. pombe
cggtaccggctatcataaacgagtt

SEQ ID NO: 63029 - DNA, 25 bp, S. pombe
ccctggatcttgagtttttacgctt

SEQ ID NO: 63030 - DNA, 25 bp, S. pombe
ccagggacttggattttcgttcttg

SEQ ID NO: 63031 - DNA, 25 bp, S. pombe
ccgggtaatggtgctttggtctttg

SEQ ID NO: 63032 - DNA, 25 bp, S. pombe
agcaggtgaattctttggtcccgcc

SEQ ID NO: 63033 - DNA, 25 bp, S. pombe
tggactaggttcatttacccgccca

SEQ ID NO: 63034 - DNA, 25 bp, S. pombe
gcagaggtcctttaaaacggctacg

SEQ ID NO: 63035 - DNA, 25 bp, S. pombe
aaataccatcttcaggttccaacag

SEQ ID NO: 63036 - DNA, 25 bp, S. pombe
atctccgaaaatctggacgcgttcc

SEQ ID NO: 63037 - DNA, 25 bp, S. pombe
agtgcgttattacagggaagccagc

SEQ ID NO: 63038 - DNA, 25 bp, S. pombe
cgacgttgttcccaaggtactcttg

SEQ ID NO: 63039 - DNA, 25 bp, S. pombe
atgcagatctttgtaaaaaccctta

SEQ ID NO: 63040 - DNA, 25 bp, S. pombe
ttaatccccgttcaatatcctttca

SEQ ID NO: 63041 - DNA, 25 bp, S. pombe
ataaccgtcggctcaaattttgaag

SEQ ID NO: 63042 - DNA, 25 bp, S. pombe
aggattatggccaacgtgcccgtaa

SEQ ID NO: 63043 - DNA, 25 bp, S. pombe
atccccagtaagtggtcccaaacat

SEQ ID NO: 63044 - DNA, 25 bp, S. pombe
agtttccgtgagtacgccaacgaca

SEQ ID NO: 63045 - DNA, 25 bp, S. pombe
agtattcccggtgtcaaaagtgcaa

SEQ ID NO: 63046 - DNA, 25 bp, S. pombe
cagtacccgggtgtcaaaagattct

SEQ ID NO: 63047 - DNA, 25 bp, S. pombe
catttaatcgggtggccttaggtct

SEQ ID NO: 63048 - DNA, 25 bp, S. pombe
atattttaggtatcccgctgggtga

SEQ ID NO: 63049 - DNA, 25 bp, S. pombe
attttcaggaaaacccgcatgtgcg

SEQ ID NO: 63050 - DNA, 25 bp, S. pombe
atcgttaagcaaaaccggcgtcgtg

SEQ ID NO: 63051 - DNA, 25 bp, S. pombe
ttaggaaacgacaccgtccaagcca

SEQ ID NO: 63052 - DNA, 25 bp, S. pombe
tttccgcaccggcaaaatttaatgg

SEQ ID NO: 63053 - DNA, 25 bp, S. pombe
actacctcagggatccaagttcgtt

SEQ ID NO: 63054 - DNA, 25 bp, S. pombe
attaaaaagcctttgccgggcactg

SEQ ID NO: 63055 - DNA, 25 bp, S. pombe
atcaaccttgtgcttggaatgcgaa

SEQ ID NO: 63056 - DNA, 25 bp, S. pombe
atgcccttttggcttggaagattac

SEQ ID NO: 63057 - DNA, 25 bp, S. pombe
atcggtcgttgtctcgaactgttag

SEQ ID NO: 63058 - DNA, 25 bp, S. pombe
aaagggctgttcagtgggcttacct

SEQ ID NO: 63059 - DNA, 25 bp, S. pombe
atcaaggccgttgagaaggttgccc

SEQ ID NO: 63060 - DNA, 25 bp, S. pombe
atatacgcggtttggatacgatcct

SEQ ID NO: 63061 - DNA, 25 bp, S. pombe
tttcgtcagtcgcaggttattaccc

SEQ ID NO: 63062 - DNA, 25 bp, S. pombe
ctacgggaggctttgggacagtact

SEQ ID NO: 63063 - DNA, 25 bp, S. pombe
aatggtatccgtcccgaaggtattg

SEQ ID NO: 63064 - DNA, 25 bp, S. pombe
attaaagtggatcctcaacgtcgag

SEQ ID NO: 63065 - DNA, 25 bp, S. pombe
gccttaccacccaagacggattgtt

SEQ ID NO: 63066 - DNA, 25 bp, S. pombe
ggctaacagttagaacggtcgcttt

SEQ ID NO: 63067 - DNA, 25 bp, S. pombe
gtaaaattgctgtgccccgaagtcg

SEQ ID NO: 63068 - DNA, 25 bp, S. pombe
gtaaggtcggtatgcgccgtttcca

SEQ ID NO: 63069 - DNA, 25 bp, S. pombe
gtttcggaaaacatacctacagctt

SEQ ID NO: 63070 - DNA, 25 bp, S. pombe
gttgtaggtactcttaccgcaaccg

SEQ ID NO: 63071 - DNA, 25 bp, S. pombe
agttcaagtagtctttcgggctctc

SEQ ID NO: 63072 - DNA, 25 bp, S. pombe
ctctcaagcaagcacccaagttttt

SEQ ID NO: 63073 - DNA, 25 bp, S. pombe
acctagtcctggtgcttggaggcgc

SEQ ID NO: 63074 - DNA, 25 bp, S. pombe
acgaccgccggtgtgaagagtgttt

SEQ ID NO: 63075 - DNA, 25 bp, S. pombe
gctgcgtaaagctttggaacccgtt

SEQ ID NO: 63076 - DNA, 25 bp, S. pombe
acgtaaggataagaaggccgcttct

SEQ ID NO: 63077 - DNA, 25 bp, S. pombe
atgggccgatcgtgtaaagttattc

SEQ ID NO: 63078 - DNA, 25 bp, S. pombe
gttggcggtctctcaaaatttgttt

SEQ ID NO: 63079 - DNA, 25 bp, S. pombe
gctaacaggtactccaaagggcgtt

SEQ ID NO: 63080 - DNA, 25 bp, S. pombe
cgggaagccatatctaccgaacttt

SEQ ID NO: 63081 - DNA, 25 bp, S. pombe
tctgttggttgcaccgttgacggca

SEQ ID NO: 63082 - DNA, 25 bp, S. pombe
ctcccgatttgaccgttactgaggt

SEQ ID NO: 63083 - DNA, 25 bp, S. pombe
gcttacaagtcatcacctttcggtg

SEQ ID NO: 63084 - DNA, 25 bp, S. pombe
gttgaaatacaagaactagttccat

SEQ ID NO: 63085 - DNA, 25 bp, S. pombe
gttacaaaacactccaagaatccta

SEQ ID NO: 63086 - DNA, 25 bp, S. pombe
atagaccaactcgacgtcgggaacg

SEQ ID NO: 63087 - DNA, 25 bp, S. pombe
atagtgggaccaaccttgacggaag

SEQ ID NO: 63088 - DNA, 25 bp, S. pombe
atgagtcctggtttcgttaagattt

SEQ ID NO: 63089 - DNA, 25 bp, S. pombe
aagtccgccaaaggaaaagctgcct

SEQ ID NO: 63090 - DNA, 25 bp, S. pombe
aaagctcgacgagacggtatccgac

SEQ ID NO: 63091 - DNA, 25 bp, S. pombe
atcaagggcatccaactcagtacaa

SEQ ID NO: 63092 - DNA, 25 bp, S. pombe
aggcagtggtagcaccgctcctaag

SEQ ID NO: 63093 - DNA, 25 bp, S. pombe
agccgtttgccatggtccagttatt

SEQ ID NO: 63094 - DNA, 25 bp, S. pombe
attcagctctttcccgtaatttgga

SEQ ID NO: 63095 - DNA, 25 bp, S. pombe
ataaagttgcctccccaggtaatag

SEQ ID NO: 63096 - DNA, 25 bp, S. pombe
ataaatttttctatgggatacaggg

SEQ ID NO: 63097 - DNA, 25 bp, S. pombe
ggacgtttctgtcaaaataccggag

SEQ ID NO: 63098 - DNA, 25 bp, S. pombe
aggtgcttcctcacacaaaacggta

SEQ ID NO: 63099 - DNA, 25 bp, S. pombe
agggattactcgtggacctaccaag

SEQ ID NO: 63100 - DNA, 25 bp, S. pombe
aaagtctacactgaagtccttccgg

SEQ ID NO: 63101 - DNA, 25 bp, S. pombe
gcattgcaccggctaaaacggaggt

SEQ ID NO: 63102 - DNA, 25 bp, S. pombe
attgctcgtaaatgtcttcgggact

SEQ ID NO: 63103 - DNA, 25 bp, S. pombe
attttggtcatactttcctgggccg

SEQ ID NO: 63104 - DNA, 25 bp, S. pombe
attctgtttaatgttagcgttctta

SEQ ID NO: 63105 - DNA, 25 bp, S. pombe
accgacccaaagttaggctcttctg

SEQ ID NO: 63106 - DNA, 25 bp, S. pombe
actagggaaaacttggcgccagctt

SEQ ID NO: 63107 - DNA, 25 bp, S. pombe
acggtgaaaacctttggcttgctgg

SEQ ID NO: 63108 - DNA, 25 bp, S. pombe
tttgggaacaaaccgctacttctgg

SEQ ID NO: 63109 - DNA, 25 bp, S. pombe
gttaggccctaatcgtagatcgtca

SEQ ID NO: 63110 - DNA, 25 bp, S. pombe
attaactttgacatcgtaacgcctc

SEQ ID NO: 63111 - DNA, 25 bp, S. pombe
aaaggtttggacacgcagtcgcggc

SEQ ID NO: 63112 - DNA, 25 bp, S. pombe
attcgaaatgagctcgcccaagttt

SEQ ID NO: 63113 - DNA, 25 bp, S. pombe
attccttagggtgtaatggctttgc

SEQ ID NO: 63114 - DNA, 25 bp, S. pombe
attcctccggagacaatggctagct

SEQ ID NO: 63115 - DNA, 25 bp, S. pombe
atctcaagtactcttttagccctgg

SEQ ID NO: 63116 - DNA, 25 bp, S. pombe
attgcggaatttgaaggtaaagtag

SEQ ID NO: 63117 - DNA, 25 bp, S. pombe
gttggaaattcctctgggcaaacat

SEQ ID NO: 63118 - DNA, 25 bp, S. pombe
tttgggaatacgtccgggaccacat

SEQ ID NO: 63119 - DNA, 25 bp, S. pombe
attcttcgcttacggacgccgaaag

SEQ ID NO: 63120 - DNA, 25 bp, S. pombe
atatttccgtaagatgcccctggac

SEQ ID NO: 63121 - DNA, 25 bp, S. pombe
ctttacaatttagagctccagctgg

SEQ ID NO: 63122 - DNA, 25 bp, S. pombe
atctccacgaccacaagtaagttct

SEQ ID NO: 63123 - DNA, 25 bp, S. pombe
attccataacacagcccattacgtt

SEQ ID NO: 63124 - DNA, 25 bp, S. pombe
atttcgaacctatcctgtcggtaat

SEQ ID NO: 63125 - DNA, 25 bp, S. pombe
aactcaagaacctcaagtcggtgga

SEQ ID NO: 63126 - DNA, 25 bp, S. pombe
aggcttttacttcaagttccacgct

SEQ ID NO: 63127 - DNA, 25 bp, S. pombe
acttcgttaagctcgagttccacgt

SEQ ID NO: 63128 - DNA, 25 bp, S. pombe
attcttggtggatgccgtggacgcc

SEQ ID NO: 63129 - DNA, 25 bp, S. pombe
attttagagcgtggccttaaggtca

SEQ ID NO: 63130 - DNA, 25 bp, S. pombe
agatgcctacggcaacaaccgtttc

SEQ ID NO: 63131 - DNA, 25 bp, S. pombe
atggcttgaagacaactaccctggt

SEQ ID NO: 63132 - DNA, 25 bp, S. pombe
atggccgaaagactttaactactgt

SEQ ID NO: 63133 - DNA, 25 bp, S. pombe
ctaggtccggacaattggcgaagtt

SEQ ID NO: 63134 - DNA, 25 bp, S. pombe
aggcgcttccgggattggatctagc

SEQ ID NO: 63135 - DNA, 25 bp, S. pombe
aggacttacggtttggacatcttca

SEQ ID NO: 63136 - DNA, 25 bp, S. pombe
aggacttaccagacgtgtaccatta

SEQ ID NO: 63137 - DNA, 25 bp, S. pombe
attacttctccgagtatctcgttag

SEQ ID NO: 63138 - DNA, 25 bp, S. pombe
ctttttccacgacattcctagtatt

SEQ ID NO: 63139 - DNA, 25 bp, S. pombe
ctttcgacgttacacctgctaattt

SEQ ID NO: 63140 - DNA, 25 bp, S. pombe
attaaaccatttcatcctccgattt

SEQ ID NO: 63141 - DNA, 25 bp, S. pombe
attaaatcgtttccttcaactcctg

SEQ ID NO: 63142 - DNA, 25 bp, S. pombe
attaacgttggtctttcagtctctc

SEQ ID NO: 63143 - DNA, 25 bp, S. pombe
tcttatacttccacgtttacccgat

SEQ ID NO: 63144 - DNA, 25 bp, S. pombe
gctcctaaccttttacaagacccag

SEQ ID NO: 63145 - DNA, 25 bp, S. pombe
ttttcgtttgagtgaccggttatcg

SEQ ID NO: 63146 - DNA, 25 bp, S. pombe
tttgggtcccagtgaatgcaagttt

SEQ ID NO: 63147 - DNA, 25 bp, S. pombe
attgcgttccgatggtcgtatttta

SEQ ID NO: 63148 - DNA, 25 bp, S. pombe
agtgcggtcgtctggccttagtaaa

SEQ ID NO: 63149 - DNA, 25 bp, S. pombe
actggtgccgccaaggccgtcggta

SEQ ID NO: 63150 - DNA, 25 bp, S. pombe
atataggttaaatccgtcgcgtcct

SEQ ID NO: 63151 - DNA, 25 bp, S. pombe
attgaagaccaacaacgccaggcgt

SEQ ID NO: 63152 - DNA, 25 bp, S. pombe
attatggaagtattgggccctcctc

SEQ ID NO: 63153 - DNA, 25 bp, S. pombe
attgatggagagtgggtcccctgtc

SEQ ID NO: 63154 - DNA, 25 bp, S. pombe
attggcgttagccttggaactttca

SEQ ID NO: 63155 - DNA, 25 bp, S. pombe
attgcagctggatccttgagattca

SEQ ID NO: 63156 - DNA, 25 bp, S. pombe
attgccatggagcatcagatgcctt

SEQ ID NO: 63157 - DNA, 25 bp, S. pombe
gtggattaacatctgccaagtccct

SEQ ID NO: 63158 - DNA, 25 bp, S. pombe
attggtcaaccgtaatctggatttt

SEQ ID NO: 63159 - DNA, 25 bp, S. pombe
attggccagtcggaaatcgtttaca

SEQ ID NO: 63160 - DNA, 25 bp, S. pombe
tattgaccggtgtgtttcttttcgc

SEQ ID NO: 63161 - DNA, 25 bp, S. pombe
accaaagggccgtgcttataagcgt

SEQ ID NO: 63162 - DNA, 25 bp, S. pombe
accaaagggccgtgcttataagcgt

SEQ ID NO: 63163 - DNA, 25 bp, S. pombe
attggacttgagcaaatgggcataa

SEQ ID NO: 63164 - DNA, 25 bp, S. pombe
atggagccttactgttggtgaacgc

SEQ ID NO: 63165 - DNA, 25 bp, S. pombe
attacgccgcgctcaggaaataagt

SEQ ID NO: 63166 - DNA, 25 bp, S. pombe
attccggtaattgggttgcacatgt

SEQ ID NO: 63167 - DNA, 25 bp, S. pombe
attggattacacagcgcgtcaactc

SEQ ID NO: 63168 - DNA, 25 bp, S. pombe
attgggtgagtcgagggatcttatc

SEQ ID NO: 63169 - DNA, 25 bp, S. pombe
attgggactcttcagggacactcta

SEQ ID NO: 63170 - DNA, 25 bp, S. pombe
atatttgactttatccttaccggct

SEQ ID NO: 63171 - DNA, 25 bp, S. pombe
attcttactcatgtcgacttaatcg

SEQ ID NO: 63172 - DNA, 25 bp, S. pombe
attgggaccaactgcttaaaccgtg

SEQ ID NO: 63173 - DNA, 25 bp, S. pombe
attccacccaccgtatttacgaatg

SEQ ID NO: 63174 - DNA, 25 bp, S. pombe
aggcccctggtttaccgatcaagag

SEQ ID NO: 63175 - DNA, 25 bp, S. pombe
agacccttgttactacatcgacgat

SEQ ID NO: 63176 - DNA, 25 bp, S. pombe
tttgcccaagaagaaccgtcctttg

SEQ ID NO: 63177 - DNA, 25 bp, S. pombe
attgtcggtactcgtggcaaagcct

SEQ ID NO: 63178 - DNA, 25 bp, S. pombe
attcccaaattctcatggactccta

SEQ ID NO: 63179 - DNA, 25 bp, S. pombe
attgtggtctgagcttcaaaccctt

SEQ ID NO: 63180 - DNA, 25 bp, S. pombe
attgtcgtgtgggttcagctatggc

SEQ ID NO: 63181 - DNA, 25 bp, S. pombe
attgctttctgggacttttgggagt

SEQ ID NO: 63182 - DNA, 25 bp, S. pombe
atacatatcggttttgcgacgaggt

SEQ ID NO: 63183 - DNA, 25 bp, S. pombe
attgagcttcccaatggtgaggttc

SEQ ID NO: 63184 - DNA, 25 bp, S. pombe
attggtcttaccagagttccgactc

SEQ ID NO: 63185 - DNA, 25 bp, S. pombe
aacttatcttctcaatttccttctc

SEQ ID NO: 63186 - DNA, 25 bp, S. pombe
atcgagaaccagctggcgactttgg

SEQ ID NO: 63187 - DNA, 25 bp, S. pombe
atttattccctacaaatgtccggat

SEQ ID NO: 63188 - DNA, 25 bp, S. pombe
agttcccgtcggcaagttattggtg

SEQ ID NO: 63189 - DNA, 25 bp, S. pombe
attcctccgtcaactccagatttat

SEQ ID NO: 63190 - DNA, 25 bp, S. pombe
attgtgcaagcgtctgtcctcagtg

SEQ ID NO: 63191 - DNA, 25 bp, S. pombe
attggaagcacgtttacgcgagtaa

SEQ ID NO: 63192 - DNA, 25 bp, S. pombe
attgggaggcttatcattccgccaa

SEQ ID NO: 63193 - DNA, 25 bp, S. pombe
atatcgaaagccttgcaccggtatc

SEQ ID NO: 63194 - DNA, 25 bp, S. pombe
attggaagccctagcaacctttttg

SEQ ID NO: 63195 - DNA, 25 bp, S. pombe
attgaaaatcttgctcccggaactt

SEQ ID NO: 63196 - DNA, 25 bp, S. pombe
attggtaaattgctcccctaacact

SEQ ID NO: 63197 - DNA, 25 bp, S. pombe
attgctgggtctgttgcgggtaaac

SEQ ID NO: 63198 - DNA, 25 bp, S. pombe
acagttgctcgtcaaggtggtacct

SEQ ID NO: 63199 - DNA, 25 bp, S. pombe
atagcggcgttaaccaggcttccaa

SEQ ID NO: 63200 - DNA, 25 bp, S. pombe
atcgtttggtggaccaactgtccaa

SEQ ID NO: 63201 - DNA, 25 bp, S. pombe
acgaatgggtcgcacaatggctctc

SEQ ID NO: 63202 - DNA, 25 bp, S. pombe
atctaactcgttcaaaccttctcat

SEQ ID NO: 63203 - DNA, 25 bp, S. pombe
atttaagcggcctcagtcttcttca

SEQ ID NO: 63204 - DNA, 25 bp, S. pombe
attgtttagtgtgatgcctcccaaa

SEQ ID NO: 63205 - DNA, 25 bp, S. pombe
attggctaagttgcaggctggcgct

SEQ ID NO: 63206 - DNA, 25 bp, S. pombe
attgtcggcatgaacctctcattac

SEQ ID NO: 63207 - DNA, 25 bp, S. pombe
attggcccatttacgccagcagggt

SEQ ID NO: 63208 - DNA, 25 bp, S. pombe
attgccgcacatggctcaagtgata

SEQ ID NO: 63209 - DNA, 25 bp, S. pombe
atttaagatacatttttggcgacag

SEQ ID NO: 63210 - DNA, 25 bp, S. pombe
attcgaggtagagcttatccctggg

SEQ ID NO: 63211 - DNA, 25 bp, S. pombe
attggtttgatctggtacctcctgg

SEQ ID NO: 63212 - DNA, 25 bp, S. pombe
attggacaatggcaaccgctgctga

SEQ ID NO: 63213 - DNA, 25 bp, S. pombe
atttacctggtagcacgagtgattt

SEQ ID NO: 63214 - DNA, 25 bp, S. pombe
attgggaaggacctcggcacatcgt

SEQ ID NO: 63215 - DNA, 25 bp, S. pombe
attggcagctattaccggtaccgtt

SEQ ID NO: 63216 - DNA, 25 bp, S. pombe
attggcgccaaaccggtattttctg

SEQ ID NO: 63217 - DNA, 25 bp, S. pombe
attggcaaccatggccgtttctttg

SEQ ID NO: 63218 - DNA, 25 bp, S. pombe
attggaccccgtacaaatgttctca

SEQ ID NO: 63219 - DNA, 25 bp, S. pombe
attgtcgactcgatggtttaccgtc

SEQ ID NO: 63220 - DNA, 25 bp, S. pombe
attggcagcagtttgggttcgcttc

SEQ ID NO: 63221 - DNA, 25 bp, S. pombe
attggtctgttgaaggcttgcctgt

SEQ ID NO: 63222 - DNA, 25 bp, S. pombe
attgcaggatttacagtcccctttt

SEQ ID NO: 63223 - DNA, 25 bp, S. pombe
agtagaggaattgccgactccggtt

SEQ ID NO: 63224 - DNA, 25 bp, S. pombe
ataagtggaggaagaaacgcgtgag

SEQ ID NO: 63225 - DNA, 25 bp, S. pombe
attggttcagcgtgttaccggagaa

SEQ ID NO: 63226 - DNA, 25 bp, S. pombe
attggtatcacctctaaacgaaagg

SEQ ID NO: 63227 - DNA, 25 bp, S. pombe
attgcaccttgggatcagcgacttt

SEQ ID NO: 63228 - DNA, 25 bp, S. pombe
attggcgccaactaggcttgcaaat

SEQ ID NO: 63229 - DNA, 25 bp, S. pombe
attggtcaaacattgtcacacttca

SEQ ID NO: 63230 - DNA, 25 bp, S. pombe
atttttacctgctgcgtttcaacga

SEQ ID NO: 63231 - DNA, 25 bp, S. pombe
atttcttccgtgtggttcgaagtgc

SEQ ID NO: 63232 - DNA, 25 bp, S. pombe
attggcttgcctgggaagtctcgaa

SEQ ID NO: 63233 - DNA, 25 bp, S. pombe
atttccccgaagatgatccctatta

SEQ ID NO: 63234 - DNA, 25 bp, S. pombe
atttccccgaggttaatggcattgt

SEQ ID NO: 63235 - DNA, 25 bp, S. pombe
attatccgtcgtgagtacttgcatt

SEQ ID NO: 63236 - DNA, 25 bp, S. pombe
attgcaattgaaccgcttggcgatt

SEQ ID NO: 63237 - DNA, 25 bp, S. pombe
attggtgattcatgactctcggact

SEQ ID NO: 63238 - DNA, 25 bp, S. pombe
attggatgcattcgttgactccgtt

SEQ ID NO: 63239 - DNA, 25 bp, S. pombe
attgcagagatcattggcgcgacta

SEQ ID NO: 63240 - DNA, 25 bp, S. pombe
attgtcaacggcgagatcccaaagc

SEQ ID NO: 63241 - DNA, 25 bp, S. pombe
attgaccatttaccagcttttgcgt

SEQ ID NO: 63242 - DNA, 25 bp, S. pombe
attccagttatacccgtcaaggcac

SEQ ID NO: 63243 - DNA, 25 bp, S. pombe
attgatcgtcagcttttcgttggtc

SEQ ID NO: 63244 - DNA, 25 bp, S. pombe
attggtatccactgctaattgctcc

SEQ ID NO: 63245 - DNA, 25 bp, S. pombe
attggtcctagcacttttccattac

SEQ ID NO: 63246 - DNA, 25 bp, S. pombe
attggcccaagtttttgtgctgtct

SEQ ID NO: 63247 - DNA, 25 bp, S. pombe
attggagcgggtgctgttgttacaa

SEQ ID NO: 63248 - DNA, 25 bp, S. pombe
attggatcccgtgcagtaactgaaa

SEQ ID NO: 63249 - DNA, 25 bp, S. pombe
attggcgtatgctcggttgaagact

SEQ ID NO: 63250 - DNA, 25 bp, S. pombe
atcggcactatttttcctactaagg

SEQ ID NO: 63251 - DNA, 25 bp, S. pombe
atggtaagtttgctcccaagccaat

SEQ ID NO: 63252 - DNA, 25 bp, S. pombe
attggtgagagcatggatcccgacg

SEQ ID NO: 63253 - DNA, 25 bp, S. pombe
attgaagaagatggcgtctccgagc

SEQ ID NO: 63254 - DNA, 25 bp, S. pombe
attgcggacagcctcttccaaagtg

SEQ ID NO: 63255 - DNA, 25 bp, S. pombe
attggcggccctaatcacgaagaag

SEQ ID NO: 63256 - DNA, 25 bp, S. pombe
attggagccccgaacagcgatgaaa

SEQ ID NO: 63257 - DNA, 25 bp, S. pombe
attggatcccgcttacaggaactgg

SEQ ID NO: 63258 - DNA, 25 bp, S. pombe
attggcttccaagtacaactgtgag

SEQ ID NO: 63259 - DNA, 25 bp, S. pombe
attacttccgatgtccatttggtct

SEQ ID NO: 63260 - DNA, 25 bp, S. pombe
attgtcccaggtacgcaccaaaaat

SEQ ID NO: 63261 - DNA, 25 bp, S. pombe
attgaccgaattgctgcgctcaaag

SEQ ID NO: 63262 - DNA, 25 bp, S. pombe
attaccataaattgccccgtggcat

SEQ ID NO: 63263 - DNA, 25 bp, S. pombe
attgatggcaattgagggctctcat

SEQ ID NO: 63264 - DNA, 25 bp, S. pombe
attggacctttacccttcaaagatg

SEQ ID NO: 63265 - DNA, 25 bp, S. pombe
attggtgcctttgctgcattagttt

SEQ ID NO: 63266 - DNA, 25 bp, S. pombe
attgaggacaccactgcttcagatg

SEQ ID NO: 63267 - DNA, 25 bp, S. pombe
attggatgatctggcgcttcctcga

SEQ ID NO: 63268 - DNA, 25 bp, S. pombe
attgggttgcgtgtgctcttgaaga

SEQ ID NO: 63269 - DNA, 25 bp, S. pombe
attggtttcgccagtttgaagcaca

SEQ ID NO: 63270 - DNA, 25 bp, S. pombe
attggagtcattgctacgaccatga

SEQ ID NO: 63271 - DNA, 25 bp, S. pombe
attggtctgattgtaattctcctga

SEQ ID NO: 63272 - DNA, 25 bp, S. pombe
attgtcccaacaagtaccttcgata

SEQ ID NO: 63273 - DNA, 25 bp, S. pombe
attgtaccagattcgtaccttcgga

SEQ ID NO: 63274 - DNA, 25 bp, S. pombe
attgtattgctaacgctaccactag

SEQ ID NO: 63275 - DNA, 25 bp, S. pombe
attgatgatatcgaacctcccgaaa

SEQ ID NO: 63276 - DNA, 25 bp, S. pombe
attggatccctcgtgaatatcgtaa

SEQ ID NO: 63277 - DNA, 25 bp, S. pombe
attggtcgcggtactatgatcttat

SEQ ID NO: 63278 - DNA, 25 bp, S. pombe
attcggattggaacccatgcgtttc

SEQ ID NO: 63279 - DNA, 25 bp, S. pombe
attggtaccgaagcacttttgcgaa

SEQ ID NO: 63280 - DNA, 25 bp, S. pombe
attggcaagccgtttagaagacacc

SEQ ID NO: 63281 - DNA, 25 bp, S. pombe
attggcttgtaaatcgatgcggtcg

SEQ ID NO: 63282 - DNA, 25 bp, S. pombe
attggctgcttatttctactttcgt

SEQ ID NO: 63283 - DNA, 25 bp, S. pombe
attccgtttttgaccagttgcttga

SEQ ID NO: 63284 - DNA, 25 bp, S. pombe
attcacgctgggatgcactgcaaga

SEQ ID NO: 63285 - DNA, 25 bp, S. pombe
attgatggtcggctcactagtgcat

SEQ ID NO: 63286 - DNA, 25 bp, S. pombe
attgaactcgtttactggtgctcct

SEQ ID NO: 63287 - DNA, 25 bp, S. pombe
atttagctcgtgcaatcggttctta

SEQ ID NO: 63288 - DNA, 25 bp, S. pombe
attgttttgtgccataccgttacga

SEQ ID NO: 63289 - DNA, 25 bp, S. pombe
attggtttgtccaatgcaccttcac

SEQ ID NO: 63290 - DNA, 25 bp, S. pombe
attggatttatcgaagacggccgtc

SEQ ID NO: 63291 - DNA, 25 bp, S. pombe
attggttttccgtactatgccagta

SEQ ID NO: 63292 - DNA, 25 bp, S. pombe
gttggatttacctcatttccaggtt

SEQ ID NO: 63293 - DNA, 25 bp, S. pombe
attgacttgtacgtccttgatgccg

SEQ ID NO: 63294 - DNA, 25 bp, S. pombe
attgttctacttgtttggacgtgga

SEQ ID NO: 63295 - DNA, 25 bp, S. pombe
attggtgctactattttaggattac

SEQ ID NO: 63296 - DNA, 25 bp, S. pombe
attggacccttgtttccttgaatca

SEQ ID NO: 63297 - DNA, 25 bp, S. pombe
attcgtcacctttggaccttaacag

SEQ ID NO: 63298 - DNA, 25 bp, S. pombe
attggtacaaatcctgctgctctta

SEQ ID NO: 63299 - DNA, 25 bp, S. pombe
attggtcgtacaggtcgtgcaggaa

SEQ ID NO: 63300 - DNA, 25 bp, S. pombe
attggcgaatcttttcactcacttc

SEQ ID NO: 63301 - DNA, 25 bp, S. pombe
attggccaactttccctcaattgta

SEQ ID NO: 63302 - DNA, 25 bp, S. pombe
attgaccaacgatttgactctatgg

SEQ ID NO: 63303 - DNA, 25 bp, S. pombe
attgaaaacagctacaccaccgcaa

SEQ ID NO: 63304 - DNA, 25 bp, S. pombe
attggatgacctatctcgttcggaa

SEQ ID NO: 63305 - DNA, 25 bp, S. pombe
attggtgacactcatccttcattgc

SEQ ID NO: 63306 - DNA, 25 bp, S. pombe
attgggcagcactgaatggacatgc

SEQ ID NO: 63307 - DNA, 25 bp, S. pombe
attggtcagcaaacatatccctcac

SEQ ID NO: 63308 - DNA, 25 bp, S. pombe
attgtcgctcgtttgcacgatttta

SEQ ID NO: 63309 - DNA, 25 bp, S. pombe
cgtgccgaggtttccgatgttggta

SEQ ID NO: 63310 - DNA, 25 bp, S. pombe
gttgcccctaacttgtacggtgaca

SEQ ID NO: 63311 - DNA, 25 bp, S. pombe
attgcaactcatttcgttccgaagc

SEQ ID NO: 63312 - DNA, 25 bp, S. pombe
attggcaattcaactttccccacaa

SEQ ID NO: 63313 - DNA, 25 bp, S. pombe
attggcagtgtttctgttgacaaca

SEQ ID NO: 63314 - DNA, 25 bp, S. pombe
attggcgttgctttttgccaagcac

SEQ ID NO: 63315 - DNA, 25 bp, S. pombe
attgatcgtcatcctgaacgtcggt

SEQ ID NO: 63316 - DNA, 25 bp, S. pombe
attggcggctgctgaagaacgtgtc

SEQ ID NO: 63317 - DNA, 25 bp, S. pombe
attgatattgcttctcacgtagctg

SEQ ID NO: 63318 - DNA, 25 bp, S. pombe
attgcaatatgttctgccgctttac

SEQ ID NO: 63319 - DNA, 25 bp, S. pombe
attgtgaatgtcatgcgcacttctc

SEQ ID NO: 63320 - DNA, 25 bp, S. pombe
attgcgaatacatctgaacggctta

SEQ ID NO: 63321 - DNA, 25 bp, S. pombe
attgtcgctagtgatgccaaccgta

SEQ ID NO: 63322 - DNA, 25 bp, S. pombe
attgctatcgcccacagagtattaa

SEQ ID NO: 63323 - DNA, 25 bp, S. pombe
attgaacgcccaccttcttatgaat

SEQ ID NO: 63324 - DNA, 25 bp, S. pombe
attggtcccaaattcttgtggcagt

SEQ ID NO: 63325 - DNA, 25 bp, S. pombe
attgatgagaacttctgcacggccc

SEQ ID NO: 63326 - DNA, 25 bp, S. pombe
attgctatgattcgacgcatgagaa

SEQ ID NO: 63327 - DNA, 25 bp, S. pombe
attgctatgtgtctgctcatgcagc

SEQ ID NO: 63328 - DNA, 25 bp, S. pombe
attgtcaggtgcttggatcaccttc

SEQ ID NO: 63329 - DNA, 25 bp, S. pombe
attgctcgtgccgatggttcgatct

SEQ ID NO: 63330 - DNA, 25 bp, S. pombe
attgccgatacacttgttttcccat

SEQ ID NO: 63331 - DNA, 25 bp, S. pombe
attgtatgtcaactttctcttccac

SEQ ID NO: 63332 - DNA, 25 bp, S. pombe
attgtaacccaaattcttccagctg

SEQ ID NO: 63333 - DNA, 25 bp, S. pombe
attggtgaccctgtagtcgacgata

SEQ ID NO: 63334 - DNA, 25 bp, S. pombe
attggtacctcttcttttgactata

SEQ ID NO: 63335 - DNA, 25 bp, S. pombe
attggtcagtagtcaattccgccgt

SEQ ID NO: 63336 - DNA, 25 bp, S. pombe
attggtcgtagtcatcatttcgcta

SEQ ID NO: 63337 - DNA, 25 bp, S. pombe
attgcgaagtcgactccaacttgaa

SEQ ID NO: 63338 - DNA, 25 bp, S. pombe
attgatccatgtcatttccggcaga

SEQ ID NO: 63339 - DNA, 25 bp, S. pombe
attgttccaatattcgacgtcgact

SEQ ID NO: 63340 - DNA, 25 bp, S. pombe
attgttgaaggctctcaccaatcct

SEQ ID NO: 63341 - DNA, 25 bp, S. pombe
attgttgaacctggccatggaaact

SEQ ID NO: 63342 - DNA, 25 bp, S. pombe
attggattgtcgcattcagtccgac

SEQ ID NO: 63343 - DNA, 25 bp, S. pombe
attggttggtaatccatcaggcccc

SEQ ID NO: 63344 - DNA, 25 bp, S. pombe
attggctatcgttgattcgtggtca

SEQ ID NO: 63345 - DNA, 25 bp, S. pombe
attggtcctgcttttagtggtgctc

SEQ ID NO: 63346 - DNA, 25 bp, S. pombe
attggtcctttgatgcgagagtccg

SEQ ID NO: 63347 - DNA, 25 bp, S. pombe
attgatgtgaatgcgcgccgttttt

SEQ ID NO: 63348 - DNA, 25 bp, S. pombe
attgtcgtcggatatgtcttggaac

SEQ ID NO: 63349 - DNA, 25 bp, S. pombe
attggcggcggatttgacgattcca

SEQ ID NO: 63350 - DNA, 25 bp, S. pombe
aggccccgaatttgagcgccttata

SEQ ID NO: 63351 - DNA, 25 bp, S. pombe
agtgcccctaaacaagccatttatg

SEQ ID NO: 63352 - DNA, 25 bp, S. pombe
attaagcctaaacaagcgcatcgtg

SEQ ID NO: 63353 - DNA, 25 bp, S. pombe
attgcaagccaaagaaaccgattta

SEQ ID NO: 63354 - DNA, 25 bp, S. pombe
attgcggtgcaaacgaacctgattt

SEQ ID NO: 63355 - DNA, 25 bp, S. pombe
attgtctctgacagtaccctactta

SEQ ID NO: 63356 - DNA, 25 bp, S. pombe
attgttctggatgaaacctcactag

SEQ ID NO: 63357 - DNA, 25 bp, S. pombe
attggcctatgaaagatacagagct

SEQ ID NO: 63358 - DNA, 25 bp, S. pombe
attggcttgaaaactccgatcctcg

SEQ ID NO: 63359 - DNA, 25 bp, S. pombe
attgtcttcctctctatctaaatct

SEQ ID NO: 63360 - DNA, 25 bp, S. pombe
attgtttccagctcattcaaggttg

SEQ ID NO: 63361 - DNA, 25 bp, S. pombe
attgtacttggcttattctcattgt

SEQ ID NO: 63362 - DNA, 25 bp, S. pombe
attgatagctgtggcactggtgcat

SEQ ID NO: 63363 - DNA, 25 bp, S. pombe
attgttttgcctacgatatcgtgcc

SEQ ID NO: 63364 - DNA, 25 bp, S. pombe
attgatgcattttccttgatctcag

SEQ ID NO: 63365 - DNA, 25 bp, S. pombe
attgttgcatttgtaggttctccta

SEQ ID NO: 63366 - DNA, 25 bp, S. pombe
attgttgattcgcaaacttcccttc

SEQ ID NO: 63367 - DNA, 25 bp, S. pombe
attgaagaatcgcttaccggcccta

SEQ ID NO: 63368 - DNA, 25 bp, S. pombe
attgcaggcttttttaccggtggtg

SEQ ID NO: 63369 - DNA, 25 bp, S. pombe
attggaatccgagtctgctactact

SEQ ID NO: 63370 - DNA, 25 bp, S. pombe
attggtcgccaattgcttacaactg

SEQ ID NO: 63371 - DNA, 25 bp, S. pombe
attggcgggcgatgcgtcaaatgca

SEQ ID NO: 63372 - DNA, 25 bp, S. pombe
attgctgcgtgtctctggaataacc

SEQ ID NO: 63373 - DNA, 25 bp, S. pombe
attggcgtgccaggttctcttattg

SEQ ID NO: 63374 - DNA, 25 bp, S. pombe
attggcgaaagcttgctccttttca

SEQ ID NO: 63375 - DNA, 25 bp, S. pombe
attgcccgtgcaaaccgacatggta

SEQ ID NO: 63376 - DNA, 25 bp, S. pombe
attgttcgtgtcaccggtggtatga

SEQ ID NO: 63377 - DNA, 25 bp, S. pombe
attggaatgttaaagctcctcatgt

SEQ ID NO: 63378 - DNA, 25 bp, S. pombe
attggcttcctatccagaacattga

SEQ ID NO: 63379 - DNA, 25 bp, S. pombe
attgttggaagtttgcgtctctccc

SEQ ID NO: 63380 - DNA, 25 bp, S. pombe
attgtttactctatgcttcctacac

SEQ ID NO: 63381 - DNA, 25 bp, S. pombe
attgcattggcctctatgggtgatc

SEQ ID NO: 63382 - DNA, 25 bp, S. pombe
attcgatggatgctgccctcaatgc

SEQ ID NO: 63383 - DNA, 25 bp, S. pombe
attggtggatttgactttgccttca

SEQ ID NO: 63384 - DNA, 25 bp, S. pombe
attggatttcttgccagttctctta

SEQ ID NO: 63385 - DNA, 25 bp, S. pombe
attgaactccaagatctaccgcatt

SEQ ID NO: 63386 - DNA, 25 bp, S. pombe
attgcttttggtgaacacggtcctc

SEQ ID NO: 63387 - DNA, 25 bp, S. pombe
attggttggcttgaaatgcgatttc

SEQ ID NO: 63388 - DNA, 25 bp, S. pombe
attgactctgacttggcaaatgcca

SEQ ID NO: 63389 - DNA, 25 bp, S. pombe
attgacttatatactctgccggaca

SEQ ID NO: 63390 - DNA, 25 bp, S. pombe
attgttgtaatcctgtcgggcaagc

SEQ ID NO: 63391 - DNA, 25 bp, S. pombe
attgtatctactgctgtcgaatccc

SEQ ID NO: 63392 - DNA, 25 bp, S. pombe
attgtgaccttcatctgcgtacgta

SEQ ID NO: 63393 - DNA, 25 bp, S. pombe
attggattcaacttcgcttatgctg

SEQ ID NO: 63394 - DNA, 25 bp, S. pombe
attggtccaacattcctatgactcc

SEQ ID NO: 63395 - DNA, 25 bp, S. pombe
attgaaactaccacgatcatcctcg

SEQ ID NO: 63396 - DNA, 25 bp, S. pombe
attgaaactttcttgcgcactctca

SEQ ID NO: 63397 - DNA, 25 bp, S. pombe
attggtgtctttgatttgcccgaac

SEQ ID NO: 63398 - DNA, 25 bp, S. pombe
attgggtgtcgaaagtctcgctcca

SEQ ID NO: 63399 - DNA, 25 bp, S. pombe
attgggttcaacgaaatcctcctca

SEQ ID NO: 63400 - DNA, 25 bp, S. pombe
attgaacgagcaacagtctgatact

SEQ ID NO: 63401 - DNA, 25 bp, S. pombe
attggcactagtactttgtctcctt

SEQ ID NO: 63402 - DNA, 25 bp, S. pombe
attgtatactgctcaaggcctggtc

SEQ ID NO: 63403 - DNA, 25 bp, S. pombe
attggcaatgcatctcgctggtgta

SEQ ID NO: 63404 - DNA, 25 bp, S. pombe
attggatgcatacccgccttatgaa

SEQ ID NO: 63405 - DNA, 25 bp, S. pombe
attgatgctcatttcggtcttatta

SEQ ID NO: 63406 - DNA, 25 bp, S. pombe
attggctcttattatgtctctactt

SEQ ID NO: 63407 - DNA, 25 bp, S. pombe
attggttgatttgttccatgcccgt

SEQ ID NO: 63408 - DNA, 25 bp, S. pombe
attgcgttacaatggatcctcggtg

SEQ ID NO: 63409 - DNA, 25 bp, S. pombe
attggtttcgaatccatactgaaga

SEQ ID NO: 63410 - DNA, 25 bp, S. pombe
atataggctatcgaaaaagtcaaga

SEQ ID NO: 63411 - DNA, 25 bp, S. pombe
attggatggtcccaaagtgctgccc

SEQ ID NO: 63412 - DNA, 25 bp, S. pombe
attggagtattcctcacagtgcgtc

SEQ ID NO: 63413 - DNA, 25 bp, S. pombe
attgagcgcttcaccaactgcagac

SEQ ID NO: 63414 - DNA, 25 bp, S. pombe
attggatgcacagatagccgccgac

SEQ ID NO: 63415 - DNA, 25 bp, S. pombe
attgattccttggttgtttgcgcaa

SEQ ID NO: 63416 - DNA, 25 bp, S. pombe
attgatctcgtagtcgttttgcgca

SEQ ID NO: 63417 - DNA, 25 bp, S. pombe
attgacagcgattcagtttccccaa

SEQ ID NO: 63418 - DNA, 25 bp, S. pombe
attacaagagacatcttccccgttc

SEQ ID NO: 63419 - DNA, 25 bp, S. pombe
attgacatcgacgttcttgatcccg

SEQ ID NO: 63420 - DNA, 25 bp, S. pombe
attgactttcgattcttgccaactg

SEQ ID NO: 63421 - DNA, 25 bp, S. pombe
attgagcccttgttattgccaactg

SEQ ID NO: 63422 - DNA, 25 bp, S. pombe
attgggcctgcaatgttggctcata

SEQ ID NO: 63423 - DNA, 25 bp, S. pombe
attggtgccaaggtagcgcctgtta

SEQ ID NO: 63424 - DNA, 25 bp, S. pombe
attggactgcaatgtaccggcgtcg

SEQ ID NO: 63425 - DNA, 25 bp, S. pombe
attgtacgcgaatcatcctgggacg

SEQ ID NO: 63426 - DNA, 25 bp, S. pombe
attgagtactctcagcaacctgctt

SEQ ID NO: 63427 - DNA, 25 bp, S. pombe
attgcaccagaattccatatccact

SEQ ID NO: 63428 - DNA, 25 bp, S. pombe
attgcacgcatggaagctttgccaa

SEQ ID NO: 63429 - DNA, 25 bp, S. pombe
attgttctcgattctattccgacaa

SEQ ID NO: 63430 - DNA, 25 bp, S. pombe
attgttatttactcactctctggct

SEQ ID NO: 63431 - DNA, 25 bp, S. pombe
attgttcggaatgcacacgtatgga

SEQ ID NO: 63432 - DNA, 25 bp, S. pombe
attgcattttgctttaccagttgga

SEQ ID NO: 63433 - DNA, 25 bp, S. pombe
attgcttgttttcaccatttgctgc

SEQ ID NO: 63434 - DNA, 25 bp, S. pombe
attgattcttctccttttgtatcgc

SEQ ID NO: 63435 - DNA, 25 bp, S. pombe
attggatctctctagctgtattgtc

SEQ ID NO: 63436 - DNA, 25 bp, S. pombe
attggtcccaaacttgctgccatga

SEQ ID NO: 63437 - DNA, 25 bp, S. pombe
attggtcccactaattatgctgctg

SEQ ID NO: 63438 - DNA, 25 bp, S. pombe
attcgcccaggtgatatagttacat

SEQ ID NO: 63439 - DNA, 25 bp, S. pombe
attgccgctcttcgttttactaaat

SEQ ID NO: 63440 - DNA, 25 bp, S. pombe
attgtcttgcatgggattaatcacc

SEQ ID NO: 63441 - DNA, 25 bp, S. pombe
attgccatcgagttgtttacaagac

SEQ ID NO: 63442 - DNA, 25 bp, S. pombe
attgaagaggttcgcttcgcacgac

SEQ ID NO: 63443 - DNA, 25 bp, S. pombe
attcaagcagaagccatccgacgtc

SEQ ID NO: 63444 - DNA, 25 bp, S. pombe
attgcaggcgcatggcagtcagcgt

SEQ ID NO: 63445 - DNA, 25 bp, S. pombe
attggagcgatacgcaatgcattct

SEQ ID NO: 63446 - DNA, 25 bp, S. pombe
gactgtggagtctgtgcaaaatacg

SEQ ID NO: 63447 - DNA, 25 bp, S. pombe
attcgtgatgcttcggccaacaaag

SEQ ID NO: 63448 - DNA, 25 bp, S. pombe
atcgactaccccttcaaagttgttg

SEQ ID NO: 63449 - DNA, 25 bp, S. pombe
attgtcttccgttccaaagttgtga

SEQ ID NO: 63450 - DNA, 25 bp, S. pombe
attcctttccttaccatggtttcat

SEQ ID NO: 63451 - DNA, 25 bp, S. pombe
attgcctgttccttcgtcaagtaat

SEQ ID NO: 63452 - DNA, 25 bp, S. pombe
attgtcttcctgaccctgaaaatac

SEQ ID NO: 63453 - DNA, 25 bp, S. pombe
attgatttgcgcttgatgcttgaaa

SEQ ID NO: 63454 - DNA, 25 bp, S. pombe
attgattccattaacttaccgccag

SEQ ID NO: 63455 - DNA, 25 bp, S. pombe
attgcttacattaattccacacgga

SEQ ID NO: 63456 - DNA, 25 bp, S. pombe
attggtcatctatctcttatgctaa

SEQ ID NO: 63457 - DNA, 25 bp, S. pombe
attggtccttattcttcttcaagca

SEQ ID NO: 63458 - DNA, 25 bp, S. pombe
attgcggccttcatgtttgcgagaa

SEQ ID NO: 63459 - DNA, 25 bp, S. pombe
attgaggttcgcgtttgtgctccca

SEQ ID NO: 63460 - DNA, 25 bp, S. pombe
attgaggcttcagaatctgctccca

SEQ ID NO: 63461 - DNA, 25 bp, S. pombe
attgaggctactgtacatgcgccca

SEQ ID NO: 63462 - DNA, 25 bp, S. pombe
atatgggtgtttatccgcttacctg

SEQ ID NO: 63463 - DNA, 25 bp, S. pombe
attggtcatattcgttggcttcaca

SEQ ID NO: 63464 - DNA, 25 bp, S. pombe
attgtatctatctcatttcacccag

SEQ ID NO: 63465 - DNA, 25 bp, S. pombe
attgatcccacttcttttacttgtc

SEQ ID NO: 63466 - DNA, 25 bp, S. pombe
attgaacatcacgactttccctatg

SEQ ID NO: 63467 - DNA, 25 bp, S. pombe
attggtcatcgcgtgattactcgta

SEQ ID NO: 63468 - DNA, 25 bp, S. pombe
attggtccccagatgattcgtaaag

SEQ ID NO: 63469 - DNA, 25 bp, S. pombe
attggtatcaatcgccttctagtga

SEQ ID NO: 63470 - DNA, 25 bp, S. pombe
attgaccaacatggactgatgctat

SEQ ID NO: 63471 - DNA, 25 bp, S. pombe
attgaaagcctctctgatgatgata

SEQ ID NO: 63472 - DNA, 25 bp, S. pombe
attgtccctcaattcagtgctacat

SEQ ID NO: 63473 - DNA, 25 bp, S. pombe
attctcggcactaacgatgcggcat

SEQ ID NO: 63474 - DNA, 25 bp, S. pombe
attgatcgtcgtaagcttcggcatc

SEQ ID NO: 63475 - DNA, 25 bp, S. pombe
attgatcttggtactgcttgcggta

SEQ ID NO: 63476 - DNA, 25 bp, S. pombe
attgatcaagtttctccatgggcta

SEQ ID NO: 63477 - DNA, 25 bp, S. pombe
attgcctcacgttcgaaatgtacca

SEQ ID NO: 63478 - DNA, 25 bp, S. pombe
attgccttgactgaaaagtacccac

SEQ ID NO: 63479 - DNA, 25 bp, S. pombe
attgccgccgtggtcaaagtttggt

SEQ ID NO: 63480 - DNA, 25 bp, S. pombe
attgagccctctctaaaggctttgg

SEQ ID NO: 63481 - DNA, 25 bp, S. pombe
atacttttgtactggcgatttcggt

SEQ ID NO: 63482 - DNA, 25 bp, S. pombe
attattttgctatggctaagccctt

SEQ ID NO: 63483 - DNA, 25 bp, S. pombe
attgttgttcgccagcgtaaggctt

SEQ ID NO: 63484 - DNA, 25 bp, S. pombe
aggcattattagcatcggtgtcgga

SEQ ID NO: 63485 - DNA, 25 bp, S. pombe
aggatttacagttccgatgacggga

SEQ ID NO: 63486 - DNA, 25 bp, S. pombe
atatgtattgacacccttagatcca

SEQ ID NO: 63487 - DNA, 25 bp, S. pombe
attcccgtaattgttgttcgacctg

SEQ ID NO: 63488 - DNA, 25 bp, S. pombe
atacccagtaacttgtcgttggagt

SEQ ID NO: 63489 - DNA, 25 bp, S. pombe
attcgtaacttcttgggtgagcgta

SEQ ID NO: 63490 - DNA, 25 bp, S. pombe
attctgtcttgtctgtggagcgtac

SEQ ID NO: 63491 - DNA, 25 bp, S. pombe
attgctttagccattggtgctgctt

SEQ ID NO: 63492 - DNA, 25 bp, S. pombe
agtcgactaattcttcctcttattt

SEQ ID NO: 63493 - DNA, 25 bp, S. pombe
agtcggaaggtgatactcctcttaa

SEQ ID NO: 63494 - DNA, 25 bp, S. pombe
attcgtgcatatgtcttagctactg

SEQ ID NO: 63495 - DNA, 25 bp, S. pombe
attggtgtctcttattttgcttgct

SEQ ID NO: 63496 - DNA, 25 bp, S. pombe
attgtatgcctaaatggttccttga

SEQ ID NO: 63497 - DNA, 25 bp, S. pombe
attgttgccaaagtggttgcgctat

SEQ ID NO: 63498 - DNA, 25 bp, S. pombe
attgctcctacatctaagggacatg

SEQ ID NO: 63499 - DNA, 25 bp, S. pombe
attgtctccactgctatgactggta

SEQ ID NO: 63500 - DNA, 25 bp, S. pombe
attgtactcctttcatgcttggttc

SEQ ID NO: 63501 - DNA, 25 bp, S. pombe
attctcaagcggaacttttcccgag

SEQ ID NO: 63502 - DNA, 25 bp, S. pombe
attgcaagtcggtggtttctaccaa

SEQ ID NO: 63503 - DNA, 25 bp, S. pombe
atatcccatatcaaacgtacggcat

SEQ ID NO: 63504 - DNA, 25 bp, S. pombe
attgaatcttggactgtttcgcctc

SEQ ID NO: 63505 - DNA, 25 bp, S. pombe
attgaattcggtggtcttttcgctt

SEQ ID NO: 63506 - DNA, 25 bp, S. pombe
attgaactcgtcgttttcttgcctg

SEQ ID NO: 63507 - DNA, 25 bp, S. pombe
attgttgtatactcacttcctgacc

SEQ ID NO: 63508 - DNA, 25 bp, S. pombe
attgtcttgatttgtacgctccttc

SEQ ID NO: 63509 - DNA, 25 bp, S. pombe
attgtctggcaatcaaggcatccga

SEQ ID NO: 63510 - DNA, 25 bp, S. pombe
attgcttcgcagtacatggatgatc

SEQ ID NO: 63511 - DNA, 25 bp, S. pombe
attgctggagttttgcctgtatcat

SEQ ID NO: 63512 - DNA, 25 bp, S. pombe
attgctggttggtctgttgccatca

SEQ ID NO: 63513 - DNA, 25 bp, S. pombe
attgtcgttgccagatacctttttg

SEQ ID NO: 63514 - DNA, 25 bp, S. pombe
attctagttgccagtactgtcctta

SEQ ID NO: 63515 - DNA, 25 bp, S. pombe
attccgataccgctagtgtttctaa

SEQ ID NO: 63516 - DNA, 25 bp, S. pombe
attcccgacgccagtgtagttcaaa

SEQ ID NO: 63517 - DNA, 25 bp, S. pombe
attcaccctgcggatttggacgaag

SEQ ID NO: 63518 - DNA, 25 bp, S. pombe
attccagtcgctgcttcaggacgaa

SEQ ID NO: 63519 - DNA, 25 bp, S. pombe
attgctggtcaatctctattacgaa

SEQ ID NO: 63520 - DNA, 25 bp, S. pombe
attcgatgacgagcctttgcctgaa

SEQ ID NO: 63521 - DNA, 25 bp, S. pombe
attcgatcctgtaactttcctgagt

SEQ ID NO: 63522 - DNA, 25 bp, S. pombe
attcgacacgtccagctttacaaga

SEQ ID NO: 63523 - DNA, 25 bp, S. pombe
attgtacaggtccatcatttccaca

SEQ ID NO: 63524 - DNA, 25 bp, S. pombe
attgatattcctagtgttacgcacg

SEQ ID NO: 63525 - DNA, 25 bp, S. pombe
attgctgcatttgtggtacctaaga

SEQ ID NO: 63526 - DNA, 25 bp, S. pombe
attgtttcacatatcccatctcatt

SEQ ID NO: 63527 - DNA, 25 bp, S. pombe
attgttcgcaaagctatcactcgtc

SEQ ID NO: 63528 - DNA, 25 bp, S. pombe
attctttcaaagctacctctgtttc

SEQ ID NO: 63529 - DNA, 25 bp, S. pombe
attcctgacggtattcctgctatgt

SEQ ID NO: 63530 - DNA, 25 bp, S. pombe
attgtagatctttcacacaccacac

SEQ ID NO: 63531 - DNA, 25 bp, S. pombe
attgttatctttgcctctaatcgag

SEQ ID NO: 63532 - DNA, 25 bp, S. pombe
attgtctgttttccccgatatagag

SEQ ID NO: 63533 - DNA, 25 bp, S. pombe
attgttgtctcgcaattcgaatcaa

SEQ ID NO: 63534 - DNA, 25 bp, S. pombe
attgttgctgggttgttcctcaaac

SEQ ID NO: 63535 - DNA, 25 bp, S. pombe
attgattgctatggtcgttcgtgaa

SEQ ID NO: 63536 - DNA, 25 bp, S. pombe
attgattatgtggttgctccgctac

SEQ ID NO: 63537 - DNA, 25 bp, S. pombe
attgttgatctgtttcttcgctttt

SEQ ID NO: 63538 - DNA, 25 bp, S. pombe
attgctagggcacttcttcgaaatc

SEQ ID NO: 63539 - DNA, 25 bp, S. pombe
atttggtgaccgatcgaaattcaac

SEQ ID NO: 63540 - DNA, 25 bp, S. pombe
attcgggtcctgtttcaaatgtcta

SEQ ID NO: 63541 - DNA, 25 bp, S. pombe
attacggtcccgattacaagctcaa

SEQ ID NO: 63542 - DNA, 25 bp, S. pombe
attgagtgagttcttcctaggtcct

SEQ ID NO: 63543 - DNA, 25 bp, S. pombe
ataatggagccgttaactatggtgc

SEQ ID NO: 63544 - DNA, 25 bp, S. pombe
atacttggcattctcaaaaggcagc

SEQ ID NO: 63545 - DNA, 25 bp, S. pombe
atagcattaactcccaacaacgcag

SEQ ID NO: 63546 - DNA, 25 bp, S. pombe
attgatacattacatctcctctctc

SEQ ID NO: 63547 - DNA, 25 bp, S. pombe
attgatatattaccaccctcttctt

SEQ ID NO: 63548 - DNA, 25 bp, S. pombe
attgacaatcttcagctccttacat

SEQ ID NO: 63549 - DNA, 25 bp, S. pombe
attgccgagcttagagacagttcca

SEQ ID NO: 63550 - DNA, 25 bp, S. pombe
attccggttagcaaatactcgccag

SEQ ID NO: 63551 - DNA, 25 bp, S. pombe
attcctgtgattacaagagcctcgt

SEQ ID NO: 63552 - DNA, 25 bp, S. pombe
attcgcgcacagatacagagcttca

SEQ ID NO: 63553 - DNA, 25 bp, S. pombe
attgactggcatacctgtggccttt

SEQ ID NO: 63554 - DNA, 25 bp, S. pombe
attgtctgccaaacttcgcaatctt

SEQ ID NO: 63555 - DNA, 25 bp, S. pombe
attccggccaatcctaggaggctat

SEQ ID NO: 63556 - DNA, 25 bp, S. pombe
attacgttctgtcaatgggtgcatt

SEQ ID NO: 63557 - DNA, 25 bp, S. pombe
attgctcctgcacctaagggtcaac

SEQ ID NO: 63558 - DNA, 25 bp, S. pombe
attgctccggcagtaatggtgacct

SEQ ID NO: 63559 - DNA, 25 bp, S. pombe
attcgccgtgacttaattaactctg

SEQ ID NO: 63560 - DNA, 25 bp, S. pombe
attcccgaatctcaattccgtagca

SEQ ID NO: 63561 - DNA, 25 bp, S. pombe
attgtttaacccctacgcagtatga

SEQ ID NO: 63562 - DNA, 25 bp, S. pombe
attgtcttacccgttctgggtgtat

SEQ ID NO: 63563 - DNA, 25 bp, S. pombe
attgtatcaacgttgctttcggtta

SEQ ID NO: 63564 - DNA, 25 bp, S. pombe
attgtatccatccttttctctgtta

SEQ ID NO: 63565 - DNA, 25 bp, S. pombe
attgctatgcttccttttgtattta

SEQ ID NO: 63566 - DNA, 25 bp, S. pombe
attgcatgtatcaccaagtctgtat

SEQ ID NO: 63567 - DNA, 25 bp, S. pombe
attgattctgaagccatgtcgttaa

SEQ ID NO: 63568 - DNA, 25 bp, S. pombe
attgcattggcacactcagtcgttt

SEQ ID NO: 63569 - DNA, 25 bp, S. pombe
attgcatgtgcgtgctacagacgtt

SEQ ID NO: 63570 - DNA, 25 bp, S. pombe
attgagtggattgttgacccgcgct

SEQ ID NO: 63571 - DNA, 25 bp, S. pombe
attgatacattcttgggagccggcg

SEQ ID NO: 63572 - DNA, 25 bp, S. pombe
attgatcacatttggtacaccggca

SEQ ID NO: 63573 - DNA, 25 bp, S. pombe
attgattttacattagcccgagcat

SEQ ID NO: 63574 - DNA, 25 bp, S. pombe
attccatgaatgacactcctttagg

SEQ ID NO: 63575 - DNA, 25 bp, S. pombe
attctggaacatctcactctttgga

SEQ ID NO: 63576 - DNA, 25 bp, S. pombe
attgcagggacataccaacacggtt

SEQ ID NO: 63577 - DNA, 25 bp, S. pombe
attgcacaaatgttaccaggcatgg

SEQ ID NO: 63578 - DNA, 25 bp, S. pombe
attgagtcatctctgatgcccaacg

SEQ ID NO: 63579 - DNA, 25 bp, S. pombe
attgcctcttcaaactcgctggaac

SEQ ID NO: 63580 - DNA, 25 bp, S. pombe
attcctgaggttattggccgggcta

SEQ ID NO: 63581 - DNA, 25 bp, S. pombe
attccgtagtatatttccggctgga

SEQ ID NO: 63582 - DNA, 25 bp, S. pombe
attccttggtctcctttagctaggg

SEQ ID NO: 63583 - DNA, 25 bp, S. pombe
gctttgtcggttctttaatcggctt

SEQ ID NO: 63584 - DNA, 25 bp, S. pombe
atatcttgggttctttttgcgtctt

SEQ ID NO: 63585 - DNA, 25 bp, S. pombe
attctttctgttctctttggttttg

SEQ ID NO: 63586 - DNA, 25 bp, S. pombe
attgttattatgacacctggcggtg

SEQ ID NO: 63587 - DNA, 25 bp, S. pombe
attgttcttttactctagcacgctt

SEQ ID NO: 63588 - DNA, 25 bp, S. pombe
attccttagttgtttaccagctcca

SEQ ID NO: 63589 - DNA, 25 bp, S. pombe
attcctttgcgttccaatccagtat

SEQ ID NO: 63590 - DNA, 25 bp, S. pombe
attgctgcatctctgtatccaaaca

SEQ ID NO: 63591 - DNA, 25 bp, S. pombe
attgctgctcttgaactcaataccc

SEQ ID NO: 63592 - DNA, 25 bp, S. pombe
attgatccttcaaaatcctgaccca

SEQ ID NO: 63593 - DNA, 25 bp, S. pombe
attgatactttcttgcggcaacgcc

SEQ ID NO: 63594 - DNA, 25 bp, S. pombe
attgcagatctttacgctggtatag

SEQ ID NO: 63595 - DNA, 25 bp, S. pombe
attgaagacgcaaaacgaaatccta

SEQ ID NO: 63596 - DNA, 25 bp, S. pombe
attgaaactgttactgccggagaat

SEQ ID NO: 63597 - DNA, 25 bp, S. pombe
attgactgatcttatcaagccgcta

SEQ ID NO: 63598 - DNA, 25 bp, S. pombe
attgttgatgctgctaagtccctta

SEQ ID NO: 63599 - DNA, 25 bp, S. pombe
attctcctcaattgcctctaggtag

SEQ ID NO: 63600 - DNA, 25 bp, S. pombe
attctcctagatatgctgatgatga

SEQ ID NO: 63601 - DNA, 25 bp, S. pombe
attgctaccgatcctgttatcaagt

SEQ ID NO: 63602 - DNA, 25 bp, S. pombe
attgcatcaagccaccaatttcggt

SEQ ID NO: 63603 - DNA, 25 bp, S. pombe
atttcaaccaaatctcattgctgtt

SEQ ID NO: 63604 - DNA, 25 bp, S. pombe
attgatatacctaatgtctctttgg

SEQ ID NO: 63605 - DNA, 25 bp, S. pombe
atatcacattcatttccccgaagtt

SEQ ID NO: 63606 - DNA, 25 bp, S. pombe
attatggctatgcttcacttcgaag

SEQ ID NO: 63607 - DNA, 25 bp, S. pombe
attgatgtcggcttacctttacaca

SEQ ID NO: 63608 - DNA, 25 bp, S. pombe
attgatgtctggtctaggctttgaa

SEQ ID NO: 63609 - DNA, 25 bp, S. pombe
attgaatttttctttgccatgcacg

SEQ ID NO: 63610 - DNA, 25 bp, S. pombe
attcgtttttccatcctcaggaaca

SEQ ID NO: 63611 - DNA, 25 bp, S. pombe
attccattggagcaaccctctggtg

SEQ ID NO: 63612 - DNA, 25 bp, S. pombe
attccccaagaatccctgctgaggt

SEQ ID NO: 63613 - DNA, 25 bp, S. pombe
attcaaattactatactggcccgcc

SEQ ID NO: 63614 - DNA, 25 bp, S. pombe
attcaagcctgatacgacgttaccc

SEQ ID NO: 63615 - DNA, 25 bp, S. pombe
attaagcccggagaagaataccctg

SEQ ID NO: 63616 - DNA, 25 bp, S. pombe
attgccttggcttacacgacgaatt

SEQ ID NO: 63617 - DNA, 25 bp, S. pombe
atcgtgcttcgcctgaacgactaaa

SEQ ID NO: 63618 - DNA, 25 bp, S. pombe
attcgttcagcccaaaaccatgaca

SEQ ID NO: 63619 - DNA, 25 bp, S. pombe
attccttccttgactatccgtgaat

SEQ ID NO: 63620 - DNA, 25 bp, S. pombe
attccgatcgatttttctcctgaac

SEQ ID NO: 63621 - DNA, 25 bp, S. pombe
attcctattgattttttgcatcgac

SEQ ID NO: 63622 - DNA, 25 bp, S. pombe
attcctgtttacattcttggccaag

SEQ ID NO: 63623 - DNA, 25 bp, S. pombe
attgccgtttaccaacgtggacatt

SEQ ID NO: 63624 - DNA, 25 bp, S. pombe
attcagtccggataacaggcacctt

SEQ ID NO: 63625 - DNA, 25 bp, S. pombe
attgccgcccgcagaacaggtcttt

SEQ ID NO: 63626 - DNA, 25 bp, S. pombe
attcgactcgattttccaactgtcc

SEQ ID NO: 63627 - DNA, 25 bp, S. pombe
attcgacccttgctagatcacattc

SEQ ID NO: 63628 - DNA, 25 bp, S. pombe
attcctagtcgtctaattcgctgtg

SEQ ID NO: 63629 - DNA, 25 bp, S. pombe
attccaacctgtaatagccgccttg

SEQ ID NO: 63630 - DNA, 25 bp, S. pombe
attccaacgttgatgacactcctaa

SEQ ID NO: 63631 - DNA, 25 bp, S. pombe
attgctaatcagctgcgttacccta

SEQ ID NO: 63632 - DNA, 25 bp, S. pombe
attgcggatgcgatggatgtccctc

SEQ ID NO: 63633 - DNA, 25 bp, S. pombe
attgcgtgggtctttgcatgcgcca

SEQ ID NO: 63634 - DNA, 25 bp, S. pombe
attcttggagcttctaatcgccgaa

SEQ ID NO: 63635 - DNA, 25 bp, S. pombe
attgccctttaagtccgtatatgga

SEQ ID NO: 63636 - DNA, 25 bp, S. pombe
attaccttttcgagcatggacatga

SEQ ID NO: 63637 - DNA, 25 bp, S. pombe
attgacgcttttgaggctgctagag

SEQ ID NO: 63638 - DNA, 25 bp, S. pombe
attgagctgctttctgagttttatt

SEQ ID NO: 63639 - DNA, 25 bp, S. pombe
attgcgcttgctttacacatgttag

SEQ ID NO: 63640 - DNA, 25 bp, S. pombe
attcgctttgctttgccaaggtcaa

SEQ ID NO: 63641 - DNA, 25 bp, S. pombe
attgcacgggcttggaaattctatc

SEQ ID NO: 63642 - DNA, 25 bp, S. pombe
attgcaccgttgacacaaagctttt

SEQ ID NO: 63643 - DNA, 25 bp, S. pombe
attcccagcattccaaaaatccttg

SEQ ID NO: 63644 - DNA, 25 bp, S. pombe
attcctcgcaatcagcacgtcaatt

SEQ ID NO: 63645 - DNA, 25 bp, S. pombe
attgcattcggtggtcttcatcaca

SEQ ID NO: 63646 - DNA, 25 bp, S. pombe
attccgaggtattcactgcaagcta

SEQ ID NO: 63647 - DNA, 25 bp, S. pombe
attcgaggacaatcagcgcgatctt

SEQ ID NO: 63648 - DNA, 25 bp, S. pombe
attctgggcgaggacagaactccaa

SEQ ID NO: 63649 - DNA, 25 bp, S. pombe
attgctcgcccaggaatgactttta

SEQ ID NO: 63650 - DNA, 25 bp, S. pombe
attgcggagcgcgtaatacaatcca

SEQ ID NO: 63651 - DNA, 25 bp, S. pombe
attcgagccacctgttataagcaat

SEQ ID NO: 63652 - DNA, 25 bp, S. pombe
attccttccggaaattgttcgagca

SEQ ID NO: 63653 - DNA, 25 bp, S. pombe
attgcaattttgtttcccttctctc

SEQ ID NO: 63654 - DNA, 25 bp, S. pombe
attctgatacttcttcgttagcctc

SEQ ID NO: 63655 - DNA, 25 bp, S. pombe
attgcacattgcttctgctgattct

SEQ ID NO: 63656 - DNA, 25 bp, S. pombe
attgctgctggtggacgttatgaca

SEQ ID NO: 63657 - DNA, 25 bp, S. pombe
attgcactttggtctgttcaacgta

SEQ ID NO: 63658 - DNA, 25 bp, S. pombe
attgcttttcgttgtgatgccacca

SEQ ID NO: 63659 - DNA, 25 bp, S. pombe
attgcttttacttctgatcacattg

SEQ ID NO: 63660 - DNA, 25 bp, S. pombe
attgctctttgcgatactgactcta

SEQ ID NO: 63661 - DNA, 25 bp, S. pombe
attgcaaagctctcttactgctgaa

SEQ ID NO: 63662 - DNA, 25 bp, S. pombe
attgctcaagccaatgcttcctgct

SEQ ID NO: 63663 - DNA, 25 bp, S. pombe
attgctcacattgatttctctggcc

SEQ ID NO: 63664 - DNA, 25 bp, S. pombe
attgcagcattacgttccgccgtat

SEQ ID NO: 63665 - DNA, 25 bp, S. pombe
attcctgagtcttatttgcgtgcaa

SEQ ID NO: 63666 - DNA, 25 bp, S. pombe
attccatgtttctattccctcaaga

SEQ ID NO: 63667 - DNA, 25 bp, S. pombe
attcctttgagcgacttgattccca

SEQ ID NO: 63668 - DNA, 25 bp, S. pombe
atatcttatgtatactggtggtcta

SEQ ID NO: 63669 - DNA, 25 bp, S. pombe
attcttcggcaatctggttagtaca

SEQ ID NO: 63670 - DNA, 25 bp, S. pombe
attcctcccgatgtgtttggctcaa

SEQ ID NO: 63671 - DNA, 25 bp, S. pombe
attgcaaaatctctttcttcacgga

SEQ ID NO: 63672 - DNA, 25 bp, S. pombe
attaggtcctcgatttaccatgcgt

SEQ ID NO: 63673 - DNA, 25 bp, S. pombe
attctggtcggcattttacttggtc

SEQ ID NO: 63674 - DNA, 25 bp, S. pombe
attgcctgacggacaagttactttt

SEQ ID NO: 63675 - DNA, 25 bp, S. pombe
attcggtgccgtgtttgtcaatgga

SEQ ID NO: 63676 - DNA, 25 bp, S. pombe
attcgtctccgaaactcattcaagg

SEQ ID NO: 63677 - DNA, 25 bp, S. pombe
attcctcttccaaacgtatcatcga

SEQ ID NO: 63678 - DNA, 25 bp, S. pombe
attccctttgatgccgatgacacaa

SEQ ID NO: 63679 - DNA, 25 bp, S. pombe
attccgcttagagtcagtggtccga

SEQ ID NO: 63680 - DNA, 25 bp, S. pombe
attgccgcttctaaatttcgccaga

SEQ ID NO: 63681 - DNA, 25 bp, S. pombe
attgccgattttggattgtcccact

SEQ ID NO: 63682 - DNA, 25 bp, S. pombe
attgcatttgtttccaaggcctcta

SEQ ID NO: 63683 - DNA, 25 bp, S. pombe
attgcaactttattctcagccgtta

SEQ ID NO: 63684 - DNA, 25 bp, S. pombe
attgcgactctttctcagattctga

SEQ ID NO: 63685 - DNA, 25 bp, S. pombe
attgcctccctttatgatgaccagc

SEQ ID NO: 63686 - DNA, 25 bp, S. pombe
attgcagcccctcagatatatacct

SEQ ID NO: 63687 - DNA, 25 bp, S. pombe
attgcttccgcttatctttatcttg

SEQ ID NO: 63688 - DNA, 25 bp, S. pombe
attcgcacccctatttatcttattt

SEQ ID NO: 63689 - DNA, 25 bp, S. pombe
attaccgtcttcagggtgttgttga

SEQ ID NO: 63690 - DNA, 25 bp, S. pombe
attctcctttatatgggtccgtgta

SEQ ID NO: 63691 - DNA, 25 bp, S. pombe
atttggcttttaagggccacctgct

SEQ ID NO: 63692 - DNA, 25 bp, S. pombe
atttggtctttgtggtgcatactat

SEQ ID NO: 63693 - DNA, 25 bp, S. pombe
attgctcctttattcctgttggtga

SEQ ID NO: 63694 - DNA, 25 bp, S. pombe
attgcatccctcaatatcgtgttgg

SEQ ID NO: 63695 - DNA, 25 bp, S. pombe
attgctccttcaatccatttgatga

SEQ ID NO: 63696 - DNA, 25 bp, S. pombe
attgctattttctacttctatgaaa

SEQ ID NO: 63697 - DNA, 25 bp, S. pombe
attgcttcttattctctcttaacac

SEQ ID NO: 63698 - DNA, 25 bp, S. pombe
attgcttctaatacattcgtggtca

SEQ ID NO: 63699 - DNA, 25 bp, S. pombe
attgctttgatttcatcggacgcca

SEQ ID NO: 63700 - DNA, 25 bp, S. pombe
attgcgttatatacccatcatccca

SEQ ID NO: 63701 - DNA, 25 bp, S. pombe
attgcttccaaagacatgcttccac

SEQ ID NO: 63702 - DNA, 25 bp, S. pombe
attcctggtattgtcctgggtgtaa

SEQ ID NO: 63703 - DNA, 25 bp, S. pombe
attcctttctccttggtgggatgat

SEQ ID NO: 63704 - DNA, 25 bp, S. pombe
attctatattttttgctgctggtgg

SEQ ID NO: 63705 - DNA, 25 bp, S. pombe
attgctacagtgttttcgtcctgtt

SEQ ID NO: 63706 - DNA, 25 bp, S. pombe
attgctcaaaatttccctcctgatg

SEQ ID NO: 63707 - DNA, 25 bp, S. pombe
attgctgcaaaactttctgcctttt

SEQ ID NO: 63708 - DNA, 25 bp, S. pombe
attccaaactgtggtcatgcctttt

SEQ ID NO: 63709 - DNA, 25 bp, S. pombe
attgccaagtttgtctcacccttaa

SEQ ID NO: 63710 - DNA, 25 bp, S. pombe
attgcggctttatatcgctatacag

SEQ ID NO: 63711 - DNA, 25 bp, S. pombe
attgcagcgtttattcctatactcc

SEQ ID NO: 63712 - DNA, 25 bp, S. pombe
attcctcaagttcgtttcatcactg

SEQ ID NO: 63713 - DNA, 25 bp, S. pombe
atctccccactgacggatggcaaat

SEQ ID NO: 63714 - DNA, 25 bp, S. pombe
attgccctaatgatgcttttgatat

SEQ ID NO: 63715 - DNA, 25 bp, S. pombe
attccaaatatctcactaccgtcaa

SEQ ID NO: 63716 - DNA, 25 bp, S. pombe
attctaaacgaccttatccagcatc

SEQ ID NO: 63717 - DNA, 25 bp, S. pombe
attattttctggaggactcgccgac

SEQ ID NO: 63718 - DNA, 25 bp, S. pombe
attgcgtaaaacaccttgcgataag

SEQ ID NO: 63719 - DNA, 25 bp, S. pombe
attcgaccccatggaacgctttata

SEQ ID NO: 63720 - DNA, 25 bp, S. pombe
attgccagcgtttctcgttttatag

SEQ ID NO: 63721 - DNA, 25 bp, S. pombe
attccaccagcgtatcagtatattg

SEQ ID NO: 63722 - DNA, 25 bp, S. pombe
attcgccaagcggaagctgtgacta

SEQ ID NO: 63723 - DNA, 25 bp, S. pombe
attcctatcaaactgcacttcatac

SEQ ID NO: 63724 - DNA, 25 bp, S. pombe
attccaatcaattccatgcgtgctg

SEQ ID NO: 63725 - DNA, 25 bp, S. pombe
attcgacatgccttccattatgatg

SEQ ID NO: 63726 - DNA, 25 bp, S. pombe
attgctgcaatctccacaactatga

SEQ ID NO: 63727 - DNA, 25 bp, S. pombe
attgctactatacttgcccattgtg

SEQ ID NO: 63728 - DNA, 25 bp, S. pombe
attgctgctgttcttgtacatcttg

SEQ ID NO: 63729 - DNA, 25 bp, S. pombe
attgcatttgaaagccttcctcacg

SEQ ID NO: 63730 - DNA, 25 bp, S. pombe
atacacttttacagaccctaggaag

SEQ ID NO: 63731 - DNA, 25 bp, S. pombe
attcttttaatgtccggctttctca

SEQ ID NO: 63732 - DNA, 25 bp, S. pombe
attgccgctattcggtctgccaata

SEQ ID NO: 63733 - DNA, 25 bp, S. pombe
attctattctacttgctcttggagc

SEQ ID NO: 63734 - DNA, 25 bp, S. pombe
attcgtgctggacttgttgaaggcc

SEQ ID NO: 63735 - DNA, 25 bp, S. pombe
attcgatgtgtaaccttaaggcgct

SEQ ID NO: 63736 - DNA, 25 bp, S. pombe
attgctgttgctacccctaaaggtt

SEQ ID NO: 63737 - DNA, 25 bp, S. pombe
atatcgtggaagagcccgtggtttc

SEQ ID NO: 63738 - DNA, 25 bp, S. pombe
attcgtggcaagagtcctgaggaca

SEQ ID NO: 63739 - DNA, 25 bp, S. pombe
attccttggacgatcctaatctcaa

SEQ ID NO: 63740 - DNA, 25 bp, S. pombe
attgccagtattttgagccgtacaa

SEQ ID NO: 63741 - DNA, 25 bp, S. pombe
attccgtgtctcgtggtagtcgaac

SEQ ID NO: 63742 - DNA, 25 bp, S. pombe
attccgtattcctaatgatgtcccg

SEQ ID NO: 63743 - DNA, 25 bp, S. pombe
attcctgcatttatcaagtggccta

SEQ ID NO: 63744 - DNA, 25 bp, S. pombe
attcgtttagccctgttttgtgtat

SEQ ID NO: 63745 - DNA, 25 bp, S. pombe
attgcgtttattccttggtatccct

SEQ ID NO: 63746 - DNA, 25 bp, S. pombe
attctttcaattcccgatattcctg

SEQ ID NO: 63747 - DNA, 25 bp, S. pombe
attgccgctcgcagaactggtctct

SEQ ID NO: 63748 - DNA, 25 bp, S. pombe
attacctccttgtgcattaatccac

SEQ ID NO: 63749 - DNA, 25 bp, S. pombe
attacctacctggaactgccattga

SEQ ID NO: 63750 - DNA, 25 bp, S. pombe
attcctcaatggattcgtcttcgca

SEQ ID NO: 63751 - DNA, 25 bp, S. pombe
attcatgctcgaggaccaatgggtc

SEQ ID NO: 63752 - DNA, 25 bp, S. pombe
attcgtggacgacatagaggacttc

SEQ ID NO: 63753 - DNA, 25 bp, S. pombe
attgctggtgatatgtctcccgata

SEQ ID NO: 63754 - DNA, 25 bp, S. pombe
attcgtgctacaattgcgggcggtg

SEQ ID NO: 63755 - DNA, 25 bp, S. pombe
attctgctgctaatgcattgcattg

SEQ ID NO: 63756 - DNA, 25 bp, S. pombe
attctgctgctgctcaagagtgcac

SEQ ID NO: 63757 - DNA, 25 bp, S. pombe
attctctgcggctaagggactcgat

SEQ ID NO: 63758 - DNA, 25 bp, S. pombe
attcctgccaccaagtcttttgaaa

SEQ ID NO: 63759 - DNA, 25 bp, S. pombe
attcggacacgctgctttctttgag

SEQ ID NO: 63760 - DNA, 25 bp, S. pombe
attgctgtacacctacatttcactc

SEQ ID NO: 63761 - DNA, 25 bp, S. pombe
attcttcaagatcccttgcgattcc

SEQ ID NO: 63762 - DNA, 25 bp, S. pombe
attcctcttctgcttcatcaacaat

SEQ ID NO: 63763 - DNA, 25 bp, S. pombe
atcccagcttgtcttccgaaattta

SEQ ID NO: 63764 - DNA, 25 bp, S. pombe
attccagctgtttttgtcgatacct

SEQ ID NO: 63765 - DNA, 25 bp, S. pombe
attctggttccatttatcgcacttt

SEQ ID NO: 63766 - DNA, 25 bp, S. pombe
attcgagttcatcagtttggcggcc

SEQ ID NO: 63767 - DNA, 25 bp, S. pombe
attcgttcattttcgctactttgca

SEQ ID NO: 63768 - DNA, 25 bp, S. pombe
attcctttcttgtgagtcatgccga

SEQ ID NO: 63769 - DNA, 25 bp, S. pombe
attctggaattgtcacttaacggca

SEQ ID NO: 63770 - DNA, 25 bp, S. pombe
attctgggtttagtttacaatctct

SEQ ID NO: 63771 - DNA, 25 bp, S. pombe
attctattgcttttccaagacctaa

SEQ ID NO: 63772 - DNA, 25 bp, S. pombe
attctttgactaacgctggacctga

SEQ ID NO: 63773 - DNA, 25 bp, S. pombe
attcgttacttcactggtcgtactg

SEQ ID NO: 63774 - DNA, 25 bp, S. pombe
attcctattttcacgactcttcatt

SEQ ID NO: 63775 - DNA, 25 bp, S. pombe
attcgcttgtttgtaagccttcctg

SEQ ID NO: 63776 - DNA, 25 bp, S. pombe
attcttgctcttcagcgaggatgac

SEQ ID NO: 63777 - DNA, 25 bp, S. pombe
attcttcccgaatggcatgcaacat

SEQ ID NO: 63778 - DNA, 25 bp, S. pombe
attgccattcgcgacttggctgaac

SEQ ID NO: 63779 - DNA, 25 bp, S. pombe
attcgtgtccatgcttgcgacaatc

SEQ ID NO: 63780 - DNA, 25 bp, S. pombe
attcggatgccagtttgctatcggt

SEQ ID NO: 63781 - DNA, 25 bp, S. pombe
attgccgtcgttcagattgctgcat

SEQ ID NO: 63782 - DNA, 25 bp, S. pombe
attccaatggacgacacagctttta

SEQ ID NO: 63783 - DNA, 25 bp, S. pombe
attccagatagtatgcccttgtttt

SEQ ID NO: 63784 - DNA, 25 bp, S. pombe
attccaggactttcacttcgtgttt

SEQ ID NO: 63785 - DNA, 25 bp, S. pombe
atttgggtacgtcttatgtcctcat

SEQ ID NO: 63786 - DNA, 25 bp, S. pombe
attctggtgtacgttttactgccta

SEQ ID NO: 63787 - DNA, 25 bp, S. pombe
attcgggatcccatattaccatttt

SEQ ID NO: 63788 - DNA, 25 bp, S. pombe
attgccgaacgcgactcattaaata

SEQ ID NO: 63789 - DNA, 25 bp, S. pombe
attcctaccgcttctcattaataag

SEQ ID NO: 63790 - DNA, 25 bp, S. pombe
attcctacggatttgcttgacagat

SEQ ID NO: 63791 - DNA, 25 bp, S. pombe
attcctataggatgtcttacagcat

SEQ ID NO: 63792 - DNA, 25 bp, S. pombe
attccttcgatgatgctcgtaagct

SEQ ID NO: 63793 - DNA, 25 bp, S. pombe
attcctcccgaaacatctgatgtgt

SEQ ID NO: 63794 - DNA, 25 bp, S. pombe
attccactcaatgcgattcttcttg

SEQ ID NO: 63795 - DNA, 25 bp, S. pombe
attacccatgccctcaaaacataga

SEQ ID NO: 63796 - DNA, 25 bp, S. pombe
attaatttgcgtcaacccaagccac

SEQ ID NO: 63797 - DNA, 25 bp, S. pombe
attcaatttcctcagaaccagccaa

SEQ ID NO: 63798 - DNA, 25 bp, S. pombe
attaccttgctcctagtactggtgc

SEQ ID NO: 63799 - DNA, 25 bp, S. pombe
attaggattctactggttcgcggtt

SEQ ID NO: 63800 - DNA, 25 bp, S. pombe
attcgagttcaacggtggtgcctat

SEQ ID NO: 63801 - DNA, 25 bp, S. pombe
attatgaggccagacagtacgcgag

SEQ ID NO: 63802 - DNA, 25 bp, S. pombe
attccgcagatgcatctacaacgca

SEQ ID NO: 63803 - DNA, 25 bp, S. pombe
attcctatgatgtacaacggccaag

SEQ ID NO: 63804 - DNA, 25 bp, S. pombe
attctttgagataggccctctatac

SEQ ID NO: 63805 - DNA, 25 bp, S. pombe
attcctcatctaaatctgacagcga

SEQ ID NO: 63806 - DNA, 25 bp, S. pombe
attccagttgcagttatgctgttcg

SEQ ID NO: 63807 - DNA, 25 bp, S. pombe
attctgcaaagttcgcttctggttt

SEQ ID NO: 63808 - DNA, 25 bp, S. pombe
attccacaagtaccgtgtcaaacgc

SEQ ID NO: 63809 - DNA, 25 bp, S. pombe
attccacaagtaccgcgtcaagcgt

SEQ ID NO: 63810 - DNA, 25 bp, S. pombe
attccccgttcaaaaagctgtgcca

SEQ ID NO: 63811 - DNA, 25 bp, S. pombe
attcccacgcttcattagagttcgg

SEQ ID NO: 63812 - DNA, 25 bp, S. pombe
attctgctcctatttatcgtttaca

SEQ ID NO: 63813 - DNA, 25 bp, S. pombe
attcccatctcaccggcaattattt

SEQ ID NO: 63814 - DNA, 25 bp, S. pombe
atatccctccttcccaaaattatag

SEQ ID NO: 63815 - DNA, 25 bp, S. pombe
attctcctcgtttgagacccatgga

SEQ ID NO: 63816 - DNA, 25 bp, S. pombe
attcctgaggtcattggccgtgaaa

SEQ ID NO: 63817 - DNA, 25 bp, S. pombe
attccagagtgtatgttgcctttta

SEQ ID NO: 63818 - DNA, 25 bp, S. pombe
attccaacagtcatatctccaatct

SEQ ID NO: 63819 - DNA, 25 bp, S. pombe
attccaccttttccaatgcaatatc

SEQ ID NO: 63820 - DNA, 25 bp, S. pombe
attcgaggctttacggctactacat

SEQ ID NO: 63821 - DNA, 25 bp, S. pombe
attcgataatgtgggccgctggtta

SEQ ID NO: 63822 - DNA, 25 bp, S. pombe
atacaatagattggcgaaatcttaa

SEQ ID NO: 63823 - DNA, 25 bp, S. pombe
atatcacggtgcttggaaacttttc

SEQ ID NO: 63824 - DNA, 25 bp, S. pombe
attccgctgctcttcaaaagctttt

SEQ ID NO: 63825 - DNA, 25 bp, S. pombe
attcccctttatttactgtcttgca

SEQ ID NO: 63826 - DNA, 25 bp, S. pombe
attccttgttgcgttcatgatctga

SEQ ID NO: 63827 - DNA, 25 bp, S. pombe
attcatgcggattcagtcaaactgg

SEQ ID NO: 63828 - DNA, 25 bp, S. pombe
attcgagcggctaactttcttacta

SEQ ID NO: 63829 - DNA, 25 bp, S. pombe
attcgatgtgtgcattctgtcctta

SEQ ID NO: 63830 - DNA, 25 bp, S. pombe
attcgcttcaggcacgacacgatga

SEQ ID NO: 63831 - DNA, 25 bp, S. pombe
attacttccgcgtgatctcgagaga

SEQ ID NO: 63832 - DNA, 25 bp, S. pombe
attctcggtgatgcccatgatttgg

SEQ ID NO: 63833 - DNA, 25 bp, S. pombe
attcctctgcttttcaaggctttac

SEQ ID NO: 63834 - DNA, 25 bp, S. pombe
attcccgctgttcaatatggtgcca

SEQ ID NO: 63835 - DNA, 25 bp, S. pombe
attcttttggaatcttctgccttat

SEQ ID NO: 63836 - DNA, 25 bp, S. pombe
attttcttcgatatttcctcttacg

SEQ ID NO: 63837 - DNA, 25 bp, S. pombe
attccattcatcaatttcttccttc

SEQ ID NO: 63838 - DNA, 25 bp, S. pombe
attccatcatatttatcagcctccg

SEQ ID NO: 63839 - DNA, 25 bp, S. pombe
attctgtgtggcgtaattgctgcat

SEQ ID NO: 63840 - DNA, 25 bp, S. pombe
attctgttcgtcaaatgctatctca

SEQ ID NO: 63841 - DNA, 25 bp, S. pombe
attcctcctggacatactcaacaag

SEQ ID NO: 63842 - DNA, 25 bp, S. pombe
attctcttcttcgtcaagccgaaag

SEQ ID NO: 63843 - DNA, 25 bp, S. pombe
attcgccgaattttgaaatcctcta

SEQ ID NO: 63844 - DNA, 25 bp, S. pombe
attcggcgagtttggaattccataa

SEQ ID NO: 63845 - DNA, 25 bp, S. pombe
attccgtggtactagatatgttcat

SEQ ID NO: 63846 - DNA, 25 bp, S. pombe
attccttagatctttgacacattca

SEQ ID NO: 63847 - DNA, 25 bp, S. pombe
attccttcgattttgaccagccaga

SEQ ID NO: 63848 - DNA, 25 bp, S. pombe
attcaagcacgctgtcgctattcga

SEQ ID NO: 63849 - DNA, 25 bp, S. pombe
attccctcacatgctttttcaggta

SEQ ID NO: 63850 - DNA, 25 bp, S. pombe
attcggttggacactttcttgctga

SEQ ID NO: 63851 - DNA, 25 bp, S. pombe
attcgatgtcattccaagcttcctt

SEQ ID NO: 63852 - DNA, 25 bp, S. pombe
attcggcttccccagttaatattgg

SEQ ID NO: 63853 - DNA, 25 bp, S. pombe
attcgtttggctggaggtgttactc

SEQ ID NO: 63854 - DNA, 25 bp, S. pombe
attctccttggttttagatcctctg

SEQ ID NO: 63855 - DNA, 25 bp, S. pombe
attcaaattctttccaatcctcggg

SEQ ID NO: 63856 - DNA, 25 bp, S. pombe
attcaatgactattcacgttcccgg

SEQ ID NO: 63857 - DNA, 25 bp, S. pombe
attcctagtatttcatttcctctgg

SEQ ID NO: 63858 - DNA, 25 bp, S. pombe
attccggtcattacaagatgtgcct

SEQ ID NO: 63859 - DNA, 25 bp, S. pombe
attaacaacggtcaagcaggctctt

SEQ ID NO: 63860 - DNA, 25 bp, S. pombe
attactatccatcctacattatctc

SEQ ID NO: 63861 - DNA, 25 bp, S. pombe
attcgtcctcatctagttgatctag

SEQ ID NO: 63862 - DNA, 25 bp, S. pombe
attcaccctatcgtaccttgtattt

SEQ ID NO: 63863 - DNA, 25 bp, S. pombe
attcacacgatatgaccccagtttt

SEQ ID NO: 63864 - DNA, 25 bp, S. pombe
attaggagtaggctggccctcttat

SEQ ID NO: 63865 - DNA, 25 bp, S. pombe
attcgttgtcgagagtgtgggcatc

SEQ ID NO: 63866 - DNA, 25 bp, S. pombe
attttgttggagtcagtgctacgca

SEQ ID NO: 63867 - DNA, 25 bp, S. pombe
attcttcagtgtaccgattatgcta

SEQ ID NO: 63868 - DNA, 25 bp, S. pombe
attcaactcatcgtcttgcttttac

SEQ ID NO: 63869 - DNA, 25 bp, S. pombe
attcaatgaatctgccgttacctcg

SEQ ID NO: 63870 - DNA, 25 bp, S. pombe
attctatctaaatgggctgcacagc

SEQ ID NO: 63871 - DNA, 25 bp, S. pombe
gttactggcgaatggtccggaactt

SEQ ID NO: 63872 - DNA, 25 bp, S. pombe
ataacggtaacgctgctcgtggact

SEQ ID NO: 63873 - DNA, 25 bp, S. pombe
attactgctgtgctagtagtcggga

SEQ ID NO: 63874 - DNA, 25 bp, S. pombe
attcgtgttctgtatatggtcttgg

SEQ ID NO: 63875 - DNA, 25 bp, S. pombe
attctagtatcctaatcgtcgctgg

SEQ ID NO: 63876 - DNA, 25 bp, S. pombe
attcgcctatccaaattgcttctga

SEQ ID NO: 63877 - DNA, 25 bp, S. pombe
attcttcttcgttattgccttcaga

SEQ ID NO: 63878 - DNA, 25 bp, S. pombe
attcaccaatttttatcctctcact

SEQ ID NO: 63879 - DNA, 25 bp, S. pombe
attcactaacttcttcatccttttc

SEQ ID NO: 63880 - DNA, 25 bp, S. pombe
attctggaatttcttctgctccttt

SEQ ID NO: 63881 - DNA, 25 bp, S. pombe
attcggtattcttatacgcttcgcc

SEQ ID NO: 63882 - DNA, 25 bp, S. pombe
attcggatatcttacccttagctga

SEQ ID NO: 63883 - DNA, 25 bp, S. pombe
attcgcgaatttacctttgagcaag

SEQ ID NO: 63884 - DNA, 25 bp, S. pombe
attacttacgctcatttgggccatt

SEQ ID NO: 63885 - DNA, 25 bp, S. pombe
attactttcgttgtctaccacttgg

SEQ ID NO: 63886 - DNA, 25 bp, S. pombe
attatcttctttatggcgaccatct

SEQ ID NO: 63887 - DNA, 25 bp, S. pombe
attccctcgttgttgcttcttattt

SEQ ID NO: 63888 - DNA, 25 bp, S. pombe
attcccggattagtgttctctttca

SEQ ID NO: 63889 - DNA, 25 bp, S. pombe
attctactccttagttcggcttatg

SEQ ID NO: 63890 - DNA, 25 bp, S. pombe
attctcattcgctttttcgtcattt

SEQ ID NO: 63891 - DNA, 25 bp, S. pombe
attcgtctcaaagcgcatgcgtatg

SEQ ID NO: 63892 - DNA, 25 bp, S. pombe
attcgtgctaattggcctcaacatc

SEQ ID NO: 63893 - DNA, 25 bp, S. pombe
attcggcataaaacactccacattc

SEQ ID NO: 63894 - DNA, 25 bp, S. pombe
attacagcacttcaaaacagccgcc

SEQ ID NO: 63895 - DNA, 25 bp, S. pombe
attctcgacttggtacaacaggcct

SEQ ID NO: 63896 - DNA, 25 bp, S. pombe
attcgcgacgtgtttccacatgtag

SEQ ID NO: 63897 - DNA, 25 bp, S. pombe
attccgattacaatacctctgctac

SEQ ID NO: 63898 - DNA, 25 bp, S. pombe
attcgtatgggattaccgctcttca

SEQ ID NO: 63899 - DNA, 25 bp, S. pombe
attcaaacacatctgagcgaccgtc

SEQ ID NO: 63900 - DNA, 25 bp, S. pombe
attcatcaaaatcatcgcgggcggc

SEQ ID NO: 63901 - DNA, 25 bp, S. pombe
attctcaatcactttcacagcagtc

SEQ ID NO: 63902 - DNA, 25 bp, S. pombe
attctggatcagcttgcaacgattg

SEQ ID NO: 63903 - DNA, 25 bp, S. pombe
attctggactcgctaagggatttag

SEQ ID NO: 63904 - DNA, 25 bp, S. pombe
attcgaatcacgtttttggctaaag

SEQ ID NO: 63905 - DNA, 25 bp, S. pombe
attctgtcacccttcgaatggttat

SEQ ID NO: 63906 - DNA, 25 bp, S. pombe
attcgcacacccaagaaatcctatt

SEQ ID NO: 63907 - DNA, 25 bp, S. pombe
attcacgctctctatatcatcttaa

SEQ ID NO: 63908 - DNA, 25 bp, S. pombe
attccgagcctgaatcatcgtcgaa

SEQ ID NO: 63909 - DNA, 25 bp, S. pombe
attctgccatggatcaacttgccaa

SEQ ID NO: 63910 - DNA, 25 bp, S. pombe
attcccattatgaagcctcccaaaa

SEQ ID NO: 63911 - DNA, 25 bp, S. pombe
attcgccattatttttgttcctctg

SEQ ID NO: 63912 - DNA, 25 bp, S. pombe
attcgcgattgttttcttgctcatt

SEQ ID NO: 63913 - DNA, 25 bp, S. pombe
attcacgtagatttttcccaaagcg

SEQ ID NO: 63914 - DNA, 25 bp, S. pombe
attcaagccaagtatattcccaaag

SEQ ID NO: 63915 - DNA, 25 bp, S. pombe
attctccatcttcgtctagttttga

SEQ ID NO: 63916 - DNA, 25 bp, S. pombe
attcatcgtcttcatgagagccctt

SEQ ID NO: 63917 - DNA, 25 bp, S. pombe
attctacatgttcagtgcaccgttt

SEQ ID NO: 63918 - DNA, 25 bp, S. pombe
attcgactgatgctggtgaccgatt

SEQ ID NO: 63919 - DNA, 25 bp, S. pombe
attctatcattgcatgccttctcta

SEQ ID NO: 63920 - DNA, 25 bp, S. pombe
attcaattggttgcttgctctatct

SEQ ID NO: 63921 - DNA, 25 bp, S. pombe
attcacttaattcctagtcaatcag

SEQ ID NO: 63922 - DNA, 25 bp, S. pombe
attttctaaaataactcaacgcaga

SEQ ID NO: 63923 - DNA, 25 bp, S. pombe
attctctcaaattaaacccgcgcaa

SEQ ID NO: 63924 - DNA, 25 bp, S. pombe
attctcctgaattaatgggctctgc

SEQ ID NO: 63925 - DNA, 25 bp, S. pombe
attctctgaaacttatgggcctcta

SEQ ID NO: 63926 - DNA, 25 bp, S. pombe
attcgtaatgactctttgcatccta

SEQ ID NO: 63927 - DNA, 25 bp, S. pombe
attttttaccatgtttgcgtgcgct

SEQ ID NO: 63928 - DNA, 25 bp, S. pombe
attcgtttacgatcctaagcggcga

SEQ ID NO: 63929 - DNA, 25 bp, S. pombe
attagttaccggtgctaacccagca

SEQ ID NO: 63930 - DNA, 25 bp, S. pombe
attcgtttcattgccgataacccag

SEQ ID NO: 63931 - DNA, 25 bp, S. pombe
attctctacggatattgcttctcac

SEQ ID NO: 63932 - DNA, 25 bp, S. pombe
attagtgcacatcgacgttgttccc

SEQ ID NO: 63933 - DNA, 25 bp, S. pombe
attaggaccagaagcccttcgacgt

SEQ ID NO: 63934 - DNA, 25 bp, S. pombe
attaggtgcgagctcaatctttgcc

SEQ ID NO: 63935 - DNA, 25 bp, S. pombe
atactatgacacacctataccacgt

SEQ ID NO: 63936 - DNA, 25 bp, S. pombe
attatctgcaccttccaaaaactca

SEQ ID NO: 63937 - DNA, 25 bp, S. pombe
attcacgctcgtgctagaggacctg

SEQ ID NO: 63938 - DNA, 25 bp, S. pombe
attcgttcgtttcgcctatcctcac

SEQ ID NO: 63939 - DNA, 25 bp, S. pombe
attcttgagttctagcgtgtcttcc

SEQ ID NO: 63940 - DNA, 25 bp, S. pombe
attctcttcttgtctctgtgtttga

SEQ ID NO: 63941 - DNA, 25 bp, S. pombe
attctgttgcttcccttttagatga

SEQ ID NO: 63942 - DNA, 25 bp, S. pombe
attcgtggactcataccatgcttgg

SEQ ID NO: 63943 - DNA, 25 bp, S. pombe
attcttgccaatcgtgaggctgtcc

SEQ ID NO: 63944 - DNA, 25 bp, S. pombe
attctctcgatacgcatagccttga

SEQ ID NO: 63945 - DNA, 25 bp, S. pombe
attcagccgaacctaatcattatgg

SEQ ID NO: 63946 - DNA, 25 bp, S. pombe
attacctaaccaagtctcaatgcca

SEQ ID NO: 63947 - DNA, 25 bp, S. pombe
attacgacgctcaataagtccgtta

SEQ ID NO: 63948 - DNA, 25 bp, S. pombe
attagcaaaatgtttcttcgtggtg

SEQ ID NO: 63949 - DNA, 25 bp, S. pombe
attcgtacaaactcaatgccctctt

SEQ ID NO: 63950 - DNA, 25 bp, S. pombe
attcggaaagcatccattacgtttt

SEQ ID NO: 63951 - DNA, 25 bp, S. pombe
attcgtgaaaattctggcggcgcag

SEQ ID NO: 63952 - DNA, 25 bp, S. pombe
attcgtgaaatccatgagcgtctcg

SEQ ID NO: 63953 - DNA, 25 bp, S. pombe
attcgaatacctagagcgcctgctg

SEQ ID NO: 63954 - DNA, 25 bp, S. pombe
attctgaagtcccagcagctcaagt

SEQ ID NO: 63955 - DNA, 25 bp, S. pombe
attaattcccaacgccctgatgatt

SEQ ID NO: 63956 - DNA, 25 bp, S. pombe
attctattgaccaacgatttgactc

SEQ ID NO: 63957 - DNA, 25 bp, S. pombe
attctgattacgatcgctgttgccc

SEQ ID NO: 63958 - DNA, 25 bp, S. pombe
attctaagatcgagccttgcatcct

SEQ ID NO: 63959 - DNA, 25 bp, S. pombe
attttgcaaacgatcttcccaactc

SEQ ID NO: 63960 - DNA, 25 bp, S. pombe
attattcaagttgcctatcaccctt

SEQ ID NO: 63961 - DNA, 25 bp, S. pombe
attcattaacgactctgcaaatcca

SEQ ID NO: 63962 - DNA, 25 bp, S. pombe
attcgtaatcgctttcaataccatt

SEQ ID NO: 63963 - DNA, 25 bp, S. pombe
attcgtggacgcgtcttagacaatc

SEQ ID NO: 63964 - DNA, 25 bp, S. pombe
atttctggtgaggtctccaaacgta

SEQ ID NO: 63965 - DNA, 25 bp, S. pombe
attcgactctttgatgctcatctca

SEQ ID NO: 63966 - DNA, 25 bp, S. pombe
attcgtggatatgctggtcgtggtc

SEQ ID NO: 63967 - DNA, 25 bp, S. pombe
attcgtgccttgttggatcaattca

SEQ ID NO: 63968 - DNA, 25 bp, S. pombe
attcgtgacttgtctgaggcttccg

SEQ ID NO: 63969 - DNA, 25 bp, S. pombe
attctatcatcaaatttcctctcgc

SEQ ID NO: 63970 - DNA, 25 bp, S. pombe
attcgatgtcttaatgtcctccctt

SEQ ID NO: 63971 - DNA, 25 bp, S. pombe
attctatgtatctttgttccccatc

SEQ ID NO: 63972 - DNA, 25 bp, S. pombe
attctagcatgcgtgttgattcctc

SEQ ID NO: 63973 - DNA, 25 bp, S. pombe
attctgcagatgtcgttgctgacga

SEQ ID NO: 63974 - DNA, 25 bp, S. pombe
attcaggaatccgatggcgatgcta

SEQ ID NO: 63975 - DNA, 25 bp, S. pombe
attacgttatcattccaatctttgg

SEQ ID NO: 63976 - DNA, 25 bp, S. pombe
attactgttttttatgcttcctgtg

SEQ ID NO: 63977 - DNA, 25 bp, S. pombe
attacggtcttttaaatcgctcaag

SEQ ID NO: 63978 - DNA, 25 bp, S. pombe
attacggacgtcttaagggatcatc

SEQ ID NO: 63979 - DNA, 25 bp, S. pombe
ataccccggagactgaaggacttga

SEQ ID NO: 63980 - DNA, 25 bp, S. pombe
atatccccggtactaagatggcctt

SEQ ID NO: 63981 - DNA, 25 bp, S. pombe
attcgtcttcgtatgcaaatggcac

SEQ ID NO: 63982 - DNA, 25 bp, S. pombe
attcgattgtttagtccttgctgcc

SEQ ID NO: 63983 - DNA, 25 bp, S. pombe
attctgatttccctaagcttcgtga

SEQ ID NO: 63984 - DNA, 25 bp, S. pombe
attctttcccgtaagccaggtgata

SEQ ID NO: 63985 - DNA, 25 bp, S. pombe
attaaggccctcattgttcctttga

SEQ ID NO: 63986 - DNA, 25 bp, S. pombe
attcaaggccctgatggaactccat

SEQ ID NO: 63987 - DNA, 25 bp, S. pombe
attaccagatcctcacggtgtacta

SEQ ID NO: 63988 - DNA, 25 bp, S. pombe
attagacagcatgcatccagcggtt

SEQ ID NO: 63989 - DNA, 25 bp, S. pombe
attatgacttacctcgtgtcggcaa

SEQ ID NO: 63990 - DNA, 25 bp, S. pombe
attcaggttgccgtaggtcccaata

SEQ ID NO: 63991 - DNA, 25 bp, S. pombe
attcgtttgccgatcaattccaata

SEQ ID NO: 63992 - DNA, 25 bp, S. pombe
attctcccgattctcttgacaatgt

SEQ ID NO: 63993 - DNA, 25 bp, S. pombe
attctcgtatttctcggcagcatat

SEQ ID NO: 63994 - DNA, 25 bp, S. pombe
atatactcgtcctgtcatggttcat

SEQ ID NO: 63995 - DNA, 25 bp, S. pombe
attctcctgtttctgcattgtgtat

SEQ ID NO: 63996 - DNA, 25 bp, S. pombe
attacttgttgtctgatgttttgca

SEQ ID NO: 63997 - DNA, 25 bp, S. pombe
attcggtgtctttttgcttcttcaa

SEQ ID NO: 63998 - DNA, 25 bp, S. pombe
attagcggattttccacttctacca

SEQ ID NO: 63999 - DNA, 25 bp, S. pombe
attaccgtttatccctgagggcaat

SEQ ID NO: 64000 - DNA, 25 bp, S. pombe
attaccgctttatgctcgctacgaa

SEQ ID NO: 64001 - DNA, 25 bp, S. pombe
attacacgatggtacaggcctccag

SEQ ID NO: 64002 - DNA, 25 bp, S. pombe
attacatggaggaatctggcccgtc

SEQ ID NO: 64003 - DNA, 25 bp, S. pombe
attacattgaaattggacgccaccg

SEQ ID NO: 64004 - DNA, 25 bp, S. pombe
attctacccctgtttgcattgaggt

SEQ ID NO: 64005 - DNA, 25 bp, S. pombe
attaaccacttgttgctgcctgatg

SEQ ID NO: 64006 - DNA, 25 bp, S. pombe
attcaatttggccatgaccctagtg

SEQ ID NO: 64007 - DNA, 25 bp, S. pombe
attcaactcagtctccgatgtatta

SEQ ID NO: 64008 - DNA, 25 bp, S. pombe
attctcaagcttttgttcaacacga

SEQ ID NO: 64009 - DNA, 25 bp, S. pombe
atatcttgcgttctcattagcgtat

SEQ ID NO: 64010 - DNA, 25 bp, S. pombe
atttccctaaaactcaagctccaga

SEQ ID NO: 64011 - DNA, 25 bp, S. pombe
attctccactggtttttcatgctac

SEQ ID NO: 64012 - DNA, 25 bp, S. pombe
attctcttctgcctttaatcttatc

SEQ ID NO: 64013 - DNA, 25 bp, S. pombe
attctccctcctctatatttgataa

SEQ ID NO: 64014 - DNA, 25 bp, S. pombe
attcaacgtggattgctacgcaggt

SEQ ID NO: 64015 - DNA, 25 bp, S. pombe
attcaacggacatcttcattgcctg

SEQ ID NO: 64016 - DNA, 25 bp, S. pombe
attcaaccagaattcgccaatcatc

SEQ ID NO: 64017 - DNA, 25 bp, S. pombe
attacattccagacgttccttacaa

SEQ ID NO: 64018 - DNA, 25 bp, S. pombe
attactcgccatactctatctttaa

SEQ ID NO: 64019 - DNA, 25 bp, S. pombe
attatctagtgttaccctttccgcg

SEQ ID NO: 64020 - DNA, 25 bp, S. pombe
attcacttctgatcggcctttatac

SEQ ID NO: 64021 - DNA, 25 bp, S. pombe
attctctgtggtttggccactcaaa

SEQ ID NO: 64022 - DNA, 25 bp, S. pombe
attctgttgctttcaaccctcataa

SEQ ID NO: 64023 - DNA, 25 bp, S. pombe
attctgttatggtcagccccttgaa

SEQ ID NO: 64024 - DNA, 25 bp, S. pombe
attctgcgggtctcaagacagcatt

SEQ ID NO: 64025 - DNA, 25 bp, S. pombe
attcttctgcgattttcatgactga

SEQ ID NO: 64026 - DNA, 25 bp, S. pombe
attcatccgctacttctggagctga

SEQ ID NO: 64027 - DNA, 25 bp, S. pombe
attcagcggtatcgccatgaagcgc

SEQ ID NO: 64028 - DNA, 25 bp, S. pombe
attctacgatgcgacactgttcaat

SEQ ID NO: 64029 - DNA, 25 bp, S. pombe
attctcgtcatgttcttgctttata

SEQ ID NO: 64030 - DNA, 25 bp, S. pombe
attttgtatgagaccgccttgttgt

SEQ ID NO: 64031 - DNA, 25 bp, S. pombe
attctttagaccctgccaatgtgtt

SEQ ID NO: 64032 - DNA, 25 bp, S. pombe
attcttcacgctcattcggtggtaa

SEQ ID NO: 64033 - DNA, 25 bp, S. pombe
attcttccgctgtccaagtagttga

SEQ ID NO: 64034 - DNA, 25 bp, S. pombe
attcttgggcgtgacattcaatctg

SEQ ID NO: 64035 - DNA, 25 bp, S. pombe
atttcgtttgctgccttaactttgt

SEQ ID NO: 64036 - DNA, 25 bp, S. pombe
atttcttttccatcagaaccttcgg

SEQ ID NO: 64037 - DNA, 25 bp, S. pombe
attaccattacctcagacctgtttt

SEQ ID NO: 64038 - DNA, 25 bp, S. pombe
cttatgccctttgtagaccgatttt

SEQ ID NO: 64039 - DNA, 25 bp, S. pombe
attacggattatgtcgactcggatt

SEQ ID NO: 64040 - DNA, 25 bp, S. pombe
attcaaatcatgcttgtcggtcaag

SEQ ID NO: 64041 - DNA, 25 bp, S. pombe
attatgccgctgtcggagaagcctc

SEQ ID NO: 64042 - DNA, 25 bp, S. pombe
attcagcgagtgtgttggtgcgtca

SEQ ID NO: 64043 - DNA, 25 bp, S. pombe
attatttgactgtccgcatttcgcg

SEQ ID NO: 64044 - DNA, 25 bp, S. pombe
ctttgcctgggcctctaaattaatg

SEQ ID NO: 64045 - DNA, 25 bp, S. pombe
atttgaccttcgtggtattcctcct

SEQ ID NO: 64046 - DNA, 25 bp, S. pombe
atttggctttcgagttttcctagtg

SEQ ID NO: 64047 - DNA, 25 bp, S. pombe
attaggcttgatttccaggacttct

SEQ ID NO: 64048 - DNA, 25 bp, S. pombe
attatccggcagtacttgactttac

SEQ ID NO: 64049 - DNA, 25 bp, S. pombe
attaccctgttgttacactcgatgt

SEQ ID NO: 64050 - DNA, 25 bp, S. pombe
atacaacctttgctacgtctaatgt

SEQ ID NO: 64051 - DNA, 25 bp, S. pombe
attaaagctcttcctaccagtatta

SEQ ID NO: 64052 - DNA, 25 bp, S. pombe
attcaaacaccgtctatacctttag

SEQ ID NO: 64053 - DNA, 25 bp, S. pombe
acaccaacggttctcaatttttcat

SEQ ID NO: 64054 - DNA, 25 bp, S. pombe
atacttgggtttttcactttgacat

SEQ ID NO: 64055 - DNA, 25 bp, S. pombe
attcttgtgtttactttcatcttta

SEQ ID NO: 64056 - DNA, 25 bp, S. pombe
attcacttgtttggtttagcattca

SEQ ID NO: 64057 - DNA, 25 bp, S. pombe
attcatcctggtacttccattgtga

SEQ ID NO: 64058 - DNA, 25 bp, S. pombe
attctcagttaactctccagggaca

SEQ ID NO: 64059 - DNA, 25 bp, S. pombe
attcaagtttatttcgtacgctcaa

SEQ ID NO: 64060 - DNA, 25 bp, S. pombe
attcatcgttttacttgtccgctac

SEQ ID NO: 64061 - DNA, 25 bp, S. pombe
attacgattcgtattcctcctacga

SEQ ID NO: 64062 - DNA, 25 bp, S. pombe
attagctaacctacattccatctta

SEQ ID NO: 64063 - DNA, 25 bp, S. pombe
attagcctacaaccttactcatttg

SEQ ID NO: 64064 - DNA, 25 bp, S. pombe
attaaatcgagatatgttccttatt

SEQ ID NO: 64065 - DNA, 25 bp, S. pombe
attacattgtgggttgcggattata

SEQ ID NO: 64066 - DNA, 25 bp, S. pombe
attactaaggttggcggcagtcagt

SEQ ID NO: 64067 - DNA, 25 bp, S. pombe
attagtaactttgctgggctcggaa

SEQ ID NO: 64068 - DNA, 25 bp, S. pombe
attacttagtttctgcctcattcga

SEQ ID NO: 64069 - DNA, 25 bp, S. pombe
attcttctcaagtgggcctattcta

SEQ ID NO: 64070 - DNA, 25 bp, S. pombe
attcagttttgcaaacctgcctcta

SEQ ID NO: 64071 - DNA, 25 bp, S. pombe
attcttcttcctatcaacattgtcg

SEQ ID NO: 64072 - DNA, 25 bp, S. pombe
attcttctcttgtttcagacgttcg

SEQ ID NO: 64073 - DNA, 25 bp, S. pombe
attctattgcttttcatcccgattc

SEQ ID NO: 64074 - DNA, 25 bp, S. pombe
attcatccaattcctaaagctcgtc

SEQ ID NO: 64075 - DNA, 25 bp, S. pombe
atatacccatgtcaagccttcaaac

SEQ ID NO: 64076 - DNA, 25 bp, S. pombe
attacccaatcccagctttttgagt

SEQ ID NO: 64077 - DNA, 25 bp, S. pombe
attcactaatgtcctcatcttcttt

SEQ ID NO: 64078 - DNA, 25 bp, S. pombe
attaacgccgattctttgtatcccg

SEQ ID NO: 64079 - DNA, 25 bp, S. pombe
attctttgcctgattttcttcctta

SEQ ID NO: 64080 - DNA, 25 bp, S. pombe
attcataccacgatttacctcctat

SEQ ID NO: 64081 - DNA, 25 bp, S. pombe
attcattccttcttctgtggattca

SEQ ID NO: 64082 - DNA, 25 bp, S. pombe
attcttgcttccttcttgggctcta

SEQ ID NO: 64083 - DNA, 25 bp, S. pombe
attcttttgatcctgttggctctta

SEQ ID NO: 64084 - DNA, 25 bp, S. pombe
attcattttcaccttgtcagcacga

SEQ ID NO: 64085 - DNA, 25 bp, S. pombe
attctttcatcgcttttgacacaca

SEQ ID NO: 64086 - DNA, 25 bp, S. pombe
attcttactccacgattatctgcta

SEQ ID NO: 64087 - DNA, 25 bp, S. pombe
attttcccgatccatgcatatctaa

SEQ ID NO: 64088 - DNA, 25 bp, S. pombe
attcttcatccctgtctcagataaa

SEQ ID NO: 64089 - DNA, 25 bp, S. pombe
attcttcgccagtgtcttgctaaag

SEQ ID NO: 64090 - DNA, 25 bp, S. pombe
attacccacagattcgctttcaaag

SEQ ID NO: 64091 - DNA, 25 bp, S. pombe
attagcttccgttacacaacctgaa

SEQ ID NO: 64092 - DNA, 25 bp, S. pombe
attacgacgctccaagcactgttaa

SEQ ID NO: 64093 - DNA, 25 bp, S. pombe
attcaagagcttcgcattgtccttc

SEQ ID NO: 64094 - DNA, 25 bp, S. pombe
ctataaggttggtgacattgtcgac

SEQ ID NO: 64095 - DNA, 25 bp, S. pombe
attcactgggctgctaaatcttatg

SEQ ID NO: 64096 - DNA, 25 bp, S. pombe
atatttcgttcctaccataatcctg

SEQ ID NO: 64097 - DNA, 25 bp, S. pombe
attagtggtgtattccttcctactt

SEQ ID NO: 64098 - DNA, 25 bp, S. pombe
attaggtatgcccatcgttgacttt

SEQ ID NO: 64099 - DNA, 25 bp, S. pombe
attcagctttcaaaggccggtgctc

SEQ ID NO: 64100 - DNA, 25 bp, S. pombe
attaccgtatcctcgatgaccaaag

SEQ ID NO: 64101 - DNA, 25 bp, S. pombe
agtactgtgtactaaacgccccaag

SEQ ID NO: 64102 - DNA, 25 bp, S. pombe
attacgttgagctcaagacctccaa

SEQ ID NO: 64103 - DNA, 25 bp, S. pombe
attaccattactccaaacggccaag

SEQ ID NO: 64104 - DNA, 25 bp, S. pombe
attactactatggaattggcacccc

SEQ ID NO: 64105 - DNA, 25 bp, S. pombe
atatttccttcgagccatggtacta

SEQ ID NO: 64106 - DNA, 25 bp, S. pombe
attaactgcttcaagtgccggattc

SEQ ID NO: 64107 - DNA, 25 bp, S. pombe
attcaacagtcagatatccggcatt

SEQ ID NO: 64108 - DNA, 25 bp, S. pombe
attaagcctaattatccggatcatt

SEQ ID NO: 64109 - DNA, 25 bp, S. pombe
attaagcctaactatcccggtcgat

SEQ ID NO: 64110 - DNA, 25 bp, S. pombe
attaatgctgctattcctcgcatgt

SEQ ID NO: 64111 - DNA, 25 bp, S. pombe
attcaggctctgatatcactgcttt

SEQ ID NO: 64112 - DNA, 25 bp, S. pombe
attcataatcttactcgtcaacccg

SEQ ID NO: 64113 - DNA, 25 bp, S. pombe
atcaaatggaagtgggtgcccgact

SEQ ID NO: 64114 - DNA, 25 bp, S. pombe
attaacgttgcaagtggcgccggtt

SEQ ID NO: 64115 - DNA, 25 bp, S. pombe
attcatgacatatacgtggcccggc

SEQ ID NO: 64116 - DNA, 25 bp, S. pombe
attcatactattcatcttcctcgtc

SEQ ID NO: 64117 - DNA, 25 bp, S. pombe
attcatatctttcaagtgctccacc

SEQ ID NO: 64118 - DNA, 25 bp, S. pombe
cttacatctactcaacgttatcctg

SEQ ID NO: 64119 - DNA, 25 bp, S. pombe
atggtcgccctgaaaagttacctga

SEQ ID NO: 64120 - DNA, 25 bp, S. pombe
atttctgcgttaaattcctcaccca

SEQ ID NO: 64121 - DNA, 25 bp, S. pombe
attacctatatttgcctttccacag

SEQ ID NO: 64122 - DNA, 25 bp, S. pombe
attaactctgctttgcgtagcgtca

SEQ ID NO: 64123 - DNA, 25 bp, S. pombe
attcaactcttgatggctgtgttca

SEQ ID NO: 64124 - DNA, 25 bp, S. pombe
attcacgctcattttgggtttctaa

SEQ ID NO: 64125 - DNA, 25 bp, S. pombe
atttacccttctcttgtgctattaa

SEQ ID NO: 64126 - DNA, 25 bp, S. pombe
attaccattcaatctattcacctcg

SEQ ID NO: 64127 - DNA, 25 bp, S. pombe
attcaccttcggttagtcctgtcgg

SEQ ID NO: 64128 - DNA, 25 bp, S. pombe
attacaactcgctttgaatcgctgt

SEQ ID NO: 64129 - DNA, 25 bp, S. pombe
attacttccgataagctgttgtctt

SEQ ID NO: 64130 - DNA, 25 bp, S. pombe
attactttgcaacacttgtccttaa

SEQ ID NO: 64131 - DNA, 25 bp, S. pombe
attcatcttagctgtgaaggctcct

SEQ ID NO: 64132 - DNA, 25 bp, S. pombe
attactatcgtggagcagcaggtgc

SEQ ID NO: 64133 - DNA, 25 bp, S. pombe
attatgtacaggagacaggtcgagc

SEQ ID NO: 64134 - DNA, 25 bp, S. pombe
attagtgacactggccaaggtttaa

SEQ ID NO: 64135 - DNA, 25 bp, S. pombe
atctatgtcaactgctaaccggtca

SEQ ID NO: 64136 - DNA, 25 bp, S. pombe
atttcattttcacaaagcactggga

SEQ ID NO: 64137 - DNA, 25 bp, S. pombe
attttgttttgcgaatggcctgggt

SEQ ID NO: 64138 - DNA, 25 bp, S. pombe
atttttcctagtatacgctgggtat

SEQ ID NO: 64139 - DNA, 25 bp, S. pombe
attaagtcactaaccacatggctgc

SEQ ID NO: 64140 - DNA, 25 bp, S. pombe
attaatgttgacactgccgggcgac

SEQ ID NO: 64141 - DNA, 25 bp, S. pombe
attacacctcaggacatgggtcaaa

SEQ ID NO: 64142 - DNA, 25 bp, S. pombe
atagcccttcgacatgcggcgatga

SEQ ID NO: 64143 - DNA, 25 bp, S. pombe
attcaccttgctcatgtcggcgata

SEQ ID NO: 64144 - DNA, 25 bp, S. pombe
attacctgtctgaagctgattttga

SEQ ID NO: 64145 - DNA, 25 bp, S. pombe
attcaacgtctcgagtttgccatga

SEQ ID NO: 64146 - DNA, 25 bp, S. pombe
attacctttcggttctgccaactag

SEQ ID NO: 64147 - DNA, 25 bp, S. pombe
attcacctgatagtcttattgtcgg

SEQ ID NO: 64148 - DNA, 25 bp, S. pombe
attcaagcacaagcagcagctgctc

SEQ ID NO: 64149 - DNA, 25 bp, S. pombe
attcaagcatcaccgagcaatccag

SEQ ID NO: 64150 - DNA, 25 bp, S. pombe
attagcacaaggttgtacccctcgt

SEQ ID NO: 64151 - DNA, 25 bp, S. pombe
attacctgcaggtcatgtacccagt

SEQ ID NO: 64152 - DNA, 25 bp, S. pombe
attaatctcataccgcttgtcttgc

SEQ ID NO: 64153 - DNA, 25 bp, S. pombe
attacttatccttgctcagaagctg

SEQ ID NO: 64154 - DNA, 25 bp, S. pombe
attactgctatgcaagccaacgctc

SEQ ID NO: 64155 - DNA, 25 bp, S. pombe
attactatagtcgtgctttcgcaat

SEQ ID NO: 64156 - DNA, 25 bp, S. pombe
attacgaagatgaactccctgcctg

SEQ ID NO: 64157 - DNA, 25 bp, S. pombe
attataggccttccatgtgcgccaa

SEQ ID NO: 64158 - DNA, 25 bp, S. pombe
attaatggcgttcttgctgtcacaa

SEQ ID NO: 64159 - DNA, 25 bp, S. pombe
attagggctgtatcttcattccgcg

SEQ ID NO: 64160 - DNA, 25 bp, S. pombe
attaaggcagaatctctcttccctc

SEQ ID NO: 64161 - DNA, 25 bp, S. pombe
attagcattaattgccctcttaccc

SEQ ID NO: 64162 - DNA, 25 bp, S. pombe
attatgtcaaaagcgcctattccct

SEQ ID NO: 64163 - DNA, 25 bp, S. pombe
acagtgtccggtgtttgggccctga

SEQ ID NO: 64164 - DNA, 25 bp, S. pombe
aggagacctcgtgtttaggcctaat

SEQ ID NO: 64165 - DNA, 25 bp, S. pombe
attttacacaatgcctcgagacgtt

SEQ ID NO: 64166 - DNA, 25 bp, S. pombe
attagtgcagaaccgccatcagcaa

SEQ ID NO: 64167 - DNA, 25 bp, S. pombe
attacccgactacgcgcagagatat

SEQ ID NO: 64168 - DNA, 25 bp, S. pombe
attactgacggttctcgtacactca

SEQ ID NO: 64169 - DNA, 25 bp, S. pombe
attttaccgtggagcttcctcaaat

SEQ ID NO: 64170 - DNA, 25 bp, S. pombe
attaatactactcgtggtcccacaa

SEQ ID NO: 64171 - DNA, 25 bp, S. pombe
attagctttgtctctggtctccaaa

SEQ ID NO: 64172 - DNA, 25 bp, S. pombe
attactgctttgttcttgttcacca

SEQ ID NO: 64173 - DNA, 25 bp, S. pombe
attaatctttatcgttttcatgatc

SEQ ID NO: 64174 - DNA, 25 bp, S. pombe
attacatgtcgaccttgcttcagat

SEQ ID NO: 64175 - DNA, 25 bp, S. pombe
attttgactggcgttgtctcaaccc

SEQ ID NO: 64176 - DNA, 25 bp, S. pombe
atttacgaatcgtggcagtaccttc

SEQ ID NO: 64177 - DNA, 25 bp, S. pombe
atttagctaacgctgctgagtccca

SEQ ID NO: 64178 - DNA, 25 bp, S. pombe
attagctctctacgatgtttacaaa

SEQ ID NO: 64179 - DNA, 25 bp, S. pombe
attacatgcttcctggcgttacaag

SEQ ID NO: 64180 - DNA, 25 bp, S. pombe
attactaatcaggtggtcgcccaag

SEQ ID NO: 64181 - DNA, 25 bp, S. pombe
attaacaaaatctacctctcctgac

SEQ ID NO: 64182 - DNA, 25 bp, S. pombe
attaaccaatactatccttcccaag

SEQ ID NO: 64183 - DNA, 25 bp, S. pombe
attacttctgaagcacccactactt

SEQ ID NO: 64184 - DNA, 25 bp, S. pombe
attaaacataccaaccaactcactt

SEQ ID NO: 64185 - DNA, 25 bp, S. pombe
atttaagtactctgccaactccttt

SEQ ID NO: 64186 - DNA, 25 bp, S. pombe
attaacgactcgacagctagccaat

SEQ ID NO: 64187 - DNA, 25 bp, S. pombe
attacacgatttacgctccagactt

SEQ ID NO: 64188 - DNA, 25 bp, S. pombe
attatccgcattaatcgtggcacct

SEQ ID NO: 64189 - DNA, 25 bp, S. pombe
cttttgaccaggatagtgacgcgga

SEQ ID NO: 64190 - DNA, 25 bp, S. pombe
attttcataacctgtgatccagccc

SEQ ID NO: 64191 - DNA, 25 bp, S. pombe
atttttgcagaaaggcgtccatccc

SEQ ID NO: 64192 - DNA, 25 bp, S. pombe
atagttaaccaacctgagcctcaac

SEQ ID NO: 64193 - DNA, 25 bp, S. pombe
attatggtgtactggcgacaaggac

SEQ ID NO: 64194 - DNA, 25 bp, S. pombe
attacgttgcactagtcggctatgg

SEQ ID NO: 64195 - DNA, 25 bp, S. pombe
attaacttgtcgctcgtttccaaat

SEQ ID NO: 64196 - DNA, 25 bp, S. pombe
attacactttcacttgtccttacag

SEQ ID NO: 64197 - DNA, 25 bp, S. pombe
attatctcagttgcattacatcgta

SEQ ID NO: 64198 - DNA, 25 bp, S. pombe
attactcacaatgcttcccatgtac

SEQ ID NO: 64199 - DNA, 25 bp, S. pombe
attttccaacacttactctgatgcc

SEQ ID NO: 64200 - DNA, 25 bp, S. pombe
attacatgttctttgatccgattca

SEQ ID NO: 64201 - DNA, 25 bp, S. pombe
attatcatgttcctcatacagctga

SEQ ID NO: 64202 - DNA, 25 bp, S. pombe
attacttgttcactgagctcttgct

SEQ ID NO: 64203 - DNA, 25 bp, S. pombe
attacttttcaccatcattttggga

SEQ ID NO: 64204 - DNA, 25 bp, S. pombe
attaattttcctactgtctctgttg

SEQ ID NO: 64205 - DNA, 25 bp, S. pombe
attagatggtctcctttattctccg

SEQ ID NO: 64206 - DNA, 25 bp, S. pombe
attatgatgacgcttttgctgcccc

SEQ ID NO: 64207 - DNA, 25 bp, S. pombe
attagtctggtcatgcttgatcccc

SEQ ID NO: 64208 - DNA, 25 bp, S. pombe
attttatctcgtcccaatcaggtgg

SEQ ID NO: 64209 - DNA, 25 bp, S. pombe
attagtatctcacggccaacttgta

SEQ ID NO: 64210 - DNA, 25 bp, S. pombe
atttggacccttgcaaagcgttctt

SEQ ID NO: 64211 - DNA, 25 bp, S. pombe
atttatggccgcttcaaggttgctc

SEQ ID NO: 64212 - DNA, 25 bp, S. pombe
attaaggctccatcaagcctggctg

SEQ ID NO: 64213 - DNA, 25 bp, S. pombe
attaacgaagcttcactctgtgata

SEQ ID NO: 64214 - DNA, 25 bp, S. pombe
attaacgaactctatctctctgacg

SEQ ID NO: 64215 - DNA, 25 bp, S. pombe
attaaaactccttgatgctctgcct

SEQ ID NO: 64216 - DNA, 25 bp, S. pombe
attagaatccaccaaagcttcccat

SEQ ID NO: 64217 - DNA, 25 bp, S. pombe
attagaacccgcacgtggctctgat

SEQ ID NO: 64218 - DNA, 25 bp, S. pombe
atttaactgaccaacatggaatggt

SEQ ID NO: 64219 - DNA, 25 bp, S. pombe
atttcaactggcctacgaacttatg

SEQ ID NO: 64220 - DNA, 25 bp, S. pombe
atttcccttgatcctcgaagtttgc

SEQ ID NO: 64221 - DNA, 25 bp, S. pombe
attaccgtggtcttgtctattttat

SEQ ID NO: 64222 - DNA, 25 bp, S. pombe
attaggcgatcgtcttctttgttaa

SEQ ID NO: 64223 - DNA, 25 bp, S. pombe
attaactcatcttcttctcttttgc

SEQ ID NO: 64224 - DNA, 25 bp, S. pombe
attacatctgcattatttcctctcc

SEQ ID NO: 64225 - DNA, 25 bp, S. pombe
attatacgaaatcgtgcgcctcctt

SEQ ID NO: 64226 - DNA, 25 bp, S. pombe
atttgtcgaataccaccctgaatgt

SEQ ID NO: 64227 - DNA, 25 bp, S. pombe
attactctgaaaatgcccctatatg

SEQ ID NO: 64228 - DNA, 25 bp, S. pombe
attacaacttgcttaggcggccgta

SEQ ID NO: 64229 - DNA, 25 bp, S. pombe
atttatatgtggaaagggccctggt

SEQ ID NO: 64230 - DNA, 25 bp, S. pombe
attagcaaatgctcttggtccagga

SEQ ID NO: 64231 - DNA, 25 bp, S. pombe
attaaacagcgacttggatcccaaa

SEQ ID NO: 64232 - DNA, 25 bp, S. pombe
atataagcctaaagctgtcccttcc

SEQ ID NO: 64233 - DNA, 25 bp, S. pombe
attttgcctgaaactgctaatcgtg

SEQ ID NO: 64234 - DNA, 25 bp, S. pombe
attttcctcatgaagccgaattgcg

SEQ ID NO: 64235 - DNA, 25 bp, S. pombe
atatcttgcccatgtaccaattggt

SEQ ID NO: 64236 - DNA, 25 bp, S. pombe
attttggctggcaagaccatctctt

SEQ ID NO: 64237 - DNA, 25 bp, S. pombe
atttacctgaaaaccatcctcaacg

SEQ ID NO: 64238 - DNA, 25 bp, S. pombe
atttaccgcgtcttgaagcctaacg

SEQ ID NO: 64239 - DNA, 25 bp, S. pombe
atttttgcgttcatccaccataagg

SEQ ID NO: 64240 - DNA, 25 bp, S. pombe
attttgctggctattggaacttgga

SEQ ID NO: 64241 - DNA, 25 bp, S. pombe
atttcatcgtttctggaaccgctac

SEQ ID NO: 64242 - DNA, 25 bp, S. pombe
atatactgatacactccctacgaat

SEQ ID NO: 64243 - DNA, 25 bp, S. pombe
attatcctgtacctcttcgagctta

SEQ ID NO: 64244 - DNA, 25 bp, S. pombe
attagccgaagccaatgagaagtta

SEQ ID NO: 64245 - DNA, 25 bp, S. pombe
attatcgcgaagcatctgacaatga

SEQ ID NO: 64246 - DNA, 25 bp, S. pombe
attacgctaccattgatgagtctga

SEQ ID NO: 64247 - DNA, 25 bp, S. pombe
attatccaactgtcttcacctgata

SEQ ID NO: 64248 - DNA, 25 bp, S. pombe
attacaccctcaatgcttcaaatgc

SEQ ID NO: 64249 - DNA, 25 bp, S. pombe
attagcccaatcaatcattcttctg

SEQ ID NO: 64250 - DNA, 25 bp, S. pombe
attagatccaacttccacgttttca

SEQ ID NO: 64251 - DNA, 25 bp, S. pombe
attacgactatatcatcacgctcag

SEQ ID NO: 64252 - DNA, 25 bp, S. pombe
attattttgctcctctcacttattg

SEQ ID NO: 64253 - DNA, 25 bp, S. pombe
attactcatcccattccagatttga

SEQ ID NO: 64254 - DNA, 25 bp, S. pombe
attactgttggtctctgcaatctca

SEQ ID NO: 64255 - DNA, 25 bp, S. pombe
attagtgtatgatcttcggacgaag

SEQ ID NO: 64256 - DNA, 25 bp, S. pombe
attatgttgatgtttctcggacgaa

SEQ ID NO: 64257 - DNA, 25 bp, S. pombe
attactgtgcgtcagcattggctgc

SEQ ID NO: 64258 - DNA, 25 bp, S. pombe
attatcaccgtgtcagctctgatgt

SEQ ID NO: 64259 - DNA, 25 bp, S. pombe
atatttcatcagtatatgtattacc

SEQ ID NO: 64260 - DNA, 25 bp, S. pombe
atttttaactttcctctctgccatt

SEQ ID NO: 64261 - DNA, 25 bp, S. pombe
attatattcacctttgtcgctcttt

SEQ ID NO: 64262 - DNA, 25 bp, S. pombe
atttattactcggatgccatgcctt

SEQ ID NO: 64263 - DNA, 25 bp, S. pombe
atattgtaattgctgacctcggttg

SEQ ID NO: 64264 - DNA, 25 bp, S. pombe
attatcactctcacaacacaatggc

SEQ ID NO: 64265 - DNA, 25 bp, S. pombe
atttggtttccagtcacgcacaata

SEQ ID NO: 64266 - DNA, 25 bp, S. pombe
attatttcatgtccgtcatacgcga

SEQ ID NO: 64267 - DNA, 25 bp, S. pombe
attatttgcccaccattactcatat

SEQ ID NO: 64268 - DNA, 25 bp, S. pombe
attattctcaaacgccaatccgact

SEQ ID NO: 64269 - DNA, 25 bp, S. pombe
attttgcactaccaaatactgctga

SEQ ID NO: 64270 - DNA, 25 bp, S. pombe
atttaatgctcccacgtgtgcgagg

SEQ ID NO: 64271 - DNA, 25 bp, S. pombe
attattcgcggccttgttctggaag

SEQ ID NO: 64272 - DNA, 25 bp, S. pombe
attagttgcgtgtacgttccggatg

SEQ ID NO: 64273 - DNA, 25 bp, S. pombe
attacgatcgttttgcaccttactg

SEQ ID NO: 64274 - DNA, 25 bp, S. pombe
attacgtccaatctaccgatatcgc

SEQ ID NO: 64275 - DNA, 25 bp, S. pombe
acattattttatctaccgtctcccg

SEQ ID NO: 64276 - DNA, 25 bp, S. pombe
attatgggttttcattcttccgcca

SEQ ID NO: 64277 - DNA, 25 bp, S. pombe
attagcggtttctggttacctatca

SEQ ID NO: 64278 - DNA, 25 bp, S. pombe
attatcgctgttgccggctatgttc

SEQ ID NO: 64279 - DNA, 25 bp, S. pombe
attacccgatcaagagccgtggaat

SEQ ID NO: 64280 - DNA, 25 bp, S. pombe
atatcaacggttgcataccctggaa

SEQ ID NO: 64281 - DNA, 25 bp, S. pombe
atgcgaaaccagatcaaccatttgc

SEQ ID NO: 64282 - DNA, 25 bp, S. pombe
attagatacacgaccgatcctttct

SEQ ID NO: 64283 - DNA, 25 bp, S. pombe
atatagaccgggtgctactttgtcc

SEQ ID NO: 64284 - DNA, 25 bp, S. pombe
atataggccgtgtggctcctttaca

SEQ ID NO: 64285 - DNA, 25 bp, S. pombe
ataagctgacgtttatcgttttact

SEQ ID NO: 64286 - DNA, 25 bp, S. pombe
atagcggacagtattggacgtttta

SEQ ID NO: 64287 - DNA, 25 bp, S. pombe
ataccgatttttgctttggctttat

SEQ ID NO: 64288 - DNA, 25 bp, S. pombe
attatcttttttgtgttggcctctg

SEQ ID NO: 64289 - DNA, 25 bp, S. pombe
attacgctttatattgcttgccccg

SEQ ID NO: 64290 - DNA, 25 bp, S. pombe
atttgagtgctttgatgttcccgtg

SEQ ID NO: 64291 - DNA, 25 bp, S. pombe
attatggttctaagcttggcacggc

SEQ ID NO: 64292 - DNA, 25 bp, S. pombe
attatcgcagacgttctcgagtcag

SEQ ID NO: 64293 - DNA, 25 bp, S. pombe
attaccaaaggtcattgctctgctt

SEQ ID NO: 64294 - DNA, 25 bp, S. pombe
atttcattccctgttaacttataga

SEQ ID NO: 64295 - DNA, 25 bp, S. pombe
atttttctcgaaacagctggcccca

SEQ ID NO: 64296 - DNA, 25 bp, S. pombe
atttttgtcgattcccagtgtagct

SEQ ID NO: 64297 - DNA, 25 bp, S. pombe
attttcatttatggccctgtggagc

SEQ ID NO: 64298 - DNA, 25 bp, S. pombe
attttaagtcattgcgttgtctacg

SEQ ID NO: 64299 - DNA, 25 bp, S. pombe
atttctccgtacagttgtcttcgta

SEQ ID NO: 64300 - DNA, 25 bp, S. pombe
atttgatcctttgagttctttccag

SEQ ID NO: 64301 - DNA, 25 bp, S. pombe
attattgtattaacacctcccctga

SEQ ID NO: 64302 - DNA, 25 bp, S. pombe
atttttggatgaactcccagctcct

SEQ ID NO: 64303 - DNA, 25 bp, S. pombe
atttttgagagtcaccccgacaact

SEQ ID NO: 64304 - DNA, 25 bp, S. pombe
atttttcattaccaccgttgtcact

SEQ ID NO: 64305 - DNA, 25 bp, S. pombe
atttcactgttctcctagtattcct

SEQ ID NO: 64306 - DNA, 25 bp, S. pombe
atttacttaggtcctcaggtgtcca

SEQ ID NO: 64307 - DNA, 25 bp, S. pombe
attaggctcgtttccaatttgtcaa

SEQ ID NO: 64308 - DNA, 25 bp, S. pombe
attagcctctatgtctgttttgtct

SEQ ID NO: 64309 - DNA, 25 bp, S. pombe
attatgatcgctcgttctggttttc

SEQ ID NO: 64310 - DNA, 25 bp, S. pombe
attacccgctctgatgttttacact

SEQ ID NO: 64311 - DNA, 25 bp, S. pombe
attacgcctttggtctttatagagc

SEQ ID NO: 64312 - DNA, 25 bp, S. pombe
attagtgcctgcttaactgttttgg

SEQ ID NO: 64313 - DNA, 25 bp, S. pombe
atttggacctgtaccttttgcatag

SEQ ID NO: 64314 - DNA, 25 bp, S. pombe
attatctaactgatccttccgttgg

SEQ ID NO: 64315 - DNA, 25 bp, S. pombe
attattgcatactctcctttctgtc

SEQ ID NO: 64316 - DNA, 25 bp, S. pombe
attttaccctaactgatcccaagag

SEQ ID NO: 64317 - DNA, 25 bp, S. pombe
attttttctttgatacgactgtacg

SEQ ID NO: 64318 - DNA, 25 bp, S. pombe
atttgttttgacagagtccctctat

SEQ ID NO: 64319 - DNA, 25 bp, S. pombe
attagtttgggcagagcttcctatg

SEQ ID NO: 64320 - DNA, 25 bp, S. pombe
attagatttcgatgcgtccatgcta

SEQ ID NO: 64321 - DNA, 25 bp, S. pombe
attagtgtttgcagtctcgcgtgat

SEQ ID NO: 64322 - DNA, 25 bp, S. pombe
attattgatcctgtgactcgtgctc

SEQ ID NO: 64323 - DNA, 25 bp, S. pombe
atttttccggtggtcagatccaacg

SEQ ID NO: 64324 - DNA, 25 bp, S. pombe
attatttccctgttgatgagcttga

SEQ ID NO: 64325 - DNA, 25 bp, S. pombe
attattcccagaactttggccgtca

SEQ ID NO: 64326 - DNA, 25 bp, S. pombe
attaccagccgtactttgctacgta

SEQ ID NO: 64327 - DNA, 25 bp, S. pombe
attattcgccgtttatcttacagga

SEQ ID NO: 64328 - DNA, 25 bp, S. pombe
atttgtcccaggtgacagtacggat

SEQ ID NO: 64329 - DNA, 25 bp, S. pombe
attatcggctgtacaacaacctatt

SEQ ID NO: 64330 - DNA, 25 bp, S. pombe
atttctgatgctgacaaaagtgcta

SEQ ID NO: 64331 - DNA, 25 bp, S. pombe
attagtgatctgcaccagggctata

SEQ ID NO: 64332 - DNA, 25 bp, S. pombe
attagttctccagggcttgtgataa

SEQ ID NO: 64333 - DNA, 25 bp, S. pombe
atttggtccctcgaaattcaagagc

SEQ ID NO: 64334 - DNA, 25 bp, S. pombe
attttgaccaacacactatctcttc

SEQ ID NO: 64335 - DNA, 25 bp, S. pombe
attttcaccacctcgtaatgcaatg

SEQ ID NO: 64336 - DNA, 25 bp, S. pombe
attagctgggctgacgatgagtatt

SEQ ID NO: 64337 - DNA, 25 bp, S. pombe
atttttcttgagctcacggcaacga

SEQ ID NO: 64338 - DNA, 25 bp, S. pombe
atttcctggaggtatacggcaccga

SEQ ID NO: 64339 - DNA, 25 bp, S. pombe
atttccctcaggtatacgagcctac

SEQ ID NO: 64340 - DNA, 25 bp, S. pombe
atttccaatggttcagggattcgaa

SEQ ID NO: 64341 - DNA, 25 bp, S. pombe
attagtcgtattgctgttccatcca

SEQ ID NO: 64342 - DNA, 25 bp, S. pombe
attatggctattggccgtatctctc

SEQ ID NO: 64343 - DNA, 25 bp, S. pombe
attattgctgctacgccgctgaact

SEQ ID NO: 64344 - DNA, 25 bp, S. pombe
attttgctctggctctgatgatggt

SEQ ID NO: 64345 - DNA, 25 bp, S. pombe
atttggccggttatcatgtgtccta

SEQ ID NO: 64346 - DNA, 25 bp, S. pombe
atttccacggctttgtatttataca

SEQ ID NO: 64347 - DNA, 25 bp, S. pombe
attatcgcaaactcgcttttcaacg

SEQ ID NO: 64348 - DNA, 25 bp, S. pombe
attatccttcttactggcattccga

SEQ ID NO: 64349 - DNA, 25 bp, S. pombe
attatctttagacttggcgcccgaa

SEQ ID NO: 64350 - DNA, 25 bp, S. pombe
attattttgcaacagcctcgcacga

SEQ ID NO: 64351 - DNA, 25 bp, S. pombe
attatgcttatctacgtcttcgtcg

SEQ ID NO: 64352 - DNA, 25 bp, S. pombe
atttctaggcttatcgctgcaactg

SEQ ID NO: 64353 - DNA, 25 bp, S. pombe
attttagcgttaagcgatcattgca

SEQ ID NO: 64354 - DNA, 25 bp, S. pombe
attttgtcatgcacgatgcgactac

SEQ ID NO: 64355 - DNA, 25 bp, S. pombe
attttgattgcaacagctcccattc

SEQ ID NO: 64356 - DNA, 25 bp, S. pombe
attatacccattttacttctccgat

SEQ ID NO: 64357 - DNA, 25 bp, S. pombe
attatccaactatctgattccctta

SEQ ID NO: 64358 - DNA, 25 bp, S. pombe
atttgcttagcagacgttcccttaa

SEQ ID NO: 64359 - DNA, 25 bp, S. pombe
atttgactacgtggtgtcccaagtt

SEQ ID NO: 64360 - DNA, 25 bp, S. pombe
attatgcatcaagaggttcccaact

SEQ ID NO: 64361 - DNA, 25 bp, S. pombe
atttctcaatcgctacatccaaacg

SEQ ID NO: 64362 - DNA, 25 bp, S. pombe
atttactagcgactccaattccaaa

SEQ ID NO: 64363 - DNA, 25 bp, S. pombe
atttttctttgtaccatctacgcca

SEQ ID NO: 64364 - DNA, 25 bp, S. pombe
atttattattctttggccttggcca

SEQ ID NO: 64365 - DNA, 25 bp, S. pombe
atttattgtttcaggctcttcggac

SEQ ID NO: 64366 - DNA, 25 bp, S. pombe
atttatcgtattcgtgttcgccgtg

SEQ ID NO: 64367 - DNA, 25 bp, S. pombe
atttatctgagcatgcctattccca

SEQ ID NO: 64368 - DNA, 25 bp, S. pombe
atttttaatgcatctattccgcgaa

SEQ ID NO: 64369 - DNA, 25 bp, S. pombe
atttatttcgttctttgccatcacc

SEQ ID NO: 64370 - DNA, 25 bp, S. pombe
attttctttgcagagtttgcggtac

SEQ ID NO: 64371 - DNA, 25 bp, S. pombe
atttcattctgttgcttgttatcgg

SEQ ID NO: 64372 - DNA, 25 bp, S. pombe
attatcaccctgcttttgatcggac

SEQ ID NO: 64373 - DNA, 25 bp, S. pombe
atttagctgggttttgtccgctagg

SEQ ID NO: 64374 - DNA, 25 bp, S. pombe
atttcagcgggcatttcgacttatg

SEQ ID NO: 64375 - DNA, 25 bp, S. pombe
attttcgagtactatgccgagcgta

SEQ ID NO: 64376 - DNA, 25 bp, S. pombe
attttgtttgtgttgatcctgctct

SEQ ID NO: 64377 - DNA, 25 bp, S. pombe
attttctagtcgtctttgtcagctt

SEQ ID NO: 64378 - DNA, 25 bp, S. pombe
atttgccgacggtttcatgatccac

SEQ ID NO: 64379 - DNA, 25 bp, S. pombe
atttaatgacggttgctccagccat

SEQ ID NO: 64380 - DNA, 25 bp, S. pombe
atttaaccgacatgctgcgagccat

SEQ ID NO: 64381 - DNA, 25 bp, S. pombe
attttacgggctttgtgttctggct

SEQ ID NO: 64382 - DNA, 25 bp, S. pombe
atttatccactctcttggttgggct

SEQ ID NO: 64383 - DNA, 25 bp, S. pombe
attatggcaggtattttcgcggatg

SEQ ID NO: 64384 - DNA, 25 bp, S. pombe
attaggagtacttcttgggcacgcc

SEQ ID NO: 64385 - DNA, 25 bp, S. pombe
attagtgcagtactctcttttaacc

SEQ ID NO: 64386 - DNA, 25 bp, S. pombe
attattgcaccgtcttttgctgaca

SEQ ID NO: 64387 - DNA, 25 bp, S. pombe
attatctcccgcgtttgtcaatcaa

SEQ ID NO: 64388 - DNA, 25 bp, S. pombe
atttctcttccattcggtaatcatt

SEQ ID NO: 64389 - DNA, 25 bp, S. pombe
attttcttccctccgacatatgaga

SEQ ID NO: 64390 - DNA, 25 bp, S. pombe
atttttatcgcgctatggcttgaag

SEQ ID NO: 64391 - DNA, 25 bp, S. pombe
attttggtctggtattcgccgaatg

SEQ ID NO: 64392 - DNA, 25 bp, S. pombe
attttgctttgtacttcagccgtga

SEQ ID NO: 64393 - DNA, 25 bp, S. pombe
attatccatgaggtccaatcgttcg

SEQ ID NO: 64394 - DNA, 25 bp, S. pombe
atttttggttgctcatcatgatgac

SEQ ID NO: 64395 - DNA, 25 bp, S. pombe
attttgtcagttgtcatcttgcgga

SEQ ID NO: 64396 - DNA, 25 bp, S. pombe
attatctgccattccacgcgagaag

SEQ ID NO: 64397 - DNA, 25 bp, S. pombe
attatgctcattgcaagcgcaacgg

SEQ ID NO: 64398 - DNA, 25 bp, S. pombe
atttgctcaatctaacccacgtaag

SEQ ID NO: 64399 - DNA, 25 bp, S. pombe
atttccacacgaactggcatctttg

SEQ ID NO: 64400 - DNA, 25 bp, S. pombe
attttgcttgcaacggtaccattgt

SEQ ID NO: 64401 - DNA, 25 bp, S. pombe
attatttcagcacttggtctctcac

SEQ ID NO: 64402 - DNA, 25 bp, S. pombe
attttacatggttgcagttgctcgc

SEQ ID NO: 64403 - DNA, 25 bp, S. pombe
atttatgaaggttgccctcatcctg

SEQ ID NO: 64404 - DNA, 25 bp, S. pombe
atttcaccatttcaggctcaagcgt

SEQ ID NO: 64405 - DNA, 25 bp, S. pombe
attttggcatgatcgcaggcggaac

SEQ ID NO: 64406 - DNA, 25 bp, S. pombe
atttctggcgaagcagtgcccataa

SEQ ID NO: 64407 - DNA, 25 bp, S. pombe
atttggaccctttggtcggtgcgca

SEQ ID NO: 64408 - DNA, 25 bp, S. pombe
attttagctgagttgaatcggtcca

SEQ ID NO: 64409 - DNA, 25 bp, S. pombe
attttcggcttattcctccagtcat

SEQ ID NO: 64410 - DNA, 25 bp, S. pombe
atttatcagtcttttacccgtctgg

SEQ ID NO: 64411 - DNA, 25 bp, S. pombe
atttgaacgcatccttacacctttg

SEQ ID NO: 64412 - DNA, 25 bp, S. pombe
atttggaccttaatagccgctttgt

SEQ ID NO: 64413 - DNA, 25 bp, S. pombe
atttggtaccttatcctcgtattca

SEQ ID NO: 64414 - DNA, 25 bp, S. pombe
attatggtacaatcattccctggaa

SEQ ID NO: 64415 - DNA, 25 bp, S. pombe
attatgctgaacgtgctgttcccga

SEQ ID NO: 64416 - DNA, 25 bp, S. pombe
attatcgagcacttcattgctgccc

SEQ ID NO: 64417 - DNA, 25 bp, S. pombe
attttccaatcaggtgttgcgacac

SEQ ID NO: 64418 - DNA, 25 bp, S. pombe
attttcaatcccctgttgcaaactt

SEQ ID NO: 64419 - DNA, 25 bp, S. pombe
attttaatgcctgcgtcttttgcga

SEQ ID NO: 64420 - DNA, 25 bp, S. pombe
attttttggccaacgtatttgctga

SEQ ID NO: 64421 - DNA, 25 bp, S. pombe
atttcttatcctttgactttccaca

SEQ ID NO: 64422 - DNA, 25 bp, S. pombe
atttattatgccatttcttccccgg

SEQ ID NO: 64423 - DNA, 25 bp, S. pombe
attttatttttctgatccctctcct

SEQ ID NO: 64424 - DNA, 25 bp, S. pombe
attttgctgatctcatcaaccgtgc

SEQ ID NO: 64425 - DNA, 25 bp, S. pombe
attattatcatcattccgaaccaga

SEQ ID NO: 64426 - DNA, 25 bp, S. pombe
attatattatcactggccctccgga

SEQ ID NO: 64427 - DNA, 25 bp, S. pombe
atttcattacagatatcgtggcgga

SEQ ID NO: 64428 - DNA, 25 bp, S. pombe
atttcaaaatcctacacgcactatc

SEQ ID NO: 64429 - DNA, 25 bp, S. pombe
atttgaacgtactccggaacagcag

SEQ ID NO: 64430 - DNA, 25 bp, S. pombe
atttcaacgttctttcgaagccctg

SEQ ID NO: 64431 - DNA, 25 bp, S. pombe
atttcgactgttcttagcggcgtat

SEQ ID NO: 64432 - DNA, 25 bp, S. pombe
atttctcctcctctgaaagtggttc

SEQ ID NO: 64433 - DNA, 25 bp, S. pombe
atttacgctcaatttcaacgctcga

SEQ ID NO: 64434 - DNA, 25 bp, S. pombe
attatacagtcaatgtcgcacccct

SEQ ID NO: 64435 - DNA, 25 bp, S. pombe
attttcttgatttcagcggcacttt

SEQ ID NO: 64436 - DNA, 25 bp, S. pombe
atttacaagaccttggcgtccgcta

SEQ ID NO: 64437 - DNA, 25 bp, S. pombe
atttagataatccaggtgccaccgt

SEQ ID NO: 64438 - DNA, 25 bp, S. pombe
atttaaataccgctgccaggttggt

SEQ ID NO: 64439 - DNA, 25 bp, S. pombe
atatcaaagtctgccgtcctcgcat

SEQ ID NO: 64440 - DNA, 25 bp, S. pombe
attatatcagtttccgtcaccacat

SEQ ID NO: 64441 - DNA, 25 bp, S. pombe
attatttctcaaagtgccgcacatt

SEQ ID NO: 64442 - DNA, 25 bp, S. pombe
atttcattgtgatagctgtggtacc

SEQ ID NO: 64443 - DNA, 25 bp, S. pombe
atttattctgctgttcggaaccatg

SEQ ID NO: 64444 - DNA, 25 bp, S. pombe
attttgtctgctgattgcgctgaaa

SEQ ID NO: 64445 - DNA, 25 bp, S. pombe
attttgctgtacttgatcacgttta

SEQ ID NO: 64446 - DNA, 25 bp, S. pombe
atttttctgaccttgctgcttctaa

SEQ ID NO: 64447 - DNA, 25 bp, S. pombe
attattcgctttttgtgccttacaa

SEQ ID NO: 64448 - DNA, 25 bp, S. pombe
attttacttctacttgcgcatttga

SEQ ID NO: 64449 - DNA, 25 bp, S. pombe
attttgccagctgatgtcggttgta

SEQ ID NO: 64450 - DNA, 25 bp, S. pombe
attattctaccccaagtgcaggtta

SEQ ID NO: 64451 - DNA, 25 bp, S. pombe
atatgatccttacccaattccgtga

SEQ ID NO: 64452 - DNA, 25 bp, S. pombe
ataagccttaagcaaacatccggta

SEQ ID NO: 64453 - DNA, 25 bp, S. pombe
atattccgtaagctaactcctggcg

SEQ ID NO: 64454 - DNA, 25 bp, S. pombe
attttcagtcatacgtacagcttcg

SEQ ID NO: 64455 - DNA, 25 bp, S. pombe
atttctattgggttgctgtcttacg

SEQ ID NO: 64456 - DNA, 25 bp, S. pombe
atttatttgttctctgctttcctgg

SEQ ID NO: 64457 - DNA, 25 bp, S. pombe
atttgatttcttcacttgttgccgg

SEQ ID NO: 64458 - DNA, 25 bp, S. pombe
attttacgcttgtactctgttccac

SEQ ID NO: 64459 - DNA, 25 bp, S. pombe
atttgctctacgacgtcaacgttgg

SEQ ID NO: 64460 - DNA, 25 bp, S. pombe
atttgttgagcgagtaccgttgaaa

SEQ ID NO: 64461 - DNA, 25 bp, S. pombe
atttgttggccagcaaacgcttgaa

SEQ ID NO: 64462 - DNA, 25 bp, S. pombe
atttgggttcttgcaagcgcttgag

SEQ ID NO: 64463 - DNA, 25 bp, S. pombe
attattggatccttgcttgctactg

SEQ ID NO: 64464 - DNA, 25 bp, S. pombe
atttatggcattttcttgtactcaa

SEQ ID NO: 64465 - DNA, 25 bp, S. pombe
atttaggtcgtgatcaatctcgtga

SEQ ID NO: 64466 - DNA, 25 bp, S. pombe
atttttgacattgctcctggaggta

SEQ ID NO: 64467 - DNA, 25 bp, S. pombe
atttatcgagtcaatggccccttta

SEQ ID NO: 64468 - DNA, 25 bp, S. pombe
attttcaagccggaactccatctta

SEQ ID NO: 64469 - DNA, 25 bp, S. pombe
atttgtcgaccggtagtgccttgtt

SEQ ID NO: 64470 - DNA, 25 bp, S. pombe
atttttcaagatcccagagcctttg

SEQ ID NO: 64471 - DNA, 25 bp, S. pombe
atattttcaagtatgcggcaattaa

SEQ ID NO: 64472 - DNA, 25 bp, S. pombe
attttccaagtttctgcggcctata

SEQ ID NO: 64473 - DNA, 25 bp, S. pombe
atttctggtggtgtttatcctgtca

SEQ ID NO: 64474 - DNA, 25 bp, S. pombe
atttgacgaccgacaacaacgcctt

SEQ ID NO: 64475 - DNA, 25 bp, S. pombe
attttaatcactcgcgaacgcattc

SEQ ID NO: 64476 - DNA, 25 bp, S. pombe
attttctacatctacgcaacggtcg

SEQ ID NO: 64477 - DNA, 25 bp, S. pombe
atatttctcaaatcgttcgttcagt

SEQ ID NO: 64478 - DNA, 25 bp, S. pombe
attttgaaagcactcggtatcggat

SEQ ID NO: 64479 - DNA, 25 bp, S. pombe
attttacaatactagcggcgctgac

SEQ ID NO: 64480 - DNA, 25 bp, S. pombe
atttgaaaagattagggcctcggct

SEQ ID NO: 64481 - DNA, 25 bp, S. pombe
atttaaatcgattcagcggccacgg

SEQ ID NO: 64482 - DNA, 25 bp, S. pombe
attttaatgcagactcatcctcacc

SEQ ID NO: 64483 - DNA, 25 bp, S. pombe
atttcacacagccttggaatccgtt

SEQ ID NO: 64484 - DNA, 25 bp, S. pombe
atttcccaggtataatcgcattcga

SEQ ID NO: 64485 - DNA, 25 bp, S. pombe
atttcctgctgatgtacttcgacgg

SEQ ID NO: 64486 - DNA, 25 bp, S. pombe
attttcttcaagaccagctcatcca

SEQ ID NO: 64487 - DNA, 25 bp, S. pombe
attttcactgacctatctctcaaaa

SEQ ID NO: 64488 - DNA, 25 bp, S. pombe
attttaagcgcttgcattcccaaag

SEQ ID NO: 64489 - DNA, 25 bp, S. pombe
attttgaatggccagcttcgcgata

SEQ ID NO: 64490 - DNA, 25 bp, S. pombe
atttatgagctgtgtcgcattgcgt

SEQ ID NO: 64491 - DNA, 25 bp, S. pombe
atttcaggcgttatgctacacagca

SEQ ID NO: 64492 - DNA, 25 bp, S. pombe
atttggtgtagacgccgatcaggct

SEQ ID NO: 64493 - DNA, 25 bp, S. pombe
atttctatttatcccgatcccaaga

SEQ ID NO: 64494 - DNA, 25 bp, S. pombe
atttctatttatcccctgaaccata

SEQ ID NO: 64495 - DNA, 25 bp, S. pombe
attttcattcgcgatgtcatgtcag

SEQ ID NO: 64496 - DNA, 25 bp, S. pombe
atctttcagagggtgcgcatggcga

SEQ ID NO: 64497 - DNA, 25 bp, S. pombe
atttcctgggcttatgtggataatt

SEQ ID NO: 64498 - DNA, 25 bp, S. pombe
atttcggagcgcaacatggagtata

SEQ ID NO: 64499 - DNA, 25 bp, S. pombe
atttcattccctgagctcgttatac

SEQ ID NO: 64500 - DNA, 25 bp, S. pombe
atttattcccttttcagctagacgc

SEQ ID NO: 64501 - DNA, 25 bp, S. pombe
atttcaacacgtacaatcgctagag

SEQ ID NO: 64502 - DNA, 25 bp, S. pombe
atttaactcgctatgtcgctggtgt

SEQ ID NO: 64503 - DNA, 25 bp, S. pombe
atttgtcgtgtttaccgtctgggca

SEQ ID NO: 64504 - DNA, 25 bp, S. pombe
atttcctgatatacgggcaacactg

SEQ ID NO: 64505 - DNA, 25 bp, S. pombe
atattcctgttgttggcggtcattc

SEQ ID NO: 64506 - DNA, 25 bp, S. pombe
atttccttggtcgtgcagaatctca

SEQ ID NO: 64507 - DNA, 25 bp, S. pombe
atttgccttggtgtatcgacgatgc

SEQ ID NO: 64508 - DNA, 25 bp, S. pombe
atttcttacttttcgacatgccaac

SEQ ID NO: 64509 - DNA, 25 bp, S. pombe
atttcagatggcgttttggctcaag

SEQ ID NO: 64510 - DNA, 25 bp, S. pombe
atttttggcttcgttgctgtcatac

SEQ ID NO: 64511 - DNA, 25 bp, S. pombe
atttatgtgagaatgcggtgcgcct

SEQ ID NO: 64512 - DNA, 25 bp, S. pombe
atttagtgcaatccagctgcggcag

SEQ ID NO: 64513 - DNA, 25 bp, S. pombe
atataggtcctccattgcacagcgt

SEQ ID NO: 64514 - DNA, 25 bp, S. pombe
atatggtcggtctgataagcgtaca

SEQ ID NO: 64515 - DNA, 25 bp, S. pombe
attttcacatttactctatccatcc

SEQ ID NO: 64516 - DNA, 25 bp, S. pombe
attttctcttaactgctctcacact

SEQ ID NO: 64517 - DNA, 25 bp, S. pombe
attttcgctctaggtgattgcactc

SEQ ID NO: 64518 - DNA, 25 bp, S. pombe
atttcccgtgctgcttcagaagcta

SEQ ID NO: 64519 - DNA, 25 bp, S. pombe
attttttctgctccactcaacaata

SEQ ID NO: 64520 - DNA, 25 bp, S. pombe
atttcattttcaaattgttgcaaca

SEQ ID NO: 64521 - DNA, 25 bp, S. pombe
atttccttcaacaaatgccaggcat

SEQ ID NO: 64522 - DNA, 25 bp, S. pombe
atttactttgcaccatcgccaggat

SEQ ID NO: 64523 - DNA, 25 bp, S. pombe
atttatgtttcaggcctctccgtta

SEQ ID NO: 64524 - DNA, 25 bp, S. pombe
atttctggttccttgacacttgtaa

SEQ ID NO: 64525 - DNA, 25 bp, S. pombe
atttgctgctttcacggacttatac

SEQ ID NO: 64526 - DNA, 25 bp, S. pombe
atttgctttcatcacgagacggaga

SEQ ID NO: 64527 - DNA, 25 bp, S. pombe
atttctgactacattcgccgagcgt

SEQ ID NO: 64528 - DNA, 25 bp, S. pombe
atttatggcattccttcatctcgag

SEQ ID NO: 64529 - DNA, 25 bp, S. pombe
atttatggatgacacttctcgttct

SEQ ID NO: 64530 - DNA, 25 bp, S. pombe
atttcgaggactcctgttcgtcata

SEQ ID NO: 64531 - DNA, 25 bp, S. pombe
atttgctgacaatcctatacgagta

SEQ ID NO: 64532 - DNA, 25 bp, S. pombe
atttcttcaaaactaatcgcgtcga

SEQ ID NO: 64533 - DNA, 25 bp, S. pombe
atttctacgaaatttgtcctcctga

SEQ ID NO: 64534 - DNA, 25 bp, S. pombe
atttaggtgctgtcggctttatcca

SEQ ID NO: 64535 - DNA, 25 bp, S. pombe
atttagctggtgtgtctgcattcat

SEQ ID NO: 64536 - DNA, 25 bp, S. pombe
atttgcgtacggtgttttggactct

SEQ ID NO: 64537 - DNA, 25 bp, S. pombe
atgggaaccgatcagcccttggaaa

SEQ ID NO: 64538 - DNA, 25 bp, S. pombe
ataggaccccaacatcaggctggaa

SEQ ID NO: 64539 - DNA, 25 bp, S. pombe
atatcgcccagtcgtaccaaaggat

SEQ ID NO: 64540 - DNA, 25 bp, S. pombe
atatggccttgtctacccaagttaa

SEQ ID NO: 64541 - DNA, 25 bp, S. pombe
atattacacagtcaacccaatggct

SEQ ID NO: 64542 - DNA, 25 bp, S. pombe
atttactttagatcaggtgccgaca

SEQ ID NO: 64543 - DNA, 25 bp, S. pombe
atttacgctgctggtgattgccgcc

SEQ ID NO: 64544 - DNA, 25 bp, S. pombe
atttggtgcatctggattgcccgac

SEQ ID NO: 64545 - DNA, 25 bp, S. pombe
atttattacagccatctcagccatc

SEQ ID NO: 64546 - DNA, 25 bp, S. pombe
atttatgctagcttacacgaccagg

SEQ ID NO: 64547 - DNA, 25 bp, S. pombe
atttagcgacaaatccggcgtcaga

SEQ ID NO: 64548 - DNA, 25 bp, S. pombe
atttatgctataacactactccctc

SEQ ID NO: 64549 - DNA, 25 bp, S. pombe
atttagtgctgatctcgaacgtctc

SEQ ID NO: 64550 - DNA, 25 bp, S. pombe
atttactggtactggcactggctca

SEQ ID NO: 64551 - DNA, 25 bp, S. pombe
atttactattgtcagctttgcgcgc

SEQ ID NO: 64552 - DNA, 25 bp, S. pombe
atttatctttgctgccattgtcggc

SEQ ID NO: 64553 - DNA, 25 bp, S. pombe
atttatcaatccttgcttcttctgc

SEQ ID NO: 64554 - DNA, 25 bp, S. pombe
attttagcatgcaattcctcttctg

SEQ ID NO: 64555 - DNA, 25 bp, S. pombe
attttaccgctcaatgtccttacaa

SEQ ID NO: 64556 - DNA, 25 bp, S. pombe
atttcttccgtgaatgtcgttcctg

SEQ ID NO: 64557 - DNA, 25 bp, S. pombe
atttcttgcccattgtcacttttga

SEQ ID NO: 64558 - DNA, 25 bp, S. pombe
atttatttggcgcatctaatcctcc

SEQ ID NO: 64559 - DNA, 25 bp, S. pombe
atttttggcatatgatcgctctcct

SEQ ID NO: 64560 - DNA, 25 bp, S. pombe
atttttcgtaaatcgctcagctaag

SEQ ID NO: 64561 - DNA, 25 bp, S. pombe
atttgggctctttagaggtcggcaa

SEQ ID NO: 64562 - DNA, 25 bp, S. pombe
atttactacttttgagcttcgtggt

SEQ ID NO: 64563 - DNA, 25 bp, S. pombe
atttcgcacattcttcctttttgta

SEQ ID NO: 64564 - DNA, 25 bp, S. pombe
atttcgccattaccacaattttcgt

SEQ ID NO: 64565 - DNA, 25 bp, S. pombe
atttcgcctgttccctttattaatg

SEQ ID NO: 64566 - DNA, 25 bp, S. pombe
atttattcacacactttcatcgctc

SEQ ID NO: 64567 - DNA, 25 bp, S. pombe
atagtttccagtcttcggtcacaaa

SEQ ID NO: 64568 - DNA, 25 bp, S. pombe
atttctatacgttctattccaccag

SEQ ID NO: 64569 - DNA, 25 bp, S. pombe
atttctctaggctttattactccat

SEQ ID NO: 64570 - DNA, 25 bp, S. pombe
atttcttttggttattggcctgcat

SEQ ID NO: 64571 - DNA, 25 bp, S. pombe
atttttgctctggtacatttgcacc

SEQ ID NO: 64572 - DNA, 25 bp, S. pombe
atttttgctatccaacgctgtgatc

SEQ ID NO: 64573 - DNA, 25 bp, S. pombe
atttcgttccaagtgctgtggctgt

SEQ ID NO: 64574 - DNA, 25 bp, S. pombe
atttcttctgccgtcaaggatgaga

SEQ ID NO: 64575 - DNA, 25 bp, S. pombe
atttcctccgctgtcaaggatgaga

SEQ ID NO: 64576 - DNA, 25 bp, S. pombe
atttggctgccgttccagaggaaag

SEQ ID NO: 64577 - DNA, 25 bp, S. pombe
atttcttctccttcaatacctatgt

SEQ ID NO: 64578 - DNA, 25 bp, S. pombe
atttgttagcacttaccagaccatt

SEQ ID NO: 64579 - DNA, 25 bp, S. pombe
atttgttgtcttttgcaggccagtt

SEQ ID NO: 64580 - DNA, 25 bp, S. pombe
atttcgtttgtttcgagcgcagttg

SEQ ID NO: 64581 - DNA, 25 bp, S. pombe
atttcttctttatcgatggcttcag

SEQ ID NO: 64582 - DNA, 25 bp, S. pombe
atttgcttgagcgaaaggcctttca

SEQ ID NO: 64583 - DNA, 25 bp, S. pombe
atttcactagcgttagatcctccac

SEQ ID NO: 64584 - DNA, 25 bp, S. pombe
atttagcgctcatgaagattcttcc

SEQ ID NO: 64585 - DNA, 25 bp, S. pombe
atttacagtccctatgcatttttga

SEQ ID NO: 64586 - DNA, 25 bp, S. pombe
atttacgtactcatccttctgtgaa

SEQ ID NO: 64587 - DNA, 25 bp, S. pombe
atttatcggaccacactacatctaa

SEQ ID NO: 64588 - DNA, 25 bp, S. pombe
atttgatctggctcttcgtactcga

SEQ ID NO: 64589 - DNA, 25 bp, S. pombe
atttgacgccatattgaaacgactg

SEQ ID NO: 64590 - DNA, 25 bp, S. pombe
atttgaacgtgcaacaagagcaact

SEQ ID NO: 64591 - DNA, 25 bp, S. pombe
atttcaccttgctgtacaggctcaa

SEQ ID NO: 64592 - DNA, 25 bp, S. pombe
atatctacgtggttttcagttcaag

SEQ ID NO: 64593 - DNA, 25 bp, S. pombe
atttaccactggagagcatctgcta

SEQ ID NO: 64594 - DNA, 25 bp, S. pombe
atttcattcactcgattggacgccc

SEQ ID NO: 64595 - DNA, 25 bp, S. pombe
atttctactcatctaggttgtccaa

SEQ ID NO: 64596 - DNA, 25 bp, S. pombe
atttgcgtgagtacttacacctccc

SEQ ID NO: 64597 - DNA, 25 bp, S. pombe
atcgtcgtttagctgatcacttctc

SEQ ID NO: 64598 - DNA, 25 bp, S. pombe
atttcttcttctttatatggtgcca

SEQ ID NO: 64599 - DNA, 25 bp, S. pombe
atattactacggctgagtttcggaa

SEQ ID NO: 64600 - DNA, 25 bp, S. pombe
atatcagtttcgtcgtggttctctc

SEQ ID NO: 64601 - DNA, 25 bp, S. pombe
atttatttggacctggttccatccg

SEQ ID NO: 64602 - DNA, 25 bp, S. pombe
atttatttcgagctgcgtctgcaat

SEQ ID NO: 64603 - DNA, 25 bp, S. pombe
atttagtacaaggtgcaggctcaat

SEQ ID NO: 64604 - DNA, 25 bp, S. pombe
atttcagcggcaatggagagtgtca

SEQ ID NO: 64605 - DNA, 25 bp, S. pombe
atttcatcgatgcttgcgcgttcat

SEQ ID NO: 64606 - DNA, 25 bp, S. pombe
atttaagcactgatatgtccctcgc

SEQ ID NO: 64607 - DNA, 25 bp, S. pombe
atttgcttcacgaaggatccctcta

SEQ ID NO: 64608 - DNA, 25 bp, S. pombe
atttctcaaccaaggatccatccgc

SEQ ID NO: 64609 - DNA, 25 bp, S. pombe
atatttcaccaacgtatccaggact

SEQ ID NO: 64610 - DNA, 25 bp, S. pombe
atatgctaacctgccttggatactt

SEQ ID NO: 64611 - DNA, 25 bp, S. pombe
atttggaaccatcgctttgaatcag

SEQ ID NO: 64612 - DNA, 25 bp, S. pombe
atttggacgccatttcatttcattg

SEQ ID NO: 64613 - DNA, 25 bp, S. pombe
atttctgagcccaagcctcttaagg

SEQ ID NO: 64614 - DNA, 25 bp, S. pombe
atttctacgacttggctcctaagga

SEQ ID NO: 64615 - DNA, 25 bp, S. pombe
atattcctcagcagtttcagtgcga

SEQ ID NO: 64616 - DNA, 25 bp, S. pombe
atttcccagcatatgttatatcgga

SEQ ID NO: 64617 - DNA, 25 bp, S. pombe
atttccgcttcaagggattcgccag

SEQ ID NO: 64618 - DNA, 25 bp, S. pombe
atttcacctctcagggacttcaaat

SEQ ID NO: 64619 - DNA, 25 bp, S. pombe
atataccttatgatccttttcgaaa

SEQ ID NO: 64620 - DNA, 25 bp, S. pombe
atatttcattatcttctttccccaa

SEQ ID NO: 64621 - DNA, 25 bp, S. pombe
atttaatctctcctttttgcaacca

SEQ ID NO: 64622 - DNA, 25 bp, S. pombe
atttcgttgtagctcacttccatta

SEQ ID NO: 64623 - DNA, 25 bp, S. pombe
atttccatttggctatcttcgctac

SEQ ID NO: 64624 - DNA, 25 bp, S. pombe
atttctcatcttccttatggtccta

SEQ ID NO: 64625 - DNA, 25 bp, S. pombe
atttctcgaattatctccgctgttg

SEQ ID NO: 64626 - DNA, 25 bp, S. pombe
atttgcctaaggattcttctgttga

SEQ ID NO: 64627 - DNA, 25 bp, S. pombe
atttccttcgtgattctcctattaa

SEQ ID NO: 64628 - DNA, 25 bp, S. pombe
atttgtttgctgcattttcaggtta

SEQ ID NO: 64629 - DNA, 25 bp, S. pombe
atttgcccagagattatggcgcata

SEQ ID NO: 64630 - DNA, 25 bp, S. pombe
atttcgactgatgctttggcagctc

SEQ ID NO: 64631 - DNA, 25 bp, S. pombe
atttggaaacctgctatgagtctgc

SEQ ID NO: 64632 - DNA, 25 bp, S. pombe
atttgtccaagcgtactgctttcgt

SEQ ID NO: 64633 - DNA, 25 bp, S. pombe
atattcggcttttttggtcactgga

SEQ ID NO: 64634 - DNA, 25 bp, S. pombe
atattcgtcaacttggttctggccc

SEQ ID NO: 64635 - DNA, 25 bp, S. pombe
atttcacctcatgttttggactagt

SEQ ID NO: 64636 - DNA, 25 bp, S. pombe
atttcactctacgaggtatcgactt

SEQ ID NO: 64637 - DNA, 25 bp, S. pombe
atttcctctaccgttgacaatgaca

SEQ ID NO: 64638 - DNA, 25 bp, S. pombe
atttcctcttaccttacgattcaag

SEQ ID NO: 64639 - DNA, 25 bp, S. pombe
atttcgttcggctatggctgcatca

SEQ ID NO: 64640 - DNA, 25 bp, S. pombe
atttcttccagtgtgtcgacaagca

SEQ ID NO: 64641 - DNA, 25 bp, S. pombe
atttgcctccaattacttcagttca

SEQ ID NO: 64642 - DNA, 25 bp, S. pombe
atttgcgtcgtgttacttctttagt

SEQ ID NO: 64643 - DNA, 25 bp, S. pombe
atttcggctgctttatttttcattt

SEQ ID NO: 64644 - DNA, 25 bp, S. pombe
atttgccagtggtgattttgctcgt

SEQ ID NO: 64645 - DNA, 25 bp, S. pombe
atttcttggcgagttggtctgcatc

SEQ ID NO: 64646 - DNA, 25 bp, S. pombe
atttctctggccgttacttgaagta

SEQ ID NO: 64647 - DNA, 25 bp, S. pombe
atattcctcccgctactggaattaa

SEQ ID NO: 64648 - DNA, 25 bp, S. pombe
atttccagcccgcaactgttttaga

SEQ ID NO: 64649 - DNA, 25 bp, S. pombe
accatcgtgggctgaatcacctgag

SEQ ID NO: 64650 - DNA, 25 bp, S. pombe
atttcgtgggcataaacccgcttct

SEQ ID NO: 64651 - DNA, 25 bp, S. pombe
atattcgtggtttacaaggccgctc

SEQ ID NO: 64652 - DNA, 25 bp, S. pombe
atttctggtatcaaacgggctggtt

SEQ ID NO: 64653 - DNA, 25 bp, S. pombe
atttctgcatttgaaccgatcgctt

SEQ ID NO: 64654 - DNA, 25 bp, S. pombe
atttccttatccgacacagttggtg

SEQ ID NO: 64655 - DNA, 25 bp, S. pombe
atttgcttatgacccactgcatggt

SEQ ID NO: 64656 - DNA, 25 bp, S. pombe
atttggtatcgtgcgccagagctac

SEQ ID NO: 64657 - DNA, 25 bp, S. pombe
atttgcacttctgcaggacaccatt

SEQ ID NO: 64658 - DNA, 25 bp, S. pombe
atttgcgctgtctcaggatatgcat

SEQ ID NO: 64659 - DNA, 25 bp, S. pombe
atttgcgactcaaaggcctcatgac

SEQ ID NO: 64660 - DNA, 25 bp, S. pombe
atttgcaaacactctccttaagcga

SEQ ID NO: 64661 - DNA, 25 bp, S. pombe
atttgcaaaatcttccctgttaccg

SEQ ID NO: 64662 - DNA, 25 bp, S. pombe
atttcaatacacgtcgcttgcttca

SEQ ID NO: 64663 - DNA, 25 bp, S. pombe
atatgtcaaataacccatctcctcg

SEQ ID NO: 64664 - DNA, 25 bp, S. pombe
atttcatgaaaacccactccattct

SEQ ID NO: 64665 - DNA, 25 bp, S. pombe
atttctcgaacctattgatcccatt

SEQ ID NO: 64666 - DNA, 25 bp, S. pombe
atttccgacattcaagagctccttg

SEQ ID NO: 64667 - DNA, 25 bp, S. pombe
atttggttactagactggagcttgt

SEQ ID NO: 64668 - DNA, 25 bp, S. pombe
atttgtgcaaacttccggcgtctat

SEQ ID NO: 64669 - DNA, 25 bp, S. pombe
atttcatatgatccttcttgtgcag

SEQ ID NO: 64670 - DNA, 25 bp, S. pombe
atttgtgcatcgtggacaggcttca

SEQ ID NO: 64671 - DNA, 25 bp, S. pombe
atttgtgaagcctaatcctgtgtgg

SEQ ID NO: 64672 - DNA, 25 bp, S. pombe
atttcgttactgattgctgcatcta

SEQ ID NO: 64673 - DNA, 25 bp, S. pombe
atttgtcccgatcttatactcgtag

SEQ ID NO: 64674 - DNA, 25 bp, S. pombe
atttgtttcctgaatttcgccgaag

SEQ ID NO: 64675 - DNA, 25 bp, S. pombe
atttgttaccttctcctcaaggaga

SEQ ID NO: 64676 - DNA, 25 bp, S. pombe
ctttggtcgcggagtctacagacga

SEQ ID NO: 64677 - DNA, 25 bp, S. pombe
atttgatgcacctgacgtctacgac

SEQ ID NO: 64678 - DNA, 25 bp, S. pombe
atttcatgtccatccattcattcca

SEQ ID NO: 64679 - DNA, 25 bp, S. pombe
atttcagtccttgatgcatttctca

SEQ ID NO: 64680 - DNA, 25 bp, S. pombe
atttctcctgttgcatattccatag

SEQ ID NO: 64681 - DNA, 25 bp, S. pombe
atttcttcttctgctttctgatatg

SEQ ID NO: 64682 - DNA, 25 bp, S. pombe
atttctttctattcttgctgtgtac

SEQ ID NO: 64683 - DNA, 25 bp, S. pombe
atttgctgttggtactgccagtgga

SEQ ID NO: 64684 - DNA, 25 bp, S. pombe
atttcgtctaatagcgcaggccaca

SEQ ID NO: 64685 - DNA, 25 bp, S. pombe
atttcaatctgctttggcggccata

SEQ ID NO: 64686 - DNA, 25 bp, S. pombe
atttcatactgctattcatccgctt

SEQ ID NO: 64687 - DNA, 25 bp, S. pombe
atttcatccctattatcggccgttt

SEQ ID NO: 64688 - DNA, 25 bp, S. pombe
atttcatgcgtttacatcaccgcgt

SEQ ID NO: 64689 - DNA, 25 bp, S. pombe
atttcactttcactgcatctcaaga

SEQ ID NO: 64690 - DNA, 25 bp, S. pombe
atttcacaatgttctgctcattatg

SEQ ID NO: 64691 - DNA, 25 bp, S. pombe
atttcaaatgcttcagtctgcctgc

SEQ ID NO: 64692 - DNA, 25 bp, S. pombe
atctcccatccctggaacagttatt

SEQ ID NO: 64693 - DNA, 25 bp, S. pombe
atttcccatgtttcaaggcgtcttg

SEQ ID NO: 64694 - DNA, 25 bp, S. pombe
atttccgcagcttccaaagtacgta

SEQ ID NO: 64695 - DNA, 25 bp, S. pombe
atttccggtcgagagcagcatacaa

SEQ ID NO: 64696 - DNA, 25 bp, S. pombe
atttccatggaaagtgccgcataca

SEQ ID NO: 64697 - DNA, 25 bp, S. pombe
atattagcgactgtactcctggttc

SEQ ID NO: 64698 - DNA, 25 bp, S. pombe
atttcatcaatcacttccacagcaa

SEQ ID NO: 64699 - DNA, 25 bp, S. pombe
atttctttctactccatccataatt

SEQ ID NO: 64700 - DNA, 25 bp, S. pombe
atttgctttgcatacaccaccttat

SEQ ID NO: 64701 - DNA, 25 bp, S. pombe
atattttcgctatccacggtgttgc

SEQ ID NO: 64702 - DNA, 25 bp, S. pombe
atactctttaatccctcgttttcag

SEQ ID NO: 64703 - DNA, 25 bp, S. pombe
atattagtcgtctacctcgttgtta

SEQ ID NO: 64704 - DNA, 25 bp, S. pombe
atatctcctatcacgtctcagttaa

SEQ ID NO: 64705 - DNA, 25 bp, S. pombe
atttctcaatcccatgtccaggtta

SEQ ID NO: 64706 - DNA, 25 bp, S. pombe
atttccaatcccaatctggtcttgg

SEQ ID NO: 64707 - DNA, 25 bp, S. pombe
atataggaatgcctgccttcaatcc

SEQ ID NO: 64708 - DNA, 25 bp, S. pombe
atttctatggctgttgctacacctt

SEQ ID NO: 64709 - DNA, 25 bp, S. pombe
atttctctacatggttcttttggca

SEQ ID NO: 64710 - DNA, 25 bp, S. pombe
atttctgtctcggttcttgttgacc

SEQ ID NO: 64711 - DNA, 25 bp, S. pombe
atttctgctgtcacttctgtattca

SEQ ID NO: 64712 - DNA, 25 bp, S. pombe
atttcgatactgtgcaaacctccat

SEQ ID NO: 64713 - DNA, 25 bp, S. pombe
atttgcgtgaagagccgtatacaca

SEQ ID NO: 64714 - DNA, 25 bp, S. pombe
atttgggacagttggccacggcata

SEQ ID NO: 64715 - DNA, 25 bp, S. pombe
atttgaaacactttcctccgcatat

SEQ ID NO: 64716 - DNA, 25 bp, S. pombe
atttgacgatttacctgatgcctac

SEQ ID NO: 64717 - DNA, 25 bp, S. pombe
atatcgtgacggtatgaatgcggcc

SEQ ID NO: 64718 - DNA, 25 bp, S. pombe
atattctttggatcaactcacccgt

SEQ ID NO: 64719 - DNA, 25 bp, S. pombe
atatagtggtgctcctactgacggc

SEQ ID NO: 64720 - DNA, 25 bp, S. pombe
atttgctaattcacaggtcacctct

SEQ ID NO: 64721 - DNA, 25 bp, S. pombe
atttccgaaatgacagcttcaccgc

SEQ ID NO: 64722 - DNA, 25 bp, S. pombe
atcgttccaactcacgttctaaaca

SEQ ID NO: 64723 - DNA, 25 bp, S. pombe
atcttatcacatctcaaggacccgg

SEQ ID NO: 64724 - DNA, 25 bp, S. pombe
atttcctgattttgatcctgaccgg

SEQ ID NO: 64725 - DNA, 25 bp, S. pombe
atttctctccataacacacattcag

SEQ ID NO: 64726 - DNA, 25 bp, S. pombe
atttgcattctgttcatcccttgat

SEQ ID NO: 64727 - DNA, 25 bp, S. pombe
atttctctctctacttttgatgacc

SEQ ID NO: 64728 - DNA, 25 bp, S. pombe
atttctctgcattcattgttccata

SEQ ID NO: 64729 - DNA, 25 bp, S. pombe
atttctggcattcctgtatgtatca

SEQ ID NO: 64730 - DNA, 25 bp, S. pombe
atatttgctcaacctagatttaaag

SEQ ID NO: 64731 - DNA, 25 bp, S. pombe
atttgtgccagaccggttggtgaac

SEQ ID NO: 64732 - DNA, 25 bp, S. pombe
atttgtcacggcgacgtcttagaac

SEQ ID NO: 64733 - DNA, 25 bp, S. pombe
atttgtgcagaatcgccaagctaca

SEQ ID NO: 64734 - DNA, 25 bp, S. pombe
atttgggatcacctgccatcagtaa

SEQ ID NO: 64735 - DNA, 25 bp, S. pombe
atttggtcatgcgtaccacagtacg

SEQ ID NO: 64736 - DNA, 25 bp, S. pombe
atttgattgatcgtcctgccagtac

SEQ ID NO: 64737 - DNA, 25 bp, S. pombe
atataggacagccacgttacgttgt

SEQ ID NO: 64738 - DNA, 25 bp, S. pombe
atatacgcgggagccgtaggtcgtt

SEQ ID NO: 64739 - DNA, 25 bp, S. pombe
atatacgctggtcgcttaggagtct

SEQ ID NO: 64740 - DNA, 25 bp, S. pombe
atttgctcaggctttgcttcgatca

SEQ ID NO: 64741 - DNA, 25 bp, S. pombe
atttgactggcggtcatgcatcttg

SEQ ID NO: 64742 - DNA, 25 bp, S. pombe
atttgacttctgacttgtttgcctg

SEQ ID NO: 64743 - DNA, 25 bp, S. pombe
atttgatttccacttcttcgcattt

SEQ ID NO: 64744 - DNA, 25 bp, S. pombe
atttgctattccctatttcactacc

SEQ ID NO: 64745 - DNA, 25 bp, S. pombe
atttccagctccaacttatgcgaga

SEQ ID NO: 64746 - DNA, 25 bp, S. pombe
atttgctgcgctccattccgaggaa

SEQ ID NO: 64747 - DNA, 25 bp, S. pombe
atttgataccactttgccaatgcaa

SEQ ID NO: 64748 - DNA, 25 bp, S. pombe
atttgaccccaatttcgtgatctcg

SEQ ID NO: 64749 - DNA, 25 bp, S. pombe
atttgatccttctaatacgctacga

SEQ ID NO: 64750 - DNA, 25 bp, S. pombe
atttggatttgatcaaccgcgcttc

SEQ ID NO: 64751 - DNA, 25 bp, S. pombe
atttgctccttatgaacgccgtgtc

SEQ ID NO: 64752 - DNA, 25 bp, S. pombe
atattacactaattcaagcaatcta

SEQ ID NO: 64753 - DNA, 25 bp, S. pombe
atatctggcaatacacgacgttctg

SEQ ID NO: 64754 - DNA, 25 bp, S. pombe
atttggaatccccacaatgtctctg

SEQ ID NO: 64755 - DNA, 25 bp, S. pombe
atttgtggatcctccatactcgcat

SEQ ID NO: 64756 - DNA, 25 bp, S. pombe
atttgggtatcagcttcaagacgca

SEQ ID NO: 64757 - DNA, 25 bp, S. pombe
atttggagtccattttccgatcaag

SEQ ID NO: 64758 - DNA, 25 bp, S. pombe
acggacggaacagagacggccacaa

SEQ ID NO: 64759 - DNA, 25 bp, S. pombe
atcggacccggattctaggctagat

SEQ ID NO: 64760 - DNA, 25 bp, S. pombe
atttgacccgtgttctaagcatcga

SEQ ID NO: 64761 - DNA, 25 bp, S. pombe
atttccgttgagacttgcccatgtt

SEQ ID NO: 64762 - DNA, 25 bp, S. pombe
atattacttttcttgatgccgctac

SEQ ID NO: 64763 - DNA, 25 bp, S. pombe
atttgccttcacttttctggtgcaa

SEQ ID NO: 64764 - DNA, 25 bp, S. pombe
atttgcctccattattccatcgaaa

SEQ ID NO: 64765 - DNA, 25 bp, S. pombe
atatttgcacaatcagtacctcgaa

SEQ ID NO: 64766 - DNA, 25 bp, S. pombe
atttgcgaacagtcgtatcctcgaa

SEQ ID NO: 64767 - DNA, 25 bp, S. pombe
atttgacaatttctcctccattcat

SEQ ID NO: 64768 - DNA, 25 bp, S. pombe
atttggtatgttcatttcctctctg

SEQ ID NO: 64769 - DNA, 25 bp, S. pombe
atttggcaggtgattcgcttgcata

SEQ ID NO: 64770 - DNA, 25 bp, S. pombe
agaaccacctgatgtgtttacccca

SEQ ID NO: 64771 - DNA, 25 bp, S. pombe
caaactaggtagtggaatcgcccca

SEQ ID NO: 64772 - DNA, 25 bp, S. pombe
ccaaggacgttgtggttgacgacaa

SEQ ID NO: 64773 - DNA, 25 bp, S. pombe
atggaaagccactgcaatcggccgt

SEQ ID NO: 64774 - DNA, 25 bp, S. pombe
atataccttcgtttactcgtgtgca

SEQ ID NO: 64775 - DNA, 25 bp, S. pombe
atattccacgtcacctgcttatatg

SEQ ID NO: 64776 - DNA, 25 bp, S. pombe
atttccacgtttaccatgtctatga

SEQ ID NO: 64777 - DNA, 25 bp, S. pombe
atttgccctgctattgaatgtctta

SEQ ID NO: 64778 - DNA, 25 bp, S. pombe
atttgtccgctgctggaaatcctat

SEQ ID NO: 64779 - DNA, 25 bp, S. pombe
atttggccacaaagcgatgaatcac

SEQ ID NO: 64780 - DNA, 25 bp, S. pombe
ataccgagttttggcgacgaccagc

SEQ ID NO: 64781 - DNA, 25 bp, S. pombe
atatcaagccaagtgtctccgatcg

SEQ ID NO: 64782 - DNA, 25 bp, S. pombe
atttgttggctcaaatctctcgtcg

SEQ ID NO: 64783 - DNA, 25 bp, S. pombe
atttgttcagctaaatggatctcga

SEQ ID NO: 64784 - DNA, 25 bp, S. pombe
atttgctaactatgatgtctgccga

SEQ ID NO: 64785 - DNA, 25 bp, S. pombe
atttgcttcctatattcatgcctat

SEQ ID NO: 64786 - DNA, 25 bp, S. pombe
atttgcttcgcttctaacagtttcg

SEQ ID NO: 64787 - DNA, 25 bp, S. pombe
atttggtgctctccgaaattggtga

SEQ ID NO: 64788 - DNA, 25 bp, S. pombe
atatactctcttccgcaagattggc

SEQ ID NO: 64789 - DNA, 25 bp, S. pombe
atttgtgcatattacggtgtcccag

SEQ ID NO: 64790 - DNA, 25 bp, S. pombe
atttgacgatcattccattgaggag

SEQ ID NO: 64791 - DNA, 25 bp, S. pombe
atttgacgcgttacttgactgacag

SEQ ID NO: 64792 - DNA, 25 bp, S. pombe
atattcgctttaacgttgccaaggc

SEQ ID NO: 64793 - DNA, 25 bp, S. pombe
atatcgtccaggtactacggcgtta

SEQ ID NO: 64794 - DNA, 25 bp, S. pombe
atatcgcattgggagacttggtcgt

SEQ ID NO: 64795 - DNA, 25 bp, S. pombe
atactcgtacggcttggtcgacaaa

SEQ ID NO: 64796 - DNA, 25 bp, S. pombe
atatttgtagcgcttatctttcaag

SEQ ID NO: 64797 - DNA, 25 bp, S. pombe
atttggtgaggctttctttggatga

SEQ ID NO: 64798 - DNA, 25 bp, S. pombe
atttgcttgaccttgattttactga

SEQ ID NO: 64799 - DNA, 25 bp, S. pombe
atttggtgagcctgttggtgattca

SEQ ID NO: 64800 - DNA, 25 bp, S. pombe
atatcggtacgctgttctcataact

SEQ ID NO: 64801 - DNA, 25 bp, S. pombe
atattttgacgcttgctcagggtgc

SEQ ID NO: 64802 - DNA, 25 bp, S. pombe
atttgtatccatcgtcgctgaggac

SEQ ID NO: 64803 - DNA, 25 bp, S. pombe
atttgattgcttcttctcgtatcgc

SEQ ID NO: 64804 - DNA, 25 bp, S. pombe
atttgcttcttaattctccgatcga

SEQ ID NO: 64805 - DNA, 25 bp, S. pombe
atattggctcactaattctctttcc

SEQ ID NO: 64806 - DNA, 25 bp, S. pombe
atttgctcgtcaacaccgtgtaata

SEQ ID NO: 64807 - DNA, 25 bp, S. pombe
atttggtgtacttacgctgctagcg

SEQ ID NO: 64808 - DNA, 25 bp, S. pombe
atattatgctagtcaaccctggcct

SEQ ID NO: 64809 - DNA, 25 bp, S. pombe
atagtcagtgttcgaccagatccct

SEQ ID NO: 64810 - DNA, 25 bp, S. pombe
atagtccatgacataccaaccgttc

SEQ ID NO: 64811 - DNA, 25 bp, S. pombe
atattgtctcccatgttactgcgat

SEQ ID NO: 64812 - DNA, 25 bp, S. pombe
atattgtatcttctccatcatctgt

SEQ ID NO: 64813 - DNA, 25 bp, S. pombe
atattatactggatcctggctttgg

SEQ ID NO: 64814 - DNA, 25 bp, S. pombe
atattctcagggatcgtggacttag

SEQ ID NO: 64815 - DNA, 25 bp, S. pombe
atcttaccctatgactattcgttta

SEQ ID NO: 64816 - DNA, 25 bp, S. pombe
atagtccccaagctcgtgtattttg

SEQ ID NO: 64817 - DNA, 25 bp, S. pombe
atattgacttaactgctcgtgagag

SEQ ID NO: 64818 - DNA, 25 bp, S. pombe
atattttgctttcgttggcgtgaac

SEQ ID NO: 64819 - DNA, 25 bp, S. pombe
atattcttgcttctttggaggccca

SEQ ID NO: 64820 - DNA, 25 bp, S. pombe
atttgcttctattttctgggctttc

SEQ ID NO: 64821 - DNA, 25 bp, S. pombe
atattgtctattttacgggccgata

SEQ ID NO: 64822 - DNA, 25 bp, S. pombe
atatgtgctcttttaacgaccgcct

SEQ ID NO: 64823 - DNA, 25 bp, S. pombe
atatcagtcacttcttaaacctcct

SEQ ID NO: 64824 - DNA, 25 bp, S. pombe
atatagtccatttcaaacgcctcgt

SEQ ID NO: 64825 - DNA, 25 bp, S. pombe
atatcgatcttttacctcaactcag

SEQ ID NO: 64826 - DNA, 25 bp, S. pombe
atttgatttttcatccgactcagaa

SEQ ID NO: 64827 - DNA, 25 bp, S. pombe
atattctactaagggagcggctcaa

SEQ ID NO: 64828 - DNA, 25 bp, S. pombe
atattgctagcagtgtttcggcctt

SEQ ID NO: 64829 - DNA, 25 bp, S. pombe
atattgttcaatgtgcttctccctc

SEQ ID NO: 64830 - DNA, 25 bp, S. pombe
atttggctgcaaagtttcctctcca

SEQ ID NO: 64831 - DNA, 25 bp, S. pombe
atttgggtcaagagctcactgtccg

SEQ ID NO: 64832 - DNA, 25 bp, S. pombe
atttggtccaagacgctaaagccga

SEQ ID NO: 64833 - DNA, 25 bp, S. pombe
atttgcaccgtgatatggctactgt

SEQ ID NO: 64834 - DNA, 25 bp, S. pombe
atctatgccggtgatgctgactaca

SEQ ID NO: 64835 - DNA, 25 bp, S. pombe
atttgggagctcttgaggctgatca

SEQ ID NO: 64836 - DNA, 25 bp, S. pombe
atttggctattcttgaggcagctga

SEQ ID NO: 64837 - DNA, 25 bp, S. pombe
atatctgtgaagtcatggttccatg

SEQ ID NO: 64838 - DNA, 25 bp, S. pombe
atatttgattatcgctgctgctcct

SEQ ID NO: 64839 - DNA, 25 bp, S. pombe
atatatcatgcccagtcaatcgtcc

SEQ ID NO: 64840 - DNA, 25 bp, S. pombe
atattggccctgtccagagtttagc

SEQ ID NO: 64841 - DNA, 25 bp, S. pombe
atttggatccttagagcgctttatg

SEQ ID NO: 64842 - DNA, 25 bp, S. pombe
atttgagatccctatacgctgcatt

SEQ ID NO: 64843 - DNA, 25 bp, S. pombe
atttgagaccgctgacttcttgcgc

SEQ ID NO: 64844 - DNA, 25 bp, S. pombe
atatcaaaccgcgtacttcgtgact

SEQ ID NO: 64845 - DNA, 25 bp, S. pombe
atataaaaagcccactcctgatcct

SEQ ID NO: 64846 - DNA, 25 bp, S. pombe
atatgttagacagtgggtatccggt

SEQ ID NO: 64847 - DNA, 25 bp, S. pombe
atatgttccaagactcactaccggc

SEQ ID NO: 64848 - DNA, 25 bp, S. pombe
atattgttcagcatcttccgcagat

SEQ ID NO: 64849 - DNA, 25 bp, S. pombe
atttgttcgagagttctgcgctgca

SEQ ID NO: 64850 - DNA, 25 bp, S. pombe
atttgattcgcatctgtgtcggcat

SEQ ID NO: 64851 - DNA, 25 bp, S. pombe
atatttccagcatcgtgagggccgt

SEQ ID NO: 64852 - DNA, 25 bp, S. pombe
atattcacagtatccttaccagcac

SEQ ID NO: 64853 - DNA, 25 bp, S. pombe
atattagagctcttcctatttcaac

SEQ ID NO: 64854 - DNA, 25 bp, S. pombe
atattgggtcagctcatattgctca

SEQ ID NO: 64855 - DNA, 25 bp, S. pombe
atattgtttcagctacttcatcctc

SEQ ID NO: 64856 - DNA, 25 bp, S. pombe
atattcttcgcaaggcttttgacac

SEQ ID NO: 64857 - DNA, 25 bp, S. pombe
atattgcttcttctgcttcttcaaa

SEQ ID NO: 64858 - DNA, 25 bp, S. pombe
atattcgttcgtacttacccaatcg

SEQ ID NO: 64859 - DNA, 25 bp, S. pombe
atattcgctcggttttcaacttggc

SEQ ID NO: 64860 - DNA, 25 bp, S. pombe
atattcgccctagttctattcttga

SEQ ID NO: 64861 - DNA, 25 bp, S. pombe
atattcaccctagttcttctgtagc

SEQ ID NO: 64862 - DNA, 25 bp, S. pombe
atatctcaggtttcatgggtcctca

SEQ ID NO: 64863 - DNA, 25 bp, S. pombe
atttgatgctgacgttctttcctgg

SEQ ID NO: 64864 - DNA, 25 bp, S. pombe
atatctcaggacatctctatgaccg

SEQ ID NO: 64865 - DNA, 25 bp, S. pombe
atatatctgactaacccaggcagcc

SEQ ID NO: 64866 - DNA, 25 bp, S. pombe
atttgggatcatgctggtggttctc

SEQ ID NO: 64867 - DNA, 25 bp, S. pombe
atttggctacatgctggtggacctc

SEQ ID NO: 64868 - DNA, 25 bp, S. pombe
atttggcttaccttcgtgatcctaa

SEQ ID NO: 64869 - DNA, 25 bp, S. pombe
atattcgttcactttcgtttcagac

SEQ ID NO: 64870 - DNA, 25 bp, S. pombe
cacgaatgggttgctttacacgaaa

SEQ ID NO: 64871 - DNA, 25 bp, S. pombe
actgaagggtcgtgtcccatggaca

SEQ ID NO: 64872 - DNA, 25 bp, S. pombe
atatggttcccggtttattcgatgt

SEQ ID NO: 64873 - DNA, 25 bp, S. pombe
atttgtttcccagtgtgtcagttga

SEQ ID NO: 64874 - DNA, 25 bp, S. pombe
atatttccttacgtggaccatatcg

SEQ ID NO: 64875 - DNA, 25 bp, S. pombe
atatacgccttgactgctggatact

SEQ ID NO: 64876 - DNA, 25 bp, S. pombe
atatatagtcatcccattgtgcata

SEQ ID NO: 64877 - DNA, 25 bp, S. pombe
atatttggtgctggtgttcaaccca

SEQ ID NO: 64878 - DNA, 25 bp, S. pombe
atattccccagatggcattacacca

SEQ ID NO: 64879 - DNA, 25 bp, S. pombe
atattcgtgatccaaacaccctgac

SEQ ID NO: 64880 - DNA, 25 bp, S. pombe
atatgccaggatgcaaactcgggcc

SEQ ID NO: 64881 - DNA, 25 bp, S. pombe
atattcttgttccaatgccagtcct

SEQ ID NO: 64882 - DNA, 25 bp, S. pombe
atattcgattttcatctcgttgcga

SEQ ID NO: 64883 - DNA, 25 bp, S. pombe
atttggtatcttctctgcttgtgca

SEQ ID NO: 64884 - DNA, 25 bp, S. pombe
atttggttgcttcccttgagagatc

SEQ ID NO: 64885 - DNA, 25 bp, S. pombe
ataagggtgcattctatcaaaacga

SEQ ID NO: 64886 - DNA, 25 bp, S. pombe
atatacaatttagccctatacgttc

SEQ ID NO: 64887 - DNA, 25 bp, S. pombe
atatcaaatttcgaccgtttcagga

SEQ ID NO: 64888 - DNA, 25 bp, S. pombe
atattcaatttgctcggttatccga

SEQ ID NO: 64889 - DNA, 25 bp, S. pombe
atatcacgaaacaacggcctcaaat

SEQ ID NO: 64890 - DNA, 25 bp, S. pombe
atatttgggtctgcaattcctattg

SEQ ID NO: 64891 - DNA, 25 bp, S. pombe
atatttgtttctgtacttccattaa

SEQ ID NO: 64892 - DNA, 25 bp, S. pombe
atattccttggactcttgattctgc

SEQ ID NO: 64893 - DNA, 25 bp, S. pombe
atagtgccgtaagagctgcttccag

SEQ ID NO: 64894 - DNA, 25 bp, S. pombe
atatagctgcaacccaagtcgtatc

SEQ ID NO: 64895 - DNA, 25 bp, S. pombe
atatgcattgtctccaagctttatg

SEQ ID NO: 64896 - DNA, 25 bp, S. pombe
atatcttttgacatcccatttcaga

SEQ ID NO: 64897 - DNA, 25 bp, S. pombe
atattttccttacccatgatccaaa

SEQ ID NO: 64898 - DNA, 25 bp, S. pombe
atattgcgcattgtggtttaccaga

SEQ ID NO: 64899 - DNA, 25 bp, S. pombe
atttggcttccttgtttaccagcaa

SEQ ID NO: 64900 - DNA, 25 bp, S. pombe
atttggcttccattgttcaacaagg

SEQ ID NO: 64901 - DNA, 25 bp, S. pombe
atttggtgcaatgcctggctcacaa

SEQ ID NO: 64902 - DNA, 25 bp, S. pombe
atttggcgatttttgtgctgctaaa

SEQ ID NO: 64903 - DNA, 25 bp, S. pombe
atattggcagtctgacggctctcaa

SEQ ID NO: 64904 - DNA, 25 bp, S. pombe
atattgcgactcagatgggctcata

SEQ ID NO: 64905 - DNA, 25 bp, S. pombe
atattgcatcctggcgattgcttaa

SEQ ID NO: 64906 - DNA, 25 bp, S. pombe
atattactctggctctgatttgaca

SEQ ID NO: 64907 - DNA, 25 bp, S. pombe
atataccgttgcttacattgtggaa

SEQ ID NO: 64908 - DNA, 25 bp, S. pombe
atataccaatggctcctgctgggaa

SEQ ID NO: 64909 - DNA, 25 bp, S. pombe
atatacttcgaaggactctccatat

SEQ ID NO: 64910 - DNA, 25 bp, S. pombe
atatacatctccaattggctcacct

SEQ ID NO: 64911 - DNA, 25 bp, S. pombe
atatgacccatatatcccggcggag

SEQ ID NO: 64912 - DNA, 25 bp, S. pombe
atatacacaaatacctctcgagcct

SEQ ID NO: 64913 - DNA, 25 bp, S. pombe
atatatacaaccacatctcagaccc

SEQ ID NO: 64914 - DNA, 25 bp, S. pombe
atatattggagagcagccctccgca

SEQ ID NO: 64915 - DNA, 25 bp, S. pombe
atatgggccgtttcactttgcgtga

SEQ ID NO: 64916 - DNA, 25 bp, S. pombe
atatgggcctcttaaatcagttgtg

SEQ ID NO: 64917 - DNA, 25 bp, S. pombe
atattcccattaacaaggtccttgt

SEQ ID NO: 64918 - DNA, 25 bp, S. pombe
atatcgcctttgaaccttggtatta

SEQ ID NO: 64919 - DNA, 25 bp, S. pombe
atagataccttccttgaacaccgaa

SEQ ID NO: 64920 - DNA, 25 bp, S. pombe
atagtagcactgtccctgaagtaaa

SEQ ID NO: 64921 - DNA, 25 bp, S. pombe
atattcgttgccttcaatcactttc

SEQ ID NO: 64922 - DNA, 25 bp, S. pombe
atatgttttgcctcagatcgtcttg

SEQ ID NO: 64923 - DNA, 25 bp, S. pombe
atatctcgtcgaattgcgtcgttct

SEQ ID NO: 64924 - DNA, 25 bp, S. pombe
atattgatattcttcccggatttct

SEQ ID NO: 64925 - DNA, 25 bp, S. pombe
atatgtcactctgatagctccgttt

SEQ ID NO: 64926 - DNA, 25 bp, S. pombe
atatgcatacacagctcaatccgat

SEQ ID NO: 64927 - DNA, 25 bp, S. pombe
atattgacgacgctatcgctttgct

SEQ ID NO: 64928 - DNA, 25 bp, S. pombe
atattctagctcaggacactcgggc

SEQ ID NO: 64929 - DNA, 25 bp, S. pombe
atattctactttgtcctgatggtca

SEQ ID NO: 64930 - DNA, 25 bp, S. pombe
atattgtcagcgcatgccttcaagg

SEQ ID NO: 64931 - DNA, 25 bp, S. pombe
atatagtccagctgctactgcaagc

SEQ ID NO: 64932 - DNA, 25 bp, S. pombe
atattcattcgctgtctcatgtgca

SEQ ID NO: 64933 - DNA, 25 bp, S. pombe
atattgccgatgttgttcgcgattt

SEQ ID NO: 64934 - DNA, 25 bp, S. pombe
atattgctgctattgttccttcttt

SEQ ID NO: 64935 - DNA, 25 bp, S. pombe
atattcctgacttcctttcttttgt

SEQ ID NO: 64936 - DNA, 25 bp, S. pombe
atatctcgtgtatccatttgcatta

SEQ ID NO: 64937 - DNA, 25 bp, S. pombe
atatagcatttatcatcctcctctt

SEQ ID NO: 64938 - DNA, 25 bp, S. pombe
atatagctagtgtgcttgctggcct

SEQ ID NO: 64939 - DNA, 25 bp, S. pombe
atataccatgcttagaggctcgccc

SEQ ID NO: 64940 - DNA, 25 bp, S. pombe
atatctgacttttcgacttccactg

SEQ ID NO: 64941 - DNA, 25 bp, S. pombe
atcattgaaatcttggacttgcaca

SEQ ID NO: 64942 - DNA, 25 bp, S. pombe
atagcacttgaactgcgcggtagac

SEQ ID NO: 64943 - DNA, 25 bp, S. pombe
atatccgtgatcatggcgtgttacc

SEQ ID NO: 64944 - DNA, 25 bp, S. pombe
atatttggctgctgaaattctcgaa

SEQ ID NO: 64945 - DNA, 25 bp, S. pombe
atatattcggctcctgtttcgcaga

SEQ ID NO: 64946 - DNA, 25 bp, S. pombe
atatatccctctaatgtacgtgcaa

SEQ ID NO: 64947 - DNA, 25 bp, S. pombe
atatataccctttttcatgctcaca

SEQ ID NO: 64948 - DNA, 25 bp, S. pombe
atattacaggttttacgccagcgct

SEQ ID NO: 64949 - DNA, 25 bp, S. pombe
atatcgctactgtcggtggtctcat

SEQ ID NO: 64950 - DNA, 25 bp, S. pombe
atatttgctcatttgtggcgtctca

SEQ ID NO: 64951 - DNA, 25 bp, S. pombe
atatcttgctatgcttgacgtcacc

SEQ ID NO: 64952 - DNA, 25 bp, S. pombe
atatttgctgatacttccgctactt

SEQ ID NO: 64953 - DNA, 25 bp, S. pombe
atatgttgccaaaaacgttcctgtt

SEQ ID NO: 64954 - DNA, 25 bp, S. pombe
atatttccatatccaactgctcatc

SEQ ID NO: 64955 - DNA, 25 bp, S. pombe
atatattctacttcagtcgctgcag

SEQ ID NO: 64956 - DNA, 25 bp, S. pombe
atatttccattctagctcctgcgat

SEQ ID NO: 64957 - DNA, 25 bp, S. pombe
atatattcatgccatcgagccccga

SEQ ID NO: 64958 - DNA, 25 bp, S. pombe
atatttggtacattcctcagcactc

SEQ ID NO: 64959 - DNA, 25 bp, S. pombe
atatcacgaaacctccgtatctcac

SEQ ID NO: 64960 - DNA, 25 bp, S. pombe
atatgcttagactcgggttatgaca

SEQ ID NO: 64961 - DNA, 25 bp, S. pombe
atatcttcgacgacacgtatttgaa

SEQ ID NO: 64962 - DNA, 25 bp, S. pombe
atatcttgcgtcgtattcttcttga

SEQ ID NO: 64963 - DNA, 25 bp, S. pombe
atatttctctccttgattctgttga

SEQ ID NO: 64964 - DNA, 25 bp, S. pombe
atattctactgctttcctagctcta

SEQ ID NO: 64965 - DNA, 25 bp, S. pombe
atattatatgtcactttattgcttt

SEQ ID NO: 64966 - DNA, 25 bp, S. pombe
atattcatcgtttcttaatcgctgg

SEQ ID NO: 64967 - DNA, 25 bp, S. pombe
atatcaatgttgctccttgggcttt

SEQ ID NO: 64968 - DNA, 25 bp, S. pombe
atatcatcgttatccttgaggctgc

SEQ ID NO: 64969 - DNA, 25 bp, S. pombe
atatacttgctatcacttgttgcgc

SEQ ID NO: 64970 - DNA, 25 bp, S. pombe
atatatcttcaatcctcgttggtcc

SEQ ID NO: 64971 - DNA, 25 bp, S. pombe
ataccaatgcaatcccagatagcgt

SEQ ID NO: 64972 - DNA, 25 bp, S. pombe
atagcccatcgatgccgagtagggt

SEQ ID NO: 64973 - DNA, 25 bp, S. pombe
atatgcgccgttgcacaagctaaca

SEQ ID NO: 64974 - DNA, 25 bp, S. pombe
atcaccgcagattggccagagctta

SEQ ID NO: 64975 - DNA, 25 bp, S. pombe
atatccactgatgactatgacgctt

SEQ ID NO: 64976 - DNA, 25 bp, S. pombe
atatctatgaattacttgccgccgc

SEQ ID NO: 64977 - DNA, 25 bp, S. pombe
atatcctgacttttatgctggccgc

SEQ ID NO: 64978 - DNA, 25 bp, S. pombe
atatctcaacttctagttctcacag

SEQ ID NO: 64979 - DNA, 25 bp, S. pombe
atattcattgttgtcgttgccatac

SEQ ID NO: 64980 - DNA, 25 bp, S. pombe
atattcatattgtccctactccaac

SEQ ID NO: 64981 - DNA, 25 bp, S. pombe
atattttggaacctcattccctcac

SEQ ID NO: 64982 - DNA, 25 bp, S. pombe
atattatctggatttcgtggccctc

SEQ ID NO: 64983 - DNA, 25 bp, S. pombe
atattctcggtcaactcggtcatac

SEQ ID NO: 64984 - DNA, 25 bp, S. pombe
atatttgcatcgcttaccggaacca

SEQ ID NO: 64985 - DNA, 25 bp, S. pombe
atagaaggtttattcagcattaaat

SEQ ID NO: 64986 - DNA, 25 bp, S. pombe
atcggatgtcgttactaccaaactt

SEQ ID NO: 64987 - DNA, 25 bp, S. pombe
atatcgctgctctctcaaggaaacg

SEQ ID NO: 64988 - DNA, 25 bp, S. pombe
atatactgctcatctcgaacaattg

SEQ ID NO: 64989 - DNA, 25 bp, S. pombe
atataatgtcattcctgcaccttca

SEQ ID NO: 64990 - DNA, 25 bp, S. pombe
atatacactgcttcatcttcatctt

SEQ ID NO: 64991 - DNA, 25 bp, S. pombe
atatttgcacagtcaatcctcctta

SEQ ID NO: 64992 - DNA, 25 bp, S. pombe
atatgtctgccttaactcttgtcaa

SEQ ID NO: 64993 - DNA, 25 bp, S. pombe
atatcttgcctccaactatcggaag

SEQ ID NO: 64994 - DNA, 25 bp, S. pombe
atatagtcgaaaaggctcgccaaca

SEQ ID NO: 64995 - DNA, 25 bp, S. pombe
atatactcgaagattctcctgaaag

SEQ ID NO: 64996 - DNA, 25 bp, S. pombe
acaaccggaaccagtcagaagagtt

SEQ ID NO: 64997 - DNA, 25 bp, S. pombe
atatgcctaccagttttgcggaaac

SEQ ID NO: 64998 - DNA, 25 bp, S. pombe
atatgtccctcgctttggcgaaaaa

SEQ ID NO: 64999 - DNA, 25 bp, S. pombe
atatcctaatgttctttggctatgg

SEQ ID NO: 65000 - DNA, 25 bp, S. pombe
atagacatactttcttcggaggatg

SEQ ID NO: 65001 - DNA, 25 bp, S. pombe
atatcatccattcgtttcacacaac

SEQ ID NO: 65002 - DNA, 25 bp, S. pombe
atataggctgtttccacatgcacac

SEQ ID NO: 65003 - DNA, 25 bp, S. pombe
atatatgcctgcttgtctgaacgaa

SEQ ID NO: 65004 - DNA, 25 bp, S. pombe
atatatcaccatgtcctatgccatt

SEQ ID NO: 65005 - DNA, 25 bp, S. pombe
atatttcatatcttccttcctttca

SEQ ID NO: 65006 - DNA, 25 bp, S. pombe
atatatgccttgttccttttcttga

SEQ ID NO: 65007 - DNA, 25 bp, S. pombe
atatctgccattacccgttatagga

SEQ ID NO: 65008 - DNA, 25 bp, S. pombe
atatgctgtatatccccactcaaaa

SEQ ID NO: 65009 - DNA, 25 bp, S. pombe
atatggttcatctcgatactcaaga

SEQ ID NO: 65010 - DNA, 25 bp, S. pombe
atagtttggcctttcatccaggcag

SEQ ID NO: 65011 - DNA, 25 bp, S. pombe
ataattcaggttctccgttggcaat

SEQ ID NO: 65012 - DNA, 25 bp, S. pombe
atgaatttggttctccctggacagg

SEQ ID NO: 65013 - DNA, 25 bp, S. pombe
atatacttggtgtcgtccgtggata

SEQ ID NO: 65014 - DNA, 25 bp, S. pombe
atatttgacgttgtcgctggactaa

SEQ ID NO: 65015 - DNA, 25 bp, S. pombe
aagtcgtaagcgctgttgtaagtct

SEQ ID NO: 65016 - DNA, 25 bp, S. pombe
atagcttacctaggcgtatttcccg

SEQ ID NO: 65017 - DNA, 25 bp, S. pombe
atacctacttagtgctttacgtgag

SEQ ID NO: 65018 - DNA, 25 bp, S. pombe
atatcctaccataaccgtcttttga

SEQ ID NO: 65019 - DNA, 25 bp, S. pombe
atatacctttatgtgcccgtgttag

SEQ ID NO: 65020 - DNA, 25 bp, S. pombe
atagacctcgtattgtcgggtttca

SEQ ID NO: 65021 - DNA, 25 bp, S. pombe
atatttcttctacttcacagttccc

SEQ ID NO: 65022 - DNA, 25 bp, S. pombe
atatgaagggtgctattgcgcgaaa

SEQ ID NO: 65023 - DNA, 25 bp, S. pombe
atatttggtggagcattgcgaataa

SEQ ID NO: 65024 - DNA, 25 bp, S. pombe
atatttatgcatccccttgcgttaa

SEQ ID NO: 65025 - DNA, 25 bp, S. pombe
atatacttattcctctacctcaaaa

SEQ ID NO: 65026 - DNA, 25 bp, S. pombe
atagagcctacagctgctgccaaaa

SEQ ID NO: 65027 - DNA, 25 bp, S. pombe
ataggactgacaaggcggctgaact

SEQ ID NO: 65028 - DNA, 25 bp, S. pombe
acatggttgaaactgccgccattcg

SEQ ID NO: 65029 - DNA, 25 bp, S. pombe
atagaaattgggaccttgccctcac

SEQ ID NO: 65030 - DNA, 25 bp, S. pombe
atcaaatttgttcactttcctccac

SEQ ID NO: 65031 - DNA, 25 bp, S. pombe
atatcggcagcctctggtccaaaag

SEQ ID NO: 65032 - DNA, 25 bp, S. pombe
atataacaagtcatcggcgcaacag

SEQ ID NO: 65033 - DNA, 25 bp, S. pombe
atataacttgataactgctgctgca

SEQ ID NO: 65034 - DNA, 25 bp, S. pombe
atatcaaacgtttcgacacacctcg

SEQ ID NO: 65035 - DNA, 25 bp, S. pombe
atatattccgttagtctacacccag

SEQ ID NO: 65036 - DNA, 25 bp, S. pombe
atatttctgcgtatgttgacacctc

SEQ ID NO: 65037 - DNA, 25 bp, S. pombe
atatcttctcagcttcgtgaacttc

SEQ ID NO: 65038 - DNA, 25 bp, S. pombe
atatctttcaatgtcgtgctaagca

SEQ ID NO: 65039 - DNA, 25 bp, S. pombe
atatctcggagttcgtatttggcag

SEQ ID NO: 65040 - DNA, 25 bp, S. pombe
atatcgtggtattcgtttcatgtcg

SEQ ID NO: 65041 - DNA, 25 bp, S. pombe
atatctatatgtctgctctcattaa

SEQ ID NO: 65042 - DNA, 25 bp, S. pombe
atatccgctcgttcatcatggagta

SEQ ID NO: 65043 - DNA, 25 bp, S. pombe
atatcacccatgcaacaattgtcgg

SEQ ID NO: 65044 - DNA, 25 bp, S. pombe
atagaggcgatgcaacctctgctcg

SEQ ID NO: 65045 - DNA, 25 bp, S. pombe
atagatgcaggactattgcgcctcc

SEQ ID NO: 65046 - DNA, 25 bp, S. pombe
atatctgcttacgttacgccatcta

SEQ ID NO: 65047 - DNA, 25 bp, S. pombe
atatactatgcatcgtttcctcttc

SEQ ID NO: 65048 - DNA, 25 bp, S. pombe
atatgaggatgatcccttgccttct

SEQ ID NO: 65049 - DNA, 25 bp, S. pombe
atatgcggatgctccttcaatttcc

SEQ ID NO: 65050 - DNA, 25 bp, S. pombe
atatgggttgccgaaggcttaccaa

SEQ ID NO: 65051 - DNA, 25 bp, S. pombe
atagggttcgcggtatgctatcccc

SEQ ID NO: 65052 - DNA, 25 bp, S. pombe
ataggtttcgatccaacgcattccg

SEQ ID NO: 65053 - DNA, 25 bp, S. pombe
atagagtgttcgacgctatccgtgt

SEQ ID NO: 65054 - DNA, 25 bp, S. pombe
atagcttactatatttactgttggg

SEQ ID NO: 65055 - DNA, 25 bp, S. pombe
atatgttacacttttcccgtctggt

SEQ ID NO: 65056 - DNA, 25 bp, S. pombe
atatgttgcccttgtatgagtctca

SEQ ID NO: 65057 - DNA, 25 bp, S. pombe
atagtgagcctttgacacccgaaga

SEQ ID NO: 65058 - DNA, 25 bp, S. pombe
ataaggcaaaccgagagccgcgaag

SEQ ID NO: 65059 - DNA, 25 bp, S. pombe
atacaagaacaatccccagcgaaac

SEQ ID NO: 65060 - DNA, 25 bp, S. pombe
atatcacatgtttattcgcctccta

SEQ ID NO: 65061 - DNA, 25 bp, S. pombe
atatctcagagtaatatccctcctc

SEQ ID NO: 65062 - DNA, 25 bp, S. pombe
atataaagtatcttcctccctgtgt

SEQ ID NO: 65063 - DNA, 25 bp, S. pombe
atatcgaaatccttccaacctgttt

SEQ ID NO: 65064 - DNA, 25 bp, S. pombe
atatcgtaccgagattagctctgga

SEQ ID NO: 65065 - DNA, 25 bp, S. pombe
atatctttactttctgttgactcta

SEQ ID NO: 65066 - DNA, 25 bp, S. pombe
atatccgtactttctatctgacagc

SEQ ID NO: 65067 - DNA, 25 bp, S. pombe
atatcctaactccatatccaactgt

SEQ ID NO: 65068 - DNA, 25 bp, S. pombe
atatctttgccaccaatccaacgat

SEQ ID NO: 65069 - DNA, 25 bp, S. pombe
atatctttctcgttatctctagtca

SEQ ID NO: 65070 - DNA, 25 bp, S. pombe
atatgccgtcgttgagacttcaaga

SEQ ID NO: 65071 - DNA, 25 bp, S. pombe
atatctcgcggacgatagcattgaa

SEQ ID NO: 65072 - DNA, 25 bp, S. pombe
atcagatcgcgaaccgttacgtact

SEQ ID NO: 65073 - DNA, 25 bp, S. pombe
atatcgtgccttcttctgatgttat

SEQ ID NO: 65074 - DNA, 25 bp, S. pombe
atatctgtcttttgcttccttcata

SEQ ID NO: 65075 - DNA, 25 bp, S. pombe
atatatgtcatttctcttccttctg

SEQ ID NO: 65076 - DNA, 25 bp, S. pombe
atatcagccaattccagttttccaa

SEQ ID NO: 65077 - DNA, 25 bp, S. pombe
atatccgctctgttggtgtttccaa

SEQ ID NO: 65078 - DNA, 25 bp, S. pombe
atatccgccgttgatgagtctgctc

SEQ ID NO: 65079 - DNA, 25 bp, S. pombe
atatcaccattgtttgctatgcccc

SEQ ID NO: 65080 - DNA, 25 bp, S. pombe
atatacctgctttatcaatgctgac

SEQ ID NO: 65081 - DNA, 25 bp, S. pombe
atagccctttattatttactgttag

SEQ ID NO: 65082 - DNA, 25 bp, S. pombe
atatcccgtttcttaaagcagtcga

SEQ ID NO: 65083 - DNA, 25 bp, S. pombe
atatctgcagccgatactctggaac

SEQ ID NO: 65084 - DNA, 25 bp, S. pombe
atatctcctagtagctctggtacgg

SEQ ID NO: 65085 - DNA, 25 bp, S. pombe
atatcctctagtatcggtgcaaatg

SEQ ID NO: 65086 - DNA, 25 bp, S. pombe
atatgagacgccgatcgtccgtagt

SEQ ID NO: 65087 - DNA, 25 bp, S. pombe
atatgagagcgccttgcagtctgca

SEQ ID NO: 65088 - DNA, 25 bp, S. pombe
atatgctgaatccatgagccctgct

SEQ ID NO: 65089 - DNA, 25 bp, S. pombe
atatggtgttgtttcgaagcgacga

SEQ ID NO: 65090 - DNA, 25 bp, S. pombe
atatgcgtgacggtttggtttcaaa

SEQ ID NO: 65091 - DNA, 25 bp, S. pombe
atactggagaccaagtgctacccca

SEQ ID NO: 65092 - DNA, 25 bp, S. pombe
atatcttgggactcgatcatccacc

SEQ ID NO: 65093 - DNA, 25 bp, S. pombe
atatccttcactttcgattgcggaa

SEQ ID NO: 65094 - DNA, 25 bp, S. pombe
atatgtcttctaatgccctgcaaac

SEQ ID NO: 65095 - DNA, 25 bp, S. pombe
atatgtgcttgaaggccatgatgcc

SEQ ID NO: 65096 - DNA, 25 bp, S. pombe
atatgcttttgcttgccgtactcaa

SEQ ID NO: 65097 - DNA, 25 bp, S. pombe
atatcctttgcttcatcgttgacaa

SEQ ID NO: 65098 - DNA, 25 bp, S. pombe
atatcacgtgtcagctaccaagaaa

SEQ ID NO: 65099 - DNA, 25 bp, S. pombe
atatgctgcacgctaatcatccgat

SEQ ID NO: 65100 - DNA, 25 bp, S. pombe
atatcttgtgcaggctatgtcgtta

SEQ ID NO: 65101 - DNA, 25 bp, S. pombe
atatcatattcttctggacttcgag

SEQ ID NO: 65102 - DNA, 25 bp, S. pombe
atatcaatgcataacgaggcttcta

SEQ ID NO: 65103 - DNA, 25 bp, S. pombe
atatcggcattaactctgagtcggc

SEQ ID NO: 65104 - DNA, 25 bp, S. pombe
atatgggcattctctcgtgatcaag

SEQ ID NO: 65105 - DNA, 25 bp, S. pombe
atatggacttaaatcgtgcgaacga

SEQ ID NO: 65106 - DNA, 25 bp, S. pombe
atagtagttagatgccccagtcgga

SEQ ID NO: 65107 - DNA, 25 bp, S. pombe
ataggtcgtgcagtggttcgtgtcc

SEQ ID NO: 65108 - DNA, 25 bp, S. pombe
atagagcatcagaggccgtcttgtc

SEQ ID NO: 65109 - DNA, 25 bp, S. pombe
atagcctctacctcttctaaaagta

SEQ ID NO: 65110 - DNA, 25 bp, S. pombe
atagtcactttactcgtgcatccat

SEQ ID NO: 65111 - DNA, 25 bp, S. pombe
atagtcaggctgaagcggagagcaa

SEQ ID NO: 65112 - DNA, 25 bp, S. pombe
atatctcgaggacttggcccatcaa

SEQ ID NO: 65113 - DNA, 25 bp, S. pombe
atatcgctgcgtattgtgcctccaa

SEQ ID NO: 65114 - DNA, 25 bp, S. pombe
atatgagctcttctgttcctcaaga

SEQ ID NO: 65115 - DNA, 25 bp, S. pombe
atatcactatggctttttgggctat

SEQ ID NO: 65116 - DNA, 25 bp, S. pombe
atagctgggcaggtattcctttgcg

SEQ ID NO: 65117 - DNA, 25 bp, S. pombe
atagtgttggcgaaaagcgtatctc

SEQ ID NO: 65118 - DNA, 25 bp, S. pombe
atactttctccaacataggtacttg

SEQ ID NO: 65119 - DNA, 25 bp, S. pombe
atacgatttccctaacgatcacggc

SEQ ID NO: 65120 - DNA, 25 bp, S. pombe
atatgggtggccgattagtcaagtc

SEQ ID NO: 65121 - DNA, 25 bp, S. pombe
atatgggagtgcgtttagtagtaca

SEQ ID NO: 65122 - DNA, 25 bp, S. pombe
atagctcggacgattcagtcgacaa

SEQ ID NO: 65123 - DNA, 25 bp, S. pombe
atccgccgacgtttgaaggcaccaa

SEQ ID NO: 65124 - DNA, 25 bp, S. pombe
atgggacggcacttttactcctaat

SEQ ID NO: 65125 - DNA, 25 bp, S. pombe
ataggagcggattttcttaccaaag

SEQ ID NO: 65126 - DNA, 25 bp, S. pombe
aggaaagggtatcgcttcttccgct

SEQ ID NO: 65127 - DNA, 25 bp, S. pombe
atgttcaaacgagtgggtcttccct

SEQ ID NO: 65128 - DNA, 25 bp, S. pombe
atgttatcaacgtgaccacttccgt

SEQ ID NO: 65129 - DNA, 25 bp, S. pombe
agtcttcaaaaatcaccttccacca

SEQ ID NO: 65130 - DNA, 25 bp, S. pombe
atacttgaaaacagcccttgtccca

SEQ ID NO: 65131 - DNA, 25 bp, S. pombe
atatctcttatggaaggactttcaa

SEQ ID NO: 65132 - DNA, 25 bp, S. pombe
atatgtttcttgtggacctatcagt

SEQ ID NO: 65133 - DNA, 25 bp, S. pombe
atagctggtctgatcctacggtatt

SEQ ID NO: 65134 - DNA, 25 bp, S. pombe
atatctcagttttctctacctgtat

SEQ ID NO: 65135 - DNA, 25 bp, S. pombe
atatcccttctctttatggcactat

SEQ ID NO: 65136 - DNA, 25 bp, S. pombe
atatccgatgtttccagcgccattt

SEQ ID NO: 65137 - DNA, 25 bp, S. pombe
atatctgttgttttcggtcatggca

SEQ ID NO: 65138 - DNA, 25 bp, S. pombe
atatgcttcgtgaaacggccagtga

SEQ ID NO: 65139 - DNA, 25 bp, S. pombe
atatctctggtgctaagccctggat

SEQ ID NO: 65140 - DNA, 25 bp, S. pombe
atatcgcgcgtttcatcaatcattc

SEQ ID NO: 65141 - DNA, 25 bp, S. pombe
atatccgggatatcaacttctctca

SEQ ID NO: 65142 - DNA, 25 bp, S. pombe
atatctttgcgaaacaggccttggc

SEQ ID NO: 65143 - DNA, 25 bp, S. pombe
atatcggtcagtcaagccctagagc

SEQ ID NO: 65144 - DNA, 25 bp, S. pombe
atatgccactgacatttcattccct

SEQ ID NO: 65145 - DNA, 25 bp, S. pombe
atatcgagcagtccattgtatacca

SEQ ID NO: 65146 - DNA, 25 bp, S. pombe
atatgggatgcttgttcgagagacc

SEQ ID NO: 65147 - DNA, 25 bp, S. pombe
atatgatactgctgccatgggtgaa

SEQ ID NO: 65148 - DNA, 25 bp, S. pombe
ataggactttcgtctcgtgatgaaa

SEQ ID NO: 65149 - DNA, 25 bp, S. pombe
atatcgtcttccgtcttgctatgaa

SEQ ID NO: 65150 - DNA, 25 bp, S. pombe
atatgattcttctgatcctgcttgg

SEQ ID NO: 65151 - DNA, 25 bp, S. pombe
atagtgctgcagtccttgaatattt

SEQ ID NO: 65152 - DNA, 25 bp, S. pombe
atatgatgctcctcaataccgttat

SEQ ID NO: 65153 - DNA, 25 bp, S. pombe
atatctctccattttaccgctttaa

SEQ ID NO: 65154 - DNA, 25 bp, S. pombe
atatcctatctgtcagcaagccgga

SEQ ID NO: 65155 - DNA, 25 bp, S. pombe
atatcgttctgttcaaccactgact

SEQ ID NO: 65156 - DNA, 25 bp, S. pombe
atatggaatccttacacgcagccct

SEQ ID NO: 65157 - DNA, 25 bp, S. pombe
atagattttgaaagaaggcgtcgtc

SEQ ID NO: 65158 - DNA, 25 bp, S. pombe
atactgtgatgattgcccgaggtgc

SEQ ID NO: 65159 - DNA, 25 bp, S. pombe
atactggtaatgtccgtggtggtta

SEQ ID NO: 65160 - DNA, 25 bp, S. pombe
atatgctcgtactcgccagaatttg

SEQ ID NO: 65161 - DNA, 25 bp, S. pombe
atatgctcaaacgtgctcaaatttt

SEQ ID NO: 65162 - DNA, 25 bp, S. pombe
atatgtccacatagtctctcttttc

SEQ ID NO: 65163 - DNA, 25 bp, S. pombe
atatgtgcacactcccttagtttac

SEQ ID NO: 65164 - DNA, 25 bp, S. pombe
atatgtgcaccttttcgtactgcag

SEQ ID NO: 65165 - DNA, 25 bp, S. pombe
atatgctgaattgcctacttatcga

SEQ ID NO: 65166 - DNA, 25 bp, S. pombe
atatgcctatatgcgtgaccttcag

SEQ ID NO: 65167 - DNA, 25 bp, S. pombe
atatgatcgtcctttggagccaaca

SEQ ID NO: 65168 - DNA, 25 bp, S. pombe
atatgactaccacttgggccatggc

SEQ ID NO: 65169 - DNA, 25 bp, S. pombe
atagtgctccgacttggatgcttgc

SEQ ID NO: 65170 - DNA, 25 bp, S. pombe
atatgtttgcaacttctggcattgt

SEQ ID NO: 65171 - DNA, 25 bp, S. pombe
atagttatcatccttctgtcgagag

SEQ ID NO: 65172 - DNA, 25 bp, S. pombe
atagtccatcatctccgggatattc

SEQ ID NO: 65173 - DNA, 25 bp, S. pombe
atatgcgttcagttcgtgcggaaaa

SEQ ID NO: 65174 - DNA, 25 bp, S. pombe
ataggatacacattgcccacgaaga

SEQ ID NO: 65175 - DNA, 25 bp, S. pombe
atagagttggtcgtaccgctcgagc

SEQ ID NO: 65176 - DNA, 25 bp, S. pombe
ataggtgtcgatccttccacaaaag

SEQ ID NO: 65177 - DNA, 25 bp, S. pombe
atatgttaccatgctttcacaagaa

SEQ ID NO: 65178 - DNA, 25 bp, S. pombe
atatggtcgccaagtttgaagcagg

SEQ ID NO: 65179 - DNA, 25 bp, S. pombe
atatggctcgccagctttgaatatg

SEQ ID NO: 65180 - DNA, 25 bp, S. pombe
atatgcgccttgctgctattgaaca

SEQ ID NO: 65181 - DNA, 25 bp, S. pombe
atatgcttcgtgcagcgcattggat

SEQ ID NO: 65182 - DNA, 25 bp, S. pombe
atatccctgaatctcaagtccttga

SEQ ID NO: 65183 - DNA, 25 bp, S. pombe
atatccctgacaagtatcgtcgtgt

SEQ ID NO: 65184 - DNA, 25 bp, S. pombe
atagcagccgaacctaactcagtac

SEQ ID NO: 65185 - DNA, 25 bp, S. pombe
atatgaagcttactctcgtccagaa

SEQ ID NO: 65186 - DNA, 25 bp, S. pombe
atatgaattctctgctggtccatta

SEQ ID NO: 65187 - DNA, 25 bp, S. pombe
atatgcattattcggctgttccagt

SEQ ID NO: 65188 - DNA, 25 bp, S. pombe
atatccaatatcctgctgttacacc

SEQ ID NO: 65189 - DNA, 25 bp, S. pombe
atatgcgctgttactcgtacaaccg

SEQ ID NO: 65190 - DNA, 25 bp, S. pombe
atagctccatccaaattattcgaag

SEQ ID NO: 65191 - DNA, 25 bp, S. pombe
atactcgaccgtgctattcagatga

SEQ ID NO: 65192 - DNA, 25 bp, S. pombe
atatccgacatattgactggctcgt

SEQ ID NO: 65193 - DNA, 25 bp, S. pombe
atatccgcaacattgatccttttgg

SEQ ID NO: 65194 - DNA, 25 bp, S. pombe
atatgcggtgcctttgttctagcag

SEQ ID NO: 65195 - DNA, 25 bp, S. pombe
atagttcttcatattctcgtcacct

SEQ ID NO: 65196 - DNA, 25 bp, S. pombe
atagaaatggaaatcccctccctgg

SEQ ID NO: 65197 - DNA, 25 bp, S. pombe
atatggaaagcagttcacccaccct

SEQ ID NO: 65198 - DNA, 25 bp, S. pombe
atagctgctctagaaacgtatacaa

SEQ ID NO: 65199 - DNA, 25 bp, S. pombe
atagttccctaaatgcttacagcaa

SEQ ID NO: 65200 - DNA, 25 bp, S. pombe
atagcaacccatttagttccacact

SEQ ID NO: 65201 - DNA, 25 bp, S. pombe
atatgaaccgtgctgaggaccttat

SEQ ID NO: 65202 - DNA, 25 bp, S. pombe
atatgcacaccgatgcggctgaagc

SEQ ID NO: 65203 - DNA, 25 bp, S. pombe
atactacgttgatcgcattacccag

SEQ ID NO: 65204 - DNA, 25 bp, S. pombe
atatcccacttttagttctcgtgca

SEQ ID NO: 65205 - DNA, 25 bp, S. pombe
atatcctccttattagttactgcga

SEQ ID NO: 65206 - DNA, 25 bp, S. pombe
atatgccccatcaattccgttatat

SEQ ID NO: 65207 - DNA, 25 bp, S. pombe
atatccaccacatttgctgttctat

SEQ ID NO: 65208 - DNA, 25 bp, S. pombe
atactgggatgcacctttgtccttg

SEQ ID NO: 65209 - DNA, 25 bp, S. pombe
atagctgccgtaggtgcttttcgtc

SEQ ID NO: 65210 - DNA, 25 bp, S. pombe
atagcagcggtcgtagtaattatcg

SEQ ID NO: 65211 - DNA, 25 bp, S. pombe
atagtgttcccgtttatgcccatac

SEQ ID NO: 65212 - DNA, 25 bp, S. pombe
ataccattggaatcttcaccgtcag

SEQ ID NO: 65213 - DNA, 25 bp, S. pombe
atagcctacgaaggttttggcaaat

SEQ ID NO: 65214 - DNA, 25 bp, S. pombe
atatccttcgtagctctttggagca

SEQ ID NO: 65215 - DNA, 25 bp, S. pombe
atacctcctgttcatcgtaaacatc

SEQ ID NO: 65216 - DNA, 25 bp, S. pombe
atccgtccaggccaagaggttagtg

SEQ ID NO: 65217 - DNA, 25 bp, S. pombe
atatcctcgcccaaatgtttttaag

SEQ ID NO: 65218 - DNA, 25 bp, S. pombe
atatcctcccattaatgttttgccc

SEQ ID NO: 65219 - DNA, 25 bp, S. pombe
atatccataccgaactgtcattctc

SEQ ID NO: 65220 - DNA, 25 bp, S. pombe
atatcctttatgttgctcttacgcg

SEQ ID NO: 65221 - DNA, 25 bp, S. pombe
atatccttgtgattctttctttccc

SEQ ID NO: 65222 - DNA, 25 bp, S. pombe
atatccttggtttatttgcttctcc

SEQ ID NO: 65223 - DNA, 25 bp, S. pombe
atatccacctggctatatgtgttac

SEQ ID NO: 65224 - DNA, 25 bp, S. pombe
atatgccttttgcaagcgtcttacc

SEQ ID NO: 65225 - DNA, 25 bp, S. pombe
atatggcttctcgtgttcgcattta

SEQ ID NO: 65226 - DNA, 25 bp, S. pombe
atatggtctctgctgtaggtggaac

SEQ ID NO: 65227 - DNA, 25 bp, S. pombe
atatgcgttatactgtagcttccaa

SEQ ID NO: 65228 - DNA, 25 bp, S. pombe
ataggctttacgaatctctcagaga

SEQ ID NO: 65229 - DNA, 25 bp, S. pombe
ataggtggttcgctgccatcaataa

SEQ ID NO: 65230 - DNA, 25 bp, S. pombe
ataggtgtgtttcgtgagctcatca

SEQ ID NO: 65231 - DNA, 25 bp, S. pombe
atagggttcgtggaggctcttcgat

SEQ ID NO: 65232 - DNA, 25 bp, S. pombe
atatgttgatgcttgacccactgtt

SEQ ID NO: 65233 - DNA, 25 bp, S. pombe
ataggtcatgttgccaagcttttcg

SEQ ID NO: 65234 - DNA, 25 bp, S. pombe
atagtaggcctgtccaaccattgtt

SEQ ID NO: 65235 - DNA, 25 bp, S. pombe
atagatcggctttccaacggttgtg

SEQ ID NO: 65236 - DNA, 25 bp, S. pombe
atagcagttcctaatgtctccaacg

SEQ ID NO: 65237 - DNA, 25 bp, S. pombe
ataggtcctgaactacgcatgcgaa

SEQ ID NO: 65238 - DNA, 25 bp, S. pombe
atagtgcccgaccacatagcggata

SEQ ID NO: 65239 - DNA, 25 bp, S. pombe
atgctccgcccattaaagccgaaag

SEQ ID NO: 65240 - DNA, 25 bp, S. pombe
actccggttattatgtcgaaagcgt

SEQ ID NO: 65241 - DNA, 25 bp, S. pombe
ataggcgtgttactcttggagcctt

SEQ ID NO: 65242 - DNA, 25 bp, S. pombe
atagtcgcttcaattgttatgcaca

SEQ ID NO: 65243 - DNA, 25 bp, S. pombe
atagtggatgttctgcttctgcaat

SEQ ID NO: 65244 - DNA, 25 bp, S. pombe
atagagggccttattcatgatgctt

SEQ ID NO: 65245 - DNA, 25 bp, S. pombe
atatgtgctgcatttaaccgatgag

SEQ ID NO: 65246 - DNA, 25 bp, S. pombe
atagatgtctgaagtcgctcgagtc

SEQ ID NO: 65247 - DNA, 25 bp, S. pombe
atatgttgcatcactgggccatttt

SEQ ID NO: 65248 - DNA, 25 bp, S. pombe
atatgtctgctagtttggctgctca

SEQ ID NO: 65249 - DNA, 25 bp, S. pombe
atagcccagcttttgatgattcaag

SEQ ID NO: 65250 - DNA, 25 bp, S. pombe
atatgcagctgccacccgataatga

SEQ ID NO: 65251 - DNA, 25 bp, S. pombe
ataggctctgccgtattaggatgga

SEQ ID NO: 65252 - DNA, 25 bp, S. pombe
ataggtatattttctcatggtgcga

SEQ ID NO: 65253 - DNA, 25 bp, S. pombe
atatgtgttcagcttctctaggtga

SEQ ID NO: 65254 - DNA, 25 bp, S. pombe
atatgtttggtcagccacaggcgat

SEQ ID NO: 65255 - DNA, 25 bp, S. pombe
atatgtttgtttgtccaccagaaga

SEQ ID NO: 65256 - DNA, 25 bp, S. pombe
atatgcatctggatctgttcccgcg

SEQ ID NO: 65257 - DNA, 25 bp, S. pombe
atagctcggaaagtttacggacacg

SEQ ID NO: 65258 - DNA, 25 bp, S. pombe
atactgctgctaaactttaccgacc

SEQ ID NO: 65259 - DNA, 25 bp, S. pombe
ataccgctatgatccttactcacat

SEQ ID NO: 65260 - DNA, 25 bp, S. pombe
atagcgatcctctcgatgtttgtga

SEQ ID NO: 65261 - DNA, 25 bp, S. pombe
atacccctacaaaccaaagtcgcag

SEQ ID NO: 65262 - DNA, 25 bp, S. pombe
atagcgctttgcaacgagtatattc

SEQ ID NO: 65263 - DNA, 25 bp, S. pombe
atagcctgcttcatacgttttctta

SEQ ID NO: 65264 - DNA, 25 bp, S. pombe
atagcttttgctgagtttccattta

SEQ ID NO: 65265 - DNA, 25 bp, S. pombe
atagttaatggtcctgctgctcctt

SEQ ID NO: 65266 - DNA, 25 bp, S. pombe
atatgatctcgacgctaaggctcct

SEQ ID NO: 65267 - DNA, 25 bp, S. pombe
atatggctagtgctaatggacacat

SEQ ID NO: 65268 - DNA, 25 bp, S. pombe
atagtaacgttgtcatggcggacta

SEQ ID NO: 65269 - DNA, 25 bp, S. pombe
atagactacggttcacaggtggata

SEQ ID NO: 65270 - DNA, 25 bp, S. pombe
atagcggctcggattcggaagatga

SEQ ID NO: 65271 - DNA, 25 bp, S. pombe
atatggacgggcttcctcaacaatc

SEQ ID NO: 65272 - DNA, 25 bp, S. pombe
atatggtcgtttgccgatccaacaa

SEQ ID NO: 65273 - DNA, 25 bp, S. pombe
atagccgcatcgaaatgccgccaaa

SEQ ID NO: 65274 - DNA, 25 bp, S. pombe
ataggatattctcatgctcctcttc

SEQ ID NO: 65275 - DNA, 25 bp, S. pombe
atagcaatgattgtggtcctttcat

SEQ ID NO: 65276 - DNA, 25 bp, S. pombe
atagtaattgcttggtctgtttctc

SEQ ID NO: 65277 - DNA, 25 bp, S. pombe
atagtgttcggattggccagtctac

SEQ ID NO: 65278 - DNA, 25 bp, S. pombe
atatgtgtcgcgtcaagccgaatct

SEQ ID NO: 65279 - DNA, 25 bp, S. pombe
ataccaacggttgtacctctgctgg

SEQ ID NO: 65280 - DNA, 25 bp, S. pombe
atacttacggttaatcaggtctttg

SEQ ID NO: 65281 - DNA, 25 bp, S. pombe
atagctgttgcgtctgtaaccggtt

SEQ ID NO: 65282 - DNA, 25 bp, S. pombe
atacccttgaagtttgtttctcagc

SEQ ID NO: 65283 - DNA, 25 bp, S. pombe
atacgtatttagatgtttgtacaca

SEQ ID NO: 65284 - DNA, 25 bp, S. pombe
atacgattccaagctttctgaacat

SEQ ID NO: 65285 - DNA, 25 bp, S. pombe
atagcgattccatactttactgaga

SEQ ID NO: 65286 - DNA, 25 bp, S. pombe
atagctattcttctcttctacgata

SEQ ID NO: 65287 - DNA, 25 bp, S. pombe
atatgggtcctcattatccacgagt

SEQ ID NO: 65288 - DNA, 25 bp, S. pombe
atacggctcctcatcttaaagttgt

SEQ ID NO: 65289 - DNA, 25 bp, S. pombe
atacgcttcacgcttctacaaattt

SEQ ID NO: 65290 - DNA, 25 bp, S. pombe
atacccgtcggtgctacaaatgttg

SEQ ID NO: 65291 - DNA, 25 bp, S. pombe
atacccgttagagctgattcgtgtt

SEQ ID NO: 65292 - DNA, 25 bp, S. pombe
atagactgtattttcccaactggac

SEQ ID NO: 65293 - DNA, 25 bp, S. pombe
atatgtctcattacgctccaaagga

SEQ ID NO: 65294 - DNA, 25 bp, S. pombe
atagtgctccttcgcttagacatgg

SEQ ID NO: 65295 - DNA, 25 bp, S. pombe
atatggctgttcttttgatttcccc

SEQ ID NO: 65296 - DNA, 25 bp, S. pombe
atatggttccctagagtgccttgac

SEQ ID NO: 65297 - DNA, 25 bp, S. pombe
ataggcgtagcagaatttcgcttac

SEQ ID NO: 65298 - DNA, 25 bp, S. pombe
ataggagtacatgttgccatcgcat

SEQ ID NO: 65299 - DNA, 25 bp, S. pombe
atagttcgcaaagttgtccagcaga

SEQ ID NO: 65300 - DNA, 25 bp, S. pombe
atacctaccctttggagctggtcgt

SEQ ID NO: 65301 - DNA, 25 bp, S. pombe
ataccgtaacttaccctggtcatga

SEQ ID NO: 65302 - DNA, 25 bp, S. pombe
atactcatgttaccgccattacagt

SEQ ID NO: 65303 - DNA, 25 bp, S. pombe
atacttgtatcacacctaactgctc

SEQ ID NO: 65304 - DNA, 25 bp, S. pombe
ataccggtgcatcttctgaatccaa

SEQ ID NO: 65305 - DNA, 25 bp, S. pombe
atacctggcagcaagggcgaggcta

SEQ ID NO: 65306 - DNA, 25 bp, S. pombe
ataccgacttccttgattgccagaa

SEQ ID NO: 65307 - DNA, 25 bp, S. pombe
atagcactacttcatacattccaac

SEQ ID NO: 65308 - DNA, 25 bp, S. pombe
ataggccatctaattatcggtctca

SEQ ID NO: 65309 - DNA, 25 bp, S. pombe
atagaggcagctgtcttcagatgct

SEQ ID NO: 65310 - DNA, 25 bp, S. pombe
atagatgctcatgctctttggcact

SEQ ID NO: 65311 - DNA, 25 bp, S. pombe
ataggccttatctttggcagtcaag

SEQ ID NO: 65312 - DNA, 25 bp, S. pombe
atacccaatctgagcaggaggctgc

SEQ ID NO: 65313 - DNA, 25 bp, S. pombe
ataccctcagttggtaggccgtgga

SEQ ID NO: 65314 - DNA, 25 bp, S. pombe
ataccccatgtggaaatgagacttg

SEQ ID NO: 65315 - DNA, 25 bp, S. pombe
atagaacctggtttacctgcgtcgg

SEQ ID NO: 65316 - DNA, 25 bp, S. pombe
atactatccccacgttgatgacgat

SEQ ID NO: 65317 - DNA, 25 bp, S. pombe
atagccgaggatttgttcgacaccg

SEQ ID NO: 65318 - DNA, 25 bp, S. pombe
atagtcttggattctgtggagctca

SEQ ID NO: 65319 - DNA, 25 bp, S. pombe
ataggcatcggtattgtcgcatctc

SEQ ID NO: 65320 - DNA, 25 bp, S. pombe
ataccatcggtgttcgtggccctaa

SEQ ID NO: 65321 - DNA, 25 bp, S. pombe
ataggtacattgttttggagcccaa

SEQ ID NO: 65322 - DNA, 25 bp, S. pombe
atagccaacctttatcgatttcgga

SEQ ID NO: 65323 - DNA, 25 bp, S. pombe
atagtaacttcttggctgttcccag

SEQ ID NO: 65324 - DNA, 25 bp, S. pombe
atactgactcggaggatcttccaag

SEQ ID NO: 65325 - DNA, 25 bp, S. pombe
atactgctttggaggtttgccctga

SEQ ID NO: 65326 - DNA, 25 bp, S. pombe
atagttggtattttctgcgctggcc

SEQ ID NO: 65327 - DNA, 25 bp, S. pombe
atagtcatcctgttgaggctgcttc

SEQ ID NO: 65328 - DNA, 25 bp, S. pombe
atagtcatctctcatgcaggagccg

SEQ ID NO: 65329 - DNA, 25 bp, S. pombe
atagtggaccatcacatccttacgc

SEQ ID NO: 65330 - DNA, 25 bp, S. pombe
atagacgagcaatccattttgacgc

SEQ ID NO: 65331 - DNA, 25 bp, S. pombe
atagagtagctattgttattgaaca

SEQ ID NO: 65332 - DNA, 25 bp, S. pombe
atgagcgtactgctgttgttaacgt

SEQ ID NO: 65333 - DNA, 25 bp, S. pombe
ataccgcgatcatcttttaaaccag

SEQ ID NO: 65334 - DNA, 25 bp, S. pombe
atacggaattccactgtcacaaatg

SEQ ID NO: 65335 - DNA, 25 bp, S. pombe
atagggcaacactcttcgcgatcaa

SEQ ID NO: 65336 - DNA, 25 bp, S. pombe
atagctacggcctcttcaaatgcaa

SEQ ID NO: 65337 - DNA, 25 bp, S. pombe
ataccactggatcacattttatgca

SEQ ID NO: 65338 - DNA, 25 bp, S. pombe
ataccttcaggccagcgattatatc

SEQ ID NO: 65339 - DNA, 25 bp, S. pombe
atacgttccagatgtcctctatcga

SEQ ID NO: 65340 - DNA, 25 bp, S. pombe
ataggtctcgaggactctatctata

SEQ ID NO: 65341 - DNA, 25 bp, S. pombe
atagtgatcgtgctcgcgctttata

SEQ ID NO: 65342 - DNA, 25 bp, S. pombe
atagagacggatccgcggtcacagc

SEQ ID NO: 65343 - DNA, 25 bp, S. pombe
atagaacagaatccgccgtacgttt

SEQ ID NO: 65344 - DNA, 25 bp, S. pombe
ataaagaacctcctgcatcaactgt

SEQ ID NO: 65345 - DNA, 25 bp, S. pombe
atagtgcacaactgcctcttgttag

SEQ ID NO: 65346 - DNA, 25 bp, S. pombe
atagctcgagacttccttcttgaat

SEQ ID NO: 65347 - DNA, 25 bp, S. pombe
atagccaagacactgctgtccatag

SEQ ID NO: 65348 - DNA, 25 bp, S. pombe
atagtcatccatgcctatctgaaga

SEQ ID NO: 65349 - DNA, 25 bp, S. pombe
atagtcatatgcttggtttaccttc

SEQ ID NO: 65350 - DNA, 25 bp, S. pombe
atcgtctcattaaggaaatcgggcc

SEQ ID NO: 65351 - DNA, 25 bp, S. pombe
atagctgtgtctgatttcgtcgcaa

SEQ ID NO: 65352 - DNA, 25 bp, S. pombe
atagcggatctcgattttttcagaa

SEQ ID NO: 65353 - DNA, 25 bp, S. pombe
atacattcaccaaagtggcccgtac

SEQ ID NO: 65354 - DNA, 25 bp, S. pombe
atactcccgactgctggatcatgta

SEQ ID NO: 65355 - DNA, 25 bp, S. pombe
ataccaatgggtttgatgctcatgt

SEQ ID NO: 65356 - DNA, 25 bp, S. pombe
atacgttggatccttacctcaatac

SEQ ID NO: 65357 - DNA, 25 bp, S. pombe
atagatccaacgtttcctgattcgg

SEQ ID NO: 65358 - DNA, 25 bp, S. pombe
atacgacaagcgcttctaaccaaaa

SEQ ID NO: 65359 - DNA, 25 bp, S. pombe
atcacaaatcctcttctagaccaat

SEQ ID NO: 65360 - DNA, 25 bp, S. pombe
atgccaagttggtgtcagcccattg

SEQ ID NO: 65361 - DNA, 25 bp, S. pombe
ataatgattgcggacgtcgcccttg

SEQ ID NO: 65362 - DNA, 25 bp, S. pombe
atgggcctttacatgggtttcctct

SEQ ID NO: 65363 - DNA, 25 bp, S. pombe
atactgactattcttggcgtttcct

SEQ ID NO: 65364 - DNA, 25 bp, S. pombe
atagtgctgcatctcatttccggta

SEQ ID NO: 65365 - DNA, 25 bp, S. pombe
atagctgcctttattgcccatgtaa

SEQ ID NO: 65366 - DNA, 25 bp, S. pombe
atagccctttttagagtcatatttg

SEQ ID NO: 65367 - DNA, 25 bp, S. pombe
ataccttatttcaatgcccctattt

SEQ ID NO: 65368 - DNA, 25 bp, S. pombe
ataactgctggtctaacttttctag

SEQ ID NO: 65369 - DNA, 25 bp, S. pombe
atagccctgattcaatttctcgtaa

SEQ ID NO: 65370 - DNA, 25 bp, S. pombe
atagacgattctcagcattttcctc

SEQ ID NO: 65371 - DNA, 25 bp, S. pombe
atagcaaaggttcatctcgccggaa

SEQ ID NO: 65372 - DNA, 25 bp, S. pombe
ataaaggcgcttggtccgagctgga

SEQ ID NO: 65373 - DNA, 25 bp, S. pombe
atacatctacagctactgttgccgc

SEQ ID NO: 65374 - DNA, 25 bp, S. pombe
ataagagtggtgcaggtatccccgc

SEQ ID NO: 65375 - DNA, 25 bp, S. pombe
atacgatcatcatctcggcggaatc

SEQ ID NO: 65376 - DNA, 25 bp, S. pombe
atagctgtcatagttgcgggtcaaa

SEQ ID NO: 65377 - DNA, 25 bp, S. pombe
atagctgctgcatttcgacatggtg

SEQ ID NO: 65378 - DNA, 25 bp, S. pombe
atagcattggatctgcgcctctaat

SEQ ID NO: 65379 - DNA, 25 bp, S. pombe
atactctgcgagttgctggatctga

SEQ ID NO: 65380 - DNA, 25 bp, S. pombe
atactgaggttgctcgagcctactg

SEQ ID NO: 65381 - DNA, 25 bp, S. pombe
atacgaacggtttgtgcctttctgt

SEQ ID NO: 65382 - DNA, 25 bp, S. pombe
atcaagcaaaggctggtcccctatt

SEQ ID NO: 65383 - DNA, 25 bp, S. pombe
atagcaataaggtactgcgttcaaa

SEQ ID NO: 65384 - DNA, 25 bp, S. pombe
ataccaattctgtcactggctctac

SEQ ID NO: 65385 - DNA, 25 bp, S. pombe
atagatgacattctccggtctagaa

SEQ ID NO: 65386 - DNA, 25 bp, S. pombe
atagatgctttttctcaggatccaa

SEQ ID NO: 65387 - DNA, 25 bp, S. pombe
atagcagcgcttcttcagaatcctt

SEQ ID NO: 65388 - DNA, 25 bp, S. pombe
atagcggctctctttgaacgtttat

SEQ ID NO: 65389 - DNA, 25 bp, S. pombe
atagcggctttatagacgttgtctt

SEQ ID NO: 65390 - DNA, 25 bp, S. pombe
ataccgatacttgcatgtactactg

SEQ ID NO: 65391 - DNA, 25 bp, S. pombe
ataacgtcgctaacttactgtctca

SEQ ID NO: 65392 - DNA, 25 bp, S. pombe
atagagaactccttcttcactgttc

SEQ ID NO: 65393 - DNA, 25 bp, S. pombe
atagcaccaatgtttcgcgcaccat

SEQ ID NO: 65394 - DNA, 25 bp, S. pombe
atagacttgtaatgacctgtcataa

SEQ ID NO: 65395 - DNA, 25 bp, S. pombe
atacacttattttggcctggtcttc

SEQ ID NO: 65396 - DNA, 25 bp, S. pombe
atacctattatacggcctggtctag

SEQ ID NO: 65397 - DNA, 25 bp, S. pombe
ataactattgtacagccaggtggca

SEQ ID NO: 65398 - DNA, 25 bp, S. pombe
ataattccgggatgtcagagttgaa

SEQ ID NO: 65399 - DNA, 25 bp, S. pombe
atagttctcgtttcattcctcttaa

SEQ ID NO: 65400 - DNA, 25 bp, S. pombe
atagtttgtgcattcgttcccttaa

SEQ ID NO: 65401 - DNA, 25 bp, S. pombe
atagttgctaattcagttgccctta

SEQ ID NO: 65402 - DNA, 25 bp, S. pombe
atagcttctgaaggacggtccatta

SEQ ID NO: 65403 - DNA, 25 bp, S. pombe
atcaatttgcccgaacctggaataa

SEQ ID NO: 65404 - DNA, 25 bp, S. pombe
ataccccaacgcttcatggaacaga

SEQ ID NO: 65405 - DNA, 25 bp, S. pombe
atacgtacgagactgcagcggttta

SEQ ID NO: 65406 - DNA, 25 bp, S. pombe
atactctacaatggtctgcggtctt

SEQ ID NO: 65407 - DNA, 25 bp, S. pombe
atacttcaaatgttatggcactttc

SEQ ID NO: 65408 - DNA, 25 bp, S. pombe
atactcttggattctatccctgttc

SEQ ID NO: 65409 - DNA, 25 bp, S. pombe
ataattatgccattgctgctgctcg

SEQ ID NO: 65410 - DNA, 25 bp, S. pombe
atacgctaatgacggccttcagtgg

SEQ ID NO: 65411 - DNA, 25 bp, S. pombe
atacccttcttactgaactggacgg

SEQ ID NO: 65412 - DNA, 25 bp, S. pombe
atagccgtaatggttcgcatgctgc

SEQ ID NO: 65413 - DNA, 25 bp, S. pombe
atagccgtcgacgttctacggattt

SEQ ID NO: 65414 - DNA, 25 bp, S. pombe
atagcatccgtattgcaaaccgcct

SEQ ID NO: 65415 - DNA, 25 bp, S. pombe
atagccgctgctttaacaactccat

SEQ ID NO: 65416 - DNA, 25 bp, S. pombe
atagaaagtcattcttccggccaag

SEQ ID NO: 65417 - DNA, 25 bp, S. pombe
atacgaacagttattgcaggcgagg

SEQ ID NO: 65418 - DNA, 25 bp, S. pombe
atacggtcaatttctttgggctcat

SEQ ID NO: 65419 - DNA, 25 bp, S. pombe
aggcgcgtaatcacttttacacatt

SEQ ID NO: 65420 - DNA, 25 bp, S. pombe
atggcccggtgtctttatcaagttt

SEQ ID NO: 65421 - DNA, 25 bp, S. pombe
ataccacggtggagtctgacaacgt

SEQ ID NO: 65422 - DNA, 25 bp, S. pombe
atagccatcctattgctgcaaaata

SEQ ID NO: 65423 - DNA, 25 bp, S. pombe
atagctctgcgcgatatggataaaa

SEQ ID NO: 65424 - DNA, 25 bp, S. pombe
atactcatgggcttggtgctaaaca

SEQ ID NO: 65425 - DNA, 25 bp, S. pombe
ataccttctcgatggcattactcaa

SEQ ID NO: 65426 - DNA, 25 bp, S. pombe
atacggtgactatatgccatccttc

SEQ ID NO: 65427 - DNA, 25 bp, S. pombe
atacttgtcctctcgtatggttaac

SEQ ID NO: 65428 - DNA, 25 bp, S. pombe
atacgctggaactcgtctgctgtat

SEQ ID NO: 65429 - DNA, 25 bp, S. pombe
ataacggacacatcggagcttacag

SEQ ID NO: 65430 - DNA, 25 bp, S. pombe
atactactgctgtctcggcgaatat

SEQ ID NO: 65431 - DNA, 25 bp, S. pombe
ataccattgcttgaggtgaatccta

SEQ ID NO: 65432 - DNA, 25 bp, S. pombe
atgccgctggcaaaaggtttcgctt

SEQ ID NO: 65433 - DNA, 25 bp, S. pombe
atactgttgacaatggtgcctcagc

SEQ ID NO: 65434 - DNA, 25 bp, S. pombe
atagctctccaaatttactcgggta

SEQ ID NO: 65435 - DNA, 25 bp, S. pombe
atacatctcctaacttacttcgagt

SEQ ID NO: 65436 - DNA, 25 bp, S. pombe
atagcctccgagtattagcaccaaa

SEQ ID NO: 65437 - DNA, 25 bp, S. pombe
atactcgataatgacaacctcgatg

SEQ ID NO: 65438 - DNA, 25 bp, S. pombe
atactggtactggaaatcccatcga

SEQ ID NO: 65439 - DNA, 25 bp, S. pombe
atacttccgcatgatagctcagctg

SEQ ID NO: 65440 - DNA, 25 bp, S. pombe
atacctctcatacttgattcgtttg

SEQ ID NO: 65441 - DNA, 25 bp, S. pombe
atagcaattcgtggtcttgttctcc

SEQ ID NO: 65442 - DNA, 25 bp, S. pombe
atagctgttgctggtatcattgttt

SEQ ID NO: 65443 - DNA, 25 bp, S. pombe
atagccgattgggatactgatttac

SEQ ID NO: 65444 - DNA, 25 bp, S. pombe
atacgcgagctgacatgaacgatat

SEQ ID NO: 65445 - DNA, 25 bp, S. pombe
atagcagctatggttggaatcttat

SEQ ID NO: 65446 - DNA, 25 bp, S. pombe
atacgtttctgagagccattctgaa

SEQ ID NO: 65447 - DNA, 25 bp, S. pombe
atagcgttctctgtactctgaatga

SEQ ID NO: 65448 - DNA, 25 bp, S. pombe
atacgtgtccatgtcaactggtatt

SEQ ID NO: 65449 - DNA, 25 bp, S. pombe
ataccattcctcgtaatccttattg

SEQ ID NO: 65450 - DNA, 25 bp, S. pombe
ataagcgtcctttggtgacccgtgg

SEQ ID NO: 65451 - DNA, 25 bp, S. pombe
ataattataactatccccagccttc

SEQ ID NO: 65452 - DNA, 25 bp, S. pombe
ataaagactagttccggcggcacct

SEQ ID NO: 65453 - DNA, 25 bp, S. pombe
accaagaaggtaaaagcggcatgtt

SEQ ID NO: 65454 - DNA, 25 bp, S. pombe
atacgagtatcttcgtcgttcgctc

SEQ ID NO: 65455 - DNA, 25 bp, S. pombe
atacaatttatgtcgatcccacctc

SEQ ID NO: 65456 - DNA, 25 bp, S. pombe
ataaagttgagcgtgctgtcggcct

SEQ ID NO: 65457 - DNA, 25 bp, S. pombe
atcatgtggaatcagcggtacgcaa

SEQ ID NO: 65458 - DNA, 25 bp, S. pombe
atactctttcaagggcagaacgccg

SEQ ID NO: 65459 - DNA, 25 bp, S. pombe
atactttgattcaggcgactatgcc

SEQ ID NO: 65460 - DNA, 25 bp, S. pombe
atacccctttgtacttggatgccaa

SEQ ID NO: 65461 - DNA, 25 bp, S. pombe
atgaaacgtatccaacgcggtcctg

SEQ ID NO: 65462 - DNA, 25 bp, S. pombe
atacattccatggtcgattcgtaat

SEQ ID NO: 65463 - DNA, 25 bp, S. pombe
atactcccagtgacgattattcgat

SEQ ID NO: 65464 - DNA, 25 bp, S. pombe
atacgaatccaaacgctgagcaggg

SEQ ID NO: 65465 - DNA, 25 bp, S. pombe
aggctgaactttacgaccttggctc

SEQ ID NO: 65466 - DNA, 25 bp, S. pombe
acgtaactttttgctttacacgcat

SEQ ID NO: 65467 - DNA, 25 bp, S. pombe
atcgccgccggtgtttttacaggtg

SEQ ID NO: 65468 - DNA, 25 bp, S. pombe
atactggccgtgttaatttctcgtc

SEQ ID NO: 65469 - DNA, 25 bp, S. pombe
atacgagccattactcacatgtctc

SEQ ID NO: 65470 - DNA, 25 bp, S. pombe
atacgcttcaacctcactgatcttg

SEQ ID NO: 65471 - DNA, 25 bp, S. pombe
atactccgttcagttctctaattgc

SEQ ID NO: 65472 - DNA, 25 bp, S. pombe
atacgagtaggcgtttcttgtcctc

SEQ ID NO: 65473 - DNA, 25 bp, S. pombe
atgaccgtagggactttcctagctt

SEQ ID NO: 65474 - DNA, 25 bp, S. pombe
atacgctagacgattttcctgactc

SEQ ID NO: 65475 - DNA, 25 bp, S. pombe
atacgagattccattgttccttcat

SEQ ID NO: 65476 - DNA, 25 bp, S. pombe
atacgaatcccgagtcatggtccaa

SEQ ID NO: 65477 - DNA, 25 bp, S. pombe
ataacaatccgcgtactcgtatcta

SEQ ID NO: 65478 - DNA, 25 bp, S. pombe
ataaacgccggtttggctcacctag

SEQ ID NO: 65479 - DNA, 25 bp, S. pombe
atacaattgatgaggttgccacaca

SEQ ID NO: 65480 - DNA, 25 bp, S. pombe
ataccaggcatgttagcggctctaa

SEQ ID NO: 65481 - DNA, 25 bp, S. pombe
ataccagtcaatatatgcaatccaa

SEQ ID NO: 65482 - DNA, 25 bp, S. pombe
ataccactgctgtacaatccttgat

SEQ ID NO: 65483 - DNA, 25 bp, S. pombe
ataccattttaattcgctctgatag

SEQ ID NO: 65484 - DNA, 25 bp, S. pombe
atacgattttacctcttcattcacc

SEQ ID NO: 65485 - DNA, 25 bp, S. pombe
atacctcctatgattgctccattac

SEQ ID NO: 65486 - DNA, 25 bp, S. pombe
atactacctgagaccgcttcatttt

SEQ ID NO: 65487 - DNA, 25 bp, S. pombe
atactcactctatatctgctggatt

SEQ ID NO: 65488 - DNA, 25 bp, S. pombe
atacgcaccaagttctagttcattt

SEQ ID NO: 65489 - DNA, 25 bp, S. pombe
atacccgccgacgtagttatcttgg

SEQ ID NO: 65490 - DNA, 25 bp, S. pombe
atacaccccgtcttggtaatttgag

SEQ ID NO: 65491 - DNA, 25 bp, S. pombe
ataccatgaatcttgctttggatgc

SEQ ID NO: 65492 - DNA, 25 bp, S. pombe
atagccaatatgttttcgcgtcgcc

SEQ ID NO: 65493 - DNA, 25 bp, S. pombe
atacctgattgtctgatcggtcgcc

SEQ ID NO: 65494 - DNA, 25 bp, S. pombe
ataaattcgtgcgtatgtttcccct

SEQ ID NO: 65495 - DNA, 25 bp, S. pombe
atactttcagtgctcatattggccc

SEQ ID NO: 65496 - DNA, 25 bp, S. pombe
ataccgtagtacacaatcttgcgtt

SEQ ID NO: 65497 - DNA, 25 bp, S. pombe
atacctgctgttcaacattcttggt

SEQ ID NO: 65498 - DNA, 25 bp, S. pombe
atacctgtgttgcaaaaccgtctta

SEQ ID NO: 65499 - DNA, 25 bp, S. pombe
ataccgcttatggaaccgcaagttt

SEQ ID NO: 65500 - DNA, 25 bp, S. pombe
ataccgctatgtttgcaaacccgac

SEQ ID NO: 65501 - DNA, 25 bp, S. pombe
atacatctggcgatttgaccatccg

SEQ ID NO: 65502 - DNA, 25 bp, S. pombe
ataagcgtcttttatacgtccgccg

SEQ ID NO: 65503 - DNA, 25 bp, S. pombe
ataagcgtcttttatacgtccgccg

SEQ ID NO: 65504 - DNA, 25 bp, S. pombe
ataccgatcagggtgtcttctgaca

SEQ ID NO: 65505 - DNA, 25 bp, S. pombe
atacctctcgttatcatgttgcaag

SEQ ID NO: 65506 - DNA, 25 bp, S. pombe
atacctatcgttatgatgccgttgg

SEQ ID NO: 65507 - DNA, 25 bp, S. pombe
atacctgacagtgctttgccagtat

SEQ ID NO: 65508 - DNA, 25 bp, S. pombe
atacctaatgttcttcctttcactg

SEQ ID NO: 65509 - DNA, 25 bp, S. pombe
atacctttcattctcatacctctaa

SEQ ID NO: 65510 - DNA, 25 bp, S. pombe
atacctggtttgctgaagccatcta

SEQ ID NO: 65511 - DNA, 25 bp, S. pombe
atacctagagagtttccgcaagcac

SEQ ID NO: 65512 - DNA, 25 bp, S. pombe
atactctctttgattgacggccagc

SEQ ID NO: 65513 - DNA, 25 bp, S. pombe
atacgccttgccatacacgtgatag

SEQ ID NO: 65514 - DNA, 25 bp, S. pombe
atacgccgcctttcaagctatgttg

SEQ ID NO: 65515 - DNA, 25 bp, S. pombe
atacgttggctgtaggatcacctgc

SEQ ID NO: 65516 - DNA, 25 bp, S. pombe
atacgtatagctctgcagttcctgg

SEQ ID NO: 65517 - DNA, 25 bp, S. pombe
atacgtacgctcttgttgtcgattt

SEQ ID NO: 65518 - DNA, 25 bp, S. pombe
atacacccacattttctttttctag

SEQ ID NO: 65519 - DNA, 25 bp, S. pombe
atacccacatatttgattctctgct

SEQ ID NO: 65520 - DNA, 25 bp, S. pombe
ataccgtttgcaatgaatcttcctt

SEQ ID NO: 65521 - DNA, 25 bp, S. pombe
ataccgtgacatcgttttctgcttt

SEQ ID NO: 65522 - DNA, 25 bp, S. pombe
atacgctttctttccgtcctattat

SEQ ID NO: 65523 - DNA, 25 bp, S. pombe
atacctgaattttgccgttctgtta

SEQ ID NO: 65524 - DNA, 25 bp, S. pombe
atacccctattatgcttcaatctgc

SEQ ID NO: 65525 - DNA, 25 bp, S. pombe
atacccctttgaagccgatatcgtt

SEQ ID NO: 65526 - DNA, 25 bp, S. pombe
atacaacgcgttttgcacttgcttg

SEQ ID NO: 65527 - DNA, 25 bp, S. pombe
atacgcccgtattgtgatgctttat

SEQ ID NO: 65528 - DNA, 25 bp, S. pombe
atactcctcctcttgtagtttactt

SEQ ID NO: 65529 - DNA, 25 bp, S. pombe
atactccgtctttttgtcttcattt

SEQ ID NO: 65530 - DNA, 25 bp, S. pombe
atacccgtttggttgtgcatgccta

SEQ ID NO: 65531 - DNA, 25 bp, S. pombe
atacctgcgcatttcaattgaccgt

SEQ ID NO: 65532 - DNA, 25 bp, S. pombe
atactgctccttccagatcttatga

SEQ ID NO: 65533 - DNA, 25 bp, S. pombe
atacacatccgtttttaccttggag

SEQ ID NO: 65534 - DNA, 25 bp, S. pombe
atacgcaccactatttattcgggaa

SEQ ID NO: 65535 - DNA, 25 bp, S. pombe
atggccgtaatcctggtggaccgaa

SEQ ID NO: 65536 - DNA, 25 bp, S. pombe
atcccgatttcgtggcgactctgga

SEQ ID NO: 65537 - DNA, 25 bp, S. pombe
ataacgatcgtcttaggtccatgcc

SEQ ID NO: 65538 - DNA, 25 bp, S. pombe
ataccgtcggtatgctggcctttat

SEQ ID NO: 65539 - DNA, 25 bp, S. pombe
atacgagtcgtataggtgccttttt

SEQ ID NO: 65540 - DNA, 25 bp, S. pombe
atacggttgctccaatggtgcactt

SEQ ID NO: 65541 - DNA, 25 bp, S. pombe
atacgtgtttcgatggatacttacc

SEQ ID NO: 65542 - DNA, 25 bp, S. pombe
ataagtttccgtctgatgatcctgc

SEQ ID NO: 65543 - DNA, 25 bp, S. pombe
ataaatctggtcctcaagacattat

SEQ ID NO: 65544 - DNA, 25 bp, S. pombe
ataccgctggtataatgtctgcttt

SEQ ID NO: 65545 - DNA, 25 bp, S. pombe
ataccgctgttccaaatgccttatt

SEQ ID NO: 65546 - DNA, 25 bp, S. pombe
atactcctggctattcattttcaac

SEQ ID NO: 65547 - DNA, 25 bp, S. pombe
atactctttgtcattttctcgcgaa

SEQ ID NO: 65548 - DNA, 25 bp, S. pombe
atacgcagagtatgctacctggcgc

SEQ ID NO: 65549 - DNA, 25 bp, S. pombe
ataccgagtatttacgcttgagaca

SEQ ID NO: 65550 - DNA, 25 bp, S. pombe
ataccgttgctgcagagtttctgga

SEQ ID NO: 65551 - DNA, 25 bp, S. pombe
atacttgttcttccaagcttctgga

SEQ ID NO: 65552 - DNA, 25 bp, S. pombe
atacttggctgctatgaaactccgt

SEQ ID NO: 65553 - DNA, 25 bp, S. pombe
atactgcgagctgtggtcttgggtc

SEQ ID NO: 65554 - DNA, 25 bp, S. pombe
ataaatggtggccttcgctgaactt

SEQ ID NO: 65555 - DNA, 25 bp, S. pombe
atacaggtcgtgtgtggtacccatc

SEQ ID NO: 65556 - DNA, 25 bp, S. pombe
atacattgcacagttggccgctaac

SEQ ID NO: 65557 - DNA, 25 bp, S. pombe
atacgatggttgctcagcctgggca

SEQ ID NO: 65558 - DNA, 25 bp, S. pombe
atactgagatcccttgccattgaag

SEQ ID NO: 65559 - DNA, 25 bp, S. pombe
atactgggccagagctatcatgaat

SEQ ID NO: 65560 - DNA, 25 bp, S. pombe
atactgctggcgctactcttgaatc

SEQ ID NO: 65561 - DNA, 25 bp, S. pombe
atacgttgaggaccctttcattgtg

SEQ ID NO: 65562 - DNA, 25 bp, S. pombe
atacggtgggcgatcctttgttgat

SEQ ID NO: 65563 - DNA, 25 bp, S. pombe
acaacttaatgagcccgtggttcct

SEQ ID NO: 65564 - DNA, 25 bp, S. pombe
ataatcctactgaacaacggccatt

SEQ ID NO: 65565 - DNA, 25 bp, S. pombe
atacacgcaagtcgcaatactacag

SEQ ID NO: 65566 - DNA, 25 bp, S. pombe
ataaccagatgcttcgctatatgat

SEQ ID NO: 65567 - DNA, 25 bp, S. pombe
ataataatcgctgcccgtttggagg

SEQ ID NO: 65568 - DNA, 25 bp, S. pombe
atctttcatttcgttcaagccgtgg

SEQ ID NO: 65569 - DNA, 25 bp, S. pombe
atactcgcattcgtggtttgccaaa

SEQ ID NO: 65570 - DNA, 25 bp, S. pombe
atactatcctaatgctgctgccact

SEQ ID NO: 65571 - DNA, 25 bp, S. pombe
atactactcttttgtcttactcgaa

SEQ ID NO: 65572 - DNA, 25 bp, S. pombe
atacgcaaccagctggatcttttgg

SEQ ID NO: 65573 - DNA, 25 bp, S. pombe
atactccaaaggttccttatatgtg

SEQ ID NO: 65574 - DNA, 25 bp, S. pombe
atacgtggccggttatgctgagtaa

SEQ ID NO: 65575 - DNA, 25 bp, S. pombe
ataactaccgcgtcattcgtcatat

SEQ ID NO: 65576 - DNA, 25 bp, S. pombe
ataagttacgctcttcagtttccga

SEQ ID NO: 65577 - DNA, 25 bp, S. pombe
atacaagtcgttctacgtttcgcca

SEQ ID NO: 65578 - DNA, 25 bp, S. pombe
atgaaaggcgtttctcgggttctgc

SEQ ID NO: 65579 - DNA, 25 bp, S. pombe
atacaacaccttttgcggaggctct

SEQ ID NO: 65580 - DNA, 25 bp, S. pombe
ataaagctccttgttgggccatatt

SEQ ID NO: 65581 - DNA, 25 bp, S. pombe
ataactttattgttcccgcattcca

SEQ ID NO: 65582 - DNA, 25 bp, S. pombe
ataacaagtttgcttccgctgtctc

SEQ ID NO: 65583 - DNA, 25 bp, S. pombe
ataaacgtcaacttgctcggtgtct

SEQ ID NO: 65584 - DNA, 25 bp, S. pombe
ataaacgagccattatccgcttctt

SEQ ID NO: 65585 - DNA, 25 bp, S. pombe
atacggattctggtaagcgcttttt

SEQ ID NO: 65586 - DNA, 25 bp, S. pombe
atactgtttctggtagactgcttaa

SEQ ID NO: 65587 - DNA, 25 bp, S. pombe
atactggcgattctgctactcttaa

SEQ ID NO: 65588 - DNA, 25 bp, S. pombe
atacactctttttgaacacctcctt

SEQ ID NO: 65589 - DNA, 25 bp, S. pombe
atactactggtgttcaagctctcgt

SEQ ID NO: 65590 - DNA, 25 bp, S. pombe
atacataccgaccattcaattgaag

SEQ ID NO: 65591 - DNA, 25 bp, S. pombe
atactggactacctctgcaatttac

SEQ ID NO: 65592 - DNA, 25 bp, S. pombe
atacatcacttttgggtgcacacgt

SEQ ID NO: 65593 - DNA, 25 bp, S. pombe
atcacactgcatggagatgggttac

SEQ ID NO: 65594 - DNA, 25 bp, S. pombe
atacatcgcattggtcgcagtggac

SEQ ID NO: 65595 - DNA, 25 bp, S. pombe
atacaagcgctgttgactggtggac

SEQ ID NO: 65596 - DNA, 25 bp, S. pombe
atgaatactgtgttggcggctggat

SEQ ID NO: 65597 - DNA, 25 bp, S. pombe
ataatgcttggcttggcggctcaat

SEQ ID NO: 65598 - DNA, 25 bp, S. pombe
ataatgcttggcttcgaagcggcat

SEQ ID NO: 65599 - DNA, 25 bp, S. pombe
atacaggctagcttcgacgcagaaa

SEQ ID NO: 65600 - DNA, 25 bp, S. pombe
atacggcttcgttggcagattctgg

SEQ ID NO: 65601 - DNA, 25 bp, S. pombe
atactgctaattaacggcgctcaag

SEQ ID NO: 65602 - DNA, 25 bp, S. pombe
atactgcttctgttcaatggtttga

SEQ ID NO: 65603 - DNA, 25 bp, S. pombe
atacatccgtgcttcaacgtgttga

SEQ ID NO: 65604 - DNA, 25 bp, S. pombe
atacgtgcttaataccctggatctt

SEQ ID NO: 65605 - DNA, 25 bp, S. pombe
atactggcttaattacatgcttgag

SEQ ID NO: 65606 - DNA, 25 bp, S. pombe
atcgggttactatcatggtagccaa

SEQ ID NO: 65607 - DNA, 25 bp, S. pombe
atcggtaatttcactgggagctcaa

SEQ ID NO: 65608 - DNA, 25 bp, S. pombe
tttttcaagttctaggtgtacaaag

SEQ ID NO: 65609 - DNA, 25 bp, S. pombe
atcaatttcgtttcggtttgaccag

SEQ ID NO: 65610 - DNA, 25 bp, S. pombe
atcaacgtcgtcacggattttccat

SEQ ID NO: 65611 - DNA, 25 bp, S. pombe
ataaagtctccatctgggttcgtcg

SEQ ID NO: 65612 - DNA, 25 bp, S. pombe
atcaatttttcttcagggttcctgc

SEQ ID NO: 65613 - DNA, 25 bp, S. pombe
ataaagtcattgatgcttccctgcc

SEQ ID NO: 65614 - DNA, 25 bp, S. pombe
ataataatagctatcttccaccctc

SEQ ID NO: 65615 - DNA, 25 bp, S. pombe
ataacaatactaatctgcctgccct

SEQ ID NO: 65616 - DNA, 25 bp, S. pombe
atacactatctaacaggcctcttgc

SEQ ID NO: 65617 - DNA, 25 bp, S. pombe
ataacttctagcaagactcctgatg

SEQ ID NO: 65618 - DNA, 25 bp, S. pombe
ataatgtccgacagcagccagtctg

SEQ ID NO: 65619 - DNA, 25 bp, S. pombe
atactactaatcatgcggaagcctt

SEQ ID NO: 65620 - DNA, 25 bp, S. pombe
atactgctcaaaaagctgcgggcct

SEQ ID NO: 65621 - DNA, 25 bp, S. pombe
atactgttaaatatggttcaattgt

SEQ ID NO: 65622 - DNA, 25 bp, S. pombe
atcctgtgctaatatccggtacggt

SEQ ID NO: 65623 - DNA, 25 bp, S. pombe
ataactttagttgcacgccctatgt

SEQ ID NO: 65624 - DNA, 25 bp, S. pombe
atacactttttcttcgcgccaaatt

SEQ ID NO: 65625 - DNA, 25 bp, S. pombe
atacttgttttctgtgcaactcaac

SEQ ID NO: 65626 - DNA, 25 bp, S. pombe
atactgctgctgatggaaccaagac

SEQ ID NO: 65627 - DNA, 25 bp, S. pombe
atactgttgctggaaggcatcccaa

SEQ ID NO: 65628 - DNA, 25 bp, S. pombe
atactttccaaaatccctgtaatag

SEQ ID NO: 65629 - DNA, 25 bp, S. pombe
atactttgccaattcttcgcgattt

SEQ ID NO: 65630 - DNA, 25 bp, S. pombe
atacttgtgctatgtttgcctctta

SEQ ID NO: 65631 - DNA, 25 bp, S. pombe
ataactcttccatcaattcctggtc

SEQ ID NO: 65632 - DNA, 25 bp, S. pombe
ataatgctcatccacttagactcag

SEQ ID NO: 65633 - DNA, 25 bp, S. pombe
atactcatccattcagctagactca

SEQ ID NO: 65634 - DNA, 25 bp, S. pombe
atacactgcccgtattcatattgca

SEQ ID NO: 65635 - DNA, 25 bp, S. pombe
atacggacgatggtttgttgcaaaa

SEQ ID NO: 65636 - DNA, 25 bp, S. pombe
atactggaggtctatatctgaatgg

SEQ ID NO: 65637 - DNA, 25 bp, S. pombe
ataactatcgctctttattgcgttc

SEQ ID NO: 65638 - DNA, 25 bp, S. pombe
atacactacgctttgtgagatggta

SEQ ID NO: 65639 - DNA, 25 bp, S. pombe
atacaccaactctgcggtcgatttg

SEQ ID NO: 65640 - DNA, 25 bp, S. pombe
ataaagctaccatcggtgctgattt

SEQ ID NO: 65641 - DNA, 25 bp, S. pombe
atactaatgctttggccaactcttt

SEQ ID NO: 65642 - DNA, 25 bp, S. pombe
atactcaacacatttccgctaggga

SEQ ID NO: 65643 - DNA, 25 bp, S. pombe
agcgttggccgtatgaagtttgttc

SEQ ID NO: 65644 - DNA, 25 bp, S. pombe
atctctctggttgttttgtttggtc

SEQ ID NO: 65645 - DNA, 25 bp, S. pombe
atactttccgtgttttgcctgaagc

SEQ ID NO: 65646 - DNA, 25 bp, S. pombe
atcacaagatcactccgtttttcgt

SEQ ID NO: 65647 - DNA, 25 bp, S. pombe
ataaccgctggacggaaggccttat

SEQ ID NO: 65648 - DNA, 25 bp, S. pombe
ataagactaccagtattgcccttgc

SEQ ID NO: 65649 - DNA, 25 bp, S. pombe
ataatggtacgcattttcttcgccc

SEQ ID NO: 65650 - DNA, 25 bp, S. pombe
atactgacgagttttctgctttgcc

SEQ ID NO: 65651 - DNA, 25 bp, S. pombe
atacacagactactttgcgcactta

SEQ ID NO: 65652 - DNA, 25 bp, S. pombe
atactcttctgattcttctgcatct

SEQ ID NO: 65653 - DNA, 25 bp, S. pombe
ataacgagtcgtatgttgtcacatc

SEQ ID NO: 65654 - DNA, 25 bp, S. pombe
atactcaagctaacacttcttcctt

SEQ ID NO: 65655 - DNA, 25 bp, S. pombe
atacatgaatcatctgcttccctct

SEQ ID NO: 65656 - DNA, 25 bp, S. pombe
ataatgaacagcttgcgggcactct

SEQ ID NO: 65657 - DNA, 25 bp, S. pombe
ataagaaatccagcacagcccgttt

SEQ ID NO: 65658 - DNA, 25 bp, S. pombe
ataatacttatcacgcacccagttt

SEQ ID NO: 65659 - DNA, 25 bp, S. pombe
ataatactgttgttggaccggttgt

SEQ ID NO: 65660 - DNA, 25 bp, S. pombe
ataatcctcttgttcaacatcgtgg

SEQ ID NO: 65661 - DNA, 25 bp, S. pombe
atacaggcattagcaaactctcttg

SEQ ID NO: 65662 - DNA, 25 bp, S. pombe
atacacgcttagaatccatccttgg

SEQ ID NO: 65663 - DNA, 25 bp, S. pombe
ataacatccacttccgttgttggta

SEQ ID NO: 65664 - DNA, 25 bp, S. pombe
atacaacccgagtggctcttggaaa

SEQ ID NO: 65665 - DNA, 25 bp, S. pombe
atacaggcactagcgtggcttctga

SEQ ID NO: 65666 - DNA, 25 bp, S. pombe
atacattgattgcttcctgttctcg

SEQ ID NO: 65667 - DNA, 25 bp, S. pombe
ataagtactggttcatcgatgtcac

SEQ ID NO: 65668 - DNA, 25 bp, S. pombe
atacactccttttaccaatcagcaa

SEQ ID NO: 65669 - DNA, 25 bp, S. pombe
ataagcccttttacgcagttgcaga

SEQ ID NO: 65670 - DNA, 25 bp, S. pombe
ataaaccattttaccggcagcatct

SEQ ID NO: 65671 - DNA, 25 bp, S. pombe
atacaactcgtgtaggcgctggtcc

SEQ ID NO: 65672 - DNA, 25 bp, S. pombe
ataaattcttagacctcagtgcccc

SEQ ID NO: 65673 - DNA, 25 bp, S. pombe
ataacgctcgttaccattacactta

SEQ ID NO: 65674 - DNA, 25 bp, S. pombe
ataacggtttgccatctcaaagatg

SEQ ID NO: 65675 - DNA, 25 bp, S. pombe
atcaagggccgtccttgcaagatcg

SEQ ID NO: 65676 - DNA, 25 bp, S. pombe
atcattagccctttcttaaacgaga

SEQ ID NO: 65677 - DNA, 25 bp, S. pombe
atcagcaaagtctgtttctcgaaaa

SEQ ID NO: 65678 - DNA, 25 bp, S. pombe
atacaggtcattcgtgatcgcgcat

SEQ ID NO: 65679 - DNA, 25 bp, S. pombe
atactatgtatggtgcttcggctca

SEQ ID NO: 65680 - DNA, 25 bp, S. pombe
atacttgtgattcgccttatgctaa

SEQ ID NO: 65681 - DNA, 25 bp, S. pombe
atacttgctacattccttgcttgga

SEQ ID NO: 65682 - DNA, 25 bp, S. pombe
atactttgacaactctgtacgcgaa

SEQ ID NO: 65683 - DNA, 25 bp, S. pombe
atacttggaatcatgccgagccgag

SEQ ID NO: 65684 - DNA, 25 bp, S. pombe
atactacctttattatcatcgcctc

SEQ ID NO: 65685 - DNA, 25 bp, S. pombe
atacacatactgttaaatatggttc

SEQ ID NO: 65686 - DNA, 25 bp, S. pombe
ataacaccgtacctcgtgagtcgat

SEQ ID NO: 65687 - DNA, 25 bp, S. pombe
atcaatgaacgtcctgcaaaagctg

SEQ ID NO: 65688 - DNA, 25 bp, S. pombe
ataagcgtcctgtcgagaatgaaaa

SEQ ID NO: 65689 - DNA, 25 bp, S. pombe
ataagtgctctatctgcgaatcaag

SEQ ID NO: 65690 - DNA, 25 bp, S. pombe
atcaccaatcctgaggctgcggaga

SEQ ID NO: 65691 - DNA, 25 bp, S. pombe
atcaggcatgatctctatgtctgta

SEQ ID NO: 65692 - DNA, 25 bp, S. pombe
ataaaaccactgttcgttgtcctca

SEQ ID NO: 65693 - DNA, 25 bp, S. pombe
ataatttcgccatgtgtactccgtc

SEQ ID NO: 65694 - DNA, 25 bp, S. pombe
ataaggttgctatgtctccctcaat

SEQ ID NO: 65695 - DNA, 25 bp, S. pombe
ataacttgttgtactggttcgccca

SEQ ID NO: 65696 - DNA, 25 bp, S. pombe
atacattctgttgttggcttgccaa

SEQ ID NO: 65697 - DNA, 25 bp, S. pombe
atacagttgcttaccttcattccaa

SEQ ID NO: 65698 - DNA, 25 bp, S. pombe
ataaattctcaacctgctcttaacg

SEQ ID NO: 65699 - DNA, 25 bp, S. pombe
atacattaaagcctcgcgttactcg

SEQ ID NO: 65700 - DNA, 25 bp, S. pombe
ataataatacagctccttcttctcg

SEQ ID NO: 65701 - DNA, 25 bp, S. pombe
atacaatggttgctgaacgccgata

SEQ ID NO: 65702 - DNA, 25 bp, S. pombe
atacaacttgcacgtttggctcttt

SEQ ID NO: 65703 - DNA, 25 bp, S. pombe
ataaacagtgcggttgctgccactt

SEQ ID NO: 65704 - DNA, 25 bp, S. pombe
ataaacagtgccttgttccctcatt

SEQ ID NO: 65705 - DNA, 25 bp, S. pombe
atacaatcgtggtgctactgctcct

SEQ ID NO: 65706 - DNA, 25 bp, S. pombe
atacatatctttgctggatctccct

SEQ ID NO: 65707 - DNA, 25 bp, S. pombe
atacatcatttctcgactagccaaa

SEQ ID NO: 65708 - DNA, 25 bp, S. pombe
atacaaggtactatgcaatccagca

SEQ ID NO: 65709 - DNA, 25 bp, S. pombe
atacagctagttcttgcactgccat

SEQ ID NO: 65710 - DNA, 25 bp, S. pombe
atacatgctggtacaggttcgcctg

SEQ ID NO: 65711 - DNA, 25 bp, S. pombe
ataatgcttcttgggcttccatgta

SEQ ID NO: 65712 - DNA, 25 bp, S. pombe
ataatttcttgactgcatctcgtaa

SEQ ID NO: 65713 - DNA, 25 bp, S. pombe
atcatccctcatccaatgatgctga

SEQ ID NO: 65714 - DNA, 25 bp, S. pombe
ataacatgacttgccgatctccaaa

SEQ ID NO: 65715 - DNA, 25 bp, S. pombe
atacatgctcgtatagctcttgaaa

SEQ ID NO: 65716 - DNA, 25 bp, S. pombe
atacagctcctgttagtgctttgag

SEQ ID NO: 65717 - DNA, 25 bp, S. pombe
ataaatgcccatttgattcctaaat

SEQ ID NO: 65718 - DNA, 25 bp, S. pombe
atacattattgacgctactgccgct

SEQ ID NO: 65719 - DNA, 25 bp, S. pombe
atacatctggcatgactagctcctc

SEQ ID NO: 65720 - DNA, 25 bp, S. pombe
atcactcattgggatcagatgcctg

SEQ ID NO: 65721 - DNA, 25 bp, S. pombe
atacacttcttattttttcatgagc

SEQ ID NO: 65722 - DNA, 25 bp, S. pombe
atcaatcgtgatgcttctggtaaag

SEQ ID NO: 65723 - DNA, 25 bp, S. pombe
ataaccgacctattggaagagcagc

SEQ ID NO: 65724 - DNA, 25 bp, S. pombe
ataagcagtgcagttctttctcctc

SEQ ID NO: 65725 - DNA, 25 bp, S. pombe
atcaaggttggttttcacgctggac

SEQ ID NO: 65726 - DNA, 25 bp, S. pombe
ataactatcttgctccataccatga

SEQ ID NO: 65727 - DNA, 25 bp, S. pombe
atacacagctatttcgttacgtgaa

SEQ ID NO: 65728 - DNA, 25 bp, S. pombe
ataacggcatttggcgaaccattat

SEQ ID NO: 65729 - DNA, 25 bp, S. pombe
ctaacagctgatgcccgtacaatta

SEQ ID NO: 65730 - DNA, 25 bp, S. pombe
atacacccggcgaccagattgaata

SEQ ID NO: 65731 - DNA, 25 bp, S. pombe
atcagcaactcctttcgtcaatgta

SEQ ID NO: 65732 - DNA, 25 bp, S. pombe
ataaatcgcgctaatgccttgctta

SEQ ID NO: 65733 - DNA, 25 bp, S. pombe
ataactgcggaggtgcttgtgccat

SEQ ID NO: 65734 - DNA, 25 bp, S. pombe
atgaactggctaaacgaactgactt

SEQ ID NO: 65735 - DNA, 25 bp, S. pombe
ataagggcagcggaaacatacattt

SEQ ID NO: 65736 - DNA, 25 bp, S. pombe
atcacaaatcggaaacctgacaatt

SEQ ID NO: 65737 - DNA, 25 bp, S. pombe
atgctaagccctatggaaaaccttt

SEQ ID NO: 65738 - DNA, 25 bp, S. pombe
atgtacgccctgcttaaatgacctt

SEQ ID NO: 65739 - DNA, 25 bp, S. pombe
ataaccctctttcttatgacactga

SEQ ID NO: 65740 - DNA, 25 bp, S. pombe
ataactcgttttttggtcagcctgc

SEQ ID NO: 65741 - DNA, 25 bp, S. pombe
ataactacttttttgctgaagctca

SEQ ID NO: 65742 - DNA, 25 bp, S. pombe
ataagctatctcctatttgtcgtcc

SEQ ID NO: 65743 - DNA, 25 bp, S. pombe
ataactactggccattgcattcgca

SEQ ID NO: 65744 - DNA, 25 bp, S. pombe
atacactttggaactgctacatgca

SEQ ID NO: 65745 - DNA, 25 bp, S. pombe
ataaatcgacaatcagttccccggg

SEQ ID NO: 65746 - DNA, 25 bp, S. pombe
ataatactgttccattttctcgcac

SEQ ID NO: 65747 - DNA, 25 bp, S. pombe
ataatgtctggtctagttcttctac

SEQ ID NO: 65748 - DNA, 25 bp, S. pombe
ataaggctagctctatttctcttcc

SEQ ID NO: 65749 - DNA, 25 bp, S. pombe
atcaaggatatgaccgtgctcgcaa

SEQ ID NO: 65750 - DNA, 25 bp, S. pombe
ataatgaaccttttgcgtgcaatgc

SEQ ID NO: 65751 - DNA, 25 bp, S. pombe
ataaacatcgtctcatccaaagcat

SEQ ID NO: 65752 - DNA, 25 bp, S. pombe
ataatttggctttcggtgtcgctgc

SEQ ID NO: 65753 - DNA, 25 bp, S. pombe
ataacttagtagtcgctggcggtgg

SEQ ID NO: 65754 - DNA, 25 bp, S. pombe
ataactcttatgtcagggtgagcac

SEQ ID NO: 65755 - DNA, 25 bp, S. pombe
ataactctgctcctgagggtgacaa

SEQ ID NO: 65756 - DNA, 25 bp, S. pombe
ataacttcatcggacgcgggacatc

SEQ ID NO: 65757 - DNA, 25 bp, S. pombe
atcgaacgactaaaggcggctacca

SEQ ID NO: 65758 - DNA, 25 bp, S. pombe
atcaacaaacttcgacggctgcttc

SEQ ID NO: 65759 - DNA, 25 bp, S. pombe
atcacagtgtctaggagcggctcaa

SEQ ID NO: 65760 - DNA, 25 bp, S. pombe
atcactatgatcatgcaggcggcaa

SEQ ID NO: 65761 - DNA, 25 bp, S. pombe
atcaatatgatcgtgcttcgcctga

SEQ ID NO: 65762 - DNA, 25 bp, S. pombe
ataatgttcttctctgctgtacaaa

SEQ ID NO: 65763 - DNA, 25 bp, S. pombe
atcaattttcctttagccttatggg

SEQ ID NO: 65764 - DNA, 25 bp, S. pombe
ataatgtttcatgcttctccttttg

SEQ ID NO: 65765 - DNA, 25 bp, S. pombe
ataatctcttccgatttcgctcatt

SEQ ID NO: 65766 - DNA, 25 bp, S. pombe
ataacgcttcatcgctttgtcatat

SEQ ID NO: 65767 - DNA, 25 bp, S. pombe
ataagcgtcactgggcaattctctt

SEQ ID NO: 65768 - DNA, 25 bp, S. pombe
ataaggatcacgtttctgccgttat

SEQ ID NO: 65769 - DNA, 25 bp, S. pombe
atgaattgggtgtcgtagcttttaa

SEQ ID NO: 65770 - DNA, 25 bp, S. pombe
atcaacatatggcaccgagcgcttt

SEQ ID NO: 65771 - DNA, 25 bp, S. pombe
ataatcaagtgtacgaggctccatt

SEQ ID NO: 65772 - DNA, 25 bp, S. pombe
ataatgaaggatcgcctgcctgcca

SEQ ID NO: 65773 - DNA, 25 bp, S. pombe
ataatatgatggtcgccgctgatcc

SEQ ID NO: 65774 - DNA, 25 bp, S. pombe
ataattccacttcagaggccagatt

SEQ ID NO: 65775 - DNA, 25 bp, S. pombe
ataaactgtctggtgttcttcaaca

SEQ ID NO: 65776 - DNA, 25 bp, S. pombe
ataacactttgcgtgctcgcttaga

SEQ ID NO: 65777 - DNA, 25 bp, S. pombe
atcactattattcaccgagtcggac

SEQ ID NO: 65778 - DNA, 25 bp, S. pombe
atcaatctttgtgcccaatggaatg

SEQ ID NO: 65779 - DNA, 25 bp, S. pombe
atcaaggctgaatcttcctccgaag

SEQ ID NO: 65780 - DNA, 25 bp, S. pombe
atcagaagcgacagtgcccaagcag

SEQ ID NO: 65781 - DNA, 25 bp, S. pombe
atctacgctcaacagtccatcatga

SEQ ID NO: 65782 - DNA, 25 bp, S. pombe
ataagccaaagtttcctctgtctga

SEQ ID NO: 65783 - DNA, 25 bp, S. pombe
ataagtcaccacttgttccaacgtg

SEQ ID NO: 65784 - DNA, 25 bp, S. pombe
ataagctactcctttatctacgacg

SEQ ID NO: 65785 - DNA, 25 bp, S. pombe
ataagtcctacttttctatcccagg

SEQ ID NO: 65786 - DNA, 25 bp, S. pombe
ataattcctcacagcttcgagcgga

SEQ ID NO: 65787 - DNA, 25 bp, S. pombe
ataattctccgcttatcaagtgaaa

SEQ ID NO: 65788 - DNA, 25 bp, S. pombe
ataatggccgactttcaatctaacc

SEQ ID NO: 65789 - DNA, 25 bp, S. pombe
ataagggcgcatgggttatccacat

SEQ ID NO: 65790 - DNA, 25 bp, S. pombe
atcaatgagtcgatcgtctaccctt

SEQ ID NO: 65791 - DNA, 25 bp, S. pombe
ataatgcattctctggcttacgtct

SEQ ID NO: 65792 - DNA, 25 bp, S. pombe
ataacccgtttgaagatcgctgtgt

SEQ ID NO: 65793 - DNA, 25 bp, S. pombe
ataagctccttctccagtctatttt

SEQ ID NO: 65794 - DNA, 25 bp, S. pombe
ataatcttgtacttcaaccccaatc

SEQ ID NO: 65795 - DNA, 25 bp, S. pombe
ataaccatgtcagagttccaccaac

SEQ ID NO: 65796 - DNA, 25 bp, S. pombe
aggcctcggaaattttgtctcgctg

SEQ ID NO: 65797 - DNA, 25 bp, S. pombe
atccaccgaaaatttcttccgtgtg

SEQ ID NO: 65798 - DNA, 25 bp, S. pombe
ataacaatgcccttatcagttcctc

SEQ ID NO: 65799 - DNA, 25 bp, S. pombe
atcaacaacgccttcttttagcttt

SEQ ID NO: 65800 - DNA, 25 bp, S. pombe
atcaactcctcctttcgttggtgga

SEQ ID NO: 65801 - DNA, 25 bp, S. pombe
ataacttctgctaattctgctcaag

SEQ ID NO: 65802 - DNA, 25 bp, S. pombe
ataactggtcatgctgtctttgagg

SEQ ID NO: 65803 - DNA, 25 bp, S. pombe
atcaaagaaattccgctgctagcag

SEQ ID NO: 65804 - DNA, 25 bp, S. pombe
ataatgacaccaggcgctcaagcga

SEQ ID NO: 65805 - DNA, 25 bp, S. pombe
atcatctggaaacccttcttacttt

SEQ ID NO: 65806 - DNA, 25 bp, S. pombe
atcccgaagtccttgcagtcgttaa

SEQ ID NO: 65807 - DNA, 25 bp, S. pombe
ataagttgcgtcaagccctatggct

SEQ ID NO: 65808 - DNA, 25 bp, S. pombe
ataaggatggtctcgcgtcaggtca

SEQ ID NO: 65809 - DNA, 25 bp, S. pombe
ataattggtcattccatgggagcga

SEQ ID NO: 65810 - DNA, 25 bp, S. pombe
atcaacgctttcctgggctggacta

SEQ ID NO: 65811 - DNA, 25 bp, S. pombe
atcaacgcttatgtaggacgacctg

SEQ ID NO: 65812 - DNA, 25 bp, S. pombe
atcaagcgttgcgttaagcctgacc

SEQ ID NO: 65813 - DNA, 25 bp, S. pombe
atcaaggctgtcgatatgtcagaga

SEQ ID NO: 65814 - DNA, 25 bp, S. pombe
ataagcgcgttttaccagatgttgt

SEQ ID NO: 65815 - DNA, 25 bp, S. pombe
atcgaagcaatcatgtaccgccctt

SEQ ID NO: 65816 - DNA, 25 bp, S. pombe
atcagatcaagctctctcaactttg

SEQ ID NO: 65817 - DNA, 25 bp, S. pombe
atcaatccagatatgctcagcgttg

SEQ ID NO: 65818 - DNA, 25 bp, S. pombe
ataatgccaaccaagtcgactgagt

SEQ ID NO: 65819 - DNA, 25 bp, S. pombe
atcactgaattttgtacggcggctt

SEQ ID NO: 65820 - DNA, 25 bp, S. pombe
ataagagacagcagctcctggcttc

SEQ ID NO: 65821 - DNA, 25 bp, S. pombe
ataatgcccatcgatccctaataaa

SEQ ID NO: 65822 - DNA, 25 bp, S. pombe
atcagccgatgacgccgaagcagaa

SEQ ID NO: 65823 - DNA, 25 bp, S. pombe
atcatgacaatggtgctggcaatcg

SEQ ID NO: 65824 - DNA, 25 bp, S. pombe
atcagcagccagttgacagtgtcgc

SEQ ID NO: 65825 - DNA, 25 bp, S. pombe
cgtcgtcaaatacaagtctcgcttc

SEQ ID NO: 65826 - DNA, 25 bp, S. pombe
tccggttaacattacgatctcgtcc

SEQ ID NO: 65827 - DNA, 25 bp, S. pombe
atgggttagaacacgttcagtctaa

SEQ ID NO: 65828 - DNA, 25 bp, S. pombe
atctttgatactaagcccggcattt

SEQ ID NO: 65829 - DNA, 25 bp, S. pombe
atctttggagatatccgccgtttca

SEQ ID NO: 65830 - DNA, 25 bp, S. pombe
atcaacttgcgtatgccgctttatt

SEQ ID NO: 65831 - DNA, 25 bp, S. pombe
atgcaacttagtacagccacgtctg

SEQ ID NO: 65832 - DNA, 25 bp, S. pombe
atcaaaacgctacttccttgctatc

SEQ ID NO: 65833 - DNA, 25 bp, S. pombe
ataacgacgatccttcatggcggtt

SEQ ID NO: 65834 - DNA, 25 bp, S. pombe
atcatccgtagacaaaaccgcgctt

SEQ ID NO: 65835 - DNA, 25 bp, S. pombe
atcaatcgcactactgaagctagca

SEQ ID NO: 65836 - DNA, 25 bp, S. pombe
atcacctgccaaacctattcgtaaa

SEQ ID NO: 65837 - DNA, 25 bp, S. pombe
atcacacgtcccgtctttggataaa

SEQ ID NO: 65838 - DNA, 25 bp, S. pombe
ataaggctcgccgtttgggatacaa

SEQ ID NO: 65839 - DNA, 25 bp, S. pombe
ataagtctcagcgttctttagcaga

SEQ ID NO: 65840 - DNA, 25 bp, S. pombe
ataagttcgcttattctagtagaaa

SEQ ID NO: 65841 - DNA, 25 bp, S. pombe
atcaagctttctgactttggttgga

SEQ ID NO: 65842 - DNA, 25 bp, S. pombe
atcaagtttcctaccgttattgctc

SEQ ID NO: 65843 - DNA, 25 bp, S. pombe
atgcaagttctccaaccttttttca

SEQ ID NO: 65844 - DNA, 25 bp, S. pombe
ataagcgtgctcaaatctcaatttt

SEQ ID NO: 65845 - DNA, 25 bp, S. pombe
ataagcctgctccaatgtacatttt

SEQ ID NO: 65846 - DNA, 25 bp, S. pombe
atcaatcattcatgcgctcctaatt

SEQ ID NO: 65847 - DNA, 25 bp, S. pombe
ataatctactatgcatccaaatggt

SEQ ID NO: 65848 - DNA, 25 bp, S. pombe
acgcgttagtttggattccgaggat

SEQ ID NO: 65849 - DNA, 25 bp, S. pombe
atctattgcagtaccgacgacttct

SEQ ID NO: 65850 - DNA, 25 bp, S. pombe
atcttctcaaaatacagcccgttct

SEQ ID NO: 65851 - DNA, 25 bp, S. pombe
atcagatcacgagtttaccgcggct

SEQ ID NO: 65852 - DNA, 25 bp, S. pombe
atcagcttcgcgaacttgtcaaact

SEQ ID NO: 65853 - DNA, 25 bp, S. pombe
atcgatcgcataacccgttacgcag

SEQ ID NO: 65854 - DNA, 25 bp, S. pombe
agcccaagggccgtgcttacaagcg

SEQ ID NO: 65855 - DNA, 25 bp, S. pombe
agcccaagggccgtgcttacaagcg

SEQ ID NO: 65856 - DNA, 25 bp, S. pombe
atcattcaatgctccgtttaactcg

SEQ ID NO: 65857 - DNA, 25 bp, S. pombe
ataatcaagctgtccgcgcaatatt

SEQ ID NO: 65858 - DNA, 25 bp, S. pombe
atctttagctgtcgccgcatatgaa

SEQ ID NO: 65859 - DNA, 25 bp, S. pombe
ataatgatatattccgtcctgacga

SEQ ID NO: 65860 - DNA, 25 bp, S. pombe
atcttccttatgagctcaacgtcgg

SEQ ID NO: 65861 - DNA, 25 bp, S. pombe
atccaatgacaaccgaaccttagct

SEQ ID NO: 65862 - DNA, 25 bp, S. pombe
atctgggaaactattccttagctaa

SEQ ID NO: 65863 - DNA, 25 bp, S. pombe
atcttcgtaatgcacctccttatgt

SEQ ID NO: 65864 - DNA, 25 bp, S. pombe
atctcatcccgatattgtttctgat

SEQ ID NO: 65865 - DNA, 25 bp, S. pombe
ataattctcttgctccacaattcac

SEQ ID NO: 65866 - DNA, 25 bp, S. pombe
ataagtctcattcctctacttgtgc

SEQ ID NO: 65867 - DNA, 25 bp, S. pombe
atcaagaagcttggcaccattcctc

SEQ ID NO: 65868 - DNA, 25 bp, S. pombe
atcacgaacttgtactcacttccaa

SEQ ID NO: 65869 - DNA, 25 bp, S. pombe
atcacaaacatattcctgccttttc

SEQ ID NO: 65870 - DNA, 25 bp, S. pombe
atcattccggattgtatcgctttcg

SEQ ID NO: 65871 - DNA, 25 bp, S. pombe
atcgacactcgggaaactgttcaaa

SEQ ID NO: 65872 - DNA, 25 bp, S. pombe
atcaacacccaggagttgctggtca

SEQ ID NO: 65873 - DNA, 25 bp, S. pombe
atcaactatggtatcctacgtcttt

SEQ ID NO: 65874 - DNA, 25 bp, S. pombe
ataatttgcgtttccaacagcttcc

SEQ ID NO: 65875 - DNA, 25 bp, S. pombe
ataatctgagcgttgctagcccctt

SEQ ID NO: 65876 - DNA, 25 bp, S. pombe
atcaatgcgtgctgatctctctcaa

SEQ ID NO: 65877 - DNA, 25 bp, S. pombe
atcaatgctgcagctattgctccaa

SEQ ID NO: 65878 - DNA, 25 bp, S. pombe
atcattggtgcgtcaggtgaagctt

SEQ ID NO: 65879 - DNA, 25 bp, S. pombe
atctatggcacgtcgcgatgagtta

SEQ ID NO: 65880 - DNA, 25 bp, S. pombe
atcatatgatgaggccggttcttcg

SEQ ID NO: 65881 - DNA, 25 bp, S. pombe
atcaactatttgacgctgttcgcga

SEQ ID NO: 65882 - DNA, 25 bp, S. pombe
atcagcaatgtcttgactgccgtta

SEQ ID NO: 65883 - DNA, 25 bp, S. pombe
atcaggattcttctccaaatgcatc

SEQ ID NO: 65884 - DNA, 25 bp, S. pombe
atcagggtggtcttgtcagcgatga

SEQ ID NO: 65885 - DNA, 25 bp, S. pombe
atcagatcctgactcgattcgacaa

SEQ ID NO: 65886 - DNA, 25 bp, S. pombe
atcacggatggatggcagctcgagc

SEQ ID NO: 65887 - DNA, 25 bp, S. pombe
atcacggatttaggccctgatgctc

SEQ ID NO: 65888 - DNA, 25 bp, S. pombe
atcaatttgcattcacggtggtctt

SEQ ID NO: 65889 - DNA, 25 bp, S. pombe
atcctatttgacacctttggccaaa

SEQ ID NO: 65890 - DNA, 25 bp, S. pombe
atcacgtttgactatcttgggtaca

SEQ ID NO: 65891 - DNA, 25 bp, S. pombe
atcagctttcgcctttgggtcaaaa

SEQ ID NO: 65892 - DNA, 25 bp, S. pombe
atcacattagttgcgctattccctt

SEQ ID NO: 65893 - DNA, 25 bp, S. pombe
atcagcagattcttattctacccct

SEQ ID NO: 65894 - DNA, 25 bp, S. pombe
atcatcaatctctctcagtaactct

SEQ ID NO: 65895 - DNA, 25 bp, S. pombe
atcaagatttcattcgtaagcctgg

SEQ ID NO: 65896 - DNA, 25 bp, S. pombe
atcaaagattcttcgcggagagcgg

SEQ ID NO: 65897 - DNA, 25 bp, S. pombe
atcactatccatatgctgctggcgt

SEQ ID NO: 65898 - DNA, 25 bp, S. pombe
atcacattcttcagcgctcgtatta

SEQ ID NO: 65899 - DNA, 25 bp, S. pombe
atcaatccttcaaccaggtatatcg

SEQ ID NO: 65900 - DNA, 25 bp, S. pombe
ataattatccttcctggtcattctg

SEQ ID NO: 65901 - DNA, 25 bp, S. pombe
ataattacgctttcgattggtctcg

SEQ ID NO: 65902 - DNA, 25 bp, S. pombe
ataattccacaatgccttgctttcg

SEQ ID NO: 65903 - DNA, 25 bp, S. pombe
acgatttcaaaagcttggcccgaat

SEQ ID NO: 65904 - DNA, 25 bp, S. pombe
atggtaggtaaagccagctccccat

SEQ ID NO: 65905 - DNA, 25 bp, S. pombe
atcaccgttttcgtcaagggccaat

SEQ ID NO: 65906 - DNA, 25 bp, S. pombe
atctccccttatacttggtaacgat

SEQ ID NO: 65907 - DNA, 25 bp, S. pombe
atcctggtcgttatacttaccgtga

SEQ ID NO: 65908 - DNA, 25 bp, S. pombe
atgcccttacttatttattccctat

SEQ ID NO: 65909 - DNA, 25 bp, S. pombe
atctcctaaccaaattcttcgcgaa

SEQ ID NO: 65910 - DNA, 25 bp, S. pombe
atctcttccacgatcaatctacgga

SEQ ID NO: 65911 - DNA, 25 bp, S. pombe
atccgtccttgcttcaatctaagta

SEQ ID NO: 65912 - DNA, 25 bp, S. pombe
atcagaagctttggcttaccgctgc

SEQ ID NO: 65913 - DNA, 25 bp, S. pombe
ataatacgctttgtgattcctctga

SEQ ID NO: 65914 - DNA, 25 bp, S. pombe
ataatatcgtcaatcctctttccag

SEQ ID NO: 65915 - DNA, 25 bp, S. pombe
atcaatgcgttcttttcaacctcaa

SEQ ID NO: 65916 - DNA, 25 bp, S. pombe
atcatattccatttgaggccctaaa

SEQ ID NO: 65917 - DNA, 25 bp, S. pombe
atcaacagctacgagtccatctatg

SEQ ID NO: 65918 - DNA, 25 bp, S. pombe
atcagcactctcttttgctatcaag

SEQ ID NO: 65919 - DNA, 25 bp, S. pombe
atcatgcccgcatcttggttaaagg

SEQ ID NO: 65920 - DNA, 25 bp, S. pombe
atcagatttacttttcccagctggg

SEQ ID NO: 65921 - DNA, 25 bp, S. pombe
atcaatttactcagtcccgtacatg

SEQ ID NO: 65922 - DNA, 25 bp, S. pombe
atcaatgtaatgagcagcctccctc

SEQ ID NO: 65923 - DNA, 25 bp, S. pombe
atcagtgtgttgtctgagcacccac

SEQ ID NO: 65924 - DNA, 25 bp, S. pombe
atcaccggaatatgctttcagccta

SEQ ID NO: 65925 - DNA, 25 bp, S. pombe
atctctctataatgttccgggtcta

SEQ ID NO: 65926 - DNA, 25 bp, S. pombe
atcaatgtcgctattcgtggtggta

SEQ ID NO: 65927 - DNA, 25 bp, S. pombe
atcatttcacctcagctatggcaaa

SEQ ID NO: 65928 - DNA, 25 bp, S. pombe
atcatatccacctgctgcggaaagt

SEQ ID NO: 65929 - DNA, 25 bp, S. pombe
atcattgagccctctttgaaggcat

SEQ ID NO: 65930 - DNA, 25 bp, S. pombe
atctcaatcgccttctgttaaacaa

SEQ ID NO: 65931 - DNA, 25 bp, S. pombe
atcagcgacctgttttataccacat

SEQ ID NO: 65932 - DNA, 25 bp, S. pombe
atcaattatctgtttcattacgcca

SEQ ID NO: 65933 - DNA, 25 bp, S. pombe
atcactcacagattacttttccgta

SEQ ID NO: 65934 - DNA, 25 bp, S. pombe
atcactgactatgactttgacggta

SEQ ID NO: 65935 - DNA, 25 bp, S. pombe
atcattgggttctgttcttctttag

SEQ ID NO: 65936 - DNA, 25 bp, S. pombe
atcagtacgttcctggttcacatgg

SEQ ID NO: 65937 - DNA, 25 bp, S. pombe
atcaatcgtgttcatcgttcatctg

SEQ ID NO: 65938 - DNA, 25 bp, S. pombe
atcaattctgtctacttttctcaaa

SEQ ID NO: 65939 - DNA, 25 bp, S. pombe
atctcctagattcagcacttcgtga

SEQ ID NO: 65940 - DNA, 25 bp, S. pombe
agcatttggacggaactggcctttg

SEQ ID NO: 65941 - DNA, 25 bp, S. pombe
atgcttgttaaatactgggcttcga

SEQ ID NO: 65942 - DNA, 25 bp, S. pombe
atcttgttaccgtttggagtgctcc

SEQ ID NO: 65943 - DNA, 25 bp, S. pombe
atcgtcgtaatgtagccttgggcaa

SEQ ID NO: 65944 - DNA, 25 bp, S. pombe
atcattgttctatccgtattgtcag

SEQ ID NO: 65945 - DNA, 25 bp, S. pombe
atcattatctgtgaaaatcctagtc

SEQ ID NO: 65946 - DNA, 25 bp, S. pombe
accctgtccgtatatcacaacttgt

SEQ ID NO: 65947 - DNA, 25 bp, S. pombe
agcaccgagggtaaccaacgctggt

SEQ ID NO: 65948 - DNA, 25 bp, S. pombe
atcgtccaagtaaacctaggcatta

SEQ ID NO: 65949 - DNA, 25 bp, S. pombe
atgcttcccctgctttgaagactgg

SEQ ID NO: 65950 - DNA, 25 bp, S. pombe
atcaatgccgctacttattctgtca

SEQ ID NO: 65951 - DNA, 25 bp, S. pombe
atcaactcgacggatcgtgacacaa

SEQ ID NO: 65952 - DNA, 25 bp, S. pombe
atcaactctgacttaagtacccgaa

SEQ ID NO: 65953 - DNA, 25 bp, S. pombe
atccacatctgatctgaagtcaccc

SEQ ID NO: 65954 - DNA, 25 bp, S. pombe
atcacaatctcatcgaagcacttcc

SEQ ID NO: 65955 - DNA, 25 bp, S. pombe
atcaaagtgttgtcaccattcccac

SEQ ID NO: 65956 - DNA, 25 bp, S. pombe
atcatgcggcgttgtatgtggaaca

SEQ ID NO: 65957 - DNA, 25 bp, S. pombe
atcatgcaagtttggttggtcaagc

SEQ ID NO: 65958 - DNA, 25 bp, S. pombe
atcagagcctgttaagtgtaaccta

SEQ ID NO: 65959 - DNA, 25 bp, S. pombe
atcaagccactttaagcgtctactc

SEQ ID NO: 65960 - DNA, 25 bp, S. pombe
atcaagccgctaagaccagttttgc

SEQ ID NO: 65961 - DNA, 25 bp, S. pombe
atctcaccttgatgaccaaacttgc

SEQ ID NO: 65962 - DNA, 25 bp, S. pombe
atctttcatatgttgactaagtttg

SEQ ID NO: 65963 - DNA, 25 bp, S. pombe
atcttttcatgctggcgatcgtatc

SEQ ID NO: 65964 - DNA, 25 bp, S. pombe
atctcttgcttctggaactgttcac

SEQ ID NO: 65965 - DNA, 25 bp, S. pombe
atcatctttgtcttacggcatcttc

SEQ ID NO: 65966 - DNA, 25 bp, S. pombe
atcaaatctgttttcgcgcctgtga

SEQ ID NO: 65967 - DNA, 25 bp, S. pombe
atcacagtcgtgttctagcggttgt

SEQ ID NO: 65968 - DNA, 25 bp, S. pombe
atcaaccgtggttccgatgttatcg

SEQ ID NO: 65969 - DNA, 25 bp, S. pombe
atcaacgggtttagcgatggttcaa

SEQ ID NO: 65970 - DNA, 25 bp, S. pombe
atcaaaggtcttacggtgtgcccaa

SEQ ID NO: 65971 - DNA, 25 bp, S. pombe
atcgaaaacttttggtgcgtcctga

SEQ ID NO: 65972 - DNA, 25 bp, S. pombe
atcaaattcattgttcgcgcgcgtt

SEQ ID NO: 65973 - DNA, 25 bp, S. pombe
atcttgtaatctattgccgaccgac

SEQ ID NO: 65974 - DNA, 25 bp, S. pombe
atcttctgactttttccgtttgaca

SEQ ID NO: 65975 - DNA, 25 bp, S. pombe
atcatttggagggttacaccactgt

SEQ ID NO: 65976 - DNA, 25 bp, S. pombe
atcatggtttgcgtttagccctttt

SEQ ID NO: 65977 - DNA, 25 bp, S. pombe
atcagctgctttttattcgtaatct

SEQ ID NO: 65978 - DNA, 25 bp, S. pombe
atcacttctacattttcgactgctg

SEQ ID NO: 65979 - DNA, 25 bp, S. pombe
atcacagactcctagttctattttg

SEQ ID NO: 65980 - DNA, 25 bp, S. pombe
atcttgcttcatcttgggagtttgc

SEQ ID NO: 65981 - DNA, 25 bp, S. pombe
atcttctcgtcattctaggctttag

SEQ ID NO: 65982 - DNA, 25 bp, S. pombe
atctatgaaaccagcctttaaccct

SEQ ID NO: 65983 - DNA, 25 bp, S. pombe
atcaccttcacctttattcaatcag

SEQ ID NO: 65984 - DNA, 25 bp, S. pombe
atcaccctccgtatcaaaatctaaa

SEQ ID NO: 65985 - DNA, 25 bp, S. pombe
atcaactttggcgatggcattgttt

SEQ ID NO: 65986 - DNA, 25 bp, S. pombe
atcatatatgtaccatcccaacgct

SEQ ID NO: 65987 - DNA, 25 bp, S. pombe
atcatcattattcccgcaaaagctc

SEQ ID NO: 65988 - DNA, 25 bp, S. pombe
atcaaagtcagaactcccacggtga

SEQ ID NO: 65989 - DNA, 25 bp, S. pombe
atcaaaccagaagctgaacagcgaa

SEQ ID NO: 65990 - DNA, 25 bp, S. pombe
atcaaacgccttcctcaaagcgata

SEQ ID NO: 65991 - DNA, 25 bp, S. pombe
atgcaaagtcttcactcatcaaagg

SEQ ID NO: 65992 - DNA, 25 bp, S. pombe
atcgttaccacctttggtatctcca

SEQ ID NO: 65993 - DNA, 25 bp, S. pombe
atcaggaaccatggtttcgtcccca

SEQ ID NO: 65994 - DNA, 25 bp, S. pombe
atcaaatccggcgatctaatcttaa

SEQ ID NO: 65995 - DNA, 25 bp, S. pombe
atcacctgccgagtttcaagctatg

SEQ ID NO: 65996 - DNA, 25 bp, S. pombe
atcagccgccgaaagctctattgcg

SEQ ID NO: 65997 - DNA, 25 bp, S. pombe
atcatccgtcgtgagtatttgcact

SEQ ID NO: 65998 - DNA, 25 bp, S. pombe
atcagcctgtagttggattttttac

SEQ ID NO: 65999 - DNA, 25 bp, S. pombe
atctagtggatttaaacatgtttta

SEQ ID NO: 66000 - DNA, 25 bp, S. pombe
atcattgccgatggagaacactttc

SEQ ID NO: 66001 - DNA, 25 bp, S. pombe
atcactgtaatcctgaaacctttga

SEQ ID NO: 66002 - DNA, 25 bp, S. pombe
atcacgatctgacccaaactttgta

SEQ ID NO: 66003 - DNA, 25 bp, S. pombe
atcacccttcattatactcaaatcc

SEQ ID NO: 66004 - DNA, 25 bp, S. pombe
atcacccttaaaatcacagcagcaa

SEQ ID NO: 66005 - DNA, 25 bp, S. pombe
atcatccgttcctctagttcagtta

SEQ ID NO: 66006 - DNA, 25 bp, S. pombe
atcacctttcactcaagatgtcttg

SEQ ID NO: 66007 - DNA, 25 bp, S. pombe
atcattttgtgttggctactagcgg

SEQ ID NO: 66008 - DNA, 25 bp, S. pombe
atctatttatgtttgctctgcttcg

SEQ ID NO: 66009 - DNA, 25 bp, S. pombe
atcactttttgcttgtccattcgag

SEQ ID NO: 66010 - DNA, 25 bp, S. pombe
atcacacatgtttttctcttgcagg

SEQ ID NO: 66011 - DNA, 25 bp, S. pombe
atcatacgatcaaggccaagctggt

SEQ ID NO: 66012 - DNA, 25 bp, S. pombe
atcatgcgcgtctacgaacagcgtt

SEQ ID NO: 66013 - DNA, 25 bp, S. pombe
atcagtggactacgcaactcagtta

SEQ ID NO: 66014 - DNA, 25 bp, S. pombe
atctgatggacaacgtcgtcgcgta

SEQ ID NO: 66015 - DNA, 25 bp, S. pombe
atctatgaggttggtcttgtgcgta

SEQ ID NO: 66016 - DNA, 25 bp, S. pombe
atcatggataaacgcttcgccgtct

SEQ ID NO: 66017 - DNA, 25 bp, S. pombe
atcgagtaagaccaggcgcggtttt

SEQ ID NO: 66018 - DNA, 25 bp, S. pombe
atcgtttcaatctgggctggtctcc

SEQ ID NO: 66019 - DNA, 25 bp, S. pombe
acggcgttcaaatggctcgggtgtt

SEQ ID NO: 66020 - DNA, 25 bp, S. pombe
atcgttttcaaaccgcttggcgcat

SEQ ID NO: 66021 - DNA, 25 bp, S. pombe
atcactttttggaaggtgctcgcaa

SEQ ID NO: 66022 - DNA, 25 bp, S. pombe
atcacgcttttgatagtcctcgacg

SEQ ID NO: 66023 - DNA, 25 bp, S. pombe
atcaccaatttcattctcgagactc

SEQ ID NO: 66024 - DNA, 25 bp, S. pombe
atcatcgctggctacatatcgtgtg

SEQ ID NO: 66025 - DNA, 25 bp, S. pombe
atcaccatgcagaccattctggagg

SEQ ID NO: 66026 - DNA, 25 bp, S. pombe
atcgccggaatgtcacttatgcttc

SEQ ID NO: 66027 - DNA, 25 bp, S. pombe
atcgggcagaagtcattcgcactct

SEQ ID NO: 66028 - DNA, 25 bp, S. pombe
atcgaaaatcagcttccatccattg

SEQ ID NO: 66029 - DNA, 25 bp, S. pombe
atctcaaaagcttcgatgcttcccg

SEQ ID NO: 66030 - DNA, 25 bp, S. pombe
atctacggatcggttagcttaacag

SEQ ID NO: 66031 - DNA, 25 bp, S. pombe
atctactcctcgcagtactagaaag

SEQ ID NO: 66032 - DNA, 25 bp, S. pombe
atctttctcttcagtgtcgtggtat

SEQ ID NO: 66033 - DNA, 25 bp, S. pombe
atcatcaaccttcttggcgtgggag

SEQ ID NO: 66034 - DNA, 25 bp, S. pombe
atcttactgcccatacaaaccgtgt

SEQ ID NO: 66035 - DNA, 25 bp, S. pombe
atcggcaagcccagaaaatccctat

SEQ ID NO: 66036 - DNA, 25 bp, S. pombe
atcaccgtcgaattctcagttcaaa

SEQ ID NO: 66037 - DNA, 25 bp, S. pombe
atcagattgatcctgccttgatgcg

SEQ ID NO: 66038 - DNA, 25 bp, S. pombe
atcagtggtctttctcatgaggaac

SEQ ID NO: 66039 - DNA, 25 bp, S. pombe
atcagttgtgtgttctcatcgagca

SEQ ID NO: 66040 - DNA, 25 bp, S. pombe
atctagtacatcgacagcatccagc

SEQ ID NO: 66041 - DNA, 25 bp, S. pombe
atgctttagtggaagacacctcggt

SEQ ID NO: 66042 - DNA, 25 bp, S. pombe
atgctttaactatgccaatacggct

SEQ ID NO: 66043 - DNA, 25 bp, S. pombe
atctattccaaattcgccaagggct

SEQ ID NO: 66044 - DNA, 25 bp, S. pombe
atcagcaacaagtatagcccatatt

SEQ ID NO: 66045 - DNA, 25 bp, S. pombe
atctaagcatattgaacgtccagta

SEQ ID NO: 66046 - DNA, 25 bp, S. pombe
atctcaatcattcatcctaccaaaa

SEQ ID NO: 66047 - DNA, 25 bp, S. pombe
atctacgcttctattttacgaccca

SEQ ID NO: 66048 - DNA, 25 bp, S. pombe
atctacctctctctttaacaatttc

SEQ ID NO: 66049 - DNA, 25 bp, S. pombe
atctacaccgttgcattacgcagtt

SEQ ID NO: 66050 - DNA, 25 bp, S. pombe
atctctcgctcgtgcaggaaaggtt

SEQ ID NO: 66051 - DNA, 25 bp, S. pombe
ttccattgagaaccgcgaaaagatg

SEQ ID NO: 66052 - DNA, 25 bp, S. pombe
atctcattgcgcgagccggaattaa

SEQ ID NO: 66053 - DNA, 25 bp, S. pombe
atctatggcctactcgcgatgacat

SEQ ID NO: 66054 - DNA, 25 bp, S. pombe
atcattcagcctatcggccatcaaa

SEQ ID NO: 66055 - DNA, 25 bp, S. pombe
atcatcgccctacggttggcaatta

SEQ ID NO: 66056 - DNA, 25 bp, S. pombe
atcaccaataccgttttctgttcct

SEQ ID NO: 66057 - DNA, 25 bp, S. pombe
atcagtgtcaatccgtttatccttc

SEQ ID NO: 66058 - DNA, 25 bp, S. pombe
atgctttatgagtgtttacggtcga

SEQ ID NO: 66059 - DNA, 25 bp, S. pombe
atcgtcttgtaggtttcggtgctga

SEQ ID NO: 66060 - DNA, 25 bp, S. pombe
atcagattgtcctgtttgcggcgta

SEQ ID NO: 66061 - DNA, 25 bp, S. pombe
atcagaagtcccattgtttgcttat

SEQ ID NO: 66062 - DNA, 25 bp, S. pombe
atcagccatccccattttttgtatt

SEQ ID NO: 66063 - DNA, 25 bp, S. pombe
atcatggcccggaatttctttactt

SEQ ID NO: 66064 - DNA, 25 bp, S. pombe
atctgccaccggtcgtaagagagct

SEQ ID NO: 66065 - DNA, 25 bp, S. pombe
atctaattgctgttgctccaaacgc

SEQ ID NO: 66066 - DNA, 25 bp, S. pombe
atcataaggctgttgctcccagagt

SEQ ID NO: 66067 - DNA, 25 bp, S. pombe
atcattagctcgtgatgccacacag

SEQ ID NO: 66068 - DNA, 25 bp, S. pombe
atctccagattgtgatgccagacag

SEQ ID NO: 66069 - DNA, 25 bp, S. pombe
atcgacgttcttgccgagataccat

SEQ ID NO: 66070 - DNA, 25 bp, S. pombe
atctttctttattttgcgccgcaaa

SEQ ID NO: 66071 - DNA, 25 bp, S. pombe
atctctttctcatattcgcatttcc

SEQ ID NO: 66072 - DNA, 25 bp, S. pombe
atctgactcttgcaaggttggctca

SEQ ID NO: 66073 - DNA, 25 bp, S. pombe
atctatctccgcaagcaagttggtg

SEQ ID NO: 66074 - DNA, 25 bp, S. pombe
atcttttcagcaagcgactaggagg

SEQ ID NO: 66075 - DNA, 25 bp, S. pombe
atctgccagtttactaggagtcggt

SEQ ID NO: 66076 - DNA, 25 bp, S. pombe
atctccgttattgaatgtgccgtta

SEQ ID NO: 66077 - DNA, 25 bp, S. pombe
atcccagttacttcggtcctagaat

SEQ ID NO: 66078 - DNA, 25 bp, S. pombe
atcccgtgtgctgccaggaaggaaa

SEQ ID NO: 66079 - DNA, 25 bp, S. pombe
agcctacggcttcattaactgacgc

SEQ ID NO: 66080 - DNA, 25 bp, S. pombe
atcctactgattctttagagggcgc

SEQ ID NO: 66081 - DNA, 25 bp, S. pombe
atcgcttcaagtctttaaggcttcg

SEQ ID NO: 66082 - DNA, 25 bp, S. pombe
atctttctaacgtacaagggcttcg

SEQ ID NO: 66083 - DNA, 25 bp, S. pombe
atcagattcgtattcttgcgcgtgc

SEQ ID NO: 66084 - DNA, 25 bp, S. pombe
atcttgatcgtgactctcttggtgc

SEQ ID NO: 66085 - DNA, 25 bp, S. pombe
atctatattgattctcctgtccgac

SEQ ID NO: 66086 - DNA, 25 bp, S. pombe
atcttaagttatctgccggcactag

SEQ ID NO: 66087 - DNA, 25 bp, S. pombe
atcattgctggtattcccaacgctt

SEQ ID NO: 66088 - DNA, 25 bp, S. pombe
atcttctcgtttacgcatccaatgt

SEQ ID NO: 66089 - DNA, 25 bp, S. pombe
atcattccagcatgcatatttcaag

SEQ ID NO: 66090 - DNA, 25 bp, S. pombe
atcattcgcaatatctagtcctaaa

SEQ ID NO: 66091 - DNA, 25 bp, S. pombe
atcgtactccggaagagattgctag

SEQ ID NO: 66092 - DNA, 25 bp, S. pombe
atcagtatccggctaatgttcatgt

SEQ ID NO: 66093 - DNA, 25 bp, S. pombe
atcgtaccggttatgctgttcttgc

SEQ ID NO: 66094 - DNA, 25 bp, S. pombe
atcttagctcgcgtttggtttgtta

SEQ ID NO: 66095 - DNA, 25 bp, S. pombe
atcatattcatctgttttccctctc

SEQ ID NO: 66096 - DNA, 25 bp, S. pombe
atctattcaacactagtttccccta

SEQ ID NO: 66097 - DNA, 25 bp, S. pombe
atctttcccagatgtttctttcaaa

SEQ ID NO: 66098 - DNA, 25 bp, S. pombe
atcttcatcgccaggtattctttga

SEQ ID NO: 66099 - DNA, 25 bp, S. pombe
atcttgcacctgatggtcttctatt

SEQ ID NO: 66100 - DNA, 25 bp, S. pombe
atctttccaggtcatcatcattgtc

SEQ ID NO: 66101 - DNA, 25 bp, S. pombe
atctagctgccggaaggtttccaaa

SEQ ID NO: 66102 - DNA, 25 bp, S. pombe
atcttggcccagcagttttgatgca

SEQ ID NO: 66103 - DNA, 25 bp, S. pombe
atcatgttgttcataagccgcgcaa

SEQ ID NO: 66104 - DNA, 25 bp, S. pombe
atcatgtgtcctatttcagccctga

SEQ ID NO: 66105 - DNA, 25 bp, S. pombe
atcggtatggctatgtccgcatctt

SEQ ID NO: 66106 - DNA, 25 bp, S. pombe
atcgtagacgtgtgtccgacatatc

SEQ ID NO: 66107 - DNA, 25 bp, S. pombe
atcggatgccggtgctactgtagag

SEQ ID NO: 66108 - DNA, 25 bp, S. pombe
atcaggagacgtgctgctgttgaaa

SEQ ID NO: 66109 - DNA, 25 bp, S. pombe
atcagtacaggctacccttgaggaa

SEQ ID NO: 66110 - DNA, 25 bp, S. pombe
atcaggctcgtatcgttgctttgaa

SEQ ID NO: 66111 - DNA, 25 bp, S. pombe
atctggcagctttcggacgttaaat

SEQ ID NO: 66112 - DNA, 25 bp, S. pombe
atcttgactcattgcgagagcgcta

SEQ ID NO: 66113 - DNA, 25 bp, S. pombe
atcgcgacctgctttgggaaatgct

SEQ ID NO: 66114 - DNA, 25 bp, S. pombe
atcaggcctcgtatggtagtagcaa

SEQ ID NO: 66115 - DNA, 25 bp, S. pombe
atcaggccctgtatgtgccatgata

SEQ ID NO: 66116 - DNA, 25 bp, S. pombe
atcatgttgcacttgtgtctcctaa

SEQ ID NO: 66117 - DNA, 25 bp, S. pombe
atcattggttgcgacacatccgtga

SEQ ID NO: 66118 - DNA, 25 bp, S. pombe
atcagggctttagaagaatgtcata

SEQ ID NO: 66119 - DNA, 25 bp, S. pombe
atcttgatgctcctgttgaacgtgt

SEQ ID NO: 66120 - DNA, 25 bp, S. pombe
atctggcatcttcttgtctggtgac

SEQ ID NO: 66121 - DNA, 25 bp, S. pombe
atcatcgtctttatctcttaactcg

SEQ ID NO: 66122 - DNA, 25 bp, S. pombe
atctctttgtgcttccggtggaaga

SEQ ID NO: 66123 - DNA, 25 bp, S. pombe
atctttccccattttttcatctatt

SEQ ID NO: 66124 - DNA, 25 bp, S. pombe
atctcatttcctttcatttcctttt

SEQ ID NO: 66125 - DNA, 25 bp, S. pombe
atcaggttggcgttcattttgctta

SEQ ID NO: 66126 - DNA, 25 bp, S. pombe
atcttgtctgttgccaaactcatca

SEQ ID NO: 66127 - DNA, 25 bp, S. pombe
atcatatcacttttccatagaccgc

SEQ ID NO: 66128 - DNA, 25 bp, S. pombe
atcatcaagcttatcacctgaccag

SEQ ID NO: 66129 - DNA, 25 bp, S. pombe
atcatgctacttattcagcgccaag

SEQ ID NO: 66130 - DNA, 25 bp, S. pombe
atcatcatactctttctgcttcgaa

SEQ ID NO: 66131 - DNA, 25 bp, S. pombe
atcatcagtggcatagtctacgtat

SEQ ID NO: 66132 - DNA, 25 bp, S. pombe
atcatgcctattcgtcgtggttact

SEQ ID NO: 66133 - DNA, 25 bp, S. pombe
atcatgcatctacggaagctgtgtc

SEQ ID NO: 66134 - DNA, 25 bp, S. pombe
atgcgtctcaaacaaatcactcagt

SEQ ID NO: 66135 - DNA, 25 bp, S. pombe
acggacgataaacccaataacgatg

SEQ ID NO: 66136 - DNA, 25 bp, S. pombe
accaccgtttcatcctatgaacgaa

SEQ ID NO: 66137 - DNA, 25 bp, S. pombe
atcccgttttgctcgtatcgacgaa

SEQ ID NO: 66138 - DNA, 25 bp, S. pombe
atctatcgtttttcggattgcgccg

SEQ ID NO: 66139 - DNA, 25 bp, S. pombe
atcttcgtcttcgtcgtttatcacg

SEQ ID NO: 66140 - DNA, 25 bp, S. pombe
atcttgctgagcttcttggtttaca

SEQ ID NO: 66141 - DNA, 25 bp, S. pombe
atcgttggtttgcttattgcagcta

SEQ ID NO: 66142 - DNA, 25 bp, S. pombe
atcggttttagctagttcggcgcct

SEQ ID NO: 66143 - DNA, 25 bp, S. pombe
atcggttttatgttttgctggttgc

SEQ ID NO: 66144 - DNA, 25 bp, S. pombe
atctgcgtttggtatgtcatccgga

SEQ ID NO: 66145 - DNA, 25 bp, S. pombe
atcgctggacggcaccaaggacttg

SEQ ID NO: 66146 - DNA, 25 bp, S. pombe
atcttaccactcttacttggagcta

SEQ ID NO: 66147 - DNA, 25 bp, S. pombe
atcttgacaccttgcattgctttgg

SEQ ID NO: 66148 - DNA, 25 bp, S. pombe
atcattagacctttgagcaacccca

SEQ ID NO: 66149 - DNA, 25 bp, S. pombe
atctgctgcatctcttgtaaaaccc

SEQ ID NO: 66150 - DNA, 25 bp, S. pombe
atctccatctcccagtcaaatgaaa

SEQ ID NO: 66151 - DNA, 25 bp, S. pombe
atctaccagccgtgcaaatcataca

SEQ ID NO: 66152 - DNA, 25 bp, S. pombe
atcttcccataatcatccttgtgtt

SEQ ID NO: 66153 - DNA, 25 bp, S. pombe
atctttcggagattgcacactctga

SEQ ID NO: 66154 - DNA, 25 bp, S. pombe
atgcattaacccttgtacacttacc

SEQ ID NO: 66155 - DNA, 25 bp, S. pombe
atctttaccatgctgctcaagctta

SEQ ID NO: 66156 - DNA, 25 bp, S. pombe
atcttcaaattcaagccgctgtcca

SEQ ID NO: 66157 - DNA, 25 bp, S. pombe
atcttcatctgtagcatcagccact

SEQ ID NO: 66158 - DNA, 25 bp, S. pombe
atcatcccaaatatctcccagaatt

SEQ ID NO: 66159 - DNA, 25 bp, S. pombe
atctggaactaatctttcacctctc

SEQ ID NO: 66160 - DNA, 25 bp, S. pombe
atcttactatcttactttcttcctc

SEQ ID NO: 66161 - DNA, 25 bp, S. pombe
atctattgggcttagtattccggtt

SEQ ID NO: 66162 - DNA, 25 bp, S. pombe
atcgttggcgcgacgtagtacgttt

SEQ ID NO: 66163 - DNA, 25 bp, S. pombe
atctttgttgttcgtatccgtggta

SEQ ID NO: 66164 - DNA, 25 bp, S. pombe
atctttggattttaccgcgtagaca

SEQ ID NO: 66165 - DNA, 25 bp, S. pombe
atcttccctttggagctggttctaa

SEQ ID NO: 66166 - DNA, 25 bp, S. pombe
atcttcgccgataaagctggtctca

SEQ ID NO: 66167 - DNA, 25 bp, S. pombe
atctttgggcgaacagctttctgca

SEQ ID NO: 66168 - DNA, 25 bp, S. pombe
atctatgtacataactccttgggaa

SEQ ID NO: 66169 - DNA, 25 bp, S. pombe
atctcttacataccccttaatcgaa

SEQ ID NO: 66170 - DNA, 25 bp, S. pombe
atcttctcctgctcatgctcattaa

SEQ ID NO: 66171 - DNA, 25 bp, S. pombe
atcttcatctcgtgcagtttcaaac

SEQ ID NO: 66172 - DNA, 25 bp, S. pombe
atctttgttgtattgagcatccttg

SEQ ID NO: 66173 - DNA, 25 bp, S. pombe
atcattttatggcttcttcgacaga

SEQ ID NO: 66174 - DNA, 25 bp, S. pombe
atcatcatcttcttcgctttctgga

SEQ ID NO: 66175 - DNA, 25 bp, S. pombe
atcattatatttccaacctcctttt

SEQ ID NO: 66176 - DNA, 25 bp, S. pombe
atcttttattgaaacctccgccatg

SEQ ID NO: 66177 - DNA, 25 bp, S. pombe
atcttttacagccaattctgccgac

SEQ ID NO: 66178 - DNA, 25 bp, S. pombe
atcatcaatccagcttcctgatagg

SEQ ID NO: 66179 - DNA, 25 bp, S. pombe
atctcgtcaagcattccgtacattg

SEQ ID NO: 66180 - DNA, 25 bp, S. pombe
atctctgtcgcgtttacttgtattg

SEQ ID NO: 66181 - DNA, 25 bp, S. pombe
atcttgctagcgttcatccattttc

SEQ ID NO: 66182 - DNA, 25 bp, S. pombe
atcttctagtgctgtttcttctacg

SEQ ID NO: 66183 - DNA, 25 bp, S. pombe
atcttttggcttgcttggactggta

SEQ ID NO: 66184 - DNA, 25 bp, S. pombe
atcttgttcggagctttgtgtggta

SEQ ID NO: 66185 - DNA, 25 bp, S. pombe
atcttttaggtactcttgctggtgg

SEQ ID NO: 66186 - DNA, 25 bp, S. pombe
atctttgctttgaccgccgatatgc

SEQ ID NO: 66187 - DNA, 25 bp, S. pombe
atcttctctattaacgtctattgcc

SEQ ID NO: 66188 - DNA, 25 bp, S. pombe
atcattcatgtatcactgctgctgc

SEQ ID NO: 66189 - DNA, 25 bp, S. pombe
atctatatgtatccgccgatgctac

SEQ ID NO: 66190 - DNA, 25 bp, S. pombe
atctcttttgcagtgttatccatcc

SEQ ID NO: 66191 - DNA, 25 bp, S. pombe
atcattctggtgttgtttccatcct

SEQ ID NO: 66192 - DNA, 25 bp, S. pombe
atcttctggtgctgttcaacactta

SEQ ID NO: 66193 - DNA, 25 bp, S. pombe
atcgtaatctccgtaaatgctcctt

SEQ ID NO: 66194 - DNA, 25 bp, S. pombe
atcgcccttctcttacaatggaatt

SEQ ID NO: 66195 - DNA, 25 bp, S. pombe
atcattctcctcgttttcacaagtt

SEQ ID NO: 66196 - DNA, 25 bp, S. pombe
atcttcctcttgttttagcagcttt

SEQ ID NO: 66197 - DNA, 25 bp, S. pombe
atcttgtccttgtttattgtcactg

SEQ ID NO: 66198 - DNA, 25 bp, S. pombe
atctgagtcacttttgcatttggca

SEQ ID NO: 66199 - DNA, 25 bp, S. pombe
atctaatcgattttcacctcctatt

SEQ ID NO: 66200 - DNA, 25 bp, S. pombe
atctccttatcttattcccgtattt

SEQ ID NO: 66201 - DNA, 25 bp, S. pombe
atccgttattccactcatttacttt

SEQ ID NO: 66202 - DNA, 25 bp, S. pombe
atctgcgttgacttctaatctcttc

SEQ ID NO: 66203 - DNA, 25 bp, S. pombe
atctgtttgaggattggtatcccaa

SEQ ID NO: 66204 - DNA, 25 bp, S. pombe
atctccgttttctaagacatctccg

SEQ ID NO: 66205 - DNA, 25 bp, S. pombe
atcttcgaccatttcaactgcttgg

SEQ ID NO: 66206 - DNA, 25 bp, S. pombe
atcttcgtctttacttcgtcgtgag

SEQ ID NO: 66207 - DNA, 25 bp, S. pombe
atcggtatcattaatcgtcgtcgta

SEQ ID NO: 66208 - DNA, 25 bp, S. pombe
atcgtgtacttaatcctcgtggtgc

SEQ ID NO: 66209 - DNA, 25 bp, S. pombe
atctatactggtctttctacaatgg

SEQ ID NO: 66210 - DNA, 25 bp, S. pombe
atctagcgtctacctttgtgcaaga

SEQ ID NO: 66211 - DNA, 25 bp, S. pombe
actcttgtccaaagtcaggcgggtc

SEQ ID NO: 66212 - DNA, 25 bp, S. pombe
atctttgcccattgttcagctggat

SEQ ID NO: 66213 - DNA, 25 bp, S. pombe
atcttggtgctgctaacggtacatc

SEQ ID NO: 66214 - DNA, 25 bp, S. pombe
atcgtcgatgctcctgaagagtcca

SEQ ID NO: 66215 - DNA, 25 bp, S. pombe
atcttctgagattctgggcgctgca

SEQ ID NO: 66216 - DNA, 25 bp, S. pombe
atctagaagtagtcggaccgctcgt

SEQ ID NO: 66217 - DNA, 25 bp, S. pombe
atctatggacgaaattcggcgtcta

SEQ ID NO: 66218 - DNA, 25 bp, S. pombe
atctttgagttatctgcccagtctg

SEQ ID NO: 66219 - DNA, 25 bp, S. pombe
atctttgcgactttctgcccatgtt

SEQ ID NO: 66220 - DNA, 25 bp, S. pombe
atctttggatgttgtctactctttg

SEQ ID NO: 66221 - DNA, 25 bp, S. pombe
atctttggatgttgtctactctttg

SEQ ID NO: 66222 - DNA, 25 bp, S. pombe
atcttcgtattcattacatcttttg

SEQ ID NO: 66223 - DNA, 25 bp, S. pombe
atcttcaatacttaacacctcttcg

SEQ ID NO: 66224 - DNA, 25 bp, S. pombe
atctatcttacgtatactctccttt

SEQ ID NO: 66225 - DNA, 25 bp, S. pombe
atctactttaaatcctgcctctatg

SEQ ID NO: 66226 - DNA, 25 bp, S. pombe
atctgtcttgatgcttttgttcctt

SEQ ID NO: 66227 - DNA, 25 bp, S. pombe
atcggtctagcttttatttgccaaa

SEQ ID NO: 66228 - DNA, 25 bp, S. pombe
atcgacgtgacgcttatagccgtag

SEQ ID NO: 66229 - DNA, 25 bp, S. pombe
atcttcttacgtcttgcagcagcga

SEQ ID NO: 66230 - DNA, 25 bp, S. pombe
atctgctcccactgaatcatatgac

SEQ ID NO: 66231 - DNA, 25 bp, S. pombe
atctatactcattttacatccccga

SEQ ID NO: 66232 - DNA, 25 bp, S. pombe
atcttcatttgatgttgagcccata

SEQ ID NO: 66233 - DNA, 25 bp, S. pombe
atctacttctgctgcttgtcaacaa

SEQ ID NO: 66234 - DNA, 25 bp, S. pombe
atctaccttctgtagcggctgaaca

SEQ ID NO: 66235 - DNA, 25 bp, S. pombe
atctcctgcttacagtgctgctaaa

SEQ ID NO: 66236 - DNA, 25 bp, S. pombe
atctatatttagtcgctcccaacat

SEQ ID NO: 66237 - DNA, 25 bp, S. pombe
atctatgtagtggatcctcgccaaa

SEQ ID NO: 66238 - DNA, 25 bp, S. pombe
atctgatgtcgggacagacgagcaa

SEQ ID NO: 66239 - DNA, 25 bp, S. pombe
atctcgtgtgcgtacagccatgaaa

SEQ ID NO: 66240 - DNA, 25 bp, S. pombe
atctcagtgtattccgtgctagcta

SEQ ID NO: 66241 - DNA, 25 bp, S. pombe
atccgtctatagttcccgctgagaa

SEQ ID NO: 66242 - DNA, 25 bp, S. pombe
atctctctttagaagcccactggaa

SEQ ID NO: 66243 - DNA, 25 bp, S. pombe
atcggagacgtgaccaaaagcgtaa

SEQ ID NO: 66244 - DNA, 25 bp, S. pombe
atcgcaaacatgtcgcttggcgttg

SEQ ID NO: 66245 - DNA, 25 bp, S. pombe
atcgatcccatcacagtagagtcag

SEQ ID NO: 66246 - DNA, 25 bp, S. pombe
atcttcaactacgtttggtgcgcag

SEQ ID NO: 66247 - DNA, 25 bp, S. pombe
atcttaactcacagatccgtctttg

SEQ ID NO: 66248 - DNA, 25 bp, S. pombe
atctactatcggcatctcaactatt

SEQ ID NO: 66249 - DNA, 25 bp, S. pombe
atctttatcgttttcatgatcatat

SEQ ID NO: 66250 - DNA, 25 bp, S. pombe
atcttcttcctatctcagagcttga

SEQ ID NO: 66251 - DNA, 25 bp, S. pombe
atcttcttgcttcagtttcctatga

SEQ ID NO: 66252 - DNA, 25 bp, S. pombe
atctggctggatccgaaagactttc

SEQ ID NO: 66253 - DNA, 25 bp, S. pombe
atgcgtgccaatctaacaacttctg

SEQ ID NO: 66254 - DNA, 25 bp, S. pombe
atctcctggtgaatactatgtccgt

SEQ ID NO: 66255 - DNA, 25 bp, S. pombe
atctctctgattacattctttccgg

SEQ ID NO: 66256 - DNA, 25 bp, S. pombe
atctccgcctatcttttgagccaga

SEQ ID NO: 66257 - DNA, 25 bp, S. pombe
atctacagtcgatatttcagacctg

SEQ ID NO: 66258 - DNA, 25 bp, S. pombe
atctccagcggatccttgatgtcaa

SEQ ID NO: 66259 - DNA, 25 bp, S. pombe
atctcgagcgtatgggctttctcaa

SEQ ID NO: 66260 - DNA, 25 bp, S. pombe
atctctggtcgttgggtgtcttaac

SEQ ID NO: 66261 - DNA, 25 bp, S. pombe
atctccgatactttggctgctttag

SEQ ID NO: 66262 - DNA, 25 bp, S. pombe
atctacgtatctctcttctattaac

SEQ ID NO: 66263 - DNA, 25 bp, S. pombe
atctccttcattctcgtagcatttg

SEQ ID NO: 66264 - DNA, 25 bp, S. pombe
atctattgatcttcgagcagggcac

SEQ ID NO: 66265 - DNA, 25 bp, S. pombe
atctatgagcgctggaatccttcaa

SEQ ID NO: 66266 - DNA, 25 bp, S. pombe
atctgctactattgtgtctcctata

SEQ ID NO: 66267 - DNA, 25 bp, S. pombe
atctcatcctgcatttgatccgaat

SEQ ID NO: 66268 - DNA, 25 bp, S. pombe
atctgcagtctgaactttccgatgt

SEQ ID NO: 66269 - DNA, 25 bp, S. pombe
atctgcagaccaactttcgcatgtt

SEQ ID NO: 66270 - DNA, 25 bp, S. pombe
atctgcgcgcacaatatctgctact

SEQ ID NO: 66271 - DNA, 25 bp, S. pombe
atctcagccatctatgttgcaagtg

SEQ ID NO: 66272 - DNA, 25 bp, S. pombe
atcgttccctacaaagctagagtca

SEQ ID NO: 66273 - DNA, 25 bp, S. pombe
atcctcttgttaaaggttggctcaa

SEQ ID NO: 66274 - DNA, 25 bp, S. pombe
atcccggtgatctcgatgattcagg

SEQ ID NO: 66275 - DNA, 25 bp, S. pombe
atccaccgttgctcgcatatatggc

SEQ ID NO: 66276 - DNA, 25 bp, S. pombe
atctcaatggctactgctccaagtg

SEQ ID NO: 66277 - DNA, 25 bp, S. pombe
atctctctgatggatgaacctattg

SEQ ID NO: 66278 - DNA, 25 bp, S. pombe
atctccgacatagctttgagcgttt

SEQ ID NO: 66279 - DNA, 25 bp, S. pombe
atctgcgagagcttactttacgtat

SEQ ID NO: 66280 - DNA, 25 bp, S. pombe
atctgaagacaatctctctcctctt

SEQ ID NO: 66281 - DNA, 25 bp, S. pombe
atctatcaagtttacctactcctca

SEQ ID NO: 66282 - DNA, 25 bp, S. pombe
atctcccattccgactcaagtataa

SEQ ID NO: 66283 - DNA, 25 bp, S. pombe
atctctactactcataccagctata

SEQ ID NO: 66284 - DNA, 25 bp, S. pombe
atctctagctcctatgtactatcga

SEQ ID NO: 66285 - DNA, 25 bp, S. pombe
atctcatatgccgttggagcactgg

SEQ ID NO: 66286 - DNA, 25 bp, S. pombe
atctcaatccttaagcagcgcaatc

SEQ ID NO: 66287 - DNA, 25 bp, S. pombe
atcgatgcatttgtggctgtagacc

SEQ ID NO: 66288 - DNA, 25 bp, S. pombe
atctgatttggatgccggtactcgt

SEQ ID NO: 66289 - DNA, 25 bp, S. pombe
atctacaacagattccggaaccgat

SEQ ID NO: 66290 - DNA, 25 bp, S. pombe
atctactgtagaatccgagcttaaa

SEQ ID NO: 66291 - DNA, 25 bp, S. pombe
atccgtggtactggtgtctctttca

SEQ ID NO: 66292 - DNA, 25 bp, S. pombe
atctgtcattatggccagctcgaaa

SEQ ID NO: 66293 - DNA, 25 bp, S. pombe
atcgttcgatgcgttgccgagcaaa

SEQ ID NO: 66294 - DNA, 25 bp, S. pombe
atcgaggaggctgctgatctacaaa

SEQ ID NO: 66295 - DNA, 25 bp, S. pombe
atctgagcagagtcccttcttataa

SEQ ID NO: 66296 - DNA, 25 bp, S. pombe
atcgtccattgcacttattctcaag

SEQ ID NO: 66297 - DNA, 25 bp, S. pombe
atcggtcatggcacatcgttcttga

SEQ ID NO: 66298 - DNA, 25 bp, S. pombe
atcgtgctaaccgttcagtcatgac

SEQ ID NO: 66299 - DNA, 25 bp, S. pombe
atctattgactatagctcgccttgc

SEQ ID NO: 66300 - DNA, 25 bp, S. pombe
atccattaggcattactcctcttgg

SEQ ID NO: 66301 - DNA, 25 bp, S. pombe
atcgtattcgactcttcgcagcata

SEQ ID NO: 66302 - DNA, 25 bp, S. pombe
atcctagtcaaaccttcaatattgg

SEQ ID NO: 66303 - DNA, 25 bp, S. pombe
atctcgagtcactttcattcaagga

SEQ ID NO: 66304 - DNA, 25 bp, S. pombe
atccgtatggattctctgtcaaagg

SEQ ID NO: 66305 - DNA, 25 bp, S. pombe
atctccaatctattcagcgtgcaaa

SEQ ID NO: 66306 - DNA, 25 bp, S. pombe
atctacaatcattatcgcgactcca

SEQ ID NO: 66307 - DNA, 25 bp, S. pombe
atctctcaccatcgaatttcatcaa

SEQ ID NO: 66308 - DNA, 25 bp, S. pombe
atctcccacgtatattgccatgttg

SEQ ID NO: 66309 - DNA, 25 bp, S. pombe
atcccatccgtacattaagctttag

SEQ ID NO: 66310 - DNA, 25 bp, S. pombe
aggccaaggtactccaagtgcttca

SEQ ID NO: 66311 - DNA, 25 bp, S. pombe
atgaaggccgttcttccatttttca

SEQ ID NO: 66312 - DNA, 25 bp, S. pombe
agggccgctggtcttggtatttcaa

SEQ ID NO: 66313 - DNA, 25 bp, S. pombe
atccgacgttgatcttggttttgat

SEQ ID NO: 66314 - DNA, 25 bp, S. pombe
atccgaagagtatacttttgaccag

SEQ ID NO: 66315 - DNA, 25 bp, S. pombe
atctgcaaatactttcctttcttcc

SEQ ID NO: 66316 - DNA, 25 bp, S. pombe
atcgaaatacgccagctatagcttt

SEQ ID NO: 66317 - DNA, 25 bp, S. pombe
atcggtgtcataggcctttttattt

SEQ ID NO: 66318 - DNA, 25 bp, S. pombe
atcggcttcacttttaggcatcaaa

SEQ ID NO: 66319 - DNA, 25 bp, S. pombe
atctggttcctctattcatttcaac

SEQ ID NO: 66320 - DNA, 25 bp, S. pombe
atctcagagcccgaacttatcgaat

SEQ ID NO: 66321 - DNA, 25 bp, S. pombe
atctcagcagcgactttcttatgtg

SEQ ID NO: 66322 - DNA, 25 bp, S. pombe
atcgtcagttcgatcatcgtcgtac

SEQ ID NO: 66323 - DNA, 25 bp, S. pombe
atctgtggttcgaagctttcccaat

SEQ ID NO: 66324 - DNA, 25 bp, S. pombe
atctgggtttgttgctagtactctc

SEQ ID NO: 66325 - DNA, 25 bp, S. pombe
atctgttatttttctccaactccag

SEQ ID NO: 66326 - DNA, 25 bp, S. pombe
atcggtcatccgaagttgctggtta

SEQ ID NO: 66327 - DNA, 25 bp, S. pombe
atcggtcagccaagtttgtcgtttt

SEQ ID NO: 66328 - DNA, 25 bp, S. pombe
atctgttcacaatgtttgccctaag

SEQ ID NO: 66329 - DNA, 25 bp, S. pombe
atctgttgctgctgacgagactcgg

SEQ ID NO: 66330 - DNA, 25 bp, S. pombe
atctgtttcacggtgatcctcgaga

SEQ ID NO: 66331 - DNA, 25 bp, S. pombe
atctgttgtcaggtattgccgccat

SEQ ID NO: 66332 - DNA, 25 bp, S. pombe
atctgggctcaggattttgggcttg

SEQ ID NO: 66333 - DNA, 25 bp, S. pombe
atcctctttctcctaaacttacaga

SEQ ID NO: 66334 - DNA, 25 bp, S. pombe
atctgcctggttttttactcccttg

SEQ ID NO: 66335 - DNA, 25 bp, S. pombe
atctctacaattcgttttacctctt

SEQ ID NO: 66336 - DNA, 25 bp, S. pombe
atctctcctaatcttggtgaccatt

SEQ ID NO: 66337 - DNA, 25 bp, S. pombe
atctctccagtttgctccatggata

SEQ ID NO: 66338 - DNA, 25 bp, S. pombe
atctcatttggtgcctccagatatg

SEQ ID NO: 66339 - DNA, 25 bp, S. pombe
atctcacttgttgcctctttattta

SEQ ID NO: 66340 - DNA, 25 bp, S. pombe
atctgatgctcaatctccttcttta

SEQ ID NO: 66341 - DNA, 25 bp, S. pombe
atctggcaatcagcctttggagcaa

SEQ ID NO: 66342 - DNA, 25 bp, S. pombe
atcggcatctcaacgttctacatgg

SEQ ID NO: 66343 - DNA, 25 bp, S. pombe
atctgccatcaggactattcttata

SEQ ID NO: 66344 - DNA, 25 bp, S. pombe
atctctatggatacagctacagtcg

SEQ ID NO: 66345 - DNA, 25 bp, S. pombe
atctcgaacatatgcgtcagtcttg

SEQ ID NO: 66346 - DNA, 25 bp, S. pombe
atctgtgaacattagcgattcctta

SEQ ID NO: 66347 - DNA, 25 bp, S. pombe
atctgtgttatatgctgttcgtgtc

SEQ ID NO: 66348 - DNA, 25 bp, S. pombe
atctgtttaatggtgacttttctta

SEQ ID NO: 66349 - DNA, 25 bp, S. pombe
atcgatttcatagttaccccttctt

SEQ ID NO: 66350 - DNA, 25 bp, S. pombe
atcgtgttcgaattgaccccggtgt

SEQ ID NO: 66351 - DNA, 25 bp, S. pombe
atcggcttcgagtagacgtttggtt

SEQ ID NO: 66352 - DNA, 25 bp, S. pombe
atcgttccaaatgtgcagctgtcgc

SEQ ID NO: 66353 - DNA, 25 bp, S. pombe
atcgtttaaagcaacctgtcgcctt

SEQ ID NO: 66354 - DNA, 25 bp, S. pombe
atctgtttttactaccgcattctac

SEQ ID NO: 66355 - DNA, 25 bp, S. pombe
atcggtgtcttctgcatttcggtaa

SEQ ID NO: 66356 - DNA, 25 bp, S. pombe
atcggtgtcctcgagaagtccgaca

SEQ ID NO: 66357 - DNA, 25 bp, S. pombe
atcgcgataacccaaaagctgcaga

SEQ ID NO: 66358 - DNA, 25 bp, S. pombe
atctgcgttggcaaaacctgctcaa

SEQ ID NO: 66359 - DNA, 25 bp, S. pombe
atctgttggcgaatcttgtcgttca

SEQ ID NO: 66360 - DNA, 25 bp, S. pombe
atcgtgggcctttatgtggtctgca

SEQ ID NO: 66361 - DNA, 25 bp, S. pombe
atctcgggcctttattgtatcattt

SEQ ID NO: 66362 - DNA, 25 bp, S. pombe
atctcttggcctatcgttgatgcaa

SEQ ID NO: 66363 - DNA, 25 bp, S. pombe
atctgctcgcgctcgtattttgaaa

SEQ ID NO: 66364 - DNA, 25 bp, S. pombe
atcgatccctggctgattttgaaaa

SEQ ID NO: 66365 - DNA, 25 bp, S. pombe
atcgccccgagagatcttctgaaaa

SEQ ID NO: 66366 - DNA, 25 bp, S. pombe
atcggaagcggtgatcttgctcaaa

SEQ ID NO: 66367 - DNA, 25 bp, S. pombe
atctgacctcttcaagcgtgttggt

SEQ ID NO: 66368 - DNA, 25 bp, S. pombe
atctctctcgctactttggtggtga

SEQ ID NO: 66369 - DNA, 25 bp, S. pombe
atcggcagtctgtcatggccctgtt

SEQ ID NO: 66370 - DNA, 25 bp, S. pombe
atgcgactacctttgcacggtatta

SEQ ID NO: 66371 - DNA, 25 bp, S. pombe
atctgcctggacactaatgggacat

SEQ ID NO: 66372 - DNA, 25 bp, S. pombe
atcggatcttctttacacgtaacgg

SEQ ID NO: 66373 - DNA, 25 bp, S. pombe
atctcgatgtttcgtcatttcactt

SEQ ID NO: 66374 - DNA, 25 bp, S. pombe
atctcgcgttgctttggattgtatt

SEQ ID NO: 66375 - DNA, 25 bp, S. pombe
accaatccctgagcctttaagtgta

SEQ ID NO: 66376 - DNA, 25 bp, S. pombe
atcgttcgcctagcgttctaaggta

SEQ ID NO: 66377 - DNA, 25 bp, S. pombe
atcgtgctcggtgtagtagcgcatc

SEQ ID NO: 66378 - DNA, 25 bp, S. pombe
atgagcccgttgaaagtctacctcg

SEQ ID NO: 66379 - DNA, 25 bp, S. pombe
atctgctcctaaattacctgctaag

SEQ ID NO: 66380 - DNA, 25 bp, S. pombe
atcgtcacttttcgtactcaagagg

SEQ ID NO: 66381 - DNA, 25 bp, S. pombe
atccgcatcttctgttattgtttgg

SEQ ID NO: 66382 - DNA, 25 bp, S. pombe
atccctatgcttttcttggtggctc

SEQ ID NO: 66383 - DNA, 25 bp, S. pombe
atccctcatggatggtttctactat

SEQ ID NO: 66384 - DNA, 25 bp, S. pombe
atccttcatggtgggttttccgcat

SEQ ID NO: 66385 - DNA, 25 bp, S. pombe
atgcggccgacatcaggatgcagta

SEQ ID NO: 66386 - DNA, 25 bp, S. pombe
atctgcttctgcgtctagttcaaca

SEQ ID NO: 66387 - DNA, 25 bp, S. pombe
atctggttctattgcctctatatct

SEQ ID NO: 66388 - DNA, 25 bp, S. pombe
atctgggactatttcctttctcgga

SEQ ID NO: 66389 - DNA, 25 bp, S. pombe
atcctgggaatggacctttggtcaa

SEQ ID NO: 66390 - DNA, 25 bp, S. pombe
atcggatttttggactttgcttcat

SEQ ID NO: 66391 - DNA, 25 bp, S. pombe
atcggttttatattctccgggcttg

SEQ ID NO: 66392 - DNA, 25 bp, S. pombe
atcggaatttttccctatgggcatt

SEQ ID NO: 66393 - DNA, 25 bp, S. pombe
atcgggtttgaatccattgccttta

SEQ ID NO: 66394 - DNA, 25 bp, S. pombe
atcgaagttcagcaacactctcgtt

SEQ ID NO: 66395 - DNA, 25 bp, S. pombe
atctggtcaaccgtacaaggcttac

SEQ ID NO: 66396 - DNA, 25 bp, S. pombe
atcggaaagttcttgtgcactgaca

SEQ ID NO: 66397 - DNA, 25 bp, S. pombe
atcggtcaattgcaatggctctcac

SEQ ID NO: 66398 - DNA, 25 bp, S. pombe
atcggtatttgctatgagccacccc

SEQ ID NO: 66399 - DNA, 25 bp, S. pombe
atcgttgacttttgctggcaccaag

SEQ ID NO: 66400 - DNA, 25 bp, S. pombe
atcctcgtatactccatttgtcatg

SEQ ID NO: 66401 - DNA, 25 bp, S. pombe
acctcactagaagtcgaccgtcatg

SEQ ID NO: 66402 - DNA, 25 bp, S. pombe
atccttcaggaatgcgaccgatcaa

SEQ ID NO: 66403 - DNA, 25 bp, S. pombe
atcgctaattatgaccctgctgaaa

SEQ ID NO: 66404 - DNA, 25 bp, S. pombe
atcctcaattcctgctgacggaaca

SEQ ID NO: 66405 - DNA, 25 bp, S. pombe
atcgacaaagtctgagcgtgctaaa

SEQ ID NO: 66406 - DNA, 25 bp, S. pombe
atcgtgccaattgcagtgccttgat

SEQ ID NO: 66407 - DNA, 25 bp, S. pombe
atcggatatgtctcatgtgcaccaa

SEQ ID NO: 66408 - DNA, 25 bp, S. pombe
atctgcctttggaccagcatggaca

SEQ ID NO: 66409 - DNA, 25 bp, S. pombe
atcgagtgtattaccagacagccca

SEQ ID NO: 66410 - DNA, 25 bp, S. pombe
atccttaacagctttggacttacta

SEQ ID NO: 66411 - DNA, 25 bp, S. pombe
atccgcaaatacctatatggctcct

SEQ ID NO: 66412 - DNA, 25 bp, S. pombe
atccctgtttcaaaaccgcaatctg

SEQ ID NO: 66413 - DNA, 25 bp, S. pombe
atccgttttgctgattccactgatc

SEQ ID NO: 66414 - DNA, 25 bp, S. pombe
atcgtagttattcatctccacttgc

SEQ ID NO: 66415 - DNA, 25 bp, S. pombe
atcgtttccattccacatcaaattc

SEQ ID NO: 66416 - DNA, 25 bp, S. pombe
atcgtcttttgtcccatgtatatgc

SEQ ID NO: 66417 - DNA, 25 bp, S. pombe
atcgtttgggcaaagctgcttctgt

SEQ ID NO: 66418 - DNA, 25 bp, S. pombe
atcgtcttgcccaaagcggtgtcaa

SEQ ID NO: 66419 - DNA, 25 bp, S. pombe
atcgtttccatcaccgtggcataat

SEQ ID NO: 66420 - DNA, 25 bp, S. pombe
atcgttccgcaatctttactacaaa

SEQ ID NO: 66421 - DNA, 25 bp, S. pombe
atcgtacctagaatctcttacttaa

SEQ ID NO: 66422 - DNA, 25 bp, S. pombe
atcgttctcaactttcttcactata

SEQ ID NO: 66423 - DNA, 25 bp, S. pombe
atcgtttgaacgttgctttaagcag

SEQ ID NO: 66424 - DNA, 25 bp, S. pombe
atcgtttgttggttgctttgggcaa

SEQ ID NO: 66425 - DNA, 25 bp, S. pombe
atcgttatccgactctgttatgttg

SEQ ID NO: 66426 - DNA, 25 bp, S. pombe
atctggtacccatttgctttgttag

SEQ ID NO: 66427 - DNA, 25 bp, S. pombe
atctggatatatgggttcgttggta

SEQ ID NO: 66428 - DNA, 25 bp, S. pombe
atcgccagcaaccaactacttggtt

SEQ ID NO: 66429 - DNA, 25 bp, S. pombe
atcgctgcagatttgggaacgtctt

SEQ ID NO: 66430 - DNA, 25 bp, S. pombe
atcgcattattaccgctggcttaag

SEQ ID NO: 66431 - DNA, 25 bp, S. pombe
atctgttcaatggactctggcttca

SEQ ID NO: 66432 - DNA, 25 bp, S. pombe
atcgagtcatcaatagccgtggcac

SEQ ID NO: 66433 - DNA, 25 bp, S. pombe
atcgctgtcactgatgctcaatgtt

SEQ ID NO: 66434 - DNA, 25 bp, S. pombe
atcgagtatctcgtgcatattcctc

SEQ ID NO: 66435 - DNA, 25 bp, S. pombe
atcgcgatttatactcaaacacctg

SEQ ID NO: 66436 - DNA, 25 bp, S. pombe
atcgagtttgtgttggttttctgaa

SEQ ID NO: 66437 - DNA, 25 bp, S. pombe
atcggtgtcgtattgtttggtctca

SEQ ID NO: 66438 - DNA, 25 bp, S. pombe
atcggctctcttttgtttgttacac

SEQ ID NO: 66439 - DNA, 25 bp, S. pombe
atcgggatttgtggcattccttcaa

SEQ ID NO: 66440 - DNA, 25 bp, S. pombe
atcgtgacgctgaacctgtgaaaac

SEQ ID NO: 66441 - DNA, 25 bp, S. pombe
atcctttgatgaccctgaatactat

SEQ ID NO: 66442 - DNA, 25 bp, S. pombe
atctgtggatgcgaagggctcctcc

SEQ ID NO: 66443 - DNA, 25 bp, S. pombe
atcggtgctgcttttggctatagga

SEQ ID NO: 66444 - DNA, 25 bp, S. pombe
atcgtactaagttatctgccgcgtt

SEQ ID NO: 66445 - DNA, 25 bp, S. pombe
atctggactgcttgtgaaattcggt

SEQ ID NO: 66446 - DNA, 25 bp, S. pombe
atcggacagctcctgacacattgga

SEQ ID NO: 66447 - DNA, 25 bp, S. pombe
atcgatgatcgtatccgcattcagc

SEQ ID NO: 66448 - DNA, 25 bp, S. pombe
atctggatcctcattgtactcactt

SEQ ID NO: 66449 - DNA, 25 bp, S. pombe
atcggatatctcattgtttcgttat

SEQ ID NO: 66450 - DNA, 25 bp, S. pombe
atcgggttgcacttgtttttcattg

SEQ ID NO: 66451 - DNA, 25 bp, S. pombe
atctggtttcacttgcaatcttatc

SEQ ID NO: 66452 - DNA, 25 bp, S. pombe
atctgtgctgtttttgaactctccc

SEQ ID NO: 66453 - DNA, 25 bp, S. pombe
atccgtgtgattggtgacgctaccc

SEQ ID NO: 66454 - DNA, 25 bp, S. pombe
atccgaagatcttggtgcagtcacc

SEQ ID NO: 66455 - DNA, 25 bp, S. pombe
atcggtgataaaatgcagtgtactc

SEQ ID NO: 66456 - DNA, 25 bp, S. pombe
atcgggtccaagtatgatgccaaca

SEQ ID NO: 66457 - DNA, 25 bp, S. pombe
atcgaggtcaccttcgatgttgacg

SEQ ID NO: 66458 - DNA, 25 bp, S. pombe
atcgatcttgattttgcccgtgtct

SEQ ID NO: 66459 - DNA, 25 bp, S. pombe
atcgagatgtctttgggccttttag

SEQ ID NO: 66460 - DNA, 25 bp, S. pombe
atcgtagtgctgttttgcctgctaa

SEQ ID NO: 66461 - DNA, 25 bp, S. pombe
atcgtcgctcgatattacttatgga

SEQ ID NO: 66462 - DNA, 25 bp, S. pombe
gacgaggtcgagtttgacgaaacca

SEQ ID NO: 66463 - DNA, 25 bp, S. pombe
atcgtgttcgcgttctatccagaaa

SEQ ID NO: 66464 - DNA, 25 bp, S. pombe
atccggcgatctaatcttaaacaag

SEQ ID NO: 66465 - DNA, 25 bp, S. pombe
atcgacgctgtttacatgcggccaa

SEQ ID NO: 66466 - DNA, 25 bp, S. pombe
atcggcgcaggtgttggtattgcac

SEQ ID NO: 66467 - DNA, 25 bp, S. pombe
atcgttggcattcagttcttctttt

SEQ ID NO: 66468 - DNA, 25 bp, S. pombe
atcgaagggtttgtgctctttttct

SEQ ID NO: 66469 - DNA, 25 bp, S. pombe
atccgcactctttacctggatttaa

SEQ ID NO: 66470 - DNA, 25 bp, S. pombe
atcgttcgtgttactggtggtatga

SEQ ID NO: 66471 - DNA, 25 bp, S. pombe
atcctgccgctactttagttggtga

SEQ ID NO: 66472 - DNA, 25 bp, S. pombe
atcctgctaatacaacaattcgtca

SEQ ID NO: 66473 - DNA, 25 bp, S. pombe
atccccgataaaactcatactgcta

SEQ ID NO: 66474 - DNA, 25 bp, S. pombe
atcgcgcacgtaggcaagtctctga

SEQ ID NO: 66475 - DNA, 25 bp, S. pombe
atcgctcatcaaatgcactacttcg

SEQ ID NO: 66476 - DNA, 25 bp, S. pombe
atcgatcatctgtctactattttgg

SEQ ID NO: 66477 - DNA, 25 bp, S. pombe
atggacgcgtgtgtttttggttgaa

SEQ ID NO: 66478 - DNA, 25 bp, S. pombe
atgggcgtgtttgttctagccttta

SEQ ID NO: 66479 - DNA, 25 bp, S. pombe
acgccggaggtgttaatagccttgt

SEQ ID NO: 66480 - DNA, 25 bp, S. pombe
atcgaaatcttgatgctgccactag

SEQ ID NO: 66481 - DNA, 25 bp, S. pombe
atcctggactttgcaacccaacata

SEQ ID NO: 66482 - DNA, 25 bp, S. pombe
atcgttagtgcttgtgaaccgctca

SEQ ID NO: 66483 - DNA, 25 bp, S. pombe
atcctcctagtaatcccgaatctga

SEQ ID NO: 66484 - DNA, 25 bp, S. pombe
atcggctgctactcatgacctaaat

SEQ ID NO: 66485 - DNA, 25 bp, S. pombe
atcgacctcactaaagctgatcaaa

SEQ ID NO: 66486 - DNA, 25 bp, S. pombe
atcggctattgaggatcttctgcaa

SEQ ID NO: 66487 - DNA, 25 bp, S. pombe
atcgtggattagtttgcatatgcaa

SEQ ID NO: 66488 - DNA, 25 bp, S. pombe
atcggcttctcgattctgtgtagaa

SEQ ID NO: 66489 - DNA, 25 bp, S. pombe
atcggaatcgacttcgctagttgaa

SEQ ID NO: 66490 - DNA, 25 bp, S. pombe
atcggatggtactctgtcgcttgaa

SEQ ID NO: 66491 - DNA, 25 bp, S. pombe
atcggataaataccctcagctgtga

SEQ ID NO: 66492 - DNA, 25 bp, S. pombe
atgccgagcaagatcccgatgcggt

SEQ ID NO: 66493 - DNA, 25 bp, S. pombe
atgccgatggaagctttgtccgttc

SEQ ID NO: 66494 - DNA, 25 bp, S. pombe
atccgcgaaatctcagtactctgta

SEQ ID NO: 66495 - DNA, 25 bp, S. pombe
atcccatgcatccacaacattggta

SEQ ID NO: 66496 - DNA, 25 bp, S. pombe
atccctcctgtattttcacactatg

SEQ ID NO: 66497 - DNA, 25 bp, S. pombe
atcctggcaagcgagtcctgaagtg

SEQ ID NO: 66498 - DNA, 25 bp, S. pombe
atcctcgaaatcttcctgaacggtg

SEQ ID NO: 66499 - DNA, 25 bp, S. pombe
atcctggaatttgccgaatttgcta

SEQ ID NO: 66500 - DNA, 25 bp, S. pombe
atcggtttgatttacagcatgctac

SEQ ID NO: 66501 - DNA, 25 bp, S. pombe
atcgtgttgttctccgtgacaagca

SEQ ID NO: 66502 - DNA, 25 bp, S. pombe
atcgatgttttatctggttcccaat

SEQ ID NO: 66503 - DNA, 25 bp, S. pombe
atccacgtatttttcttaccagcgc

SEQ ID NO: 66504 - DNA, 25 bp, S. pombe
atgcccgttctcagattaaacccag

SEQ ID NO: 66505 - DNA, 25 bp, S. pombe
atcgatgttgaactgtcattcctca

SEQ ID NO: 66506 - DNA, 25 bp, S. pombe
atcccaatactgatacgcctcgatt

SEQ ID NO: 66507 - DNA, 25 bp, S. pombe
atcccaaatttgtagcgtcttgcgc

SEQ ID NO: 66508 - DNA, 25 bp, S. pombe
atgctcgagcctttggacgacttgg

SEQ ID NO: 66509 - DNA, 25 bp, S. pombe
atcggtgctattgctacaatcttct

SEQ ID NO: 66510 - DNA, 25 bp, S. pombe
atcggtctctggttgtatgatcgca

SEQ ID NO: 66511 - DNA, 25 bp, S. pombe
acgttccatggactgatgacaatga

SEQ ID NO: 66512 - DNA, 25 bp, S. pombe
atcgttccttgatgaaagctgcgtt

SEQ ID NO: 66513 - DNA, 25 bp, S. pombe
atcctacctattcaagatctcgtcg

SEQ ID NO: 66514 - DNA, 25 bp, S. pombe
atcgctggactttacgtgagactga

SEQ ID NO: 66515 - DNA, 25 bp, S. pombe
atcgcatggcgtgtatcttggtcat

SEQ ID NO: 66516 - DNA, 25 bp, S. pombe
atccttcgtttagagaggctgccca

SEQ ID NO: 66517 - DNA, 25 bp, S. pombe
atcctgatgggactatacgaacgtt

SEQ ID NO: 66518 - DNA, 25 bp, S. pombe
atcgagttactgcatctctaggcaa

SEQ ID NO: 66519 - DNA, 25 bp, S. pombe
atccgttgcactcaacatcagcaga

SEQ ID NO: 66520 - DNA, 25 bp, S. pombe
atcgagaacctcaacaatgccattg

SEQ ID NO: 66521 - DNA, 25 bp, S. pombe
atcgtattgcacttcgaattgccaa

SEQ ID NO: 66522 - DNA, 25 bp, S. pombe
atcgcaatgatcctagaaacccaaa

SEQ ID NO: 66523 - DNA, 25 bp, S. pombe
atcgatagccgatctcagtctaaaa

SEQ ID NO: 66524 - DNA, 25 bp, S. pombe
atcgtctgctcacattgcaatcgaa

SEQ ID NO: 66525 - DNA, 25 bp, S. pombe
accaatcaatggttcaccggtttcg

SEQ ID NO: 66526 - DNA, 25 bp, S. pombe
atcccaatggcaccagatactgctt

SEQ ID NO: 66527 - DNA, 25 bp, S. pombe
atcccagtgatgctcgaaagtttca

SEQ ID NO: 66528 - DNA, 25 bp, S. pombe
atcgttggtgccgttcaagtttcaa

SEQ ID NO: 66529 - DNA, 25 bp, S. pombe
atccttcaacgagtatattgattaa

SEQ ID NO: 66530 - DNA, 25 bp, S. pombe
atcgtctatggtggatgcctctaaa

SEQ ID NO: 66531 - DNA, 25 bp, S. pombe
atcgcatatcaacaggtcgctcaat

SEQ ID NO: 66532 - DNA, 25 bp, S. pombe
atccaatcgatgtcagtctcagtaa

SEQ ID NO: 66533 - DNA, 25 bp, S. pombe
atcgtcatcgtgcagtttctacaga

SEQ ID NO: 66534 - DNA, 25 bp, S. pombe
atccttttgaggatccaaagccaag

SEQ ID NO: 66535 - DNA, 25 bp, S. pombe
atccctgttaccgtcaacaatggca

SEQ ID NO: 66536 - DNA, 25 bp, S. pombe
atcccttcttacctcaaactgaatt

SEQ ID NO: 66537 - DNA, 25 bp, S. pombe
atcgctgctttcactttaccaagtt

SEQ ID NO: 66538 - DNA, 25 bp, S. pombe
atgcggattcctgttattcgtagtc

SEQ ID NO: 66539 - DNA, 25 bp, S. pombe
atcgctgtttggcttaacgttgtct

SEQ ID NO: 66540 - DNA, 25 bp, S. pombe
atcgcgtatcggttcaaaagttgtt

SEQ ID NO: 66541 - DNA, 25 bp, S. pombe
atccggctgcgtttgcaaaacatgt

SEQ ID NO: 66542 - DNA, 25 bp, S. pombe
atccaagtgcggttgccaagattgc

SEQ ID NO: 66543 - DNA, 25 bp, S. pombe
atcccaagcgggactggtattcttt

SEQ ID NO: 66544 - DNA, 25 bp, S. pombe
atccgctacggcagtgttgttctta

SEQ ID NO: 66545 - DNA, 25 bp, S. pombe
atccaactccttcatttcttttaga

SEQ ID NO: 66546 - DNA, 25 bp, S. pombe
atccaaacgtttatccttctggcac

SEQ ID NO: 66547 - DNA, 25 bp, S. pombe
atgccaattcgtcttctacttgtac

SEQ ID NO: 66548 - DNA, 25 bp, S. pombe
atcctagatttatccttgtttccta

SEQ ID NO: 66549 - DNA, 25 bp, S. pombe
atcctgaatctgtaccctttaatct

SEQ ID NO: 66550 - DNA, 25 bp, S. pombe
atgcgaggttgggtcttttagctac

SEQ ID NO: 66551 - DNA, 25 bp, S. pombe
atcgcacgttggttcttcttagtag

SEQ ID NO: 66552 - DNA, 25 bp, S. pombe
atcgatccgtcagtagcattttcca

SEQ ID NO: 66553 - DNA, 25 bp, S. pombe
atcgacttgcataaccagtgttttc

SEQ ID NO: 66554 - DNA, 25 bp, S. pombe
atcgatcttatatgtcaggacgttt

SEQ ID NO: 66555 - DNA, 25 bp, S. pombe
atccttctactaatgggccagctat

SEQ ID NO: 66556 - DNA, 25 bp, S. pombe
atccgtccctaatgatgtcgctgaa

SEQ ID NO: 66557 - DNA, 25 bp, S. pombe
atccgctgtactttccatgttctat

SEQ ID NO: 66558 - DNA, 25 bp, S. pombe
atcccggctggaatatttcgtttgc

SEQ ID NO: 66559 - DNA, 25 bp, S. pombe
atcctcgtgttgctgttaagtcttg

SEQ ID NO: 66560 - DNA, 25 bp, S. pombe
atccataattgcactgtttccgtcg

SEQ ID NO: 66561 - DNA, 25 bp, S. pombe
atccggacactttttcctcagataa

SEQ ID NO: 66562 - DNA, 25 bp, S. pombe
atccggatgatgctggttcttccaa

SEQ ID NO: 66563 - DNA, 25 bp, S. pombe
atcgttattagagtcgttgcccacc

SEQ ID NO: 66564 - DNA, 25 bp, S. pombe
atcgctttcatgaactagtctctga

SEQ ID NO: 66565 - DNA, 25 bp, S. pombe
atcgcttctgctaatgctggatcta

SEQ ID NO: 66566 - DNA, 25 bp, S. pombe
atcgatatgcccgttggactattga

SEQ ID NO: 66567 - DNA, 25 bp, S. pombe
atcgcttagcgatcggttcgaattt

SEQ ID NO: 66568 - DNA, 25 bp, S. pombe
atccttgaggctgctggtggtgatt

SEQ ID NO: 66569 - DNA, 25 bp, S. pombe
atgccttacgctcctggagacgaaa

SEQ ID NO: 66570 - DNA, 25 bp, S. pombe
atgccccaggtgctcgaaacagaag

SEQ ID NO: 66571 - DNA, 25 bp, S. pombe
atcctaccgatgttgtaaaaactca

SEQ ID NO: 66572 - DNA, 25 bp, S. pombe
atgcttccgatcgtaaggtattctt

SEQ ID NO: 66573 - DNA, 25 bp, S. pombe
atgctggtcgactttgtggtacctt

SEQ ID NO: 66574 - DNA, 25 bp, S. pombe
atgcggtcgcaaagtcgcgtacgtt

SEQ ID NO: 66575 - DNA, 25 bp, S. pombe
atccgatgaagacccggctgttttt

SEQ ID NO: 66576 - DNA, 25 bp, S. pombe
atccgatgaaactctgactgtccgt

SEQ ID NO: 66577 - DNA, 25 bp, S. pombe
atcctgatcaagtctttcaaaccgt

SEQ ID NO: 66578 - DNA, 25 bp, S. pombe
atgccgacagagtttccaaagccag

SEQ ID NO: 66579 - DNA, 25 bp, S. pombe
atccgttggtttatcctgttgcata

SEQ ID NO: 66580 - DNA, 25 bp, S. pombe
atcccgtgtttgattccttgtgcaa

SEQ ID NO: 66581 - DNA, 25 bp, S. pombe
atgctcgtaccgcagcttcaagagg

SEQ ID NO: 66582 - DNA, 25 bp, S. pombe
atcgcatgttcacgacactcaaagg

SEQ ID NO: 66583 - DNA, 25 bp, S. pombe
atcgcaacctcctagtatcaagacg

SEQ ID NO: 66584 - DNA, 25 bp, S. pombe
atcgattttcctgaagctctgcaac

SEQ ID NO: 66585 - DNA, 25 bp, S. pombe
atgcgcttgatgtctgtgcaaacgt

SEQ ID NO: 66586 - DNA, 25 bp, S. pombe
atgctgcttgttagcaggaacattt

SEQ ID NO: 66587 - DNA, 25 bp, S. pombe
atcctgattctccagcgaagctatt

SEQ ID NO: 66588 - DNA, 25 bp, S. pombe
atccttcttctccaattccaatttt

SEQ ID NO: 66589 - DNA, 25 bp, S. pombe
atcctttggcctctatattatcttc

SEQ ID NO: 66590 - DNA, 25 bp, S. pombe
atggtttgccggtaatttagcctct

SEQ ID NO: 66591 - DNA, 25 bp, S. pombe
atcctttccggatcatttgctacat

SEQ ID NO: 66592 - DNA, 25 bp, S. pombe
atgccatttgcttgtacggttgcta

SEQ ID NO: 66593 - DNA, 25 bp, S. pombe
atcgaatctgtctatacggtcttga

SEQ ID NO: 66594 - DNA, 25 bp, S. pombe
atcctacactcacatgccgtatgta

SEQ ID NO: 66595 - DNA, 25 bp, S. pombe
atgccacttataccttgagtcacgg

SEQ ID NO: 66596 - DNA, 25 bp, S. pombe
atcctcacccttccgatattgatta

SEQ ID NO: 66597 - DNA, 25 bp, S. pombe
atcctacaccctacaattcttataa

SEQ ID NO: 66598 - DNA, 25 bp, S. pombe
atcccaacgctcgattttcttattc

SEQ ID NO: 66599 - DNA, 25 bp, S. pombe
atcgccaaactatgtctgctctgaa

SEQ ID NO: 66600 - DNA, 25 bp, S. pombe
atcccacattgcacgtttctgaaga

SEQ ID NO: 66601 - DNA, 25 bp, S. pombe
atcgccgtcgagctagtgattgcat

SEQ ID NO: 66602 - DNA, 25 bp, S. pombe
atcctggcttacttgattcttgcat

SEQ ID NO: 66603 - DNA, 25 bp, S. pombe
atccatccttttgattggcctcaaa

SEQ ID NO: 66604 - DNA, 25 bp, S. pombe
atcctccttatgtgtatggtccacc

SEQ ID NO: 66605 - DNA, 25 bp, S. pombe
atccagtgcgtcttgtagagtttac

SEQ ID NO: 66606 - DNA, 25 bp, S. pombe
atcgactctaattgctgctgcttta

SEQ ID NO: 66607 - DNA, 25 bp, S. pombe
atcgcagctgcatatactcggttaa

SEQ ID NO: 66608 - DNA, 25 bp, S. pombe
atcgcaactccaactgctggtttaa

SEQ ID NO: 66609 - DNA, 25 bp, S. pombe
atcgaactgcacgactctgggatgt

SEQ ID NO: 66610 - DNA, 25 bp, S. pombe
atcgaattgcacctgcgagatggtt

SEQ ID NO: 66611 - DNA, 25 bp, S. pombe
atgcttctctaactgctaaggtcgc

SEQ ID NO: 66612 - DNA, 25 bp, S. pombe
atgactattcctgtaagggcactaa

SEQ ID NO: 66613 - DNA, 25 bp, S. pombe
atcctattccggaagattggcctta

SEQ ID NO: 66614 - DNA, 25 bp, S. pombe
atgcctttcttcctcaaagagcttt

SEQ ID NO: 66615 - DNA, 25 bp, S. pombe
atcctttgctcccatgacgagaatt

SEQ ID NO: 66616 - DNA, 25 bp, S. pombe
atcctcctcctctgaagatgaattc

SEQ ID NO: 66617 - DNA, 25 bp, S. pombe
atcgcacacttcgttatgctcgtaa

SEQ ID NO: 66618 - DNA, 25 bp, S. pombe
atcgcacatcccttctttggataaa

SEQ ID NO: 66619 - DNA, 25 bp, S. pombe
atccaatcctattcccgttgagaaa

SEQ ID NO: 66620 - DNA, 25 bp, S. pombe
atccccggccttagtgttgacagga

SEQ ID NO: 66621 - DNA, 25 bp, S. pombe
atcctccttggcttattttagtgcg

SEQ ID NO: 66622 - DNA, 25 bp, S. pombe
atcctcgattcatggtctttggcag

SEQ ID NO: 66623 - DNA, 25 bp, S. pombe
atcccatgcttagttgtttcggctg

SEQ ID NO: 66624 - DNA, 25 bp, S. pombe
atccctgcttacgttttgattgctt

SEQ ID NO: 66625 - DNA, 25 bp, S. pombe
atccacgagctacttttacggctga

SEQ ID NO: 66626 - DNA, 25 bp, S. pombe
atccatccatgcatcgtttacgaaa

SEQ ID NO: 66627 - DNA, 25 bp, S. pombe
atccttctgttcgtggtcaactaga

SEQ ID NO: 66628 - DNA, 25 bp, S. pombe
atccctgagggcgtttcagttgaca

SEQ ID NO: 66629 - DNA, 25 bp, S. pombe
atcccgctcacttatgcttaacttt

SEQ ID NO: 66630 - DNA, 25 bp, S. pombe
atccggcttgcattgatccttattt

SEQ ID NO: 66631 - DNA, 25 bp, S. pombe
atcgctggattgttgctcactctaa

SEQ ID NO: 66632 - DNA, 25 bp, S. pombe
atcgctgcagttatcgcagttgcaa

SEQ ID NO: 66633 - DNA, 25 bp, S. pombe
atccagagagcttggcatccagcat

SEQ ID NO: 66634 - DNA, 25 bp, S. pombe
atcgcgcagagtttatcgctgtcac

SEQ ID NO: 66635 - DNA, 25 bp, S. pombe
atcgcgacttttgtgatctcagcat

SEQ ID NO: 66636 - DNA, 25 bp, S. pombe
atccgacgtcttggtgctcttcagg

SEQ ID NO: 66637 - DNA, 25 bp, S. pombe
atccacggcgttagacactagggta

SEQ ID NO: 66638 - DNA, 25 bp, S. pombe
atgcgtgctaaacttttcagatttg

SEQ ID NO: 66639 - DNA, 25 bp, S. pombe
atcgccttcaagtttatacatctcc

SEQ ID NO: 66640 - DNA, 25 bp, S. pombe
atgctggcttaatgcttatacgtcc

SEQ ID NO: 66641 - DNA, 25 bp, S. pombe
atcctgctgatttgcgttataccac

SEQ ID NO: 66642 - DNA, 25 bp, S. pombe
atccgagacataaaacccgtcaagg

SEQ ID NO: 66643 - DNA, 25 bp, S. pombe
atccaaagagatcaggcccgtcaag

SEQ ID NO: 66644 - DNA, 25 bp, S. pombe
atccgcatttattggctcttcgaga

SEQ ID NO: 66645 - DNA, 25 bp, S. pombe
atgccagtctttaccaaggaagctt

SEQ ID NO: 66646 - DNA, 25 bp, S. pombe
atcgcctggctcgtgtcaaacagat

SEQ ID NO: 66647 - DNA, 25 bp, S. pombe
atcgccggcgctggatcaaaagcta

SEQ ID NO: 66648 - DNA, 25 bp, S. pombe
atgcgaattcgatatcatgctaata

SEQ ID NO: 66649 - DNA, 25 bp, S. pombe
atcgcttctcgtagttgctattgcc

SEQ ID NO: 66650 - DNA, 25 bp, S. pombe
atcgctttggccagtgctgatgatt

SEQ ID NO: 66651 - DNA, 25 bp, S. pombe
atgcagcccgcgactatgaattatt

SEQ ID NO: 66652 - DNA, 25 bp, S. pombe
atgatccgggtcttacgaatgctaa

SEQ ID NO: 66653 - DNA, 25 bp, S. pombe
atgcctctaggttgcttcgatagct

SEQ ID NO: 66654 - DNA, 25 bp, S. pombe
atcgcgttatccgtacagtcagtat

SEQ ID NO: 66655 - DNA, 25 bp, S. pombe
atccgttaccctttgctaaatcata

SEQ ID NO: 66656 - DNA, 25 bp, S. pombe
atcgcgttaccattttgtgtgacaa

SEQ ID NO: 66657 - DNA, 25 bp, S. pombe
atcgcgctatgtttctgcttggtta

SEQ ID NO: 66658 - DNA, 25 bp, S. pombe
atgcagcttggtcaatacctctttc

SEQ ID NO: 66659 - DNA, 25 bp, S. pombe
atcctataggcgcagagtcctttga

SEQ ID NO: 66660 - DNA, 25 bp, S. pombe
atcgccttccgtttctattttggat

SEQ ID NO: 66661 - DNA, 25 bp, S. pombe
atcctacacacttacttctggtggt

SEQ ID NO: 66662 - DNA, 25 bp, S. pombe
atgccttcgaggtcatcgaggctca

SEQ ID NO: 66663 - DNA, 25 bp, S. pombe
atgccagctcaaggacatagactgt

SEQ ID NO: 66664 - DNA, 25 bp, S. pombe
atccagctctagttacagtcgcaag

SEQ ID NO: 66665 - DNA, 25 bp, S. pombe
atcctgctattttgtgcgtcgcaaa

SEQ ID NO: 66666 - DNA, 25 bp, S. pombe
atccctaattcaggcttcgtgttta

SEQ ID NO: 66667 - DNA, 25 bp, S. pombe
atgccatcattatatcgttcggtgt

SEQ ID NO: 66668 - DNA, 25 bp, S. pombe
atccgaattcgcttcttgactattt

SEQ ID NO: 66669 - DNA, 25 bp, S. pombe
atccacgagtgtcagaagtcctctc

SEQ ID NO: 66670 - DNA, 25 bp, S. pombe
atccacaggtggtaaatttgcttca

SEQ ID NO: 66671 - DNA, 25 bp, S. pombe
atcccagttgatcaggtgttgccta

SEQ ID NO: 66672 - DNA, 25 bp, S. pombe
atcccagttttcaagctttgccata

SEQ ID NO: 66673 - DNA, 25 bp, S. pombe
atccgttggtagtcaatctgccgat

SEQ ID NO: 66674 - DNA, 25 bp, S. pombe
atccgtcttttccaatctgctagaa

SEQ ID NO: 66675 - DNA, 25 bp, S. pombe
atcccctgatcttgactggactcaa

SEQ ID NO: 66676 - DNA, 25 bp, S. pombe
atccctcgtgcttttgcagaacgaa

SEQ ID NO: 66677 - DNA, 25 bp, S. pombe
atccactgctattgatttcacttcc

SEQ ID NO: 66678 - DNA, 25 bp, S. pombe
atccgtcacaaagtcgttcagcagc

SEQ ID NO: 66679 - DNA, 25 bp, S. pombe
atgctctcagcacaccaagaatcag

SEQ ID NO: 66680 - DNA, 25 bp, S. pombe
atcctcatgcaacgtctcattcaag

SEQ ID NO: 66681 - DNA, 25 bp, S. pombe
atcctatggatcattagcgcgcttt

SEQ ID NO: 66682 - DNA, 25 bp, S. pombe
atccatatcttcttggcgcatgtga

SEQ ID NO: 66683 - DNA, 25 bp, S. pombe
atccacgtgctcttgtgtcaatgac

SEQ ID NO: 66684 - DNA, 25 bp, S. pombe
atcctgctgatgttatggtttccaa

SEQ ID NO: 66685 - DNA, 25 bp, S. pombe
atcctgttcgcattgatgtttctga

SEQ ID NO: 66686 - DNA, 25 bp, S. pombe
atcccttgcgatttggttgcattgg

SEQ ID NO: 66687 - DNA, 25 bp, S. pombe
atcctcattcttttggtgtcattgg

SEQ ID NO: 66688 - DNA, 25 bp, S. pombe
atccctctctttctaggcagtggat

SEQ ID NO: 66689 - DNA, 25 bp, S. pombe
atccgtgatgtttcttcactggtga

SEQ ID NO: 66690 - DNA, 25 bp, S. pombe
atcccctcaagatccagttcaagag

SEQ ID NO: 66691 - DNA, 25 bp, S. pombe
atccccacgctatacaattcagaat

SEQ ID NO: 66692 - DNA, 25 bp, S. pombe
atccccactgattctactcgtagaa

SEQ ID NO: 66693 - DNA, 25 bp, S. pombe
atgcccaacttgtcgggcgattgga

SEQ ID NO: 66694 - DNA, 25 bp, S. pombe
atccaactcggtgctggtttgtcag

SEQ ID NO: 66695 - DNA, 25 bp, S. pombe
atccaactgttgttcgtcttttagc

SEQ ID NO: 66696 - DNA, 25 bp, S. pombe
atccaggtgaggtttgtcttttgaa

SEQ ID NO: 66697 - DNA, 25 bp, S. pombe
atgccttgtctgatttaccgtttaa

SEQ ID NO: 66698 - DNA, 25 bp, S. pombe
atccgtgtacgaattcctgctcaga

SEQ ID NO: 66699 - DNA, 25 bp, S. pombe
atgctcctagtgttttgcctcaaaa

SEQ ID NO: 66700 - DNA, 25 bp, S. pombe
atcccgaatggactaatgtatacaa

SEQ ID NO: 66701 - DNA, 25 bp, S. pombe
atccaatggaatgctgaatactgtg

SEQ ID NO: 66702 - DNA, 25 bp, S. pombe
atgcttccggtttcattggtggtaa

SEQ ID NO: 66703 - DNA, 25 bp, S. pombe
atccttcccctcctggtgatggaaa

SEQ ID NO: 66704 - DNA, 25 bp, S. pombe
atcctggcgtcaatctacttgttga

SEQ ID NO: 66705 - DNA, 25 bp, S. pombe
atcctgactggattcgatcgtgttt

SEQ ID NO: 66706 - DNA, 25 bp, S. pombe
atgccaggcgtgtacaattctgtca

SEQ ID NO: 66707 - DNA, 25 bp, S. pombe
atccactgcgtgtaactgtttgtct

SEQ ID NO: 66708 - DNA, 25 bp, S. pombe
atgctgtcggtgttcttttatgttc

SEQ ID NO: 66709 - DNA, 25 bp, S. pombe
atccccaagggtgttactgttgaca

SEQ ID NO: 66710 - DNA, 25 bp, S. pombe
atcctccacagggttttagcgttgg

SEQ ID NO: 66711 - DNA, 25 bp, S. pombe
atccccactggatgtctaacatttt

SEQ ID NO: 66712 - DNA, 25 bp, S. pombe
atccttactggcttcctaactttat

SEQ ID NO: 66713 - DNA, 25 bp, S. pombe
atcccggcatgttcttttgcgcgaa

SEQ ID NO: 66714 - DNA, 25 bp, S. pombe
atgcctcgtcaggttaccgatatca

SEQ ID NO: 66715 - DNA, 25 bp, S. pombe
atcctgatggtgatcacttgacctt

SEQ ID NO: 66716 - DNA, 25 bp, S. pombe
atcctgaactgaatcctaagcgctc

SEQ ID NO: 66717 - DNA, 25 bp, S. pombe
atgccatggacttgtttgacatcgt

SEQ ID NO: 66718 - DNA, 25 bp, S. pombe
atgccctggatacgatgctattacc

SEQ ID NO: 66719 - DNA, 25 bp, S. pombe
atccagcgatgatgaatctttgagc

SEQ ID NO: 66720 - DNA, 25 bp, S. pombe
atgcgggatgcaccttcatttgaaa

SEQ ID NO: 66721 - DNA, 25 bp, S. pombe
atgcatctagaaaacgtcttcctgt

SEQ ID NO: 66722 - DNA, 25 bp, S. pombe
atgcattagaagtccgttcggcgat

SEQ ID NO: 66723 - DNA, 25 bp, S. pombe
atgcggaaactgtcaagctcgagga

SEQ ID NO: 66724 - DNA, 25 bp, S. pombe
atgatgcaatcgctctcttaaagga

SEQ ID NO: 66725 - DNA, 25 bp, S. pombe
atgcattgactccatccgatttaag

SEQ ID NO: 66726 - DNA, 25 bp, S. pombe
atgcctgatcctgcacatattatcg

SEQ ID NO: 66727 - DNA, 25 bp, S. pombe
atcctatatctctatctgcatctca

SEQ ID NO: 66728 - DNA, 25 bp, S. pombe
atgccgatgcccttgatgtagccaa

SEQ ID NO: 66729 - DNA, 25 bp, S. pombe
atgccgatcctgttttggacatgct

SEQ ID NO: 66730 - DNA, 25 bp, S. pombe
atgcagccgagattgcttccaatgt

SEQ ID NO: 66731 - DNA, 25 bp, S. pombe
atggcagctcagtctgctggtaatc

SEQ ID NO: 66732 - DNA, 25 bp, S. pombe
atgcgagcatcagctgtgcgtggta

SEQ ID NO: 66733 - DNA, 25 bp, S. pombe
atgcaaatgcttgatcgccgtgatc

SEQ ID NO: 66734 - DNA, 25 bp, S. pombe
atgcgatatcatcgtcatcagccgc

SEQ ID NO: 66735 - DNA, 25 bp, S. pombe
atgcgatcatccttaaagccagtgc

SEQ ID NO: 66736 - DNA, 25 bp, S. pombe
atccagtttggccagaagtggtcga

SEQ ID NO: 66737 - DNA, 25 bp, S. pombe
atgccagttttctaccgaggatcta

SEQ ID NO: 66738 - DNA, 25 bp, S. pombe
atgaacggctccttaagtccaagct

SEQ ID NO: 66739 - DNA, 25 bp, S. pombe
atccatggtacctaaacttccttgc

SEQ ID NO: 66740 - DNA, 25 bp, S. pombe
atccattttttcaacagcttccttc

SEQ ID NO: 66741 - DNA, 25 bp, S. pombe
atcctctatttattccatcttggct

SEQ ID NO: 66742 - DNA, 25 bp, S. pombe
atgccttatccctataacacttgga

SEQ ID NO: 66743 - DNA, 25 bp, S. pombe
atccttcatcccctattcaatggag

SEQ ID NO: 66744 - DNA, 25 bp, S. pombe
atgcttgtccaacctgtaataccga

SEQ ID NO: 66745 - DNA, 25 bp, S. pombe
atgcaacaccgtatttccatgggat

SEQ ID NO: 66746 - DNA, 25 bp, S. pombe
atccaagtttggtgctctgatgaca

SEQ ID NO: 66747 - DNA, 25 bp, S. pombe
atgctggtgatttacaaattgtata

SEQ ID NO: 66748 - DNA, 25 bp, S. pombe
atgctggtattcgtacaactctctc

SEQ ID NO: 66749 - DNA, 25 bp, S. pombe
atgctagattcgatggtaccatgtc

SEQ ID NO: 66750 - DNA, 25 bp, S. pombe
atgctgcgaatgctcttggtgaagt

SEQ ID NO: 66751 - DNA, 25 bp, S. pombe
atgccttgttggtgactgactgtag

SEQ ID NO: 66752 - DNA, 25 bp, S. pombe
atccttttggctatctattgtcgta

SEQ ID NO: 66753 - DNA, 25 bp, S. pombe
atcctttggacattgcacgaacgcg

SEQ ID NO: 66754 - DNA, 25 bp, S. pombe
atcctactccttcatctatagctga

SEQ ID NO: 66755 - DNA, 25 bp, S. pombe
atgctagttcctcaagcgaaccgta

SEQ ID NO: 66756 - DNA, 25 bp, S. pombe
agctgcagttttcagaaacccggat

SEQ ID NO: 66757 - DNA, 25 bp, S. pombe
atgctcatcgttaacagaaacccga

SEQ ID NO: 66758 - DNA, 25 bp, S. pombe
atgatggaatctcctcatggcggac

SEQ ID NO: 66759 - DNA, 25 bp, S. pombe
atgaggcaacagcatcagtccatgc

SEQ ID NO: 66760 - DNA, 25 bp, S. pombe
atgctacagaagcttcgtcagccaa

SEQ ID NO: 66761 - DNA, 25 bp, S. pombe
atgctacaaagcctcaatgtcccaa

SEQ ID NO: 66762 - DNA, 25 bp, S. pombe
atgccgactcattcttggatcaaac

SEQ ID NO: 66763 - DNA, 25 bp, S. pombe
atccaactcatacggtcatctacaa

SEQ ID NO: 66764 - DNA, 25 bp, S. pombe
atccttccatcggtatctacggtat

SEQ ID NO: 66765 - DNA, 25 bp, S. pombe
atcctaatcctgatgatccgcttgt

SEQ ID NO: 66766 - DNA, 25 bp, S. pombe
atccggatttcctatacgcttggtg

SEQ ID NO: 66767 - DNA, 25 bp, S. pombe
atccggattgtctaatacctcttca

SEQ ID NO: 66768 - DNA, 25 bp, S. pombe
atgctcctttgggaagacgtcttca

SEQ ID NO: 66769 - DNA, 25 bp, S. pombe
atccttttctcgatgagcgtctgat

SEQ ID NO: 66770 - DNA, 25 bp, S. pombe
atcctgttgaattgcttgacgttaa

SEQ ID NO: 66771 - DNA, 25 bp, S. pombe
atccatgggaattcttagcagcttg

SEQ ID NO: 66772 - DNA, 25 bp, S. pombe
atgccattaactcttgctagcttga

SEQ ID NO: 66773 - DNA, 25 bp, S. pombe
atgccattcagtcaagcgcttattc

SEQ ID NO: 66774 - DNA, 25 bp, S. pombe
atgctgttaaggctgctgtttccga

SEQ ID NO: 66775 - DNA, 25 bp, S. pombe
atgccttagaccacttgtatcacga

SEQ ID NO: 66776 - DNA, 25 bp, S. pombe
atccttggtccagttgttggcacga

SEQ ID NO: 66777 - DNA, 25 bp, S. pombe
atccattttcctacttaccagacag

SEQ ID NO: 66778 - DNA, 25 bp, S. pombe
atgccagacagcacgcgaacagcga

SEQ ID NO: 66779 - DNA, 25 bp, S. pombe
atgccctattttcgtctacataatt

SEQ ID NO: 66780 - DNA, 25 bp, S. pombe
atgccttcatatgccagacaagtag

SEQ ID NO: 66781 - DNA, 25 bp, S. pombe
atgctgtttgatcgccttaactcta

SEQ ID NO: 66782 - DNA, 25 bp, S. pombe
atgctgtcgtatctttaatcttggg

SEQ ID NO: 66783 - DNA, 25 bp, S. pombe
atgctgtcgttctgttcgtattgga

SEQ ID NO: 66784 - DNA, 25 bp, S. pombe
agcggtgaggctattgacgtagtat

SEQ ID NO: 66785 - DNA, 25 bp, S. pombe
atgcacttatggctttacgctggct

SEQ ID NO: 66786 - DNA, 25 bp, S. pombe
atgcgcaatattcttttcctcgtaa

SEQ ID NO: 66787 - DNA, 25 bp, S. pombe
atgccatttgcctttttcttctttg

SEQ ID NO: 66788 - DNA, 25 bp, S. pombe
atgccatttgcagcttcttactttt

SEQ ID NO: 66789 - DNA, 25 bp, S. pombe
atgcttattgcggttctggactatt

SEQ ID NO: 66790 - DNA, 25 bp, S. pombe
atgctgttaccgctgttgactttgc

SEQ ID NO: 66791 - DNA, 25 bp, S. pombe
atgctgctactatcggttacttggc

SEQ ID NO: 66792 - DNA, 25 bp, S. pombe
atgccctgtccctaattgtgataag

SEQ ID NO: 66793 - DNA, 25 bp, S. pombe
atccatcttacgttcatttagacag

SEQ ID NO: 66794 - DNA, 25 bp, S. pombe
atcctcgtgtagaagtcgtgcagct

SEQ ID NO: 66795 - DNA, 25 bp, S. pombe
atgctgtcgtgttctagctgaggca

SEQ ID NO: 66796 - DNA, 25 bp, S. pombe
atgcgatcggattcaagcttggtta

SEQ ID NO: 66797 - DNA, 25 bp, S. pombe
atgccttgccatctacatgttactt

SEQ ID NO: 66798 - DNA, 25 bp, S. pombe
atccttggtcttttactagggctag

SEQ ID NO: 66799 - DNA, 25 bp, S. pombe
atcctatttatttttctacggctcg

SEQ ID NO: 66800 - DNA, 25 bp, S. pombe
atcctattattctgctttcaccttc

SEQ ID NO: 66801 - DNA, 25 bp, S. pombe
atgcccgcttttcctattttactgg

SEQ ID NO: 66802 - DNA, 25 bp, S. pombe
atgccggcatttatccatttttggg

SEQ ID NO: 66803 - DNA, 25 bp, S. pombe
atgctaaagttggtccttccgaggc

SEQ ID NO: 66804 - DNA, 25 bp, S. pombe
atgccaaagttggtcaattcccctt

SEQ ID NO: 66805 - DNA, 25 bp, S. pombe
atcctttgtttctagagctgcttcg

SEQ ID NO: 66806 - DNA, 25 bp, S. pombe
atcctatgctttctatgcactcttg

SEQ ID NO: 66807 - DNA, 25 bp, S. pombe
atgcgtgatgaccaggtgcgttcat

SEQ ID NO: 66808 - DNA, 25 bp, S. pombe
atgcctatacgacgtccttcgttaa

SEQ ID NO: 66809 - DNA, 25 bp, S. pombe
atgccccatagaaacgatagaagaa

SEQ ID NO: 66810 - DNA, 25 bp, S. pombe
atgaaggccgtttcgatagaacaat

SEQ ID NO: 66811 - DNA, 25 bp, S. pombe
atgtaccgcggtctgcacaaaaacg

SEQ ID NO: 66812 - DNA, 25 bp, S. pombe
atgcttcgccggtcgacatcaagaa

SEQ ID NO: 66813 - DNA, 25 bp, S. pombe
atgcccgcgttgtcatcaacatgaa

SEQ ID NO: 66814 - DNA, 25 bp, S. pombe
atccacctggtgtatcaattcaacg

SEQ ID NO: 66815 - DNA, 25 bp, S. pombe
atgacagacgttcaacttcaaaata

SEQ ID NO: 66816 - DNA, 25 bp, S. pombe
atgacaactcgtgaacctccggaac

SEQ ID NO: 66817 - DNA, 25 bp, S. pombe
atgaaccaaccgctgagacttctaa

SEQ ID NO: 66818 - DNA, 25 bp, S. pombe
agaccctcaacgctggattcctaaa

SEQ ID NO: 66819 - DNA, 25 bp, S. pombe
agtcagcgtcagagcctaggtcaca

SEQ ID NO: 66820 - DNA, 25 bp, S. pombe
atgtagttgaatctttgcgtcgcag

SEQ ID NO: 66821 - DNA, 25 bp, S. pombe
atgctatgaattcttctgccaaccc

SEQ ID NO: 66822 - DNA, 25 bp, S. pombe
atccttcttgttctggttctggaat

SEQ ID NO: 66823 - DNA, 25 bp, S. pombe
atgcactttttgtttgtctcggagg

SEQ ID NO: 66824 - DNA, 25 bp, S. pombe
actccttttgactgttacgggcaca

SEQ ID NO: 66825 - DNA, 25 bp, S. pombe
atgaccttttacagtaaccccacag

SEQ ID NO: 66826 - DNA, 25 bp, S. pombe
atgctccagctgatactagtgtacc

SEQ ID NO: 66827 - DNA, 25 bp, S. pombe
atccacactttgtcgtgctgttgat

SEQ ID NO: 66828 - DNA, 25 bp, S. pombe
atgcctattcttatatcgtttccgg

SEQ ID NO: 66829 - DNA, 25 bp, S. pombe
atgcctcaccctgaacgtgtagttt

SEQ ID NO: 66830 - DNA, 25 bp, S. pombe
atgcctcccaatgttcgttttctta

SEQ ID NO: 66831 - DNA, 25 bp, S. pombe
atgccctggcgatgacaccgtatat

SEQ ID NO: 66832 - DNA, 25 bp, S. pombe
atccagcattggtcgttcgagtttt

SEQ ID NO: 66833 - DNA, 25 bp, S. pombe
atccatgaatgtgcgttctcgggtt

SEQ ID NO: 66834 - DNA, 25 bp, S. pombe
atgccgaaggccgtgtttggaactt

SEQ ID NO: 66835 - DNA, 25 bp, S. pombe
atgcccttcacaaactggtgcagag

SEQ ID NO: 66836 - DNA, 25 bp, S. pombe
atgctcctcgtctcgatgagtacaa

SEQ ID NO: 66837 - DNA, 25 bp, S. pombe
atgctcgccgtcctaaagaacagtt

SEQ ID NO: 66838 - DNA, 25 bp, S. pombe
atgcgcctcccaataggtttaatat

SEQ ID NO: 66839 - DNA, 25 bp, S. pombe
atgccgtccaaattcgttgcttaca

SEQ ID NO: 66840 - DNA, 25 bp, S. pombe
atgccgctacactgcatttatctta

SEQ ID NO: 66841 - DNA, 25 bp, S. pombe
atgccgaataccgatgctgatgttt

SEQ ID NO: 66842 - DNA, 25 bp, S. pombe
atgctggatcattcaccggagttgg

SEQ ID NO: 66843 - DNA, 25 bp, S. pombe
atgcttgcaaatcatccagatcggg

SEQ ID NO: 66844 - DNA, 25 bp, S. pombe
atgcttcaagatgtacgttcgtggc

SEQ ID NO: 66845 - DNA, 25 bp, S. pombe
atgcccaatactgctagtcgaatcc

SEQ ID NO: 66846 - DNA, 25 bp, S. pombe
atgccttcttctgctagtgaacaac

SEQ ID NO: 66847 - DNA, 25 bp, S. pombe
atgcgtccttgtgcgatatttctga

SEQ ID NO: 66848 - DNA, 25 bp, S. pombe
atgccccatcgattgcggttttgcc

SEQ ID NO: 66849 - DNA, 25 bp, S. pombe
atgctatcgcaaacactgggttcaa

SEQ ID NO: 66850 - DNA, 25 bp, S. pombe
atgcgacctggttgtctgtggtgaa

SEQ ID NO: 66851 - DNA, 25 bp, S. pombe
atgccaagcttgtagaatccgtgaa

SEQ ID NO: 66852 - DNA, 25 bp, S. pombe
atgctagtagccctcggtaatgtat

SEQ ID NO: 66853 - DNA, 25 bp, S. pombe
atgcttcaactcacggttctaatcg

SEQ ID NO: 66854 - DNA, 25 bp, S. pombe
atgcttaagatctgcggttctcacg

SEQ ID NO: 66855 - DNA, 25 bp, S. pombe
atgctttgctacagcggatttcacg

SEQ ID NO: 66856 - DNA, 25 bp, S. pombe
atgcgccatgatacaacgttccttg

SEQ ID NO: 66857 - DNA, 25 bp, S. pombe
atgcgaaaccttgctcgcggtgtaa

SEQ ID NO: 66858 - DNA, 25 bp, S. pombe
atccaacaacttttagaggctgaaa

SEQ ID NO: 66859 - DNA, 25 bp, S. pombe
atccacacaaactttcttcttcttt

SEQ ID NO: 66860 - DNA, 25 bp, S. pombe
atgccacaattagtaccattctatt

SEQ ID NO: 66861 - DNA, 25 bp, S. pombe
atgccaacattcgtggtatctttgt

SEQ ID NO: 66862 - DNA, 25 bp, S. pombe
atgccaagtatcctgctttctttga

SEQ ID NO: 66863 - DNA, 25 bp, S. pombe
atgccaagactggtgcttctcttaa

SEQ ID NO: 66864 - DNA, 25 bp, S. pombe
atgccaagcgtggtttccatattca

SEQ ID NO: 66865 - DNA, 25 bp, S. pombe
atgcgccggtctggatttgcagagt

SEQ ID NO: 66866 - DNA, 25 bp, S. pombe
atgctcccgtttgggtcagagctaa

SEQ ID NO: 66867 - DNA, 25 bp, S. pombe
atgccccagcttgttgcaaatgcta

SEQ ID NO: 66868 - DNA, 25 bp, S. pombe
atgcccgcttatatgagtcatgctt

SEQ ID NO: 66869 - DNA, 25 bp, S. pombe
atgccaacctgcaagcgtgtagctt

SEQ ID NO: 66870 - DNA, 25 bp, S. pombe
atccaacagctttcattgtcgcttc

SEQ ID NO: 66871 - DNA, 25 bp, S. pombe
atccagcatagttgcctttgatgag

SEQ ID NO: 66872 - DNA, 25 bp, S. pombe
atgcctgtcttcttgtgtttattat

SEQ ID NO: 66873 - DNA, 25 bp, S. pombe
atgccttctttctgtattcgtgtaa

SEQ ID NO: 66874 - DNA, 25 bp, S. pombe
atgcagaggagcagcccgtgtcgtc

SEQ ID NO: 66875 - DNA, 25 bp, S. pombe
atgcacgtaaggacgtttctccctg

SEQ ID NO: 66876 - DNA, 25 bp, S. pombe
atgaccgaagatcctattgttccct

SEQ ID NO: 66877 - DNA, 25 bp, S. pombe
atgcccgaagtgttcatttccttat

SEQ ID NO: 66878 - DNA, 25 bp, S. pombe
atgcgtgccattcgtttcttcgaaa

SEQ ID NO: 66879 - DNA, 25 bp, S. pombe
atgctggtatgtcgtttcttgccta

SEQ ID NO: 66880 - DNA, 25 bp, S. pombe
atgctcgtaagagtgttccccatgc

SEQ ID NO: 66881 - DNA, 25 bp, S. pombe
atgccaggtcaacagattcgtcgta

SEQ ID NO: 66882 - DNA, 25 bp, S. pombe
atgccttctcacaagagtttccgta

SEQ ID NO: 66883 - DNA, 25 bp, S. pombe
atgcctcattcctatggtattagag

SEQ ID NO: 66884 - DNA, 25 bp, S. pombe
atgcctcattcttacggtatcagag

SEQ ID NO: 66885 - DNA, 25 bp, S. pombe
atgcgtatactctactggctacaag

SEQ ID NO: 66886 - DNA, 25 bp, S. pombe
atgcgtatgtcattccaggcgaaaa

SEQ ID NO: 66887 - DNA, 25 bp, S. pombe
atgcctcgtcttcgaacgtcaagaa

SEQ ID NO: 66888 - DNA, 25 bp, S. pombe
atgcctctcaccttgaatcggaaga

SEQ ID NO: 66889 - DNA, 25 bp, S. pombe
atgcgttttcgcgaccattatcaga

SEQ ID NO: 66890 - DNA, 25 bp, S. pombe
atgcttctattgacgggctaactga

SEQ ID NO: 66891 - DNA, 25 bp, S. pombe
atgcgagctcccaaggatgcagact

SEQ ID NO: 66892 - DNA, 25 bp, S. pombe
atgcgactgcgactatgactgcgac

SEQ ID NO: 66893 - DNA, 25 bp, S. pombe
atgctactgatgtctctggtgctga

SEQ ID NO: 66894 - DNA, 25 bp, S. pombe
atgcagggcatcgttgtatcaaatc

SEQ ID NO: 66895 - DNA, 25 bp, S. pombe
atgctgatcgtctcttgtcggaaaa

SEQ ID NO: 66896 - DNA, 25 bp, S. pombe
atgctgaagcattacattccggaag

SEQ ID NO: 66897 - DNA, 25 bp, S. pombe
atgtgttcaaagcttacccgaaaag

SEQ ID NO: 66898 - DNA, 25 bp, S. pombe
acgaggttaaaactcatggtgatgc

SEQ ID NO: 66899 - DNA, 25 bp, S. pombe
atgccatgcctttaataccactgtt

SEQ ID NO: 66900 - DNA, 25 bp, S. pombe
atgcgtgccgcttattactattttg

SEQ ID NO: 66901 - DNA, 25 bp, S. pombe
atgcgtgccatggatgaagagctgt

SEQ ID NO: 66902 - DNA, 25 bp, S. pombe
atgcattgccagtatgtccagttcc

SEQ ID NO: 66903 - DNA, 25 bp, S. pombe
atgccgttgccattaatccctttaa

SEQ ID NO: 66904 - DNA, 25 bp, S. pombe
atgcgtcccggtcgtttggatcaat

SEQ ID NO: 66905 - DNA, 25 bp, S. pombe
atgcgactcgtgttcaaggtgtatt

SEQ ID NO: 66906 - DNA, 25 bp, S. pombe
atgccactgccttggaaggtgcatt

SEQ ID NO: 66907 - DNA, 25 bp, S. pombe
atgcccttgagtgcaatgatgtgga

SEQ ID NO: 66908 - DNA, 25 bp, S. pombe
atgctcgattgctttcttatttgtt

SEQ ID NO: 66909 - DNA, 25 bp, S. pombe
atgctaattctttctcttcgggtta

SEQ ID NO: 66910 - DNA, 25 bp, S. pombe
atgcttactcatattcttcgggtga

SEQ ID NO: 66911 - DNA, 25 bp, S. pombe
atgcttagtaacgtcttcctttggc

SEQ ID NO: 66912 - DNA, 25 bp, S. pombe
atgccctcaaatcggttacttctga

SEQ ID NO: 66913 - DNA, 25 bp, S. pombe
agtcgccgtcggttggtatctgtga

SEQ ID NO: 66914 - DNA, 25 bp, S. pombe
atgccgtctgtctctatggtattta

SEQ ID NO: 66915 - DNA, 25 bp, S. pombe
atgcctactgtcactcggattttat

SEQ ID NO: 66916 - DNA, 25 bp, S. pombe
atgactgatatgtctcccgaacgct

SEQ ID NO: 66917 - DNA, 25 bp, S. pombe
atgcccttgctgatgctctgaacaa

SEQ ID NO: 66918 - DNA, 25 bp, S. pombe
atgccagatcttcgattcccaaatt

SEQ ID NO: 66919 - DNA, 25 bp, S. pombe
atgccttctgaagtcgcggtgaata

SEQ ID NO: 66920 - DNA, 25 bp, S. pombe
atgcgtttgaatgctggcgctggct

SEQ ID NO: 66921 - DNA, 25 bp, S. pombe
atgctgttcgcgacatcgaggctgg

SEQ ID NO: 66922 - DNA, 25 bp, S. pombe
atgtctacaccgactatggcggagc

SEQ ID NO: 66923 - DNA, 25 bp, S. pombe
atgctgctaccgctgtatgtggaag

SEQ ID NO: 66924 - DNA, 25 bp, S. pombe
atgctcttcacccttgtatggtatg

SEQ ID NO: 66925 - DNA, 25 bp, S. pombe
atgctttcaaatccgctgatggctt

SEQ ID NO: 66926 - DNA, 25 bp, S. pombe
atgctgattcagtggctggtgccaa

SEQ ID NO: 66927 - DNA, 25 bp, S. pombe
atgctgttcctcctgctgaagcaaa

SEQ ID NO: 66928 - DNA, 25 bp, S. pombe
atgagtccgccgtagaagcaacaat

SEQ ID NO: 66929 - DNA, 25 bp, S. pombe
atgcaatcggccaaagtacaaaagc

SEQ ID NO: 66930 - DNA, 25 bp, S. pombe
atgcctcgtcaaatcagtgacatta

SEQ ID NO: 66931 - DNA, 25 bp, S. pombe
atgctagtcatgaaccttggcagcg

SEQ ID NO: 66932 - DNA, 25 bp, S. pombe
atgcttggagatacgtctggacacc

SEQ ID NO: 66933 - DNA, 25 bp, S. pombe
atgcccgatgatatttctgctagcc

SEQ ID NO: 66934 - DNA, 25 bp, S. pombe
atgctcccagatagtttagttgcca

SEQ ID NO: 66935 - DNA, 25 bp, S. pombe
atgcttccagcacgtgattctttaa

SEQ ID NO: 66936 - DNA, 25 bp, S. pombe
atgctgtccacacaaactcgtcaag

SEQ ID NO: 66937 - DNA, 25 bp, S. pombe
atgctcttcagcttcaaattcgtta

SEQ ID NO: 66938 - DNA, 25 bp, S. pombe
atgcattcctgctggtaccgattta

SEQ ID NO: 66939 - DNA, 25 bp, S. pombe
atgcgtttctttaccactgtcaata

SEQ ID NO: 66940 - DNA, 25 bp, S. pombe
atgctaagttttctcctgttgctac

SEQ ID NO: 66941 - DNA, 25 bp, S. pombe
atgccatttatcttctcaaccagga

SEQ ID NO: 66942 - DNA, 25 bp, S. pombe
atgcctgtaatgttattttgcccta

SEQ ID NO: 66943 - DNA, 25 bp, S. pombe
atgccttgatatgctcactttgctt

SEQ ID NO: 66944 - DNA, 25 bp, S. pombe
atgccttatctgttcaatgtcgctg

SEQ ID NO: 66945 - DNA, 25 bp, S. pombe
atgcgttctcaattcaaggacgact

SEQ ID NO: 66946 - DNA, 25 bp, S. pombe
atgctgttccaattagtgctatcga

SEQ ID NO: 66947 - DNA, 25 bp, S. pombe
atgccttccgattatgtgtcatcca

SEQ ID NO: 66948 - DNA, 25 bp, S. pombe
atgcctcccgtcttgatgaatacaa

SEQ ID NO: 66949 - DNA, 25 bp, S. pombe
atgcctccatctacagttaatcaag

SEQ ID NO: 66950 - DNA, 25 bp, S. pombe
atgctgacggttctagtttgcgaaa

SEQ ID NO: 66951 - DNA, 25 bp, S. pombe
atgctggcggcttttaactacgaaa

SEQ ID NO: 66952 - DNA, 25 bp, S. pombe
atgcctgagggtactatcatctcca

SEQ ID NO: 66953 - DNA, 25 bp, S. pombe
atgcctgagggtaccatcatttcaa

SEQ ID NO: 66954 - DNA, 25 bp, S. pombe
atgcacaagcctctggtcttatgga

SEQ ID NO: 66955 - DNA, 25 bp, S. pombe
atgctcaacgtgctagtcgtgtcga

SEQ ID NO: 66956 - DNA, 25 bp, S. pombe
atgcggcacagatggttctttcttc

SEQ ID NO: 66957 - DNA, 25 bp, S. pombe
atgcaagccgatgtattttttagac

SEQ ID NO: 66958 - DNA, 25 bp, S. pombe
atgcggtcaggaatatctttgctta

SEQ ID NO: 66959 - DNA, 25 bp, S. pombe
atgcccatttggttgtttctgctac

SEQ ID NO: 66960 - DNA, 25 bp, S. pombe
atgcccgttggtggagcgtgtcatt

SEQ ID NO: 66961 - DNA, 25 bp, S. pombe
atgaccgcattgttgaaggcattca

SEQ ID NO: 66962 - DNA, 25 bp, S. pombe
atgcgccgcaattcagaagcttgtt

SEQ ID NO: 66963 - DNA, 25 bp, S. pombe
atgcgcttgccaacgatttgaactt

SEQ ID NO: 66964 - DNA, 25 bp, S. pombe
atgcgattgcacacattttgttttt

SEQ ID NO: 66965 - DNA, 25 bp, S. pombe
atgctgggccaaatctttgtgcttt

SEQ ID NO: 66966 - DNA, 25 bp, S. pombe
atgctggagctacattttgcgcgtt

SEQ ID NO: 66967 - DNA, 25 bp, S. pombe
atgcgagtgtacttgttatgcccct

SEQ ID NO: 66968 - DNA, 25 bp, S. pombe
atgcttgacacagcagagctctcaa

SEQ ID NO: 66969 - DNA, 25 bp, S. pombe
atgcgatacgttcctctggcgagtc

SEQ ID NO: 66970 - DNA, 25 bp, S. pombe
atgagttggtatcctgtacgctcac

SEQ ID NO: 66971 - DNA, 25 bp, S. pombe
atgcgtcgaggatctgttcctatca

SEQ ID NO: 66972 - DNA, 25 bp, S. pombe
atgcagcatacaacgcctcaaaggc

SEQ ID NO: 66973 - DNA, 25 bp, S. pombe
atgctcaagtactacgcgactggga

SEQ ID NO: 66974 - DNA, 25 bp, S. pombe
atgacaagctacttcgcgaaaccac

SEQ ID NO: 66975 - DNA, 25 bp, S. pombe
atgccggtattttagcctgtcgtat

SEQ ID NO: 66976 - DNA, 25 bp, S. pombe
atgcctgatgttatcaatgcctgtc

SEQ ID NO: 66977 - DNA, 25 bp, S. pombe
atgcctgatcctaatcgtgttctcg

SEQ ID NO: 66978 - DNA, 25 bp, S. pombe
atgcctgatattgcggatgtttccc

SEQ ID NO: 66979 - DNA, 25 bp, S. pombe
atgcgtctttagtcattgaagctgc

SEQ ID NO: 66980 - DNA, 25 bp, S. pombe
atgcactctctaaagcttgaacccg

SEQ ID NO: 66981 - DNA, 25 bp, S. pombe
atgaactctttccatcaaacggtcc

SEQ ID NO: 66982 - DNA, 25 bp, S. pombe
atgaacctttgttgaaatccgccgg

SEQ ID NO: 66983 - DNA, 25 bp, S. pombe
atgatactgttaccggcgttaccga

SEQ ID NO: 66984 - DNA, 25 bp, S. pombe
atgaagtctctagcccagatgtagc

SEQ ID NO: 66985 - DNA, 25 bp, S. pombe
atgcgagatcacagttaggctttca

SEQ ID NO: 66986 - DNA, 25 bp, S. pombe
atgcatctactcaaagacccgtcta

SEQ ID NO: 66987 - DNA, 25 bp, S. pombe
atgatatccatgacgaagagcctga

SEQ ID NO: 66988 - DNA, 25 bp, S. pombe
atgcaagcttcatcagagcctgcta

SEQ ID NO: 66989 - DNA, 25 bp, S. pombe
atgaacttgacctctgcgttcaact

SEQ ID NO: 66990 - DNA, 25 bp, S. pombe
atgaacattatatccaagcccgtgg

SEQ ID NO: 66991 - DNA, 25 bp, S. pombe
atgaatattaccaacatacccgccg

SEQ ID NO: 66992 - DNA, 25 bp, S. pombe
atgctttttacatgaatgcccgccg

SEQ ID NO: 66993 - DNA, 25 bp, S. pombe
atgctgtatctgtaccaatcccaaa

SEQ ID NO: 66994 - DNA, 25 bp, S. pombe
atgcttttggagacagatgccccat

SEQ ID NO: 66995 - DNA, 25 bp, S. pombe
atgcgtcattgatgtgctgtgccca

SEQ ID NO: 66996 - DNA, 25 bp, S. pombe
atgcagatctctattgggaccacga

SEQ ID NO: 66997 - DNA, 25 bp, S. pombe
atgaattttattccgactccgacta

SEQ ID NO: 66998 - DNA, 25 bp, S. pombe
atgaatacccatttaaaagctgtta

SEQ ID NO: 66999 - DNA, 25 bp, S. pombe
atgctaacctctgattctcttgaag

SEQ ID NO: 67000 - DNA, 25 bp, S. pombe
atgctgaactccgtaggccattgaa

SEQ ID NO: 67001 - DNA, 25 bp, S. pombe
atgcttttccttgaatccgatggat

SEQ ID NO: 67002 - DNA, 25 bp, S. pombe
atgctgctcttgtttgctatgatca

SEQ ID NO: 67003 - DNA, 25 bp, S. pombe
atgcgctgattttggatgcttttag

SEQ ID NO: 67004 - DNA, 25 bp, S. pombe
atgcgtattttttcttctctatcgg

SEQ ID NO: 67005 - DNA, 25 bp, S. pombe
atgcgttattatttgttttacactg

SEQ ID NO: 67006 - DNA, 25 bp, S. pombe
atgcgtttggatggtttctatcaac

SEQ ID NO: 67007 - DNA, 25 bp, S. pombe
atgcgtgttccatccatttataact

SEQ ID NO: 67008 - DNA, 25 bp, S. pombe
atgctcatggtggtatgccagtcaa

SEQ ID NO: 67009 - DNA, 25 bp, S. pombe
agacattcgtgctcgtgaagtaggt

SEQ ID NO: 67010 - DNA, 25 bp, S. pombe
atgaatcttctctcgtatactacgt

SEQ ID NO: 67011 - DNA, 25 bp, S. pombe
atgatggacagttcaacgtcctccc

SEQ ID NO: 67012 - DNA, 25 bp, S. pombe
atgagacgccatcaacagcatcgac

SEQ ID NO: 67013 - DNA, 25 bp, S. pombe
atgctaggccccaatgttcaactat

SEQ ID NO: 67014 - DNA, 25 bp, S. pombe
atgttacattcgagttccctgttgc

SEQ ID NO: 67015 - DNA, 25 bp, S. pombe
atgcttctatttttattccctggtt

SEQ ID NO: 67016 - DNA, 25 bp, S. pombe
atgcttttgcttctatatcctctgg

SEQ ID NO: 67017 - DNA, 25 bp, S. pombe
atgatggttggcacgaatcttcggg

SEQ ID NO: 67018 - DNA, 25 bp, S. pombe
atgcacgttacgctggactgtacaa

SEQ ID NO: 67019 - DNA, 25 bp, S. pombe
atgactgttggcaccatgactggtc

SEQ ID NO: 67020 - DNA, 25 bp, S. pombe
atgcacaaatcccagagtacagagt

SEQ ID NO: 67021 - DNA, 25 bp, S. pombe
atgaattttcaattgccaacagggc

SEQ ID NO: 67022 - DNA, 25 bp, S. pombe
agcaattgacttcggacttagagga

SEQ ID NO: 67023 - DNA, 25 bp, S. pombe
atgaatcgtgatggtggtgttaaaa

SEQ ID NO: 67024 - DNA, 25 bp, S. pombe
atgcacctgttgttcctgattacta

SEQ ID NO: 67025 - DNA, 25 bp, S. pombe
atgctctcgtttatctttctcaatt

SEQ ID NO: 67026 - DNA, 25 bp, S. pombe
atgcgtcgttctaccattgtgccaa

SEQ ID NO: 67027 - DNA, 25 bp, S. pombe
atgcgattattgctacttgtccaaa

SEQ ID NO: 67028 - DNA, 25 bp, S. pombe
atgatcctgaagcatcctctaaaga

SEQ ID NO: 67029 - DNA, 25 bp, S. pombe
atgctgtcgcttccgagccaaaaga

SEQ ID NO: 67030 - DNA, 25 bp, S. pombe
atgctattgctttccatcaaggcgc

SEQ ID NO: 67031 - DNA, 25 bp, S. pombe
atgcgatctcttgcacattctggaa

SEQ ID NO: 67032 - DNA, 25 bp, S. pombe
atgcatactgcagcactttgtgtta

SEQ ID NO: 67033 - DNA, 25 bp, S. pombe
atgcagcaacaggttattcgccaag

SEQ ID NO: 67034 - DNA, 25 bp, S. pombe
atgctcatatttactgttcccactt

SEQ ID NO: 67035 - DNA, 25 bp, S. pombe
atgaatcccgttactggctttagcg

SEQ ID NO: 67036 - DNA, 25 bp, S. pombe
atgacttctgccgaattggcttcag

SEQ ID NO: 67037 - DNA, 25 bp, S. pombe
atgcatttgctcgtgaacgcctcta

SEQ ID NO: 67038 - DNA, 25 bp, S. pombe
atgctgcgattcgagagcttcgtga

SEQ ID NO: 67039 - DNA, 25 bp, S. pombe
atgctgcgcattcggcgatactgaa

SEQ ID NO: 67040 - DNA, 25 bp, S. pombe
atgctgataaccagtattctccctt

SEQ ID NO: 67041 - DNA, 25 bp, S. pombe
atgcttctacaaagatggtcccctt

SEQ ID NO: 67042 - DNA, 25 bp, S. pombe
atgcttcaaataaacgtccccgatc

SEQ ID NO: 67043 - DNA, 25 bp, S. pombe
atgttggcaacaaaacccctgcttg

SEQ ID NO: 67044 - DNA, 25 bp, S. pombe
atgactgtcctttgaacctgacttc

SEQ ID NO: 67045 - DNA, 25 bp, S. pombe
atgacttttcttcacgattttcgac

SEQ ID NO: 67046 - DNA, 25 bp, S. pombe
atgactgtttgctttcacgatgcct

SEQ ID NO: 67047 - DNA, 25 bp, S. pombe
atgagggtggctacttcgtcgtcga

SEQ ID NO: 67048 - DNA, 25 bp, S. pombe
atgaacgttgttattatcctcgaaa

SEQ ID NO: 67049 - DNA, 25 bp, S. pombe
atgaattcgtgattacctttccaaa

SEQ ID NO: 67050 - DNA, 25 bp, S. pombe
atgctattcgtatgcacgtttccca

SEQ ID NO: 67051 - DNA, 25 bp, S. pombe
atgcagttttgtcctacttgtggaa

SEQ ID NO: 67052 - DNA, 25 bp, S. pombe
atgacatcgacgacagaccttcttc

SEQ ID NO: 67053 - DNA, 25 bp, S. pombe
atgaatctaggtcaccttcacctta

SEQ ID NO: 67054 - DNA, 25 bp, S. pombe
atgacattaaggcatacctccctgt

SEQ ID NO: 67055 - DNA, 25 bp, S. pombe
atgaatttaacgaccccgatctgtt

SEQ ID NO: 67056 - DNA, 25 bp, S. pombe
atgaccctgggtgcacattaaagaa

SEQ ID NO: 67057 - DNA, 25 bp, S. pombe
atgctcatcctggtgtcgacgttaa

SEQ ID NO: 67058 - DNA, 25 bp, S. pombe
agcaaaagcgtagcggacccgtcaa

SEQ ID NO: 67059 - DNA, 25 bp, S. pombe
atgtcgatacttctaccgtcaaggt

SEQ ID NO: 67060 - DNA, 25 bp, S. pombe
atgctaactctcatttgggtctaag

SEQ ID NO: 67061 - DNA, 25 bp, S. pombe
atgctattcgctcagttttcgcatt

SEQ ID NO: 67062 - DNA, 25 bp, S. pombe
atgcttgtctcttttgtgtttttcc

SEQ ID NO: 67063 - DNA, 25 bp, S. pombe
atgaatgtctttctggttttcctcc

SEQ ID NO: 67064 - DNA, 25 bp, S. pombe
atgactttcctactttttctattat

SEQ ID NO: 67065 - DNA, 25 bp, S. pombe
atgaaggtcagcttgtgccacgtga

SEQ ID NO: 67066 - DNA, 25 bp, S. pombe
atgctgtggtatacattcatcctga

SEQ ID NO: 67067 - DNA, 25 bp, S. pombe
atgctcagtctttggatccttctta

SEQ ID NO: 67068 - DNA, 25 bp, S. pombe
atgcacctctttatccttatttttc

SEQ ID NO: 67069 - DNA, 25 bp, S. pombe
atgaagcgtttgctccgtttgggtc

SEQ ID NO: 67070 - DNA, 25 bp, S. pombe
agaaggtcttttcttgggcggctct

SEQ ID NO: 67071 - DNA, 25 bp, S. pombe
atgaagcgtcttcggattcgttaaa

SEQ ID NO: 67072 - DNA, 25 bp, S. pombe
atgaatggttctcctattggtcctt

SEQ ID NO: 67073 - DNA, 25 bp, S. pombe
atgcattcccttctagttatacttg

SEQ ID NO: 67074 - DNA, 25 bp, S. pombe
atgtcaaaccatccacagagcatat

SEQ ID NO: 67075 - DNA, 25 bp, S. pombe
atgatgcgtgcttacattaggctaa

SEQ ID NO: 67076 - DNA, 25 bp, S. pombe
atgaagcagctatctcgggctccat

SEQ ID NO: 67077 - DNA, 25 bp, S. pombe
atgaatgatggtttcgcggacgatg

SEQ ID NO: 67078 - DNA, 25 bp, S. pombe
atgaatagccttttgcgcgaagcat

SEQ ID NO: 67079 - DNA, 25 bp, S. pombe
atgctgttactcttcatggcagtaa

SEQ ID NO: 67080 - DNA, 25 bp, S. pombe
atgctgcatctgtcgagttgcgcaa

SEQ ID NO: 67081 - DNA, 25 bp, S. pombe
atgcatgcactcgagaaggctgaaa

SEQ ID NO: 67082 - DNA, 25 bp, S. pombe
atgagaccgatgatcctgaatcagt

SEQ ID NO: 67083 - DNA, 25 bp, S. pombe
atgaaaccatttctgtgcgtctcgc

SEQ ID NO: 67084 - DNA, 25 bp, S. pombe
atgctgagcgtttgaatgaatccca

SEQ ID NO: 67085 - DNA, 25 bp, S. pombe
atgctactgctttagtatctcctgg

SEQ ID NO: 67086 - DNA, 25 bp, S. pombe
atgctgacagcaaaaccggtggttt

SEQ ID NO: 67087 - DNA, 25 bp, S. pombe
atgcttgaatactaccgggctgttt

SEQ ID NO: 67088 - DNA, 25 bp, S. pombe
atgattgagcctaccgagtctgaga

SEQ ID NO: 67089 - DNA, 25 bp, S. pombe
atgcatttgcctattaccttgcaag

SEQ ID NO: 67090 - DNA, 25 bp, S. pombe
atgctgccgatgatgatgctcttca

SEQ ID NO: 67091 - DNA, 25 bp, S. pombe
atgatgccagtgatgagcctacagc

SEQ ID NO: 67092 - DNA, 25 bp, S. pombe
atgctgcaacatcctatgcttacac

SEQ ID NO: 67093 - DNA, 25 bp, S. pombe
atgctgaattacttgctaatgcaac

SEQ ID NO: 67094 - DNA, 25 bp, S. pombe
atgctaatcataagtgtccacccaa

SEQ ID NO: 67095 - DNA, 25 bp, S. pombe
atgctacaaaatcactcatctcctg

SEQ ID NO: 67096 - DNA, 25 bp, S. pombe
atgctattaaatctgcccttcgaag

SEQ ID NO: 67097 - DNA, 25 bp, S. pombe
atgcatttctcattgttcaccatcc

SEQ ID NO: 67098 - DNA, 25 bp, S. pombe
atgcattcgctattggatgtcctcc

SEQ ID NO: 67099 - DNA, 25 bp, S. pombe
atgcattggcttctattctgaccac

SEQ ID NO: 67100 - DNA, 25 bp, S. pombe
atgctatttgctcctatttccaagc

SEQ ID NO: 67101 - DNA, 25 bp, S. pombe
atgaagtcccctatgtatttgccag

SEQ ID NO: 67102 - DNA, 25 bp, S. pombe
atgactccaaggtctttcgtttctg

SEQ ID NO: 67103 - DNA, 25 bp, S. pombe
atgatgcggcaggttttaccattaa

SEQ ID NO: 67104 - DNA, 25 bp, S. pombe
atggccctaaatataccttgaccta

SEQ ID NO: 67105 - DNA, 25 bp, S. pombe
atgacggtcatttgcttacgggttc

SEQ ID NO: 67106 - DNA, 25 bp, S. pombe
atgcattggatcaaacttatgggtg

SEQ ID NO: 67107 - DNA, 25 bp, S. pombe
atgcttgaagcatgaccctcagttg

SEQ ID NO: 67108 - DNA, 25 bp, S. pombe
atgctttcagcttgaccgtcatgat

SEQ ID NO: 67109 - DNA, 25 bp, S. pombe
atgcacaatagctataccgtctctg

SEQ ID NO: 67110 - DNA, 25 bp, S. pombe
atgcatccatcaggagtcggtctta

SEQ ID NO: 67111 - DNA, 25 bp, S. pombe
atgcatcaattggagcgctgtttct

SEQ ID NO: 67112 - DNA, 25 bp, S. pombe
atgttcgtgcaatggcttttcgtcc

SEQ ID NO: 67113 - DNA, 25 bp, S. pombe
atgacctttcggcttttgcagacca

SEQ ID NO: 67114 - DNA, 25 bp, S. pombe
atgactagactcgtccaggatttac

SEQ ID NO: 67115 - DNA, 25 bp, S. pombe
atgagctctctttggttgcgtttat

SEQ ID NO: 67116 - DNA, 25 bp, S. pombe
atgagtccgtgacacatgctgaaga

SEQ ID NO: 67117 - DNA, 25 bp, S. pombe
atgaaaccgacacatccattatttg

SEQ ID NO: 67118 - DNA, 25 bp, S. pombe
atgaacctcgaagatcaccttctct

SEQ ID NO: 67119 - DNA, 25 bp, S. pombe
atgaagcctccgattgtcaattctc

SEQ ID NO: 67120 - DNA, 25 bp, S. pombe
atgagagtcctagagctgtcgattc

SEQ ID NO: 67121 - DNA, 25 bp, S. pombe
atgcatgctgaaaaccaaccctgtc

SEQ ID NO: 67122 - DNA, 25 bp, S. pombe
atgaagaaaacgtgcgcctctctca

SEQ ID NO: 67123 - DNA, 25 bp, S. pombe
atgaagaattactggctgcccttga

SEQ ID NO: 67124 - DNA, 25 bp, S. pombe
atgatgtacatcctcgagttcccaa

SEQ ID NO: 67125 - DNA, 25 bp, S. pombe
atgagtctgctcaccaagggcactt

SEQ ID NO: 67126 - DNA, 25 bp, S. pombe
atgagcctagccaagctgatgctgt

SEQ ID NO: 67127 - DNA, 25 bp, S. pombe
atgaggtggaccctgcgttattgca

SEQ ID NO: 67128 - DNA, 25 bp, S. pombe
atgaagcttctctgcactcgcaatg

SEQ ID NO: 67129 - DNA, 25 bp, S. pombe
atgcttcagcagatgatgcctctaa

SEQ ID NO: 67130 - DNA, 25 bp, S. pombe
atgcagtggtggtgtcgctagaaac

SEQ ID NO: 67131 - DNA, 25 bp, S. pombe
atgactggcatgctggtcgtatcga

SEQ ID NO: 67132 - DNA, 25 bp, S. pombe
atgagccaatccctaactgggctga

SEQ ID NO: 67133 - DNA, 25 bp, S. pombe
atgacacaacctgacattgaaatag

SEQ ID NO: 67134 - DNA, 25 bp, S. pombe
atgacaaccacttacgaggcctagt

SEQ ID NO: 67135 - DNA, 25 bp, S. pombe
atgaaacaacatctcgatcctcgtc

SEQ ID NO: 67136 - DNA, 25 bp, S. pombe
atgcaacttgttgcttctctcgaaa

SEQ ID NO: 67137 - DNA, 25 bp, S. pombe
atgctacgtcttacttctttactga

SEQ ID NO: 67138 - DNA, 25 bp, S. pombe
atgctatcagtcatcttcctttcat

SEQ ID NO: 67139 - DNA, 25 bp, S. pombe
atgacctcctcagaatcaactgtgt

SEQ ID NO: 67140 - DNA, 25 bp, S. pombe
atgcagatcgcattgaggccaactt

SEQ ID NO: 67141 - DNA, 25 bp, S. pombe
atgcagcttcttcgcgataacttga

SEQ ID NO: 67142 - DNA, 25 bp, S. pombe
atgcttccacagtctactgagcgta

SEQ ID NO: 67143 - DNA, 25 bp, S. pombe
atgctatcttcttttctaccataag

SEQ ID NO: 67144 - DNA, 25 bp, S. pombe
atgctaggcttttcacctcgaaagt

SEQ ID NO: 67145 - DNA, 25 bp, S. pombe
atgctagtgctgcaaagcctcgtac

SEQ ID NO: 67146 - DNA, 25 bp, S. pombe
atgaactcctaaatgcgtcgctgac

SEQ ID NO: 67147 - DNA, 25 bp, S. pombe
tacgctacgaccatcgggatccgat

SEQ ID NO: 67148 - DNA, 25 bp, S. pombe
atgacgactcttatgttgcttgtaa

SEQ ID NO: 67149 - DNA, 25 bp, S. pombe
atgcaggcattgaggctctctttga

SEQ ID NO: 67150 - DNA, 25 bp, S. pombe
atgaaatccccaataaccgacagct

SEQ ID NO: 67151 - DNA, 25 bp, S. pombe
atgcttctgatatccatgcgtacga

SEQ ID NO: 67152 - DNA, 25 bp, S. pombe
atgctatgctttgcactggagccac

SEQ ID NO: 67153 - DNA, 25 bp, S. pombe
atgcttctccatggactgggccgca

SEQ ID NO: 67154 - DNA, 25 bp, S. pombe
atgctatctcaggaactgctcaaga

SEQ ID NO: 67155 - DNA, 25 bp, S. pombe
atgctattcagcaacagcggctaca

SEQ ID NO: 67156 - DNA, 25 bp, S. pombe
atgagcattggcacgctggtactac

SEQ ID NO: 67157 - DNA, 25 bp, S. pombe
atgcattctagcagacggaaataca

SEQ ID NO: 67158 - DNA, 25 bp, S. pombe
atgagatcagacagcacgtgaatga

SEQ ID NO: 67159 - DNA, 25 bp, S. pombe
atgagcatgcgtcgacttggagtta

SEQ ID NO: 67160 - DNA, 25 bp, S. pombe
atgacaggtccatttcggtacaatg

SEQ ID NO: 67161 - DNA, 25 bp, S. pombe
atgatcggatctgctacgattacaa

SEQ ID NO: 67162 - DNA, 25 bp, S. pombe
atgaagctctcttgccagatctgga

SEQ ID NO: 67163 - DNA, 25 bp, S. pombe
atgcagcccgtgaagcagttcaatt

SEQ ID NO: 67164 - DNA, 25 bp, S. pombe
atgcagcccatgctacagttttgta

SEQ ID NO: 67165 - DNA, 25 bp, S. pombe
atgcatgcgtcaactgaatttcgtt

SEQ ID NO: 67166 - DNA, 25 bp, S. pombe
atgcatgtccgggagtttcgagttc

SEQ ID NO: 67167 - DNA, 25 bp, S. pombe
atggacgttactcccaatgacggtt

SEQ ID NO: 67168 - DNA, 25 bp, S. pombe
atgaacgttctattcgtggcggtcg

SEQ ID NO: 67169 - DNA, 25 bp, S. pombe
atgaagcttatcttcatccggccgt

SEQ ID NO: 67170 - DNA, 25 bp, S. pombe
atgaactgtcttactccagacgcgt

SEQ ID NO: 67171 - DNA, 25 bp, S. pombe
atgcatttattaactacgacgctta

SEQ ID NO: 67172 - DNA, 25 bp, S. pombe
atgcttcttcgtcagttggcgctaa

SEQ ID NO: 67173 - DNA, 25 bp, S. pombe
atgcttctgtctttacacgtgtaga

SEQ ID NO: 67174 - DNA, 25 bp, S. pombe
atgcttctgctaaagtctggtttca

SEQ ID NO: 67175 - DNA, 25 bp, S. pombe
atgcttctgtcgtttcgaaacctac

SEQ ID NO: 67176 - DNA, 25 bp, S. pombe
atgcagaaatccttcatctctcttt

SEQ ID NO: 67177 - DNA, 25 bp, S. pombe
atgcaatatctcaattcaccctggt

SEQ ID NO: 67178 - DNA, 25 bp, S. pombe
atgaatcatccaacctccactggcg

SEQ ID NO: 67179 - DNA, 25 bp, S. pombe
atgaaattcacggtccctgggatat

SEQ ID NO: 67180 - DNA, 25 bp, S. pombe
atgaagacccgctgtctcgtgagat

SEQ ID NO: 67181 - DNA, 25 bp, S. pombe
atgacgacgatatggctcttctagc

SEQ ID NO: 67182 - DNA, 25 bp, S. pombe
atgaggcctctatagtttttggtga

SEQ ID NO: 67183 - DNA, 25 bp, S. pombe
atgagcaccgaacctgttgttttta

SEQ ID NO: 67184 - DNA, 25 bp, S. pombe
atgactcccattttctttcgttata

SEQ ID NO: 67185 - DNA, 25 bp, S. pombe
atgcttccctcaatttattggcgta

SEQ ID NO: 67186 - DNA, 25 bp, S. pombe
atgtccccgaatttaatgaatctgc

SEQ ID NO: 67187 - DNA, 25 bp, S. pombe
atgttagcctaactattcgtcccat

SEQ ID NO: 67188 - DNA, 25 bp, S. pombe
acttttaggcgctgggtcaacttca

SEQ ID NO: 67189 - DNA, 25 bp, S. pombe
actttgtagttctgggtttgctggc

SEQ ID NO: 67190 - DNA, 25 bp, S. pombe
atgatgcacctgtaaaacctcgtaa

SEQ ID NO: 67191 - DNA, 25 bp, S. pombe
atgagcttgcgcttaaagcccgaga

SEQ ID NO: 67192 - DNA, 25 bp, S. pombe
atgaggttcttacagccaatttgct

SEQ ID NO: 67193 - DNA, 25 bp, S. pombe
atggacctttcgactatggaatttc

SEQ ID NO: 67194 - DNA, 25 bp, S. pombe
atgacacaggtaattttcgccatta

SEQ ID NO: 67195 - DNA, 25 bp, S. pombe
atgacatggcggtttttcccgatag

SEQ ID NO: 67196 - DNA, 25 bp, S. pombe
atgcaacgcgtgtttattctacaga

SEQ ID NO: 67197 - DNA, 25 bp, S. pombe
atgaatgcgcgtttggtagctcaca

SEQ ID NO: 67198 - DNA, 25 bp, S. pombe
atgatcacgctttctggtggtcaga

SEQ ID NO: 67199 - DNA, 25 bp, S. pombe
atgcaacgtctttggttgactgcaa

SEQ ID NO: 67200 - DNA, 25 bp, S. pombe
atgaacaggctgctgcggataccgc

SEQ ID NO: 67201 - DNA, 25 bp, S. pombe
atgaaggattgcttgcagcgcgtga

SEQ ID NO: 67202 - DNA, 25 bp, S. pombe
atgcattgacaatatccctgacgaa

SEQ ID NO: 67203 - DNA, 25 bp, S. pombe
atgcatttgtatctggtccgtgttt

SEQ ID NO: 67204 - DNA, 25 bp, S. pombe
atgcattatgtttggctctacgagc

SEQ ID NO: 67205 - DNA, 25 bp, S. pombe
atgcatctacttttgctgctgagca

SEQ ID NO: 67206 - DNA, 25 bp, S. pombe
atgcactcgtatttgcttcagctaa

SEQ ID NO: 67207 - DNA, 25 bp, S. pombe
atgaccttatcacttgtctaaacag

SEQ ID NO: 67208 - DNA, 25 bp, S. pombe
atgcagcctctttttgatcttacca

SEQ ID NO: 67209 - DNA, 25 bp, S. pombe
atgaagtttcttctgatattcgaaa

SEQ ID NO: 67210 - DNA, 25 bp, S. pombe
atgaagtttccgcagagtctctcaa

SEQ ID NO: 67211 - DNA, 25 bp, S. pombe
atgactacttcaactcggctatttc

SEQ ID NO: 67212 - DNA, 25 bp, S. pombe
atgactactttgactcccagttatc

SEQ ID NO: 67213 - DNA, 25 bp, S. pombe
atgcaattcctgatccattttccgt

SEQ ID NO: 67214 - DNA, 25 bp, S. pombe
atgaacatccttccgcatatgctat

SEQ ID NO: 67215 - DNA, 25 bp, S. pombe
atgcagccatgtttgatctaccaca

SEQ ID NO: 67216 - DNA, 25 bp, S. pombe
atgcagactctgttttatacccttc

SEQ ID NO: 67217 - DNA, 25 bp, S. pombe
atgaacttcctgaggactccttgcg

SEQ ID NO: 67218 - DNA, 25 bp, S. pombe
atgaagttgctcaaacatctccgcc

SEQ ID NO: 67219 - DNA, 25 bp, S. pombe
atgaagttgcaagctttcccaccat

SEQ ID NO: 67220 - DNA, 25 bp, S. pombe
atgaattgtctttgtggaacccact

SEQ ID NO: 67221 - DNA, 25 bp, S. pombe
atgaattccctattaaacctcgtgg

SEQ ID NO: 67222 - DNA, 25 bp, S. pombe
atgatattccctttagtcgtcctat

SEQ ID NO: 67223 - DNA, 25 bp, S. pombe
atgatgagttccgttttcagtccct

SEQ ID NO: 67224 - DNA, 25 bp, S. pombe
atgaagaatcccttatggcgtccca

SEQ ID NO: 67225 - DNA, 25 bp, S. pombe
atgttgaatcccttagtcttatccc

SEQ ID NO: 67226 - DNA, 25 bp, S. pombe
atgtcaaatccagccgtattaccgc

SEQ ID NO: 67227 - DNA, 25 bp, S. pombe
actctaaccataccagaacgtccag

SEQ ID NO: 67228 - DNA, 25 bp, S. pombe
atgactactcctgatgctgaagcaa

SEQ ID NO: 67229 - DNA, 25 bp, S. pombe
atggtccgtcttttatttgcaaact

SEQ ID NO: 67230 - DNA, 25 bp, S. pombe
atgacttgggtcttgattctttaga

SEQ ID NO: 67231 - DNA, 25 bp, S. pombe
atgactctaccatttcgtctttaga

SEQ ID NO: 67232 - DNA, 25 bp, S. pombe
atgaagtaccttgcagcttatttac

SEQ ID NO: 67233 - DNA, 25 bp, S. pombe
atgtcaggacgcgtgcaaaaagtta

SEQ ID NO: 67234 - DNA, 25 bp, S. pombe
atggcttacgcttgggaaggcttcc

SEQ ID NO: 67235 - DNA, 25 bp, S. pombe
atggaatttcgtcgccaaacttgct

SEQ ID NO: 67236 - DNA, 25 bp, S. pombe
atgatccgaaaaggcgccaacgttt

SEQ ID NO: 67237 - DNA, 25 bp, S. pombe
atgaccgcaaagatggctgaaccat

SEQ ID NO: 67238 - DNA, 25 bp, S. pombe
atgagctcgtaatccgtgttcagcc

SEQ ID NO: 67239 - DNA, 25 bp, S. pombe
atgatgccaatagcctttcttcagc

SEQ ID NO: 67240 - DNA, 25 bp, S. pombe
atgaatccttccgaatctctcaagg

SEQ ID NO: 67241 - DNA, 25 bp, S. pombe
atgaaagcatcccagaaccgcacag

SEQ ID NO: 67242 - DNA, 25 bp, S. pombe
atgacagggaaaactcctccagctt

SEQ ID NO: 67243 - DNA, 25 bp, S. pombe
atgataccgaaaatcactcgcccag

SEQ ID NO: 67244 - DNA, 25 bp, S. pombe
atgatatcaagtctggagctcccgt

SEQ ID NO: 67245 - DNA, 25 bp, S. pombe
atgaatatcatgacgctcaactccc

SEQ ID NO: 67246 - DNA, 25 bp, S. pombe
atgagtattgccgtatatgccctta

SEQ ID NO: 67247 - DNA, 25 bp, S. pombe
atgagtcctcgtgttcacatgttga

SEQ ID NO: 67248 - DNA, 25 bp, S. pombe
atgactctgatttatgtttgcgtac

SEQ ID NO: 67249 - DNA, 25 bp, S. pombe
atgacctttcattcattgctcgtgc

SEQ ID NO: 67250 - DNA, 25 bp, S. pombe
atgaacttgattccattgctcctca

SEQ ID NO: 67251 - DNA, 25 bp, S. pombe
atgaggttgaccgattgcttgcaat

SEQ ID NO: 67252 - DNA, 25 bp, S. pombe
atgatcggtacggatgtctcgcagt

SEQ ID NO: 67253 - DNA, 25 bp, S. pombe
atgacatgcggcctctgtggatccg

SEQ ID NO: 67254 - DNA, 25 bp, S. pombe
atgaatgccgctgagatcactgata

SEQ ID NO: 67255 - DNA, 25 bp, S. pombe
atgatccgtttggacctaccataac

SEQ ID NO: 67256 - DNA, 25 bp, S. pombe
atgaggatgcagactttgacaacga

SEQ ID NO: 67257 - DNA, 25 bp, S. pombe
atgaatctgaatttctcccactcaa

SEQ ID NO: 67258 - DNA, 25 bp, S. pombe
atgaatcctacctcatttatatatg

SEQ ID NO: 67259 - DNA, 25 bp, S. pombe
atgactatcatatcttcgtggcata

SEQ ID NO: 67260 - DNA, 25 bp, S. pombe
atgacttcgattcacactggctcaa

SEQ ID NO: 67261 - DNA, 25 bp, S. pombe
atgacatgtcagttcttgcacgcgt

SEQ ID NO: 67262 - DNA, 25 bp, S. pombe
atgaattcgtcgtactcgcttgtga

SEQ ID NO: 67263 - DNA, 25 bp, S. pombe
atgaatttcttgcatcacccatgga

SEQ ID NO: 67264 - DNA, 25 bp, S. pombe
atgcaattctcggacaactcacatt

SEQ ID NO: 67265 - DNA, 25 bp, S. pombe
atgatcacgctttacgactttctcg

SEQ ID NO: 67266 - DNA, 25 bp, S. pombe
atgaacgtgagcttcgccgtattgc

SEQ ID NO: 67267 - DNA, 25 bp, S. pombe
atgaacaacgatcgctcttttcttg

SEQ ID NO: 67268 - DNA, 25 bp, S. pombe
atgaacaccgtcaaatttggctgga

SEQ ID NO: 67269 - DNA, 25 bp, S. pombe
atgaaatccgatttggcttccgtac

SEQ ID NO: 67270 - DNA, 25 bp, S. pombe
atgaggcattttcatgcggcgtgct

SEQ ID NO: 67271 - DNA, 25 bp, S. pombe
atgacattgagtaaagcggctttcc

SEQ ID NO: 67272 - DNA, 25 bp, S. pombe
atgactgccaagagtctcgccaaat

SEQ ID NO: 67273 - DNA, 25 bp, S. pombe
atgggcctaattgctcctcaaactt

SEQ ID NO: 67274 - DNA, 25 bp, S. pombe
agaaatactaccctcgtcttacatt

SEQ ID NO: 67275 - DNA, 25 bp, S. pombe
atgataaaatcagcccttcctacgt

SEQ ID NO: 67276 - DNA, 25 bp, S. pombe
atgaaaaactcagcactgtcccttc

SEQ ID NO: 67277 - DNA, 25 bp, S. pombe
atgagatgttcgttgcttgctgtgc

SEQ ID NO: 67278 - DNA, 25 bp, S. pombe
atgattgtatcgctgtcttacagga

SEQ ID NO: 67279 - DNA, 25 bp, S. pombe
atgaaggatcctgtcgtctctcaat

SEQ ID NO: 67280 - DNA, 25 bp, S. pombe
atgaaggtcctcttaatttgaactg

SEQ ID NO: 67281 - DNA, 25 bp, S. pombe
atgaaggctttcttgctctttacaa

SEQ ID NO: 67282 - DNA, 25 bp, S. pombe
atgagttgcttcttactgggtcagt

SEQ ID NO: 67283 - DNA, 25 bp, S. pombe
atgatgtcgctttttccggatcaaa

SEQ ID NO: 67284 - DNA, 25 bp, S. pombe
atgacacttcttcttctggtatcta

SEQ ID NO: 67285 - DNA, 25 bp, S. pombe
atgactcgtcttctaatgtgcatag

SEQ ID NO: 67286 - DNA, 25 bp, S. pombe
atgactcagctgatgcaattaggtg

SEQ ID NO: 67287 - DNA, 25 bp, S. pombe
atgagcacttgtctcagtcacttca

SEQ ID NO: 67288 - DNA, 25 bp, S. pombe
atgaactatctgcatcctacaagcc

SEQ ID NO: 67289 - DNA, 25 bp, S. pombe
atgaatctcttttccaccttggttt

SEQ ID NO: 67290 - DNA, 25 bp, S. pombe
atgactaaccgcttgcttcaaagaa

SEQ ID NO: 67291 - DNA, 25 bp, S. pombe
atgacaaacctgctgcttcggaaga

SEQ ID NO: 67292 - DNA, 25 bp, S. pombe
atgaaaagccttttgccgagccgca

SEQ ID NO: 67293 - DNA, 25 bp, S. pombe
atgaaattccttttcgtgctggcga

SEQ ID NO: 67294 - DNA, 25 bp, S. pombe
atgacaatggtgagtcgcctgcctc

SEQ ID NO: 67295 - DNA, 25 bp, S. pombe
atgactgtccatgaatctttgcttc

SEQ ID NO: 67296 - DNA, 25 bp, S. pombe
atgactggcactgacttggttttga

SEQ ID NO: 67297 - DNA, 25 bp, S. pombe
atgactccctcggttacatatttga

SEQ ID NO: 67298 - DNA, 25 bp, S. pombe
atgactttccgttgtcacttttgac

SEQ ID NO: 67299 - DNA, 25 bp, S. pombe
atgagctttcggagttggtgtctga

SEQ ID NO: 67300 - DNA, 25 bp, S. pombe
atgagtttgctacgtttgcttgcca

SEQ ID NO: 67301 - DNA, 25 bp, S. pombe
atgagtctttgttttctgcaggcca

SEQ ID NO: 67302 - DNA, 25 bp, S. pombe
atgagcgcatttttattcgccaaaa

SEQ ID NO: 67303 - DNA, 25 bp, S. pombe
atgagctgtcctatagattccaaaa

SEQ ID NO: 67304 - DNA, 25 bp, S. pombe
atgacttccttatatgctgcaacca

SEQ ID NO: 67305 - DNA, 25 bp, S. pombe
atgacagttctgacgatgatcgcgg

SEQ ID NO: 67306 - DNA, 25 bp, S. pombe
atgaaccttcttgtgagccaactga

SEQ ID NO: 67307 - DNA, 25 bp, S. pombe
atgatactgcatcttacggccaaag

SEQ ID NO: 67308 - DNA, 25 bp, S. pombe
atgacactaccaacaccactgatga

SEQ ID NO: 67309 - DNA, 25 bp, S. pombe
atgagatgctctttgttcgtggtga

SEQ ID NO: 67310 - DNA, 25 bp, S. pombe
atgagcatgcctgttgatctcgttg

SEQ ID NO: 67311 - DNA, 25 bp, S. pombe
atgatcccagtcctgccgagaatag

SEQ ID NO: 67312 - DNA, 25 bp, S. pombe
atgatccgcttgtgcctgaaattgc

SEQ ID NO: 67313 - DNA, 25 bp, S. pombe
atgacaatgctatccggttatacaa

SEQ ID NO: 67314 - DNA, 25 bp, S. pombe
atgagcgatgaacccggacttccaa

SEQ ID NO: 67315 - DNA, 25 bp, S. pombe
atgaggctcgaaactgtctctccca

SEQ ID NO: 67316 - DNA, 25 bp, S. pombe
atgaggctgatctaagtattttaat

SEQ ID NO: 67317 - DNA, 25 bp, S. pombe
atgactcgacgaaagcagctgcttt

SEQ ID NO: 67318 - DNA, 25 bp, S. pombe
atgagaaggagaccctagctgccct

SEQ ID NO: 67319 - DNA, 25 bp, S. pombe
atgatacgtgaagccgacaccgatg

SEQ ID NO: 67320 - DNA, 25 bp, S. pombe
atgacttggatgtctcggccggtga

SEQ ID NO: 67321 - DNA, 25 bp, S. pombe
atgagttctttcttagccggtagct

SEQ ID NO: 67322 - DNA, 25 bp, S. pombe
atgattgacgttagcattcagccta

SEQ ID NO: 67323 - DNA, 25 bp, S. pombe
atgatcatgcttctgcagctgtagc

SEQ ID NO: 67324 - DNA, 25 bp, S. pombe
atgaaaaatgcggtctgtcgcgcgc

SEQ ID NO: 67325 - DNA, 25 bp, S. pombe
atgaaacgtcgcgtcggttgcgtac

SEQ ID NO: 67326 - DNA, 25 bp, S. pombe
atggaaaagcagcaccgttcggcgt

SEQ ID NO: 67327 - DNA, 25 bp, S. pombe
atgactacccgtaaccttacagatg

SEQ ID NO: 67328 - DNA, 25 bp, S. pombe
atgatggctcttgtgatacccgtat

SEQ ID NO: 67329 - DNA, 25 bp, S. pombe
atgatggtcttgagtctgcgccgga

SEQ ID NO: 67330 - DNA, 25 bp, S. pombe
atgtatggcttaccgttacgacgca

SEQ ID NO: 67331 - DNA, 25 bp, S. pombe
atgagttggcaacccgaagcaacga

SEQ ID NO: 67332 - DNA, 25 bp, S. pombe
atgaggatgcccagtcgtccaatct

SEQ ID NO: 67333 - DNA, 25 bp, S. pombe
atgaaagatcctcgtcttccaatcc

SEQ ID NO: 67334 - DNA, 25 bp, S. pombe
atgactatgcccgagttttcacttc

SEQ ID NO: 67335 - DNA, 25 bp, S. pombe
atgagtcttgctgattttatggaac

SEQ ID NO: 67336 - DNA, 25 bp, S. pombe
atgtctcgatcgaccttttgaggga

SEQ ID NO: 67337 - DNA, 25 bp, S. pombe
atgttcaagtgttccacggtcgtgt

SEQ ID NO: 67338 - DNA, 25 bp, S. pombe
atgtctttggtagcctacgactcag

SEQ ID NO: 67339 - DNA, 25 bp, S. pombe
atgagcttgtcgatcatttcttccc

SEQ ID NO: 67340 - DNA, 25 bp, S. pombe
atgactctgttgactttgtttctaa

SEQ ID NO: 67341 - DNA, 25 bp, S. pombe
atgacatttcagtcttggtttcaaa

SEQ ID NO: 67342 - DNA, 25 bp, S. pombe
atgacattgctcttcttgatgaaac

SEQ ID NO: 67343 - DNA, 25 bp, S. pombe
atgatatgagcttgtctgatgacga

SEQ ID NO: 67344 - DNA, 25 bp, S. pombe
atgacagagcttcatcctgatgagc

SEQ ID NO: 67345 - DNA, 25 bp, S. pombe
atgagtttatgtccagagatccggg

SEQ ID NO: 67346 - DNA, 25 bp, S. pombe
atgatcctaccgtaatgtctgctgc

SEQ ID NO: 67347 - DNA, 25 bp, S. pombe
atgatggctatgactcgtgcggttc

SEQ ID NO: 67348 - DNA, 25 bp, S. pombe
atgatggaatccttgtcgacttcac

SEQ ID NO: 67349 - DNA, 25 bp, S. pombe
atgagcgcatttctgttgacgaagc

SEQ ID NO: 67350 - DNA, 25 bp, S. pombe
atgtcctttgggttggcgagagtac

SEQ ID NO: 67351 - DNA, 25 bp, S. pombe
atgtactcggaaactcagccaactc

SEQ ID NO: 67352 - DNA, 25 bp, S. pombe
atgattgtcgctcaaccaggaaccg

SEQ ID NO: 67353 - DNA, 25 bp, S. pombe
atggtgcaagcttcagtcctaaaat

SEQ ID NO: 67354 - DNA, 25 bp, S. pombe
atgagcattccggtaatgcagttaa

SEQ ID NO: 67355 - DNA, 25 bp, S. pombe
atgagagaccgccaaccagtatgag

SEQ ID NO: 67356 - DNA, 25 bp, S. pombe
atgtccctcccagtgccgaggaagg

SEQ ID NO: 67357 - DNA, 25 bp, S. pombe
atgactccaagctcgcgtctagaaa

SEQ ID NO: 67358 - DNA, 25 bp, S. pombe
atgactcctggaaccggtagaacat

SEQ ID NO: 67359 - DNA, 25 bp, S. pombe
atgactcgccataatcgtcaggcat

SEQ ID NO: 67360 - DNA, 25 bp, S. pombe
atgagatcttttgctctgcgcagaa

SEQ ID NO: 67361 - DNA, 25 bp, S. pombe
atgagacagttcttgccgagcaggc

SEQ ID NO: 67362 - DNA, 25 bp, S. pombe
atgtctcgtgaaaacgtcgcgcgta

SEQ ID NO: 67363 - DNA, 25 bp, S. pombe
atgtcgcttccaagggctgtcggtc

SEQ ID NO: 67364 - DNA, 25 bp, S. pombe
atgagtctttatgggagcctccggc

SEQ ID NO: 67365 - DNA, 25 bp, S. pombe
atgtccagtcttcaaaaacgccctg

SEQ ID NO: 67366 - DNA, 25 bp, S. pombe
atgattgccagagggctaatctacc

SEQ ID NO: 67367 - DNA, 25 bp, S. pombe
agaggctcaagatgctgtacaaaaa

SEQ ID NO: 67368 - DNA, 25 bp, S. pombe
atgatgccatgtttagcggacttaa

SEQ ID NO: 67369 - DNA, 25 bp, S. pombe
atgacgctgcaatagatgcccttaa

SEQ ID NO: 67370 - DNA, 25 bp, S. pombe
atgtctatgcagcaagtggccttag

SEQ ID NO: 67371 - DNA, 25 bp, S. pombe
atgatcacatcgcaagtggccctga

SEQ ID NO: 67372 - DNA, 25 bp, S. pombe
atgatccaaataatgcgtcccctgc

SEQ ID NO: 67373 - DNA, 25 bp, S. pombe
atgataacggccatggtccaacaat

SEQ ID NO: 67374 - DNA, 25 bp, S. pombe
atgatacactggctcgttcggaaga

SEQ ID NO: 67375 - DNA, 25 bp, S. pombe
atgattcctggcttggtttccaaag

SEQ ID NO: 67376 - DNA, 25 bp, S. pombe
atgactcagctcctttggttccaga

SEQ ID NO: 67377 - DNA, 25 bp, S. pombe
atgactagcccttcgctttcagaaa

SEQ ID NO: 67378 - DNA, 25 bp, S. pombe
atgacgatactctgcattctgcgaa

SEQ ID NO: 67379 - DNA, 25 bp, S. pombe
atgtcgaaacttaaggcccaatctg

SEQ ID NO: 67380 - DNA, 25 bp, S. pombe
atgtttcaacatctgaggccgaagg

SEQ ID NO: 67381 - DNA, 25 bp, S. pombe
atgtctgtcagtactaaacgtcttg

SEQ ID NO: 67382 - DNA, 25 bp, S. pombe
atgttactgttcgtggtcccaaggc

SEQ ID NO: 67383 - DNA, 25 bp, S. pombe
atgatctgctttgccgtggattcac

SEQ ID NO: 67384 - DNA, 25 bp, S. pombe
atgataccgtccagtagattccttc

SEQ ID NO: 67385 - DNA, 25 bp, S. pombe
atgtacctcccaaggcagtagtttt

SEQ ID NO: 67386 - DNA, 25 bp, S. pombe
atgtacgcggtctgggtctgttgca

SEQ ID NO: 67387 - DNA, 25 bp, S. pombe
atgtccgtcaaatgatgcagtcccc

SEQ ID NO: 67388 - DNA, 25 bp, S. pombe
atgagtatctatccgcagttagcga

SEQ ID NO: 67389 - DNA, 25 bp, S. pombe
atgagctgtatgctacgccatgcta

SEQ ID NO: 67390 - DNA, 25 bp, S. pombe
atgatgctgcttcagatcatcctgc

SEQ ID NO: 67391 - DNA, 25 bp, S. pombe
atgtgcttacaacacttccaaggcc

SEQ ID NO: 67392 - DNA, 25 bp, S. pombe
atgtcttcagacagtttccaacggc

SEQ ID NO: 67393 - DNA, 25 bp, S. pombe
atgttggcatttcggcactgatagc

SEQ ID NO: 67394 - DNA, 25 bp, S. pombe
atgaccatgcatatagccttggccc

SEQ ID NO: 67395 - DNA, 25 bp, S. pombe
atgattctttttctgtggcctcgct

SEQ ID NO: 67396 - DNA, 25 bp, S. pombe
atgatgacttcgttggtacgccttt

SEQ ID NO: 67397 - DNA, 25 bp, S. pombe
atgtagttccttttgaagcctttcg

SEQ ID NO: 67398 - DNA, 25 bp, S. pombe
atgtccacaagaattaagtcgtcgt

SEQ ID NO: 67399 - DNA, 25 bp, S. pombe
atgttggagaattgtcaatgtcgac

SEQ ID NO: 67400 - DNA, 25 bp, S. pombe
atgtaggtcgtctctgtaagttccc

SEQ ID NO: 67401 - DNA, 25 bp, S. pombe
atgttggacgtgtgtttacttgctc

SEQ ID NO: 67402 - DNA, 25 bp, S. pombe
atgatacctctgcagaatcttcagg

SEQ ID NO: 67403 - DNA, 25 bp, S. pombe
atgtaatcgcagctcgactcatgaa

SEQ ID NO: 67404 - DNA, 25 bp, S. pombe
atgggctaaccgaccacatggattc

SEQ ID NO: 67405 - DNA, 25 bp, S. pombe
atgtctcaaattatccttcctttcc

SEQ ID NO: 67406 - DNA, 25 bp, S. pombe
atgttcccatttatgcttagcttcc

SEQ ID NO: 67407 - DNA, 25 bp, S. pombe
atgttacaccattttctctacttcg

SEQ ID NO: 67408 - DNA, 25 bp, S. pombe
agttcgtatgggacacggcgttcgc

SEQ ID NO: 67409 - DNA, 25 bp, S. pombe
agttcgtcaagtcacgccttttata

SEQ ID NO: 67410 - DNA, 25 bp, S. pombe
atgatttgcaaattgtccgcggtta

SEQ ID NO: 67411 - DNA, 25 bp, S. pombe
atgataagccaacttgccggttctg

SEQ ID NO: 67412 - DNA, 25 bp, S. pombe
atgagactgccaataatcctcctgc

SEQ ID NO: 67413 - DNA, 25 bp, S. pombe
atgagtcgcgcaataatccttatag

SEQ ID NO: 67414 - DNA, 25 bp, S. pombe
atgaggcttctgtcattcctggtag

SEQ ID NO: 67415 - DNA, 25 bp, S. pombe
atgaccattgcttggctttagcgga

SEQ ID NO: 67416 - DNA, 25 bp, S. pombe
atgtattcgctattttaacttgtgg

SEQ ID NO: 67417 - DNA, 25 bp, S. pombe
atgtattcgtactctgattgcaggc

SEQ ID NO: 67418 - DNA, 25 bp, S. pombe
atgagttctaattccaatacagatc

SEQ ID NO: 67419 - DNA, 25 bp, S. pombe
atgattgtcgtgatcgttggcgcga

SEQ ID NO: 67420 - DNA, 25 bp, S. pombe
atgtttcaatgcatcctttgcgaag

SEQ ID NO: 67421 - DNA, 25 bp, S. pombe
atgttgccaagcgagactctcacga

SEQ ID NO: 67422 - DNA, 25 bp, S. pombe
atgtgttaaagttgcaccgtcctgt

SEQ ID NO: 67423 - DNA, 25 bp, S. pombe
atgtttgaagaggaccctggcgctc

SEQ ID NO: 67424 - DNA, 25 bp, S. pombe
atgtctactttactctccgaaaact

SEQ ID NO: 67425 - DNA, 25 bp, S. pombe
atgtctcagcttatattcccactaa

SEQ ID NO: 67426 - DNA, 25 bp, S. pombe
atgtctctggttgttcccgacaatt

SEQ ID NO: 67427 - DNA, 25 bp, S. pombe
atgtgggatccaacggactttcata

SEQ ID NO: 67428 - DNA, 25 bp, S. pombe
atgaggatacacaacgtaccgttag

SEQ ID NO: 67429 - DNA, 25 bp, S. pombe
atgtcgatgacaattttacctttag

SEQ ID NO: 67430 - DNA, 25 bp, S. pombe
atgtacgtgattccgtcagtctcat

SEQ ID NO: 67431 - DNA, 25 bp, S. pombe
atgatttctgtatctgctcgcagta

SEQ ID NO: 67432 - DNA, 25 bp, S. pombe
atgagtttgatcttcctcctgctga

SEQ ID NO: 67433 - DNA, 25 bp, S. pombe
atggccaagttgtacctcctagagg

SEQ ID NO: 67434 - DNA, 25 bp, S. pombe
atgttgtgttttctgtctatggctg

SEQ ID NO: 67435 - DNA, 25 bp, S. pombe
atgtcgctggttgtcgagttactaa

SEQ ID NO: 67436 - DNA, 25 bp, S. pombe
atgttgcaggtttgtccgcttacta

SEQ ID NO: 67437 - DNA, 25 bp, S. pombe
atgagcatatgtatcttcaacccat

SEQ ID NO: 67438 - DNA, 25 bp, S. pombe
atgagtctcattgttcaagccctga

SEQ ID NO: 67439 - DNA, 25 bp, S. pombe
atgttggttcatcacaacctgccga

SEQ ID NO: 67440 - DNA, 25 bp, S. pombe
atgattcttgctttgtatcgccaac

SEQ ID NO: 67441 - DNA, 25 bp, S. pombe
atgatactcctttgagagccactcc

SEQ ID NO: 67442 - DNA, 25 bp, S. pombe
atgatttacgcaccaagccatgttc

SEQ ID NO: 67443 - DNA, 25 bp, S. pombe
gttgaaatcccctgaaaccaagttg

SEQ ID NO: 67444 - DNA, 25 bp, S. pombe
aggcaaatccacatcagcaaggctg

SEQ ID NO: 67445 - DNA, 25 bp, S. pombe
agccccagccatgttatacggtgat

SEQ ID NO: 67446 - DNA, 25 bp, S. pombe
atgtacgatatcatacttttaaaga

SEQ ID NO: 67447 - DNA, 25 bp, S. pombe
atgtcagcagaagacctttttacaa

SEQ ID NO: 67448 - DNA, 25 bp, S. pombe
atgatattaccaaccttcttctaca

SEQ ID NO: 67449 - DNA, 25 bp, S. pombe
atgtttccacatacgcagtacctaa

SEQ ID NO: 67450 - DNA, 25 bp, S. pombe
atgtaccccttctagattcttatat

SEQ ID NO: 67451 - DNA, 25 bp, S. pombe
atgtttcccctgcattttctgtaaa

SEQ ID NO: 67452 - DNA, 25 bp, S. pombe
atgatggtcctgtaattgctcacaa

SEQ ID NO: 67453 - DNA, 25 bp, S. pombe
atgttgtcacggaagacgacctgga

SEQ ID NO: 67454 - DNA, 25 bp, S. pombe
atgattctacatggtcgagctacgt

SEQ ID NO: 67455 - DNA, 25 bp, S. pombe
atgatgtttgcgtccaacgatcgaa

SEQ ID NO: 67456 - DNA, 25 bp, S. pombe
atgttgttctcttttcgagcgatag

SEQ ID NO: 67457 - DNA, 25 bp, S. pombe
atgatcctgtgctagtcttacttta

SEQ ID NO: 67458 - DNA, 25 bp, S. pombe
atgttggtgcagttctaagccttct

SEQ ID NO: 67459 - DNA, 25 bp, S. pombe
atgattggtactttgactggtgctc

SEQ ID NO: 67460 - DNA, 25 bp, S. pombe
atgattggctcctatggaccttctg

SEQ ID NO: 67461 - DNA, 25 bp, S. pombe
atgatgtggtcattcagggctccct

SEQ ID NO: 67462 - DNA, 25 bp, S. pombe
atgatcttgaacctgttggcgctca

SEQ ID NO: 67463 - DNA, 25 bp, S. pombe
atgagttccatcgtccatgtattgc

SEQ ID NO: 67464 - DNA, 25 bp, S. pombe
atggctgcgaggaaactgacccgaa

SEQ ID NO: 67465 - DNA, 25 bp, S. pombe
atgatgagcgtgtcttaccttctat

SEQ ID NO: 67466 - DNA, 25 bp, S. pombe
atgaggcatctgaccttcaacaaat

SEQ ID NO: 67467 - DNA, 25 bp, S. pombe
atgttacacccaaatgaaccgccta

SEQ ID NO: 67468 - DNA, 25 bp, S. pombe
atgttgctcgtcgtaaacctgcgaa

SEQ ID NO: 67469 - DNA, 25 bp, S. pombe
atgttggaaatcttcctccttctac

SEQ ID NO: 67470 - DNA, 25 bp, S. pombe
atgtttgaagtgttccttcctaccg

SEQ ID NO: 67471 - DNA, 25 bp, S. pombe
atgagttacttgtctccttccaaat

SEQ ID NO: 67472 - DNA, 25 bp, S. pombe
atgagtctaaatctccttcacaaaa

SEQ ID NO: 67473 - DNA, 25 bp, S. pombe
atgaggtttatgcttcttcaccaaa

SEQ ID NO: 67474 - DNA, 25 bp, S. pombe
atgtggttgaatctcacgtacctcc

SEQ ID NO: 67475 - DNA, 25 bp, S. pombe
atgttgctaaacttgcgcacttccc

SEQ ID NO: 67476 - DNA, 25 bp, S. pombe
atgtctaaagctggtgcgcctgatc

SEQ ID NO: 67477 - DNA, 25 bp, S. pombe
atgtttcaattggtgctcgtgttcg

SEQ ID NO: 67478 - DNA, 25 bp, S. pombe
atgtgaccaaggttcctcgtcttag

SEQ ID NO: 67479 - DNA, 25 bp, S. pombe
atgttcctagatttactcgtggaca

SEQ ID NO: 67480 - DNA, 25 bp, S. pombe
atgtatccagtgtcgttctttatga

SEQ ID NO: 67481 - DNA, 25 bp, S. pombe
atgttagccgtaatgtcttctgggt

SEQ ID NO: 67482 - DNA, 25 bp, S. pombe
atgtttatgtttgtcggtccaccag

SEQ ID NO: 67483 - DNA, 25 bp, S. pombe
atgttcgtagtagacgcgacgtcct

SEQ ID NO: 67484 - DNA, 25 bp, S. pombe
atgttcctttagtaactcactctcc

SEQ ID NO: 67485 - DNA, 25 bp, S. pombe
atgttcgtctttggagagctcgtgc

SEQ ID NO: 67486 - DNA, 25 bp, S. pombe
atgatgaagccgttcgcgttgccga

SEQ ID NO: 67487 - DNA, 25 bp, S. pombe
atgttaatgagtacggtgaatcccc

SEQ ID NO: 67488 - DNA, 25 bp, S. pombe
agttgaattacctctgcatacccac

SEQ ID NO: 67489 - DNA, 25 bp, S. pombe
agttgtttatcctggtgaccctcga

SEQ ID NO: 67490 - DNA, 25 bp, S. pombe
atgtttactcgcttttacggtcact

SEQ ID NO: 67491 - DNA, 25 bp, S. pombe
atgttggacccttactatcgtgtca

SEQ ID NO: 67492 - DNA, 25 bp, S. pombe
atgttggtttcatactcactttcaa

SEQ ID NO: 67493 - DNA, 25 bp, S. pombe
atgtcactttaatgcctggtcctta

SEQ ID NO: 67494 - DNA, 25 bp, S. pombe
atgttgcttttcaccggaatggcca

SEQ ID NO: 67495 - DNA, 25 bp, S. pombe
atgtcaacctctcaatcaagtgaac

SEQ ID NO: 67496 - DNA, 25 bp, S. pombe
atgatttgactgctggtcgtgcttc

SEQ ID NO: 67497 - DNA, 25 bp, S. pombe
atgatcggttgcattgtctttccca

SEQ ID NO: 67498 - DNA, 25 bp, S. pombe
atgtcggatgtggttgcccaagctt

SEQ ID NO: 67499 - DNA, 25 bp, S. pombe
atgatgcttcttgtcctatcgatga

SEQ ID NO: 67500 - DNA, 25 bp, S. pombe
atgtacttgctgtgtttactggccg

SEQ ID NO: 67501 - DNA, 25 bp, S. pombe
atgtacccatgttggcttggaacgc

SEQ ID NO: 67502 - DNA, 25 bp, S. pombe
atgtccttcaatccggttatggcaa

SEQ ID NO: 67503 - DNA, 25 bp, S. pombe
atgttcatgttgtgtcagatcctca

SEQ ID NO: 67504 - DNA, 25 bp, S. pombe
atgttcatgatattcgtcgccctga

SEQ ID NO: 67505 - DNA, 25 bp, S. pombe
atgttgaacctcgaatcttctgaga

SEQ ID NO: 67506 - DNA, 25 bp, S. pombe
atgtttgcccgaaacttttgcgatc

SEQ ID NO: 67507 - DNA, 25 bp, S. pombe
atgttcatgaattccttctcaccaa

SEQ ID NO: 67508 - DNA, 25 bp, S. pombe
atgttgattgtcgtgcaggctcagc

SEQ ID NO: 67509 - DNA, 25 bp, S. pombe
atgttgtgcctgttatcgctaagtc

SEQ ID NO: 67510 - DNA, 25 bp, S. pombe
atgatcctcattgctttcgtttaca

SEQ ID NO: 67511 - DNA, 25 bp, S. pombe
atgatgcctttgttacgcttcttaa

SEQ ID NO: 67512 - DNA, 25 bp, S. pombe
atgtttggtctctatgttgcttcct

SEQ ID NO: 67513 - DNA, 25 bp, S. pombe
atgtttactcatttgttccccataa

SEQ ID NO: 67514 - DNA, 25 bp, S. pombe
atgttatacctcctgtactacgaag

SEQ ID NO: 67515 - DNA, 25 bp, S. pombe
atgttcccgttggtactgcggatag

SEQ ID NO: 67516 - DNA, 25 bp, S. pombe
agtttacgttgcagacatgttgtcg

SEQ ID NO: 67517 - DNA, 25 bp, S. pombe
atgttgctactgatccgaaaggacg

SEQ ID NO: 67518 - DNA, 25 bp, S. pombe
atgattcgccaattactgatgctga

SEQ ID NO: 67519 - DNA, 25 bp, S. pombe
atgatcctgccattctagcattgtc

SEQ ID NO: 67520 - DNA, 25 bp, S. pombe
atgatccctcacttactatattcct

SEQ ID NO: 67521 - DNA, 25 bp, S. pombe
atgatttctccagtgatgcttttac

SEQ ID NO: 67522 - DNA, 25 bp, S. pombe
atgataactcacatgcatctcctta

SEQ ID NO: 67523 - DNA, 25 bp, S. pombe
atgtgctaactcaacctactatgct

SEQ ID NO: 67524 - DNA, 25 bp, S. pombe
atgatgccaggcttacctcaaatgc

SEQ ID NO: 67525 - DNA, 25 bp, S. pombe
atgttaccgctaccattactggcaa

SEQ ID NO: 67526 - DNA, 25 bp, S. pombe
atgtttatcctcagtgttggtgcaa

SEQ ID NO: 67527 - DNA, 25 bp, S. pombe
atgtctaaaccagctggaggtccaa

SEQ ID NO: 67528 - DNA, 25 bp, S. pombe
atgttattaccgctggaactgccat

SEQ ID NO: 67529 - DNA, 25 bp, S. pombe
atgtgggtaacgtgtcacctgctca

SEQ ID NO: 67530 - DNA, 25 bp, S. pombe
atgtttccttataggccttctgttc

SEQ ID NO: 67531 - DNA, 25 bp, S. pombe
atgtatgtatcctgacggcggtata

SEQ ID NO: 67532 - DNA, 25 bp, S. pombe
atgtttgtcaatatttccccactaa

SEQ ID NO: 67533 - DNA, 25 bp, S. pombe
atgattattcaagctctggctccca

SEQ ID NO: 67534 - DNA, 25 bp, S. pombe
atgtatttgtagtcatcggccctgc

SEQ ID NO: 67535 - DNA, 25 bp, S. pombe
atgttgttatatttgcagccggtgc

SEQ ID NO: 67536 - DNA, 25 bp, S. pombe
atgttgtattctttgatccctctgc

SEQ ID NO: 67537 - DNA, 25 bp, S. pombe
atgttgctatttttatccgtcgttg

SEQ ID NO: 67538 - DNA, 25 bp, S. pombe
atgatttaattcttccaccgttgca

SEQ ID NO: 67539 - DNA, 25 bp, S. pombe
atgattccttatactacactcacag

SEQ ID NO: 67540 - DNA, 25 bp, S. pombe
atgattctcgttcctattgctttta

SEQ ID NO: 67541 - DNA, 25 bp, S. pombe
agatcgcgttggctatgtgcatcag

SEQ ID NO: 67542 - DNA, 25 bp, S. pombe
atgtgaatcccaaaacagaagcggt

SEQ ID NO: 67543 - DNA, 25 bp, S. pombe
atgattctttacttacccgattaga

SEQ ID NO: 67544 - DNA, 25 bp, S. pombe
atgtctacagatctttgccctgttt

SEQ ID NO: 67545 - DNA, 25 bp, S. pombe
atgtcgcaagaccttttaccttcta

SEQ ID NO: 67546 - DNA, 25 bp, S. pombe
atgtcagcgaaccatttacccaagg

SEQ ID NO: 67547 - DNA, 25 bp, S. pombe
atgtcgcttcccaatgtagttttgc

SEQ ID NO: 67548 - DNA, 25 bp, S. pombe
atgtcgtctgctcgatactatggat

SEQ ID NO: 67549 - DNA, 25 bp, S. pombe
atgtcccttcaatgttgccatatgg

SEQ ID NO: 67550 - DNA, 25 bp, S. pombe
atgttatccgtgaacttcctattgt

SEQ ID NO: 67551 - DNA, 25 bp, S. pombe
atgttacaccgttcttctgctgaat

SEQ ID NO: 67552 - DNA, 25 bp, S. pombe
atgttccatccaaatgtgtacgcaa

SEQ ID NO: 67553 - DNA, 25 bp, S. pombe
atgattcttcaattcgcatttggag

SEQ ID NO: 67554 - DNA, 25 bp, S. pombe
atgattcatcacatccactttggct

SEQ ID NO: 67555 - DNA, 25 bp, S. pombe
atgattatagcagccctgggtgcaa

SEQ ID NO: 67556 - DNA, 25 bp, S. pombe
agtcttcagcgtttcggaccttaag

SEQ ID NO: 67557 - DNA, 25 bp, S. pombe
atgtttacgtttcggcatctttaag

SEQ ID NO: 67558 - DNA, 25 bp, S. pombe
atgtctctacagtatttgcacctac

SEQ ID NO: 67559 - DNA, 25 bp, S. pombe
atgttcgacagactgattgcctccc

SEQ ID NO: 67560 - DNA, 25 bp, S. pombe
atgtttgtaagctttgcctctcgcg

SEQ ID NO: 67561 - DNA, 25 bp, S. pombe
atgtttatccgtttgcagcttctag

SEQ ID NO: 67562 - DNA, 25 bp, S. pombe
atgtcagaaatgatcgtgcttcctc

SEQ ID NO: 67563 - DNA, 25 bp, S. pombe
atgtaatcaatgaacctccacgccg

SEQ ID NO: 67564 - DNA, 25 bp, S. pombe
atgtatctttggacactctgcactc

SEQ ID NO: 67565 - DNA, 25 bp, S. pombe
atgttgattcttcagcaggtcttga

SEQ ID NO: 67566 - DNA, 25 bp, S. pombe
atgtcatcaatatggctctgcgtaa

SEQ ID NO: 67567 - DNA, 25 bp, S. pombe
atgattcacataggcgatcgtccca

SEQ ID NO: 67568 - DNA, 25 bp, S. pombe
atgattcatcatttggtggagcgca

SEQ ID NO: 67569 - DNA, 25 bp, S. pombe
atgtcttccttgttgagatccttgg

SEQ ID NO: 67570 - DNA, 25 bp, S. pombe
atgtcgtcgtctactgaacctagca

SEQ ID NO: 67571 - DNA, 25 bp, S. pombe
atgtctactgctgttaactgggctg

SEQ ID NO: 67572 - DNA, 25 bp, S. pombe
atggtcgggcaagcacttccaggaa

SEQ ID NO: 67573 - DNA, 25 bp, S. pombe
atgtcgggccaaaatcttcaccaga

SEQ ID NO: 67574 - DNA, 25 bp, S. pombe
atgttgttccaaagattgctgacta

SEQ ID NO: 67575 - DNA, 25 bp, S. pombe
atgtatgttcagcaacctcaggcca

SEQ ID NO: 67576 - DNA, 25 bp, S. pombe
atgtctcccgaagatctaggcgtaa

SEQ ID NO: 67577 - DNA, 25 bp, S. pombe
atgtcctcccaaacattgatggtgt

SEQ ID NO: 67578 - DNA, 25 bp, S. pombe
agtcttgttccccatgctggagatt

SEQ ID NO: 67579 - DNA, 25 bp, S. pombe
atgtttcgtcgtgatgctgcagaga

SEQ ID NO: 67580 - DNA, 25 bp, S. pombe
atgttccagatactcctcctgaaaa

SEQ ID NO: 67581 - DNA, 25 bp, S. pombe
atgttcgcattgttcgtgatccaaa

SEQ ID NO: 67582 - DNA, 25 bp, S. pombe
atgttcactggatcgttccaactct

SEQ ID NO: 67583 - DNA, 25 bp, S. pombe
atgttcaagtcaatgctgctcccaa

SEQ ID NO: 67584 - DNA, 25 bp, S. pombe
atgtttgcgtcaatgtccatcgata

SEQ ID NO: 67585 - DNA, 25 bp, S. pombe
atgttcgtgctccagtcagtcttga

SEQ ID NO: 67586 - DNA, 25 bp, S. pombe
atgttgctcctagatctgtttcaga

SEQ ID NO: 67587 - DNA, 25 bp, S. pombe
atgtagtccaagaacttcccgtatc

SEQ ID NO: 67588 - DNA, 25 bp, S. pombe
atggcgttcaagagcagttttctgc

SEQ ID NO: 67589 - DNA, 25 bp, S. pombe
atgtgtaccggttgacgtgatgccc

SEQ ID NO: 67590 - DNA, 25 bp, S. pombe
atgttacttgggatgctgcttccac

SEQ ID NO: 67591 - DNA, 25 bp, S. pombe
atgttaactgggttgtgcctgcatt

SEQ ID NO: 67592 - DNA, 25 bp, S. pombe
atgtctatttggctagttgcgctcc

SEQ ID NO: 67593 - DNA, 25 bp, S. pombe
atgtccatgctgagcgtatgtctcg

SEQ ID NO: 67594 - DNA, 25 bp, S. pombe
atgtctatgcggacgggtagctata

SEQ ID NO: 67595 - DNA, 25 bp, S. pombe
atgtcgatgagacccgtgctagcga

SEQ ID NO: 67596 - DNA, 25 bp, S. pombe
atgtcgtcaaactggctgaggccga

SEQ ID NO: 67597 - DNA, 25 bp, S. pombe
atgtgatcattgtttacagttggca

SEQ ID NO: 67598 - DNA, 25 bp, S. pombe
atgttcgcgatttagcagcggctca

SEQ ID NO: 67599 - DNA, 25 bp, S. pombe
atgttggtcactctgaggatgctca

SEQ ID NO: 67600 - DNA, 25 bp, S. pombe
atgttggtccagtccgtatatcatc

SEQ ID NO: 67601 - DNA, 25 bp, S. pombe
atgttgatatttcctccgctgacaa

SEQ ID NO: 67602 - DNA, 25 bp, S. pombe
atgttgtttgcttctgccgcagaaa

SEQ ID NO: 67603 - DNA, 25 bp, S. pombe
atgttgaatatcatccgcaccacac

SEQ ID NO: 67604 - DNA, 25 bp, S. pombe
atgtctaaaattgctgctgccgcaa

SEQ ID NO: 67605 - DNA, 25 bp, S. pombe
atgtttaattctaccgccattgcaa

SEQ ID NO: 67606 - DNA, 25 bp, S. pombe
atgtttaatttgtctgccgttgcac

SEQ ID NO: 67607 - DNA, 25 bp, S. pombe
atgtttctaactgtgctgcgattca

SEQ ID NO: 67608 - DNA, 25 bp, S. pombe
atgtacgtgcgctttatgcttacaa

SEQ ID NO: 67609 - DNA, 25 bp, S. pombe
atgtcaagtgccctggatgcttcaa

SEQ ID NO: 67610 - DNA, 25 bp, S. pombe
atgttacgctttcatttgccggatt

SEQ ID NO: 67611 - DNA, 25 bp, S. pombe
atgttgcatactatcgtttccggtt

SEQ ID NO: 67612 - DNA, 25 bp, S. pombe
atgtgtctttcgtccggatgagcgt

SEQ ID NO: 67613 - DNA, 25 bp, S. pombe
atgggcattgatcaccggttttcag

SEQ ID NO: 67614 - DNA, 25 bp, S. pombe
atgtcatccacaaaagcctctggca

SEQ ID NO: 67615 - DNA, 25 bp, S. pombe
atgttctcgcagacagactttcgtt

SEQ ID NO: 67616 - DNA, 25 bp, S. pombe
atgtggtcggtcaagctggtcgtcc

SEQ ID NO: 67617 - DNA, 25 bp, S. pombe
atgtctacggtcaacacgtgcgtca

SEQ ID NO: 67618 - DNA, 25 bp, S. pombe
atgtctacggtattgatctcgctga

SEQ ID NO: 67619 - DNA, 25 bp, S. pombe
atgtcgttgggtatttgctttggca

SEQ ID NO: 67620 - DNA, 25 bp, S. pombe
atgtctttgcaaccttttttcggct

SEQ ID NO: 67621 - DNA, 25 bp, S. pombe
atgttgctgctcttgttttatggtc

SEQ ID NO: 67622 - DNA, 25 bp, S. pombe
atgtacgccgttggtgattgcgcat

SEQ ID NO: 67623 - DNA, 25 bp, S. pombe
atgttcgtcgattggttcatgcgct

SEQ ID NO: 67624 - DNA, 25 bp, S. pombe
atgtgtatgttattcgttacttggt

SEQ ID NO: 67625 - DNA, 25 bp, S. pombe
atgttgatgttcttcgttacgttac

SEQ ID NO: 67626 - DNA, 25 bp, S. pombe
atgtcgggtctcatttcaggtgcta

SEQ ID NO: 67627 - DNA, 25 bp, S. pombe
atgtcttgggtgatgctctcggtaa

SEQ ID NO: 67628 - DNA, 25 bp, S. pombe
atgttaatcaaccacgttctgccga

SEQ ID NO: 67629 - DNA, 25 bp, S. pombe
atgttaaagctcctcatgttcctct

SEQ ID NO: 67630 - DNA, 25 bp, S. pombe
atgtccgacatctcaaattctgcgt

SEQ ID NO: 67631 - DNA, 25 bp, S. pombe
atgtgcctggtctttagttgatcct

SEQ ID NO: 67632 - DNA, 25 bp, S. pombe
atgtcagtcgtgtctgtgatctcga

SEQ ID NO: 67633 - DNA, 25 bp, S. pombe
atgtcgtcgcagatgtgtgccgatt

SEQ ID NO: 67634 - DNA, 25 bp, S. pombe
agtcgccaggttaatgggattcccg

SEQ ID NO: 67635 - DNA, 25 bp, S. pombe
atgggcaaggttcacggatctctcg

SEQ ID NO: 67636 - DNA, 25 bp, S. pombe
gggctagttactcttcgttcaataa

SEQ ID NO: 67637 - DNA, 25 bp, S. pombe
atgtctcgcattgcttctgagtcta

SEQ ID NO: 67638 - DNA, 25 bp, S. pombe
atgttccttggcatcgagtcatcaa

SEQ ID NO: 67639 - DNA, 25 bp, S. pombe
atgttttactcgacaactctggaaa

SEQ ID NO: 67640 - DNA, 25 bp, S. pombe
atgtttcgatcatgcatcacctgcg

SEQ ID NO: 67641 - DNA, 25 bp, S. pombe
atgtttttcattgtcgctgcaggtt

SEQ ID NO: 67642 - DNA, 25 bp, S. pombe
atgtttttcttactgcagctggtat

SEQ ID NO: 67643 - DNA, 25 bp, S. pombe
atgtctttcgacgaccaggtgtgat

SEQ ID NO: 67644 - DNA, 25 bp, S. pombe
atgtagaggcgattctccggacact

SEQ ID NO: 67645 - DNA, 25 bp, S. pombe
atgtagacaaatcatccatccctct

SEQ ID NO: 67646 - DNA, 25 bp, S. pombe
atgggtcagtcgcagtcgcaaatct

SEQ ID NO: 67647 - DNA, 25 bp, S. pombe
atggactccattgcaactaacactc

SEQ ID NO: 67648 - DNA, 25 bp, S. pombe
atgggtatccgctaactaacatcga

SEQ ID NO: 67649 - DNA, 25 bp, S. pombe
atgtaattttcatcgctcaacgccg

SEQ ID NO: 67650 - DNA, 25 bp, S. pombe
atgtcatttgttgtcgctaaggtcc

SEQ ID NO: 67651 - DNA, 25 bp, S. pombe
atgtatttctactcctactggttcc

SEQ ID NO: 67652 - DNA, 25 bp, S. pombe
atgtattttacgtcttcctggtctc

SEQ ID NO: 67653 - DNA, 25 bp, S. pombe
atgtggttaactacggttctcgcgg

SEQ ID NO: 67654 - DNA, 25 bp, S. pombe
atgtctttaactatgatttccctgg

SEQ ID NO: 67655 - DNA, 25 bp, S. pombe
atgtttttcaatacgcttaccctgg

SEQ ID NO: 67656 - DNA, 25 bp, S. pombe
atgtttcttctaaccatcttcctta

SEQ ID NO: 67657 - DNA, 25 bp, S. pombe
atgtttgctttccatacacttctcg

SEQ ID NO: 67658 - DNA, 25 bp, S. pombe
atgtttctttacctcatctggacac

SEQ ID NO: 67659 - DNA, 25 bp, S. pombe
atgttttcagtccatcatcatccaa

SEQ ID NO: 67660 - DNA, 25 bp, S. pombe
atgtcattatcacctattgcttctg

SEQ ID NO: 67661 - DNA, 25 bp, S. pombe
atgtctattcccgtgcatgctgatg

SEQ ID NO: 67662 - DNA, 25 bp, S. pombe
atgtctacttcattccatcatgcaa

SEQ ID NO: 67663 - DNA, 25 bp, S. pombe
atgtctcggatcctctccaaaaaat

SEQ ID NO: 67664 - DNA, 25 bp, S. pombe
atggtaatctactgcaactggttag

SEQ ID NO: 67665 - DNA, 25 bp, S. pombe
atgttattcctgctggtcctgttta

SEQ ID NO: 67666 - DNA, 25 bp, S. pombe
atgtctagctctaaggccaaccaaa

SEQ ID NO: 67667 - DNA, 25 bp, S. pombe
atgtgccagtatcatcgccagacta

SEQ ID NO: 67668 - DNA, 25 bp, S. pombe
atgtccaagtcaatgctgcccctaa

SEQ ID NO: 67669 - DNA, 25 bp, S. pombe
atgtgcatcatgttggaggcccttt

SEQ ID NO: 67670 - DNA, 25 bp, S. pombe
atgttatgtattgcccatcgtttga

SEQ ID NO: 67671 - DNA, 25 bp, S. pombe
atggaatggctgtagccccggtaac

SEQ ID NO: 67672 - DNA, 25 bp, S. pombe
atgtcaaattcgaatccgtcctacg

SEQ ID NO: 67673 - DNA, 25 bp, S. pombe
atgtcagtgttggttctcgtctcaa

SEQ ID NO: 67674 - DNA, 25 bp, S. pombe
atgtcgtttatcgtcaactctttcc

SEQ ID NO: 67675 - DNA, 25 bp, S. pombe
atgtttactattggtgccttcgcaa

SEQ ID NO: 67676 - DNA, 25 bp, S. pombe
atggtgctactaccgatgaacctgc

SEQ ID NO: 67677 - DNA, 25 bp, S. pombe
atgtgttgacttccaacgagcccaa

SEQ ID NO: 67678 - DNA, 25 bp, S. pombe
atgttatgcgagttcttcgtactaa

SEQ ID NO: 67679 - DNA, 25 bp, S. pombe
atgtgtatgtactgctttgaccaaa

SEQ ID NO: 67680 - DNA, 25 bp, S. pombe
atgtggattcactcctcaatacaaa

SEQ ID NO: 67681 - DNA, 25 bp, S. pombe
atgtgcaagcatgttttaaacgctc

SEQ ID NO: 67682 - DNA, 25 bp, S. pombe
atgtccaacctgtttacgatctcat

SEQ ID NO: 67683 - DNA, 25 bp, S. pombe
atgtttcccctttctcaatatgata

SEQ ID NO: 67684 - DNA, 25 bp, S. pombe
atgtctactcatggctttccagata

SEQ ID NO: 67685 - DNA, 25 bp, S. pombe
atgtttttctgctttccagatcctc

SEQ ID NO: 67686 - DNA, 25 bp, S. pombe
atgtcgttttgtccagtgagtctcc

SEQ ID NO: 67687 - DNA, 25 bp, S. pombe
atgtcttattgttccagctaccttt

SEQ ID NO: 67688 - DNA, 25 bp, S. pombe
atgtcttttatcttggtaccttatc

SEQ ID NO: 67689 - DNA, 25 bp, S. pombe
atgtttacttctagcgattccttct

SEQ ID NO: 67690 - DNA, 25 bp, S. pombe
atgtttgtgtttgtattccttgtaa

SEQ ID NO: 67691 - DNA, 25 bp, S. pombe
atgggctttcatatactacttttga

SEQ ID NO: 67692 - DNA, 25 bp, S. pombe
atggttctttccttctacaacttga

SEQ ID NO: 67693 - DNA, 25 bp, S. pombe
atggtttttggatctagcggtaata

SEQ ID NO: 67694 - DNA, 25 bp, S. pombe
atgtttgcctgggaagctgagcgtt

SEQ ID NO: 67695 - DNA, 25 bp, S. pombe
atgtttcccatcgagagctgagtta

SEQ ID NO: 67696 - DNA, 25 bp, S. pombe
cgtactcctggtgttaactcgttga

SEQ ID NO: 67697 - DNA, 25 bp, S. pombe
atgtactctcgtgttctttccgtcg

SEQ ID NO: 67698 - DNA, 25 bp, S. pombe
atgtttctcgtcctatttcttctgt

SEQ ID NO: 67699 - DNA, 25 bp, S. pombe
atgtttatcttgtttctgctcgtcc

SEQ ID NO: 67700 - DNA, 25 bp, S. pombe
atgtttactatttctgcgtcgcagg

SEQ ID NO: 67701 - DNA, 25 bp, S. pombe
atgtcactgcattgttgtttctcgt

SEQ ID NO: 67702 - DNA, 25 bp, S. pombe
atgtgatgagcctgccttacgtgaa

SEQ ID NO: 67703 - DNA, 25 bp, S. pombe
atgtatattccgtttatggctgcaa

SEQ ID NO: 67704 - DNA, 25 bp, S. pombe
atgtatgcttccttggttgttgaga

SEQ ID NO: 67705 - DNA, 25 bp, S. pombe
atgtctgcgtccatttatgctgaac

SEQ ID NO: 67706 - DNA, 25 bp, S. pombe
atgtcgcggcggtttatgctataac

SEQ ID NO: 67707 - DNA, 25 bp, S. pombe
atgtctggccagattttcaatattg

SEQ ID NO: 67708 - DNA, 25 bp, S. pombe
atgtatggccagtatgctcctaata

SEQ ID NO: 67709 - DNA, 25 bp, S. pombe
atgtctgagccatatgacccatata

SEQ ID NO: 67710 - DNA, 25 bp, S. pombe
atgtatgatccttatacctctcctt

SEQ ID NO: 67711 - DNA, 25 bp, S. pombe
atgtttgcaacaagtgggcctcttc

SEQ ID NO: 67712 - DNA, 25 bp, S. pombe
atgtatatatatgcgcgagaccctt

SEQ ID NO: 67713 - DNA, 25 bp, S. pombe
atgtaattccaccatgagtcctttc

SEQ ID NO: 67714 - DNA, 25 bp, S. pombe
atgtactcacctatgcaacagcaac

SEQ ID NO: 67715 - DNA, 25 bp, S. pombe
atgtactcatccctacgctataata

SEQ ID NO: 67716 - DNA, 25 bp, S. pombe
atgtcctagtggctcgataccgaaa

SEQ ID NO: 67717 - DNA, 25 bp, S. pombe
agtcgcccactgtaaggtcggcaag

SEQ ID NO: 67718 - DNA, 25 bp, S. pombe
atgtcgccaattcaacgccgagatg

SEQ ID NO: 67719 - DNA, 25 bp, S. pombe
atgtcaccaacaaaagctcctcaag

SEQ ID NO: 67720 - DNA, 25 bp, S. pombe
aggacttcgtggtaccagcatcgat

SEQ ID NO: 67721 - DNA, 25 bp, S. pombe
atggaggtcgatgtacccattccta

SEQ ID NO: 67722 - DNA, 25 bp, S. pombe
atgggttctccattgccaaatcgct

SEQ ID NO: 67723 - DNA, 25 bp, S. pombe
atgtcccaactccaactattattac

SEQ ID NO: 67724 - DNA, 25 bp, S. pombe
agtcggacttcctacttatttgcac

SEQ ID NO: 67725 - DNA, 25 bp, S. pombe
atgtacggcttattaccccttgacg

SEQ ID NO: 67726 - DNA, 25 bp, S. pombe
atgtaccttcaatacacccttgatg

SEQ ID NO: 67727 - DNA, 25 bp, S. pombe
atgtacctataattcgcctggctta

SEQ ID NO: 67728 - DNA, 25 bp, S. pombe
atgtacctgaactatactctgttga

SEQ ID NO: 67729 - DNA, 25 bp, S. pombe
atgtcgtctaaacttctttctatga

SEQ ID NO: 67730 - DNA, 25 bp, S. pombe
atgggttgagcaggtctttatctaa

SEQ ID NO: 67731 - DNA, 25 bp, S. pombe
aggcggcagagcacaggattgtcca

SEQ ID NO: 67732 - DNA, 25 bp, S. pombe
aggctactaattgtagtgatcacac

SEQ ID NO: 67733 - DNA, 25 bp, S. pombe
aggtcttaattggtcgtatacttgc

SEQ ID NO: 67734 - DNA, 25 bp, S. pombe
atgtgaacttagacaagactctcat

SEQ ID NO: 67735 - DNA, 25 bp, S. pombe
atgtgagagctttacgagatcgcat

SEQ ID NO: 67736 - DNA, 25 bp, S. pombe
atgtactattcgttacctcatccag

SEQ ID NO: 67737 - DNA, 25 bp, S. pombe
atgtctgtattccaaacgcgaccgt

SEQ ID NO: 67738 - DNA, 25 bp, S. pombe
atgtctccttttcgagcgacaagaa

SEQ ID NO: 67739 - DNA, 25 bp, S. pombe
atgtctttcttctcagctgtgtaaa

SEQ ID NO: 67740 - DNA, 25 bp, S. pombe
atgtcattctttcgagttcgtttag

SEQ ID NO: 67741 - DNA, 25 bp, S. pombe
atgtcaaccattccaattccttgta

SEQ ID NO: 67742 - DNA, 25 bp, S. pombe
atggaaccattgcaatccggctgcg

SEQ ID NO: 67743 - DNA, 25 bp, S. pombe
aggcgtttgttatcgatatgaccca

SEQ ID NO: 67744 - DNA, 25 bp, S. pombe
agggattctttaggcgggaccgcat

SEQ ID NO: 67745 - DNA, 25 bp, S. pombe
agttatcttttactgggctaccact

SEQ ID NO: 67746 - DNA, 25 bp, S. pombe
atgtcagactttgatcaatccgttg

SEQ ID NO: 67747 - DNA, 25 bp, S. pombe
atgtgcgtgagcgtcaaaagccctt

SEQ ID NO: 67748 - DNA, 25 bp, S. pombe
atgtcctaggtattgaagccgcccg

SEQ ID NO: 67749 - DNA, 25 bp, S. pombe
atgtgtcgacgattctgattccgcc

SEQ ID NO: 67750 - DNA, 25 bp, S. pombe
atgtgacttgtattccctttctaac

SEQ ID NO: 67751 - DNA, 25 bp, S. pombe
atgtcacttggtaggatatttctca

SEQ ID NO: 67752 - DNA, 25 bp, S. pombe
atgtcttggcaagcttacgttgata

SEQ ID NO: 67753 - DNA, 25 bp, S. pombe
atgtgtattcaaccaactgtatgaa

SEQ ID NO: 67754 - DNA, 25 bp, S. pombe
atgtctgattgggataccgttacta

SEQ ID NO: 67755 - DNA, 25 bp, S. pombe
atgtctttgtctcatctcatttggt

SEQ ID NO: 67756 - DNA, 25 bp, S. pombe
atgtctcggtcttcaaatcactgtt

SEQ ID NO: 67757 - DNA, 25 bp, S. pombe
atgtcttgggattgctattcttcta

SEQ ID NO: 67758 - DNA, 25 bp, S. pombe
atgtcatatctgcagtggtttctct

SEQ ID NO: 67759 - DNA, 25 bp, S. pombe
atgtcttccctttggcattacgaga

SEQ ID NO: 67760 - DNA, 25 bp, S. pombe
atgtcgtcctctgttagtgaagaat

SEQ ID NO: 67761 - DNA, 25 bp, S. pombe
atgtcattcgttgtctcttgggaga

SEQ ID NO: 67762 - DNA, 25 bp, S. pombe
atgtcgtctgctattctccttggag

SEQ ID NO: 67763 - DNA, 25 bp, S. pombe
atgtgcgcatccatctcttcttgat

SEQ ID NO: 67764 - DNA, 25 bp, S. pombe
atgtgctatttgctattctgtcttg

SEQ ID NO: 67765 - DNA, 25 bp, S. pombe
aggcttcaaacgcttttgtgtggaa

SEQ ID NO: 67766 - DNA, 25 bp, S. pombe
agggatcctattctaacgttcgtat

SEQ ID NO: 67767 - DNA, 25 bp, S. pombe
atgtgtgtccttcagtaacgttttg

SEQ ID NO: 67768 - DNA, 25 bp, S. pombe
atgtcgctttctggattattgccgc

SEQ ID NO: 67769 - DNA, 25 bp, S. pombe
atgtgatgcttactgcgtctattcc

SEQ ID NO: 67770 - DNA, 25 bp, S. pombe
atgtgttgtcagaggcgcaagccaa

SEQ ID NO: 67771 - DNA, 25 bp, S. pombe
aggcttgggccatctataatcggtc

SEQ ID NO: 67772 - DNA, 25 bp, S. pombe
aggcatttacacaacggacgctcaa

SEQ ID NO: 67773 - DNA, 25 bp, S. pombe
atggtttcaccatggattccaccag

SEQ ID NO: 67774 - DNA, 25 bp, S. pombe
atggttaactccacttagcagcaag

SEQ ID NO: 67775 - DNA, 25 bp, S. pombe
atgggcttaactccagttcatttga

SEQ ID NO: 67776 - DNA, 25 bp, S. pombe
atggttcaagtgtggaagctccgta

SEQ ID NO: 67777 - DNA, 25 bp, S. pombe
atggtattagagctcgtacccgcta

SEQ ID NO: 67778 - DNA, 25 bp, S. pombe
atgggtcttagtttgtacgctgcct

SEQ ID NO: 67779 - DNA, 25 bp, S. pombe
atgggtttaccagttggagctctct

SEQ ID NO: 67780 - DNA, 25 bp, S. pombe
atgggtattgtttcctttgctgttc

SEQ ID NO: 67781 - DNA, 25 bp, S. pombe
atgtgggttttatctcttctattat

SEQ ID NO: 67782 - DNA, 25 bp, S. pombe
atgtctgctaatcatttctcttcct

SEQ ID NO: 67783 - DNA, 25 bp, S. pombe
atgtctcatctattcattctctctt

SEQ ID NO: 67784 - DNA, 25 bp, S. pombe
atgtgtccgctttaagagtaccaaa

SEQ ID NO: 67785 - DNA, 25 bp, S. pombe
atggatcacatcttgctatagctac

SEQ ID NO: 67786 - DNA, 25 bp, S. pombe
atgggcctatcgagcgcatacgagt

SEQ ID NO: 67787 - DNA, 25 bp, S. pombe
atggatttatccctcgcaacagatg

SEQ ID NO: 67788 - DNA, 25 bp, S. pombe
atggtttacctgcaaactgtgaatg

SEQ ID NO: 67789 - DNA, 25 bp, S. pombe
atggtccggttattactcttatgta

SEQ ID NO: 67790 - DNA, 25 bp, S. pombe
atggaataccttaccgttactgaag

SEQ ID NO: 67791 - DNA, 25 bp, S. pombe
aggccattgtctccgactttaagga

SEQ ID NO: 67792 - DNA, 25 bp, S. pombe
atgtctctcgtggaactgctgttat

SEQ ID NO: 67793 - DNA, 25 bp, S. pombe
atgtctgcttctgaacttgcaacta

SEQ ID NO: 67794 - DNA, 25 bp, S. pombe
atgtctgcctccgaacttgctacaa

SEQ ID NO: 67795 - DNA, 25 bp, S. pombe
agtgtcccggacgttctaaagctat

SEQ ID NO: 67796 - DNA, 25 bp, S. pombe
atgggtcgagttgctggattcttac

SEQ ID NO: 67797 - DNA, 25 bp, S. pombe
atggactacgttggtggttctctaa

SEQ ID NO: 67798 - DNA, 25 bp, S. pombe
atgggttcgttatatattcctgtaa

SEQ ID NO: 67799 - DNA, 25 bp, S. pombe
atggtttccgacatacttccagtgg

SEQ ID NO: 67800 - DNA, 25 bp, S. pombe
atgggttctcgatattcatgttcac

SEQ ID NO: 67801 - DNA, 25 bp, S. pombe
atgtcgttcccaagactgctgctaa

SEQ ID NO: 67802 - DNA, 25 bp, S. pombe
atggatttggttgtcgatgctctag

SEQ ID NO: 67803 - DNA, 25 bp, S. pombe
atggcggagcaggttcaaacgtctt

SEQ ID NO: 67804 - DNA, 25 bp, S. pombe
atggcctatggctctaaacgtcttc

SEQ ID NO: 67805 - DNA, 25 bp, S. pombe
atggttatgagatcagacagcacgt

SEQ ID NO: 67806 - DNA, 25 bp, S. pombe
atggtgtttgataaacgccctcgtc

SEQ ID NO: 67807 - DNA, 25 bp, S. pombe
atgggattcgtggaaccgccaaaca

SEQ ID NO: 67808 - DNA, 25 bp, S. pombe
atgggcatcaaagcactacgtgtag

SEQ ID NO: 67809 - DNA, 25 bp, S. pombe
atggatccgaagatctgggcagcat

SEQ ID NO: 67810 - DNA, 25 bp, S. pombe
atggaccgaaggtgtctgcgagttc

SEQ ID NO: 67811 - DNA, 25 bp, S. pombe
atggacggccgatctgatttatgac

SEQ ID NO: 67812 - DNA, 25 bp, S. pombe
atgggctcctctttatacgatgttc

SEQ ID NO: 67813 - DNA, 25 bp, S. pombe
atgtgcttccctacgacatcgagta

SEQ ID NO: 67814 - DNA, 25 bp, S. pombe
atgggattgctaaagactctactga

SEQ ID NO: 67815 - DNA, 25 bp, S. pombe
atgtcgttctttggccttaaaagat

SEQ ID NO: 67816 - DNA, 25 bp, S. pombe
atgtggctctaactactacgacgca

SEQ ID NO: 67817 - DNA, 25 bp, S. pombe
aggaggcccaaatacacgtgtgaat

SEQ ID NO: 67818 - DNA, 25 bp, S. pombe
atggttcgtgcctacctaagtgtaa

SEQ ID NO: 67819 - DNA, 25 bp, S. pombe
atggttactcgtcgtcttagtacaa

SEQ ID NO: 67820 - DNA, 25 bp, S. pombe
atggtttccgtcaatcctagcaaaa

SEQ ID NO: 67821 - DNA, 25 bp, S. pombe
atgtctcattgttcttctaattcga

SEQ ID NO: 67822 - DNA, 25 bp, S. pombe
atgtctcctttaactgaaatcagcc

SEQ ID NO: 67823 - DNA, 25 bp, S. pombe
atgtctctcgttgttcctgataatt

SEQ ID NO: 67824 - DNA, 25 bp, S. pombe
atggaccctcggagcctgtaataaa

SEQ ID NO: 67825 - DNA, 25 bp, S. pombe
atggtcccagagagccgtgtttgtc

SEQ ID NO: 67826 - DNA, 25 bp, S. pombe
atggtagccttgtctcaggttttgt

SEQ ID NO: 67827 - DNA, 25 bp, S. pombe
atggaagcgcttcctgaacgtcttc

SEQ ID NO: 67828 - DNA, 25 bp, S. pombe
atggtccgcgatttgaatttcttta

SEQ ID NO: 67829 - DNA, 25 bp, S. pombe
atgggcaactgaggtttcttcgtaa

SEQ ID NO: 67830 - DNA, 25 bp, S. pombe
atgggcaacttcgttcagttcgtgt

SEQ ID NO: 67831 - DNA, 25 bp, S. pombe
atgtgccataaaactccaatccttc

SEQ ID NO: 67832 - DNA, 25 bp, S. pombe
atgtccataaatcatctgcttcctc

SEQ ID NO: 67833 - DNA, 25 bp, S. pombe
atgtccatgacattaccattccttg

SEQ ID NO: 67834 - DNA, 25 bp, S. pombe
atgtgcacgtaatgcgatccgcttt

SEQ ID NO: 67835 - DNA, 25 bp, S. pombe
atgtccgtgatgtagctgctgctca

SEQ ID NO: 67836 - DNA, 25 bp, S. pombe
atgtcccataatgaggctcgtgcta

SEQ ID NO: 67837 - DNA, 25 bp, S. pombe
atgtctcctcagaaaggttgtctag

SEQ ID NO: 67838 - DNA, 25 bp, S. pombe
atggatgcttggaacattgtttctc

SEQ ID NO: 67839 - DNA, 25 bp, S. pombe
atggatcttggtcagcgtgatatca

SEQ ID NO: 67840 - DNA, 25 bp, S. pombe
atggtgttttgagtgccgttccaac

SEQ ID NO: 67841 - DNA, 25 bp, S. pombe
atggtggtaggaatgccgttcccta

SEQ ID NO: 67842 - DNA, 25 bp, S. pombe
atgggtgaagagactgcccttgcct

SEQ ID NO: 67843 - DNA, 25 bp, S. pombe
atggtggatgccttagcgccaatgc

SEQ ID NO: 67844 - DNA, 25 bp, S. pombe
atggagctactgtccgcgaggcaaa

SEQ ID NO: 67845 - DNA, 25 bp, S. pombe
atggatcggcatttgcgagtcgaca

SEQ ID NO: 67846 - DNA, 25 bp, S. pombe
atgtgattcctattgcgtgtaagct

SEQ ID NO: 67847 - DNA, 25 bp, S. pombe
atgtcggttttggtgtcagcagtac

SEQ ID NO: 67848 - DNA, 25 bp, S. pombe
atgtcgtttcatgtttcagcattac

SEQ ID NO: 67849 - DNA, 25 bp, S. pombe
atgtcgattttgatgctatgcgttg

SEQ ID NO: 67850 - DNA, 25 bp, S. pombe
atgtcgatgatttttctctctttcc

SEQ ID NO: 67851 - DNA, 25 bp, S. pombe
atgtcgctggtggtactggtgatat

SEQ ID NO: 67852 - DNA, 25 bp, S. pombe
atggcatgtcaaactgcgcattatt

SEQ ID NO: 67853 - DNA, 25 bp, S. pombe
atggaggacaaatgcttctttcttt

SEQ ID NO: 67854 - DNA, 25 bp, S. pombe
atggtcaacaagaagctcgggcagc

SEQ ID NO: 67855 - DNA, 25 bp, S. pombe
atggcagacaggttgcgctctcaag

SEQ ID NO: 67856 - DNA, 25 bp, S. pombe
atgggctctcggtaattcctgcgta

SEQ ID NO: 67857 - DNA, 25 bp, S. pombe
ttgggtttccttcttctgggaagag

SEQ ID NO: 67858 - DNA, 25 bp, S. pombe
atgggtttcgttttatctgggatca

SEQ ID NO: 67859 - DNA, 25 bp, S. pombe
atgggctttcttattcttgctggca

SEQ ID NO: 67860 - DNA, 25 bp, S. pombe
atggtggtcatttagtccttgtcga

SEQ ID NO: 67861 - DNA, 25 bp, S. pombe
atggctgaaaccttttcaccatcac

SEQ ID NO: 67862 - DNA, 25 bp, S. pombe
atgtgggagttaagcctggcccgca

SEQ ID NO: 67863 - DNA, 25 bp, S. pombe
atgtccaactgcttttttgacgtta

SEQ ID NO: 67864 - DNA, 25 bp, S. pombe
atgtcctgcaggtgatttagccctt

SEQ ID NO: 67865 - DNA, 25 bp, S. pombe
atgtgcccggaaagttgcagcttca

SEQ ID NO: 67866 - DNA, 25 bp, S. pombe
atgtccctccgtatgctgagcttat

SEQ ID NO: 67867 - DNA, 25 bp, S. pombe
atgtcgctgctacgttgcttaattt

SEQ ID NO: 67868 - DNA, 25 bp, S. pombe
atgggcgctcagttgtttgacattt

SEQ ID NO: 67869 - DNA, 25 bp, S. pombe
atgtggcgctctctatttggtttca

SEQ ID NO: 67870 - DNA, 25 bp, S. pombe
atgggtgtagctatcatggcgttca

SEQ ID NO: 67871 - DNA, 25 bp, S. pombe
atgggtgtggctcatcgtgatttaa

SEQ ID NO: 67872 - DNA, 25 bp, S. pombe
atgggcttggccttggagttacaaa

SEQ ID NO: 67873 - DNA, 25 bp, S. pombe
atggttatttctgatggcctgcacg

SEQ ID NO: 67874 - DNA, 25 bp, S. pombe
atggatgagactctctgacccatca

SEQ ID NO: 67875 - DNA, 25 bp, S. pombe
atgtggcagcaattcttacctctat

SEQ ID NO: 67876 - DNA, 25 bp, S. pombe
atgtggtcaacatagcatcctcctt

SEQ ID NO: 67877 - DNA, 25 bp, S. pombe
atgggttccttgactgcagacactt

SEQ ID NO: 67878 - DNA, 25 bp, S. pombe
atgggtagtcatttgctatacactt

SEQ ID NO: 67879 - DNA, 25 bp, S. pombe
atgggcttcttatcatgctaccaag

SEQ ID NO: 67880 - DNA, 25 bp, S. pombe
atgggcgtctagtacagctctgaaa

SEQ ID NO: 67881 - DNA, 25 bp, S. pombe
atggaagttcgtgctcttaaacaaa

SEQ ID NO: 67882 - DNA, 25 bp, S. pombe
atggtacttagttcgcttcaccaca

SEQ ID NO: 67883 - DNA, 25 bp, S. pombe
atgtgtattttctatgccaatgcac

SEQ ID NO: 67884 - DNA, 25 bp, S. pombe
atgtgcgtcttgacattgcttagca

SEQ ID NO: 67885 - DNA, 25 bp, S. pombe
atggtggtcttgttgctctcgaagc

SEQ ID NO: 67886 - DNA, 25 bp, S. pombe
atgggatgctgctgttgcttccaac

SEQ ID NO: 67887 - DNA, 25 bp, S. pombe
atgggcattgcagctattactcaaa

SEQ ID NO: 67888 - DNA, 25 bp, S. pombe
atgggcagctgtttactggatcgaa

SEQ ID NO: 67889 - DNA, 25 bp, S. pombe
atggagattgataatgccagcaaga

SEQ ID NO: 67890 - DNA, 25 bp, S. pombe
atggagactacaacagcagcgatga

SEQ ID NO: 67891 - DNA, 25 bp, S. pombe
agatggtgctgctcatggtcgagtt

SEQ ID NO: 67892 - DNA, 25 bp, S. pombe
atggtagctatctgtggactgtcct

SEQ ID NO: 67893 - DNA, 25 bp, S. pombe
atgtggaacacctcactttagtgga

SEQ ID NO: 67894 - DNA, 25 bp, S. pombe
atggaaacactctccttgctaaggc

SEQ ID NO: 67895 - DNA, 25 bp, S. pombe
atggaacacactacccaatgtaaga

SEQ ID NO: 67896 - DNA, 25 bp, S. pombe
atgtgttgattcttgctcgtctcga

SEQ ID NO: 67897 - DNA, 25 bp, S. pombe
atggtgttttgccttactctgaatg

SEQ ID NO: 67898 - DNA, 25 bp, S. pombe
atggttcgtctcgttgacatcttaa

SEQ ID NO: 67899 - DNA, 25 bp, S. pombe
atggcagtttaactcactcggtaga

SEQ ID NO: 67900 - DNA, 25 bp, S. pombe
atggacatgcttatgacgcctttaa

SEQ ID NO: 67901 - DNA, 25 bp, S. pombe
atggctgacacacttaccgactatt

SEQ ID NO: 67902 - DNA, 25 bp, S. pombe
atgggaatccttatcgagcatttaa

SEQ ID NO: 67903 - DNA, 25 bp, S. pombe
atggaggacgttcagccaactgctg

SEQ ID NO: 67904 - DNA, 25 bp, S. pombe
atgtgttacagaagtcgggtccaaa

SEQ ID NO: 67905 - DNA, 25 bp, S. pombe
atgtgtgttcgatcgtttctcgcaa

SEQ ID NO: 67906 - DNA, 25 bp, S. pombe
atggtggtcagcttcttttgctcaa

SEQ ID NO: 67907 - DNA, 25 bp, S. pombe
atgggaatcgtgtcttaccgccata

SEQ ID NO: 67908 - DNA, 25 bp, S. pombe
atggaaacgtagcactcactggctc

SEQ ID NO: 67909 - DNA, 25 bp, S. pombe
atggtacccctattatcaatcttcc

SEQ ID NO: 67910 - DNA, 25 bp, S. pombe
agaggcccgccgtttagatattcct

SEQ ID NO: 67911 - DNA, 25 bp, S. pombe
aggcctacgatgatgttaactgcaa

SEQ ID NO: 67912 - DNA, 25 bp, S. pombe
atggctctagccctttagaatccag

SEQ ID NO: 67913 - DNA, 25 bp, S. pombe
atggtttgactttctaaggcagcaa

SEQ ID NO: 67914 - DNA, 25 bp, S. pombe
atgggcctatgcattctcgtagaaa

SEQ ID NO: 67915 - DNA, 25 bp, S. pombe
atggacctcgcatatcttatcatgg

SEQ ID NO: 67916 - DNA, 25 bp, S. pombe
atggttatatgcgtcctgtttccca

SEQ ID NO: 67917 - DNA, 25 bp, S. pombe
atggcagttcgctcgttaaatcgtg

SEQ ID NO: 67918 - DNA, 25 bp, S. pombe
atggttcatcgtgctattttgggta

SEQ ID NO: 67919 - DNA, 25 bp, S. pombe
atggtcgtattgtttctggcagttc

SEQ ID NO: 67920 - DNA, 25 bp, S. pombe
atggtaccagggaatcatggcggaa

SEQ ID NO: 67921 - DNA, 25 bp, S. pombe
atggtcccacgccagtattgcagga

SEQ ID NO: 67922 - DNA, 25 bp, S. pombe
atggtgaatgtggtgattttaatac

SEQ ID NO: 67923 - DNA, 25 bp, S. pombe
atggatgaagctgctctcgtcgaag

SEQ ID NO: 67924 - DNA, 25 bp, S. pombe
atggacaactaggacgtgctcaatt

SEQ ID NO: 67925 - DNA, 25 bp, S. pombe
atggcgcagacgctatcgtgtagct

SEQ ID NO: 67926 - DNA, 25 bp, S. pombe
atggttgctttgttagatcgcctcc

SEQ ID NO: 67927 - DNA, 25 bp, S. pombe
atggcatttcctttaatcctgatcc

SEQ ID NO: 67928 - DNA, 25 bp, S. pombe
atggcacattgctttgaaacgtaca

SEQ ID NO: 67929 - DNA, 25 bp, S. pombe
atggccatgcatcgattccagatcg

SEQ ID NO: 67930 - DNA, 25 bp, S. pombe
aggccagacggcttattccgcagaa

SEQ ID NO: 67931 - DNA, 25 bp, S. pombe
atggcagcctccagttaacacagga

SEQ ID NO: 67932 - DNA, 25 bp, S. pombe
atgggcctaccaaagcaagcacaaa

SEQ ID NO: 67933 - DNA, 25 bp, S. pombe
atggctcgtactaaacaaacagctc

SEQ ID NO: 67934 - DNA, 25 bp, S. pombe
atggctcgtactaaacaaacagctc

SEQ ID NO: 67935 - DNA, 25 bp, S. pombe
atggccaatcttagaacgcagaagc

SEQ ID NO: 67936 - DNA, 25 bp, S. pombe
atggccaatggataacgcccagcct

SEQ ID NO: 67937 - DNA, 25 bp, S. pombe
atggacgaagcttacaggtgccggt

SEQ ID NO: 67938 - DNA, 25 bp, S. pombe
atggatggccgttgagcagttcctc

SEQ ID NO: 67939 - DNA, 25 bp, S. pombe
atgggatctcccacgaagtcgatat

SEQ ID NO: 67940 - DNA, 25 bp, S. pombe
aggtcctgggcaaacggctctcaag

SEQ ID NO: 67941 - DNA, 25 bp, S. pombe
atggatcgattccaacggtttctcc

SEQ ID NO: 67942 - DNA, 25 bp, S. pombe
atggctagcattgacccatgcgtta

SEQ ID NO: 67943 - DNA, 25 bp, S. pombe
atggtcaccaatttacttgagacgg

SEQ ID NO: 67944 - DNA, 25 bp, S. pombe
atggtacttattgggctggaactgt

SEQ ID NO: 67945 - DNA, 25 bp, S. pombe
atggtgaactttgtgcagctaactt

SEQ ID NO: 67946 - DNA, 25 bp, S. pombe
atgggcaagctttccatcatgccta

SEQ ID NO: 67947 - DNA, 25 bp, S. pombe
atggatgagtctactcgccgagcga

SEQ ID NO: 67948 - DNA, 25 bp, S. pombe
atggagagagttcctgtctacggtt

SEQ ID NO: 67949 - DNA, 25 bp, S. pombe
atggcactacattactttttacaat

SEQ ID NO: 67950 - DNA, 25 bp, S. pombe
atgggttacttttttgcgactgctt

SEQ ID NO: 67951 - DNA, 25 bp, S. pombe
atggattcttctaaggttcctgtta

SEQ ID NO: 67952 - DNA, 25 bp, S. pombe
atggactttctcaaggcactgcttt

SEQ ID NO: 67953 - DNA, 25 bp, S. pombe
atggagtcttatcacgctgcagcaa

SEQ ID NO: 67954 - DNA, 25 bp, S. pombe
atggaaatttcgtcccaggtacaat

SEQ ID NO: 67955 - DNA, 25 bp, S. pombe
atggtgaatctgaagctctctcctt

SEQ ID NO: 67956 - DNA, 25 bp, S. pombe
atgggactgctttaatacttattac

SEQ ID NO: 67957 - DNA, 25 bp, S. pombe
atgggcaccaattggcaatcttttt

SEQ ID NO: 67958 - DNA, 25 bp, S. pombe
atggtgcctttttccctggactaag

SEQ ID NO: 67959 - DNA, 25 bp, S. pombe
atggtgcatctttatctcaccgtac

SEQ ID NO: 67960 - DNA, 25 bp, S. pombe
atggtattgctgttgatcctcgtca

SEQ ID NO: 67961 - DNA, 25 bp, S. pombe
atggtgcttgcttatattctgctgc

SEQ ID NO: 67962 - DNA, 25 bp, S. pombe
atgggcttcctatatctgtgcgatt

SEQ ID NO: 67963 - DNA, 25 bp, S. pombe
aggccatgtccttgaatcctggtga

SEQ ID NO: 67964 - DNA, 25 bp, S. pombe
atggtccttttcttgttgcttcaaa

SEQ ID NO: 67965 - DNA, 25 bp, S. pombe
aggccctcgtggtgttttgaagcaa

SEQ ID NO: 67966 - DNA, 25 bp, S. pombe
aggcgtttgcacttacctttgttag

SEQ ID NO: 67967 - DNA, 25 bp, S. pombe
atggcccgaagtcaatgcacgattt

SEQ ID NO: 67968 - DNA, 25 bp, S. pombe
aggctccgacgatgacgccgaggtt

SEQ ID NO: 67969 - DNA, 25 bp, S. pombe
atggatccatgggtgtatcccttac

SEQ ID NO: 67970 - DNA, 25 bp, S. pombe
atggatgacgccaatgttccttctc

SEQ ID NO: 67971 - DNA, 25 bp, S. pombe
atggatctcagcgaatgtacctaat

SEQ ID NO: 67972 - DNA, 25 bp, S. pombe
atggtctccagcgttgactatatca

SEQ ID NO: 67973 - DNA, 25 bp, S. pombe
atggtctcgcaagttggcaatgcaa

SEQ ID NO: 67974 - DNA, 25 bp, S. pombe
atggtgtctatctttactttgagga

SEQ ID NO: 67975 - DNA, 25 bp, S. pombe
atggttctttactatctgattcacg

SEQ ID NO: 67976 - DNA, 25 bp, S. pombe
atgggatcacgtactatcgattcaa

SEQ ID NO: 67977 - DNA, 25 bp, S. pombe
atgggtctaaacctcatgtcttctc

SEQ ID NO: 67978 - DNA, 25 bp, S. pombe
atggtcactgcaacgtagagtctat

SEQ ID NO: 67979 - DNA, 25 bp, S. pombe
atggtactgcatttttggccttctt

SEQ ID NO: 67980 - DNA, 25 bp, S. pombe
atgggatctgcttctgttggccttg

SEQ ID NO: 67981 - DNA, 25 bp, S. pombe
atgggtgcagcttcctggacggatc

SEQ ID NO: 67982 - DNA, 25 bp, S. pombe
atggtgttggcagttgatctcttaa

SEQ ID NO: 67983 - DNA, 25 bp, S. pombe
atggcttatacagagcaacttcaag

SEQ ID NO: 67984 - DNA, 25 bp, S. pombe
atggcttcacaaaccatcccgaagt

SEQ ID NO: 67985 - DNA, 25 bp, S. pombe
atggcttcggtgacttccaaagttc

SEQ ID NO: 67986 - DNA, 25 bp, S. pombe
atggctgtcggtcctgtaactggaa

SEQ ID NO: 67987 - DNA, 25 bp, S. pombe
atggacttcctttggatcccaatac

SEQ ID NO: 67988 - DNA, 25 bp, S. pombe
atggtttatgacacagctctcgcag

SEQ ID NO: 67989 - DNA, 25 bp, S. pombe
atggctttacaaattctttcgtcga

SEQ ID NO: 67990 - DNA, 25 bp, S. pombe
atggtcttcacttttcgtctttggg

SEQ ID NO: 67991 - DNA, 25 bp, S. pombe
atggttattcctaccctctatggtg

SEQ ID NO: 67992 - DNA, 25 bp, S. pombe
atggagtactccgtgaccgtattaa

SEQ ID NO: 67993 - DNA, 25 bp, S. pombe
atggagaacttcgtggtcgctgaaa

SEQ ID NO: 67994 - DNA, 25 bp, S. pombe
atggagaccaccgttgttgaggaat

SEQ ID NO: 67995 - DNA, 25 bp, S. pombe
atggtgtttccgatttgagtgctgc

SEQ ID NO: 67996 - DNA, 25 bp, S. pombe
atggtgcttctagtgttttggctgc

SEQ ID NO: 67997 - DNA, 25 bp, S. pombe
atgggtgattcgaattctttattac

SEQ ID NO: 67998 - DNA, 25 bp, S. pombe
atggtggttggatcacgatgcttta

SEQ ID NO: 67999 - DNA, 25 bp, S. pombe
atggtgcttggttaccagcaacttt

SEQ ID NO: 68000 - DNA, 25 bp, S. pombe
atggcggttgtattgcagcactcac

SEQ ID NO: 68001 - DNA, 25 bp, S. pombe
atggttcgatctgatgctcgtgcac

SEQ ID NO: 68002 - DNA, 25 bp, S. pombe
atggttcagtctatgcagctggcga

SEQ ID NO: 68003 - DNA, 25 bp, S. pombe
atggttacatctttgcatcgtgcaa

SEQ ID NO: 68004 - DNA, 25 bp, S. pombe
atggtccgttattctgcagctcctg

SEQ ID NO: 68005 - DNA, 25 bp, S. pombe
atggtcattatactgcctatgcaag

SEQ ID NO: 68006 - DNA, 25 bp, S. pombe
atggtgtctctcttcgtgatactaa

SEQ ID NO: 68007 - DNA, 25 bp, S. pombe
atggaccctgctcggattgcattta

SEQ ID NO: 68008 - DNA, 25 bp, S. pombe
atggaccgcttctgtgatgctttaa

SEQ ID NO: 68009 - DNA, 25 bp, S. pombe
atggacgacctcttggtcttacaga

SEQ ID NO: 68010 - DNA, 25 bp, S. pombe
atggaaactctcttggccagtaata

SEQ ID NO: 68011 - DNA, 25 bp, S. pombe
atggtacctctgcttacagtacggc

SEQ ID NO: 68012 - DNA, 25 bp, S. pombe
aggctcccatttcacctaaattaga

SEQ ID NO: 68013 - DNA, 25 bp, S. pombe
aggccggttcagctcttaatttgat

SEQ ID NO: 68014 - DNA, 25 bp, S. pombe
atggtcggattgctgcttttaacta

SEQ ID NO: 68015 - DNA, 25 bp, S. pombe
aggctcgccgcttgtggagagatta

SEQ ID NO: 68016 - DNA, 25 bp, S. pombe
atggctagtagcttccttggttctt

SEQ ID NO: 68017 - DNA, 25 bp, S. pombe
atggtgctatggctgctcgatttac

SEQ ID NO: 68018 - DNA, 25 bp, S. pombe
atggtgcgaggtcgaaattctccct

SEQ ID NO: 68019 - DNA, 25 bp, S. pombe
atggtagtttggctctttctcgtgc

SEQ ID NO: 68020 - DNA, 25 bp, S. pombe
atggtgatgttgctagtcttgcctc

SEQ ID NO: 68021 - DNA, 25 bp, S. pombe
atggatattttctcttggcttatga

SEQ ID NO: 68022 - DNA, 25 bp, S. pombe
atggatattcttcttatacagctag

SEQ ID NO: 68023 - DNA, 25 bp, S. pombe
atggttggctatttgatatgatcac

SEQ ID NO: 68024 - DNA, 25 bp, S. pombe
atggctctggcccacgtatgacgct

SEQ ID NO: 68025 - DNA, 25 bp, S. pombe
aggcatttgccgttggatggccttt

SEQ ID NO: 68026 - DNA, 25 bp, S. pombe
atggcaattcaagctggacctttta

SEQ ID NO: 68027 - DNA, 25 bp, S. pombe
atggacgctgacctttctgaattgt

SEQ ID NO: 68028 - DNA, 25 bp, S. pombe
atggaccgaaattatctgctattgt

SEQ ID NO: 68029 - DNA, 25 bp, S. pombe
atggatccagcacatcatattaagg

SEQ ID NO: 68030 - DNA, 25 bp, S. pombe
atggctggcgtttctgttaaggatg

SEQ ID NO: 68031 - DNA, 25 bp, S. pombe
atggatatcgttgcagagactcaga

SEQ ID NO: 68032 - DNA, 25 bp, S. pombe
agtgtgagctgtagtcttgataaac

SEQ ID NO: 68033 - DNA, 25 bp, S. pombe
agtgctgacgcttttcggaaaaaat

SEQ ID NO: 68034 - DNA, 25 bp, S. pombe
atggcgtttcgtgctgcaagaattg

SEQ ID NO: 68035 - DNA, 25 bp, S. pombe
aggccgtgacaattagaactcgcaa

SEQ ID NO: 68036 - DNA, 25 bp, S. pombe
atggacctattattcgtaccgctac

SEQ ID NO: 68037 - DNA, 25 bp, S. pombe
atggcacgccaggtggaccgaaatt

SEQ ID NO: 68038 - DNA, 25 bp, S. pombe
atggcgccaaagatatcccgtgttt

SEQ ID NO: 68039 - DNA, 25 bp, S. pombe
aggaatggaagagcctttccctgct

SEQ ID NO: 68040 - DNA, 25 bp, S. pombe
atggttggcaatatccttaccgctc

SEQ ID NO: 68041 - DNA, 25 bp, S. pombe
atggttgactctacatatcttcccc

SEQ ID NO: 68042 - DNA, 25 bp, S. pombe
aggtaaactggctcaacccagcgta

SEQ ID NO: 68043 - DNA, 25 bp, S. pombe
gggcgaaccccatatgttccaagga

SEQ ID NO: 68044 - DNA, 25 bp, S. pombe
atggccgaaaatcctccattttgga

SEQ ID NO: 68045 - DNA, 25 bp, S. pombe
atggagtctgaatctgttcccaccg

SEQ ID NO: 68046 - DNA, 25 bp, S. pombe
atggctcttttaccttccaagcaat

SEQ ID NO: 68047 - DNA, 25 bp, S. pombe
atggtctctttgctgctggcgaaat

SEQ ID NO: 68048 - DNA, 25 bp, S. pombe
atggtctcttgtctcgatgctggat

SEQ ID NO: 68049 - DNA, 25 bp, S. pombe
atggaatatggattggccgctgctt

SEQ ID NO: 68050 - DNA, 25 bp, S. pombe
atggatttgctgagctcttccaaag

SEQ ID NO: 68051 - DNA, 25 bp, S. pombe
atggagtccatggatgccttgacaa

SEQ ID NO: 68052 - DNA, 25 bp, S. pombe
atggcgacttcttgttccgcattta

SEQ ID NO: 68053 - DNA, 25 bp, S. pombe
aggctgaatgatcggcaactctctt

SEQ ID NO: 68054 - DNA, 25 bp, S. pombe
atggctaatggaagcactcgttctt

SEQ ID NO: 68055 - DNA, 25 bp, S. pombe
atggtttcacattgtcttcgtgcta

SEQ ID NO: 68056 - DNA, 25 bp, S. pombe
atggttgctactctgtgatggttaa

SEQ ID NO: 68057 - DNA, 25 bp, S. pombe
atggcttttcgatgtacgttacgac

SEQ ID NO: 68058 - DNA, 25 bp, S. pombe
atggcggtatatccaaggcccagaa

SEQ ID NO: 68059 - DNA, 25 bp, S. pombe
atggctggcatgttccgtattccta

SEQ ID NO: 68060 - DNA, 25 bp, S. pombe
atggcgtagcagaccttattcgctc

SEQ ID NO: 68061 - DNA, 25 bp, S. pombe
aggccgaggtgtatttcgtgcgttt

SEQ ID NO: 68062 - DNA, 25 bp, S. pombe
agaccgagggtcatttacgtgtcct

SEQ ID NO: 68063 - DNA, 25 bp, S. pombe
atggccggcgattccttattgaaat

SEQ ID NO: 68064 - DNA, 25 bp, S. pombe
aggatccaatgtcaactctttacga

SEQ ID NO: 68065 - DNA, 25 bp, S. pombe
atggacctatgtgtttaatcggcgc

SEQ ID NO: 68066 - DNA, 25 bp, S. pombe
atggaccacggcttcattgcaaagg

SEQ ID NO: 68067 - DNA, 25 bp, S. pombe
atggatcatcacctacttctgaaag

SEQ ID NO: 68068 - DNA, 25 bp, S. pombe
atggccgtctgagcagcctgacaat

SEQ ID NO: 68069 - DNA, 25 bp, S. pombe
atggttgcactacagattcgtggac

SEQ ID NO: 68070 - DNA, 25 bp, S. pombe
atggttcttatgcttcttctctgta

SEQ ID NO: 68071 - DNA, 25 bp, S. pombe
atggttgctgcaatgacacctcttc

SEQ ID NO: 68072 - DNA, 25 bp, S. pombe
atggcttacaaaccctattcgagaa

SEQ ID NO: 68073 - DNA, 25 bp, S. pombe
aggctatcaaggctcgtcttcaaga

SEQ ID NO: 68074 - DNA, 25 bp, S. pombe
aggctagcaaaatgtcttccctctt

SEQ ID NO: 68075 - DNA, 25 bp, S. pombe
aggtaccaaattgattcccgccgat

SEQ ID NO: 68076 - DNA, 25 bp, S. pombe
agtcttgggactttatggccttatt

SEQ ID NO: 68077 - DNA, 25 bp, S. pombe
aagggtttagtgtggccatcgtcga

SEQ ID NO: 68078 - DNA, 25 bp, S. pombe
atggctggatctagtttacccgtgg

SEQ ID NO: 68079 - DNA, 25 bp, S. pombe
atggttcttatttctactttgctag

SEQ ID NO: 68080 - DNA, 25 bp, S. pombe
atggaacttcaaaccaccgtgcggg

SEQ ID NO: 68081 - DNA, 25 bp, S. pombe
atggaatttctgcttatccggctgg

SEQ ID NO: 68082 - DNA, 25 bp, S. pombe
atggaatgtttggtcgatgccccta

SEQ ID NO: 68083 - DNA, 25 bp, S. pombe
atggaacttccattcgacttcgcga

SEQ ID NO: 68084 - DNA, 25 bp, S. pombe
atggagtctccgtatgcgtttcaca

SEQ ID NO: 68085 - DNA, 25 bp, S. pombe
atggttcttccattgtctctgtaca

SEQ ID NO: 68086 - DNA, 25 bp, S. pombe
aggccgtaccgcgaagtaattgaat

SEQ ID NO: 68087 - DNA, 25 bp, S. pombe
agcggttaggcgcacttaattattt

SEQ ID NO: 68088 - DNA, 25 bp, S. pombe
atggatggatccctcttattctctg

SEQ ID NO: 68089 - DNA, 25 bp, S. pombe
aggcgtgttcgcgatcaatacttgt

SEQ ID NO: 68090 - DNA, 25 bp, S. pombe
atggcgtcttcggtactttcaggtt

SEQ ID NO: 68091 - DNA, 25 bp, S. pombe
atggatttctcggtatcttgctgct

SEQ ID NO: 68092 - DNA, 25 bp, S. pombe
atggaattcatcaacgcatccctgc

SEQ ID NO: 68093 - DNA, 25 bp, S. pombe
atggaggtcatcaccatcatcatca

SEQ ID NO: 68094 - DNA, 25 bp, S. pombe
atggagccatttcctcattatcact

SEQ ID NO: 68095 - DNA, 25 bp, S. pombe
atggcgctcatggttatcttatatc

SEQ ID NO: 68096 - DNA, 25 bp, S. pombe
atggcagcctgtcattgctacaatc

SEQ ID NO: 68097 - DNA, 25 bp, S. pombe
atggagccacggatgttcttaaaca

SEQ ID NO: 68098 - DNA, 25 bp, S. pombe
atggacacatcgctgttgttcaaaa

SEQ ID NO: 68099 - DNA, 25 bp, S. pombe
atggactccagtcttgctgaagaaa

SEQ ID NO: 68100 - DNA, 25 bp, S. pombe
atggttccatggattccatcaggaa

SEQ ID NO: 68101 - DNA, 25 bp, S. pombe
atggttgcaacgaatttggcgcgta

SEQ ID NO: 68102 - DNA, 25 bp, S. pombe
atggacctcacatctcgattttgta

SEQ ID NO: 68103 - DNA, 25 bp, S. pombe
atggatgcctattttccctttgatc

SEQ ID NO: 68104 - DNA, 25 bp, S. pombe
atggctggtcaagttgctgttccta

SEQ ID NO: 68105 - DNA, 25 bp, S. pombe
aggccttcggccaatgttccaaatg

SEQ ID NO: 68106 - DNA, 25 bp, S. pombe
agtcgccgagtttaagcatcagcaa

SEQ ID NO: 68107 - DNA, 25 bp, S. pombe
agtcaggctagcacaacgcatcaaa

SEQ ID NO: 68108 - DNA, 25 bp, S. pombe
atggccgtgccaagcccgaatctag

SEQ ID NO: 68109 - DNA, 25 bp, S. pombe
atggcacccagaagcaatcatcgat

SEQ ID NO: 68110 - DNA, 25 bp, S. pombe
atggcagttgatgttcccgaagggt

SEQ ID NO: 68111 - DNA, 25 bp, S. pombe
atggcttccatcagatccttcagga

SEQ ID NO: 68112 - DNA, 25 bp, S. pombe
atggctttgatttgctaactagtaa

SEQ ID NO: 68113 - DNA, 25 bp, S. pombe
atggcgcttattctaattgcttcaa

SEQ ID NO: 68114 - DNA, 25 bp, S. pombe
atggaacttctgtggctcattgccc

SEQ ID NO: 68115 - DNA, 25 bp, S. pombe
atggcaacgattctttcttcgtctt

SEQ ID NO: 68116 - DNA, 25 bp, S. pombe
atggcaggaattccgttttcaattt

SEQ ID NO: 68117 - DNA, 25 bp, S. pombe
atggaaactccggtgctgttcgtgc

SEQ ID NO: 68118 - DNA, 25 bp, S. pombe
aggaaagcgccgtggctacgatgct

SEQ ID NO: 68119 - DNA, 25 bp, S. pombe
agtgctatcggacacacggttggca

SEQ ID NO: 68120 - DNA, 25 bp, S. pombe
aggaaaggctctcggcatggtccca

SEQ ID NO: 68121 - DNA, 25 bp, S. pombe
aggcttctggtggtttggtcgaatc

SEQ ID NO: 68122 - DNA, 25 bp, S. pombe
atggcttatcgctattttttggaac

SEQ ID NO: 68123 - DNA, 25 bp, S. pombe
atggcttcatgctgtatcttttgtg

SEQ ID NO: 68124 - DNA, 25 bp, S. pombe
atggctaaggcctcaaagggaaagc

SEQ ID NO: 68125 - DNA, 25 bp, S. pombe
atggcgtggcttatatgcattccct

SEQ ID NO: 68126 - DNA, 25 bp, S. pombe
atggatgccgacttttctcatcatc

SEQ ID NO: 68127 - DNA, 25 bp, S. pombe
atggctcaattttctggttgtcctt

SEQ ID NO: 68128 - DNA, 25 bp, S. pombe
atggcaaatgccagcgtttcaaccc

SEQ ID NO: 68129 - DNA, 25 bp, S. pombe
aggctattaccttgtacgcgagact

SEQ ID NO: 68130 - DNA, 25 bp, S. pombe
atggccttagcagttgtccgtggta

SEQ ID NO: 68131 - DNA, 25 bp, S. pombe
aggctattgaggatggtcctcgccc

SEQ ID NO: 68132 - DNA, 25 bp, S. pombe
atggctctggttgggttcgagtaaa

SEQ ID NO: 68133 - DNA, 25 bp, S. pombe
atggctcatactgcggattactcaa

SEQ ID NO: 68134 - DNA, 25 bp, S. pombe
atggcaaaatcagcacgttcaaaaa

SEQ ID NO: 68135 - DNA, 25 bp, S. pombe
atggcgcagcgttttgggcaaattc

SEQ ID NO: 68136 - DNA, 25 bp, S. pombe
atggactgttcctttggatgctgac

SEQ ID NO: 68137 - DNA, 25 bp, S. pombe
atggcactgttcgttggatggctac

SEQ ID NO: 68138 - DNA, 25 bp, S. pombe
atggcctacctgatggatgcgtatc

SEQ ID NO: 68139 - DNA, 25 bp, S. pombe
atggcaagcccaactgaagcattat

SEQ ID NO: 68140 - DNA, 25 bp, S. pombe
atggcgcaccttcttatgttttaac

SEQ ID NO: 68141 - DNA, 25 bp, S. pombe
atggagtttctcgttttgtgcgaaa

SEQ ID NO: 68142 - DNA, 25 bp, S. pombe
atggcgttcttcctttttcgaattg

SEQ ID NO: 68143 - DNA, 25 bp, S. pombe
aggcgttttcgcgtttacaaggatg

SEQ ID NO: 68144 - DNA, 25 bp, S. pombe
aggcctgttcttctattagcagcga

SEQ ID NO: 68145 - DNA, 25 bp, S. pombe
aggcaatgtctctcgttacagtgga

SEQ ID NO: 68146 - DNA, 25 bp, S. pombe
atggccgatacttgtggaacccttg

SEQ ID NO: 68147 - DNA, 25 bp, S. pombe
atggccaaccacaaggaccgccttt

SEQ ID NO: 68148 - DNA, 25 bp, S. pombe
aggaatccgcaagcctaaatctatt

SEQ ID NO: 68149 - DNA, 25 bp, S. pombe
aggcagaacgccttcgtgaagttta

SEQ ID NO: 68150 - DNA, 25 bp, S. pombe
aggccaatgcggaggtagatagttt

SEQ ID NO: 68151 - DNA, 25 bp, S. pombe
atggcgtcggtgaaagccttgttca

SEQ ID NO: 68152 - DNA, 25 bp, S. pombe
atggaaccagagatcgctttcttct

SEQ ID NO: 68153 - DNA, 25 bp, S. pombe
atggaagccgcaagtcctatctctt

SEQ ID NO: 68154 - DNA, 25 bp, S. pombe
atggcacacccgaatacaactacta

SEQ ID NO: 68155 - DNA, 25 bp, S. pombe
atggacgaacagtctcctggtatcg

SEQ ID NO: 68156 - DNA, 25 bp, S. pombe
atggcacgccacatcaactattttg

SEQ ID NO: 68157 - DNA, 25 bp, S. pombe
atggctcctcagacaacagtatatt

SEQ ID NO: 68158 - DNA, 25 bp, S. pombe
atggcattctgctacttctgataat

SEQ ID NO: 68159 - DNA, 25 bp, S. pombe
atggctgctgtcaatatcatcaaga

SEQ ID NO: 68160 - DNA, 25 bp, S. pombe
aggctgcttgctttgacggtgtcaa

SEQ ID NO: 68161 - DNA, 25 bp, S. pombe
aggaatgcacattccatgctctcat

SEQ ID NO: 68162 - DNA, 25 bp, S. pombe
aggctgcatacttctcatgcttcta

SEQ ID NO: 68163 - DNA, 25 bp, S. pombe
atggcaattttcctcgttctaatgc

SEQ ID NO: 68164 - DNA, 25 bp, S. pombe
aggcttatcctgaggtatcaagtgt

SEQ ID NO: 68165 - DNA, 25 bp, S. pombe
atggacttattgttggccttatttt

SEQ ID NO: 68166 - DNA, 25 bp, S. pombe
atggacgtattgaggctgcttgctt

SEQ ID NO: 68167 - DNA, 25 bp, S. pombe
atggacgtttgactagtgcctggaa

SEQ ID NO: 68168 - DNA, 25 bp, S. pombe
atggacggttatacttgcctatcaa

SEQ ID NO: 68169 - DNA, 25 bp, S. pombe
atggccgtgtgttttctcaggagac

SEQ ID NO: 68170 - DNA, 25 bp, S. pombe
atggaattccttggctgtcagtgct

SEQ ID NO: 68171 - DNA, 25 bp, S. pombe
atggaattccattttgcttgctgtt

SEQ ID NO: 68172 - DNA, 25 bp, S. pombe
atggaagcctttatactcgttgaaa

SEQ ID NO: 68173 - DNA, 25 bp, S. pombe
aggacccagaaatgcgctttctttc

SEQ ID NO: 68174 - DNA, 25 bp, S. pombe
aggacctaatggtgctcttttaata

SEQ ID NO: 68175 - DNA, 25 bp, S. pombe
aggaacttaggctcatctcttcata

SEQ ID NO: 68176 - DNA, 25 bp, S. pombe
aggaattccaactcattcgtcgtgg

SEQ ID NO: 68177 - DNA, 25 bp, S. pombe
actagttacaaatcttccttccgct

SEQ ID NO: 68178 - DNA, 25 bp, S. pombe
atggccccagaggttttacgaggtg

SEQ ID NO: 68179 - DNA, 25 bp, S. pombe
atggctccatttcctttgaaatcgt

SEQ ID NO: 68180 - DNA, 25 bp, S. pombe
atggccgatttggttgataaaccta

SEQ ID NO: 68181 - DNA, 25 bp, S. pombe
aggaccgcaaccatcaagctagaat

SEQ ID NO: 68182 - DNA, 25 bp, S. pombe
aggaggccagcaccgttttcaaaag

SEQ ID NO: 68183 - DNA, 25 bp, S. pombe
atggaatggcgcctacatccgataa

SEQ ID NO: 68184 - DNA, 25 bp, S. pombe
atggaagcccagtactctctgaaga

SEQ ID NO: 68185 - DNA, 25 bp, S. pombe
atggctttctatgtctcactattgg

SEQ ID NO: 68186 - DNA, 25 bp, S. pombe
atggctatcctaggattcgccttaa

SEQ ID NO: 68187 - DNA, 25 bp, S. pombe
atggcattcttagtcaggcattcta

SEQ ID NO: 68188 - DNA, 25 bp, S. pombe
atggctgtcttacatgcgcttaatg

SEQ ID NO: 68189 - DNA, 25 bp, S. pombe
atggcttcttacaatctcttcctta

SEQ ID NO: 68190 - DNA, 25 bp, S. pombe
aggctactcatatctcaaatcacta

SEQ ID NO: 68191 - DNA, 25 bp, S. pombe
aggctagccaattctacgctcaaag

SEQ ID NO: 68192 - DNA, 25 bp, S. pombe
aggctagcccaattgatgcccaata

SEQ ID NO: 68193 - DNA, 25 bp, S. pombe
atggcgtccgtgctggtgctaaaaa

SEQ ID NO: 68194 - DNA, 25 bp, S. pombe
atggctaccgagcttgtcgttcaaa

SEQ ID NO: 68195 - DNA, 25 bp, S. pombe
atggctactaacgttggccctcaaa

SEQ ID NO: 68196 - DNA, 25 bp, S. pombe
atggcaaccaacgttgggcctcaaa

SEQ ID NO: 68197 - DNA, 25 bp, S. pombe
atggccaatgcatttattactcgtg

SEQ ID NO: 68198 - DNA, 25 bp, S. pombe
atggctgtattgcatatccctctga

SEQ ID NO: 68199 - DNA, 25 bp, S. pombe
atggcatttcgcattcctgcaaaat

SEQ ID NO: 68200 - DNA, 25 bp, S. pombe
atggcattctcgatacttgtacaca

SEQ ID NO: 68201 - DNA, 25 bp, S. pombe
atggcatttggagcactttctggaa

SEQ ID NO: 68202 - DNA, 25 bp, S. pombe
aggcggtggcttgctttctggatca

SEQ ID NO: 68203 - DNA, 25 bp, S. pombe
atggctcctacttatacacttctta

SEQ ID NO: 68204 - DNA, 25 bp, S. pombe
atggccgtacattctacagtcgtta

SEQ ID NO: 68205 - DNA, 25 bp, S. pombe
atggcagagtactttctcgtttaag

SEQ ID NO: 68206 - DNA, 25 bp, S. pombe
atggcatcccactttctttttactg

SEQ ID NO: 68207 - DNA, 25 bp, S. pombe
atggctgccaatcgttcttatttac

SEQ ID NO: 68208 - DNA, 25 bp, S. pombe
atggcgtggatgcttccaagcttac

SEQ ID NO: 68209 - DNA, 25 bp, S. pombe
aggagtagatccgtacgcagcttat

SEQ ID NO: 68210 - DNA, 25 bp, S. pombe
aggcaatgacactagctcaggatat

SEQ ID NO: 68211 - DNA, 25 bp, S. pombe
aggcattggtgctagcattcttcgt

SEQ ID NO: 68212 - DNA, 25 bp, S. pombe
aggcacttggtaattcggcggaaca

SEQ ID NO: 68213 - DNA, 25 bp, S. pombe
atggcccgtgctattcctatggaat

SEQ ID NO: 68214 - DNA, 25 bp, S. pombe
aggcgtcgtatttctactagctcaa

SEQ ID NO: 68215 - DNA, 25 bp, S. pombe
atggctgcttctgtttttcttaagt

SEQ ID NO: 68216 - DNA, 25 bp, S. pombe
atggctttgctcctaagtgttttac

SEQ ID NO: 68217 - DNA, 25 bp, S. pombe
atggccgttgcgaaaagcgttattt

SEQ ID NO: 68218 - DNA, 25 bp, S. pombe
atggcgatacagctaggcctcacac

SEQ ID NO: 68219 - DNA, 25 bp, S. pombe
atggctaatcactcgagttcgtcca

SEQ ID NO: 68220 - DNA, 25 bp, S. pombe
atggccacagaacttgtcgtgcaaa

SEQ ID NO: 68221 - DNA, 25 bp, S. pombe
atggctacgtgcttagtcgcgacaa

SEQ ID NO: 68222 - DNA, 25 bp, S. pombe
atggctacttatttggctgaccgtg

SEQ ID NO: 68223 - DNA, 25 bp, S. pombe
aggcttccagatgtcgctgaacttg

SEQ ID NO: 68224 - DNA, 25 bp, S. pombe
aggctatccaatctgctcgaagtca

SEQ ID NO: 68225 - DNA, 25 bp, S. pombe
aggtcatcggcaaaaaagttcttat

SEQ ID NO: 68226 - DNA, 25 bp, S. pombe
atggctaccttagctacagcttggt

SEQ ID NO: 68227 - DNA, 25 bp, S. pombe
aggccacgacggttttttgcttgag

SEQ ID NO: 68228 - DNA, 25 bp, S. pombe
atggcgagtgatgcgttttcgactt

SEQ ID NO: 68229 - DNA, 25 bp, S. pombe
aggccctatcatggtcttgatgcag

SEQ ID NO: 68230 - DNA, 25 bp, S. pombe
aggcccacatcagctcgtgtaggaa

SEQ ID NO: 68231 - DNA, 25 bp, S. pombe
aggccagacagtacgcgagcagcaa

SEQ ID NO: 68232 - DNA, 25 bp, S. pombe
atggcccatcagcaggtatcacaat

SEQ ID NO: 68233 - DNA, 25 bp, S. pombe
atggcttggagctcagtgcagaatt

SEQ ID NO: 68234 - DNA, 25 bp, S. pombe
atggccatggtttagctgttgaatc

SEQ ID NO: 68235 - DNA, 25 bp, S. pombe
aggttaattacgctttgcctggatt

SEQ ID NO: 68236 - DNA, 25 bp, S. pombe
aggttactataatcctgcccagttt

SEQ ID NO: 68237 - DNA, 25 bp, S. pombe
aggaatatgcttgttatggctctac

SEQ ID NO: 68238 - DNA, 25 bp, S. pombe
agaaatctttttgttgacgacaact

SEQ ID NO: 68239 - DNA, 25 bp, S. pombe
aggcattaggtgaagctggtgccaa

SEQ ID NO: 68240 - DNA, 25 bp, S. pombe
aggaattttttcatgctaacgcata

SEQ ID NO: 68241 - DNA, 25 bp, S. pombe
agggtactacggttgcagttggcaa

SEQ ID NO: 68242 - DNA, 25 bp, S. pombe
aggaaaccctcttctactggacaag

SEQ ID NO: 68243 - DNA, 25 bp, S. pombe
aggaatacaccaaagctttcgccac

SEQ ID NO: 68244 - DNA, 25 bp, S. pombe
aggcagatacactacggccttcgga

SEQ ID NO: 68245 - DNA, 25 bp, S. pombe
aggcgagagccgtcacaattagcag

SEQ ID NO: 68246 - DNA, 25 bp, S. pombe
atggccaagtcgaagaatcatacta

SEQ ID NO: 68247 - DNA, 25 bp, S. pombe
aggcatggcagctttttgaatcaaa

SEQ ID NO: 68248 - DNA, 25 bp, S. pombe
aggcttcgcctttctaaaatatgag

SEQ ID NO: 68249 - DNA, 25 bp, S. pombe
aggctcgtcgtgctctcaaaaagaa

SEQ ID NO: 68250 - DNA, 25 bp, S. pombe
atggcctttgctggcttcaagaaac

SEQ ID NO: 68251 - DNA, 25 bp, S. pombe
aggtgctccctgttacaaataatga

SEQ ID NO: 68252 - DNA, 25 bp, S. pombe
atggcctcccttttgcagtgaaaac

SEQ ID NO: 68253 - DNA, 25 bp, S. pombe
aggcttccttttagattgtcaaaca

SEQ ID NO: 68254 - DNA, 25 bp, S. pombe
aggctgaccctttgatgattacgaa

SEQ ID NO: 68255 - DNA, 25 bp, S. pombe
aggcgacgcctaatgatattgctca

SEQ ID NO: 68256 - DNA, 25 bp, S. pombe
atggctcctattaaatctcgtagaa

SEQ ID NO: 68257 - DNA, 25 bp, S. pombe
atggccgtacataatcaacttcgaa

SEQ ID NO: 68258 - DNA, 25 bp, S. pombe
atggctcgtatcactcagcaattcg

SEQ ID NO: 68259 - DNA, 25 bp, S. pombe
atggctcaagcgtatgtgacccaat

SEQ ID NO: 68260 - DNA, 25 bp, S. pombe
aggcacataggcatttagaacagtt

SEQ ID NO: 68261 - DNA, 25 bp, S. pombe
aggctgttattttcgggtctcattt

SEQ ID NO: 68262 - DNA, 25 bp, S. pombe
aggctgggcctatattgtggccgct

SEQ ID NO: 68263 - DNA, 25 bp, S. pombe
aggcttttctatgatcttaccgctt

SEQ ID NO: 68264 - DNA, 25 bp, S. pombe
aggccgttaagctttgttgctccga

SEQ ID NO: 68265 - DNA, 25 bp, S. pombe
aggcctgttttcttgaactcattca

SEQ ID NO: 68266 - DNA, 25 bp, S. pombe
aggcgtcaaaccatacgtccttgaa

SEQ ID NO: 68267 - DNA, 25 bp, S. pombe
atggcgttaatccttacctttgtga

SEQ ID NO: 68268 - DNA, 25 bp, S. pombe
atggccttaatcgtgcgtcctttga

SEQ ID NO: 68269 - DNA, 25 bp, S. pombe
atggccttacaggtggatatcttaa

SEQ ID NO: 68270 - DNA, 25 bp, S. pombe
aggctcctccaggtgctaatttcag

SEQ ID NO: 68271 - DNA, 25 bp, S. pombe
aggctcctcttggtagcaatcgtga

SEQ ID NO: 68272 - DNA, 25 bp, S. pombe
atggcgttcgttatggtgcatcttt

SEQ ID NO: 68273 - DNA, 25 bp, S. pombe
atggcgcttctgttagtggtacctg

SEQ ID NO: 68274 - DNA, 25 bp, S. pombe
aggccgatgctgtttggcgttccgt

SEQ ID NO: 68275 - DNA, 25 bp, S. pombe
atggcctgcgcagatcttggtgtat

SEQ ID NO: 68276 - DNA, 25 bp, S. pombe
aggctgctggccatcattttaagaa

SEQ ID NO: 68277 - DNA, 25 bp, S. pombe
atggcgcctgcagaacttaaacgac

SEQ ID NO: 68278 - DNA, 25 bp, S. pombe
atggcgcctggtaactctcgaatag

SEQ ID NO: 68279 - DNA, 25 bp, S. pombe
atggcggagtaaaggcctttctcaa

SEQ ID NO: 68280 - DNA, 25 bp, S. pombe
atggccggtaatttccacattgctc

SEQ ID NO: 68281 - DNA, 25 bp, S. pombe
atggccgtgctgatatccctgttga

SEQ ID NO: 68282 - DNA, 25 bp, S. pombe
atggcctggagtcacgcttttgcaa

SEQ ID NO: 68283 - DNA, 25 bp, S. pombe
aggctcctaccaacatatcgatgtg

SEQ ID NO: 68284 - DNA, 25 bp, S. pombe
aggcgcgtagccaatcgtcgatctt

SEQ ID NO: 68285 - DNA, 25 bp, S. pombe
atggccacaatcgtcctattggttt

SEQ ID NO: 68286 - DNA, 25 bp, S. pombe
aggcctatatctcattctttgcgta

SEQ ID NO: 68287 - DNA, 25 bp, S. pombe
aggccgttcgtgtcgctgaacttag

SEQ ID NO: 68288 - DNA, 25 bp, S. pombe
aggctgagaccgacttccaaattgt

SEQ ID NO: 68289 - DNA, 25 bp, S. pombe
aggcgaatcaggtagttctctttca

SEQ ID NO: 68290 - DNA, 25 bp, S. pombe
aggatatgagctcttccgacatggc

SEQ ID NO: 68291 - DNA, 25 bp, S. pombe
aggtgattgaggaccctcgacttta

SEQ ID NO: 68292 - DNA, 25 bp, S. pombe
aggcttatcgaattcgctgcaacca

SEQ ID NO: 68293 - DNA, 25 bp, S. pombe
aggcttactagcttgttgaaactta

SEQ ID NO: 68294 - DNA, 25 bp, S. pombe
aggctcaaacccatggtactgctta

SEQ ID NO: 68295 - DNA, 25 bp, S. pombe
aggaagaaacgcgtgagacgcctta

SEQ ID NO: 68296 - DNA, 25 bp, S. pombe
agtaacactggccttcgtaatcgta

SEQ ID NO: 68297 - DNA, 25 bp, S. pombe
aggatagtggagctcgtcatcccgt

SEQ ID NO: 68298 - DNA, 25 bp, S. pombe
aggtacctatgatgcgacttcgtga

SEQ ID NO: 68299 - DNA, 25 bp, S. pombe
aggaagatatcccagcgaccacgtt

SEQ ID NO: 68300 - DNA, 25 bp, S. pombe
aggaatgatctacctgctgacgtcc

SEQ ID NO: 68301 - DNA, 25 bp, S. pombe
aggaggctttgagtgctgcatcttc

SEQ ID NO: 68302 - DNA, 25 bp, S. pombe
atggcccgcattttggactcttggt

SEQ ID NO: 68303 - DNA, 25 bp, S. pombe
aggcctcgcttctgatggcgtctgg

SEQ ID NO: 68304 - DNA, 25 bp, S. pombe
aggctgatgcttactggtgtctttc

SEQ ID NO: 68305 - DNA, 25 bp, S. pombe
aggcggattacgcatatctgttcaa

SEQ ID NO: 68306 - DNA, 25 bp, S. pombe
aggctggcttcccaaattgcaacta

SEQ ID NO: 68307 - DNA, 25 bp, S. pombe
aggcggatgtccacgttgcaattct

SEQ ID NO: 68308 - DNA, 25 bp, S. pombe
aggcggtgtcgcttattctgaatat

SEQ ID NO: 68309 - DNA, 25 bp, S. pombe
aggcggtggcgcttcaagtatacat

SEQ ID NO: 68310 - DNA, 25 bp, S. pombe
aggctggatggtttagcgtctatca

SEQ ID NO: 68311 - DNA, 25 bp, S. pombe
aggctcagagccatccagtattgct

SEQ ID NO: 68312 - DNA, 25 bp, S. pombe
aggccattccttaccatttgcaggt

SEQ ID NO: 68313 - DNA, 25 bp, S. pombe
aggctcagtttagtccatatccggc

SEQ ID NO: 68314 - DNA, 25 bp, S. pombe
aggccagatgtttttcttcgagtca

SEQ ID NO: 68315 - DNA, 25 bp, S. pombe
aggctgagcgttttgttttcgccat

SEQ ID NO: 68316 - DNA, 25 bp, S. pombe
aggaccctaatgttcttccaatccg

SEQ ID NO: 68317 - DNA, 25 bp, S. pombe
aggcgcgaaaatactttcccagccg

SEQ ID NO: 68318 - DNA, 25 bp, S. pombe
aggccgttgagaaggttgcccctgg

SEQ ID NO: 68319 - DNA, 25 bp, S. pombe
aggcctttggtatgcacacttttgg

SEQ ID NO: 68320 - DNA, 25 bp, S. pombe
aggctcttctggatacaccttgaat

SEQ ID NO: 68321 - DNA, 25 bp, S. pombe
aggccttctgcccatcagaatttaa

SEQ ID NO: 68322 - DNA, 25 bp, S. pombe
aggcgattcaaattctttcattaga

SEQ ID NO: 68323 - DNA, 25 bp, S. pombe
aggccttcaaccgtttgatgactca

SEQ ID NO: 68324 - DNA, 25 bp, S. pombe
aggctcttcattcttttataatcca

SEQ ID NO: 68325 - DNA, 25 bp, S. pombe
aggccgctgacattgatttcttacc

SEQ ID NO: 68326 - DNA, 25 bp, S. pombe
atggccttgacattgttgactatga

SEQ ID NO: 68327 - DNA, 25 bp, S. pombe
atggccttgaagatcacacgagttt

SEQ ID NO: 68328 - DNA, 25 bp, S. pombe
aggccgtaatgtgcttcgtgtttgg

SEQ ID NO: 68329 - DNA, 25 bp, S. pombe
aggcccggagtttgctggatatgtc

SEQ ID NO: 68330 - DNA, 25 bp, S. pombe
aggcctcggagagagttcttgctca

SEQ ID NO: 68331 - DNA, 25 bp, S. pombe
aggccttcggattcgtcagcgtgta

SEQ ID NO: 68332 - DNA, 25 bp, S. pombe
aggacagtgacaaccgaacaatttc

SEQ ID NO: 68333 - DNA, 25 bp, S. pombe
aggagactggcgtcacaccgatggt

SEQ ID NO: 68334 - DNA, 25 bp, S. pombe
aggcgtatccatggaccctgagaga

SEQ ID NO: 68335 - DNA, 25 bp, S. pombe
aggctctattccacacttcgaaaga

SEQ ID NO: 68336 - DNA, 25 bp, S. pombe
aggcgtctactcacacgatatcgaa

SEQ ID NO: 68337 - DNA, 25 bp, S. pombe
aggctgtgctaactgtactcttgga

SEQ ID NO: 68338 - DNA, 25 bp, S. pombe
aggtgtgcgtgctgtatatccggac

SEQ ID NO: 68339 - DNA, 25 bp, S. pombe
aggcttctttctgaactcgttatct

SEQ ID NO: 68340 - DNA, 25 bp, S. pombe
aggccatttgtatccgtgcattttc

SEQ ID NO: 68341 - DNA, 25 bp, S. pombe
aggccgtatatttcatgcgacttgt

SEQ ID NO: 68342 - DNA, 25 bp, S. pombe
aggagccaagaggaactatgatatc

SEQ ID NO: 68343 - DNA, 25 bp, S. pombe
aggaatggctcgcagacgcaactac

SEQ ID NO: 68344 - DNA, 25 bp, S. pombe
aggttggaagcctacgcattctaca

SEQ ID NO: 68345 - DNA, 25 bp, S. pombe
aggctatcgtactcgtttgctagaa

SEQ ID NO: 68346 - DNA, 25 bp, S. pombe
aggcgtgaacactccccaaatgatg

SEQ ID NO: 68347 - DNA, 25 bp, S. pombe
gaaggagggctcaccaaaccaattt

SEQ ID NO: 68348 - DNA, 25 bp, S. pombe
aggctaagccatttttgagatttca

SEQ ID NO: 68349 - DNA, 25 bp, S. pombe
aggccttgcccaaaatatttagctg

SEQ ID NO: 68350 - DNA, 25 bp, S. pombe
aggccttgctccaatttatcgtttg

SEQ ID NO: 68351 - DNA, 25 bp, S. pombe
aggcgctttttacatgaggcttctt

SEQ ID NO: 68352 - DNA, 25 bp, S. pombe
aggccttttttgctagctctttcaa

SEQ ID NO: 68353 - DNA, 25 bp, S. pombe
aggttacttttgctgtcctttcaca

SEQ ID NO: 68354 - DNA, 25 bp, S. pombe
aggacaacctttgcttcttttatcg

SEQ ID NO: 68355 - DNA, 25 bp, S. pombe
aggcctccttctctattaattgatg

SEQ ID NO: 68356 - DNA, 25 bp, S. pombe
aggcgctaataatgtcaccatcgaa

SEQ ID NO: 68357 - DNA, 25 bp, S. pombe
aggctcttgttggatttctggacgc

SEQ ID NO: 68358 - DNA, 25 bp, S. pombe
aggcaaaagctcgtgctgaagcgaa

SEQ ID NO: 68359 - DNA, 25 bp, S. pombe
aggaatgcgaaatgtatgctgtgaa

SEQ ID NO: 68360 - DNA, 25 bp, S. pombe
aggcttgccatttccttcaaatttt

SEQ ID NO: 68361 - DNA, 25 bp, S. pombe
aggcgattgtcaacagctatttcaa

SEQ ID NO: 68362 - DNA, 25 bp, S. pombe
aggaagaccagagcaacaccaaact

SEQ ID NO: 68363 - DNA, 25 bp, S. pombe
aggcttgactaaagagcgattttta

SEQ ID NO: 68364 - DNA, 25 bp, S. pombe
aggcctccccaaaggattgctgtta

SEQ ID NO: 68365 - DNA, 25 bp, S. pombe
agcggctaccgaaatggcattggcg

SEQ ID NO: 68366 - DNA, 25 bp, S. pombe
aggcccttggctatagtaatctctc

SEQ ID NO: 68367 - DNA, 25 bp, S. pombe
aggacgctggttacatttagatgct

SEQ ID NO: 68368 - DNA, 25 bp, S. pombe
aggactgagcgtttcgttctgcgat

SEQ ID NO: 68369 - DNA, 25 bp, S. pombe
acgacgcccaaaagcttcttgaatt

SEQ ID NO: 68370 - DNA, 25 bp, S. pombe
aggcgctatcatgttcgagtgctta

SEQ ID NO: 68371 - DNA, 25 bp, S. pombe
agtggtactgctttcgtgtttattc

SEQ ID NO: 68372 - DNA, 25 bp, S. pombe
agtccaatggctgaggcagtttttc

SEQ ID NO: 68373 - DNA, 25 bp, S. pombe
aggcgtgtactttgctggaattatg

SEQ ID NO: 68374 - DNA, 25 bp, S. pombe
aggccgctttgaaggctgctgaaga

SEQ ID NO: 68375 - DNA, 25 bp, S. pombe
aggcatctctccttaccagggaaga

SEQ ID NO: 68376 - DNA, 25 bp, S. pombe
aggctattgagtttgctcgtcgcaa

SEQ ID NO: 68377 - DNA, 25 bp, S. pombe
aggctcaacgctttgttgatgacaa

SEQ ID NO: 68378 - DNA, 25 bp, S. pombe
aggtcatttgactcgccaaacttct

SEQ ID NO: 68379 - DNA, 25 bp, S. pombe
aggtatttccactgcaccaaaacat

SEQ ID NO: 68380 - DNA, 25 bp, S. pombe
aggagcagtctctttaggccataag

SEQ ID NO: 68381 - DNA, 25 bp, S. pombe
aggatgcggtcctgatggccataca

SEQ ID NO: 68382 - DNA, 25 bp, S. pombe
aggcatggtggcttttctggattac

SEQ ID NO: 68383 - DNA, 25 bp, S. pombe
aggcaggtcgcatattcgtgttcat

SEQ ID NO: 68384 - DNA, 25 bp, S. pombe
aggagactatctctactgtttccac

SEQ ID NO: 68385 - DNA, 25 bp, S. pombe
aggacgttcgtctgattcatctaat

SEQ ID NO: 68386 - DNA, 25 bp, S. pombe
tacgggtactcctgaaactggcggt

SEQ ID NO: 68387 - DNA, 25 bp, S. pombe
acgggtttccttcaattgtcgctgg

SEQ ID NO: 68388 - DNA, 25 bp, S. pombe
accggtactaccctatacgttgatg

SEQ ID NO: 68389 - DNA, 25 bp, S. pombe
aggaagtctgttgactcacccaggg

SEQ ID NO: 68390 - DNA, 25 bp, S. pombe
aggctattcgactttcttacgatca

SEQ ID NO: 68391 - DNA, 25 bp, S. pombe
aggcgttccagctatacatttcaat

SEQ ID NO: 68392 - DNA, 25 bp, S. pombe
aggagcgttgtcgatccagttactc

SEQ ID NO: 68393 - DNA, 25 bp, S. pombe
aggacgttcactttgcggtagctac

SEQ ID NO: 68394 - DNA, 25 bp, S. pombe
aggacaaaactcttctgccgacgaa

SEQ ID NO: 68395 - DNA, 25 bp, S. pombe
aggcacggacctttctactgaagaa

SEQ ID NO: 68396 - DNA, 25 bp, S. pombe
aggtcggatggtgcttcttacagag

SEQ ID NO: 68397 - DNA, 25 bp, S. pombe
aggacgccactaaggcctatcagga

SEQ ID NO: 68398 - DNA, 25 bp, S. pombe
aggtgcatccggaggccaagtcaga

SEQ ID NO: 68399 - DNA, 25 bp, S. pombe
aggtttagagaattcccacacgagg

SEQ ID NO: 68400 - DNA, 25 bp, S. pombe
aggcttctggatttacattggtgac

SEQ ID NO: 68401 - DNA, 25 bp, S. pombe
aggcgtctggtcttcacatacaatt

SEQ ID NO: 68402 - DNA, 25 bp, S. pombe
aggctcatgtcgatttactcactgc

SEQ ID NO: 68403 - DNA, 25 bp, S. pombe
aggctgatgccgatatgtctacacc

SEQ ID NO: 68404 - DNA, 25 bp, S. pombe
aggcggtcatgcaaagtgtcaccca

SEQ ID NO: 68405 - DNA, 25 bp, S. pombe
aggaaaccattcatgacccgatagt

SEQ ID NO: 68406 - DNA, 25 bp, S. pombe
aggaagatccttcgagcaccacgat

SEQ ID NO: 68407 - DNA, 25 bp, S. pombe
aggaggatcctgaagctgagcgcat

SEQ ID NO: 68408 - DNA, 25 bp, S. pombe
aggaggccatcaaacgtccattgtc

SEQ ID NO: 68409 - DNA, 25 bp, S. pombe
aggatgtcgcataacggtcctttcc

SEQ ID NO: 68410 - DNA, 25 bp, S. pombe
aggtggcatatcagccaggccaggc

SEQ ID NO: 68411 - DNA, 25 bp, S. pombe
aggagtcgtgcgtcatgaacaagat

SEQ ID NO: 68412 - DNA, 25 bp, S. pombe
aggatgccggagtcatacttcgatt

SEQ ID NO: 68413 - DNA, 25 bp, S. pombe
aggctctatcggctgatcccgaatg

SEQ ID NO: 68414 - DNA, 25 bp, S. pombe
aggctctttgaattgcttgccgaaa

SEQ ID NO: 68415 - DNA, 25 bp, S. pombe
aggctgctcgtgaatatcttgaaaa

SEQ ID NO: 68416 - DNA, 25 bp, S. pombe
aggcattcggcttccttacaaaatc

SEQ ID NO: 68417 - DNA, 25 bp, S. pombe
aggacaaggttgatgcttccgacaa

SEQ ID NO: 68418 - DNA, 25 bp, S. pombe
aggaccgacgtagttttcagatcac

SEQ ID NO: 68419 - DNA, 25 bp, S. pombe
aggcatctggtgctaaaattggtca

SEQ ID NO: 68420 - DNA, 25 bp, S. pombe
acgacaatttttcttccgaagcgag

SEQ ID NO: 68421 - DNA, 25 bp, S. pombe
aggcactgcagaagagtccgctctt

SEQ ID NO: 68422 - DNA, 25 bp, S. pombe
aggctcatgacaaggctcaacgctt

SEQ ID NO: 68423 - DNA, 25 bp, S. pombe
aggctcatgttgctgctctcgatta

SEQ ID NO: 68424 - DNA, 25 bp, S. pombe
aggctgctggtccttctagagttaa

SEQ ID NO: 68425 - DNA, 25 bp, S. pombe
aggcaaatgctgaagctgctgctcc

SEQ ID NO: 68426 - DNA, 25 bp, S. pombe
aggcaagatggttggcctgcccttg

SEQ ID NO: 68427 - DNA, 25 bp, S. pombe
aggctcctgcgatgtttactttgaa

SEQ ID NO: 68428 - DNA, 25 bp, S. pombe
aggctcctgctgacgatgttgttat

SEQ ID NO: 68429 - DNA, 25 bp, S. pombe
accgcaattcgtgcaagggttcctt

SEQ ID NO: 68430 - DNA, 25 bp, S. pombe
aaagcaaccgtccatgtgggtaact

SEQ ID NO: 68431 - DNA, 25 bp, S. pombe
aggaacccgtcgttggtgctagaca

SEQ ID NO: 68432 - DNA, 25 bp, S. pombe
aggaatgcacctttgtggagtcccc

SEQ ID NO: 68433 - DNA, 25 bp, S. pombe
aggacaaactagttgggccgccatt

SEQ ID NO: 68434 - DNA, 25 bp, S. pombe
aggtgcatctgctggcggaaacttt

SEQ ID NO: 68435 - DNA, 25 bp, S. pombe
agactttgttcgtgttgttgactac

SEQ ID NO: 68436 - DNA, 25 bp, S. pombe
aggtactgactctcgtttggtaacg

SEQ ID NO: 68437 - DNA, 25 bp, S. pombe
aggaagctgcttgttttctgggaca

SEQ ID NO: 68438 - DNA, 25 bp, S. pombe
aggctcgtgttcctttcttggataa

SEQ ID NO: 68439 - DNA, 25 bp, S. pombe
aggctcgccctttttctttgcatta

SEQ ID NO: 68440 - DNA, 25 bp, S. pombe
aggtcaactatccatcgtacttttc

SEQ ID NO: 68441 - DNA, 25 bp, S. pombe
aggacaagaacgtcgctcactctgg

SEQ ID NO: 68442 - DNA, 25 bp, S. pombe
aggacaagttcgttgactcactcaa

SEQ ID NO: 68443 - DNA, 25 bp, S. pombe
aggacaccattgaacgttctcatcc

SEQ ID NO: 68444 - DNA, 25 bp, S. pombe
aggactcactggaatttgctgctaa

SEQ ID NO: 68445 - DNA, 25 bp, S. pombe
aggattttgcggacggctcaagaac

SEQ ID NO: 68446 - DNA, 25 bp, S. pombe
aggataaatcccttgtcacaccaca

SEQ ID NO: 68447 - DNA, 25 bp, S. pombe
aggatacgtcttctgatccagtcgt

SEQ ID NO: 68448 - DNA, 25 bp, S. pombe
aggttatgttatctaccgcatccgt

SEQ ID NO: 68449 - DNA, 25 bp, S. pombe
aggaatttattctggcacgcttggt

SEQ ID NO: 68450 - DNA, 25 bp, S. pombe
aggaagttattgtcgcttgcggagc

SEQ ID NO: 68451 - DNA, 25 bp, S. pombe
caggcaagttactctactactgtga

SEQ ID NO: 68452 - DNA, 25 bp, S. pombe
aggcagagtcgatcgctcaggactt

SEQ ID NO: 68453 - DNA, 25 bp, S. pombe
aggagtctggagaagcatcccctca

SEQ ID NO: 68454 - DNA, 25 bp, S. pombe
aggagttggaaatctacactgcaaa

SEQ ID NO: 68455 - DNA, 25 bp, S. pombe
aggctctcctaaggttgctttgtca

SEQ ID NO: 68456 - DNA, 25 bp, S. pombe
aggactactagaagctggacttgaa

SEQ ID NO: 68457 - DNA, 25 bp, S. pombe
aggactccatcattttccgtctgat

SEQ ID NO: 68458 - DNA, 25 bp, S. pombe
aggcagtcaaacatcccaatgctga

SEQ ID NO: 68459 - DNA, 25 bp, S. pombe
aggagccgactcacacatcagtggt

SEQ ID NO: 68460 - DNA, 25 bp, S. pombe
aggacacgagtcacataagtatcat

SEQ ID NO: 68461 - DNA, 25 bp, S. pombe
aggctaccactaacatctttacttc

SEQ ID NO: 68462 - DNA, 25 bp, S. pombe
aggctacctcgaacagttgtcttta

SEQ ID NO: 68463 - DNA, 25 bp, S. pombe
aggacaattctacggcttttattct

SEQ ID NO: 68464 - DNA, 25 bp, S. pombe
aggaactcctgaacttgaacaagca

SEQ ID NO: 68465 - DNA, 25 bp, S. pombe
aggatgactccgctcttaatgaaag

SEQ ID NO: 68466 - DNA, 25 bp, S. pombe
aggctatgctatacagggtcacggc

SEQ ID NO: 68467 - DNA, 25 bp, S. pombe
aggcattttctatgaccagcggcat

SEQ ID NO: 68468 - DNA, 25 bp, S. pombe
aggctatttctgatcccagtgtcaa

SEQ ID NO: 68469 - DNA, 25 bp, S. pombe
aggcagatcttcttcaccgaattaa

SEQ ID NO: 68470 - DNA, 25 bp, S. pombe
aggcattctctctcatcactaatga

SEQ ID NO: 68471 - DNA, 25 bp, S. pombe
aggctattccgttcacagagatttt

SEQ ID NO: 68472 - DNA, 25 bp, S. pombe
aggctactgcctatgttctatttta

SEQ ID NO: 68473 - DNA, 25 bp, S. pombe
aggcatactgccgttattcatcaaa

SEQ ID NO: 68474 - DNA, 25 bp, S. pombe
aggcacatcttctctgaattctgca

SEQ ID NO: 68475 - DNA, 25 bp, S. pombe
aggcaacgctgatttcgagcttccg

SEQ ID NO: 68476 - DNA, 25 bp, S. pombe
aggcatgaccgatgttgccagtcaa

SEQ ID NO: 68477 - DNA, 25 bp, S. pombe
aggacaaacttcttctgagcccatt

SEQ ID NO: 68478 - DNA, 25 bp, S. pombe
aggaattatttctctcacctgcaat

SEQ ID NO: 68479 - DNA, 25 bp, S. pombe
aggctagtgatttacttcctcaaat

SEQ ID NO: 68480 - DNA, 25 bp, S. pombe
aggcatttagccatttactgtcact

SEQ ID NO: 68481 - DNA, 25 bp, S. pombe
aggcttactcttggttgaatgtgac

SEQ ID NO: 68482 - DNA, 25 bp, S. pombe
aggcttctcattctggatctaattt

SEQ ID NO: 68483 - DNA, 25 bp, S. pombe
aggcttctaccgctgatattactaa

SEQ ID NO: 68484 - DNA, 25 bp, S. pombe
aggcattttgccgagtctttgaatg

SEQ ID NO: 68485 - DNA, 25 bp, S. pombe
aggcatgtacagtgattctttatat

SEQ ID NO: 68486 - DNA, 25 bp, S. pombe
aggcatcttggatgagctttccact

SEQ ID NO: 68487 - DNA, 25 bp, S. pombe
aggcttctccaaatcagttgctact

SEQ ID NO: 68488 - DNA, 25 bp, S. pombe
aggctttctctaatctatcttacaa

SEQ ID NO: 68489 - DNA, 25 bp, S. pombe
aggtatgtactcgatcatttcaacg

SEQ ID NO: 68490 - DNA, 25 bp, S. pombe
aggacgtgtaaagccattctgtgtt

SEQ ID NO: 68491 - DNA, 25 bp, S. pombe
aggagcgtctaaaaccattgtcttt

SEQ ID NO: 68492 - DNA, 25 bp, S. pombe
aggcagagggtatcagcagcgcttc

SEQ ID NO: 68493 - DNA, 25 bp, S. pombe
aggattgggctttcaatggctacaa

SEQ ID NO: 68494 - DNA, 25 bp, S. pombe
aggagaattggctgcgcttcgtgat

SEQ ID NO: 68495 - DNA, 25 bp, S. pombe
agtgcgttcaggaggccatcgatat

SEQ ID NO: 68496 - DNA, 25 bp, S. pombe
aggagttcagcgactggcctacgat

SEQ ID NO: 68497 - DNA, 25 bp, S. pombe
aggatcttgctgctcttgaacgcga

SEQ ID NO: 68498 - DNA, 25 bp, S. pombe
aggcacattcaccatctctaatttg

SEQ ID NO: 68499 - DNA, 25 bp, S. pombe
aggacattttgatcgccttcgaaaa

SEQ ID NO: 68500 - DNA, 25 bp, S. pombe
aggactttctaatccttcgctgaag

SEQ ID NO: 68501 - DNA, 25 bp, S. pombe
aggacctttatgtgcctgacttgag

SEQ ID NO: 68502 - DNA, 25 bp, S. pombe
aggcattatcctttgggctaaccgt

SEQ ID NO: 68503 - DNA, 25 bp, S. pombe
aaggaatgcattgcgggaaaccgaa

SEQ ID NO: 68504 - DNA, 25 bp, S. pombe
agggaaagccgttgccagttactgc

SEQ ID NO: 68505 - DNA, 25 bp, S. pombe
aggcagctgaactttttcctggcta

SEQ ID NO: 68506 - DNA, 25 bp, S. pombe
aggatactgttgagtccatcgccga

SEQ ID NO: 68507 - DNA, 25 bp, S. pombe
aggatttgatcatcgtccttcaacc

SEQ ID NO: 68508 - DNA, 25 bp, S. pombe
aggcttggtcaaggctcgatcacaa

SEQ ID NO: 68509 - DNA, 25 bp, S. pombe
aggttcgtacaactctcagggattt

SEQ ID NO: 68510 - DNA, 25 bp, S. pombe
aggtcatcgtcctagtcaagatcct

SEQ ID NO: 68511 - DNA, 25 bp, S. pombe
aggacatagcagttgttactcccta

SEQ ID NO: 68512 - DNA, 25 bp, S. pombe
aggaactgctccttcgtatgagata

SEQ ID NO: 68513 - DNA, 25 bp, S. pombe
aggaagcctactgaacccaattgtc

SEQ ID NO: 68514 - DNA, 25 bp, S. pombe
agtgtgagcctctgggaacccgtat

SEQ ID NO: 68515 - DNA, 25 bp, S. pombe
aggagacctttacaacatccgctat

SEQ ID NO: 68516 - DNA, 25 bp, S. pombe
aggagccctcttctaaatcaccgtt

SEQ ID NO: 68517 - DNA, 25 bp, S. pombe
aggacgatcatttgggctcttgtgt

SEQ ID NO: 68518 - DNA, 25 bp, S. pombe
aggacgacgtggatgcactcatgga

SEQ ID NO: 68519 - DNA, 25 bp, S. pombe
aggacagtcgtagcgcattgcatgc

SEQ ID NO: 68520 - DNA, 25 bp, S. pombe
aggaatgtatgttcccatcgcagct

SEQ ID NO: 68521 - DNA, 25 bp, S. pombe
aggcaagctattatgcagcatctga

SEQ ID NO: 68522 - DNA, 25 bp, S. pombe
aggcaacttttccacctgcaatgac

SEQ ID NO: 68523 - DNA, 25 bp, S. pombe
aggaaattcttcatgctgctgggat

SEQ ID NO: 68524 - DNA, 25 bp, S. pombe
aggaagtttgccatgctgcgaaagc

SEQ ID NO: 68525 - DNA, 25 bp, S. pombe
aggagatgcacgctacgctaacgaa

SEQ ID NO: 68526 - DNA, 25 bp, S. pombe
aggaatgctggaacccgtttactag

SEQ ID NO: 68527 - DNA, 25 bp, S. pombe
aggcaatgtgccatcccttttttga

SEQ ID NO: 68528 - DNA, 25 bp, S. pombe
aggcaaggatcagtctcagcatgtt

SEQ ID NO: 68529 - DNA, 25 bp, S. pombe
aggcacttgcatctctgagctatat

SEQ ID NO: 68530 - DNA, 25 bp, S. pombe
aggactcatccattcatgactgtta

SEQ ID NO: 68531 - DNA, 25 bp, S. pombe
aggactttcacttgcagatttctgt

SEQ ID NO: 68532 - DNA, 25 bp, S. pombe
aggaagctgtcgactttgttcgcaa

SEQ ID NO: 68533 - DNA, 25 bp, S. pombe
aggaatgcgtcaatgcttgctcttc

SEQ ID NO: 68534 - DNA, 25 bp, S. pombe
aggaatggtgatggcttctccttct

SEQ ID NO: 68535 - DNA, 25 bp, S. pombe
aggaatggcttctattgctgcgacc

SEQ ID NO: 68536 - DNA, 25 bp, S. pombe
aggaactcgtctatgcaggagccct

SEQ ID NO: 68537 - DNA, 25 bp, S. pombe
aggtattctttgactgggagctccc

SEQ ID NO: 68538 - DNA, 25 bp, S. pombe
aggtcaagctttcgaggccttcaac

SEQ ID NO: 68539 - DNA, 25 bp, S. pombe
aggaactagcggtcaactttctcca

SEQ ID NO: 68540 - DNA, 25 bp, S. pombe
aggatgaacggtcacggtttccacg

SEQ ID NO: 68541 - DNA, 25 bp, S. pombe
aggtacatcgggtggtctttactcg

SEQ ID NO: 68542 - DNA, 25 bp, S. pombe
agtgacatatccagtttccttcaac

SEQ ID NO: 68543 - DNA, 25 bp, S. pombe
agcgacttcaaggtcttcctttgaa

SEQ ID NO: 68544 - DNA, 25 bp, S. pombe
aggacttcagagtagcttcatgctt

SEQ ID NO: 68545 - DNA, 25 bp, S. pombe
aggactgtgagaacgctgctgcatg

SEQ ID NO: 68546 - DNA, 25 bp, S. pombe
aggacattggagacgatgatttttc

SEQ ID NO: 68547 - DNA, 25 bp, S. pombe
aggactctgggattggctcattttc

SEQ ID NO: 68548 - DNA, 25 bp, S. pombe
aggacttgaagctcgacttttgccg

SEQ ID NO: 68549 - DNA, 25 bp, S. pombe
aggacttgattgctccactttgctt

SEQ ID NO: 68550 - DNA, 25 bp, S. pombe
aggacattgtcttactcacgtcttt

SEQ ID NO: 68551 - DNA, 25 bp, S. pombe
aggattactctcaagccactttttt

SEQ ID NO: 68552 - DNA, 25 bp, S. pombe
aggatctttttccaaatgctgtaaa

SEQ ID NO: 68553 - DNA, 25 bp, S. pombe
aggactgtgacttcggtatctttaa

SEQ ID NO: 68554 - DNA, 25 bp, S. pombe
agcgtcgtgcaatcgaatacgtttc

SEQ ID NO: 68555 - DNA, 25 bp, S. pombe
aggacgtaaaagtacctgctgcttc

SEQ ID NO: 68556 - DNA, 25 bp, S. pombe
aggactccatcgttctctaatgtta

SEQ ID NO: 68557 - DNA, 25 bp, S. pombe
aggactgcactcgtttaccgaaaga

SEQ ID NO: 68558 - DNA, 25 bp, S. pombe
aggacgccatgtactctaaagacaa

SEQ ID NO: 68559 - DNA, 25 bp, S. pombe
aggacatgccttctatcttggaaaa

SEQ ID NO: 68560 - DNA, 25 bp, S. pombe
aggatgctcgaggtctttctggaga

SEQ ID NO: 68561 - DNA, 25 bp, S. pombe
aggttctttatctcattctggtact

SEQ ID NO: 68562 - DNA, 25 bp, S. pombe
aggtttactattccagtcttgtcgg

SEQ ID NO: 68563 - DNA, 25 bp, S. pombe
aggttgtgaaattgaagcctctgtg

SEQ ID NO: 68564 - DNA, 25 bp, S. pombe
aggtcgtcaatttcgtgcacttgta

SEQ ID NO: 68565 - DNA, 25 bp, S. pombe
agttgtgggtcgtgattacttgtac

SEQ ID NO: 68566 - DNA, 25 bp, S. pombe
agtgtttcgtcgtgctaacttaaat

SEQ ID NO: 68567 - DNA, 25 bp, S. pombe
aggattgtgcgccagatgccaattt

SEQ ID NO: 68568 - DNA, 25 bp, S. pombe
aggtgtgatcaccatgagcaagcat

SEQ ID NO: 68569 - DNA, 25 bp, S. pombe
aggaaagcgaactgctgtccctcaa

SEQ ID NO: 68570 - DNA, 25 bp, S. pombe
aggaaaagtacgcttccgctgctaa

SEQ ID NO: 68571 - DNA, 25 bp, S. pombe
aggtgccgaacgtcatgatttactt

SEQ ID NO: 68572 - DNA, 25 bp, S. pombe
aggagcctaccgaatgtcattccaa

SEQ ID NO: 68573 - DNA, 25 bp, S. pombe
aggtcgattggcttaccgagcagct

SEQ ID NO: 68574 - DNA, 25 bp, S. pombe
aggacaacccgccttatgagtctgt

SEQ ID NO: 68575 - DNA, 25 bp, S. pombe
aggaaaccctgcttctatgagtgtt

SEQ ID NO: 68576 - DNA, 25 bp, S. pombe
aggactacgacttttacattggtga

SEQ ID NO: 68577 - DNA, 25 bp, S. pombe
aggactcctccattttagctagcgg

SEQ ID NO: 68578 - DNA, 25 bp, S. pombe
aggatctttaccttctcagcaagtc

SEQ ID NO: 68579 - DNA, 25 bp, S. pombe
aggttcatgtttcttgctcgtacaa

SEQ ID NO: 68580 - DNA, 25 bp, S. pombe
aggtttttgaatcagccactcgtgc

SEQ ID NO: 68581 - DNA, 25 bp, S. pombe
aggtttttgagactgcagctcgtgc

SEQ ID NO: 68582 - DNA, 25 bp, S. pombe
aggtttggatgcgtacagctggtct

SEQ ID NO: 68583 - DNA, 25 bp, S. pombe
aggtgagattttgatcaggtgcaat

SEQ ID NO: 68584 - DNA, 25 bp, S. pombe
aggtgtgttgttgaatcttcccgtt

SEQ ID NO: 68585 - DNA, 25 bp, S. pombe
aggatgacacctattctttaccctc

SEQ ID NO: 68586 - DNA, 25 bp, S. pombe
aggaaaccattgttcgtgtcaccgg

SEQ ID NO: 68587 - DNA, 25 bp, S. pombe
aggacgcccttggtgttggatacaa

SEQ ID NO: 68588 - DNA, 25 bp, S. pombe
aggaccatccttctgaagcggcagc

SEQ ID NO: 68589 - DNA, 25 bp, S. pombe
aggagcctctttctgactggcaaaa

SEQ ID NO: 68590 - DNA, 25 bp, S. pombe
aggagacattttcgtgcctgatgaa

SEQ ID NO: 68591 - DNA, 25 bp, S. pombe
aggatacaagttctgcattgcaaat

SEQ ID NO: 68592 - DNA, 25 bp, S. pombe
aggaagctcaaggtcatctcgaaaa

SEQ ID NO: 68593 - DNA, 25 bp, S. pombe
aggagacttgaatgcttgtttgaaa

SEQ ID NO: 68594 - DNA, 25 bp, S. pombe
aggtgagtcgacaactcttcctcaa

SEQ ID NO: 68595 - DNA, 25 bp, S. pombe
aggagtacgtgcttcaatccttcgc

SEQ ID NO: 68596 - DNA, 25 bp, S. pombe
aggaagctgctgattatattatgta

SEQ ID NO: 68597 - DNA, 25 bp, S. pombe
aggattacagcttggacgtttatgg

SEQ ID NO: 68598 - DNA, 25 bp, S. pombe
aggattccgttgttgctgcttttgc

SEQ ID NO: 68599 - DNA, 25 bp, S. pombe
aggatgatgccggagatttctatct

SEQ ID NO: 68600 - DNA, 25 bp, S. pombe
aggttgcttcggatcactatctatc

SEQ ID NO: 68601 - DNA, 25 bp, S. pombe
agggcgcgtttttcaaatcttgttg

SEQ ID NO: 68602 - DNA, 25 bp, S. pombe
aggactgggtattttcaacttctgt

SEQ ID NO: 68603 - DNA, 25 bp, S. pombe
aggactgtggtttatggcaccttat

SEQ ID NO: 68604 - DNA, 25 bp, S. pombe
aggactttcctactggcactgtgtt

SEQ ID NO: 68605 - DNA, 25 bp, S. pombe
aggacatcctttagcggcgttctgt

SEQ ID NO: 68606 - DNA, 25 bp, S. pombe
aggttggccttgctgataagtatga

SEQ ID NO: 68607 - DNA, 25 bp, S. pombe
aggagtactgtttctctgtaccgtg

SEQ ID NO: 68608 - DNA, 25 bp, S. pombe
aggttatggtggtcttttgtctgtc

SEQ ID NO: 68609 - DNA, 25 bp, S. pombe
aggtgattatccagcacgcacaggc

SEQ ID NO: 68610 - DNA, 25 bp, S. pombe
agggcagtcatcgagacatcgccga

SEQ ID NO: 68611 - DNA, 25 bp, S. pombe
agggctatccgccatgtcagggaaa

SEQ ID NO: 68612 - DNA, 25 bp, S. pombe
aggatttcatgaacattgagccaac

SEQ ID NO: 68613 - DNA, 25 bp, S. pombe
aggaccagcagtatatcttatcaaa

SEQ ID NO: 68614 - DNA, 25 bp, S. pombe
aggaggaatgtcgtttgcttgcaaa

SEQ ID NO: 68615 - DNA, 25 bp, S. pombe
aggacaaggccatcaagcgctggaa

SEQ ID NO: 68616 - DNA, 25 bp, S. pombe
agagactttggataaaatgacctga

SEQ ID NO: 68617 - DNA, 25 bp, S. pombe
aggtgtcattcgttccgttggtata

SEQ ID NO: 68618 - DNA, 25 bp, S. pombe
aggagtttggccttttagctcagaa

SEQ ID NO: 68619 - DNA, 25 bp, S. pombe
aggacttcctcctttttatgatgaa

SEQ ID NO: 68620 - DNA, 25 bp, S. pombe
aggattgtctcctaatttgttgaag

SEQ ID NO: 68621 - DNA, 25 bp, S. pombe
aggactaattcatctgccagttcta

SEQ ID NO: 68622 - DNA, 25 bp, S. pombe
agtgggatatcctgtgccgggctat

SEQ ID NO: 68623 - DNA, 25 bp, S. pombe
aggaggattcccgtggctgcttctt

SEQ ID NO: 68624 - DNA, 25 bp, S. pombe
aggaggatcttatcggtcacctctt

SEQ ID NO: 68625 - DNA, 25 bp, S. pombe
aggatcgtcttaccaggaagcctcc

SEQ ID NO: 68626 - DNA, 25 bp, S. pombe
aggtcggtgattccatgcttcaaga

SEQ ID NO: 68627 - DNA, 25 bp, S. pombe
agtgttgttcactggcttcagatta

SEQ ID NO: 68628 - DNA, 25 bp, S. pombe
aggttgttcgcatgagcggtcattt

SEQ ID NO: 68629 - DNA, 25 bp, S. pombe
aggattgctgctcagtacgtctgga

SEQ ID NO: 68630 - DNA, 25 bp, S. pombe
aggagctgctagtttcacgttggta

SEQ ID NO: 68631 - DNA, 25 bp, S. pombe
aggacgtgactcattcgttgcagct

SEQ ID NO: 68632 - DNA, 25 bp, S. pombe
aggacgcgatctcgattcggacgaa

SEQ ID NO: 68633 - DNA, 25 bp, S. pombe
aggagagttcctttacagtacacat

SEQ ID NO: 68634 - DNA, 25 bp, S. pombe
aggacatactccaaaaggtctgttg

SEQ ID NO: 68635 - DNA, 25 bp, S. pombe
aggagactgccgatcctttttgctg

SEQ ID NO: 68636 - DNA, 25 bp, S. pombe
aggagtcgtcgtatctactttctat

SEQ ID NO: 68637 - DNA, 25 bp, S. pombe
aggaccgtctgtttttatcgcttat

SEQ ID NO: 68638 - DNA, 25 bp, S. pombe
aggatcccgctgttttagaacttgt

SEQ ID NO: 68639 - DNA, 25 bp, S. pombe
aggtcctcaggacttttactctagt

SEQ ID NO: 68640 - DNA, 25 bp, S. pombe
aggagagagcgctcttcttccggag

SEQ ID NO: 68641 - DNA, 25 bp, S. pombe
aggaggagcgttctctcatcggcta

SEQ ID NO: 68642 - DNA, 25 bp, S. pombe
aggagtatgttcgaagcttgccaaa

SEQ ID NO: 68643 - DNA, 25 bp, S. pombe
aggatgcgcttcaacatgcttggtt

SEQ ID NO: 68644 - DNA, 25 bp, S. pombe
aggatccatgctttagagtctcaga

SEQ ID NO: 68645 - DNA, 25 bp, S. pombe
aggtctacgtagtgatgcagctgta

SEQ ID NO: 68646 - DNA, 25 bp, S. pombe
agggcacgagcattctgcaaacgaa

SEQ ID NO: 68647 - DNA, 25 bp, S. pombe
aggacgatttgctcgtattctatac

SEQ ID NO: 68648 - DNA, 25 bp, S. pombe
aggtggtttccgtggcagattctaa

SEQ ID NO: 68649 - DNA, 25 bp, S. pombe
aggatgcatctgaaaccggaggttc

SEQ ID NO: 68650 - DNA, 25 bp, S. pombe
aggactctgatatccctgatttaca

SEQ ID NO: 68651 - DNA, 25 bp, S. pombe
aggagcacgcattccgcaaggttaa

SEQ ID NO: 68652 - DNA, 25 bp, S. pombe
aggtatgctcgctttggctgatgaa

SEQ ID NO: 68653 - DNA, 25 bp, S. pombe
aggtatgctggctcgcggacattat

SEQ ID NO: 68654 - DNA, 25 bp, S. pombe
aggttgctggattcgctccctatga

SEQ ID NO: 68655 - DNA, 25 bp, S. pombe
aggattgccagatgctgcgacccaa

SEQ ID NO: 68656 - DNA, 25 bp, S. pombe
aggtcgagttttatgccgcattggc

SEQ ID NO: 68657 - DNA, 25 bp, S. pombe
agggaggcgtgtttaactctgtgaa

SEQ ID NO: 68658 - DNA, 25 bp, S. pombe
aggtgcacttgcctatggttaccat

SEQ ID NO: 68659 - DNA, 25 bp, S. pombe
agggacgttgcatattcctgatatt

SEQ ID NO: 68660 - DNA, 25 bp, S. pombe
agaggactgggatttcacgcgttgt

SEQ ID NO: 68661 - DNA, 25 bp, S. pombe
aggtcatagttcatctactcgtcgt

SEQ ID NO: 68662 - DNA, 25 bp, S. pombe
aggtatcccagccaattcagatttg

SEQ ID NO: 68663 - DNA, 25 bp, S. pombe
aggtgttgcctggagtcgtaattca

SEQ ID NO: 68664 - DNA, 25 bp, S. pombe
aggatttgcctggagctctttcacc

SEQ ID NO: 68665 - DNA, 25 bp, S. pombe
aggttctccatttctgttccagtct

SEQ ID NO: 68666 - DNA, 25 bp, S. pombe
aggagatcacgcatttgtgcccatg

SEQ ID NO: 68667 - DNA, 25 bp, S. pombe
aggtttaggcgtctgtgttgctata

SEQ ID NO: 68668 - DNA, 25 bp, S. pombe
aggatgttgacgctcgtgttgccta

SEQ ID NO: 68669 - DNA, 25 bp, S. pombe
aggataaacttgacttctctgtgaa

SEQ ID NO: 68670 - DNA, 25 bp, S. pombe
aggatgatccttattgtttctgcaa

SEQ ID NO: 68671 - DNA, 25 bp, S. pombe
aggataccttcatcattttgcgtgg

SEQ ID NO: 68672 - DNA, 25 bp, S. pombe
aggatacattacttttttgccagag

SEQ ID NO: 68673 - DNA, 25 bp, S. pombe
agggcttagactttgatcccaataa

SEQ ID NO: 68674 - DNA, 25 bp, S. pombe
aggagattcatgttgtcgtcgccaa

SEQ ID NO: 68675 - DNA, 25 bp, S. pombe
aggagctagcggtctctatgtcaaa

SEQ ID NO: 68676 - DNA, 25 bp, S. pombe
aggtctgaaagcctctagtcaagaa

SEQ ID NO: 68677 - DNA, 25 bp, S. pombe
aggtgctcaacttttgttacgcgtt

SEQ ID NO: 68678 - DNA, 25 bp, S. pombe
aggagccaatctttcgtcaggccaa

SEQ ID NO: 68679 - DNA, 25 bp, S. pombe
aggattcagaagcttttcgccgtcg

SEQ ID NO: 68680 - DNA, 25 bp, S. pombe
aggatttgatcgctaaacccatgcc

SEQ ID NO: 68681 - DNA, 25 bp, S. pombe
aggtttttgtacgatactccgatat

SEQ ID NO: 68682 - DNA, 25 bp, S. pombe
aggttttacctctgttgctgcatgg

SEQ ID NO: 68683 - DNA, 25 bp, S. pombe
aggttgctctaaaactctagctggt

SEQ ID NO: 68684 - DNA, 25 bp, S. pombe
aggtgctttgaatcctgacccagaa

SEQ ID NO: 68685 - DNA, 25 bp, S. pombe
aggtttttgttgatcggtctccaga

SEQ ID NO: 68686 - DNA, 25 bp, S. pombe
aggtttttatctgtcgagatgccaa

SEQ ID NO: 68687 - DNA, 25 bp, S. pombe
aggatctttttacctccagagcaaa

SEQ ID NO: 68688 - DNA, 25 bp, S. pombe
aggagcttctttactactcacgcaa

SEQ ID NO: 68689 - DNA, 25 bp, S. pombe
aggagcttcctcatttaactagata

SEQ ID NO: 68690 - DNA, 25 bp, S. pombe
aggagatacttccttcgcagcacga

SEQ ID NO: 68691 - DNA, 25 bp, S. pombe
agggaagccgtccatcgagtatgct

SEQ ID NO: 68692 - DNA, 25 bp, S. pombe
agggaactccggaaattcctgctga

SEQ ID NO: 68693 - DNA, 25 bp, S. pombe
aggtgtttccgctaaattcttctga

SEQ ID NO: 68694 - DNA, 25 bp, S. pombe
aggtggttcgagcaattcctcttga

SEQ ID NO: 68695 - DNA, 25 bp, S. pombe
agtgcggttcgacaaagcgctaaac

SEQ ID NO: 68696 - DNA, 25 bp, S. pombe
aggaggatccagttcgaaccaaaag

SEQ ID NO: 68697 - DNA, 25 bp, S. pombe
aggatgctgatactcttcgtaccat

SEQ ID NO: 68698 - DNA, 25 bp, S. pombe
aggtttcctaccttactgatgagcc

SEQ ID NO: 68699 - DNA, 25 bp, S. pombe
aggagttttaccaatctcgcgctga

SEQ ID NO: 68700 - DNA, 25 bp, S. pombe
agggtttgtctcatcttactagtcg

SEQ ID NO: 68701 - DNA, 25 bp, S. pombe
aggtgcttcttctatccaaactttg

SEQ ID NO: 68702 - DNA, 25 bp, S. pombe
agggcttcctcgtatacgactttag

SEQ ID NO: 68703 - DNA, 25 bp, S. pombe
aggtccatgcaatcgtcttcattag

SEQ ID NO: 68704 - DNA, 25 bp, S. pombe
aggatatcggcattctgacattcat

SEQ ID NO: 68705 - DNA, 25 bp, S. pombe
aggagtttaatcctccagtcggaga

SEQ ID NO: 68706 - DNA, 25 bp, S. pombe
agggtaaaagctcatcgtccgataa

SEQ ID NO: 68707 - DNA, 25 bp, S. pombe
agggatctacctcttataccatttc

SEQ ID NO: 68708 - DNA, 25 bp, S. pombe
aggtacttcctgatgttccaattta

SEQ ID NO: 68709 - DNA, 25 bp, S. pombe
aggtggagccacgttagcagccgac

SEQ ID NO: 68710 - DNA, 25 bp, S. pombe
aggtcgtgtttacagctgccagaca

SEQ ID NO: 68711 - DNA, 25 bp, S. pombe
aggtctttactactggccattagca

SEQ ID NO: 68712 - DNA, 25 bp, S. pombe
aggatcttttccatatctcacttgt

SEQ ID NO: 68713 - DNA, 25 bp, S. pombe
aggtgcgatccgcaattgttcttgc

SEQ ID NO: 68714 - DNA, 25 bp, S. pombe
aggagtctacccttcatttagttct

SEQ ID NO: 68715 - DNA, 25 bp, S. pombe
aggagtctactctacatcttgttct

SEQ ID NO: 68716 - DNA, 25 bp, S. pombe
agttaaagcctcatcgggtaccaag

SEQ ID NO: 68717 - DNA, 25 bp, S. pombe
agttaagtcactctcagcagctgtt

SEQ ID NO: 68718 - DNA, 25 bp, S. pombe
agggtctacgcggaatctgcaattc

SEQ ID NO: 68719 - DNA, 25 bp, S. pombe
agggttgactcccaaattgttgaca

SEQ ID NO: 68720 - DNA, 25 bp, S. pombe
aggttagatgctgtttctccgtatc

SEQ ID NO: 68721 - DNA, 25 bp, S. pombe
aggtaattgctacttgttcgcctca

SEQ ID NO: 68722 - DNA, 25 bp, S. pombe
aggttcatcgcaaaacatttcccca

SEQ ID NO: 68723 - DNA, 25 bp, S. pombe
aggtttggccattacattttctagt

SEQ ID NO: 68724 - DNA, 25 bp, S. pombe
aggttggcgctttaatcttattgaa

SEQ ID NO: 68725 - DNA, 25 bp, S. pombe
aggtttcctctgtaatcaactacaa

SEQ ID NO: 68726 - DNA, 25 bp, S. pombe
aggtattaccgagtgcttagctaaa

SEQ ID NO: 68727 - DNA, 25 bp, S. pombe
aggtcttcatgcacccattggtaaa

SEQ ID NO: 68728 - DNA, 25 bp, S. pombe
aggttgctacgattacatctcttgc

SEQ ID NO: 68729 - DNA, 25 bp, S. pombe
aggaggctacgcatccactggacgt

SEQ ID NO: 68730 - DNA, 25 bp, S. pombe
aggatgggcctcacattttgtcaat

SEQ ID NO: 68731 - DNA, 25 bp, S. pombe
aggatgggactgatgcttttgcaaa

SEQ ID NO: 68732 - DNA, 25 bp, S. pombe
aggtcatcaacgacaccttcggtat

SEQ ID NO: 68733 - DNA, 25 bp, S. pombe
aggtaatcctgttgcttgccgtgta

SEQ ID NO: 68734 - DNA, 25 bp, S. pombe
aggtattttccctactggattctct

SEQ ID NO: 68735 - DNA, 25 bp, S. pombe
aggtataaccccagctgtagctgct

SEQ ID NO: 68736 - DNA, 25 bp, S. pombe
aggatgcttattgtcgctggtaccg

SEQ ID NO: 68737 - DNA, 25 bp, S. pombe
aggttgtaacttggctggtcagctc

SEQ ID NO: 68738 - DNA, 25 bp, S. pombe
aggtacgtcacattggtctttccaa

SEQ ID NO: 68739 - DNA, 25 bp, S. pombe
aggtccgtctgcaggttctgtcgaa

SEQ ID NO: 68740 - DNA, 25 bp, S. pombe
aggtccttgagcagtccttgtcaga

SEQ ID NO: 68741 - DNA, 25 bp, S. pombe
aggtctttcagatgtctcagtgcca

SEQ ID NO: 68742 - DNA, 25 bp, S. pombe
aggttatccgtgctgtcattgaaat

SEQ ID NO: 68743 - DNA, 25 bp, S. pombe
aggttcgcaacgtttctaatgatga

SEQ ID NO: 68744 - DNA, 25 bp, S. pombe
aggtatagcaaatgcgattggaggt

SEQ ID NO: 68745 - DNA, 25 bp, S. pombe
aggatattcaagctccccatggtat

SEQ ID NO: 68746 - DNA, 25 bp, S. pombe
aggattccaagttcatgccgcggta

SEQ ID NO: 68747 - DNA, 25 bp, S. pombe
aggttcgcctgtgagcactcagcat

SEQ ID NO: 68748 - DNA, 25 bp, S. pombe
aggttgagatgaatcctcgccgatt

SEQ ID NO: 68749 - DNA, 25 bp, S. pombe
aggatatggtgccattctctgccat

SEQ ID NO: 68750 - DNA, 25 bp, S. pombe
aggtcattgctgacactttcgaagc

SEQ ID NO: 68751 - DNA, 25 bp, S. pombe
aggttactgctcgtgtcatcaaggc

SEQ ID NO: 68752 - DNA, 25 bp, S. pombe
aggtcctaacttgacgacgctagaa

SEQ ID NO: 68753 - DNA, 25 bp, S. pombe
agtgacctttttgcctcaactagaa

SEQ ID NO: 68754 - DNA, 25 bp, S. pombe
agtaccgtttatcgcaccaagctgg

SEQ ID NO: 68755 - DNA, 25 bp, S. pombe
caggtccgttcgttccacaaacaga

SEQ ID NO: 68756 - DNA, 25 bp, S. pombe
agggcggttatcctcaacaaccata

SEQ ID NO: 68757 - DNA, 25 bp, S. pombe
agggttcgttcaattgctcatcagt

SEQ ID NO: 68758 - DNA, 25 bp, S. pombe
aggttctgctgactccacaattaga

SEQ ID NO: 68759 - DNA, 25 bp, S. pombe
aggtcttgtcagttcgctttatgta

SEQ ID NO: 68760 - DNA, 25 bp, S. pombe
aggtttgacgctatgtacaatgaga

SEQ ID NO: 68761 - DNA, 25 bp, S. pombe
aggtttcccttgctgacttgcaaaa

SEQ ID NO: 68762 - DNA, 25 bp, S. pombe
aggatttccaccttggcagcttaga

SEQ ID NO: 68763 - DNA, 25 bp, S. pombe
aggttggccctcttgatgcactttt

SEQ ID NO: 68764 - DNA, 25 bp, S. pombe
aggataagcctttttctcatatatt

SEQ ID NO: 68765 - DNA, 25 bp, S. pombe
aggttacccttattgcagcagtcat

SEQ ID NO: 68766 - DNA, 25 bp, S. pombe
agtgattcaactcttacggctaaac

SEQ ID NO: 68767 - DNA, 25 bp, S. pombe
aggttcctgctgtttttcttcaaga

SEQ ID NO: 68768 - DNA, 25 bp, S. pombe
aggtgtcactgctgggcttctaaaa

SEQ ID NO: 68769 - DNA, 25 bp, S. pombe
aggtccatctgagcttgttgttaac

SEQ ID NO: 68770 - DNA, 25 bp, S. pombe
aggtgctggcgaacctttgggaatt

SEQ ID NO: 68771 - DNA, 25 bp, S. pombe
agtgtaggtcctgctttggaaccat

SEQ ID NO: 68772 - DNA, 25 bp, S. pombe
aggtattacagagcgccttgctgac

SEQ ID NO: 68773 - DNA, 25 bp, S. pombe
aggtattccagaagccatttccaca

SEQ ID NO: 68774 - DNA, 25 bp, S. pombe
aggtttccacatgcgtattctagtt

SEQ ID NO: 68775 - DNA, 25 bp, S. pombe
aggtttagctctcgcaggtgttact

SEQ ID NO: 68776 - DNA, 25 bp, S. pombe
aggtctgtgcactccatttatttat

SEQ ID NO: 68777 - DNA, 25 bp, S. pombe
aggttctctctccattaacgttgaa

SEQ ID NO: 68778 - DNA, 25 bp, S. pombe
aggtctccttctatatcatcacaag

SEQ ID NO: 68779 - DNA, 25 bp, S. pombe
aggtcagcagacctcttttgacaaa

SEQ ID NO: 68780 - DNA, 25 bp, S. pombe
agggtgcagtgcttcgtttgacaga

SEQ ID NO: 68781 - DNA, 25 bp, S. pombe
aggtcgcagatgaactctcggaaac

SEQ ID NO: 68782 - DNA, 25 bp, S. pombe
aggtgttcaacgacccgctgtttcg

SEQ ID NO: 68783 - DNA, 25 bp, S. pombe
aggttatccttgttgatccctctca

SEQ ID NO: 68784 - DNA, 25 bp, S. pombe
agagtcgtacttttggacacttcaa

SEQ ID NO: 68785 - DNA, 25 bp, S. pombe
aggtcgcatatgtttatctacgtta

SEQ ID NO: 68786 - DNA, 25 bp, S. pombe
aggttgtttcgcatttatgctcata

SEQ ID NO: 68787 - DNA, 25 bp, S. pombe
aggtcatttctcgacggtattccca

SEQ ID NO: 68788 - DNA, 25 bp, S. pombe
aggtcaattggtggcgattcttccc

SEQ ID NO: 68789 - DNA, 25 bp, S. pombe
aggtcgagtaaagccacacgtgtat

SEQ ID NO: 68790 - DNA, 25 bp, S. pombe
aaaggtgatagatcgtcggcgacgc

SEQ ID NO: 68791 - DNA, 25 bp, S. pombe
agggctctgaccgactggttgagtc

SEQ ID NO: 68792 - DNA, 25 bp, S. pombe
aggtctcgctctggacatactttaa

SEQ ID NO: 68793 - DNA, 25 bp, S. pombe
aggttcaattgtcatcctctcatga

SEQ ID NO: 68794 - DNA, 25 bp, S. pombe
aggttgcccttcaagctgctattaa

SEQ ID NO: 68795 - DNA, 25 bp, S. pombe
aggtgtacgccctgcacaaatttgg

SEQ ID NO: 68796 - DNA, 25 bp, S. pombe
agggctccaaccttgaagcaattac

SEQ ID NO: 68797 - DNA, 25 bp, S. pombe
aggtccggctctagttcaagttcaa

SEQ ID NO: 68798 - DNA, 25 bp, S. pombe
agggctttgcctatatacagtttaa

SEQ ID NO: 68799 - DNA, 25 bp, S. pombe
agggcatttggtgtttcgtgattac

SEQ ID NO: 68800 - DNA, 25 bp, S. pombe
aggtgatttgttgctttcggctgat

SEQ ID NO: 68801 - DNA, 25 bp, S. pombe
agggtgtccgtgactatgtcttgaa

SEQ ID NO: 68802 - DNA, 25 bp, S. pombe
aggtgatggcacaccccaaagtcgt

SEQ ID NO: 68803 - DNA, 25 bp, S. pombe
aggtgtacgacttcttccataatgc

SEQ ID NO: 68804 - DNA, 25 bp, S. pombe
agggatggcgcattattcccaacct

SEQ ID NO: 68805 - DNA, 25 bp, S. pombe
agggtgctgcctttattccaattta

SEQ ID NO: 68806 - DNA, 25 bp, S. pombe
aggtgcctctgttatttgtttttgt

SEQ ID NO: 68807 - DNA, 25 bp, S. pombe
aggtgcgtcttttgtttctttcgat

SEQ ID NO: 68808 - DNA, 25 bp, S. pombe
aggtcgtgttggttcaagttgccgt

SEQ ID NO: 68809 - DNA, 25 bp, S. pombe
aggtcaatactctcgatatgcgttc

SEQ ID NO: 68810 - DNA, 25 bp, S. pombe
aggtagctcaagtgtatctgcaaaa

SEQ ID NO: 68811 - DNA, 25 bp, S. pombe
aggtagcccgacattctgcagagaa

SEQ ID NO: 68812 - DNA, 25 bp, S. pombe
agttggacggaactgctaggcccta

SEQ ID NO: 68813 - DNA, 25 bp, S. pombe
agtctggccgagtttttggcaacat

SEQ ID NO: 68814 - DNA, 25 bp, S. pombe
agggatcgtgcctttgcatatcagc

SEQ ID NO: 68815 - DNA, 25 bp, S. pombe
agggtcttgtaattcttgctggtga

SEQ ID NO: 68816 - DNA, 25 bp, S. pombe
aggtatcgccatttcatcgactgaa

SEQ ID NO: 68817 - DNA, 25 bp, S. pombe
aggtttggcaacatcgcctttgcaa

SEQ ID NO: 68818 - DNA, 25 bp, S. pombe
agcggttcctaagcaatccttacaa

SEQ ID NO: 68819 - DNA, 25 bp, S. pombe
aggtgttgcctatcgtattttctaa

SEQ ID NO: 68820 - DNA, 25 bp, S. pombe
agggattcctaactcatcattctcc

SEQ ID NO: 68821 - DNA, 25 bp, S. pombe
agggtcgtttgctcatcaatgattc

SEQ ID NO: 68822 - DNA, 25 bp, S. pombe
agggcgacctatctggacttatttt

SEQ ID NO: 68823 - DNA, 25 bp, S. pombe
agggccagacctcgttgacacaagg

SEQ ID NO: 68824 - DNA, 25 bp, S. pombe
aggtctccgtattttctcatttgat

SEQ ID NO: 68825 - DNA, 25 bp, S. pombe
aggtcgcggtgttttcagaattctc

SEQ ID NO: 68826 - DNA, 25 bp, S. pombe
agtggaacactcgatctcaaaagga

SEQ ID NO: 68827 - DNA, 25 bp, S. pombe
agtgccaacacatcattcatacatc

SEQ ID NO: 68828 - DNA, 25 bp, S. pombe
aggtccgattacttcaagcactctt

SEQ ID NO: 68829 - DNA, 25 bp, S. pombe
aggtcaagattgttgctcctcctga

SEQ ID NO: 68830 - DNA, 25 bp, S. pombe
aggtgaagaccatcctctatttgct

SEQ ID NO: 68831 - DNA, 25 bp, S. pombe
agtgcatacggcttctttgtttcat

SEQ ID NO: 68832 - DNA, 25 bp, S. pombe
agtggtacaaacatgtcgtccccgg

SEQ ID NO: 68833 - DNA, 25 bp, S. pombe
agtgaagaacccatgatcgtcgtcc

SEQ ID NO: 68834 - DNA, 25 bp, S. pombe
agggcaaactctttgctctatcgtc

SEQ ID NO: 68835 - DNA, 25 bp, S. pombe
aggtatcttttctggcactctgtct

SEQ ID NO: 68836 - DNA, 25 bp, S. pombe
aggtcgtgccattgagagatctcca

SEQ ID NO: 68837 - DNA, 25 bp, S. pombe
aggtcattcttctaagttctcagga

SEQ ID NO: 68838 - DNA, 25 bp, S. pombe
aggtatgcctgacttgagttctctt

SEQ ID NO: 68839 - DNA, 25 bp, S. pombe
aggtatcttcaacggagtctgcagt

SEQ ID NO: 68840 - DNA, 25 bp, S. pombe
aggtcttaggcatgagtctctcagt

SEQ ID NO: 68841 - DNA, 25 bp, S. pombe
agagcatgctggtttgaatcgtcaa

SEQ ID NO: 68842 - DNA, 25 bp, S. pombe
agtccgaccctgaaatcacacagtt

SEQ ID NO: 68843 - DNA, 25 bp, S. pombe
acttaggtattctcgtgggtgcctt

SEQ ID NO: 68844 - DNA, 25 bp, S. pombe
agttgaaattttccaccggtgcagc

SEQ ID NO: 68845 - DNA, 25 bp, S. pombe
agttaatccgttcaccgagtctgca

SEQ ID NO: 68846 - DNA, 25 bp, S. pombe
agttccttccttcatttattcgact

SEQ ID NO: 68847 - DNA, 25 bp, S. pombe
aggtccttccttgctcttatttatg

SEQ ID NO: 68848 - DNA, 25 bp, S. pombe
aggtgccttacgaacttactattgt

SEQ ID NO: 68849 - DNA, 25 bp, S. pombe
agcgaaattccttggtccgcaaatc

SEQ ID NO: 68850 - DNA, 25 bp, S. pombe
agtgggacgtgtgtctttccaacat

SEQ ID NO: 68851 - DNA, 25 bp, S. pombe
agtggtgttccctctgtaaaatcag

SEQ ID NO: 68852 - DNA, 25 bp, S. pombe
agtgagtcttcagcgggtacaacaa

SEQ ID NO: 68853 - DNA, 25 bp, S. pombe
agtgattccactttggctgctagca

SEQ ID NO: 68854 - DNA, 25 bp, S. pombe
agtggagtccatacccatatgacaa

SEQ ID NO: 68855 - DNA, 25 bp, S. pombe
aggtcatgccaaaggattccgtgtt

SEQ ID NO: 68856 - DNA, 25 bp, S. pombe
aggtcacccatttcagggcgtgtta

SEQ ID NO: 68857 - DNA, 25 bp, S. pombe
agaggcaaaagtccctacattcttt

SEQ ID NO: 68858 - DNA, 25 bp, S. pombe
aggtaccaactttgccaactgctat

SEQ ID NO: 68859 - DNA, 25 bp, S. pombe
aggtactgttctttggagggattgt

SEQ ID NO: 68860 - DNA, 25 bp, S. pombe
aggtccttctctgttggaggattac

SEQ ID NO: 68861 - DNA, 25 bp, S. pombe
agaccactgaagatctcgggcattc

SEQ ID NO: 68862 - DNA, 25 bp, S. pombe
aggtgatccatcttatattcgttct

SEQ ID NO: 68863 - DNA, 25 bp, S. pombe
agtgattctgacttgcgcgaagcta

SEQ ID NO: 68864 - DNA, 25 bp, S. pombe
agtgtacatccttgcaaacatgcta

SEQ ID NO: 68865 - DNA, 25 bp, S. pombe
aggtcagatcgttcaacaagtttca

SEQ ID NO: 68866 - DNA, 25 bp, S. pombe
ctggtcgacgtagaaaggctgcatt

SEQ ID NO: 68867 - DNA, 25 bp, S. pombe
agggatttgagaatcctccccatcg

SEQ ID NO: 68868 - DNA, 25 bp, S. pombe
aggtgtattgagttctactgccgct

SEQ ID NO: 68869 - DNA, 25 bp, S. pombe
agtgtctacaacttataccctcgtt

SEQ ID NO: 68870 - DNA, 25 bp, S. pombe
aggtgatacaccttcaaaacttgtt

SEQ ID NO: 68871 - DNA, 25 bp, S. pombe
taggcgaccaccacgttatcgaggt

SEQ ID NO: 68872 - DNA, 25 bp, S. pombe
agggaatcactcaattcttaccaaa

SEQ ID NO: 68873 - DNA, 25 bp, S. pombe
gagacggcggctcttttaagtttag

SEQ ID NO: 68874 - DNA, 25 bp, S. pombe
tagttgggacaccatttctacgggt

SEQ ID NO: 68875 - DNA, 25 bp, S. pombe
agggaatctacaggcgttttcgcgt

SEQ ID NO: 68876 - DNA, 25 bp, S. pombe
agggacatctccttggacgtttggc

SEQ ID NO: 68877 - DNA, 25 bp, S. pombe
accaaaatcggtctgctcttatatc

SEQ ID NO: 68878 - DNA, 25 bp, S. pombe
agtccaagatcagggatttctaata

SEQ ID NO: 68879 - DNA, 25 bp, S. pombe
aggtgccaaacctgattttcacaga

SEQ ID NO: 68880 - DNA, 25 bp, S. pombe
aggtgataaacctctttccatcgac

SEQ ID NO: 68881 - DNA, 25 bp, S. pombe
agtcgctaaacttctccgtaatggt

SEQ ID NO: 68882 - DNA, 25 bp, S. pombe
agggtcatcagaggtcggcgtcaca

SEQ ID NO: 68883 - DNA, 25 bp, S. pombe
agggctataataatccaccatcaag

SEQ ID NO: 68884 - DNA, 25 bp, S. pombe
catggtctaagtatcaaggcacgaa

SEQ ID NO: 68885 - DNA, 25 bp, S. pombe
aggtgctagattatcttgagccgaa

SEQ ID NO: 68886 - DNA, 25 bp, S. pombe
agggttatcctttgggcaattctcg

SEQ ID NO: 68887 - DNA, 25 bp, S. pombe
aggtgttccctttcgtgaaactcat

SEQ ID NO: 68888 - DNA, 25 bp, S. pombe
aggtgtatgcacttgtacggagata

SEQ ID NO: 68889 - DNA, 25 bp, S. pombe
agtgtcttatttattggcccgccaa

SEQ ID NO: 68890 - DNA, 25 bp, S. pombe
agtgtattacctgacgttccttatc

SEQ ID NO: 68891 - DNA, 25 bp, S. pombe
agtgtttacttctacgtttgctcaa

SEQ ID NO: 68892 - DNA, 25 bp, S. pombe
agggattcatttccagcctttagaa

SEQ ID NO: 68893 - DNA, 25 bp, S. pombe
agggattattgttcacctatcaaac

SEQ ID NO: 68894 - DNA, 25 bp, S. pombe
aggtgctccagtgcaaccacaaaaa

SEQ ID NO: 68895 - DNA, 25 bp, S. pombe
agggccgttaactcctatgaccaag

SEQ ID NO: 68896 - DNA, 25 bp, S. pombe
agggttttacctatattgacgcaag

SEQ ID NO: 68897 - DNA, 25 bp, S. pombe
agtgtagactaccaaccgacgaggc

SEQ ID NO: 68898 - DNA, 25 bp, S. pombe
agggaatactactttgcaccaatgt

SEQ ID NO: 68899 - DNA, 25 bp, S. pombe
agggacttagattttgaccacattc

SEQ ID NO: 68900 - DNA, 25 bp, S. pombe
agggtatgctttttctcaaggtgaa

SEQ ID NO: 68901 - DNA, 25 bp, S. pombe
aggtccacccgatcaagtcattgaa

SEQ ID NO: 68902 - DNA, 25 bp, S. pombe
actcccaaaggccaatcgattatcg

SEQ ID NO: 68903 - DNA, 25 bp, S. pombe
agacccaaggccatatcgttacgat

SEQ ID NO: 68904 - DNA, 25 bp, S. pombe
agtggaaaaacacgcctcttgcttt

SEQ ID NO: 68905 - DNA, 25 bp, S. pombe
agtcgaaaaccagtacccatgattt

SEQ ID NO: 68906 - DNA, 25 bp, S. pombe
agtgctatactacctttaccaattt

SEQ ID NO: 68907 - DNA, 25 bp, S. pombe
agtgttcccgtcatgaagcccttaa

SEQ ID NO: 68908 - DNA, 25 bp, S. pombe
agtggttccagtcatcaaccgttta

SEQ ID NO: 68909 - DNA, 25 bp, S. pombe
aggtgcgtttgatagacgctcaggc

SEQ ID NO: 68910 - DNA, 25 bp, S. pombe
aggtcccatctggaattcccttaat

SEQ ID NO: 68911 - DNA, 25 bp, S. pombe
agggctctgaccatattgtcgttac

SEQ ID NO: 68912 - DNA, 25 bp, S. pombe
agggtgtaccaccatgggctatgtc

SEQ ID NO: 68913 - DNA, 25 bp, S. pombe
actagcgatattgcttcggcggaac

SEQ ID NO: 68914 - DNA, 25 bp, S. pombe
agtgctaacaccattcgtcgtgcag

SEQ ID NO: 68915 - DNA, 25 bp, S. pombe
agtgtaaaccttcctgactatgttg

SEQ ID NO: 68916 - DNA, 25 bp, S. pombe
aggtgaggttcttgagcgtatcttc

SEQ ID NO: 68917 - DNA, 25 bp, S. pombe
agggttgatccattccctcaaatta

SEQ ID NO: 68918 - DNA, 25 bp, S. pombe
agggcaatcgcacttcacgctatat

SEQ ID NO: 68919 - DNA, 25 bp, S. pombe
agggatctcgcacttgattctgaca

SEQ ID NO: 68920 - DNA, 25 bp, S. pombe
agggattcactcaatctcctggaag

SEQ ID NO: 68921 - DNA, 25 bp, S. pombe
aggtgatctaataagccgcgctgaa

SEQ ID NO: 68922 - DNA, 25 bp, S. pombe
aggtgattttcaaactgctgctagt

SEQ ID NO: 68923 - DNA, 25 bp, S. pombe
agggcttattttactgcatgtggat

SEQ ID NO: 68924 - DNA, 25 bp, S. pombe
aggtgccgagtttgtctcatttgac

SEQ ID NO: 68925 - DNA, 25 bp, S. pombe
aggtgcccatattagcttcattgct

SEQ ID NO: 68926 - DNA, 25 bp, S. pombe
agtgacggcagttgatgcttctcca

SEQ ID NO: 68927 - DNA, 25 bp, S. pombe
aggtgtgctactttctcgattgcaa

SEQ ID NO: 68928 - DNA, 25 bp, S. pombe
aggtgtgtacgcttctcaatataga

SEQ ID NO: 68929 - DNA, 25 bp, S. pombe
agggtgaatcgctcttacgagacta

SEQ ID NO: 68930 - DNA, 25 bp, S. pombe
aggtgctgtaaaagctcctcgcatc

SEQ ID NO: 68931 - DNA, 25 bp, S. pombe
agtgtctccaatacttcaagtgctg

SEQ ID NO: 68932 - DNA, 25 bp, S. pombe
agtgcacttgaaggctccaacgctg

SEQ ID NO: 68933 - DNA, 25 bp, S. pombe
agtgattccgttggcaatgctgtga

SEQ ID NO: 68934 - DNA, 25 bp, S. pombe
agtgatttcccttcaactgtagagc

SEQ ID NO: 68935 - DNA, 25 bp, S. pombe
agggatcttaactgcttggtaccaa

SEQ ID NO: 68936 - DNA, 25 bp, S. pombe
agtgacaaattctaccgcctagttc

SEQ ID NO: 68937 - DNA, 25 bp, S. pombe
agtgtttacacttcagctcctgcta

SEQ ID NO: 68938 - DNA, 25 bp, S. pombe
agggaatctcaaagtaccctctctc

SEQ ID NO: 68939 - DNA, 25 bp, S. pombe
aggtgcaagtgcaattatcccctcc

SEQ ID NO: 68940 - DNA, 25 bp, S. pombe
agggatcttcttatttcttacatat

SEQ ID NO: 68941 - DNA, 25 bp, S. pombe
agtggtttcctttgctcttctcata

SEQ ID NO: 68942 - DNA, 25 bp, S. pombe
aggtgattctcgttgatccctctca

SEQ ID NO: 68943 - DNA, 25 bp, S. pombe
aggtgtatgtcgactgtatctcttc

SEQ ID NO: 68944 - DNA, 25 bp, S. pombe
agtggttctgctgctgatacgcaaa

SEQ ID NO: 68945 - DNA, 25 bp, S. pombe
agtgatgatcttgctcgtaccaata

SEQ ID NO: 68946 - DNA, 25 bp, S. pombe
agggcagcactaacagttcgggatt

SEQ ID NO: 68947 - DNA, 25 bp, S. pombe
agggtgcatgctcgattttttaaaa

SEQ ID NO: 68948 - DNA, 25 bp, S. pombe
agtacggccttgctttaccaaagat

SEQ ID NO: 68949 - DNA, 25 bp, S. pombe
agtaagcctcttcttctaaacgatt

SEQ ID NO: 68950 - DNA, 25 bp, S. pombe
agtacgagctctgcctgtaaggtta

SEQ ID NO: 68951 - DNA, 25 bp, S. pombe
agggtatctctttggctgctataac

SEQ ID NO: 68952 - DNA, 25 bp, S. pombe
agggataccatgaagtctgctgata

SEQ ID NO: 68953 - DNA, 25 bp, S. pombe
agggcaaaattgctcgtgctacgtg

SEQ ID NO: 68954 - DNA, 25 bp, S. pombe
cgcgcccaaagagcccttgaagaaa

SEQ ID NO: 68955 - DNA, 25 bp, S. pombe
agtgcctacactggtcctttactaa

SEQ ID NO: 68956 - DNA, 25 bp, S. pombe
agtctttccccgatcttaatggatt

SEQ ID NO: 68957 - DNA, 25 bp, S. pombe
agtcttccctcgcaactagaatggg

SEQ ID NO: 68958 - DNA, 25 bp, S. pombe
agtctactcctgctaatctaaatca

SEQ ID NO: 68959 - DNA, 25 bp, S. pombe
agtctatctcggctcttcgaaaaaa

SEQ ID NO: 68960 - DNA, 25 bp, S. pombe
agtggtgccaaggttgttcctcaaa

SEQ ID NO: 68961 - DNA, 25 bp, S. pombe
agtcctcaaaagttttgctctctac

SEQ ID NO: 68962 - DNA, 25 bp, S. pombe
agtcctcaggttatcaatgcctctt

SEQ ID NO: 68963 - DNA, 25 bp, S. pombe
agggtaagtcatctcagtccatcat

SEQ ID NO: 68964 - DNA, 25 bp, S. pombe
aggtgtacggaccagagtgccacat

SEQ ID NO: 68965 - DNA, 25 bp, S. pombe
agtgtatacggacagcgtctccttc

SEQ ID NO: 68966 - DNA, 25 bp, S. pombe
agttgcaacaggaggcttttcggct

SEQ ID NO: 68967 - DNA, 25 bp, S. pombe
agtgacgacgatctttttagtgaaa

SEQ ID NO: 68968 - DNA, 25 bp, S. pombe
agtggtatcgagtcttttaggaact

SEQ ID NO: 68969 - DNA, 25 bp, S. pombe
agtctctctagagcaccggcgaaag

SEQ ID NO: 68970 - DNA, 25 bp, S. pombe
agatctcgtggagccggtggacaac

SEQ ID NO: 68971 - DNA, 25 bp, S. pombe
agatatggtcgaagcccgtcgcctc

SEQ ID NO: 68972 - DNA, 25 bp, S. pombe
agtgctggtgctggattcatttatc

SEQ ID NO: 68973 - DNA, 25 bp, S. pombe
agggtggcatctttctattacccac

SEQ ID NO: 68974 - DNA, 25 bp, S. pombe
agtatggcccttcggaatatggtcc

SEQ ID NO: 68975 - DNA, 25 bp, S. pombe
agttcgctcgctctgaaacggtcga

SEQ ID NO: 68976 - DNA, 25 bp, S. pombe
agctggccttcgcaaattgggttaa

SEQ ID NO: 68977 - DNA, 25 bp, S. pombe
agtggacgctgaacgatgtttgcaa

SEQ ID NO: 68978 - DNA, 25 bp, S. pombe
agtggcttcaagtttcagtcagtga

SEQ ID NO: 68979 - DNA, 25 bp, S. pombe
agtggattctaatctgcgcttggat

SEQ ID NO: 68980 - DNA, 25 bp, S. pombe
agggaggatgtatctgagccattga

SEQ ID NO: 68981 - DNA, 25 bp, S. pombe
agtgtcgaatttcctatgccattga

SEQ ID NO: 68982 - DNA, 25 bp, S. pombe
agttccccgagacattgagtcctga

SEQ ID NO: 68983 - DNA, 25 bp, S. pombe
agtgtcctcccctagacaagtaaga

SEQ ID NO: 68984 - DNA, 25 bp, S. pombe
agattccaaccctgtaccattgaaa

SEQ ID NO: 68985 - DNA, 25 bp, S. pombe
agtgctgctggaaccgttgacccaa

SEQ ID NO: 68986 - DNA, 25 bp, S. pombe
agtagctgatggtccgtctagtcaa

SEQ ID NO: 68987 - DNA, 25 bp, S. pombe
agtgactcatgatcagcggcttacc

SEQ ID NO: 68988 - DNA, 25 bp, S. pombe
agtgatcatgcgttagcggtttcta

SEQ ID NO: 68989 - DNA, 25 bp, S. pombe
agtgtttggacgtctatgatgcagc

SEQ ID NO: 68990 - DNA, 25 bp, S. pombe
agtgcttcagcacctgttgattcga

SEQ ID NO: 68991 - DNA, 25 bp, S. pombe
agtgctgctggctctgttgatccta

SEQ ID NO: 68992 - DNA, 25 bp, S. pombe
agtcgccgaatacgcagaatctctt

SEQ ID NO: 68993 - DNA, 25 bp, S. pombe
agattcgtgaactcgcaactcaaga

SEQ ID NO: 68994 - DNA, 25 bp, S. pombe
agggctatttctaaagcaatcgata

SEQ ID NO: 68995 - DNA, 25 bp, S. pombe
agtgggagttttacagctatgctaa

SEQ ID NO: 68996 - DNA, 25 bp, S. pombe
agggtttggccttgcaagacatttt

SEQ ID NO: 68997 - DNA, 25 bp, S. pombe
agggtattgaccagcacggcattgt

SEQ ID NO: 68998 - DNA, 25 bp, S. pombe
agtccggtcgtatccaagccaagaa

SEQ ID NO: 68999 - DNA, 25 bp, S. pombe
agtccaggtcatgttcttcttttaa

SEQ ID NO: 69000 - DNA, 25 bp, S. pombe
agtgctcaggcttatttttggtcgt

SEQ ID NO: 69001 - DNA, 25 bp, S. pombe
agggccgtgattgctcttcatgatc

SEQ ID NO: 69002 - DNA, 25 bp, S. pombe
agggcactcgtggttcttttatgaa

SEQ ID NO: 69003 - DNA, 25 bp, S. pombe
agtggatccgctggaacttctgatt

SEQ ID NO: 69004 - DNA, 25 bp, S. pombe
agggaacagagcttgacccttctct

SEQ ID NO: 69005 - DNA, 25 bp, S. pombe
agtgccccttctacgaattctaagg

SEQ ID NO: 69006 - DNA, 25 bp, S. pombe
agtgccgtttcaaactatgctccta

SEQ ID NO: 69007 - DNA, 25 bp, S. pombe
agtggcttgtaattcaacttccaaa

SEQ ID NO: 69008 - DNA, 25 bp, S. pombe
agtggaacgagacacactgcgcttc

SEQ ID NO: 69009 - DNA, 25 bp, S. pombe
agggacactcgaatatcagctcttg

SEQ ID NO: 69010 - DNA, 25 bp, S. pombe
agtgatatcgtccaaatcgccagtg

SEQ ID NO: 69011 - DNA, 25 bp, S. pombe
agtgaagcaacagtagcccctacca

SEQ ID NO: 69012 - DNA, 25 bp, S. pombe
agtgctggtccttacaaccaagcta

SEQ ID NO: 69013 - DNA, 25 bp, S. pombe
agtgtagcttctaacccacttgctt

SEQ ID NO: 69014 - DNA, 25 bp, S. pombe
agtgagagattccaacccaatgttt

SEQ ID NO: 69015 - DNA, 25 bp, S. pombe
agtgtcagcaaccttttggccggat

SEQ ID NO: 69016 - DNA, 25 bp, S. pombe
agtgggcatcacctcttgggacaag

SEQ ID NO: 69017 - DNA, 25 bp, S. pombe
agtggcgcctaaatacgtttctcat

SEQ ID NO: 69018 - DNA, 25 bp, S. pombe
agtacgccgtatatcgcttgtttca

SEQ ID NO: 69019 - DNA, 25 bp, S. pombe
agtaccgtgatgctaagttccgccg

SEQ ID NO: 69020 - DNA, 25 bp, S. pombe
agtgtgttggtcttaaagctcctcc

SEQ ID NO: 69021 - DNA, 25 bp, S. pombe
agtgagcgtctttctaaactccttc

SEQ ID NO: 69022 - DNA, 25 bp, S. pombe
agtgatcccaaagcaaagccgcaat

SEQ ID NO: 69023 - DNA, 25 bp, S. pombe
agtgtcgccaatcctcaattacgaa

SEQ ID NO: 69024 - DNA, 25 bp, S. pombe
agatgctcttaaaatggttggtacc

SEQ ID NO: 69025 - DNA, 25 bp, S. pombe
agtcctctgatacactgtccagtga

SEQ ID NO: 69026 - DNA, 25 bp, S. pombe
agtgagctatgtgaacgtccttgtc

SEQ ID NO: 69027 - DNA, 25 bp, S. pombe
agtgagctacattcctggttcgata

SEQ ID NO: 69028 - DNA, 25 bp, S. pombe
agggcctcaatgttatctcgccaat

SEQ ID NO: 69029 - DNA, 25 bp, S. pombe
agggcctttattagatcggctgaaa

SEQ ID NO: 69030 - DNA, 25 bp, S. pombe
agtgcgacgctctagtgatattgat

SEQ ID NO: 69031 - DNA, 25 bp, S. pombe
agtgtgctcaattaggccgtttgcc

SEQ ID NO: 69032 - DNA, 25 bp, S. pombe
agtcttgaacattctgtcgatgagg

SEQ ID NO: 69033 - DNA, 25 bp, S. pombe
agggcgcaaagcttgtccttggtga

SEQ ID NO: 69034 - DNA, 25 bp, S. pombe
agggcctcaacttggtcctggagat

SEQ ID NO: 69035 - DNA, 25 bp, S. pombe
actggtcctcttatttacggtcctg

SEQ ID NO: 69036 - DNA, 25 bp, S. pombe
agtggtcaccttatggtatcgtgct

SEQ ID NO: 69037 - DNA, 25 bp, S. pombe
agtgcgctcacgatttggtctatat

SEQ ID NO: 69038 - DNA, 25 bp, S. pombe
agtgtctccgttgtggtaattcctt

SEQ ID NO: 69039 - DNA, 25 bp, S. pombe
agtttcgcatttctgtacgccgagt

SEQ ID NO: 69040 - DNA, 25 bp, S. pombe
agtgtatcccaagattttcccacat

SEQ ID NO: 69041 - DNA, 25 bp, S. pombe
agtgatctctacactggtaccccgg

SEQ ID NO: 69042 - DNA, 25 bp, S. pombe
agctaagtatcaacggtcaacccag

SEQ ID NO: 69043 - DNA, 25 bp, S. pombe
agtcaagttcatacggaccttccga

SEQ ID NO: 69044 - DNA, 25 bp, S. pombe
agtaagtctttagcccttcagaacg

SEQ ID NO: 69045 - DNA, 25 bp, S. pombe
agtgaagaatgtacccctgctaaga

SEQ ID NO: 69046 - DNA, 25 bp, S. pombe
agtgaatgcattgtcctcggtaaac

SEQ ID NO: 69047 - DNA, 25 bp, S. pombe
agtgaaatgctctccggtgctaaaa

SEQ ID NO: 69048 - DNA, 25 bp, S. pombe
agtgcagcagccttttatgtcccat

SEQ ID NO: 69049 - DNA, 25 bp, S. pombe
agtcaagtcgtgtcatgctgccaaa

SEQ ID NO: 69050 - DNA, 25 bp, S. pombe
agtaatgctcaatctgtgccagcaa

SEQ ID NO: 69051 - DNA, 25 bp, S. pombe
agtgaatctcactacacgactggta

SEQ ID NO: 69052 - DNA, 25 bp, S. pombe
agtgcgccctgacatatctataacc

SEQ ID NO: 69053 - DNA, 25 bp, S. pombe
agtggacttgacttgcctatgaaag

SEQ ID NO: 69054 - DNA, 25 bp, S. pombe
agtggttctgacttggttgacgcgt

SEQ ID NO: 69055 - DNA, 25 bp, S. pombe
agtgacattgtatttttgcgggcat

SEQ ID NO: 69056 - DNA, 25 bp, S. pombe
agtgcatttctctcatttcgaggat

SEQ ID NO: 69057 - DNA, 25 bp, S. pombe
agtcatttatcaactcttcgagctg

SEQ ID NO: 69058 - DNA, 25 bp, S. pombe
agtgttggcgtttcgatcagtgcta

SEQ ID NO: 69059 - DNA, 25 bp, S. pombe
agtaattccgatattcagcgattga

SEQ ID NO: 69060 - DNA, 25 bp, S. pombe
agtccctcatttcaacgttcagtga

SEQ ID NO: 69061 - DNA, 25 bp, S. pombe
agtcctcgctgtaagcactgcaaaa

SEQ ID NO: 69062 - DNA, 25 bp, S. pombe
agtgcgtccttccagtatcaacaaa

SEQ ID NO: 69063 - DNA, 25 bp, S. pombe
agtgcgtgccctaatgctcaaacag

SEQ ID NO: 69064 - DNA, 25 bp, S. pombe
agtgaactacttttacaacagcttt

SEQ ID NO: 69065 - DNA, 25 bp, S. pombe
agtgcagttcgtaaagtcaagccta

SEQ ID NO: 69066 - DNA, 25 bp, S. pombe
agtctgttcccataatcacttcatg

SEQ ID NO: 69067 - DNA, 25 bp, S. pombe
agtcttttgcagcagaatccacctg

SEQ ID NO: 69068 - DNA, 25 bp, S. pombe
agtcttgttacattaaccgcggcct

SEQ ID NO: 69069 - DNA, 25 bp, S. pombe
agtcgtacaagctcggattccattg

SEQ ID NO: 69070 - DNA, 25 bp, S. pombe
agtcattacaatcagctggtgccgc

SEQ ID NO: 69071 - DNA, 25 bp, S. pombe
agtcatccatttgaagctgtgcaag

SEQ ID NO: 69072 - DNA, 25 bp, S. pombe
agtaatgagaactgctcttcctccc

SEQ ID NO: 69073 - DNA, 25 bp, S. pombe
agtggtaccatttcttctacctcga

SEQ ID NO: 69074 - DNA, 25 bp, S. pombe
agatcgcaaccattggacctactac

SEQ ID NO: 69075 - DNA, 25 bp, S. pombe
agtctggagacttgtattgtacgca

SEQ ID NO: 69076 - DNA, 25 bp, S. pombe
agtcggcaagccatagttcaagaat

SEQ ID NO: 69077 - DNA, 25 bp, S. pombe
agtcatcgaacgctattccagtatt

SEQ ID NO: 69078 - DNA, 25 bp, S. pombe
agtcgcaaactattattcccgcatt

SEQ ID NO: 69079 - DNA, 25 bp, S. pombe
agtccgtccttgttctttcaatggt

SEQ ID NO: 69080 - DNA, 25 bp, S. pombe
agtggataccactggacttcacgca

SEQ ID NO: 69081 - DNA, 25 bp, S. pombe
agtggtcccactggagcctgaacag

SEQ ID NO: 69082 - DNA, 25 bp, S. pombe
agtgcgatacacagggctcgtccag

SEQ ID NO: 69083 - DNA, 25 bp, S. pombe
agctgactcaatgtctccaatgggt

SEQ ID NO: 69084 - DNA, 25 bp, S. pombe
agtgctgctagtgttccggtggtaa

SEQ ID NO: 69085 - DNA, 25 bp, S. pombe
agtacgaccatctcatgcaggacat

SEQ ID NO: 69086 - DNA, 25 bp, S. pombe
agtgctttaggtacaacggctgcca

SEQ ID NO: 69087 - DNA, 25 bp, S. pombe
agtgccttacttacgtattagccag

SEQ ID NO: 69088 - DNA, 25 bp, S. pombe
agtgcccttcttctattattgtcag

SEQ ID NO: 69089 - DNA, 25 bp, S. pombe
agtgtctttcttcttgtaattatgc

SEQ ID NO: 69090 - DNA, 25 bp, S. pombe
agtggattctttttgctattttcgc

SEQ ID NO: 69091 - DNA, 25 bp, S. pombe
agtgtaatttccatgctttcttccc

SEQ ID NO: 69092 - DNA, 25 bp, S. pombe
agtgcttacattgcttcctaatacc

SEQ ID NO: 69093 - DNA, 25 bp, S. pombe
agtgtctgaattggaccttgctctc

SEQ ID NO: 69094 - DNA, 25 bp, S. pombe
agtggtgtatctcacttctctctag

SEQ ID NO: 69095 - DNA, 25 bp, S. pombe
agtttgtaacttcgagcgctggaaa

SEQ ID NO: 69096 - DNA, 25 bp, S. pombe
agtgctttaaacgtggcagccgaaa

SEQ ID NO: 69097 - DNA, 25 bp, S. pombe
agtgttttactcgtggtgctggaat

SEQ ID NO: 69098 - DNA, 25 bp, S. pombe
agtgttttcacttgtcctgttagca

SEQ ID NO: 69099 - DNA, 25 bp, S. pombe
agtgcttctccaatagatccttcta

SEQ ID NO: 69100 - DNA, 25 bp, S. pombe
agtgtaggagcacaaccatccgaca

SEQ ID NO: 69101 - DNA, 25 bp, S. pombe
agtcaaagacatcgaacctccagca

SEQ ID NO: 69102 - DNA, 25 bp, S. pombe
agtctactcagatccaagcaagcga

SEQ ID NO: 69103 - DNA, 25 bp, S. pombe
agttcccaagctggccagcaaggaa

SEQ ID NO: 69104 - DNA, 25 bp, S. pombe
agtctcattctcttcccagaaggaa

SEQ ID NO: 69105 - DNA, 25 bp, S. pombe
agtcgaattcattcctcagggagaa

SEQ ID NO: 69106 - DNA, 25 bp, S. pombe
agtgcaatatgatgtacccggagta

SEQ ID NO: 69107 - DNA, 25 bp, S. pombe
agtccatcagtagctgcattcgttc

SEQ ID NO: 69108 - DNA, 25 bp, S. pombe
agtgcatcaaaatcctccgaattag

SEQ ID NO: 69109 - DNA, 25 bp, S. pombe
agtcggccatcgtccaaattgatgc

SEQ ID NO: 69110 - DNA, 25 bp, S. pombe
agttacgatcgtcaatccattccgt

SEQ ID NO: 69111 - DNA, 25 bp, S. pombe
agttacctacactgaacacgccaag

SEQ ID NO: 69112 - DNA, 25 bp, S. pombe
gccttggcacaactctttaaatcgg

SEQ ID NO: 69113 - DNA, 25 bp, S. pombe
agtcgtcacgaatttgcccaaaagg

SEQ ID NO: 69114 - DNA, 25 bp, S. pombe
agtgatttccatattccaccgaagg

SEQ ID NO: 69115 - DNA, 25 bp, S. pombe
agtgacctctctacttaatccagaa

SEQ ID NO: 69116 - DNA, 25 bp, S. pombe
agtctccgtattactactactgcta

SEQ ID NO: 69117 - DNA, 25 bp, S. pombe
agtcatctccattgtttaccggtgt

SEQ ID NO: 69118 - DNA, 25 bp, S. pombe
agtcatatcctgttcgttatcgttc

SEQ ID NO: 69119 - DNA, 25 bp, S. pombe
agtgatcatcctttattcttccatt

SEQ ID NO: 69120 - DNA, 25 bp, S. pombe
agtcagccttcaatgcagtattcct

SEQ ID NO: 69121 - DNA, 25 bp, S. pombe
agtcgattcatctcatgagttcccc

SEQ ID NO: 69122 - DNA, 25 bp, S. pombe
agtgccttatcggttggtcagcgca

SEQ ID NO: 69123 - DNA, 25 bp, S. pombe
agtgccaaatcgactgctgctgata

SEQ ID NO: 69124 - DNA, 25 bp, S. pombe
agtctgcaaacgctgccttaactag

SEQ ID NO: 69125 - DNA, 25 bp, S. pombe
agttatacctggcactcaatacgag

SEQ ID NO: 69126 - DNA, 25 bp, S. pombe
agtcgagagctcctcattaagcgaa

SEQ ID NO: 69127 - DNA, 25 bp, S. pombe
agtcaaggtccctatcaatcgtcat

SEQ ID NO: 69128 - DNA, 25 bp, S. pombe
agtgctttccatcccgaacaaggag

SEQ ID NO: 69129 - DNA, 25 bp, S. pombe
agttttttccgctgatgcaaggttt

SEQ ID NO: 69130 - DNA, 25 bp, S. pombe
agtgctctgtttcctcaaatcatag

SEQ ID NO: 69131 - DNA, 25 bp, S. pombe
agtgtcatctgttttaatgctcgac

SEQ ID NO: 69132 - DNA, 25 bp, S. pombe
agtgctcctgcttttaacatctatg

SEQ ID NO: 69133 - DNA, 25 bp, S. pombe
agtgtgcttcctacttcttatggta

SEQ ID NO: 69134 - DNA, 25 bp, S. pombe
agtgtcgtcaatatgtccatcggcg

SEQ ID NO: 69135 - DNA, 25 bp, S. pombe
agtgccgacattaatcccataggag

SEQ ID NO: 69136 - DNA, 25 bp, S. pombe
agtccgtgttgagcccaagacatat

SEQ ID NO: 69137 - DNA, 25 bp, S. pombe
agtgttgctaccatttctgctacta

SEQ ID NO: 69138 - DNA, 25 bp, S. pombe
agtgatctcgattctatttacaaac

SEQ ID NO: 69139 - DNA, 25 bp, S. pombe
agtgctctgacttttccacaggaat

SEQ ID NO: 69140 - DNA, 25 bp, S. pombe
agtgtcagcattggcttccatggga

SEQ ID NO: 69141 - DNA, 25 bp, S. pombe
agtcatcaagagtccatcggcttct

SEQ ID NO: 69142 - DNA, 25 bp, S. pombe
agtctgcagcagcacgcttaattga

SEQ ID NO: 69143 - DNA, 25 bp, S. pombe
agttacggacgctaaacgccaggct

SEQ ID NO: 69144 - DNA, 25 bp, S. pombe
agttcctggacctattagtgtgccg

SEQ ID NO: 69145 - DNA, 25 bp, S. pombe
agtcgatatacgcattccactcaac

SEQ ID NO: 69146 - DNA, 25 bp, S. pombe
agtaacaccagtttgtcctcatacg

SEQ ID NO: 69147 - DNA, 25 bp, S. pombe
agtcaaacaatgtctttcccatccc

SEQ ID NO: 69148 - DNA, 25 bp, S. pombe
agtgtaaaatcacttccccatccat

SEQ ID NO: 69149 - DNA, 25 bp, S. pombe
agtcctgcttctgtcaagttgacga

SEQ ID NO: 69150 - DNA, 25 bp, S. pombe
agtgaaattcatgctgcttcctttg

SEQ ID NO: 69151 - DNA, 25 bp, S. pombe
agtgattcatttgctgtctgcgttg

SEQ ID NO: 69152 - DNA, 25 bp, S. pombe
agtgctattgttctttgtgcctcga

SEQ ID NO: 69153 - DNA, 25 bp, S. pombe
agtgtatttactccttgcgaatgga

SEQ ID NO: 69154 - DNA, 25 bp, S. pombe
agtgatttcaattcatcccggaatg

SEQ ID NO: 69155 - DNA, 25 bp, S. pombe
agtgatttcaattcaccccggagct

SEQ ID NO: 69156 - DNA, 25 bp, S. pombe
agtgatttaatttcccctcagctat

SEQ ID NO: 69157 - DNA, 25 bp, S. pombe
agtcctggagacaattgccccatag

SEQ ID NO: 69158 - DNA, 25 bp, S. pombe
agtgccgcaagaataatcctcgtaa

SEQ ID NO: 69159 - DNA, 25 bp, S. pombe
agtctgttgagatgcaccacgagtc

SEQ ID NO: 69160 - DNA, 25 bp, S. pombe
agtgctcttggattactgcgacttc

SEQ ID NO: 69161 - DNA, 25 bp, S. pombe
agtgaccttgaatggccttgctacc

SEQ ID NO: 69162 - DNA, 25 bp, S. pombe
agtcccgatggccagtctatagtta

SEQ ID NO: 69163 - DNA, 25 bp, S. pombe
agatcagcactttgcaagctctaag

SEQ ID NO: 69164 - DNA, 25 bp, S. pombe
agtgcagcacttccagcatctttag

SEQ ID NO: 69165 - DNA, 25 bp, S. pombe
agtgatcgcctcgatactgatgtat

SEQ ID NO: 69166 - DNA, 25 bp, S. pombe
agtactcctcttcgacaaaacatgc

SEQ ID NO: 69167 - DNA, 25 bp, S. pombe
agtaccttgcatcctcatggagctg

SEQ ID NO: 69168 - DNA, 25 bp, S. pombe
agtgcttcgctttcatctgtgcata

SEQ ID NO: 69169 - DNA, 25 bp, S. pombe
agtgctattgctaagttgccatatc

SEQ ID NO: 69170 - DNA, 25 bp, S. pombe
agtgaattgtcttcttccatctgct

SEQ ID NO: 69171 - DNA, 25 bp, S. pombe
agtgccaggaaagcctcaccaatag

SEQ ID NO: 69172 - DNA, 25 bp, S. pombe
agtgccagagtatacttcatcccaa

SEQ ID NO: 69173 - DNA, 25 bp, S. pombe
agtgcctcagctcgactttgaaaaa

SEQ ID NO: 69174 - DNA, 25 bp, S. pombe
agtgccttgcggtcatgtatttgaa

SEQ ID NO: 69175 - DNA, 25 bp, S. pombe
agtcaccagaaggacgttccgtcgt

SEQ ID NO: 69176 - DNA, 25 bp, S. pombe
agtcgcttatacaccacctgttatg

SEQ ID NO: 69177 - DNA, 25 bp, S. pombe
agtcgcttcgacaatcctgtctgat

SEQ ID NO: 69178 - DNA, 25 bp, S. pombe
agtcgagctggcgttgtcaaggcta

SEQ ID NO: 69179 - DNA, 25 bp, S. pombe
agtcgcgtcctaacttggcatggaa

SEQ ID NO: 69180 - DNA, 25 bp, S. pombe
agtcagcttcccgatttggtgaaag

SEQ ID NO: 69181 - DNA, 25 bp, S. pombe
agtacggccctgtttcgattattgc

SEQ ID NO: 69182 - DNA, 25 bp, S. pombe
agtacccctcgctgatgtttgaaca

SEQ ID NO: 69183 - DNA, 25 bp, S. pombe
agtagagttgatgcccgacgacgtc

SEQ ID NO: 69184 - DNA, 25 bp, S. pombe
tagtaaacttggtcacggcgatcgt

SEQ ID NO: 69185 - DNA, 25 bp, S. pombe
agtcaaagattttctttcaatttgg

SEQ ID NO: 69186 - DNA, 25 bp, S. pombe
agtgcttttcttttttcaatcgcgc

SEQ ID NO: 69187 - DNA, 25 bp, S. pombe
agtatggtcatttgctgaggctcgt

SEQ ID NO: 69188 - DNA, 25 bp, S. pombe
agtccttctgcttctagcgtcgttg

SEQ ID NO: 69189 - DNA, 25 bp, S. pombe
agtgcctcctttcaaacgtgtttat

SEQ ID NO: 69190 - DNA, 25 bp, S. pombe
agtgactattacagcactcgcgcgg

SEQ ID NO: 69191 - DNA, 25 bp, S. pombe
agtagtgactggtgtcttcaacccc

SEQ ID NO: 69192 - DNA, 25 bp, S. pombe
agtaacacgctctcatcagaatcag

SEQ ID NO: 69193 - DNA, 25 bp, S. pombe
agtaagccgctgcagctgaattcaa

SEQ ID NO: 69194 - DNA, 25 bp, S. pombe
agtcacattgttcagtgcacctaat

SEQ ID NO: 69195 - DNA, 25 bp, S. pombe
agcggtcagcacaagcgaatggcat

SEQ ID NO: 69196 - DNA, 25 bp, S. pombe
agtcctcgacaaggtatatgcagtc

SEQ ID NO: 69197 - DNA, 25 bp, S. pombe
agtcgtcaagactatctgctgggta

SEQ ID NO: 69198 - DNA, 25 bp, S. pombe
agtgctatctcgacaattttgggac

SEQ ID NO: 69199 - DNA, 25 bp, S. pombe
agtcaatctgcgaaacttttgctag

SEQ ID NO: 69200 - DNA, 25 bp, S. pombe
agtgctactgttcgatcttttgcaa

SEQ ID NO: 69201 - DNA, 25 bp, S. pombe
agtgcgcctgtatacacattacaag

SEQ ID NO: 69202 - DNA, 25 bp, S. pombe
agtcggtgaaagtactctccagtgg

SEQ ID NO: 69203 - DNA, 25 bp, S. pombe
agtgcttgtgaaatgtattgctcca

SEQ ID NO: 69204 - DNA, 25 bp, S. pombe
agtctcagtgtaatgtatccccttc

SEQ ID NO: 69205 - DNA, 25 bp, S. pombe
agtgctcgtcatttgtacggcctta

SEQ ID NO: 69206 - DNA, 25 bp, S. pombe
agtgcgcgaattagctcctgagttt

SEQ ID NO: 69207 - DNA, 25 bp, S. pombe
agtcgtggtcgaagtcatctcaaag

SEQ ID NO: 69208 - DNA, 25 bp, S. pombe
agtcggccacaaagtatctctcagg

SEQ ID NO: 69209 - DNA, 25 bp, S. pombe
agttggtaaaggtagatctctgcgt

SEQ ID NO: 69210 - DNA, 25 bp, S. pombe
agtcatggtcttcggtacagtcagg

SEQ ID NO: 69211 - DNA, 25 bp, S. pombe
agtcagtttacccaagtgctggata

SEQ ID NO: 69212 - DNA, 25 bp, S. pombe
agtgcgcctctttttactggtatat

SEQ ID NO: 69213 - DNA, 25 bp, S. pombe
agtaatcgttttacctcaggtgtca

SEQ ID NO: 69214 - DNA, 25 bp, S. pombe
agtcagaatcagtacgggttggcgt

SEQ ID NO: 69215 - DNA, 25 bp, S. pombe
agtctgagacatgccaaccacggtg

SEQ ID NO: 69216 - DNA, 25 bp, S. pombe
agttcctactccaccaagttatgta

SEQ ID NO: 69217 - DNA, 25 bp, S. pombe
aattacttccaatcctttactctag

SEQ ID NO: 69218 - DNA, 25 bp, S. pombe
agtaccattctattttattaatatt

SEQ ID NO: 69219 - DNA, 25 bp, S. pombe
agtcaggtggagttgctttctaaga

SEQ ID NO: 69220 - DNA, 25 bp, S. pombe
agtctgattattcttttttccgtga

SEQ ID NO: 69221 - DNA, 25 bp, S. pombe
agtgctgctatgatgttttcttctc

SEQ ID NO: 69222 - DNA, 25 bp, S. pombe
agtgctaattctgtttctcgccttt

SEQ ID NO: 69223 - DNA, 25 bp, S. pombe
agtgcttgatttttctgcttcgttt

SEQ ID NO: 69224 - DNA, 25 bp, S. pombe
agtcgattatcagcagtaggctctg

SEQ ID NO: 69225 - DNA, 25 bp, S. pombe
agatttcccacgatggttacgccaa

SEQ ID NO: 69226 - DNA, 25 bp, S. pombe
agattgggccaaccggaacttgcga

SEQ ID NO: 69227 - DNA, 25 bp, S. pombe
agttgggtcgattctcaaaccgcgc

SEQ ID NO: 69228 - DNA, 25 bp, S. pombe
agttagttgaggactccattctccc

SEQ ID NO: 69229 - DNA, 25 bp, S. pombe
agtctcgacttttctggatttacct

SEQ ID NO: 69230 - DNA, 25 bp, S. pombe
agttcgagttcatgggactgtaccc

SEQ ID NO: 69231 - DNA, 25 bp, S. pombe
agtccgatcatcatatggtcgcctt

SEQ ID NO: 69232 - DNA, 25 bp, S. pombe
agtacccacctgttatatcgaagca

SEQ ID NO: 69233 - DNA, 25 bp, S. pombe
agtcccttgctttgcttttggagag

SEQ ID NO: 69234 - DNA, 25 bp, S. pombe
agtccgcttttgtcttacttggtga

SEQ ID NO: 69235 - DNA, 25 bp, S. pombe
agtaccttcacaaaatgcgccattc

SEQ ID NO: 69236 - DNA, 25 bp, S. pombe
agtccaacttcgaatatgcctcagg

SEQ ID NO: 69237 - DNA, 25 bp, S. pombe
agtacaattcatataagtctcggtt

SEQ ID NO: 69238 - DNA, 25 bp, S. pombe
agtagatttgagatcaactcgggat

SEQ ID NO: 69239 - DNA, 25 bp, S. pombe
agtagttcacttgcaacctgacggc

SEQ ID NO: 69240 - DNA, 25 bp, S. pombe
agtaatgactttgcacacggacaag

SEQ ID NO: 69241 - DNA, 25 bp, S. pombe
agtcaattgttgtggcttcttttct

SEQ ID NO: 69242 - DNA, 25 bp, S. pombe
agtccattgttgttgggtgtcccca

SEQ ID NO: 69243 - DNA, 25 bp, S. pombe
agtcgttgacgatgtctgcaccaaa

SEQ ID NO: 69244 - DNA, 25 bp, S. pombe
agtcgttcgcgagttccaggaaatt

SEQ ID NO: 69245 - DNA, 25 bp, S. pombe
agctacattcggctatcggatgttt

SEQ ID NO: 69246 - DNA, 25 bp, S. pombe
agtcgcggctgaccatattttgttt

SEQ ID NO: 69247 - DNA, 25 bp, S. pombe
agtcccctagccatattggttcgtt

SEQ ID NO: 69248 - DNA, 25 bp, S. pombe
agtacctaacgttcttcaagctcaa

SEQ ID NO: 69249 - DNA, 25 bp, S. pombe
agtccatgctgaaactgatgctatt

SEQ ID NO: 69250 - DNA, 25 bp, S. pombe
agtccatcattgctgcttgcattta

SEQ ID NO: 69251 - DNA, 25 bp, S. pombe
agtccttgcatactgtttgtctcag

SEQ ID NO: 69252 - DNA, 25 bp, S. pombe
agtatttgcttttctgtttcggtag

SEQ ID NO: 69253 - DNA, 25 bp, S. pombe
agtaccgctgtttttgtatcctgaa

SEQ ID NO: 69254 - DNA, 25 bp, S. pombe
agtgcgaccttttcttttcatcata

SEQ ID NO: 69255 - DNA, 25 bp, S. pombe
agtctggcggttcttttgatgtcga

SEQ ID NO: 69256 - DNA, 25 bp, S. pombe
agtcgtcgttttctgatgctgattc

SEQ ID NO: 69257 - DNA, 25 bp, S. pombe
agtcgctgctgttcttcaagttttc

SEQ ID NO: 69258 - DNA, 25 bp, S. pombe
agtcgatttgtctcaaggattgcca

SEQ ID NO: 69259 - DNA, 25 bp, S. pombe
agtacagctggcgaaacgtttccaa

SEQ ID NO: 69260 - DNA, 25 bp, S. pombe
agtcactctcttcaacgttaattag

SEQ ID NO: 69261 - DNA, 25 bp, S. pombe
agtaatgcagtatctcgtggcttct

SEQ ID NO: 69262 - DNA, 25 bp, S. pombe
agtcactgtttattgcacccttgtt

SEQ ID NO: 69263 - DNA, 25 bp, S. pombe
agtgccttcatcagattccttttga

SEQ ID NO: 69264 - DNA, 25 bp, S. pombe
agtgcctgctctaccattattttta

SEQ ID NO: 69265 - DNA, 25 bp, S. pombe
agtcctctctccgaatttgttgaac

SEQ ID NO: 69266 - DNA, 25 bp, S. pombe
agtcccctcaagatgctgcgaataa

SEQ ID NO: 69267 - DNA, 25 bp, S. pombe
agtccactgtaactgaagctgcaaa

SEQ ID NO: 69268 - DNA, 25 bp, S. pombe
agtcgcgctgataatctggatgcta

SEQ ID NO: 69269 - DNA, 25 bp, S. pombe
agtctcgctcaagctgttgctgaag

SEQ ID NO: 69270 - DNA, 25 bp, S. pombe
agtccgcttcggtacatgctgatac

SEQ ID NO: 69271 - DNA, 25 bp, S. pombe
agtccgattccggtatctgttggaa

SEQ ID NO: 69272 - DNA, 25 bp, S. pombe
agtcctactccatctaatgctggga

SEQ ID NO: 69273 - DNA, 25 bp, S. pombe
agttgctgaactccgtaaccgtgaa

SEQ ID NO: 69274 - DNA, 25 bp, S. pombe
agtttaccgctgcaaagatcacctt

SEQ ID NO: 69275 - DNA, 25 bp, S. pombe
agttatccgtgacaacaaccgcttt

SEQ ID NO: 69276 - DNA, 25 bp, S. pombe
agttacctgattcctgttacggttg

SEQ ID NO: 69277 - DNA, 25 bp, S. pombe
agttcactacttcttcgactatgtc

SEQ ID NO: 69278 - DNA, 25 bp, S. pombe
agtttcatgtttgtaaagtcgctac

SEQ ID NO: 69279 - DNA, 25 bp, S. pombe
agtttaccttcagagaatgtccaag

SEQ ID NO: 69280 - DNA, 25 bp, S. pombe
agagttacctagctttagtgacaaa

SEQ ID NO: 69281 - DNA, 25 bp, S. pombe
aaagtaccattgcatttcctaccca

SEQ ID NO: 69282 - DNA, 25 bp, S. pombe
gaagaacgaaagcattaccctccca

SEQ ID NO: 69283 - DNA, 25 bp, S. pombe
agtagtttgcgatatttccctgccc

SEQ ID NO: 69284 - DNA, 25 bp, S. pombe
agtcgttatgttcatgttggctctc

SEQ ID NO: 69285 - DNA, 25 bp, S. pombe
agtcgttacattacagctctgggat

SEQ ID NO: 69286 - DNA, 25 bp, S. pombe
agtcgtcgactttcacttgatcaaa

SEQ ID NO: 69287 - DNA, 25 bp, S. pombe
agtcctctcactttactttccaaag

SEQ ID NO: 69288 - DNA, 25 bp, S. pombe
agtccttgtatacccatctgttttt

SEQ ID NO: 69289 - DNA, 25 bp, S. pombe
agtacatctgaatccacactgtttg

SEQ ID NO: 69290 - DNA, 25 bp, S. pombe
agtcgtgatacttctcctaattttg

SEQ ID NO: 69291 - DNA, 25 bp, S. pombe
agtagtgcctcctttgttaatgttg

SEQ ID NO: 69292 - DNA, 25 bp, S. pombe
agtctctacacgcatttttcaattt

SEQ ID NO: 69293 - DNA, 25 bp, S. pombe
agtctattcatgttctctgccgtaa

SEQ ID NO: 69294 - DNA, 25 bp, S. pombe
agtcaatcccttccatatcatatgt

SEQ ID NO: 69295 - DNA, 25 bp, S. pombe
agtcaaaactctcctatcagcattt

SEQ ID NO: 69296 - DNA, 25 bp, S. pombe
agtcataacttcagcagaggccgcc

SEQ ID NO: 69297 - DNA, 25 bp, S. pombe
agtacagagcttacaggaggcccct

SEQ ID NO: 69298 - DNA, 25 bp, S. pombe
agtccgccatgcattgtagaacctg

SEQ ID NO: 69299 - DNA, 25 bp, S. pombe
agtaccgcgtcaagcgtaactgctg

SEQ ID NO: 69300 - DNA, 25 bp, S. pombe
agtaccgtgtcaaacgcaactgctg

SEQ ID NO: 69301 - DNA, 25 bp, S. pombe
agtatgagggtgttactgaacctga

SEQ ID NO: 69302 - DNA, 25 bp, S. pombe
agagaagttggacctcttccctgaa

SEQ ID NO: 69303 - DNA, 25 bp, S. pombe
agataaggtgagctcgtctcccgag

SEQ ID NO: 69304 - DNA, 25 bp, S. pombe
agagtcggctagcatttctccggaa

SEQ ID NO: 69305 - DNA, 25 bp, S. pombe
acctttaggtcatgtttggcttgca

SEQ ID NO: 69306 - DNA, 25 bp, S. pombe
agtctctttggttcgttgtttatgc

SEQ ID NO: 69307 - DNA, 25 bp, S. pombe
agtcgtcttcagaacgttggtctcc

SEQ ID NO: 69308 - DNA, 25 bp, S. pombe
agttatcgcaactcactaagtccac

SEQ ID NO: 69309 - DNA, 25 bp, S. pombe
agtacttccaagatgtcgacgatta

SEQ ID NO: 69310 - DNA, 25 bp, S. pombe
agtactgtcctgcaactaacgatgt

SEQ ID NO: 69311 - DNA, 25 bp, S. pombe
agtttgtccttattccatacctttg

SEQ ID NO: 69312 - DNA, 25 bp, S. pombe
agttgttccgtatgcgtttattcgc

SEQ ID NO: 69313 - DNA, 25 bp, S. pombe
agtctgtccactcgcttggtatcta

SEQ ID NO: 69314 - DNA, 25 bp, S. pombe
agttatctccggtattggtggtcct

SEQ ID NO: 69315 - DNA, 25 bp, S. pombe
agttcattgccggacaggtggttga

SEQ ID NO: 69316 - DNA, 25 bp, S. pombe
agtctattccgtacacttagctatg

SEQ ID NO: 69317 - DNA, 25 bp, S. pombe
agtctactggtctatcacctactag

SEQ ID NO: 69318 - DNA, 25 bp, S. pombe
agtctactagatggtacctgctcaa

SEQ ID NO: 69319 - DNA, 25 bp, S. pombe
agttagctgagtttcgtcgccaacc

SEQ ID NO: 69320 - DNA, 25 bp, S. pombe
agtctgctttcggtctccttgacag

SEQ ID NO: 69321 - DNA, 25 bp, S. pombe
agtattcaacgttcacgtgtcctcg

SEQ ID NO: 69322 - DNA, 25 bp, S. pombe
agtcatgcaactttagcacggccgt

SEQ ID NO: 69323 - DNA, 25 bp, S. pombe
agtctcaacttaatgcctaccttat

SEQ ID NO: 69324 - DNA, 25 bp, S. pombe
agtcatcgagctttatccacaaaca

SEQ ID NO: 69325 - DNA, 25 bp, S. pombe
agtaaaagcgtgtcttactgagatc

SEQ ID NO: 69326 - DNA, 25 bp, S. pombe
agttaaagctgattccaacggacca

SEQ ID NO: 69327 - DNA, 25 bp, S. pombe
agtatcattaatcgcgggaacggcc

SEQ ID NO: 69328 - DNA, 25 bp, S. pombe
agatttctatctcccggaacgattc

SEQ ID NO: 69329 - DNA, 25 bp, S. pombe
agattctgcttcaccccaaaattgg

SEQ ID NO: 69330 - DNA, 25 bp, S. pombe
agtcatactttcttcctataaatgg

SEQ ID NO: 69331 - DNA, 25 bp, S. pombe
agtctaatattctctccttttgctg

SEQ ID NO: 69332 - DNA, 25 bp, S. pombe
agtcttcaattctctccttatatgc

SEQ ID NO: 69333 - DNA, 25 bp, S. pombe
agtcattcaagctacccttgtttgc

SEQ ID NO: 69334 - DNA, 25 bp, S. pombe
agtctatcaacattcacccacttat

SEQ ID NO: 69335 - DNA, 25 bp, S. pombe
agttatttccgtatgctttagccca

SEQ ID NO: 69336 - DNA, 25 bp, S. pombe
agtcaacaaacttcgttctcaggaa

SEQ ID NO: 69337 - DNA, 25 bp, S. pombe
agtagaccaagctacgttgctcctg

SEQ ID NO: 69338 - DNA, 25 bp, S. pombe
agtagatcatcaccaaagtcacccg

SEQ ID NO: 69339 - DNA, 25 bp, S. pombe
agttgcaaccaaccctgtggatgta

SEQ ID NO: 69340 - DNA, 25 bp, S. pombe
agtagcaacatgtactcccggattc

SEQ ID NO: 69341 - DNA, 25 bp, S. pombe
agtatccttgggtcgaaacatgtat

SEQ ID NO: 69342 - DNA, 25 bp, S. pombe
agtcgttcgtcgttggcaagttcaa

SEQ ID NO: 69343 - DNA, 25 bp, S. pombe
agtaagtggctttgcgcacttgctt

SEQ ID NO: 69344 - DNA, 25 bp, S. pombe
agttcgaagacaaagcagcagcagc

SEQ ID NO: 69345 - DNA, 25 bp, S. pombe
agcttccaaaagagtacgacgtgtc

SEQ ID NO: 69346 - DNA, 25 bp, S. pombe
agtttattcaagtgtacgctcgcgt

SEQ ID NO: 69347 - DNA, 25 bp, S. pombe
agttgctttaaatgccacaccaggg

SEQ ID NO: 69348 - DNA, 25 bp, S. pombe
agtagtttcaaacccatcgactttg

SEQ ID NO: 69349 - DNA, 25 bp, S. pombe
agtagtttctccttactcagcagaa

SEQ ID NO: 69350 - DNA, 25 bp, S. pombe
agtaggttgtccatcatctttgaaa

SEQ ID NO: 69351 - DNA, 25 bp, S. pombe
agttgggtatccttcaatctctaaa

SEQ ID NO: 69352 - DNA, 25 bp, S. pombe
agtaattatactcgccttcctaaat

SEQ ID NO: 69353 - DNA, 25 bp, S. pombe
agtcagatttcctgaatcacctcca

SEQ ID NO: 69354 - DNA, 25 bp, S. pombe
agtaccctcagctggtgctcaggta

SEQ ID NO: 69355 - DNA, 25 bp, S. pombe
agtagaagagcgtgtacccgttcct

SEQ ID NO: 69356 - DNA, 25 bp, S. pombe
agtataaacgcagtggaccccagtc

SEQ ID NO: 69357 - DNA, 25 bp, S. pombe
agtcttgacagctacattcaaccca

SEQ ID NO: 69358 - DNA, 25 bp, S. pombe
agtcttatcccgtatgaacccacat

SEQ ID NO: 69359 - DNA, 25 bp, S. pombe
agtactcatgcttcaaatgcttcag

SEQ ID NO: 69360 - DNA, 25 bp, S. pombe
agtactcctatcaaatcaccacaac

SEQ ID NO: 69361 - DNA, 25 bp, S. pombe
agtattcctaccaatagctcacaac

SEQ ID NO: 69362 - DNA, 25 bp, S. pombe
agtataacatccctttcaaacccat

SEQ ID NO: 69363 - DNA, 25 bp, S. pombe
agttttgccagcctatcgaaaccgt

SEQ ID NO: 69364 - DNA, 25 bp, S. pombe
agtacttgtctgcttttgaacctgt

SEQ ID NO: 69365 - DNA, 25 bp, S. pombe
agtcagtcttgtcttcttcgaaaac

SEQ ID NO: 69366 - DNA, 25 bp, S. pombe
agtcaactttcaattcttcgtacaa

SEQ ID NO: 69367 - DNA, 25 bp, S. pombe
agtcacctatctctaattgccttaa

SEQ ID NO: 69368 - DNA, 25 bp, S. pombe
agtcacccatacttcagttgcttta

SEQ ID NO: 69369 - DNA, 25 bp, S. pombe
agtactctcccttggctgttgaaga

SEQ ID NO: 69370 - DNA, 25 bp, S. pombe
agtacaatgcggacaccactgttaa

SEQ ID NO: 69371 - DNA, 25 bp, S. pombe
agtaccactacttcgaccaaatcat

SEQ ID NO: 69372 - DNA, 25 bp, S. pombe
agtattgtcccaacacatctgtgaa

SEQ ID NO: 69373 - DNA, 25 bp, S. pombe
agtcttcccgatgctgtcattgaaa

SEQ ID NO: 69374 - DNA, 25 bp, S. pombe
gcgtcccgtgcttaattgttggtac

SEQ ID NO: 69375 - DNA, 25 bp, S. pombe
agtcatcggtgttgcaattcttgcg

SEQ ID NO: 69376 - DNA, 25 bp, S. pombe
agttgccttattccagtacatgcga

SEQ ID NO: 69377 - DNA, 25 bp, S. pombe
agttacttttgttgctaagccgtca

SEQ ID NO: 69378 - DNA, 25 bp, S. pombe
agtagcagttttgcgctatgggcct

SEQ ID NO: 69379 - DNA, 25 bp, S. pombe
agtactttttacgtcagtgtcgcct

SEQ ID NO: 69380 - DNA, 25 bp, S. pombe
agatattccctaaacggtattcgat

SEQ ID NO: 69381 - DNA, 25 bp, S. pombe
agtcattcattattattcgtctatt

SEQ ID NO: 69382 - DNA, 25 bp, S. pombe
agtcatccactttattcttcatcgt

SEQ ID NO: 69383 - DNA, 25 bp, S. pombe
agtcttcctattttgcttgtcgctt

SEQ ID NO: 69384 - DNA, 25 bp, S. pombe
agtattcaattcacgttatccacaa

SEQ ID NO: 69385 - DNA, 25 bp, S. pombe
agtcaagtcttctttcggttctatc

SEQ ID NO: 69386 - DNA, 25 bp, S. pombe
agttttctactacctaattcaagat

SEQ ID NO: 69387 - DNA, 25 bp, S. pombe
agttagtcttcccacttttagaatg

SEQ ID NO: 69388 - DNA, 25 bp, S. pombe
agtcttgctgctaccgaatttggga

SEQ ID NO: 69389 - DNA, 25 bp, S. pombe
agtcatttcaattctctctttggga

SEQ ID NO: 69390 - DNA, 25 bp, S. pombe
agtatcttaaacttcgctcatcgga

SEQ ID NO: 69391 - DNA, 25 bp, S. pombe
agttggcgaagtgctagtgcccgca

SEQ ID NO: 69392 - DNA, 25 bp, S. pombe
agttcggaaaatacggctgccctgt

SEQ ID NO: 69393 - DNA, 25 bp, S. pombe
agtaactgctttgtttgctcacgtt

SEQ ID NO: 69394 - DNA, 25 bp, S. pombe
agtactacagtttcttctgcgtcca

SEQ ID NO: 69395 - DNA, 25 bp, S. pombe
agtagcaacgtttctattcctcggt

SEQ ID NO: 69396 - DNA, 25 bp, S. pombe
agtcaagctcttctcatttttctgt

SEQ ID NO: 69397 - DNA, 25 bp, S. pombe
agtagtcgtctcaccaaattatatg

SEQ ID NO: 69398 - DNA, 25 bp, S. pombe
agtagccacaccgtcacaaattaat

SEQ ID NO: 69399 - DNA, 25 bp, S. pombe
agttccgtctgctcaagaagttctt

SEQ ID NO: 69400 - DNA, 25 bp, S. pombe
agtaactcttgccttggcattcctt

SEQ ID NO: 69401 - DNA, 25 bp, S. pombe
agtagacttttggttgcttctcgtc

SEQ ID NO: 69402 - DNA, 25 bp, S. pombe
agttcactaattgactgttgtcgtc

SEQ ID NO: 69403 - DNA, 25 bp, S. pombe
agtcacttttcatttcgttctcaga

SEQ ID NO: 69404 - DNA, 25 bp, S. pombe
agtacttgctgctgattcatcgtca

SEQ ID NO: 69405 - DNA, 25 bp, S. pombe
agtacatggccatttttcagctcac

SEQ ID NO: 69406 - DNA, 25 bp, S. pombe
agtcacttcggtcgcagttcataat

SEQ ID NO: 69407 - DNA, 25 bp, S. pombe
agtactctgatggtctggttctcaa

SEQ ID NO: 69408 - DNA, 25 bp, S. pombe
agagtccggtcgtgtttcaattcca

SEQ ID NO: 69409 - DNA, 25 bp, S. pombe
agtaaagccaccacatttgctgcat

SEQ ID NO: 69410 - DNA, 25 bp, S. pombe
agtacgccaacgacattggtttcgt

SEQ ID NO: 69411 - DNA, 25 bp, S. pombe
agcttaggcaagctcttcgttcggt

SEQ ID NO: 69412 - DNA, 25 bp, S. pombe
agattggccgatttgctacgcgtac

SEQ ID NO: 69413 - DNA, 25 bp, S. pombe
agttctgaccgctgatgtttttgtt

SEQ ID NO: 69414 - DNA, 25 bp, S. pombe
agtactgaccgaactcattctttca

SEQ ID NO: 69415 - DNA, 25 bp, S. pombe
agttcgcctagatcggtttgcacat

SEQ ID NO: 69416 - DNA, 25 bp, S. pombe
agttagctgatatctcggagaccaa

SEQ ID NO: 69417 - DNA, 25 bp, S. pombe
agtagttcttcttcaggatctgtcg

SEQ ID NO: 69418 - DNA, 25 bp, S. pombe
agtaatgcctgtgccaaatggtggt

SEQ ID NO: 69419 - DNA, 25 bp, S. pombe
agtatatcgcttttccaagcctgtg

SEQ ID NO: 69420 - DNA, 25 bp, S. pombe
agtaatatcttgtacaccgcctgct

SEQ ID NO: 69421 - DNA, 25 bp, S. pombe
agttttctggtggtccaagcagcaa

SEQ ID NO: 69422 - DNA, 25 bp, S. pombe
agtaccacattctttattaacgctc

SEQ ID NO: 69423 - DNA, 25 bp, S. pombe
agtaacaattcctcactagtccatt

SEQ ID NO: 69424 - DNA, 25 bp, S. pombe
agtaacccttctccctataatatat

SEQ ID NO: 69425 - DNA, 25 bp, S. pombe
agtttccgtctctcttcacaattta

SEQ ID NO: 69426 - DNA, 25 bp, S. pombe
agtatatctgttcctcccacgaata

SEQ ID NO: 69427 - DNA, 25 bp, S. pombe
agttctggcacaacgagcacgcgaa

SEQ ID NO: 69428 - DNA, 25 bp, S. pombe
agttatgcaacttcgtggccaacat

SEQ ID NO: 69429 - DNA, 25 bp, S. pombe
tatcgtatacggtgttggaatcgtt

SEQ ID NO: 69430 - DNA, 25 bp, S. pombe
agtatggccctttctcggttgagaa

SEQ ID NO: 69431 - DNA, 25 bp, S. pombe
agtatggccgcttattcagttatta

SEQ ID NO: 69432 - DNA, 25 bp, S. pombe
agtataccagtattcccttaccatg

SEQ ID NO: 69433 - DNA, 25 bp, S. pombe
agttgatccattttcacttttccaa

SEQ ID NO: 69434 - DNA, 25 bp, S. pombe
agtatgctcgtgctggtgcaactat

SEQ ID NO: 69435 - DNA, 25 bp, S. pombe
agttgacgtactgggcagcgagaaa

SEQ ID NO: 69436 - DNA, 25 bp, S. pombe
agttgctcgtcctggcttaacggaa

SEQ ID NO: 69437 - DNA, 25 bp, S. pombe
agttctgttctctgggttgacgaaa

SEQ ID NO: 69438 - DNA, 25 bp, S. pombe
agtttctcaatctgggcagttcgca

SEQ ID NO: 69439 - DNA, 25 bp, S. pombe
agtttgtcaatccacgtgttctagc

SEQ ID NO: 69440 - DNA, 25 bp, S. pombe
agttccatgtacctagcccgtaaag

SEQ ID NO: 69441 - DNA, 25 bp, S. pombe
agttactatgggtcttcctgttgat

SEQ ID NO: 69442 - DNA, 25 bp, S. pombe
agtttcattccaaaggctccaagcg

SEQ ID NO: 69443 - DNA, 25 bp, S. pombe
agtttcaacggatgcatcactagtt

SEQ ID NO: 69444 - DNA, 25 bp, S. pombe
agttctgaatcctccaacgttgatg

SEQ ID NO: 69445 - DNA, 25 bp, S. pombe
agttgagaatcctaagcccgttgtc

SEQ ID NO: 69446 - DNA, 25 bp, S. pombe
agttgaaatccgtcgccaagttttg

SEQ ID NO: 69447 - DNA, 25 bp, S. pombe
agaggcaaacctcacccagatattt

SEQ ID NO: 69448 - DNA, 25 bp, S. pombe
agttttatgcgtgttttcaatgtca

SEQ ID NO: 69449 - DNA, 25 bp, S. pombe
agtttgttcgcgctgctttaagtag

SEQ ID NO: 69450 - DNA, 25 bp, S. pombe
agttcttgtaccctattttctgcat

SEQ ID NO: 69451 - DNA, 25 bp, S. pombe
agtttggtatttttctatcctgtat

SEQ ID NO: 69452 - DNA, 25 bp, S. pombe
agttgttttggacgagcctttccag

SEQ ID NO: 69453 - DNA, 25 bp, S. pombe
agttgccgatcctggtgtggtttca

SEQ ID NO: 69454 - DNA, 25 bp, S. pombe
agtattcgtccttttgttattgtca

SEQ ID NO: 69455 - DNA, 25 bp, S. pombe
agtatttccaccagctttcattgtc

SEQ ID NO: 69456 - DNA, 25 bp, S. pombe
agtttcccaacccagagatgcattg

SEQ ID NO: 69457 - DNA, 25 bp, S. pombe
agttctgcccagaatggctacgctt

SEQ ID NO: 69458 - DNA, 25 bp, S. pombe
agcttatgacactgggaactcttct

SEQ ID NO: 69459 - DNA, 25 bp, S. pombe
agtatcccacattggagaaccatgt

SEQ ID NO: 69460 - DNA, 25 bp, S. pombe
agaacctcgcagacgtaccaatgtg

SEQ ID NO: 69461 - DNA, 25 bp, S. pombe
agtacatcccaattctttctagaca

SEQ ID NO: 69462 - DNA, 25 bp, S. pombe
agtattgaccaatttgcctctaagg

SEQ ID NO: 69463 - DNA, 25 bp, S. pombe
agttttctactgttcctgctaggac

SEQ ID NO: 69464 - DNA, 25 bp, S. pombe
agtttgtttctgaccgatctcagga

SEQ ID NO: 69465 - DNA, 25 bp, S. pombe
agtatcgattttacctgacactgag

SEQ ID NO: 69466 - DNA, 25 bp, S. pombe
agttgcgttactacaatgtcgttgt

SEQ ID NO: 69467 - DNA, 25 bp, S. pombe
agtactgttcgctcttgtcgtattg

SEQ ID NO: 69468 - DNA, 25 bp, S. pombe
agtacgttctaccttcgctgatatg

SEQ ID NO: 69469 - DNA, 25 bp, S. pombe
agagacgttgcttgggctcccagtg

SEQ ID NO: 69470 - DNA, 25 bp, S. pombe
agtatgcttatttcattcgacccca

SEQ ID NO: 69471 - DNA, 25 bp, S. pombe
agtagctctatgagtttgccgccta

SEQ ID NO: 69472 - DNA, 25 bp, S. pombe
agatacctgatgtttaagtccttgg

SEQ ID NO: 69473 - DNA, 25 bp, S. pombe
agtacgctctgctttaagtggcttc

SEQ ID NO: 69474 - DNA, 25 bp, S. pombe
agtttccactgatcagactgctgct

SEQ ID NO: 69475 - DNA, 25 bp, S. pombe
agttttctcatgttcagcatcttgt

SEQ ID NO: 69476 - DNA, 25 bp, S. pombe
agttctgtggtgagtcttgcttaat

SEQ ID NO: 69477 - DNA, 25 bp, S. pombe
agtatgaagcttctgatgccgaccc

SEQ ID NO: 69478 - DNA, 25 bp, S. pombe
agtaggacctccaatatcataccag

SEQ ID NO: 69479 - DNA, 25 bp, S. pombe
agttggcatccctttgaagactcag

SEQ ID NO: 69480 - DNA, 25 bp, S. pombe
agattggcactcctttggaagtcct

SEQ ID NO: 69481 - DNA, 25 bp, S. pombe
agtattccagatcttacactcctct

SEQ ID NO: 69482 - DNA, 25 bp, S. pombe
agttgccatcatagacttagccgtg

SEQ ID NO: 69483 - DNA, 25 bp, S. pombe
agtatttccatgctcttaggcgtaa

SEQ ID NO: 69484 - DNA, 25 bp, S. pombe
agtttggctcctattctctttagaa

SEQ ID NO: 69485 - DNA, 25 bp, S. pombe
agtattatcactgccatttccttgg

SEQ ID NO: 69486 - DNA, 25 bp, S. pombe
agtatgttcactgccttaactctac

SEQ ID NO: 69487 - DNA, 25 bp, S. pombe
agtagctctctatctcttactttac

SEQ ID NO: 69488 - DNA, 25 bp, S. pombe
agtacgctaagcacattcactgtta

SEQ ID NO: 69489 - DNA, 25 bp, S. pombe
agttttagaatctttccctgctgct

SEQ ID NO: 69490 - DNA, 25 bp, S. pombe
agttttgcaaatttctgggtcgtca

SEQ ID NO: 69491 - DNA, 25 bp, S. pombe
agttatcgacaattccggtgctacc

SEQ ID NO: 69492 - DNA, 25 bp, S. pombe
agttactgtgcaaaccgctttccta

SEQ ID NO: 69493 - DNA, 25 bp, S. pombe
agttaaaggtgccatcattcaagca

SEQ ID NO: 69494 - DNA, 25 bp, S. pombe
cgtcctacggttcctataatgcaga

SEQ ID NO: 69495 - DNA, 25 bp, S. pombe
cagtcctactgttggtcgaattggt

SEQ ID NO: 69496 - DNA, 25 bp, S. pombe
agatcatggtcccagttacgggctt

SEQ ID NO: 69497 - DNA, 25 bp, S. pombe
agttgagttcatttctacagggctg

SEQ ID NO: 69498 - DNA, 25 bp, S. pombe
agtagtgcattcttttccgttgacc

SEQ ID NO: 69499 - DNA, 25 bp, S. pombe
agtagggaacagtctcgcagccaga

SEQ ID NO: 69500 - DNA, 25 bp, S. pombe
agtagcagcggcgattccagtgacg

SEQ ID NO: 69501 - DNA, 25 bp, S. pombe
agtattactgcgtcacaacaaccca

SEQ ID NO: 69502 - DNA, 25 bp, S. pombe
agcttacgaaacatcctccgagttt

SEQ ID NO: 69503 - DNA, 25 bp, S. pombe
agattcgtcgtttcttcaacttgtc

SEQ ID NO: 69504 - DNA, 25 bp, S. pombe
agttgccgacagagtatctactagg

SEQ ID NO: 69505 - DNA, 25 bp, S. pombe
agttccgtcagttctatcttcgaat

SEQ ID NO: 69506 - DNA, 25 bp, S. pombe
agttcgcgtgtttaatgcccatcat

SEQ ID NO: 69507 - DNA, 25 bp, S. pombe
agtatctcttgttaatctcccactt

SEQ ID NO: 69508 - DNA, 25 bp, S. pombe
agtaccagttgatattcgtgccttg

SEQ ID NO: 69509 - DNA, 25 bp, S. pombe
agtatcctgttatgattcctgccat

SEQ ID NO: 69510 - DNA, 25 bp, S. pombe
agtatcctgtattgtgttcctggca

SEQ ID NO: 69511 - DNA, 25 bp, S. pombe
agtttggcagtttgttcgtccacaa

SEQ ID NO: 69512 - DNA, 25 bp, S. pombe
agtttcgcagtggtatttgtagcaa

SEQ ID NO: 69513 - DNA, 25 bp, S. pombe
gagttttggtggctatcttacctta

SEQ ID NO: 69514 - DNA, 25 bp, S. pombe
agtttattttccatcatttctgcgt

SEQ ID NO: 69515 - DNA, 25 bp, S. pombe
agttcatactaaggctactcttccc

SEQ ID NO: 69516 - DNA, 25 bp, S. pombe
agtttgaataactcctctcttctca

SEQ ID NO: 69517 - DNA, 25 bp, S. pombe
agtagtagttctagctcgtcttcct

SEQ ID NO: 69518 - DNA, 25 bp, S. pombe
agtagtggttatagctctggcccta

SEQ ID NO: 69519 - DNA, 25 bp, S. pombe
agttctcggatctcttcaagctcaa

SEQ ID NO: 69520 - DNA, 25 bp, S. pombe
agtatctctccctctttgagtggta

SEQ ID NO: 69521 - DNA, 25 bp, S. pombe
agtattcttgctctcgtttatgtcc

SEQ ID NO: 69522 - DNA, 25 bp, S. pombe
agtatgccactcgtttattcagtcg

SEQ ID NO: 69523 - DNA, 25 bp, S. pombe
agttcacctccttgtaatatatctg

SEQ ID NO: 69524 - DNA, 25 bp, S. pombe
agtatgacctccgactttgattctg

SEQ ID NO: 69525 - DNA, 25 bp, S. pombe
agttacctcctatttttcctacatg

SEQ ID NO: 69526 - DNA, 25 bp, S. pombe
agttgaagccttctgtttcactacg

SEQ ID NO: 69527 - DNA, 25 bp, S. pombe
agttaagccagatagctcttcctgc

SEQ ID NO: 69528 - DNA, 25 bp, S. pombe
agttaactctgaaatcacttctaga

SEQ ID NO: 69529 - DNA, 25 bp, S. pombe
agtttccgactcaccgacaatgaat

SEQ ID NO: 69530 - DNA, 25 bp, S. pombe
agttcttgatttctctggtaatggc

SEQ ID NO: 69531 - DNA, 25 bp, S. pombe
agttgttggtctcttagatcctgaa

SEQ ID NO: 69532 - DNA, 25 bp, S. pombe
agtagtatgccctcttcagctattc

SEQ ID NO: 69533 - DNA, 25 bp, S. pombe
agtagtacacttccagccattatta

SEQ ID NO: 69534 - DNA, 25 bp, S. pombe
agattgaaccttccaactcacttag

SEQ ID NO: 69535 - DNA, 25 bp, S. pombe
agtattgattctcctttcttttctc

SEQ ID NO: 69536 - DNA, 25 bp, S. pombe
agtatttggctgcttatcttctctt

SEQ ID NO: 69537 - DNA, 25 bp, S. pombe
agttatatggccttgatcctcaaag

SEQ ID NO: 69538 - DNA, 25 bp, S. pombe
agtttgatggtctttcccaactcca

SEQ ID NO: 69539 - DNA, 25 bp, S. pombe
agatttggcgtctttcctaacttct

SEQ ID NO: 69540 - DNA, 25 bp, S. pombe
agtttgctcgtctttcacacaacaa

SEQ ID NO: 69541 - DNA, 25 bp, S. pombe
agttctggattcgttgcctatacaa

SEQ ID NO: 69542 - DNA, 25 bp, S. pombe
agccttccaacgttcttataactcg

SEQ ID NO: 69543 - DNA, 25 bp, S. pombe
agtttgcatctttggcttttaatta

SEQ ID NO: 69544 - DNA, 25 bp, S. pombe
agttgtgcttctacctttctaagta

SEQ ID NO: 69545 - DNA, 25 bp, S. pombe
agtatctctctctttggttgctata

SEQ ID NO: 69546 - DNA, 25 bp, S. pombe
agtttctgcaattcgagctgttaaa

SEQ ID NO: 69547 - DNA, 25 bp, S. pombe
agtttacgaccgcatgggcctaatt

SEQ ID NO: 69548 - DNA, 25 bp, S. pombe
agttctgtccttccaggtactatat

SEQ ID NO: 69549 - DNA, 25 bp, S. pombe
agtttctacattctgtgctcttcaa

SEQ ID NO: 69550 - DNA, 25 bp, S. pombe
agtatatgcttatgccgatgctctt

SEQ ID NO: 69551 - DNA, 25 bp, S. pombe
agactactcaaaccgaccttggtca

SEQ ID NO: 69552 - DNA, 25 bp, S. pombe
agttttcaagagtccctttctcact

SEQ ID NO: 69553 - DNA, 25 bp, S. pombe
agtattatccaattccccatttctt

SEQ ID NO: 69554 - DNA, 25 bp, S. pombe
agtattggatgcatgtcctctcaga

SEQ ID NO: 69555 - DNA, 25 bp, S. pombe
agtatttctcgctctcttattaagg

SEQ ID NO: 69556 - DNA, 25 bp, S. pombe
agttctcccagtatttatgcctcgt

SEQ ID NO: 69557 - DNA, 25 bp, S. pombe
aaatcccgatggaacttactctcct

SEQ ID NO: 69558 - DNA, 25 bp, S. pombe
agaggccctaatgcacacgaatttg

SEQ ID NO: 69559 - DNA, 25 bp, S. pombe
agaggctcgtaaggccaaagcggat

SEQ ID NO: 69560 - DNA, 25 bp, S. pombe
actattcaattcgtcgcccttggag

SEQ ID NO: 69561 - DNA, 25 bp, S. pombe
agtattgacctcttaccacttggaa

SEQ ID NO: 69562 - DNA, 25 bp, S. pombe
agtttgacctcctcgaagatgatga

SEQ ID NO: 69563 - DNA, 25 bp, S. pombe
agttgcttctctcatcgaaaggtcg

SEQ ID NO: 69564 - DNA, 25 bp, S. pombe
agttgcttcatgagacccaaggcca

SEQ ID NO: 69565 - DNA, 25 bp, S. pombe
agtattatatgttgctcccgatgtg

SEQ ID NO: 69566 - DNA, 25 bp, S. pombe
agtttatcatgcgtatccccatgga

SEQ ID NO: 69567 - DNA, 25 bp, S. pombe
agttataatccttatccctctgaaa

SEQ ID NO: 69568 - DNA, 25 bp, S. pombe
agttacaactcttcatagcctcgat

SEQ ID NO: 69569 - DNA, 25 bp, S. pombe
agttattctcaacgtgcttctacac

SEQ ID NO: 69570 - DNA, 25 bp, S. pombe
agtttattagcacacctcttcatct

SEQ ID NO: 69571 - DNA, 25 bp, S. pombe
agttatttcgtctaccttctcatgg

SEQ ID NO: 69572 - DNA, 25 bp, S. pombe
agttaatagctataccgcggaatcc

SEQ ID NO: 69573 - DNA, 25 bp, S. pombe
agttttgttatggaccggtcttctg

SEQ ID NO: 69574 - DNA, 25 bp, S. pombe
agtattcttactcaatcttctccag

SEQ ID NO: 69575 - DNA, 25 bp, S. pombe
agattagcaatacagaccccgacgg

SEQ ID NO: 69576 - DNA, 25 bp, S. pombe
agtttaccacaagctcaatctgaat

SEQ ID NO: 69577 - DNA, 25 bp, S. pombe
agtttaaacacattccaactgagtg

SEQ ID NO: 69578 - DNA, 25 bp, S. pombe
agtttaaacacattccaactgagtg

SEQ ID NO: 69579 - DNA, 25 bp, S. pombe
agaactccgtatgaaaagcgtatgg

SEQ ID NO: 69580 - DNA, 25 bp, S. pombe
agattcccgcttcaacaaggctatt

SEQ ID NO: 69581 - DNA, 25 bp, S. pombe
agtttcctgttaagactcgtctcta

SEQ ID NO: 69582 - DNA, 25 bp, S. pombe
agttgttatcctgatggtaggattt

SEQ ID NO: 69583 - DNA, 25 bp, S. pombe
agtttaccttgctcacttgattgtt

SEQ ID NO: 69584 - DNA, 25 bp, S. pombe
agttctagcgggatacctgatttat

SEQ ID NO: 69585 - DNA, 25 bp, S. pombe
agttctacggagactgacaccatct

SEQ ID NO: 69586 - DNA, 25 bp, S. pombe
aatttgccaagtgtccggaagcctt

SEQ ID NO: 69587 - DNA, 25 bp, S. pombe
agttgctaaagtgctgcccaaacct

SEQ ID NO: 69588 - DNA, 25 bp, S. pombe
agattgttatccctgccaacaacta

SEQ ID NO: 69589 - DNA, 25 bp, S. pombe
agttgtttgccgttgctagtcaaga

SEQ ID NO: 69590 - DNA, 25 bp, S. pombe
agttttgctgggtatcttagctcgc

SEQ ID NO: 69591 - DNA, 25 bp, S. pombe
agataattcggtttctctcgtcaat

SEQ ID NO: 69592 - DNA, 25 bp, S. pombe
agatcaagcctgtacaacccacgga

SEQ ID NO: 69593 - DNA, 25 bp, S. pombe
agatgcaggaatcaagccccaggga

SEQ ID NO: 69594 - DNA, 25 bp, S. pombe
caggatgcaaactcgggcccattct

SEQ ID NO: 69595 - DNA, 25 bp, S. pombe
agttcacccggctaatgacgagcac

SEQ ID NO: 69596 - DNA, 25 bp, S. pombe
agtttcatactctagatctccgtct

SEQ ID NO: 69597 - DNA, 25 bp, S. pombe
agattatccccattttctacttctg

SEQ ID NO: 69598 - DNA, 25 bp, S. pombe
agttattcccattctttctgttcct

SEQ ID NO: 69599 - DNA, 25 bp, S. pombe
agatggtggccttcgttttggagaa

SEQ ID NO: 69600 - DNA, 25 bp, S. pombe
agttcaactgatcgccgtgtttgta

SEQ ID NO: 69601 - DNA, 25 bp, S. pombe
agttacacttgcatcgctttcatga

SEQ ID NO: 69602 - DNA, 25 bp, S. pombe
agttaccggctgatgctcgtcaaaa

SEQ ID NO: 69603 - DNA, 25 bp, S. pombe
agttcactcgagttgtcgcttggaa

SEQ ID NO: 69604 - DNA, 25 bp, S. pombe
agattcagcctgttattcccgaaaa

SEQ ID NO: 69605 - DNA, 25 bp, S. pombe
agttgaacgaactccatctgacaaa

SEQ ID NO: 69606 - DNA, 25 bp, S. pombe
agttcgactcttccttgtatacaag

SEQ ID NO: 69607 - DNA, 25 bp, S. pombe
agttatgttccgtatttcacacaat

SEQ ID NO: 69608 - DNA, 25 bp, S. pombe
agtttattgccatacgtgccactta

SEQ ID NO: 69609 - DNA, 25 bp, S. pombe
agttcatttctcaatcatcggctca

SEQ ID NO: 69610 - DNA, 25 bp, S. pombe
agtttatcaactggcctaggctact

SEQ ID NO: 69611 - DNA, 25 bp, S. pombe
agttattctactgccacatcgatac

SEQ ID NO: 69612 - DNA, 25 bp, S. pombe
agttattacagttcgctacaggcac

SEQ ID NO: 69613 - DNA, 25 bp, S. pombe
agttagatgtcacttctctacgaag

SEQ ID NO: 69614 - DNA, 25 bp, S. pombe
agttgacgttttactgactccagtg

SEQ ID NO: 69615 - DNA, 25 bp, S. pombe
agtttgcatatcgattcttcaccca

SEQ ID NO: 69616 - DNA, 25 bp, S. pombe
agtttgctttacactcaccatatgc

SEQ ID NO: 69617 - DNA, 25 bp, S. pombe
agttcctatagttgcacttagtgcg

SEQ ID NO: 69618 - DNA, 25 bp, S. pombe
agttccttgttagcttgtgtcgtat

SEQ ID NO: 69619 - DNA, 25 bp, S. pombe
agtttccaatgttgatcccgctaat

SEQ ID NO: 69620 - DNA, 25 bp, S. pombe
agattttccttctctactagtgttg

SEQ ID NO: 69621 - DNA, 25 bp, S. pombe
agttcttcgtactcatactactgct

SEQ ID NO: 69622 - DNA, 25 bp, S. pombe
agttttatgctccttggtgtggtca

SEQ ID NO: 69623 - DNA, 25 bp, S. pombe
agtttatactgccttttgcgtccaa

SEQ ID NO: 69624 - DNA, 25 bp, S. pombe
agttatcttctcgtttggttggcat

SEQ ID NO: 69625 - DNA, 25 bp, S. pombe
agttttctcatcgttctggacgtga

SEQ ID NO: 69626 - DNA, 25 bp, S. pombe
agttttcttcgcctttactcatgat

SEQ ID NO: 69627 - DNA, 25 bp, S. pombe
agattatggcatgccgttttctaat

SEQ ID NO: 69628 - DNA, 25 bp, S. pombe
agattcaagtgctctttttgccttt

SEQ ID NO: 69629 - DNA, 25 bp, S. pombe
agttctgacaaatgcttgtcctgga

SEQ ID NO: 69630 - DNA, 25 bp, S. pombe
agtttaatgagtccctgtactgcga

SEQ ID NO: 69631 - DNA, 25 bp, S. pombe
agatttggtagtatgcgtcgccctt

SEQ ID NO: 69632 - DNA, 25 bp, S. pombe
agtttcagtgattaccttggcccct

SEQ ID NO: 69633 - DNA, 25 bp, S. pombe
agatcgaatgttcctcttttacctc

SEQ ID NO: 69634 - DNA, 25 bp, S. pombe
agatccctttacgaattcacagagt

SEQ ID NO: 69635 - DNA, 25 bp, S. pombe
agttcctttctactgtctcgataat

SEQ ID NO: 69636 - DNA, 25 bp, S. pombe
agttcagcatcgtcgtaattcccaa

SEQ ID NO: 69637 - DNA, 25 bp, S. pombe
agttcaacattcctaattctcgcag

SEQ ID NO: 69638 - DNA, 25 bp, S. pombe
agatagcgtccttctttcgaaaaag

SEQ ID NO: 69639 - DNA, 25 bp, S. pombe
agctacgttattcttcgattccaag

SEQ ID NO: 69640 - DNA, 25 bp, S. pombe
agatatccctttcattcgtttacga

SEQ ID NO: 69641 - DNA, 25 bp, S. pombe
agttcattcttagagctttgcgccc

SEQ ID NO: 69642 - DNA, 25 bp, S. pombe
agttctgtcttggatgtgtttctca

SEQ ID NO: 69643 - DNA, 25 bp, S. pombe
agttacgtatgcaagactgttctca

SEQ ID NO: 69644 - DNA, 25 bp, S. pombe
agtttagtatctcgacttcctcaac

SEQ ID NO: 69645 - DNA, 25 bp, S. pombe
agttttatatcatgactgtcccaga

SEQ ID NO: 69646 - DNA, 25 bp, S. pombe
agttgtcatcttgtcagcattccac

SEQ ID NO: 69647 - DNA, 25 bp, S. pombe
agttcctttgatttttgcatacgca

SEQ ID NO: 69648 - DNA, 25 bp, S. pombe
agttccttcttcttattgagcgtgt

SEQ ID NO: 69649 - DNA, 25 bp, S. pombe
agttagaagctccacttttgcaagg

SEQ ID NO: 69650 - DNA, 25 bp, S. pombe
agattggtgactctcttttcgatga

SEQ ID NO: 69651 - DNA, 25 bp, S. pombe
agattcctgaagcttctttctatgg

SEQ ID NO: 69652 - DNA, 25 bp, S. pombe
agttcccagatccttatttgttgcg

SEQ ID NO: 69653 - DNA, 25 bp, S. pombe
agattcccaattctcttgcattttc

SEQ ID NO: 69654 - DNA, 25 bp, S. pombe
agttaccactttttctgcattctag

SEQ ID NO: 69655 - DNA, 25 bp, S. pombe
agttcccatcctatctttcatatca

SEQ ID NO: 69656 - DNA, 25 bp, S. pombe
agttcatcaatgctttggtgcccga

SEQ ID NO: 69657 - DNA, 25 bp, S. pombe
agttgctgttgctatccaagactct

SEQ ID NO: 69658 - DNA, 25 bp, S. pombe
agttttgggatctctggagcctgat

SEQ ID NO: 69659 - DNA, 25 bp, S. pombe
agttactggcgatcctgaagcacgt

SEQ ID NO: 69660 - DNA, 25 bp, S. pombe
agttattgaacaccccatggacctt

SEQ ID NO: 69661 - DNA, 25 bp, S. pombe
agttcattgtgatccacatcctgga

SEQ ID NO: 69662 - DNA, 25 bp, S. pombe
agatcattcgatgctcagggattga

SEQ ID NO: 69663 - DNA, 25 bp, S. pombe
agttctgatgtttccgatctgtctt

SEQ ID NO: 69664 - DNA, 25 bp, S. pombe
agatttggcatgctctcgaagctgc

SEQ ID NO: 69665 - DNA, 25 bp, S. pombe
agttctgagggtgcgacatctggat

SEQ ID NO: 69666 - DNA, 25 bp, S. pombe
agctaagaaagctgctgctgccgct

SEQ ID NO: 69667 - DNA, 25 bp, S. pombe
agatcaaatcagttcgttacgttca

SEQ ID NO: 69668 - DNA, 25 bp, S. pombe
agattcgaagatcctttctcgtctc

SEQ ID NO: 69669 - DNA, 25 bp, S. pombe
agttctggtcttgcatttcttcata

SEQ ID NO: 69670 - DNA, 25 bp, S. pombe
agttggaccttgtacacttactcca

SEQ ID NO: 69671 - DNA, 25 bp, S. pombe
agttggagcctttgagccttttgac

SEQ ID NO: 69672 - DNA, 25 bp, S. pombe
agttggcatgcctgaagccgatgta

SEQ ID NO: 69673 - DNA, 25 bp, S. pombe
agttgaatgctcttgggctcgcata

SEQ ID NO: 69674 - DNA, 25 bp, S. pombe
agttatgtttatcgcgctccagagt

SEQ ID NO: 69675 - DNA, 25 bp, S. pombe
agttgtgttatcgttgtcactgcct

SEQ ID NO: 69676 - DNA, 25 bp, S. pombe
agttggtaatcgctgcactcttctt

SEQ ID NO: 69677 - DNA, 25 bp, S. pombe
agatattggaaccaggccctatttc

SEQ ID NO: 69678 - DNA, 25 bp, S. pombe
agattgttgcaacagcgctctctat

SEQ ID NO: 69679 - DNA, 25 bp, S. pombe
agttcttttataattcccacctctg

SEQ ID NO: 69680 - DNA, 25 bp, S. pombe
agttgagttttgtttcctcacctgg

SEQ ID NO: 69681 - DNA, 25 bp, S. pombe
agttgtaatattttctccctctgcg

SEQ ID NO: 69682 - DNA, 25 bp, S. pombe
agttgtcaaacttgtgctccgagtc

SEQ ID NO: 69683 - DNA, 25 bp, S. pombe
agttgctgaatcctcttgatccttt

SEQ ID NO: 69684 - DNA, 25 bp, S. pombe
agattattcagctgctcgtcgttta

SEQ ID NO: 69685 - DNA, 25 bp, S. pombe
agagttccagcctcgtcgaaggatt

SEQ ID NO: 69686 - DNA, 25 bp, S. pombe
agatgctccttacccaggttactat

SEQ ID NO: 69687 - DNA, 25 bp, S. pombe
agttctcttactgtgtatccgttct

SEQ ID NO: 69688 - DNA, 25 bp, S. pombe
agttgcgttagagttgttccctcct

SEQ ID NO: 69689 - DNA, 25 bp, S. pombe
agttggaggatggtcgtactctttc

SEQ ID NO: 69690 - DNA, 25 bp, S. pombe
agttcctcgtgctcgttatgttaaa

SEQ ID NO: 69691 - DNA, 25 bp, S. pombe
agttctctctaatcctgacatttac

SEQ ID NO: 69692 - DNA, 25 bp, S. pombe
agttctttcactccctgtatttgaa

SEQ ID NO: 69693 - DNA, 25 bp, S. pombe
agttcttctcattcttcttcatctt

SEQ ID NO: 69694 - DNA, 25 bp, S. pombe
agttctccagcttttggattcattg

SEQ ID NO: 69695 - DNA, 25 bp, S. pombe
agatttacagctttgggaccttcgg

SEQ ID NO: 69696 - DNA, 25 bp, S. pombe
agattccacctatgcaattcgtttg

SEQ ID NO: 69697 - DNA, 25 bp, S. pombe
agttctggctatacatgcgtctctt

SEQ ID NO: 69698 - DNA, 25 bp, S. pombe
agttcagccaatactcagcctttgg

SEQ ID NO: 69699 - DNA, 25 bp, S. pombe
agttcagtcatatctcgagcttagg

SEQ ID NO: 69700 - DNA, 25 bp, S. pombe
agatagcgtatcgtttcccaggctt

SEQ ID NO: 69701 - DNA, 25 bp, S. pombe
agttggttcatttctcagccatttg

SEQ ID NO: 69702 - DNA, 25 bp, S. pombe
agatcattgagaacgagcctggcat

SEQ ID NO: 69703 - DNA, 25 bp, S. pombe
agatcctgatgaccgacctggttgg

SEQ ID NO: 69704 - DNA, 25 bp, S. pombe
agattccttgtaaccaacggctcta

SEQ ID NO: 69705 - DNA, 25 bp, S. pombe
agattactggtcatccttctgttcg

SEQ ID NO: 69706 - DNA, 25 bp, S. pombe
agttctgggctttgcaattgttcaa

SEQ ID NO: 69707 - DNA, 25 bp, S. pombe
agttcagcttcatttggtgcatccg

SEQ ID NO: 69708 - DNA, 25 bp, S. pombe
agttcgccgctcattctcaagaatt

SEQ ID NO: 69709 - DNA, 25 bp, S. pombe
agttccctctcaatatctgcggaat

SEQ ID NO: 69710 - DNA, 25 bp, S. pombe
agatgtaacccgtgtcatgaccaag

SEQ ID NO: 69711 - DNA, 25 bp, S. pombe
agttgaaggcgctggacgccaacta

SEQ ID NO: 69712 - DNA, 25 bp, S. pombe
agttgcatatcgagtgaatccttag

SEQ ID NO: 69713 - DNA, 25 bp, S. pombe
agttgctgttcgagtccagttacca

SEQ ID NO: 69714 - DNA, 25 bp, S. pombe
agttgtttccctattgtataccgct

SEQ ID NO: 69715 - DNA, 25 bp, S. pombe
agttgttcctctggcattattaccc

SEQ ID NO: 69716 - DNA, 25 bp, S. pombe
agattgttcctgacgtcgaaccagc

SEQ ID NO: 69717 - DNA, 25 bp, S. pombe
agttcgtcgcgtttgtgacctcaaa

SEQ ID NO: 69718 - DNA, 25 bp, S. pombe
agttgcctactatctcggagctggg

SEQ ID NO: 69719 - DNA, 25 bp, S. pombe
agttgcgcgactttctggatgagat

SEQ ID NO: 69720 - DNA, 25 bp, S. pombe
agattgtccgcgtagttgtgtttat

SEQ ID NO: 69721 - DNA, 25 bp, S. pombe
agttgactctgttaattgtgtggca

SEQ ID NO: 69722 - DNA, 25 bp, S. pombe
agttgctggctacattcctggatat

SEQ ID NO: 69723 - DNA, 25 bp, S. pombe
agattctacttttactgctgctacg

SEQ ID NO: 69724 - DNA, 25 bp, S. pombe
agattgctgctcttactagccgtaa

SEQ ID NO: 69725 - DNA, 25 bp, S. pombe
agttgatgctagtggagtcgcctca

SEQ ID NO: 69726 - DNA, 25 bp, S. pombe
agattttggcatttactgggctcat

SEQ ID NO: 69727 - DNA, 25 bp, S. pombe
agttggctgacgctatgggcatcaa

SEQ ID NO: 69728 - DNA, 25 bp, S. pombe
agatactcaaccgttccaatgcagg

SEQ ID NO: 69729 - DNA, 25 bp, S. pombe
agatttatacctttccattgctcct

SEQ ID NO: 69730 - DNA, 25 bp, S. pombe
agcatgcttatcagggaaaggctaa

SEQ ID NO: 69731 - DNA, 25 bp, S. pombe
agatctttttgcgaaggcaggccaa

SEQ ID NO: 69732 - DNA, 25 bp, S. pombe
agattcagcgtatcattcgtccaac

SEQ ID NO: 69733 - DNA, 25 bp, S. pombe
agttccgtcttctttgatcctgact

SEQ ID NO: 69734 - DNA, 25 bp, S. pombe
agttccccttgttctatacagagca

SEQ ID NO: 69735 - DNA, 25 bp, S. pombe
agttgtacgaagacttgctacctaa

SEQ ID NO: 69736 - DNA, 25 bp, S. pombe
agttccagcgatacctgctgagcaa

SEQ ID NO: 69737 - DNA, 25 bp, S. pombe
agttccaggtgttcttacagagcat

SEQ ID NO: 69738 - DNA, 25 bp, S. pombe
agttccatccttttgtagcgtgtgc

SEQ ID NO: 69739 - DNA, 25 bp, S. pombe
agatatcgccctggtttaggtgctg

SEQ ID NO: 69740 - DNA, 25 bp, S. pombe
agttcgtatgctactaccgtggcta

SEQ ID NO: 69741 - DNA, 25 bp, S. pombe
agttggctcgtcgtctccgtggcga

SEQ ID NO: 69742 - DNA, 25 bp, S. pombe
agttgatttggcttccgcattaaaa

SEQ ID NO: 69743 - DNA, 25 bp, S. pombe
agattgcaaagagtcttgtggttgc

SEQ ID NO: 69744 - DNA, 25 bp, S. pombe
agatctatctactcatcctttggga

SEQ ID NO: 69745 - DNA, 25 bp, S. pombe
agttgttgtctcacatcgttacgca

SEQ ID NO: 69746 - DNA, 25 bp, S. pombe
agatgaacttcctcttgttccagag

SEQ ID NO: 69747 - DNA, 25 bp, S. pombe
agatccaacgccttgcgtttgcaag

SEQ ID NO: 69748 - DNA, 25 bp, S. pombe
agatcaaggccttcttacgtgctat

SEQ ID NO: 69749 - DNA, 25 bp, S. pombe
agattaacggctcccttgctcgtat

SEQ ID NO: 69750 - DNA, 25 bp, S. pombe
agattttctacacagcaagcgcgcg

SEQ ID NO: 69751 - DNA, 25 bp, S. pombe
agattctttacggacttgctcgagt

SEQ ID NO: 69752 - DNA, 25 bp, S. pombe
agatatgatccttcgtactatacac

SEQ ID NO: 69753 - DNA, 25 bp, S. pombe
agatctgaagcttctgctagcaatg

SEQ ID NO: 69754 - DNA, 25 bp, S. pombe
agatctagcagattggcagccaaga

SEQ ID NO: 69755 - DNA, 25 bp, S. pombe
agattacattctcgtcagccaagga

SEQ ID NO: 69756 - DNA, 25 bp, S. pombe
agttgcttcgcatcccttaaaaagt

SEQ ID NO: 69757 - DNA, 25 bp, S. pombe
agattttctgcgaacgcttccaaaa

SEQ ID NO: 69758 - DNA, 25 bp, S. pombe
agaccaaacaagctcgcgacgcgtg

SEQ ID NO: 69759 - DNA, 25 bp, S. pombe
agactctaatcatgttccttcggta

SEQ ID NO: 69760 - DNA, 25 bp, S. pombe
agatactcgtaatgtggacctggag

SEQ ID NO: 69761 - DNA, 25 bp, S. pombe
agatactgagaatccttccgctgaa

SEQ ID NO: 69762 - DNA, 25 bp, S. pombe
agatattggatctcgcttacaagaa

SEQ ID NO: 69763 - DNA, 25 bp, S. pombe
agattcaaccatcaactccttgtga

SEQ ID NO: 69764 - DNA, 25 bp, S. pombe
agataccatcgacactctccttttt

SEQ ID NO: 69765 - DNA, 25 bp, S. pombe
agatacgttggatccggctctgtta

SEQ ID NO: 69766 - DNA, 25 bp, S. pombe
agataacaccatcaccgaactcgat

SEQ ID NO: 69767 - DNA, 25 bp, S. pombe
agagtacatggcacccgaagtcttt

SEQ ID NO: 69768 - DNA, 25 bp, S. pombe
agattacagaatcgcgtcgcctttg

SEQ ID NO: 69769 - DNA, 25 bp, S. pombe
agatcaggccattgcatgtgtctct

SEQ ID NO: 69770 - DNA, 25 bp, S. pombe
agatctagctcttcatttcgctgga

SEQ ID NO: 69771 - DNA, 25 bp, S. pombe
agatcgctgctgaaattcaccctgg

SEQ ID NO: 69772 - DNA, 25 bp, S. pombe
agatccttggagtcatgcttagaag

SEQ ID NO: 69773 - DNA, 25 bp, S. pombe
agatcttacctcttcttacgaaatt

SEQ ID NO: 69774 - DNA, 25 bp, S. pombe
agattgtaaccgtcttgccgaagag

SEQ ID NO: 69775 - DNA, 25 bp, S. pombe
agaggattctgctccaaaagccaat

SEQ ID NO: 69776 - DNA, 25 bp, S. pombe
agaatacactgcctctaaaagcccc

SEQ ID NO: 69777 - DNA, 25 bp, S. pombe
agataaacatgcctctttcgaaccc

SEQ ID NO: 69778 - DNA, 25 bp, S. pombe
agattgtcaagcgttcgagctccca

SEQ ID NO: 69779 - DNA, 25 bp, S. pombe
agagattcggacttccagggccaga

SEQ ID NO: 69780 - DNA, 25 bp, S. pombe
agaggctatcaactaaacttcccgg

SEQ ID NO: 69781 - DNA, 25 bp, S. pombe
agatcgttcgttaccagcgttgaat

SEQ ID NO: 69782 - DNA, 25 bp, S. pombe
agatattttgtctgctcggttgctt

SEQ ID NO: 69783 - DNA, 25 bp, S. pombe
agatattacttccacacggttgcgc

SEQ ID NO: 69784 - DNA, 25 bp, S. pombe
agattgattctcaggactccattcc

SEQ ID NO: 69785 - DNA, 25 bp, S. pombe
agatcagacaaagaatgcccgcgtt

SEQ ID NO: 69786 - DNA, 25 bp, S. pombe
agagcaactgcaaaacgaaatactt

SEQ ID NO: 69787 - DNA, 25 bp, S. pombe
agataaccggtctccaagcactgtt

SEQ ID NO: 69788 - DNA, 25 bp, S. pombe
agatatacctaattccaccagcact

SEQ ID NO: 69789 - DNA, 25 bp, S. pombe
agagtcacgctatgttcctagtgct

SEQ ID NO: 69790 - DNA, 25 bp, S. pombe
agttgatccttttgctgacactggt

SEQ ID NO: 69791 - DNA, 25 bp, S. pombe
agttgtctccttcgattgatgtgca

SEQ ID NO: 69792 - DNA, 25 bp, S. pombe
agatcatccttctagaggcgttcac

SEQ ID NO: 69793 - DNA, 25 bp, S. pombe
agatctcgaaagcaatactcctcca

SEQ ID NO: 69794 - DNA, 25 bp, S. pombe
agattttaagtcctgccgccattga

SEQ ID NO: 69795 - DNA, 25 bp, S. pombe
agttgatatgcattcctctacgcct

SEQ ID NO: 69796 - DNA, 25 bp, S. pombe
agattgaagctctccatacgccttg

SEQ ID NO: 69797 - DNA, 25 bp, S. pombe
agattgacactgtggttcacgcggc

SEQ ID NO: 69798 - DNA, 25 bp, S. pombe
agaatttcaggcactttcccagaat

SEQ ID NO: 69799 - DNA, 25 bp, S. pombe
agaactacgccaaggaatcccggat

SEQ ID NO: 69800 - DNA, 25 bp, S. pombe
agacaggctaggcagtacaacttgg

SEQ ID NO: 69801 - DNA, 25 bp, S. pombe
agaggaggtttctcgtactatcgaa

SEQ ID NO: 69802 - DNA, 25 bp, S. pombe
agattggtgttttcctatcgcgatc

SEQ ID NO: 69803 - DNA, 25 bp, S. pombe
agatagcccttcaagttgccggtac

SEQ ID NO: 69804 - DNA, 25 bp, S. pombe
agatcatccttttgggtgccggtac

SEQ ID NO: 69805 - DNA, 25 bp, S. pombe
agatgcccgatttgcggtcgtggat

SEQ ID NO: 69806 - DNA, 25 bp, S. pombe
agatgcatcaaatcctgcgtccgga

SEQ ID NO: 69807 - DNA, 25 bp, S. pombe
agatcaacggatctcttgctcgtat

SEQ ID NO: 69808 - DNA, 25 bp, S. pombe
agattctggttcaactcgcggtcag

SEQ ID NO: 69809 - DNA, 25 bp, S. pombe
agatattaccgatcatcctgttgaa

SEQ ID NO: 69810 - DNA, 25 bp, S. pombe
agatatgttccgctctttgcataaa

SEQ ID NO: 69811 - DNA, 25 bp, S. pombe
agactatgacggcacttttctttcc

SEQ ID NO: 69812 - DNA, 25 bp, S. pombe
agcgtagccgttggtgatcgtgtct

SEQ ID NO: 69813 - DNA, 25 bp, S. pombe
agattggattcgacgttgctgcttc

SEQ ID NO: 69814 - DNA, 25 bp, S. pombe
agattgctattcttcgtgatcgctc

SEQ ID NO: 69815 - DNA, 25 bp, S. pombe
agattgttgctttctctgaggccgc

SEQ ID NO: 69816 - DNA, 25 bp, S. pombe
agatctactcttgcctgaatgccag

SEQ ID NO: 69817 - DNA, 25 bp, S. pombe
agattatgtcttccacagttacgcc

SEQ ID NO: 69818 - DNA, 25 bp, S. pombe
agattcgtgctagccatttactcgt

SEQ ID NO: 69819 - DNA, 25 bp, S. pombe
agatacagtcatttcacttctcctc

SEQ ID NO: 69820 - DNA, 25 bp, S. pombe
agattcgcaatgctcaacttgccca

SEQ ID NO: 69821 - DNA, 25 bp, S. pombe
agatctcatggttcgcttttgtaat

SEQ ID NO: 69822 - DNA, 25 bp, S. pombe
agattttcttccgtgtgacatttgc

SEQ ID NO: 69823 - DNA, 25 bp, S. pombe
agattgcttctctttcgtgggatat

SEQ ID NO: 69824 - DNA, 25 bp, S. pombe
agatacttctagaccaccacattaa

SEQ ID NO: 69825 - DNA, 25 bp, S. pombe
agatcgatttcattgcttgccattg

SEQ ID NO: 69826 - DNA, 25 bp, S. pombe
agattgatagcctcttccagcatgg

SEQ ID NO: 69827 - DNA, 25 bp, S. pombe
agattcttatctactctgactccag

SEQ ID NO: 69828 - DNA, 25 bp, S. pombe
agatttaacctatttctctcgcaaa

SEQ ID NO: 69829 - DNA, 25 bp, S. pombe
agattcttgagcttgtaggtccagg

SEQ ID NO: 69830 - DNA, 25 bp, S. pombe
agatcattgtccttcaaggtgccgt

SEQ ID NO: 69831 - DNA, 25 bp, S. pombe
agattttccaattatgcctgccgag

SEQ ID NO: 69832 - DNA, 25 bp, S. pombe
agatttcctattaaatcgagatatg

SEQ ID NO: 69833 - DNA, 25 bp, S. pombe
agattcgatctttgactcttgacaa

SEQ ID NO: 69834 - DNA, 25 bp, S. pombe
agattccttttctaatcccattggt

SEQ ID NO: 69835 - DNA, 25 bp, S. pombe
agattgtttttctttctctcttggc

SEQ ID NO: 69836 - DNA, 25 bp, S. pombe
agattgcttcttccgattttttgac

SEQ ID NO: 69837 - DNA, 25 bp, S. pombe
agattcgtcttcagcaacgtcttac

SEQ ID NO: 69838 - DNA, 25 bp, S. pombe
agatgtggtcatatgcaaaacgcct

SEQ ID NO: 69839 - DNA, 25 bp, S. pombe
agctgtgcaagctgccaatgaacgt

SEQ ID NO: 69840 - DNA, 25 bp, S. pombe
agatcatccagtttccatcaagcat

SEQ ID NO: 69841 - DNA, 25 bp, S. pombe
agattgcatctggttctgctacagt

SEQ ID NO: 69842 - DNA, 25 bp, S. pombe
agatacatttttggcgacagatggg

SEQ ID NO: 69843 - DNA, 25 bp, S. pombe
agatctgctttatcagttccacgca

SEQ ID NO: 69844 - DNA, 25 bp, S. pombe
agattgctggtaacgtctctgctcg

SEQ ID NO: 69845 - DNA, 25 bp, S. pombe
agattcaggatacgcgtcttctcca

SEQ ID NO: 69846 - DNA, 25 bp, S. pombe
agatgtccaatatggctctggccca

SEQ ID NO: 69847 - DNA, 25 bp, S. pombe
agattagcgatttaggacatccctt

SEQ ID NO: 69848 - DNA, 25 bp, S. pombe
agatcgaggttcaacagcactcccg

SEQ ID NO: 69849 - DNA, 25 bp, S. pombe
agatcacatcaattttcctggcctc

SEQ ID NO: 69850 - DNA, 25 bp, S. pombe
agattctgcctcacctgttgatgat

SEQ ID NO: 69851 - DNA, 25 bp, S. pombe
agattgcttcaactgccttcctata

SEQ ID NO: 69852 - DNA, 25 bp, S. pombe
agatacattcaactcttctccatat

SEQ ID NO: 69853 - DNA, 25 bp, S. pombe
agatatcctctacgcttccaaagtg

SEQ ID NO: 69854 - DNA, 25 bp, S. pombe
agattccctacactataccagatgg

SEQ ID NO: 69855 - DNA, 25 bp, S. pombe
agatagccagaccactcttgataaa

SEQ ID NO: 69856 - DNA, 25 bp, S. pombe
agattccatacacttctcttagcaa

SEQ ID NO: 69857 - DNA, 25 bp, S. pombe
agatgaattacaagctggcggataa

SEQ ID NO: 69858 - DNA, 25 bp, S. pombe
agattctcttgcttcttggcattat

SEQ ID NO: 69859 - DNA, 25 bp, S. pombe
agaggctggtgttccacgtttaact

SEQ ID NO: 69860 - DNA, 25 bp, S. pombe
agatgaggattcagctgccggtcta

SEQ ID NO: 69861 - DNA, 25 bp, S. pombe
agattttgataagcactcctcccat

SEQ ID NO: 69862 - DNA, 25 bp, S. pombe
agattctacgaaaacagcctatgca

SEQ ID NO: 69863 - DNA, 25 bp, S. pombe
agatccatcctcctacagtgaaaga

SEQ ID NO: 69864 - DNA, 25 bp, S. pombe
agatcatccactctatcgcaaaatc

SEQ ID NO: 69865 - DNA, 25 bp, S. pombe
agatatccagtccatccagctaaga

SEQ ID NO: 69866 - DNA, 25 bp, S. pombe
agatacccagtccaaccagatgagt

SEQ ID NO: 69867 - DNA, 25 bp, S. pombe
agattctcactctgctcaaaatgaa

SEQ ID NO: 69868 - DNA, 25 bp, S. pombe
agatcatgcatctgggccggtgaat

SEQ ID NO: 69869 - DNA, 25 bp, S. pombe
agatgcagcatcaggttcgtccaca

SEQ ID NO: 69870 - DNA, 25 bp, S. pombe
agatgcaatcatcggcttctatgaa

SEQ ID NO: 69871 - DNA, 25 bp, S. pombe
agatcttcaggccttttgcatcgtt

SEQ ID NO: 69872 - DNA, 25 bp, S. pombe
agattttccatcgtttcacttcttc

SEQ ID NO: 69873 - DNA, 25 bp, S. pombe
agattctacactatctgcttcttct

SEQ ID NO: 69874 - DNA, 25 bp, S. pombe
agatcgtcacggacagactgtttgt

SEQ ID NO: 69875 - DNA, 25 bp, S. pombe
agatatgtcgcatttggcagctcaa

SEQ ID NO: 69876 - DNA, 25 bp, S. pombe
agataaatcattgttcctgctcctc

SEQ ID NO: 69877 - DNA, 25 bp, S. pombe
agatccctaacgaactgctggcagt

SEQ ID NO: 69878 - DNA, 25 bp, S. pombe
agatggcgcaaggacaagactgttc

SEQ ID NO: 69879 - DNA, 25 bp, S. pombe
agatcatgaaactcttcgcgctttt

SEQ ID NO: 69880 - DNA, 25 bp, S. pombe
agagtgcggacttgttcgttttgct

SEQ ID NO: 69881 - DNA, 25 bp, S. pombe
agatgttccatatactcgtgttcga

SEQ ID NO: 69882 - DNA, 25 bp, S. pombe
agatccttcccttgaatttgctaag

SEQ ID NO: 69883 - DNA, 25 bp, S. pombe
agatcgctttcctgctgttttaaaa

SEQ ID NO: 69884 - DNA, 25 bp, S. pombe
agatatgccttagcctttttacctt

SEQ ID NO: 69885 - DNA, 25 bp, S. pombe
caatgcgactggaaactttttacct

SEQ ID NO: 69886 - DNA, 25 bp, S. pombe
agagacgcggtgatttttatgtaat

SEQ ID NO: 69887 - DNA, 25 bp, S. pombe
agaggccgagtctcgttattccaac

SEQ ID NO: 69888 - DNA, 25 bp, S. pombe
agagagttaaccctgctgctattgc

SEQ ID NO: 69889 - DNA, 25 bp, S. pombe
agacgcttcttctactaacgattcc

SEQ ID NO: 69890 - DNA, 25 bp, S. pombe
agatcgctgctttaactagccgtaa

SEQ ID NO: 69891 - DNA, 25 bp, S. pombe
agatacatcttccaacgtctcttta

SEQ ID NO: 69892 - DNA, 25 bp, S. pombe
agatcctattcaaacgtctcttctg

SEQ ID NO: 69893 - DNA, 25 bp, S. pombe
agatccctcatatctcgcacttatg

SEQ ID NO: 69894 - DNA, 25 bp, S. pombe
agatcacgatctacaagctccgatt

SEQ ID NO: 69895 - DNA, 25 bp, S. pombe
agatcatgggttctgccgtagcagc

SEQ ID NO: 69896 - DNA, 25 bp, S. pombe
agataatgatccttcgtcgttgcaa

SEQ ID NO: 69897 - DNA, 25 bp, S. pombe
agatattgatccctctgtcatgtct

SEQ ID NO: 69898 - DNA, 25 bp, S. pombe
agagagggtattgcttctcttcccg

SEQ ID NO: 69899 - DNA, 25 bp, S. pombe
agagagggttatctgtgcttctacc

SEQ ID NO: 69900 - DNA, 25 bp, S. pombe
agatcctgctggtcaacacttaact

SEQ ID NO: 69901 - DNA, 25 bp, S. pombe
agatctctcgaattcaaagtgcaac

SEQ ID NO: 69902 - DNA, 25 bp, S. pombe
agatatctcgcgctcagacggacaa

SEQ ID NO: 69903 - DNA, 25 bp, S. pombe
agatttatggtctacacggcacaaa

SEQ ID NO: 69904 - DNA, 25 bp, S. pombe
agatttatgtgaaagcccagcagca

SEQ ID NO: 69905 - DNA, 25 bp, S. pombe
agatttgtgtgttagcactccgcca

SEQ ID NO: 69906 - DNA, 25 bp, S. pombe
agagcttgaggaatgtgcccgcagt

SEQ ID NO: 69907 - DNA, 25 bp, S. pombe
agatcttctgactgcttttgagaac

SEQ ID NO: 69908 - DNA, 25 bp, S. pombe
agatctcattcattggcgacttcga

SEQ ID NO: 69909 - DNA, 25 bp, S. pombe
agatatctctcgcaagatctctcga

SEQ ID NO: 69910 - DNA, 25 bp, S. pombe
agatccgttggctagttgtcctcaa

SEQ ID NO: 69911 - DNA, 25 bp, S. pombe
agatttgtgcatccaagtcgcgcag

SEQ ID NO: 69912 - DNA, 25 bp, S. pombe
agatctttgttactctttacaggaa

SEQ ID NO: 69913 - DNA, 25 bp, S. pombe
agatgagtccgttttacgtcgctta

SEQ ID NO: 69914 - DNA, 25 bp, S. pombe
agaggtatcgacagttgcgtccgtc

SEQ ID NO: 69915 - DNA, 25 bp, S. pombe
agaggtactcggctttgacatcgtt

SEQ ID NO: 69916 - DNA, 25 bp, S. pombe
agatgtattggacacggccggtcaa

SEQ ID NO: 69917 - DNA, 25 bp, S. pombe
agatgtttttattaggccaggtcct

SEQ ID NO: 69918 - DNA, 25 bp, S. pombe
agatcttttttctagcggagagctc

SEQ ID NO: 69919 - DNA, 25 bp, S. pombe
agatctcgtgatactccacctgaag

SEQ ID NO: 69920 - DNA, 25 bp, S. pombe
agatattcttggagctgcctctcat

SEQ ID NO: 69921 - DNA, 25 bp, S. pombe
agatcattttgctgactgtctctct

SEQ ID NO: 69922 - DNA, 25 bp, S. pombe
agatgctttggacacgattcctctt

SEQ ID NO: 69923 - DNA, 25 bp, S. pombe
agatcttttgacgagccaatgccca

SEQ ID NO: 69924 - DNA, 25 bp, S. pombe
agatcttatggccaagtcttgctat

SEQ ID NO: 69925 - DNA, 25 bp, S. pombe
agatctctgatactgacttcgacaa

SEQ ID NO: 69926 - DNA, 25 bp, S. pombe
agatctcaaatctcttcctgacata

SEQ ID NO: 69927 - DNA, 25 bp, S. pombe
agagtaattcggctgctgttgcaac

SEQ ID NO: 69928 - DNA, 25 bp, S. pombe
agagagctcatgtatcgcggcgaca

SEQ ID NO: 69929 - DNA, 25 bp, S. pombe
agataccatggtcgctacaaattag

SEQ ID NO: 69930 - DNA, 25 bp, S. pombe
agatctccacgggttcgagttactg

SEQ ID NO: 69931 - DNA, 25 bp, S. pombe
agatgttaccgccttcgatagggtg

SEQ ID NO: 69932 - DNA, 25 bp, S. pombe
agatcagtccgctaccaggatcaag

SEQ ID NO: 69933 - DNA, 25 bp, S. pombe
agatggactctttgcattttgcgtt

SEQ ID NO: 69934 - DNA, 25 bp, S. pombe
agataccttaattcatcgttgctaa

SEQ ID NO: 69935 - DNA, 25 bp, S. pombe
agatatgtttcgcagtcgttttgaa

SEQ ID NO: 69936 - DNA, 25 bp, S. pombe
agatgtacaatgtcaccgatcccga

SEQ ID NO: 69937 - DNA, 25 bp, S. pombe
agatgttttgcgcacggcgttgcaa

SEQ ID NO: 69938 - DNA, 25 bp, S. pombe
agaggtttctggatccttaccaaat

SEQ ID NO: 69939 - DNA, 25 bp, S. pombe
agagattgtccttattactaccaag

SEQ ID NO: 69940 - DNA, 25 bp, S. pombe
agacttacgtttcttcaccagtagg

SEQ ID NO: 69941 - DNA, 25 bp, S. pombe
agagaggaaatctcctaatgcctaa

SEQ ID NO: 69942 - DNA, 25 bp, S. pombe
agagaagatttctcctcttcctaca

SEQ ID NO: 69943 - DNA, 25 bp, S. pombe
agatgacggttcttctgtctacgtt

SEQ ID NO: 69944 - DNA, 25 bp, S. pombe
agatcatctcgcaaactgctttatg

SEQ ID NO: 69945 - DNA, 25 bp, S. pombe
agatgatctcagtacggcttttggc

SEQ ID NO: 69946 - DNA, 25 bp, S. pombe
agatcccgcatctttatgttattcg

SEQ ID NO: 69947 - DNA, 25 bp, S. pombe
agatgcccgtattcttctgtttaac

SEQ ID NO: 69948 - DNA, 25 bp, S. pombe
agatcactcctgatgctgtcgagat

SEQ ID NO: 69949 - DNA, 25 bp, S. pombe
agatcaccttcactggacgatgttt

SEQ ID NO: 69950 - DNA, 25 bp, S. pombe
agatacacattgttgcagaggctgc

SEQ ID NO: 69951 - DNA, 25 bp, S. pombe
agataatcatgtcctgatgccctca

SEQ ID NO: 69952 - DNA, 25 bp, S. pombe
agaggctgcaaagcttcgtgccatg

SEQ ID NO: 69953 - DNA, 25 bp, S. pombe
agagagctgaaacatccgatgccat

SEQ ID NO: 69954 - DNA, 25 bp, S. pombe
agatgctgtttcaaagggtgccaaa

SEQ ID NO: 69955 - DNA, 25 bp, S. pombe
agatgctgccgtgaaatggtctcat

SEQ ID NO: 69956 - DNA, 25 bp, S. pombe
agatcttcaatctcagaggctcgat

SEQ ID NO: 69957 - DNA, 25 bp, S. pombe
agatcctcacttcaaggctcgtaaa

SEQ ID NO: 69958 - DNA, 25 bp, S. pombe
agatactgactttagcggctgggaa

SEQ ID NO: 69959 - DNA, 25 bp, S. pombe
agatacgacttttacgtgcctattt

SEQ ID NO: 69960 - DNA, 25 bp, S. pombe
agaggaaactggttcttccccattg

SEQ ID NO: 69961 - DNA, 25 bp, S. pombe
agatcagttatcgagggttgccttc

SEQ ID NO: 69962 - DNA, 25 bp, S. pombe
agatcctgctcaccaagacgaagtt

SEQ ID NO: 69963 - DNA, 25 bp, S. pombe
agatccttcgcttaactacatttca

SEQ ID NO: 69964 - DNA, 25 bp, S. pombe
agatgaacctacaattcgccgtgtc

SEQ ID NO: 69965 - DNA, 25 bp, S. pombe
agagcacaaggctttccgaaaggca

SEQ ID NO: 69966 - DNA, 25 bp, S. pombe
aacctactgttttcaaaaggcgctg

SEQ ID NO: 69967 - DNA, 25 bp, S. pombe
agatggtttctatttccacggcttt

SEQ ID NO: 69968 - DNA, 25 bp, S. pombe
agatgtggcagagacttcctcgtcg

SEQ ID NO: 69969 - DNA, 25 bp, S. pombe
agatcaggttgctagccttcaggaa

SEQ ID NO: 69970 - DNA, 25 bp, S. pombe
agatgctcgttcagctgttatggct

SEQ ID NO: 69971 - DNA, 25 bp, S. pombe
agatgcgtgtgtgtgtgcttcagca

SEQ ID NO: 69972 - DNA, 25 bp, S. pombe
agaggccttggccatagcctttggc

SEQ ID NO: 69973 - DNA, 25 bp, S. pombe
agatctaccaagctggtggtgctcc

SEQ ID NO: 69974 - DNA, 25 bp, S. pombe
agatcgtgtgcaagaggttcctcat

SEQ ID NO: 69975 - DNA, 25 bp, S. pombe
agatgcagttcacaagctacccatg

SEQ ID NO: 69976 - DNA, 25 bp, S. pombe
catgagcgttacgaaaacctccctt

SEQ ID NO: 69977 - DNA, 25 bp, S. pombe
agctttatgaaagagccgccccaga

SEQ ID NO: 69978 - DNA, 25 bp, S. pombe
agagctttcaaagacccctaggaat

SEQ ID NO: 69979 - DNA, 25 bp, S. pombe
agagactaaaggtcgtgacgccgat

SEQ ID NO: 69980 - DNA, 25 bp, S. pombe
agagaccctgaactcgtccagaagg

SEQ ID NO: 69981 - DNA, 25 bp, S. pombe
agatgttccgatcatcgtcctgtat

SEQ ID NO: 69982 - DNA, 25 bp, S. pombe
agatgacccatctattgtgcgtaga

SEQ ID NO: 69983 - DNA, 25 bp, S. pombe
agatgatccgtctgtcactgttgaa

SEQ ID NO: 69984 - DNA, 25 bp, S. pombe
agatgttaacagactcgatgagctt

SEQ ID NO: 69985 - DNA, 25 bp, S. pombe
agatcttgtccgagcagagactgct

SEQ ID NO: 69986 - DNA, 25 bp, S. pombe
agatcttttggtggagacatgctca

SEQ ID NO: 69987 - DNA, 25 bp, S. pombe
agatgcttttggtcctatcgctcaa

SEQ ID NO: 69988 - DNA, 25 bp, S. pombe
agagggactgattattcactggcca

SEQ ID NO: 69989 - DNA, 25 bp, S. pombe
agagggagtcaattcttccgcagtc

SEQ ID NO: 69990 - DNA, 25 bp, S. pombe
agagtttataataccccgcgtgcca

SEQ ID NO: 69991 - DNA, 25 bp, S. pombe
agaggttacacctctttgggcggcg

SEQ ID NO: 69992 - DNA, 25 bp, S. pombe
agaggattactcttccttctacggt

SEQ ID NO: 69993 - DNA, 25 bp, S. pombe
agctgcacttaatcaagacgtcgga

SEQ ID NO: 69994 - DNA, 25 bp, S. pombe
agcccttgaaagaaaccctgatgag

SEQ ID NO: 69995 - DNA, 25 bp, S. pombe
agacctagtttctctatccatttct

SEQ ID NO: 69996 - DNA, 25 bp, S. pombe
agacgtagcttccattagtccacat

SEQ ID NO: 69997 - DNA, 25 bp, S. pombe
agatcctacttcctgaatccgaact

SEQ ID NO: 69998 - DNA, 25 bp, S. pombe
agatcctcatgccttcttgggtgat

SEQ ID NO: 69999 - DNA, 25 bp, S. pombe
agatgcgatggtacccaggcgtgat

SEQ ID NO: 70000 - DNA, 25 bp, S. pombe
agatgcgctcttttcacagttggat

SEQ ID NO: 70001 - DNA, 25 bp, S. pombe
agatggattcccactgctaatcgta

SEQ ID NO: 70002 - DNA, 25 bp, S. pombe
agaggattcccgtgatacacagcaa

SEQ ID NO: 70003 - DNA, 25 bp, S. pombe
agatgtgaatcagcgacttctagtc

SEQ ID NO: 70004 - DNA, 25 bp, S. pombe
agatctgtatgctgccactattggt

SEQ ID NO: 70005 - DNA, 25 bp, S. pombe
agatgcccacttggctaagttggct

SEQ ID NO: 70006 - DNA, 25 bp, S. pombe
agatgagattctttacctcgcgcaa

SEQ ID NO: 70007 - DNA, 25 bp, S. pombe
agatccatctctaaagtcttctctc

SEQ ID NO: 70008 - DNA, 25 bp, S. pombe
agatccttcaattatccttctcgat

SEQ ID NO: 70009 - DNA, 25 bp, S. pombe
agagtatctatcgacctcctatgga

SEQ ID NO: 70010 - DNA, 25 bp, S. pombe
agatcctcattccatgccatattat

SEQ ID NO: 70011 - DNA, 25 bp, S. pombe
agatcctgcattggctcaagctatt

SEQ ID NO: 70012 - DNA, 25 bp, S. pombe
agatgcttctttcactttgtcttca

SEQ ID NO: 70013 - DNA, 25 bp, S. pombe
agatcgactttcttttgctctgcaa

SEQ ID NO: 70014 - DNA, 25 bp, S. pombe
agatcgtttatcttctgctcttcat

SEQ ID NO: 70015 - DNA, 25 bp, S. pombe
agatggttggtgctcgtttgatttc

SEQ ID NO: 70016 - DNA, 25 bp, S. pombe
agatgagcttatccatagccccatt

SEQ ID NO: 70017 - DNA, 25 bp, S. pombe
agatgttgcatctcgtggtattgat

SEQ ID NO: 70018 - DNA, 25 bp, S. pombe
agatgtacgatctttttggtaggta

SEQ ID NO: 70019 - DNA, 25 bp, S. pombe
caggcttcaaggtttcgtcgggtat

SEQ ID NO: 70020 - DNA, 25 bp, S. pombe
agaggctaaggctattctacggtta

SEQ ID NO: 70021 - DNA, 25 bp, S. pombe
agagtcagctcctcgttatgatact

SEQ ID NO: 70022 - DNA, 25 bp, S. pombe
agaggctaccattcaacgatattac

SEQ ID NO: 70023 - DNA, 25 bp, S. pombe
agatgcgtatccacaagcgtctcat

SEQ ID NO: 70024 - DNA, 25 bp, S. pombe
agaggtgatactggcctaacagcaa

SEQ ID NO: 70025 - DNA, 25 bp, S. pombe
agatgagccacttgtctctgacaat

SEQ ID NO: 70026 - DNA, 25 bp, S. pombe
agatcctccgttgcactgagttaat

SEQ ID NO: 70027 - DNA, 25 bp, S. pombe
agatccatcagggttcagccagttg

SEQ ID NO: 70028 - DNA, 25 bp, S. pombe
agatggcacctgaatttcgagtccc

SEQ ID NO: 70029 - DNA, 25 bp, S. pombe
agagatttcgagctcgtccaagctt

SEQ ID NO: 70030 - DNA, 25 bp, S. pombe
agagactcctggcagttacacagct

SEQ ID NO: 70031 - DNA, 25 bp, S. pombe
agaggccgtggagctgtacacagca

SEQ ID NO: 70032 - DNA, 25 bp, S. pombe
agaggaagtcgagcctgccaagcac

SEQ ID NO: 70033 - DNA, 25 bp, S. pombe
agatgaaatgtcgacctctgcacct

SEQ ID NO: 70034 - DNA, 25 bp, S. pombe
agagcgaattctcacggaccgtatt

SEQ ID NO: 70035 - DNA, 25 bp, S. pombe
agatccaaatactcctaaacgcaat

SEQ ID NO: 70036 - DNA, 25 bp, S. pombe
agatgccgcaacgtctagaaacaca

SEQ ID NO: 70037 - DNA, 25 bp, S. pombe
agatgtctggacgtgctaacggaat

SEQ ID NO: 70038 - DNA, 25 bp, S. pombe
tagttttacttgcaatcgggaccct

SEQ ID NO: 70039 - DNA, 25 bp, S. pombe
agatgctttgactgcgaatcgagga

SEQ ID NO: 70040 - DNA, 25 bp, S. pombe
agatgtatgggacactgctcttgaa

SEQ ID NO: 70041 - DNA, 25 bp, S. pombe
agatggatggcgttctcgtcctaca

SEQ ID NO: 70042 - DNA, 25 bp, S. pombe
agatggccagcgtacattgttacta

SEQ ID NO: 70043 - DNA, 25 bp, S. pombe
agaggcctctgatcattggaatcca

SEQ ID NO: 70044 - DNA, 25 bp, S. pombe
agatgaccttcctattgctacttat

SEQ ID NO: 70045 - DNA, 25 bp, S. pombe
agatgctcccttttgctgatttaat

SEQ ID NO: 70046 - DNA, 25 bp, S. pombe
agatgatgcaccagaacttcctaat

SEQ ID NO: 70047 - DNA, 25 bp, S. pombe
agatgatcctataactttcgccaat

SEQ ID NO: 70048 - DNA, 25 bp, S. pombe
agatgacagtactgttcgccttaca

SEQ ID NO: 70049 - DNA, 25 bp, S. pombe
agatgcggtttcaagtcgtttacag

SEQ ID NO: 70050 - DNA, 25 bp, S. pombe
agatgctgtattttctgtcggtgct

SEQ ID NO: 70051 - DNA, 25 bp, S. pombe
agatgtacgcattcttcgggatatt

SEQ ID NO: 70052 - DNA, 25 bp, S. pombe
agaggctatcgatctcattgcagag

SEQ ID NO: 70053 - DNA, 25 bp, S. pombe
agagagcgattgcaccatctgcagc

SEQ ID NO: 70054 - DNA, 25 bp, S. pombe
agatggtttcaagtttccttcctgc

SEQ ID NO: 70055 - DNA, 25 bp, S. pombe
agaggatcttcaaaacgcccttctg

SEQ ID NO: 70056 - DNA, 25 bp, S. pombe
agaggttccagttcacgtggtgcat

SEQ ID NO: 70057 - DNA, 25 bp, S. pombe
agagccgtcggttcccttgatggga

SEQ ID NO: 70058 - DNA, 25 bp, S. pombe
agatgccacactcgaatttttcaag

SEQ ID NO: 70059 - DNA, 25 bp, S. pombe
agatggtcgtcgtagcactcattat

SEQ ID NO: 70060 - DNA, 25 bp, S. pombe
agatgttcccatgccttatagtcat

SEQ ID NO: 70061 - DNA, 25 bp, S. pombe
agagatttcaacctgcattcgccat

SEQ ID NO: 70062 - DNA, 25 bp, S. pombe
agagctgagcaatcgccatgctaac

SEQ ID NO: 70063 - DNA, 25 bp, S. pombe
agacggtcgattcaaggcatcctcg

SEQ ID NO: 70064 - DNA, 25 bp, S. pombe
agagccatactggatgacccaccta

SEQ ID NO: 70065 - DNA, 25 bp, S. pombe
agagctctccagaatcaaattttag

SEQ ID NO: 70066 - DNA, 25 bp, S. pombe
agagcctgcttcaaacaagccacgt

SEQ ID NO: 70067 - DNA, 25 bp, S. pombe
agatgattttcatttcctccctttt

SEQ ID NO: 70068 - DNA, 25 bp, S. pombe
agagttcgtggtcgatcaactgatc

SEQ ID NO: 70069 - DNA, 25 bp, S. pombe
agaatccgtgaacttaccgctttag

SEQ ID NO: 70070 - DNA, 25 bp, S. pombe
agatgatcctaatattgcctctccc

SEQ ID NO: 70071 - DNA, 25 bp, S. pombe
agagtgctctgctcgaacaaatccc

SEQ ID NO: 70072 - DNA, 25 bp, S. pombe
agcaggcctggtcaaaaattcccct

SEQ ID NO: 70073 - DNA, 25 bp, S. pombe
agaccacgaggatggcgttttccct

SEQ ID NO: 70074 - DNA, 25 bp, S. pombe
aagccggcagcgtgggtttgaattt

SEQ ID NO: 70075 - DNA, 25 bp, S. pombe
agactggtaacttgggctcttctgt

SEQ ID NO: 70076 - DNA, 25 bp, S. pombe
agagtctttcacagcacatgcaaaa

SEQ ID NO: 70077 - DNA, 25 bp, S. pombe
agatgtcgtctcaaagtgccaataa

SEQ ID NO: 70078 - DNA, 25 bp, S. pombe
agatgcagctgctcttggtgctata

SEQ ID NO: 70079 - DNA, 25 bp, S. pombe
agatgcacagcttcgtgtggctcga

SEQ ID NO: 70080 - DNA, 25 bp, S. pombe
agatgatacttacttgccttctcct

SEQ ID NO: 70081 - DNA, 25 bp, S. pombe
agatgaatctctcttcttgtcttct

SEQ ID NO: 70082 - DNA, 25 bp, S. pombe
agatgtttccatatcttcttctctc

SEQ ID NO: 70083 - DNA, 25 bp, S. pombe
agatggccttatcatttctacacct

SEQ ID NO: 70084 - DNA, 25 bp, S. pombe
agatggcgctgttctattgctttac

SEQ ID NO: 70085 - DNA, 25 bp, S. pombe
agatggtgctactcattggcttgaa

SEQ ID NO: 70086 - DNA, 25 bp, S. pombe
agaggttcctcagcttgattttgaa

SEQ ID NO: 70087 - DNA, 25 bp, S. pombe
agaggattatctaggcgttctttaa

SEQ ID NO: 70088 - DNA, 25 bp, S. pombe
agagtgtttccgtcagtatttccca

SEQ ID NO: 70089 - DNA, 25 bp, S. pombe
agaggatgctttacgtacccttcca

SEQ ID NO: 70090 - DNA, 25 bp, S. pombe
agagccacacatcctgctatttaag

SEQ ID NO: 70091 - DNA, 25 bp, S. pombe
agatgtcctatcgatccatttcaaa

SEQ ID NO: 70092 - DNA, 25 bp, S. pombe
agatggaatctaaactttgctcaaa

SEQ ID NO: 70093 - DNA, 25 bp, S. pombe
agaggttgtcgctattttacgtcaa

SEQ ID NO: 70094 - DNA, 25 bp, S. pombe
agacgtcgccgttgttaatcagtaa

SEQ ID NO: 70095 - DNA, 25 bp, S. pombe
agaggttcttcatctactatgccac

SEQ ID NO: 70096 - DNA, 25 bp, S. pombe
agaccctcaaatcaactagccatgt

SEQ ID NO: 70097 - DNA, 25 bp, S. pombe
agagttgatgcttaggaccccgtat

SEQ ID NO: 70098 - DNA, 25 bp, S. pombe
agaggttgcaaagcctgctccagtt

SEQ ID NO: 70099 - DNA, 25 bp, S. pombe
agaggccaggcttcagaatctggat

SEQ ID NO: 70100 - DNA, 25 bp, S. pombe
agagccaaggctgcagaacgcgaag

SEQ ID NO: 70101 - DNA, 25 bp, S. pombe
agaggcggcggctgatttgcataaa

SEQ ID NO: 70102 - DNA, 25 bp, S. pombe
agaggtggctactgcacttgctaat

SEQ ID NO: 70103 - DNA, 25 bp, S. pombe
agagtgctcctttgcttcaggacaa

SEQ ID NO: 70104 - DNA, 25 bp, S. pombe
agaccctcttcttttggtcgacaat

SEQ ID NO: 70105 - DNA, 25 bp, S. pombe
agactgccgctttgacgggtgcaaa

SEQ ID NO: 70106 - DNA, 25 bp, S. pombe
agagtcggctcttgcaaatgcttca

SEQ ID NO: 70107 - DNA, 25 bp, S. pombe
agagtcgagtctttcaatttgtgag

SEQ ID NO: 70108 - DNA, 25 bp, S. pombe
agaggactcgactgatcccgaagaa

SEQ ID NO: 70109 - DNA, 25 bp, S. pombe
agaggttgggtcactccagcaagaa

SEQ ID NO: 70110 - DNA, 25 bp, S. pombe
agatggcagcttcttggtatcggca

SEQ ID NO: 70111 - DNA, 25 bp, S. pombe
agagttacatgcctagcttttggta

SEQ ID NO: 70112 - DNA, 25 bp, S. pombe
agagttatcgcgtgttccttcgaac

SEQ ID NO: 70113 - DNA, 25 bp, S. pombe
agactgtttcctctattcttcggtt

SEQ ID NO: 70114 - DNA, 25 bp, S. pombe
agatgttttccgatcctcaatatgg

SEQ ID NO: 70115 - DNA, 25 bp, S. pombe
agagagtttggctcatcaccaacgg

SEQ ID NO: 70116 - DNA, 25 bp, S. pombe
agacgcttggaggacaatcgcagaa

SEQ ID NO: 70117 - DNA, 25 bp, S. pombe
agaccattggctcaagcttctagag

SEQ ID NO: 70118 - DNA, 25 bp, S. pombe
agaggaccttccactgaatcagact

SEQ ID NO: 70119 - DNA, 25 bp, S. pombe
agaggtttaacgacaatcaccataa

SEQ ID NO: 70120 - DNA, 25 bp, S. pombe
agactcgataatttccagaccaccg

SEQ ID NO: 70121 - DNA, 25 bp, S. pombe
agaggcagtttgtcgagcttatgaa

SEQ ID NO: 70122 - DNA, 25 bp, S. pombe
agagacctgtgccaaaaaccgtagt

SEQ ID NO: 70123 - DNA, 25 bp, S. pombe
agacgccagctgcaacaaggtcgta

SEQ ID NO: 70124 - DNA, 25 bp, S. pombe
agagactcacgacacaagcgctctg

SEQ ID NO: 70125 - DNA, 25 bp, S. pombe
agaggacggagcctttctgttgcct

SEQ ID NO: 70126 - DNA, 25 bp, S. pombe
agaggacgctgctgttttgcttggc

SEQ ID NO: 70127 - DNA, 25 bp, S. pombe
agagcagttgcctggtgtcattggt

SEQ ID NO: 70128 - DNA, 25 bp, S. pombe
agagagtcttcatgccgctgagtgg

SEQ ID NO: 70129 - DNA, 25 bp, S. pombe
agagtatctctttatcgcatttgga

SEQ ID NO: 70130 - DNA, 25 bp, S. pombe
agaggcattgttatcgactggtcaa

SEQ ID NO: 70131 - DNA, 25 bp, S. pombe
agaggttgatctccgtatcggtcaa

SEQ ID NO: 70132 - DNA, 25 bp, S. pombe
agatggatcgtcagcgtcctggtaa

SEQ ID NO: 70133 - DNA, 25 bp, S. pombe
agagaacgcctgcagtttggtgaaa

SEQ ID NO: 70134 - DNA, 25 bp, S. pombe
agatggtgcttatcatcccgttgat

SEQ ID NO: 70135 - DNA, 25 bp, S. pombe
agccaatgctgttggagcccgaggt

SEQ ID NO: 70136 - DNA, 25 bp, S. pombe
agagcattacgaacgcttgaacaat

SEQ ID NO: 70137 - DNA, 25 bp, S. pombe
agaccttatgactgcattgggcgat

SEQ ID NO: 70138 - DNA, 25 bp, S. pombe
agagactgcgtctaccgttggtact

SEQ ID NO: 70139 - DNA, 25 bp, S. pombe
agaaacgcgtcaaatctgtctaccc

SEQ ID NO: 70140 - DNA, 25 bp, S. pombe
agagtccacttcctctgtcgagaag

SEQ ID NO: 70141 - DNA, 25 bp, S. pombe
agaggatctccactacttcactaaa

SEQ ID NO: 70142 - DNA, 25 bp, S. pombe
agaggatttggagtcaccgcattaa

SEQ ID NO: 70143 - DNA, 25 bp, S. pombe
agaggattctccgatgggctttgaa

SEQ ID NO: 70144 - DNA, 25 bp, S. pombe
agagatttcttttggcgtttcgtcg

SEQ ID NO: 70145 - DNA, 25 bp, S. pombe
agagtcgtatttcagcgtttcgtaa

SEQ ID NO: 70146 - DNA, 25 bp, S. pombe
agagctggtatgttaatgggatttt

SEQ ID NO: 70147 - DNA, 25 bp, S. pombe
agactggtagttacccgtcttcgca

SEQ ID NO: 70148 - DNA, 25 bp, S. pombe
aaattgggtcggactctaccacttg

SEQ ID NO: 70149 - DNA, 25 bp, S. pombe
agagttggacccgtagtatccctct

SEQ ID NO: 70150 - DNA, 25 bp, S. pombe
agagttggtcctgtagtagctgctt

SEQ ID NO: 70151 - DNA, 25 bp, S. pombe
agcccgtggaccgagaaatccgata

SEQ ID NO: 70152 - DNA, 25 bp, S. pombe
agacgggcgtatttctttgatcgat

SEQ ID NO: 70153 - DNA, 25 bp, S. pombe
agaccggcgccatttttggttatga

SEQ ID NO: 70154 - DNA, 25 bp, S. pombe
agagtcctcgcctagtggtgccagt

SEQ ID NO: 70155 - DNA, 25 bp, S. pombe
agagctactgctgctgagttgctga

SEQ ID NO: 70156 - DNA, 25 bp, S. pombe
agaggtgctgtgtttgccactgaaa

SEQ ID NO: 70157 - DNA, 25 bp, S. pombe
agagtgctgcttccgattctgaaat

SEQ ID NO: 70158 - DNA, 25 bp, S. pombe
agactggtgttatcaagcccggtat

SEQ ID NO: 70159 - DNA, 25 bp, S. pombe
agaggagcgtgttacagtccccatt

SEQ ID NO: 70160 - DNA, 25 bp, S. pombe
agagaaagcggttgattcacagcaa

SEQ ID NO: 70161 - DNA, 25 bp, S. pombe
agactgtaaacctcttctcaaacaa

SEQ ID NO: 70162 - DNA, 25 bp, S. pombe
agacgttaacgctcttttagccaag

SEQ ID NO: 70163 - DNA, 25 bp, S. pombe
agagtggccccaatattttcttctt

SEQ ID NO: 70164 - DNA, 25 bp, S. pombe
agagatgacagcaatccttcctcgt

SEQ ID NO: 70165 - DNA, 25 bp, S. pombe
agagcactacttctcaacttgcaac

SEQ ID NO: 70166 - DNA, 25 bp, S. pombe
agagcatcatactgtctcaacttcc

SEQ ID NO: 70167 - DNA, 25 bp, S. pombe
agcagcacgtacttccaaaaattgg

SEQ ID NO: 70168 - DNA, 25 bp, S. pombe
gatgcgttttctctaaaaatgggtt

SEQ ID NO: 70169 - DNA, 25 bp, S. pombe
acagcttggtcgctacataaaggtg

SEQ ID NO: 70170 - DNA, 25 bp, S. pombe
agagggttcgtttcgacgattcaat

SEQ ID NO: 70171 - DNA, 25 bp, S. pombe
agagggttacttgctacatgatcca

SEQ ID NO: 70172 - DNA, 25 bp, S. pombe
agaggtgctcagtccagaattgcat

SEQ ID NO: 70173 - DNA, 25 bp, S. pombe
agagcagcggctacagtgaaaacac

SEQ ID NO: 70174 - DNA, 25 bp, S. pombe
agagctcgctgcacaattgaatcca

SEQ ID NO: 70175 - DNA, 25 bp, S. pombe
agagtctttccatcttcagtctcat

SEQ ID NO: 70176 - DNA, 25 bp, S. pombe
agagggatcgttgccaggtgtaact

SEQ ID NO: 70177 - DNA, 25 bp, S. pombe
agacggcttgatcgtacactctgag

SEQ ID NO: 70178 - DNA, 25 bp, S. pombe
agaggatcgtgatagtgctcgtcaa

SEQ ID NO: 70179 - DNA, 25 bp, S. pombe
agagcaggataaccacttgattcat

SEQ ID NO: 70180 - DNA, 25 bp, S. pombe
agaggttacttttctcaccgagttg

SEQ ID NO: 70181 - DNA, 25 bp, S. pombe
agaggttacttttcacccatgcata

SEQ ID NO: 70182 - DNA, 25 bp, S. pombe
agacttcgcaagtggaccgctaagc

SEQ ID NO: 70183 - DNA, 25 bp, S. pombe
agagattcaacgtgcagctatcccc

SEQ ID NO: 70184 - DNA, 25 bp, S. pombe
agagttagacagttccaacgctcct

SEQ ID NO: 70185 - DNA, 25 bp, S. pombe
agcagttaaccttcgaagcctttca

SEQ ID NO: 70186 - DNA, 25 bp, S. pombe
agagaatccaatatcttccgcctct

SEQ ID NO: 70187 - DNA, 25 bp, S. pombe
agagctatcacgtactgttgccgtt

SEQ ID NO: 70188 - DNA, 25 bp, S. pombe
agagccgcatcttcatatgtacctt

SEQ ID NO: 70189 - DNA, 25 bp, S. pombe
agaacgagctcccaggccatctatt

SEQ ID NO: 70190 - DNA, 25 bp, S. pombe
agagatcgcgctactgaacgtcgaa

SEQ ID NO: 70191 - DNA, 25 bp, S. pombe
agagttccaataccgcctcatagaa

SEQ ID NO: 70192 - DNA, 25 bp, S. pombe
agagatcctccacccggaattgtag

SEQ ID NO: 70193 - DNA, 25 bp, S. pombe
agagtactctgcctccaggattttc

SEQ ID NO: 70194 - DNA, 25 bp, S. pombe
agagttgtgtgatgctaccaccaaa

SEQ ID NO: 70195 - DNA, 25 bp, S. pombe
agacgggttacacgattcatcctct

SEQ ID NO: 70196 - DNA, 25 bp, S. pombe
agagtgaggttttgtttctccgcta

SEQ ID NO: 70197 - DNA, 25 bp, S. pombe
agaggtgttcctgtttcggcagcta

SEQ ID NO: 70198 - DNA, 25 bp, S. pombe
agagtgctatcattcttttgtcggc

SEQ ID NO: 70199 - DNA, 25 bp, S. pombe
agagctttactcttcctgtatgcac

SEQ ID NO: 70200 - DNA, 25 bp, S. pombe
agagtttttgtctctgttgcacgcc

SEQ ID NO: 70201 - DNA, 25 bp, S. pombe
agagtggtattgagcctggtcctgc

SEQ ID NO: 70202 - DNA, 25 bp, S. pombe
accatattgcgtttgcaggccattc

SEQ ID NO: 70203 - DNA, 25 bp, S. pombe
gcggcaattaatttgggccttcctt

SEQ ID NO: 70204 - DNA, 25 bp, S. pombe
agaccttgatattcgggctttcctt

SEQ ID NO: 70205 - DNA, 25 bp, S. pombe
agacacttttgcacgggtgttccaa

SEQ ID NO: 70206 - DNA, 25 bp, S. pombe
agaggtgccccgagcatacaagaag

SEQ ID NO: 70207 - DNA, 25 bp, S. pombe
agagcgtttccgtcgcagacagtaa

SEQ ID NO: 70208 - DNA, 25 bp, S. pombe
agagagtatcccgttggcacagaaa

SEQ ID NO: 70209 - DNA, 25 bp, S. pombe
agagcttttgctgagtgtatccatt

SEQ ID NO: 70210 - DNA, 25 bp, S. pombe
agagctttcaccaaacactgataat

SEQ ID NO: 70211 - DNA, 25 bp, S. pombe
agacctgtgtccgtacaacttgtag

SEQ ID NO: 70212 - DNA, 25 bp, S. pombe
agaccgttaggtgatatctcctcat

SEQ ID NO: 70213 - DNA, 25 bp, S. pombe
agagcttttaagttatatccctgca

SEQ ID NO: 70214 - DNA, 25 bp, S. pombe
agagtttgtgactcgtcatcctgta

SEQ ID NO: 70215 - DNA, 25 bp, S. pombe
agacttgggatctcattactgggca

SEQ ID NO: 70216 - DNA, 25 bp, S. pombe
agagcgcctgctgagtttttacttc

SEQ ID NO: 70217 - DNA, 25 bp, S. pombe
agagcgcttggttgtcattcgattt

SEQ ID NO: 70218 - DNA, 25 bp, S. pombe
agagttatcgacgtttctggaggat

SEQ ID NO: 70219 - DNA, 25 bp, S. pombe
agagataccgcttatttctttaaat

SEQ ID NO: 70220 - DNA, 25 bp, S. pombe
agagatacccattcttttgacttat

SEQ ID NO: 70221 - DNA, 25 bp, S. pombe
agagcttcccatttttagccattgc

SEQ ID NO: 70222 - DNA, 25 bp, S. pombe
agagttgccgaatttctgtcctgac

SEQ ID NO: 70223 - DNA, 25 bp, S. pombe
agagtatgcgggatctttccatcgc

SEQ ID NO: 70224 - DNA, 25 bp, S. pombe
agagactagcaccaatgtatcccca

SEQ ID NO: 70225 - DNA, 25 bp, S. pombe
agacctccttctccattgacaaagg

SEQ ID NO: 70226 - DNA, 25 bp, S. pombe
agagcagctgtttgatccatggaat

SEQ ID NO: 70227 - DNA, 25 bp, S. pombe
agacgatagcttagctcccgagagc

SEQ ID NO: 70228 - DNA, 25 bp, S. pombe
agagactcagttcttgcgcgtccta

SEQ ID NO: 70229 - DNA, 25 bp, S. pombe
agagaacgtctaatactatgtccac

SEQ ID NO: 70230 - DNA, 25 bp, S. pombe
agagttgtggatgtcactggtcccg

SEQ ID NO: 70231 - DNA, 25 bp, S. pombe
agagcttttgatgcaccgagttcgt

SEQ ID NO: 70232 - DNA, 25 bp, S. pombe
agagattttgatacccctatctcgc

SEQ ID NO: 70233 - DNA, 25 bp, S. pombe
agacgtggtttatcctattttcata

SEQ ID NO: 70234 - DNA, 25 bp, S. pombe
aacgtggttccatattttcccatgt

SEQ ID NO: 70235 - DNA, 25 bp, S. pombe
agacctgcgttctaaagttggccaa

SEQ ID NO: 70236 - DNA, 25 bp, S. pombe
agaccgttcatgcaaaatctccagg

SEQ ID NO: 70237 - DNA, 25 bp, S. pombe
agaccattgatcctgagcatgcatt

SEQ ID NO: 70238 - DNA, 25 bp, S. pombe
agagctatggagttacttttccaaa

SEQ ID NO: 70239 - DNA, 25 bp, S. pombe
agaccagactctttcgttaacaaat

SEQ ID NO: 70240 - DNA, 25 bp, S. pombe
agactcatcctcaccgttgagaaaa

SEQ ID NO: 70241 - DNA, 25 bp, S. pombe
agagcatcattctgttcctaacatg

SEQ ID NO: 70242 - DNA, 25 bp, S. pombe
agagctttctcacttttggatgcgt

SEQ ID NO: 70243 - DNA, 25 bp, S. pombe
agagagacttccgattcatcctttc

SEQ ID NO: 70244 - DNA, 25 bp, S. pombe
agactggctttactcctgtttgcat

SEQ ID NO: 70245 - DNA, 25 bp, S. pombe
agagcgtcgtctggcttttattgga

SEQ ID NO: 70246 - DNA, 25 bp, S. pombe
agagcttcctgtgactccaataaga

SEQ ID NO: 70247 - DNA, 25 bp, S. pombe
agagttcctcttactgcagcaattg

SEQ ID NO: 70248 - DNA, 25 bp, S. pombe
agactatcctttgctgaaattcgag

SEQ ID NO: 70249 - DNA, 25 bp, S. pombe
agacgtccagtatcttccaatagct

SEQ ID NO: 70250 - DNA, 25 bp, S. pombe
agactggtgcggtccttgcaaatac

SEQ ID NO: 70251 - DNA, 25 bp, S. pombe
agacgttcgtgcagcatcgcttaga

SEQ ID NO: 70252 - DNA, 25 bp, S. pombe
agagcgcttcggacggtattcaact

SEQ ID NO: 70253 - DNA, 25 bp, S. pombe
agacgaggattacgccctttatcaa

SEQ ID NO: 70254 - DNA, 25 bp, S. pombe
agcagccttataatgaacgttggat

SEQ ID NO: 70255 - DNA, 25 bp, S. pombe
agagcctgctaacgtacatttcgag

SEQ ID NO: 70256 - DNA, 25 bp, S. pombe
agagcctcaacgacaaacgcttctt

SEQ ID NO: 70257 - DNA, 25 bp, S. pombe
agacccaagtctgcagtttattatg

SEQ ID NO: 70258 - DNA, 25 bp, S. pombe
agacctcctcgatagtagatgctgt

SEQ ID NO: 70259 - DNA, 25 bp, S. pombe
agagactcatcctgaattagacgca

SEQ ID NO: 70260 - DNA, 25 bp, S. pombe
agagacacactcttgcgttgacatc

SEQ ID NO: 70261 - DNA, 25 bp, S. pombe
agacaccaacggcatcattcagaaa

SEQ ID NO: 70262 - DNA, 25 bp, S. pombe
agactccattggaacggtttgcgga

SEQ ID NO: 70263 - DNA, 25 bp, S. pombe
agaccagttgatccacatcgtgttg

SEQ ID NO: 70264 - DNA, 25 bp, S. pombe
agaccagcattctcagacctttatt

SEQ ID NO: 70265 - DNA, 25 bp, S. pombe
agaccatcttctcaagcatctttac

SEQ ID NO: 70266 - DNA, 25 bp, S. pombe
agagacggtattcttcccttttcag

SEQ ID NO: 70267 - DNA, 25 bp, S. pombe
agagcctggatggttgattcctgta

SEQ ID NO: 70268 - DNA, 25 bp, S. pombe
agacctggcatttggaccatcacta

SEQ ID NO: 70269 - DNA, 25 bp, S. pombe
agactctgaagacgcatatactgat

SEQ ID NO: 70270 - DNA, 25 bp, S. pombe
agacgggcactcataaagctttatt

SEQ ID NO: 70271 - DNA, 25 bp, S. pombe
agacagcccaacacagacatttttt

SEQ ID NO: 70272 - DNA, 25 bp, S. pombe
agagctccacgaattatacatcaaa

SEQ ID NO: 70273 - DNA, 25 bp, S. pombe
agagcattcaattgtttacgaggat

SEQ ID NO: 70274 - DNA, 25 bp, S. pombe
agagaattcgactcttcctgcttgg

SEQ ID NO: 70275 - DNA, 25 bp, S. pombe
agagaagttcaatcgtcttacggga

SEQ ID NO: 70276 - DNA, 25 bp, S. pombe
agagcaggctggttattctgtaaaa

SEQ ID NO: 70277 - DNA, 25 bp, S. pombe
agacgctttagcttctgttacactt

SEQ ID NO: 70278 - DNA, 25 bp, S. pombe
agagcctttggcatccttatcgatc

SEQ ID NO: 70279 - DNA, 25 bp, S. pombe
agagctaatttcttcaagccccagc

SEQ ID NO: 70280 - DNA, 25 bp, S. pombe
agagcggctttaatgatttccctcc

SEQ ID NO: 70281 - DNA, 25 bp, S. pombe
agaccgctttgctatacttcgttaa

SEQ ID NO: 70282 - DNA, 25 bp, S. pombe
agagccggttcattgatttttcaaa

SEQ ID NO: 70283 - DNA, 25 bp, S. pombe
agagaaagcttctttgcttccttgc

SEQ ID NO: 70284 - DNA, 25 bp, S. pombe
agagaaacctcatattgtcacattt

SEQ ID NO: 70285 - DNA, 25 bp, S. pombe
agagcaacacccttctttatgaaca

SEQ ID NO: 70286 - DNA, 25 bp, S. pombe
agaagtacctgctcttgaagtttaa

SEQ ID NO: 70287 - DNA, 25 bp, S. pombe
agcacaaaaagttgcgtgtggcccc

SEQ ID NO: 70288 - DNA, 25 bp, S. pombe
agaaaccaactgttgcgctacccgt

SEQ ID NO: 70289 - DNA, 25 bp, S. pombe
agacccagaaattgtggctctcctt

SEQ ID NO: 70290 - DNA, 25 bp, S. pombe
agagcgcttctgacattgttcggag

SEQ ID NO: 70291 - DNA, 25 bp, S. pombe
agacgcgagtcactggctactggaa

SEQ ID NO: 70292 - DNA, 25 bp, S. pombe
agagcaccttcactgtttactgatt

SEQ ID NO: 70293 - DNA, 25 bp, S. pombe
agacacccatgcgattttgagcctt

SEQ ID NO: 70294 - DNA, 25 bp, S. pombe
agaccctcattactttggcctttga

SEQ ID NO: 70295 - DNA, 25 bp, S. pombe
agacctgctttgtacttgggcagca

SEQ ID NO: 70296 - DNA, 25 bp, S. pombe
agacgagacttactgctggccgctg

SEQ ID NO: 70297 - DNA, 25 bp, S. pombe
agaccagcctcatttgtgagcccat

SEQ ID NO: 70298 - DNA, 25 bp, S. pombe
agagccttttccttcaacgcaagaa

SEQ ID NO: 70299 - DNA, 25 bp, S. pombe
agaagcattttcctgattaccaaga

SEQ ID NO: 70300 - DNA, 25 bp, S. pombe
agagccgttggttattgatgaagac

SEQ ID NO: 70301 - DNA, 25 bp, S. pombe
agcacttttggtcagtatgcggaac

SEQ ID NO: 70302 - DNA, 25 bp, S. pombe
agacttgttagtcgactttgaaccg

SEQ ID NO: 70303 - DNA, 25 bp, S. pombe
agagcagttgtctatggcacagtta

SEQ ID NO: 70304 - DNA, 25 bp, S. pombe
agagcgtttgtttcacatgttcgtg

SEQ ID NO: 70305 - DNA, 25 bp, S. pombe
agactgttttttcaatcaatgctag

SEQ ID NO: 70306 - DNA, 25 bp, S. pombe
agacgtgccttctggttctgaagtt

SEQ ID NO: 70307 - DNA, 25 bp, S. pombe
agagcgtgtttctggtttcccattt

SEQ ID NO: 70308 - DNA, 25 bp, S. pombe
agactttttatggtgctttactatt

SEQ ID NO: 70309 - DNA, 25 bp, S. pombe
agactatttggaggcctgcttggtt

SEQ ID NO: 70310 - DNA, 25 bp, S. pombe
agaaactaggtcactgcgcaggtca

SEQ ID NO: 70311 - DNA, 25 bp, S. pombe
agacctccttgaagcacaaaccaaa

SEQ ID NO: 70312 - DNA, 25 bp, S. pombe
agactcgttaccacttgataccctt

SEQ ID NO: 70313 - DNA, 25 bp, S. pombe
agagaatatttttccgcttcaccca

SEQ ID NO: 70314 - DNA, 25 bp, S. pombe
agaaagcttacttcgtcgttcctca

SEQ ID NO: 70315 - DNA, 25 bp, S. pombe
aaccaaccttgctgttttggcactt

SEQ ID NO: 70316 - DNA, 25 bp, S. pombe
aacgaacccgcaagttaggcagctc

SEQ ID NO: 70317 - DNA, 25 bp, S. pombe
agacggtcatttcgtgctagctggc

SEQ ID NO: 70318 - DNA, 25 bp, S. pombe
agacgttttagcttcatatcggcag

SEQ ID NO: 70319 - DNA, 25 bp, S. pombe
agacgcttttcattttcttagcaaa

SEQ ID NO: 70320 - DNA, 25 bp, S. pombe
agagcagttgttcatgtcgctggtt

SEQ ID NO: 70321 - DNA, 25 bp, S. pombe
agagcactctcttcgtttggacctt

SEQ ID NO: 70322 - DNA, 25 bp, S. pombe
agagcatcatccaaagcctttttca

SEQ ID NO: 70323 - DNA, 25 bp, S. pombe
agagcttgctcttcaacattatcaa

SEQ ID NO: 70324 - DNA, 25 bp, S. pombe
agaccttcccaaattcagcgattat

SEQ ID NO: 70325 - DNA, 25 bp, S. pombe
agactaattcctatctttcggctgc

SEQ ID NO: 70326 - DNA, 25 bp, S. pombe
agagcttttagttaaccagtgcgaa

SEQ ID NO: 70327 - DNA, 25 bp, S. pombe
agacttgggagttctgaccttgcgt

SEQ ID NO: 70328 - DNA, 25 bp, S. pombe
agacctttggaatgtgcttattgat

SEQ ID NO: 70329 - DNA, 25 bp, S. pombe
agaccggtgggtatgctcttagcca

SEQ ID NO: 70330 - DNA, 25 bp, S. pombe
agaacggtgtttatgccttgcctac

SEQ ID NO: 70331 - DNA, 25 bp, S. pombe
aactttgcgaagtgtcgctcccaac

SEQ ID NO: 70332 - DNA, 25 bp, S. pombe
agaatatggaggagcccgttactat

SEQ ID NO: 70333 - DNA, 25 bp, S. pombe
agaattggtggcagacgtcttgact

SEQ ID NO: 70334 - DNA, 25 bp, S. pombe
agctcttcgtggaggaagttgctag

SEQ ID NO: 70335 - DNA, 25 bp, S. pombe
agacggccgtccagtgcaaattttg

SEQ ID NO: 70336 - DNA, 25 bp, S. pombe
agacgcgcgcgttttggataagttg

SEQ ID NO: 70337 - DNA, 25 bp, S. pombe
agaccgctcactattcatttcttaa

SEQ ID NO: 70338 - DNA, 25 bp, S. pombe
agacaagctgaacctcctaagcgtg

SEQ ID NO: 70339 - DNA, 25 bp, S. pombe
agacgtcggcggagcgattgcacca

SEQ ID NO: 70340 - DNA, 25 bp, S. pombe
agaacttgatggctcggtgcaatta

SEQ ID NO: 70341 - DNA, 25 bp, S. pombe
agagcggctttgatgatggttttaa

SEQ ID NO: 70342 - DNA, 25 bp, S. pombe
agagcgcaaattctcgtgtcgtccg

SEQ ID NO: 70343 - DNA, 25 bp, S. pombe
agagcgtcaattcattcgtcgtgca

SEQ ID NO: 70344 - DNA, 25 bp, S. pombe
agacgttttgaatgcgctcgatgaa

SEQ ID NO: 70345 - DNA, 25 bp, S. pombe
agacaaattttgctttgcctgccgg

SEQ ID NO: 70346 - DNA, 25 bp, S. pombe
agcaaattttgcaacttcttaggga

SEQ ID NO: 70347 - DNA, 25 bp, S. pombe
agacgtttatcttctgtctcgactg

SEQ ID NO: 70348 - DNA, 25 bp, S. pombe
agactattgctatcggcttcattgt

SEQ ID NO: 70349 - DNA, 25 bp, S. pombe
agactaactttcctctgtcatttaa

SEQ ID NO: 70350 - DNA, 25 bp, S. pombe
agagctctcgtcctttggctttagg

SEQ ID NO: 70351 - DNA, 25 bp, S. pombe
agagcctttctgtcttcgtgaatac

SEQ ID NO: 70352 - DNA, 25 bp, S. pombe
agagccttcacttctactgttgaat

SEQ ID NO: 70353 - DNA, 25 bp, S. pombe
agacttccctgcctgtaacgatgga

SEQ ID NO: 70354 - DNA, 25 bp, S. pombe
agacggcactttacttctagctgaa

SEQ ID NO: 70355 - DNA, 25 bp, S. pombe
agaacaggagcgctctgaacttgag

SEQ ID NO: 70356 - DNA, 25 bp, S. pombe
agacgcaaacgcagaatctcctcaa

SEQ ID NO: 70357 - DNA, 25 bp, S. pombe
agaccagtccacctatgatcagaag

SEQ ID NO: 70358 - DNA, 25 bp, S. pombe
agaattggccggaaaactcgcgtcg

SEQ ID NO: 70359 - DNA, 25 bp, S. pombe
agaactgttcgcgatacgtcgggcc

SEQ ID NO: 70360 - DNA, 25 bp, S. pombe
agaacgtttgatgccgatcgaccat

SEQ ID NO: 70361 - DNA, 25 bp, S. pombe
agacgctgatgctgcttcgaatctt

SEQ ID NO: 70362 - DNA, 25 bp, S. pombe
agagccgtcatgttagtcatttgtt

SEQ ID NO: 70363 - DNA, 25 bp, S. pombe
agagccttcatttacttttgatcag

SEQ ID NO: 70364 - DNA, 25 bp, S. pombe
agacctgccattcagttctattcat

SEQ ID NO: 70365 - DNA, 25 bp, S. pombe
agactaccactgcatcttctaaatt

SEQ ID NO: 70366 - DNA, 25 bp, S. pombe
agacggatggcctcaatgggctcaa

SEQ ID NO: 70367 - DNA, 25 bp, S. pombe
agacgagctgttgctactacttcag

SEQ ID NO: 70368 - DNA, 25 bp, S. pombe
agaccactgctagcggacatatcac

SEQ ID NO: 70369 - DNA, 25 bp, S. pombe
agaccacctgatgctgtaattccta

SEQ ID NO: 70370 - DNA, 25 bp, S. pombe
agacctttgtttttggatggcagcc

SEQ ID NO: 70371 - DNA, 25 bp, S. pombe
agactcttggttctttagactggta

SEQ ID NO: 70372 - DNA, 25 bp, S. pombe
agacacggcgttgcttgaaactaat

SEQ ID NO: 70373 - DNA, 25 bp, S. pombe
agctgaaaacgacacggccaacttt

SEQ ID NO: 70374 - DNA, 25 bp, S. pombe
actctgaaacgtatggacccctaat

SEQ ID NO: 70375 - DNA, 25 bp, S. pombe
agctaacggaaagccacctgctaaa

SEQ ID NO: 70376 - DNA, 25 bp, S. pombe
gactaaagagtacactccctttcct

SEQ ID NO: 70377 - DNA, 25 bp, S. pombe
aaaacaaactttctccttcttcatg

SEQ ID NO: 70378 - DNA, 25 bp, S. pombe
agaattaaacgtgcgcctgcttttc

SEQ ID NO: 70379 - DNA, 25 bp, S. pombe
agaacgattacgtgccgctgttaat

SEQ ID NO: 70380 - DNA, 25 bp, S. pombe
agcaccgttacgattctcttaagta

SEQ ID NO: 70381 - DNA, 25 bp, S. pombe
agacgtttactgattctcccattta

SEQ ID NO: 70382 - DNA, 25 bp, S. pombe
agacgactcccgaagaagttcttga

SEQ ID NO: 70383 - DNA, 25 bp, S. pombe
agacgaattgtcacagacttttctg

SEQ ID NO: 70384 - DNA, 25 bp, S. pombe
agacgaattcctgcatgccggtatt

SEQ ID NO: 70385 - DNA, 25 bp, S. pombe
agactcagaatcgttcatccggcaa

SEQ ID NO: 70386 - DNA, 25 bp, S. pombe
agaccggtacagatccaagaaggat

SEQ ID NO: 70387 - DNA, 25 bp, S. pombe
agaccgaggatcttatccgtaccga

SEQ ID NO: 70388 - DNA, 25 bp, S. pombe
agactcgggttttgttcacacactg

SEQ ID NO: 70389 - DNA, 25 bp, S. pombe
agacttgtggcctttgtttacctat

SEQ ID NO: 70390 - DNA, 25 bp, S. pombe
agactgctgttcgtttgattcttcc

SEQ ID NO: 70391 - DNA, 25 bp, S. pombe
agaatgtacccatatttcgtgctcc

SEQ ID NO: 70392 - DNA, 25 bp, S. pombe
agacttgttgattcgcactagcggt

SEQ ID NO: 70393 - DNA, 25 bp, S. pombe
agactcttctgattccagtagcgtg

SEQ ID NO: 70394 - DNA, 25 bp, S. pombe
agactatgatctttgctcctcatgt

SEQ ID NO: 70395 - DNA, 25 bp, S. pombe
agactctgatctttcttcagggcaa

SEQ ID NO: 70396 - DNA, 25 bp, S. pombe
agaacttgagaatacctttggtact

SEQ ID NO: 70397 - DNA, 25 bp, S. pombe
agaacacgactcctccttttgggag

SEQ ID NO: 70398 - DNA, 25 bp, S. pombe
agaaagtccgcttggtttccttgag

SEQ ID NO: 70399 - DNA, 25 bp, S. pombe
agaaataacgactccagcctacagc

SEQ ID NO: 70400 - DNA, 25 bp, S. pombe
agaaacaccgaaaccagccattgca

SEQ ID NO: 70401 - DNA, 25 bp, S. pombe
agcaaaattcctccgtactacgaag

SEQ ID NO: 70402 - DNA, 25 bp, S. pombe
agacggtctggtgagtttactagat

SEQ ID NO: 70403 - DNA, 25 bp, S. pombe
agacggattaggtgctttggctaga

SEQ ID NO: 70404 - DNA, 25 bp, S. pombe
agacgcctctaacgatgctatttta

SEQ ID NO: 70405 - DNA, 25 bp, S. pombe
agaactcgcttatccaattctttgc

SEQ ID NO: 70406 - DNA, 25 bp, S. pombe
agaactcaattctcgctttttccat

SEQ ID NO: 70407 - DNA, 25 bp, S. pombe
agaccatgaccaagcgtgttcttac

SEQ ID NO: 70408 - DNA, 25 bp, S. pombe
agaccataccaaccgccaattgagt

SEQ ID NO: 70409 - DNA, 25 bp, S. pombe
agacattaccgacccattactatat

SEQ ID NO: 70410 - DNA, 25 bp, S. pombe
agactttctcgatccattaattttg

SEQ ID NO: 70411 - DNA, 25 bp, S. pombe
agactttccgcatcgcacagtttat

SEQ ID NO: 70412 - DNA, 25 bp, S. pombe
agacttttatcgtaatggcacttta

SEQ ID NO: 70413 - DNA, 25 bp, S. pombe
agacttttgcaacaatgctcgcctt

SEQ ID NO: 70414 - DNA, 25 bp, S. pombe
agactttgatgaccaatccacccaa

SEQ ID NO: 70415 - DNA, 25 bp, S. pombe
agacatcgtgaggtgcttttgaatc

SEQ ID NO: 70416 - DNA, 25 bp, S. pombe
agactcttggtactcattggactcc

SEQ ID NO: 70417 - DNA, 25 bp, S. pombe
agactattggtctcttggctgcatc

SEQ ID NO: 70418 - DNA, 25 bp, S. pombe
agactattgacactcgcattcgtat

SEQ ID NO: 70419 - DNA, 25 bp, S. pombe
agacttctcattccgatttcttaga

SEQ ID NO: 70420 - DNA, 25 bp, S. pombe
agacatctgctctgggatttctttg

SEQ ID NO: 70421 - DNA, 25 bp, S. pombe
agcacgacttttgatccgttcggat

SEQ ID NO: 70422 - DNA, 25 bp, S. pombe
acaaactttctttcggtcgcttgag

SEQ ID NO: 70423 - DNA, 25 bp, S. pombe
agaagatcttccttaccgtagcatt

SEQ ID NO: 70424 - DNA, 25 bp, S. pombe
agaatgttccccattggtggcgtga

SEQ ID NO: 70425 - DNA, 25 bp, S. pombe
agaaacctctacgttcgaaggcgag

SEQ ID NO: 70426 - DNA, 25 bp, S. pombe
agacttcacataatcaacccgactg

SEQ ID NO: 70427 - DNA, 25 bp, S. pombe
agaagcctgcaccattgttttacgt

SEQ ID NO: 70428 - DNA, 25 bp, S. pombe
agaaggcgtgcgaatttttactgtc

SEQ ID NO: 70429 - DNA, 25 bp, S. pombe
agaaactgttagctctcctgcagag

SEQ ID NO: 70430 - DNA, 25 bp, S. pombe
agaccgattctatgactcctgagca

SEQ ID NO: 70431 - DNA, 25 bp, S. pombe
agacttgagacttcagcactccgta

SEQ ID NO: 70432 - DNA, 25 bp, S. pombe
agactcgacaaagcctcagttcatt

SEQ ID NO: 70433 - DNA, 25 bp, S. pombe
agaccgttgacatctccaattctat

SEQ ID NO: 70434 - DNA, 25 bp, S. pombe
agaacgcggaattccaaccactgaa

SEQ ID NO: 70435 - DNA, 25 bp, S. pombe
agaaagccgcttctgaggcagccga

SEQ ID NO: 70436 - DNA, 25 bp, S. pombe
agaaaccagtatggctgagtgcaat

SEQ ID NO: 70437 - DNA, 25 bp, S. pombe
agacgctgtggatgttactaccgaa

SEQ ID NO: 70438 - DNA, 25 bp, S. pombe
agaacgtatggtgttgcctgccggc

SEQ ID NO: 70439 - DNA, 25 bp, S. pombe
agacaactagtgaagcctcttccgc

SEQ ID NO: 70440 - DNA, 25 bp, S. pombe
agacgaatattttctccagctccaa

SEQ ID NO: 70441 - DNA, 25 bp, S. pombe
agaaagctttccctattactcctga

SEQ ID NO: 70442 - DNA, 25 bp, S. pombe
agaaatctacgaccatttgacccct

SEQ ID NO: 70443 - DNA, 25 bp, S. pombe
agacactgttccaaacttgtttcga

SEQ ID NO: 70444 - DNA, 25 bp, S. pombe
agaacgctatcattccttttacgga

SEQ ID NO: 70445 - DNA, 25 bp, S. pombe
agcaacgtgcaatcctactttaggt

SEQ ID NO: 70446 - DNA, 25 bp, S. pombe
agaagcagccaatcaacctagtacg

SEQ ID NO: 70447 - DNA, 25 bp, S. pombe
agacgcacatcgacagatgcaccaa

SEQ ID NO: 70448 - DNA, 25 bp, S. pombe
agacattgatgtcccactcagcttg

SEQ ID NO: 70449 - DNA, 25 bp, S. pombe
agacttactcagacatgtggtttta

SEQ ID NO: 70450 - DNA, 25 bp, S. pombe
agactcacctgctacgttggaaaat

SEQ ID NO: 70451 - DNA, 25 bp, S. pombe
agaccccattgttcgtcgaaacgag

SEQ ID NO: 70452 - DNA, 25 bp, S. pombe
aagctttccgaatacgtcaattggc

SEQ ID NO: 70453 - DNA, 25 bp, S. pombe
agactatttatccttgaatctcggg

SEQ ID NO: 70454 - DNA, 25 bp, S. pombe
agacgagttattccttacatgcccg

SEQ ID NO: 70455 - DNA, 25 bp, S. pombe
agacttgtacttggccttatatgac

SEQ ID NO: 70456 - DNA, 25 bp, S. pombe
agacgattccttgcattttgatgac

SEQ ID NO: 70457 - DNA, 25 bp, S. pombe
agacgtagccatccatcttttggtg

SEQ ID NO: 70458 - DNA, 25 bp, S. pombe
agacgataccatcccttcaaatgta

SEQ ID NO: 70459 - DNA, 25 bp, S. pombe
agacgtgaataccttgcccaatgat

SEQ ID NO: 70460 - DNA, 25 bp, S. pombe
agacttgatatttcttggcctaccc

SEQ ID NO: 70461 - DNA, 25 bp, S. pombe
agacgttgactttgttgaccgacct

SEQ ID NO: 70462 - DNA, 25 bp, S. pombe
agacaagtgatcagtcggatgcccc

SEQ ID NO: 70463 - DNA, 25 bp, S. pombe
agacgaggcatctctcttatgtcca

SEQ ID NO: 70464 - DNA, 25 bp, S. pombe
agaagcggcagctacttcagatgct

SEQ ID NO: 70465 - DNA, 25 bp, S. pombe
agaagatattgtggccgttcgtcct

SEQ ID NO: 70466 - DNA, 25 bp, S. pombe
agaaaacccttctgttattcctcat

SEQ ID NO: 70467 - DNA, 25 bp, S. pombe
aaaatgccggatcttttattccttg

SEQ ID NO: 70468 - DNA, 25 bp, S. pombe
agaatctgccctagaagtggttcca

SEQ ID NO: 70469 - DNA, 25 bp, S. pombe
agaacccctgtaaatggtctcgcag

SEQ ID NO: 70470 - DNA, 25 bp, S. pombe
agaaagtccttgtggcactcggatc

SEQ ID NO: 70471 - DNA, 25 bp, S. pombe
agaagacacaccttgcagcttacac

SEQ ID NO: 70472 - DNA, 25 bp, S. pombe
agaaatcccatctgcgttcgacaac

SEQ ID NO: 70473 - DNA, 25 bp, S. pombe
agaacgtgccaaaatgtacccatcg

SEQ ID NO: 70474 - DNA, 25 bp, S. pombe
agaaccaggttactgctgttcgccg

SEQ ID NO: 70475 - DNA, 25 bp, S. pombe
agacactgctggatcgaattggttt

SEQ ID NO: 70476 - DNA, 25 bp, S. pombe
agacgatggctcttggtacatcttt

SEQ ID NO: 70477 - DNA, 25 bp, S. pombe
agacagtatatgaaccgacccggtg

SEQ ID NO: 70478 - DNA, 25 bp, S. pombe
agaaacaacccctttgcatctggat

SEQ ID NO: 70479 - DNA, 25 bp, S. pombe
agaagtggaccgacttgctcgttta

SEQ ID NO: 70480 - DNA, 25 bp, S. pombe
agaaagttgccgacttcctttgcta

SEQ ID NO: 70481 - DNA, 25 bp, S. pombe
agaaacgtaaaaccctcgctgtcat

SEQ ID NO: 70482 - DNA, 25 bp, S. pombe
agaaacacaaggcatctcctcgtgc

SEQ ID NO: 70483 - DNA, 25 bp, S. pombe
agacaattcaagtggctcgtcgctc

SEQ ID NO: 70484 - DNA, 25 bp, S. pombe
agcaatgttaatgcggcagcaacgt

SEQ ID NO: 70485 - DNA, 25 bp, S. pombe
agaagtatcggaagcggcgcctttt

SEQ ID NO: 70486 - DNA, 25 bp, S. pombe
agaatcatacgtaggcggctccgtt

SEQ ID NO: 70487 - DNA, 25 bp, S. pombe
agaacgccagagtcagccggaagtt

SEQ ID NO: 70488 - DNA, 25 bp, S. pombe
agaactccaggctcctacatagaag

SEQ ID NO: 70489 - DNA, 25 bp, S. pombe
agaacgagcacatcgtgttagcgat

SEQ ID NO: 70490 - DNA, 25 bp, S. pombe
agacgatgataagccatctcccgca

SEQ ID NO: 70491 - DNA, 25 bp, S. pombe
agaaatgtcaatggtgtccctacga

SEQ ID NO: 70492 - DNA, 25 bp, S. pombe
agaaactcaccgatcttctacaaac

SEQ ID NO: 70493 - DNA, 25 bp, S. pombe
agaaagttgcccagcttctcaaagg

SEQ ID NO: 70494 - DNA, 25 bp, S. pombe
agaacggtgcctacactggtgagaa

SEQ ID NO: 70495 - DNA, 25 bp, S. pombe
agaagcagcggcgtgcatcctcaat

SEQ ID NO: 70496 - DNA, 25 bp, S. pombe
agaagccatacaagcatcctaattg

SEQ ID NO: 70497 - DNA, 25 bp, S. pombe
agacagccatttcgctttcaacggg

SEQ ID NO: 70498 - DNA, 25 bp, S. pombe
agacgatttgctgtatgccgacggc

SEQ ID NO: 70499 - DNA, 25 bp, S. pombe
agacacttttttggcaagagatggg

SEQ ID NO: 70500 - DNA, 25 bp, S. pombe
agacttttgctcatttccgtgctat

SEQ ID NO: 70501 - DNA, 25 bp, S. pombe
agaacgaactcgcttctattgtctc

SEQ ID NO: 70502 - DNA, 25 bp, S. pombe
agacacttggcattactgggctcat

SEQ ID NO: 70503 - DNA, 25 bp, S. pombe
agacatttgatattcacggtccaat

SEQ ID NO: 70504 - DNA, 25 bp, S. pombe
agaaaatgttattcgcgatgccgtc

SEQ ID NO: 70505 - DNA, 25 bp, S. pombe
agaaaatgttattcgcgatgccgtc

SEQ ID NO: 70506 - DNA, 25 bp, S. pombe
agaacttcgagtccttagagcctta

SEQ ID NO: 70507 - DNA, 25 bp, S. pombe
agaaatgctcgatactttgcccgtt

SEQ ID NO: 70508 - DNA, 25 bp, S. pombe
agactaaggaactcgtctctctcta

SEQ ID NO: 70509 - DNA, 25 bp, S. pombe
agactaaggctttccttgctgatcc

SEQ ID NO: 70510 - DNA, 25 bp, S. pombe
agaatactccaatacctgttgtttg

SEQ ID NO: 70511 - DNA, 25 bp, S. pombe
agaaaccttcaagccttctttgttg

SEQ ID NO: 70512 - DNA, 25 bp, S. pombe
agacacgcaccctttgtggaatttc

SEQ ID NO: 70513 - DNA, 25 bp, S. pombe
agacaccatgaaacctctgaggatt

SEQ ID NO: 70514 - DNA, 25 bp, S. pombe
agactactattcttcagcctatcgc

SEQ ID NO: 70515 - DNA, 25 bp, S. pombe
agactgacgttgttcgagctgtcga

SEQ ID NO: 70516 - DNA, 25 bp, S. pombe
agactgcctgtcgaatgcgattgct

SEQ ID NO: 70517 - DNA, 25 bp, S. pombe
agacacacttgaacggatctccgca

SEQ ID NO: 70518 - DNA, 25 bp, S. pombe
agacagagtttgttggatgcccaat

SEQ ID NO: 70519 - DNA, 25 bp, S. pombe
agaatattttgacacctcctttgcc

SEQ ID NO: 70520 - DNA, 25 bp, S. pombe
agaattctttggtgcttttagctgc

SEQ ID NO: 70521 - DNA, 25 bp, S. pombe
agaatgtattagatgccggttgtga

SEQ ID NO: 70522 - DNA, 25 bp, S. pombe
agaaggatttctgcgctggatttaa

SEQ ID NO: 70523 - DNA, 25 bp, S. pombe
agaaatatctcgttccatctgacct

SEQ ID NO: 70524 - DNA, 25 bp, S. pombe
agacacggttgttgtgcatgccgct

SEQ ID NO: 70525 - DNA, 25 bp, S. pombe
agaaatgggtcacccgctttcagat

SEQ ID NO: 70526 - DNA, 25 bp, S. pombe
agaatggtttttccaattccaattg

SEQ ID NO: 70527 - DNA, 25 bp, S. pombe
agaagcagatttctgtcgtccgcac

SEQ ID NO: 70528 - DNA, 25 bp, S. pombe
agaacagtggcctttcgtccatcga

SEQ ID NO: 70529 - DNA, 25 bp, S. pombe
agaatggttcgagggcacggtctta

SEQ ID NO: 70530 - DNA, 25 bp, S. pombe
agcaagggatttggactcggtatca

SEQ ID NO: 70531 - DNA, 25 bp, S. pombe
agaaagcgcgcgatacactggtgga

SEQ ID NO: 70532 - DNA, 25 bp, S. pombe
agaaggcccacttcgtagggatctt

SEQ ID NO: 70533 - DNA, 25 bp, S. pombe
agaaaacactcttggacttgccgcc

SEQ ID NO: 70534 - DNA, 25 bp, S. pombe
agaaggaccgcgttggacagtctcc

SEQ ID NO: 70535 - DNA, 25 bp, S. pombe
agaagtcttccgctaacatgataag

SEQ ID NO: 70536 - DNA, 25 bp, S. pombe
agaacatatctaacctttcgggagg

SEQ ID NO: 70537 - DNA, 25 bp, S. pombe
agaattagtgaaccttgaccgtgag

SEQ ID NO: 70538 - DNA, 25 bp, S. pombe
agaatccgtagatccgctcctggat

SEQ ID NO: 70539 - DNA, 25 bp, S. pombe
agaaggagaagaaccactactagtg

SEQ ID NO: 70540 - DNA, 25 bp, S. pombe
agaagttgcaactccctaacgtaga

SEQ ID NO: 70541 - DNA, 25 bp, S. pombe
agaaatgtcaaatgccctcaacgga

SEQ ID NO: 70542 - DNA, 25 bp, S. pombe
agacagcttcatatagtgcccgcaa

SEQ ID NO: 70543 - DNA, 25 bp, S. pombe
agaaatctcgtgttgcgttcgcatg

SEQ ID NO: 70544 - DNA, 25 bp, S. pombe
agcgaaacctactttggcagcacta

SEQ ID NO: 70545 - DNA, 25 bp, S. pombe
agacttcgtcgtatagcgttggtac

SEQ ID NO: 70546 - DNA, 25 bp, S. pombe
agacttttcgttgatgcctgtttac

SEQ ID NO: 70547 - DNA, 25 bp, S. pombe
agacaatattaccaatcgtttgtgg

SEQ ID NO: 70548 - DNA, 25 bp, S. pombe
agcaccttctacaagggctcgtggg

SEQ ID NO: 70549 - DNA, 25 bp, S. pombe
aacttggaagtttggcagacgttca

SEQ ID NO: 70550 - DNA, 25 bp, S. pombe
agcagtttgaaaccttccaccataa

SEQ ID NO: 70551 - DNA, 25 bp, S. pombe
agcaattgtacctcccttggcaaag

SEQ ID NO: 70552 - DNA, 25 bp, S. pombe
agaactgggcacttcctttatcaaa

SEQ ID NO: 70553 - DNA, 25 bp, S. pombe
agaacccggactatatgttccagaa

SEQ ID NO: 70554 - DNA, 25 bp, S. pombe
agcaacccggttatactacatatga

SEQ ID NO: 70555 - DNA, 25 bp, S. pombe
agaacgtcgggttgctgccttatta

SEQ ID NO: 70556 - DNA, 25 bp, S. pombe
agaagcagcggtttatggtcctcct

SEQ ID NO: 70557 - DNA, 25 bp, S. pombe
agacaacttatcgactcttgcattg

SEQ ID NO: 70558 - DNA, 25 bp, S. pombe
agacatccttattatccttggtaaa

SEQ ID NO: 70559 - DNA, 25 bp, S. pombe
agacttgcttctttcaccggaaaat

SEQ ID NO: 70560 - DNA, 25 bp, S. pombe
agaacttgtcatcgccgttaacaga

SEQ ID NO: 70561 - DNA, 25 bp, S. pombe
agacatctccgtcccgttggaagat

SEQ ID NO: 70562 - DNA, 25 bp, S. pombe
agacactcaattaccagtgggacgt

SEQ ID NO: 70563 - DNA, 25 bp, S. pombe
agacatgttgttgtttgcttgcaca

SEQ ID NO: 70564 - DNA, 25 bp, S. pombe
agacattgttgaacgccagtccaaa

SEQ ID NO: 70565 - DNA, 25 bp, S. pombe
agacatttctataccactctccaaa

SEQ ID NO: 70566 - DNA, 25 bp, S. pombe
agacttttcttcttctgtcgcaaat

SEQ ID NO: 70567 - DNA, 25 bp, S. pombe
agaacacctgcttggaattccggaa

SEQ ID NO: 70568 - DNA, 25 bp, S. pombe
agaaattcgtgctcataccgggaaa

SEQ ID NO: 70569 - DNA, 25 bp, S. pombe
agacaaattttcctatccctataag

SEQ ID NO: 70570 - DNA, 25 bp, S. pombe
agaaaagcttatcttattattcaag

SEQ ID NO: 70571 - DNA, 25 bp, S. pombe
agaagtactttttgacgcctctagc

SEQ ID NO: 70572 - DNA, 25 bp, S. pombe
agcaattcctgctgtcattcgggtg

SEQ ID NO: 70573 - DNA, 25 bp, S. pombe
agaattgcccggtattgcacgagat

SEQ ID NO: 70574 - DNA, 25 bp, S. pombe
agacttgcactcttattcttcgtgg

SEQ ID NO: 70575 - DNA, 25 bp, S. pombe
agaaatgctctcctattcattctgt

SEQ ID NO: 70576 - DNA, 25 bp, S. pombe
agaaatgaccgatttggtgctctcg

SEQ ID NO: 70577 - DNA, 25 bp, S. pombe
agacactgtctcttgtgccgcatat

SEQ ID NO: 70578 - DNA, 25 bp, S. pombe
agaacatgcctttgctgagattcaa

SEQ ID NO: 70579 - DNA, 25 bp, S. pombe
agaacaacgagcctgtcactcttca

SEQ ID NO: 70580 - DNA, 25 bp, S. pombe
agacactcacacttataactatttg

SEQ ID NO: 70581 - DNA, 25 bp, S. pombe
agctattccaatctaatccatctgg

SEQ ID NO: 70582 - DNA, 25 bp, S. pombe
agaatcaatatcgtccaaccgccga

SEQ ID NO: 70583 - DNA, 25 bp, S. pombe
agaaccaatgtttgctctccgattg

SEQ ID NO: 70584 - DNA, 25 bp, S. pombe
agaaatctgattcccttcaggaagg

SEQ ID NO: 70585 - DNA, 25 bp, S. pombe
agacagctctccttatatgtttgcc

SEQ ID NO: 70586 - DNA, 25 bp, S. pombe
agaacctgctttacttcctgaagct

SEQ ID NO: 70587 - DNA, 25 bp, S. pombe
agaacactcctaaagatcccaactt

SEQ ID NO: 70588 - DNA, 25 bp, S. pombe
agaagcacaacgtctcaagcccgag

SEQ ID NO: 70589 - DNA, 25 bp, S. pombe
agaaacgtgaccatccttactttgt

SEQ ID NO: 70590 - DNA, 25 bp, S. pombe
agacaacggttcatctcttacttct

SEQ ID NO: 70591 - DNA, 25 bp, S. pombe
agacagactgttttctctttcttcc

SEQ ID NO: 70592 - DNA, 25 bp, S. pombe
agaaattccaggctgccggtatttt

SEQ ID NO: 70593 - DNA, 25 bp, S. pombe
agaaattccgtaccgctcttattga

SEQ ID NO: 70594 - DNA, 25 bp, S. pombe
agaaatctctcgtcacatcgttttt

SEQ ID NO: 70595 - DNA, 25 bp, S. pombe
agaagccttctgtccatggtcaatt

SEQ ID NO: 70596 - DNA, 25 bp, S. pombe
agaagcttacgggatggttttcatc

SEQ ID NO: 70597 - DNA, 25 bp, S. pombe
cgaagctttcggcactgttttagtt

SEQ ID NO: 70598 - DNA, 25 bp, S. pombe
agaactttctcgcatcagcttttac

SEQ ID NO: 70599 - DNA, 25 bp, S. pombe
agaaatcggcatgctaccttggcaa

SEQ ID NO: 70600 - DNA, 25 bp, S. pombe
agaaaagttccatccagtggtgaaa

SEQ ID NO: 70601 - DNA, 25 bp, S. pombe
agaaagaggctccttctcaggttgc

SEQ ID NO: 70602 - DNA, 25 bp, S. pombe
agaagtttgagcctcactaccgtct

SEQ ID NO: 70603 - DNA, 25 bp, S. pombe
agaaattattcaattccgccccatg

SEQ ID NO: 70604 - DNA, 25 bp, S. pombe
agaaatgctttcagagtacccctcg

SEQ ID NO: 70605 - DNA, 25 bp, S. pombe
accatttacgaagctactcctagac

SEQ ID NO: 70606 - DNA, 25 bp, S. pombe
acttattaaatagcattacagaaac

SEQ ID NO: 70607 - DNA, 25 bp, S. pombe
agcaggccttaacacccgagaaaag

SEQ ID NO: 70608 - DNA, 25 bp, S. pombe
agaagacttacactactcccaagaa

SEQ ID NO: 70609 - DNA, 25 bp, S. pombe
agaaacctgaggaacgacgcaaaca

SEQ ID NO: 70610 - DNA, 25 bp, S. pombe
agaaacgcgtgagacgccttaaacg

SEQ ID NO: 70611 - DNA, 25 bp, S. pombe
agaaattgctgaccgttttgagttc

SEQ ID NO: 70612 - DNA, 25 bp, S. pombe
agaaaggccgtttgtctgcgattac

SEQ ID NO: 70613 - DNA, 25 bp, S. pombe
agaaaggcgcgattttcccgatcca

SEQ ID NO: 70614 - DNA, 25 bp, S. pombe
agaaaggatgctacttctgcccgca

SEQ ID NO: 70615 - DNA, 25 bp, S. pombe
agaaacaactgaggctcccactgtt

SEQ ID NO: 70616 - DNA, 25 bp, S. pombe
agaaaacctgcgctcctggataatt

SEQ ID NO: 70617 - DNA, 25 bp, S. pombe
agaatgcccgccagtttttgaaagt

SEQ ID NO: 70618 - DNA, 25 bp, S. pombe
agaagtctgaaagccttttcttaca

SEQ ID NO: 70619 - DNA, 25 bp, S. pombe
agaagtctgagagccttttccttca

SEQ ID NO: 70620 - DNA, 25 bp, S. pombe
agaacgtgcatctcctgattgccaa

SEQ ID NO: 70621 - DNA, 25 bp, S. pombe
agaacttgctaaggcgtcatcacaa

SEQ ID NO: 70622 - DNA, 25 bp, S. pombe
agaacttgctcctgctattcatgca

SEQ ID NO: 70623 - DNA, 25 bp, S. pombe
agaagcatttctcggccaaacttaa

SEQ ID NO: 70624 - DNA, 25 bp, S. pombe
agaagatcttccctcaccaaattaa

SEQ ID NO: 70625 - DNA, 25 bp, S. pombe
agaacagctgtctgcaatgcgaact

SEQ ID NO: 70626 - DNA, 25 bp, S. pombe
agcaccgatgtctgaatcaagcgat

SEQ ID NO: 70627 - DNA, 25 bp, S. pombe
agcttcgttctgtatgcactgaggc

SEQ ID NO: 70628 - DNA, 25 bp, S. pombe
agcattcatgctttggtgggccggt

SEQ ID NO: 70629 - DNA, 25 bp, S. pombe
agaaagccactggtgggtcggcatc

SEQ ID NO: 70630 - DNA, 25 bp, S. pombe
agaactacacattgttcctgtaaat

SEQ ID NO: 70631 - DNA, 25 bp, S. pombe
agaaggtcctattacaagggctgga

SEQ ID NO: 70632 - DNA, 25 bp, S. pombe
agaagagtcttttaccacccttgag

SEQ ID NO: 70633 - DNA, 25 bp, S. pombe
agaaacagacctttacgcagatgaa

SEQ ID NO: 70634 - DNA, 25 bp, S. pombe
agaaactgacgcttcctttgttgat

SEQ ID NO: 70635 - DNA, 25 bp, S. pombe
agaaactgactgtatcctctcctaa

SEQ ID NO: 70636 - DNA, 25 bp, S. pombe
agaaatcctattagagctccccaag

SEQ ID NO: 70637 - DNA, 25 bp, S. pombe
agaaacgcttttacatttgcacaag

SEQ ID NO: 70638 - DNA, 25 bp, S. pombe
agaaagcactgctcttactgccatg

SEQ ID NO: 70639 - DNA, 25 bp, S. pombe
agaacattacttcctctggtgcatt

SEQ ID NO: 70640 - DNA, 25 bp, S. pombe
agaaagtagctcaactcgccgatgt

SEQ ID NO: 70641 - DNA, 25 bp, S. pombe
agaaaaatcatcaaccaccggaggt

SEQ ID NO: 70642 - DNA, 25 bp, S. pombe
agaagagagtgctgcagcccttgct

SEQ ID NO: 70643 - DNA, 25 bp, S. pombe
agaagcatattctcgtcctcaacat

SEQ ID NO: 70644 - DNA, 25 bp, S. pombe
agaacaatgtgctgctctcctaagt

SEQ ID NO: 70645 - DNA, 25 bp, S. pombe
agaagctgatgcgtatgctccactt

SEQ ID NO: 70646 - DNA, 25 bp, S. pombe
agaagagtgctttgctccaattgca

SEQ ID NO: 70647 - DNA, 25 bp, S. pombe
agaaaacatgtcctcaccttatcac

SEQ ID NO: 70648 - DNA, 25 bp, S. pombe
agaaacatagtcttctgcccttcac

SEQ ID NO: 70649 - DNA, 25 bp, S. pombe
aaataccttcggaactgacctcaca

SEQ ID NO: 70650 - DNA, 25 bp, S. pombe
agaagactttggctctctataccca

SEQ ID NO: 70651 - DNA, 25 bp, S. pombe
acagtggttcttcatttaacggcaa

SEQ ID NO: 70652 - DNA, 25 bp, S. pombe
agaacggtttacgatcggctggcga

SEQ ID NO: 70653 - DNA, 25 bp, S. pombe
agaagctgccagaccatctgtcatc

SEQ ID NO: 70654 - DNA, 25 bp, S. pombe
agaagcaccgctgtcgctaggcaaa

SEQ ID NO: 70655 - DNA, 25 bp, S. pombe
agaacgccgtcgtcgtgaacaagtt

SEQ ID NO: 70656 - DNA, 25 bp, S. pombe
agctagcggccaacctagaggctat

SEQ ID NO: 70657 - DNA, 25 bp, S. pombe
agaactcgctcgtctagaagaatat

SEQ ID NO: 70658 - DNA, 25 bp, S. pombe
agaaccgcaggattcacgagtgtat

SEQ ID NO: 70659 - DNA, 25 bp, S. pombe
agcgcacttcggtacttgggcaaat

SEQ ID NO: 70660 - DNA, 25 bp, S. pombe
agcagttacgtctcaaagccgacaa

SEQ ID NO: 70661 - DNA, 25 bp, S. pombe
agaaactcgcttcacagagctctcg

SEQ ID NO: 70662 - DNA, 25 bp, S. pombe
agaagaatcctctgcacggctctag

SEQ ID NO: 70663 - DNA, 25 bp, S. pombe
agaagaacttatcctctcagcactt

SEQ ID NO: 70664 - DNA, 25 bp, S. pombe
agaaggagatcatgtgccccaggct

SEQ ID NO: 70665 - DNA, 25 bp, S. pombe
agaatcagatgaaagttggccacct

SEQ ID NO: 70666 - DNA, 25 bp, S. pombe
agaatcctttgcatctgctggcgca

SEQ ID NO: 70667 - DNA, 25 bp, S. pombe
agaactttatgtgttgtgcccaaga

SEQ ID NO: 70668 - DNA, 25 bp, S. pombe
agaacttcctgttgtttgcgcgcaa

SEQ ID NO: 70669 - DNA, 25 bp, S. pombe
agaactgtccttactgtcaatctct

SEQ ID NO: 70670 - DNA, 25 bp, S. pombe
agaagttccatcttcgcttactgtc

SEQ ID NO: 70671 - DNA, 25 bp, S. pombe
agaagatcgtcttcccactgaagtc

SEQ ID NO: 70672 - DNA, 25 bp, S. pombe
agaaaccttatcgaagctgcctctc

SEQ ID NO: 70673 - DNA, 25 bp, S. pombe
agaatttcgcgcatccgatttcatg

SEQ ID NO: 70674 - DNA, 25 bp, S. pombe
agaacttgaactcggatgcacttta

SEQ ID NO: 70675 - DNA, 25 bp, S. pombe
agaacttggtcttaagcctcttgct

SEQ ID NO: 70676 - DNA, 25 bp, S. pombe
agaacgaagatttgaacgccagcag

SEQ ID NO: 70677 - DNA, 25 bp, S. pombe
agaagactacaatctcgacgagcaa

SEQ ID NO: 70678 - DNA, 25 bp, S. pombe
agaagaatccccttgctgcaagcgg

SEQ ID NO: 70679 - DNA, 25 bp, S. pombe
agaacgatcagtccctgttgctgga

SEQ ID NO: 70680 - DNA, 25 bp, S. pombe
agaaccatctttcctgcaatgtgtc

SEQ ID NO: 70681 - DNA, 25 bp, S. pombe
agaacgcattcagcatcacatatcg

SEQ ID NO: 70682 - DNA, 25 bp, S. pombe
agaaacaccagctttttcgcatgca

SEQ ID NO: 70683 - DNA, 25 bp, S. pombe
agaaaatctccttctttcacatcct

SEQ ID NO: 70684 - DNA, 25 bp, S. pombe
agaaaaaccttcttgctgctctcaa

SEQ ID NO: 70685 - DNA, 25 bp, S. pombe
agaatactaatgtgtccgatccaga

SEQ ID NO: 70686 - DNA, 25 bp, S. pombe
agcagaatctaatcagtcggacaat

SEQ ID NO: 70687 - DNA, 25 bp, S. pombe
agaactgctaatgcaatcggccaaa

SEQ ID NO: 70688 - DNA, 25 bp, S. pombe
agaagcagccgaggaatctgatgaa

SEQ ID NO: 70689 - DNA, 25 bp, S. pombe
agaacgcgcgatggcacatatcaga

SEQ ID NO: 70690 - DNA, 25 bp, S. pombe
agaacctaaaggctcttgctgataa

SEQ ID NO: 70691 - DNA, 25 bp, S. pombe
agaagcgtactacagtctccctata

SEQ ID NO: 70692 - DNA, 25 bp, S. pombe
agaagccgagtacgcagttgcctta

SEQ ID NO: 70693 - DNA, 25 bp, S. pombe
agaagaccaactctccatgaaacgg

SEQ ID NO: 70694 - DNA, 25 bp, S. pombe
agcaacctcatatcttccaaaacgc

SEQ ID NO: 70695 - DNA, 25 bp, S. pombe
agaactgccttgctctccaaaaaga

SEQ ID NO: 70696 - DNA, 25 bp, S. pombe
agaagataccctgtcattttgagaa

SEQ ID NO: 70697 - DNA, 25 bp, S. pombe
agaactagtcttttgcggagtagca

SEQ ID NO: 70698 - DNA, 25 bp, S. pombe
agaagggcttcgtaagcggcgtctt

SEQ ID NO: 70699 - DNA, 25 bp, S. pombe
agaagctgttgaggcctaccttgtc

SEQ ID NO: 70700 - DNA, 25 bp, S. pombe
agaagccacgaagtcagccattgat

SEQ ID NO: 70701 - DNA, 25 bp, S. pombe
agaagtttcctctcgcaagggacta

SEQ ID NO: 70702 - DNA, 25 bp, S. pombe
agaagtttcaccttcgcaatctcag

SEQ ID NO: 70703 - DNA, 25 bp, S. pombe
acctacttccccagttagcataaat

SEQ ID NO: 70704 - DNA, 25 bp, S. pombe
cttttgatattcttcgggcttacca

SEQ ID NO: 70705 - DNA, 25 bp, S. pombe
agctgttccttttcgggttagactg

SEQ ID NO: 70706 - DNA, 25 bp, S. pombe
actggtcgtgctaaaggttttgcct

SEQ ID NO: 70707 - DNA, 25 bp, S. pombe
acgccaaagttcacattgttgccct

SEQ ID NO: 70708 - DNA, 25 bp, S. pombe
agcgaacctgttatccttcgtactg

SEQ ID NO: 70709 - DNA, 25 bp, S. pombe
agaatacgccagtttcacactactc

SEQ ID NO: 70710 - DNA, 25 bp, S. pombe
agaagacgctgatttcattactaat

SEQ ID NO: 70711 - DNA, 25 bp, S. pombe
agaatcccttaatttgctcaaactt

SEQ ID NO: 70712 - DNA, 25 bp, S. pombe
agcccactggccgatctaaaggttt

SEQ ID NO: 70713 - DNA, 25 bp, S. pombe
agaagctcgtgctaacaacgctgcc

SEQ ID NO: 70714 - DNA, 25 bp, S. pombe
agaacgctttcgtgaacttctcatc

SEQ ID NO: 70715 - DNA, 25 bp, S. pombe
agaattcttttctcgctagtttaat

SEQ ID NO: 70716 - DNA, 25 bp, S. pombe
agaatttgtttctgcgttgtgtcct

SEQ ID NO: 70717 - DNA, 25 bp, S. pombe
agcgatttaacctctactggatcct

SEQ ID NO: 70718 - DNA, 25 bp, S. pombe
agcattttacatttcctatccaacc

SEQ ID NO: 70719 - DNA, 25 bp, S. pombe
agcagagaaaggctcacttcggcgc

SEQ ID NO: 70720 - DNA, 25 bp, S. pombe
agaactaactcttcagtttctctga

SEQ ID NO: 70721 - DNA, 25 bp, S. pombe
agcaggtaacttcctttctttggct

SEQ ID NO: 70722 - DNA, 25 bp, S. pombe
agcagcctaatggtccatctgggtt

SEQ ID NO: 70723 - DNA, 25 bp, S. pombe
agaatttgatccgagctcagctacc

SEQ ID NO: 70724 - DNA, 25 bp, S. pombe
agaaggtttcgaatgccactgcaac

SEQ ID NO: 70725 - DNA, 25 bp, S. pombe
agaagggtgcttccctgttcaagac

SEQ ID NO: 70726 - DNA, 25 bp, S. pombe
agcaaggtgtttgcgtttcgcgttt

SEQ ID NO: 70727 - DNA, 25 bp, S. pombe
agaagcagccccacatcttccaaaa

SEQ ID NO: 70728 - DNA, 25 bp, S. pombe
agaatttgtcttatcgcgctggtga

SEQ ID NO: 70729 - DNA, 25 bp, S. pombe
agaatggtgttctctaccttgaaaa

SEQ ID NO: 70730 - DNA, 25 bp, S. pombe
agcaaggttcctatacgtcaaatga

SEQ ID NO: 70731 - DNA, 25 bp, S. pombe
agaagacctcgtacagttgttacat

SEQ ID NO: 70732 - DNA, 25 bp, S. pombe
agaagactcctaaagcagctggtga

SEQ ID NO: 70733 - DNA, 25 bp, S. pombe
agaagcatgcctctaccaaggtctt

SEQ ID NO: 70734 - DNA, 25 bp, S. pombe
agaagcgccctaatgttaagctagt

SEQ ID NO: 70735 - DNA, 25 bp, S. pombe
agaagacccacttttacatgccagc

SEQ ID NO: 70736 - DNA, 25 bp, S. pombe
agaagcaatctccataaatgccatt

SEQ ID NO: 70737 - DNA, 25 bp, S. pombe
agaagcctttcgaactgccattaag

SEQ ID NO: 70738 - DNA, 25 bp, S. pombe
agaacggtatcccttggcactagaa

SEQ ID NO: 70739 - DNA, 25 bp, S. pombe
agcaacggtatgttttcacttgtac

SEQ ID NO: 70740 - DNA, 25 bp, S. pombe
agaaccggatgctcttgccaatgtt

SEQ ID NO: 70741 - DNA, 25 bp, S. pombe
agaacctcgacttattccacgtttg

SEQ ID NO: 70742 - DNA, 25 bp, S. pombe
agaaccatctgcttttgctacacgt

SEQ ID NO: 70743 - DNA, 25 bp, S. pombe
agaattgcactctctttacacgaac

SEQ ID NO: 70744 - DNA, 25 bp, S. pombe
agaattcaggtgattctccctaccc

SEQ ID NO: 70745 - DNA, 25 bp, S. pombe
agcaatgatcgaattcccagcactt

SEQ ID NO: 70746 - DNA, 25 bp, S. pombe
agcaaatgaaccacctacagtctat

SEQ ID NO: 70747 - DNA, 25 bp, S. pombe
agctcatcataaccttactaccgaa

SEQ ID NO: 70748 - DNA, 25 bp, S. pombe
acgattcttcgctcaaaccggatta

SEQ ID NO: 70749 - DNA, 25 bp, S. pombe
cattattctccctcccttgggcgtt

SEQ ID NO: 70750 - DNA, 25 bp, S. pombe
agaatcttccaaaccatcttcgggt

SEQ ID NO: 70751 - DNA, 25 bp, S. pombe
agaagtccactatttcttcccgtga

SEQ ID NO: 70752 - DNA, 25 bp, S. pombe
agaagactctatcctcaagaccttt

SEQ ID NO: 70753 - DNA, 25 bp, S. pombe
agcacacatctttggctcgaagtct

SEQ ID NO: 70754 - DNA, 25 bp, S. pombe
agaagctgctgctaaagcctctgct

SEQ ID NO: 70755 - DNA, 25 bp, S. pombe
agaatcttgcatagtcgcctcaggt

SEQ ID NO: 70756 - DNA, 25 bp, S. pombe
agcaaatttcgcaggcttgggtaaa

SEQ ID NO: 70757 - DNA, 25 bp, S. pombe
agctattccgtatgcgtttgttcgc

SEQ ID NO: 70758 - DNA, 25 bp, S. pombe
agcaacgccgtttggtttggtggct

SEQ ID NO: 70759 - DNA, 25 bp, S. pombe
agaagcctcgtgttttctcagcaca

SEQ ID NO: 70760 - DNA, 25 bp, S. pombe
agaagccgcttatggttcagcacct

SEQ ID NO: 70761 - DNA, 25 bp, S. pombe
agaatgactcttttgtctccagttc

SEQ ID NO: 70762 - DNA, 25 bp, S. pombe
agaagattggcgcttgcactgctga

SEQ ID NO: 70763 - DNA, 25 bp, S. pombe
agaagcgttctctacattcgatgat

SEQ ID NO: 70764 - DNA, 25 bp, S. pombe
agaaggagtctccactattgcttcc

SEQ ID NO: 70765 - DNA, 25 bp, S. pombe
agaagtacgtctcttgattcccaac

SEQ ID NO: 70766 - DNA, 25 bp, S. pombe
agaagtacattcctcttgatctccg

SEQ ID NO: 70767 - DNA, 25 bp, S. pombe
agaagctactctttgcttatctccg

SEQ ID NO: 70768 - DNA, 25 bp, S. pombe
agaagctctctgttccattgcacat

SEQ ID NO: 70769 - DNA, 25 bp, S. pombe
agaagtcttcttcccaatgttgtta

SEQ ID NO: 70770 - DNA, 25 bp, S. pombe
agaagatttctaccgaagtgttcaa

SEQ ID NO: 70771 - DNA, 25 bp, S. pombe
agaattgcactttgcgcgaagccgc

SEQ ID NO: 70772 - DNA, 25 bp, S. pombe
agaaccattgttgatatccaccgcc

SEQ ID NO: 70773 - DNA, 25 bp, S. pombe
agaagcctctttttacatacccact

SEQ ID NO: 70774 - DNA, 25 bp, S. pombe
agaatttgcatttaccaaggcccct

SEQ ID NO: 70775 - DNA, 25 bp, S. pombe
agaatttcgcttaccaatggctttt

SEQ ID NO: 70776 - DNA, 25 bp, S. pombe
agaagttcacgtctcaatggcgctt

SEQ ID NO: 70777 - DNA, 25 bp, S. pombe
agcaccgtctagtcaattctatcct

SEQ ID NO: 70778 - DNA, 25 bp, S. pombe
agaattggatcatcgcggcttcatc

SEQ ID NO: 70779 - DNA, 25 bp, S. pombe
agcagacttgatacagccgagttat

SEQ ID NO: 70780 - DNA, 25 bp, S. pombe
agaagcatcttgacgctgaggttca

SEQ ID NO: 70781 - DNA, 25 bp, S. pombe
agaagctgtcgatgcaacgttgaaa

SEQ ID NO: 70782 - DNA, 25 bp, S. pombe
agcacattgtgcacgaagatcatta

SEQ ID NO: 70783 - DNA, 25 bp, S. pombe
agcatgtctattccgatagctgcac

SEQ ID NO: 70784 - DNA, 25 bp, S. pombe
agcagtatctcggttggcatgcaga

SEQ ID NO: 70785 - DNA, 25 bp, S. pombe
agaatcctgcggtttctgcaagtga

SEQ ID NO: 70786 - DNA, 25 bp, S. pombe
agaagtcactaatttgcactcccaa

SEQ ID NO: 70787 - DNA, 25 bp, S. pombe
agaatgctacgctttatcactcgtc

SEQ ID NO: 70788 - DNA, 25 bp, S. pombe
agcacccacagatagacccatttag

SEQ ID NO: 70789 - DNA, 25 bp, S. pombe
agcagctgttttgactccgttagat

SEQ ID NO: 70790 - DNA, 25 bp, S. pombe
agaagtatcacgtccttccgttact

SEQ ID NO: 70791 - DNA, 25 bp, S. pombe
agaagtcccatctgctatgccagta

SEQ ID NO: 70792 - DNA, 25 bp, S. pombe
agaagacattgcagtcggtgccctt

SEQ ID NO: 70793 - DNA, 25 bp, S. pombe
agaagcacgcattttggctcaaaac

SEQ ID NO: 70794 - DNA, 25 bp, S. pombe
agaagcagcctattggatccaacaa

SEQ ID NO: 70795 - DNA, 25 bp, S. pombe
agcaagccactgttggtgataacaa

SEQ ID NO: 70796 - DNA, 25 bp, S. pombe
agcaaaacgctgctgagtgccgtca

SEQ ID NO: 70797 - DNA, 25 bp, S. pombe
agcacttcgaattccaacggcttta

SEQ ID NO: 70798 - DNA, 25 bp, S. pombe
agcactccttctattttggctttga

SEQ ID NO: 70799 - DNA, 25 bp, S. pombe
agaatacttttcctcgtggtgtcga

SEQ ID NO: 70800 - DNA, 25 bp, S. pombe
agcaaaacttacttcgtgttgtcga

SEQ ID NO: 70801 - DNA, 25 bp, S. pombe
agctaagtcttctaccagttggttg

SEQ ID NO: 70802 - DNA, 25 bp, S. pombe
agcgaagagccaaaacagcccgaat

SEQ ID NO: 70803 - DNA, 25 bp, S. pombe
agcagtcctctctcataaggttgca

SEQ ID NO: 70804 - DNA, 25 bp, S. pombe
agcaactggctctggaatttcctaa

SEQ ID NO: 70805 - DNA, 25 bp, S. pombe
agcacctgcgtataacactttctta

SEQ ID NO: 70806 - DNA, 25 bp, S. pombe
agcagctgagcaagacctacttttg

SEQ ID NO: 70807 - DNA, 25 bp, S. pombe
agcatctgagaaaaaccgccttgaa

SEQ ID NO: 70808 - DNA, 25 bp, S. pombe
agcatcctcgtccattacaaagcgg

SEQ ID NO: 70809 - DNA, 25 bp, S. pombe
agcactcattcgctggattgacgtt

SEQ ID NO: 70810 - DNA, 25 bp, S. pombe
agaatttggcggcattggctcttct

SEQ ID NO: 70811 - DNA, 25 bp, S. pombe
agcaagctgccgctgacgttaaaga

SEQ ID NO: 70812 - DNA, 25 bp, S. pombe
agcagaacctctgattcccaggaat

SEQ ID NO: 70813 - DNA, 25 bp, S. pombe
agcagaacctcgtgccgcaggtgaa

SEQ ID NO: 70814 - DNA, 25 bp, S. pombe
agaattaccttcacttgatcgcttc

SEQ ID NO: 70815 - DNA, 25 bp, S. pombe
agaatctatccttgatctttctaga

SEQ ID NO: 70816 - DNA, 25 bp, S. pombe
agaatgctgtgcttatgctctcttc

SEQ ID NO: 70817 - DNA, 25 bp, S. pombe
agaagagatgccgtccatcgtgcga

SEQ ID NO: 70818 - DNA, 25 bp, S. pombe
agcagaagccactccttcaaaggaa

SEQ ID NO: 70819 - DNA, 25 bp, S. pombe
agcaatctacagaacctcctaagga

SEQ ID NO: 70820 - DNA, 25 bp, S. pombe
agcacctacgcacatggacttggga

SEQ ID NO: 70821 - DNA, 25 bp, S. pombe
agcaagttctgtttggacacacgaa

SEQ ID NO: 70822 - DNA, 25 bp, S. pombe
agaagtcccttgcaagctctaaaag

SEQ ID NO: 70823 - DNA, 25 bp, S. pombe
agaagtctgggaatcattttctgaa

SEQ ID NO: 70824 - DNA, 25 bp, S. pombe
agaaggtgccagatcttacgctgat

SEQ ID NO: 70825 - DNA, 25 bp, S. pombe
agaatgccatttcggcggctcagaa

SEQ ID NO: 70826 - DNA, 25 bp, S. pombe
agaatgcttttctgcgcctgaggtt

SEQ ID NO: 70827 - DNA, 25 bp, S. pombe
agaagttatctacgccacacaatca

SEQ ID NO: 70828 - DNA, 25 bp, S. pombe
agaagtttcattgggcacacagctc

SEQ ID NO: 70829 - DNA, 25 bp, S. pombe
agcatcagagttgttgagccacccg

SEQ ID NO: 70830 - DNA, 25 bp, S. pombe
agcacaggatgctttaaggtccaag

SEQ ID NO: 70831 - DNA, 25 bp, S. pombe
agcttcgtgcccaattagacagatt

SEQ ID NO: 70832 - DNA, 25 bp, S. pombe
agcttcgtgatcgtttggagcactt

SEQ ID NO: 70833 - DNA, 25 bp, S. pombe
agctcgcactgcattacgggaagtc

SEQ ID NO: 70834 - DNA, 25 bp, S. pombe
agaatcatcaagactcccggtaata

SEQ ID NO: 70835 - DNA, 25 bp, S. pombe
agcaatggccgcattcccgaagaat

SEQ ID NO: 70836 - DNA, 25 bp, S. pombe
agctcaggtccttgagtctacttta

SEQ ID NO: 70837 - DNA, 25 bp, S. pombe
agcttcatccttatttacctcaaac

SEQ ID NO: 70838 - DNA, 25 bp, S. pombe
acctactcagtatttacccgattct

SEQ ID NO: 70839 - DNA, 25 bp, S. pombe
agcacgccttgtcgtacgtttagac

SEQ ID NO: 70840 - DNA, 25 bp, S. pombe
agcactccctttgacgttatcaagt

SEQ ID NO: 70841 - DNA, 25 bp, S. pombe
agcttgccggctttgactttaacag

SEQ ID NO: 70842 - DNA, 25 bp, S. pombe
agcacttcgtcttctacgttaacaa

SEQ ID NO: 70843 - DNA, 25 bp, S. pombe
agctaaagtcctcatcagtggcctg

SEQ ID NO: 70844 - DNA, 25 bp, S. pombe
agctaattatcgtcctcgtgagcct

SEQ ID NO: 70845 - DNA, 25 bp, S. pombe
agcaaagtatctaccatcggcttct

SEQ ID NO: 70846 - DNA, 25 bp, S. pombe
agcaacaatgtctcagccgtatatt

SEQ ID NO: 70847 - DNA, 25 bp, S. pombe
agaatgcattttctccatctgctga

SEQ ID NO: 70848 - DNA, 25 bp, S. pombe
agaagtcgatgccttgctcgcaaga

SEQ ID NO: 70849 - DNA, 25 bp, S. pombe
agaaggcgctgccattctctcaaat

SEQ ID NO: 70850 - DNA, 25 bp, S. pombe
agaatctccttctgttgcaatgcct

SEQ ID NO: 70851 - DNA, 25 bp, S. pombe
agaatccatttgctactcttcctaa

SEQ ID NO: 70852 - DNA, 25 bp, S. pombe
agcaacgtgttggtactcccttgta

SEQ ID NO: 70853 - DNA, 25 bp, S. pombe
agcatgacttggataatccttaagt

SEQ ID NO: 70854 - DNA, 25 bp, S. pombe
agaatttggtgtttctcttcctcca

SEQ ID NO: 70855 - DNA, 25 bp, S. pombe
agaatctcggtcaccattacacgaa

SEQ ID NO: 70856 - DNA, 25 bp, S. pombe
agaaggtcgtcaatgtgctcgtgaa

SEQ ID NO: 70857 - DNA, 25 bp, S. pombe
agcagggcacgtttcattcaatttc

SEQ ID NO: 70858 - DNA, 25 bp, S. pombe
agcacgggcagtcgctattacagac

SEQ ID NO: 70859 - DNA, 25 bp, S. pombe
agaatcgctttccaatgatcaattg

SEQ ID NO: 70860 - DNA, 25 bp, S. pombe
agcaaagttgtcagctcagcaattg

SEQ ID NO: 70861 - DNA, 25 bp, S. pombe
agcaaactcttacttggcacagtgg

SEQ ID NO: 70862 - DNA, 25 bp, S. pombe
agcaaagtccatttgggcctcttga

SEQ ID NO: 70863 - DNA, 25 bp, S. pombe
agctcaatcggtatgggcctttgga

SEQ ID NO: 70864 - DNA, 25 bp, S. pombe
agcaggtcgggcaggtaaatctatt

SEQ ID NO: 70865 - DNA, 25 bp, S. pombe
agcaactcgaggacggacgtacttt

SEQ ID NO: 70866 - DNA, 25 bp, S. pombe
agcaacttgaagatggacgtactct

SEQ ID NO: 70867 - DNA, 25 bp, S. pombe
agcagttagaagatggacgtacttt

SEQ ID NO: 70868 - DNA, 25 bp, S. pombe
agctgatcgactcaatgctgcggat

SEQ ID NO: 70869 - DNA, 25 bp, S. pombe
agcagcatggtcctgatcttcgaat

SEQ ID NO: 70870 - DNA, 25 bp, S. pombe
agcagcaattgccttcatcatcaac

SEQ ID NO: 70871 - DNA, 25 bp, S. pombe
agcagcgttgccgatgtgaatacct

SEQ ID NO: 70872 - DNA, 25 bp, S. pombe
agcaaaatccactgttttcttgtag

SEQ ID NO: 70873 - DNA, 25 bp, S. pombe
agaatactcaactcctaatcctgct

SEQ ID NO: 70874 - DNA, 25 bp, S. pombe
agaaggtcttcgtgtgatccgcgag

SEQ ID NO: 70875 - DNA, 25 bp, S. pombe
agaatggtcttcctcgtgatcgatg

SEQ ID NO: 70876 - DNA, 25 bp, S. pombe
agcatttgctcgacttttgacgggc

SEQ ID NO: 70877 - DNA, 25 bp, S. pombe
agcatttttggctgtgaccttggca

SEQ ID NO: 70878 - DNA, 25 bp, S. pombe
agcagccatttgttcggactcattt

SEQ ID NO: 70879 - DNA, 25 bp, S. pombe
agcaccggtattcggtatctttcgt

SEQ ID NO: 70880 - DNA, 25 bp, S. pombe
agaattggttaactctctcgctggc

SEQ ID NO: 70881 - DNA, 25 bp, S. pombe
agcaaattgtataccaccgaacccg

SEQ ID NO: 70882 - DNA, 25 bp, S. pombe
aaaatccggcaagcaagtacctggg

SEQ ID NO: 70883 - DNA, 25 bp, S. pombe
agcaatattacccattacgtctcca

SEQ ID NO: 70884 - DNA, 25 bp, S. pombe
agaatttttctattcctggctctgc

SEQ ID NO: 70885 - DNA, 25 bp, S. pombe
agcacaattacgtagtccggttctt

SEQ ID NO: 70886 - DNA, 25 bp, S. pombe
agcaactgaaactgtactcactgtt

SEQ ID NO: 70887 - DNA, 25 bp, S. pombe
agaaggctgtatccagctccttcaa

SEQ ID NO: 70888 - DNA, 25 bp, S. pombe
agaatccttctcaacgtggtaatat

SEQ ID NO: 70889 - DNA, 25 bp, S. pombe
agaataatcccactcgttggcgcta

SEQ ID NO: 70890 - DNA, 25 bp, S. pombe
agcttaatcagcgagttgaacggaa

SEQ ID NO: 70891 - DNA, 25 bp, S. pombe
agcttactcggtgcttatgggcaac

SEQ ID NO: 70892 - DNA, 25 bp, S. pombe
agcatatgacgctcttgctattggg

SEQ ID NO: 70893 - DNA, 25 bp, S. pombe
agaatatcacccagcttatgccgaa

SEQ ID NO: 70894 - DNA, 25 bp, S. pombe
agcattatccaatatctttttagca

SEQ ID NO: 70895 - DNA, 25 bp, S. pombe
agaatctaacatgccttttgtccaa

SEQ ID NO: 70896 - DNA, 25 bp, S. pombe
agcaacatctctttcgttatcaagg

SEQ ID NO: 70897 - DNA, 25 bp, S. pombe
agcaaattttcttactcatcgatag

SEQ ID NO: 70898 - DNA, 25 bp, S. pombe
agcaactgagttttcgcatcgatta

SEQ ID NO: 70899 - DNA, 25 bp, S. pombe
agaattattcttgggctcctcaaag

SEQ ID NO: 70900 - DNA, 25 bp, S. pombe
agcaatatctatgtcggccattcaa

SEQ ID NO: 70901 - DNA, 25 bp, S. pombe
agcaaatctcacttcttcgattgga

SEQ ID NO: 70902 - DNA, 25 bp, S. pombe
agaatcagcgcgtttgtccaattta

SEQ ID NO: 70903 - DNA, 25 bp, S. pombe
agcaatccagagacatttcccttta

SEQ ID NO: 70904 - DNA, 25 bp, S. pombe
agcataaaagctcctactcctagtc

SEQ ID NO: 70905 - DNA, 25 bp, S. pombe
agcacatgagacacgctaccgtttt

SEQ ID NO: 70906 - DNA, 25 bp, S. pombe
agcaatgaacaacgcttcgctcgaa

SEQ ID NO: 70907 - DNA, 25 bp, S. pombe
agcatgtttcaaccctaccaaagat

SEQ ID NO: 70908 - DNA, 25 bp, S. pombe
aattgttccacctccaaattgggca

SEQ ID NO: 70909 - DNA, 25 bp, S. pombe
agcacggcagctcgatttagcaaac

SEQ ID NO: 70910 - DNA, 25 bp, S. pombe
agcaccgctgcaaatctttaaagat

SEQ ID NO: 70911 - DNA, 25 bp, S. pombe
agcaccgtacacattaattctggat

SEQ ID NO: 70912 - DNA, 25 bp, S. pombe
agcatcgtatcccttgtactttggt

SEQ ID NO: 70913 - DNA, 25 bp, S. pombe
agcagctctacgcttaaagacaaat

SEQ ID NO: 70914 - DNA, 25 bp, S. pombe
agcaaactttatgctgcccatcata

SEQ ID NO: 70915 - DNA, 25 bp, S. pombe
agcagagtcttgaacgtgcctttga

SEQ ID NO: 70916 - DNA, 25 bp, S. pombe
agcttccaaaagtcttgctcgtttc

SEQ ID NO: 70917 - DNA, 25 bp, S. pombe
agctgaaaacaacgcatccttaaaa

SEQ ID NO: 70918 - DNA, 25 bp, S. pombe
agctaagacaaacgcttgattccga

SEQ ID NO: 70919 - DNA, 25 bp, S. pombe
agcatatacacctttgacttcgttg

SEQ ID NO: 70920 - DNA, 25 bp, S. pombe
agctactacccgatctcttttagat

SEQ ID NO: 70921 - DNA, 25 bp, S. pombe
agcacactccttcgtattttggcaa

SEQ ID NO: 70922 - DNA, 25 bp, S. pombe
agcacccgctatcggattttcaaag

SEQ ID NO: 70923 - DNA, 25 bp, S. pombe
agcaagttgtacatgttccttcaca

SEQ ID NO: 70924 - DNA, 25 bp, S. pombe
agaattgattacagtgaccctaaca

SEQ ID NO: 70925 - DNA, 25 bp, S. pombe
agcaatttctacaatgggttcgtca

SEQ ID NO: 70926 - DNA, 25 bp, S. pombe
agctttcactaattgggttggtcga

SEQ ID NO: 70927 - DNA, 25 bp, S. pombe
agcggtagctactggttgggttatt

SEQ ID NO: 70928 - DNA, 25 bp, S. pombe
agctccaattcctcatcaagggttt

SEQ ID NO: 70929 - DNA, 25 bp, S. pombe
agctaaacatgtagctaaaacgatt

SEQ ID NO: 70930 - DNA, 25 bp, S. pombe
actagcgcacgttctacaattcgta

SEQ ID NO: 70931 - DNA, 25 bp, S. pombe
agcagccctctacagttacgaattt

SEQ ID NO: 70932 - DNA, 25 bp, S. pombe
agccctactttacttgccaggtatt

SEQ ID NO: 70933 - DNA, 25 bp, S. pombe
agcaattcaaggtttggctcatatt

SEQ ID NO: 70934 - DNA, 25 bp, S. pombe
agcaattgcatccttttggctggaa

SEQ ID NO: 70935 - DNA, 25 bp, S. pombe
agcaattgcagcttccctaggaaat

SEQ ID NO: 70936 - DNA, 25 bp, S. pombe
agcaattcatgcttgacccatcaga

SEQ ID NO: 70937 - DNA, 25 bp, S. pombe
agcatgcaactgatcctaacgctgc

SEQ ID NO: 70938 - DNA, 25 bp, S. pombe
agcatgaatcgatccaaaccacctg

SEQ ID NO: 70939 - DNA, 25 bp, S. pombe
agcaaaccgtcctgcaaacatcatt

SEQ ID NO: 70940 - DNA, 25 bp, S. pombe
agctaccctgtcgaggaagtctctt

SEQ ID NO: 70941 - DNA, 25 bp, S. pombe
agcaaggctgctttgggacgtgctt

SEQ ID NO: 70942 - DNA, 25 bp, S. pombe
agcaatcatataagctgccccttgt

SEQ ID NO: 70943 - DNA, 25 bp, S. pombe
agcattcaagacgtcccttttacct

SEQ ID NO: 70944 - DNA, 25 bp, S. pombe
agctataaacggtcactttctccat

SEQ ID NO: 70945 - DNA, 25 bp, S. pombe
agcaccataactgccaaagtacagg

SEQ ID NO: 70946 - DNA, 25 bp, S. pombe
agcagtcaatctggccgatctcaat

SEQ ID NO: 70947 - DNA, 25 bp, S. pombe
agctaacgcccaaagttctggcttt

SEQ ID NO: 70948 - DNA, 25 bp, S. pombe
actaccctactatcttatccgttat

SEQ ID NO: 70949 - DNA, 25 bp, S. pombe
accaactctattctttatcctactt

SEQ ID NO: 70950 - DNA, 25 bp, S. pombe
agcactagcttttttgtttacaatc

SEQ ID NO: 70951 - DNA, 25 bp, S. pombe
agcacgagccttattgatgttacca

SEQ ID NO: 70952 - DNA, 25 bp, S. pombe
agcaaccactgtttctgcttctaaa

SEQ ID NO: 70953 - DNA, 25 bp, S. pombe
agcacctactgctgatgtttcacag

SEQ ID NO: 70954 - DNA, 25 bp, S. pombe
agcaattacatccttctaggtctga

SEQ ID NO: 70955 - DNA, 25 bp, S. pombe
agcattcggatgcttcatcggtctg

SEQ ID NO: 70956 - DNA, 25 bp, S. pombe
agcaagcgggtgttgatcgtctcgt

SEQ ID NO: 70957 - DNA, 25 bp, S. pombe
agcacctgggtttgactgagtttaa

SEQ ID NO: 70958 - DNA, 25 bp, S. pombe
agccgatcccctttgaatggtatgc

SEQ ID NO: 70959 - DNA, 25 bp, S. pombe
agcaccgctatctcttgacatgagt

SEQ ID NO: 70960 - DNA, 25 bp, S. pombe
agcaagctttgcgacatctcaactt

SEQ ID NO: 70961 - DNA, 25 bp, S. pombe
agcaatcttgcggtatcgctgactt

SEQ ID NO: 70962 - DNA, 25 bp, S. pombe
agcaatactcgatatcctgccatat

SEQ ID NO: 70963 - DNA, 25 bp, S. pombe
agctaagcttactatcactcctgat

SEQ ID NO: 70964 - DNA, 25 bp, S. pombe
agcaatatgtcttcttcacccgttt

SEQ ID NO: 70965 - DNA, 25 bp, S. pombe
agcaattggctctttcttttgtttt

SEQ ID NO: 70966 - DNA, 25 bp, S. pombe
agcactcgagcttttcatgtttatg

SEQ ID NO: 70967 - DNA, 25 bp, S. pombe
agcaatcatcatcttttctcacaaa

SEQ ID NO: 70968 - DNA, 25 bp, S. pombe
agcaaatgatgcgtcctttatccca

SEQ ID NO: 70969 - DNA, 25 bp, S. pombe
agcaaaagctttattcacccatgaa

SEQ ID NO: 70970 - DNA, 25 bp, S. pombe
accaacgtttctgtcaccatggaat

SEQ ID NO: 70971 - DNA, 25 bp, S. pombe
agcaaacatgttatccacccaggaa

SEQ ID NO: 70972 - DNA, 25 bp, S. pombe
agcatgcaagattctcgttctcagc

SEQ ID NO: 70973 - DNA, 25 bp, S. pombe
agcagctcacgatgggccttctttg

SEQ ID NO: 70974 - DNA, 25 bp, S. pombe
agcaatcatcgacatggctctcatc

SEQ ID NO: 70975 - DNA, 25 bp, S. pombe
acgattcccgttatccacttattga

SEQ ID NO: 70976 - DNA, 25 bp, S. pombe
agctagtgcccctaaacgcaaagtt

SEQ ID NO: 70977 - DNA, 25 bp, S. pombe
agcaagtgccgcttcaacagcgaaa

SEQ ID NO: 70978 - DNA, 25 bp, S. pombe
agcaggtctgacttgtttatacata

SEQ ID NO: 70979 - DNA, 25 bp, S. pombe
agctgggttcatcacgaagccaacg

SEQ ID NO: 70980 - DNA, 25 bp, S. pombe
agcggccttccgagaatccaagatt

SEQ ID NO: 70981 - DNA, 25 bp, S. pombe
agcaatgttggtaactcttcagaga

SEQ ID NO: 70982 - DNA, 25 bp, S. pombe
agcaatccttattcacttctgcgaa

SEQ ID NO: 70983 - DNA, 25 bp, S. pombe
agcatgttgagcctagctcttctca

SEQ ID NO: 70984 - DNA, 25 bp, S. pombe
agcaggcagctttgagcgttactca

SEQ ID NO: 70985 - DNA, 25 bp, S. pombe
agcgagagcttctaggccttggaac

SEQ ID NO: 70986 - DNA, 25 bp, S. pombe
agcagaggatactacgccttttagt

SEQ ID NO: 70987 - DNA, 25 bp, S. pombe
agcttgcactactcgcggttttgat

SEQ ID NO: 70988 - DNA, 25 bp, S. pombe
agcaacaccagctgacagtggtact

SEQ ID NO: 70989 - DNA, 25 bp, S. pombe
agcacctgctccagaggatgtgatt

SEQ ID NO: 70990 - DNA, 25 bp, S. pombe
agcacactgtcctcctattatattt

SEQ ID NO: 70991 - DNA, 25 bp, S. pombe
agcaacttccacaacagactacatg

SEQ ID NO: 70992 - DNA, 25 bp, S. pombe
agcgtggaagcgtgcaattattcaa

SEQ ID NO: 70993 - DNA, 25 bp, S. pombe
agctatggtgggatgcgtttcaaga

SEQ ID NO: 70994 - DNA, 25 bp, S. pombe
agcacggtgaggtttgccctgccaa

SEQ ID NO: 70995 - DNA, 25 bp, S. pombe
agctgcggatgaggagttactagat

SEQ ID NO: 70996 - DNA, 25 bp, S. pombe
agcacagttgcttcgatacacagac

SEQ ID NO: 70997 - DNA, 25 bp, S. pombe
agcatagctgtaatccatcatttca

SEQ ID NO: 70998 - DNA, 25 bp, S. pombe
agcaagctgttatcgcatctgttat

SEQ ID NO: 70999 - DNA, 25 bp, S. pombe
agctcagacatcgtagttgctgccg

SEQ ID NO: 71000 - DNA, 25 bp, S. pombe
agcatcaattgctcatgttgtccga

SEQ ID NO: 71001 - DNA, 25 bp, S. pombe
agcaaattctgcaagagccgccgca

SEQ ID NO: 71002 - DNA, 25 bp, S. pombe
agcaaaatctgctgcacctgacgaa

SEQ ID NO: 71003 - DNA, 25 bp, S. pombe
agcccctccatgataatgaactcgg

SEQ ID NO: 71004 - DNA, 25 bp, S. pombe
agcatccctttttcaacaacacggc

SEQ ID NO: 71005 - DNA, 25 bp, S. pombe
agcatcctttgtatactcatgtccc

SEQ ID NO: 71006 - DNA, 25 bp, S. pombe
agcaactcttgtcttggcatcccct

SEQ ID NO: 71007 - DNA, 25 bp, S. pombe
agctatttaccgatttgccttctaa

SEQ ID NO: 71008 - DNA, 25 bp, S. pombe
agctatttacgcattgacgccattg

SEQ ID NO: 71009 - DNA, 25 bp, S. pombe
agcttggttacatttacgcctgcat

SEQ ID NO: 71010 - DNA, 25 bp, S. pombe
agcttggttgcctatgctacaggaa

SEQ ID NO: 71011 - DNA, 25 bp, S. pombe
agcattggccttttgccaagctaga

SEQ ID NO: 71012 - DNA, 25 bp, S. pombe
agcactcgaattttggatactcaga

SEQ ID NO: 71013 - DNA, 25 bp, S. pombe
agcacttatgcattacccggaacaa

SEQ ID NO: 71014 - DNA, 25 bp, S. pombe
agctcattttgattgccggtaactg

SEQ ID NO: 71015 - DNA, 25 bp, S. pombe
agcttattagtactcggctgcaaag

SEQ ID NO: 71016 - DNA, 25 bp, S. pombe
agcatgtcttgcgttcgggtgcata

SEQ ID NO: 71017 - DNA, 25 bp, S. pombe
agcacatcttcgattagcagtggat

SEQ ID NO: 71018 - DNA, 25 bp, S. pombe
agcagtcctagaggcactcagtgat

SEQ ID NO: 71019 - DNA, 25 bp, S. pombe
agctcctcaggcgaatccgatgatt

SEQ ID NO: 71020 - DNA, 25 bp, S. pombe
agctgttaatatggttcccttccct

SEQ ID NO: 71021 - DNA, 25 bp, S. pombe
agcattagagcttacttctccgaaa

SEQ ID NO: 71022 - DNA, 25 bp, S. pombe
agcattaacttcatctccctataaa

SEQ ID NO: 71023 - DNA, 25 bp, S. pombe
agcactaatgcagcgactacttttt

SEQ ID NO: 71024 - DNA, 25 bp, S. pombe
agcacttgctttcactacttttttc

SEQ ID NO: 71025 - DNA, 25 bp, S. pombe
agcacatgttttcatctacttttca

SEQ ID NO: 71026 - DNA, 25 bp, S. pombe
agcaaacatcttcacattctcttct

SEQ ID NO: 71027 - DNA, 25 bp, S. pombe
agctaattcacgcacattgttctgt

SEQ ID NO: 71028 - DNA, 25 bp, S. pombe
agctatttccctctatctttgatgc

SEQ ID NO: 71029 - DNA, 25 bp, S. pombe
agcatatgcaaatcgcgtatccctc

SEQ ID NO: 71030 - DNA, 25 bp, S. pombe
agcactgataatccttttctcactc

SEQ ID NO: 71031 - DNA, 25 bp, S. pombe
agcttgccaagaagagactcggtac

SEQ ID NO: 71032 - DNA, 25 bp, S. pombe
agcacattgctcaactgggcggtaa

SEQ ID NO: 71033 - DNA, 25 bp, S. pombe
agcagatacacttcggcataaccaa

SEQ ID NO: 71034 - DNA, 25 bp, S. pombe
agcattggcttcgtggactttgtaa

SEQ ID NO: 71035 - DNA, 25 bp, S. pombe
agcattgggtgcctgtttgttttcc

SEQ ID NO: 71036 - DNA, 25 bp, S. pombe
agcttggcttatatgaatctttctc

SEQ ID NO: 71037 - DNA, 25 bp, S. pombe
agcacctttacaagcttttctctct

SEQ ID NO: 71038 - DNA, 25 bp, S. pombe
agcatctatgtctacaagtccttcc

SEQ ID NO: 71039 - DNA, 25 bp, S. pombe
agcttcttctatgagtccttcttaa

SEQ ID NO: 71040 - DNA, 25 bp, S. pombe
agctacacctaaactcctgaatata

SEQ ID NO: 71041 - DNA, 25 bp, S. pombe
agcgacctccgattgaaatgaccac

SEQ ID NO: 71042 - DNA, 25 bp, S. pombe
agcttcccatactgaaaacctcggt

SEQ ID NO: 71043 - DNA, 25 bp, S. pombe
agctctgccgaatttggtgaacctc

SEQ ID NO: 71044 - DNA, 25 bp, S. pombe
agctcaccgattttggtaccagcga

SEQ ID NO: 71045 - DNA, 25 bp, S. pombe
agcatacaggttttcgactccagct

SEQ ID NO: 71046 - DNA, 25 bp, S. pombe
agctaaggcttgtactggtctatcg

SEQ ID NO: 71047 - DNA, 25 bp, S. pombe
agcaaagcgtgttaccgtttctcat

SEQ ID NO: 71048 - DNA, 25 bp, S. pombe
agcaggacagtaactcgcgttctac

SEQ ID NO: 71049 - DNA, 25 bp, S. pombe
agcactgcagccttttgggtcttga

SEQ ID NO: 71050 - DNA, 25 bp, S. pombe
agcaggtgtggtgatggcttttaca

SEQ ID NO: 71051 - DNA, 25 bp, S. pombe
agcagtcggcgcacatcgtgtttaa

SEQ ID NO: 71052 - DNA, 25 bp, S. pombe
agcacctcaagttagcacatttcca

SEQ ID NO: 71053 - DNA, 25 bp, S. pombe
agcatccttggttttacactgtgag

SEQ ID NO: 71054 - DNA, 25 bp, S. pombe
agcacgcttgcttttaacactgaac

SEQ ID NO: 71055 - DNA, 25 bp, S. pombe
agcaccattttcttctgtagtacga

SEQ ID NO: 71056 - DNA, 25 bp, S. pombe
agcaccttatgttccatgggtaatg

SEQ ID NO: 71057 - DNA, 25 bp, S. pombe
agcagcctaattccgatgatgtcca

SEQ ID NO: 71058 - DNA, 25 bp, S. pombe
agcacctagtgtcgctatttcatat

SEQ ID NO: 71059 - DNA, 25 bp, S. pombe
agcactatctagagcccttgcatat

SEQ ID NO: 71060 - DNA, 25 bp, S. pombe
agcatcggctactgccacggcaaaa

SEQ ID NO: 71061 - DNA, 25 bp, S. pombe
agcagcgttagctatgcaaccgcaa

SEQ ID NO: 71062 - DNA, 25 bp, S. pombe
agctggcctcgatgaaccagatgaa

SEQ ID NO: 71063 - DNA, 25 bp, S. pombe
agcatgagtttgagacccacggcac

SEQ ID NO: 71064 - DNA, 25 bp, S. pombe
agcttcatggacaagaacctttcga

SEQ ID NO: 71065 - DNA, 25 bp, S. pombe
agctttggagaaacctctttcgaga

SEQ ID NO: 71066 - DNA, 25 bp, S. pombe
agcatttgctggtccacctttggaa

SEQ ID NO: 71067 - DNA, 25 bp, S. pombe
agcacttcagcgtcaccttttgaaa

SEQ ID NO: 71068 - DNA, 25 bp, S. pombe
agcagttggtcaacccattgagcaa

SEQ ID NO: 71069 - DNA, 25 bp, S. pombe
agcatttgctgcttcgtgcggctaa

SEQ ID NO: 71070 - DNA, 25 bp, S. pombe
agcatattgtgattatgaggccaga

SEQ ID NO: 71071 - DNA, 25 bp, S. pombe
agcatctcttactaaggagcttaaa

SEQ ID NO: 71072 - DNA, 25 bp, S. pombe
agcatgccttactcagtcacttgaa

SEQ ID NO: 71073 - DNA, 25 bp, S. pombe
agcatcgatccaatcctactttgaa

SEQ ID NO: 71074 - DNA, 25 bp, S. pombe
agcatcgttttcttatctttgagga

SEQ ID NO: 71075 - DNA, 25 bp, S. pombe
agcacttttggctgatattccacag

SEQ ID NO: 71076 - DNA, 25 bp, S. pombe
agcactgttattcctcatactcaaa

SEQ ID NO: 71077 - DNA, 25 bp, S. pombe
agcacgtatatacctcctgtacaat

SEQ ID NO: 71078 - DNA, 25 bp, S. pombe
agcacctataatcattgcagcataa

SEQ ID NO: 71079 - DNA, 25 bp, S. pombe
agcacctatcatatcacgagcacaa

SEQ ID NO: 71080 - DNA, 25 bp, S. pombe
agctaaatcatcatcccgaatggac

SEQ ID NO: 71081 - DNA, 25 bp, S. pombe
agcttcgcaatcatcgccgtgagga

SEQ ID NO: 71082 - DNA, 25 bp, S. pombe
agcatgtctgtcatgatcccagtga

SEQ ID NO: 71083 - DNA, 25 bp, S. pombe
agcagttaagtctggcggtctcatc

SEQ ID NO: 71084 - DNA, 25 bp, S. pombe
agcattcatgttcctaccggtaatc

SEQ ID NO: 71085 - DNA, 25 bp, S. pombe
agcactgttgctggattcggtcttg

SEQ ID NO: 71086 - DNA, 25 bp, S. pombe
agcacctttgctatcattgacttgt

SEQ ID NO: 71087 - DNA, 25 bp, S. pombe
agcactctttctatgactacttctc

SEQ ID NO: 71088 - DNA, 25 bp, S. pombe
agcactctgtgcacttgtatacatt

SEQ ID NO: 71089 - DNA, 25 bp, S. pombe
agctcgtcaagtcctttggtgctga

SEQ ID NO: 71090 - DNA, 25 bp, S. pombe
agcttgatcaactgctggccgagga

SEQ ID NO: 71091 - DNA, 25 bp, S. pombe
agcattatcccgctgtatagagaga

SEQ ID NO: 71092 - DNA, 25 bp, S. pombe
agctggaggccgtgatcttgattat

SEQ ID NO: 71093 - DNA, 25 bp, S. pombe
agcgagcttcattttaaccgtatac

SEQ ID NO: 71094 - DNA, 25 bp, S. pombe
agcaggttgttccaaagctcgaata

SEQ ID NO: 71095 - DNA, 25 bp, S. pombe
agcggtttttccactgtactatcta

SEQ ID NO: 71096 - DNA, 25 bp, S. pombe
agcggttttgtatgtccttcttgca

SEQ ID NO: 71097 - DNA, 25 bp, S. pombe
agcttgtccttcgaaatcctttatc

SEQ ID NO: 71098 - DNA, 25 bp, S. pombe
agcgtcgcctgttaagaaaccacct

SEQ ID NO: 71099 - DNA, 25 bp, S. pombe
actgtccttttgcaattacgtcctg

SEQ ID NO: 71100 - DNA, 25 bp, S. pombe
agctcaaattcttaaccttcttctc

SEQ ID NO: 71101 - DNA, 25 bp, S. pombe
accaggttgttatgcccaatgtcca

SEQ ID NO: 71102 - DNA, 25 bp, S. pombe
agctaggaagattgacccgcgttct

SEQ ID NO: 71103 - DNA, 25 bp, S. pombe
agctctacaagcaaacgcggccgtt

SEQ ID NO: 71104 - DNA, 25 bp, S. pombe
agcagccaactcttctcagttgtat

SEQ ID NO: 71105 - DNA, 25 bp, S. pombe
agcagcatgcggaattcttgttcaa

SEQ ID NO: 71106 - DNA, 25 bp, S. pombe
agcaggccgtagctatgtctcgata

SEQ ID NO: 71107 - DNA, 25 bp, S. pombe
agcattccttgtatttgtcctcttt

SEQ ID NO: 71108 - DNA, 25 bp, S. pombe
agctcacgatttacttccgactagt

SEQ ID NO: 71109 - DNA, 25 bp, S. pombe
agcatccattggtttccctattatt

SEQ ID NO: 71110 - DNA, 25 bp, S. pombe
agcatcatttttgtgcgctcttcaa

SEQ ID NO: 71111 - DNA, 25 bp, S. pombe
agcatcatctcgttttcttgttaca

SEQ ID NO: 71112 - DNA, 25 bp, S. pombe
agcagctaccgtttcctatgttaaa

SEQ ID NO: 71113 - DNA, 25 bp, S. pombe
agcagtgatccgttctcatgaagtc

SEQ ID NO: 71114 - DNA, 25 bp, S. pombe
agcattgtcgtgttctaggtgccga

SEQ ID NO: 71115 - DNA, 25 bp, S. pombe
agcatagtgcttttcctggtctgga

SEQ ID NO: 71116 - DNA, 25 bp, S. pombe
agcattatgctttcatcgagtttga

SEQ ID NO: 71117 - DNA, 25 bp, S. pombe
agcagaagcctgtcaccgtgtatag

SEQ ID NO: 71118 - DNA, 25 bp, S. pombe
agcgactactgccatgactggtgag

SEQ ID NO: 71119 - DNA, 25 bp, S. pombe
acaggtcacgactatgggagcttta

SEQ ID NO: 71120 - DNA, 25 bp, S. pombe
actggacggtcttagcgatcgttca

SEQ ID NO: 71121 - DNA, 25 bp, S. pombe
agcttgctcagggtaagcgtcgtta

SEQ ID NO: 71122 - DNA, 25 bp, S. pombe
agctgcttcgcctgcaatggtaggt

SEQ ID NO: 71123 - DNA, 25 bp, S. pombe
agcattcccgcagatatggttggtt

SEQ ID NO: 71124 - DNA, 25 bp, S. pombe
agcattcgcctcttacatttgtggt

SEQ ID NO: 71125 - DNA, 25 bp, S. pombe
agcagaggcgcttttcattttcgtg

SEQ ID NO: 71126 - DNA, 25 bp, S. pombe
agcagcaatgttctagtccttcgtg

SEQ ID NO: 71127 - DNA, 25 bp, S. pombe
agcagatgatatccgtagtctcccg

SEQ ID NO: 71128 - DNA, 25 bp, S. pombe
agcgatgaaccgttgtttccgatta

SEQ ID NO: 71129 - DNA, 25 bp, S. pombe
cagcgaaaccaaccagttcacctta

SEQ ID NO: 71130 - DNA, 25 bp, S. pombe
acgaagttacgtcttgcggcattat

SEQ ID NO: 71131 - DNA, 25 bp, S. pombe
acgactggtacgactcgtgggcaaa

SEQ ID NO: 71132 - DNA, 25 bp, S. pombe
agctgggattatggtccgacgtgct

SEQ ID NO: 71133 - DNA, 25 bp, S. pombe
agctttgaatgtaaccgacggtgtc

SEQ ID NO: 71134 - DNA, 25 bp, S. pombe
agcttctaattcaaccacttctggt

SEQ ID NO: 71135 - DNA, 25 bp, S. pombe
agctcattaccttcgagtctcttga

SEQ ID NO: 71136 - DNA, 25 bp, S. pombe
agcatctttgtcatgtttgcagcga

SEQ ID NO: 71137 - DNA, 25 bp, S. pombe
agcagtattgctccattgtcaagat

SEQ ID NO: 71138 - DNA, 25 bp, S. pombe
agcagcaagtttttgacgcgcttcc

SEQ ID NO: 71139 - DNA, 25 bp, S. pombe
agcttccacaatctgtcgcattttt

SEQ ID NO: 71140 - DNA, 25 bp, S. pombe
agcttgcccaattttcagtttcctc

SEQ ID NO: 71141 - DNA, 25 bp, S. pombe
agctttatggtcttacggaacttgc

SEQ ID NO: 71142 - DNA, 25 bp, S. pombe
agctcagtagtttttcggactctgc

SEQ ID NO: 71143 - DNA, 25 bp, S. pombe
agctagtgggcatattcctacgtcc

SEQ ID NO: 71144 - DNA, 25 bp, S. pombe
agctcagtctgttaaatccccagtc

SEQ ID NO: 71145 - DNA, 25 bp, S. pombe
agcgtttctacgattgcgacaatgg

SEQ ID NO: 71146 - DNA, 25 bp, S. pombe
agctttgcttacttcctggacatag

SEQ ID NO: 71147 - DNA, 25 bp, S. pombe
agctttgacacgttttctactcaca

SEQ ID NO: 71148 - DNA, 25 bp, S. pombe
agcttttaagctgtttgactctgat

SEQ ID NO: 71149 - DNA, 25 bp, S. pombe
agcttttcagcggtttaggtctaga

SEQ ID NO: 71150 - DNA, 25 bp, S. pombe
agcagagacccctagcaatgttact

SEQ ID NO: 71151 - DNA, 25 bp, S. pombe
agcagggacccattgttgatgatga

SEQ ID NO: 71152 - DNA, 25 bp, S. pombe
agcatggtaccatcgatgtatcccc

SEQ ID NO: 71153 - DNA, 25 bp, S. pombe
agcatggtcttttcgttacaatcac

SEQ ID NO: 71154 - DNA, 25 bp, S. pombe
agcagtattctttggcttccacaac

SEQ ID NO: 71155 - DNA, 25 bp, S. pombe
agcatcattatttcttctctcgcaa

SEQ ID NO: 71156 - DNA, 25 bp, S. pombe
agcagattcgtgtcttgtctcatca

SEQ ID NO: 71157 - DNA, 25 bp, S. pombe
agcagcaagcgagttatgaccacaa

SEQ ID NO: 71158 - DNA, 25 bp, S. pombe
agcagcaatgccgtttcaacttaaa

SEQ ID NO: 71159 - DNA, 25 bp, S. pombe
agcagtatgcccaagtcaaattcaa

SEQ ID NO: 71160 - DNA, 25 bp, S. pombe
agcagtggctccagcagtagcttca

SEQ ID NO: 71161 - DNA, 25 bp, S. pombe
agcatgttgcatcgtcgttttctaa

SEQ ID NO: 71162 - DNA, 25 bp, S. pombe
agcatattcgctagctttgtgcata

SEQ ID NO: 71163 - DNA, 25 bp, S. pombe
agcatcatccatccatgtttgcatc

SEQ ID NO: 71164 - DNA, 25 bp, S. pombe
agctcgtgaataatggtccagtgac

SEQ ID NO: 71165 - DNA, 25 bp, S. pombe
tagttggaacttctacttccgcttt

SEQ ID NO: 71166 - DNA, 25 bp, S. pombe
agcttggaactctttgacttcagcc

SEQ ID NO: 71167 - DNA, 25 bp, S. pombe
agcttaaaatccctactgacttgcc

SEQ ID NO: 71168 - DNA, 25 bp, S. pombe
agctgcaaacagacaagttcgtttt

SEQ ID NO: 71169 - DNA, 25 bp, S. pombe
agcgagactcacagcatacctggca

SEQ ID NO: 71170 - DNA, 25 bp, S. pombe
agcattcgtccatctatccaagaag

SEQ ID NO: 71171 - DNA, 25 bp, S. pombe
agcttctccagtccttcgaagaaag

SEQ ID NO: 71172 - DNA, 25 bp, S. pombe
agcttgctcccttattacacgaaaa

SEQ ID NO: 71173 - DNA, 25 bp, S. pombe
agcaggcgccttttttcagaacaat

SEQ ID NO: 71174 - DNA, 25 bp, S. pombe
agcaggctaccgtttttgccgctat

SEQ ID NO: 71175 - DNA, 25 bp, S. pombe
agcagtgatagttcttcgtctacca

SEQ ID NO: 71176 - DNA, 25 bp, S. pombe
agcttagcgtgtcaatgccatccat

SEQ ID NO: 71177 - DNA, 25 bp, S. pombe
agctagctacgcacgtttctatcaa

SEQ ID NO: 71178 - DNA, 25 bp, S. pombe
agctttctaacttatcgcacattcg

SEQ ID NO: 71179 - DNA, 25 bp, S. pombe
agcatccaaatgttactctttccgc

SEQ ID NO: 71180 - DNA, 25 bp, S. pombe
agctaaaatgttgctttctcccgag

SEQ ID NO: 71181 - DNA, 25 bp, S. pombe
agctaaaagttcctctggcaatcag

SEQ ID NO: 71182 - DNA, 25 bp, S. pombe
agctaaatctcctgttcttgcattg

SEQ ID NO: 71183 - DNA, 25 bp, S. pombe
tttgagcccaactgtactaacggtt

SEQ ID NO: 71184 - DNA, 25 bp, S. pombe
agctactctaattctgtccgttgac

SEQ ID NO: 71185 - DNA, 25 bp, S. pombe
agcatagttattttggacgttcctt

SEQ ID NO: 71186 - DNA, 25 bp, S. pombe
agctggtcaattacggttcttcctt

SEQ ID NO: 71187 - DNA, 25 bp, S. pombe
agctcggatgccttggaaactgcgt

SEQ ID NO: 71188 - DNA, 25 bp, S. pombe
acgtgttatcccctgaagctaaaga

SEQ ID NO: 71189 - DNA, 25 bp, S. pombe
agcttcttcagggtcttttcaagtt

SEQ ID NO: 71190 - DNA, 25 bp, S. pombe
agctttatgctttgactttacggtt

SEQ ID NO: 71191 - DNA, 25 bp, S. pombe
agcatctttgtttgcatcttctaaa

SEQ ID NO: 71192 - DNA, 25 bp, S. pombe
agcatcttctggtgcatttgcgcaa

SEQ ID NO: 71193 - DNA, 25 bp, S. pombe
agctcattgaatgcacctggtgcga

SEQ ID NO: 71194 - DNA, 25 bp, S. pombe
agcatctcagttatctacgcaacct

SEQ ID NO: 71195 - DNA, 25 bp, S. pombe
agctgccatcgtttcaggagaacca

SEQ ID NO: 71196 - DNA, 25 bp, S. pombe
agctcaaagcttgcgaacgaccaat

SEQ ID NO: 71197 - DNA, 25 bp, S. pombe
agctcattgagcttatgggactccc

SEQ ID NO: 71198 - DNA, 25 bp, S. pombe
agcttcaagtaatgtcccagccatc

SEQ ID NO: 71199 - DNA, 25 bp, S. pombe
agctatcagattaccttcttaacca

SEQ ID NO: 71200 - DNA, 25 bp, S. pombe
agcttaagcctccaactagtgtaca

SEQ ID NO: 71201 - DNA, 25 bp, S. pombe
agcgtatacagttaagcccttctag

SEQ ID NO: 71202 - DNA, 25 bp, S. pombe
agcatcctaattgcacaagtgttat

SEQ ID NO: 71203 - DNA, 25 bp, S. pombe
agcatatgctgtatcggagcctaat

SEQ ID NO: 71204 - DNA, 25 bp, S. pombe
agcttgcaatccttgcagacctgaa

SEQ ID NO: 71205 - DNA, 25 bp, S. pombe
agctatgccatttctcatatcactg

SEQ ID NO: 71206 - DNA, 25 bp, S. pombe
agcttgccattcttgtagacgacat

SEQ ID NO: 71207 - DNA, 25 bp, S. pombe
agcttccttttccagattggctact

SEQ ID NO: 71208 - DNA, 25 bp, S. pombe
agctatcacttttccgttgtctatt

SEQ ID NO: 71209 - DNA, 25 bp, S. pombe
agctcccgaaaatctttgccgttgt

SEQ ID NO: 71210 - DNA, 25 bp, S. pombe
agcatcggctgattcttctgattcc

SEQ ID NO: 71211 - DNA, 25 bp, S. pombe
agcattgtgctttagtctcatctcc

SEQ ID NO: 71212 - DNA, 25 bp, S. pombe
agcttcctataaatcttcctcaaac

SEQ ID NO: 71213 - DNA, 25 bp, S. pombe
agcctgacgtctggtttgagcctaa

SEQ ID NO: 71214 - DNA, 25 bp, S. pombe
agcttactctcgtccagaagttaaa

SEQ ID NO: 71215 - DNA, 25 bp, S. pombe
agcggatcatcccaatggtaagttc

SEQ ID NO: 71216 - DNA, 25 bp, S. pombe
agctagctcattccctgttaaatcg

SEQ ID NO: 71217 - DNA, 25 bp, S. pombe
agctagctctttacttcatggtgac

SEQ ID NO: 71218 - DNA, 25 bp, S. pombe
agctcactggtctctggcatatggt

SEQ ID NO: 71219 - DNA, 25 bp, S. pombe
agcttctttcctaggtatgtgtatt

SEQ ID NO: 71220 - DNA, 25 bp, S. pombe
agcttgtatgcttgattccgttgcc

SEQ ID NO: 71221 - DNA, 25 bp, S. pombe
accctcccagattgcaaggcttaag

SEQ ID NO: 71222 - DNA, 25 bp, S. pombe
agcatctttcctttcaacgttctaa

SEQ ID NO: 71223 - DNA, 25 bp, S. pombe
agctctctatcccaataatcgctta

SEQ ID NO: 71224 - DNA, 25 bp, S. pombe
agcgcgaccattttcaattcacgta

SEQ ID NO: 71225 - DNA, 25 bp, S. pombe
agcggttcaggatacttccatggca

SEQ ID NO: 71226 - DNA, 25 bp, S. pombe
agcggatcaaattgcacatgcttgc

SEQ ID NO: 71227 - DNA, 25 bp, S. pombe
agctgacatcgacgaggccattcgg

SEQ ID NO: 71228 - DNA, 25 bp, S. pombe
agcttcgcggcaaatatattcctaa

SEQ ID NO: 71229 - DNA, 25 bp, S. pombe
agcttcgctagtaattatcccttat

SEQ ID NO: 71230 - DNA, 25 bp, S. pombe
agcgggaacgaagcattatcaacta

SEQ ID NO: 71231 - DNA, 25 bp, S. pombe
agcgggacaatgactcgattaaaga

SEQ ID NO: 71232 - DNA, 25 bp, S. pombe
agcggtgtttactgatcctgatgac

SEQ ID NO: 71233 - DNA, 25 bp, S. pombe
agctctgtctttttgtccatggcaa

SEQ ID NO: 71234 - DNA, 25 bp, S. pombe
agcttgctcttcatcctttgagaag

SEQ ID NO: 71235 - DNA, 25 bp, S. pombe
agctgtcgctttcagttttacggag

SEQ ID NO: 71236 - DNA, 25 bp, S. pombe
agcgtggttatactttctctactac

SEQ ID NO: 71237 - DNA, 25 bp, S. pombe
agctgccagtatcaattttcccttg

SEQ ID NO: 71238 - DNA, 25 bp, S. pombe
agcttcaatcctaaggctactccag

SEQ ID NO: 71239 - DNA, 25 bp, S. pombe
agcattactcgctaaggtctcttct

SEQ ID NO: 71240 - DNA, 25 bp, S. pombe
agcattggccagtcgagggcttttt

SEQ ID NO: 71241 - DNA, 25 bp, S. pombe
agcttaccaactctgtttctgtttc

SEQ ID NO: 71242 - DNA, 25 bp, S. pombe
agctgttcctacattagttcgttcc

SEQ ID NO: 71243 - DNA, 25 bp, S. pombe
agctggaccaagactctgagtttgt

SEQ ID NO: 71244 - DNA, 25 bp, S. pombe
agcttgagcagcttttggatctctc

SEQ ID NO: 71245 - DNA, 25 bp, S. pombe
agcttgacactctttgcgatcttta

SEQ ID NO: 71246 - DNA, 25 bp, S. pombe
agctactatattctgcgatgcacta

SEQ ID NO: 71247 - DNA, 25 bp, S. pombe
agctttaaagtttgcctcacagtgg

SEQ ID NO: 71248 - DNA, 25 bp, S. pombe
agctgttatcaacttccctgtaatg

SEQ ID NO: 71249 - DNA, 25 bp, S. pombe
agctcgtgggcggtactttactatt

SEQ ID NO: 71250 - DNA, 25 bp, S. pombe
agctcgcccagcagaatcagttaag

SEQ ID NO: 71251 - DNA, 25 bp, S. pombe
agctcagtcaccaggtcactatcaa

SEQ ID NO: 71252 - DNA, 25 bp, S. pombe
agctcctttcctcatatctttaatg

SEQ ID NO: 71253 - DNA, 25 bp, S. pombe
accagtttacagacctccagaggaa

SEQ ID NO: 71254 - DNA, 25 bp, S. pombe
agctcctttatctcctactgaagaa

SEQ ID NO: 71255 - DNA, 25 bp, S. pombe
agctggcttttcttcgtttagggat

SEQ ID NO: 71256 - DNA, 25 bp, S. pombe
agctacttgtactgcgatttcgcga

SEQ ID NO: 71257 - DNA, 25 bp, S. pombe
agctacatttactcgttatgccgct

SEQ ID NO: 71258 - DNA, 25 bp, S. pombe
agctacattcaatctcttttccgat

SEQ ID NO: 71259 - DNA, 25 bp, S. pombe
agctactccgttatcctaatgcgtc

SEQ ID NO: 71260 - DNA, 25 bp, S. pombe
agcctgggcacttttacaaacttca

SEQ ID NO: 71261 - DNA, 25 bp, S. pombe
agctagacgcgattctgccaataca

SEQ ID NO: 71262 - DNA, 25 bp, S. pombe
agctcttcacttttccgtcaaattg

SEQ ID NO: 71263 - DNA, 25 bp, S. pombe
agctattgtcttttccgctaaaatt

SEQ ID NO: 71264 - DNA, 25 bp, S. pombe
agctattgcctatgacctccaaaaa

SEQ ID NO: 71265 - DNA, 25 bp, S. pombe
agcttattgctctgtcccacaaaag

SEQ ID NO: 71266 - DNA, 25 bp, S. pombe
agcttctctgtgacttttcgcaatg

SEQ ID NO: 71267 - DNA, 25 bp, S. pombe
agcttcttgggcctgtagtggaatc

SEQ ID NO: 71268 - DNA, 25 bp, S. pombe
agcttcgtatgggtgctcctggaaa

SEQ ID NO: 71269 - DNA, 25 bp, S. pombe
agctatgctgcattctgaaacacaa

SEQ ID NO: 71270 - DNA, 25 bp, S. pombe
agcttctgctgccatatcaatcaac

SEQ ID NO: 71271 - DNA, 25 bp, S. pombe
agcggcacattaactcctgagctgt

SEQ ID NO: 71272 - DNA, 25 bp, S. pombe
agctgaagccttttggcagccaatc

SEQ ID NO: 71273 - DNA, 25 bp, S. pombe
agctgataccacttttcgacggagt

SEQ ID NO: 71274 - DNA, 25 bp, S. pombe
agctatcaaattccttctctcgggt

SEQ ID NO: 71275 - DNA, 25 bp, S. pombe
agcttcagttttacattactcgtga

SEQ ID NO: 71276 - DNA, 25 bp, S. pombe
agcttggtcctgaactatttcctga

SEQ ID NO: 71277 - DNA, 25 bp, S. pombe
agcttggttctgaattcttgtcatt

SEQ ID NO: 71278 - DNA, 25 bp, S. pombe
agcgggttggctatcgtatatctcc

SEQ ID NO: 71279 - DNA, 25 bp, S. pombe
acgggttgtctacctatcaatatgc

SEQ ID NO: 71280 - DNA, 25 bp, S. pombe
agcttctaatcctcttcttgatgca

SEQ ID NO: 71281 - DNA, 25 bp, S. pombe
agcttcctagcctcttatcattata

SEQ ID NO: 71282 - DNA, 25 bp, S. pombe
agcgtactagccgttatccattcaa

SEQ ID NO: 71283 - DNA, 25 bp, S. pombe
agctgctactcagactttacagtcg

SEQ ID NO: 71284 - DNA, 25 bp, S. pombe
agctctcaaggctatgatcaattca

SEQ ID NO: 71285 - DNA, 25 bp, S. pombe
agctccctgggaagcaataccgcat

SEQ ID NO: 71286 - DNA, 25 bp, S. pombe
agctccctttctacaggactctgat

SEQ ID NO: 71287 - DNA, 25 bp, S. pombe
agctcacccattgacgttcgtaaag

SEQ ID NO: 71288 - DNA, 25 bp, S. pombe
agctaccgcttcctttacgagaaag

SEQ ID NO: 71289 - DNA, 25 bp, S. pombe
agctaccatgccactcaggaagata

SEQ ID NO: 71290 - DNA, 25 bp, S. pombe
agctgaatcatccttccaagacgta

SEQ ID NO: 71291 - DNA, 25 bp, S. pombe
agcttttctattgccaatcgtccaa

SEQ ID NO: 71292 - DNA, 25 bp, S. pombe
agctattctggcatctttatttcga

SEQ ID NO: 71293 - DNA, 25 bp, S. pombe
agctctttcaaatcatcttttatat

SEQ ID NO: 71294 - DNA, 25 bp, S. pombe
agctctcttggataatttgacttct

SEQ ID NO: 71295 - DNA, 25 bp, S. pombe
agcttcgctctacgttttcagagtt

SEQ ID NO: 71296 - DNA, 25 bp, S. pombe
agcttccttctcagttggtggtata

SEQ ID NO: 71297 - DNA, 25 bp, S. pombe
agctccctcttaagtacgctggata

SEQ ID NO: 71298 - DNA, 25 bp, S. pombe
agctgcacagctacttgaactaact

SEQ ID NO: 71299 - DNA, 25 bp, S. pombe
agctacgcgacactggactaatcca

SEQ ID NO: 71300 - DNA, 25 bp, S. pombe
agctttggccgaaagtcaacgcccg

SEQ ID NO: 71301 - DNA, 25 bp, S. pombe
agctaacggattcctactcacttta

SEQ ID NO: 71302 - DNA, 25 bp, S. pombe
agcttcttctgttttcactggtggt

SEQ ID NO: 71303 - DNA, 25 bp, S. pombe
agcttcgggctacttatctcatgac

SEQ ID NO: 71304 - DNA, 25 bp, S. pombe
agcttcgttaagtcatatatgtcac

SEQ ID NO: 71305 - DNA, 25 bp, S. pombe
agctctggtttccaaactgtcagca

SEQ ID NO: 71306 - DNA, 25 bp, S. pombe
agctcagttaatccaacctgggcag

SEQ ID NO: 71307 - DNA, 25 bp, S. pombe
agctcgtttacctccgatgatgatc

SEQ ID NO: 71308 - DNA, 25 bp, S. pombe
agctctttaccgttgctttcagata

SEQ ID NO: 71309 - DNA, 25 bp, S. pombe
agcctttaccagcaggatgtcgttt

SEQ ID NO: 71310 - DNA, 25 bp, S. pombe
agctctcattttggctgacgagggt

SEQ ID NO: 71311 - DNA, 25 bp, S. pombe
agctgcttccttggcttacaaagta

SEQ ID NO: 71312 - DNA, 25 bp, S. pombe
agcgtgatgttgaccgtgctcgcaa

SEQ ID NO: 71313 - DNA, 25 bp, S. pombe
agcgtggtcatgtcttttctgagga

SEQ ID NO: 71314 - DNA, 25 bp, S. pombe
agcttttctctctttatctgagcat

SEQ ID NO: 71315 - DNA, 25 bp, S. pombe
agcttttctttgttttgccatgcat

SEQ ID NO: 71316 - DNA, 25 bp, S. pombe
agctattgcctgattattctcctga

SEQ ID NO: 71317 - DNA, 25 bp, S. pombe
agcttatcattggtgtcttcattta

SEQ ID NO: 71318 - DNA, 25 bp, S. pombe
agctttagtagctcctgtcttagga

SEQ ID NO: 71319 - DNA, 25 bp, S. pombe
agctttagtagctcatcttcagaaa

SEQ ID NO: 71320 - DNA, 25 bp, S. pombe
agctgcttcgtttctcactaataaa

SEQ ID NO: 71321 - DNA, 25 bp, S. pombe
agctgttttgctctggctaacgaag

SEQ ID NO: 71322 - DNA, 25 bp, S. pombe
agctatcctcttggtgttcatatgc

SEQ ID NO: 71323 - DNA, 25 bp, S. pombe
agctcacctgctgatgctgttgata

SEQ ID NO: 71324 - DNA, 25 bp, S. pombe
agctccatggctgatctttcaatac

SEQ ID NO: 71325 - DNA, 25 bp, S. pombe
agctccggtctacatgtgcaatact

SEQ ID NO: 71326 - DNA, 25 bp, S. pombe
agctgggtgtattctaggcattatc

SEQ ID NO: 71327 - DNA, 25 bp, S. pombe
agctcctctgaaagcggttcatcga

SEQ ID NO: 71328 - DNA, 25 bp, S. pombe
agctttctggctacaacttcatgga

SEQ ID NO: 71329 - DNA, 25 bp, S. pombe
agctttatgcgcaacctcttagaga

SEQ ID NO: 71330 - DNA, 25 bp, S. pombe
agctatttggccttcgtgctagtaa

SEQ ID NO: 71331 - DNA, 25 bp, S. pombe
agctcgtgtagcgtttggtagccac

SEQ ID NO: 71332 - DNA, 25 bp, S. pombe
agctcctgtacttttgagacacctg

SEQ ID NO: 71333 - DNA, 25 bp, S. pombe
agctcctgcaaatatcgaacccgaa

SEQ ID NO: 71334 - DNA, 25 bp, S. pombe
agctttagaataccttgctgccctt

SEQ ID NO: 71335 - DNA, 25 bp, S. pombe
agctgtttcagacaaggactctcat

SEQ ID NO: 71336 - DNA, 25 bp, S. pombe
agctttgacacctaccagaatcgat

SEQ ID NO: 71337 - DNA, 25 bp, S. pombe
agcgttatcccaatccgtttgttga

SEQ ID NO: 71338 - DNA, 25 bp, S. pombe
agcgttatcgttccggtattgctac

SEQ ID NO: 71339 - DNA, 25 bp, S. pombe
agctgttgtttcttgtaccttttca

SEQ ID NO: 71340 - DNA, 25 bp, S. pombe
agctctttcttttctagccttgaat

SEQ ID NO: 71341 - DNA, 25 bp, S. pombe
agctttgtcattagaccgtcctcat

SEQ ID NO: 71342 - DNA, 25 bp, S. pombe
agctttacttgacttatctgtggat

SEQ ID NO: 71343 - DNA, 25 bp, S. pombe
agcttttgcttgatcatccttggac

SEQ ID NO: 71344 - DNA, 25 bp, S. pombe
acgtcgatgttgagcctatctgggc

SEQ ID NO: 71345 - DNA, 25 bp, S. pombe
agcgcagtgatacaggtttctttga

SEQ ID NO: 71346 - DNA, 25 bp, S. pombe
agcgcaagttccttggtgactttac

SEQ ID NO: 71347 - DNA, 25 bp, S. pombe
agcgaaataacgatgcggcttcttc

SEQ ID NO: 71348 - DNA, 25 bp, S. pombe
agctggaaacccaagatggcctttt

SEQ ID NO: 71349 - DNA, 25 bp, S. pombe
agcggacccaacaagctggaataat

SEQ ID NO: 71350 - DNA, 25 bp, S. pombe
agcggcctctaatcgatctattggt

SEQ ID NO: 71351 - DNA, 25 bp, S. pombe
agctgtgttatgattgttcccggtg

SEQ ID NO: 71352 - DNA, 25 bp, S. pombe
agctctgtgcttttctttcgtcgtg

SEQ ID NO: 71353 - DNA, 25 bp, S. pombe
agctactgctttacgcccttatgat

SEQ ID NO: 71354 - DNA, 25 bp, S. pombe
agctggtgaagctcatttggccgga

SEQ ID NO: 71355 - DNA, 25 bp, S. pombe
agctggctgcgaacgaatttccaaa

SEQ ID NO: 71356 - DNA, 25 bp, S. pombe
agctatcccttctagtgtttcaaag

SEQ ID NO: 71357 - DNA, 25 bp, S. pombe
agctatgcacatttctgattgttta

SEQ ID NO: 71358 - DNA, 25 bp, S. pombe
agctgtcccggttcatgcatattta

SEQ ID NO: 71359 - DNA, 25 bp, S. pombe
agctgctgcagcattccaatttgca

SEQ ID NO: 71360 - DNA, 25 bp, S. pombe
agctgtggaggatcaactcgcactt

SEQ ID NO: 71361 - DNA, 25 bp, S. pombe
agctcttaattacttctacctcttg

SEQ ID NO: 71362 - DNA, 25 bp, S. pombe
agctcttaggtggtcaacttcttca

SEQ ID NO: 71363 - DNA, 25 bp, S. pombe
agctgttgctatcgcgaagtcggtt

SEQ ID NO: 71364 - DNA, 25 bp, S. pombe
agctcttctgcaacgatctttggat

SEQ ID NO: 71365 - DNA, 25 bp, S. pombe
agctgaggccgagcgtattgtcgtt

SEQ ID NO: 71366 - DNA, 25 bp, S. pombe
agcgggatgctgttcatctttgcga

SEQ ID NO: 71367 - DNA, 25 bp, S. pombe
agctagccagcagtgaccgtaacat

SEQ ID NO: 71368 - DNA, 25 bp, S. pombe
agctgcggcagctatagcacgtatc

SEQ ID NO: 71369 - DNA, 25 bp, S. pombe
agcggatgctgctacacatcgtgaa

SEQ ID NO: 71370 - DNA, 25 bp, S. pombe
agctgcaaatgcaacacgcacttcc

SEQ ID NO: 71371 - DNA, 25 bp, S. pombe
agctgatcatttgtacacttcccta

SEQ ID NO: 71372 - DNA, 25 bp, S. pombe
agctgtttcagcttaacgatcacac

SEQ ID NO: 71373 - DNA, 25 bp, S. pombe
agctgctcgattggccacatcataa

SEQ ID NO: 71374 - DNA, 25 bp, S. pombe
agctgcttatctgtacatcctacta

SEQ ID NO: 71375 - DNA, 25 bp, S. pombe
agctgtatctccttccatttattat

SEQ ID NO: 71376 - DNA, 25 bp, S. pombe
agctcgattacaccgtttactggaa

SEQ ID NO: 71377 - DNA, 25 bp, S. pombe
agctcccttccgttttatctgagaa

SEQ ID NO: 71378 - DNA, 25 bp, S. pombe
agctagcggttcgttcgattctaaa

SEQ ID NO: 71379 - DNA, 25 bp, S. pombe
agctaaaagtcaaacacgcccctca

SEQ ID NO: 71380 - DNA, 25 bp, S. pombe
agctaaagatgtcaagcctctccct

SEQ ID NO: 71381 - DNA, 25 bp, S. pombe
agctcaacgcttcaaactattctcc

SEQ ID NO: 71382 - DNA, 25 bp, S. pombe
agctctagctttaaggacctcttcg

SEQ ID NO: 71383 - DNA, 25 bp, S. pombe
agcgagctgtccagtgttatgagca

SEQ ID NO: 71384 - DNA, 25 bp, S. pombe
agcgggtcatctagcgtagggcaat

SEQ ID NO: 71385 - DNA, 25 bp, S. pombe
agcggtgtattagttgaggatccaa

SEQ ID NO: 71386 - DNA, 25 bp, S. pombe
agctctagcattttatcttggtacg

SEQ ID NO: 71387 - DNA, 25 bp, S. pombe
agcggctcttactaccggatactta

SEQ ID NO: 71388 - DNA, 25 bp, S. pombe
agctggtcgtaatcctgttgtcgaa

SEQ ID NO: 71389 - DNA, 25 bp, S. pombe
agctggtcgtggtaagtctttcaaa

SEQ ID NO: 71390 - DNA, 25 bp, S. pombe
accacccatatattcgatgcggcaa

SEQ ID NO: 71391 - DNA, 25 bp, S. pombe
agctaacatccatctcgagagtcaa

SEQ ID NO: 71392 - DNA, 25 bp, S. pombe
agcgtattgctctctctgataatgc

SEQ ID NO: 71393 - DNA, 25 bp, S. pombe
agcgtttcacagtctatatcatttc

SEQ ID NO: 71394 - DNA, 25 bp, S. pombe
agctggcgcgacgaatttttgattc

SEQ ID NO: 71395 - DNA, 25 bp, S. pombe
agcggtattcccgttagatcaattt

SEQ ID NO: 71396 - DNA, 25 bp, S. pombe
agctccaactccactattagcggat

SEQ ID NO: 71397 - DNA, 25 bp, S. pombe
agctcttcgagctgacttggaaaca

SEQ ID NO: 71398 - DNA, 25 bp, S. pombe
agctgctgctgatatcttgtttgaa

SEQ ID NO: 71399 - DNA, 25 bp, S. pombe
agcgagcgaatcttattgtggatca

SEQ ID NO: 71400 - DNA, 25 bp, S. pombe
agctgacagaccttattgtatcaac

SEQ ID NO: 71401 - DNA, 25 bp, S. pombe
agcgacagacgctagttgagcaaaa

SEQ ID NO: 71402 - DNA, 25 bp, S. pombe
agcgagcaactcgagctgtcaaaat

SEQ ID NO: 71403 - DNA, 25 bp, S. pombe
agcgacttcctgttctgcatttatg

SEQ ID NO: 71404 - DNA, 25 bp, S. pombe
agctgcttcatctgttttaacgtcg

SEQ ID NO: 71405 - DNA, 25 bp, S. pombe
agctctgtgcagttgatcctaatac

SEQ ID NO: 71406 - DNA, 25 bp, S. pombe
agctgccatgcacaatcctaaggtt

SEQ ID NO: 71407 - DNA, 25 bp, S. pombe
agctgcttctagtacgccatcgtat

SEQ ID NO: 71408 - DNA, 25 bp, S. pombe
agctcatttagctgcaccactaata

SEQ ID NO: 71409 - DNA, 25 bp, S. pombe
agctcctgctcttgagaccaaatgc

SEQ ID NO: 71410 - DNA, 25 bp, S. pombe
agcgccgcagacgttctactagtaa

SEQ ID NO: 71411 - DNA, 25 bp, S. pombe
agcgtgacaagcgtttctctggtac

SEQ ID NO: 71412 - DNA, 25 bp, S. pombe
agcgtaagcatggttgtgcacctct

SEQ ID NO: 71413 - DNA, 25 bp, S. pombe
agcgattccgcttagtcatgacatg

SEQ ID NO: 71414 - DNA, 25 bp, S. pombe
agcgcaatagcgtctatgccatgtt

SEQ ID NO: 71415 - DNA, 25 bp, S. pombe
agctcgcgcagcacgtttggaagat

SEQ ID NO: 71416 - DNA, 25 bp, S. pombe
agctcgcttgctaatttacccattc

SEQ ID NO: 71417 - DNA, 25 bp, S. pombe
agccgttacttccaacttgcttgga

SEQ ID NO: 71418 - DNA, 25 bp, S. pombe
agctggcaatacttctggcaccgtt

SEQ ID NO: 71419 - DNA, 25 bp, S. pombe
agctgagcgttctggaactcgtgtc

SEQ ID NO: 71420 - DNA, 25 bp, S. pombe
agctgaggtttctcaactgggtcct

SEQ ID NO: 71421 - DNA, 25 bp, S. pombe
agcgatggtttttacctgtgttgcc

SEQ ID NO: 71422 - DNA, 25 bp, S. pombe
agctcctcgctggttacaaacatta

SEQ ID NO: 71423 - DNA, 25 bp, S. pombe
agctgacttcatttctttagattta

SEQ ID NO: 71424 - DNA, 25 bp, S. pombe
agctcgctcaatatctagtatgcat

SEQ ID NO: 71425 - DNA, 25 bp, S. pombe
agctggctcaacaattctgtcgata

SEQ ID NO: 71426 - DNA, 25 bp, S. pombe
agcctgctacaaaatcgcatctgcg

SEQ ID NO: 71427 - DNA, 25 bp, S. pombe
agctcgcaagctagttccatttgta

SEQ ID NO: 71428 - DNA, 25 bp, S. pombe
agctcgtgagctatacaatattatt

SEQ ID NO: 71429 - DNA, 25 bp, S. pombe
agctcgtcatgctattctcgattta

SEQ ID NO: 71430 - DNA, 25 bp, S. pombe
agctcctcatgttcctcttagtaaa

SEQ ID NO: 71431 - DNA, 25 bp, S. pombe
agctggtctgcctactttcagtaag

SEQ ID NO: 71432 - DNA, 25 bp, S. pombe
agctcgtttctattttccaatcatg

SEQ ID NO: 71433 - DNA, 25 bp, S. pombe
agctcgtttcgctttttattcccat

SEQ ID NO: 71434 - DNA, 25 bp, S. pombe
agcccttcggatgtttttactctag

SEQ ID NO: 71435 - DNA, 25 bp, S. pombe
agccagtctaagtacatttcgtcgg

SEQ ID NO: 71436 - DNA, 25 bp, S. pombe
agccgctcttgaggaattccagtca

SEQ ID NO: 71437 - DNA, 25 bp, S. pombe
agctccatttgggtttgctggacca

SEQ ID NO: 71438 - DNA, 25 bp, S. pombe
agctctagggtgtgtagctgtccac

SEQ ID NO: 71439 - DNA, 25 bp, S. pombe
agcgtattgtgccagacatccgtat

SEQ ID NO: 71440 - DNA, 25 bp, S. pombe
agccattttggagcacctggtcaga

SEQ ID NO: 71441 - DNA, 25 bp, S. pombe
agctgcacattttagtatcctcgtc

SEQ ID NO: 71442 - DNA, 25 bp, S. pombe
agctgttgttcatggtcttatgcgc

SEQ ID NO: 71443 - DNA, 25 bp, S. pombe
agctgttgcgatttgggcgatctgc

SEQ ID NO: 71444 - DNA, 25 bp, S. pombe
agcctatcgcattcattggcgacca

SEQ ID NO: 71445 - DNA, 25 bp, S. pombe
agctgtagcagttcttcgtggtgac

SEQ ID NO: 71446 - DNA, 25 bp, S. pombe
agctgctgcagcctacatgatttgg

SEQ ID NO: 71447 - DNA, 25 bp, S. pombe
acctgcagcaaaagattccgtccga

SEQ ID NO: 71448 - DNA, 25 bp, S. pombe
acctacaaagactccggccatagtt

SEQ ID NO: 71449 - DNA, 25 bp, S. pombe
agcgctccctacagaatgcaactaa

SEQ ID NO: 71450 - DNA, 25 bp, S. pombe
agcgtctcctaattcagaacctcaa

SEQ ID NO: 71451 - DNA, 25 bp, S. pombe
accagctcaaaactcgaatctcttc

SEQ ID NO: 71452 - DNA, 25 bp, S. pombe
agctcctcaatcaactcgatggttt

SEQ ID NO: 71453 - DNA, 25 bp, S. pombe
agctccagctactcacgaagtttat

SEQ ID NO: 71454 - DNA, 25 bp, S. pombe
agctccttacatcaccaattgttac

SEQ ID NO: 71455 - DNA, 25 bp, S. pombe
agctgctgcatatccaaaaccttat

SEQ ID NO: 71456 - DNA, 25 bp, S. pombe
agcgctattgaagttgacccctttg

SEQ ID NO: 71457 - DNA, 25 bp, S. pombe
agctgcaagtttacaggtgcccatt

SEQ ID NO: 71458 - DNA, 25 bp, S. pombe
agctgtttcatctcctatgtcagaa

SEQ ID NO: 71459 - DNA, 25 bp, S. pombe
agcgtggattcattgtacttcccaa

SEQ ID NO: 71460 - DNA, 25 bp, S. pombe
agctgcaagttctattccttcctta

SEQ ID NO: 71461 - DNA, 25 bp, S. pombe
agctgcatttttggctttgttccaa

SEQ ID NO: 71462 - DNA, 25 bp, S. pombe
agctgctcctaagcttgcttttata

SEQ ID NO: 71463 - DNA, 25 bp, S. pombe
agcgctcccaactattgtggtgaat

SEQ ID NO: 71464 - DNA, 25 bp, S. pombe
agcgcttccgccattgataatgact

SEQ ID NO: 71465 - DNA, 25 bp, S. pombe
agctcgcgctggtttacaatttcct

SEQ ID NO: 71466 - DNA, 25 bp, S. pombe
agctccgatgagttcattcagttat

SEQ ID NO: 71467 - DNA, 25 bp, S. pombe
agcctcagatgagctcgtgcgtatc

SEQ ID NO: 71468 - DNA, 25 bp, S. pombe
agcccaagcacttttgcgcttttaa

SEQ ID NO: 71469 - DNA, 25 bp, S. pombe
agcgctctagcatcttttttggaat

SEQ ID NO: 71470 - DNA, 25 bp, S. pombe
agcggcttcgtcaatactgttggag

SEQ ID NO: 71471 - DNA, 25 bp, S. pombe
agccgcctttacaatcgcgttattg

SEQ ID NO: 71472 - DNA, 25 bp, S. pombe
accgttcattcattagctcgtttgc

SEQ ID NO: 71473 - DNA, 25 bp, S. pombe
agcgggcttcttagatccagtcgaa

SEQ ID NO: 71474 - DNA, 25 bp, S. pombe
agcgccgttctaaggacactcgaga

SEQ ID NO: 71475 - DNA, 25 bp, S. pombe
agcgttccagcatcgatgtttccaa

SEQ ID NO: 71476 - DNA, 25 bp, S. pombe
agcgttgtagctccattgtatttaa

SEQ ID NO: 71477 - DNA, 25 bp, S. pombe
agctgctttggctaacttatttcaa

SEQ ID NO: 71478 - DNA, 25 bp, S. pombe
agctgttatggctcgctttgaaaaa

SEQ ID NO: 71479 - DNA, 25 bp, S. pombe
agcgtaatgtctccggtgtcaataa

SEQ ID NO: 71480 - DNA, 25 bp, S. pombe
agcgctacattttgcgtgtcctaga

SEQ ID NO: 71481 - DNA, 25 bp, S. pombe
agctgcaagcagttagtttctcaaa

SEQ ID NO: 71482 - DNA, 25 bp, S. pombe
agctcctctgagaaatttgcctgta

SEQ ID NO: 71483 - DNA, 25 bp, S. pombe
agctcctctacttatggacctttat

SEQ ID NO: 71484 - DNA, 25 bp, S. pombe
agctgcctctttttctacttttgat

SEQ ID NO: 71485 - DNA, 25 bp, S. pombe
agcggatgctgtttcttctggaatt

SEQ ID NO: 71486 - DNA, 25 bp, S. pombe
agcgattcgcaaatccgagctatat

SEQ ID NO: 71487 - DNA, 25 bp, S. pombe
agcggttgcgtcgacaaatgccata

SEQ ID NO: 71488 - DNA, 25 bp, S. pombe
agctggtttgcttgctctgcgtgaa

SEQ ID NO: 71489 - DNA, 25 bp, S. pombe
agcgggtatctgaactctcttaata

SEQ ID NO: 71490 - DNA, 25 bp, S. pombe
actggtcaagctgttgcgtttttca

SEQ ID NO: 71491 - DNA, 25 bp, S. pombe
agcgtctccgcaacaagattgctgg

SEQ ID NO: 71492 - DNA, 25 bp, S. pombe
agccatgcctgctgctgatggttat

SEQ ID NO: 71493 - DNA, 25 bp, S. pombe
agctggctcaatcggtcagttcata

SEQ ID NO: 71494 - DNA, 25 bp, S. pombe
agctggctcatcttttgcgttcaag

SEQ ID NO: 71495 - DNA, 25 bp, S. pombe
agcgactcactcgttgatatccaag

SEQ ID NO: 71496 - DNA, 25 bp, S. pombe
agctgtttagcgtttctccttttat

SEQ ID NO: 71497 - DNA, 25 bp, S. pombe
acctctctacgggaatgtcgatgcg

SEQ ID NO: 71498 - DNA, 25 bp, S. pombe
acccttcccaactacgatttggatg

SEQ ID NO: 71499 - DNA, 25 bp, S. pombe
agcctattcccgactacgattttat

SEQ ID NO: 71500 - DNA, 25 bp, S. pombe
agccttatactgatcgggactcttc

SEQ ID NO: 71501 - DNA, 25 bp, S. pombe
agccgaaaatttccgcgcattagcc

SEQ ID NO: 71502 - DNA, 25 bp, S. pombe
accgagaaactcattgcaaaccaat

SEQ ID NO: 71503 - DNA, 25 bp, S. pombe
agcggcgttactcttgaagtcgcat

SEQ ID NO: 71504 - DNA, 25 bp, S. pombe
accctagtttctctttatcctgaag

SEQ ID NO: 71505 - DNA, 25 bp, S. pombe
agccgagaagcttcgtcaatcactt

SEQ ID NO: 71506 - DNA, 25 bp, S. pombe
agcgcagtcaagaaagtaatcacaa

SEQ ID NO: 71507 - DNA, 25 bp, S. pombe
agcctgaatcccaaatgtcaccaaa

SEQ ID NO: 71508 - DNA, 25 bp, S. pombe
agcgtgatacctcactttccaaaga

SEQ ID NO: 71509 - DNA, 25 bp, S. pombe
agcgtagacgtttcctccaataaat

SEQ ID NO: 71510 - DNA, 25 bp, S. pombe
agcgctttggtgttgctgccaagaa

SEQ ID NO: 71511 - DNA, 25 bp, S. pombe
agcgacttcatccacttgctgaaag

SEQ ID NO: 71512 - DNA, 25 bp, S. pombe
agcgttgcccaacttgcgatagagt

SEQ ID NO: 71513 - DNA, 25 bp, S. pombe
agcgtgttgatcatgacttaccaga

SEQ ID NO: 71514 - DNA, 25 bp, S. pombe
agcgcatattgatattctcccggac

SEQ ID NO: 71515 - DNA, 25 bp, S. pombe
accttgttcttcgtcttcgtggcgg

SEQ ID NO: 71516 - DNA, 25 bp, S. pombe
acctcgttttgcgtcttcgtggtgg

SEQ ID NO: 71517 - DNA, 25 bp, S. pombe
agcgtccttttgatcttttgcatgc

SEQ ID NO: 71518 - DNA, 25 bp, S. pombe
agcgtgccattttgagctttttgca

SEQ ID NO: 71519 - DNA, 25 bp, S. pombe
agcgtgcctgtccaggagtactata

SEQ ID NO: 71520 - DNA, 25 bp, S. pombe
agcggcgtcttcagcagtggatgaa

SEQ ID NO: 71521 - DNA, 25 bp, S. pombe
agcgggattctcatgcttggtaaat

SEQ ID NO: 71522 - DNA, 25 bp, S. pombe
agcggtttgccaattgttgtctaca

SEQ ID NO: 71523 - DNA, 25 bp, S. pombe
agcggtctgacctatatttctctat

SEQ ID NO: 71524 - DNA, 25 bp, S. pombe
agcgcaactggtctctggaacggca

SEQ ID NO: 71525 - DNA, 25 bp, S. pombe
agcgacagtgtcttcttgggcgaaa

SEQ ID NO: 71526 - DNA, 25 bp, S. pombe
agcgagcatgttcacctcgtcaaaa

SEQ ID NO: 71527 - DNA, 25 bp, S. pombe
agcgctcccgctataaataatggca

SEQ ID NO: 71528 - DNA, 25 bp, S. pombe
agctgtttcttcctataatcgggca

SEQ ID NO: 71529 - DNA, 25 bp, S. pombe
agcgtcttgcgttctttgataggga

SEQ ID NO: 71530 - DNA, 25 bp, S. pombe
agcgtttcgaggaggctgccaaaac

SEQ ID NO: 71531 - DNA, 25 bp, S. pombe
actttccgaatgatcctgaggtcca

SEQ ID NO: 71532 - DNA, 25 bp, S. pombe
actactcaagaaggtctccaggttc

SEQ ID NO: 71533 - DNA, 25 bp, S. pombe
agcctaacttgatgcattctcgctt

SEQ ID NO: 71534 - DNA, 25 bp, S. pombe
acctactattgtcgagtcaacctct

SEQ ID NO: 71535 - DNA, 25 bp, S. pombe
accagactcattgaaccagaacgtt

SEQ ID NO: 71536 - DNA, 25 bp, S. pombe
agcgaactcgtaaagccgcactttg

SEQ ID NO: 71537 - DNA, 25 bp, S. pombe
agccggacagtctattaggacctga

SEQ ID NO: 71538 - DNA, 25 bp, S. pombe
acgggaactttcatggcgttatttg

SEQ ID NO: 71539 - DNA, 25 bp, S. pombe
acgaggaggctttcttgtctgggtt

SEQ ID NO: 71540 - DNA, 25 bp, S. pombe
agcggttagtgatcttcttgggtta

SEQ ID NO: 71541 - DNA, 25 bp, S. pombe
agcctgccggcgattttcaattttc

SEQ ID NO: 71542 - DNA, 25 bp, S. pombe
agcgtttacgctctttagctgatga

SEQ ID NO: 71543 - DNA, 25 bp, S. pombe
agccttatactcctttcgagcgtaa

SEQ ID NO: 71544 - DNA, 25 bp, S. pombe
agcgtagtacctgggacgacgttca

SEQ ID NO: 71545 - DNA, 25 bp, S. pombe
agcgtactaccggtgcatatgtgga

SEQ ID NO: 71546 - DNA, 25 bp, S. pombe
agctggccccattccagaagaagat

SEQ ID NO: 71547 - DNA, 25 bp, S. pombe
agctggcttcttcgtgatatttcaa

SEQ ID NO: 71548 - DNA, 25 bp, S. pombe
agcgtcacaaggctctccttaaagt

SEQ ID NO: 71549 - DNA, 25 bp, S. pombe
agccaattttcctattacacttcct

SEQ ID NO: 71550 - DNA, 25 bp, S. pombe
agcgaattttgtgcatttcaattac

SEQ ID NO: 71551 - DNA, 25 bp, S. pombe
agcgacggttctgatgatcctacac

SEQ ID NO: 71552 - DNA, 25 bp, S. pombe
agccatcccgaggattgcagctgat

SEQ ID NO: 71553 - DNA, 25 bp, S. pombe
agcgcacgtcgaatgattgctttct

SEQ ID NO: 71554 - DNA, 25 bp, S. pombe
accatgtcgggtattccagcagctg

SEQ ID NO: 71555 - DNA, 25 bp, S. pombe
agcctggaatttacatacctgacga

SEQ ID NO: 71556 - DNA, 25 bp, S. pombe
acctgaaagcaattcgttacactac

SEQ ID NO: 71557 - DNA, 25 bp, S. pombe
agcctgaccaaattcgttaccttgt

SEQ ID NO: 71558 - DNA, 25 bp, S. pombe
agccttcccaaaagtgaacacgttg

SEQ ID NO: 71559 - DNA, 25 bp, S. pombe
agccctccgcagtggttttgaacag

SEQ ID NO: 71560 - DNA, 25 bp, S. pombe
agcgcttcccaaaggcgttctagaa

SEQ ID NO: 71561 - DNA, 25 bp, S. pombe
actttggttcctcagacttggatca

SEQ ID NO: 71562 - DNA, 25 bp, S. pombe
acgtgcgggccggatttttggcata

SEQ ID NO: 71563 - DNA, 25 bp, S. pombe
agcgttcgggaggtattttctatca

SEQ ID NO: 71564 - DNA, 25 bp, S. pombe
acgttcctggtgctaagttgtccat

SEQ ID NO: 71565 - DNA, 25 bp, S. pombe
acctggccagtgtccgaagtagtct

SEQ ID NO: 71566 - DNA, 25 bp, S. pombe
agcgtccttgtcttatcgagtatgt

SEQ ID NO: 71567 - DNA, 25 bp, S. pombe
agcgtcgttgcgttcttattctata

SEQ ID NO: 71568 - DNA, 25 bp, S. pombe
agcgtctgatggctttgtttagcaa

SEQ ID NO: 71569 - DNA, 25 bp, S. pombe
agcgcctgaggtattgtttcgatgc

SEQ ID NO: 71570 - DNA, 25 bp, S. pombe
agccgaaaccgcgacagaaactgta

SEQ ID NO: 71571 - DNA, 25 bp, S. pombe
acgtgaatccaccacaagcgaggga

SEQ ID NO: 71572 - DNA, 25 bp, S. pombe
acgtggcaccacagcaagcgatggt

SEQ ID NO: 71573 - DNA, 25 bp, S. pombe
accgccgtcacttgttctgggtgga

SEQ ID NO: 71574 - DNA, 25 bp, S. pombe
agccgtctttgccttttgttgtgga

SEQ ID NO: 71575 - DNA, 25 bp, S. pombe
acatatgctcgatagacctgttatt

SEQ ID NO: 71576 - DNA, 25 bp, S. pombe
actgcacttatatgtccgaatcgcg

SEQ ID NO: 71577 - DNA, 25 bp, S. pombe
agcgccgaatatgtccgtgtttgtg

SEQ ID NO: 71578 - DNA, 25 bp, S. pombe
agcccgattgggatattctatactg

SEQ ID NO: 71579 - DNA, 25 bp, S. pombe
accatatcgattggctctggttcga

SEQ ID NO: 71580 - DNA, 25 bp, S. pombe
acccaatatggtatgtctccgactg

SEQ ID NO: 71581 - DNA, 25 bp, S. pombe
accacaccggcattttcaatagggc

SEQ ID NO: 71582 - DNA, 25 bp, S. pombe
agccagcactctacaattgtaccag

SEQ ID NO: 71583 - DNA, 25 bp, S. pombe
agccttgtgtcgtctactactttga

SEQ ID NO: 71584 - DNA, 25 bp, S. pombe
agccttgctctttcataaatgtcgg

SEQ ID NO: 71585 - DNA, 25 bp, S. pombe
agcgctgtattttcaaagactccca

SEQ ID NO: 71586 - DNA, 25 bp, S. pombe
agcgccattttacagagcatttcca

SEQ ID NO: 71587 - DNA, 25 bp, S. pombe
agcgtcattggtatcagtctttccc

SEQ ID NO: 71588 - DNA, 25 bp, S. pombe
agcccagtagtcgtagttttgtcag

SEQ ID NO: 71589 - DNA, 25 bp, S. pombe
agccgcagccgaaggagttgtttca

SEQ ID NO: 71590 - DNA, 25 bp, S. pombe
agcgtatctcgaaggattctgttaa

SEQ ID NO: 71591 - DNA, 25 bp, S. pombe
agcgttgccgatctttcatgatgta

SEQ ID NO: 71592 - DNA, 25 bp, S. pombe
agcgttggcgctcttttagtcgtca

SEQ ID NO: 71593 - DNA, 25 bp, S. pombe
agcgccgggtttggcttagtaacat

SEQ ID NO: 71594 - DNA, 25 bp, S. pombe
acgaccgagggtactgctacttaca

SEQ ID NO: 71595 - DNA, 25 bp, S. pombe
agccccagggagagctgttgcttat

SEQ ID NO: 71596 - DNA, 25 bp, S. pombe
aaacggcaattctcttaactatgta

SEQ ID NO: 71597 - DNA, 25 bp, S. pombe
agcgtatgacgcatccgtacgtgga

SEQ ID NO: 71598 - DNA, 25 bp, S. pombe
agcgtattgccactgaggcttccaa

SEQ ID NO: 71599 - DNA, 25 bp, S. pombe
agcgggagcttcaacagttttttgc

SEQ ID NO: 71600 - DNA, 25 bp, S. pombe
agcctggagcttcacaaattcttag

SEQ ID NO: 71601 - DNA, 25 bp, S. pombe
agcgtctcatccattctttgagttc

SEQ ID NO: 71602 - DNA, 25 bp, S. pombe
acgtgtatcggcgtaaaaccgcaag

SEQ ID NO: 71603 - DNA, 25 bp, S. pombe
acgtattcttttcttacccaatgca

SEQ ID NO: 71604 - DNA, 25 bp, S. pombe
actgttgtattttgctttaccgaag

SEQ ID NO: 71605 - DNA, 25 bp, S. pombe
agcgtgctctttcaattgttccaga

SEQ ID NO: 71606 - DNA, 25 bp, S. pombe
agcgatcgcttactgagttgtttag

SEQ ID NO: 71607 - DNA, 25 bp, S. pombe
agcgcagacgggttggattacacca

SEQ ID NO: 71608 - DNA, 25 bp, S. pombe
agccggtgagattaggttgttccca

SEQ ID NO: 71609 - DNA, 25 bp, S. pombe
agccccttcttctggagtgtctagt

SEQ ID NO: 71610 - DNA, 25 bp, S. pombe
agccctctatttttggtgtatctgg

SEQ ID NO: 71611 - DNA, 25 bp, S. pombe
agcgcctgttattttgattccttat

SEQ ID NO: 71612 - DNA, 25 bp, S. pombe
agcctgctgaaactcttaacaagac

SEQ ID NO: 71613 - DNA, 25 bp, S. pombe
agccctgacacctattacacgaaag

SEQ ID NO: 71614 - DNA, 25 bp, S. pombe
accgtaaaattcttcgtgacaacat

SEQ ID NO: 71615 - DNA, 25 bp, S. pombe
accgtaaaattcttcgtgacaacat

SEQ ID NO: 71616 - DNA, 25 bp, S. pombe
agccatcaaatatccttctgacgtc

SEQ ID NO: 71617 - DNA, 25 bp, S. pombe
agcgcttgacattagcctttccaat

SEQ ID NO: 71618 - DNA, 25 bp, S. pombe
agcgatttctgttcactctttactc

SEQ ID NO: 71619 - DNA, 25 bp, S. pombe
agcccgcttacgtgacttgcaaaag

SEQ ID NO: 71620 - DNA, 25 bp, S. pombe
agcccgtctatcatcggttcgaaat

SEQ ID NO: 71621 - DNA, 25 bp, S. pombe
agccatccagctaacagggttcgat

SEQ ID NO: 71622 - DNA, 25 bp, S. pombe
accagtagccgagggaagtgcttct

SEQ ID NO: 71623 - DNA, 25 bp, S. pombe
agccttggccgctgctgttggtgtt

SEQ ID NO: 71624 - DNA, 25 bp, S. pombe
acgacgatgactacggcgttttcga

SEQ ID NO: 71625 - DNA, 25 bp, S. pombe
agcgctcatcataattcctttagta

SEQ ID NO: 71626 - DNA, 25 bp, S. pombe
agcgctgcacacaattgactcttaa

SEQ ID NO: 71627 - DNA, 25 bp, S. pombe
agccgacactttgctctatgcgaag

SEQ ID NO: 71628 - DNA, 25 bp, S. pombe
accaacgatttgactctatggagca

SEQ ID NO: 71629 - DNA, 25 bp, S. pombe
acgacacggctcgtggtttggcaga

SEQ ID NO: 71630 - DNA, 25 bp, S. pombe
agcgaccacgttgctttgatggcaa

SEQ ID NO: 71631 - DNA, 25 bp, S. pombe
accaacagcgttgcttggtagcaat

SEQ ID NO: 71632 - DNA, 25 bp, S. pombe
agcgcttgaagtctcgtggctacaa

SEQ ID NO: 71633 - DNA, 25 bp, S. pombe
agcctctcaagttttggtggatgca

SEQ ID NO: 71634 - DNA, 25 bp, S. pombe
agccgcgcacgatcttcgaatgaag

SEQ ID NO: 71635 - DNA, 25 bp, S. pombe
agcctctggcagtgttaagaatagt

SEQ ID NO: 71636 - DNA, 25 bp, S. pombe
agcccatggccaagtctgaagttaa

SEQ ID NO: 71637 - DNA, 25 bp, S. pombe
agcgcagtctccctataaaagcaac

SEQ ID NO: 71638 - DNA, 25 bp, S. pombe
agcgctggcgcttgacgaagaaatt

SEQ ID NO: 71639 - DNA, 25 bp, S. pombe
agcctgctggctcacatggagtttg

SEQ ID NO: 71640 - DNA, 25 bp, S. pombe
agcctggcgctacataatatattgg

SEQ ID NO: 71641 - DNA, 25 bp, S. pombe
accactgccgctagccaaagtgaag

SEQ ID NO: 71642 - DNA, 25 bp, S. pombe
accactactcggtcaacgcgaaaag

SEQ ID NO: 71643 - DNA, 25 bp, S. pombe
agccaagttgcggatcgacctgaaa

SEQ ID NO: 71644 - DNA, 25 bp, S. pombe
accaatgtatggttcgcacgccgca

SEQ ID NO: 71645 - DNA, 25 bp, S. pombe
agccctgagccggagacttctgaag

SEQ ID NO: 71646 - DNA, 25 bp, S. pombe
agcgcactgctgctggtatctggaa

SEQ ID NO: 71647 - DNA, 25 bp, S. pombe
agccctccattgaagcatctattga

SEQ ID NO: 71648 - DNA, 25 bp, S. pombe
agcgcgctcctcatattcatattga

SEQ ID NO: 71649 - DNA, 25 bp, S. pombe
agcgcaatcgctctagacagtgtga

SEQ ID NO: 71650 - DNA, 25 bp, S. pombe
agccatctcgctgaagccaggtgag

SEQ ID NO: 71651 - DNA, 25 bp, S. pombe
agccgtttctcattgcagtgtagga

SEQ ID NO: 71652 - DNA, 25 bp, S. pombe
agccgctgttctttgggatactgat

SEQ ID NO: 71653 - DNA, 25 bp, S. pombe
agcgcttctgctttaccaaatcgca

SEQ ID NO: 71654 - DNA, 25 bp, S. pombe
agcgcttcctgtctctctgaaagaa

SEQ ID NO: 71655 - DNA, 25 bp, S. pombe
accaacctgtcgtccttgaagagaa

SEQ ID NO: 71656 - DNA, 25 bp, S. pombe
actccaacttcgcagtaggtgcatg

SEQ ID NO: 71657 - DNA, 25 bp, S. pombe
accacgactttgtacgcgaggctta

SEQ ID NO: 71658 - DNA, 25 bp, S. pombe
acctcttaaacattcccggctatag

SEQ ID NO: 71659 - DNA, 25 bp, S. pombe
cgtcgcagtaggtttagtccaaaat

SEQ ID NO: 71660 - DNA, 25 bp, S. pombe
cattaggtgatctgttttccaaaat

SEQ ID NO: 71661 - DNA, 25 bp, S. pombe
accctcgtactatcggacattctgt

SEQ ID NO: 71662 - DNA, 25 bp, S. pombe
accactcccttctttggacaatttg

SEQ ID NO: 71663 - DNA, 25 bp, S. pombe
agccacttcaactatttcgaaacct

SEQ ID NO: 71664 - DNA, 25 bp, S. pombe
agccgcattcaatgttttgcagtac

SEQ ID NO: 71665 - DNA, 25 bp, S. pombe
agccctccgcattgttgaactatta

SEQ ID NO: 71666 - DNA, 25 bp, S. pombe
agccgaatctagtcgctgggatata

SEQ ID NO: 71667 - DNA, 25 bp, S. pombe
agcctgaagctaactccggtaatgt

SEQ ID NO: 71668 - DNA, 25 bp, S. pombe
accgtctaaagctcgtagtcccaat

SEQ ID NO: 71669 - DNA, 25 bp, S. pombe
accgttgaaacatctggaccttcta

SEQ ID NO: 71670 - DNA, 25 bp, S. pombe
accattgagaaacctgagcgtccct

SEQ ID NO: 71671 - DNA, 25 bp, S. pombe
agccttgcatcctttgcacaagtat

SEQ ID NO: 71672 - DNA, 25 bp, S. pombe
agccggcattgcatatccacatgaa

SEQ ID NO: 71673 - DNA, 25 bp, S. pombe
agccgtctcgaaattgcttaacaga

SEQ ID NO: 71674 - DNA, 25 bp, S. pombe
agccttctgcgccttattataacga

SEQ ID NO: 71675 - DNA, 25 bp, S. pombe
agcgctgtctctcggaacttagaaa

SEQ ID NO: 71676 - DNA, 25 bp, S. pombe
agcgctctcgctatcgcgttgaaaa

SEQ ID NO: 71677 - DNA, 25 bp, S. pombe
agccattgctggattcgtcgtaaaa

SEQ ID NO: 71678 - DNA, 25 bp, S. pombe
agccagtgcgtcagcgggtgtaaaa

SEQ ID NO: 71679 - DNA, 25 bp, S. pombe
accttgggaccttcgttatgatgac

SEQ ID NO: 71680 - DNA, 25 bp, S. pombe
agccattgcaacacattcgcgttat

SEQ ID NO: 71681 - DNA, 25 bp, S. pombe
agccttgctatcacaacgcttgtca

SEQ ID NO: 71682 - DNA, 25 bp, S. pombe
agcgcacctgccagacaatatttaa

SEQ ID NO: 71683 - DNA, 25 bp, S. pombe
gagcctcaagaacaggttccttcca

SEQ ID NO: 71684 - DNA, 25 bp, S. pombe
agccatcgggaggtggtgtccttac

SEQ ID NO: 71685 - DNA, 25 bp, S. pombe
agccataagggctcaagtgcgcatg

SEQ ID NO: 71686 - DNA, 25 bp, S. pombe
agcgctcacgttacccagagataaa

SEQ ID NO: 71687 - DNA, 25 bp, S. pombe
agcgcacctgcattttctcaggaaa

SEQ ID NO: 71688 - DNA, 25 bp, S. pombe
agcgcagtctatttcctcacttaat

SEQ ID NO: 71689 - DNA, 25 bp, S. pombe
agccattcttctgcttccaatgaaa

SEQ ID NO: 71690 - DNA, 25 bp, S. pombe
agcctgctccctcatcaaaagaaaa

SEQ ID NO: 71691 - DNA, 25 bp, S. pombe
agccagctaacttgtccttgtattt

SEQ ID NO: 71692 - DNA, 25 bp, S. pombe
agcgccttgataccgttgaccataa

SEQ ID NO: 71693 - DNA, 25 bp, S. pombe
agcgccttagtgtcatattacgata

SEQ ID NO: 71694 - DNA, 25 bp, S. pombe
agcgctcttcgtttgatatttgcac

SEQ ID NO: 71695 - DNA, 25 bp, S. pombe
agccctcatgcgtttatttggaatc

SEQ ID NO: 71696 - DNA, 25 bp, S. pombe
agcccctgaaggttctgtcgcaaag

SEQ ID NO: 71697 - DNA, 25 bp, S. pombe
agcctcgtcattctttggattcaaa

SEQ ID NO: 71698 - DNA, 25 bp, S. pombe
agccgtgactcgttttggtcatgaa

SEQ ID NO: 71699 - DNA, 25 bp, S. pombe
agccgatgccacgatcgttgctaaa

SEQ ID NO: 71700 - DNA, 25 bp, S. pombe
agcctcgtgagcgtgcttctgctga

SEQ ID NO: 71701 - DNA, 25 bp, S. pombe
agccatattggctaattctcgtggg

SEQ ID NO: 71702 - DNA, 25 bp, S. pombe
agcgccggaaacaacatcgaacaga

SEQ ID NO: 71703 - DNA, 25 bp, S. pombe
agccccagagcaattgatcaacgat

SEQ ID NO: 71704 - DNA, 25 bp, S. pombe
agcgctacgctcttagttcattaaa

SEQ ID NO: 71705 - DNA, 25 bp, S. pombe
agccctgttcttattccatttgtga

SEQ ID NO: 71706 - DNA, 25 bp, S. pombe
agccaactcgttatacttctcttga

SEQ ID NO: 71707 - DNA, 25 bp, S. pombe
agccgatgcgttttctctaaaaatg

SEQ ID NO: 71708 - DNA, 25 bp, S. pombe
accaatgagctttccacgcttggaa

SEQ ID NO: 71709 - DNA, 25 bp, S. pombe
agccgaacgaatgcatcactttgaa

SEQ ID NO: 71710 - DNA, 25 bp, S. pombe
agccatgttccattggtacgtacct

SEQ ID NO: 71711 - DNA, 25 bp, S. pombe
accggttgaaggcacagctgatcca

SEQ ID NO: 71712 - DNA, 25 bp, S. pombe
agccaacttgaagcgtcgtatccaa

SEQ ID NO: 71713 - DNA, 25 bp, S. pombe
agccaatgaatctaccgtcgttgca

SEQ ID NO: 71714 - DNA, 25 bp, S. pombe
agccgtatcctgacgatgttcttga

SEQ ID NO: 71715 - DNA, 25 bp, S. pombe
agccgccgatcaacaagctttagct

SEQ ID NO: 71716 - DNA, 25 bp, S. pombe
acctgggataaacgcattgtacttt

SEQ ID NO: 71717 - DNA, 25 bp, S. pombe
accagcgtcttctccagatgttagg

SEQ ID NO: 71718 - DNA, 25 bp, S. pombe
agccattcggtggatgctttggtct

SEQ ID NO: 71719 - DNA, 25 bp, S. pombe
agccgacaggctcttgatgttgaat

SEQ ID NO: 71720 - DNA, 25 bp, S. pombe
agccacttctcttgcggttatacaa

SEQ ID NO: 71721 - DNA, 25 bp, S. pombe
agcctctcatgtcgatcttgtggaa

SEQ ID NO: 71722 - DNA, 25 bp, S. pombe
acccttgtcggcgatgtgaacggta

SEQ ID NO: 71723 - DNA, 25 bp, S. pombe
acctcatttacattctggatggcac

SEQ ID NO: 71724 - DNA, 25 bp, S. pombe
agccacattccagtttgcaagtcaa

SEQ ID NO: 71725 - DNA, 25 bp, S. pombe
agccgttcttattccgcaatggtaa

SEQ ID NO: 71726 - DNA, 25 bp, S. pombe
agccgtgtttactggagatactctt

SEQ ID NO: 71727 - DNA, 25 bp, S. pombe
agccgtgctgctatttactcattgc

SEQ ID NO: 71728 - DNA, 25 bp, S. pombe
agccgatggtgctcaaactcaacat

SEQ ID NO: 71729 - DNA, 25 bp, S. pombe
acacgggtcactatggagggctatc

SEQ ID NO: 71730 - DNA, 25 bp, S. pombe
agcctttgggctatggtctggatat

SEQ ID NO: 71731 - DNA, 25 bp, S. pombe
accaattcggtgttgagctcggcaa

SEQ ID NO: 71732 - DNA, 25 bp, S. pombe
accgatccggattatgagaccttca

SEQ ID NO: 71733 - DNA, 25 bp, S. pombe
accgatactggtttagactctctgt

SEQ ID NO: 71734 - DNA, 25 bp, S. pombe
accgaattcctcaattacatccgga

SEQ ID NO: 71735 - DNA, 25 bp, S. pombe
agccagagttggatatgtcatattg

SEQ ID NO: 71736 - DNA, 25 bp, S. pombe
accactaccgtcgtctatcaaaagg

SEQ ID NO: 71737 - DNA, 25 bp, S. pombe
agccagtcgatgctcgcaagatcat

SEQ ID NO: 71738 - DNA, 25 bp, S. pombe
agcctgaaggcgttcctgcagagga

SEQ ID NO: 71739 - DNA, 25 bp, S. pombe
accagtttgagccagatgccgagga

SEQ ID NO: 71740 - DNA, 25 bp, S. pombe
accaatttgatgttggctcgcaaaa

SEQ ID NO: 71741 - DNA, 25 bp, S. pombe
agcccgtctgctattccagaagaga

SEQ ID NO: 71742 - DNA, 25 bp, S. pombe
agcctctggcttatctatttaatga

SEQ ID NO: 71743 - DNA, 25 bp, S. pombe
agccggttttggacttcgatgcaac

SEQ ID NO: 71744 - DNA, 25 bp, S. pombe
agcccgatcttgttgatgattccga

SEQ ID NO: 71745 - DNA, 25 bp, S. pombe
agcctgcgatattttgtgtcttcta

SEQ ID NO: 71746 - DNA, 25 bp, S. pombe
agccagcgattttatcttgcttcag

SEQ ID NO: 71747 - DNA, 25 bp, S. pombe
agccaactgattttcttcttcagga

SEQ ID NO: 71748 - DNA, 25 bp, S. pombe
agccaccttttgtttcatttcctcg

SEQ ID NO: 71749 - DNA, 25 bp, S. pombe
agccgttctgcttactcttatatta

SEQ ID NO: 71750 - DNA, 25 bp, S. pombe
agcctttacaatacgcttccggtag

SEQ ID NO: 71751 - DNA, 25 bp, S. pombe
agccacctgtgagttctatgagcgc

SEQ ID NO: 71752 - DNA, 25 bp, S. pombe
accttgttgatactgcattggcttc

SEQ ID NO: 71753 - DNA, 25 bp, S. pombe
acctctcctgtatcattagctcaat

SEQ ID NO: 71754 - DNA, 25 bp, S. pombe
aaatccctgtcgctaatggcaaagt

SEQ ID NO: 71755 - DNA, 25 bp, S. pombe
aaatcgtcgtcgctcgaaggaggct

SEQ ID NO: 71756 - DNA, 25 bp, S. pombe
accaaggctggtaacgtcgaagtcg

SEQ ID NO: 71757 - DNA, 25 bp, S. pombe
accatccttggttgtctgtgctgga

SEQ ID NO: 71758 - DNA, 25 bp, S. pombe
acctctacttgctggccaaagtgta

SEQ ID NO: 71759 - DNA, 25 bp, S. pombe
agcctcactcttctttgatgacatt

SEQ ID NO: 71760 - DNA, 25 bp, S. pombe
agccggctatcgaatttttcactta

SEQ ID NO: 71761 - DNA, 25 bp, S. pombe
accggttttttatgtgcctacaatg

SEQ ID NO: 71762 - DNA, 25 bp, S. pombe
acccacttttactccagacgttatg

SEQ ID NO: 71763 - DNA, 25 bp, S. pombe
accggcgacatagctttatctcgtt

SEQ ID NO: 71764 - DNA, 25 bp, S. pombe
accgagcaaggtctttgtattttca

SEQ ID NO: 71765 - DNA, 25 bp, S. pombe
accgagcagggcgaactttcattta

SEQ ID NO: 71766 - DNA, 25 bp, S. pombe
acctcttaaactcgacgggattgat

SEQ ID NO: 71767 - DNA, 25 bp, S. pombe
accttcgtctagtggagcggatcta

SEQ ID NO: 71768 - DNA, 25 bp, S. pombe
accaacgtacgaggacatgctttta

SEQ ID NO: 71769 - DNA, 25 bp, S. pombe
accgtcgaacgatccaaagcagaaa

SEQ ID NO: 71770 - DNA, 25 bp, S. pombe
accgttcgtggtcccaaagctgagg

SEQ ID NO: 71771 - DNA, 25 bp, S. pombe
acctgcgtctggctttaagtctggg

SEQ ID NO: 71772 - DNA, 25 bp, S. pombe
agccaatttttactctctctgttag

SEQ ID NO: 71773 - DNA, 25 bp, S. pombe
acctctccttgtatactttccaaat

SEQ ID NO: 71774 - DNA, 25 bp, S. pombe
accgctcaagttcaagtttccataa

SEQ ID NO: 71775 - DNA, 25 bp, S. pombe
accccaagttcctatactgttgaca

SEQ ID NO: 71776 - DNA, 25 bp, S. pombe
accaccctgattttatacgttgcaa

SEQ ID NO: 71777 - DNA, 25 bp, S. pombe
acctcagatgccctaaagtcgaaat

SEQ ID NO: 71778 - DNA, 25 bp, S. pombe
accatatgatccgttaagtcgtgaa

SEQ ID NO: 71779 - DNA, 25 bp, S. pombe
accaccaaatgtgttgttgttcctg

SEQ ID NO: 71780 - DNA, 25 bp, S. pombe
accagtaagatcctcacgtcgtgta

SEQ ID NO: 71781 - DNA, 25 bp, S. pombe
agccattcacagatgcttacgttga

SEQ ID NO: 71782 - DNA, 25 bp, S. pombe
accaggcaagattgtcttcttctaa

SEQ ID NO: 71783 - DNA, 25 bp, S. pombe
agccgtaagagtgcttcttctcaga

SEQ ID NO: 71784 - DNA, 25 bp, S. pombe
agcctttcaagctgtagctgcttca

SEQ ID NO: 71785 - DNA, 25 bp, S. pombe
agcctgttgaggttgcttcttgcta

SEQ ID NO: 71786 - DNA, 25 bp, S. pombe
acctatggaatgttgctttcgcgca

SEQ ID NO: 71787 - DNA, 25 bp, S. pombe
accttgctcatttactatcccgaag

SEQ ID NO: 71788 - DNA, 25 bp, S. pombe
agcctgtaggcttcattcagactcg

SEQ ID NO: 71789 - DNA, 25 bp, S. pombe
acccgctaccttgaaagcttctgat

SEQ ID NO: 71790 - DNA, 25 bp, S. pombe
acctgcttacttccgtgaagctttg

SEQ ID NO: 71791 - DNA, 25 bp, S. pombe
accgagatctggcatttcgattgat

SEQ ID NO: 71792 - DNA, 25 bp, S. pombe
agccaggcccgttattttagatcca

SEQ ID NO: 71793 - DNA, 25 bp, S. pombe
agcctgacggcgcattttttggaat

SEQ ID NO: 71794 - DNA, 25 bp, S. pombe
acctcggcctggatttgttaatgat

SEQ ID NO: 71795 - DNA, 25 bp, S. pombe
accctcgtgccaaactacttaatga

SEQ ID NO: 71796 - DNA, 25 bp, S. pombe
accctctggccgaaaagtttgctat

SEQ ID NO: 71797 - DNA, 25 bp, S. pombe
acgcccgattttgccatgtttggga

SEQ ID NO: 71798 - DNA, 25 bp, S. pombe
acctccgatttacccatattattca

SEQ ID NO: 71799 - DNA, 25 bp, S. pombe
acgctccatgcaattaaccttggct

SEQ ID NO: 71800 - DNA, 25 bp, S. pombe
accagtatatccatgcaacttcgca

SEQ ID NO: 71801 - DNA, 25 bp, S. pombe
accaaagtcacttgaagcctgcgat

SEQ ID NO: 71802 - DNA, 25 bp, S. pombe
agcctcgccctatttacgatggtta

SEQ ID NO: 71803 - DNA, 25 bp, S. pombe
agccatgcctccaaattcgtttgat

SEQ ID NO: 71804 - DNA, 25 bp, S. pombe
accacctccatatcctaatgttgaa

SEQ ID NO: 71805 - DNA, 25 bp, S. pombe
accactttcgcatgccattgagagt

SEQ ID NO: 71806 - DNA, 25 bp, S. pombe
accttcgccgatggccttatgaaag

SEQ ID NO: 71807 - DNA, 25 bp, S. pombe
accattctctagatcctttgctaac

SEQ ID NO: 71808 - DNA, 25 bp, S. pombe
accaatcattcacttgcgctttaag

SEQ ID NO: 71809 - DNA, 25 bp, S. pombe
acctcaatttactggttgtcctggg

SEQ ID NO: 71810 - DNA, 25 bp, S. pombe
acctccatatcttctcggttcctgg

SEQ ID NO: 71811 - DNA, 25 bp, S. pombe
accattcacttcaagcggttcacat

SEQ ID NO: 71812 - DNA, 25 bp, S. pombe
accagcatttgtttgggcttggcgc

SEQ ID NO: 71813 - DNA, 25 bp, S. pombe
agccagtctatttcgtctttaccaa

SEQ ID NO: 71814 - DNA, 25 bp, S. pombe
agccttcgttcttgttcagtttaat

SEQ ID NO: 71815 - DNA, 25 bp, S. pombe
agccttcgttgttgactggtttact

SEQ ID NO: 71816 - DNA, 25 bp, S. pombe
accttcgtttggaggcttgagtcat

SEQ ID NO: 71817 - DNA, 25 bp, S. pombe
accttcgctattcgaggtcttggat

SEQ ID NO: 71818 - DNA, 25 bp, S. pombe
agccttggttatcgagttctttctc

SEQ ID NO: 71819 - DNA, 25 bp, S. pombe
agccttttcaaacattcttccatct

SEQ ID NO: 71820 - DNA, 25 bp, S. pombe
agcctttttaagtcttgttcctgat

SEQ ID NO: 71821 - DNA, 25 bp, S. pombe
agcctatttgtgatgtttcctttga

SEQ ID NO: 71822 - DNA, 25 bp, S. pombe
agccacccgtgaatgtttcctatta

SEQ ID NO: 71823 - DNA, 25 bp, S. pombe
acccgtggtgttgctatgtcgattg

SEQ ID NO: 71824 - DNA, 25 bp, S. pombe
accactgactgttatatattcgata

SEQ ID NO: 71825 - DNA, 25 bp, S. pombe
acgaagtatcctttgggagctgccc

SEQ ID NO: 71826 - DNA, 25 bp, S. pombe
accaaatgcgccaaggctcgtggtg

SEQ ID NO: 71827 - DNA, 25 bp, S. pombe
accaaggcagtcaagcactttttga

SEQ ID NO: 71828 - DNA, 25 bp, S. pombe
acctcctggtgcactagttgtttat

SEQ ID NO: 71829 - DNA, 25 bp, S. pombe
accttgcagaggttctcagagtcgc

SEQ ID NO: 71830 - DNA, 25 bp, S. pombe
acctgatgaagttttcgaacctgga

SEQ ID NO: 71831 - DNA, 25 bp, S. pombe
accgatggtttgtaacgatgccgtt

SEQ ID NO: 71832 - DNA, 25 bp, S. pombe
accgctggttcgaattcattccgag

SEQ ID NO: 71833 - DNA, 25 bp, S. pombe
accgagaatggtgtctgtctttcaa

SEQ ID NO: 71834 - DNA, 25 bp, S. pombe
accaagttggtctttgtcatccgta

SEQ ID NO: 71835 - DNA, 25 bp, S. pombe
accacagttggtttcatttcgcttt

SEQ ID NO: 71836 - DNA, 25 bp, S. pombe
accagtggacactgttactaccaga

SEQ ID NO: 71837 - DNA, 25 bp, S. pombe
accacatcaaactcttcgataccag

SEQ ID NO: 71838 - DNA, 25 bp, S. pombe
accgtaataatccttcagttgccgc

SEQ ID NO: 71839 - DNA, 25 bp, S. pombe
acctttatatttcctagcttcctgc

SEQ ID NO: 71840 - DNA, 25 bp, S. pombe
actatttggtggttcgtaacatcga

SEQ ID NO: 71841 - DNA, 25 bp, S. pombe
acctcgtggcgttcctcaaattgaa

SEQ ID NO: 71842 - DNA, 25 bp, S. pombe
acctcttgggcttgcatctaagttg

SEQ ID NO: 71843 - DNA, 25 bp, S. pombe
accctgatttgtacggagggccaat

SEQ ID NO: 71844 - DNA, 25 bp, S. pombe
acccagattcatttttggcacccaa

SEQ ID NO: 71845 - DNA, 25 bp, S. pombe
acagctaactcaacttttacccact

SEQ ID NO: 71846 - DNA, 25 bp, S. pombe
acctaggatcctgtgcttttgctaa

SEQ ID NO: 71847 - DNA, 25 bp, S. pombe
accgggatactttgtcttctgtagt

SEQ ID NO: 71848 - DNA, 25 bp, S. pombe
accatttgtttcgagtgtgcttcca

SEQ ID NO: 71849 - DNA, 25 bp, S. pombe
accttgtttatcgatggactttcta

SEQ ID NO: 71850 - DNA, 25 bp, S. pombe
accattggctagctggattttcaga

SEQ ID NO: 71851 - DNA, 25 bp, S. pombe
accactagcgttcacgattctgaag

SEQ ID NO: 71852 - DNA, 25 bp, S. pombe
acctgacggttctgttgtgttcgac

SEQ ID NO: 71853 - DNA, 25 bp, S. pombe
acccatccgttcgtggtatttggag

SEQ ID NO: 71854 - DNA, 25 bp, S. pombe
accgtcctgtggatgcagtcctgaa

SEQ ID NO: 71855 - DNA, 25 bp, S. pombe
accagagcctccaattcgtagtaga

SEQ ID NO: 71856 - DNA, 25 bp, S. pombe
accagatcaaccatttgcttgcaaa

SEQ ID NO: 71857 - DNA, 25 bp, S. pombe
accaaggtgttgatgcggctgctga

SEQ ID NO: 71858 - DNA, 25 bp, S. pombe
accagatttcgtacatgctaggcta

SEQ ID NO: 71859 - DNA, 25 bp, S. pombe
accaagagacctactagctgtgtta

SEQ ID NO: 71860 - DNA, 25 bp, S. pombe
accacatggtgtttctagcgtttat

SEQ ID NO: 71861 - DNA, 25 bp, S. pombe
caccaagttgggtagcacaaacaca

SEQ ID NO: 71862 - DNA, 25 bp, S. pombe
agccacattgcggaagaagagactt

SEQ ID NO: 71863 - DNA, 25 bp, S. pombe
acctgacggcaacagctttgatctg

SEQ ID NO: 71864 - DNA, 25 bp, S. pombe
acctccgcagcaatctactaatgtt

SEQ ID NO: 71865 - DNA, 25 bp, S. pombe
acctctagcatccagtacatttact

SEQ ID NO: 71866 - DNA, 25 bp, S. pombe
accagctatattcctacattgctag

SEQ ID NO: 71867 - DNA, 25 bp, S. pombe
accatgctcatgacatccttgtatt

SEQ ID NO: 71868 - DNA, 25 bp, S. pombe
accagcttatcatcgtgtacgtatg

SEQ ID NO: 71869 - DNA, 25 bp, S. pombe
accagttataatgggtgcatcgaaa

SEQ ID NO: 71870 - DNA, 25 bp, S. pombe
accactcttactatgtgtgcggaag

SEQ ID NO: 71871 - DNA, 25 bp, S. pombe
acgcgtcttagctatgcttggcaga

SEQ ID NO: 71872 - DNA, 25 bp, S. pombe
accgtctctgactctttgcaaattt

SEQ ID NO: 71873 - DNA, 25 bp, S. pombe
accagtctcatcttttgcgaaacag

SEQ ID NO: 71874 - DNA, 25 bp, S. pombe
aaatcctcccaaatgagacttcgga

SEQ ID NO: 71875 - DNA, 25 bp, S. pombe
aaagcctactcatgtcacttatcgg

SEQ ID NO: 71876 - DNA, 25 bp, S. pombe
accaccttgccatatattttgccag

SEQ ID NO: 71877 - DNA, 25 bp, S. pombe
accggtcctgtttcgttggatcaat

SEQ ID NO: 71878 - DNA, 25 bp, S. pombe
accacctaatgccttcgatgcagat

SEQ ID NO: 71879 - DNA, 25 bp, S. pombe
accacctgccattcattctgatgag

SEQ ID NO: 71880 - DNA, 25 bp, S. pombe
accgcacccgttatcaatagttcaa

SEQ ID NO: 71881 - DNA, 25 bp, S. pombe
accgaggcccttaacattagttgcg

SEQ ID NO: 71882 - DNA, 25 bp, S. pombe
accggtgaccttactactatcgatc

SEQ ID NO: 71883 - DNA, 25 bp, S. pombe
accaccgttgtccatgctgagaagg

SEQ ID NO: 71884 - DNA, 25 bp, S. pombe
accaccgtcgtgttgcggaggacat

SEQ ID NO: 71885 - DNA, 25 bp, S. pombe
acccctgctaattctcgtaatgacg

SEQ ID NO: 71886 - DNA, 25 bp, S. pombe
acctcctcaatacctcgattatgat

SEQ ID NO: 71887 - DNA, 25 bp, S. pombe
accggctaagcattcacgagttgat

SEQ ID NO: 71888 - DNA, 25 bp, S. pombe
accgcctttactgtggtagatgcca

SEQ ID NO: 71889 - DNA, 25 bp, S. pombe
accgtctttacgatgctgttacaaa

SEQ ID NO: 71890 - DNA, 25 bp, S. pombe
acactggtactgagtgggtccccat

SEQ ID NO: 71891 - DNA, 25 bp, S. pombe
accgccatcgtttgggtgctaattt

SEQ ID NO: 71892 - DNA, 25 bp, S. pombe
acccgctcgctttggagatgtgact

SEQ ID NO: 71893 - DNA, 25 bp, S. pombe
accactgtccttggatttggcacaa

SEQ ID NO: 71894 - DNA, 25 bp, S. pombe
acctgagcgccgatgatttcgctaa

SEQ ID NO: 71895 - DNA, 25 bp, S. pombe
acctttgccgtatcttcgttattgg

SEQ ID NO: 71896 - DNA, 25 bp, S. pombe
accatttccgtcgatttgactttag

SEQ ID NO: 71897 - DNA, 25 bp, S. pombe
accatttcaggtcgactctacagta

SEQ ID NO: 71898 - DNA, 25 bp, S. pombe
acgcatcttcgtcaagtttggcgac

SEQ ID NO: 71899 - DNA, 25 bp, S. pombe
accatgttgcttcaaattgtccgag

SEQ ID NO: 71900 - DNA, 25 bp, S. pombe
acctattgctgacaactttccgtta

SEQ ID NO: 71901 - DNA, 25 bp, S. pombe
acctactggtactactggatccgta

SEQ ID NO: 71902 - DNA, 25 bp, S. pombe
acctttggtatctccatgatgctct

SEQ ID NO: 71903 - DNA, 25 bp, S. pombe
accatctttttctaactctgctatt

SEQ ID NO: 71904 - DNA, 25 bp, S. pombe
acctaatctttctacccatcatttt

SEQ ID NO: 71905 - DNA, 25 bp, S. pombe
acgccttcttttgccaacgatattt

SEQ ID NO: 71906 - DNA, 25 bp, S. pombe
acctcttcgggtgctgatcttttaa

SEQ ID NO: 71907 - DNA, 25 bp, S. pombe
acctttgatggtcgtgcaacttcag

SEQ ID NO: 71908 - DNA, 25 bp, S. pombe
accttgaactatacacggctacctt

SEQ ID NO: 71909 - DNA, 25 bp, S. pombe
acctgataaggaacacgtcgaacgt

SEQ ID NO: 71910 - DNA, 25 bp, S. pombe
acctctcgtttagctttggatgctt

SEQ ID NO: 71911 - DNA, 25 bp, S. pombe
acctccgtgattgcctttcaaattg

SEQ ID NO: 71912 - DNA, 25 bp, S. pombe
accattgccttatgtttgttgcctc

SEQ ID NO: 71913 - DNA, 25 bp, S. pombe
accactgcgagtttgtttttcttcg

SEQ ID NO: 71914 - DNA, 25 bp, S. pombe
acctagtgcgtgtttggtcctgtac

SEQ ID NO: 71915 - DNA, 25 bp, S. pombe
acctgctctgtttaccggtcaatat

SEQ ID NO: 71916 - DNA, 25 bp, S. pombe
accagctgatttcgttgtttccatt

SEQ ID NO: 71917 - DNA, 25 bp, S. pombe
accctccttaattttcacgtgtcag

SEQ ID NO: 71918 - DNA, 25 bp, S. pombe
accccagtcaattatgtcttatatg

SEQ ID NO: 71919 - DNA, 25 bp, S. pombe
accgcatccctcaatattctagaag

SEQ ID NO: 71920 - DNA, 25 bp, S. pombe
acgacagtgatgcagttcctggaac

SEQ ID NO: 71921 - DNA, 25 bp, S. pombe
acccaaatcttctcactctattagt

SEQ ID NO: 71922 - DNA, 25 bp, S. pombe
acatgcaggacggaaaacggttcaa

SEQ ID NO: 71923 - DNA, 25 bp, S. pombe
acgaggcaactatacaggagcttca

SEQ ID NO: 71924 - DNA, 25 bp, S. pombe
accaggcttcgcaattactttttag

SEQ ID NO: 71925 - DNA, 25 bp, S. pombe
accatgagctttctttatttcgtag

SEQ ID NO: 71926 - DNA, 25 bp, S. pombe
acctgagtttgctggttatgtcttc

SEQ ID NO: 71927 - DNA, 25 bp, S. pombe
acgcttgcatgggaagaccggtttt

SEQ ID NO: 71928 - DNA, 25 bp, S. pombe
acgctgctcaaatcataccggttat

SEQ ID NO: 71929 - DNA, 25 bp, S. pombe
acctgctctactggtactggtggta

SEQ ID NO: 71930 - DNA, 25 bp, S. pombe
accgataccaacgatgagcctgaca

SEQ ID NO: 71931 - DNA, 25 bp, S. pombe
acctcatgacattacggccgtatgg

SEQ ID NO: 71932 - DNA, 25 bp, S. pombe
acctgatgaagcttcggttgctaaa

SEQ ID NO: 71933 - DNA, 25 bp, S. pombe
acctgaggtgcatcgtttgctcgaa

SEQ ID NO: 71934 - DNA, 25 bp, S. pombe
accgtgttcaacgtttgcgcaagaa

SEQ ID NO: 71935 - DNA, 25 bp, S. pombe
taccgggattacgtttgggatggat

SEQ ID NO: 71936 - DNA, 25 bp, S. pombe
accacctcttgacattgctcgtaaa

SEQ ID NO: 71937 - DNA, 25 bp, S. pombe
accaccagtatcgtagtcctttgaa

SEQ ID NO: 71938 - DNA, 25 bp, S. pombe
accagactgtcatatattccttcca

SEQ ID NO: 71939 - DNA, 25 bp, S. pombe
accattctgtagttgatgtttctta

SEQ ID NO: 71940 - DNA, 25 bp, S. pombe
accattcttcctagtgcagttgctt

SEQ ID NO: 71941 - DNA, 25 bp, S. pombe
accttcttctatctatcttgcttta

SEQ ID NO: 71942 - DNA, 25 bp, S. pombe
acctgatcgtccattacttgctgat

SEQ ID NO: 71943 - DNA, 25 bp, S. pombe
acggacctggctcaacttcgaaagt

SEQ ID NO: 71944 - DNA, 25 bp, S. pombe
acctccctaccatgttatcattgat

SEQ ID NO: 71945 - DNA, 25 bp, S. pombe
accttagcttcttaatggacatcgg

SEQ ID NO: 71946 - DNA, 25 bp, S. pombe
accagctttctgtcgaggatatgca

SEQ ID NO: 71947 - DNA, 25 bp, S. pombe
acctgaattgttgcatcctttcgac

SEQ ID NO: 71948 - DNA, 25 bp, S. pombe
acctaatttcgctttctattccctg

SEQ ID NO: 71949 - DNA, 25 bp, S. pombe
accagaatattccttatggctatca

SEQ ID NO: 71950 - DNA, 25 bp, S. pombe
accggcgattgtgagtggcctcata

SEQ ID NO: 71951 - DNA, 25 bp, S. pombe
accgtctggcttggatgggagtcaa

SEQ ID NO: 71952 - DNA, 25 bp, S. pombe
accctttgagttgtgttcctgttga

SEQ ID NO: 71953 - DNA, 25 bp, S. pombe
acctcttggtagttctcttggtgag

SEQ ID NO: 71954 - DNA, 25 bp, S. pombe
acctgctttgtcattcctgcggaag

SEQ ID NO: 71955 - DNA, 25 bp, S. pombe
acccatgttgtcttttctgaaggca

SEQ ID NO: 71956 - DNA, 25 bp, S. pombe
acctggtgcttcttccaactatgga

SEQ ID NO: 71957 - DNA, 25 bp, S. pombe
acctatcccgttactgaagcatttc

SEQ ID NO: 71958 - DNA, 25 bp, S. pombe
accatctacgctgtatgctcttgaa

SEQ ID NO: 71959 - DNA, 25 bp, S. pombe
accccgggcgtctctcttgatgaga

SEQ ID NO: 71960 - DNA, 25 bp, S. pombe
accggccctagtttctctagatatg

SEQ ID NO: 71961 - DNA, 25 bp, S. pombe
accttgccctcacttgttggaaaga

SEQ ID NO: 71962 - DNA, 25 bp, S. pombe
acctggcatgtctgtagctttcaag

SEQ ID NO: 71963 - DNA, 25 bp, S. pombe
accattcagtcggtagtttccggca

SEQ ID NO: 71964 - DNA, 25 bp, S. pombe
acgcattgcggattctttgggtgac

SEQ ID NO: 71965 - DNA, 25 bp, S. pombe
accattaatggttttgccgtctaat

SEQ ID NO: 71966 - DNA, 25 bp, S. pombe
accttcattggtgccttttctaatt

SEQ ID NO: 71967 - DNA, 25 bp, S. pombe
accattactggtgcttttgtcatta

SEQ ID NO: 71968 - DNA, 25 bp, S. pombe
acctctacgtatgtgctgcattttt

SEQ ID NO: 71969 - DNA, 25 bp, S. pombe
accattgccggtgattatcgtcgat

SEQ ID NO: 71970 - DNA, 25 bp, S. pombe
accattggctttaagtctcctgcta

SEQ ID NO: 71971 - DNA, 25 bp, S. pombe
acccttggcaattgactgtttctta

SEQ ID NO: 71972 - DNA, 25 bp, S. pombe
acctttgcttgatactggttgtaaa

SEQ ID NO: 71973 - DNA, 25 bp, S. pombe
acctcggctgttagcttctttgaat

SEQ ID NO: 71974 - DNA, 25 bp, S. pombe
actcccttcgggttgactgtagact

SEQ ID NO: 71975 - DNA, 25 bp, S. pombe
acgctatttggtcagctggcgaaat

SEQ ID NO: 71976 - DNA, 25 bp, S. pombe
acccaccctcgatgcaaaggtattg

SEQ ID NO: 71977 - DNA, 25 bp, S. pombe
accttctcttgcagtctctgataga

SEQ ID NO: 71978 - DNA, 25 bp, S. pombe
accttcaacaccttattcctatata

SEQ ID NO: 71979 - DNA, 25 bp, S. pombe
actagatgctacacgtttccttaaa

SEQ ID NO: 71980 - DNA, 25 bp, S. pombe
acccctttctcacagagcgtggtaa

SEQ ID NO: 71981 - DNA, 25 bp, S. pombe
accgcagagggcatttctcctgaaa

SEQ ID NO: 71982 - DNA, 25 bp, S. pombe
accgctgccggtgttcttggagata

SEQ ID NO: 71983 - DNA, 25 bp, S. pombe
accgcgtcggttttatatggatgtc

SEQ ID NO: 71984 - DNA, 25 bp, S. pombe
acgcttttcgttgtagtggatgccc

SEQ ID NO: 71985 - DNA, 25 bp, S. pombe
accggtgtcggtgcacatcaaatgt

SEQ ID NO: 71986 - DNA, 25 bp, S. pombe
acctggtgatcgaatggctgcccga

SEQ ID NO: 71987 - DNA, 25 bp, S. pombe
acgtaccgctatcacctagggaaat

SEQ ID NO: 71988 - DNA, 25 bp, S. pombe
acctgaacttagacaaggctctcat

SEQ ID NO: 71989 - DNA, 25 bp, S. pombe
accttcatattatcgagctcttgca

SEQ ID NO: 71990 - DNA, 25 bp, S. pombe
accgtaatgtattcgactggtccat

SEQ ID NO: 71991 - DNA, 25 bp, S. pombe
accgccacttgtatcaactcttaat

SEQ ID NO: 71992 - DNA, 25 bp, S. pombe
acgcacccagttttgctttgtcagt

SEQ ID NO: 71993 - DNA, 25 bp, S. pombe
acctttcaagttcacaccagagtct

SEQ ID NO: 71994 - DNA, 25 bp, S. pombe
acctttcttgtttatctgggagtct

SEQ ID NO: 71995 - DNA, 25 bp, S. pombe
accgttttgtgcattgcccatcgaa

SEQ ID NO: 71996 - DNA, 25 bp, S. pombe
accgcttgggaagtcatgcctgatc

SEQ ID NO: 71997 - DNA, 25 bp, S. pombe
accgttatgtgattgctacctctgc

SEQ ID NO: 71998 - DNA, 25 bp, S. pombe
acctgtgttatgtggacttgctgca

SEQ ID NO: 71999 - DNA, 25 bp, S. pombe
acgcccttcatgttctcaaattctt

SEQ ID NO: 72000 - DNA, 25 bp, S. pombe
acgtttgcggcagagacgattcaat

SEQ ID NO: 72001 - DNA, 25 bp, S. pombe
acctttgctcgtgatgtcgttgaca

SEQ ID NO: 72002 - DNA, 25 bp, S. pombe
accttctccgcagagtctttatgtg

SEQ ID NO: 72003 - DNA, 25 bp, S. pombe
acctgtcccggtgtctttattgata

SEQ ID NO: 72004 - DNA, 25 bp, S. pombe
actattcggcccattggattaaata

SEQ ID NO: 72005 - DNA, 25 bp, S. pombe
accctgggcctcattggtatttata

SEQ ID NO: 72006 - DNA, 25 bp, S. pombe
acgccggtattcatgaggctactta

SEQ ID NO: 72007 - DNA, 25 bp, S. pombe
acgccagcagcgattgatgagagaa

SEQ ID NO: 72008 - DNA, 25 bp, S. pombe
accgcatgccgctttatggacatgg

SEQ ID NO: 72009 - DNA, 25 bp, S. pombe
accttctcccattttgcacgaggat

SEQ ID NO: 72010 - DNA, 25 bp, S. pombe
acactaaactctttgaactcggaat

SEQ ID NO: 72011 - DNA, 25 bp, S. pombe
acgagacagacctgagaaccctctt

SEQ ID NO: 72012 - DNA, 25 bp, S. pombe
acgcaaacgatttccataccatctt

SEQ ID NO: 72013 - DNA, 25 bp, S. pombe
acctgccgaggatacacttttgaaa

SEQ ID NO: 72014 - DNA, 25 bp, S. pombe
acctgctgcttggtatcttcagttt

SEQ ID NO: 72015 - DNA, 25 bp, S. pombe
acctccttgtgcgacattcaattta

SEQ ID NO: 72016 - DNA, 25 bp, S. pombe
acctccttctcaacgtgctaataaa

SEQ ID NO: 72017 - DNA, 25 bp, S. pombe
acgatccgtcgctataacaaatcag

SEQ ID NO: 72018 - DNA, 25 bp, S. pombe
acgctactactcttgccttaataga

SEQ ID NO: 72019 - DNA, 25 bp, S. pombe
acctatctatagtcctgctcttaca

SEQ ID NO: 72020 - DNA, 25 bp, S. pombe
acctccattaacaactcgaatcgtc

SEQ ID NO: 72021 - DNA, 25 bp, S. pombe
acccacctatgctcgttgaagcgga

SEQ ID NO: 72022 - DNA, 25 bp, S. pombe
acccgactacattcgcttcaagaga

SEQ ID NO: 72023 - DNA, 25 bp, S. pombe
acgcatgagggttttgcatcttaca

SEQ ID NO: 72024 - DNA, 25 bp, S. pombe
acgcgagactggtttgccatttaca

SEQ ID NO: 72025 - DNA, 25 bp, S. pombe
actccttatggaagtagtttaatct

SEQ ID NO: 72026 - DNA, 25 bp, S. pombe
acccctttcgcaatttcacttaatg

SEQ ID NO: 72027 - DNA, 25 bp, S. pombe
acccattaattatatcgttcctgag

SEQ ID NO: 72028 - DNA, 25 bp, S. pombe
acctcctggtaatgtcgctaactca

SEQ ID NO: 72029 - DNA, 25 bp, S. pombe
acctcgccagcttcattttttacta

SEQ ID NO: 72030 - DNA, 25 bp, S. pombe
acctggtgcacgtgttttatatctt

SEQ ID NO: 72031 - DNA, 25 bp, S. pombe
accgtgatcacgagttgttggctat

SEQ ID NO: 72032 - DNA, 25 bp, S. pombe
accgtgtcaaggtgattgctgctac

SEQ ID NO: 72033 - DNA, 25 bp, S. pombe
acctgctgtcaaggctactttcgaa

SEQ ID NO: 72034 - DNA, 25 bp, S. pombe
acgctcagtcaaggtatgcttccat

SEQ ID NO: 72035 - DNA, 25 bp, S. pombe
acccctcattgagtcagttttgtga

SEQ ID NO: 72036 - DNA, 25 bp, S. pombe
acccacctgctggtcagattggagt

SEQ ID NO: 72037 - DNA, 25 bp, S. pombe
acccaacgcatgttgcattgtctga

SEQ ID NO: 72038 - DNA, 25 bp, S. pombe
accccatcgccttctttggaagtag

SEQ ID NO: 72039 - DNA, 25 bp, S. pombe
acgcaacatacctactatgggcggt

SEQ ID NO: 72040 - DNA, 25 bp, S. pombe
accgaaactcggttggcagcaatta

SEQ ID NO: 72041 - DNA, 25 bp, S. pombe
acctaacgctcgagcttatgctgat

SEQ ID NO: 72042 - DNA, 25 bp, S. pombe
acgctaagcgttacagctcgtttcg

SEQ ID NO: 72043 - DNA, 25 bp, S. pombe
acgcataaggtttccgcatttctcg

SEQ ID NO: 72044 - DNA, 25 bp, S. pombe
acctcgatttcgatccatttgctta

SEQ ID NO: 72045 - DNA, 25 bp, S. pombe
acctggatttctcatacgtttcata

SEQ ID NO: 72046 - DNA, 25 bp, S. pombe
acccgttcctgatgagcttttgcaa

SEQ ID NO: 72047 - DNA, 25 bp, S. pombe
acctcaagttcgtggtgttgctgaa

SEQ ID NO: 72048 - DNA, 25 bp, S. pombe
acccaacctctttcgctgattggaa

SEQ ID NO: 72049 - DNA, 25 bp, S. pombe
acccaggttttgtcgatgatcttca

SEQ ID NO: 72050 - DNA, 25 bp, S. pombe
acctcgagtttattcagtattccaa

SEQ ID NO: 72051 - DNA, 25 bp, S. pombe
accgcatggcggtatttgatgtctc

SEQ ID NO: 72052 - DNA, 25 bp, S. pombe
acctgctggtggtctttatatctaa

SEQ ID NO: 72053 - DNA, 25 bp, S. pombe
acgacggatgttgaattccattcat

SEQ ID NO: 72054 - DNA, 25 bp, S. pombe
acgaacctgtgtgtgattccgtctt

SEQ ID NO: 72055 - DNA, 25 bp, S. pombe
acgaaccatagtccgttactgaatg

SEQ ID NO: 72056 - DNA, 25 bp, S. pombe
acgggcagctttcggattacacaaa

SEQ ID NO: 72057 - DNA, 25 bp, S. pombe
acgttgctcgcgtggtaactgccag

SEQ ID NO: 72058 - DNA, 25 bp, S. pombe
acggactgaatttgtctaccgaagt

SEQ ID NO: 72059 - DNA, 25 bp, S. pombe
actgaatcgggccaagtgtttcgaa

SEQ ID NO: 72060 - DNA, 25 bp, S. pombe
accgcgtcagttttgggcttatcat

SEQ ID NO: 72061 - DNA, 25 bp, S. pombe
accgtggaatcgtaatcttgtgcat

SEQ ID NO: 72062 - DNA, 25 bp, S. pombe
acctggtgagttttgtgtcggctat

SEQ ID NO: 72063 - DNA, 25 bp, S. pombe
accgtgttcgtcttttgcttcgtgc

SEQ ID NO: 72064 - DNA, 25 bp, S. pombe
aacgtttacctttaagccattgcat

SEQ ID NO: 72065 - DNA, 25 bp, S. pombe
aactttccaccataattcttctgac

SEQ ID NO: 72066 - DNA, 25 bp, S. pombe
aacttcccaaagcaattcaagcgat

SEQ ID NO: 72067 - DNA, 25 bp, S. pombe
accgtcctgctctttgggatcaagg

SEQ ID NO: 72068 - DNA, 25 bp, S. pombe
accgcttctttggactactttagca

SEQ ID NO: 72069 - DNA, 25 bp, S. pombe
acgcgtgactttgttgacttttctc

SEQ ID NO: 72070 - DNA, 25 bp, S. pombe
actcttcgtttacatcaaatccggc

SEQ ID NO: 72071 - DNA, 25 bp, S. pombe
acgcagtactatcatctttacccaa

SEQ ID NO: 72072 - DNA, 25 bp, S. pombe
accgtcctgtgcaatcatgatttca

SEQ ID NO: 72073 - DNA, 25 bp, S. pombe
acctgctactgccttgtttttggat

SEQ ID NO: 72074 - DNA, 25 bp, S. pombe
acctgctatgggtgtttctgaaata

SEQ ID NO: 72075 - DNA, 25 bp, S. pombe
accgcctgtaggagctatctgtgaa

SEQ ID NO: 72076 - DNA, 25 bp, S. pombe
accggatcttcgagcttcttatgaa

SEQ ID NO: 72077 - DNA, 25 bp, S. pombe
accgcggttggcaaaattttcagat

SEQ ID NO: 72078 - DNA, 25 bp, S. pombe
acgggataccgaaacactgtaccag

SEQ ID NO: 72079 - DNA, 25 bp, S. pombe
accggtgtcgcagccatcattaaaa

SEQ ID NO: 72080 - DNA, 25 bp, S. pombe
actgaggagtcctgcgtttcaacac

SEQ ID NO: 72081 - DNA, 25 bp, S. pombe
actgttatgctagaagttcaaccag

SEQ ID NO: 72082 - DNA, 25 bp, S. pombe
accgttgcaagaagccgatcatgtt

SEQ ID NO: 72083 - DNA, 25 bp, S. pombe
acccttcaatgtgtggatcttctcc

SEQ ID NO: 72084 - DNA, 25 bp, S. pombe
acgtcaaagtgctcattcgggccta

SEQ ID NO: 72085 - DNA, 25 bp, S. pombe
acccaggcctggtatagttccattt

SEQ ID NO: 72086 - DNA, 25 bp, S. pombe
accgatggcgatggtgtaatcaact

SEQ ID NO: 72087 - DNA, 25 bp, S. pombe
acctgaggcgagtgctcaacagcat

SEQ ID NO: 72088 - DNA, 25 bp, S. pombe
acctgttgctggtatgcttagccat

SEQ ID NO: 72089 - DNA, 25 bp, S. pombe
accgctatgttgttgctacccaaga

SEQ ID NO: 72090 - DNA, 25 bp, S. pombe
accgttgaaactattctgccctata

SEQ ID NO: 72091 - DNA, 25 bp, S. pombe
accgattagcagatatacccggaat

SEQ ID NO: 72092 - DNA, 25 bp, S. pombe
accgtcttgctcgttactacagaaa

SEQ ID NO: 72093 - DNA, 25 bp, S. pombe
accgtccgctctttagctgaaaagg

SEQ ID NO: 72094 - DNA, 25 bp, S. pombe
accgctgcaccatcggcaaatgtga

SEQ ID NO: 72095 - DNA, 25 bp, S. pombe
actactccgaccagcaatagtcatt

SEQ ID NO: 72096 - DNA, 25 bp, S. pombe
accctccgataatgcatctaatcct

SEQ ID NO: 72097 - DNA, 25 bp, S. pombe
accgcttcttcgactaatgttgcag

SEQ ID NO: 72098 - DNA, 25 bp, S. pombe
acccgttctcgcatcatgtttagat

SEQ ID NO: 72099 - DNA, 25 bp, S. pombe
accgagttctacatcgtgatctgaa

SEQ ID NO: 72100 - DNA, 25 bp, S. pombe
acctggttcgctttcttcttgtaag

SEQ ID NO: 72101 - DNA, 25 bp, S. pombe
accggtatccctacttctgaaagag

SEQ ID NO: 72102 - DNA, 25 bp, S. pombe
accgtacacatttatctaggcacca

SEQ ID NO: 72103 - DNA, 25 bp, S. pombe
accgcaacagctccttcaagtaatg

SEQ ID NO: 72104 - DNA, 25 bp, S. pombe
acgccaatggcgcttcaactgagta

SEQ ID NO: 72105 - DNA, 25 bp, S. pombe
acccctcttgatgtcgtgaaaactc

SEQ ID NO: 72106 - DNA, 25 bp, S. pombe
accgggaacaccttatctcgatatt

SEQ ID NO: 72107 - DNA, 25 bp, S. pombe
caaagtgggaacagtcttcgactat

SEQ ID NO: 72108 - DNA, 25 bp, S. pombe
aagaattcgggcactcagttcgctt

SEQ ID NO: 72109 - DNA, 25 bp, S. pombe
acagttatgggacattcgttccgga

SEQ ID NO: 72110 - DNA, 25 bp, S. pombe
accgacttgttgtgaatgcgcccga

SEQ ID NO: 72111 - DNA, 25 bp, S. pombe
acgagtatggttccgatggtcccga

SEQ ID NO: 72112 - DNA, 25 bp, S. pombe
acccttatatctcgttgggctcaag

SEQ ID NO: 72113 - DNA, 25 bp, S. pombe
acccaatattctctttcgcataatc

SEQ ID NO: 72114 - DNA, 25 bp, S. pombe
accgactgttcgttaccattcaagg

SEQ ID NO: 72115 - DNA, 25 bp, S. pombe
accgtcgcctgtttatctcatataa

SEQ ID NO: 72116 - DNA, 25 bp, S. pombe
accgtggtctctttcattccatgaa

SEQ ID NO: 72117 - DNA, 25 bp, S. pombe
accgttattctagtttccgtatgtg

SEQ ID NO: 72118 - DNA, 25 bp, S. pombe
acccttactcgactttactgtgtga

SEQ ID NO: 72119 - DNA, 25 bp, S. pombe
taggacctattcgttttccacgtcg

SEQ ID NO: 72120 - DNA, 25 bp, S. pombe
aatttattggttgaatcccgccgtg

SEQ ID NO: 72121 - DNA, 25 bp, S. pombe
acgttttggttacctcacatcaggc

SEQ ID NO: 72122 - DNA, 25 bp, S. pombe
acgttactcgtcttatcaactcgga

SEQ ID NO: 72123 - DNA, 25 bp, S. pombe
acgctttgcttgtcttaatttccta

SEQ ID NO: 72124 - DNA, 25 bp, S. pombe
acgcgattgcttgttttatgtttcc

SEQ ID NO: 72125 - DNA, 25 bp, S. pombe
accgctttttctaacgccgatgatt

SEQ ID NO: 72126 - DNA, 25 bp, S. pombe
accgttgaaggtaccagactctgta

SEQ ID NO: 72127 - DNA, 25 bp, S. pombe
acggttatgggcctcaaactctgaa

SEQ ID NO: 72128 - DNA, 25 bp, S. pombe
acccgtcatgtctcgaattctacaa

SEQ ID NO: 72129 - DNA, 25 bp, S. pombe
accccacttcttcgaattcttcaag

SEQ ID NO: 72130 - DNA, 25 bp, S. pombe
acgccgatgtggaaactgtctccga

SEQ ID NO: 72131 - DNA, 25 bp, S. pombe
acgccagctgattttgtcattgctc

SEQ ID NO: 72132 - DNA, 25 bp, S. pombe
acccaatattttccactgacgtgag

SEQ ID NO: 72133 - DNA, 25 bp, S. pombe
accctctacttctacggacgatgaa

SEQ ID NO: 72134 - DNA, 25 bp, S. pombe
accggtcttttctctggattgattt

SEQ ID NO: 72135 - DNA, 25 bp, S. pombe
acgtgtttttcctgcggtttatcat

SEQ ID NO: 72136 - DNA, 25 bp, S. pombe
ttcccctttcggctattattttgca

SEQ ID NO: 72137 - DNA, 25 bp, S. pombe
accgactttgcctgtttgatgttta

SEQ ID NO: 72138 - DNA, 25 bp, S. pombe
accgaccttccttactttgatgtat

SEQ ID NO: 72139 - DNA, 25 bp, S. pombe
acccattgccgactactttttatga

SEQ ID NO: 72140 - DNA, 25 bp, S. pombe
accgtgatgctatgtgttgtccaac

SEQ ID NO: 72141 - DNA, 25 bp, S. pombe
acccagtatttccttgtgtagcttc

SEQ ID NO: 72142 - DNA, 25 bp, S. pombe
acccatgctttttctttgtagtcct

SEQ ID NO: 72143 - DNA, 25 bp, S. pombe
acgcctgcattaatttgtttagttc

SEQ ID NO: 72144 - DNA, 25 bp, S. pombe
acgccctttaatagagtccagttca

SEQ ID NO: 72145 - DNA, 25 bp, S. pombe
accccatttgagtgatcgtccttag

SEQ ID NO: 72146 - DNA, 25 bp, S. pombe
accccattgaatgtttctctcttac

SEQ ID NO: 72147 - DNA, 25 bp, S. pombe
accccgtcattggatatagctcttg

SEQ ID NO: 72148 - DNA, 25 bp, S. pombe
acccctgactctgatactcaaatga

SEQ ID NO: 72149 - DNA, 25 bp, S. pombe
acgctactactacaactacaacaac

SEQ ID NO: 72150 - DNA, 25 bp, S. pombe
acgcatttactgaccagacttgcaa

SEQ ID NO: 72151 - DNA, 25 bp, S. pombe
accgacatccttccaatctaatgat

SEQ ID NO: 72152 - DNA, 25 bp, S. pombe
accgaactttacaactggctgctaa

SEQ ID NO: 72153 - DNA, 25 bp, S. pombe
acgggctaactccttttactgatgt

SEQ ID NO: 72154 - DNA, 25 bp, S. pombe
acgcgcagtttattgttatttcttt

SEQ ID NO: 72155 - DNA, 25 bp, S. pombe
acgcaactagctgttttggtcttta

SEQ ID NO: 72156 - DNA, 25 bp, S. pombe
acggcgtgaaacgatcgggacatca

SEQ ID NO: 72157 - DNA, 25 bp, S. pombe
acgctggctgaatggacgggaaatt

SEQ ID NO: 72158 - DNA, 25 bp, S. pombe
accctttctacattcatctcatata

SEQ ID NO: 72159 - DNA, 25 bp, S. pombe
accctagatcccatgcagctatata

SEQ ID NO: 72160 - DNA, 25 bp, S. pombe
acgacgacgtcgaggccatgaagaa

SEQ ID NO: 72161 - DNA, 25 bp, S. pombe
acccgtggtcgttgcccatggagaa

SEQ ID NO: 72162 - DNA, 25 bp, S. pombe
acccgtttggttcccattatgattg

SEQ ID NO: 72163 - DNA, 25 bp, S. pombe
acccgctttatgttctcatctgtat

SEQ ID NO: 72164 - DNA, 25 bp, S. pombe
acccctgtatatatggctcctgaga

SEQ ID NO: 72165 - DNA, 25 bp, S. pombe
acgccttgtgcgagctatttgtatc

SEQ ID NO: 72166 - DNA, 25 bp, S. pombe
acgctttgggcattgtcactgttat

SEQ ID NO: 72167 - DNA, 25 bp, S. pombe
acgcaggacgtggttttacttatga

SEQ ID NO: 72168 - DNA, 25 bp, S. pombe
acgagaccgacgtgctcttattgaa

SEQ ID NO: 72169 - DNA, 25 bp, S. pombe
accctcggatctttcttgctatgga

SEQ ID NO: 72170 - DNA, 25 bp, S. pombe
accctggtgagccatctttgttgga

SEQ ID NO: 72171 - DNA, 25 bp, S. pombe
accctctcatgggatcacgtttgaa

SEQ ID NO: 72172 - DNA, 25 bp, S. pombe
acgccttcacatggataccttgtat

SEQ ID NO: 72173 - DNA, 25 bp, S. pombe
acgacattcctaccgctgaagatac

SEQ ID NO: 72174 - DNA, 25 bp, S. pombe
acgccttcacgccttaaatcattag

SEQ ID NO: 72175 - DNA, 25 bp, S. pombe
acgcggaagtggtccttacgatgat

SEQ ID NO: 72176 - DNA, 25 bp, S. pombe
acgggaaattgcttccaccagattt

SEQ ID NO: 72177 - DNA, 25 bp, S. pombe
acgtttggtcgatagtcctggtatt

SEQ ID NO: 72178 - DNA, 25 bp, S. pombe
acatcctggatgtcgtacagtcgca

SEQ ID NO: 72179 - DNA, 25 bp, S. pombe
accctttgatcttccagacgttaag

SEQ ID NO: 72180 - DNA, 25 bp, S. pombe
acgactcatgtcgagccaactgaag

SEQ ID NO: 72181 - DNA, 25 bp, S. pombe
acgcctatgcttcgctcaattataa

SEQ ID NO: 72182 - DNA, 25 bp, S. pombe
acgcgtaaaggctacatttgcaaat

SEQ ID NO: 72183 - DNA, 25 bp, S. pombe
accgctaggtatatttcttgttcaa

SEQ ID NO: 72184 - DNA, 25 bp, S. pombe
acccttcgtatttgtctctggtaag

SEQ ID NO: 72185 - DNA, 25 bp, S. pombe
accgcattcgtatctgtcattttct

SEQ ID NO: 72186 - DNA, 25 bp, S. pombe
acgctgctaatgtttccgattctga

SEQ ID NO: 72187 - DNA, 25 bp, S. pombe
acgcggcattgtacaccgtgatata

SEQ ID NO: 72188 - DNA, 25 bp, S. pombe
acgcggctgcatttcaatctgataa

SEQ ID NO: 72189 - DNA, 25 bp, S. pombe
acgatctattcgacctgaggagtta

SEQ ID NO: 72190 - DNA, 25 bp, S. pombe
acgcaaattactgctcatggtgatt

SEQ ID NO: 72191 - DNA, 25 bp, S. pombe
acgcatctgataattccttggctta

SEQ ID NO: 72192 - DNA, 25 bp, S. pombe
accgcagtatcctttgatttgtcta

SEQ ID NO: 72193 - DNA, 25 bp, S. pombe
accccatatcttattgctcgacgaa

SEQ ID NO: 72194 - DNA, 25 bp, S. pombe
acgctttagcttctgttacacttaa

SEQ ID NO: 72195 - DNA, 25 bp, S. pombe
acgcctacaaatcgtgtgctacttc

SEQ ID NO: 72196 - DNA, 25 bp, S. pombe
acgatctaggatctggttccaattg

SEQ ID NO: 72197 - DNA, 25 bp, S. pombe
acgactacgagacctgttttggcat

SEQ ID NO: 72198 - DNA, 25 bp, S. pombe
acgcgtagccagtgccttgtatgaa

SEQ ID NO: 72199 - DNA, 25 bp, S. pombe
acgcggcctctaaggcaggtttaga

SEQ ID NO: 72200 - DNA, 25 bp, S. pombe
tacggttttacgatagactacactc

SEQ ID NO: 72201 - DNA, 25 bp, S. pombe
acgggctgcccgaagaactggatat

SEQ ID NO: 72202 - DNA, 25 bp, S. pombe
acgatggcgctccttaacggtttct

SEQ ID NO: 72203 - DNA, 25 bp, S. pombe
acgaacgtcttccacatcaagttta

SEQ ID NO: 72204 - DNA, 25 bp, S. pombe
acgcaacgtcgtatcactatggatt

SEQ ID NO: 72205 - DNA, 25 bp, S. pombe
acgaaagcgcttatatggaatggga

SEQ ID NO: 72206 - DNA, 25 bp, S. pombe
acccacatggctgtcttgtgcaaga

SEQ ID NO: 72207 - DNA, 25 bp, S. pombe
accctctgtgcttattgttcaacta

SEQ ID NO: 72208 - DNA, 25 bp, S. pombe
acgaatatcctttttctttcagagt

SEQ ID NO: 72209 - DNA, 25 bp, S. pombe
acgcacaacctttatatcgttccgt

SEQ ID NO: 72210 - DNA, 25 bp, S. pombe
acgctcgcgtggtttgacagtacaa

SEQ ID NO: 72211 - DNA, 25 bp, S. pombe
acccaattgcgcttgcggagctaaa

SEQ ID NO: 72212 - DNA, 25 bp, S. pombe
acccgaggtcatacagcgtgctaaa

SEQ ID NO: 72213 - DNA, 25 bp, S. pombe
acccgtggaggtgagatttacagca

SEQ ID NO: 72214 - DNA, 25 bp, S. pombe
acgccgctggcgatacagatttaat

SEQ ID NO: 72215 - DNA, 25 bp, S. pombe
acgcgtgctgccgaacaagactatg

SEQ ID NO: 72216 - DNA, 25 bp, S. pombe
acagttcgtgaatggttacaagacc

SEQ ID NO: 72217 - DNA, 25 bp, S. pombe
acgtactcgaagaaactcgtcgtga

SEQ ID NO: 72218 - DNA, 25 bp, S. pombe
acgctcgttacaaatggtcccagga

SEQ ID NO: 72219 - DNA, 25 bp, S. pombe
acgcgtggtccaaatagacgtggga

SEQ ID NO: 72220 - DNA, 25 bp, S. pombe
acgcgtgcgtcgtctcaaacgtaaa

SEQ ID NO: 72221 - DNA, 25 bp, S. pombe
acgttcagtgtatctacagcctctg

SEQ ID NO: 72222 - DNA, 25 bp, S. pombe
acgtccagatgttgttaagaggcca

SEQ ID NO: 72223 - DNA, 25 bp, S. pombe
acgtaaccttgttcagcagggccaa

SEQ ID NO: 72224 - DNA, 25 bp, S. pombe
acgaagtcggccttacattctgtaa

SEQ ID NO: 72225 - DNA, 25 bp, S. pombe
acaaagtcctccctatcaattggta

SEQ ID NO: 72226 - DNA, 25 bp, S. pombe
acgactcttcagatgatgacaccat

SEQ ID NO: 72227 - DNA, 25 bp, S. pombe
acgcacattgtgaattctgactccc

SEQ ID NO: 72228 - DNA, 25 bp, S. pombe
acgcttagatggtagtactcctgta

SEQ ID NO: 72229 - DNA, 25 bp, S. pombe
acgtctactgaacgtactccgagac

SEQ ID NO: 72230 - DNA, 25 bp, S. pombe
acgaatttgtgggacgcctggagaa

SEQ ID NO: 72231 - DNA, 25 bp, S. pombe
acgcgtattgtctagtggctgtcca

SEQ ID NO: 72232 - DNA, 25 bp, S. pombe
acgccagcgctctactgaaggtgta

SEQ ID NO: 72233 - DNA, 25 bp, S. pombe
accctcttcatctacaaattccaag

SEQ ID NO: 72234 - DNA, 25 bp, S. pombe
acgatgaggtaattcctagcgcagt

SEQ ID NO: 72235 - DNA, 25 bp, S. pombe
acggacctaaggaatgcattgcggg

SEQ ID NO: 72236 - DNA, 25 bp, S. pombe
acccagatttccaggttctttcaga

SEQ ID NO: 72237 - DNA, 25 bp, S. pombe
acgcgagagggcttaacaattcttg

SEQ ID NO: 72238 - DNA, 25 bp, S. pombe
acgctcgagcggttatgacaatgtc

SEQ ID NO: 72239 - DNA, 25 bp, S. pombe
acgcccttcccatgatgatgagtat

SEQ ID NO: 72240 - DNA, 25 bp, S. pombe
acgcgccttcaccacaaagatatat

SEQ ID NO: 72241 - DNA, 25 bp, S. pombe
acgcgtcgttaaacatgcaatcatt

SEQ ID NO: 72242 - DNA, 25 bp, S. pombe
acgccccatatcgagtttcatttga

SEQ ID NO: 72243 - DNA, 25 bp, S. pombe
acgaagcgaccatcacttctggaag

SEQ ID NO: 72244 - DNA, 25 bp, S. pombe
acgcaactacactcacttctaaaaa

SEQ ID NO: 72245 - DNA, 25 bp, S. pombe
acgcttattgaattcccatcttgag

SEQ ID NO: 72246 - DNA, 25 bp, S. pombe
acgatggagctgaacacccttataa

SEQ ID NO: 72247 - DNA, 25 bp, S. pombe
acgttggcgtgaaatccttattgca

SEQ ID NO: 72248 - DNA, 25 bp, S. pombe
acgaccctaactcacttttatacat

SEQ ID NO: 72249 - DNA, 25 bp, S. pombe
acaaacaaaatctctttaccaacat

SEQ ID NO: 72250 - DNA, 25 bp, S. pombe
acgaccgttagttttattcctgcag

SEQ ID NO: 72251 - DNA, 25 bp, S. pombe
acgacttttctatgttcaatccgga

SEQ ID NO: 72252 - DNA, 25 bp, S. pombe
acgactttttagatccagactggtg

SEQ ID NO: 72253 - DNA, 25 bp, S. pombe
acgtctttctcaattatcgtcgaac

SEQ ID NO: 72254 - DNA, 25 bp, S. pombe
acgcaggattccatttttcaacact

SEQ ID NO: 72255 - DNA, 25 bp, S. pombe
acggagatccgctgtttccaacgat

SEQ ID NO: 72256 - DNA, 25 bp, S. pombe
acgcaagaatcctcgtcgtttgtct

SEQ ID NO: 72257 - DNA, 25 bp, S. pombe
acccacggacctcttattagtgaga

SEQ ID NO: 72258 - DNA, 25 bp, S. pombe
acgaaagccactcattctgttcttc

SEQ ID NO: 72259 - DNA, 25 bp, S. pombe
acgaaacagccgaatgccttacatt

SEQ ID NO: 72260 - DNA, 25 bp, S. pombe
acgaacaatccggatgcttctacat

SEQ ID NO: 72261 - DNA, 25 bp, S. pombe
acaggcatcaggtcaagcagtattc

SEQ ID NO: 72262 - DNA, 25 bp, S. pombe
acgctgttctactcacttttttaat

SEQ ID NO: 72263 - DNA, 25 bp, S. pombe
acgttgatgcttctgctatgctcga

SEQ ID NO: 72264 - DNA, 25 bp, S. pombe
acgcccagttcgcactattattgaa

SEQ ID NO: 72265 - DNA, 25 bp, S. pombe
acggccgtgacccagttgatgttaa

SEQ ID NO: 72266 - DNA, 25 bp, S. pombe
acggacgtgttgttttgtggactct

SEQ ID NO: 72267 - DNA, 25 bp, S. pombe
actggaccttgttcgtaagcatttc

SEQ ID NO: 72268 - DNA, 25 bp, S. pombe
actcgtccctagttgataaccttgg

SEQ ID NO: 72269 - DNA, 25 bp, S. pombe
acgtcttccttgttgaaattcttgg

SEQ ID NO: 72270 - DNA, 25 bp, S. pombe
actgttaaatatggttcaattgttg

SEQ ID NO: 72271 - DNA, 25 bp, S. pombe
acgttcgtattccttcaatgttgag

SEQ ID NO: 72272 - DNA, 25 bp, S. pombe
acgcttctttatcttactgcactaa

SEQ ID NO: 72273 - DNA, 25 bp, S. pombe
acgctttagctgctgttgagcttaa

SEQ ID NO: 72274 - DNA, 25 bp, S. pombe
acgagatctctcgagagggcgcgtt

SEQ ID NO: 72275 - DNA, 25 bp, S. pombe
acgaagcttacatggcgttgcccaa

SEQ ID NO: 72276 - DNA, 25 bp, S. pombe
acgacgtcggtacttgattcttcat

SEQ ID NO: 72277 - DNA, 25 bp, S. pombe
acgacgtctccgaagatgattttga

SEQ ID NO: 72278 - DNA, 25 bp, S. pombe
acgccagcagcgatattctatcttt

SEQ ID NO: 72279 - DNA, 25 bp, S. pombe
acgcttcgccgtaattatcttcttt

SEQ ID NO: 72280 - DNA, 25 bp, S. pombe
acgctttgtttacgttttcgctgca

SEQ ID NO: 72281 - DNA, 25 bp, S. pombe
acgttggttccaaggtcatttctga

SEQ ID NO: 72282 - DNA, 25 bp, S. pombe
acgctttgcggaatcggtgtctaca

SEQ ID NO: 72283 - DNA, 25 bp, S. pombe
acggccgtggcatatggtgttgaca

SEQ ID NO: 72284 - DNA, 25 bp, S. pombe
acgcagtttcctttggtactcaact

SEQ ID NO: 72285 - DNA, 25 bp, S. pombe
acgcttttatctttgcttattcggt

SEQ ID NO: 72286 - DNA, 25 bp, S. pombe
acgcaccttattcgacattctttgg

SEQ ID NO: 72287 - DNA, 25 bp, S. pombe
acgcttccttggcaattctctagaa

SEQ ID NO: 72288 - DNA, 25 bp, S. pombe
acgctcttatgatgctgacttttta

SEQ ID NO: 72289 - DNA, 25 bp, S. pombe
acgcgttgttacatcaagcgcttgt

SEQ ID NO: 72290 - DNA, 25 bp, S. pombe
acgatgtcagtagcatgtctcctat

SEQ ID NO: 72291 - DNA, 25 bp, S. pombe
acgctgtcgtaaatggtgctgctca

SEQ ID NO: 72292 - DNA, 25 bp, S. pombe
acgtgcacattggagaattcagctt

SEQ ID NO: 72293 - DNA, 25 bp, S. pombe
acgctgcttctgagtatatctcttt

SEQ ID NO: 72294 - DNA, 25 bp, S. pombe
acgctggtcgtcttattctatcatt

SEQ ID NO: 72295 - DNA, 25 bp, S. pombe
acgctggtcgtatgttttgcaaact

SEQ ID NO: 72296 - DNA, 25 bp, S. pombe
acgctttgctgttttgtgcttgaaa

SEQ ID NO: 72297 - DNA, 25 bp, S. pombe
acgcttttgtacttgcttgtggcta

SEQ ID NO: 72298 - DNA, 25 bp, S. pombe
acgcgcttttgttggtctttgccaa

SEQ ID NO: 72299 - DNA, 25 bp, S. pombe
acggcttccttttgcctataagcat

SEQ ID NO: 72300 - DNA, 25 bp, S. pombe
acgtgcgtgatcttgctgaagctca

SEQ ID NO: 72301 - DNA, 25 bp, S. pombe
acgtcgatgtcagatgaggctttca

SEQ ID NO: 72302 - DNA, 25 bp, S. pombe
acagtattaccctctttcaagtccg

SEQ ID NO: 72303 - DNA, 25 bp, S. pombe
acgttttacatctctttcaagctca

SEQ ID NO: 72304 - DNA, 25 bp, S. pombe
acgtcttttccgactgtcgattaca

SEQ ID NO: 72305 - DNA, 25 bp, S. pombe
acgattttacgtccttctggtatga

SEQ ID NO: 72306 - DNA, 25 bp, S. pombe
acgacatttgatcttcctgttcagc

SEQ ID NO: 72307 - DNA, 25 bp, S. pombe
acgtgagcgtgttgcaaaccttgcc

SEQ ID NO: 72308 - DNA, 25 bp, S. pombe
gacgctttccaacacggtcgatttt

SEQ ID NO: 72309 - DNA, 25 bp, S. pombe
acgttactgaactggaccgcatcat

SEQ ID NO: 72310 - DNA, 25 bp, S. pombe
acgaatatccactgttgcgacttta

SEQ ID NO: 72311 - DNA, 25 bp, S. pombe
acgaattctgcatttgttctagtta

SEQ ID NO: 72312 - DNA, 25 bp, S. pombe
acgacttcgccaatgttccgataag

SEQ ID NO: 72313 - DNA, 25 bp, S. pombe
acgctgttcctctatttgttttaat

SEQ ID NO: 72314 - DNA, 25 bp, S. pombe
acgctgctcaccatatgtactttaa

SEQ ID NO: 72315 - DNA, 25 bp, S. pombe
acgaatacgaattgaggctgctcct

SEQ ID NO: 72316 - DNA, 25 bp, S. pombe
acgtttgaacgtgatggatggctaa

SEQ ID NO: 72317 - DNA, 25 bp, S. pombe
acgatccaccaaagtttagcagcaa

SEQ ID NO: 72318 - DNA, 25 bp, S. pombe
acgagctcagcttttttgaagacga

SEQ ID NO: 72319 - DNA, 25 bp, S. pombe
acgcaatcacgttttggaagccatt

SEQ ID NO: 72320 - DNA, 25 bp, S. pombe
acgcttgctgctaaattggaaactt

SEQ ID NO: 72321 - DNA, 25 bp, S. pombe
acgctgcttgctggaattgtgaaaa

SEQ ID NO: 72322 - DNA, 25 bp, S. pombe
actgccattgaagcccttcgccgtt

SEQ ID NO: 72323 - DNA, 25 bp, S. pombe
acggataaatggcttcgcctgcctt

SEQ ID NO: 72324 - DNA, 25 bp, S. pombe
gatggtcaaaaagcccgttccttgt

SEQ ID NO: 72325 - DNA, 25 bp, S. pombe
cggaacaaatgagcacgggtcgttt

SEQ ID NO: 72326 - DNA, 25 bp, S. pombe
acgtatcctggattcggtatgccct

SEQ ID NO: 72327 - DNA, 25 bp, S. pombe
acgaatacttcttcggcacctaatt

SEQ ID NO: 72328 - DNA, 25 bp, S. pombe
acgtgaatttcgtgctgccgtcatt

SEQ ID NO: 72329 - DNA, 25 bp, S. pombe
acgagagatttttacgccgtctact

SEQ ID NO: 72330 - DNA, 25 bp, S. pombe
acgtgaagtctttagcacccgtggt

SEQ ID NO: 72331 - DNA, 25 bp, S. pombe
acgatcgttcgtgcttatgcggatg

SEQ ID NO: 72332 - DNA, 25 bp, S. pombe
acgatcgcatactttgttactcctg

SEQ ID NO: 72333 - DNA, 25 bp, S. pombe
acgtccataatgcttgtttgcgcga

SEQ ID NO: 72334 - DNA, 25 bp, S. pombe
acgttgcaaaggacgcttccactaa

SEQ ID NO: 72335 - DNA, 25 bp, S. pombe
acgttgaatctgttcgtgatcccga

SEQ ID NO: 72336 - DNA, 25 bp, S. pombe
acgtatgatttgatccgtcaccagg

SEQ ID NO: 72337 - DNA, 25 bp, S. pombe
acagaattgcgatctttttcccgtc

SEQ ID NO: 72338 - DNA, 25 bp, S. pombe
acgagattgtgttccttctttactg

SEQ ID NO: 72339 - DNA, 25 bp, S. pombe
acggttataacacactttgcggtca

SEQ ID NO: 72340 - DNA, 25 bp, S. pombe
acgtctttgcttgacgatgttcgaa

SEQ ID NO: 72341 - DNA, 25 bp, S. pombe
acgtttggcattgtagcattgtcaa

SEQ ID NO: 72342 - DNA, 25 bp, S. pombe
acgacgatggattggctaccgttcc

SEQ ID NO: 72343 - DNA, 25 bp, S. pombe
acgagcggctaatgttgttcttaga

SEQ ID NO: 72344 - DNA, 25 bp, S. pombe
acggcactgcatcaaatttacctat

SEQ ID NO: 72345 - DNA, 25 bp, S. pombe
acggagctgctctttataaaactgg

SEQ ID NO: 72346 - DNA, 25 bp, S. pombe
acgtccagtattccagggtgctaat

SEQ ID NO: 72347 - DNA, 25 bp, S. pombe
acgaccgtcatccaaacgtgtattg

SEQ ID NO: 72348 - DNA, 25 bp, S. pombe
acggccctatgctgttatcgatttg

SEQ ID NO: 72349 - DNA, 25 bp, S. pombe
acgattctgcatcccttaagtttag

SEQ ID NO: 72350 - DNA, 25 bp, S. pombe
acgatggttgtctcaacttcgttga

SEQ ID NO: 72351 - DNA, 25 bp, S. pombe
acgtatcttgtttgctgagagccct

SEQ ID NO: 72352 - DNA, 25 bp, S. pombe
acgatgctttttactgaaccacttt

SEQ ID NO: 72353 - DNA, 25 bp, S. pombe
acgacggttatgctcgattttgtca

SEQ ID NO: 72354 - DNA, 25 bp, S. pombe
acgaccggcttgatgcagctatcaa

SEQ ID NO: 72355 - DNA, 25 bp, S. pombe
acgagaccatgtgccatatcttcaa

SEQ ID NO: 72356 - DNA, 25 bp, S. pombe
acgaggcactgctgtacacttatat

SEQ ID NO: 72357 - DNA, 25 bp, S. pombe
acggacatatcacgtaccatgggat

SEQ ID NO: 72358 - DNA, 25 bp, S. pombe
actaagtattaccagcccggatata

SEQ ID NO: 72359 - DNA, 25 bp, S. pombe
aaattgtcaaaccactgccgagtat

SEQ ID NO: 72360 - DNA, 25 bp, S. pombe
acgattgtcaagtccaagcccatta

SEQ ID NO: 72361 - DNA, 25 bp, S. pombe
acgagtgacagttccaacgatcttg

SEQ ID NO: 72362 - DNA, 25 bp, S. pombe
actgtatgccagttgctgcggttat

SEQ ID NO: 72363 - DNA, 25 bp, S. pombe
acgtatgggctactcggtcaacaac

SEQ ID NO: 72364 - DNA, 25 bp, S. pombe
acgtactatgctctctcgaatggat

SEQ ID NO: 72365 - DNA, 25 bp, S. pombe
acgtgagtatgctttcctttttagg

SEQ ID NO: 72366 - DNA, 25 bp, S. pombe
acgatattatcgttgccggttctaa

SEQ ID NO: 72367 - DNA, 25 bp, S. pombe
acgtcaagtctgttggcgatttctt

SEQ ID NO: 72368 - DNA, 25 bp, S. pombe
acgaggtgacgctgttagtttctga

SEQ ID NO: 72369 - DNA, 25 bp, S. pombe
acgggtgaccggtgtgattatagca

SEQ ID NO: 72370 - DNA, 25 bp, S. pombe
acgtgttgctgcttggtgggctaaa

SEQ ID NO: 72371 - DNA, 25 bp, S. pombe
acgtcttatcttcgctggaaagcaa

SEQ ID NO: 72372 - DNA, 25 bp, S. pombe
acgtcgctctggctcaatggaaata

SEQ ID NO: 72373 - DNA, 25 bp, S. pombe
acagctctggtttcaaggccgttaa

SEQ ID NO: 72374 - DNA, 25 bp, S. pombe
acgcaagatgttttcgtgtctgaca

SEQ ID NO: 72375 - DNA, 25 bp, S. pombe
acgagtggttttgctgatggtcatc

SEQ ID NO: 72376 - DNA, 25 bp, S. pombe
acgagcttgctatttatcttcctga

SEQ ID NO: 72377 - DNA, 25 bp, S. pombe
acgagtacccacatgttgagcagtt

SEQ ID NO: 72378 - DNA, 25 bp, S. pombe
acgggagccgatatgtatgcacttt

SEQ ID NO: 72379 - DNA, 25 bp, S. pombe
acgggacttgttggttggcttgcaa

SEQ ID NO: 72380 - DNA, 25 bp, S. pombe
acgttcatcgggacattcttctagg

SEQ ID NO: 72381 - DNA, 25 bp, S. pombe
acgcacttgctgtcgactatttgaa

SEQ ID NO: 72382 - DNA, 25 bp, S. pombe
acgttgtcgcaactgctatcaggaa

SEQ ID NO: 72383 - DNA, 25 bp, S. pombe
acgtatttgcatttccacaggtcat

SEQ ID NO: 72384 - DNA, 25 bp, S. pombe
acggcgtcaacggaatgctgatatc

SEQ ID NO: 72385 - DNA, 25 bp, S. pombe
acgggaaatcccctctatgatattt

SEQ ID NO: 72386 - DNA, 25 bp, S. pombe
acgactacgttgacttctggatcta

SEQ ID NO: 72387 - DNA, 25 bp, S. pombe
acgtctccggtaatttggtcgcatt

SEQ ID NO: 72388 - DNA, 25 bp, S. pombe
acgttcgagttgatcgaccttttcg

SEQ ID NO: 72389 - DNA, 25 bp, S. pombe
caggtcgcggtctaagtggtacttc

SEQ ID NO: 72390 - DNA, 25 bp, S. pombe
gaagctgggaactcaaccgaacgtt

SEQ ID NO: 72391 - DNA, 25 bp, S. pombe
acgtgctcgcatatggtcaattgac

SEQ ID NO: 72392 - DNA, 25 bp, S. pombe
acgtgatcctttcgttctcaaatac

SEQ ID NO: 72393 - DNA, 25 bp, S. pombe
acgggagagcagtcctcctctaatt

SEQ ID NO: 72394 - DNA, 25 bp, S. pombe
acagtaaagcgtgttcctccttatt

SEQ ID NO: 72395 - DNA, 25 bp, S. pombe
acgagtggattaacctcctcttctt

SEQ ID NO: 72396 - DNA, 25 bp, S. pombe
acggaggctaattctcgtcttgctt

SEQ ID NO: 72397 - DNA, 25 bp, S. pombe
acgggaagttgatcgctgttttgct

SEQ ID NO: 72398 - DNA, 25 bp, S. pombe
actcgccgtcgtatagccgatttaa

SEQ ID NO: 72399 - DNA, 25 bp, S. pombe
actattaccgtttggctggatttca

SEQ ID NO: 72400 - DNA, 25 bp, S. pombe
acgattcaccgctcactattgatta

SEQ ID NO: 72401 - DNA, 25 bp, S. pombe
acgtatcgccgcttacatttataga

SEQ ID NO: 72402 - DNA, 25 bp, S. pombe
acgtacacttctcgctattttgcga

SEQ ID NO: 72403 - DNA, 25 bp, S. pombe
acgttgctgagctcttgtgtcgaaa

SEQ ID NO: 72404 - DNA, 25 bp, S. pombe
acgttgctagcgctgttgttgacct

SEQ ID NO: 72405 - DNA, 25 bp, S. pombe
acggtgttgctgctttttgggccaa

SEQ ID NO: 72406 - DNA, 25 bp, S. pombe
acgaggtcctgcctttttgaacaga

SEQ ID NO: 72407 - DNA, 25 bp, S. pombe
acgacgtctcgcacttttaatcata

SEQ ID NO: 72408 - DNA, 25 bp, S. pombe
acgatcgatcccctattaacaatga

SEQ ID NO: 72409 - DNA, 25 bp, S. pombe
acgtcgttccgtatgtctcaatatg

SEQ ID NO: 72410 - DNA, 25 bp, S. pombe
acgttggatggcgtttgttcatcaa

SEQ ID NO: 72411 - DNA, 25 bp, S. pombe
acgtcaaggccgctggaatccaatt

SEQ ID NO: 72412 - DNA, 25 bp, S. pombe
acgatcattagttcattccctcata

SEQ ID NO: 72413 - DNA, 25 bp, S. pombe
acgagctctttacatgctaatccca

SEQ ID NO: 72414 - DNA, 25 bp, S. pombe
acgacttgatatacctgtcatctcc

SEQ ID NO: 72415 - DNA, 25 bp, S. pombe
acgttaattcatcgtttgctccttc

SEQ ID NO: 72416 - DNA, 25 bp, S. pombe
acgacatacccatttttccatgtgg

SEQ ID NO: 72417 - DNA, 25 bp, S. pombe
acgacaacctgtttcatttatggga

SEQ ID NO: 72418 - DNA, 25 bp, S. pombe
acggaaccttcacttttgtagagag

SEQ ID NO: 72419 - DNA, 25 bp, S. pombe
actggaccgataccctttgtattgg

SEQ ID NO: 72420 - DNA, 25 bp, S. pombe
actggaacgcttcgaatccttcaag

SEQ ID NO: 72421 - DNA, 25 bp, S. pombe
acgtggtttcagagagcatggtcaa

SEQ ID NO: 72422 - DNA, 25 bp, S. pombe
acgaggctttagctagcgagcgcaa

SEQ ID NO: 72423 - DNA, 25 bp, S. pombe
acgaggctttagctgctggttgcaa

SEQ ID NO: 72424 - DNA, 25 bp, S. pombe
acggatcagatcctcttaccaagat

SEQ ID NO: 72425 - DNA, 25 bp, S. pombe
acgaccaacagcgttaatccatata

SEQ ID NO: 72426 - DNA, 25 bp, S. pombe
acgagccaccggtaagaacattcat

SEQ ID NO: 72427 - DNA, 25 bp, S. pombe
actccaccactgtcatgtacaatga

SEQ ID NO: 72428 - DNA, 25 bp, S. pombe
actccattcctcgacaatcaagtga

SEQ ID NO: 72429 - DNA, 25 bp, S. pombe
actcgtcttattgaacagggccatg

SEQ ID NO: 72430 - DNA, 25 bp, S. pombe
actgcagctttatcaaccggtgcga

SEQ ID NO: 72431 - DNA, 25 bp, S. pombe
acgaggagtccttgagtggattcaa

SEQ ID NO: 72432 - DNA, 25 bp, S. pombe
acgagtggcggctgcctgtgaaaat

SEQ ID NO: 72433 - DNA, 25 bp, S. pombe
acggctgaagccacttatgcatgtg

SEQ ID NO: 72434 - DNA, 25 bp, S. pombe
acggtgctaccattatctacagaca

SEQ ID NO: 72435 - DNA, 25 bp, S. pombe
acggtctgatcctttcattagtgaa

SEQ ID NO: 72436 - DNA, 25 bp, S. pombe
acggtcgtcgtgttttacgagatcg

SEQ ID NO: 72437 - DNA, 25 bp, S. pombe
acacgtcccgtctttggataaactg

SEQ ID NO: 72438 - DNA, 25 bp, S. pombe
acgagtcgccatgctttggtaaaca

SEQ ID NO: 72439 - DNA, 25 bp, S. pombe
acgagttgccaactgcattgactaa

SEQ ID NO: 72440 - DNA, 25 bp, S. pombe
acaggccctggtgattttcgtggat

SEQ ID NO: 72441 - DNA, 25 bp, S. pombe
acgatacgcttcattcattccttgg

SEQ ID NO: 72442 - DNA, 25 bp, S. pombe
acgatgtactcttgtctattcctgt

SEQ ID NO: 72443 - DNA, 25 bp, S. pombe
acgagtactgtcttctttgctggat

SEQ ID NO: 72444 - DNA, 25 bp, S. pombe
acggccacattattcttggagcgaa

SEQ ID NO: 72445 - DNA, 25 bp, S. pombe
actgacaacatcttcaaacagcttg

SEQ ID NO: 72446 - DNA, 25 bp, S. pombe
acgatcttttcttagatgctcgccg

SEQ ID NO: 72447 - DNA, 25 bp, S. pombe
acgtattagcgttgattccccagat

SEQ ID NO: 72448 - DNA, 25 bp, S. pombe
acgattgtacgctttgacccggtat

SEQ ID NO: 72449 - DNA, 25 bp, S. pombe
acgatctattagtgaagtccaacaa

SEQ ID NO: 72450 - DNA, 25 bp, S. pombe
acgagttttatacagcatccgaaga

SEQ ID NO: 72451 - DNA, 25 bp, S. pombe
acggtcttaccatttcatcgcaaat

SEQ ID NO: 72452 - DNA, 25 bp, S. pombe
acgagttgctatcagttgttcccag

SEQ ID NO: 72453 - DNA, 25 bp, S. pombe
acgagtacatatctggtgttccact

SEQ ID NO: 72454 - DNA, 25 bp, S. pombe
acgagaaactctacaattggccatt

SEQ ID NO: 72455 - DNA, 25 bp, S. pombe
acgtacttctgtttatggtgccttt

SEQ ID NO: 72456 - DNA, 25 bp, S. pombe
acggccgtctgagtcaatggtttta

SEQ ID NO: 72457 - DNA, 25 bp, S. pombe
actggtgttacatcaaattcctcaa

SEQ ID NO: 72458 - DNA, 25 bp, S. pombe
actttttcgaaatcctcccatgaga

SEQ ID NO: 72459 - DNA, 25 bp, S. pombe
acgttcttcgatttacctctacgag

SEQ ID NO: 72460 - DNA, 25 bp, S. pombe
acgatagtccgtgtttgcctgagag

SEQ ID NO: 72461 - DNA, 25 bp, S. pombe
acgtagatcgtgacactggctctgc

SEQ ID NO: 72462 - DNA, 25 bp, S. pombe
actgccgaacagattctcaagcgta

SEQ ID NO: 72463 - DNA, 25 bp, S. pombe
acgtggtttcttcttaggaggtgca

SEQ ID NO: 72464 - DNA, 25 bp, S. pombe
acttcggattttctttatcggatgc

SEQ ID NO: 72465 - DNA, 25 bp, S. pombe
acgagggttcttcatgctgttccaa

SEQ ID NO: 72466 - DNA, 25 bp, S. pombe
acacacctcgcatctaacaatttaa

SEQ ID NO: 72467 - DNA, 25 bp, S. pombe
acagcacactcctcaagaagtcttg

SEQ ID NO: 72468 - DNA, 25 bp, S. pombe
actccgcaggaactattacatcttg

SEQ ID NO: 72469 - DNA, 25 bp, S. pombe
acgttacatttcctacacatcatac

SEQ ID NO: 72470 - DNA, 25 bp, S. pombe
acgttgactttcatccacatcagga

SEQ ID NO: 72471 - DNA, 25 bp, S. pombe
acggcaactcacttacgttagaaga

SEQ ID NO: 72472 - DNA, 25 bp, S. pombe
acgtggcaccaactccggtagaaga

SEQ ID NO: 72473 - DNA, 25 bp, S. pombe
acgtgcgtcgtacatctcaagatga

SEQ ID NO: 72474 - DNA, 25 bp, S. pombe
acgtctgccagtgattctccaataa

SEQ ID NO: 72475 - DNA, 25 bp, S. pombe
acgtcgatctgtgttcactgctata

SEQ ID NO: 72476 - DNA, 25 bp, S. pombe
acgtcggctgctgtaccaggaggaa

SEQ ID NO: 72477 - DNA, 25 bp, S. pombe
acgttcacatggctttcagtcgaga

SEQ ID NO: 72478 - DNA, 25 bp, S. pombe
actcgtcaagttaccattgtcccaa

SEQ ID NO: 72479 - DNA, 25 bp, S. pombe
acggacttcctcactatgttatttg

SEQ ID NO: 72480 - DNA, 25 bp, S. pombe
acgttttctcttctctgttcttata

SEQ ID NO: 72481 - DNA, 25 bp, S. pombe
acgtctacttttgtctttgcttcaa

SEQ ID NO: 72482 - DNA, 25 bp, S. pombe
acgtccattcggtgtttcattctta

SEQ ID NO: 72483 - DNA, 25 bp, S. pombe
acgtcgaccctgtttatcaattctt

SEQ ID NO: 72484 - DNA, 25 bp, S. pombe
actggtgataatcgtagtaaatctg

SEQ ID NO: 72485 - DNA, 25 bp, S. pombe
actcgaggacggacgtactttgtct

SEQ ID NO: 72486 - DNA, 25 bp, S. pombe
actcgcagggcgctcaaatttctga

SEQ ID NO: 72487 - DNA, 25 bp, S. pombe
actggccttgccgtagttaatactg

SEQ ID NO: 72488 - DNA, 25 bp, S. pombe
acggtcttcacgctgtttacaacga

SEQ ID NO: 72489 - DNA, 25 bp, S. pombe
acggttcccgtatgatgtttggcgc

SEQ ID NO: 72490 - DNA, 25 bp, S. pombe
acagagttccgccaatcgtgaattg

SEQ ID NO: 72491 - DNA, 25 bp, S. pombe
acggctatcagcgagaatcctataa

SEQ ID NO: 72492 - DNA, 25 bp, S. pombe
actggttcagccgaggttgatccaa

SEQ ID NO: 72493 - DNA, 25 bp, S. pombe
acgtttggcccggatattgctgaag

SEQ ID NO: 72494 - DNA, 25 bp, S. pombe
acgtggatcatcgaactgtttttgc

SEQ ID NO: 72495 - DNA, 25 bp, S. pombe
acgtggtactgctcatggtgtttca

SEQ ID NO: 72496 - DNA, 25 bp, S. pombe
actgtttcactgttgcatggagatg

SEQ ID NO: 72497 - DNA, 25 bp, S. pombe
acgatattcatgttggtggcggatc

SEQ ID NO: 72498 - DNA, 25 bp, S. pombe
acgtacacttgtagctgcgggattc

SEQ ID NO: 72499 - DNA, 25 bp, S. pombe
acgtagcgcatgtacccttaatgta

SEQ ID NO: 72500 - DNA, 25 bp, S. pombe
acggagccttgtgccatgtgttctg

SEQ ID NO: 72501 - DNA, 25 bp, S. pombe
acgggtgcattgttctacttgtcat

SEQ ID NO: 72502 - DNA, 25 bp, S. pombe
acggattcttctgctgttgattcac

SEQ ID NO: 72503 - DNA, 25 bp, S. pombe
actggtaaatcccttatgttcctcg

SEQ ID NO: 72504 - DNA, 25 bp, S. pombe
acgttactaccatttatttcgcaag

SEQ ID NO: 72505 - DNA, 25 bp, S. pombe
actgttcctaagctttctattgccg

SEQ ID NO: 72506 - DNA, 25 bp, S. pombe
acgttctattgagggcgttgcccaa

SEQ ID NO: 72507 - DNA, 25 bp, S. pombe
acggattatcgtttggttctccaca

SEQ ID NO: 72508 - DNA, 25 bp, S. pombe
acgttatccgtgatgcagttaccta

SEQ ID NO: 72509 - DNA, 25 bp, S. pombe
acgatagtcgttctctgtcttccta

SEQ ID NO: 72510 - DNA, 25 bp, S. pombe
acttacttttcttttctggcaagcg

SEQ ID NO: 72511 - DNA, 25 bp, S. pombe
acttaccccatttgttcgagatcga

SEQ ID NO: 72512 - DNA, 25 bp, S. pombe
aatgttccagggtgttttgcttcct

SEQ ID NO: 72513 - DNA, 25 bp, S. pombe
actgtaccagagtcaacttcggata

SEQ ID NO: 72514 - DNA, 25 bp, S. pombe
acgtgttttcaatctactggtaatt

SEQ ID NO: 72515 - DNA, 25 bp, S. pombe
acgtgttttgccctctattgttaat

SEQ ID NO: 72516 - DNA, 25 bp, S. pombe
actgttttcgcccatgttagtcaaa

SEQ ID NO: 72517 - DNA, 25 bp, S. pombe
cactgttttagaaatattcgtcgag

SEQ ID NO: 72518 - DNA, 25 bp, S. pombe
acggatggtcttgttccagctgtaa

SEQ ID NO: 72519 - DNA, 25 bp, S. pombe
acgttacttatgatgtctcctctaa

SEQ ID NO: 72520 - DNA, 25 bp, S. pombe
acgtattcaaagatggtccagctca

SEQ ID NO: 72521 - DNA, 25 bp, S. pombe
acgtttcacagacgcggtgctacat

SEQ ID NO: 72522 - DNA, 25 bp, S. pombe
acgtttatagacctttgtgactgtt

SEQ ID NO: 72523 - DNA, 25 bp, S. pombe
acgttcttagccatactgttgtatt

SEQ ID NO: 72524 - DNA, 25 bp, S. pombe
acggtcgtacagatacctcttgttc

SEQ ID NO: 72525 - DNA, 25 bp, S. pombe
actgggcttcgaatagactcattga

SEQ ID NO: 72526 - DNA, 25 bp, S. pombe
actagtgtcatccagagctccagat

SEQ ID NO: 72527 - DNA, 25 bp, S. pombe
acgtgcagtatcaaagcctagtaga

SEQ ID NO: 72528 - DNA, 25 bp, S. pombe
acggttatgtgatgccacttggtca

SEQ ID NO: 72529 - DNA, 25 bp, S. pombe
acgtttatcgtggttctgtgctagc

SEQ ID NO: 72530 - DNA, 25 bp, S. pombe
acgttttctgattttgctgctgcta

SEQ ID NO: 72531 - DNA, 25 bp, S. pombe
actgttttggttctcgcattttgga

SEQ ID NO: 72532 - DNA, 25 bp, S. pombe
acgtattcagttttgtcttgccctt

SEQ ID NO: 72533 - DNA, 25 bp, S. pombe
acttagtcatttgtggttcctctgc

SEQ ID NO: 72534 - DNA, 25 bp, S. pombe
acgtatgttgatgccagcggtactt

SEQ ID NO: 72535 - DNA, 25 bp, S. pombe
tgacgggtcgtctcaaagtaccttt

SEQ ID NO: 72536 - DNA, 25 bp, S. pombe
actggtgagctaaccttgaccggta

SEQ ID NO: 72537 - DNA, 25 bp, S. pombe
actttgatcaacgagcttaacggta

SEQ ID NO: 72538 - DNA, 25 bp, S. pombe
actggatcctccgaaactgtcaaga

SEQ ID NO: 72539 - DNA, 25 bp, S. pombe
acggcttctctgctgaacattggta

SEQ ID NO: 72540 - DNA, 25 bp, S. pombe
acgtcctgccgtcgatagttttgag

SEQ ID NO: 72541 - DNA, 25 bp, S. pombe
actggttcaaaaatagcatcctctt

SEQ ID NO: 72542 - DNA, 25 bp, S. pombe
tcaccgtaacggtattaagcgtcct

SEQ ID NO: 72543 - DNA, 25 bp, S. pombe
acggctatccaacgttacatctacg

SEQ ID NO: 72544 - DNA, 25 bp, S. pombe
acggctctcgaatgttcaccaaatg

SEQ ID NO: 72545 - DNA, 25 bp, S. pombe
acgtcccgatgatgtgctagctaca

SEQ ID NO: 72546 - DNA, 25 bp, S. pombe
actggagacggctctgctgtaggac

SEQ ID NO: 72547 - DNA, 25 bp, S. pombe
acgtctgggctttcttattagctca

SEQ ID NO: 72548 - DNA, 25 bp, S. pombe
actttgcccaaaggtgatcccgatg

SEQ ID NO: 72549 - DNA, 25 bp, S. pombe
actcttgtacaaaagcttcccgaag

SEQ ID NO: 72550 - DNA, 25 bp, S. pombe
actcaattacgtgactacactcggg

SEQ ID NO: 72551 - DNA, 25 bp, S. pombe
acggcagcaataagtcctcatatat

SEQ ID NO: 72552 - DNA, 25 bp, S. pombe
acgtgttatggacttgcgtgtccct

SEQ ID NO: 72553 - DNA, 25 bp, S. pombe
acggtcattttattgctggtcgccc

SEQ ID NO: 72554 - DNA, 25 bp, S. pombe
actgggtttctacaactcgtgatct

SEQ ID NO: 72555 - DNA, 25 bp, S. pombe
acggaacatcttgactgaggaactt

SEQ ID NO: 72556 - DNA, 25 bp, S. pombe
acggtccaatgcaatgccattcagc

SEQ ID NO: 72557 - DNA, 25 bp, S. pombe
actggaccatcaatatgccgggcaa

SEQ ID NO: 72558 - DNA, 25 bp, S. pombe
acggaagcgatatcagcgacacagt

SEQ ID NO: 72559 - DNA, 25 bp, S. pombe
acgggttcgtgatgtatttggtgtc

SEQ ID NO: 72560 - DNA, 25 bp, S. pombe
acggtattcgtcacttgatctggga

SEQ ID NO: 72561 - DNA, 25 bp, S. pombe
acggtattccacatggcgtctgtaa

SEQ ID NO: 72562 - DNA, 25 bp, S. pombe
acgtgttccgcttttttgcattaca

SEQ ID NO: 72563 - DNA, 25 bp, S. pombe
acggttctgactttccttctatgaa

SEQ ID NO: 72564 - DNA, 25 bp, S. pombe
acggcattgctgttactactacttt

SEQ ID NO: 72565 - DNA, 25 bp, S. pombe
actggattctttgcatacccattcc

SEQ ID NO: 72566 - DNA, 25 bp, S. pombe
acagtcgactttgctacctatcgta

SEQ ID NO: 72567 - DNA, 25 bp, S. pombe
actgccgactttactacttttgtgc

SEQ ID NO: 72568 - DNA, 25 bp, S. pombe
acggacgtgcaaaggagacaccgga

SEQ ID NO: 72569 - DNA, 25 bp, S. pombe
actgtcacagacgtttgggtgtttg

SEQ ID NO: 72570 - DNA, 25 bp, S. pombe
acatctacggcgaaaacggctttgc

SEQ ID NO: 72571 - DNA, 25 bp, S. pombe
actccacctagcaggactggtgttg

SEQ ID NO: 72572 - DNA, 25 bp, S. pombe
actccccagagatggctgacgattt

SEQ ID NO: 72573 - DNA, 25 bp, S. pombe
acgtgtgtttttacctgacgagcaa

SEQ ID NO: 72574 - DNA, 25 bp, S. pombe
acgtctgtttgtacaacgggtgcaa

SEQ ID NO: 72575 - DNA, 25 bp, S. pombe
actgttgcttgtcttaccggtaatc

SEQ ID NO: 72576 - DNA, 25 bp, S. pombe
acatgaggttagtctcgtcctggtt

SEQ ID NO: 72577 - DNA, 25 bp, S. pombe
actgatggttatctttgccgtgtct

SEQ ID NO: 72578 - DNA, 25 bp, S. pombe
actagcggtagtgttgacggttcct

SEQ ID NO: 72579 - DNA, 25 bp, S. pombe
acggccatgtgtttgttgactcttt

SEQ ID NO: 72580 - DNA, 25 bp, S. pombe
acggctagtgcattgttgtacatca

SEQ ID NO: 72581 - DNA, 25 bp, S. pombe
acggatgatgtagcctctttcgaat

SEQ ID NO: 72582 - DNA, 25 bp, S. pombe
acgtgatgatgtttcttctgcttct

SEQ ID NO: 72583 - DNA, 25 bp, S. pombe
acggcattgtcgaccatccgaaatt

SEQ ID NO: 72584 - DNA, 25 bp, S. pombe
catggcgcagtgttgagctttggaa

SEQ ID NO: 72585 - DNA, 25 bp, S. pombe
actgaatcgtgcaccaaggtcgcta

SEQ ID NO: 72586 - DNA, 25 bp, S. pombe
actattactcggtcaggtatcgcca

SEQ ID NO: 72587 - DNA, 25 bp, S. pombe
actgcatagatttggtgacgggctc

SEQ ID NO: 72588 - DNA, 25 bp, S. pombe
actaagaagtgtcgagggcagcctc

SEQ ID NO: 72589 - DNA, 25 bp, S. pombe
cagctctctgctgcgaacaaatcat

SEQ ID NO: 72590 - DNA, 25 bp, S. pombe
acttcgcttcgagcataccaaaggt

SEQ ID NO: 72591 - DNA, 25 bp, S. pombe
actgcccaactagaagcccaaattt

SEQ ID NO: 72592 - DNA, 25 bp, S. pombe
actggatatttcaactggcctacga

SEQ ID NO: 72593 - DNA, 25 bp, S. pombe
acggattattatattcctccatatg

SEQ ID NO: 72594 - DNA, 25 bp, S. pombe
acggcttttattctctttgcattgg

SEQ ID NO: 72595 - DNA, 25 bp, S. pombe
acgtgatgcgtttcttatgtcgaga

SEQ ID NO: 72596 - DNA, 25 bp, S. pombe
acaggaaactggctttgcaatgcta

SEQ ID NO: 72597 - DNA, 25 bp, S. pombe
acggcaaacatgtcgtctttggcga

SEQ ID NO: 72598 - DNA, 25 bp, S. pombe
acgtgttcaacgtacatatcgccga

SEQ ID NO: 72599 - DNA, 25 bp, S. pombe
acgtgctctcaagggacttgcctaa

SEQ ID NO: 72600 - DNA, 25 bp, S. pombe
acgtgctctcaaaggtcttgcttaa

SEQ ID NO: 72601 - DNA, 25 bp, S. pombe
acggtggtcgctgcagctgaaattt

SEQ ID NO: 72602 - DNA, 25 bp, S. pombe
acggtattggcttcgctaatcttta

SEQ ID NO: 72603 - DNA, 25 bp, S. pombe
acattccatacacttacacggcatt

SEQ ID NO: 72604 - DNA, 25 bp, S. pombe
acttgccaaagttaccgctgagggt

SEQ ID NO: 72605 - DNA, 25 bp, S. pombe
actctcatggaagcaaagcccgttc

SEQ ID NO: 72606 - DNA, 25 bp, S. pombe
acgtgtacctgctgctactgcttaa

SEQ ID NO: 72607 - DNA, 25 bp, S. pombe
acgtgatcggcgtcagtaccaggaa

SEQ ID NO: 72608 - DNA, 25 bp, S. pombe
actggcctacgaacttatgaaaatt

SEQ ID NO: 72609 - DNA, 25 bp, S. pombe
actgcgcttccgtgctttagaatat

SEQ ID NO: 72610 - DNA, 25 bp, S. pombe
acgtgatactcgtgatgcatccgtt

SEQ ID NO: 72611 - DNA, 25 bp, S. pombe
acgtgataagcgtttctccggtact

SEQ ID NO: 72612 - DNA, 25 bp, S. pombe
acggtaagcgtggtgtcttgtctca

SEQ ID NO: 72613 - DNA, 25 bp, S. pombe
actgtcgattatccgccaatgtgca

SEQ ID NO: 72614 - DNA, 25 bp, S. pombe
actggcgttggcatctgcattcaca

SEQ ID NO: 72615 - DNA, 25 bp, S. pombe
acggcgcttccgtgagatgtacgaa

SEQ ID NO: 72616 - DNA, 25 bp, S. pombe
acggcttctccgttgaatgctgata

SEQ ID NO: 72617 - DNA, 25 bp, S. pombe
acggtcctcatttgtacagctatca

SEQ ID NO: 72618 - DNA, 25 bp, S. pombe
acggcggaaatttcttgagcgagac

SEQ ID NO: 72619 - DNA, 25 bp, S. pombe
acggccaaacaattgctggtgtgga

SEQ ID NO: 72620 - DNA, 25 bp, S. pombe
actgaccaacatggaatggtgctat

SEQ ID NO: 72621 - DNA, 25 bp, S. pombe
acatgcaaaagcgtggtcaagaaaa

SEQ ID NO: 72622 - DNA, 25 bp, S. pombe
actcgtgctgattctgacagtctgt

SEQ ID NO: 72623 - DNA, 25 bp, S. pombe
actggcggcttatcggttgggctaa

SEQ ID NO: 72624 - DNA, 25 bp, S. pombe
acacgactattacgcttgttccgaa

SEQ ID NO: 72625 - DNA, 25 bp, S. pombe
actacagtcgtagagttgccgtgaa

SEQ ID NO: 72626 - DNA, 25 bp, S. pombe
actaatcttgatgccgtttctctta

SEQ ID NO: 72627 - DNA, 25 bp, S. pombe
actcctcatgtgatccgtatttgca

SEQ ID NO: 72628 - DNA, 25 bp, S. pombe
actacattggttgggcttttggaat

SEQ ID NO: 72629 - DNA, 25 bp, S. pombe
actggttttgttcttatgggtctca

SEQ ID NO: 72630 - DNA, 25 bp, S. pombe
actggtgttgttttgattctgggtc

SEQ ID NO: 72631 - DNA, 25 bp, S. pombe
actggtttattcaggatggcgcaaa

SEQ ID NO: 72632 - DNA, 25 bp, S. pombe
acggtcgtttcagtggtggctctca

SEQ ID NO: 72633 - DNA, 25 bp, S. pombe
actgaggctgttccgtttagattaa

SEQ ID NO: 72634 - DNA, 25 bp, S. pombe
actggagtttccttcttacatttca

SEQ ID NO: 72635 - DNA, 25 bp, S. pombe
actcgttcttcctctgtaaagcttg

SEQ ID NO: 72636 - DNA, 25 bp, S. pombe
actccttggttctctaaatggctgg

SEQ ID NO: 72637 - DNA, 25 bp, S. pombe
actcgttggtttcatggcatcaggc

SEQ ID NO: 72638 - DNA, 25 bp, S. pombe
acggtgcggatgtttcagaagttac

SEQ ID NO: 72639 - DNA, 25 bp, S. pombe
actggtgcacgtcttaatcgtctac

SEQ ID NO: 72640 - DNA, 25 bp, S. pombe
acatagtccccgaaagtttgccatt

SEQ ID NO: 72641 - DNA, 25 bp, S. pombe
actgtagccccgatgattgttggat

SEQ ID NO: 72642 - DNA, 25 bp, S. pombe
actgttcccgctactggtacgagat

SEQ ID NO: 72643 - DNA, 25 bp, S. pombe
actattttcaatggaccggagagga

SEQ ID NO: 72644 - DNA, 25 bp, S. pombe
actactggaaagtcagtcggagcat

SEQ ID NO: 72645 - DNA, 25 bp, S. pombe
actaatcgatactggtgcgcaactc

SEQ ID NO: 72646 - DNA, 25 bp, S. pombe
actcgcttgtgttatgggtgctact

SEQ ID NO: 72647 - DNA, 25 bp, S. pombe
actgcaccatttaagccttccaaaa

SEQ ID NO: 72648 - DNA, 25 bp, S. pombe
actgccatggttcagtttgcacaaa

SEQ ID NO: 72649 - DNA, 25 bp, S. pombe
actgctacgtttggcgaatgctaaa

SEQ ID NO: 72650 - DNA, 25 bp, S. pombe
actcatggcagtttgctcgcaagtt

SEQ ID NO: 72651 - DNA, 25 bp, S. pombe
acggtcgattcgagatgctcttgaa

SEQ ID NO: 72652 - DNA, 25 bp, S. pombe
actggtccattgttcttgtcgataa

SEQ ID NO: 72653 - DNA, 25 bp, S. pombe
acggtgctgaaattgcttgctctta

SEQ ID NO: 72654 - DNA, 25 bp, S. pombe
acggttgaacatccatatccttacg

SEQ ID NO: 72655 - DNA, 25 bp, S. pombe
acggctctgtttcaattgtctgtgg

SEQ ID NO: 72656 - DNA, 25 bp, S. pombe
actggtgtttctctattcactcgag

SEQ ID NO: 72657 - DNA, 25 bp, S. pombe
acggattttgtgctgtactctctac

SEQ ID NO: 72658 - DNA, 25 bp, S. pombe
acggttgttttggtcattctgtatc

SEQ ID NO: 72659 - DNA, 25 bp, S. pombe
actaattttataaccagcttgccca

SEQ ID NO: 72660 - DNA, 25 bp, S. pombe
actaagttttttcagctcatttaca

SEQ ID NO: 72661 - DNA, 25 bp, S. pombe
actgccatacgtcgaagcttttatt

SEQ ID NO: 72662 - DNA, 25 bp, S. pombe
actcccagcctttagtttgtattct

SEQ ID NO: 72663 - DNA, 25 bp, S. pombe
acggctacgtgatgaagctgacctt

SEQ ID NO: 72664 - DNA, 25 bp, S. pombe
acggctacctgatgttgctcctaaa

SEQ ID NO: 72665 - DNA, 25 bp, S. pombe
actgtgttccatatgcatacccgaa

SEQ ID NO: 72666 - DNA, 25 bp, S. pombe
actgagatttcaaagccgactgctg

SEQ ID NO: 72667 - DNA, 25 bp, S. pombe
actggaatgcgctcgtgaaagtatt

SEQ ID NO: 72668 - DNA, 25 bp, S. pombe
actgggtgctcgtcgtaaactgttg

SEQ ID NO: 72669 - DNA, 25 bp, S. pombe
actggcgttagtctcgaaatcaaaa

SEQ ID NO: 72670 - DNA, 25 bp, S. pombe
acggccagtcgtttatgaagcatca

SEQ ID NO: 72671 - DNA, 25 bp, S. pombe
acggttattttcatggtctcactca

SEQ ID NO: 72672 - DNA, 25 bp, S. pombe
actggttactttactggagacgcta

SEQ ID NO: 72673 - DNA, 25 bp, S. pombe
acaaccgagtttcaagcatccactt

SEQ ID NO: 72674 - DNA, 25 bp, S. pombe
actggtggtgaatcggatcctccta

SEQ ID NO: 72675 - DNA, 25 bp, S. pombe
actgttcccgtatatagctctcgta

SEQ ID NO: 72676 - DNA, 25 bp, S. pombe
actgttagcttctttggttcgtatg

SEQ ID NO: 72677 - DNA, 25 bp, S. pombe
aattcaaggtacactgggtcgacag

SEQ ID NO: 72678 - DNA, 25 bp, S. pombe
actgtggaattttggctctggatga

SEQ ID NO: 72679 - DNA, 25 bp, S. pombe
actgttagactgttgtatcttgtac

SEQ ID NO: 72680 - DNA, 25 bp, S. pombe
actgtactactgttcgctcttgata

SEQ ID NO: 72681 - DNA, 25 bp, S. pombe
actactctaccattcgtcatttaac

SEQ ID NO: 72682 - DNA, 25 bp, S. pombe
actcggaatttcttcagttactaag

SEQ ID NO: 72683 - DNA, 25 bp, S. pombe
acatcggtgtcgctttgttaaccaa

SEQ ID NO: 72684 - DNA, 25 bp, S. pombe
actgccggtcaggttggtcaaacta

SEQ ID NO: 72685 - DNA, 25 bp, S. pombe
actagtgtggtcaggagagttgcta

SEQ ID NO: 72686 - DNA, 25 bp, S. pombe
actgctgagcggaattcttacctgt

SEQ ID NO: 72687 - DNA, 25 bp, S. pombe
actgctgcagccgatatggttacca

SEQ ID NO: 72688 - DNA, 25 bp, S. pombe
actgcatgcgcggattgtgttattc

SEQ ID NO: 72689 - DNA, 25 bp, S. pombe
actggccggatttttctatctggaa

SEQ ID NO: 72690 - DNA, 25 bp, S. pombe
actgtcaacttggaccgtctctgga

SEQ ID NO: 72691 - DNA, 25 bp, S. pombe
actaacactgatgctctccgtaagg

SEQ ID NO: 72692 - DNA, 25 bp, S. pombe
acggaggccatacttcttgtacaat

SEQ ID NO: 72693 - DNA, 25 bp, S. pombe
actgccgaccgaatttctgcattag

SEQ ID NO: 72694 - DNA, 25 bp, S. pombe
actagggtttctatcgagcggagca

SEQ ID NO: 72695 - DNA, 25 bp, S. pombe
actgtcctgggcatgtactctatgg

SEQ ID NO: 72696 - DNA, 25 bp, S. pombe
actgtcctggtaagaactgccgcaa

SEQ ID NO: 72697 - DNA, 25 bp, S. pombe
actctaccacttgatcctttgaatt

SEQ ID NO: 72698 - DNA, 25 bp, S. pombe
actcccaatttcagcacttgctaaa

SEQ ID NO: 72699 - DNA, 25 bp, S. pombe
acttcctcgtacacctttggagaag

SEQ ID NO: 72700 - DNA, 25 bp, S. pombe
actctcttcgtaactctttggatga

SEQ ID NO: 72701 - DNA, 25 bp, S. pombe
acattcttcgttctttggtttctcg

SEQ ID NO: 72702 - DNA, 25 bp, S. pombe
cagcttcgacgcttggttttttcgt

SEQ ID NO: 72703 - DNA, 25 bp, S. pombe
acttcgacccgtatattattgctgg

SEQ ID NO: 72704 - DNA, 25 bp, S. pombe
actatcgtatcctccttcaaatggg

SEQ ID NO: 72705 - DNA, 25 bp, S. pombe
actcaacctggtttgtgcggcattt

SEQ ID NO: 72706 - DNA, 25 bp, S. pombe
acggcagcggctagttcaacatttt

SEQ ID NO: 72707 - DNA, 25 bp, S. pombe
acatgcgttttacccagaaatcact

SEQ ID NO: 72708 - DNA, 25 bp, S. pombe
actggctctatgctatacggacttg

SEQ ID NO: 72709 - DNA, 25 bp, S. pombe
actggcttcagccatatccgaagtt

SEQ ID NO: 72710 - DNA, 25 bp, S. pombe
acggctgtactctatgaaccatttc

SEQ ID NO: 72711 - DNA, 25 bp, S. pombe
actcccttaatttagtttgcagcga

SEQ ID NO: 72712 - DNA, 25 bp, S. pombe
actccctttatttgactcttctgaa

SEQ ID NO: 72713 - DNA, 25 bp, S. pombe
actccctcactctctagaatttata

SEQ ID NO: 72714 - DNA, 25 bp, S. pombe
actcctctcgcgtttacagttaatt

SEQ ID NO: 72715 - DNA, 25 bp, S. pombe
actctcctttgtttcacagttttca

SEQ ID NO: 72716 - DNA, 25 bp, S. pombe
actccagttacatatccaggttcct

SEQ ID NO: 72717 - DNA, 25 bp, S. pombe
acttacattgacttcggtggttgcc

SEQ ID NO: 72718 - DNA, 25 bp, S. pombe
acttctcaattgatcgggtcttccg

SEQ ID NO: 72719 - DNA, 25 bp, S. pombe
acggctggctattttaatgtttatc

SEQ ID NO: 72720 - DNA, 25 bp, S. pombe
acggctgatctattttcgtctttca

SEQ ID NO: 72721 - DNA, 25 bp, S. pombe
actggttcttctcgtattcttatca

SEQ ID NO: 72722 - DNA, 25 bp, S. pombe
actgtttccaccgaatctgtttcaa

SEQ ID NO: 72723 - DNA, 25 bp, S. pombe
actgttctctcaattactttcttcg

SEQ ID NO: 72724 - DNA, 25 bp, S. pombe
actgactcctctaatttgttttgct

SEQ ID NO: 72725 - DNA, 25 bp, S. pombe
actggtttatacaatgccttcgcta

SEQ ID NO: 72726 - DNA, 25 bp, S. pombe
actggtttttattcagctcctctac

SEQ ID NO: 72727 - DNA, 25 bp, S. pombe
actgattttcgcgaggcatgttgcc

SEQ ID NO: 72728 - DNA, 25 bp, S. pombe
actgtttgtcccatgattttccgta

SEQ ID NO: 72729 - DNA, 25 bp, S. pombe
acttcattaccccagtttacagcga

SEQ ID NO: 72730 - DNA, 25 bp, S. pombe
acttcattagtttggcggtaccgat

SEQ ID NO: 72731 - DNA, 25 bp, S. pombe
acatgtcaaagtctggtggtcccgt

SEQ ID NO: 72732 - DNA, 25 bp, S. pombe
actggaatggtgctggttgccacac

SEQ ID NO: 72733 - DNA, 25 bp, S. pombe
actttcgcagaaaacgattagccaa

SEQ ID NO: 72734 - DNA, 25 bp, S. pombe
acttgctcaacctgacaacgatcaa

SEQ ID NO: 72735 - DNA, 25 bp, S. pombe
actggtggtctaagcacagcggaaa

SEQ ID NO: 72736 - DNA, 25 bp, S. pombe
actcgtgcgttgaagttcgtcctaa

SEQ ID NO: 72737 - DNA, 25 bp, S. pombe
actgctccagaaagtcatgcttcgt

SEQ ID NO: 72738 - DNA, 25 bp, S. pombe
actggtcgacgggtattttcatctc

SEQ ID NO: 72739 - DNA, 25 bp, S. pombe
actgggccacgtgtgattgtgtata

SEQ ID NO: 72740 - DNA, 25 bp, S. pombe
actgctggaattcgcgttggtgtat

SEQ ID NO: 72741 - DNA, 25 bp, S. pombe
actgacgaattggagcttgccgatt

SEQ ID NO: 72742 - DNA, 25 bp, S. pombe
actgttgaagcttttctccgttttg

SEQ ID NO: 72743 - DNA, 25 bp, S. pombe
actgcagttatacattacacggaat

SEQ ID NO: 72744 - DNA, 25 bp, S. pombe
actggtgtatcgcagaccctgcaaa

SEQ ID NO: 72745 - DNA, 25 bp, S. pombe
actgggcattcctgcttggtggaaa

SEQ ID NO: 72746 - DNA, 25 bp, S. pombe
actggtacgcagttgtcggtcatta

SEQ ID NO: 72747 - DNA, 25 bp, S. pombe
actggatgctgtcgatttctggttt

SEQ ID NO: 72748 - DNA, 25 bp, S. pombe
actggttcttcatttgctggtatta

SEQ ID NO: 72749 - DNA, 25 bp, S. pombe
actcgtatcctcatgtatcgtctat

SEQ ID NO: 72750 - DNA, 25 bp, S. pombe
actggtcgctacatgttcgatggat

SEQ ID NO: 72751 - DNA, 25 bp, S. pombe
actcgtttagttttcgcattgcaaa

SEQ ID NO: 72752 - DNA, 25 bp, S. pombe
actcgtttagattcatgtgccgcta

SEQ ID NO: 72753 - DNA, 25 bp, S. pombe
actgtgtattggaccttcggatctc

SEQ ID NO: 72754 - DNA, 25 bp, S. pombe
actgtggttagcactgtcgttcctg

SEQ ID NO: 72755 - DNA, 25 bp, S. pombe
actgtgcgtacagtacttcgctttt

SEQ ID NO: 72756 - DNA, 25 bp, S. pombe
actctttacaatgctatttcccgtg

SEQ ID NO: 72757 - DNA, 25 bp, S. pombe
acattacttacctcagtggatcctg

SEQ ID NO: 72758 - DNA, 25 bp, S. pombe
actccacctcgtctaattactgtat

SEQ ID NO: 72759 - DNA, 25 bp, S. pombe
actaggactcgtttacagtgtcgtt

SEQ ID NO: 72760 - DNA, 25 bp, S. pombe
actgttccaaatctgtttcggtaca

SEQ ID NO: 72761 - DNA, 25 bp, S. pombe
actacatctcctctaatttgcgtga

SEQ ID NO: 72762 - DNA, 25 bp, S. pombe
actgtatccttttaacacgcgcatg

SEQ ID NO: 72763 - DNA, 25 bp, S. pombe
actgcttccatgatttacgctgctg

SEQ ID NO: 72764 - DNA, 25 bp, S. pombe
actgttccctctggcggtgctgctg

SEQ ID NO: 72765 - DNA, 25 bp, S. pombe
actgtcccttctgctggtgctgtag

SEQ ID NO: 72766 - DNA, 25 bp, S. pombe
actgctcccattgtcatcgatatta

SEQ ID NO: 72767 - DNA, 25 bp, S. pombe
actgctgacacaatgcttcctattt

SEQ ID NO: 72768 - DNA, 25 bp, S. pombe
actggattcgttttgcatcctgcac

SEQ ID NO: 72769 - DNA, 25 bp, S. pombe
actcgtctatgttttgtatcccaaa

SEQ ID NO: 72770 - DNA, 25 bp, S. pombe
actcgtgccaaagctattcgcgaaa

SEQ ID NO: 72771 - DNA, 25 bp, S. pombe
acaccgatactcgtcattattggaa

SEQ ID NO: 72772 - DNA, 25 bp, S. pombe
actactgaagtgttcctcggatacc

SEQ ID NO: 72773 - DNA, 25 bp, S. pombe
actacgatcagttgcttcaggtgtt

SEQ ID NO: 72774 - DNA, 25 bp, S. pombe
actccaccagagacgattgccaaga

SEQ ID NO: 72775 - DNA, 25 bp, S. pombe
actttgcccgtgtttacttgagcag

SEQ ID NO: 72776 - DNA, 25 bp, S. pombe
actatatcacgaactctcttggcga

SEQ ID NO: 72777 - DNA, 25 bp, S. pombe
actacgccagtgtctggtaaaactt

SEQ ID NO: 72778 - DNA, 25 bp, S. pombe
actgagcgtgattttaccgtctcct

SEQ ID NO: 72779 - DNA, 25 bp, S. pombe
actcggtttacagctacattcgtca

SEQ ID NO: 72780 - DNA, 25 bp, S. pombe
actgtgccttaaacaagccgaccaa

SEQ ID NO: 72781 - DNA, 25 bp, S. pombe
actacttcttgcctcgtttgaacga

SEQ ID NO: 72782 - DNA, 25 bp, S. pombe
actacatttcatggtcctggtcaaa

SEQ ID NO: 72783 - DNA, 25 bp, S. pombe
actgcgtccatgataggtgtgcctt

SEQ ID NO: 72784 - DNA, 25 bp, S. pombe
actgctacatccactggctatacga

SEQ ID NO: 72785 - DNA, 25 bp, S. pombe
actcgagttcgtccagtgatcaagg

SEQ ID NO: 72786 - DNA, 25 bp, S. pombe
actgcaaatggccttcgatactcga

SEQ ID NO: 72787 - DNA, 25 bp, S. pombe
actactactagtttgtcgactgcaa

SEQ ID NO: 72788 - DNA, 25 bp, S. pombe
actacttcaaattccctaatgccaa

SEQ ID NO: 72789 - DNA, 25 bp, S. pombe
actagcattaaatctcgtcgcacca

SEQ ID NO: 72790 - DNA, 25 bp, S. pombe
actatgtaaatatccgccgtgctct

SEQ ID NO: 72791 - DNA, 25 bp, S. pombe
actcatcaacattttatcttcaccc

SEQ ID NO: 72792 - DNA, 25 bp, S. pombe
actgtaaagtctactcaagcccgca

SEQ ID NO: 72793 - DNA, 25 bp, S. pombe
actgttattgactatgctgccgacc

SEQ ID NO: 72794 - DNA, 25 bp, S. pombe
actactatttgttaactgagcccca

SEQ ID NO: 72795 - DNA, 25 bp, S. pombe
actgctattgaggcccttcgtcgtt

SEQ ID NO: 72796 - DNA, 25 bp, S. pombe
actctgtggagtgattcaacctttt

SEQ ID NO: 72797 - DNA, 25 bp, S. pombe
actctgtcaagttctttaggcttat

SEQ ID NO: 72798 - DNA, 25 bp, S. pombe
actgctattatttcttctacgcttt

SEQ ID NO: 72799 - DNA, 25 bp, S. pombe
actgccatttgaacttagccatgcc

SEQ ID NO: 72800 - DNA, 25 bp, S. pombe
actgttcttgattctatagcccctg

SEQ ID NO: 72801 - DNA, 25 bp, S. pombe
actgttggctcttcagatagctctg

SEQ ID NO: 72802 - DNA, 25 bp, S. pombe
actgtctctgctactagtggatctg

SEQ ID NO: 72803 - DNA, 25 bp, S. pombe
actgtcttcttttggtgttggctaa

SEQ ID NO: 72804 - DNA, 25 bp, S. pombe
actgatttcttcttgggtcacttat

SEQ ID NO: 72805 - DNA, 25 bp, S. pombe
actgtttcttcttcttcgagcactt

SEQ ID NO: 72806 - DNA, 25 bp, S. pombe
actgtacttttgctgtgtgtgactc

SEQ ID NO: 72807 - DNA, 25 bp, S. pombe
actgctgctgctactagtgctcgct

SEQ ID NO: 72808 - DNA, 25 bp, S. pombe
actgatgctgaaatacgctctcttt

SEQ ID NO: 72809 - DNA, 25 bp, S. pombe
actgctgctttcaacggtggtgttt

SEQ ID NO: 72810 - DNA, 25 bp, S. pombe
acttcatggtcctcacggtggtttc

SEQ ID NO: 72811 - DNA, 25 bp, S. pombe
actcctggtttgtacatgggttatt

SEQ ID NO: 72812 - DNA, 25 bp, S. pombe
actccatctgttagttctcggtcta

SEQ ID NO: 72813 - DNA, 25 bp, S. pombe
actgactttggattttgtgctcgat

SEQ ID NO: 72814 - DNA, 25 bp, S. pombe
actgtcgtgggtattatgttgcatc

SEQ ID NO: 72815 - DNA, 25 bp, S. pombe
actgccttgggatttttgttcatga

SEQ ID NO: 72816 - DNA, 25 bp, S. pombe
actgctagtgctgtttctggatttg

SEQ ID NO: 72817 - DNA, 25 bp, S. pombe
actgatcggtcattgttgtcggcaa

SEQ ID NO: 72818 - DNA, 25 bp, S. pombe
actgcgcctgcctatttaaacattg

SEQ ID NO: 72819 - DNA, 25 bp, S. pombe
actgcgccagctcgtcagaaatttg

SEQ ID NO: 72820 - DNA, 25 bp, S. pombe
actgctccaatgctagacgatcttg

SEQ ID NO: 72821 - DNA, 25 bp, S. pombe
acatccgctgccgaagaagctaagg

SEQ ID NO: 72822 - DNA, 25 bp, S. pombe
actgacgcgctttccaagtatgagg

SEQ ID NO: 72823 - DNA, 25 bp, S. pombe
actgctactaattcacaaggtgcga

SEQ ID NO: 72824 - DNA, 25 bp, S. pombe
actgttctcaataattggcccagca

SEQ ID NO: 72825 - DNA, 25 bp, S. pombe
acttttctatgcaagctacccaaac

SEQ ID NO: 72826 - DNA, 25 bp, S. pombe
actcatctttccagtaccgattagc

SEQ ID NO: 72827 - DNA, 25 bp, S. pombe
actgctcttactttgattccgttag

SEQ ID NO: 72828 - DNA, 25 bp, S. pombe
acacctttacactttgccgttatgt

SEQ ID NO: 72829 - DNA, 25 bp, S. pombe
acaccatcaaatcttcgtcggcgat

SEQ ID NO: 72830 - DNA, 25 bp, S. pombe
actgattctcagttggctgcgatgt

SEQ ID NO: 72831 - DNA, 25 bp, S. pombe
actgcttctcaattcagcggtcata

SEQ ID NO: 72832 - DNA, 25 bp, S. pombe
actgttttgtatttgttgtgcattc

SEQ ID NO: 72833 - DNA, 25 bp, S. pombe
actgtttttcatcaatgcgtgccct

SEQ ID NO: 72834 - DNA, 25 bp, S. pombe
acacgtttaggacttggagcacttc

SEQ ID NO: 72835 - DNA, 25 bp, S. pombe
acacttagcattctcgagggatctg

SEQ ID NO: 72836 - DNA, 25 bp, S. pombe
acatttttccgtggcagaggtcgcg

SEQ ID NO: 72837 - DNA, 25 bp, S. pombe
actgcttcgtatgcttcaaggtcac

SEQ ID NO: 72838 - DNA, 25 bp, S. pombe
actcttcactctttggagtcggcga

SEQ ID NO: 72839 - DNA, 25 bp, S. pombe
actttgcacgtttgggattcggcca

SEQ ID NO: 72840 - DNA, 25 bp, S. pombe
acattaaagttctgtttgcgaccaa

SEQ ID NO: 72841 - DNA, 25 bp, S. pombe
acttcaaagagtccccaatttcagc

SEQ ID NO: 72842 - DNA, 25 bp, S. pombe
actctaggaggcaccagtttgtcat

SEQ ID NO: 72843 - DNA, 25 bp, S. pombe
actctccgcaaggatgccaggttta

SEQ ID NO: 72844 - DNA, 25 bp, S. pombe
actgatttctccgaagttgcttatg

SEQ ID NO: 72845 - DNA, 25 bp, S. pombe
acttgtcctcagttattctgccgaa

SEQ ID NO: 72846 - DNA, 25 bp, S. pombe
actctaatctatgttgtccctgtac

SEQ ID NO: 72847 - DNA, 25 bp, S. pombe
actcgatatgtactgttttcttgga

SEQ ID NO: 72848 - DNA, 25 bp, S. pombe
actgctgatactgacgtttcttcga

SEQ ID NO: 72849 - DNA, 25 bp, S. pombe
actgcttgagctaattgaggttatc

SEQ ID NO: 72850 - DNA, 25 bp, S. pombe
actctatgtctgtctatcgttgcca

SEQ ID NO: 72851 - DNA, 25 bp, S. pombe
actttgcagtgcctatgctggtgaa

SEQ ID NO: 72852 - DNA, 25 bp, S. pombe
actccagtaggttctcagcatgtga

SEQ ID NO: 72853 - DNA, 25 bp, S. pombe
actgctatttcgatcactattcctg

SEQ ID NO: 72854 - DNA, 25 bp, S. pombe
actgcgatgtttgtacattgcccgt

SEQ ID NO: 72855 - DNA, 25 bp, S. pombe
actcttcttgcatagctaggttcat

SEQ ID NO: 72856 - DNA, 25 bp, S. pombe
actctaggtctgtcgcaaatttcat

SEQ ID NO: 72857 - DNA, 25 bp, S. pombe
actctcgcgatcaccaatgttgatg

SEQ ID NO: 72858 - DNA, 25 bp, S. pombe
acagctcgagtgttacaatgttcgt

SEQ ID NO: 72859 - DNA, 25 bp, S. pombe
acacgggaacgatagtcttttagca

SEQ ID NO: 72860 - DNA, 25 bp, S. pombe
actgccggatcctgatttagttcat

SEQ ID NO: 72861 - DNA, 25 bp, S. pombe
actgccgctgatactgttatttttt

SEQ ID NO: 72862 - DNA, 25 bp, S. pombe
actcctgtatcatgcatctcttttt

SEQ ID NO: 72863 - DNA, 25 bp, S. pombe
actgcttattgctgagtctctttca

SEQ ID NO: 72864 - DNA, 25 bp, S. pombe
actatccattcatgagcgtctttct

SEQ ID NO: 72865 - DNA, 25 bp, S. pombe
actaggcattgaaagcagtcctgct

SEQ ID NO: 72866 - DNA, 25 bp, S. pombe
actgaagctcctgtagaggctgcta

SEQ ID NO: 72867 - DNA, 25 bp, S. pombe
actgctactcctgatcgtgttgata

SEQ ID NO: 72868 - DNA, 25 bp, S. pombe
actgcgacttcttacttgtgatcta

SEQ ID NO: 72869 - DNA, 25 bp, S. pombe
actgcattcttttccttgtgtctat

SEQ ID NO: 72870 - DNA, 25 bp, S. pombe
actgcattgattttcgcgtctggta

SEQ ID NO: 72871 - DNA, 25 bp, S. pombe
actcttgcattgtccggcttggtat

SEQ ID NO: 72872 - DNA, 25 bp, S. pombe
actcttttacctcgcttagatgcta

SEQ ID NO: 72873 - DNA, 25 bp, S. pombe
actcggatttccaagcattattcaa

SEQ ID NO: 72874 - DNA, 25 bp, S. pombe
actccgtcctcctgatgatttgaat

SEQ ID NO: 72875 - DNA, 25 bp, S. pombe
actttcggcttccaaaggtgtgctt

SEQ ID NO: 72876 - DNA, 25 bp, S. pombe
acatttgggtactcagcgcaggtca

SEQ ID NO: 72877 - DNA, 25 bp, S. pombe
actcatttcggcgagttagccattg

SEQ ID NO: 72878 - DNA, 25 bp, S. pombe
acatatttggtggagcattgcgaat

SEQ ID NO: 72879 - DNA, 25 bp, S. pombe
actcagttgtgtgtgcttgcgatta

SEQ ID NO: 72880 - DNA, 25 bp, S. pombe
actagttggctttttcacattacag

SEQ ID NO: 72881 - DNA, 25 bp, S. pombe
actgaaatcggcatttgcatcttaa

SEQ ID NO: 72882 - DNA, 25 bp, S. pombe
actgaagtcgattgttttctctcaa

SEQ ID NO: 72883 - DNA, 25 bp, S. pombe
actacagtctgtcgttttccattat

SEQ ID NO: 72884 - DNA, 25 bp, S. pombe
actacatcctgacggttcttatcga

SEQ ID NO: 72885 - DNA, 25 bp, S. pombe
actacatccatggagactggcgaat

SEQ ID NO: 72886 - DNA, 25 bp, S. pombe
actcctgcacataaacggcctgaaa

SEQ ID NO: 72887 - DNA, 25 bp, S. pombe
actccctcagaaccagtgttatcaa

SEQ ID NO: 72888 - DNA, 25 bp, S. pombe
acattccaactgagtgttttaaata

SEQ ID NO: 72889 - DNA, 25 bp, S. pombe
actctgccaaccttctgggtataga

SEQ ID NO: 72890 - DNA, 25 bp, S. pombe
actcccagtactttgcgaatatcag

SEQ ID NO: 72891 - DNA, 25 bp, S. pombe
actcatgtggtgacttactcgttca

SEQ ID NO: 72892 - DNA, 25 bp, S. pombe
actagtagatcctgagctcgctgat

SEQ ID NO: 72893 - DNA, 25 bp, S. pombe
acttgtaatattgtctttaggcttt

SEQ ID NO: 72894 - DNA, 25 bp, S. pombe
acttcgaactactgctttagcgttg

SEQ ID NO: 72895 - DNA, 25 bp, S. pombe
acagcgactggactttcacgatccg

SEQ ID NO: 72896 - DNA, 25 bp, S. pombe
actctgactgggtttcttgtgtgcg

SEQ ID NO: 72897 - DNA, 25 bp, S. pombe
actcgttgcgagttctgctagcatt

SEQ ID NO: 72898 - DNA, 25 bp, S. pombe
actgccttcgatgatgttaacccta

SEQ ID NO: 72899 - DNA, 25 bp, S. pombe
actccggctgttattcaatcgatca

SEQ ID NO: 72900 - DNA, 25 bp, S. pombe
actccattgagtaaccttatttttg

SEQ ID NO: 72901 - DNA, 25 bp, S. pombe
actgctcaacgcgaaaacccattta

SEQ ID NO: 72902 - DNA, 25 bp, S. pombe
acttttccttcctgcagtcaagata

SEQ ID NO: 72903 - DNA, 25 bp, S. pombe
actcttacaaagtactctgctccgt

SEQ ID NO: 72904 - DNA, 25 bp, S. pombe
actcagcagcagattttactcgtcc

SEQ ID NO: 72905 - DNA, 25 bp, S. pombe
actcatggtcattactgtctactta

SEQ ID NO: 72906 - DNA, 25 bp, S. pombe
actcagctttgcagaatggtactca

SEQ ID NO: 72907 - DNA, 25 bp, S. pombe
acattgcccttcagtcgtatttaat

SEQ ID NO: 72908 - DNA, 25 bp, S. pombe
actctgccggtcttgacgtatttga

SEQ ID NO: 72909 - DNA, 25 bp, S. pombe
acagctgctggagaatacggtcgat

SEQ ID NO: 72910 - DNA, 25 bp, S. pombe
actctggagatactcgaccttctga

SEQ ID NO: 72911 - DNA, 25 bp, S. pombe
actgctgtgattttagtcctcgtgc

SEQ ID NO: 72912 - DNA, 25 bp, S. pombe
actcgtgtatcttattccatcattg

SEQ ID NO: 72913 - DNA, 25 bp, S. pombe
actcaatggctcttgtacgttttcc

SEQ ID NO: 72914 - DNA, 25 bp, S. pombe
actcattttcttcatcgtggtttgg

SEQ ID NO: 72915 - DNA, 25 bp, S. pombe
actcactggtcacgtcgattgttga

SEQ ID NO: 72916 - DNA, 25 bp, S. pombe
actctcggtgcctgctattggtggt

SEQ ID NO: 72917 - DNA, 25 bp, S. pombe
actatcggtacatccatgagtcgtg

SEQ ID NO: 72918 - DNA, 25 bp, S. pombe
actacgagaacttggctggtgtgat

SEQ ID NO: 72919 - DNA, 25 bp, S. pombe
actcacgtagctgatgtgggtggca

SEQ ID NO: 72920 - DNA, 25 bp, S. pombe
actccagcttctgttggcgctgaaa

SEQ ID NO: 72921 - DNA, 25 bp, S. pombe
actcctgcttatgttggcggtgcca

SEQ ID NO: 72922 - DNA, 25 bp, S. pombe
actcaccctatatcttggctcaaga

SEQ ID NO: 72923 - DNA, 25 bp, S. pombe
actcactccattaactccattagaa

SEQ ID NO: 72924 - DNA, 25 bp, S. pombe
actttccgatatctctaattcagcg

SEQ ID NO: 72925 - DNA, 25 bp, S. pombe
actatgataccgactactccatcaa

SEQ ID NO: 72926 - DNA, 25 bp, S. pombe
acttggatgtgatcattgtttacag

SEQ ID NO: 72927 - DNA, 25 bp, S. pombe
acttggtcgtgccaaattgtcactt

SEQ ID NO: 72928 - DNA, 25 bp, S. pombe
acttgcgctaacaaatcttgcttca

SEQ ID NO: 72929 - DNA, 25 bp, S. pombe
actcctgtttcaatttggctgtttg

SEQ ID NO: 72930 - DNA, 25 bp, S. pombe
acttctttctgctgttagtggtatg

SEQ ID NO: 72931 - DNA, 25 bp, S. pombe
acttccctgccttacatttggttag

SEQ ID NO: 72932 - DNA, 25 bp, S. pombe
actctccgatgcgtattctacggga

SEQ ID NO: 72933 - DNA, 25 bp, S. pombe
actctcttgatagtccctacggaaa

SEQ ID NO: 72934 - DNA, 25 bp, S. pombe
actcctagtcgtctgcttcgagaaa

SEQ ID NO: 72935 - DNA, 25 bp, S. pombe
actttactgcttccctgctaatgaa

SEQ ID NO: 72936 - DNA, 25 bp, S. pombe
actcttctcttgcttctttaggaaa

SEQ ID NO: 72937 - DNA, 25 bp, S. pombe
actcgttcagcttgtcttttgtttt

SEQ ID NO: 72938 - DNA, 25 bp, S. pombe
actctggtcgtaaattcctttctag

SEQ ID NO: 72939 - DNA, 25 bp, S. pombe
acttgcgtagtattcgtcctttaga

SEQ ID NO: 72940 - DNA, 25 bp, S. pombe
actattaaccttctcgctttcaatg

SEQ ID NO: 72941 - DNA, 25 bp, S. pombe
acttgacaattcacttacccacgag

SEQ ID NO: 72942 - DNA, 25 bp, S. pombe
actcagcgtgtacttcttgaaccaa

SEQ ID NO: 72943 - DNA, 25 bp, S. pombe
actatcctctgtgcatcctaatttg

SEQ ID NO: 72944 - DNA, 25 bp, S. pombe
actatctccagttattactcgacgg

SEQ ID NO: 72945 - DNA, 25 bp, S. pombe
actattccatcttctactaggtcgg

SEQ ID NO: 72946 - DNA, 25 bp, S. pombe
acatgtttagcttcgaaacctcgcc

SEQ ID NO: 72947 - DNA, 25 bp, S. pombe
acagttagcctgtcgcaaatccttc

SEQ ID NO: 72948 - DNA, 25 bp, S. pombe
actttgctgggttaacctgtgtcac

SEQ ID NO: 72949 - DNA, 25 bp, S. pombe
acatgtagctaaaacgattgcaggc

SEQ ID NO: 72950 - DNA, 25 bp, S. pombe
actttacgaggattctttgtctgaa

SEQ ID NO: 72951 - DNA, 25 bp, S. pombe
actttacatttactccacgtctgaa

SEQ ID NO: 72952 - DNA, 25 bp, S. pombe
acttctaacatgtaccaacgccgtg

SEQ ID NO: 72953 - DNA, 25 bp, S. pombe
actttatagtgatccatccccagag

SEQ ID NO: 72954 - DNA, 25 bp, S. pombe
acatttacaggagggcagccaccgt

SEQ ID NO: 72955 - DNA, 25 bp, S. pombe
actagctagggagaacgcacggtta

SEQ ID NO: 72956 - DNA, 25 bp, S. pombe
actacactctctatcaaccataatt

SEQ ID NO: 72957 - DNA, 25 bp, S. pombe
actacaattgctatcgcagcctgtt

SEQ ID NO: 72958 - DNA, 25 bp, S. pombe
actctcttctcactcaattggttaa

SEQ ID NO: 72959 - DNA, 25 bp, S. pombe
actcatagtacttgcgatgctcttt

SEQ ID NO: 72960 - DNA, 25 bp, S. pombe
actcatactagttcgacgtgtcctt

SEQ ID NO: 72961 - DNA, 25 bp, S. pombe
actctatcttgaatggcggttccac

SEQ ID NO: 72962 - DNA, 25 bp, S. pombe
actcttatggttctggtttggctgc

SEQ ID NO: 72963 - DNA, 25 bp, S. pombe
actagaagcgcctatacttttgccg

SEQ ID NO: 72964 - DNA, 25 bp, S. pombe
acttcttcgtggaaagtctggccga

SEQ ID NO: 72965 - DNA, 25 bp, S. pombe
actcatttttgtttggacccatcta

SEQ ID NO: 72966 - DNA, 25 bp, S. pombe
actcttaatcttcgttatccttctg

SEQ ID NO: 72967 - DNA, 25 bp, S. pombe
acttttccatctattcctcattcat

SEQ ID NO: 72968 - DNA, 25 bp, S. pombe
actcttctcaaccttcaactattaa

SEQ ID NO: 72969 - DNA, 25 bp, S. pombe
acttctcctagcattaactccggtg

SEQ ID NO: 72970 - DNA, 25 bp, S. pombe
actcttctcataagcaaccgtctaa

SEQ ID NO: 72971 - DNA, 25 bp, S. pombe
actatgtttctttctcggttaagct

SEQ ID NO: 72972 - DNA, 25 bp, S. pombe
actaagatctttttccgtttcgcat

SEQ ID NO: 72973 - DNA, 25 bp, S. pombe
actcaatttatctttctcgtttcga

SEQ ID NO: 72974 - DNA, 25 bp, S. pombe
actctttagatcttgtccgtcatac

SEQ ID NO: 72975 - DNA, 25 bp, S. pombe
actttgtggctaaacgtctcgatta

SEQ ID NO: 72976 - DNA, 25 bp, S. pombe
acttgttggctttctatttcgtcta

SEQ ID NO: 72977 - DNA, 25 bp, S. pombe
actctgtactcgtttacttcttcaa

SEQ ID NO: 72978 - DNA, 25 bp, S. pombe
actcatggacttctgtacctattca

SEQ ID NO: 72979 - DNA, 25 bp, S. pombe
actcgtgttatgaattcctctgcag

SEQ ID NO: 72980 - DNA, 25 bp, S. pombe
actacgtgccattcgatgatgatga

SEQ ID NO: 72981 - DNA, 25 bp, S. pombe
acatcaatactatcgcggccagtgt

SEQ ID NO: 72982 - DNA, 25 bp, S. pombe
actctcgttagctcgtgtatcagtt

SEQ ID NO: 72983 - DNA, 25 bp, S. pombe
actttttagcatccttaacgtctcg

SEQ ID NO: 72984 - DNA, 25 bp, S. pombe
acttcttcagaacctgttacttctc

SEQ ID NO: 72985 - DNA, 25 bp, S. pombe
acttcttcttcaaattggacctcgc

SEQ ID NO: 72986 - DNA, 25 bp, S. pombe
actagctttctaacatttcacctca

SEQ ID NO: 72987 - DNA, 25 bp, S. pombe
actcttggccctactttattgctaa

SEQ ID NO: 72988 - DNA, 25 bp, S. pombe
actcgtggtttaattcttggcattc

SEQ ID NO: 72989 - DNA, 25 bp, S. pombe
actcaggctttttatgacttggcat

SEQ ID NO: 72990 - DNA, 25 bp, S. pombe
actaacgttcgtggatctactgcat

SEQ ID NO: 72991 - DNA, 25 bp, S. pombe
cactacacggttttgcacgacgaaa

SEQ ID NO: 72992 - DNA, 25 bp, S. pombe
actactctcgtttctgccgaaaaga

SEQ ID NO: 72993 - DNA, 25 bp, S. pombe
actctcctggacatgcttgctgaaa

SEQ ID NO: 72994 - DNA, 25 bp, S. pombe
actctgactgcttctttagcattag

SEQ ID NO: 72995 - DNA, 25 bp, S. pombe
actcatggtgccgatttatgcgctc

SEQ ID NO: 72996 - DNA, 25 bp, S. pombe
actctgcctctttgcttgaacagaa

SEQ ID NO: 72997 - DNA, 25 bp, S. pombe
acttccgtggactcaattgctagtt

SEQ ID NO: 72998 - DNA, 25 bp, S. pombe
acagctccagcaccagttataacga

SEQ ID NO: 72999 - DNA, 25 bp, S. pombe
actctccagtgggttctatacgaaa

SEQ ID NO: 73000 - DNA, 25 bp, S. pombe
actcatcatgagcttgttcctaaac

SEQ ID NO: 73001 - DNA, 25 bp, S. pombe
actcattggcgtatctcattgcaag

SEQ ID NO: 73002 - DNA, 25 bp, S. pombe
acttttcagctctttcatgtcatag

SEQ ID NO: 73003 - DNA, 25 bp, S. pombe
actcttgtttgtttcgtgcattgtc

SEQ ID NO: 73004 - DNA, 25 bp, S. pombe
actctttatgtttgctggtgctata

SEQ ID NO: 73005 - DNA, 25 bp, S. pombe
actcatgtatattctctctgggcta

SEQ ID NO: 73006 - DNA, 25 bp, S. pombe
acttgtattgttcctatggctaccc

SEQ ID NO: 73007 - DNA, 25 bp, S. pombe
acatttctccttgtatgactaccta

SEQ ID NO: 73008 - DNA, 25 bp, S. pombe
acttatgctcttttttatccctcaa

SEQ ID NO: 73009 - DNA, 25 bp, S. pombe
actattctctacttgttatgcctta

SEQ ID NO: 73010 - DNA, 25 bp, S. pombe
actctcccaatgatttactgtttga

SEQ ID NO: 73011 - DNA, 25 bp, S. pombe
actatccctctttcacataatcagt

SEQ ID NO: 73012 - DNA, 25 bp, S. pombe
actatccatgttttcacgtctacta

SEQ ID NO: 73013 - DNA, 25 bp, S. pombe
actacagaaaggtcggtgctcttcc

SEQ ID NO: 73014 - DNA, 25 bp, S. pombe
actagggaatgttcggttccaccag

SEQ ID NO: 73015 - DNA, 25 bp, S. pombe
actaagggtgtatgtgtttcaggaa

SEQ ID NO: 73016 - DNA, 25 bp, S. pombe
acttctggtccatcatgattcacga

SEQ ID NO: 73017 - DNA, 25 bp, S. pombe
aaccagcgcccgatcgtaaagtgta

SEQ ID NO: 73018 - DNA, 25 bp, S. pombe
aaaggatggctaccgcgtaagttag

SEQ ID NO: 73019 - DNA, 25 bp, S. pombe
actagaatggcatctcggtctcttt

SEQ ID NO: 73020 - DNA, 25 bp, S. pombe
actagttctgcgtctggtgttcatg

SEQ ID NO: 73021 - DNA, 25 bp, S. pombe
acacatttcacgtacgctgttcagt

SEQ ID NO: 73022 - DNA, 25 bp, S. pombe
aagtttgccggcgtcgatatccgtg

SEQ ID NO: 73023 - DNA, 25 bp, S. pombe
acattgggtgggttttgagcctctc

SEQ ID NO: 73024 - DNA, 25 bp, S. pombe
acttcgactggtttgttggacattc

SEQ ID NO: 73025 - DNA, 25 bp, S. pombe
acttcgttgctttcacatgggttac

SEQ ID NO: 73026 - DNA, 25 bp, S. pombe
actcttgttttcttcattggttaca

SEQ ID NO: 73027 - DNA, 25 bp, S. pombe
actcttctccttttactgttcacaa

SEQ ID NO: 73028 - DNA, 25 bp, S. pombe
acttgtacttctatacttcccgata

SEQ ID NO: 73029 - DNA, 25 bp, S. pombe
acttgcttttgccagaactttccga

SEQ ID NO: 73030 - DNA, 25 bp, S. pombe
acttcattgggctctagttcgtatg

SEQ ID NO: 73031 - DNA, 25 bp, S. pombe
acattactacaaaacgccagcggtg

SEQ ID NO: 73032 - DNA, 25 bp, S. pombe
acttgatcgaagtttgcgcccatac

SEQ ID NO: 73033 - DNA, 25 bp, S. pombe
actagatgcgattgtctgcgaccct

SEQ ID NO: 73034 - DNA, 25 bp, S. pombe
actactgctgttactgagacttctt

SEQ ID NO: 73035 - DNA, 25 bp, S. pombe
actactcccaacttgactagcataa

SEQ ID NO: 73036 - DNA, 25 bp, S. pombe
acattgtcggcttggtaatcacgct

SEQ ID NO: 73037 - DNA, 25 bp, S. pombe
acttgcatggttttggattccgctg

SEQ ID NO: 73038 - DNA, 25 bp, S. pombe
actagctgtgccttggaattccgtt

SEQ ID NO: 73039 - DNA, 25 bp, S. pombe
actcttccctcgtgtcatgatagaa

SEQ ID NO: 73040 - DNA, 25 bp, S. pombe
acttgtccccagtgtatggctagaa

SEQ ID NO: 73041 - DNA, 25 bp, S. pombe
actattcatcggtggactactacaa

SEQ ID NO: 73042 - DNA, 25 bp, S. pombe
actaatgcgttctgccatggttttt

SEQ ID NO: 73043 - DNA, 25 bp, S. pombe
actatgctgttaacgttcctttgag

SEQ ID NO: 73044 - DNA, 25 bp, S. pombe
acatgacttatgtgcgttcgttaga

SEQ ID NO: 73045 - DNA, 25 bp, S. pombe
acatccaacgtgtcttctgggtcaa

SEQ ID NO: 73046 - DNA, 25 bp, S. pombe
actacacctgtgtctatgcgaatga

SEQ ID NO: 73047 - DNA, 25 bp, S. pombe
acttacaagggcttgccagctggtt

SEQ ID NO: 73048 - DNA, 25 bp, S. pombe
acttcaatgtggcactcccaggaat

SEQ ID NO: 73049 - DNA, 25 bp, S. pombe
acttgcggttgggtgttcagtcaat

SEQ ID NO: 73050 - DNA, 25 bp, S. pombe
acttggttcaagctagcgtccagca

SEQ ID NO: 73051 - DNA, 25 bp, S. pombe
acttctggtgaagctatccccgaaa

SEQ ID NO: 73052 - DNA, 25 bp, S. pombe
gacttcgcaaatcaggaccccgaaa

SEQ ID NO: 73053 - DNA, 25 bp, S. pombe
acttctcaagattcacgacgtctcg

SEQ ID NO: 73054 - DNA, 25 bp, S. pombe
acttcatgatacctgtttcttctcg

SEQ ID NO: 73055 - DNA, 25 bp, S. pombe
acttcacactgtttactgcatcgag

SEQ ID NO: 73056 - DNA, 25 bp, S. pombe
acttgccagtgtcttcagctaaggt

SEQ ID NO: 73057 - DNA, 25 bp, S. pombe
actaactgcttggtatcgtgacgaa

SEQ ID NO: 73058 - DNA, 25 bp, S. pombe
actaggctgcttcaatctgtcaatg

SEQ ID NO: 73059 - DNA, 25 bp, S. pombe
acttgatttgcttcatgtccatgac

SEQ ID NO: 73060 - DNA, 25 bp, S. pombe
acttcatgtccggtatctactcaaa

SEQ ID NO: 73061 - DNA, 25 bp, S. pombe
actactgtgcactctactactgaga

SEQ ID NO: 73062 - DNA, 25 bp, S. pombe
actactttcaacgagctactgcttt

SEQ ID NO: 73063 - DNA, 25 bp, S. pombe
acagcaaagagatcgtccacgggat

SEQ ID NO: 73064 - DNA, 25 bp, S. pombe
actttactggtactgatgctgtcaa

SEQ ID NO: 73065 - DNA, 25 bp, S. pombe
actttcatcggtgttggtcctggtc

SEQ ID NO: 73066 - DNA, 25 bp, S. pombe
actaatttggtggttcgtccatcct

SEQ ID NO: 73067 - DNA, 25 bp, S. pombe
actagtttcgtcaattcgtgccttt

SEQ ID NO: 73068 - DNA, 25 bp, S. pombe
actagattactcatttcgtgacata

SEQ ID NO: 73069 - DNA, 25 bp, S. pombe
acattcttcaccctggcaaggctaa

SEQ ID NO: 73070 - DNA, 25 bp, S. pombe
acttcctctctcatacggttatgga

SEQ ID NO: 73071 - DNA, 25 bp, S. pombe
acttgtaatgttcacttgctctcga

SEQ ID NO: 73072 - DNA, 25 bp, S. pombe
acttaaatgattccaaggctcctct

SEQ ID NO: 73073 - DNA, 25 bp, S. pombe
acttctctactggtcaatggctcat

SEQ ID NO: 73074 - DNA, 25 bp, S. pombe
actatcttcgtactatggctgcttc

SEQ ID NO: 73075 - DNA, 25 bp, S. pombe
actttcccgatattaatgccgctat

SEQ ID NO: 73076 - DNA, 25 bp, S. pombe
acttaacggcgatgagtctgcgtat

SEQ ID NO: 73077 - DNA, 25 bp, S. pombe
acattgaacaagctaggcctactga

SEQ ID NO: 73078 - DNA, 25 bp, S. pombe
acttgaaatccgtacgactgccatt

SEQ ID NO: 73079 - DNA, 25 bp, S. pombe
cactggaaacgcctaggagccctta

SEQ ID NO: 73080 - DNA, 25 bp, S. pombe
acaggtactgcacgctatgctagca

SEQ ID NO: 73081 - DNA, 25 bp, S. pombe
acatcgacgatatctgcagcgggaa

SEQ ID NO: 73082 - DNA, 25 bp, S. pombe
acatcgggtaattggctgggcaact

SEQ ID NO: 73083 - DNA, 25 bp, S. pombe
acatccgttttgagacctatttcca

SEQ ID NO: 73084 - DNA, 25 bp, S. pombe
acttggtttctgcaggtatcgttca

SEQ ID NO: 73085 - DNA, 25 bp, S. pombe
acagtattttcccaagtcacgtctc

SEQ ID NO: 73086 - DNA, 25 bp, S. pombe
ccgtgttttacttgggccaattctg

SEQ ID NO: 73087 - DNA, 25 bp, S. pombe
ccgttccctaactcgcaagatgtgg

SEQ ID NO: 73088 - DNA, 25 bp, S. pombe
acttagacacgtgggctcctggatt

SEQ ID NO: 73089 - DNA, 25 bp, S. pombe
acttcaacctttatggatgagcttg

SEQ ID NO: 73090 - DNA, 25 bp, S. pombe
acattcgcactcatttggttcgttt

SEQ ID NO: 73091 - DNA, 25 bp, S. pombe
acttcttgtgcaaccggattctttt

SEQ ID NO: 73092 - DNA, 25 bp, S. pombe
aaacggtcacttggtagtacctcag

SEQ ID NO: 73093 - DNA, 25 bp, S. pombe
actaggtgttgcttcacttgttcca

SEQ ID NO: 73094 - DNA, 25 bp, S. pombe
actagagtcaggttcgttcaataca

SEQ ID NO: 73095 - DNA, 25 bp, S. pombe
actacgtctatgtatggtgctccac

SEQ ID NO: 73096 - DNA, 25 bp, S. pombe
actactgttatccagactgtaccga

SEQ ID NO: 73097 - DNA, 25 bp, S. pombe
acatcctcattttctggtacttcgg

SEQ ID NO: 73098 - DNA, 25 bp, S. pombe
actatcttgttgaggtgtggtcgat

SEQ ID NO: 73099 - DNA, 25 bp, S. pombe
acattatttcgcataccagttctcg

SEQ ID NO: 73100 - DNA, 25 bp, S. pombe
catcctttaccattacctttcacgt

SEQ ID NO: 73101 - DNA, 25 bp, S. pombe
acttttccgcaaatcttgttctcga

SEQ ID NO: 73102 - DNA, 25 bp, S. pombe
actttttctatcagtggtctctcga

SEQ ID NO: 73103 - DNA, 25 bp, S. pombe
actttttcttcatgttgctttgcta

SEQ ID NO: 73104 - DNA, 25 bp, S. pombe
acttccttcttttatcttttgtgca

SEQ ID NO: 73105 - DNA, 25 bp, S. pombe
acttctcctgttaaaacctctgcta

SEQ ID NO: 73106 - DNA, 25 bp, S. pombe
acttctccacttccaaacttagatg

SEQ ID NO: 73107 - DNA, 25 bp, S. pombe
acttgtggcgtcctaccgagaataa

SEQ ID NO: 73108 - DNA, 25 bp, S. pombe
acttcgtcttttgtgctggtgatga

SEQ ID NO: 73109 - DNA, 25 bp, S. pombe
acagtgtcaatgttcgcaaccgtga

SEQ ID NO: 73110 - DNA, 25 bp, S. pombe
acttgagcaatcttcacagcgtctt

SEQ ID NO: 73111 - DNA, 25 bp, S. pombe
acttcaccaggttgcttttgatgct

SEQ ID NO: 73112 - DNA, 25 bp, S. pombe
actaccctggtgtttctgatgttga

SEQ ID NO: 73113 - DNA, 25 bp, S. pombe
acttttctcgctagtgttgatcagc

SEQ ID NO: 73114 - DNA, 25 bp, S. pombe
actatgctccctcattttcagtaaa

SEQ ID NO: 73115 - DNA, 25 bp, S. pombe
acttcccactcgaatgttactcgaa

SEQ ID NO: 73116 - DNA, 25 bp, S. pombe
catcttcctgccaatggagttgaca

SEQ ID NO: 73117 - DNA, 25 bp, S. pombe
actacctccaactatttgcatgcaa

SEQ ID NO: 73118 - DNA, 25 bp, S. pombe
acataccagctcactgttggatcat

SEQ ID NO: 73119 - DNA, 25 bp, S. pombe
acatctctcgtcaaagtttccgtga

SEQ ID NO: 73120 - DNA, 25 bp, S. pombe
actattcgtccaagtgtctcacaag

SEQ ID NO: 73121 - DNA, 25 bp, S. pombe
acattcgcccaatggcatatgccaa

SEQ ID NO: 73122 - DNA, 25 bp, S. pombe
acaccgtcctcttgcgtggtaagaa

SEQ ID NO: 73123 - DNA, 25 bp, S. pombe
acacagtagccctggtttgcaacaa

SEQ ID NO: 73124 - DNA, 25 bp, S. pombe
acttcactgatttggagccctcatt

SEQ ID NO: 73125 - DNA, 25 bp, S. pombe
acattctcagagttgccttttcggt

SEQ ID NO: 73126 - DNA, 25 bp, S. pombe
acactaaagattgtgatttccgttc

SEQ ID NO: 73127 - DNA, 25 bp, S. pombe
acattgaccgttctgattttcgtga

SEQ ID NO: 73128 - DNA, 25 bp, S. pombe
acattggtgggactcgattttcgaa

SEQ ID NO: 73129 - DNA, 25 bp, S. pombe
actttgctcgtgcttattctttgaa

SEQ ID NO: 73130 - DNA, 25 bp, S. pombe
acatccgtcgtctttacctaaatag

SEQ ID NO: 73131 - DNA, 25 bp, S. pombe
acttcttctgtctcgggtaatgcta

SEQ ID NO: 73132 - DNA, 25 bp, S. pombe
actattctctgatgacattcctcaa

SEQ ID NO: 73133 - DNA, 25 bp, S. pombe
actttgcttcattcacttccatcta

SEQ ID NO: 73134 - DNA, 25 bp, S. pombe
acttccatcgactgcaactatactt

SEQ ID NO: 73135 - DNA, 25 bp, S. pombe
actttcatctgaagcgaacgcacct

SEQ ID NO: 73136 - DNA, 25 bp, S. pombe
actttctctgatattgactctgcca

SEQ ID NO: 73137 - DNA, 25 bp, S. pombe
acttatacgatggtgcgacgtgccc

SEQ ID NO: 73138 - DNA, 25 bp, S. pombe
acatggctcatgacttggccgatga

SEQ ID NO: 73139 - DNA, 25 bp, S. pombe
acatactactgtcgctgatactacc

SEQ ID NO: 73140 - DNA, 25 bp, S. pombe
acattcatgaagttctccgtctacg

SEQ ID NO: 73141 - DNA, 25 bp, S. pombe
acttctgcacgactttcatttgacg

SEQ ID NO: 73142 - DNA, 25 bp, S. pombe
acttctgccgagacatgatgtgtta

SEQ ID NO: 73143 - DNA, 25 bp, S. pombe
actttgctgctgttcatgactctta

SEQ ID NO: 73144 - DNA, 25 bp, S. pombe
actagaggcacttcagcaggagtcc

SEQ ID NO: 73145 - DNA, 25 bp, S. pombe
actatgagtgtttcgctgctattct

SEQ ID NO: 73146 - DNA, 25 bp, S. pombe
actagtttgcttagtgttggctgca

SEQ ID NO: 73147 - DNA, 25 bp, S. pombe
acttggtcttgatatgttacgccgt

SEQ ID NO: 73148 - DNA, 25 bp, S. pombe
acattggcgccatttttgaatctcc

SEQ ID NO: 73149 - DNA, 25 bp, S. pombe
actatggtcccttctatatttatgg

SEQ ID NO: 73150 - DNA, 25 bp, S. pombe
acttgggacctcgtatgtttgcatg

SEQ ID NO: 73151 - DNA, 25 bp, S. pombe
actttggaatccatgagctcttcat

SEQ ID NO: 73152 - DNA, 25 bp, S. pombe
actttgagtttgatgtcgatgctat

SEQ ID NO: 73153 - DNA, 25 bp, S. pombe
actatctggattattgcctgacatg

SEQ ID NO: 73154 - DNA, 25 bp, S. pombe
acttcatcttacagtccaatgccat

SEQ ID NO: 73155 - DNA, 25 bp, S. pombe
acttgtgtttggtgctactcattac

SEQ ID NO: 73156 - DNA, 25 bp, S. pombe
acttctcttcggcatcatttatgaa

SEQ ID NO: 73157 - DNA, 25 bp, S. pombe
acttctgcgtctggtggtcattata

SEQ ID NO: 73158 - DNA, 25 bp, S. pombe
acttgctttcatggctggtgctaat

SEQ ID NO: 73159 - DNA, 25 bp, S. pombe
acttcatgtggctctggtgtaactg

SEQ ID NO: 73160 - DNA, 25 bp, S. pombe
acatggctaagacacgtttcgcgta

SEQ ID NO: 73161 - DNA, 25 bp, S. pombe
acttgctacagacacctatgttcgt

SEQ ID NO: 73162 - DNA, 25 bp, S. pombe
actttatgaacgtgatgccagacaa

SEQ ID NO: 73163 - DNA, 25 bp, S. pombe
acttcactgatctgactttccttaa

SEQ ID NO: 73164 - DNA, 25 bp, S. pombe
acattcctaatggttctgtccttga

SEQ ID NO: 73165 - DNA, 25 bp, S. pombe
acttgtgcaaatcatgtcatcatac

SEQ ID NO: 73166 - DNA, 25 bp, S. pombe
actttcaaatcgacttctactccta

SEQ ID NO: 73167 - DNA, 25 bp, S. pombe
actttgatgggtcttcctcgagaga

SEQ ID NO: 73168 - DNA, 25 bp, S. pombe
actttgtcggacacctcatatgaga

SEQ ID NO: 73169 - DNA, 25 bp, S. pombe
actatagccgctgaacacattatta

SEQ ID NO: 73170 - DNA, 25 bp, S. pombe
acttttccattcctactttcatatt

SEQ ID NO: 73171 - DNA, 25 bp, S. pombe
acttgttgccaatgtttgtcctttg

SEQ ID NO: 73172 - DNA, 25 bp, S. pombe
acttgcttccagactgttttcagtt

SEQ ID NO: 73173 - DNA, 25 bp, S. pombe
acttcttcttactatcttcctgatt

SEQ ID NO: 73174 - DNA, 25 bp, S. pombe
acttttgctttctttgtggcgcata

SEQ ID NO: 73175 - DNA, 25 bp, S. pombe
acatgcttaaccagcctgtcgatga

SEQ ID NO: 73176 - DNA, 25 bp, S. pombe
acaagatcgacgagcctcggcagtt

SEQ ID NO: 73177 - DNA, 25 bp, S. pombe
acattgtcatgaagcttcctcgtgg

SEQ ID NO: 73178 - DNA, 25 bp, S. pombe
acttgtctcttggttgtgttggttt

SEQ ID NO: 73179 - DNA, 25 bp, S. pombe
actatgcctcttgtttctctgtatt

SEQ ID NO: 73180 - DNA, 25 bp, S. pombe
actattctcttcatttgttctctgt

SEQ ID NO: 73181 - DNA, 25 bp, S. pombe
acttctcctgtcacattgaatcctt

SEQ ID NO: 73182 - DNA, 25 bp, S. pombe
aaagtagtactctccattccaatcc

SEQ ID NO: 73183 - DNA, 25 bp, S. pombe
aaagccagtcgctccaaatggtatg

SEQ ID NO: 73184 - DNA, 25 bp, S. pombe
acttcgagatgtgtccaacaggaga

SEQ ID NO: 73185 - DNA, 25 bp, S. pombe
acataaaagctccttccgaatcttc

SEQ ID NO: 73186 - DNA, 25 bp, S. pombe
acttcataagctcaatatccctgtc

SEQ ID NO: 73187 - DNA, 25 bp, S. pombe
acattaagggccgtttcactgtcca

SEQ ID NO: 73188 - DNA, 25 bp, S. pombe
acttaggttgctgctgtttctgtac

SEQ ID NO: 73189 - DNA, 25 bp, S. pombe
acttacattgcgtgggtttgactga

SEQ ID NO: 73190 - DNA, 25 bp, S. pombe
acatgtcggccataaggtcttgcta

SEQ ID NO: 73191 - DNA, 25 bp, S. pombe
acttccacaaggactggcagcgtta

SEQ ID NO: 73192 - DNA, 25 bp, S. pombe
acattcctatacttctgggctttaa

SEQ ID NO: 73193 - DNA, 25 bp, S. pombe
acatttctaaagtctggcgcagtat

SEQ ID NO: 73194 - DNA, 25 bp, S. pombe
acatacttgctatttctgctcgggt

SEQ ID NO: 73195 - DNA, 25 bp, S. pombe
acatagctttaagatctggaggatc

SEQ ID NO: 73196 - DNA, 25 bp, S. pombe
acatatgctgcaacgacacctggag

SEQ ID NO: 73197 - DNA, 25 bp, S. pombe
acaagtcaccaatccggttggctta

SEQ ID NO: 73198 - DNA, 25 bp, S. pombe
acttttggcttttggtgtgttactg

SEQ ID NO: 73199 - DNA, 25 bp, S. pombe
acacactttccttatagcttttttg

SEQ ID NO: 73200 - DNA, 25 bp, S. pombe
acagccttgggcacatggtctttta

SEQ ID NO: 73201 - DNA, 25 bp, S. pombe
acagtttcaggcattggttcattta

SEQ ID NO: 73202 - DNA, 25 bp, S. pombe
acttctgtcggtgatggttctgtac

SEQ ID NO: 73203 - DNA, 25 bp, S. pombe
acttcttctagtggaggttctcagc

SEQ ID NO: 73204 - DNA, 25 bp, S. pombe
actttagcagtttgtcgtgtcattc

SEQ ID NO: 73205 - DNA, 25 bp, S. pombe
actttcacgtgttggcatgtctgta

SEQ ID NO: 73206 - DNA, 25 bp, S. pombe
actttacatacttcacttcttacta

SEQ ID NO: 73207 - DNA, 25 bp, S. pombe
acttaaatactcctatctccgacat

SEQ ID NO: 73208 - DNA, 25 bp, S. pombe
acatcgatacagctttgtctacctc

SEQ ID NO: 73209 - DNA, 25 bp, S. pombe
acatcagatggcgtccttttacagc

SEQ ID NO: 73210 - DNA, 25 bp, S. pombe
acattgattcattgccattcttccg

SEQ ID NO: 73211 - DNA, 25 bp, S. pombe
acattgctgatctggatattcccgt

SEQ ID NO: 73212 - DNA, 25 bp, S. pombe
acagcttgtcaacctatagccacag

SEQ ID NO: 73213 - DNA, 25 bp, S. pombe
acttttctcttgttttagcttctga

SEQ ID NO: 73214 - DNA, 25 bp, S. pombe
acttttccgtgagtttcagattcta

SEQ ID NO: 73215 - DNA, 25 bp, S. pombe
actttgttttgtactctgccatgca

SEQ ID NO: 73216 - DNA, 25 bp, S. pombe
acttactgttttaccgcttcatgac

SEQ ID NO: 73217 - DNA, 25 bp, S. pombe
acagaacttccttggctgcgtgtta

SEQ ID NO: 73218 - DNA, 25 bp, S. pombe
acatcgtgattgttgcttcggaaaa

SEQ ID NO: 73219 - DNA, 25 bp, S. pombe
acatgcactgtgagtcactccgtaa

SEQ ID NO: 73220 - DNA, 25 bp, S. pombe
acttttgatcccatccctaagaaga

SEQ ID NO: 73221 - DNA, 25 bp, S. pombe
acttttgcgcctactaccaagagaa

SEQ ID NO: 73222 - DNA, 25 bp, S. pombe
acttaaccttcttgctatggctgaa

SEQ ID NO: 73223 - DNA, 25 bp, S. pombe
acttgaacctgctttgtcggaaacg

SEQ ID NO: 73224 - DNA, 25 bp, S. pombe
actttcctagatgttcgtgagccag

SEQ ID NO: 73225 - DNA, 25 bp, S. pombe
acttgtctctagattttgcgagcca

SEQ ID NO: 73226 - DNA, 25 bp, S. pombe
acaccatctgatacttttaccctta

SEQ ID NO: 73227 - DNA, 25 bp, S. pombe
acatctccatgtactcaaatcacac

SEQ ID NO: 73228 - DNA, 25 bp, S. pombe
acatatatatcatcgcagtgctggt

SEQ ID NO: 73229 - DNA, 25 bp, S. pombe
acattgtcaatgtctctcgcgaata

SEQ ID NO: 73230 - DNA, 25 bp, S. pombe
acttgcaacttcttcagccgatgat

SEQ ID NO: 73231 - DNA, 25 bp, S. pombe
acttcaatgtctttcactgtctgat

SEQ ID NO: 73232 - DNA, 25 bp, S. pombe
acttgttactcatcagctctttgtc

SEQ ID NO: 73233 - DNA, 25 bp, S. pombe
acttttattatattctctctcctcc

SEQ ID NO: 73234 - DNA, 25 bp, S. pombe
acaggcctacttttctttcttactg

SEQ ID NO: 73235 - DNA, 25 bp, S. pombe
acaggcttactatttttgggacact

SEQ ID NO: 73236 - DNA, 25 bp, S. pombe
aaggatggcgatcaaactactttgt

SEQ ID NO: 73237 - DNA, 25 bp, S. pombe
acaggaggcctacaactaatttcaa

SEQ ID NO: 73238 - DNA, 25 bp, S. pombe
acatcggttccttcactatttacat

SEQ ID NO: 73239 - DNA, 25 bp, S. pombe
acattgtgtcgcctcagttatttaa

SEQ ID NO: 73240 - DNA, 25 bp, S. pombe
acatcgcgtgctttccatggaattg

SEQ ID NO: 73241 - DNA, 25 bp, S. pombe
aacgagcgcctctggtaaatgatcc

SEQ ID NO: 73242 - DNA, 25 bp, S. pombe
acatcgcaggcgacccagtaagaaa

SEQ ID NO: 73243 - DNA, 25 bp, S. pombe
acatcccggtcactcagttggtaaa

SEQ ID NO: 73244 - DNA, 25 bp, S. pombe
acttcacttgacttgcgttggcaaa

SEQ ID NO: 73245 - DNA, 25 bp, S. pombe
acatcctggcgatttagatcctgat

SEQ ID NO: 73246 - DNA, 25 bp, S. pombe
acacctgaggaaattgaagcttgga

SEQ ID NO: 73247 - DNA, 25 bp, S. pombe
acatctcgatctcagctgtgaagct

SEQ ID NO: 73248 - DNA, 25 bp, S. pombe
acttctggcagagcgtatatcttct

SEQ ID NO: 73249 - DNA, 25 bp, S. pombe
acttctgatcgttgctttaattgtc

SEQ ID NO: 73250 - DNA, 25 bp, S. pombe
acttttcaaccttctgcaattgtcc

SEQ ID NO: 73251 - DNA, 25 bp, S. pombe
acttcatcatcatcgtgtttcagga

SEQ ID NO: 73252 - DNA, 25 bp, S. pombe
acttgatatgtctttttgcacctga

SEQ ID NO: 73253 - DNA, 25 bp, S. pombe
acttgatttatcttcttgctgccat

SEQ ID NO: 73254 - DNA, 25 bp, S. pombe
acttgtatcttcacattgctcgagc

SEQ ID NO: 73255 - DNA, 25 bp, S. pombe
acagcattttcgtttggcatgggcc

SEQ ID NO: 73256 - DNA, 25 bp, S. pombe
acagatttgggattgcgtcgtggcc

SEQ ID NO: 73257 - DNA, 25 bp, S. pombe
acaggattcttggacgtcttatgcc

SEQ ID NO: 73258 - DNA, 25 bp, S. pombe
acagtgctcgttctttagggctatt

SEQ ID NO: 73259 - DNA, 25 bp, S. pombe
acatttctacattctttaggcgttt

SEQ ID NO: 73260 - DNA, 25 bp, S. pombe
acattcccaactattaacttcttcg

SEQ ID NO: 73261 - DNA, 25 bp, S. pombe
acttccttatcagaacttcctactt

SEQ ID NO: 73262 - DNA, 25 bp, S. pombe
acttggttccatgggattccgcaaa

SEQ ID NO: 73263 - DNA, 25 bp, S. pombe
acagggttccgtgggtcttcatgaa

SEQ ID NO: 73264 - DNA, 25 bp, S. pombe
acatgggcatcatttaacgcgtttg

SEQ ID NO: 73265 - DNA, 25 bp, S. pombe
acaggttctttatgcggattctcga

SEQ ID NO: 73266 - DNA, 25 bp, S. pombe
acttatttgttcttccgcagtacga

SEQ ID NO: 73267 - DNA, 25 bp, S. pombe
acttatttgtctgtctctgtggatt

SEQ ID NO: 73268 - DNA, 25 bp, S. pombe
acttagattcttttcacactggcga

SEQ ID NO: 73269 - DNA, 25 bp, S. pombe
acttctgtgtcttatcaaacggctg

SEQ ID NO: 73270 - DNA, 25 bp, S. pombe
acttcgtgatgttctacccatgggt

SEQ ID NO: 73271 - DNA, 25 bp, S. pombe
acttcgctagcttctgatacttggg

SEQ ID NO: 73272 - DNA, 25 bp, S. pombe
acattgcggtcttctgccagtagga

SEQ ID NO: 73273 - DNA, 25 bp, S. pombe
acacctttaattgcttacccattgc

SEQ ID NO: 73274 - DNA, 25 bp, S. pombe
acaccctcggttgttacatttctga

SEQ ID NO: 73275 - DNA, 25 bp, S. pombe
acatccccggtgttgaatttgtcat

SEQ ID NO: 73276 - DNA, 25 bp, S. pombe
taaccgcctgggaggtattggtccg

SEQ ID NO: 73277 - DNA, 25 bp, S. pombe
gaaacggctccgtggaaacttgcaa

SEQ ID NO: 73278 - DNA, 25 bp, S. pombe
acagcaagacttctgcaatctgggc

SEQ ID NO: 73279 - DNA, 25 bp, S. pombe
acatctgatgactcttcaatgcgat

SEQ ID NO: 73280 - DNA, 25 bp, S. pombe
acagcttccatccatatcgtcgata

SEQ ID NO: 73281 - DNA, 25 bp, S. pombe
acatgttcacattatccctcgtaaa

SEQ ID NO: 73282 - DNA, 25 bp, S. pombe
acagtgcaggacacaccgttcgaga

SEQ ID NO: 73283 - DNA, 25 bp, S. pombe
acagtcttgggcattggtcctgggc

SEQ ID NO: 73284 - DNA, 25 bp, S. pombe
acttcctttgggatccagtagtcta

SEQ ID NO: 73285 - DNA, 25 bp, S. pombe
acttcaattttggttctcgctaata

SEQ ID NO: 73286 - DNA, 25 bp, S. pombe
acttgcttttatcgtttgtctcaaa

SEQ ID NO: 73287 - DNA, 25 bp, S. pombe
aaatgctttagacgctttaccaact

SEQ ID NO: 73288 - DNA, 25 bp, S. pombe
acatttttagttatccaccagagct

SEQ ID NO: 73289 - DNA, 25 bp, S. pombe
acttctttggacgttgtctattctt

SEQ ID NO: 73290 - DNA, 25 bp, S. pombe
acattctttggtgttgtcagctctc

SEQ ID NO: 73291 - DNA, 25 bp, S. pombe
acatggcctggtccaagacttctaa

SEQ ID NO: 73292 - DNA, 25 bp, S. pombe
acatccctggcgtcgaaattgtcaa

SEQ ID NO: 73293 - DNA, 25 bp, S. pombe
acatcagcactcctactaaatcgta

SEQ ID NO: 73294 - DNA, 25 bp, S. pombe
acatatgcttcctctatggagttac

SEQ ID NO: 73295 - DNA, 25 bp, S. pombe
acatacgattgagcagttgaccatc

SEQ ID NO: 73296 - DNA, 25 bp, S. pombe
acaagcacggccgtggacacgttaa

SEQ ID NO: 73297 - DNA, 25 bp, S. pombe
acaggtcgccccagagacatttgga

SEQ ID NO: 73298 - DNA, 25 bp, S. pombe
acaggtccctaaatgcaacagttgc

SEQ ID NO: 73299 - DNA, 25 bp, S. pombe
acagcaatgcgccacacggagggtt

SEQ ID NO: 73300 - DNA, 25 bp, S. pombe
acatctacgtacttgagctctggtt

SEQ ID NO: 73301 - DNA, 25 bp, S. pombe
acatcttcttccaaagctcggtata

SEQ ID NO: 73302 - DNA, 25 bp, S. pombe
acttccctagaattcctgagcttat

SEQ ID NO: 73303 - DNA, 25 bp, S. pombe
acttctcaagtttgtccagtgtata

SEQ ID NO: 73304 - DNA, 25 bp, S. pombe
acatgtccggcgatgtcgatgaatc

SEQ ID NO: 73305 - DNA, 25 bp, S. pombe
acatatacgtggatcctcatgcggc

SEQ ID NO: 73306 - DNA, 25 bp, S. pombe
acttgcgagcttgttatgcgtgttt

SEQ ID NO: 73307 - DNA, 25 bp, S. pombe
acattgtacaagactgcccagaggc

SEQ ID NO: 73308 - DNA, 25 bp, S. pombe
acatctgtcatattggcactccggg

SEQ ID NO: 73309 - DNA, 25 bp, S. pombe
acatcatgcatttcggattacggtg

SEQ ID NO: 73310 - DNA, 25 bp, S. pombe
acatctgctttccacttacattttt

SEQ ID NO: 73311 - DNA, 25 bp, S. pombe
acattgctggccatttgacttcatt

SEQ ID NO: 73312 - DNA, 25 bp, S. pombe
acttgcctgcacatgttgactttat

SEQ ID NO: 73313 - DNA, 25 bp, S. pombe
acttgtgctgttgctacctctggaa

SEQ ID NO: 73314 - DNA, 25 bp, S. pombe
acatccttcttttgacttgcaagct

SEQ ID NO: 73315 - DNA, 25 bp, S. pombe
acatctgatttacgtgccgtctaca

SEQ ID NO: 73316 - DNA, 25 bp, S. pombe
acattgatgtcttctatccctgaac

SEQ ID NO: 73317 - DNA, 25 bp, S. pombe
acttgactctgctgatgccatggaa

SEQ ID NO: 73318 - DNA, 25 bp, S. pombe
tcctattcctaaacaaacgttcagt

SEQ ID NO: 73319 - DNA, 25 bp, S. pombe
acatttcacgcatacaaaccttcag

SEQ ID NO: 73320 - DNA, 25 bp, S. pombe
acatcttccaagagctagaccgtct

SEQ ID NO: 73321 - DNA, 25 bp, S. pombe
acatgtttcaaattcctggtggatt

SEQ ID NO: 73322 - DNA, 25 bp, S. pombe
acatgcttctgtaaacgcgttggag

SEQ ID NO: 73323 - DNA, 25 bp, S. pombe
acatacttgtcggatcaccaagaat

SEQ ID NO: 73324 - DNA, 25 bp, S. pombe
acatggcattatcgcactattagta

SEQ ID NO: 73325 - DNA, 25 bp, S. pombe
acatggattactttgctacggcaca

SEQ ID NO: 73326 - DNA, 25 bp, S. pombe
acattgggcacaaattacagcaggc

SEQ ID NO: 73327 - DNA, 25 bp, S. pombe
acttggcgcaagttgtctcgcagga

SEQ ID NO: 73328 - DNA, 25 bp, S. pombe
acttccagtgtatccagcgttgtca

SEQ ID NO: 73329 - DNA, 25 bp, S. pombe
acttgggctgtcttcggatgattta

SEQ ID NO: 73330 - DNA, 25 bp, S. pombe
acttggacattgttctacagtttag

SEQ ID NO: 73331 - DNA, 25 bp, S. pombe
acttgcatccattgtaataaattct

SEQ ID NO: 73332 - DNA, 25 bp, S. pombe
acttgacgacgtatcagccttgcta

SEQ ID NO: 73333 - DNA, 25 bp, S. pombe
acagtagcctgtttatcgagcctct

SEQ ID NO: 73334 - DNA, 25 bp, S. pombe
acattcgccttgttataactcctgt

SEQ ID NO: 73335 - DNA, 25 bp, S. pombe
acattcttcgtgattatagctccat

SEQ ID NO: 73336 - DNA, 25 bp, S. pombe
acattaatcactcagctgtcgcttt

SEQ ID NO: 73337 - DNA, 25 bp, S. pombe
acattacacctgctgcggagtttaa

SEQ ID NO: 73338 - DNA, 25 bp, S. pombe
acatcttcaacgtttggtctcctaa

SEQ ID NO: 73339 - DNA, 25 bp, S. pombe
acattttcgctgcttgtaacttgtg

SEQ ID NO: 73340 - DNA, 25 bp, S. pombe
acacgcatcgcaagtactctaacaa

SEQ ID NO: 73341 - DNA, 25 bp, S. pombe
acactccgtcgtactgcagaagaat

SEQ ID NO: 73342 - DNA, 25 bp, S. pombe
acacgcccctcaagaattgtcaagt

SEQ ID NO: 73343 - DNA, 25 bp, S. pombe
acaggcgccccaatatcagaggaac

SEQ ID NO: 73344 - DNA, 25 bp, S. pombe
acactttttccctcataaagccgag

SEQ ID NO: 73345 - DNA, 25 bp, S. pombe
acactttttcttcgcgccaaattcg

SEQ ID NO: 73346 - DNA, 25 bp, S. pombe
acattccttggttagatgccactat

SEQ ID NO: 73347 - DNA, 25 bp, S. pombe
acttgatgtcagctggattcgtgga

SEQ ID NO: 73348 - DNA, 25 bp, S. pombe
acatgtgctgttcttattcgtggac

SEQ ID NO: 73349 - DNA, 25 bp, S. pombe
acattgcgcctgaggttcttgctaa

SEQ ID NO: 73350 - DNA, 25 bp, S. pombe
acattcgagcatcagtgtgccttca

SEQ ID NO: 73351 - DNA, 25 bp, S. pombe
acattcgtgctgaattgcccttcat

SEQ ID NO: 73352 - DNA, 25 bp, S. pombe
acattctgggaggtgtcctttttgt

SEQ ID NO: 73353 - DNA, 25 bp, S. pombe
acagacgtattattggcttcgatcc

SEQ ID NO: 73354 - DNA, 25 bp, S. pombe
acaggcttcagatatggcttcgacc

SEQ ID NO: 73355 - DNA, 25 bp, S. pombe
acagttccagaagggttgcgcacat

SEQ ID NO: 73356 - DNA, 25 bp, S. pombe
acagtcttcgaagctgctgctaaca

SEQ ID NO: 73357 - DNA, 25 bp, S. pombe
acattcttcgtggtgttgctggagc

SEQ ID NO: 73358 - DNA, 25 bp, S. pombe
acattttttggacgtgtggcagcga

SEQ ID NO: 73359 - DNA, 25 bp, S. pombe
acattcattgggttgtattcctctg

SEQ ID NO: 73360 - DNA, 25 bp, S. pombe
acttggcgaagctttatgcgtcttt

SEQ ID NO: 73361 - DNA, 25 bp, S. pombe
acttgtcgagagttcttctgcttaa

SEQ ID NO: 73362 - DNA, 25 bp, S. pombe
acacgttatcaaagccctctcaaag

SEQ ID NO: 73363 - DNA, 25 bp, S. pombe
acattacacatcctgtgacctctta

SEQ ID NO: 73364 - DNA, 25 bp, S. pombe
acatttctccctaacgatgctgtag

SEQ ID NO: 73365 - DNA, 25 bp, S. pombe
acttggactctcttatcgacgtatg

SEQ ID NO: 73366 - DNA, 25 bp, S. pombe
acattggacttgctgacgactggaa

SEQ ID NO: 73367 - DNA, 25 bp, S. pombe
acttggcccttgaacgcacagaaga

SEQ ID NO: 73368 - DNA, 25 bp, S. pombe
acttgatccctgatattgacgacga

SEQ ID NO: 73369 - DNA, 25 bp, S. pombe
acttggctttctcttggcaatcatt

SEQ ID NO: 73370 - DNA, 25 bp, S. pombe
acagtggctctgaccgctatacaat

SEQ ID NO: 73371 - DNA, 25 bp, S. pombe
acattgcccgtggaatactgcgaat

SEQ ID NO: 73372 - DNA, 25 bp, S. pombe
acattccttgtgtaatttgcggagc

SEQ ID NO: 73373 - DNA, 25 bp, S. pombe
acatatcacctcttgtcagtgttga

SEQ ID NO: 73374 - DNA, 25 bp, S. pombe
acatccacatcgttgtctgctgtga

SEQ ID NO: 73375 - DNA, 25 bp, S. pombe
acatcgacacatggtttgattgcat

SEQ ID NO: 73376 - DNA, 25 bp, S. pombe
acattactgcgcgagttgttgctgt

SEQ ID NO: 73377 - DNA, 25 bp, S. pombe
acatgtccgtcttgtcattattcaa

SEQ ID NO: 73378 - DNA, 25 bp, S. pombe
acatcaccttagtcgttcatcatca

SEQ ID NO: 73379 - DNA, 25 bp, S. pombe
acatgatcctgttcttgccttattg

SEQ ID NO: 73380 - DNA, 25 bp, S. pombe
acaggcggccatgatgtctttacaa

SEQ ID NO: 73381 - DNA, 25 bp, S. pombe
acatggcaccttgtttgatttccca

SEQ ID NO: 73382 - DNA, 25 bp, S. pombe
cagcaccacagaagcgcagtacttg

SEQ ID NO: 73383 - DNA, 25 bp, S. pombe
acatgccatgctaactgcttgtcaa

SEQ ID NO: 73384 - DNA, 25 bp, S. pombe
acattccatgtggtgctcttacata

SEQ ID NO: 73385 - DNA, 25 bp, S. pombe
acattgctggcttggcattttctaa

SEQ ID NO: 73386 - DNA, 25 bp, S. pombe
acatctggtcagttcttattcataa

SEQ ID NO: 73387 - DNA, 25 bp, S. pombe
acaggtcatcgtgtcaatggcttca

SEQ ID NO: 73388 - DNA, 25 bp, S. pombe
acatcacgcattcctgtcaatggtt

SEQ ID NO: 73389 - DNA, 25 bp, S. pombe
acagtcctctacttgattcagttca

SEQ ID NO: 73390 - DNA, 25 bp, S. pombe
acagttcattatttcgtggcatcgt

SEQ ID NO: 73391 - DNA, 25 bp, S. pombe
acaggatgaaatgattgccaggcgt

SEQ ID NO: 73392 - DNA, 25 bp, S. pombe
acaggctgatgctgcttgtcaatgc

SEQ ID NO: 73393 - DNA, 25 bp, S. pombe
acaccggtgctattggatccagaac

SEQ ID NO: 73394 - DNA, 25 bp, S. pombe
acattcatgggtttggctgtttcaa

SEQ ID NO: 73395 - DNA, 25 bp, S. pombe
acatcgtgcgattccagttactaca

SEQ ID NO: 73396 - DNA, 25 bp, S. pombe
acagctggtattgcaggtgccgcac

SEQ ID NO: 73397 - DNA, 25 bp, S. pombe
acatatttgatcgttggctaccagg

SEQ ID NO: 73398 - DNA, 25 bp, S. pombe
acattctttcagatggtgctgcctc

SEQ ID NO: 73399 - DNA, 25 bp, S. pombe
acatgagcgcttcgatggttgtgcc

SEQ ID NO: 73400 - DNA, 25 bp, S. pombe
acaggcgttggatgtattcccttgg

SEQ ID NO: 73401 - DNA, 25 bp, S. pombe
acagggttcgatgtttccgcacgtt

SEQ ID NO: 73402 - DNA, 25 bp, S. pombe
acaggcttcattcggtcattattgg

SEQ ID NO: 73403 - DNA, 25 bp, S. pombe
acatggcttttgctggtttcggaac

SEQ ID NO: 73404 - DNA, 25 bp, S. pombe
acatggtatgttctggattctctaa

SEQ ID NO: 73405 - DNA, 25 bp, S. pombe
acagtgtttgatccggatactcctc

SEQ ID NO: 73406 - DNA, 25 bp, S. pombe
acagtttgtcattcgtcatcttctt

SEQ ID NO: 73407 - DNA, 25 bp, S. pombe
acattagctgtttctgctcctggtt

SEQ ID NO: 73408 - DNA, 25 bp, S. pombe
acattctctgtttgtgtctctgaac

SEQ ID NO: 73409 - DNA, 25 bp, S. pombe
acatttgtttcggttatagcagcat

SEQ ID NO: 73410 - DNA, 25 bp, S. pombe
acatttgtttaccattgccgcacat

SEQ ID NO: 73411 - DNA, 25 bp, S. pombe
acatggtcttacagttgatcctcga

SEQ ID NO: 73412 - DNA, 25 bp, S. pombe
acatggtttttggttgagcttgcac

SEQ ID NO: 73413 - DNA, 25 bp, S. pombe
acactgttatgcgttgggttcccaa

SEQ ID NO: 73414 - DNA, 25 bp, S. pombe
acattcggaggttcgcttagtcagt

SEQ ID NO: 73415 - DNA, 25 bp, S. pombe
acatctgggatgtctaccgtgagct

SEQ ID NO: 73416 - DNA, 25 bp, S. pombe
acatcctgctgagctacagttggct

SEQ ID NO: 73417 - DNA, 25 bp, S. pombe
acacgtctatacacatgttgctgat

SEQ ID NO: 73418 - DNA, 25 bp, S. pombe
acatcatgttaactccattccgatc

SEQ ID NO: 73419 - DNA, 25 bp, S. pombe
acatatttcagaacctgccctgatc

SEQ ID NO: 73420 - DNA, 25 bp, S. pombe
acattctttgcagtgttctccgtaa

SEQ ID NO: 73421 - DNA, 25 bp, S. pombe
acatcttcaagatatcctcgcggaa

SEQ ID NO: 73422 - DNA, 25 bp, S. pombe
acatctgctcaaacgtctcttaata

SEQ ID NO: 73423 - DNA, 25 bp, S. pombe
acatctgcgatcacgactttgactg

SEQ ID NO: 73424 - DNA, 25 bp, S. pombe
acatcttgtcccaatcatttgtcgt

SEQ ID NO: 73425 - DNA, 25 bp, S. pombe
acaccgcctgctattaattttacta

SEQ ID NO: 73426 - DNA, 25 bp, S. pombe
acacctccgttttcattttcttatg

SEQ ID NO: 73427 - DNA, 25 bp, S. pombe
acattcacactctttacttttcttg

SEQ ID NO: 73428 - DNA, 25 bp, S. pombe
acattcatccctattctttgtcatg

SEQ ID NO: 73429 - DNA, 25 bp, S. pombe
acatctgatcccagcattgtttctg

SEQ ID NO: 73430 - DNA, 25 bp, S. pombe
acacttaccaacctgtttcatgcgt

SEQ ID NO: 73431 - DNA, 25 bp, S. pombe
acatgctaatgtatcttcccttgaa

SEQ ID NO: 73432 - DNA, 25 bp, S. pombe
acagctgaaatgtcatcggccatga

SEQ ID NO: 73433 - DNA, 25 bp, S. pombe
acatcttccctatcatctagtgtgt

SEQ ID NO: 73434 - DNA, 25 bp, S. pombe
acatttccgtgatatttctcgcata

SEQ ID NO: 73435 - DNA, 25 bp, S. pombe
acagttactggatgtttctcgacaa

SEQ ID NO: 73436 - DNA, 25 bp, S. pombe
aaaaagctacttctaatgccaaaat

SEQ ID NO: 73437 - DNA, 25 bp, S. pombe
aaagaaatccccatcaccagtgttt

SEQ ID NO: 73438 - DNA, 25 bp, S. pombe
acaaacctctcatagttcgggtgcc

SEQ ID NO: 73439 - DNA, 25 bp, S. pombe
acaggtcgaggtggaacttctatat

SEQ ID NO: 73440 - DNA, 25 bp, S. pombe
acagcatccgaaaagcttcagtttt

SEQ ID NO: 73441 - DNA, 25 bp, S. pombe
acatctcgtaaaacatcggcctctt

SEQ ID NO: 73442 - DNA, 25 bp, S. pombe
acagccgtcaaaatatccgcaaatt

SEQ ID NO: 73443 - DNA, 25 bp, S. pombe
acagtcgctgaatctgctccaaaga

SEQ ID NO: 73444 - DNA, 25 bp, S. pombe
acaggtatcgtattgctttcagagg

SEQ ID NO: 73445 - DNA, 25 bp, S. pombe
acagtttatgcttgttcggcttgct

SEQ ID NO: 73446 - DNA, 25 bp, S. pombe
aagttgttcgttcaagcttgcttcc

SEQ ID NO: 73447 - DNA, 25 bp, S. pombe
acacatattcttggtggaacactat

SEQ ID NO: 73448 - DNA, 25 bp, S. pombe
acatcaattcctcagtcgtactatc

SEQ ID NO: 73449 - DNA, 25 bp, S. pombe
acatctttggatgttgtctactctt

SEQ ID NO: 73450 - DNA, 25 bp, S. pombe
acatcttcgttggtggtcatagcat

SEQ ID NO: 73451 - DNA, 25 bp, S. pombe
acatcttcgcctcctttaatgatac

SEQ ID NO: 73452 - DNA, 25 bp, S. pombe
acatgcgatgcccttctttataata

SEQ ID NO: 73453 - DNA, 25 bp, S. pombe
acatgcgtgatcgactatttactga

SEQ ID NO: 73454 - DNA, 25 bp, S. pombe
acatgcgtgaccttcatttgggaca

SEQ ID NO: 73455 - DNA, 25 bp, S. pombe
acatgtgtactattattcgatctca

SEQ ID NO: 73456 - DNA, 25 bp, S. pombe
acagctgttgtaattgattttccgc

SEQ ID NO: 73457 - DNA, 25 bp, S. pombe
acagtgcctggatgactttccgtgg

SEQ ID NO: 73458 - DNA, 25 bp, S. pombe
acatgaggctagtcaacctttccag

SEQ ID NO: 73459 - DNA, 25 bp, S. pombe
acatgggtgatcttgcgactttact

SEQ ID NO: 73460 - DNA, 25 bp, S. pombe
acagtgtttatgaaggacctgaaaa

SEQ ID NO: 73461 - DNA, 25 bp, S. pombe
acaggcaattatgggtactcgacaa

SEQ ID NO: 73462 - DNA, 25 bp, S. pombe
acatcttgttcttgtgttgctcgat

SEQ ID NO: 73463 - DNA, 25 bp, S. pombe
acatcattggctttttcgtgcgaaa

SEQ ID NO: 73464 - DNA, 25 bp, S. pombe
acatcattttccctacgatctgtaa

SEQ ID NO: 73465 - DNA, 25 bp, S. pombe
acagcttcacccgtcaaatctgaaa

SEQ ID NO: 73466 - DNA, 25 bp, S. pombe
acaaaatctactccaagtcgtccaa

SEQ ID NO: 73467 - DNA, 25 bp, S. pombe
acacctttattcatcgtcgtatcaa

SEQ ID NO: 73468 - DNA, 25 bp, S. pombe
acatctacttctttaagcagcagca

SEQ ID NO: 73469 - DNA, 25 bp, S. pombe
acaaatcttaccagcgacttccaaa

SEQ ID NO: 73470 - DNA, 25 bp, S. pombe
aaatgccttacgaggagttccgctc

SEQ ID NO: 73471 - DNA, 25 bp, S. pombe
acaaagtcatactggattgctctga

SEQ ID NO: 73472 - DNA, 25 bp, S. pombe
acagatgctctgaatgactcggcaa

SEQ ID NO: 73473 - DNA, 25 bp, S. pombe
acagctcatctatcaattgctattg

SEQ ID NO: 73474 - DNA, 25 bp, S. pombe
acagctcattgatcattccgttttt

SEQ ID NO: 73475 - DNA, 25 bp, S. pombe
acagcctctttcacgagtgttttct

SEQ ID NO: 73476 - DNA, 25 bp, S. pombe
acagcttctttacagttgtctctct

SEQ ID NO: 73477 - DNA, 25 bp, S. pombe
acagcgtatttgactttggatgacc

SEQ ID NO: 73478 - DNA, 25 bp, S. pombe
acaggtatttgctctttgttcttaa

SEQ ID NO: 73479 - DNA, 25 bp, S. pombe
aagcgatgctctctgcaatcatgaa

SEQ ID NO: 73480 - DNA, 25 bp, S. pombe
acagcgagcctgatcttgagaaagt

SEQ ID NO: 73481 - DNA, 25 bp, S. pombe
acaggtgcctctttcagtcaatact

SEQ ID NO: 73482 - DNA, 25 bp, S. pombe
acacctgcttctgtgcgtcaaagta

SEQ ID NO: 73483 - DNA, 25 bp, S. pombe
acatccctatttagctgtttggcat

SEQ ID NO: 73484 - DNA, 25 bp, S. pombe
acatgcctcttgcacttattgtgtc

SEQ ID NO: 73485 - DNA, 25 bp, S. pombe
acatgcctgattcccctgatagtta

SEQ ID NO: 73486 - DNA, 25 bp, S. pombe
acatcctgatgtttccgaagctgtt

SEQ ID NO: 73487 - DNA, 25 bp, S. pombe
acagtaggtatttgcttagctcaac

SEQ ID NO: 73488 - DNA, 25 bp, S. pombe
acatccggtgattatattgcaagtg

SEQ ID NO: 73489 - DNA, 25 bp, S. pombe
acatggcctggtgctcttcagattg

SEQ ID NO: 73490 - DNA, 25 bp, S. pombe
acaggactatgtttctcgcgacgta

SEQ ID NO: 73491 - DNA, 25 bp, S. pombe
acagctgagcccgtttttaacttat

SEQ ID NO: 73492 - DNA, 25 bp, S. pombe
acaaggccccttataatgcttattt

SEQ ID NO: 73493 - DNA, 25 bp, S. pombe
acaaagcccggaattcaagcctacg

SEQ ID NO: 73494 - DNA, 25 bp, S. pombe
acagccaagacttagtccttccaaa

SEQ ID NO: 73495 - DNA, 25 bp, S. pombe
acaccaatgattccgtaattcccaa

SEQ ID NO: 73496 - DNA, 25 bp, S. pombe
acagctgctgtgctttctgaagtct

SEQ ID NO: 73497 - DNA, 25 bp, S. pombe
aacgagtatattgattaaggattag

SEQ ID NO: 73498 - DNA, 25 bp, S. pombe
aacgagtatattgattaaggattag

SEQ ID NO: 73499 - DNA, 25 bp, S. pombe
acagtctcttcgcagaacaggtcgt

SEQ ID NO: 73500 - DNA, 25 bp, S. pombe
acagctttcactacaaactgagttg

SEQ ID NO: 73501 - DNA, 25 bp, S. pombe
acatctccgccaagtccaattataa

SEQ ID NO: 73502 - DNA, 25 bp, S. pombe
acatctccgtcatgttcctgaatat

SEQ ID NO: 73503 - DNA, 25 bp, S. pombe
acatctgcacccttttgctttaaaa

SEQ ID NO: 73504 - DNA, 25 bp, S. pombe
acatgcctgccatttggtctttgaa

SEQ ID NO: 73505 - DNA, 25 bp, S. pombe
aactaacttaactcacggatgtaca

SEQ ID NO: 73506 - DNA, 25 bp, S. pombe
aaaaaatttacatcgccagcaacca

SEQ ID NO: 73507 - DNA, 25 bp, S. pombe
acaaaccgttgatcattccgagacc

SEQ ID NO: 73508 - DNA, 25 bp, S. pombe
acagcttcgggtacgtctactggta

SEQ ID NO: 73509 - DNA, 25 bp, S. pombe
acaggaatttctgctccctatgagg

SEQ ID NO: 73510 - DNA, 25 bp, S. pombe
acagtatatttcagcccgttggcgc

SEQ ID NO: 73511 - DNA, 25 bp, S. pombe
acagatttggagttaatgggtcaga

SEQ ID NO: 73512 - DNA, 25 bp, S. pombe
acaaggtgtggttcaagtgcgtcaa

SEQ ID NO: 73513 - DNA, 25 bp, S. pombe
acagacttgtatgcctgtggcgcta

SEQ ID NO: 73514 - DNA, 25 bp, S. pombe
acaggctcagaagctctaatggcta

SEQ ID NO: 73515 - DNA, 25 bp, S. pombe
acagagctcagtttctcgtttggag

SEQ ID NO: 73516 - DNA, 25 bp, S. pombe
acaatgctttcattccgtttggaga

SEQ ID NO: 73517 - DNA, 25 bp, S. pombe
acatgactgttggtcgcgttgggac

SEQ ID NO: 73518 - DNA, 25 bp, S. pombe
acatccttctgttcccattggtagt

SEQ ID NO: 73519 - DNA, 25 bp, S. pombe
acatccttcgatggcattcttggtg

SEQ ID NO: 73520 - DNA, 25 bp, S. pombe
acagtcattcgcgtgctttggagtc

SEQ ID NO: 73521 - DNA, 25 bp, S. pombe
acagattcacccagtattggcgaat

SEQ ID NO: 73522 - DNA, 25 bp, S. pombe
aaagattactcgtgatccggaattc

SEQ ID NO: 73523 - DNA, 25 bp, S. pombe
acaagtgtaccgttgcttcgtcaaa

SEQ ID NO: 73524 - DNA, 25 bp, S. pombe
acagttggcaagtctcggatgggtt

SEQ ID NO: 73525 - DNA, 25 bp, S. pombe
acaggactaatctttgcctcagtta

SEQ ID NO: 73526 - DNA, 25 bp, S. pombe
acagggctttattgttcgtgctcaa

SEQ ID NO: 73527 - DNA, 25 bp, S. pombe
acagctttggctatttctcttattg

SEQ ID NO: 73528 - DNA, 25 bp, S. pombe
acagcttgggtgtcattgttcgtga

SEQ ID NO: 73529 - DNA, 25 bp, S. pombe
acagcttcagtgctcatttgatcag

SEQ ID NO: 73530 - DNA, 25 bp, S. pombe
acagctatcggcaaatcatctacag

SEQ ID NO: 73531 - DNA, 25 bp, S. pombe
acatgaacgctggatctttgactga

SEQ ID NO: 73532 - DNA, 25 bp, S. pombe
aatgcctccaggattaccggacgaa

SEQ ID NO: 73533 - DNA, 25 bp, S. pombe
acaaaaaattatcctccacttctca

SEQ ID NO: 73534 - DNA, 25 bp, S. pombe
acagctcgacgattaaaccgtgttt

SEQ ID NO: 73535 - DNA, 25 bp, S. pombe
acagcgcgaggattcaaccatcgat

SEQ ID NO: 73536 - DNA, 25 bp, S. pombe
acatgcgcaatgataccccaggtaa

SEQ ID NO: 73537 - DNA, 25 bp, S. pombe
acatgcatgatatgtctgcctctca

SEQ ID NO: 73538 - DNA, 25 bp, S. pombe
acacagatgcagactttgagcagca

SEQ ID NO: 73539 - DNA, 25 bp, S. pombe
acaaacggatttgctttcaccactt

SEQ ID NO: 73540 - DNA, 25 bp, S. pombe
acaaaaagtcttctgtctcaccggt

SEQ ID NO: 73541 - DNA, 25 bp, S. pombe
acaaacaactcaaacgtcgaccatc

SEQ ID NO: 73542 - DNA, 25 bp, S. pombe
aaattgtcaaagctactccccaagt

SEQ ID NO: 73543 - DNA, 25 bp, S. pombe
acaatgccgggtctgagaaactcat

SEQ ID NO: 73544 - DNA, 25 bp, S. pombe
acactgcgcgaagtcattcgtacta

SEQ ID NO: 73545 - DNA, 25 bp, S. pombe
acagcaggatgtcgaggcacttcaa

SEQ ID NO: 73546 - DNA, 25 bp, S. pombe
acagcgctcgtgaggcattacaact

SEQ ID NO: 73547 - DNA, 25 bp, S. pombe
acatggctcgtgaacgtcttcatat

SEQ ID NO: 73548 - DNA, 25 bp, S. pombe
acagttcaattctagtccgtttggg

SEQ ID NO: 73549 - DNA, 25 bp, S. pombe
acaacaacgttgactctaccggcat

SEQ ID NO: 73550 - DNA, 25 bp, S. pombe
acacatcccgttccattattcgtaa

SEQ ID NO: 73551 - DNA, 25 bp, S. pombe
gaaggattgactctgggtaccgcca

SEQ ID NO: 73552 - DNA, 25 bp, S. pombe
acacgcactatcagaaaacctcctt

SEQ ID NO: 73553 - DNA, 25 bp, S. pombe
acacacctcctcctaattatgatga

SEQ ID NO: 73554 - DNA, 25 bp, S. pombe
acagctcctgactttgagacttcaa

SEQ ID NO: 73555 - DNA, 25 bp, S. pombe
acagttctctgatggcgttggttat

SEQ ID NO: 73556 - DNA, 25 bp, S. pombe
acacttacgtcccagtcagatttgt

SEQ ID NO: 73557 - DNA, 25 bp, S. pombe
aacttgtcagtcaaactcgtttctt

SEQ ID NO: 73558 - DNA, 25 bp, S. pombe
acacccgtaggaatgcacctttgca

SEQ ID NO: 73559 - DNA, 25 bp, S. pombe
acaggctcctgaaaatccgtttaga

SEQ ID NO: 73560 - DNA, 25 bp, S. pombe
acagcagcacggtcttacttggaaa

SEQ ID NO: 73561 - DNA, 25 bp, S. pombe
acagctctgagcatttacttggaaa

SEQ ID NO: 73562 - DNA, 25 bp, S. pombe
acagcactgagccaattccattttc

SEQ ID NO: 73563 - DNA, 25 bp, S. pombe
acagctcatcctgctaagtttgaca

SEQ ID NO: 73564 - DNA, 25 bp, S. pombe
acaggatcctcctttgtggcagata

SEQ ID NO: 73565 - DNA, 25 bp, S. pombe
acactgccctacttcactatatgaa

SEQ ID NO: 73566 - DNA, 25 bp, S. pombe
acacatgctgctatcgaatcttaca

SEQ ID NO: 73567 - DNA, 25 bp, S. pombe
aaaattcctaccacttacgctggag

SEQ ID NO: 73568 - DNA, 25 bp, S. pombe
aaacgttttggcatttaccatgagg

SEQ ID NO: 73569 - DNA, 25 bp, S. pombe
aaactagttggtatctttcctggtg

SEQ ID NO: 73570 - DNA, 25 bp, S. pombe
aacactaggaatgtttgtcctttgg

SEQ ID NO: 73571 - DNA, 25 bp, S. pombe
acagccgaaagtgcttcttccaaag

SEQ ID NO: 73572 - DNA, 25 bp, S. pombe
acagacttgaccatattgcgaccag

SEQ ID NO: 73573 - DNA, 25 bp, S. pombe
acaagaaggctcaccgtaacggtat

SEQ ID NO: 73574 - DNA, 25 bp, S. pombe
acacacccttttctgaactctgaaa

SEQ ID NO: 73575 - DNA, 25 bp, S. pombe
acaccgatcttgttgaagcccttga

SEQ ID NO: 73576 - DNA, 25 bp, S. pombe
acagtagtctcgttagtgcttttga

SEQ ID NO: 73577 - DNA, 25 bp, S. pombe
acatggcgagccttggatagtttag

SEQ ID NO: 73578 - DNA, 25 bp, S. pombe
acagaagaccttcgccgatttggag

SEQ ID NO: 73579 - DNA, 25 bp, S. pombe
acagtaatccttcctcatttttaga

SEQ ID NO: 73580 - DNA, 25 bp, S. pombe
acaagagtacgcaaacctgattaaa

SEQ ID NO: 73581 - DNA, 25 bp, S. pombe
acaaaagcagtgagcatgggttaca

SEQ ID NO: 73582 - DNA, 25 bp, S. pombe
acaactcaccatcacgagagctgga

SEQ ID NO: 73583 - DNA, 25 bp, S. pombe
acaagcgattcaagtggacccctat

SEQ ID NO: 73584 - DNA, 25 bp, S. pombe
acacagaatgtcaagcgcgtcctac

SEQ ID NO: 73585 - DNA, 25 bp, S. pombe
acaacaactctgtgcgatgccatat

SEQ ID NO: 73586 - DNA, 25 bp, S. pombe
acaagctattcgtggatttatggac

SEQ ID NO: 73587 - DNA, 25 bp, S. pombe
acaccccactgctaatcgaattgat

SEQ ID NO: 73588 - DNA, 25 bp, S. pombe
acagtcagtcgtttagctttagaaa

SEQ ID NO: 73589 - DNA, 25 bp, S. pombe
acagatcctcctttacattttgaaa

SEQ ID NO: 73590 - DNA, 25 bp, S. pombe
acagctcctatttcttctttgcaat

SEQ ID NO: 73591 - DNA, 25 bp, S. pombe
acacgcaacattcttttccaatttc

SEQ ID NO: 73592 - DNA, 25 bp, S. pombe
acacctattgtgttgatgcctttgt

SEQ ID NO: 73593 - DNA, 25 bp, S. pombe
acactgctcagtcatggtatacgct

SEQ ID NO: 73594 - DNA, 25 bp, S. pombe
acacttcgcgaacgtgattctacta

SEQ ID NO: 73595 - DNA, 25 bp, S. pombe
acacttatcgtcctgttccgtaaat

SEQ ID NO: 73596 - DNA, 25 bp, S. pombe
acactaatcgtgttttgccctcaaa

SEQ ID NO: 73597 - DNA, 25 bp, S. pombe
acaagcatattgtgattatgaggcc

SEQ ID NO: 73598 - DNA, 25 bp, S. pombe
acaacgctatgtatcgaggccgggt

SEQ ID NO: 73599 - DNA, 25 bp, S. pombe
aaatctgtttactccaaagcttgca

SEQ ID NO: 73600 - DNA, 25 bp, S. pombe
aagtttttagcacccacggatcgat

SEQ ID NO: 73601 - DNA, 25 bp, S. pombe
acagttcttatttcccaggtgttct

SEQ ID NO: 73602 - DNA, 25 bp, S. pombe
acaggtcttgtttttgcggttgcat

SEQ ID NO: 73603 - DNA, 25 bp, S. pombe
acaaagtcggtttcaatcgcttctt

SEQ ID NO: 73604 - DNA, 25 bp, S. pombe
acaaaacttttcaatggcagccggg

SEQ ID NO: 73605 - DNA, 25 bp, S. pombe
acagaattactttcattccgccgga

SEQ ID NO: 73606 - DNA, 25 bp, S. pombe
acagtaacaccaagcagttcctctt

SEQ ID NO: 73607 - DNA, 25 bp, S. pombe
acagatttcacatctcgaatcccaa

SEQ ID NO: 73608 - DNA, 25 bp, S. pombe
aaatttagcatttgaactttccgat

SEQ ID NO: 73609 - DNA, 25 bp, S. pombe
acaggttttacattcactccatcaa

SEQ ID NO: 73610 - DNA, 25 bp, S. pombe
acactggttctatatctgcttcaca

SEQ ID NO: 73611 - DNA, 25 bp, S. pombe
acactgggactgttgtagctcgcga

SEQ ID NO: 73612 - DNA, 25 bp, S. pombe
acacgcatggactatttaacgctga

SEQ ID NO: 73613 - DNA, 25 bp, S. pombe
acagcgattgacttcattataccaa

SEQ ID NO: 73614 - DNA, 25 bp, S. pombe
acagccaggtgatctatcttttcaa

SEQ ID NO: 73615 - DNA, 25 bp, S. pombe
acagctctcgtttcattcctttgaa

SEQ ID NO: 73616 - DNA, 25 bp, S. pombe
acaccgctgcttacagtcgttgtga

SEQ ID NO: 73617 - DNA, 25 bp, S. pombe
acacctctctttcctattctaaata

SEQ ID NO: 73618 - DNA, 25 bp, S. pombe
acagcctcttcttttgcacatacta

SEQ ID NO: 73619 - DNA, 25 bp, S. pombe
acagcactcttcttttcgatgttga

SEQ ID NO: 73620 - DNA, 25 bp, S. pombe
acagctcctgtccaacaatctaaag

SEQ ID NO: 73621 - DNA, 25 bp, S. pombe
acagcctctagtacaacatcttcat

SEQ ID NO: 73622 - DNA, 25 bp, S. pombe
acagtctacagtacccagcatattc

SEQ ID NO: 73623 - DNA, 25 bp, S. pombe
acagaatgccaacctcaactttgag

SEQ ID NO: 73624 - DNA, 25 bp, S. pombe
acagaatgccggttctgccatgtta

SEQ ID NO: 73625 - DNA, 25 bp, S. pombe
acaaatgtgcgcctgttccagttaa

SEQ ID NO: 73626 - DNA, 25 bp, S. pombe
acacgaattatgatgcctacgctta

SEQ ID NO: 73627 - DNA, 25 bp, S. pombe
acagccagctttgctttatctcagt

SEQ ID NO: 73628 - DNA, 25 bp, S. pombe
acagatccttgttttttagtggtca

SEQ ID NO: 73629 - DNA, 25 bp, S. pombe
acagatggtttactattctcttggt

SEQ ID NO: 73630 - DNA, 25 bp, S. pombe
aaatgccagttctccattggacgtt

SEQ ID NO: 73631 - DNA, 25 bp, S. pombe
acacattattaccattttgccgaga

SEQ ID NO: 73632 - DNA, 25 bp, S. pombe
acaccacttggattgagcttacaga

SEQ ID NO: 73633 - DNA, 25 bp, S. pombe
acacgcactgtgttttgaatgacaa

SEQ ID NO: 73634 - DNA, 25 bp, S. pombe
acaccactgtattttgggccgctat

SEQ ID NO: 73635 - DNA, 25 bp, S. pombe
acaaattgtattgtgggccggattt

SEQ ID NO: 73636 - DNA, 25 bp, S. pombe
acacgacgttctggttcgcacttag

SEQ ID NO: 73637 - DNA, 25 bp, S. pombe
acagagtcgattacagattccactg

SEQ ID NO: 73638 - DNA, 25 bp, S. pombe
acacaacagacactcgtactcatta

SEQ ID NO: 73639 - DNA, 25 bp, S. pombe
acacttttaccagctgtgaggcttt

SEQ ID NO: 73640 - DNA, 25 bp, S. pombe
acactggtggtatcttttcctcata

SEQ ID NO: 73641 - DNA, 25 bp, S. pombe
acactaatgggcacgctattcctat

SEQ ID NO: 73642 - DNA, 25 bp, S. pombe
aaagtacactctagtcgggcgtcct

SEQ ID NO: 73643 - DNA, 25 bp, S. pombe
acacctcctgtacatccgattgata

SEQ ID NO: 73644 - DNA, 25 bp, S. pombe
acacggcgttaccagacgttacaga

SEQ ID NO: 73645 - DNA, 25 bp, S. pombe
acactgccagttacctacgtttatg

SEQ ID NO: 73646 - DNA, 25 bp, S. pombe
acacttatatcgaatctctctccag

SEQ ID NO: 73647 - DNA, 25 bp, S. pombe
acaagctgatgctcaatctttcaag

SEQ ID NO: 73648 - DNA, 25 bp, S. pombe
acacagctgctggaaacctcttaaa

SEQ ID NO: 73649 - DNA, 25 bp, S. pombe
ccaagtaggcggtttcaatctttgt

SEQ ID NO: 73650 - DNA, 25 bp, S. pombe
acaactagtgcgattgctaccaatt

SEQ ID NO: 73651 - DNA, 25 bp, S. pombe
acagatgctttcttttgtagccgaa

SEQ ID NO: 73652 - DNA, 25 bp, S. pombe
acagagttctttccggattcagaca

SEQ ID NO: 73653 - DNA, 25 bp, S. pombe
acaagtttcactctgaatccagctc

SEQ ID NO: 73654 - DNA, 25 bp, S. pombe
acagacctgatcttttagacccatc

SEQ ID NO: 73655 - DNA, 25 bp, S. pombe
acacgtagcctgtggtgcacttgtc

SEQ ID NO: 73656 - DNA, 25 bp, S. pombe
acacagtcggtggtggtgcctatga

SEQ ID NO: 73657 - DNA, 25 bp, S. pombe
acacgctctggtgatgatctccgta

SEQ ID NO: 73658 - DNA, 25 bp, S. pombe
acaccatcgcctgcaatttcagaat

SEQ ID NO: 73659 - DNA, 25 bp, S. pombe
acacgcaatgcgcttgtttcatgaa

SEQ ID NO: 73660 - DNA, 25 bp, S. pombe
acagcattacaggtcattcgtcaaa

SEQ ID NO: 73661 - DNA, 25 bp, S. pombe
aaattgctgaaacatctcttactga

SEQ ID NO: 73662 - DNA, 25 bp, S. pombe
acaaagtggcattgcgtctctcgtt

SEQ ID NO: 73663 - DNA, 25 bp, S. pombe
acagatgatggtttggctgccctta

SEQ ID NO: 73664 - DNA, 25 bp, S. pombe
acagatctgggatactgccggtcag

SEQ ID NO: 73665 - DNA, 25 bp, S. pombe
acagattccacggttgcttcaatta

SEQ ID NO: 73666 - DNA, 25 bp, S. pombe
acacgcagccctttatatatggtaa

SEQ ID NO: 73667 - DNA, 25 bp, S. pombe
aaattattgcttctcgggactactg

SEQ ID NO: 73668 - DNA, 25 bp, S. pombe
aagcattacgttcacgagtacccga

SEQ ID NO: 73669 - DNA, 25 bp, S. pombe
aaatactaaggtcgcgagtgcccgt

SEQ ID NO: 73670 - DNA, 25 bp, S. pombe
acaaaatcacattcgggaggcccat

SEQ ID NO: 73671 - DNA, 25 bp, S. pombe
acagaagctgatctcgcggttgcaa

SEQ ID NO: 73672 - DNA, 25 bp, S. pombe
acactttacgttccagagcaatgct

SEQ ID NO: 73673 - DNA, 25 bp, S. pombe
acactcctcctaaagaagactctat

SEQ ID NO: 73674 - DNA, 25 bp, S. pombe
acacacatacttacttctgttcgat

SEQ ID NO: 73675 - DNA, 25 bp, S. pombe
acaactacgtactggctgcagctat

SEQ ID NO: 73676 - DNA, 25 bp, S. pombe
acagagcgctttggttgccttttta

SEQ ID NO: 73677 - DNA, 25 bp, S. pombe
acagcagcgtttgttgtcttggcat

SEQ ID NO: 73678 - DNA, 25 bp, S. pombe
acaacgtatgcgtcggcagcttgaa

SEQ ID NO: 73679 - DNA, 25 bp, S. pombe
acaagctcttcgtcgtcgtatattt

SEQ ID NO: 73680 - DNA, 25 bp, S. pombe
acacactgctgttggcgtcgaaact

SEQ ID NO: 73681 - DNA, 25 bp, S. pombe
acagccattgtattgcatgtcgaat

SEQ ID NO: 73682 - DNA, 25 bp, S. pombe
acaagcgtgctcgtgctggtgagat

SEQ ID NO: 73683 - DNA, 25 bp, S. pombe
acaacctgctgcaccggtgaaatct

SEQ ID NO: 73684 - DNA, 25 bp, S. pombe
acaacctcgttgagcgcttggctga

SEQ ID NO: 73685 - DNA, 25 bp, S. pombe
acagacccagtttgcgcttttgaca

SEQ ID NO: 73686 - DNA, 25 bp, S. pombe
acagcaggccaggttggttctttac

SEQ ID NO: 73687 - DNA, 25 bp, S. pombe
acagcgattgctttagtctatttgc

SEQ ID NO: 73688 - DNA, 25 bp, S. pombe
acactgattctatagctgctgctgc

SEQ ID NO: 73689 - DNA, 25 bp, S. pombe
acagctgctactttagcttctgaaa

SEQ ID NO: 73690 - DNA, 25 bp, S. pombe
acactctactttatatgccacactg

SEQ ID NO: 73691 - DNA, 25 bp, S. pombe
acacctcaagtttgttgccaggctt

SEQ ID NO: 73692 - DNA, 25 bp, S. pombe
aaattggatctcacttcccttttca

SEQ ID NO: 73693 - DNA, 25 bp, S. pombe
acacactacactttttccatcattt

SEQ ID NO: 73694 - DNA, 25 bp, S. pombe
acacttcacattcatttccattcat

SEQ ID NO: 73695 - DNA, 25 bp, S. pombe
acacctcataactctgtcaagctta

SEQ ID NO: 73696 - DNA, 25 bp, S. pombe
acacatcagctagattactggcgtt

SEQ ID NO: 73697 - DNA, 25 bp, S. pombe
aaataggacttgcacgcgtttcatc

SEQ ID NO: 73698 - DNA, 25 bp, S. pombe
acaaacatacgtgtcgctgctttca

SEQ ID NO: 73699 - DNA, 25 bp, S. pombe
acagctagcttaggttccgtgacta

SEQ ID NO: 73700 - DNA, 25 bp, S. pombe
acagcaagcgttcttccggtatatc

SEQ ID NO: 73701 - DNA, 25 bp, S. pombe
acactgcactcctgtgtctagaagt

SEQ ID NO: 73702 - DNA, 25 bp, S. pombe
acagcagttcgtttctgactttcaa

SEQ ID NO: 73703 - DNA, 25 bp, S. pombe
acaagcgcgcttaccaaatgctagg

SEQ ID NO: 73704 - DNA, 25 bp, S. pombe
acacacgtttcgacacaattgcttc

SEQ ID NO: 73705 - DNA, 25 bp, S. pombe
acaacgtctagggaattatcttcta

SEQ ID NO: 73706 - DNA, 25 bp, S. pombe
aaatttttgtatctaaggtgccata

SEQ ID NO: 73707 - DNA, 25 bp, S. pombe
aaactccattcctctagatttcgat

SEQ ID NO: 73708 - DNA, 25 bp, S. pombe
aactcctcccgatacgattatacag

SEQ ID NO: 73709 - DNA, 25 bp, S. pombe
acaccgctcccgttattttattatg

SEQ ID NO: 73710 - DNA, 25 bp, S. pombe
acactcgtcctacgttttttggatg

SEQ ID NO: 73711 - DNA, 25 bp, S. pombe
acactttgccgtgcattatctggga

SEQ ID NO: 73712 - DNA, 25 bp, S. pombe
acacctggtgatgttatcttgcaat

SEQ ID NO: 73713 - DNA, 25 bp, S. pombe
acactgttggtcctaacttcaagca

SEQ ID NO: 73714 - DNA, 25 bp, S. pombe
acaccgggatctctggaatgaacac

SEQ ID NO: 73715 - DNA, 25 bp, S. pombe
acaacttggaccttggagattcgcc

SEQ ID NO: 73716 - DNA, 25 bp, S. pombe
acaagtttttccgaagtgttggatg

SEQ ID NO: 73717 - DNA, 25 bp, S. pombe
acaaagctagtcttcataaggatgt

SEQ ID NO: 73718 - DNA, 25 bp, S. pombe
acaattgcgaattctcccaggatgg

SEQ ID NO: 73719 - DNA, 25 bp, S. pombe
acaacaggtatgtccctcagtggaa

SEQ ID NO: 73720 - DNA, 25 bp, S. pombe
acaactggtgctgccgctggtggaa

SEQ ID NO: 73721 - DNA, 25 bp, S. pombe
acaactgtggcgcaccgtaggaata

SEQ ID NO: 73722 - DNA, 25 bp, S. pombe
acactcttctcctttcgtagtgaaa

SEQ ID NO: 73723 - DNA, 25 bp, S. pombe
acagctttcgcttattttggtagat

SEQ ID NO: 73724 - DNA, 25 bp, S. pombe
acacatgcttccatacttcggtatg

SEQ ID NO: 73725 - DNA, 25 bp, S. pombe
acaacttcccgagatagcgtttaat

SEQ ID NO: 73726 - DNA, 25 bp, S. pombe
aaagttacgtttctgaacctgtcat

SEQ ID NO: 73727 - DNA, 25 bp, S. pombe
aaagttgcggctctgggaccttgta

SEQ ID NO: 73728 - DNA, 25 bp, S. pombe
acaaggctcttacttcacgttttga

SEQ ID NO: 73729 - DNA, 25 bp, S. pombe
acacagttgctttctcgtcgtttaa

SEQ ID NO: 73730 - DNA, 25 bp, S. pombe
acaatggagctttgggccctgttca

SEQ ID NO: 73731 - DNA, 25 bp, S. pombe
aaattgttttggcagctcagaatca

SEQ ID NO: 73732 - DNA, 25 bp, S. pombe
acaaatgttctattgctagccgtat

SEQ ID NO: 73733 - DNA, 25 bp, S. pombe
acacatctttcatatgttgactaag

SEQ ID NO: 73734 - DNA, 25 bp, S. pombe
acaccactggcaactcttacagtag

SEQ ID NO: 73735 - DNA, 25 bp, S. pombe
acaaaatccattgcttatgccccaa

SEQ ID NO: 73736 - DNA, 25 bp, S. pombe
acaaataccttgagtgttctgccaa

SEQ ID NO: 73737 - DNA, 25 bp, S. pombe
aaacctgccgttattggtattccat

SEQ ID NO: 73738 - DNA, 25 bp, S. pombe
aaacctgttgtatcgtgggactctt

SEQ ID NO: 73739 - DNA, 25 bp, S. pombe
acaactttattatcggctaggcctt

SEQ ID NO: 73740 - DNA, 25 bp, S. pombe
acaacttatttatcctcatactccg

SEQ ID NO: 73741 - DNA, 25 bp, S. pombe
acaaattgtttccatacgctgcttc

SEQ ID NO: 73742 - DNA, 25 bp, S. pombe
gttgaatttcagctgaccggtgtaa

SEQ ID NO: 73743 - DNA, 25 bp, S. pombe
aaaatttcatgctgtccggttaaca

SEQ ID NO: 73744 - DNA, 25 bp, S. pombe
acaagtgttgggtatacatggcatt

SEQ ID NO: 73745 - DNA, 25 bp, S. pombe
acactttgtgtggaaatcggcttta

SEQ ID NO: 73746 - DNA, 25 bp, S. pombe
acactattgttggatttccggcctc

SEQ ID NO: 73747 - DNA, 25 bp, S. pombe
acacatactgttaaatatggttcaa

SEQ ID NO: 73748 - DNA, 25 bp, S. pombe
cagaacccattatacgatgccaagt

SEQ ID NO: 73749 - DNA, 25 bp, S. pombe
ctaagcgtcaccgtaaaattcttcg

SEQ ID NO: 73750 - DNA, 25 bp, S. pombe
aaatcccagtttcagtttcgcagtg

SEQ ID NO: 73751 - DNA, 25 bp, S. pombe
acaatgtcaatgttcccgtttaagg

SEQ ID NO: 73752 - DNA, 25 bp, S. pombe
acaagtgttgttgggcatttctcaa

SEQ ID NO: 73753 - DNA, 25 bp, S. pombe
acacaggttttggacattcttcaac

SEQ ID NO: 73754 - DNA, 25 bp, S. pombe
acactcgaatatgccctttctgaga

SEQ ID NO: 73755 - DNA, 25 bp, S. pombe
acaacgcattgctctttctgacaat

SEQ ID NO: 73756 - DNA, 25 bp, S. pombe
acaactctctgatgacttcgtacta

SEQ ID NO: 73757 - DNA, 25 bp, S. pombe
acaactttgcgccatttcttttaga

SEQ ID NO: 73758 - DNA, 25 bp, S. pombe
acaacaatctgctcctcgtttggag

SEQ ID NO: 73759 - DNA, 25 bp, S. pombe
acaaagatcctttccgacaactgag

SEQ ID NO: 73760 - DNA, 25 bp, S. pombe
aaagaatcagattccgcgaccacta

SEQ ID NO: 73761 - DNA, 25 bp, S. pombe
aaagaagttactagccatccctcac

SEQ ID NO: 73762 - DNA, 25 bp, S. pombe
acaagggctgctaacgtgttttcaa

SEQ ID NO: 73763 - DNA, 25 bp, S. pombe
acaagcgtcttctctatgttcgtcg

SEQ ID NO: 73764 - DNA, 25 bp, S. pombe
acaaagcctgtctctttagtttggc

SEQ ID NO: 73765 - DNA, 25 bp, S. pombe
acaacgtacatctccttcatttttt

SEQ ID NO: 73766 - DNA, 25 bp, S. pombe
aaatagtggaaatgcaccttcttct

SEQ ID NO: 73767 - DNA, 25 bp, S. pombe
acactttccgttagcttcacattta

SEQ ID NO: 73768 - DNA, 25 bp, S. pombe
acacttgtcgagctactgatcgttt

SEQ ID NO: 73769 - DNA, 25 bp, S. pombe
acacacctatttatgctcgttctac

SEQ ID NO: 73770 - DNA, 25 bp, S. pombe
acaacttcatgttccttctgtgtaa

SEQ ID NO: 73771 - DNA, 25 bp, S. pombe
acaacataccgatctttctgaccaa

SEQ ID NO: 73772 - DNA, 25 bp, S. pombe
acaatcatccagcttccgttgaaaa

SEQ ID NO: 73773 - DNA, 25 bp, S. pombe
acaacgctagtgctactggtcataa

SEQ ID NO: 73774 - DNA, 25 bp, S. pombe
acaagccatagtctacttctgaagt

SEQ ID NO: 73775 - DNA, 25 bp, S. pombe
acaatccatgtacgttcctcagcaa

SEQ ID NO: 73776 - DNA, 25 bp, S. pombe
acaatccatgttacgcctcaagaac

SEQ ID NO: 73777 - DNA, 25 bp, S. pombe
acaaggtttcatttctcgggcgtat

SEQ ID NO: 73778 - DNA, 25 bp, S. pombe
acaactactattttcacggtggctt

SEQ ID NO: 73779 - DNA, 25 bp, S. pombe
acaacaccaattttactgaacgtag

SEQ ID NO: 73780 - DNA, 25 bp, S. pombe
acaaccccttcatttacaacgcttg

SEQ ID NO: 73781 - DNA, 25 bp, S. pombe
aaatcccgacttgttgaacgctata

SEQ ID NO: 73782 - DNA, 25 bp, S. pombe
acaaacagctcgtaagtctaccggt

SEQ ID NO: 73783 - DNA, 25 bp, S. pombe
acaaacagctcgtaagtctaccggt

SEQ ID NO: 73784 - DNA, 25 bp, S. pombe
aaagcaacttgataggtccttgagg

SEQ ID NO: 73785 - DNA, 25 bp, S. pombe
acaaggctttgtctttgcttctcga

SEQ ID NO: 73786 - DNA, 25 bp, S. pombe
acaatagtacagctctcatttctcc

SEQ ID NO: 73787 - DNA, 25 bp, S. pombe
acaaagtactcatgctctcgattcc

SEQ ID NO: 73788 - DNA, 25 bp, S. pombe
acacttgtcgtgtttgggatgtccg

SEQ ID NO: 73789 - DNA, 25 bp, S. pombe
aaatctgatctggagttgggctatg

SEQ ID NO: 73790 - DNA, 25 bp, S. pombe
aaattgctgctgagaatgccgcccg

SEQ ID NO: 73791 - DNA, 25 bp, S. pombe
acaacgtcttgtatgctcgctcagt

SEQ ID NO: 73792 - DNA, 25 bp, S. pombe
acaagaaggttgagctcgccgtcct

SEQ ID NO: 73793 - DNA, 25 bp, S. pombe
aaattcgagacgagcttgccgctta

SEQ ID NO: 73794 - DNA, 25 bp, S. pombe
acaactcgaaaaccgtctagctcta

SEQ ID NO: 73795 - DNA, 25 bp, S. pombe
aaattgcccatccagacagaacatc

SEQ ID NO: 73796 - DNA, 25 bp, S. pombe
aaattgccgctttacgtagtcatcg

SEQ ID NO: 73797 - DNA, 25 bp, S. pombe
aaatgcttgccggtgataactattc

SEQ ID NO: 73798 - DNA, 25 bp, S. pombe
acaaatccctgctgataatcttcct

SEQ ID NO: 73799 - DNA, 25 bp, S. pombe
acaaatccactgttgcttctttagc

SEQ ID NO: 73800 - DNA, 25 bp, S. pombe
acaacgacagccattcatcatctaa

SEQ ID NO: 73801 - DNA, 25 bp, S. pombe
acaacgcttggtgcatttactggaa

SEQ ID NO: 73802 - DNA, 25 bp, S. pombe
acaaacgtgcttggatttatctcga

SEQ ID NO: 73803 - DNA, 25 bp, S. pombe
acaaggatccagttgtttcccatgc

SEQ ID NO: 73804 - DNA, 25 bp, S. pombe
aaattgtgacgttcttgcccaaaga

SEQ ID NO: 73805 - DNA, 25 bp, S. pombe
acaagtttcagtgttctcgacagga

SEQ ID NO: 73806 - DNA, 25 bp, S. pombe
aaattgctttgtgagatgtttccca

SEQ ID NO: 73807 - DNA, 25 bp, S. pombe
aaattaacccgatcactggagtgga

SEQ ID NO: 73808 - DNA, 25 bp, S. pombe
aaattaactccctctgcagtgattg

SEQ ID NO: 73809 - DNA, 25 bp, S. pombe
aaattacagttccttgcgggtgcgg

SEQ ID NO: 73810 - DNA, 25 bp, S. pombe
aaataataactcctcttcggtgcca

SEQ ID NO: 73811 - DNA, 25 bp, S. pombe
aaatatttggtgctttctcccttct

SEQ ID NO: 73812 - DNA, 25 bp, S. pombe
acaatactaggtcttctcattccgt

SEQ ID NO: 73813 - DNA, 25 bp, S. pombe
acaagaaattgactggctggctcca

SEQ ID NO: 73814 - DNA, 25 bp, S. pombe
acaatttgatgcattctacgaggac

SEQ ID NO: 73815 - DNA, 25 bp, S. pombe
aaattattctaacactcctccacgt

SEQ ID NO: 73816 - DNA, 25 bp, S. pombe
aaattttcggagatcggaccctgct

SEQ ID NO: 73817 - DNA, 25 bp, S. pombe
acaagtttactgttgcctggtgggc

SEQ ID NO: 73818 - DNA, 25 bp, S. pombe
acacatcctgctatatcttccatat

SEQ ID NO: 73819 - DNA, 25 bp, S. pombe
acaacgctgctttcattttgctgat

SEQ ID NO: 73820 - DNA, 25 bp, S. pombe
acacatattttcgttgcctgcatga

SEQ ID NO: 73821 - DNA, 25 bp, S. pombe
acaatgtaatcgtttccagccccag

SEQ ID NO: 73822 - DNA, 25 bp, S. pombe
acaatgatttggttggcaccggcca

SEQ ID NO: 73823 - DNA, 25 bp, S. pombe
acaacttggagaacgcgtcacgagc

SEQ ID NO: 73824 - DNA, 25 bp, S. pombe
acacagagggtgaggcattggataa

SEQ ID NO: 73825 - DNA, 25 bp, S. pombe
aaatttactcggcaagcttccaaag

SEQ ID NO: 73826 - DNA, 25 bp, S. pombe
aaatacttctcgcatgaaccccgga

SEQ ID NO: 73827 - DNA, 25 bp, S. pombe
aaattgcttcggctcaaggcgttgg

SEQ ID NO: 73828 - DNA, 25 bp, S. pombe
acaaagtttgcttcttacgccaaga

SEQ ID NO: 73829 - DNA, 25 bp, S. pombe
acaacatttctaatcctggcagctg

SEQ ID NO: 73830 - DNA, 25 bp, S. pombe
acactatctgattatcaccttcctg

SEQ ID NO: 73831 - DNA, 25 bp, S. pombe
acaacgagcttctccgtatcgagga

SEQ ID NO: 73832 - DNA, 25 bp, S. pombe
acaagcttggtgcatctgttgccga

SEQ ID NO: 73833 - DNA, 25 bp, S. pombe
acaaatctgttgacgctttcttgga

SEQ ID NO: 73834 - DNA, 25 bp, S. pombe
acaaccttttcggtctcaagcgagt

SEQ ID NO: 73835 - DNA, 25 bp, S. pombe
acaaatctttattgcgtcgcaccgg

SEQ ID NO: 73836 - DNA, 25 bp, S. pombe
acaaggattcttccatcactgttgc

SEQ ID NO: 73837 - DNA, 25 bp, S. pombe
acaacttgctttccacttatcgtgt

SEQ ID NO: 73838 - DNA, 25 bp, S. pombe
aaatttgctttacagttgggctatg

SEQ ID NO: 73839 - DNA, 25 bp, S. pombe
aaatatcggtttcgtttggtgctgt

SEQ ID NO: 73840 - DNA, 25 bp, S. pombe
aaatatcgcgactcgtaagccgtgc

SEQ ID NO: 73841 - DNA, 25 bp, S. pombe
acaaagtatttctgcgatgcccata

SEQ ID NO: 73842 - DNA, 25 bp, S. pombe
aaattaagcgccaaaccaatcctgc

SEQ ID NO: 73843 - DNA, 25 bp, S. pombe
aaattactatggaagggcctcagca

SEQ ID NO: 73844 - DNA, 25 bp, S. pombe
aaatttctgaagaacaatcgggaga

SEQ ID NO: 73845 - DNA, 25 bp, S. pombe
acaatacagtttatcgcacgaccca

SEQ ID NO: 73846 - DNA, 25 bp, S. pombe
acaaccagttgtcatcatcacgagt

SEQ ID NO: 73847 - DNA, 25 bp, S. pombe
acaacgactacatctattcctactt

SEQ ID NO: 73848 - DNA, 25 bp, S. pombe
aaattcgctggcttggaaccggtga

SEQ ID NO: 73849 - DNA, 25 bp, S. pombe
aaattgactgacttgcgcactgccg

SEQ ID NO: 73850 - DNA, 25 bp, S. pombe
aaagaaataccctgtcaccatcttc

SEQ ID NO: 73851 - DNA, 25 bp, S. pombe
aaagaaattccatcccggtggctat

SEQ ID NO: 73852 - DNA, 25 bp, S. pombe
aactacgatttctcccggtgaatat

SEQ ID NO: 73853 - DNA, 25 bp, S. pombe
aacttcgaatcctccggtagaagca

SEQ ID NO: 73854 - DNA, 25 bp, S. pombe
aacttatgttcctcggactttagat

SEQ ID NO: 73855 - DNA, 25 bp, S. pombe
aacttctgagaagcccgtctttaga

SEQ ID NO: 73856 - DNA, 25 bp, S. pombe
aagggtccccagctgccgaagatta

SEQ ID NO: 73857 - DNA, 25 bp, S. pombe
aaattggcccacattcctgaaatta

SEQ ID NO: 73858 - DNA, 25 bp, S. pombe
aaatcatggcccaggatggcgtagt

SEQ ID NO: 73859 - DNA, 25 bp, S. pombe
aaattgcttgtctttcaggaacgat

SEQ ID NO: 73860 - DNA, 25 bp, S. pombe
aaatttcgcgaccagctcagttgtt

SEQ ID NO: 73861 - DNA, 25 bp, S. pombe
aaattgcggcagatcaccttcgttt

SEQ ID NO: 73862 - DNA, 25 bp, S. pombe
aaattggaccagcatcgctctcgtt

SEQ ID NO: 73863 - DNA, 25 bp, S. pombe
aaattgaaaagcctgccaccggcat

SEQ ID NO: 73864 - DNA, 25 bp, S. pombe
acaaggttccaatatctgcgcgaat

SEQ ID NO: 73865 - DNA, 25 bp, S. pombe
aaatacccctatgcataatcgttcc

SEQ ID NO: 73866 - DNA, 25 bp, S. pombe
aaattgccggttacacgactcactt

SEQ ID NO: 73867 - DNA, 25 bp, S. pombe
aaattcccgtcaattctcctaagtg

SEQ ID NO: 73868 - DNA, 25 bp, S. pombe
aaatttgcgcagtctttttaacgag

SEQ ID NO: 73869 - DNA, 25 bp, S. pombe
aaatatctgacacctttttctaccg

SEQ ID NO: 73870 - DNA, 25 bp, S. pombe
acaaggtgcctgagggcttcatcac

SEQ ID NO: 73871 - DNA, 25 bp, S. pombe
acaacttcggttgtggtagctctcg

SEQ ID NO: 73872 - DNA, 25 bp, S. pombe
aaatacccagttaggcgttctcgct

SEQ ID NO: 73873 - DNA, 25 bp, S. pombe
aaattgaagtgggttgcagtaccta

SEQ ID NO: 73874 - DNA, 25 bp, S. pombe
aaattatcatgtctggtcctaccga

SEQ ID NO: 73875 - DNA, 25 bp, S. pombe
aaattatcagtcttgggttgcccct

SEQ ID NO: 73876 - DNA, 25 bp, S. pombe
acaaatgtgctttcctggtggccgt

SEQ ID NO: 73877 - DNA, 25 bp, S. pombe
acaagtgtcgaattgtttgacagat

SEQ ID NO: 73878 - DNA, 25 bp, S. pombe
acaagcttcgagacttggcagccaa

SEQ ID NO: 73879 - DNA, 25 bp, S. pombe
acaagcccgttcgtggatccaagat

SEQ ID NO: 73880 - DNA, 25 bp, S. pombe
acaagtcccttattggtcacagtag

SEQ ID NO: 73881 - DNA, 25 bp, S. pombe
acaagctgcctcgtacggtattgga

SEQ ID NO: 73882 - DNA, 25 bp, S. pombe
acaagaatcccgtcttcaaggcgga

SEQ ID NO: 73883 - DNA, 25 bp, S. pombe
acaatcagttgtgccttcagaatct

SEQ ID NO: 73884 - DNA, 25 bp, S. pombe
acaatcgcatcttattcttctaacc

SEQ ID NO: 73885 - DNA, 25 bp, S. pombe
acaagctgttattttcttcaccctt

SEQ ID NO: 73886 - DNA, 25 bp, S. pombe
acaacactttatgtcgagttcgtgg

SEQ ID NO: 73887 - DNA, 25 bp, S. pombe
aaatactttcaggtgggttccatcg

SEQ ID NO: 73888 - DNA, 25 bp, S. pombe
acaatctaggttgctcggtgccttt

SEQ ID NO: 73889 - DNA, 25 bp, S. pombe
acaaggctgccgtgaagcgcatgtt

SEQ ID NO: 73890 - DNA, 25 bp, S. pombe
acaagctactattccattcaccaat

SEQ ID NO: 73891 - DNA, 25 bp, S. pombe
acaactagcaattgccttggctcct

SEQ ID NO: 73892 - DNA, 25 bp, S. pombe
acaactctatttatgacttctggat

SEQ ID NO: 73893 - DNA, 25 bp, S. pombe
acaactctcatttggctacctgttt

SEQ ID NO: 73894 - DNA, 25 bp, S. pombe
acaattcatagaacgctgcctcttt

SEQ ID NO: 73895 - DNA, 25 bp, S. pombe
aaattcaatccgcatgtcattctta

SEQ ID NO: 73896 - DNA, 25 bp, S. pombe
aaattcctcaagctacagctccttt

SEQ ID NO: 73897 - DNA, 25 bp, S. pombe
aaatccctcacaaacgactactgtt

SEQ ID NO: 73898 - DNA, 25 bp, S. pombe
aaatcaccaatctcagcggctattt

SEQ ID NO: 73899 - DNA, 25 bp, S. pombe
acaatgggtcaaagatcctacgctg

SEQ ID NO: 73900 - DNA, 25 bp, S. pombe
acaaggtgccctgtgtgtacttggc

SEQ ID NO: 73901 - DNA, 25 bp, S. pombe
acaaggtgtcctcgttgctaagaag

SEQ ID NO: 73902 - DNA, 25 bp, S. pombe
acaacgtcttcgcttgcttgatgaa

SEQ ID NO: 73903 - DNA, 25 bp, S. pombe
acaattgctgctacatcgatacctc

SEQ ID NO: 73904 - DNA, 25 bp, S. pombe
acaatgtctgctaccgactctatgg

SEQ ID NO: 73905 - DNA, 25 bp, S. pombe
acaatggtcttgcttcttatggaga

SEQ ID NO: 73906 - DNA, 25 bp, S. pombe
acaagttattgcctttgtctcgcag

SEQ ID NO: 73907 - DNA, 25 bp, S. pombe
acaagttctcttagtttgctccaga

SEQ ID NO: 73908 - DNA, 25 bp, S. pombe
acaagttccatctgtctggattcaa

SEQ ID NO: 73909 - DNA, 25 bp, S. pombe
acaatgtttctgctgttgctgattc

SEQ ID NO: 73910 - DNA, 25 bp, S. pombe
acaagtgctttgtgattctcataca

SEQ ID NO: 73911 - DNA, 25 bp, S. pombe
acaagagattctgcgtattatcaca

SEQ ID NO: 73912 - DNA, 25 bp, S. pombe
acaagagctcttgccaatattcaaa

SEQ ID NO: 73913 - DNA, 25 bp, S. pombe
acaatcacttttgtgcactccagag

SEQ ID NO: 73914 - DNA, 25 bp, S. pombe
acaatccttttctcagttcatctga

SEQ ID NO: 73915 - DNA, 25 bp, S. pombe
aaatactacttctgggcattcgtgc

SEQ ID NO: 73916 - DNA, 25 bp, S. pombe
aaatacttttgctcgaatccggcat

SEQ ID NO: 73917 - DNA, 25 bp, S. pombe
aaattcgacgctcaccaagttgggt

SEQ ID NO: 73918 - DNA, 25 bp, S. pombe
aaattcgtacttcactcaatcgtta

SEQ ID NO: 73919 - DNA, 25 bp, S. pombe
aacttcctacttctgtcaacattga

SEQ ID NO: 73920 - DNA, 25 bp, S. pombe
aaatccgtcctatctttctgcgttt

SEQ ID NO: 73921 - DNA, 25 bp, S. pombe
aaattaccgggacttctacgatgcg

SEQ ID NO: 73922 - DNA, 25 bp, S. pombe
aaattggctcttcagctacgagcgg

SEQ ID NO: 73923 - DNA, 25 bp, S. pombe
aaattggctactattcgccgagctg

SEQ ID NO: 73924 - DNA, 25 bp, S. pombe
acaacggcggtgatgtttctgctat

SEQ ID NO: 73925 - DNA, 25 bp, S. pombe
acaatacgcctcttctgtaactgaa

SEQ ID NO: 73926 - DNA, 25 bp, S. pombe
acaatccttcatcttctagacgtga

SEQ ID NO: 73927 - DNA, 25 bp, S. pombe
acaagcatccttttttaacgacgat

SEQ ID NO: 73928 - DNA, 25 bp, S. pombe
acaagctcctgttatggtccacaat

SEQ ID NO: 73929 - DNA, 25 bp, S. pombe
aaatcccgtaaagttgccaatgcaa

SEQ ID NO: 73930 - DNA, 25 bp, S. pombe
aaattccagttgttttctcttgcaa

SEQ ID NO: 73931 - DNA, 25 bp, S. pombe
aaattgctagttgtttggctgaaat

SEQ ID NO: 73932 - DNA, 25 bp, S. pombe
aaattggccagcaccggatatgaat

SEQ ID NO: 73933 - DNA, 25 bp, S. pombe
aaattggtccagttcggtgtactct

SEQ ID NO: 73934 - DNA, 25 bp, S. pombe
aaattagccaagctctgggaccttc

SEQ ID NO: 73935 - DNA, 25 bp, S. pombe
aaattcagccgtcttatgggtttcg

SEQ ID NO: 73936 - DNA, 25 bp, S. pombe
aaattatccgccgtcttggttgcat

SEQ ID NO: 73937 - DNA, 25 bp, S. pombe
acaatgttcgtcatgccttgggtat

SEQ ID NO: 73938 - DNA, 25 bp, S. pombe
aaattggctggtatcgtccttttgc

SEQ ID NO: 73939 - DNA, 25 bp, S. pombe
aaatatactggtgtcgacggtgttc

SEQ ID NO: 73940 - DNA, 25 bp, S. pombe
acaatgatgacgataccgacggtat

SEQ ID NO: 73941 - DNA, 25 bp, S. pombe
acaatgcatggtatggcctgggaat

SEQ ID NO: 73942 - DNA, 25 bp, S. pombe
aaattgtcatccactatttgggaaa

SEQ ID NO: 73943 - DNA, 25 bp, S. pombe
aaattgatgctttccgctatcgtat

SEQ ID NO: 73944 - DNA, 25 bp, S. pombe
acaacgcttgctaattgattctggc

SEQ ID NO: 73945 - DNA, 25 bp, S. pombe
acaatcaactgctcttgatgccgtc

SEQ ID NO: 73946 - DNA, 25 bp, S. pombe
aaataatcccgtttacttgcgctat

SEQ ID NO: 73947 - DNA, 25 bp, S. pombe
aaattccgtaatatgccttccaaga

SEQ ID NO: 73948 - DNA, 25 bp, S. pombe
aaatactggtacaccttctccaaag

SEQ ID NO: 73949 - DNA, 25 bp, S. pombe
aaatttgtttgcaccttccaactcg

SEQ ID NO: 73950 - DNA, 25 bp, S. pombe
aaattgattctccaaatcgccgtcg

SEQ ID NO: 73951 - DNA, 25 bp, S. pombe
aaatcttttggcacccgttgtatct

SEQ ID NO: 73952 - DNA, 25 bp, S. pombe
aaagcttttgggtctaccgacattg

SEQ ID NO: 73953 - DNA, 25 bp, S. pombe
aaatcttttcgactatacccaattg

SEQ ID NO: 73954 - DNA, 25 bp, S. pombe
aaatatagcgggttcaaggtactga

SEQ ID NO: 73955 - DNA, 25 bp, S. pombe
acaatcactgctcgcatgttctgaa

SEQ ID NO: 73956 - DNA, 25 bp, S. pombe
acaatcagctgtctatggctacgct

SEQ ID NO: 73957 - DNA, 25 bp, S. pombe
acaatcgcttgttatcactactctc

SEQ ID NO: 73958 - DNA, 25 bp, S. pombe
acaactgtggatttagctcgctcta

SEQ ID NO: 73959 - DNA, 25 bp, S. pombe
acaattgggaacactctgctgcgaa

SEQ ID NO: 73960 - DNA, 25 bp, S. pombe
acaaggctggctatactgctgaaca

SEQ ID NO: 73961 - DNA, 25 bp, S. pombe
acaagagcggccattccagatgaaa

SEQ ID NO: 73962 - DNA, 25 bp, S. pombe
aaagaaggtggctgctcgtactcgc

SEQ ID NO: 73963 - DNA, 25 bp, S. pombe
aaattaatctttatcgttttcatga

SEQ ID NO: 73964 - DNA, 25 bp, S. pombe
aaatctactcgtttacctgtttctg

SEQ ID NO: 73965 - DNA, 25 bp, S. pombe
aaatcgatacgccaacttcaaacct

SEQ ID NO: 73966 - DNA, 25 bp, S. pombe
aaatttttcctactccattactcag

SEQ ID NO: 73967 - DNA, 25 bp, S. pombe
aaattgattcccgtacgtgacaaat

SEQ ID NO: 73968 - DNA, 25 bp, S. pombe
aaattattgttcgttcttcaggtga

SEQ ID NO: 73969 - DNA, 25 bp, S. pombe
aaattggtgcccatcacgttggcga

SEQ ID NO: 73970 - DNA, 25 bp, S. pombe
acaatgggtacggtcactctaggtc

SEQ ID NO: 73971 - DNA, 25 bp, S. pombe
acaatgaatccacgacctctgtagg

SEQ ID NO: 73972 - DNA, 25 bp, S. pombe
aaattggaagcatcgcactggcctc

SEQ ID NO: 73973 - DNA, 25 bp, S. pombe
acaatttcaggctcgttgcattaag

SEQ ID NO: 73974 - DNA, 25 bp, S. pombe
aaatttcaagcttcagttttaccag

SEQ ID NO: 73975 - DNA, 25 bp, S. pombe
aaatttatgagctttgtttccaaca

SEQ ID NO: 73976 - DNA, 25 bp, S. pombe
aagatttggtcgtggtcctactcgc

SEQ ID NO: 73977 - DNA, 25 bp, S. pombe
aaatattttcggtgcctgctttcct

SEQ ID NO: 73978 - DNA, 25 bp, S. pombe
aaattgctttggatgcgactctttc

SEQ ID NO: 73979 - DNA, 25 bp, S. pombe
aaatgtttcgtcgtaaagctggtca

SEQ ID NO: 73980 - DNA, 25 bp, S. pombe
aaattgtgtcgaacgttttcttgat

SEQ ID NO: 73981 - DNA, 25 bp, S. pombe
aaattggttgcacgattttttgtga

SEQ ID NO: 73982 - DNA, 25 bp, S. pombe
aaattgggtccgcttatgctttaca

SEQ ID NO: 73983 - DNA, 25 bp, S. pombe
aaattcttacgtattctgctattga

SEQ ID NO: 73984 - DNA, 25 bp, S. pombe
aaattctaacgtttccttgctctct

SEQ ID NO: 73985 - DNA, 25 bp, S. pombe
aaatctgatgactccttcgtaagcg

SEQ ID NO: 73986 - DNA, 25 bp, S. pombe
aaatcacagccaactcttcgggaga

SEQ ID NO: 73987 - DNA, 25 bp, S. pombe
aaatccggcgatctaatcttaaaca

SEQ ID NO: 73988 - DNA, 25 bp, S. pombe
aaattaacgcattacctcctgcaca

SEQ ID NO: 73989 - DNA, 25 bp, S. pombe
aaatccaacgtctaccacctagtag

SEQ ID NO: 73990 - DNA, 25 bp, S. pombe
acaagaggtagtggcttctccggtt

SEQ ID NO: 73991 - DNA, 25 bp, S. pombe
aaatcactctcctttttcgttacat

SEQ ID NO: 73992 - DNA, 25 bp, S. pombe
aaatcccgtcaagtctcaagttcct

SEQ ID NO: 73993 - DNA, 25 bp, S. pombe
aaataccgacatcttccgtatcttg

SEQ ID NO: 73994 - DNA, 25 bp, S. pombe
acaatctcgccccaatgagtgtaga

SEQ ID NO: 73995 - DNA, 25 bp, S. pombe
aaatcaagctttctcaccaaggtgt

SEQ ID NO: 73996 - DNA, 25 bp, S. pombe
aaattaatgccgctcgtgctgagac

SEQ ID NO: 73997 - DNA, 25 bp, S. pombe
aaattgcaagcattccctctttcag

SEQ ID NO: 73998 - DNA, 25 bp, S. pombe
aaattgcaagcaccatctccaaaag

SEQ ID NO: 73999 - DNA, 25 bp, S. pombe
aaatatatcacacatcgtcgacctc

SEQ ID NO: 74000 - DNA, 25 bp, S. pombe
aaatctcaatcactaagtccccatc

SEQ ID NO: 74001 - DNA, 25 bp, S. pombe
aaattaatcttacttcgcctgtctc

SEQ ID NO: 74002 - DNA, 25 bp, S. pombe
aaattattcctactgctcgtcgtgt

SEQ ID NO: 74003 - DNA, 25 bp, S. pombe
aaattgaccgctacgctagacttgt

SEQ ID NO: 74004 - DNA, 25 bp, S. pombe
aaattgtagctcaagacccatcctc

SEQ ID NO: 74005 - DNA, 25 bp, S. pombe
aaattgtgcgcataaccctttctac

SEQ ID NO: 74006 - DNA, 25 bp, S. pombe
aaattggctgattttggcctttctc

SEQ ID NO: 74007 - DNA, 25 bp, S. pombe
aaattgccacttatgaccttgccac

SEQ ID NO: 74008 - DNA, 25 bp, S. pombe
aaatattgccgtatatcgaagctac

SEQ ID NO: 74009 - DNA, 25 bp, S. pombe
aaatcgtggtggttatcgtcagtcc

SEQ ID NO: 74010 - DNA, 25 bp, S. pombe
aaatacgcttaactcgtctactctg

SEQ ID NO: 74011 - DNA, 25 bp, S. pombe
aaattcgcgctaccatggtcgatgt

SEQ ID NO: 74012 - DNA, 25 bp, S. pombe
aaattcgcctggcagagcagcgtat

SEQ ID NO: 74013 - DNA, 25 bp, S. pombe
aaattaccggcttgcagcacatttg

SEQ ID NO: 74014 - DNA, 25 bp, S. pombe
aaatttatgctgctcctgtctttaa

SEQ ID NO: 74015 - DNA, 25 bp, S. pombe
aaattctactactcctatggctggc

SEQ ID NO: 74016 - DNA, 25 bp, S. pombe
acaataatctttcggttcctgctgc

SEQ ID NO: 74017 - DNA, 25 bp, S. pombe
acaatatagctcttactgcggttaa

SEQ ID NO: 74018 - DNA, 25 bp, S. pombe
acaattcctcttgccgaactggata

SEQ ID NO: 74019 - DNA, 25 bp, S. pombe
aaattctccgtattgttcgaccgat

SEQ ID NO: 74020 - DNA, 25 bp, S. pombe
aaattgattcactgctttctgctag

SEQ ID NO: 74021 - DNA, 25 bp, S. pombe
aaatattgcgactactttcagagga

SEQ ID NO: 74022 - DNA, 25 bp, S. pombe
aaatctcatcaaccgacttttggga

SEQ ID NO: 74023 - DNA, 25 bp, S. pombe
aaatctgatagaggcgtatggcgaa

SEQ ID NO: 74024 - DNA, 25 bp, S. pombe
aaatgtcgctacagtggacgcgatt

SEQ ID NO: 74025 - DNA, 25 bp, S. pombe
aaatatatgttcttccaggcgagac

SEQ ID NO: 74026 - DNA, 25 bp, S. pombe
aaattattgtgttccagcccatcca

SEQ ID NO: 74027 - DNA, 25 bp, S. pombe
aaattgtttgattctcagcgctctc

SEQ ID NO: 74028 - DNA, 25 bp, S. pombe
acaattggttaagtgagcgccttga

SEQ ID NO: 74029 - DNA, 25 bp, S. pombe
aaattggtgtgactctccgtgactc

SEQ ID NO: 74030 - DNA, 25 bp, S. pombe
acaatttcagtggttcgcttgcgtc

SEQ ID NO: 74031 - DNA, 25 bp, S. pombe
acaatggtgctgcttctgtcaaaga

SEQ ID NO: 74032 - DNA, 25 bp, S. pombe
aaattgccgatgctcttcagacagt

SEQ ID NO: 74033 - DNA, 25 bp, S. pombe
aaattgcaaatgacctcgctcacgt

SEQ ID NO: 74034 - DNA, 25 bp, S. pombe
aaattgtcgcgatggcttggagtcc

SEQ ID NO: 74035 - DNA, 25 bp, S. pombe
acaatctgtgggttggcgtcgaatt

SEQ ID NO: 74036 - DNA, 25 bp, S. pombe
aaattgacctctggcaactacatcg

SEQ ID NO: 74037 - DNA, 25 bp, S. pombe
aaatagacgcgcatgacactactcc

SEQ ID NO: 74038 - DNA, 25 bp, S. pombe
aaatgagcaagcacgtcgagcgccc

SEQ ID NO: 74039 - DNA, 25 bp, S. pombe
aaattcattactgcttcggattcaa

SEQ ID NO: 74040 - DNA, 25 bp, S. pombe
aaattccgttcagactaccaacact

SEQ ID NO: 74041 - DNA, 25 bp, S. pombe
aaattccatttagacatcccacttc

SEQ ID NO: 74042 - DNA, 25 bp, S. pombe
aaatcccttgtgttggcattagcct

SEQ ID NO: 74043 - DNA, 25 bp, S. pombe
aaattcgctttcatctaccactaaa

SEQ ID NO: 74044 - DNA, 25 bp, S. pombe
aaatccttggttttttggctctgag

SEQ ID NO: 74045 - DNA, 25 bp, S. pombe
aaagcctggtggtgtcttcggtgta

SEQ ID NO: 74046 - DNA, 25 bp, S. pombe
acaatccttacattggtaccggcac

SEQ ID NO: 74047 - DNA, 25 bp, S. pombe
aaatctcttagacggacggatgcta

SEQ ID NO: 74048 - DNA, 25 bp, S. pombe
aaattcttagcattcgtcggcagca

SEQ ID NO: 74049 - DNA, 25 bp, S. pombe
aaatgcaatcctccggaatgcgaga

SEQ ID NO: 74050 - DNA, 25 bp, S. pombe
aaattgcatgcacagtctctggtcc

SEQ ID NO: 74051 - DNA, 25 bp, S. pombe
acaattcctcaacttttcctagtct

SEQ ID NO: 74052 - DNA, 25 bp, S. pombe
aaattgagatttgctggtcccagtc

SEQ ID NO: 74053 - DNA, 25 bp, S. pombe
aaatacccagttatcatggccttcc

SEQ ID NO: 74054 - DNA, 25 bp, S. pombe
aaattagcttggacatccccggcct

SEQ ID NO: 74055 - DNA, 25 bp, S. pombe
aaattacttgatgcctctccagagg

SEQ ID NO: 74056 - DNA, 25 bp, S. pombe
aaattatctctgaaccctctcatgg

SEQ ID NO: 74057 - DNA, 25 bp, S. pombe
aaattactctgctagacactccgat

SEQ ID NO: 74058 - DNA, 25 bp, S. pombe
aaattactctcgtgatctcgctgat

SEQ ID NO: 74059 - DNA, 25 bp, S. pombe
aaattactctcgaactcctcatgaa

SEQ ID NO: 74060 - DNA, 25 bp, S. pombe
aaatcgtccaccaagccgaagaaat

SEQ ID NO: 74061 - DNA, 25 bp, S. pombe
aaatcatacacatggacgccgacgc

SEQ ID NO: 74062 - DNA, 25 bp, S. pombe
aaatcgaactcggtcgcaaggctcg

SEQ ID NO: 74063 - DNA, 25 bp, S. pombe
aaataattctcatgtcagtagcgcc

SEQ ID NO: 74064 - DNA, 25 bp, S. pombe
aaattctgcgtccttaattcttcct

SEQ ID NO: 74065 - DNA, 25 bp, S. pombe
aaattgcgcgccattgatgatctga

SEQ ID NO: 74066 - DNA, 25 bp, S. pombe
aaattggctgcggatctggctgtgc

SEQ ID NO: 74067 - DNA, 25 bp, S. pombe
aaattgactggcaagcggctgatca

SEQ ID NO: 74068 - DNA, 25 bp, S. pombe
aaattctgtatgaagccgctgatga

SEQ ID NO: 74069 - DNA, 25 bp, S. pombe
aaatatttcagtaccgttggctggg

SEQ ID NO: 74070 - DNA, 25 bp, S. pombe
aaattgctgttctacgatccaggat

SEQ ID NO: 74071 - DNA, 25 bp, S. pombe
aaattggtccccatcgatcttgtat

SEQ ID NO: 74072 - DNA, 25 bp, S. pombe
aaattccaacaacatctctcttgct

SEQ ID NO: 74073 - DNA, 25 bp, S. pombe
aaattgaccctcattcttcttcttt

SEQ ID NO: 74074 - DNA, 25 bp, S. pombe
aaattcgcctttttctatcagagct

SEQ ID NO: 74075 - DNA, 25 bp, S. pombe
aaattggtttctttgctacgctgat

SEQ ID NO: 74076 - DNA, 25 bp, S. pombe
aaatttactatttgcaagctcgcga

SEQ ID NO: 74077 - DNA, 25 bp, S. pombe
aaatttactgaaacatctcccgaga

SEQ ID NO: 74078 - DNA, 25 bp, S. pombe
aaattcacaatcaacacagcctcgg

SEQ ID NO: 74079 - DNA, 25 bp, S. pombe
aaatcctaatgctacaacctcatgc

SEQ ID NO: 74080 - DNA, 25 bp, S. pombe
aaattgaagatcctacggccgcgtc

SEQ ID NO: 74081 - DNA, 25 bp, S. pombe
aaattattgtccaccgctggcactg

SEQ ID NO: 74082 - DNA, 25 bp, S. pombe
aaatcaagggttccatcttcctcgt

SEQ ID NO: 74083 - DNA, 25 bp, S. pombe
aaattccatgcttccttatggctag

SEQ ID NO: 74084 - DNA, 25 bp, S. pombe
aaatatgatgctcgtgggtctctgc

SEQ ID NO: 74085 - DNA, 25 bp, S. pombe
aaattgttcgttagtggctgcacat

SEQ ID NO: 74086 - DNA, 25 bp, S. pombe
aaattggtcctttctggccatgatc

SEQ ID NO: 74087 - DNA, 25 bp, S. pombe
aaattatctcctgccaagttattcg

SEQ ID NO: 74088 - DNA, 25 bp, S. pombe
aaattatccgatgccactgttaagg

SEQ ID NO: 74089 - DNA, 25 bp, S. pombe
aaatcacccgaacatgctttagaga

SEQ ID NO: 74090 - DNA, 25 bp, S. pombe
aaatttctaccgtgtttctcctcag

SEQ ID NO: 74091 - DNA, 25 bp, S. pombe
aaatttaaacttctctccttctcag

SEQ ID NO: 74092 - DNA, 25 bp, S. pombe
aaattttaagttcatgcggctccaa

SEQ ID NO: 74093 - DNA, 25 bp, S. pombe
aaatattcctttgctatgggccaca

SEQ ID NO: 74094 - DNA, 25 bp, S. pombe
aaatattcgatgagcctaacctaca

SEQ ID NO: 74095 - DNA, 25 bp, S. pombe
aaattgtttgttgctaatcctgaaa

SEQ ID NO: 74096 - DNA, 25 bp, S. pombe
aaattgttgatgcaggtttcgggct

SEQ ID NO: 74097 - DNA, 25 bp, S. pombe
aaattatgtggccagggtccgcgac

SEQ ID NO: 74098 - DNA, 25 bp, S. pombe
aaattatgtctcaggttcgcgcgtc

SEQ ID NO: 74099 - DNA, 25 bp, S. pombe
aaattgtgcatttgtccctgtccgt

SEQ ID NO: 74100 - DNA, 25 bp, S. pombe
aaatttgcagtatttcgcgtacctc

SEQ ID NO: 74101 - DNA, 25 bp, S. pombe
aaattctcatttctttggactctag

SEQ ID NO: 74102 - DNA, 25 bp, S. pombe
aaattcatgcattgtttaccccgtc

SEQ ID NO: 74103 - DNA, 25 bp, S. pombe
aaattcctatcgtccgtgcgcgtat

SEQ ID NO: 74104 - DNA, 25 bp, S. pombe
aaatcgctaatatctggtgaggtgc

SEQ ID NO: 74105 - DNA, 25 bp, S. pombe
aaattcgtatagtcgcatgtgcaac

SEQ ID NO: 74106 - DNA, 25 bp, S. pombe
aaatatgcgatcttttctacggccc

SEQ ID NO: 74107 - DNA, 25 bp, S. pombe
aaattgtctattatgctcgtgctgc

SEQ ID NO: 74108 - DNA, 25 bp, S. pombe
aaatctatgttcagcaccgtctttt

SEQ ID NO: 74109 - DNA, 25 bp, S. pombe
aaatttgtttatcccagctgttccg

SEQ ID NO: 74110 - DNA, 25 bp, S. pombe
aaatttactgttcccatgtttcgtg

SEQ ID NO: 74111 - DNA, 25 bp, S. pombe
aaattctcctgatcctctttatagt

SEQ ID NO: 74112 - DNA, 25 bp, S. pombe
aaattgagcctagccgttgaaaaca

SEQ ID NO: 74113 - DNA, 25 bp, S. pombe
aaattcagccttgcaagatccaaaa

SEQ ID NO: 74114 - DNA, 25 bp, S. pombe
aactgccagaattccataatcccaa

SEQ ID NO: 74115 - DNA, 25 bp, S. pombe
aaatctccaatcctctagataccga

SEQ ID NO: 74116 - DNA, 25 bp, S. pombe
aaattactcgtattcagcctcccat

SEQ ID NO: 74117 - DNA, 25 bp, S. pombe
aaattccttgctttcagtcttctca

SEQ ID NO: 74118 - DNA, 25 bp, S. pombe
aaattacgacgctcagttgtctaaa

SEQ ID NO: 74119 - DNA, 25 bp, S. pombe
aaatgggacttcagccgacttggag

SEQ ID NO: 74120 - DNA, 25 bp, S. pombe
aaatcgaatcactcaaacccttggt

SEQ ID NO: 74121 - DNA, 25 bp, S. pombe
aaatctgttcctgaagaccctgttt

SEQ ID NO: 74122 - DNA, 25 bp, S. pombe
aaatatttccatcacgctacttcgt

SEQ ID NO: 74123 - DNA, 25 bp, S. pombe
aaatttgtcattaaccatcccgaag

SEQ ID NO: 74124 - DNA, 25 bp, S. pombe
aaatttggcttacgcctccaaagcg

SEQ ID NO: 74125 - DNA, 25 bp, S. pombe
aaattcgtctccgtttacatgaggt

SEQ ID NO: 74126 - DNA, 25 bp, S. pombe
aaagttgcctcccttcaagaacttg

SEQ ID NO: 74127 - DNA, 25 bp, S. pombe
aaattccactcaccttcaaaaatcg

SEQ ID NO: 74128 - DNA, 25 bp, S. pombe
aaattaccctcttcattatccgtag

SEQ ID NO: 74129 - DNA, 25 bp, S. pombe
aaatagacccttacttcatgaagtt

SEQ ID NO: 74130 - DNA, 25 bp, S. pombe
aaatagccgccttttagcagtgaat

SEQ ID NO: 74131 - DNA, 25 bp, S. pombe
aaatatctcctgctattcaatctag

SEQ ID NO: 74132 - DNA, 25 bp, S. pombe
aaattcttcgtgacaacattcaagg

SEQ ID NO: 74133 - DNA, 25 bp, S. pombe
aaattcttcgtgacaacattcaagg

SEQ ID NO: 74134 - DNA, 25 bp, S. pombe
aaattgcttcttgggctcatatcac

SEQ ID NO: 74135 - DNA, 25 bp, S. pombe
aaattcttcttcacatccataccat

SEQ ID NO: 74136 - DNA, 25 bp, S. pombe
aaattctgtatttcttcctcacact

SEQ ID NO: 74137 - DNA, 25 bp, S. pombe
aaattctgatttgcctgcctccaag

SEQ ID NO: 74138 - DNA, 25 bp, S. pombe
aaattgctcatctattggcagctta

SEQ ID NO: 74139 - DNA, 25 bp, S. pombe
aaatcgtcacgaggagccatctact

SEQ ID NO: 74140 - DNA, 25 bp, S. pombe
aaataggcaaccaaccagctctaga

SEQ ID NO: 74141 - DNA, 25 bp, S. pombe
aaataccataccatgtggccaagag

SEQ ID NO: 74142 - DNA, 25 bp, S. pombe
aaataccttctagtgtttctccagg

SEQ ID NO: 74143 - DNA, 25 bp, S. pombe
cacgaagcctttcctttcaattagt

SEQ ID NO: 74144 - DNA, 25 bp, S. pombe
caaggacgtcttctttttgcagtta

SEQ ID NO: 74145 - DNA, 25 bp, S. pombe
aaagaacactagcattttatggtta

SEQ ID NO: 74146 - DNA, 25 bp, S. pombe
aaaaacggtgccattggcgcgttat

SEQ ID NO: 74147 - DNA, 25 bp, S. pombe
aaaccttgggctgctacttgggcca

SEQ ID NO: 74148 - DNA, 25 bp, S. pombe
aaatccttgcaggtatcaacttgtg

SEQ ID NO: 74149 - DNA, 25 bp, S. pombe
aaattcaagctgttttccgcaccaa

SEQ ID NO: 74150 - DNA, 25 bp, S. pombe
aaatatcggtcgcttacctacagca

SEQ ID NO: 74151 - DNA, 25 bp, S. pombe
aaatcagagactcccttcaatcatc

SEQ ID NO: 74152 - DNA, 25 bp, S. pombe
aaattctacctctttgtctcgtaat

SEQ ID NO: 74153 - DNA, 25 bp, S. pombe
aaattcctgtatcccgagacaagct

SEQ ID NO: 74154 - DNA, 25 bp, S. pombe
aaattccctatttcgagacaagtgc

SEQ ID NO: 74155 - DNA, 25 bp, S. pombe
aaattaccagattgctcacacacac

SEQ ID NO: 74156 - DNA, 25 bp, S. pombe
aaatgccatttttgcgaagatcact

SEQ ID NO: 74157 - DNA, 25 bp, S. pombe
aaatccagttttcaatacctccaca

SEQ ID NO: 74158 - DNA, 25 bp, S. pombe
aaatacaattcttcgagtcacccca

SEQ ID NO: 74159 - DNA, 25 bp, S. pombe
aaattcaatctctcatgttaccgct

SEQ ID NO: 74160 - DNA, 25 bp, S. pombe
aaatttctcaagctttcgctgctct

SEQ ID NO: 74161 - DNA, 25 bp, S. pombe
aaattcaagcctccacgggtagtat

SEQ ID NO: 74162 - DNA, 25 bp, S. pombe
aaatcggcaaacacaggcagtggtc

SEQ ID NO: 74163 - DNA, 25 bp, S. pombe
aaatctcgcatgcttggaaggcttt

SEQ ID NO: 74164 - DNA, 25 bp, S. pombe
aaatccagcatgcaccgacaacgtt

SEQ ID NO: 74165 - DNA, 25 bp, S. pombe
aaattctctcgcaaacaccagtatg

SEQ ID NO: 74166 - DNA, 25 bp, S. pombe
aaatttgctggttcgcattcagaca

SEQ ID NO: 74167 - DNA, 25 bp, S. pombe
aaataggcgttcttgcattgcagac

SEQ ID NO: 74168 - DNA, 25 bp, S. pombe
aaatatgattgcaacccttcgacct

SEQ ID NO: 74169 - DNA, 25 bp, S. pombe
aaatttcttgcatcatgtgtcccct

SEQ ID NO: 74170 - DNA, 25 bp, S. pombe
aaatcaaattgttagggtgcccagt

SEQ ID NO: 74171 - DNA, 25 bp, S. pombe
aaattcgttgactggcgtccaaatt

SEQ ID NO: 74172 - DNA, 25 bp, S. pombe
aaattcagtgtcgatggcgggctaa

SEQ ID NO: 74173 - DNA, 25 bp, S. pombe
aaattaatttcagctgcacggacag

SEQ ID NO: 74174 - DNA, 25 bp, S. pombe
aaatttcgtttgatccaccagctag

SEQ ID NO: 74175 - DNA, 25 bp, S. pombe
aaatcttggttccagtcggacggat

SEQ ID NO: 74176 - DNA, 25 bp, S. pombe
aattcggtcccggtggcaacattgg

SEQ ID NO: 74177 - DNA, 25 bp, S. pombe
aaatcggttccgtgtcagctcaagg

SEQ ID NO: 74178 - DNA, 25 bp, S. pombe
aaatccgtacgtgctgtcttcaaga

SEQ ID NO: 74179 - DNA, 25 bp, S. pombe
aaattcgtgcatggtggtctcaaaa

SEQ ID NO: 74180 - DNA, 25 bp, S. pombe
aaattagctgctgaggatcccaaat

SEQ ID NO: 74181 - DNA, 25 bp, S. pombe
aaattactgctgaagatgttcttgc

SEQ ID NO: 74182 - DNA, 25 bp, S. pombe
aaattagtcttgcagctcttggatt

SEQ ID NO: 74183 - DNA, 25 bp, S. pombe
aaattagtcctcaatccatctcttt

SEQ ID NO: 74184 - DNA, 25 bp, S. pombe
aaattttagtgtcgcaggtcaccca

SEQ ID NO: 74185 - DNA, 25 bp, S. pombe
aaatttatcggctacagcgtcccaa

SEQ ID NO: 74186 - DNA, 25 bp, S. pombe
aaattatccttttccagcacttcga

SEQ ID NO: 74187 - DNA, 25 bp, S. pombe
aaattttttcttggagcgatctcga

SEQ ID NO: 74188 - DNA, 25 bp, S. pombe
aaatttgttgcctcgagttccatga

SEQ ID NO: 74189 - DNA, 25 bp, S. pombe
aaatcgacaccgtcatcattgtagg

SEQ ID NO: 74190 - DNA, 25 bp, S. pombe
aaatcacacatactgactcctgggt

SEQ ID NO: 74191 - DNA, 25 bp, S. pombe
aaatcgaggcatcatggcactgggt

SEQ ID NO: 74192 - DNA, 25 bp, S. pombe
aaatatgggcggttctgcgtgacac

SEQ ID NO: 74193 - DNA, 25 bp, S. pombe
aaatatggagcccttctcgtgtcat

SEQ ID NO: 74194 - DNA, 25 bp, S. pombe
aaatcgaagagctcactagtgtcat

SEQ ID NO: 74195 - DNA, 25 bp, S. pombe
aaatttaatgtttcggcctatgcct

SEQ ID NO: 74196 - DNA, 25 bp, S. pombe
aaatttagttcatgggcactccctg

SEQ ID NO: 74197 - DNA, 25 bp, S. pombe
aaatattttatctgtcccactcgtg

SEQ ID NO: 74198 - DNA, 25 bp, S. pombe
aaattttatacatctgccattggct

SEQ ID NO: 74199 - DNA, 25 bp, S. pombe
aaatatcttggtatccgcttctgct

SEQ ID NO: 74200 - DNA, 25 bp, S. pombe
aaatattcggtctagcgcaagccca

SEQ ID NO: 74201 - DNA, 25 bp, S. pombe
aaattttcgactgggatgcacacgt

SEQ ID NO: 74202 - DNA, 25 bp, S. pombe
aaattacatttcttcctctcgactt

SEQ ID NO: 74203 - DNA, 25 bp, S. pombe
aaatctactttatccttgtacgcat

SEQ ID NO: 74204 - DNA, 25 bp, S. pombe
aaatctgccctctcaactttattga

SEQ ID NO: 74205 - DNA, 25 bp, S. pombe
aaatcatcgccccaaagctttatat

SEQ ID NO: 74206 - DNA, 25 bp, S. pombe
aaatctttacttatgggctctgcca

SEQ ID NO: 74207 - DNA, 25 bp, S. pombe
aaatttcacttcttttcctgcagtc

SEQ ID NO: 74208 - DNA, 25 bp, S. pombe
aaatgtatcccggagcctggttcca

SEQ ID NO: 74209 - DNA, 25 bp, S. pombe
aaaggcggaggcatcccgtaaaatg

SEQ ID NO: 74210 - DNA, 25 bp, S. pombe
aaatctgactcaactgtgttaggga

SEQ ID NO: 74211 - DNA, 25 bp, S. pombe
aaatcgcctacattggtcttcgtgg

SEQ ID NO: 74212 - DNA, 25 bp, S. pombe
aaatagttctgcttcgcctaagaag

SEQ ID NO: 74213 - DNA, 25 bp, S. pombe
aaatatttcctttggtgagcagtaa

SEQ ID NO: 74214 - DNA, 25 bp, S. pombe
aaatacctttgtccttgatacctcg

SEQ ID NO: 74215 - DNA, 25 bp, S. pombe
aaatgccccttcgaagtgatacatc

SEQ ID NO: 74216 - DNA, 25 bp, S. pombe
aaataccacctcgattgctgaagct

SEQ ID NO: 74217 - DNA, 25 bp, S. pombe
aaatacggcctccttgatatacttc

SEQ ID NO: 74218 - DNA, 25 bp, S. pombe
aaatactgctgccttttcgtcaatt

SEQ ID NO: 74219 - DNA, 25 bp, S. pombe
aaatcaagcttcgtcttcgacaatg

SEQ ID NO: 74220 - DNA, 25 bp, S. pombe
aaatcaccattcaatcattcgcaca

SEQ ID NO: 74221 - DNA, 25 bp, S. pombe
aaatttctctgcgttgcattgccaa

SEQ ID NO: 74222 - DNA, 25 bp, S. pombe
aaatctacagtgtgctgcttgtcaa

SEQ ID NO: 74223 - DNA, 25 bp, S. pombe
aaatacaatggctgcacctgctaga

SEQ ID NO: 74224 - DNA, 25 bp, S. pombe
aaatatcctcgaacttgaagcaaag

SEQ ID NO: 74225 - DNA, 25 bp, S. pombe
aaatccgtcgtaccagcggtagcaa

SEQ ID NO: 74226 - DNA, 25 bp, S. pombe
aaatcgaaacttgctctggcggcga

SEQ ID NO: 74227 - DNA, 25 bp, S. pombe
aaatcggtcacttgcatccacaagg

SEQ ID NO: 74228 - DNA, 25 bp, S. pombe
aaatctggctctttgaccctatgtg

SEQ ID NO: 74229 - DNA, 25 bp, S. pombe
aaatttcgttttgcatttgcttggc

SEQ ID NO: 74230 - DNA, 25 bp, S. pombe
aaatctttggttcgccatgttgctc

SEQ ID NO: 74231 - DNA, 25 bp, S. pombe
aaattatatttgttgcgcctctgct

SEQ ID NO: 74232 - DNA, 25 bp, S. pombe
aaatatcatcttcgttccttctatc

SEQ ID NO: 74233 - DNA, 25 bp, S. pombe
aaatatgcacttgtccgttcttgct

SEQ ID NO: 74234 - DNA, 25 bp, S. pombe
aaatatcgctttagccgttgctggt

SEQ ID NO: 74235 - DNA, 25 bp, S. pombe
aaatatcgggttgcatttgccttac

SEQ ID NO: 74236 - DNA, 25 bp, S. pombe
aaattttcgatgtcgctgcctttga

SEQ ID NO: 74237 - DNA, 25 bp, S. pombe
aaattattccagtcgaggctgctct

SEQ ID NO: 74238 - DNA, 25 bp, S. pombe
aaatctttgcctttgggctctgtag

SEQ ID NO: 74239 - DNA, 25 bp, S. pombe
aaatttctctcaagggttcgtcaat

SEQ ID NO: 74240 - DNA, 25 bp, S. pombe
aaatttcctcaaatccattgcttag

SEQ ID NO: 74241 - DNA, 25 bp, S. pombe
aaatttcctcagtataatcctcaag

SEQ ID NO: 74242 - DNA, 25 bp, S. pombe
aaattttgctcgtctattcgcctgg

SEQ ID NO: 74243 - DNA, 25 bp, S. pombe
aaatttgttccaattctcatcccga

SEQ ID NO: 74244 - DNA, 25 bp, S. pombe
aaatttcgattggatctcctgccct

SEQ ID NO: 74245 - DNA, 25 bp, S. pombe
aaatctactttggaattcgccctgt

SEQ ID NO: 74246 - DNA, 25 bp, S. pombe
aaatctactcatttagcgaccgctt

SEQ ID NO: 74247 - DNA, 25 bp, S. pombe
aaatcatcccattgctcgaacaact

SEQ ID NO: 74248 - DNA, 25 bp, S. pombe
aaatatcatccatgcttcgaacagc

SEQ ID NO: 74249 - DNA, 25 bp, S. pombe
aaatatatctgcttgttctgtacct

SEQ ID NO: 74250 - DNA, 25 bp, S. pombe
aaatattctgttcctttacctcaag

SEQ ID NO: 74251 - DNA, 25 bp, S. pombe
aaatattttctctttttcctcgcag

SEQ ID NO: 74252 - DNA, 25 bp, S. pombe
aaatttgtgcccttgtgaatcttgc

SEQ ID NO: 74253 - DNA, 25 bp, S. pombe
aaatttggacaccttctcgctcaat

SEQ ID NO: 74254 - DNA, 25 bp, S. pombe
aaatattggcgcatcttcacctagt

SEQ ID NO: 74255 - DNA, 25 bp, S. pombe
aaatatctctgccactctttcgtat

SEQ ID NO: 74256 - DNA, 25 bp, S. pombe
aaatattctgctctgtcttctgtgt

SEQ ID NO: 74257 - DNA, 25 bp, S. pombe
aaatttgcctgaagaagtcccacct

SEQ ID NO: 74258 - DNA, 25 bp, S. pombe
aaatactgtttctttatctaagcat

SEQ ID NO: 74259 - DNA, 25 bp, S. pombe
aaatgaagctggttgatactcgaaa

SEQ ID NO: 74260 - DNA, 25 bp, S. pombe
aaatgcgcaaggtgctaccggtacg

SEQ ID NO: 74261 - DNA, 25 bp, S. pombe
aaatctctactgttgttgaacttga

SEQ ID NO: 74262 - DNA, 25 bp, S. pombe
aaatatcatgctcaccatgtgccct

SEQ ID NO: 74263 - DNA, 25 bp, S. pombe
aaaagcgaaagccatgtctcctgat

SEQ ID NO: 74264 - DNA, 25 bp, S. pombe
aaatccgacttctatgttagcgata

SEQ ID NO: 74265 - DNA, 25 bp, S. pombe
aaataaccagcattcccagcaatat

SEQ ID NO: 74266 - DNA, 25 bp, S. pombe
aaatttgcaatgttccgcttgtgga

SEQ ID NO: 74267 - DNA, 25 bp, S. pombe
aaatttgctatgtgcggctgccagt

SEQ ID NO: 74268 - DNA, 25 bp, S. pombe
aaatatgtggatttcctgggcttat

SEQ ID NO: 74269 - DNA, 25 bp, S. pombe
aaatatgttgctgcacctggcggta

SEQ ID NO: 74270 - DNA, 25 bp, S. pombe
aaatctttcgaaggctgtgcaggat

SEQ ID NO: 74271 - DNA, 25 bp, S. pombe
aaatcaatccatcaactgccattac

SEQ ID NO: 74272 - DNA, 25 bp, S. pombe
aaatcacatggtcctaagcctagag

SEQ ID NO: 74273 - DNA, 25 bp, S. pombe
aaatatccagtgttgcaaagcgtgt

SEQ ID NO: 74274 - DNA, 25 bp, S. pombe
aaatagctactcttgcaacggcagg

SEQ ID NO: 74275 - DNA, 25 bp, S. pombe
aaataacacttcgactgactcagcc

SEQ ID NO: 74276 - DNA, 25 bp, S. pombe
aaatatttcaatccagcatctccac

SEQ ID NO: 74277 - DNA, 25 bp, S. pombe
aaatatgtgatgttgctgctctcca

SEQ ID NO: 74278 - DNA, 25 bp, S. pombe
aaatcatctatgtcatgttcagaat

SEQ ID NO: 74279 - DNA, 25 bp, S. pombe
aaatgcattcaactccttgggcttc

SEQ ID NO: 74280 - DNA, 25 bp, S. pombe
aaatgcctcaggaagaatgggactc

SEQ ID NO: 74281 - DNA, 25 bp, S. pombe
aactacttggtaaatcagcgggagg

SEQ ID NO: 74282 - DNA, 25 bp, S. pombe
caataccacttcacttcgggattaa

SEQ ID NO: 74283 - DNA, 25 bp, S. pombe
aaatatcttgttccggtttacgctg

SEQ ID NO: 74284 - DNA, 25 bp, S. pombe
aaatcgtccgcttcagtttcgaaca

SEQ ID NO: 74285 - DNA, 25 bp, S. pombe
aaatccttgcgttctttatcgacca

SEQ ID NO: 74286 - DNA, 25 bp, S. pombe
aaatgcctctgtgactatttctggc

SEQ ID NO: 74287 - DNA, 25 bp, S. pombe
aaatatccagtatctcttctgcgag

SEQ ID NO: 74288 - DNA, 25 bp, S. pombe
aaatatgccgataagtgctcccgtg

SEQ ID NO: 74289 - DNA, 25 bp, S. pombe
aaatacagatcttcgttctcgcgtg

SEQ ID NO: 74290 - DNA, 25 bp, S. pombe
aaatacagacacagctttacgggcg

SEQ ID NO: 74291 - DNA, 25 bp, S. pombe
aaatgaaacaactggccgctgcgaa

SEQ ID NO: 74292 - DNA, 25 bp, S. pombe
aaagtatccaaacgccttgctgctg

SEQ ID NO: 74293 - DNA, 25 bp, S. pombe
aaatctctctactacgactgatggg

SEQ ID NO: 74294 - DNA, 25 bp, S. pombe
aaagatcccaatcgcatactgatga

SEQ ID NO: 74295 - DNA, 25 bp, S. pombe
aaatatctcctcaactagcgatgaa

SEQ ID NO: 74296 - DNA, 25 bp, S. pombe
aaatcttcgcatcgcttactgtgaa

SEQ ID NO: 74297 - DNA, 25 bp, S. pombe
aaatcattagcacgcatcttcctgg

SEQ ID NO: 74298 - DNA, 25 bp, S. pombe
aaatgcttccatttactcaacaagt

SEQ ID NO: 74299 - DNA, 25 bp, S. pombe
aaatgtcccttttgctgatactact

SEQ ID NO: 74300 - DNA, 25 bp, S. pombe
aaatgttcacgatcgtttccccaat

SEQ ID NO: 74301 - DNA, 25 bp, S. pombe
aaatattcctgatgcagttccctct

SEQ ID NO: 74302 - DNA, 25 bp, S. pombe
aaatattcgctgaaacgtcttgctg

SEQ ID NO: 74303 - DNA, 25 bp, S. pombe
aaatcattcgacaacgggtggctga

SEQ ID NO: 74304 - DNA, 25 bp, S. pombe
aaatgccaaagatttcgcggcgatt

SEQ ID NO: 74305 - DNA, 25 bp, S. pombe
aaatgcagcaaatttcatcctggga

SEQ ID NO: 74306 - DNA, 25 bp, S. pombe
aaatcacttcacattccatgggacc

SEQ ID NO: 74307 - DNA, 25 bp, S. pombe
aaatatgggttctccacacatggaa

SEQ ID NO: 74308 - DNA, 25 bp, S. pombe
aaatagagtcttgatgtacctgaaa

SEQ ID NO: 74309 - DNA, 25 bp, S. pombe
aaatccctcaagtttctgaagtctt

SEQ ID NO: 74310 - DNA, 25 bp, S. pombe
aaatccgccggttttgatcaagctg

SEQ ID NO: 74311 - DNA, 25 bp, S. pombe
aaatccttcggtttcaacagctgca

SEQ ID NO: 74312 - DNA, 25 bp, S. pombe
aaatcaatacgtcgcttggcatgga

SEQ ID NO: 74313 - DNA, 25 bp, S. pombe
aaatccattcgtgcgtgagatgcta

SEQ ID NO: 74314 - DNA, 25 bp, S. pombe
aaatcacaccgtccaatctgagcaa

SEQ ID NO: 74315 - DNA, 25 bp, S. pombe
aaatcattcggttttgctcatcctc

SEQ ID NO: 74316 - DNA, 25 bp, S. pombe
aaatcttgggcttcttggatcttct

SEQ ID NO: 74317 - DNA, 25 bp, S. pombe
aaatctggcttgctcttgaatgcgg

SEQ ID NO: 74318 - DNA, 25 bp, S. pombe
aaatccgctatgctcctgatagatg

SEQ ID NO: 74319 - DNA, 25 bp, S. pombe
aaatatcgctatctccaacggctga

SEQ ID NO: 74320 - DNA, 25 bp, S. pombe
aaatatcgcttcaacaatgggtcaa

SEQ ID NO: 74321 - DNA, 25 bp, S. pombe
aaatgggttcattacgggatcaaat

SEQ ID NO: 74322 - DNA, 25 bp, S. pombe
aaatgtgggtagtcaacggtctcgt

SEQ ID NO: 74323 - DNA, 25 bp, S. pombe
aaatactctcaccaaggttctctcg

SEQ ID NO: 74324 - DNA, 25 bp, S. pombe
aaatcgttgctgtcaaggttctccg

SEQ ID NO: 74325 - DNA, 25 bp, S. pombe
aaatcgttggtctgcattgtccatt

SEQ ID NO: 74326 - DNA, 25 bp, S. pombe
aaatcaggttgctcagttttcgaca

SEQ ID NO: 74327 - DNA, 25 bp, S. pombe
aaatcctacaaatcttatccgacaa

SEQ ID NO: 74328 - DNA, 25 bp, S. pombe
aaatcctcgctatcctgtatttggg

SEQ ID NO: 74329 - DNA, 25 bp, S. pombe
aaatcctagtggtccttcttatggt

SEQ ID NO: 74330 - DNA, 25 bp, S. pombe
aaatgctatagcctggtaccccgta

SEQ ID NO: 74331 - DNA, 25 bp, S. pombe
aaatgccaagctcgtttgacccgtg

SEQ ID NO: 74332 - DNA, 25 bp, S. pombe
aaatccaacttgtgtatgccctgtt

SEQ ID NO: 74333 - DNA, 25 bp, S. pombe
aaatctcaacttcctttgttgcata

SEQ ID NO: 74334 - DNA, 25 bp, S. pombe
aaatcatcatttttgcgctggttgc

SEQ ID NO: 74335 - DNA, 25 bp, S. pombe
aaatcaatgttttgcctcctgacca

SEQ ID NO: 74336 - DNA, 25 bp, S. pombe
aaatagcacgaactcttccattccg

SEQ ID NO: 74337 - DNA, 25 bp, S. pombe
aaataacgttcttcggattcatgga

SEQ ID NO: 74338 - DNA, 25 bp, S. pombe
aaatacactgttcctcgtactactg

SEQ ID NO: 74339 - DNA, 25 bp, S. pombe
aaatacctcattccttgtcgattac

SEQ ID NO: 74340 - DNA, 25 bp, S. pombe
aaatctcactctacctttcagaaac

SEQ ID NO: 74341 - DNA, 25 bp, S. pombe
aaatgggcccgtctgaatagaaagt

SEQ ID NO: 74342 - DNA, 25 bp, S. pombe
aaatcgacccttccatttgtaaatg

SEQ ID NO: 74343 - DNA, 25 bp, S. pombe
aaatctactcgtggacttcgtgcta

SEQ ID NO: 74344 - DNA, 25 bp, S. pombe
aaatgcatatctgtcgtttctttag

SEQ ID NO: 74345 - DNA, 25 bp, S. pombe
aaatcattcgtgctgttctttctaa

SEQ ID NO: 74346 - DNA, 25 bp, S. pombe
aacttgttagcctgccttttcaacg

SEQ ID NO: 74347 - DNA, 25 bp, S. pombe
aaatcgtctttgttgcatcctttta

SEQ ID NO: 74348 - DNA, 25 bp, S. pombe
aaatcgcattagctgttgcccatct

SEQ ID NO: 74349 - DNA, 25 bp, S. pombe
aaatcagatggtagtttgctccctt

SEQ ID NO: 74350 - DNA, 25 bp, S. pombe
aaatagcacatctttttcttcgcct

SEQ ID NO: 74351 - DNA, 25 bp, S. pombe
aaataacactgctctttctccttat

SEQ ID NO: 74352 - DNA, 25 bp, S. pombe
aaatgaacatcaacgcgcgcgtact

SEQ ID NO: 74353 - DNA, 25 bp, S. pombe
aaatcaccccacgtcttgatagtgt

SEQ ID NO: 74354 - DNA, 25 bp, S. pombe
aaatccgctctcagttggaacaatg

SEQ ID NO: 74355 - DNA, 25 bp, S. pombe
aaatctctcatcttcgcatggcgaa

SEQ ID NO: 74356 - DNA, 25 bp, S. pombe
aaatcgcagccatttcagtggtttc

SEQ ID NO: 74357 - DNA, 25 bp, S. pombe
aaatcactgtcatccgtggttccaa

SEQ ID NO: 74358 - DNA, 25 bp, S. pombe
aaatacatgccatacgtgtcctgta

SEQ ID NO: 74359 - DNA, 25 bp, S. pombe
aaatacgacctttatggcggcatta

SEQ ID NO: 74360 - DNA, 25 bp, S. pombe
aaatccctactgtaaatgtggctga

SEQ ID NO: 74361 - DNA, 25 bp, S. pombe
aaatcctgacgcaccaattttggcc

SEQ ID NO: 74362 - DNA, 25 bp, S. pombe
aaacctactagtgccattgttgaac

SEQ ID NO: 74363 - DNA, 25 bp, S. pombe
aaaggtctccaagagcatcgccgaa

SEQ ID NO: 74364 - DNA, 25 bp, S. pombe
aaatggcttccggaagtctctagta

SEQ ID NO: 74365 - DNA, 25 bp, S. pombe
aaatcgcttgccttaatgctcttgt

SEQ ID NO: 74366 - DNA, 25 bp, S. pombe
aaatcgttggtctcacaggatccta

SEQ ID NO: 74367 - DNA, 25 bp, S. pombe
aaatcgttgaacatcctttggctaa

SEQ ID NO: 74368 - DNA, 25 bp, S. pombe
aaatcgagtctatgcgtttgcgtaa

SEQ ID NO: 74369 - DNA, 25 bp, S. pombe
aaatgggttgtaataatctggttat

SEQ ID NO: 74370 - DNA, 25 bp, S. pombe
aaatggccttctcaatacgactttc

SEQ ID NO: 74371 - DNA, 25 bp, S. pombe
aaatcatctggtctctgcttcggta

SEQ ID NO: 74372 - DNA, 25 bp, S. pombe
aaatcatctgaacccgtttcatgcg

SEQ ID NO: 74373 - DNA, 25 bp, S. pombe
aaatcatccatacgcgttttacatt

SEQ ID NO: 74374 - DNA, 25 bp, S. pombe
aaatctttgggcctgtcttagctgt

SEQ ID NO: 74375 - DNA, 25 bp, S. pombe
aaatctcctggagcttccgaagata

SEQ ID NO: 74376 - DNA, 25 bp, S. pombe
aatattccgggacctacgaactgct

SEQ ID NO: 74377 - DNA, 25 bp, S. pombe
aaatcatcaccggttcccgaaagca

SEQ ID NO: 74378 - DNA, 25 bp, S. pombe
aaaatcccaaattctcctaaagctg

SEQ ID NO: 74379 - DNA, 25 bp, S. pombe
aaatcacacgtccattttcatctca

SEQ ID NO: 74380 - DNA, 25 bp, S. pombe
aaatggccgtaatattgcagtcaat

SEQ ID NO: 74381 - DNA, 25 bp, S. pombe
aaaggtcgcgtatcaccaaactgga

SEQ ID NO: 74382 - DNA, 25 bp, S. pombe
aaatcgttctgggttgcctgcgaaa

SEQ ID NO: 74383 - DNA, 25 bp, S. pombe
aaatgctggatcaactgcggctcct

SEQ ID NO: 74384 - DNA, 25 bp, S. pombe
aaatgccataattgccgcgagctgt

SEQ ID NO: 74385 - DNA, 25 bp, S. pombe
aaatacaatatccacgcttgctcgg

SEQ ID NO: 74386 - DNA, 25 bp, S. pombe
aaatcaaactccaatacgcctactg

SEQ ID NO: 74387 - DNA, 25 bp, S. pombe
aaatgaatgccctctatatgtcctc

SEQ ID NO: 74388 - DNA, 25 bp, S. pombe
aaatcgatgccctagcttctaagtt

SEQ ID NO: 74389 - DNA, 25 bp, S. pombe
aaatcatcccgacgttttggcagtg

SEQ ID NO: 74390 - DNA, 25 bp, S. pombe
aaatgatcccatttgttcttaggag

SEQ ID NO: 74391 - DNA, 25 bp, S. pombe
aaatccggataagtcctgcgtcgag

SEQ ID NO: 74392 - DNA, 25 bp, S. pombe
aaatccaggatcagcgttcgtcaaa

SEQ ID NO: 74393 - DNA, 25 bp, S. pombe
aaatccaggtcgtcggttgctcgaa

SEQ ID NO: 74394 - DNA, 25 bp, S. pombe
aaatcgaggctgctttgttgtctca

SEQ ID NO: 74395 - DNA, 25 bp, S. pombe
aaatcggacctcatttctgaagtaa

SEQ ID NO: 74396 - DNA, 25 bp, S. pombe
aaaggcggccctgaacgaacaagag

SEQ ID NO: 74397 - DNA, 25 bp, S. pombe
aaagtacgctaccaagcagccgaca

SEQ ID NO: 74398 - DNA, 25 bp, S. pombe
aaagttggctactggagtcttcgga

SEQ ID NO: 74399 - DNA, 25 bp, S. pombe
aaaggccatcttctcggtcgtttgg

SEQ ID NO: 74400 - DNA, 25 bp, S. pombe
aaatgacccctttccatcagttgat

SEQ ID NO: 74401 - DNA, 25 bp, S. pombe
aaatgactcgcatgattccatccat

SEQ ID NO: 74402 - DNA, 25 bp, S. pombe
aaatgagttctcgagcttacctttt

SEQ ID NO: 74403 - DNA, 25 bp, S. pombe
aaaggcttaaagatatcccatgata

SEQ ID NO: 74404 - DNA, 25 bp, S. pombe
aaagtgctactgctttctgggcctt

SEQ ID NO: 74405 - DNA, 25 bp, S. pombe
aaagttctcggtgcattgggtctta

SEQ ID NO: 74406 - DNA, 25 bp, S. pombe
aaatgtccgcccttgggttggtatg

SEQ ID NO: 74407 - DNA, 25 bp, S. pombe
aaatgcacccactttggttcaaaag

SEQ ID NO: 74408 - DNA, 25 bp, S. pombe
aaatccccaacttagctacttgcag

SEQ ID NO: 74409 - DNA, 25 bp, S. pombe
aaacggctatactcgtacccagagc

SEQ ID NO: 74410 - DNA, 25 bp, S. pombe
aaacgacttggatctggccctaacg

SEQ ID NO: 74411 - DNA, 25 bp, S. pombe
aaatgcatcgcgtacgtcaggtgct

SEQ ID NO: 74412 - DNA, 25 bp, S. pombe
aaatcaatgcgttctctcatgagat

SEQ ID NO: 74413 - DNA, 25 bp, S. pombe
aaatcaagcgttcctcatgcactaa

SEQ ID NO: 74414 - DNA, 25 bp, S. pombe
aaatcgttgccaaagctgccggcgt

SEQ ID NO: 74415 - DNA, 25 bp, S. pombe
aaatcttggccccagctagtagcaa

SEQ ID NO: 74416 - DNA, 25 bp, S. pombe
aaatgacagtcctggtctttccact

SEQ ID NO: 74417 - DNA, 25 bp, S. pombe
aaagaagtccgcactcatttcttcg

SEQ ID NO: 74418 - DNA, 25 bp, S. pombe
aaaccgtcgtgctggattcttttgt

SEQ ID NO: 74419 - DNA, 25 bp, S. pombe
aaagacgtctggtgcgatagtttgc

SEQ ID NO: 74420 - DNA, 25 bp, S. pombe
aaatcgttgtcttcaacaccggctg

SEQ ID NO: 74421 - DNA, 25 bp, S. pombe
aaatccttatttaatccctagctat

SEQ ID NO: 74422 - DNA, 25 bp, S. pombe
aaatcgttacttgacgctaatgcat

SEQ ID NO: 74423 - DNA, 25 bp, S. pombe
aaatcgtttcatattcaggaagctg

SEQ ID NO: 74424 - DNA, 25 bp, S. pombe
aaatgcacttggacgcttcgggtaa

SEQ ID NO: 74425 - DNA, 25 bp, S. pombe
aaatgccttcctcgtggtggagtaa

SEQ ID NO: 74426 - DNA, 25 bp, S. pombe
aaatcgcaaccctcgagtgtctaat

SEQ ID NO: 74427 - DNA, 25 bp, S. pombe
aaatgctggtaccaccgagtttcca

SEQ ID NO: 74428 - DNA, 25 bp, S. pombe
aaatgctgcttggtcaatctccatt

SEQ ID NO: 74429 - DNA, 25 bp, S. pombe
aaatcatttgatgctcgcccatttc

SEQ ID NO: 74430 - DNA, 25 bp, S. pombe
aaatcgttcatcttctccaactgtt

SEQ ID NO: 74431 - DNA, 25 bp, S. pombe
aaatgcttgaccgaaatcgccgtat

SEQ ID NO: 74432 - DNA, 25 bp, S. pombe
aaatgcagcgatgcctatttagaag

SEQ ID NO: 74433 - DNA, 25 bp, S. pombe
aaatcccctgatgatttccctgagg

SEQ ID NO: 74434 - DNA, 25 bp, S. pombe
aaatcccatcttttgtttctgcttg

SEQ ID NO: 74435 - DNA, 25 bp, S. pombe
aaatcttcctgtggtgtttgtttgg

SEQ ID NO: 74436 - DNA, 25 bp, S. pombe
aaatcttacttcagctttgttgcaa

SEQ ID NO: 74437 - DNA, 25 bp, S. pombe
aaatgcttactgctccttttgtgta

SEQ ID NO: 74438 - DNA, 25 bp, S. pombe
aaatcttttgctatgttttcctcat

SEQ ID NO: 74439 - DNA, 25 bp, S. pombe
aaagttacattgattatttccgctg

SEQ ID NO: 74440 - DNA, 25 bp, S. pombe
aaagttaggctgctacagtgcccct

SEQ ID NO: 74441 - DNA, 25 bp, S. pombe
aaatcgttgcccagaaactactcct

SEQ ID NO: 74442 - DNA, 25 bp, S. pombe
aaatgttttagctcgatatcctgaa

SEQ ID NO: 74443 - DNA, 25 bp, S. pombe
aaatccattacttctgcgatctctg

SEQ ID NO: 74444 - DNA, 25 bp, S. pombe
aaatctcacgagttgccaagcattc

SEQ ID NO: 74445 - DNA, 25 bp, S. pombe
aaatcctgcaactgctcatcttgaa

SEQ ID NO: 74446 - DNA, 25 bp, S. pombe
aaatcctgcgaaggcatttatgtac

SEQ ID NO: 74447 - DNA, 25 bp, S. pombe
aaatcctcagaaacccttgatcatt

SEQ ID NO: 74448 - DNA, 25 bp, S. pombe
aaatctgcacaactggctcgtactg

SEQ ID NO: 74449 - DNA, 25 bp, S. pombe
aaatctcacgagagcgagctgtcca

SEQ ID NO: 74450 - DNA, 25 bp, S. pombe
aaatgcttcgagtgcgactccatag

SEQ ID NO: 74451 - DNA, 25 bp, S. pombe
aaagtcaagtatccgcatctccatt

SEQ ID NO: 74452 - DNA, 25 bp, S. pombe
aaatgccaatgctaacactgccacg

SEQ ID NO: 74453 - DNA, 25 bp, S. pombe
aaatcgcttgattacgcttactcca

SEQ ID NO: 74454 - DNA, 25 bp, S. pombe
aaatccttgacattcgtggcgtcga

SEQ ID NO: 74455 - DNA, 25 bp, S. pombe
aaatctttggcaagccgagcctcaa

SEQ ID NO: 74456 - DNA, 25 bp, S. pombe
aaatgcctttcttgcagcaacctaa

SEQ ID NO: 74457 - DNA, 25 bp, S. pombe
aaatcttgtgttttcagttgtacga

SEQ ID NO: 74458 - DNA, 25 bp, S. pombe
aaatcttgcactttagcgtcgtatc

SEQ ID NO: 74459 - DNA, 25 bp, S. pombe
aaatctccacttgatagctcgtcag

SEQ ID NO: 74460 - DNA, 25 bp, S. pombe
aaatcccctttttagcgtcagacat

SEQ ID NO: 74461 - DNA, 25 bp, S. pombe
aaatcttcattctcttcggtcaaaa

SEQ ID NO: 74462 - DNA, 25 bp, S. pombe
aaatcttcaagcagctgtacttcaa

SEQ ID NO: 74463 - DNA, 25 bp, S. pombe
aaatgatacttctaactcccctaca

SEQ ID NO: 74464 - DNA, 25 bp, S. pombe
aaatgcattcgtttattacgcttaa

SEQ ID NO: 74465 - DNA, 25 bp, S. pombe
aaatcccgattcttcctttgatgat

SEQ ID NO: 74466 - DNA, 25 bp, S. pombe
aaatctacgtgctttatcttccagt

SEQ ID NO: 74467 - DNA, 25 bp, S. pombe
aaatctacgcaattgactcttccgc

SEQ ID NO: 74468 - DNA, 25 bp, S. pombe
aaatctaggattgagcttgccctca

SEQ ID NO: 74469 - DNA, 25 bp, S. pombe
aaatgtgactttgggcattgcccta

SEQ ID NO: 74470 - DNA, 25 bp, S. pombe
aaagtagctattcaccaaggcgcag

SEQ ID NO: 74471 - DNA, 25 bp, S. pombe
aaagtaccactgttcctgagaccat

SEQ ID NO: 74472 - DNA, 25 bp, S. pombe
aaatgcgatacttgttcccagaact

SEQ ID NO: 74473 - DNA, 25 bp, S. pombe
aaatggaccctgctgaacatactcg

SEQ ID NO: 74474 - DNA, 25 bp, S. pombe
aaaggcagttgactcctactacttc

SEQ ID NO: 74475 - DNA, 25 bp, S. pombe
aaatgctctttttcgatcttccatg

SEQ ID NO: 74476 - DNA, 25 bp, S. pombe
aaatgcttctgtttctgttgatgac

SEQ ID NO: 74477 - DNA, 25 bp, S. pombe
aaatgtgcctggaagctgctaggat

SEQ ID NO: 74478 - DNA, 25 bp, S. pombe
aaatggcacgacaatcctcaggtta

SEQ ID NO: 74479 - DNA, 25 bp, S. pombe
aaagagctacaatcactaaggacgt

SEQ ID NO: 74480 - DNA, 25 bp, S. pombe
aaatgccctcgctgcaaaggtgagc

SEQ ID NO: 74481 - DNA, 25 bp, S. pombe
aaatctgccggtcctcaaggagaca

SEQ ID NO: 74482 - DNA, 25 bp, S. pombe
aaatcgatgccattgtcgtcggcgc

SEQ ID NO: 74483 - DNA, 25 bp, S. pombe
aaatgccatcagaattgtgctccta

SEQ ID NO: 74484 - DNA, 25 bp, S. pombe
aaatgcattgcgaaattccctcctg

SEQ ID NO: 74485 - DNA, 25 bp, S. pombe
aaatgcttgtttttgccatgccgct

SEQ ID NO: 74486 - DNA, 25 bp, S. pombe
aaatgttactgtgggccaggcctat

SEQ ID NO: 74487 - DNA, 25 bp, S. pombe
aaatgtattcgtgctcaggtgcctt

SEQ ID NO: 74488 - DNA, 25 bp, S. pombe
aaagctcggtttctatatttgtcgc

SEQ ID NO: 74489 - DNA, 25 bp, S. pombe
aaatgacgggctatgtttctactcg

SEQ ID NO: 74490 - DNA, 25 bp, S. pombe
aaatgaagggtgttcctcttcgtct

SEQ ID NO: 74491 - DNA, 25 bp, S. pombe
aacgttacagagtgttcagttcttg

SEQ ID NO: 74492 - DNA, 25 bp, S. pombe
aaagcttacggatggtctttctgct

SEQ ID NO: 74493 - DNA, 25 bp, S. pombe
aaatgttacgctacgaggctttctt

SEQ ID NO: 74494 - DNA, 25 bp, S. pombe
aaagtactgatccaagcttacaagg

SEQ ID NO: 74495 - DNA, 25 bp, S. pombe
aaatgccaattcctgactggatcaa

SEQ ID NO: 74496 - DNA, 25 bp, S. pombe
aaatcgctcgttttattgctcatct

SEQ ID NO: 74497 - DNA, 25 bp, S. pombe
aaatcctgcgtttgtaagccgtttg

SEQ ID NO: 74498 - DNA, 25 bp, S. pombe
aaatcggccttatcagagcctgatt

SEQ ID NO: 74499 - DNA, 25 bp, S. pombe
aaatcggtctggtgaagctcgcact

SEQ ID NO: 74500 - DNA, 25 bp, S. pombe
aaatgctcgccttggtgatattgct

SEQ ID NO: 74501 - DNA, 25 bp, S. pombe
aaatgatgcctttcgctttttctcc

SEQ ID NO: 74502 - DNA, 25 bp, S. pombe
aaatcctgtgttagcattctttccc

SEQ ID NO: 74503 - DNA, 25 bp, S. pombe
aaatcgtgctgtttgtatgctttca

SEQ ID NO: 74504 - DNA, 25 bp, S. pombe
aaatcgtgcaggttttgctcgtcac

SEQ ID NO: 74505 - DNA, 25 bp, S. pombe
aaatgtgtcggattacttctggcag

SEQ ID NO: 74506 - DNA, 25 bp, S. pombe
aaatccggatgcaagtttcagacta

SEQ ID NO: 74507 - DNA, 25 bp, S. pombe
aaatgacattgcttccatcaaaggt

SEQ ID NO: 74508 - DNA, 25 bp, S. pombe
aaatgactctcaacgatcggaagat

SEQ ID NO: 74509 - DNA, 25 bp, S. pombe
aaatgcgtacgattccgacactaaa

SEQ ID NO: 74510 - DNA, 25 bp, S. pombe
aaatctgatgaaacggtctgcaaac

SEQ ID NO: 74511 - DNA, 25 bp, S. pombe
aaatccttttcctttcagcaacttg

SEQ ID NO: 74512 - DNA, 25 bp, S. pombe
aaaggaatcttgttgttgagggaat

SEQ ID NO: 74513 - DNA, 25 bp, S. pombe
aaatggaacgtgctctaggtatcaa

SEQ ID NO: 74514 - DNA, 25 bp, S. pombe
aaatgggttcatcgtcgcaggtgct

SEQ ID NO: 74515 - DNA, 25 bp, S. pombe
aaatcggctattgcagtcttgtata

SEQ ID NO: 74516 - DNA, 25 bp, S. pombe
aaatcggtgtttcgtcaagccatac

SEQ ID NO: 74517 - DNA, 25 bp, S. pombe
aaatcgcggatttcgtacatgccat

SEQ ID NO: 74518 - DNA, 25 bp, S. pombe
aaatgtttattcacctctttgcctt

SEQ ID NO: 74519 - DNA, 25 bp, S. pombe
aaatgatgttttccaaccgcttcct

SEQ ID NO: 74520 - DNA, 25 bp, S. pombe
aaatgaacgtgtcaccgccaactaa

SEQ ID NO: 74521 - DNA, 25 bp, S. pombe
aaaggcacgcattaaccctcaaact

SEQ ID NO: 74522 - DNA, 25 bp, S. pombe
aaatcgtcatggatgctgagcacgc

SEQ ID NO: 74523 - DNA, 25 bp, S. pombe
aaatggtagctgatgcaatcactga

SEQ ID NO: 74524 - DNA, 25 bp, S. pombe
aaatggcgtattgcatcctgtcgga

SEQ ID NO: 74525 - DNA, 25 bp, S. pombe
aaacctcgttctcttggaggacctg

SEQ ID NO: 74526 - DNA, 25 bp, S. pombe
aaatggagaccttcctcttcagcaa

SEQ ID NO: 74527 - DNA, 25 bp, S. pombe
aaatggcaatttccgctttagaact

SEQ ID NO: 74528 - DNA, 25 bp, S. pombe
aaatgccggactgtactcggatcaa

SEQ ID NO: 74529 - DNA, 25 bp, S. pombe
aaatgcttggacgtggaccgtggaa

SEQ ID NO: 74530 - DNA, 25 bp, S. pombe
aaatgttcttccaattcacggtagt

SEQ ID NO: 74531 - DNA, 25 bp, S. pombe
aaatgccatttcttatccagggtta

SEQ ID NO: 74532 - DNA, 25 bp, S. pombe
aaatgcctcttttctcgcagtggat

SEQ ID NO: 74533 - DNA, 25 bp, S. pombe
aaatcctctttgacacgcttagttg

SEQ ID NO: 74534 - DNA, 25 bp, S. pombe
aaatgtttcatcttgcggttttcgt

SEQ ID NO: 74535 - DNA, 25 bp, S. pombe
ggaaggttccaatgtcgtagtcgtt

SEQ ID NO: 74536 - DNA, 25 bp, S. pombe
aaagagttacttatcgtcgtcgtct

SEQ ID NO: 74537 - DNA, 25 bp, S. pombe
aaatggctttttttggctgtgtggt

SEQ ID NO: 74538 - DNA, 25 bp, S. pombe
aaatgatgcttttttgggcgggcct

SEQ ID NO: 74539 - DNA, 25 bp, S. pombe
aaatgatgactttttctcctctgac

SEQ ID NO: 74540 - DNA, 25 bp, S. pombe
aaatggctgcatgttttcccgaaag

SEQ ID NO: 74541 - DNA, 25 bp, S. pombe
aaaggccatcaaatttcccgaacat

SEQ ID NO: 74542 - DNA, 25 bp, S. pombe
aaaggttcaagttccccattacatg

SEQ ID NO: 74543 - DNA, 25 bp, S. pombe
aaagatatccagctcaacgttgaac

SEQ ID NO: 74544 - DNA, 25 bp, S. pombe
aaagccccattgtcaccagtagaaa

SEQ ID NO: 74545 - DNA, 25 bp, S. pombe
aaatggccaatgcttgactgctgct

SEQ ID NO: 74546 - DNA, 25 bp, S. pombe
aaatggaaacaattgatgctcgctc

SEQ ID NO: 74547 - DNA, 25 bp, S. pombe
aaatgtcgcaagcatcatgtccctc

SEQ ID NO: 74548 - DNA, 25 bp, S. pombe
aaatgatccatctgcaaccggagct

SEQ ID NO: 74549 - DNA, 25 bp, S. pombe
aaatgctctcatgactccattggaa

SEQ ID NO: 74550 - DNA, 25 bp, S. pombe
aaatgccgctgttgtcgtatcgaaa

SEQ ID NO: 74551 - DNA, 25 bp, S. pombe
aaatgacctgtttcgtttgaactat

SEQ ID NO: 74552 - DNA, 25 bp, S. pombe
aaatgtccggatgcctttactcaag

SEQ ID NO: 74553 - DNA, 25 bp, S. pombe
aaatgatcccaaagcgtttgcccaa

SEQ ID NO: 74554 - DNA, 25 bp, S. pombe
aaatgtgtcggcttgggctacctca

SEQ ID NO: 74555 - DNA, 25 bp, S. pombe
aaatgttcaccattacgctggcact

SEQ ID NO: 74556 - DNA, 25 bp, S. pombe
aaatgtttacgccatctgtctcctg

SEQ ID NO: 74557 - DNA, 25 bp, S. pombe
aaatggaaattatcgcccgtgctcg

SEQ ID NO: 74558 - DNA, 25 bp, S. pombe
aaagtcaacgtctccctgaggatat

SEQ ID NO: 74559 - DNA, 25 bp, S. pombe
aaaggaattagcttcttcgatgaat

SEQ ID NO: 74560 - DNA, 25 bp, S. pombe
aaaggaactgcctcattctctgata

SEQ ID NO: 74561 - DNA, 25 bp, S. pombe
aaagtcgtcgactcttcaaattcca

SEQ ID NO: 74562 - DNA, 25 bp, S. pombe
aacagttacgccatattcaagattt

SEQ ID NO: 74563 - DNA, 25 bp, S. pombe
aaatgtcttccacctttgcaaagga

SEQ ID NO: 74564 - DNA, 25 bp, S. pombe
aaatggtctactgatttgactacgc

SEQ ID NO: 74565 - DNA, 25 bp, S. pombe
aaaggaatcggtccagctgaatgac

SEQ ID NO: 74566 - DNA, 25 bp, S. pombe
aaaggccacggtcagctgttgaaga

SEQ ID NO: 74567 - DNA, 25 bp, S. pombe
aaatgaccaagcgtgctccttctga

SEQ ID NO: 74568 - DNA, 25 bp, S. pombe
aaatgggcgctgctgttccaactac

SEQ ID NO: 74569 - DNA, 25 bp, S. pombe
aaatggagttcgttctccgacatcc

SEQ ID NO: 74570 - DNA, 25 bp, S. pombe
caaagggcggtttccattaaggcat

SEQ ID NO: 74571 - DNA, 25 bp, S. pombe
aaatgtccctactgtcctaatgaaa

SEQ ID NO: 74572 - DNA, 25 bp, S. pombe
aaatgcttccaactcgacttaatga

SEQ ID NO: 74573 - DNA, 25 bp, S. pombe
aaatgccgatgcgtttgatgaaagc

SEQ ID NO: 74574 - DNA, 25 bp, S. pombe
aaatgagcgtgtacttgcagtcaat

SEQ ID NO: 74575 - DNA, 25 bp, S. pombe
aaatggcattgttcaccgtgacata

SEQ ID NO: 74576 - DNA, 25 bp, S. pombe
aaaggtcagttcaacggcaattcgt

SEQ ID NO: 74577 - DNA, 25 bp, S. pombe
aaaggcgctagggtggtcagcatta

SEQ ID NO: 74578 - DNA, 25 bp, S. pombe
aaatgagcctgcgacatgtatctgc

SEQ ID NO: 74579 - DNA, 25 bp, S. pombe
aaatgggctgctgttgatgctgctc

SEQ ID NO: 74580 - DNA, 25 bp, S. pombe
aaatgggcttcaccagagttgcgaa

SEQ ID NO: 74581 - DNA, 25 bp, S. pombe
aaaggcatttgatcgccattccaac

SEQ ID NO: 74582 - DNA, 25 bp, S. pombe
aaagtgcccgagtgcaaacctgaac

SEQ ID NO: 74583 - DNA, 25 bp, S. pombe
aaagtcgacggatgaacgcctagaa

SEQ ID NO: 74584 - DNA, 25 bp, S. pombe
gaaaccgtcggtgatacgtttacat

SEQ ID NO: 74585 - DNA, 25 bp, S. pombe
aaagtccttgaacctgtcgttgcaa

SEQ ID NO: 74586 - DNA, 25 bp, S. pombe
aaagtccgtgcaattcagctcgttt

SEQ ID NO: 74587 - DNA, 25 bp, S. pombe
aaagttcgtttttgcatgccttggc

SEQ ID NO: 74588 - DNA, 25 bp, S. pombe
aaatgttctattttctgtcgctcgt

SEQ ID NO: 74589 - DNA, 25 bp, S. pombe
aaatgttcattttttgctcggcaaa

SEQ ID NO: 74590 - DNA, 25 bp, S. pombe
aaatgtctttttgatgcgcggcgaa

SEQ ID NO: 74591 - DNA, 25 bp, S. pombe
aaatgactatttatcgggcaccaaa

SEQ ID NO: 74592 - DNA, 25 bp, S. pombe
aacatggtcattgattcgggatcga

SEQ ID NO: 74593 - DNA, 25 bp, S. pombe
aagccgacgcaattttcgaggccgt

SEQ ID NO: 74594 - DNA, 25 bp, S. pombe
aaatgaagtattcccttgaccgctt

SEQ ID NO: 74595 - DNA, 25 bp, S. pombe
aaagattctagtgggcttggacgcg

SEQ ID NO: 74596 - DNA, 25 bp, S. pombe
aaatgttctcatcccttttacatca

SEQ ID NO: 74597 - DNA, 25 bp, S. pombe
aaagtggcactcgtcttggtaccaa

SEQ ID NO: 74598 - DNA, 25 bp, S. pombe
aaatggcctagtactgctggttcca

SEQ ID NO: 74599 - DNA, 25 bp, S. pombe
aaatgacatctcgtggactcgctat

SEQ ID NO: 74600 - DNA, 25 bp, S. pombe
aaatgagaccagtccatctgattta

SEQ ID NO: 74601 - DNA, 25 bp, S. pombe
aaatggagccattctccggttgggt

SEQ ID NO: 74602 - DNA, 25 bp, S. pombe
taaagggaaacctcgtctcacaaag

SEQ ID NO: 74603 - DNA, 25 bp, S. pombe
aaatggccatcaaaattccctctgt

SEQ ID NO: 74604 - DNA, 25 bp, S. pombe
aaatgggctacacttttcgtctgat

SEQ ID NO: 74605 - DNA, 25 bp, S. pombe
aaatgagttgaatttgttcgccaaa

SEQ ID NO: 74606 - DNA, 25 bp, S. pombe
aaaggcagttgctctttggccgaag

SEQ ID NO: 74607 - DNA, 25 bp, S. pombe
aaaggcacttcaaccttacctgtag

SEQ ID NO: 74608 - DNA, 25 bp, S. pombe
aaagtgcaacactccgtcaacaggt

SEQ ID NO: 74609 - DNA, 25 bp, S. pombe
aaaggattcagtcccaagtatcagg

SEQ ID NO: 74610 - DNA, 25 bp, S. pombe
aaagccatgtaccaccacgtatatc

SEQ ID NO: 74611 - DNA, 25 bp, S. pombe
aaatgcctatgaatcctatcgtaac

SEQ ID NO: 74612 - DNA, 25 bp, S. pombe
aaatgccggatttcgtctgagaaca

SEQ ID NO: 74613 - DNA, 25 bp, S. pombe
aaaggcggaatttcgaagacatcgg

SEQ ID NO: 74614 - DNA, 25 bp, S. pombe
aaatgctcactcacttgaacatccg

SEQ ID NO: 74615 - DNA, 25 bp, S. pombe
aaatgagtctctaccagggacctct

SEQ ID NO: 74616 - DNA, 25 bp, S. pombe
aaagggtgaccaagagtacgctcca

SEQ ID NO: 74617 - DNA, 25 bp, S. pombe
aaatgggtagcgtggtttgcaagca

SEQ ID NO: 74618 - DNA, 25 bp, S. pombe
aaatggcacagcgtctttaaggata

SEQ ID NO: 74619 - DNA, 25 bp, S. pombe
aaatgtttgcgcatgccgaattaaa

SEQ ID NO: 74620 - DNA, 25 bp, S. pombe
aaagtactacttttatcgcatccaa

SEQ ID NO: 74621 - DNA, 25 bp, S. pombe
aaaggtcgtctttctattgttcaat

SEQ ID NO: 74622 - DNA, 25 bp, S. pombe
aaagtgttgtctcattgtagtccta

SEQ ID NO: 74623 - DNA, 25 bp, S. pombe
aaatggttgccttaggtgcttccta

SEQ ID NO: 74624 - DNA, 25 bp, S. pombe
aaatgggcatgtttaggcgttcctt

SEQ ID NO: 74625 - DNA, 25 bp, S. pombe
aaatgcatttgccttactgaccttt

SEQ ID NO: 74626 - DNA, 25 bp, S. pombe
aaatgaggactcttgccgatgctgc

SEQ ID NO: 74627 - DNA, 25 bp, S. pombe
aaatgaagagccctgctgcgtgctc

SEQ ID NO: 74628 - DNA, 25 bp, S. pombe
aaatgcatgcaagagcgcgtggccc

SEQ ID NO: 74629 - DNA, 25 bp, S. pombe
aaatgctgacaagcctgttgcacct

SEQ ID NO: 74630 - DNA, 25 bp, S. pombe
aaagtgatatgaccgcttccgagca

SEQ ID NO: 74631 - DNA, 25 bp, S. pombe
aaatgctggcaatcttgaggctgaa

SEQ ID NO: 74632 - DNA, 25 bp, S. pombe
aaagctcagcattgcctcagagaat

SEQ ID NO: 74633 - DNA, 25 bp, S. pombe
aaatgtgccttccatatctattcag

SEQ ID NO: 74634 - DNA, 25 bp, S. pombe
aaatggctctgttggtttgtcaaac

SEQ ID NO: 74635 - DNA, 25 bp, S. pombe
aaatgcttgtctttgatcctcgtaa

SEQ ID NO: 74636 - DNA, 25 bp, S. pombe
aaatgcattttcttgtctggcagaa

SEQ ID NO: 74637 - DNA, 25 bp, S. pombe
aaatgctgcttttgttctcgcgatg

SEQ ID NO: 74638 - DNA, 25 bp, S. pombe
aaatgtcttcaacttatcgcgatat

SEQ ID NO: 74639 - DNA, 25 bp, S. pombe
aaagggtctcccaagataattcgtg

SEQ ID NO: 74640 - DNA, 25 bp, S. pombe
aaatgggcatttctcgctctgcttg

SEQ ID NO: 74641 - DNA, 25 bp, S. pombe
aaaggcgttcagagttttcagcaga

SEQ ID NO: 74642 - DNA, 25 bp, S. pombe
aaaggcgttcaagggcatcttcacc

SEQ ID NO: 74643 - DNA, 25 bp, S. pombe
aaaggctttcaagggtctctgattt

SEQ ID NO: 74644 - DNA, 25 bp, S. pombe
aaaggcgatctcaaacaatccggtt

SEQ ID NO: 74645 - DNA, 25 bp, S. pombe
aaagggtactgagcacccaggtgca

SEQ ID NO: 74646 - DNA, 25 bp, S. pombe
aaatggttcgtgttcatggtccaga

SEQ ID NO: 74647 - DNA, 25 bp, S. pombe
aaatggtccatcagctgtttccgac

SEQ ID NO: 74648 - DNA, 25 bp, S. pombe
aaaggagcccgttgttcgtgaacag

SEQ ID NO: 74649 - DNA, 25 bp, S. pombe
aaagtcgcttacaccgaaacagaga

SEQ ID NO: 74650 - DNA, 25 bp, S. pombe
aaaggcactgacagccactggagaa

SEQ ID NO: 74651 - DNA, 25 bp, S. pombe
aaatggcaagccatctcctactaga

SEQ ID NO: 74652 - DNA, 25 bp, S. pombe
aaatgtatggtcctactgtcgcttc

SEQ ID NO: 74653 - DNA, 25 bp, S. pombe
aaatgtggacccaatcttccagtct

SEQ ID NO: 74654 - DNA, 25 bp, S. pombe
aaaggcaaacctcttgtcaactcca

SEQ ID NO: 74655 - DNA, 25 bp, S. pombe
aaaggcttgaacgtgcgcgtgctga

SEQ ID NO: 74656 - DNA, 25 bp, S. pombe
aaagtcaccatcttgtctcgtattg

SEQ ID NO: 74657 - DNA, 25 bp, S. pombe
aaatgattcgccttcacttgtgttg

SEQ ID NO: 74658 - DNA, 25 bp, S. pombe
aaatgttggctgtttgcttttcttg

SEQ ID NO: 74659 - DNA, 25 bp, S. pombe
aaagttgccagctttgtctgacgtt

SEQ ID NO: 74660 - DNA, 25 bp, S. pombe
aaatgatccccgagtggcactgttt

SEQ ID NO: 74661 - DNA, 25 bp, S. pombe
aaaggcatcccgaggcatatcttag

SEQ ID NO: 74662 - DNA, 25 bp, S. pombe
aacattggccaaggtggaggtacac

SEQ ID NO: 74663 - DNA, 25 bp, S. pombe
aaatgtcgtctatgcgaggccaagc

SEQ ID NO: 74664 - DNA, 25 bp, S. pombe
aaatgatcgccttgggtcacaggct

SEQ ID NO: 74665 - DNA, 25 bp, S. pombe
aaatgacattcctgagctccgagtg

SEQ ID NO: 74666 - DNA, 25 bp, S. pombe
aaatgtgatccacgaactggccgct

SEQ ID NO: 74667 - DNA, 25 bp, S. pombe
aaatggtatgcgacccgctaagctc

SEQ ID NO: 74668 - DNA, 25 bp, S. pombe
aaatgtttcgccgtctgctaatcat

SEQ ID NO: 74669 - DNA, 25 bp, S. pombe
aaatgtttgccctctgctttatatc

SEQ ID NO: 74670 - DNA, 25 bp, S. pombe
aaagtcctcttagcgtcattgtagt

SEQ ID NO: 74671 - DNA, 25 bp, S. pombe
aaaggacctaatattcatgatgtga

SEQ ID NO: 74672 - DNA, 25 bp, S. pombe
aaaggaatccatcgagttgcaagaa

SEQ ID NO: 74673 - DNA, 25 bp, S. pombe
aaagaggttctttgttgcacatgga

SEQ ID NO: 74674 - DNA, 25 bp, S. pombe
aacatttccttatggtgtcgctaaa

SEQ ID NO: 74675 - DNA, 25 bp, S. pombe
aaaggcccattctggcgtggtaaat

SEQ ID NO: 74676 - DNA, 25 bp, S. pombe
aaatggcgctcaatgccggtggtta

SEQ ID NO: 74677 - DNA, 25 bp, S. pombe
aaatgttgctgagtccttggtttcg

SEQ ID NO: 74678 - DNA, 25 bp, S. pombe
aaatgtagcgctgaattcctttgca

SEQ ID NO: 74679 - DNA, 25 bp, S. pombe
aaatgttatctttcagcccattcaa

SEQ ID NO: 74680 - DNA, 25 bp, S. pombe
aaatgttgattctattgcccttaat

SEQ ID NO: 74681 - DNA, 25 bp, S. pombe
aaatggcatcatctcactgaacaaa

SEQ ID NO: 74682 - DNA, 25 bp, S. pombe
aaatggtgctgccaactctctggaa

SEQ ID NO: 74683 - DNA, 25 bp, S. pombe
aaaggtgccgtcgacgtgtcagatt

SEQ ID NO: 74684 - DNA, 25 bp, S. pombe
aaaggcttcatattcacgttcgtcg

SEQ ID NO: 74685 - DNA, 25 bp, S. pombe
aatttgccgcttttgtagccaacgt

SEQ ID NO: 74686 - DNA, 25 bp, S. pombe
aaagtggcagcttttgtagcccctt

SEQ ID NO: 74687 - DNA, 25 bp, S. pombe
aaaggtacgtttgatgccatctctt

SEQ ID NO: 74688 - DNA, 25 bp, S. pombe
aaaggaagcctgctgggccatttcc

SEQ ID NO: 74689 - DNA, 25 bp, S. pombe
aaaggcttttgctcaatttgcttcc

SEQ ID NO: 74690 - DNA, 25 bp, S. pombe
aaaggctttggaggcaatgcatcgc

SEQ ID NO: 74691 - DNA, 25 bp, S. pombe
aaatgatggctcatgttctgatgat

SEQ ID NO: 74692 - DNA, 25 bp, S. pombe
aaatgtgcgtcttcttgcgcatgca

SEQ ID NO: 74693 - DNA, 25 bp, S. pombe
aaagatacgccctttatcgtgacgc

SEQ ID NO: 74694 - DNA, 25 bp, S. pombe
aaaagaaagaagctccgccgtcctg

SEQ ID NO: 74695 - DNA, 25 bp, S. pombe
aaatgtgcagcaacctttggccgag

SEQ ID NO: 74696 - DNA, 25 bp, S. pombe
aaatgatttgcttccgttcaatgaa

SEQ ID NO: 74697 - DNA, 25 bp, S. pombe
aaatggtctgtctgcgagacgtcaa

SEQ ID NO: 74698 - DNA, 25 bp, S. pombe
aaatgtgttgtttgagcccaccaaa

SEQ ID NO: 74699 - DNA, 25 bp, S. pombe
aaatgtgtcatctttggcccacaca

SEQ ID NO: 74700 - DNA, 25 bp, S. pombe
aaagtcaagcttcgtttgcccggag

SEQ ID NO: 74701 - DNA, 25 bp, S. pombe
aaatgtcgagttatcttccaccgtt

SEQ ID NO: 74702 - DNA, 25 bp, S. pombe
aaatgtccatgttttatcgggccac

SEQ ID NO: 74703 - DNA, 25 bp, S. pombe
aaatgtcccatgctgtactttatag

SEQ ID NO: 74704 - DNA, 25 bp, S. pombe
aaatgtttgctgcttacgctgtggg

SEQ ID NO: 74705 - DNA, 25 bp, S. pombe
aaatggattcggacaactccctgtt

SEQ ID NO: 74706 - DNA, 25 bp, S. pombe
aaatgtgctttggtcatccatccac

SEQ ID NO: 74707 - DNA, 25 bp, S. pombe
aaagagattattcgccaggttcaaa

SEQ ID NO: 74708 - DNA, 25 bp, S. pombe
aaaggtcttcatggctcattgttca

SEQ ID NO: 74709 - DNA, 25 bp, S. pombe
aaaggctttgatggctactgcttaa

SEQ ID NO: 74710 - DNA, 25 bp, S. pombe
aaatgtctctggtacggttgctcac

SEQ ID NO: 74711 - DNA, 25 bp, S. pombe
aaatggctattctcttgttcgcaag

SEQ ID NO: 74712 - DNA, 25 bp, S. pombe
aaaggattggctttccttcgggcat

SEQ ID NO: 74713 - DNA, 25 bp, S. pombe
aaagtttcgcatgaaccaggccgca

SEQ ID NO: 74714 - DNA, 25 bp, S. pombe
aaagaattccccaacaagtccgatg

SEQ ID NO: 74715 - DNA, 25 bp, S. pombe
aaagacgcgtctaaacgagccgtat

SEQ ID NO: 74716 - DNA, 25 bp, S. pombe
aaaggacacgcatttgcttcaccta

SEQ ID NO: 74717 - DNA, 25 bp, S. pombe
aaaggacatctggtgctgcctatcc

SEQ ID NO: 74718 - DNA, 25 bp, S. pombe
aaatggattagcgttgctctccctt

SEQ ID NO: 74719 - DNA, 25 bp, S. pombe
aaatgggctatcgatgctttccgtt

SEQ ID NO: 74720 - DNA, 25 bp, S. pombe
aaatgggttttcaagctttcagtgc

SEQ ID NO: 74721 - DNA, 25 bp, S. pombe
aaagttgtttccattcctcattccg

SEQ ID NO: 74722 - DNA, 25 bp, S. pombe
aaagtctcagttcttccaaatcgcc

SEQ ID NO: 74723 - DNA, 25 bp, S. pombe
aaaggccgtttcgtcgcagaatgtg

SEQ ID NO: 74724 - DNA, 25 bp, S. pombe
aaaggctcttgcgtttgctagtact

SEQ ID NO: 74725 - DNA, 25 bp, S. pombe
aaatggcctatcatccttggtactt

SEQ ID NO: 74726 - DNA, 25 bp, S. pombe
aaaggcgctctggaatatctcctaa

SEQ ID NO: 74727 - DNA, 25 bp, S. pombe
aaatgtcagctgctattgtccgata

SEQ ID NO: 74728 - DNA, 25 bp, S. pombe
aaatgtctctgctatatgtcgccgt

SEQ ID NO: 74729 - DNA, 25 bp, S. pombe
aaaggcatttttgctctgtgtcccc

SEQ ID NO: 74730 - DNA, 25 bp, S. pombe
aaaggccttcttgcagcttttggac

SEQ ID NO: 74731 - DNA, 25 bp, S. pombe
aaatggcttttttgtcttggaatga

SEQ ID NO: 74732 - DNA, 25 bp, S. pombe
aaaggtgccaaaaccctgatgtttg

SEQ ID NO: 74733 - DNA, 25 bp, S. pombe
aaatggcccatacaacctgagtttc

SEQ ID NO: 74734 - DNA, 25 bp, S. pombe
aaatggtgttgcttcagcctttcga

SEQ ID NO: 74735 - DNA, 25 bp, S. pombe
aaagtcgctttggatgagctggaac

SEQ ID NO: 74736 - DNA, 25 bp, S. pombe
aaagtgcagctcatggagttggcaa

SEQ ID NO: 74737 - DNA, 25 bp, S. pombe
aaagacagctcatcgtcaaccatga

SEQ ID NO: 74738 - DNA, 25 bp, S. pombe
aaagtcgatccaggtcgttcttcga

SEQ ID NO: 74739 - DNA, 25 bp, S. pombe
aaatgggtcttcttgggcttctatc

SEQ ID NO: 74740 - DNA, 25 bp, S. pombe
aaaggctagtggatcttctgtacaa

SEQ ID NO: 74741 - DNA, 25 bp, S. pombe
aaagcttcaacctttatttcaggat

SEQ ID NO: 74742 - DNA, 25 bp, S. pombe
aaacttcaagctgttttctggccca

SEQ ID NO: 74743 - DNA, 25 bp, S. pombe
aaagcttcaactctttccgtgacgt

SEQ ID NO: 74744 - DNA, 25 bp, S. pombe
aaaggcgtctgttgatttagcacat

SEQ ID NO: 74745 - DNA, 25 bp, S. pombe
aaaggcggcatctacttcgaactat

SEQ ID NO: 74746 - DNA, 25 bp, S. pombe
aaaggtgccgtctgatgcaattgaa

SEQ ID NO: 74747 - DNA, 25 bp, S. pombe
aaagacgcgggctctagggcagcta

SEQ ID NO: 74748 - DNA, 25 bp, S. pombe
aaagtcccgagccatttcgaagctt

SEQ ID NO: 74749 - DNA, 25 bp, S. pombe
aaagtcagtccaaccattcgaacgt

SEQ ID NO: 74750 - DNA, 25 bp, S. pombe
aaagcactaccacgtttgtgtccta

SEQ ID NO: 74751 - DNA, 25 bp, S. pombe
aaatggaatctcctcttgcgcttga

SEQ ID NO: 74752 - DNA, 25 bp, S. pombe
aaatggataatctctcacctgctac

SEQ ID NO: 74753 - DNA, 25 bp, S. pombe
aaatggaaagtatgccctcgccgat

SEQ ID NO: 74754 - DNA, 25 bp, S. pombe
aaagtactgaatgccgccaataccc

SEQ ID NO: 74755 - DNA, 25 bp, S. pombe
aaagtactggtcaagctgctgcttc

SEQ ID NO: 74756 - DNA, 25 bp, S. pombe
aaagtggagctgctagtcctcaagc

SEQ ID NO: 74757 - DNA, 25 bp, S. pombe
aaaggttggtctcattgccgctcgc

SEQ ID NO: 74758 - DNA, 25 bp, S. pombe
aaagtttcaattcttgccagctcca

SEQ ID NO: 74759 - DNA, 25 bp, S. pombe
aaagtttccttccaatcatccaaat

SEQ ID NO: 74760 - DNA, 25 bp, S. pombe
aaagatttcctattaaatcgagata

SEQ ID NO: 74761 - DNA, 25 bp, S. pombe
aacgaaaccttgcagacttggagaa

SEQ ID NO: 74762 - DNA, 25 bp, S. pombe
aaagtagggcttttggctgtcacat

SEQ ID NO: 74763 - DNA, 25 bp, S. pombe
aaagaaggactatctcgcgacgaga

SEQ ID NO: 74764 - DNA, 25 bp, S. pombe
aaagtgtcatgggatcctctgtact

SEQ ID NO: 74765 - DNA, 25 bp, S. pombe
aaaggcatctcgctacagttatcta

SEQ ID NO: 74766 - DNA, 25 bp, S. pombe
aaaggtgctgcttactttgttcctg

SEQ ID NO: 74767 - DNA, 25 bp, S. pombe
aaatggactttgtgatcctcccgta

SEQ ID NO: 74768 - DNA, 25 bp, S. pombe
aaaggctgtttgtattgtcggccag

SEQ ID NO: 74769 - DNA, 25 bp, S. pombe
aaaggcttttagttgctcgccgtga

SEQ ID NO: 74770 - DNA, 25 bp, S. pombe
aaatggcatttatggcgccgtcgct

SEQ ID NO: 74771 - DNA, 25 bp, S. pombe
aaagatgacttatacccgtgccgtt

SEQ ID NO: 74772 - DNA, 25 bp, S. pombe
aaaggtccaaaagccagtgcccatt

SEQ ID NO: 74773 - DNA, 25 bp, S. pombe
caaacgtaaagctcgaactgccctt

SEQ ID NO: 74774 - DNA, 25 bp, S. pombe
aaagtataaagctcccttgtcctct

SEQ ID NO: 74775 - DNA, 25 bp, S. pombe
aaaggtatgcccaagctctctttat

SEQ ID NO: 74776 - DNA, 25 bp, S. pombe
aaagtttaccaattcgtctgccact

SEQ ID NO: 74777 - DNA, 25 bp, S. pombe
aaagtttcaacaatacggtgctcaa

SEQ ID NO: 74778 - DNA, 25 bp, S. pombe
aaaggaccatttcctgttggaatat

SEQ ID NO: 74779 - DNA, 25 bp, S. pombe
aaagatccgtttgctttcgacaacg

SEQ ID NO: 74780 - DNA, 25 bp, S. pombe
aaagccccagatgccttaaagaacg

SEQ ID NO: 74781 - DNA, 25 bp, S. pombe
aaaggatccatctgcggatacctcc

SEQ ID NO: 74782 - DNA, 25 bp, S. pombe
aaagttaccccactgatacctatgg

SEQ ID NO: 74783 - DNA, 25 bp, S. pombe
aaagttccacgggttgtcatttcat

SEQ ID NO: 74784 - DNA, 25 bp, S. pombe
aaagtttactggatggtttctctga

SEQ ID NO: 74785 - DNA, 25 bp, S. pombe
aaagtccttgctaaccctatgtata

SEQ ID NO: 74786 - DNA, 25 bp, S. pombe
aaagatcgattattccggccgaggt

SEQ ID NO: 74787 - DNA, 25 bp, S. pombe
aaagtttgatgatccctgcctattg

SEQ ID NO: 74788 - DNA, 25 bp, S. pombe
aaagttgatgatcccgttgccgttg

SEQ ID NO: 74789 - DNA, 25 bp, S. pombe
aaagtgctctttcatgttttgtaag

SEQ ID NO: 74790 - DNA, 25 bp, S. pombe
aaaggctcttctcggcttgtattga

SEQ ID NO: 74791 - DNA, 25 bp, S. pombe
aaagacgcccacgattttcagaagt

SEQ ID NO: 74792 - DNA, 25 bp, S. pombe
aaagtcggcgctttgtgtcgtcaaa

SEQ ID NO: 74793 - DNA, 25 bp, S. pombe
aaagtatgccctgagcgctattctt

SEQ ID NO: 74794 - DNA, 25 bp, S. pombe
aaaggatgcgctggagtctctaaac

SEQ ID NO: 74795 - DNA, 25 bp, S. pombe
aaaggtgccgttcagattaactcat

SEQ ID NO: 74796 - DNA, 25 bp, S. pombe
aaagtcctgtttctgttagcaatga

SEQ ID NO: 74797 - DNA, 25 bp, S. pombe
aaagtttgtcgtccgcttatctata

SEQ ID NO: 74798 - DNA, 25 bp, S. pombe
aaaggagggtgcatcattgactggc

SEQ ID NO: 74799 - DNA, 25 bp, S. pombe
aaagatggtgcaagcgccgtgacat

SEQ ID NO: 74800 - DNA, 25 bp, S. pombe
aaaggagccgcatcacagtgaattg

SEQ ID NO: 74801 - DNA, 25 bp, S. pombe
aaaggctcccactaatgatggcagt

SEQ ID NO: 74802 - DNA, 25 bp, S. pombe
aaaggacccatcttcacatgtgaaa

SEQ ID NO: 74803 - DNA, 25 bp, S. pombe
aaagctgccatgcataaccctaatg

SEQ ID NO: 74804 - DNA, 25 bp, S. pombe
aaagatgcaggatcaagcccgctta

SEQ ID NO: 74805 - DNA, 25 bp, S. pombe
aaaggcggagtctgatctagttaat

SEQ ID NO: 74806 - DNA, 25 bp, S. pombe
aaaggcggcgttttatgctgttgga

SEQ ID NO: 74807 - DNA, 25 bp, S. pombe
aaaggcttggttttggctgctatgg

SEQ ID NO: 74808 - DNA, 25 bp, S. pombe
aaaggttggtcttattgctgctcgt

SEQ ID NO: 74809 - DNA, 25 bp, S. pombe
aaaggttggtgtcactggcaagtac

SEQ ID NO: 74810 - DNA, 25 bp, S. pombe
aaaggtatttcttccatgcagccca

SEQ ID NO: 74811 - DNA, 25 bp, S. pombe
aaagctaacaaatctccgctctact

SEQ ID NO: 74812 - DNA, 25 bp, S. pombe
aaagaatgccaatgactccctcaag

SEQ ID NO: 74813 - DNA, 25 bp, S. pombe
aaagaaggagagtcctgccacccat

SEQ ID NO: 74814 - DNA, 25 bp, S. pombe
aaaggatggccaacctgggacctgg

SEQ ID NO: 74815 - DNA, 25 bp, S. pombe
aaaggtgcttctccttggcgacaat

SEQ ID NO: 74816 - DNA, 25 bp, S. pombe
aaagggctgcgcagtggcgtaacaa

SEQ ID NO: 74817 - DNA, 25 bp, S. pombe
aaagatgtcgaattggtccttccaa

SEQ ID NO: 74818 - DNA, 25 bp, S. pombe
aaagattcgcttgggtcgctaacac

SEQ ID NO: 74819 - DNA, 25 bp, S. pombe
aaaggaactctcgacacagggcact

SEQ ID NO: 74820 - DNA, 25 bp, S. pombe
aaagggctaatatatcgtgtgcata

SEQ ID NO: 74821 - DNA, 25 bp, S. pombe
aaaggtctctagttgcattggctct

SEQ ID NO: 74822 - DNA, 25 bp, S. pombe
aaaggtctccaccatgcagggtaaa

SEQ ID NO: 74823 - DNA, 25 bp, S. pombe
aaaggtcaccaatgccggtgctaag

SEQ ID NO: 74824 - DNA, 25 bp, S. pombe
aaagcaaactcgtgccggtcaacgt

SEQ ID NO: 74825 - DNA, 25 bp, S. pombe
aaagcagaacatagcggtcaaacga

SEQ ID NO: 74826 - DNA, 25 bp, S. pombe
aaaggatacagactcggctatgccg

SEQ ID NO: 74827 - DNA, 25 bp, S. pombe
aaagtttaccgccatcatgatgcag

SEQ ID NO: 74828 - DNA, 25 bp, S. pombe
aaagctttgactgccgatgagatcc

SEQ ID NO: 74829 - DNA, 25 bp, S. pombe
aaagttgctaaggacgcagctactc

SEQ ID NO: 74830 - DNA, 25 bp, S. pombe
aaagcattcctcaactaatctccgg

SEQ ID NO: 74831 - DNA, 25 bp, S. pombe
aaactgtaccttctaatgccatcac

SEQ ID NO: 74832 - DNA, 25 bp, S. pombe
aaagggcgctcgttgttatatttca

SEQ ID NO: 74833 - DNA, 25 bp, S. pombe
aaagtccctgcttgtatctattgct

SEQ ID NO: 74834 - DNA, 25 bp, S. pombe
aaagtgccgcagagtgtttgataat

SEQ ID NO: 74835 - DNA, 25 bp, S. pombe
aaagtgtccgttttcaagctatgcg

SEQ ID NO: 74836 - DNA, 25 bp, S. pombe
aaagtatcgcgtgaagaatttgccg

SEQ ID NO: 74837 - DNA, 25 bp, S. pombe
aaagatttccaagcgggctgctgcc

SEQ ID NO: 74838 - DNA, 25 bp, S. pombe
aaaggatgcttcgatactatgttca

SEQ ID NO: 74839 - DNA, 25 bp, S. pombe
aaagtactgatcttgcctctcagtc

SEQ ID NO: 74840 - DNA, 25 bp, S. pombe
aaagttctgcgcttattacgccttt

SEQ ID NO: 74841 - DNA, 25 bp, S. pombe
aaagatactgcctctaaagcctcat

SEQ ID NO: 74842 - DNA, 25 bp, S. pombe
aaaggtctgcctttacagctactat

SEQ ID NO: 74843 - DNA, 25 bp, S. pombe
aaagaagctccaatggctccttttc

SEQ ID NO: 74844 - DNA, 25 bp, S. pombe
aaagactcccatatctcgattttcc

SEQ ID NO: 74845 - DNA, 25 bp, S. pombe
aaagatgcaactgcttcttcttctt

SEQ ID NO: 74846 - DNA, 25 bp, S. pombe
aaagtgatacacatagctagctcgg

SEQ ID NO: 74847 - DNA, 25 bp, S. pombe
aaaggaccagcgtgtagctcgcaca

SEQ ID NO: 74848 - DNA, 25 bp, S. pombe
aaagcttctttgcactcaagtaccc

SEQ ID NO: 74849 - DNA, 25 bp, S. pombe
aaagatttctctcaccaaatacaga

SEQ ID NO: 74850 - DNA, 25 bp, S. pombe
aaagtgttgctgaacccgtagtcgg

SEQ ID NO: 74851 - DNA, 25 bp, S. pombe
aaagggtgccccttcttcaattcat

SEQ ID NO: 74852 - DNA, 25 bp, S. pombe
aaactgtttgcctatcctccaaagt

SEQ ID NO: 74853 - DNA, 25 bp, S. pombe
aaagcgtgattctgattaccaaagt

SEQ ID NO: 74854 - DNA, 25 bp, S. pombe
aaagacgctgtcgagattaccgaat

SEQ ID NO: 74855 - DNA, 25 bp, S. pombe
aaagacgctgtcgacgttacggagt

SEQ ID NO: 74856 - DNA, 25 bp, S. pombe
aaagcaagtactctgttaccggccg

SEQ ID NO: 74857 - DNA, 25 bp, S. pombe
aaagaggttctcctgatacgccgga

SEQ ID NO: 74858 - DNA, 25 bp, S. pombe
aaaggttactccaatccgcttgtat

SEQ ID NO: 74859 - DNA, 25 bp, S. pombe
aaaggttatgttcgcagattctgga

SEQ ID NO: 74860 - DNA, 25 bp, S. pombe
aaaggtcctgtaatcacattcatta

SEQ ID NO: 74861 - DNA, 25 bp, S. pombe
aaaggtggctatatgtctctatgga

SEQ ID NO: 74862 - DNA, 25 bp, S. pombe
aaagagatcctttcggtggtgccaa

SEQ ID NO: 74863 - DNA, 25 bp, S. pombe
aaagaagtatcgtgatgccagacaa

SEQ ID NO: 74864 - DNA, 25 bp, S. pombe
aatacaaccatcttgggcggtagta

SEQ ID NO: 74865 - DNA, 25 bp, S. pombe
aaagatactccttcgcgggttgtga

SEQ ID NO: 74866 - DNA, 25 bp, S. pombe
aaagtaactctggtcctgctggagc

SEQ ID NO: 74867 - DNA, 25 bp, S. pombe
aaagacaatctttacgccggagcaa

SEQ ID NO: 74868 - DNA, 25 bp, S. pombe
aaaacacgacggtcagtcacgacgc

SEQ ID NO: 74869 - DNA, 25 bp, S. pombe
aaagttcaagagcattcttcccgag

SEQ ID NO: 74870 - DNA, 25 bp, S. pombe
aaaggtctgacacagtcgttcgcga

SEQ ID NO: 74871 - DNA, 25 bp, S. pombe
aaaggttgcacatcttcagttggaa

SEQ ID NO: 74872 - DNA, 25 bp, S. pombe
aaaggttccaccatgcattttgaat

SEQ ID NO: 74873 - DNA, 25 bp, S. pombe
aaagctggtacactttctcgtttgc

SEQ ID NO: 74874 - DNA, 25 bp, S. pombe
aaagtgcgccaaagctcgcggagct

SEQ ID NO: 74875 - DNA, 25 bp, S. pombe
aaagatccaaaaatgctcccagtat

SEQ ID NO: 74876 - DNA, 25 bp, S. pombe
aaagacttgcatactctgcggaata

SEQ ID NO: 74877 - DNA, 25 bp, S. pombe
aaagaccctcttttctattccagat

SEQ ID NO: 74878 - DNA, 25 bp, S. pombe
aaagtgccgctatttcttgttaact

SEQ ID NO: 74879 - DNA, 25 bp, S. pombe
aaagctccgaggtggatcctggttc

SEQ ID NO: 74880 - DNA, 25 bp, S. pombe
aaagtcaccaagtccgattccgatt

SEQ ID NO: 74881 - DNA, 25 bp, S. pombe
aaagtcatccacatcctgttaggtt

SEQ ID NO: 74882 - DNA, 25 bp, S. pombe
aaagtccactcattgctttgcgtgt

SEQ ID NO: 74883 - DNA, 25 bp, S. pombe
aaagtccgcttatgctgcgatgctg

SEQ ID NO: 74884 - DNA, 25 bp, S. pombe
aaagtgtctctttagctgcgagggt

SEQ ID NO: 74885 - DNA, 25 bp, S. pombe
aaagtttcttcctctgacttctata

SEQ ID NO: 74886 - DNA, 25 bp, S. pombe
aaagtctcctgcaccgaatttccaa

SEQ ID NO: 74887 - DNA, 25 bp, S. pombe
aaagcctttgcgtgttgaatttcgt

SEQ ID NO: 74888 - DNA, 25 bp, S. pombe
aaagtcgtgggtattgatatttccg

SEQ ID NO: 74889 - DNA, 25 bp, S. pombe
aaagtgtgttcgtttgtcttcaaga

SEQ ID NO: 74890 - DNA, 25 bp, S. pombe
aaaggtgctccggtgtttcgcaagc

SEQ ID NO: 74891 - DNA, 25 bp, S. pombe
aaagatctgctgttcgtcgtgttaa

SEQ ID NO: 74892 - DNA, 25 bp, S. pombe
aaagatctgctgctcgttcgggtac

SEQ ID NO: 74893 - DNA, 25 bp, S. pombe
aaagtatcattgacggccttggaga

SEQ ID NO: 74894 - DNA, 25 bp, S. pombe
aaagtcactattaccaccggtgtcg

SEQ ID NO: 74895 - DNA, 25 bp, S. pombe
aaagatgctgattttcgcaccggtc

SEQ ID NO: 74896 - DNA, 25 bp, S. pombe
aaagaatcatgcgaccgaccgatgt

SEQ ID NO: 74897 - DNA, 25 bp, S. pombe
aaagcagctgctgaagcggccctaa

SEQ ID NO: 74898 - DNA, 25 bp, S. pombe
aaagggcatatgacgcagctctcac

SEQ ID NO: 74899 - DNA, 25 bp, S. pombe
aaagagttggtcgagcctcctaccg

SEQ ID NO: 74900 - DNA, 25 bp, S. pombe
aaagatgtagattcggcgtctgccg

SEQ ID NO: 74901 - DNA, 25 bp, S. pombe
aaagggtggtgctaagcgccatcgt

SEQ ID NO: 74902 - DNA, 25 bp, S. pombe
aaagaggcattctggtaccgcaagc

SEQ ID NO: 74903 - DNA, 25 bp, S. pombe
aaagaaaatcctattgaccctcaga

SEQ ID NO: 74904 - DNA, 25 bp, S. pombe
aaagccattacctgaaattccgaat

SEQ ID NO: 74905 - DNA, 25 bp, S. pombe
aaaacgatcgttcaagtcgccgacg

SEQ ID NO: 74906 - DNA, 25 bp, S. pombe
aaagacaacgtttgagagcctccgg

SEQ ID NO: 74907 - DNA, 25 bp, S. pombe
aaagtatatcgtcttgtcctcgcta

SEQ ID NO: 74908 - DNA, 25 bp, S. pombe
aaagtactagtcctattcctgctcg

SEQ ID NO: 74909 - DNA, 25 bp, S. pombe
aaagtatggatcagtctgctccgcc

SEQ ID NO: 74910 - DNA, 25 bp, S. pombe
aaagttgctgatttctctgctcaca

SEQ ID NO: 74911 - DNA, 25 bp, S. pombe
aaagcaagaaaagcccaagcaacca

SEQ ID NO: 74912 - DNA, 25 bp, S. pombe
aaagcaagaaaagcccaagcaacca

SEQ ID NO: 74913 - DNA, 25 bp, S. pombe
aaagcaagagaagcccaagcagccc

SEQ ID NO: 74914 - DNA, 25 bp, S. pombe
aaagctacacttccctcagaaattg

SEQ ID NO: 74915 - DNA, 25 bp, S. pombe
aaagtatcatcttccagtaatatag

SEQ ID NO: 74916 - DNA, 25 bp, S. pombe
aaagatatgctaccagaatgctctg

SEQ ID NO: 74917 - DNA, 25 bp, S. pombe
aaagatttactaggttgctcacaac

SEQ ID NO: 74918 - DNA, 25 bp, S. pombe
aaagatgttacttggtgctcgatca

SEQ ID NO: 74919 - DNA, 25 bp, S. pombe
aaacatgcttcacagttgcgtgccg

SEQ ID NO: 74920 - DNA, 25 bp, S. pombe
aaacccgagttgagcgagcctttgt

SEQ ID NO: 74921 - DNA, 25 bp, S. pombe
aaagctggctttgttcgtcaccacg

SEQ ID NO: 74922 - DNA, 25 bp, S. pombe
aaagcttcatatattccggccaatc

SEQ ID NO: 74923 - DNA, 25 bp, S. pombe
aaagtcggcagcagttggccaaagt

SEQ ID NO: 74924 - DNA, 25 bp, S. pombe
aaagcttgacgcaaaacgactgaca

SEQ ID NO: 74925 - DNA, 25 bp, S. pombe
aaagccttcgttaacgacccatgag

SEQ ID NO: 74926 - DNA, 25 bp, S. pombe
aaagcgttggttgacgccatcgact

SEQ ID NO: 74927 - DNA, 25 bp, S. pombe
aaacgtggtgatccaattcctcgtc

SEQ ID NO: 74928 - DNA, 25 bp, S. pombe
aaagacgtttatcgcgttccacgca

SEQ ID NO: 74929 - DNA, 25 bp, S. pombe
aaagtcgttattcttgcttcaccag

SEQ ID NO: 74930 - DNA, 25 bp, S. pombe
aaagtcgctcacacttcgttagaag

SEQ ID NO: 74931 - DNA, 25 bp, S. pombe
aaagtcctgcaatgcggtttcgcat

SEQ ID NO: 74932 - DNA, 25 bp, S. pombe
aaagtcttatctgttgcctcaattg

SEQ ID NO: 74933 - DNA, 25 bp, S. pombe
aaagcgttacccatcttacggacat

SEQ ID NO: 74934 - DNA, 25 bp, S. pombe
aaagtgcttgatccaattcctacgg

SEQ ID NO: 74935 - DNA, 25 bp, S. pombe
aaagattcttcctttccaatccgtg

SEQ ID NO: 74936 - DNA, 25 bp, S. pombe
aaagctggcacttggactttccctg

SEQ ID NO: 74937 - DNA, 25 bp, S. pombe
aaagactgagattcgggcttacctt

SEQ ID NO: 74938 - DNA, 25 bp, S. pombe
aaagcacgaatttggctcgcaaggt

SEQ ID NO: 74939 - DNA, 25 bp, S. pombe
aaagtctcagtgaaatgcttcgtga

SEQ ID NO: 74940 - DNA, 25 bp, S. pombe
aaacttggtgaaatcgatcgtgctc

SEQ ID NO: 74941 - DNA, 25 bp, S. pombe
aaagtatcttgcctatcttcgtaag

SEQ ID NO: 74942 - DNA, 25 bp, S. pombe
aaagatttcgtttgctgtagtacag

SEQ ID NO: 74943 - DNA, 25 bp, S. pombe
aaagttgtcgtcagcactatgcata

SEQ ID NO: 74944 - DNA, 25 bp, S. pombe
aaagtcttcaaaggcacctgctgaa

SEQ ID NO: 74945 - DNA, 25 bp, S. pombe
aaagttatggtgtccgacgctctta

SEQ ID NO: 74946 - DNA, 25 bp, S. pombe
aaagttcaagtacagaggctccatt

SEQ ID NO: 74947 - DNA, 25 bp, S. pombe
aaagtctatttgttcgtggcggatt

SEQ ID NO: 74948 - DNA, 25 bp, S. pombe
aaagtcattttgctagttgtggatc

SEQ ID NO: 74949 - DNA, 25 bp, S. pombe
aaagttgttggtgctgtcgtggact

SEQ ID NO: 74950 - DNA, 25 bp, S. pombe
aaaattgatcgtgcacccgggaaat

SEQ ID NO: 74951 - DNA, 25 bp, S. pombe
aaagagatgatcctgaacccgacga

SEQ ID NO: 74952 - DNA, 25 bp, S. pombe
aaagagttcggatcccaagggcatt

SEQ ID NO: 74953 - DNA, 25 bp, S. pombe
aacagttacgaatcccacttggctt

SEQ ID NO: 74954 - DNA, 25 bp, S. pombe
aaactgtccgaagcccaattgaaat

SEQ ID NO: 74955 - DNA, 25 bp, S. pombe
aaacgtgggcaaccaataatgcgaa

SEQ ID NO: 74956 - DNA, 25 bp, S. pombe
aaccactgtagctcaaaacgcgtag

SEQ ID NO: 74957 - DNA, 25 bp, S. pombe
aaagctcgtcaggacaaagaacgtt

SEQ ID NO: 74958 - DNA, 25 bp, S. pombe
aaaccgtctgcaatcaacgatacga

SEQ ID NO: 74959 - DNA, 25 bp, S. pombe
aaagccgttatggatcacgtgccgt

SEQ ID NO: 74960 - DNA, 25 bp, S. pombe
aaagctgacttcctcaacgtccagt

SEQ ID NO: 74961 - DNA, 25 bp, S. pombe
aaagtaccagctggtgctcctgaag

SEQ ID NO: 74962 - DNA, 25 bp, S. pombe
aaagttacatcccttctgaaagtga

SEQ ID NO: 74963 - DNA, 25 bp, S. pombe
aaagtttccaatcccagtgaagtga

SEQ ID NO: 74964 - DNA, 25 bp, S. pombe
aaagtcgtatgccactgctttcaca

SEQ ID NO: 74965 - DNA, 25 bp, S. pombe
aaagtcagtcatcacgctcgagcaa

SEQ ID NO: 74966 - DNA, 25 bp, S. pombe
aaagtatgcccttgcctggaatgaa

SEQ ID NO: 74967 - DNA, 25 bp, S. pombe
aaagattctgcgatgttggataaca

SEQ ID NO: 74968 - DNA, 25 bp, S. pombe
aaagatcttgccttgtcgaaatcaa

SEQ ID NO: 74969 - DNA, 25 bp, S. pombe
aaagctattccgttttgatcaacca

SEQ ID NO: 74970 - DNA, 25 bp, S. pombe
aaagcagattccctttttcccatcg

SEQ ID NO: 74971 - DNA, 25 bp, S. pombe
aaagagagtcttctgctttgccttc

SEQ ID NO: 74972 - DNA, 25 bp, S. pombe
aaagaatacctatgcgtctgccttc

SEQ ID NO: 74973 - DNA, 25 bp, S. pombe
aaagaagactcgtgctatccgtcgc

SEQ ID NO: 74974 - DNA, 25 bp, S. pombe
aaagaatacgccctgtggtcgtcgc

SEQ ID NO: 74975 - DNA, 25 bp, S. pombe
aaagaactcccgtctattcagatag

SEQ ID NO: 74976 - DNA, 25 bp, S. pombe
aaagacgtcagctcttaccgtcaat

SEQ ID NO: 74977 - DNA, 25 bp, S. pombe
aaaacgaccttctttctagatgccg

SEQ ID NO: 74978 - DNA, 25 bp, S. pombe
aaagaccttcttgttacgtgctcgt

SEQ ID NO: 74979 - DNA, 25 bp, S. pombe
aaagacactcctaatttcatcgatg

SEQ ID NO: 74980 - DNA, 25 bp, S. pombe
aaagacattgcctcaatccattgcc

SEQ ID NO: 74981 - DNA, 25 bp, S. pombe
aaagaaatcattactgcccctcttg

SEQ ID NO: 74982 - DNA, 25 bp, S. pombe
aaagaaagcattccttccgtcgagt

SEQ ID NO: 74983 - DNA, 25 bp, S. pombe
aaagaattgctcttcctgttcgtgt

SEQ ID NO: 74984 - DNA, 25 bp, S. pombe
aaagttactccttctatcatcggtg

SEQ ID NO: 74985 - DNA, 25 bp, S. pombe
aaagttgcctgtagcgaagacgcgc

SEQ ID NO: 74986 - DNA, 25 bp, S. pombe
aaagttgcctttgaaatctccaaga

SEQ ID NO: 74987 - DNA, 25 bp, S. pombe
aagaccgaactcaggaagcttgatg

SEQ ID NO: 74988 - DNA, 25 bp, S. pombe
aaagttggcgcgactgtgtttgcta

SEQ ID NO: 74989 - DNA, 25 bp, S. pombe
aaagttggtgctactcctgttctac

SEQ ID NO: 74990 - DNA, 25 bp, S. pombe
aaagtacttggctcctgcatacata

SEQ ID NO: 74991 - DNA, 25 bp, S. pombe
aaagtttgctgagacttcattcgca

SEQ ID NO: 74992 - DNA, 25 bp, S. pombe
aaagaacaaagctcttccgctgcag

SEQ ID NO: 74993 - DNA, 25 bp, S. pombe
aaagatcctaagctttctcggcagc

SEQ ID NO: 74994 - DNA, 25 bp, S. pombe
aaagctgcagattggtggtcccttg

SEQ ID NO: 74995 - DNA, 25 bp, S. pombe
aaacgcgtacgcagtcaaggtggac

SEQ ID NO: 74996 - DNA, 25 bp, S. pombe
aaaccgaaggttgcaagctgttcag

SEQ ID NO: 74997 - DNA, 25 bp, S. pombe
aaagcccagcggcatctaatggttc

SEQ ID NO: 74998 - DNA, 25 bp, S. pombe
aaagcctaggagtcactaatgtcga

SEQ ID NO: 74999 - DNA, 25 bp, S. pombe
aaagttgtgtgggttcctgatgtca

SEQ ID NO: 75000 - DNA, 25 bp, S. pombe
aaagtttcacaatctcttcgcaaga

SEQ ID NO: 75001 - DNA, 25 bp, S. pombe
aaagtattttccctcgtatgcatgt

SEQ ID NO: 75002 - DNA, 25 bp, S. pombe
aaagtttatgtccttgtgcgccgtg

SEQ ID NO: 75003 - DNA, 25 bp, S. pombe
aaagttgctctttttgtcgactggc

SEQ ID NO: 75004 - DNA, 25 bp, S. pombe
aaagcagccccttgtttggattgat

SEQ ID NO: 75005 - DNA, 25 bp, S. pombe
aaagcagctggccttgaattggaaa

SEQ ID NO: 75006 - DNA, 25 bp, S. pombe
aaagagtacaagcatattgtgatta

SEQ ID NO: 75007 - DNA, 25 bp, S. pombe
aaagagtcacaacctagcgtcttcc

SEQ ID NO: 75008 - DNA, 25 bp, S. pombe
aaagatctagcattccttcctcaat

SEQ ID NO: 75009 - DNA, 25 bp, S. pombe
aaagttgagccttcttcatcaagta

SEQ ID NO: 75010 - DNA, 25 bp, S. pombe
aaagcggagccccatatcacaacta

SEQ ID NO: 75011 - DNA, 25 bp, S. pombe
aaaccgtgtctgtgaatttcctact

SEQ ID NO: 75012 - DNA, 25 bp, S. pombe
aaaccaggtggctcatcattttcga

SEQ ID NO: 75013 - DNA, 25 bp, S. pombe
aaacggcggcgagatgatgacattg

SEQ ID NO: 75014 - DNA, 25 bp, S. pombe
aaacgtcgtcgaaataccgctgcta

SEQ ID NO: 75015 - DNA, 25 bp, S. pombe
aaactacagctagagattccggtaa

SEQ ID NO: 75016 - DNA, 25 bp, S. pombe
aaacttgttgcagctcagaccggta

SEQ ID NO: 75017 - DNA, 25 bp, S. pombe
aaagttggcagaccttgtgatgcga

SEQ ID NO: 75018 - DNA, 25 bp, S. pombe
aaagcttgtatgaccattctgggaa

SEQ ID NO: 75019 - DNA, 25 bp, S. pombe
aaacctggtacttagctatggctgc

SEQ ID NO: 75020 - DNA, 25 bp, S. pombe
aaacctgccgcagttgatgactact

SEQ ID NO: 75021 - DNA, 25 bp, S. pombe
aaagatgcgtgtccagaaagctaat

SEQ ID NO: 75022 - DNA, 25 bp, S. pombe
aaagatgcagttccgcagctactga

SEQ ID NO: 75023 - DNA, 25 bp, S. pombe
aaagacgtcttcgacatgagcgaga

SEQ ID NO: 75024 - DNA, 25 bp, S. pombe
aaagttgctgagttacccggacata

SEQ ID NO: 75025 - DNA, 25 bp, S. pombe
aaagattcgaccaattccggataag

SEQ ID NO: 75026 - DNA, 25 bp, S. pombe
aaagatttaagcatgacttggataa

SEQ ID NO: 75027 - DNA, 25 bp, S. pombe
aaagcttaatcagggcacaaggtaa

SEQ ID NO: 75028 - DNA, 25 bp, S. pombe
aaagcataggcttggtgcacatggg

SEQ ID NO: 75029 - DNA, 25 bp, S. pombe
aaagctatggttttgccgttgatgc

SEQ ID NO: 75030 - DNA, 25 bp, S. pombe
aaagcatttgcggttccgtgctgaa

SEQ ID NO: 75031 - DNA, 25 bp, S. pombe
aaagaaatggcatcctcttccaacc

SEQ ID NO: 75032 - DNA, 25 bp, S. pombe
aaactagtgactggactgctgccgc

SEQ ID NO: 75033 - DNA, 25 bp, S. pombe
aaagccggaaatactggtgctgccc

SEQ ID NO: 75034 - DNA, 25 bp, S. pombe
aaagcacgcacaggatttggaaatt

SEQ ID NO: 75035 - DNA, 25 bp, S. pombe
aaagattgcttcctttccatctatc

SEQ ID NO: 75036 - DNA, 25 bp, S. pombe
aaagatgagtcgtctgaggctgctc

SEQ ID NO: 75037 - DNA, 25 bp, S. pombe
aaagacgctgcgttggtggcatcaa

SEQ ID NO: 75038 - DNA, 25 bp, S. pombe
aaagaatgatgccttcgttgcccat

SEQ ID NO: 75039 - DNA, 25 bp, S. pombe
aaagcaagtctcttcgagctctgat

SEQ ID NO: 75040 - DNA, 25 bp, S. pombe
aaagcaatgtcttgctgtcgctctg

SEQ ID NO: 75041 - DNA, 25 bp, S. pombe
aaagagttcctgtacggcgttcgat

SEQ ID NO: 75042 - DNA, 25 bp, S. pombe
aaagattatctttccggcgttgttg

SEQ ID NO: 75043 - DNA, 25 bp, S. pombe
aaagcatttctttcgccggatcatt

SEQ ID NO: 75044 - DNA, 25 bp, S. pombe
aaagactttgcgaatgcgcggtcaa

SEQ ID NO: 75045 - DNA, 25 bp, S. pombe
aaaccatagtcgttatgcctcacca

SEQ ID NO: 75046 - DNA, 25 bp, S. pombe
aaacctatacctgatggtgcaccta

SEQ ID NO: 75047 - DNA, 25 bp, S. pombe
aaacttgatacattcccggatcctg

SEQ ID NO: 75048 - DNA, 25 bp, S. pombe
aaagttgaaactgccgtgctctcta

SEQ ID NO: 75049 - DNA, 25 bp, S. pombe
aaagttgacaacaccagcagtctta

SEQ ID NO: 75050 - DNA, 25 bp, S. pombe
aaagcactacttcctatttcttctc

SEQ ID NO: 75051 - DNA, 25 bp, S. pombe
aaagctatcatgtttccggtcgaca

SEQ ID NO: 75052 - DNA, 25 bp, S. pombe
aaagcgacattgattccgtcaaagg

SEQ ID NO: 75053 - DNA, 25 bp, S. pombe
aaacgatatttttacttgcacccag

SEQ ID NO: 75054 - DNA, 25 bp, S. pombe
aaagcggctaatatcgttcgtcctt

SEQ ID NO: 75055 - DNA, 25 bp, S. pombe
aaagcgtcgtttattcctatacaag

SEQ ID NO: 75056 - DNA, 25 bp, S. pombe
aaacgtgctcgtgacaacggtcgca

SEQ ID NO: 75057 - DNA, 25 bp, S. pombe
aacactctgaaatgcttttgaacgg

SEQ ID NO: 75058 - DNA, 25 bp, S. pombe
aaagccgtcccttgataagtaatgc

SEQ ID NO: 75059 - DNA, 25 bp, S. pombe
aaagcatcttcccaagttacttcgt

SEQ ID NO: 75060 - DNA, 25 bp, S. pombe
aaagctcattcctaagtattgctga

SEQ ID NO: 75061 - DNA, 25 bp, S. pombe
aaagacttctctcatgcactcagct

SEQ ID NO: 75062 - DNA, 25 bp, S. pombe
aaagatcttctttttgctcgcctac

SEQ ID NO: 75063 - DNA, 25 bp, S. pombe
aaagcagtccgttatacgcgcgaga

SEQ ID NO: 75064 - DNA, 25 bp, S. pombe
aaagagccttcactatctcgtgttg

SEQ ID NO: 75065 - DNA, 25 bp, S. pombe
aaagcaggcttctttccttgatttt

SEQ ID NO: 75066 - DNA, 25 bp, S. pombe
aaagcaattatcctccttcgttgtg

SEQ ID NO: 75067 - DNA, 25 bp, S. pombe
aaagcaaaacttaattcccagctga

SEQ ID NO: 75068 - DNA, 25 bp, S. pombe
aaagcgctgaacctactacccatgg

SEQ ID NO: 75069 - DNA, 25 bp, S. pombe
aaagctggaatttgcacagcctgaa

SEQ ID NO: 75070 - DNA, 25 bp, S. pombe
aaagctgcgaaattaccctcggaag

SEQ ID NO: 75071 - DNA, 25 bp, S. pombe
aaactgatgaacaagacacgccggt

SEQ ID NO: 75072 - DNA, 25 bp, S. pombe
aaacgtgaattatctcgccgacaaa

SEQ ID NO: 75073 - DNA, 25 bp, S. pombe
aaagagtcaatgtttctcccgccgg

SEQ ID NO: 75074 - DNA, 25 bp, S. pombe
aaagagcacgctttcactgaaatca

SEQ ID NO: 75075 - DNA, 25 bp, S. pombe
aaaccattcttaattgcgcttccgg

SEQ ID NO: 75076 - DNA, 25 bp, S. pombe
aaagcttgctagtcagttggccaat

SEQ ID NO: 75077 - DNA, 25 bp, S. pombe
aaagacgctagacctcttactctac

SEQ ID NO: 75078 - DNA, 25 bp, S. pombe
aaagcagcctgattttttacgtatg

SEQ ID NO: 75079 - DNA, 25 bp, S. pombe
aaagcacttgttcattactcgaatg

SEQ ID NO: 75080 - DNA, 25 bp, S. pombe
aaagacgtgttcatgttactcaaga

SEQ ID NO: 75081 - DNA, 25 bp, S. pombe
aaagcacgttccagcttctatcaag

SEQ ID NO: 75082 - DNA, 25 bp, S. pombe
aaagacgatcctgcgttgtccaagg

SEQ ID NO: 75083 - DNA, 25 bp, S. pombe
aaacggaccaccaattgcccagaag

SEQ ID NO: 75084 - DNA, 25 bp, S. pombe
aaagcagttcgtggcatgctaccgc

SEQ ID NO: 75085 - DNA, 25 bp, S. pombe
aaagagattcgtagccatttggcag

SEQ ID NO: 75086 - DNA, 25 bp, S. pombe
aaagatgtcttgatgcctcattaca

SEQ ID NO: 75087 - DNA, 25 bp, S. pombe
aaagcattccatttgttatcgagca

SEQ ID NO: 75088 - DNA, 25 bp, S. pombe
aaagcatgactgaggcattagcgga

SEQ ID NO: 75089 - DNA, 25 bp, S. pombe
aaagatggtgacatgctaccaggaa

SEQ ID NO: 75090 - DNA, 25 bp, S. pombe
aaagagtcttctgatcccactgaaa

SEQ ID NO: 75091 - DNA, 25 bp, S. pombe
aaagcattaagtctgtgccgatatg

SEQ ID NO: 75092 - DNA, 25 bp, S. pombe
aacagcaaaactcatcaccagtgat

SEQ ID NO: 75093 - DNA, 25 bp, S. pombe
aaagctgcgcagttggacggacttg

SEQ ID NO: 75094 - DNA, 25 bp, S. pombe
aaagctgccgatgcccaaattgatg

SEQ ID NO: 75095 - DNA, 25 bp, S. pombe
aaagcgctccggcaagatgactact

SEQ ID NO: 75096 - DNA, 25 bp, S. pombe
aaacttcgtgggtgatactatgcgc

SEQ ID NO: 75097 - DNA, 25 bp, S. pombe
aaacgggacgtatagacttcatgct

SEQ ID NO: 75098 - DNA, 25 bp, S. pombe
aaagcgcgtcaacaagattttcaat

SEQ ID NO: 75099 - DNA, 25 bp, S. pombe
aaagatggccatgtacgtgcggacg

SEQ ID NO: 75100 - DNA, 25 bp, S. pombe
aaacgacctgtagtggcccaggcat

SEQ ID NO: 75101 - DNA, 25 bp, S. pombe
aaacgaacagcttctggcaaaaaag

SEQ ID NO: 75102 - DNA, 25 bp, S. pombe
aaaccaagtgcttctggacgataca

SEQ ID NO: 75103 - DNA, 25 bp, S. pombe
aaagcacacgctcaagaaggtacta

SEQ ID NO: 75104 - DNA, 25 bp, S. pombe
aaagacgttctttccatgactcata

SEQ ID NO: 75105 - DNA, 25 bp, S. pombe
aaagaccctgtcactctgattgaaa

SEQ ID NO: 75106 - DNA, 25 bp, S. pombe
aaagctgccgctgaaattgttaaag

SEQ ID NO: 75107 - DNA, 25 bp, S. pombe
aaagccccgcacatcttggtagaag

SEQ ID NO: 75108 - DNA, 25 bp, S. pombe
aaagctccccaaactcttttcagtg

SEQ ID NO: 75109 - DNA, 25 bp, S. pombe
aaacgcacccgtgttgttgtcatta

SEQ ID NO: 75110 - DNA, 25 bp, S. pombe
aaacgcgccggaaattcttctcttg

SEQ ID NO: 75111 - DNA, 25 bp, S. pombe
aaagctttccttgttcgcaatgtct

SEQ ID NO: 75112 - DNA, 25 bp, S. pombe
aaagcatcattctctctattcaacg

SEQ ID NO: 75113 - DNA, 25 bp, S. pombe
aaagagtcttccgatgatgccatgt

SEQ ID NO: 75114 - DNA, 25 bp, S. pombe
aaagaagctttccaatgccgctgct

SEQ ID NO: 75115 - DNA, 25 bp, S. pombe
aaagacgatgttactggcgagcctc

SEQ ID NO: 75116 - DNA, 25 bp, S. pombe
aaagcccatatttcgggagcctaat

SEQ ID NO: 75117 - DNA, 25 bp, S. pombe
aaagcctgcatttccggtcagtttt

SEQ ID NO: 75118 - DNA, 25 bp, S. pombe
aaagcctgttggagcggacgttgat

SEQ ID NO: 75119 - DNA, 25 bp, S. pombe
aaagcagcagcagcattttaagcct

SEQ ID NO: 75120 - DNA, 25 bp, S. pombe
aaagctgcagctgctgttcaaacag

SEQ ID NO: 75121 - DNA, 25 bp, S. pombe
aaagccagtggctaatgctccgttt

SEQ ID NO: 75122 - DNA, 25 bp, S. pombe
aaagctgggaggttgcatcaaactg

SEQ ID NO: 75123 - DNA, 25 bp, S. pombe
aaagcttggaggcactcacattcaa

SEQ ID NO: 75124 - DNA, 25 bp, S. pombe
aaagctagccttcgtactattcgtc

SEQ ID NO: 75125 - DNA, 25 bp, S. pombe
aaagaagccttcgtttgtctcgaca

SEQ ID NO: 75126 - DNA, 25 bp, S. pombe
aaagaatgtcctcctttggctggaa

SEQ ID NO: 75127 - DNA, 25 bp, S. pombe
aaactgcatgggtaccttgggtgtt

SEQ ID NO: 75128 - DNA, 25 bp, S. pombe
aaacttgaggcagggttcgcagtct

SEQ ID NO: 75129 - DNA, 25 bp, S. pombe
aaactacagtgctgcgttcggtaat

SEQ ID NO: 75130 - DNA, 25 bp, S. pombe
aaacttcattgctccttttgtaacg

SEQ ID NO: 75131 - DNA, 25 bp, S. pombe
aaagcattgctatcccactttggaa

SEQ ID NO: 75132 - DNA, 25 bp, S. pombe
aaagacatttcttgccagccttgtg

SEQ ID NO: 75133 - DNA, 25 bp, S. pombe
aaagactgctttaccagcgcttggt

SEQ ID NO: 75134 - DNA, 25 bp, S. pombe
aaagacgctttagctgctgttgagc

SEQ ID NO: 75135 - DNA, 25 bp, S. pombe
aaagcggatcttccagcagctgtcg

SEQ ID NO: 75136 - DNA, 25 bp, S. pombe
aaagcaagagctaccagatgtcatg

SEQ ID NO: 75137 - DNA, 25 bp, S. pombe
aaagcatggtctactgagcatctag

SEQ ID NO: 75138 - DNA, 25 bp, S. pombe
aaagctggtgatcctgctgctttga

SEQ ID NO: 75139 - DNA, 25 bp, S. pombe
aaagccacaggaactggcgctcttg

SEQ ID NO: 75140 - DNA, 25 bp, S. pombe
aaactcaacgtcaatgggatcatgt

SEQ ID NO: 75141 - DNA, 25 bp, S. pombe
aaagctacactttcagcccattttc

SEQ ID NO: 75142 - DNA, 25 bp, S. pombe
aaacggagtcggatatgcttcccct

SEQ ID NO: 75143 - DNA, 25 bp, S. pombe
aaacgctcttttagaggctggccgt

SEQ ID NO: 75144 - DNA, 25 bp, S. pombe
aaaccattttctgaggctacagctc

SEQ ID NO: 75145 - DNA, 25 bp, S. pombe
aaaatcttcactctagttctaccgc

SEQ ID NO: 75146 - DNA, 25 bp, S. pombe
aaagcgttgctggtttgaccatcct

SEQ ID NO: 75147 - DNA, 25 bp, S. pombe
aaagctcctcatgttcctcttagta

SEQ ID NO: 75148 - DNA, 25 bp, S. pombe
aaactcgctaggtgcttttgaattt

SEQ ID NO: 75149 - DNA, 25 bp, S. pombe
aaagctcgggcgtgcagttgcgaaa

SEQ ID NO: 75150 - DNA, 25 bp, S. pombe
aaagccagtgccctatttaagcgaa

SEQ ID NO: 75151 - DNA, 25 bp, S. pombe
aaagccaacatacacgcacctgatg

SEQ ID NO: 75152 - DNA, 25 bp, S. pombe
aaagcctacagaagccgacatcaag

SEQ ID NO: 75153 - DNA, 25 bp, S. pombe
aaaagtcaatcctctgaagcatggg

SEQ ID NO: 75154 - DNA, 25 bp, S. pombe
aacagttaatttctgaacgtgcgca

SEQ ID NO: 75155 - DNA, 25 bp, S. pombe
aaagctcccttacctgaagagtcga

SEQ ID NO: 75156 - DNA, 25 bp, S. pombe
aaagcccgagcaacctacgagagga

SEQ ID NO: 75157 - DNA, 25 bp, S. pombe
aaagccgctgacaaaatatcgagag

SEQ ID NO: 75158 - DNA, 25 bp, S. pombe
aaacatttaacagaatcaggacttt

SEQ ID NO: 75159 - DNA, 25 bp, S. pombe
aaactttacactcattgaccacgct

SEQ ID NO: 75160 - DNA, 25 bp, S. pombe
aaacgtcgagactctgcagaccgat

SEQ ID NO: 75161 - DNA, 25 bp, S. pombe
aaagctttggacacagaatctcgaa

SEQ ID NO: 75162 - DNA, 25 bp, S. pombe
aaactgtttttccaagagctccacg

SEQ ID NO: 75163 - DNA, 25 bp, S. pombe
aaactggatatttcaactggcctac

SEQ ID NO: 75164 - DNA, 25 bp, S. pombe
aaagcttgatttaccacttcctcat

SEQ ID NO: 75165 - DNA, 25 bp, S. pombe
aaagctatttctggttggtccaata

SEQ ID NO: 75166 - DNA, 25 bp, S. pombe
aaagctttgcctgcttggtgcacta

SEQ ID NO: 75167 - DNA, 25 bp, S. pombe
aaagccagtcctaaagtttctcagt

SEQ ID NO: 75168 - DNA, 25 bp, S. pombe
aaagccagactgatacgtattccca

SEQ ID NO: 75169 - DNA, 25 bp, S. pombe
aaagctattttacctcaactggaat

SEQ ID NO: 75170 - DNA, 25 bp, S. pombe
aaagctttattacggatgtgggcaa

SEQ ID NO: 75171 - DNA, 25 bp, S. pombe
aaagctttctgagccgattggacaa

SEQ ID NO: 75172 - DNA, 25 bp, S. pombe
aaagcttctgcttgcaccgttgaga

SEQ ID NO: 75173 - DNA, 25 bp, S. pombe
aaagcctcgatctcgttttgacgga

SEQ ID NO: 75174 - DNA, 25 bp, S. pombe
aaagctttggctcatgtctatcacg

SEQ ID NO: 75175 - DNA, 25 bp, S. pombe
aaaccctctcgtttgtgaccgattg

SEQ ID NO: 75176 - DNA, 25 bp, S. pombe
aaagaacctcgaaaggcaccttctg

SEQ ID NO: 75177 - DNA, 25 bp, S. pombe
aattcacggaaattgacgaccaccg

SEQ ID NO: 75178 - DNA, 25 bp, S. pombe
aaagctctaccgttaatcagtatgg

SEQ ID NO: 75179 - DNA, 25 bp, S. pombe
aaagcttaccgctcttcttgatgaa

SEQ ID NO: 75180 - DNA, 25 bp, S. pombe
gaaagcttaccagcggtttggagcc

SEQ ID NO: 75181 - DNA, 25 bp, S. pombe
aaagccattcactgctgcgtttgtg

SEQ ID NO: 75182 - DNA, 25 bp, S. pombe
aaacgtctcagtagctgctggtatt

SEQ ID NO: 75183 - DNA, 25 bp, S. pombe
aaagcatccatttctgtatcaggcg

SEQ ID NO: 75184 - DNA, 25 bp, S. pombe
aaagctgcctcttctgttaacggaa

SEQ ID NO: 75185 - DNA, 25 bp, S. pombe
aaagctgctctcgttttacgggcta

SEQ ID NO: 75186 - DNA, 25 bp, S. pombe
aaacctgactattgggatcgcgtcg

SEQ ID NO: 75187 - DNA, 25 bp, S. pombe
aaaccagattcttcggtgcagcttt

SEQ ID NO: 75188 - DNA, 25 bp, S. pombe
aaagcccattgttcctattgatttg

SEQ ID NO: 75189 - DNA, 25 bp, S. pombe
aaagcctgttggtcgtactgttgag

SEQ ID NO: 75190 - DNA, 25 bp, S. pombe
aaacttcgtaaccatcgccgtgagg

SEQ ID NO: 75191 - DNA, 25 bp, S. pombe
aaagcgcatgcttggactcgtcatt

SEQ ID NO: 75192 - DNA, 25 bp, S. pombe
aaagcgttctggttcagtcgacttc

SEQ ID NO: 75193 - DNA, 25 bp, S. pombe
aaactgtatcaagccgttagtacta

SEQ ID NO: 75194 - DNA, 25 bp, S. pombe
aaagctgattttaccgtctgtgtac

SEQ ID NO: 75195 - DNA, 25 bp, S. pombe
aaagcatcattgttcctggatctgg

SEQ ID NO: 75196 - DNA, 25 bp, S. pombe
aaacctgcatcccagtcgaatgttg

SEQ ID NO: 75197 - DNA, 25 bp, S. pombe
aacaccgcttattccaatcattgag

SEQ ID NO: 75198 - DNA, 25 bp, S. pombe
aaagccagtgctatcaaatttgagg

SEQ ID NO: 75199 - DNA, 25 bp, S. pombe
aaagctgttcacatcaacctgggaa

SEQ ID NO: 75200 - DNA, 25 bp, S. pombe
aaagctttccaattatgcagcggag

SEQ ID NO: 75201 - DNA, 25 bp, S. pombe
aaagctgtccgatcttcgtgaacaa

SEQ ID NO: 75202 - DNA, 25 bp, S. pombe
aaagcagtccgtatatggtcacact

SEQ ID NO: 75203 - DNA, 25 bp, S. pombe
aaagctcccgtaatattctcacact

SEQ ID NO: 75204 - DNA, 25 bp, S. pombe
aaagcagcttgggagtcaccgcaac

SEQ ID NO: 75205 - DNA, 25 bp, S. pombe
aaagcattggagcagctacgcgaca

SEQ ID NO: 75206 - DNA, 25 bp, S. pombe
aaagccatcgatcagtatgttgaca

SEQ ID NO: 75207 - DNA, 25 bp, S. pombe
aaagcccacagcgttgaatcaatga

SEQ ID NO: 75208 - DNA, 25 bp, S. pombe
aaaccaagcgtttcctgtatataga

SEQ ID NO: 75209 - DNA, 25 bp, S. pombe
aaagcctatgaatacctgtcagtta

SEQ ID NO: 75210 - DNA, 25 bp, S. pombe
aaagccgccaaaggtcttcagttgc

SEQ ID NO: 75211 - DNA, 25 bp, S. pombe
aaagctctgcggacggtttttgatg

SEQ ID NO: 75212 - DNA, 25 bp, S. pombe
aaagcttgcccctattgatgaaaaa

SEQ ID NO: 75213 - DNA, 25 bp, S. pombe
aaagcttggccgtttatcaatacta

SEQ ID NO: 75214 - DNA, 25 bp, S. pombe
aaagcttcatcgcaactacaatcac

SEQ ID NO: 75215 - DNA, 25 bp, S. pombe
aaagcttcttggtcttacagctcaa

SEQ ID NO: 75216 - DNA, 25 bp, S. pombe
aaagcgcacatctttactcgagata

SEQ ID NO: 75217 - DNA, 25 bp, S. pombe
aaagcgtctatcaatcctggattca

SEQ ID NO: 75218 - DNA, 25 bp, S. pombe
aaaccgctgatcctcatcatggtta

SEQ ID NO: 75219 - DNA, 25 bp, S. pombe
aaaaaagcagctcgacagtctaaca

SEQ ID NO: 75220 - DNA, 25 bp, S. pombe
aaaccgaccctagtattctgattga

SEQ ID NO: 75221 - DNA, 25 bp, S. pombe
aaaccgtgacgctgaattctggaat

SEQ ID NO: 75222 - DNA, 25 bp, S. pombe
aaaccctcctcttgaatccgagaag

SEQ ID NO: 75223 - DNA, 25 bp, S. pombe
aaacttcttctcttgcattactgga

SEQ ID NO: 75224 - DNA, 25 bp, S. pombe
aaactccttcttacatgtcagcgaa

SEQ ID NO: 75225 - DNA, 25 bp, S. pombe
aaagctgctcaaaacattcttcccg

SEQ ID NO: 75226 - DNA, 25 bp, S. pombe
aaagcatgcgcgatagtctgtcaaa

SEQ ID NO: 75227 - DNA, 25 bp, S. pombe
aaagctcaagcaattgtcttctcaa

SEQ ID NO: 75228 - DNA, 25 bp, S. pombe
aaactcgcgattctcaagaggttca

SEQ ID NO: 75229 - DNA, 25 bp, S. pombe
aaaccggtgctgatcgtgaagtcca

SEQ ID NO: 75230 - DNA, 25 bp, S. pombe
aaaccggccgtttgagacagcttgc

SEQ ID NO: 75231 - DNA, 25 bp, S. pombe
aatagctccactgttaaggtccctg

SEQ ID NO: 75232 - DNA, 25 bp, S. pombe
aaacccgtcagtataggtctccaga

SEQ ID NO: 75233 - DNA, 25 bp, S. pombe
aaaccggatcagctttaacttcaga

SEQ ID NO: 75234 - DNA, 25 bp, S. pombe
aaacgcgtggtcttgtgctacgtca

SEQ ID NO: 75235 - DNA, 25 bp, S. pombe
aaacgtggcagacttggttcgtcag

SEQ ID NO: 75236 - DNA, 25 bp, S. pombe
aaagcggtcgatttgacttctctca

SEQ ID NO: 75237 - DNA, 25 bp, S. pombe
aaagccgtcctgttgcctatactag

SEQ ID NO: 75238 - DNA, 25 bp, S. pombe
aaagctcttacattgagtcctcaag

SEQ ID NO: 75239 - DNA, 25 bp, S. pombe
aaagcttttgattggctcttctcaa

SEQ ID NO: 75240 - DNA, 25 bp, S. pombe
aaagctgctttgtccgtttcattca

SEQ ID NO: 75241 - DNA, 25 bp, S. pombe
aaagcctatctcgaggatttctata

SEQ ID NO: 75242 - DNA, 25 bp, S. pombe
aaagcggttcaccagttgcatcagc

SEQ ID NO: 75243 - DNA, 25 bp, S. pombe
aaagctggtcaacgccttgcacatt

SEQ ID NO: 75244 - DNA, 25 bp, S. pombe
aaagctatgtcgttctgctggcagt

SEQ ID NO: 75245 - DNA, 25 bp, S. pombe
aaacctcattgagtgttgccgatgt

SEQ ID NO: 75246 - DNA, 25 bp, S. pombe
aaacgccatgggacatactcactag

SEQ ID NO: 75247 - DNA, 25 bp, S. pombe
aaacccgtggtatctttcattgctg

SEQ ID NO: 75248 - DNA, 25 bp, S. pombe
aaagctctcaggatgccacaattga

SEQ ID NO: 75249 - DNA, 25 bp, S. pombe
aaagcgtttctcgtcaaaatgccgc

SEQ ID NO: 75250 - DNA, 25 bp, S. pombe
aaagctacgcttggctgaaaagccg

SEQ ID NO: 75251 - DNA, 25 bp, S. pombe
aaagctatcgccttgtacataaccc

SEQ ID NO: 75252 - DNA, 25 bp, S. pombe
aaagctctggctttgcttcatactc

SEQ ID NO: 75253 - DNA, 25 bp, S. pombe
aaacttgccatctcaatctactgct

SEQ ID NO: 75254 - DNA, 25 bp, S. pombe
aacagcttcgactcaatgaccttgg

SEQ ID NO: 75255 - DNA, 25 bp, S. pombe
aaactcgaagaggagcgtgccttac

SEQ ID NO: 75256 - DNA, 25 bp, S. pombe
aaactttacaggcagatccttccct

SEQ ID NO: 75257 - DNA, 25 bp, S. pombe
aaagccgttagccttcgaatggatc

SEQ ID NO: 75258 - DNA, 25 bp, S. pombe
aaagctcttaatcttgcgagaagca

SEQ ID NO: 75259 - DNA, 25 bp, S. pombe
aaacgtcttgatacttttcgaactg

SEQ ID NO: 75260 - DNA, 25 bp, S. pombe
aaagcccatggtcttttggaacgca

SEQ ID NO: 75261 - DNA, 25 bp, S. pombe
aaacgctacagatgtgctcaacctc

SEQ ID NO: 75262 - DNA, 25 bp, S. pombe
aacagccatggattttacacgtcta

SEQ ID NO: 75263 - DNA, 25 bp, S. pombe
aaacgccttgaatttctatcatcat

SEQ ID NO: 75264 - DNA, 25 bp, S. pombe
aaacccttccatgtctagctttatt

SEQ ID NO: 75265 - DNA, 25 bp, S. pombe
aaaccagttccattactcggcttat

SEQ ID NO: 75266 - DNA, 25 bp, S. pombe
aaacatacatttttacttggcctat

SEQ ID NO: 75267 - DNA, 25 bp, S. pombe
aaacaacttattcacgaggtagatg

SEQ ID NO: 75268 - DNA, 25 bp, S. pombe
aaacttgttcaacagcaacaaaggt

SEQ ID NO: 75269 - DNA, 25 bp, S. pombe
aaacgggatcgcaccaatgtcaaga

SEQ ID NO: 75270 - DNA, 25 bp, S. pombe
aaagcggtactcattaggtcaagac

SEQ ID NO: 75271 - DNA, 25 bp, S. pombe
aaagccgtactcctcatcatggtaa

SEQ ID NO: 75272 - DNA, 25 bp, S. pombe
aaaccgcgcgattaatttgcttggc

SEQ ID NO: 75273 - DNA, 25 bp, S. pombe
aaaccgccgttgatgatcaggtggt

SEQ ID NO: 75274 - DNA, 25 bp, S. pombe
aaagctttctttagagcgcgacaaa

SEQ ID NO: 75275 - DNA, 25 bp, S. pombe
aaagctccaaacttgtatgcgattg

SEQ ID NO: 75276 - DNA, 25 bp, S. pombe
aaagccaaagccttgttgcgcttgt

SEQ ID NO: 75277 - DNA, 25 bp, S. pombe
aaagctatatccctgcttatgcctt

SEQ ID NO: 75278 - DNA, 25 bp, S. pombe
aaagctatggcgttgcgacggttaa

SEQ ID NO: 75279 - DNA, 25 bp, S. pombe
aaaccattgcctacgatcgctatta

SEQ ID NO: 75280 - DNA, 25 bp, S. pombe
aaagctgtggatgttcgcgttcgag

SEQ ID NO: 75281 - DNA, 25 bp, S. pombe
aaagctggagacgttactgttcaaa

SEQ ID NO: 75282 - DNA, 25 bp, S. pombe
aaagctggacgaagtcttgttcaaa

SEQ ID NO: 75283 - DNA, 25 bp, S. pombe
aaacggtgctggtccttcttcagaa

SEQ ID NO: 75284 - DNA, 25 bp, S. pombe
aaacgggatccgatggaccacagtc

SEQ ID NO: 75285 - DNA, 25 bp, S. pombe
aaacggagaccgatgtcaaagccaa

SEQ ID NO: 75286 - DNA, 25 bp, S. pombe
aaactgaatggcctcgttgcgcaga

SEQ ID NO: 75287 - DNA, 25 bp, S. pombe
aaacgcaaggtacgtctgcacatcc

SEQ ID NO: 75288 - DNA, 25 bp, S. pombe
aaactgcgacttttgcttcatgaac

SEQ ID NO: 75289 - DNA, 25 bp, S. pombe
aaacaggtcctcttcgtcataggcg

SEQ ID NO: 75290 - DNA, 25 bp, S. pombe
aaactagtcttccttatgctcctga

SEQ ID NO: 75291 - DNA, 25 bp, S. pombe
aaaccagtcgcattgtgtaccttga

SEQ ID NO: 75292 - DNA, 25 bp, S. pombe
aaaccggctgctggatcttgtatag

SEQ ID NO: 75293 - DNA, 25 bp, S. pombe
aaagctgcttgccagtgtactcaat

SEQ ID NO: 75294 - DNA, 25 bp, S. pombe
aaagctccattgactcgagcggaat

SEQ ID NO: 75295 - DNA, 25 bp, S. pombe
aaagcctttgcatgtgtcacttgca

SEQ ID NO: 75296 - DNA, 25 bp, S. pombe
aaagccgctatgagtctacctgaga

SEQ ID NO: 75297 - DNA, 25 bp, S. pombe
aaagctcccatgatattgatcccga

SEQ ID NO: 75298 - DNA, 25 bp, S. pombe
aaagctgctaagatgttggccaaca

SEQ ID NO: 75299 - DNA, 25 bp, S. pombe
aaagctgttgtgatgtatggtcccc

SEQ ID NO: 75300 - DNA, 25 bp, S. pombe
aaacttgctatgcttgtggtaccgc

SEQ ID NO: 75301 - DNA, 25 bp, S. pombe
aaagccatcttgctcttagagaccg

SEQ ID NO: 75302 - DNA, 25 bp, S. pombe
aaagccagttacaccaagtttgatc

SEQ ID NO: 75303 - DNA, 25 bp, S. pombe
aaaccagattactgtacctctctac

SEQ ID NO: 75304 - DNA, 25 bp, S. pombe
aaaccatactctgctcgatacattg

SEQ ID NO: 75305 - DNA, 25 bp, S. pombe
aaacctcatctgtatctctcataaa

SEQ ID NO: 75306 - DNA, 25 bp, S. pombe
aaaccggtcgcgtagtagattgcag

SEQ ID NO: 75307 - DNA, 25 bp, S. pombe
aaaccgtgaccctgcacgatgtaga

SEQ ID NO: 75308 - DNA, 25 bp, S. pombe
aaaccttgacttgcgacgttcgaga

SEQ ID NO: 75309 - DNA, 25 bp, S. pombe
aaagcgttacgatgcccagtcgggt

SEQ ID NO: 75310 - DNA, 25 bp, S. pombe
aaagcctttttgtctaactggtctg

SEQ ID NO: 75311 - DNA, 25 bp, S. pombe
aaacctgttacattttttggatctg

SEQ ID NO: 75312 - DNA, 25 bp, S. pombe
aaagctgcatctgtcgtttctggaa

SEQ ID NO: 75313 - DNA, 25 bp, S. pombe
aaacgcttgattccgagtcaacaac

SEQ ID NO: 75314 - DNA, 25 bp, S. pombe
aaagcgcttcgttaccacatctgat

SEQ ID NO: 75315 - DNA, 25 bp, S. pombe
aaacctactgtggaactgacattga

SEQ ID NO: 75316 - DNA, 25 bp, S. pombe
aaacctgactgttctatcgactcta

SEQ ID NO: 75317 - DNA, 25 bp, S. pombe
aaagccatccaattctaattcccaa

SEQ ID NO: 75318 - DNA, 25 bp, S. pombe
aaaccatccattagtactgccaaca

SEQ ID NO: 75319 - DNA, 25 bp, S. pombe
aaacgagcttgtgctaccgagtcaa

SEQ ID NO: 75320 - DNA, 25 bp, S. pombe
aaacggttcaaccacaggatgtgct

SEQ ID NO: 75321 - DNA, 25 bp, S. pombe
aaacggcttcaatccaatcatcgct

SEQ ID NO: 75322 - DNA, 25 bp, S. pombe
aaacgtgttcgatcctacatctagt

SEQ ID NO: 75323 - DNA, 25 bp, S. pombe
aaagcggccttaactctaattcaga

SEQ ID NO: 75324 - DNA, 25 bp, S. pombe
aaagcccactaagcattgttacaga

SEQ ID NO: 75325 - DNA, 25 bp, S. pombe
aagtctgacaacaccttgcctaaaa

SEQ ID NO: 75326 - DNA, 25 bp, S. pombe
aagtctgacgactcaaacctcaatg

SEQ ID NO: 75327 - DNA, 25 bp, S. pombe
aaactgaagagctactatcccgcaa

SEQ ID NO: 75328 - DNA, 25 bp, S. pombe
aacagcggtttatccatcttgaagg

SEQ ID NO: 75329 - DNA, 25 bp, S. pombe
aaacgttgttacatgcctagattgc

SEQ ID NO: 75330 - DNA, 25 bp, S. pombe
aaaccagtgtattcatcgctcaccg

SEQ ID NO: 75331 - DNA, 25 bp, S. pombe
aaactattgtctcacggatgccgga

SEQ ID NO: 75332 - DNA, 25 bp, S. pombe
aaaccttgcttatgggtcttcctgc

SEQ ID NO: 75333 - DNA, 25 bp, S. pombe
aaaccttcttatttgatgccttcca

SEQ ID NO: 75334 - DNA, 25 bp, S. pombe
aaaccatgggagctgttacattcat

SEQ ID NO: 75335 - DNA, 25 bp, S. pombe
aaaccattggtattccatgctaaca

SEQ ID NO: 75336 - DNA, 25 bp, S. pombe
aaacctcgagattttcatgctcaaa

SEQ ID NO: 75337 - DNA, 25 bp, S. pombe
aaacgttcgcctttggcagatcaaa

SEQ ID NO: 75338 - DNA, 25 bp, S. pombe
aaagcgccttcgtgtatggtcgcaa

SEQ ID NO: 75339 - DNA, 25 bp, S. pombe
aaacgtctctcgtcgtatgtaccat

SEQ ID NO: 75340 - DNA, 25 bp, S. pombe
aaacgagtgatagcttcgggagaca

SEQ ID NO: 75341 - DNA, 25 bp, S. pombe
aaagcccgagcttaccaaggtagca

SEQ ID NO: 75342 - DNA, 25 bp, S. pombe
aaacgccaagatttccaaggaagct

SEQ ID NO: 75343 - DNA, 25 bp, S. pombe
aaacattagccatgctgaagcggaa

SEQ ID NO: 75344 - DNA, 25 bp, S. pombe
aaacttacccaccagaacttcaatg

SEQ ID NO: 75345 - DNA, 25 bp, S. pombe
aaacctaccgatgcagaagaccatt

SEQ ID NO: 75346 - DNA, 25 bp, S. pombe
aaaccgaaactgatgagcctgctgt

SEQ ID NO: 75347 - DNA, 25 bp, S. pombe
aaacgcagttcgttctactctgact

SEQ ID NO: 75348 - DNA, 25 bp, S. pombe
aaacggctatcgatgtacctgcaaa

SEQ ID NO: 75349 - DNA, 25 bp, S. pombe
aaaatgtagcgacccgccgtctatg

SEQ ID NO: 75350 - DNA, 25 bp, S. pombe
aaaatgccaacacccgtggtattgt

SEQ ID NO: 75351 - DNA, 25 bp, S. pombe
aaaatgctgataacccagtgggtct

SEQ ID NO: 75352 - DNA, 25 bp, S. pombe
aaacggatcttggtctggtggtcat

SEQ ID NO: 75353 - DNA, 25 bp, S. pombe
aagaccattacccttgaggttgaat

SEQ ID NO: 75354 - DNA, 25 bp, S. pombe
aaagccagcacggtacttcgctgaa

SEQ ID NO: 75355 - DNA, 25 bp, S. pombe
aaacccatacctgtcaccaaagaag

SEQ ID NO: 75356 - DNA, 25 bp, S. pombe
aaacctctactccattactacaata

SEQ ID NO: 75357 - DNA, 25 bp, S. pombe
aaaccgtgctcgcttagctgaatgc

SEQ ID NO: 75358 - DNA, 25 bp, S. pombe
aaacccttggtctgtagcaacacat

SEQ ID NO: 75359 - DNA, 25 bp, S. pombe
aaaccatgctatgctgtttaccacc

SEQ ID NO: 75360 - DNA, 25 bp, S. pombe
aataatgtgtggctttaccttccgg

SEQ ID NO: 75361 - DNA, 25 bp, S. pombe
aaaccagcttgcatttcatatcgtg

SEQ ID NO: 75362 - DNA, 25 bp, S. pombe
aaaccgcgaatatccaggctgcata

SEQ ID NO: 75363 - DNA, 25 bp, S. pombe
aaactcccaagatgagaggtcaagc

SEQ ID NO: 75364 - DNA, 25 bp, S. pombe
aaaccatccgaaaagcgatcccgcg

SEQ ID NO: 75365 - DNA, 25 bp, S. pombe
aaactaccaagagagcttcccgtgt

SEQ ID NO: 75366 - DNA, 25 bp, S. pombe
aagtaaacttggcttcgctccgcta

SEQ ID NO: 75367 - DNA, 25 bp, S. pombe
aaacgtgtccgtcttaggcgacgat

SEQ ID NO: 75368 - DNA, 25 bp, S. pombe
aaaccgccgcttctgtaatcaagca

SEQ ID NO: 75369 - DNA, 25 bp, S. pombe
aaaccatttcacctcacatgttgga

SEQ ID NO: 75370 - DNA, 25 bp, S. pombe
aaactcgtaatttctctgttgatga

SEQ ID NO: 75371 - DNA, 25 bp, S. pombe
aaactcgttttgatgcattccgtag

SEQ ID NO: 75372 - DNA, 25 bp, S. pombe
aaacggtatcttcctttcatagtgg

SEQ ID NO: 75373 - DNA, 25 bp, S. pombe
aaacgagttggtggctttatgggca

SEQ ID NO: 75374 - DNA, 25 bp, S. pombe
aaaccgatcaggtgtctgctaggga

SEQ ID NO: 75375 - DNA, 25 bp, S. pombe
aaaccgcaatgctacgggtaccatt

SEQ ID NO: 75376 - DNA, 25 bp, S. pombe
aaaccagcgttctattgaggacctt

SEQ ID NO: 75377 - DNA, 25 bp, S. pombe
aaacccagttttgatgctcctcttg

SEQ ID NO: 75378 - DNA, 25 bp, S. pombe
aacacctcagtcgtttttcattcct

SEQ ID NO: 75379 - DNA, 25 bp, S. pombe
aaacctgaaccgtctttatctctat

SEQ ID NO: 75380 - DNA, 25 bp, S. pombe
aaacaacaactgcttcttgctactc

SEQ ID NO: 75381 - DNA, 25 bp, S. pombe
aaactacaactggtggtggcgctct

SEQ ID NO: 75382 - DNA, 25 bp, S. pombe
aaactagccactgccggttgtgata

SEQ ID NO: 75383 - DNA, 25 bp, S. pombe
aaaataccgcgttgggtcgtcatgc

SEQ ID NO: 75384 - DNA, 25 bp, S. pombe
aaacatttttcttgagcgtggaagc

SEQ ID NO: 75385 - DNA, 25 bp, S. pombe
aaactttgttctctggctggactga

SEQ ID NO: 75386 - DNA, 25 bp, S. pombe
aaacttctttgggtgcgactacgca

SEQ ID NO: 75387 - DNA, 25 bp, S. pombe
aaacgcagaattggagtccgtcaat

SEQ ID NO: 75388 - DNA, 25 bp, S. pombe
aaaccagctgataagttccgtgata

SEQ ID NO: 75389 - DNA, 25 bp, S. pombe
aaaccctctatactgtccttgacaa

SEQ ID NO: 75390 - DNA, 25 bp, S. pombe
aaacctgctttaaatcctgctgaaa

SEQ ID NO: 75391 - DNA, 25 bp, S. pombe
aaaccatctgttgaagttgtataca

SEQ ID NO: 75392 - DNA, 25 bp, S. pombe
aaaccttgtcgctgatgccgttgaa

SEQ ID NO: 75393 - DNA, 25 bp, S. pombe
aaaccttgcccttgtagctttgaag

SEQ ID NO: 75394 - DNA, 25 bp, S. pombe
aaaccatccgcccaaacttatgaag

SEQ ID NO: 75395 - DNA, 25 bp, S. pombe
aaacttactttgtctgttggtgcga

SEQ ID NO: 75396 - DNA, 25 bp, S. pombe
aaacttcatttatcgtggattggcg

SEQ ID NO: 75397 - DNA, 25 bp, S. pombe
aaacacccttagagcaagtcattgc

SEQ ID NO: 75398 - DNA, 25 bp, S. pombe
aaaccccatcattaaaaccatctgc

SEQ ID NO: 75399 - DNA, 25 bp, S. pombe
aaacgtcaaatctgatactgccaat

SEQ ID NO: 75400 - DNA, 25 bp, S. pombe
aaacgttgaatctcgactctctgaa

SEQ ID NO: 75401 - DNA, 25 bp, S. pombe
aaacttgattttgccatccaggagg

SEQ ID NO: 75402 - DNA, 25 bp, S. pombe
aaacttgggcttgctttcagggaca

SEQ ID NO: 75403 - DNA, 25 bp, S. pombe
aaaccttcacctcatacattgcgag

SEQ ID NO: 75404 - DNA, 25 bp, S. pombe
gaaacccaagaagagcgttgtcaaa

SEQ ID NO: 75405 - DNA, 25 bp, S. pombe
aaagccaaagattcccttctgtgtc

SEQ ID NO: 75406 - DNA, 25 bp, S. pombe
aaacgcttcatcctgcacatttgag

SEQ ID NO: 75407 - DNA, 25 bp, S. pombe
aaaagggctgagtgatggaccgcta

SEQ ID NO: 75408 - DNA, 25 bp, S. pombe
aaacgagccgtatctcttcatcgag

SEQ ID NO: 75409 - DNA, 25 bp, S. pombe
aaacgcaacggcaatctctttggca

SEQ ID NO: 75410 - DNA, 25 bp, S. pombe
aaacgatccaacaaccttaagcata

SEQ ID NO: 75411 - DNA, 25 bp, S. pombe
ggaacccgacaatcattgggaccaa

SEQ ID NO: 75412 - DNA, 25 bp, S. pombe
aaaccgttgctgacaagtccgctta

SEQ ID NO: 75413 - DNA, 25 bp, S. pombe
aaacgcgtctctactagcaactgtt

SEQ ID NO: 75414 - DNA, 25 bp, S. pombe
aaaccgttgccaacatgattcgtgg

SEQ ID NO: 75415 - DNA, 25 bp, S. pombe
aaacctgttaccaatgctggcgctg

SEQ ID NO: 75416 - DNA, 25 bp, S. pombe
aaactgcgatttcctttgttggtgc

SEQ ID NO: 75417 - DNA, 25 bp, S. pombe
aaacggatgtccctttcttgatggc

SEQ ID NO: 75418 - DNA, 25 bp, S. pombe
aaacgtagatacctcagcttgtgat

SEQ ID NO: 75419 - DNA, 25 bp, S. pombe
aaacctattatttcgctcgtgatgc

SEQ ID NO: 75420 - DNA, 25 bp, S. pombe
aaacctatcgctatctatcgtatga

SEQ ID NO: 75421 - DNA, 25 bp, S. pombe
aaacctttccccaggatcatgtgca

SEQ ID NO: 75422 - DNA, 25 bp, S. pombe
aaaattattcccacggtcttgcttg

SEQ ID NO: 75423 - DNA, 25 bp, S. pombe
aaaattaatctttatcgttttcatg

SEQ ID NO: 75424 - DNA, 25 bp, S. pombe
aaacgaacatcttctcctttttctg

SEQ ID NO: 75425 - DNA, 25 bp, S. pombe
aaactattaattccgccttggcaga

SEQ ID NO: 75426 - DNA, 25 bp, S. pombe
aaaaccggtagagccaatccacatc

SEQ ID NO: 75427 - DNA, 25 bp, S. pombe
aaactcctggtatatatcaacatgc

SEQ ID NO: 75428 - DNA, 25 bp, S. pombe
aaaccgctggaatagccttcatgac

SEQ ID NO: 75429 - DNA, 25 bp, S. pombe
aaaccgctgcgatgaactatggcaa

SEQ ID NO: 75430 - DNA, 25 bp, S. pombe
aaaccgattgcactgaatcatcgaa

SEQ ID NO: 75431 - DNA, 25 bp, S. pombe
aaacgatatcgaattgcgccagaaa

SEQ ID NO: 75432 - DNA, 25 bp, S. pombe
aaacgatatccaggcgccatagaat

SEQ ID NO: 75433 - DNA, 25 bp, S. pombe
aaacgctacaagtctcgtgagagct

SEQ ID NO: 75434 - DNA, 25 bp, S. pombe
aaacttgcgcattttggctccatct

SEQ ID NO: 75435 - DNA, 25 bp, S. pombe
aaacatatcgatctactccatacct

SEQ ID NO: 75436 - DNA, 25 bp, S. pombe
aaactctcaagcgttctcatctgac

SEQ ID NO: 75437 - DNA, 25 bp, S. pombe
aaactctcaacctctgcttatggaa

SEQ ID NO: 75438 - DNA, 25 bp, S. pombe
aacactacccgggtcttggagagat

SEQ ID NO: 75439 - DNA, 25 bp, S. pombe
aaacccttttggactagaggatgct

SEQ ID NO: 75440 - DNA, 25 bp, S. pombe
aaaccgcgcaggagcttgcaagtca

SEQ ID NO: 75441 - DNA, 25 bp, S. pombe
aacactcatgcggtgccaattcgaa

SEQ ID NO: 75442 - DNA, 25 bp, S. pombe
aacactagctgattgcacaagccag

SEQ ID NO: 75443 - DNA, 25 bp, S. pombe
aaactcgaggatctcatgcgcgttg

SEQ ID NO: 75444 - DNA, 25 bp, S. pombe
aaaccgcaggatggccagcgtgtta

SEQ ID NO: 75445 - DNA, 25 bp, S. pombe
aaacgggtaatcacttcaatgcata

SEQ ID NO: 75446 - DNA, 25 bp, S. pombe
aaaccgaggaacaagctttacagca

SEQ ID NO: 75447 - DNA, 25 bp, S. pombe
aaactgcagctccatttattccgaa

SEQ ID NO: 75448 - DNA, 25 bp, S. pombe
aaacggtcgatttgaatgcgcacat

SEQ ID NO: 75449 - DNA, 25 bp, S. pombe
aaaccgctccaagcaagctgatcaa

SEQ ID NO: 75450 - DNA, 25 bp, S. pombe
aaacaggcttgctatccgagtgaga

SEQ ID NO: 75451 - DNA, 25 bp, S. pombe
aaactggctctctagttgctgttga

SEQ ID NO: 75452 - DNA, 25 bp, S. pombe
aaactagtgttcctggcatttacgc

SEQ ID NO: 75453 - DNA, 25 bp, S. pombe
aaactctcgtccttcaaatgcgtct

SEQ ID NO: 75454 - DNA, 25 bp, S. pombe
aaaccgatgtctcttggatccatgt

SEQ ID NO: 75455 - DNA, 25 bp, S. pombe
aaacgcccaggtgtcgatgaatttt

SEQ ID NO: 75456 - DNA, 25 bp, S. pombe
aaacaccacggcttttggaactcat

SEQ ID NO: 75457 - DNA, 25 bp, S. pombe
aaacggctgttatgtgctaccacac

SEQ ID NO: 75458 - DNA, 25 bp, S. pombe
aaacttgctgctgacggtactgaca

SEQ ID NO: 75459 - DNA, 25 bp, S. pombe
aaaccgtcgctgtcggtgtcatcaa

SEQ ID NO: 75460 - DNA, 25 bp, S. pombe
aaacgcgccagccttgagattttaa

SEQ ID NO: 75461 - DNA, 25 bp, S. pombe
aaactttgaaattgcccatctggag

SEQ ID NO: 75462 - DNA, 25 bp, S. pombe
aaaagcttaggctagcacctcttaa

SEQ ID NO: 75463 - DNA, 25 bp, S. pombe
aaaacttctggcaaagagtcttcaa

SEQ ID NO: 75464 - DNA, 25 bp, S. pombe
aaacttatcgcttagagcctgctgg

SEQ ID NO: 75465 - DNA, 25 bp, S. pombe
aaactacgacacgaccaacagcgtt

SEQ ID NO: 75466 - DNA, 25 bp, S. pombe
aaacttctcaacgattaccagcggc

SEQ ID NO: 75467 - DNA, 25 bp, S. pombe
aaactgttcagacgaccactactac

SEQ ID NO: 75468 - DNA, 25 bp, S. pombe
aaactgattcggaggtcgctgcgac

SEQ ID NO: 75469 - DNA, 25 bp, S. pombe
aaacgggtggttggcatgcttcgac

SEQ ID NO: 75470 - DNA, 25 bp, S. pombe
aaacggattgtgatgcagctcttgc

SEQ ID NO: 75471 - DNA, 25 bp, S. pombe
aaactggtagtgagcattccacccc

SEQ ID NO: 75472 - DNA, 25 bp, S. pombe
aaactgctgaagtcttggaccctga

SEQ ID NO: 75473 - DNA, 25 bp, S. pombe
aaacgcagacgtccttacacaaatt

SEQ ID NO: 75474 - DNA, 25 bp, S. pombe
aaacggatttacaacagaccagcat

SEQ ID NO: 75475 - DNA, 25 bp, S. pombe
aaacgccttatccttaatgacacta

SEQ ID NO: 75476 - DNA, 25 bp, S. pombe
aaacgcgtgcgtcgtctcaaacgta

SEQ ID NO: 75477 - DNA, 25 bp, S. pombe
aaacgatctgcgtgtcttgcgataa

SEQ ID NO: 75478 - DNA, 25 bp, S. pombe
aaacgccaggcttctcttgagatga

SEQ ID NO: 75479 - DNA, 25 bp, S. pombe
aaacatctcaaagtcgcctgcgcta

SEQ ID NO: 75480 - DNA, 25 bp, S. pombe
aaaactgcaaagtcccaagctctgg

SEQ ID NO: 75481 - DNA, 25 bp, S. pombe
aaacgagttcgtgctcaggctcgtg

SEQ ID NO: 75482 - DNA, 25 bp, S. pombe
aaacgagttcgttatgccacaccta

SEQ ID NO: 75483 - DNA, 25 bp, S. pombe
aaacgtgctccggagattcagttag

SEQ ID NO: 75484 - DNA, 25 bp, S. pombe
aaacgtttgccatggttctgattcc

SEQ ID NO: 75485 - DNA, 25 bp, S. pombe
aaacactactcgtggtgacgttcct

SEQ ID NO: 75486 - DNA, 25 bp, S. pombe
aaaattctcgtcgtagggccaggca

SEQ ID NO: 75487 - DNA, 25 bp, S. pombe
aaacaacttgaaaatgcctctgaag

SEQ ID NO: 75488 - DNA, 25 bp, S. pombe
aaacgttgtccacgaactgccagaa

SEQ ID NO: 75489 - DNA, 25 bp, S. pombe
aagaactttgaccttcgtcctggtg

SEQ ID NO: 75490 - DNA, 25 bp, S. pombe
aaaattctcgacattcttcgggtat

SEQ ID NO: 75491 - DNA, 25 bp, S. pombe
aagcaacccggtcttagtgaggctc

SEQ ID NO: 75492 - DNA, 25 bp, S. pombe
aaaacatccggtcaacttgtggctc

SEQ ID NO: 75493 - DNA, 25 bp, S. pombe
aaaactccttatacaaaccttgctg

SEQ ID NO: 75494 - DNA, 25 bp, S. pombe
aaacgatcctttttcaagctggcat

SEQ ID NO: 75495 - DNA, 25 bp, S. pombe
aaacgctagtttacttgcttcaaca

SEQ ID NO: 75496 - DNA, 25 bp, S. pombe
aaacgcaatgttcctcttttgaatt

SEQ ID NO: 75497 - DNA, 25 bp, S. pombe
aaacggctggctatttcaatacgat

SEQ ID NO: 75498 - DNA, 25 bp, S. pombe
aaacggtcagtcatgcctctacatt

SEQ ID NO: 75499 - DNA, 25 bp, S. pombe
aaacggctggagatctggcgattgc

SEQ ID NO: 75500 - DNA, 25 bp, S. pombe
aaacattgtcctttctggtggtagt

SEQ ID NO: 75501 - DNA, 25 bp, S. pombe
aaacggctctgctgatattgacatg

SEQ ID NO: 75502 - DNA, 25 bp, S. pombe
aaacttctgtgctgatgatatcgag

SEQ ID NO: 75503 - DNA, 25 bp, S. pombe
aaacagcttgactcattatcaatgg

SEQ ID NO: 75504 - DNA, 25 bp, S. pombe
aaacagctctgcttctaccatgagt

SEQ ID NO: 75505 - DNA, 25 bp, S. pombe
aaacgttatgtctgtgcttgcacta

SEQ ID NO: 75506 - DNA, 25 bp, S. pombe
aaactgcttttgctggtcttatgac

SEQ ID NO: 75507 - DNA, 25 bp, S. pombe
aaactgcttggtcggctcgttgtga

SEQ ID NO: 75508 - DNA, 25 bp, S. pombe
aaactctccgtgatgttggtggcaa

SEQ ID NO: 75509 - DNA, 25 bp, S. pombe
aaacacgctggacgcatttggcaaa

SEQ ID NO: 75510 - DNA, 25 bp, S. pombe
aaacaatgctggtgatttacaaatt

SEQ ID NO: 75511 - DNA, 25 bp, S. pombe
aaaagccttactatccgtccgtatg

SEQ ID NO: 75512 - DNA, 25 bp, S. pombe
aaaagccattacagtctttcctccg

SEQ ID NO: 75513 - DNA, 25 bp, S. pombe
aaaagcgactggctggcattccttc

SEQ ID NO: 75514 - DNA, 25 bp, S. pombe
aaaagctacgaccaagcattttgtt

SEQ ID NO: 75515 - DNA, 25 bp, S. pombe
aaaactacgacctgcaattgtgcga

SEQ ID NO: 75516 - DNA, 25 bp, S. pombe
aaaacgtctgtgtcaacctcgaaca

SEQ ID NO: 75517 - DNA, 25 bp, S. pombe
aaacatttagcccacgacagatcat

SEQ ID NO: 75518 - DNA, 25 bp, S. pombe
aaactgttaccagctccaggtcgta

SEQ ID NO: 75519 - DNA, 25 bp, S. pombe
aaacggcgtctcgaactatttcaat

SEQ ID NO: 75520 - DNA, 25 bp, S. pombe
aaacggcatttctactctttacaat

SEQ ID NO: 75521 - DNA, 25 bp, S. pombe
aacaccacctatcgccgtgaaggaa

SEQ ID NO: 75522 - DNA, 25 bp, S. pombe
aaacgttgtgctttggcagcagcta

SEQ ID NO: 75523 - DNA, 25 bp, S. pombe
aaactcttcattctacgcaactata

SEQ ID NO: 75524 - DNA, 25 bp, S. pombe
aaactccaatgtctattgttccaga

SEQ ID NO: 75525 - DNA, 25 bp, S. pombe
aaacaaccaagcattcgacgtcctt

SEQ ID NO: 75526 - DNA, 25 bp, S. pombe
aaaaagccacctgttgatacgcctt

SEQ ID NO: 75527 - DNA, 25 bp, S. pombe
aaaagacctgctgaaatacctgaag

SEQ ID NO: 75528 - DNA, 25 bp, S. pombe
aaaaacaccgaccaagatactgaga

SEQ ID NO: 75529 - DNA, 25 bp, S. pombe
aaaaacccagttcatgctactactc

SEQ ID NO: 75530 - DNA, 25 bp, S. pombe
aaaaacaatgcatcaaacctccgcc

SEQ ID NO: 75531 - DNA, 25 bp, S. pombe
aaaagaaggccttgcaccagcttat

SEQ ID NO: 75532 - DNA, 25 bp, S. pombe
aaaaatggactattgcccctactgg

SEQ ID NO: 75533 - DNA, 25 bp, S. pombe
aaacaatggttcgttccgcaggtgg

SEQ ID NO: 75534 - DNA, 25 bp, S. pombe
aaacaattattgcttctgacgagga

SEQ ID NO: 75535 - DNA, 25 bp, S. pombe
aaacattgatgtaccttcgactaga

SEQ ID NO: 75536 - DNA, 25 bp, S. pombe
aaacatttaatcctgaccgctgggc

SEQ ID NO: 75537 - DNA, 25 bp, S. pombe
aaactcttcaattaccaggctgggc

SEQ ID NO: 75538 - DNA, 25 bp, S. pombe
aaacttctattgttgccgttctccg

SEQ ID NO: 75539 - DNA, 25 bp, S. pombe
aaacttggattctgcggattcccgg

SEQ ID NO: 75540 - DNA, 25 bp, S. pombe
aaacactggatttggcttggtccct

SEQ ID NO: 75541 - DNA, 25 bp, S. pombe
aaacatctactttggcggcagcttc

SEQ ID NO: 75542 - DNA, 25 bp, S. pombe
aaacttttctggactggagactcac

SEQ ID NO: 75543 - DNA, 25 bp, S. pombe
aaactctccatatttttctgaatcg

SEQ ID NO: 75544 - DNA, 25 bp, S. pombe
aaactactgctatctttgtgaacat

SEQ ID NO: 75545 - DNA, 25 bp, S. pombe
aaactccgtatcgtgtgccttcaga

SEQ ID NO: 75546 - DNA, 25 bp, S. pombe
aaacatctcaactggtacttcaaat

SEQ ID NO: 75547 - DNA, 25 bp, S. pombe
aaaacctcatccagcctacgaaaat

SEQ ID NO: 75548 - DNA, 25 bp, S. pombe
aaactctgcaacatggctttcctga

SEQ ID NO: 75549 - DNA, 25 bp, S. pombe
aaactccaaatctagctgaacctga

SEQ ID NO: 75550 - DNA, 25 bp, S. pombe
aaacaatcctctggcaaactcggtc

SEQ ID NO: 75551 - DNA, 25 bp, S. pombe
aaaacccctattctcataaccatgt

SEQ ID NO: 75552 - DNA, 25 bp, S. pombe
aaaactgccttggatcgtttgaatt

SEQ ID NO: 75553 - DNA, 25 bp, S. pombe
aaaaactgttcgtgccctgtctttg

SEQ ID NO: 75554 - DNA, 25 bp, S. pombe
aaacatcctgaaagtggcactcgtc

SEQ ID NO: 75555 - DNA, 25 bp, S. pombe
aaacttcttcttgctccatgaggga

SEQ ID NO: 75556 - DNA, 25 bp, S. pombe
aaactcttgtttgctgactcggcgc

SEQ ID NO: 75557 - DNA, 25 bp, S. pombe
aaaaatgtcggtttgtccttgccag

SEQ ID NO: 75558 - DNA, 25 bp, S. pombe
aacaattcccttgtatcccgaatat

SEQ ID NO: 75559 - DNA, 25 bp, S. pombe
cgaaatttcattgcgaatcccgatt

SEQ ID NO: 75560 - DNA, 25 bp, S. pombe
aacacagtacaagcgaaccctataa

SEQ ID NO: 75561 - DNA, 25 bp, S. pombe
aaaagatatcgagcgacccagtttt

SEQ ID NO: 75562 - DNA, 25 bp, S. pombe
cttgcaaatacctcaaaccgtttct

SEQ ID NO: 75563 - DNA, 25 bp, S. pombe
cttaagaacacatccccgggtattg

SEQ ID NO: 75564 - DNA, 25 bp, S. pombe
gtacaacaaccatcgtccgggaact

SEQ ID NO: 75565 - DNA, 25 bp, S. pombe
aaaattgcttcatggtgccgtcggc

SEQ ID NO: 75566 - DNA, 25 bp, S. pombe
aaacattgcttccaaagttacattg

SEQ ID NO: 75567 - DNA, 25 bp, S. pombe
aaacaaggctactgctagcgctcac

SEQ ID NO: 75568 - DNA, 25 bp, S. pombe
aaacataggctacgcgttcaggtgg

SEQ ID NO: 75569 - DNA, 25 bp, S. pombe
aaacaaatcccatatcctcgtatac

SEQ ID NO: 75570 - DNA, 25 bp, S. pombe
aaacaaaggccgcatctctcgtttc

SEQ ID NO: 75571 - DNA, 25 bp, S. pombe
aacagcatcattggccgtaccattg

SEQ ID NO: 75572 - DNA, 25 bp, S. pombe
aaactctcttgaggttcctgttcat

SEQ ID NO: 75573 - DNA, 25 bp, S. pombe
aaacacccggtgtatcatctgtaca

SEQ ID NO: 75574 - DNA, 25 bp, S. pombe
aaacaccttggtactatcactacga

SEQ ID NO: 75575 - DNA, 25 bp, S. pombe
aaactgctcttggattcttcactga

SEQ ID NO: 75576 - DNA, 25 bp, S. pombe
aaacattttgagtctgttcaggaac

SEQ ID NO: 75577 - DNA, 25 bp, S. pombe
aaactgagctatatgttccgcctcc

SEQ ID NO: 75578 - DNA, 25 bp, S. pombe
aaactgaccaatttaactcctgccg

SEQ ID NO: 75579 - DNA, 25 bp, S. pombe
aaactgtgccatccttgaaacgtga

SEQ ID NO: 75580 - DNA, 25 bp, S. pombe
aaactggctcagttcctaagcgtaa

SEQ ID NO: 75581 - DNA, 25 bp, S. pombe
aaacagtccgtagatgcaggcttga

SEQ ID NO: 75582 - DNA, 25 bp, S. pombe
aaacaatcctctgtcgagacttgac

SEQ ID NO: 75583 - DNA, 25 bp, S. pombe
aaaaacacattattccggctcctgt

SEQ ID NO: 75584 - DNA, 25 bp, S. pombe
aaacagtatcttgtggaccatccgt

SEQ ID NO: 75585 - DNA, 25 bp, S. pombe
aaactgattgaaatgcccgtgctgc

SEQ ID NO: 75586 - DNA, 25 bp, S. pombe
aaactttgcagttgccttggatgcc

SEQ ID NO: 75587 - DNA, 25 bp, S. pombe
aaacatcattcctcctaaaccaaag

SEQ ID NO: 75588 - DNA, 25 bp, S. pombe
aaaaactctcttgcagcgtaccaaa

SEQ ID NO: 75589 - DNA, 25 bp, S. pombe
aactacggttggtgttggcgtcgat

SEQ ID NO: 75590 - DNA, 25 bp, S. pombe
aaaacgcgtcggtgcttactcttat

SEQ ID NO: 75591 - DNA, 25 bp, S. pombe
aaactcaggctctagtctatcaacc

SEQ ID NO: 75592 - DNA, 25 bp, S. pombe
aaactcgatgccgttgttcatccta

SEQ ID NO: 75593 - DNA, 25 bp, S. pombe
aaaatgacaacctctctacctgttt

SEQ ID NO: 75594 - DNA, 25 bp, S. pombe
aaaaagcaactccttctgacacagt

SEQ ID NO: 75595 - DNA, 25 bp, S. pombe
aaacaccagtcttttttctcctatg

SEQ ID NO: 75596 - DNA, 25 bp, S. pombe
aaactatgtcaatccagcaccactg

SEQ ID NO: 75597 - DNA, 25 bp, S. pombe
aaacattcctatagcactagccact

SEQ ID NO: 75598 - DNA, 25 bp, S. pombe
aaacattttttccatcaggcctgca

SEQ ID NO: 75599 - DNA, 25 bp, S. pombe
aaacatttttaccatcgtgatgacg

SEQ ID NO: 75600 - DNA, 25 bp, S. pombe
aaacatactcttcctatcgaatcac

SEQ ID NO: 75601 - DNA, 25 bp, S. pombe
aaaacgtctttatcacaatcggtgc

SEQ ID NO: 75602 - DNA, 25 bp, S. pombe
aaacacatcgtttccatattgagta

SEQ ID NO: 75603 - DNA, 25 bp, S. pombe
aaacttgcgttctcatgctggacaa

SEQ ID NO: 75604 - DNA, 25 bp, S. pombe
aaactattggtggattctttacagg

SEQ ID NO: 75605 - DNA, 25 bp, S. pombe
aaactcatatccttgacgctacaga

SEQ ID NO: 75606 - DNA, 25 bp, S. pombe
aaactcatatctttcaccctaatac

SEQ ID NO: 75607 - DNA, 25 bp, S. pombe
aaaatgcaatgcttcgaaacctcga

SEQ ID NO: 75608 - DNA, 25 bp, S. pombe
aaaacagtcttacaagcctccaggc

SEQ ID NO: 75609 - DNA, 25 bp, S. pombe
aaaactttggttatcgctcctgcct

SEQ ID NO: 75610 - DNA, 25 bp, S. pombe
aaaaacgattgcatttcctcttcct

SEQ ID NO: 75611 - DNA, 25 bp, S. pombe
aaaaggacagtatcctccgtcgtgt

SEQ ID NO: 75612 - DNA, 25 bp, S. pombe
aaaaggttgcgatcgtcagcgtcct

SEQ ID NO: 75613 - DNA, 25 bp, S. pombe
aaacttggtgttcaacccgtgatga

SEQ ID NO: 75614 - DNA, 25 bp, S. pombe
aaacttgggcttccaatgctgtcgt

SEQ ID NO: 75615 - DNA, 25 bp, S. pombe
aaactaggtgtctctatttctatta

SEQ ID NO: 75616 - DNA, 25 bp, S. pombe
aaactcgttgttttcattatcattc

SEQ ID NO: 75617 - DNA, 25 bp, S. pombe
aaactcgttcgtggtgcttatttga

SEQ ID NO: 75618 - DNA, 25 bp, S. pombe
aaactcgtacttgcactttgcttga

SEQ ID NO: 75619 - DNA, 25 bp, S. pombe
aaacttaccttcacaatctcttaca

SEQ ID NO: 75620 - DNA, 25 bp, S. pombe
aaactccaacttctctatcatttac

SEQ ID NO: 75621 - DNA, 25 bp, S. pombe
aaactaccgatttccttcttgatca

SEQ ID NO: 75622 - DNA, 25 bp, S. pombe
aaacaatagggccagcactttccgc

SEQ ID NO: 75623 - DNA, 25 bp, S. pombe
aaaaatcaagtgtacctgctgtggt

SEQ ID NO: 75624 - DNA, 25 bp, S. pombe
aaaaaagtgctgtgcctaggcgttg

SEQ ID NO: 75625 - DNA, 25 bp, S. pombe
aaaaaagcaggctcgtcccgttgat

SEQ ID NO: 75626 - DNA, 25 bp, S. pombe
aaaatcgactgctgaagccgccgtt

SEQ ID NO: 75627 - DNA, 25 bp, S. pombe
aaacatccacaataagcccgtatct

SEQ ID NO: 75628 - DNA, 25 bp, S. pombe
aaacaactagcatatacccgtctct

SEQ ID NO: 75629 - DNA, 25 bp, S. pombe
aaacaacttcaaataactagctctg

SEQ ID NO: 75630 - DNA, 25 bp, S. pombe
aaaagcgatccgtcaaacttgagtt

SEQ ID NO: 75631 - DNA, 25 bp, S. pombe
aaaagccattcgacaagttcaggaa

SEQ ID NO: 75632 - DNA, 25 bp, S. pombe
aaaacactgcctacaaagctcgtaa

SEQ ID NO: 75633 - DNA, 25 bp, S. pombe
aaaaatgtcctcagaagatgcttca

SEQ ID NO: 75634 - DNA, 25 bp, S. pombe
aaaaatcatcccagtatttctccca

SEQ ID NO: 75635 - DNA, 25 bp, S. pombe
aaaaaggcgcctcctattcctagtg

SEQ ID NO: 75636 - DNA, 25 bp, S. pombe
cagacgtgcccttaaaggtttggct

SEQ ID NO: 75637 - DNA, 25 bp, S. pombe
aaaagcgcgcgattcaaagattttc

SEQ ID NO: 75638 - DNA, 25 bp, S. pombe
aaaagcctgtgcctgctggagactg

SEQ ID NO: 75639 - DNA, 25 bp, S. pombe
aaacatgctgctggttctggttctg

SEQ ID NO: 75640 - DNA, 25 bp, S. pombe
aaacacttgtgcaatggcttcctgc

SEQ ID NO: 75641 - DNA, 25 bp, S. pombe
aaaaatcttcatggttgccccttgt

SEQ ID NO: 75642 - DNA, 25 bp, S. pombe
aaaaatgtgaactttcctcccgctg

SEQ ID NO: 75643 - DNA, 25 bp, S. pombe
aaaaatctgaatgccctttgtgccg

SEQ ID NO: 75644 - DNA, 25 bp, S. pombe
aaaacattggtgctcctttgggcgg

SEQ ID NO: 75645 - DNA, 25 bp, S. pombe
aaaaattggtggtccgcttctctcg

SEQ ID NO: 75646 - DNA, 25 bp, S. pombe
aaacaattgcgatgccagctttctc

SEQ ID NO: 75647 - DNA, 25 bp, S. pombe
aaaagcatggaatgccgtttgctga

SEQ ID NO: 75648 - DNA, 25 bp, S. pombe
aaaacagcgaaagtgcgggttgcaa

SEQ ID NO: 75649 - DNA, 25 bp, S. pombe
aaacttcgagatttgcgtggcttca

SEQ ID NO: 75650 - DNA, 25 bp, S. pombe
aaaaaggctcttgaagggcttccag

SEQ ID NO: 75651 - DNA, 25 bp, S. pombe
aaacattactttgcccagtaccttg

SEQ ID NO: 75652 - DNA, 25 bp, S. pombe
aaaaagacatcctcttcagtgccca

SEQ ID NO: 75653 - DNA, 25 bp, S. pombe
aaaactactgcctcattaacctata

SEQ ID NO: 75654 - DNA, 25 bp, S. pombe
aaacattcattcttctgcttcaacc

SEQ ID NO: 75655 - DNA, 25 bp, S. pombe
aaacaattgggacgatgaggacatt

SEQ ID NO: 75656 - DNA, 25 bp, S. pombe
aaaacattccccttgagtatgcccg

SEQ ID NO: 75657 - DNA, 25 bp, S. pombe
aaaaattccttctgcgcttgcaacg

SEQ ID NO: 75658 - DNA, 25 bp, S. pombe
aaaagttccccgagtggcaagctca

SEQ ID NO: 75659 - DNA, 25 bp, S. pombe
aaaagttcccgagagtggagcgata

SEQ ID NO: 75660 - DNA, 25 bp, S. pombe
aaacaaagcgcatgtccgtcgtgat

SEQ ID NO: 75661 - DNA, 25 bp, S. pombe
aaacacaagcgtcgtcatcgtcatg

SEQ ID NO: 75662 - DNA, 25 bp, S. pombe
aaacattcaagacattcgcgcacag

SEQ ID NO: 75663 - DNA, 25 bp, S. pombe
aaactatactgaacatcacgcccgt

SEQ ID NO: 75664 - DNA, 25 bp, S. pombe
aaacttcaacattttgctgtctcaa

SEQ ID NO: 75665 - DNA, 25 bp, S. pombe
aaacttaagcctctgtgcactgaag

SEQ ID NO: 75666 - DNA, 25 bp, S. pombe
aaacaaattgcccttgtctctcaag

SEQ ID NO: 75667 - DNA, 25 bp, S. pombe
aaaaaagtgcacgagaatgtctcaa

SEQ ID NO: 75668 - DNA, 25 bp, S. pombe
aaacatctcggcttggacctaatgg

SEQ ID NO: 75669 - DNA, 25 bp, S. pombe
aaacatctccgcctgaggtgaagga

SEQ ID NO: 75670 - DNA, 25 bp, S. pombe
aaaaatgcgatccatcgggcaatcg

SEQ ID NO: 75671 - DNA, 25 bp, S. pombe
aaaacggcattacagtcagatgcaa

SEQ ID NO: 75672 - DNA, 25 bp, S. pombe
aaaactgcgcctttggacgttcata

SEQ ID NO: 75673 - DNA, 25 bp, S. pombe
aagaatgcgcctcctaaaagtgctc

SEQ ID NO: 75674 - DNA, 25 bp, S. pombe
aaaaaccacgttctcatgggcaaag

SEQ ID NO: 75675 - DNA, 25 bp, S. pombe
aaaaaacgttatcttgctcagcaat

SEQ ID NO: 75676 - DNA, 25 bp, S. pombe
aaaaactcggcatgattcctcgcaa

SEQ ID NO: 75677 - DNA, 25 bp, S. pombe
aaacatgctcttccttatggctacg

SEQ ID NO: 75678 - DNA, 25 bp, S. pombe
aaacatctctctcatttagcttcat

SEQ ID NO: 75679 - DNA, 25 bp, S. pombe
aaacatcatgtcctttcttctatca

SEQ ID NO: 75680 - DNA, 25 bp, S. pombe
aaacaatgcttcttctctactacag

SEQ ID NO: 75681 - DNA, 25 bp, S. pombe
aaacagttcagcttcatcaattaaa

SEQ ID NO: 75682 - DNA, 25 bp, S. pombe
aaacagacgcgattgcaccaagcaa

SEQ ID NO: 75683 - DNA, 25 bp, S. pombe
aaacaactggattcttcaacaagga

SEQ ID NO: 75684 - DNA, 25 bp, S. pombe
aaaaagtgctcgcatgctccatcaa

SEQ ID NO: 75685 - DNA, 25 bp, S. pombe
aaacagcagtttggctgcgcttgca

SEQ ID NO: 75686 - DNA, 25 bp, S. pombe
aaacagatttccgtcgttgcattct

SEQ ID NO: 75687 - DNA, 25 bp, S. pombe
aaacatactttctcctttatcgatt

SEQ ID NO: 75688 - DNA, 25 bp, S. pombe
aaaaagctttctatcgccgactggt

SEQ ID NO: 75689 - DNA, 25 bp, S. pombe
aaaaagcgtgttatcgccgatatgg

SEQ ID NO: 75690 - DNA, 25 bp, S. pombe
aaacacggctattttgcccaaatgg

SEQ ID NO: 75691 - DNA, 25 bp, S. pombe
aaccctactgacgttccataaagcg

SEQ ID NO: 75692 - DNA, 25 bp, S. pombe
aaacagcccaatgcatttcaaattt

SEQ ID NO: 75693 - DNA, 25 bp, S. pombe
aaaagcggtcgcctgtaaaacagct

SEQ ID NO: 75694 - DNA, 25 bp, S. pombe
aaaacgcgtgcgtcgtctcaaacgt

SEQ ID NO: 75695 - DNA, 25 bp, S. pombe
aaacagggattactcggtgccaaat

SEQ ID NO: 75696 - DNA, 25 bp, S. pombe
aaaagcgccgagaatcaacctccta

SEQ ID NO: 75697 - DNA, 25 bp, S. pombe
aaaactcttgacagcaggtgttgca

SEQ ID NO: 75698 - DNA, 25 bp, S. pombe
aaacatgtagctaaaacgattgcag

SEQ ID NO: 75699 - DNA, 25 bp, S. pombe
aaacattcgctttttgcaattgcaa

SEQ ID NO: 75700 - DNA, 25 bp, S. pombe
aaacattcccattgttctttgcggt

SEQ ID NO: 75701 - DNA, 25 bp, S. pombe
aaacagctttgatgctcgtgctcta

SEQ ID NO: 75702 - DNA, 25 bp, S. pombe
aaacatgacatctgctactttgcaa

SEQ ID NO: 75703 - DNA, 25 bp, S. pombe
aaacaagcacttccatctttatcca

SEQ ID NO: 75704 - DNA, 25 bp, S. pombe
aaaacatgctttgcccttagttgaa

SEQ ID NO: 75705 - DNA, 25 bp, S. pombe
aaaacattggctccttggtcgtcaa

SEQ ID NO: 75706 - DNA, 25 bp, S. pombe
aaaatgcaagcttggcgttttccca

SEQ ID NO: 75707 - DNA, 25 bp, S. pombe
aaaagaagacctcgcattttcctct

SEQ ID NO: 75708 - DNA, 25 bp, S. pombe
aaaacattacgctggtcagccctcg

SEQ ID NO: 75709 - DNA, 25 bp, S. pombe
aaaacttcgatgtgcgtactcccag

SEQ ID NO: 75710 - DNA, 25 bp, S. pombe
aaaagtggtcaggtggtccccgcag

SEQ ID NO: 75711 - DNA, 25 bp, S. pombe
aaaagacacggttgagcccgctccg

SEQ ID NO: 75712 - DNA, 25 bp, S. pombe
aaaagcgacgcctttgaaagacaat

SEQ ID NO: 75713 - DNA, 25 bp, S. pombe
aaaagcgacctcctaaacactcata

SEQ ID NO: 75714 - DNA, 25 bp, S. pombe
aaaagccggcatctaacaattcaaa

SEQ ID NO: 75715 - DNA, 25 bp, S. pombe
aaaagccggcttgcaacaacgtgac

SEQ ID NO: 75716 - DNA, 25 bp, S. pombe
aaaagctcggaatcttcgtcgtaag

SEQ ID NO: 75717 - DNA, 25 bp, S. pombe
aaaactctggacgacttgcgtggta

SEQ ID NO: 75718 - DNA, 25 bp, S. pombe
aaacacatcgtgagccctggtaata

SEQ ID NO: 75719 - DNA, 25 bp, S. pombe
aaacaatggtgttgctcgtcccgaa

SEQ ID NO: 75720 - DNA, 25 bp, S. pombe
aaacacctgtatgcactgattcaaa

SEQ ID NO: 75721 - DNA, 25 bp, S. pombe
aaacaactcatattcagcgattcta

SEQ ID NO: 75722 - DNA, 25 bp, S. pombe
aaacaacacaataagcgcagtcaag

SEQ ID NO: 75723 - DNA, 25 bp, S. pombe
aaaacacaagtttcgcaatcgcagg

SEQ ID NO: 75724 - DNA, 25 bp, S. pombe
aaacaaatacctacattgcagcccc

SEQ ID NO: 75725 - DNA, 25 bp, S. pombe
aaaaagcatactgacctgccttcac

SEQ ID NO: 75726 - DNA, 25 bp, S. pombe
aaacagcacgtggaccagagcctgc

SEQ ID NO: 75727 - DNA, 25 bp, S. pombe
aagaacggcatggactcggaccact

SEQ ID NO: 75728 - DNA, 25 bp, S. pombe
aaaactacctccaagtagcgctgaa

SEQ ID NO: 75729 - DNA, 25 bp, S. pombe
aaaaattcctcgtagtattggcact

SEQ ID NO: 75730 - DNA, 25 bp, S. pombe
aaaaattcccatgactactgctgcg

SEQ ID NO: 75731 - DNA, 25 bp, S. pombe
aaaaattcgcctgatccgtgggcta

SEQ ID NO: 75732 - DNA, 25 bp, S. pombe
aaaaattccctgacatcgcatggcg

SEQ ID NO: 75733 - DNA, 25 bp, S. pombe
aaacaagcttctaaagcctccgaag

SEQ ID NO: 75734 - DNA, 25 bp, S. pombe
aaaactcatgctgccaagcgtcttg

SEQ ID NO: 75735 - DNA, 25 bp, S. pombe
aaaacctcatccctatcggaagaat

SEQ ID NO: 75736 - DNA, 25 bp, S. pombe
aaaagcttcgatgggttacactagg

SEQ ID NO: 75737 - DNA, 25 bp, S. pombe
aaaactgttgcaccgttacgatatg

SEQ ID NO: 75738 - DNA, 25 bp, S. pombe
aaacaccagagattgcagctcctgc

SEQ ID NO: 75739 - DNA, 25 bp, S. pombe
aaaagtgaaactctcctcgctgttt

SEQ ID NO: 75740 - DNA, 25 bp, S. pombe
aaaacgagtattccccatggtgatg

SEQ ID NO: 75741 - DNA, 25 bp, S. pombe
aaaaggttattctccagcgtatggc

SEQ ID NO: 75742 - DNA, 25 bp, S. pombe
aaaaagtttctgtgccggttctgca

SEQ ID NO: 75743 - DNA, 25 bp, S. pombe
aaaaatcatgtctcgctctttcaag

SEQ ID NO: 75744 - DNA, 25 bp, S. pombe
aaaaatatctgcttcggctcgtaag

SEQ ID NO: 75745 - DNA, 25 bp, S. pombe
aaaaattcgtttggcgcgtcatggc

SEQ ID NO: 75746 - DNA, 25 bp, S. pombe
aaaaatcggcgtactgtggctcaaa

SEQ ID NO: 75747 - DNA, 25 bp, S. pombe
aaacagcttcactataccgacctat

SEQ ID NO: 75748 - DNA, 25 bp, S. pombe
aaacaaatccataacggctcctctt

SEQ ID NO: 75749 - DNA, 25 bp, S. pombe
aaacacctgctgagcttgatatgga

SEQ ID NO: 75750 - DNA, 25 bp, S. pombe
aaacacttcagtcatttgatggtaa

SEQ ID NO: 75751 - DNA, 25 bp, S. pombe
aaaagcttccttctttggatacaag

SEQ ID NO: 75752 - DNA, 25 bp, S. pombe
aaaagcctctttctgttcgtggact

SEQ ID NO: 75753 - DNA, 25 bp, S. pombe
aaaactcatatttcctttcacgcga

SEQ ID NO: 75754 - DNA, 25 bp, S. pombe
aaacagctatcaattcctccaaggt

SEQ ID NO: 75755 - DNA, 25 bp, S. pombe
aaacactgttccgagtgcggtactc

SEQ ID NO: 75756 - DNA, 25 bp, S. pombe
aaaacttgtcttggctgaggtgaat

SEQ ID NO: 75757 - DNA, 25 bp, S. pombe
aacagacccacgatttttgagtact

SEQ ID NO: 75758 - DNA, 25 bp, S. pombe
aaacacgtgtcttcatactttcagt

SEQ ID NO: 75759 - DNA, 25 bp, S. pombe
aaaaacgtgctttggcagctagtgc

SEQ ID NO: 75760 - DNA, 25 bp, S. pombe
aaaaccatggtctggcgatgaagaa

SEQ ID NO: 75761 - DNA, 25 bp, S. pombe
aaaacatctctggtggtcgtactgc

SEQ ID NO: 75762 - DNA, 25 bp, S. pombe
aaaacggctcgtcggtttgtgcaag

SEQ ID NO: 75763 - DNA, 25 bp, S. pombe
aaaacgaatcgtccctattctgcaa

SEQ ID NO: 75764 - DNA, 25 bp, S. pombe
aaaacgcgccgtgtatggataccaa

SEQ ID NO: 75765 - DNA, 25 bp, S. pombe
aaaatcgtcgtctatggtcaatcta

SEQ ID NO: 75766 - DNA, 25 bp, S. pombe
aaaaaatctcccagtctatctagac

SEQ ID NO: 75767 - DNA, 25 bp, S. pombe
aaaaattccatcatcagttcacaaa

SEQ ID NO: 75768 - DNA, 25 bp, S. pombe
aaaactgctcactaatgctgttgaa

SEQ ID NO: 75769 - DNA, 25 bp, S. pombe
aaaacttacagattgctcccacatg

SEQ ID NO: 75770 - DNA, 25 bp, S. pombe
aaacacgcgatcatttcgagctgcc

SEQ ID NO: 75771 - DNA, 25 bp, S. pombe
aaacacggctttatctaactccttg

SEQ ID NO: 75772 - DNA, 25 bp, S. pombe
aaaatcgtgcgtgtccgaacgcgta

SEQ ID NO: 75773 - DNA, 25 bp, S. pombe
aaaatcgtcgtggtcaaagagctag

SEQ ID NO: 75774 - DNA, 25 bp, S. pombe
aaacaactgtcaaccgatgcttcac

SEQ ID NO: 75775 - DNA, 25 bp, S. pombe
aaacaccgtttccatgagcaactgt

SEQ ID NO: 75776 - DNA, 25 bp, S. pombe
aaacacgctttctgcgagacagttt

SEQ ID NO: 75777 - DNA, 25 bp, S. pombe
aaaaggcatctccaagggtcagttt

SEQ ID NO: 75778 - DNA, 25 bp, S. pombe
aacaagacctcctgaacatcgtatt

SEQ ID NO: 75779 - DNA, 25 bp, S. pombe
aaaacaactccatgcaagcggtgct

SEQ ID NO: 75780 - DNA, 25 bp, S. pombe
aaaaccaatctctaaacgctcatgt

SEQ ID NO: 75781 - DNA, 25 bp, S. pombe
aaaacacccgcggtacttatgatgc

SEQ ID NO: 75782 - DNA, 25 bp, S. pombe
aaaagaacgcggctccttgtcatga

SEQ ID NO: 75783 - DNA, 25 bp, S. pombe
aaaaacccatggatcctcttctaag

SEQ ID NO: 75784 - DNA, 25 bp, S. pombe
aaaaagcgccttgctcttcttgagc

SEQ ID NO: 75785 - DNA, 25 bp, S. pombe
aaacaagctgctggtgtctctgtat

SEQ ID NO: 75786 - DNA, 25 bp, S. pombe
aaaaatgtctacgttgctggatgca

SEQ ID NO: 75787 - DNA, 25 bp, S. pombe
aaaacttcaatcttgtgcgatgcga

SEQ ID NO: 75788 - DNA, 25 bp, S. pombe
aaaactacaacaatgcgcttcgcaa

SEQ ID NO: 75789 - DNA, 25 bp, S. pombe
aaaatttcaagctgccttttcgcat

SEQ ID NO: 75790 - DNA, 25 bp, S. pombe
aaacacttcatacgctttcagcatt

SEQ ID NO: 75791 - DNA, 25 bp, S. pombe
aaacacgtgcatttgctgttcaaaa

SEQ ID NO: 75792 - DNA, 25 bp, S. pombe
aaacacttgcattggtcgtcgaaac

SEQ ID NO: 75793 - DNA, 25 bp, S. pombe
aaaaccgtagtgcatgaggaccctg

SEQ ID NO: 75794 - DNA, 25 bp, S. pombe
aaaacggttgatctggcttccatta

SEQ ID NO: 75795 - DNA, 25 bp, S. pombe
aaaacggttgcagcgcctactaaga

SEQ ID NO: 75796 - DNA, 25 bp, S. pombe
aaaacttttctcaggcttctcagga

SEQ ID NO: 75797 - DNA, 25 bp, S. pombe
aaaactagttttgccttctcaggtg

SEQ ID NO: 75798 - DNA, 25 bp, S. pombe
aaaactagcattttcgctcaactcc

SEQ ID NO: 75799 - DNA, 25 bp, S. pombe
aaaactagcatagtggcccaagtca

SEQ ID NO: 75800 - DNA, 25 bp, S. pombe
aaaaatgcgctaggtgcacccgata

SEQ ID NO: 75801 - DNA, 25 bp, S. pombe
aaaacagtcttcgtgcaaccgtaga

SEQ ID NO: 75802 - DNA, 25 bp, S. pombe
aaaacatgcaacagctcttccggta

SEQ ID NO: 75803 - DNA, 25 bp, S. pombe
aaaaatgcacaagctctcctgaggc

SEQ ID NO: 75804 - DNA, 25 bp, S. pombe
aaaaatcatccagtgcttcgaccag

SEQ ID NO: 75805 - DNA, 25 bp, S. pombe
aaaacttgccaagcgtactcagagc

SEQ ID NO: 75806 - DNA, 25 bp, S. pombe
aaaagctgtccatgggtaatccctc

SEQ ID NO: 75807 - DNA, 25 bp, S. pombe
aaaaatctgttcacgatcccacata

SEQ ID NO: 75808 - DNA, 25 bp, S. pombe
aaaagaccttgatcgttccactagt

SEQ ID NO: 75809 - DNA, 25 bp, S. pombe
aaaaagagttggtcgtcgctgcttc

SEQ ID NO: 75810 - DNA, 25 bp, S. pombe
aaaacggatttgtcgccactactca

SEQ ID NO: 75811 - DNA, 25 bp, S. pombe
aaaaagtgtcttctccatctgcact

SEQ ID NO: 75812 - DNA, 25 bp, S. pombe
aaaaatgatccttcgcttacggctc

SEQ ID NO: 75813 - DNA, 25 bp, S. pombe
aaaacataccttactgatacgcctc

SEQ ID NO: 75814 - DNA, 25 bp, S. pombe
aaaaatccacttggtgtccgctcca

SEQ ID NO: 75815 - DNA, 25 bp, S. pombe
aaaatttacaaccatacccgcacag

SEQ ID NO: 75816 - DNA, 25 bp, S. pombe
aaaagttttcacctacctggcattg

SEQ ID NO: 75817 - DNA, 25 bp, S. pombe
aaaagtacttagcatcccgagattg

SEQ ID NO: 75818 - DNA, 25 bp, S. pombe
aaaagtcaacccattcctgaatctc

SEQ ID NO: 75819 - DNA, 25 bp, S. pombe
aaaagcaaagccaatttccgcacct

SEQ ID NO: 75820 - DNA, 25 bp, S. pombe
aaaaccctgcgcttttcgctggata

SEQ ID NO: 75821 - DNA, 25 bp, S. pombe
aaaaatttgcatcgtctcggtggac

SEQ ID NO: 75822 - DNA, 25 bp, S. pombe
aaaactctatcagagcctggctcgt

SEQ ID NO: 75823 - DNA, 25 bp, S. pombe
aaaaactctcaatgcaatcccgatg

SEQ ID NO: 75824 - DNA, 25 bp, S. pombe
aaaagctatctgaactaccgaccca

SEQ ID NO: 75825 - DNA, 25 bp, S. pombe
aaaagctgattatctgctccggcca

SEQ ID NO: 75826 - DNA, 25 bp, S. pombe
aaaacagattcgtgtcagcggccct

SEQ ID NO: 75827 - DNA, 25 bp, S. pombe
gttacgaagtcgtgtaggcctcctc

SEQ ID NO: 75828 - DNA, 25 bp, S. pombe
aaaaatatcgcgctgtcttctggtt

SEQ ID NO: 75829 - DNA, 25 bp, S. pombe
aaaaatacctctggcatcttccgtt

SEQ ID NO: 75830 - DNA, 25 bp, S. pombe
aaaaatattaccctcgtctcactct

SEQ ID NO: 75831 - DNA, 25 bp, S. pombe
aaacaagatcgtgttccttcacctt

SEQ ID NO: 75832 - DNA, 25 bp, S. pombe
aaacaatgagggtcactccttcaga

SEQ ID NO: 75833 - DNA, 25 bp, S. pombe
aaaagtcttcagacgcttggaagga

SEQ ID NO: 75834 - DNA, 25 bp, S. pombe
aaaaatgcgcaacccttttagtgca

SEQ ID NO: 75835 - DNA, 25 bp, S. pombe
aaaagagctataccgctgttcttgg

SEQ ID NO: 75836 - DNA, 25 bp, S. pombe
aacaaactctacagggacttcgcac

SEQ ID NO: 75837 - DNA, 25 bp, S. pombe
aacactgtttactcggcagttcaga

SEQ ID NO: 75838 - DNA, 25 bp, S. pombe
aaaatgtcctactggcagcggaaga

SEQ ID NO: 75839 - DNA, 25 bp, S. pombe
aaaaccctgacactgtacgtgcaaa

SEQ ID NO: 75840 - DNA, 25 bp, S. pombe
aaaaccagcggccttgagtggaata

SEQ ID NO: 75841 - DNA, 25 bp, S. pombe
aaaacgcgtcatcgttgagatggaa

SEQ ID NO: 75842 - DNA, 25 bp, S. pombe
aaaaatcaagcgctctcgtcgccat

SEQ ID NO: 75843 - DNA, 25 bp, S. pombe
aaaaagacctgcttctgagtcacct

SEQ ID NO: 75844 - DNA, 25 bp, S. pombe
aaaaagctctgttcaagtctaatct

SEQ ID NO: 75845 - DNA, 25 bp, S. pombe
aaaaatgcctcttccattgctgaga

SEQ ID NO: 75846 - DNA, 25 bp, S. pombe
aaaacatcttcttccttcaattcat

SEQ ID NO: 75847 - DNA, 25 bp, S. pombe
aaaactttactgcatcaccatcttc

SEQ ID NO: 75848 - DNA, 25 bp, S. pombe
aaaactatatccatacccactatcg

SEQ ID NO: 75849 - DNA, 25 bp, S. pombe
aaaacttcacccatccaaagatcgt

SEQ ID NO: 75850 - DNA, 25 bp, S. pombe
aaaatcttgacagcccaaggccttg

SEQ ID NO: 75851 - DNA, 25 bp, S. pombe
aacgaagtcgagctcggcgacgttt

SEQ ID NO: 75852 - DNA, 25 bp, S. pombe
aaaaggctggactcgaggcacgttt

SEQ ID NO: 75853 - DNA, 25 bp, S. pombe
aaaaggcttaactgacgatcgtctc

SEQ ID NO: 75854 - DNA, 25 bp, S. pombe
aaaatggtacctgaacggctcggat

SEQ ID NO: 75855 - DNA, 25 bp, S. pombe
aaaaggtaccgctgttgccatgcaa

SEQ ID NO: 75856 - DNA, 25 bp, S. pombe
aaaagtggcacccatttacgcgtca

SEQ ID NO: 75857 - DNA, 25 bp, S. pombe
ttaacatgggacgaggttaagcctc

SEQ ID NO: 75858 - DNA, 25 bp, S. pombe
gctataaagccacaggttacaccgg

SEQ ID NO: 75859 - DNA, 25 bp, S. pombe
aaaaagccctattgttgacccagag

SEQ ID NO: 75860 - DNA, 25 bp, S. pombe
aaaaaatgcgctattctctacctca

SEQ ID NO: 75861 - DNA, 25 bp, S. pombe
aaaaatccagattacgcccgcattg

SEQ ID NO: 75862 - DNA, 25 bp, S. pombe
aaaagctccctgtcttcattggtgc

SEQ ID NO: 75863 - DNA, 25 bp, S. pombe
aaaagtgtgacgacttctcttcggc

SEQ ID NO: 75864 - DNA, 25 bp, S. pombe
aaaagaaatgctgtcaccacaccct

SEQ ID NO: 75865 - DNA, 25 bp, S. pombe
aaaaacgtgtcatatcctgcttgcc

SEQ ID NO: 75866 - DNA, 25 bp, S. pombe
aaaacacgctgtttatccacttgcg

SEQ ID NO: 75867 - DNA, 25 bp, S. pombe
aaaaagctatttactctcacctgcc

SEQ ID NO: 75868 - DNA, 25 bp, S. pombe
aaaaaccagctcattgactccgcag

SEQ ID NO: 75869 - DNA, 25 bp, S. pombe
aaaaaggctgccatgggtcctgacc

SEQ ID NO: 75870 - DNA, 25 bp, S. pombe
aaaactgggacttcgctgctttctg

SEQ ID NO: 75871 - DNA, 25 bp, S. pombe
aaaacattacttacgcctgcttctc

SEQ ID NO: 75872 - DNA, 25 bp, S. pombe
aaaagcatatccttaccgcgaacct

SEQ ID NO: 75873 - DNA, 25 bp, S. pombe
aaaaaagcgttgttcatcctgctat

SEQ ID NO: 75874 - DNA, 25 bp, S. pombe
aacaagaaaaattgcccctctccat

SEQ ID NO: 75875 - DNA, 25 bp, S. pombe
aaaagtgcggtcttaccaggcttct

SEQ ID NO: 75876 - DNA, 25 bp, S. pombe
aaaaaccgttctttcatatctcttg

SEQ ID NO: 75877 - DNA, 25 bp, S. pombe
aaaaaattctgtccttcctgcggtg

SEQ ID NO: 75878 - DNA, 25 bp, S. pombe
aaaaaagcgtgtgcctgcctggtgt

SEQ ID NO: 75879 - DNA, 25 bp, S. pombe
aaaaagcacattcgcccgtatggtt

SEQ ID NO: 75880 - DNA, 25 bp, S. pombe
aaaatacatcttggcctggaaggct

SEQ ID NO: 75881 - DNA, 25 bp, S. pombe
aaaaggagcctctcttgccaaagga

SEQ ID NO: 75882 - DNA, 25 bp, S. pombe
aaaactgcgtgcaccgggcctatgt

SEQ ID NO: 75883 - DNA, 25 bp, S. pombe
aaaaaggctctgctacccgtcatat

SEQ ID NO: 75884 - DNA, 25 bp, S. pombe
aaaaagcagcttgatgccgccgttg

SEQ ID NO: 75885 - DNA, 25 bp, S. pombe
aaaaacatcgggtactggcaacatt

SEQ ID NO: 75886 - DNA, 25 bp, S. pombe
aaaaagcgcgtttctatgcgttaca

SEQ ID NO: 75887 - DNA, 25 bp, S. pombe
aaaagagggtatccctccttcacag

SEQ ID NO: 75888 - DNA, 25 bp, S. pombe
aaaaagtcggatctcttcgctcaaa

SEQ ID NO: 75889 - DNA, 25 bp, S. pombe
aaaaagtccctgctcgtcatggaag

SEQ ID NO: 75890 - DNA, 25 bp, S. pombe
aaaaagctccacacctgtcgaatag

SEQ ID NO: 75891 - DNA, 25 bp, S. pombe
caaagggttcacatcccttaccaga

SEQ ID NO: 75892 - DNA, 25 bp, S. pombe
aaaagattccctgcgttttcgctgc

SEQ ID NO: 75893 - DNA, 25 bp, S. pombe
aaaactcctccatatgttactgcgg

SEQ ID NO: 75894 - DNA, 25 bp, S. pombe
aaaaccacgaacttgtctcttctgc

SEQ ID NO: 75895 - DNA, 25 bp, S. pombe
aaaaggtccttctctctatcaagtt

SEQ ID NO: 75896 - DNA, 25 bp, S. pombe
aaaaggttctatgccatcaactggt

SEQ ID NO: 75897 - DNA, 25 bp, S. pombe
aaaacttgctcaatcttcttcctaa

SEQ ID NO: 75898 - DNA, 25 bp, S. pombe
aaaactcgactatttctctactgaa

SEQ ID NO: 75899 - DNA, 25 bp, S. pombe
aaaacttcctgatatccttcaagag

SEQ ID NO: 75900 - DNA, 25 bp, S. pombe
aaaagattacccagctcattccttc

SEQ ID NO: 75901 - DNA, 25 bp, S. pombe
aaaaacgctccattggtgcgtcaag

SEQ ID NO: 75902 - DNA, 25 bp, S. pombe
aaaacactcgacatgggcgccatat

SEQ ID NO: 75903 - DNA, 25 bp, S. pombe
aaaacactcgctgcatttgatgctg

SEQ ID NO: 75904 - DNA, 25 bp, S. pombe
aacacaagacggtaagcctgagctt

SEQ ID NO: 75905 - DNA, 25 bp, S. pombe
aaaattacttcagctactcctctag

SEQ ID NO: 75906 - DNA, 25 bp, S. pombe
aacaacttgcccgtgtaacagaatt

SEQ ID NO: 75907 - DNA, 25 bp, S. pombe
aaaagctcgatgtcttcttccatta

SEQ ID NO: 75908 - DNA, 25 bp, S. pombe
aaaacactcgcaggtagcttccatg

SEQ ID NO: 75909 - DNA, 25 bp, S. pombe
aaaaactagcacttcgtccgatgcg

SEQ ID NO: 75910 - DNA, 25 bp, S. pombe
aaaagtgctccatccaagcggaaga

SEQ ID NO: 75911 - DNA, 25 bp, S. pombe
aaaagcactcctaccgacgaagatg

SEQ ID NO: 75912 - DNA, 25 bp, S. pombe
aaaaaatcctgttctcggctcagag

SEQ ID NO: 75913 - DNA, 25 bp, S. pombe
aaaacacttaatgactctctgagag

SEQ ID NO: 75914 - DNA, 25 bp, S. pombe
aaaagattcaccaggcagctgtgga

SEQ ID NO: 75915 - DNA, 25 bp, S. pombe
aaaaccaacctccagatcagtgtaa

SEQ ID NO: 75916 - DNA, 25 bp, S. pombe
aaaacaccgcttcatgctgagacgt

SEQ ID NO: 75917 - DNA, 25 bp, S. pombe
aaaacggctcttcatctcagcaggt

SEQ ID NO: 75918 - DNA, 25 bp, S. pombe
aaaaggagcctctcgatatccctat

SEQ ID NO: 75919 - DNA, 25 bp, S. pombe
aaaaccgatttcaacaagctgcctg

SEQ ID NO: 75920 - DNA, 25 bp, S. pombe
aaaacagctgtcttctggtcgtgat

SEQ ID NO: 75921 - DNA, 25 bp, S. pombe
aaaacgcatcactctttccataaat

SEQ ID NO: 75922 - DNA, 25 bp, S. pombe
aaaacatcttacacttactcatcgc

SEQ ID NO: 75923 - DNA, 25 bp, S. pombe
aaaacatttcgcagcattcgccatg

SEQ ID NO: 75924 - DNA, 25 bp, S. pombe
aaaacgttgccgaatctgctcaagc

SEQ ID NO: 75925 - DNA, 25 bp, S. pombe
aaaacagttaccttgatgctatcag

SEQ ID NO: 75926 - DNA, 25 bp, S. pombe
aaaatggtaaccctgatcgcttata

SEQ ID NO: 75927 - DNA, 25 bp, S. pombe
aaaagtctcgaaacagggcaaccat

SEQ ID NO: 75928 - DNA, 25 bp, S. pombe
aaaagttggacacttgcaagaacca

SEQ ID NO: 75929 - DNA, 25 bp, S. pombe
aaaactgttgaccatgccggtacca

SEQ ID NO: 75930 - DNA, 25 bp, S. pombe
aaaactcattcatcaccggtactac

SEQ ID NO: 75931 - DNA, 25 bp, S. pombe
aaaactttccctccgtgatgatgat

SEQ ID NO: 75932 - DNA, 25 bp, S. pombe
aaaactcttcagctttctcgcaagc

SEQ ID NO: 75933 - DNA, 25 bp, S. pombe
aaaacactctgaacgtgtcggtcaa

SEQ ID NO: 75934 - DNA, 25 bp, S. pombe
aaaactatcggaactctcaaagcaa

SEQ ID NO: 75935 - DNA, 25 bp, S. pombe
aaaagcccgatttccactgggcaat

SEQ ID NO: 75936 - DNA, 25 bp, S. pombe
aaaatacggtgttcctgaggcggtg

SEQ ID NO: 75937 - DNA, 25 bp, S. pombe
aaaactctccttgatggtgctgctg

SEQ ID NO: 75938 - DNA, 25 bp, S. pombe
aaaactgctgcccttagagttgctg

SEQ ID NO: 75939 - DNA, 25 bp, S. pombe
aaaaccgttcaatctcttgcattga

SEQ ID NO: 75940 - DNA, 25 bp, S. pombe
aaaacatagcccaccttctgaggag

SEQ ID NO: 75941 - DNA, 25 bp, S. pombe
aaaatttgccagcttgttcaaggag

SEQ ID NO: 75942 - DNA, 25 bp, S. pombe
aaaagaatccgtccatttcatgaaa

SEQ ID NO: 75943 - DNA, 25 bp, S. pombe
aaaatagcccgtgatgttgcattaa

SEQ ID NO: 75944 - DNA, 25 bp, S. pombe
aaaaggcttctacttctaactcaag

SEQ ID NO: 75945 - DNA, 25 bp, S. pombe
aaaacagtgtcttttccatccatca

SEQ ID NO: 75946 - DNA, 25 bp, S. pombe
aaaacaggttgctattcactttcag

SEQ ID NO: 75947 - DNA, 25 bp, S. pombe
aaaacaggttgttccatcttcacaa

SEQ ID NO: 75948 - DNA, 25 bp, S. pombe
aaaatccgagttctgttacaaagca

SEQ ID NO: 75949 - DNA, 25 bp, S. pombe
aaaatctcgagtcttgtatactggg

SEQ ID NO: 75950 - DNA, 25 bp, S. pombe
aaaacgctcgtcttggttctattca

SEQ ID NO: 75951 - DNA, 25 bp, S. pombe
aaaagcagcttttggagcttcgaaa

SEQ ID NO: 75952 - DNA, 25 bp, S. pombe
aaaaccgctttctgactttgatgga

SEQ ID NO: 75953 - DNA, 25 bp, S. pombe
aaaaccgctttgtctgaagtcagat

SEQ ID NO: 75954 - DNA, 25 bp, S. pombe
aacacctcccagcactatggtttag

SEQ ID NO: 75955 - DNA, 25 bp, S. pombe
aaaactcccacagctgaggttgatt

SEQ ID NO: 75956 - DNA, 25 bp, S. pombe
aaaacccgacactgaggctgagatc

SEQ ID NO: 75957 - DNA, 25 bp, S. pombe
aaaatcccgaacctgtggctcaaca

SEQ ID NO: 75958 - DNA, 25 bp, S. pombe
aaaacttcagttttcgctgtcatag

SEQ ID NO: 75959 - DNA, 25 bp, S. pombe
aaaagcattcatccactaccattaa

SEQ ID NO: 75960 - DNA, 25 bp, S. pombe
aaaacattggcgtccacgattcacc

SEQ ID NO: 75961 - DNA, 25 bp, S. pombe
aaaacttgcagccatcgacgttcaa

SEQ ID NO: 75962 - DNA, 25 bp, S. pombe
aaaacttgaggtggctgcactgtcg

SEQ ID NO: 75963 - DNA, 25 bp, S. pombe
aaaacgacatcttatccgcaattcc

SEQ ID NO: 75964 - DNA, 25 bp, S. pombe
aaaactgcttctgacaacacttcgc

SEQ ID NO: 75965 - DNA, 25 bp, S. pombe
aaaacgtgctgctactcagagcgct

SEQ ID NO: 75966 - DNA, 25 bp, S. pombe
aaaacggctttcaagagcgcctgac

SEQ ID NO: 75967 - DNA, 25 bp, S. pombe
aaaagcggttactagtgccactgca

SEQ ID NO: 75968 - DNA, 25 bp, S. pombe
aaaagtggtgcgtacgcgtcaccgt

SEQ ID NO: 75969 - DNA, 25 bp, S. pombe
aaaatttgcgcgctcaattggccct

SEQ ID NO: 75970 - DNA, 25 bp, S. pombe
aaaagctctcggcaagcttggcggt

SEQ ID NO: 75971 - DNA, 25 bp, S. pombe
aaaagtcgtgtgcaagccgtcaaaa

SEQ ID NO: 75972 - DNA, 25 bp, S. pombe
aaaagattactctacccgacatcgc

SEQ ID NO: 75973 - DNA, 25 bp, S. pombe
aaaagattcctctactagtccggcg

SEQ ID NO: 75974 - DNA, 25 bp, S. pombe
aaaagcgtgtcttactgagatctag

SEQ ID NO: 75975 - DNA, 25 bp, S. pombe
aaaacgattcttacgcttgctatgt

SEQ ID NO: 75976 - DNA, 25 bp, S. pombe
aaaaccttctctgcctgtaagtgat

SEQ ID NO: 75977 - DNA, 25 bp, S. pombe
aaaacgatgctgtccgtgttgccca

SEQ ID NO: 75978 - DNA, 25 bp, S. pombe
aaaactgctcgatttagcttccgca

SEQ ID NO: 75979 - DNA, 25 bp, S. pombe
aaaattgggagtatccgtcgcctca

SEQ ID NO: 75980 - DNA, 25 bp, S. pombe
aaaagctgtcaaagttctccggccg

SEQ ID NO: 75981 - DNA, 25 bp, S. pombe
aaaacgcttagttgttccggctgcg

SEQ ID NO: 75982 - DNA, 25 bp, S. pombe
aaaagatctgtttctgatcccgtta

SEQ ID NO: 75983 - DNA, 25 bp, S. pombe
aaaacctggttccactctgtatgag

SEQ ID NO: 75984 - DNA, 25 bp, S. pombe
aaaactgccgtcaaccgctgtatgg

SEQ ID NO: 75985 - DNA, 25 bp, S. pombe
aaaagctactcaacacctgcttcat

SEQ ID NO: 75986 - DNA, 25 bp, S. pombe
aaaactcctgtcgaccttgttgatt

SEQ ID NO: 75987 - DNA, 25 bp, S. pombe
aaaactcctgatccctcggaagatg

SEQ ID NO: 75988 - DNA, 25 bp, S. pombe
aaaatagatcctcttcttgaagcag

SEQ ID NO: 75989 - DNA, 25 bp, S. pombe
aaaataatgctgatcgtccgaagtg

SEQ ID NO: 75990 - DNA, 25 bp, S. pombe
aaaattccggacaatttgcagcaat

SEQ ID NO: 75991 - DNA, 25 bp, S. pombe
aaaagagacatggtcctttgccaag

SEQ ID NO: 75992 - DNA, 25 bp, S. pombe
aaaacgttcatcatggcgggattgc

SEQ ID NO: 75993 - DNA, 25 bp, S. pombe
aaaatcccctcaatgccatgcaaat

SEQ ID NO: 75994 - DNA, 25 bp, S. pombe
aaaactgcacttttgcttcagcttt

SEQ ID NO: 75995 - DNA, 25 bp, S. pombe
aaaactcgtttggttatgcgtcgcg

SEQ ID NO: 75996 - DNA, 25 bp, S. pombe
aaaactcgattatttctctgccggc

SEQ ID NO: 75997 - DNA, 25 bp, S. pombe
aaaactctgttttgcgcgtcactgt

SEQ ID NO: 75998 - DNA, 25 bp, S. pombe
aaaactctgataatccgcggctaga

SEQ ID NO: 75999 - DNA, 25 bp, S. pombe
aaaagcggttactcgtgatactagt

SEQ ID NO: 76000 - DNA, 25 bp, S. pombe
ctacggcggtagctctttaagtact

SEQ ID NO: 76001 - DNA, 25 bp, S. pombe
aaaacggatctcatgcttccagcgt

SEQ ID NO: 76002 - DNA, 25 bp, S. pombe
aaaactgcgtcttatgcttctcgtg

SEQ ID NO: 76003 - DNA, 25 bp, S. pombe
aaaagtcggcaatgtcatcctctac

SEQ ID NO: 76004 - DNA, 25 bp, S. pombe
aaaagaggagcatggtgcgttccaa

SEQ ID NO: 76005 - DNA, 25 bp, S. pombe
aaaagtcttcgcttgccaggttcaa

SEQ ID NO: 76006 - DNA, 25 bp, S. pombe
aaaagctccctttcagattcatctc

SEQ ID NO: 76007 - DNA, 25 bp, S. pombe
aacaaggcacctggaattgctcgcc

SEQ ID NO: 76008 - DNA, 25 bp, S. pombe
aaaagaatgcgccttctccaaccga

SEQ ID NO: 76009 - DNA, 25 bp, S. pombe
aaaagtatgtgtcgcctcctggtaa

SEQ ID NO: 76010 - DNA, 25 bp, S. pombe
aaaaggctcgtgctctcggtgtaaa

SEQ ID NO: 76011 - DNA, 25 bp, S. pombe
aaaatcattccccatcgtgaacatg

SEQ ID NO: 76012 - DNA, 25 bp, S. pombe
aaaattgcacggcatgcgctggttc

SEQ ID NO: 76013 - DNA, 25 bp, S. pombe
aaaacgccgctgttgctgctggtgc

SEQ ID NO: 76014 - DNA, 25 bp, S. pombe
aaaacgctggtgagtgctgggcctt

SEQ ID NO: 76015 - DNA, 25 bp, S. pombe
aaaagcggcatgtttcaagatgaaa

SEQ ID NO: 76016 - DNA, 25 bp, S. pombe
aaaatgcgcatatcccgaggttgat

SEQ ID NO: 76017 - DNA, 25 bp, S. pombe
aaaacgatgatttccggagcactat

SEQ ID NO: 76018 - DNA, 25 bp, S. pombe
aaaaggcattcatggaggtcattcc

SEQ ID NO: 76019 - DNA, 25 bp, S. pombe
aaaagacatggcagcgcagtttccc

SEQ ID NO: 76020 - DNA, 25 bp, S. pombe
aacaggatgcgctcgttcaaattaa

SEQ ID NO: 76021 - DNA, 25 bp, S. pombe
aacagaagcgctgccatctatggtt

SEQ ID NO: 76022 - DNA, 25 bp, S. pombe
aaaaccgccccattcctcaatggat

SEQ ID NO: 76023 - DNA, 25 bp, S. pombe
aaaatcacatccctttctggtttga

SEQ ID NO: 76024 - DNA, 25 bp, S. pombe
aaaatcgcatcccttttccttattg

SEQ ID NO: 76025 - DNA, 25 bp, S. pombe
aaaagatgctgccatggctggtttt

SEQ ID NO: 76026 - DNA, 25 bp, S. pombe
aaaagtgttgcacctggtcgtcatc

SEQ ID NO: 76027 - DNA, 25 bp, S. pombe
aaaagcgcactacttcctgcgagaa

SEQ ID NO: 76028 - DNA, 25 bp, S. pombe
aaaaccataccgactgctgcaaaat

SEQ ID NO: 76029 - DNA, 25 bp, S. pombe
aaaagtgctatcactcctaccacag

SEQ ID NO: 76030 - DNA, 25 bp, S. pombe
aaaacccttacggattcagatgtcg

SEQ ID NO: 76031 - DNA, 25 bp, S. pombe
aaaacgcgttatggctttggcagta

SEQ ID NO: 76032 - DNA, 25 bp, S. pombe
aaaatccgttcagctttttgcgagc

SEQ ID NO: 76033 - DNA, 25 bp, S. pombe
aaaaccgtatctgcttcgattgctg

SEQ ID NO: 76034 - DNA, 25 bp, S. pombe
aaaaccgttcatctgtgcctcatat

SEQ ID NO: 76035 - DNA, 25 bp, S. pombe
aaaaccagttgcttggcatccacaa

SEQ ID NO: 76036 - DNA, 25 bp, S. pombe
aaaatcgcagttttggctcatccct

SEQ ID NO: 76037 - DNA, 25 bp, S. pombe
aaaatcttctactacagcctctaag

SEQ ID NO: 76038 - DNA, 25 bp, S. pombe
aaaatgttgctcctgaagccctaat

SEQ ID NO: 76039 - DNA, 25 bp, S. pombe
aaaatgtttcatcgctcgcagccaa

SEQ ID NO: 76040 - DNA, 25 bp, S. pombe
aaaatcatcagtttagtcaccgact

SEQ ID NO: 76041 - DNA, 25 bp, S. pombe
aaaagcatttgattcctgccgctac

SEQ ID NO: 76042 - DNA, 25 bp, S. pombe
aaaagcacattgactttgccctctc

SEQ ID NO: 76043 - DNA, 25 bp, S. pombe
aaaagccaattacttgcccatcagg

SEQ ID NO: 76044 - DNA, 25 bp, S. pombe
aaaatcttcgcatcctgctcgtttc

SEQ ID NO: 76045 - DNA, 25 bp, S. pombe
gaaagtcgtcgagcagtttttacct

SEQ ID NO: 76046 - DNA, 25 bp, S. pombe
aaaatgctgtcgtggtttctactcc

SEQ ID NO: 76047 - DNA, 25 bp, S. pombe
aaaatcagttggtacgcttcgctag

SEQ ID NO: 76048 - DNA, 25 bp, S. pombe
aaaaggatcttcgtctcagtcgaat

SEQ ID NO: 76049 - DNA, 25 bp, S. pombe
aaaaggcacttcgtctccgacaaca

SEQ ID NO: 76050 - DNA, 25 bp, S. pombe
aaaagcgcgcttaacttacctccag

SEQ ID NO: 76051 - DNA, 25 bp, S. pombe
aaaagggctcttatcgactctcctt

SEQ ID NO: 76052 - DNA, 25 bp, S. pombe
aaaagggcctaattctccatcttcg

SEQ ID NO: 76053 - DNA, 25 bp, S. pombe
aaaagtcatctcagggctcaagctt

SEQ ID NO: 76054 - DNA, 25 bp, S. pombe
aaaatgcgtgctcagcgtgttcgtc

SEQ ID NO: 76055 - DNA, 25 bp, S. pombe
aaaagctctgctcattttctggttg

SEQ ID NO: 76056 - DNA, 25 bp, S. pombe
aaaatcgacgactttctcggcttgg

SEQ ID NO: 76057 - DNA, 25 bp, S. pombe
caaatgcaaacgtttttactggtct

SEQ ID NO: 76058 - DNA, 25 bp, S. pombe
aacatgtagctaaaacgattgcagg

SEQ ID NO: 76059 - DNA, 25 bp, S. pombe
aacacatttacgcacttgggctcta

SEQ ID NO: 76060 - DNA, 25 bp, S. pombe
aacactttgaccaagtcggccatcg

SEQ ID NO: 76061 - DNA, 25 bp, S. pombe
aaaatcacttgagctatccagacga

SEQ ID NO: 76062 - DNA, 25 bp, S. pombe
aaaattgctcgagtgttggctacga

SEQ ID NO: 76063 - DNA, 25 bp, S. pombe
aacaatagatcctactcgttccact

SEQ ID NO: 76064 - DNA, 25 bp, S. pombe
aaaataatcaaccacaatctccacc

SEQ ID NO: 76065 - DNA, 25 bp, S. pombe
aaaatctatgcagccgcaatttgac

SEQ ID NO: 76066 - DNA, 25 bp, S. pombe
aaaatccaatcaatctctcttcgca

SEQ ID NO: 76067 - DNA, 25 bp, S. pombe
aacggtcgctggatggtcttacttg

SEQ ID NO: 76068 - DNA, 25 bp, S. pombe
aacggtcgtcggtgtgcagaactgc

SEQ ID NO: 76069 - DNA, 25 bp, S. pombe
aaaaggagcaacatggcagcaccat

SEQ ID NO: 76070 - DNA, 25 bp, S. pombe
aaaagcgctgcattttatcaggcca

SEQ ID NO: 76071 - DNA, 25 bp, S. pombe
aaaagtctcatttctcctgtgtacc

SEQ ID NO: 76072 - DNA, 25 bp, S. pombe
aacaaatcctgccactgggtctatt

SEQ ID NO: 76073 - DNA, 25 bp, S. pombe
aaaaggtctgtatcgtccaacaaag

SEQ ID NO: 76074 - DNA, 25 bp, S. pombe
aaaagggctgcagctgccatgaaaa

SEQ ID NO: 76075 - DNA, 25 bp, S. pombe
aaaatggttggcgtgctgtacaata

SEQ ID NO: 76076 - DNA, 25 bp, S. pombe
aagattcaattctccccaaacttgt

SEQ ID NO: 76077 - DNA, 25 bp, S. pombe
aacttcacaacccatgccgaaaatg

SEQ ID NO: 76078 - DNA, 25 bp, S. pombe
aactcgaacccgtttgaagtatgtg

SEQ ID NO: 76079 - DNA, 25 bp, S. pombe
aacacgtttaccagaccacatggct

SEQ ID NO: 76080 - DNA, 25 bp, S. pombe
aaaagtttggctcaggctgccatca

SEQ ID NO: 76081 - DNA, 25 bp, S. pombe
aaaatttgaggagcccagcacctat

SEQ ID NO: 76082 - DNA, 25 bp, S. pombe
aactttgtagaagccactcccgttg

SEQ ID NO: 76083 - DNA, 25 bp, S. pombe
aatcttagaagctggcctacccgtt

SEQ ID NO: 76084 - DNA, 25 bp, S. pombe
aaaagggtccagttttcagccatgc

SEQ ID NO: 76085 - DNA, 25 bp, S. pombe
aaaagtgtcttgaaccatgggtcta

SEQ ID NO: 76086 - DNA, 25 bp, S. pombe
aaaagagttgcacctcccacttgtt

SEQ ID NO: 76087 - DNA, 25 bp, S. pombe
aacacagatgttagcagtccccttg

SEQ ID NO: 76088 - DNA, 25 bp, S. pombe
aaaagctcctgtgcattatccttgg

SEQ ID NO: 76089 - DNA, 25 bp, S. pombe
aaaagtcctgcttttcctcttggtg

SEQ ID NO: 76090 - DNA, 25 bp, S. pombe
aaaattcctttgctttcagtggtga

SEQ ID NO: 76091 - DNA, 25 bp, S. pombe
aaaagctcggcttcgatgttcccgt

SEQ ID NO: 76092 - DNA, 25 bp, S. pombe
aaaaggcgaagcttctgcaatttgc

SEQ ID NO: 76093 - DNA, 25 bp, S. pombe
aaaagggtgatcatcgcgcattgtc

SEQ ID NO: 76094 - DNA, 25 bp, S. pombe
aaaagacgacactttcgctaccaca

SEQ ID NO: 76095 - DNA, 25 bp, S. pombe
aaaatccgcaatttcgcaacgacat

SEQ ID NO: 76096 - DNA, 25 bp, S. pombe
aacagagaccaatggccggcttctt

SEQ ID NO: 76097 - DNA, 25 bp, S. pombe
taaaagacgacgtcccttgacttat

SEQ ID NO: 76098 - DNA, 25 bp, S. pombe
aaaagggatctagccgtccattcct

SEQ ID NO: 76099 - DNA, 25 bp, S. pombe
aaaagcagcgttctactcctgcatt

SEQ ID NO: 76100 - DNA, 25 bp, S. pombe
aaaagtgcagttgtacgccatcata

SEQ ID NO: 76101 - DNA, 25 bp, S. pombe
aaaagtttgcatttcaagcacttga

SEQ ID NO: 76102 - DNA, 25 bp, S. pombe
aaaagaccctatgcacggttcgctc

SEQ ID NO: 76103 - DNA, 25 bp, S. pombe
aaaatatcccttaacggctgtcgca

SEQ ID NO: 76104 - DNA, 25 bp, S. pombe
aaaattccgtctaatgctacattcc

SEQ ID NO: 76105 - DNA, 25 bp, S. pombe
aaaatacgtccccttgcttgtatgg

SEQ ID NO: 76106 - DNA, 25 bp, S. pombe
aaaagattttcctatcgctctgctt

SEQ ID NO: 76107 - DNA, 25 bp, S. pombe
aaaatggataccctatgccctgcga

SEQ ID NO: 76108 - DNA, 25 bp, S. pombe
aaaaggagtcgccttcgccagtgat

SEQ ID NO: 76109 - DNA, 25 bp, S. pombe
aacaatacagtgagtcttcccttct

SEQ ID NO: 76110 - DNA, 25 bp, S. pombe
aaaattcggatctttgtcccctatg

SEQ ID NO: 76111 - DNA, 25 bp, S. pombe
aacagttaggtggttgcacccatct

SEQ ID NO: 76112 - DNA, 25 bp, S. pombe
aacagtaagccgcttggcgtctttc

SEQ ID NO: 76113 - DNA, 25 bp, S. pombe
aacgaaggaccgctttgtgctttca

SEQ ID NO: 76114 - DNA, 25 bp, S. pombe
aagcgtattcacgaggtccgtgttc

SEQ ID NO: 76115 - DNA, 25 bp, S. pombe
aagccgcaatgggaatgtccggtcc

SEQ ID NO: 76116 - DNA, 25 bp, S. pombe
aactcggcaaaccaccttggatggt

SEQ ID NO: 76117 - DNA, 25 bp, S. pombe
aacacgcccaaaccaagtcgatgta

SEQ ID NO: 76118 - DNA, 25 bp, S. pombe
aacacgcacccatcttggtggtatt

SEQ ID NO: 76119 - DNA, 25 bp, S. pombe
aacacatacttttgctttgctggag

SEQ ID NO: 76120 - DNA, 25 bp, S. pombe
aacaaatggtgctgacttgcggaat

SEQ ID NO: 76121 - DNA, 25 bp, S. pombe
aaaagagctcgatttgcacacaggg

SEQ ID NO: 76122 - DNA, 25 bp, S. pombe
aacaggttttcttcataaatccaat

SEQ ID NO: 76123 - DNA, 25 bp, S. pombe
aagaggtttcctcaaaattgcctga

SEQ ID NO: 76124 - DNA, 25 bp, S. pombe
aacacctatttacgttgatccctcg

SEQ ID NO: 76125 - DNA, 25 bp, S. pombe
aaccacggtgttcaaagctactcta

SEQ ID NO: 76126 - DNA, 25 bp, S. pombe
cacccggtgtttcaatgccaaacgg

SEQ ID NO: 76127 - DNA, 25 bp, S. pombe
aacaaggttatgctcctccacaagg

SEQ ID NO: 76128 - DNA, 25 bp, S. pombe
aaaatgaattatcctgcctctccaa

SEQ ID NO: 76129 - DNA, 25 bp, S. pombe
aaaagactgcagcacttgctcgcta

SEQ ID NO: 76130 - DNA, 25 bp, S. pombe
aaaattcctgatgctggccatatcc

SEQ ID NO: 76131 - DNA, 25 bp, S. pombe
aaaagaccatggctgctttggctct

SEQ ID NO: 76132 - DNA, 25 bp, S. pombe
aaaatgcaccctaatgctcttcatc

SEQ ID NO: 76133 - DNA, 25 bp, S. pombe
aaaatcggcacttgatggctgatca

SEQ ID NO: 76134 - DNA, 25 bp, S. pombe
aaaatgctcttacatctgcttcctt

SEQ ID NO: 76135 - DNA, 25 bp, S. pombe
aaaatagcatctcttgctccacgaa

SEQ ID NO: 76136 - DNA, 25 bp, S. pombe
aaaagtcacacagtttgcagcaaaa

SEQ ID NO: 76137 - DNA, 25 bp, S. pombe
aacaaggacgaacttccagaagaat

SEQ ID NO: 76138 - DNA, 25 bp, S. pombe
aaaattgccgatggacatgccgccg

SEQ ID NO: 76139 - DNA, 25 bp, S. pombe
aaaagtctcagctgtcttggcgatg

SEQ ID NO: 76140 - DNA, 25 bp, S. pombe
aaaagtctatccctctgttgtatga

SEQ ID NO: 76141 - DNA, 25 bp, S. pombe
aaaatgggctcttgacgtttgctgc

SEQ ID NO: 76142 - DNA, 25 bp, S. pombe
aaaaggagccttcgcttcatgtgat

SEQ ID NO: 76143 - DNA, 25 bp, S. pombe
aacaagttcctgttctagcagaaga

SEQ ID NO: 76144 - DNA, 25 bp, S. pombe
aaaagttgactgttgatccgacaaa

SEQ ID NO: 76145 - DNA, 25 bp, S. pombe
aaaagtcatcggctcattcgcacag

SEQ ID NO: 76146 - DNA, 25 bp, S. pombe
aacagaaccaggagacaggccctta

SEQ ID NO: 76147 - DNA, 25 bp, S. pombe
aacaaccttttggtggtgctcgtgc

SEQ ID NO: 76148 - DNA, 25 bp, S. pombe
aaaatgccacttcttcgtcaaactt

SEQ ID NO: 76149 - DNA, 25 bp, S. pombe
aaaatagccttgttcctagtacaca

SEQ ID NO: 76150 - DNA, 25 bp, S. pombe
aaaatgggttttaccatgtatgcaa

SEQ ID NO: 76151 - DNA, 25 bp, S. pombe
aaaaggctgcttatgctgaatttaa

SEQ ID NO: 76152 - DNA, 25 bp, S. pombe
aaaaggtgcatagcgcgagcttctc

SEQ ID NO: 76153 - DNA, 25 bp, S. pombe
aaaatcagcaaccactgaccggtcc

SEQ ID NO: 76154 - DNA, 25 bp, S. pombe
aaaatcagctactgctaccactgct

SEQ ID NO: 76155 - DNA, 25 bp, S. pombe
aaaatagcagcctcggcgtctggaa

SEQ ID NO: 76156 - DNA, 25 bp, S. pombe
aaaatggactctacggactctaaag

SEQ ID NO: 76157 - DNA, 25 bp, S. pombe
aacaagtgctgtttccttggttcca

SEQ ID NO: 76158 - DNA, 25 bp, S. pombe
aaaaggtgttttcggcatctgcatc

SEQ ID NO: 76159 - DNA, 25 bp, S. pombe
aacaaagattccatttcctcagctg

SEQ ID NO: 76160 - DNA, 25 bp, S. pombe
aaaatttcatccactgatcctcgta

SEQ ID NO: 76161 - DNA, 25 bp, S. pombe
aaaatatgctgctcttcttcctgaa

SEQ ID NO: 76162 - DNA, 25 bp, S. pombe
aaaatcctttttgctcctgacaatc

SEQ ID NO: 76163 - DNA, 25 bp, S. pombe
aaaatggctttcaccctgctaaata

SEQ ID NO: 76164 - DNA, 25 bp, S. pombe
aaaaggctttgttccgtgctctgaa

SEQ ID NO: 76165 - DNA, 25 bp, S. pombe
aaaagtgcggtttacgtgacagaca

SEQ ID NO: 76166 - DNA, 25 bp, S. pombe
aaaatcttctcggtgcttattccaa

SEQ ID NO: 76167 - DNA, 25 bp, S. pombe
aacaattgttggctcttaccccaga

SEQ ID NO: 76168 - DNA, 25 bp, S. pombe
aacaattcctggtttaccgactgcg

SEQ ID NO: 76169 - DNA, 25 bp, S. pombe
aacatgttttggtgcatagcccagc

SEQ ID NO: 76170 - DNA, 25 bp, S. pombe
aacttctgttcaaacagctgcccag

SEQ ID NO: 76171 - DNA, 25 bp, S. pombe
aacagccctgtcacattacaagatc

SEQ ID NO: 76172 - DNA, 25 bp, S. pombe
aacagaacacgctgagttgagctga

SEQ ID NO: 76173 - DNA, 25 bp, S. pombe
aaccggacgcagttcagcgaggact

SEQ ID NO: 76174 - DNA, 25 bp, S. pombe
aacaccgagcgagtacctaggagat

SEQ ID NO: 76175 - DNA, 25 bp, S. pombe
aacagctgggttacttccaaaaatg

SEQ ID NO: 76176 - DNA, 25 bp, S. pombe
aacagcgcggtcgttactatgaact

SEQ ID NO: 76177 - DNA, 25 bp, S. pombe
aacagaccgttattcagatgattac

SEQ ID NO: 76178 - DNA, 25 bp, S. pombe
aaaattcgtctccacaatgttccat

SEQ ID NO: 76179 - DNA, 25 bp, S. pombe
aacaatctcatttccaacttcttat

SEQ ID NO: 76180 - DNA, 25 bp, S. pombe
aacaagttcctttggatgatccgaa

SEQ ID NO: 76181 - DNA, 25 bp, S. pombe
aaaatatttcgtcaagctaagcaag

SEQ ID NO: 76182 - DNA, 25 bp, S. pombe
aaaatcctttacttcatgctaccaa

SEQ ID NO: 76183 - DNA, 25 bp, S. pombe
aaaatgccattgttgcggctggaaa

SEQ ID NO: 76184 - DNA, 25 bp, S. pombe
aaaatctatcacttggtctcgtaaa

SEQ ID NO: 76185 - DNA, 25 bp, S. pombe
aacaagcttcctatgtatcgtgaaa

SEQ ID NO: 76186 - DNA, 25 bp, S. pombe
aaaatgcattgggtattcctctgaa

SEQ ID NO: 76187 - DNA, 25 bp, S. pombe
aaaattagcttttctcctcatgaag

SEQ ID NO: 76188 - DNA, 25 bp, S. pombe
aaaatgtcgcgtctctttggaagga

SEQ ID NO: 76189 - DNA, 25 bp, S. pombe
aaaatcatcgcgacagcactgttgg

SEQ ID NO: 76190 - DNA, 25 bp, S. pombe
aaaatgctcgtttttgttgcgggag

SEQ ID NO: 76191 - DNA, 25 bp, S. pombe
aaaattatatcctggcagccgtctt

SEQ ID NO: 76192 - DNA, 25 bp, S. pombe
aaaatgcttactactcctgctgttt

SEQ ID NO: 76193 - DNA, 25 bp, S. pombe
aaaatgtcttgcgatcactcagcga

SEQ ID NO: 76194 - DNA, 25 bp, S. pombe
aacaattgcgacgtatgcctgctga

SEQ ID NO: 76195 - DNA, 25 bp, S. pombe
aaaattgctgaccttgggaatgctt

SEQ ID NO: 76196 - DNA, 25 bp, S. pombe
aaaattcgagtcttgggatggtcta

SEQ ID NO: 76197 - DNA, 25 bp, S. pombe
aaaatcgcggttactccttgacagg

SEQ ID NO: 76198 - DNA, 25 bp, S. pombe
aaaatagctgaccttcgccttgaag

SEQ ID NO: 76199 - DNA, 25 bp, S. pombe
aaaattctgcacaattcgcctacag

SEQ ID NO: 76200 - DNA, 25 bp, S. pombe
aaaatctctgagaatcccacgaccc

SEQ ID NO: 76201 - DNA, 25 bp, S. pombe
aagaagctttatctcttccttggcc

SEQ ID NO: 76202 - DNA, 25 bp, S. pombe
aacagttcgggcattgttgctggtc

SEQ ID NO: 76203 - DNA, 25 bp, S. pombe
aacagcgtgctgctcatgccgaaaa

SEQ ID NO: 76204 - DNA, 25 bp, S. pombe
aacagcgtctggtatggtaaaactt

SEQ ID NO: 76205 - DNA, 25 bp, S. pombe
aacaggttctgctgagttcaacgtt

SEQ ID NO: 76206 - DNA, 25 bp, S. pombe
aacagcttgggatacgtctacgcct

SEQ ID NO: 76207 - DNA, 25 bp, S. pombe
aacaatttgttcttaccgatcctga

SEQ ID NO: 76208 - DNA, 25 bp, S. pombe
aaaatcttttactctagctctcgca

SEQ ID NO: 76209 - DNA, 25 bp, S. pombe
aaaatttccgatacattccctgaca

SEQ ID NO: 76210 - DNA, 25 bp, S. pombe
aaaattctacgagtttcccatcaag

SEQ ID NO: 76211 - DNA, 25 bp, S. pombe
aacacccgagaaaagcgcttcagat

SEQ ID NO: 76212 - DNA, 25 bp, S. pombe
aacacagccttattcaagtttcaat

SEQ ID NO: 76213 - DNA, 25 bp, S. pombe
aactgacacttgaggaattctgcga

SEQ ID NO: 76214 - DNA, 25 bp, S. pombe
aactgctcgtttggcaaaaccagat

SEQ ID NO: 76215 - DNA, 25 bp, S. pombe
aacagcaacttgtcctgatcctagt

SEQ ID NO: 76216 - DNA, 25 bp, S. pombe
aacatggagttggacgatccggctc

SEQ ID NO: 76217 - DNA, 25 bp, S. pombe
aagcgaagcttctgaggtcgtgttc

SEQ ID NO: 76218 - DNA, 25 bp, S. pombe
caatcaagtttcagaggtccttccc

SEQ ID NO: 76219 - DNA, 25 bp, S. pombe
aacactctttccaaaactgcatcta

SEQ ID NO: 76220 - DNA, 25 bp, S. pombe
aaaattgattcatattccaagacat

SEQ ID NO: 76221 - DNA, 25 bp, S. pombe
aacaattgagattccggccaacgat

SEQ ID NO: 76222 - DNA, 25 bp, S. pombe
aaaattgagcctacgccattacctt

SEQ ID NO: 76223 - DNA, 25 bp, S. pombe
aaaattggcctgttttgctccattg

SEQ ID NO: 76224 - DNA, 25 bp, S. pombe
aaaattgcttctttgccgtgtgttt

SEQ ID NO: 76225 - DNA, 25 bp, S. pombe
aaaatgctttcatgtgccggtgccg

SEQ ID NO: 76226 - DNA, 25 bp, S. pombe
aaaatgcggctactgtaatgcgtgc

SEQ ID NO: 76227 - DNA, 25 bp, S. pombe
aaaatgctcaattctctacctggac

SEQ ID NO: 76228 - DNA, 25 bp, S. pombe
aacaatctcgtttgcctgaactacg

SEQ ID NO: 76229 - DNA, 25 bp, S. pombe
aaaattgatgttcctcgtactccag

SEQ ID NO: 76230 - DNA, 25 bp, S. pombe
aaaatcgtctattcttaactcgtga

SEQ ID NO: 76231 - DNA, 25 bp, S. pombe
aacagactggcttgccggtgagtca

SEQ ID NO: 76232 - DNA, 25 bp, S. pombe
aacagcgccgtacactcagagtaat

SEQ ID NO: 76233 - DNA, 25 bp, S. pombe
aatcgtccctacttctttaatactg

SEQ ID NO: 76234 - DNA, 25 bp, S. pombe
aacttccttcaatctttggagtcat

SEQ ID NO: 76235 - DNA, 25 bp, S. pombe
aaaatcctgtcatagttgcggcggt

SEQ ID NO: 76236 - DNA, 25 bp, S. pombe
aaaatgccttcaatctttccggtgt

SEQ ID NO: 76237 - DNA, 25 bp, S. pombe
aacaagttggtgtctgtgcctggta

SEQ ID NO: 76238 - DNA, 25 bp, S. pombe
aacaattttctgcttttttcgatgg

SEQ ID NO: 76239 - DNA, 25 bp, S. pombe
aacaacttacccatttgcattgcca

SEQ ID NO: 76240 - DNA, 25 bp, S. pombe
aaaatcatccccaagtttctgtaca

SEQ ID NO: 76241 - DNA, 25 bp, S. pombe
aaaatccagccgacaatgacttcct

SEQ ID NO: 76242 - DNA, 25 bp, S. pombe
aacaaacagctcgtaagtctaccgg

SEQ ID NO: 76243 - DNA, 25 bp, S. pombe
aacaatgccgtttttgtgcgaaata

SEQ ID NO: 76244 - DNA, 25 bp, S. pombe
aacaaggatgtttcggatgctcaaa

SEQ ID NO: 76245 - DNA, 25 bp, S. pombe
aacactcatatgcacgactctacaa

SEQ ID NO: 76246 - DNA, 25 bp, S. pombe
aacaacttggttttgcttgccacga

SEQ ID NO: 76247 - DNA, 25 bp, S. pombe
aacaacgtttgatctttgctggcaa

SEQ ID NO: 76248 - DNA, 25 bp, S. pombe
aaaatcatgtttcccgatggactta

SEQ ID NO: 76249 - DNA, 25 bp, S. pombe
aaaattgcttataccgtggcgatta

SEQ ID NO: 76250 - DNA, 25 bp, S. pombe
aacagatgctcgttcgccccgatgt

SEQ ID NO: 76251 - DNA, 25 bp, S. pombe
aacaagtacatgtccgcagtgtgaa

SEQ ID NO: 76252 - DNA, 25 bp, S. pombe
aaaattgacatctctcgctctgata

SEQ ID NO: 76253 - DNA, 25 bp, S. pombe
aaaattgactgccttcgccattgga

SEQ ID NO: 76254 - DNA, 25 bp, S. pombe
aaaatttctgagcttcctgctggat

SEQ ID NO: 76255 - DNA, 25 bp, S. pombe
aaaattgccttgtacttcctcataa

SEQ ID NO: 76256 - DNA, 25 bp, S. pombe
aacaatccgagctttttcctatgtc

SEQ ID NO: 76257 - DNA, 25 bp, S. pombe
aacaatggcgtgttcgtcttgctat

SEQ ID NO: 76258 - DNA, 25 bp, S. pombe
aacacaggtgattctgctggtcgtc

SEQ ID NO: 76259 - DNA, 25 bp, S. pombe
aacagcggaatgagcacgtcctgaa

SEQ ID NO: 76260 - DNA, 25 bp, S. pombe
aacaagcatccatcacattctaata

SEQ ID NO: 76261 - DNA, 25 bp, S. pombe
aacaatgcctatgcttctgcagaac

SEQ ID NO: 76262 - DNA, 25 bp, S. pombe
aaaatcattatcctctctggctgaa

SEQ ID NO: 76263 - DNA, 25 bp, S. pombe
aacaaatttccctatgcctacgtat

SEQ ID NO: 76264 - DNA, 25 bp, S. pombe
aaaattctcttgacgcttttgcgat

SEQ ID NO: 76265 - DNA, 25 bp, S. pombe
aaaatctgcgatttcggtttggctc

SEQ ID NO: 76266 - DNA, 25 bp, S. pombe
aaaattgctgttggcggttcctctg

SEQ ID NO: 76267 - DNA, 25 bp, S. pombe
aaaattggttgtcgctgctgtccgg

SEQ ID NO: 76268 - DNA, 25 bp, S. pombe
aaaattcagtttcctttgcacaaga

SEQ ID NO: 76269 - DNA, 25 bp, S. pombe
aacacttcttttcagttgcaccaag

SEQ ID NO: 76270 - DNA, 25 bp, S. pombe
aacaggcttatgagggtggtcagat

SEQ ID NO: 76271 - DNA, 25 bp, S. pombe
aacaaatcgagcttgcatccatcac

SEQ ID NO: 76272 - DNA, 25 bp, S. pombe
aacacaccaactattgtccactgga

SEQ ID NO: 76273 - DNA, 25 bp, S. pombe
aaaattttttcacctcaatcgctgg

SEQ ID NO: 76274 - DNA, 25 bp, S. pombe
aaaattccaagctttgttcctcctg

SEQ ID NO: 76275 - DNA, 25 bp, S. pombe
aacaacaccaatcttttacatctcc

SEQ ID NO: 76276 - DNA, 25 bp, S. pombe
aacaacaatcattgcctccttagca

SEQ ID NO: 76277 - DNA, 25 bp, S. pombe
aacagaccatttgctactatcgaga

SEQ ID NO: 76278 - DNA, 25 bp, S. pombe
aacaatgtacatctccaagccagga

SEQ ID NO: 76279 - DNA, 25 bp, S. pombe
aacaaattccttcccatttgggcag

SEQ ID NO: 76280 - DNA, 25 bp, S. pombe
aacaattgcttaacccatttggacg

SEQ ID NO: 76281 - DNA, 25 bp, S. pombe
aacggaaatgtctcttgcaaggtgt

SEQ ID NO: 76282 - DNA, 25 bp, S. pombe
aactggaaaggaagttcgcagcggt

SEQ ID NO: 76283 - DNA, 25 bp, S. pombe
aacagcttgcgacccatgttagcaa

SEQ ID NO: 76284 - DNA, 25 bp, S. pombe
aacagcctcttgtgctggatacaca

SEQ ID NO: 76285 - DNA, 25 bp, S. pombe
aatgatgaccattgcgaggcgtcgc

SEQ ID NO: 76286 - DNA, 25 bp, S. pombe
ctatctgaaggtgatggctcccgca

SEQ ID NO: 76287 - DNA, 25 bp, S. pombe
aaaattggctgaggctattcgcgaa

SEQ ID NO: 76288 - DNA, 25 bp, S. pombe
aaaattctcaatactctacgctaaa

SEQ ID NO: 76289 - DNA, 25 bp, S. pombe
aaaatatcgccaatcttactgccca

SEQ ID NO: 76290 - DNA, 25 bp, S. pombe
aaaatatccatcatcttcatcttcc

SEQ ID NO: 76291 - DNA, 25 bp, S. pombe
aaaatattctcattgcgtcgtcctc

SEQ ID NO: 76292 - DNA, 25 bp, S. pombe
aacacacttcatcatttcccagaaa

SEQ ID NO: 76293 - DNA, 25 bp, S. pombe
aacaggattctcttggaccaaacca

SEQ ID NO: 76294 - DNA, 25 bp, S. pombe
aacaacttttgactcgcgatcctaa

SEQ ID NO: 76295 - DNA, 25 bp, S. pombe
aacaacttttggacctctctgctga

SEQ ID NO: 76296 - DNA, 25 bp, S. pombe
aacaacttctggatcgtatgctgag

SEQ ID NO: 76297 - DNA, 25 bp, S. pombe
aactgagccccaaaagcctggaata

SEQ ID NO: 76298 - DNA, 25 bp, S. pombe
aacagtattcgtgctattccaaaga

SEQ ID NO: 76299 - DNA, 25 bp, S. pombe
aagccaagttcctcctgaagttgtg

SEQ ID NO: 76300 - DNA, 25 bp, S. pombe
aaaattcttcgttatcagcgcctaa

SEQ ID NO: 76301 - DNA, 25 bp, S. pombe
aacactttctcaagctcaaatccta

SEQ ID NO: 76302 - DNA, 25 bp, S. pombe
aacagctgtattgggtttgcatgcc

SEQ ID NO: 76303 - DNA, 25 bp, S. pombe
aacatgcctttccagtttcatcaat

SEQ ID NO: 76304 - DNA, 25 bp, S. pombe
aacatgcttactgcggtttcaagtg

SEQ ID NO: 76305 - DNA, 25 bp, S. pombe
aactctgtactcgaatgtttccggg

SEQ ID NO: 76306 - DNA, 25 bp, S. pombe
aacttggttaacatcttggccggca

SEQ ID NO: 76307 - DNA, 25 bp, S. pombe
aacatcacctcatattactttccta

SEQ ID NO: 76308 - DNA, 25 bp, S. pombe
aactcactagttgaccgtacacttg

SEQ ID NO: 76309 - DNA, 25 bp, S. pombe
aacaagactcatttatcgccaaggg

SEQ ID NO: 76310 - DNA, 25 bp, S. pombe
aacaacacgctactactacaactac

SEQ ID NO: 76311 - DNA, 25 bp, S. pombe
aacaaacctccatggtcagacgcat

SEQ ID NO: 76312 - DNA, 25 bp, S. pombe
aacaatcaagaaatcgctcgtgccg

SEQ ID NO: 76313 - DNA, 25 bp, S. pombe
aactaagagggcactatggaccgaa

SEQ ID NO: 76314 - DNA, 25 bp, S. pombe
aacaaatgaccctttactagcgccg

SEQ ID NO: 76315 - DNA, 25 bp, S. pombe
aacaattactcgtctatttcggcca

SEQ ID NO: 76316 - DNA, 25 bp, S. pombe
aaaattgcacaatcccataccggtt

SEQ ID NO: 76317 - DNA, 25 bp, S. pombe
aacattggtcaagcccatggtcttt

SEQ ID NO: 76318 - DNA, 25 bp, S. pombe
aacaaggtgtcatctccaagtctct

SEQ ID NO: 76319 - DNA, 25 bp, S. pombe
aacaagctggtctttctgcaagtca

SEQ ID NO: 76320 - DNA, 25 bp, S. pombe
aacaagctgcgttttcgtatgatta

SEQ ID NO: 76321 - DNA, 25 bp, S. pombe
gaaaatttggctgcccttaatcccg

SEQ ID NO: 76322 - DNA, 25 bp, S. pombe
aaaattgctggtgccgccattgatg

SEQ ID NO: 76323 - DNA, 25 bp, S. pombe
aacttgatacgtttaccgacttcat

SEQ ID NO: 76324 - DNA, 25 bp, S. pombe
aacactcttgggtattcacacctac

SEQ ID NO: 76325 - DNA, 25 bp, S. pombe
aacagttagcgcctttggacctccg

SEQ ID NO: 76326 - DNA, 25 bp, S. pombe
aacactacgagcttttgttgcctcc

SEQ ID NO: 76327 - DNA, 25 bp, S. pombe
aagctgtcacgggtttctagtttgg

SEQ ID NO: 76328 - DNA, 25 bp, S. pombe
aacttccgccccagatgatattata

SEQ ID NO: 76329 - DNA, 25 bp, S. pombe
aacatattcttctttcaccggatga

SEQ ID NO: 76330 - DNA, 25 bp, S. pombe
aacagaatgtcttcagctcttccac

SEQ ID NO: 76331 - DNA, 25 bp, S. pombe
aacagcactggacatgtttcctcat

SEQ ID NO: 76332 - DNA, 25 bp, S. pombe
aacagatcggcatggttatcgtgct

SEQ ID NO: 76333 - DNA, 25 bp, S. pombe
aacaatcatctcaaaggtcgcggaa

SEQ ID NO: 76334 - DNA, 25 bp, S. pombe
aacaaatcccaattgcttgctgaga

SEQ ID NO: 76335 - DNA, 25 bp, S. pombe
aactgttctttacaaggtggccgat

SEQ ID NO: 76336 - DNA, 25 bp, S. pombe
aacaggttcagctgtacggttgccg

SEQ ID NO: 76337 - DNA, 25 bp, S. pombe
aacagggcgtttttgtttgcgctgc

SEQ ID NO: 76338 - DNA, 25 bp, S. pombe
aacatcggctttttattaacctgca

SEQ ID NO: 76339 - DNA, 25 bp, S. pombe
aacacgagtcttatgcaacttccgc

SEQ ID NO: 76340 - DNA, 25 bp, S. pombe
ccaattgaacttatgcggtccacgc

SEQ ID NO: 76341 - DNA, 25 bp, S. pombe
aacaaggtcttactgtcgttgcctg

SEQ ID NO: 76342 - DNA, 25 bp, S. pombe
aacaagcctcttgctgtcgttggtg

SEQ ID NO: 76343 - DNA, 25 bp, S. pombe
aacaggcaccttgccattggtggtg

SEQ ID NO: 76344 - DNA, 25 bp, S. pombe
aacagccacgctcttattcaatggg

SEQ ID NO: 76345 - DNA, 25 bp, S. pombe
aacaccagcttctctgttcaattca

SEQ ID NO: 76346 - DNA, 25 bp, S. pombe
aacactctccggtttgcttactggg

SEQ ID NO: 76347 - DNA, 25 bp, S. pombe
aacactccttcgtatacttgacttt

SEQ ID NO: 76348 - DNA, 25 bp, S. pombe
aacaatcctttgtcagtcttcactt

SEQ ID NO: 76349 - DNA, 25 bp, S. pombe
aacaaccttggtcctgaatccttga

SEQ ID NO: 76350 - DNA, 25 bp, S. pombe
aacaacgtgcagctgatgagcgcaa

SEQ ID NO: 76351 - DNA, 25 bp, S. pombe
aacaacgtgcccaagaggagttaga

SEQ ID NO: 76352 - DNA, 25 bp, S. pombe
aacaagccgaccaagtttgtctatt

SEQ ID NO: 76353 - DNA, 25 bp, S. pombe
aacacgcctattctttggccttgtt

SEQ ID NO: 76354 - DNA, 25 bp, S. pombe
aacacttgttttgcttgtcgttctt

SEQ ID NO: 76355 - DNA, 25 bp, S. pombe
aacactctcgttaccaatgtccttt

SEQ ID NO: 76356 - DNA, 25 bp, S. pombe
aacagtccgctaatatcgacggtca

SEQ ID NO: 76357 - DNA, 25 bp, S. pombe
aacctcgcgtgcatgaagtcggtga

SEQ ID NO: 76358 - DNA, 25 bp, S. pombe
aacactctacgcctgtatctgggtg

SEQ ID NO: 76359 - DNA, 25 bp, S. pombe
aacagccttcgctcgatattggatg

SEQ ID NO: 76360 - DNA, 25 bp, S. pombe
aacaggaatcctcggatagcggagt

SEQ ID NO: 76361 - DNA, 25 bp, S. pombe
aacagagtctcaaagaatccgggaa

SEQ ID NO: 76362 - DNA, 25 bp, S. pombe
aacacgatcttgtcgataaccctac

SEQ ID NO: 76363 - DNA, 25 bp, S. pombe
aacaagcttcttctaatgcaccttc

SEQ ID NO: 76364 - DNA, 25 bp, S. pombe
aacatatgctctctttaattactaa

SEQ ID NO: 76365 - DNA, 25 bp, S. pombe
aacaatcctgtttcttcttctctaa

SEQ ID NO: 76366 - DNA, 25 bp, S. pombe
aacaacttgtctttgctttcttcca

SEQ ID NO: 76367 - DNA, 25 bp, S. pombe
aacaatgcagttccagcaggccgaa

SEQ ID NO: 76368 - DNA, 25 bp, S. pombe
aacatagcattgacactggcgccgg

SEQ ID NO: 76369 - DNA, 25 bp, S. pombe
aacaaatttactggctctcgagctg

SEQ ID NO: 76370 - DNA, 25 bp, S. pombe
aacttcactttgtacgtcttggtcg

SEQ ID NO: 76371 - DNA, 25 bp, S. pombe
aacaacgtttgatggctttagtgga

SEQ ID NO: 76372 - DNA, 25 bp, S. pombe
aacaatgggttgagacttctagtct

SEQ ID NO: 76373 - DNA, 25 bp, S. pombe
aacaatggcgtcgtgaagcttctaa

SEQ ID NO: 76374 - DNA, 25 bp, S. pombe
aacatcatatactcgaccctctaaa

SEQ ID NO: 76375 - DNA, 25 bp, S. pombe
aacacattccaactgagtgttttaa

SEQ ID NO: 76376 - DNA, 25 bp, S. pombe
aacattaattcatggccggtcaccg

SEQ ID NO: 76377 - DNA, 25 bp, S. pombe
aacaaagcttctatgcatcgtgata

SEQ ID NO: 76378 - DNA, 25 bp, S. pombe
aacaagcgcttatttgtcgtttcta

SEQ ID NO: 76379 - DNA, 25 bp, S. pombe
aacacaggccttttggagtctattg

SEQ ID NO: 76380 - DNA, 25 bp, S. pombe
aactagacgttctgctttgctgagt

SEQ ID NO: 76381 - DNA, 25 bp, S. pombe
aacaccttgttctctattgctagtc

SEQ ID NO: 76382 - DNA, 25 bp, S. pombe
aacaagatgaagctccctctgatga

SEQ ID NO: 76383 - DNA, 25 bp, S. pombe
aacaacatcttactctcctgtgtat

SEQ ID NO: 76384 - DNA, 25 bp, S. pombe
aacatcgatttgttcgtcgcttgaa

SEQ ID NO: 76385 - DNA, 25 bp, S. pombe
aactttttgcgtgtcggaaatgcca

SEQ ID NO: 76386 - DNA, 25 bp, S. pombe
aacttggtgggtgagccagctacac

SEQ ID NO: 76387 - DNA, 25 bp, S. pombe
aacatgtggctacgtataccgcaac

SEQ ID NO: 76388 - DNA, 25 bp, S. pombe
aacagatacaccgtaaccgcatggc

SEQ ID NO: 76389 - DNA, 25 bp, S. pombe
aacaaagggtcgtgatgctgatgaa

SEQ ID NO: 76390 - DNA, 25 bp, S. pombe
aacagctcaaactttcttcgcataa

SEQ ID NO: 76391 - DNA, 25 bp, S. pombe
aacactctggagttgcttccgaaag

SEQ ID NO: 76392 - DNA, 25 bp, S. pombe
aacaccgatttcgtcgatgttgcta

SEQ ID NO: 76393 - DNA, 25 bp, S. pombe
aatcccgttagtgctagttctcaaa

SEQ ID NO: 76394 - DNA, 25 bp, S. pombe
aacaacgtcgctgaagaggctcaaa

SEQ ID NO: 76395 - DNA, 25 bp, S. pombe
aacacacccgcggattggtctaaat

SEQ ID NO: 76396 - DNA, 25 bp, S. pombe
aacacacatctttcatatgttgact

SEQ ID NO: 76397 - DNA, 25 bp, S. pombe
aacaactctcttaatgtatggtgaa

SEQ ID NO: 76398 - DNA, 25 bp, S. pombe
aacagcatgcattttttcctggctc

SEQ ID NO: 76399 - DNA, 25 bp, S. pombe
aacagctgaagcgttttctttcgaa

SEQ ID NO: 76400 - DNA, 25 bp, S. pombe
aacagcttcctatatcacgtgtcag

SEQ ID NO: 76401 - DNA, 25 bp, S. pombe
gaactgcttcgatgttacgtacggg

SEQ ID NO: 76402 - DNA, 25 bp, S. pombe
aacagttttggcacgcttatcaatc

SEQ ID NO: 76403 - DNA, 25 bp, S. pombe
aacactgttgatggcactcacttag

SEQ ID NO: 76404 - DNA, 25 bp, S. pombe
aacagatagcgcatcttcgctcaga

SEQ ID NO: 76405 - DNA, 25 bp, S. pombe
aactatttcaactggtggtcgcttt

SEQ ID NO: 76406 - DNA, 25 bp, S. pombe
aacatcctcgtttcaagcgcagtgg

SEQ ID NO: 76407 - DNA, 25 bp, S. pombe
aacagtcaatttcgttctcctggtc

SEQ ID NO: 76408 - DNA, 25 bp, S. pombe
aacagtcttatgtgttcttgcccct

SEQ ID NO: 76409 - DNA, 25 bp, S. pombe
aacactgtattagcgtttcacctcg

SEQ ID NO: 76410 - DNA, 25 bp, S. pombe
aacatcgctgctgaaaagacccgtc

SEQ ID NO: 76411 - DNA, 25 bp, S. pombe
aacttggagctggagctggtcttcc

SEQ ID NO: 76412 - DNA, 25 bp, S. pombe
aacagttttatgaaatccgcagcac

SEQ ID NO: 76413 - DNA, 25 bp, S. pombe
aacattttgtgtcttatggccgaat

SEQ ID NO: 76414 - DNA, 25 bp, S. pombe
aacatgtattctccgtttcgtagca

SEQ ID NO: 76415 - DNA, 25 bp, S. pombe
aacagtttgctgctcgaggtgtaaa

SEQ ID NO: 76416 - DNA, 25 bp, S. pombe
aacagctattcatgcttacgcctga

SEQ ID NO: 76417 - DNA, 25 bp, S. pombe
aacactactatacgtacctcgagtt

SEQ ID NO: 76418 - DNA, 25 bp, S. pombe
aacaccctattccagatattcgagt

SEQ ID NO: 76419 - DNA, 25 bp, S. pombe
aacacctagatctcgtttccatgat

SEQ ID NO: 76420 - DNA, 25 bp, S. pombe
aacatccctgagtggttctcttatc

SEQ ID NO: 76421 - DNA, 25 bp, S. pombe
aacatccctatatgcctgtcattta

SEQ ID NO: 76422 - DNA, 25 bp, S. pombe
aacatacgcgtaaccatgctgcatg

SEQ ID NO: 76423 - DNA, 25 bp, S. pombe
aacattcacgtgatgcaagcggcga

SEQ ID NO: 76424 - DNA, 25 bp, S. pombe
aacacttcgcttcaaacttctctat

SEQ ID NO: 76425 - DNA, 25 bp, S. pombe
tacccttactaacactcttcaattt

SEQ ID NO: 76426 - DNA, 25 bp, S. pombe
aacatgctttacacaatcctaccgt

SEQ ID NO: 76427 - DNA, 25 bp, S. pombe
aactttggatgctcaacctactggt

SEQ ID NO: 76428 - DNA, 25 bp, S. pombe
aacatcttgggctatcgaccgactt

SEQ ID NO: 76429 - DNA, 25 bp, S. pombe
aacattcttgctggattgaacgcgc

SEQ ID NO: 76430 - DNA, 25 bp, S. pombe
aacttccctggattagaccctgacg

SEQ ID NO: 76431 - DNA, 25 bp, S. pombe
aacactacctgttgaaacctctgat

SEQ ID NO: 76432 - DNA, 25 bp, S. pombe
aacatcttcggatggccgtgccaag

SEQ ID NO: 76433 - DNA, 25 bp, S. pombe
aacagcttcccgttggagatggcaa

SEQ ID NO: 76434 - DNA, 25 bp, S. pombe
aacactgtcgatcgttatcaaggaa

SEQ ID NO: 76435 - DNA, 25 bp, S. pombe
aacactgttgagctgtatgccgaga

SEQ ID NO: 76436 - DNA, 25 bp, S. pombe
aacagtctccatattatgccgaggt

SEQ ID NO: 76437 - DNA, 25 bp, S. pombe
aacacatgctactgatgctctcgtt

SEQ ID NO: 76438 - DNA, 25 bp, S. pombe
aacatgggttcttctgctgaggccg

SEQ ID NO: 76439 - DNA, 25 bp, S. pombe
aactgtggtctcgatttacctcgtg

SEQ ID NO: 76440 - DNA, 25 bp, S. pombe
aacagtgcttggatggctgctactt

SEQ ID NO: 76441 - DNA, 25 bp, S. pombe
aacaggcggcagtcaactattcctc

SEQ ID NO: 76442 - DNA, 25 bp, S. pombe
aacatggcccgtaactttcaatctg

SEQ ID NO: 76443 - DNA, 25 bp, S. pombe
aacagtcccaaactttccagtgctg

SEQ ID NO: 76444 - DNA, 25 bp, S. pombe
aacactcggcagtatcttgattcga

SEQ ID NO: 76445 - DNA, 25 bp, S. pombe
aacatacgccatacacgttgtgagt

SEQ ID NO: 76446 - DNA, 25 bp, S. pombe
aactgacgccattgattcgttggat

SEQ ID NO: 76447 - DNA, 25 bp, S. pombe
aacagccttacttttacttttgcat

SEQ ID NO: 76448 - DNA, 25 bp, S. pombe
aactgctgttactcggacttttgat

SEQ ID NO: 76449 - DNA, 25 bp, S. pombe
aactctctcatatccgttcgatttg

SEQ ID NO: 76450 - DNA, 25 bp, S. pombe
aacattttgcgaccaggagtacctg

SEQ ID NO: 76451 - DNA, 25 bp, S. pombe
aactttgagacccagagtcccgatg

SEQ ID NO: 76452 - DNA, 25 bp, S. pombe
aacttgacgccattgaagatcccca

SEQ ID NO: 76453 - DNA, 25 bp, S. pombe
aacttggttatcagcttgcagacac

SEQ ID NO: 76454 - DNA, 25 bp, S. pombe
aacagtgaggtgtcttcttcaaatc

SEQ ID NO: 76455 - DNA, 25 bp, S. pombe
aacgatatgtggacagcacgacttt

SEQ ID NO: 76456 - DNA, 25 bp, S. pombe
aaccagcagggaggatcggatcttc

SEQ ID NO: 76457 - DNA, 25 bp, S. pombe
aactatgccggttacatggacacta

SEQ ID NO: 76458 - DNA, 25 bp, S. pombe
aacttagttatgtctccacaggtaa

SEQ ID NO: 76459 - DNA, 25 bp, S. pombe
aactttctgtgatctctcctttgga

SEQ ID NO: 76460 - DNA, 25 bp, S. pombe
aacttgttggaatcgactactgccc

SEQ ID NO: 76461 - DNA, 25 bp, S. pombe
aactttgcagttcccgttgaggttg

SEQ ID NO: 76462 - DNA, 25 bp, S. pombe
aacatatgccaattgctcagatgag

SEQ ID NO: 76463 - DNA, 25 bp, S. pombe
aacagaccagaaatatgctcagcaa

SEQ ID NO: 76464 - DNA, 25 bp, S. pombe
aacacgccgcagtaattcaccattt

SEQ ID NO: 76465 - DNA, 25 bp, S. pombe
aacttcgtcgaattactgagcatat

SEQ ID NO: 76466 - DNA, 25 bp, S. pombe
aacttgtccacaatgatccacgttg

SEQ ID NO: 76467 - DNA, 25 bp, S. pombe
aactttcacttgactacaccaatgg

SEQ ID NO: 76468 - DNA, 25 bp, S. pombe
aactccgcatgcatctttacagatt

SEQ ID NO: 76469 - DNA, 25 bp, S. pombe
aacagctatcattttctcgtcttca

SEQ ID NO: 76470 - DNA, 25 bp, S. pombe
aacagcatagctttagtgtgtatta

SEQ ID NO: 76471 - DNA, 25 bp, S. pombe
aacagtctgccaatcctttgacaaa

SEQ ID NO: 76472 - DNA, 25 bp, S. pombe
aacagacttagcatttcgtggagaa

SEQ ID NO: 76473 - DNA, 25 bp, S. pombe
aactctagctggtggtgcttggact

SEQ ID NO: 76474 - DNA, 25 bp, S. pombe
aacagcttagtgtctggagccgcta

SEQ ID NO: 76475 - DNA, 25 bp, S. pombe
aacatcttgagtttgtgagctctcg

SEQ ID NO: 76476 - DNA, 25 bp, S. pombe
aactatatttattgggcccctgtat

SEQ ID NO: 76477 - DNA, 25 bp, S. pombe
aacattcggcagtgctacagccatt

SEQ ID NO: 76478 - DNA, 25 bp, S. pombe
aacccaatgcttgctggtaacgttg

SEQ ID NO: 76479 - DNA, 25 bp, S. pombe
aacatgccagtcttgatcctgtttt

SEQ ID NO: 76480 - DNA, 25 bp, S. pombe
aacatcaaggaatcgctgcttcgct

SEQ ID NO: 76481 - DNA, 25 bp, S. pombe
aacgagtttcccctagtgtctatgc

SEQ ID NO: 76482 - DNA, 25 bp, S. pombe
aacatgatgtcttccactcgagcta

SEQ ID NO: 76483 - DNA, 25 bp, S. pombe
aacatgattctgactctttggctga

SEQ ID NO: 76484 - DNA, 25 bp, S. pombe
aacatgtattctactttgactcaaa

SEQ ID NO: 76485 - DNA, 25 bp, S. pombe
aacatgctcacgatgtttatcccac

SEQ ID NO: 76486 - DNA, 25 bp, S. pombe
aacattcagattggcattttcggat

SEQ ID NO: 76487 - DNA, 25 bp, S. pombe
aacatgaacgtgctcttcttggtgg

SEQ ID NO: 76488 - DNA, 25 bp, S. pombe
aacaccttcgttactcttgattgta

SEQ ID NO: 76489 - DNA, 25 bp, S. pombe
aactactaaattctggtctcgatga

SEQ ID NO: 76490 - DNA, 25 bp, S. pombe
aacttgcaaagctggttgtccgtga

SEQ ID NO: 76491 - DNA, 25 bp, S. pombe
aacttgccaatctctgtgaacgggt

SEQ ID NO: 76492 - DNA, 25 bp, S. pombe
aacattggcaaacgcctcttcagcc

SEQ ID NO: 76493 - DNA, 25 bp, S. pombe
aacagccttgaagttcagcttgcta

SEQ ID NO: 76494 - DNA, 25 bp, S. pombe
gattagaaggtgcagggagagcgat

SEQ ID NO: 76495 - DNA, 25 bp, S. pombe
aactcatccgtagtcgaatcagcgc

SEQ ID NO: 76496 - DNA, 25 bp, S. pombe
aacttatcgctgacggacgatccat

SEQ ID NO: 76497 - DNA, 25 bp, S. pombe
aacataatcccgctcttgatacatc

SEQ ID NO: 76498 - DNA, 25 bp, S. pombe
aacatttaccagcacattgtccatt

SEQ ID NO: 76499 - DNA, 25 bp, S. pombe
aacatgttgacaagggccagcccat

SEQ ID NO: 76500 - DNA, 25 bp, S. pombe
aacatgtctcttggtggcggcaaca

SEQ ID NO: 76501 - DNA, 25 bp, S. pombe
aacttcattatgctgggccggaggt

SEQ ID NO: 76502 - DNA, 25 bp, S. pombe
aacagtacagatccttcagcggcaa

SEQ ID NO: 76503 - DNA, 25 bp, S. pombe
aacagaactacaaccatcgcttaca

SEQ ID NO: 76504 - DNA, 25 bp, S. pombe
aacagctctttctgctttatttcct

SEQ ID NO: 76505 - DNA, 25 bp, S. pombe
aacagtgcctttgcagttgttaaca

SEQ ID NO: 76506 - DNA, 25 bp, S. pombe
aacatggtttccttgagcttgctca

SEQ ID NO: 76507 - DNA, 25 bp, S. pombe
aacagtatgccttctcttccagtat

SEQ ID NO: 76508 - DNA, 25 bp, S. pombe
aacatttgccattacttccgtggac

SEQ ID NO: 76509 - DNA, 25 bp, S. pombe
aactttgccttcgaatctccggaag

SEQ ID NO: 76510 - DNA, 25 bp, S. pombe
aacttcacgacatgttcagctgcta

SEQ ID NO: 76511 - DNA, 25 bp, S. pombe
aacttctcgccattgctagcaagta

SEQ ID NO: 76512 - DNA, 25 bp, S. pombe
aacttcttccggcagacttaacgat

SEQ ID NO: 76513 - DNA, 25 bp, S. pombe
aactttatcacgctatgcctcataa

SEQ ID NO: 76514 - DNA, 25 bp, S. pombe
aacttatccaagctattcacactcc

SEQ ID NO: 76515 - DNA, 25 bp, S. pombe
aacatatggtaaacccgtccaccag

SEQ ID NO: 76516 - DNA, 25 bp, S. pombe
aactcggtgcaaatcccaaacgtgg

SEQ ID NO: 76517 - DNA, 25 bp, S. pombe
aagaaggacctgcaactaacgaaga

SEQ ID NO: 76518 - DNA, 25 bp, S. pombe
aactaaaatcgtctattggtgcaat

SEQ ID NO: 76519 - DNA, 25 bp, S. pombe
aacagtaaatcttctcctgtcgccg

SEQ ID NO: 76520 - DNA, 25 bp, S. pombe
aacagtattgcctctatctttgcct

SEQ ID NO: 76521 - DNA, 25 bp, S. pombe
aacattcttccatctgatttttcaa

SEQ ID NO: 76522 - DNA, 25 bp, S. pombe
aacattccttctttttgtcttcaca

SEQ ID NO: 76523 - DNA, 25 bp, S. pombe
aacttgcgtttgaaggttcctcctg

SEQ ID NO: 76524 - DNA, 25 bp, S. pombe
aactttggttatcttcgcctctacg

SEQ ID NO: 76525 - DNA, 25 bp, S. pombe
aactcttcggaatgtgctttttatg

SEQ ID NO: 76526 - DNA, 25 bp, S. pombe
aactacttgttgcttcttttggtga

SEQ ID NO: 76527 - DNA, 25 bp, S. pombe
aacggctttacctcctgtatatagt

SEQ ID NO: 76528 - DNA, 25 bp, S. pombe
aactacgatttcaacagccagagct

SEQ ID NO: 76529 - DNA, 25 bp, S. pombe
aactatcgaccacagctggaatctt

SEQ ID NO: 76530 - DNA, 25 bp, S. pombe
aactttagtcacatttcctgctctt

SEQ ID NO: 76531 - DNA, 25 bp, S. pombe
aactatcattttttctcgtcctggt

SEQ ID NO: 76532 - DNA, 25 bp, S. pombe
aacttcaatgttccctgtagcgcta

SEQ ID NO: 76533 - DNA, 25 bp, S. pombe
aacattatgtttacgcgtcgctgta

SEQ ID NO: 76534 - DNA, 25 bp, S. pombe
aacatcaccacagttttctctcatg

SEQ ID NO: 76535 - DNA, 25 bp, S. pombe
aactcacttagttcttgtctacgga

SEQ ID NO: 76536 - DNA, 25 bp, S. pombe
aacttttcaagcaggttctccgtat

SEQ ID NO: 76537 - DNA, 25 bp, S. pombe
aacttctccaacaacgattactcgt

SEQ ID NO: 76538 - DNA, 25 bp, S. pombe
aacattcctcaagatcgcattcagt

SEQ ID NO: 76539 - DNA, 25 bp, S. pombe
aacattgcttacatctgccttggac

SEQ ID NO: 76540 - DNA, 25 bp, S. pombe
aactcagcatgttgccgctcaaata

SEQ ID NO: 76541 - DNA, 25 bp, S. pombe
aacatcctttgtttgcaccactttc

SEQ ID NO: 76542 - DNA, 25 bp, S. pombe
aactccttgttatacatccgtacac

SEQ ID NO: 76543 - DNA, 25 bp, S. pombe
aaccctttaaagcatgacgatcgtg

SEQ ID NO: 76544 - DNA, 25 bp, S. pombe
aagccccttaagacaaactgccagt

SEQ ID NO: 76545 - DNA, 25 bp, S. pombe
aactaccacatatgttggacccagt

SEQ ID NO: 76546 - DNA, 25 bp, S. pombe
aagctgaacacaacgttgggcctcc

SEQ ID NO: 76547 - DNA, 25 bp, S. pombe
aactttgtttcttacggtgctcaag

SEQ ID NO: 76548 - DNA, 25 bp, S. pombe
aacttcgtcccaagaagaagctcaa

SEQ ID NO: 76549 - DNA, 25 bp, S. pombe
gatacggagctatctcttttccttc

SEQ ID NO: 76550 - DNA, 25 bp, S. pombe
aacaggatccagtttagtcccttgc

SEQ ID NO: 76551 - DNA, 25 bp, S. pombe
aacaggcggcatataactctcttat

SEQ ID NO: 76552 - DNA, 25 bp, S. pombe
aacatcgggatcagtcggattcacc

SEQ ID NO: 76553 - DNA, 25 bp, S. pombe
aacaggccaatcttatctcacttgt

SEQ ID NO: 76554 - DNA, 25 bp, S. pombe
aacatggccatttgcattctcggtg

SEQ ID NO: 76555 - DNA, 25 bp, S. pombe
aacatggcctgctcatttagtgatg

SEQ ID NO: 76556 - DNA, 25 bp, S. pombe
aacatgagcctgttcccaagctatt

SEQ ID NO: 76557 - DNA, 25 bp, S. pombe
aactcggcacctgatgcaagtcatt

SEQ ID NO: 76558 - DNA, 25 bp, S. pombe
aacttcatgcattcgtaccgttgat

SEQ ID NO: 76559 - DNA, 25 bp, S. pombe
aactcaacccgcaagccatgatgga

SEQ ID NO: 76560 - DNA, 25 bp, S. pombe
aactaaaccggcaactatgatcaga

SEQ ID NO: 76561 - DNA, 25 bp, S. pombe
aacttgctattcagttgcagccggc

SEQ ID NO: 76562 - DNA, 25 bp, S. pombe
aacatggtagttttgtccgcaagcc

SEQ ID NO: 76563 - DNA, 25 bp, S. pombe
aatcggtatttgtgatcgtccaccc

SEQ ID NO: 76564 - DNA, 25 bp, S. pombe
aactgtgaacttttggctaatgccc

SEQ ID NO: 76565 - DNA, 25 bp, S. pombe
aacgtggacagtacattcccggtct

SEQ ID NO: 76566 - DNA, 25 bp, S. pombe
aactgtcgggcctgatctaatggat

SEQ ID NO: 76567 - DNA, 25 bp, S. pombe
aacttccctggcttatcatcaagaa

SEQ ID NO: 76568 - DNA, 25 bp, S. pombe
aactttgcgcatgttgtccaaggga

SEQ ID NO: 76569 - DNA, 25 bp, S. pombe
aacagtcctgggtattctatcactt

SEQ ID NO: 76570 - DNA, 25 bp, S. pombe
aacgtcccggtttgcttagcatggc

SEQ ID NO: 76571 - DNA, 25 bp, S. pombe
aacagggacgctttgtggacgagta

SEQ ID NO: 76572 - DNA, 25 bp, S. pombe
aacaggcctctcattacaagcagct

SEQ ID NO: 76573 - DNA, 25 bp, S. pombe
aacgtggacttatgcctggtcttac

SEQ ID NO: 76574 - DNA, 25 bp, S. pombe
aactgctggcgctattgagtctgct

SEQ ID NO: 76575 - DNA, 25 bp, S. pombe
aacatcagcagccaacttactggta

SEQ ID NO: 76576 - DNA, 25 bp, S. pombe
aacatcgatactactcagttcccat

SEQ ID NO: 76577 - DNA, 25 bp, S. pombe
aacatggttgccttttactcctttg

SEQ ID NO: 76578 - DNA, 25 bp, S. pombe
aactatcttctttttcactttccag

SEQ ID NO: 76579 - DNA, 25 bp, S. pombe
aactattatcctaactgtcttcccg

SEQ ID NO: 76580 - DNA, 25 bp, S. pombe
aacatttggtgtgatcttttccatc

SEQ ID NO: 76581 - DNA, 25 bp, S. pombe
aacattgatgtttccctttaccata

SEQ ID NO: 76582 - DNA, 25 bp, S. pombe
aaccatatttcctcggagatccgtg

SEQ ID NO: 76583 - DNA, 25 bp, S. pombe
aactcctgttcctgcagaaatggct

SEQ ID NO: 76584 - DNA, 25 bp, S. pombe
aactctagcttcaatccaattctgg

SEQ ID NO: 76585 - DNA, 25 bp, S. pombe
aacataatgcttgcatccgttccgt

SEQ ID NO: 76586 - DNA, 25 bp, S. pombe
aacatacttctgtcaagcgttctcg

SEQ ID NO: 76587 - DNA, 25 bp, S. pombe
aactcttggttaatgccatccgtgt

SEQ ID NO: 76588 - DNA, 25 bp, S. pombe
aacttatgcgggatcgtgccgcgta

SEQ ID NO: 76589 - DNA, 25 bp, S. pombe
aacattcccagtcttgtcgatggtg

SEQ ID NO: 76590 - DNA, 25 bp, S. pombe
aacatgttgccggttttcttaagat

SEQ ID NO: 76591 - DNA, 25 bp, S. pombe
aacttgcctgagctaatttccgaag

SEQ ID NO: 76592 - DNA, 25 bp, S. pombe
aacttgcaaggcatgttgttcgaaa

SEQ ID NO: 76593 - DNA, 25 bp, S. pombe
aacatatgtgtccttgtgcctacgg

SEQ ID NO: 76594 - DNA, 25 bp, S. pombe
aactcaatgctctgccacttcaaaa

SEQ ID NO: 76595 - DNA, 25 bp, S. pombe
aactatgaggcatctccttcgatta

SEQ ID NO: 76596 - DNA, 25 bp, S. pombe
aactcatcgaatttagcttctgctt

SEQ ID NO: 76597 - DNA, 25 bp, S. pombe
aactctggaatcttggtaacttcta

SEQ ID NO: 76598 - DNA, 25 bp, S. pombe
aactctgaggcctgtgaaatgtgtc

SEQ ID NO: 76599 - DNA, 25 bp, S. pombe
aacgtagtgcttgggaggatttcct

SEQ ID NO: 76600 - DNA, 25 bp, S. pombe
aacatggcggtggttcatcgaaaaa

SEQ ID NO: 76601 - DNA, 25 bp, S. pombe
aacatggcagcttcaatattcggaa

SEQ ID NO: 76602 - DNA, 25 bp, S. pombe
aacatcagcgtctattttgaagcaa

SEQ ID NO: 76603 - DNA, 25 bp, S. pombe
aactaagggtggcttcgacgagaat

SEQ ID NO: 76604 - DNA, 25 bp, S. pombe
aactatgagagggtttccgacaaga

SEQ ID NO: 76605 - DNA, 25 bp, S. pombe
aactaacgggtctaatgcttcaaat

SEQ ID NO: 76606 - DNA, 25 bp, S. pombe
aactacttctgtaaacttatcgcga

SEQ ID NO: 76607 - DNA, 25 bp, S. pombe
aacatgtccgctctactactgaaag

SEQ ID NO: 76608 - DNA, 25 bp, S. pombe
aacttcgagtgagccctgatgctga

SEQ ID NO: 76609 - DNA, 25 bp, S. pombe
aacattgtattcgacccatgccaaa

SEQ ID NO: 76610 - DNA, 25 bp, S. pombe
aactgttatctctgacgacggactt

SEQ ID NO: 76611 - DNA, 25 bp, S. pombe
aagcataaaattcctgagccgcagc

SEQ ID NO: 76612 - DNA, 25 bp, S. pombe
aacttaactaccttttgcaccaatg

SEQ ID NO: 76613 - DNA, 25 bp, S. pombe
aacatcgtttccttcattggctgaa

SEQ ID NO: 76614 - DNA, 25 bp, S. pombe
aacattggcggcgatgaacactgaa

SEQ ID NO: 76615 - DNA, 25 bp, S. pombe
aacattggcagtgggaacgtattca

SEQ ID NO: 76616 - DNA, 25 bp, S. pombe
aactcaagcgactgactggtattca

SEQ ID NO: 76617 - DNA, 25 bp, S. pombe
aactccatgttagacgagctttcta

SEQ ID NO: 76618 - DNA, 25 bp, S. pombe
aactcgtgtttctggtgtttctata

SEQ ID NO: 76619 - DNA, 25 bp, S. pombe
aactttgcccagttatgaagccgca

SEQ ID NO: 76620 - DNA, 25 bp, S. pombe
aacttgagacacctcttacatctac

SEQ ID NO: 76621 - DNA, 25 bp, S. pombe
aacttcaaactgctgctcaatcttc

SEQ ID NO: 76622 - DNA, 25 bp, S. pombe
aacttcccttcgttgaacagtatat

SEQ ID NO: 76623 - DNA, 25 bp, S. pombe
aacttggctcatgctattgaattga

SEQ ID NO: 76624 - DNA, 25 bp, S. pombe
aacattgcaatctcttgggcagtga

SEQ ID NO: 76625 - DNA, 25 bp, S. pombe
aacttgttgaactggacgacttaga

SEQ ID NO: 76626 - DNA, 25 bp, S. pombe
aacttttatgtctcaacgtcttagc

SEQ ID NO: 76627 - DNA, 25 bp, S. pombe
aactttagttttgattgctcccatg

SEQ ID NO: 76628 - DNA, 25 bp, S. pombe
aacgtttttccctatcagaagcaag

SEQ ID NO: 76629 - DNA, 25 bp, S. pombe
aactgcctttggtttcatgagaagc

SEQ ID NO: 76630 - DNA, 25 bp, S. pombe
aactccattgggttaggtgacctgc

SEQ ID NO: 76631 - DNA, 25 bp, S. pombe
aacttctccgtaatggtgctgatcc

SEQ ID NO: 76632 - DNA, 25 bp, S. pombe
aacttactctgcttctgatgtcgat

SEQ ID NO: 76633 - DNA, 25 bp, S. pombe
aactcaactgctgacgaggcggttc

SEQ ID NO: 76634 - DNA, 25 bp, S. pombe
aacgaggccggttgtaccaattgca

SEQ ID NO: 76635 - DNA, 25 bp, S. pombe
aacggaatgcaaccccagcgaaaat

SEQ ID NO: 76636 - DNA, 25 bp, S. pombe
aacggaacacagtctacgcttttag

SEQ ID NO: 76637 - DNA, 25 bp, S. pombe
aactctgcagatgaactacccttga

SEQ ID NO: 76638 - DNA, 25 bp, S. pombe
aactttccggacgtaatggcttctg

SEQ ID NO: 76639 - DNA, 25 bp, S. pombe
aacttactccagaacaacgccttgt

SEQ ID NO: 76640 - DNA, 25 bp, S. pombe
aacttacccgattttcagtctgcag

SEQ ID NO: 76641 - DNA, 25 bp, S. pombe
aacttactttcttttcttcatgcac

SEQ ID NO: 76642 - DNA, 25 bp, S. pombe
aactttatgctactttccttgatcc

SEQ ID NO: 76643 - DNA, 25 bp, S. pombe
aacattttgttagttgccgcccttg

SEQ ID NO: 76644 - DNA, 25 bp, S. pombe
aacttctgtcttgcatttgtgtccg

SEQ ID NO: 76645 - DNA, 25 bp, S. pombe
aactttttcccttgatatcatctcc

SEQ ID NO: 76646 - DNA, 25 bp, S. pombe
aacttttacctactatgacgcacac

SEQ ID NO: 76647 - DNA, 25 bp, S. pombe
aacattggtccatattcgcagtcga

SEQ ID NO: 76648 - DNA, 25 bp, S. pombe
aacttgatgaattggaatcccgcgt

SEQ ID NO: 76649 - DNA, 25 bp, S. pombe
aactctggctaacgaatcctgggat

SEQ ID NO: 76650 - DNA, 25 bp, S. pombe
aactcttggaaaagtcgctgtgcgt

SEQ ID NO: 76651 - DNA, 25 bp, S. pombe
aacttcgtgatttgttccgtcgctt

SEQ ID NO: 76652 - DNA, 25 bp, S. pombe
aacttcctatctctcatacttgctt

SEQ ID NO: 76653 - DNA, 25 bp, S. pombe
aactgaccaacatggaatggtgcta

SEQ ID NO: 76654 - DNA, 25 bp, S. pombe
aactgaccaacatggaatggtgcta

SEQ ID NO: 76655 - DNA, 25 bp, S. pombe
aactaccgatctttggagcttcttc

SEQ ID NO: 76656 - DNA, 25 bp, S. pombe
aagcatccctagtcttgaagctact

SEQ ID NO: 76657 - DNA, 25 bp, S. pombe
aactgtcgctggtttaacgatcggt

SEQ ID NO: 76658 - DNA, 25 bp, S. pombe
aacccgacgattgtttcattcatcc

SEQ ID NO: 76659 - DNA, 25 bp, S. pombe
aactgcacggcgaaggtcattcatt

SEQ ID NO: 76660 - DNA, 25 bp, S. pombe
aactcgccagtgcttgttgaatctt

SEQ ID NO: 76661 - DNA, 25 bp, S. pombe
aactgcatccctcttgggaggctaa

SEQ ID NO: 76662 - DNA, 25 bp, S. pombe
aactgtcgccgttatgggaggatac

SEQ ID NO: 76663 - DNA, 25 bp, S. pombe
aactctcttgcgtagaaagcgttac

SEQ ID NO: 76664 - DNA, 25 bp, S. pombe
aacttcttggacaggagattcaacc

SEQ ID NO: 76665 - DNA, 25 bp, S. pombe
aacttgttgcggagtcgaatccctt

SEQ ID NO: 76666 - DNA, 25 bp, S. pombe
aactatgttagccttcctgaatcac

SEQ ID NO: 76667 - DNA, 25 bp, S. pombe
aactctgtcatagacgtcgatgcct

SEQ ID NO: 76668 - DNA, 25 bp, S. pombe
aacattgtgcttgacgatgctgtgc

SEQ ID NO: 76669 - DNA, 25 bp, S. pombe
aactgctgcctggtttatgagtgcc

SEQ ID NO: 76670 - DNA, 25 bp, S. pombe
aactgctactcgctataagtccttg

SEQ ID NO: 76671 - DNA, 25 bp, S. pombe
aactcataaagctattctcgacaat

SEQ ID NO: 76672 - DNA, 25 bp, S. pombe
aacttgcaaatgttggctgcccgat

SEQ ID NO: 76673 - DNA, 25 bp, S. pombe
aactcacataattgtcgctgccggt

SEQ ID NO: 76674 - DNA, 25 bp, S. pombe
aactcacaaagctacctgttggatg

SEQ ID NO: 76675 - DNA, 25 bp, S. pombe
aactccattgactcctatgttactc

SEQ ID NO: 76676 - DNA, 25 bp, S. pombe
aacttcatcttcaactgttccaact

SEQ ID NO: 76677 - DNA, 25 bp, S. pombe
aacattgcacctacactttctaaga

SEQ ID NO: 76678 - DNA, 25 bp, S. pombe
aactgccaatgctgcctttgagcaa

SEQ ID NO: 76679 - DNA, 25 bp, S. pombe
aactcgtctgggtgttgaagacaaa

SEQ ID NO: 76680 - DNA, 25 bp, S. pombe
aatcggttgagcacgttaatggcta

SEQ ID NO: 76681 - DNA, 25 bp, S. pombe
aactatagtgacatttcctttggat

SEQ ID NO: 76682 - DNA, 25 bp, S. pombe
aacttagccactctctttgtatggt

SEQ ID NO: 76683 - DNA, 25 bp, S. pombe
aactataccactctgagccttcagg

SEQ ID NO: 76684 - DNA, 25 bp, S. pombe
aacttagccctatagagcttcctgt

SEQ ID NO: 76685 - DNA, 25 bp, S. pombe
gaacttagacggcaaggctacgcat

SEQ ID NO: 76686 - DNA, 25 bp, S. pombe
aactattgtggccatatcgagcgaa

SEQ ID NO: 76687 - DNA, 25 bp, S. pombe
aactatttgttatggctcgtgagca

SEQ ID NO: 76688 - DNA, 25 bp, S. pombe
aactttttctcattttcgtcacagg

SEQ ID NO: 76689 - DNA, 25 bp, S. pombe
aactgatcttgatgtgccagcggaa

SEQ ID NO: 76690 - DNA, 25 bp, S. pombe
aacttcatttgattgccaggtcgat

SEQ ID NO: 76691 - DNA, 25 bp, S. pombe
aactcctgtgcatttgaaggccgat

SEQ ID NO: 76692 - DNA, 25 bp, S. pombe
aacttagtcattgctggatgtcgaa

SEQ ID NO: 76693 - DNA, 25 bp, S. pombe
aacttttggagaagcttcgcccaga

SEQ ID NO: 76694 - DNA, 25 bp, S. pombe
aacttttgctagcagttgccagtaa

SEQ ID NO: 76695 - DNA, 25 bp, S. pombe
aactcgcctgaaacttgctacattt

SEQ ID NO: 76696 - DNA, 25 bp, S. pombe
aactcacctaccatgtcaaattctt

SEQ ID NO: 76697 - DNA, 25 bp, S. pombe
aactacttcactaacatttccactg

SEQ ID NO: 76698 - DNA, 25 bp, S. pombe
aacttagtcgtgctacttctgatgt

SEQ ID NO: 76699 - DNA, 25 bp, S. pombe
aactctattcgttgatactggtgat

SEQ ID NO: 76700 - DNA, 25 bp, S. pombe
aacttcattctttctacggtagcta

SEQ ID NO: 76701 - DNA, 25 bp, S. pombe
aacttccactattgtccaagagctc

SEQ ID NO: 76702 - DNA, 25 bp, S. pombe
aactcttgtctttgactaaggctgc

SEQ ID NO: 76703 - DNA, 25 bp, S. pombe
aactagcggctttgtattgggatat

SEQ ID NO: 76704 - DNA, 25 bp, S. pombe
aacttcagacgttcacttgactcct

SEQ ID NO: 76705 - DNA, 25 bp, S. pombe
aacgactggagtaccggatgagccc

SEQ ID NO: 76706 - DNA, 25 bp, S. pombe
aacggtgggaactgttgtgcctatc

SEQ ID NO: 76707 - DNA, 25 bp, S. pombe
aacggttggcctgactttggtgcac

SEQ ID NO: 76708 - DNA, 25 bp, S. pombe
aacgggtgctcctgtcattggaaaa

SEQ ID NO: 76709 - DNA, 25 bp, S. pombe
aacgagggtccgatcagtgcgttca

SEQ ID NO: 76710 - DNA, 25 bp, S. pombe
aactggtagtccaattcgacgtaca

SEQ ID NO: 76711 - DNA, 25 bp, S. pombe
aactggtacccgtaatgctcgtaca

SEQ ID NO: 76712 - DNA, 25 bp, S. pombe
aactgatttacccacaattgcacca

SEQ ID NO: 76713 - DNA, 25 bp, S. pombe
aactatcgcacgtggtgttcgcaaa

SEQ ID NO: 76714 - DNA, 25 bp, S. pombe
aacggaaaggttgcagtccaaagca

SEQ ID NO: 76715 - DNA, 25 bp, S. pombe
aacttcagaagagccatccctagat

SEQ ID NO: 76716 - DNA, 25 bp, S. pombe
aactaccaggtttggcatcataggc

SEQ ID NO: 76717 - DNA, 25 bp, S. pombe
aactctgcgagttttggaccagcct

SEQ ID NO: 76718 - DNA, 25 bp, S. pombe
aactcgcggtctttgtcagatcgga

SEQ ID NO: 76719 - DNA, 25 bp, S. pombe
aactctgaggtttattcgggtgatc

SEQ ID NO: 76720 - DNA, 25 bp, S. pombe
aactgtgtgttataggcgtcgccgc

SEQ ID NO: 76721 - DNA, 25 bp, S. pombe
aactcgctttcataagcttttccgc

SEQ ID NO: 76722 - DNA, 25 bp, S. pombe
aactccttatctttatgcatttccc

SEQ ID NO: 76723 - DNA, 25 bp, S. pombe
aactctcttttctgatgattcccga

SEQ ID NO: 76724 - DNA, 25 bp, S. pombe
aactcattacttcggaatctgccag

SEQ ID NO: 76725 - DNA, 25 bp, S. pombe
aactcatcatatttcgggatccgca

SEQ ID NO: 76726 - DNA, 25 bp, S. pombe
aactcatcatatttccgggtccgct

SEQ ID NO: 76727 - DNA, 25 bp, S. pombe
aactgcatttagtcctggtgtcggt

SEQ ID NO: 76728 - DNA, 25 bp, S. pombe
aactatttatgctacatggatacca

SEQ ID NO: 76729 - DNA, 25 bp, S. pombe
aactttgctttctagctttgctgct

SEQ ID NO: 76730 - DNA, 25 bp, S. pombe
aacttctcttttacttctgtctctt

SEQ ID NO: 76731 - DNA, 25 bp, S. pombe
aacttcagctctggtgcctttgtca

SEQ ID NO: 76732 - DNA, 25 bp, S. pombe
aacttctgctcccatttttgtgagt

SEQ ID NO: 76733 - DNA, 25 bp, S. pombe
aactcatgcccgttatcttattgga

SEQ ID NO: 76734 - DNA, 25 bp, S. pombe
aactcgctggtgttgactttttgac

SEQ ID NO: 76735 - DNA, 25 bp, S. pombe
aactagctgggcgtgttcttttgat

SEQ ID NO: 76736 - DNA, 25 bp, S. pombe
aactttgtcagaattccgtggtact

SEQ ID NO: 76737 - DNA, 25 bp, S. pombe
aactttgctgattttgccgggaggt

SEQ ID NO: 76738 - DNA, 25 bp, S. pombe
aactttgcgtggtcatgttgctgcg

SEQ ID NO: 76739 - DNA, 25 bp, S. pombe
aacttagctggttcacttgctgatg

SEQ ID NO: 76740 - DNA, 25 bp, S. pombe
aactctacatagtcttagccgtgga

SEQ ID NO: 76741 - DNA, 25 bp, S. pombe
aacttacacgtattatcctgcatgg

SEQ ID NO: 76742 - DNA, 25 bp, S. pombe
aacttcttcggcaaatcctgatgag

SEQ ID NO: 76743 - DNA, 25 bp, S. pombe
aacttcatcatcagcgcagtcgtta

SEQ ID NO: 76744 - DNA, 25 bp, S. pombe
aactatcgatcttcctatcaagcta

SEQ ID NO: 76745 - DNA, 25 bp, S. pombe
aactttactgtcactgatgactcca

SEQ ID NO: 76746 - DNA, 25 bp, S. pombe
aactttcatcgtcggtggcctctaa

SEQ ID NO: 76747 - DNA, 25 bp, S. pombe
aactttatcaatcgacgtgctttaa

SEQ ID NO: 76748 - DNA, 25 bp, S. pombe
aacgtcgaacgtgagcgcgcttttg

SEQ ID NO: 76749 - DNA, 25 bp, S. pombe
aactttgaagcttccattcgactga

SEQ ID NO: 76750 - DNA, 25 bp, S. pombe
aactagaacagttacaagcgcgtta

SEQ ID NO: 76751 - DNA, 25 bp, S. pombe
aacgttttctctgtcattttctcaa

SEQ ID NO: 76752 - DNA, 25 bp, S. pombe
aacgttctttccattgctttgtaca

SEQ ID NO: 76753 - DNA, 25 bp, S. pombe
aactaatactgcttcatctctttcc

SEQ ID NO: 76754 - DNA, 25 bp, S. pombe
aactacaggctgaattctctcttta

SEQ ID NO: 76755 - DNA, 25 bp, S. pombe
aactagctgatcctgttgctcgtta

SEQ ID NO: 76756 - DNA, 25 bp, S. pombe
aactaatgatccttatgtccgtaat

SEQ ID NO: 76757 - DNA, 25 bp, S. pombe
aacttattcttgatgtactggccta

SEQ ID NO: 76758 - DNA, 25 bp, S. pombe
aactttctcctcaattcgtcaagct

SEQ ID NO: 76759 - DNA, 25 bp, S. pombe
aactttctccaacatcgtcaatcat

SEQ ID NO: 76760 - DNA, 25 bp, S. pombe
aacttattcaacctgcaaccttgac

SEQ ID NO: 76761 - DNA, 25 bp, S. pombe
aactatttccatatgcgtccttact

SEQ ID NO: 76762 - DNA, 25 bp, S. pombe
aactcagtattctcactttccaaag

SEQ ID NO: 76763 - DNA, 25 bp, S. pombe
aactattactcttcacctacaatgg

SEQ ID NO: 76764 - DNA, 25 bp, S. pombe
aagctggtgccaaggagttaaagga

SEQ ID NO: 76765 - DNA, 25 bp, S. pombe
aacggtatacgtgattgttcaggaa

SEQ ID NO: 76766 - DNA, 25 bp, S. pombe
aacggatgatcctacgcaagcttcc

SEQ ID NO: 76767 - DNA, 25 bp, S. pombe
aaccagaggctgtacggagacccca

SEQ ID NO: 76768 - DNA, 25 bp, S. pombe
aacgaccgccattgcagaggacatt

SEQ ID NO: 76769 - DNA, 25 bp, S. pombe
aactctggagtcgttggatgcgctt

SEQ ID NO: 76770 - DNA, 25 bp, S. pombe
aactccagagtttatggctgcccat

SEQ ID NO: 76771 - DNA, 25 bp, S. pombe
aactcacgtgtttgatggcaagact

SEQ ID NO: 76772 - DNA, 25 bp, S. pombe
aactagtcgtgtttgtgttcccata

SEQ ID NO: 76773 - DNA, 25 bp, S. pombe
aactttctggtttcaatccttctgt

SEQ ID NO: 76774 - DNA, 25 bp, S. pombe
aaccttgttcacgaaactgatacgg

SEQ ID NO: 76775 - DNA, 25 bp, S. pombe
aactattctgaccttgatacatggg

SEQ ID NO: 76776 - DNA, 25 bp, S. pombe
aactatcctgtcgtcgtcaatggta

SEQ ID NO: 76777 - DNA, 25 bp, S. pombe
aactgacgttcagcgcactagtgta

SEQ ID NO: 76778 - DNA, 25 bp, S. pombe
aactctgttaatcccaattcttctg

SEQ ID NO: 76779 - DNA, 25 bp, S. pombe
aactagatgtatttcctgtcggcct

SEQ ID NO: 76780 - DNA, 25 bp, S. pombe
aactatgattcttggcactctcggt

SEQ ID NO: 76781 - DNA, 25 bp, S. pombe
aactcattgacttacatgttcagga

SEQ ID NO: 76782 - DNA, 25 bp, S. pombe
aactctaatgagtcctttctatcaa

SEQ ID NO: 76783 - DNA, 25 bp, S. pombe
aactctggctcaacgtctttgacga

SEQ ID NO: 76784 - DNA, 25 bp, S. pombe
aactgtctcctgatgcgtttgacga

SEQ ID NO: 76785 - DNA, 25 bp, S. pombe
aactctgcctgtttgcgattcagaa

SEQ ID NO: 76786 - DNA, 25 bp, S. pombe
aactaggtcgtgtcgcaagccttga

SEQ ID NO: 76787 - DNA, 25 bp, S. pombe
aactgagctgatcttcaacggtatg

SEQ ID NO: 76788 - DNA, 25 bp, S. pombe
aactcttgtgttctactgggtcttt

SEQ ID NO: 76789 - DNA, 25 bp, S. pombe
aagcgttcgtagctacgttcacaga

SEQ ID NO: 76790 - DNA, 25 bp, S. pombe
aagactctaaactacgtacttctag

SEQ ID NO: 76791 - DNA, 25 bp, S. pombe
ctacgctttaacaccaacatttcga

SEQ ID NO: 76792 - DNA, 25 bp, S. pombe
aacgaatctgtacttagcggccatt

SEQ ID NO: 76793 - DNA, 25 bp, S. pombe
aactggtcgtcgtatgagccctcaa

SEQ ID NO: 76794 - DNA, 25 bp, S. pombe
aactcgtcaatctgtgcggttatcc

SEQ ID NO: 76795 - DNA, 25 bp, S. pombe
aagccttactgggatcgttatgatc

SEQ ID NO: 76796 - DNA, 25 bp, S. pombe
aagcgcttaaaggatcccgatgctc

SEQ ID NO: 76797 - DNA, 25 bp, S. pombe
aactcactcctggattatctgcgtt

SEQ ID NO: 76798 - DNA, 25 bp, S. pombe
aactccgctatatatgtcgcgttac

SEQ ID NO: 76799 - DNA, 25 bp, S. pombe
aactctcctatgctattggtgttgc

SEQ ID NO: 76800 - DNA, 25 bp, S. pombe
aactctctttggatcgtgtatgctt

SEQ ID NO: 76801 - DNA, 25 bp, S. pombe
aactcctttgagtccactgttcgaa

SEQ ID NO: 76802 - DNA, 25 bp, S. pombe
aactgcggacaaagtcgaacagact

SEQ ID NO: 76803 - DNA, 25 bp, S. pombe
aactggcggttggtcatctagagaa

SEQ ID NO: 76804 - DNA, 25 bp, S. pombe
aacgcggtatcttacaaggttctgt

SEQ ID NO: 76805 - DNA, 25 bp, S. pombe
aactggcaaccggagctgaagcatg

SEQ ID NO: 76806 - DNA, 25 bp, S. pombe
aacggcctcaaatgctgagcagcat

SEQ ID NO: 76807 - DNA, 25 bp, S. pombe
aactgtgagcgacaagattctttat

SEQ ID NO: 76808 - DNA, 25 bp, S. pombe
aactgccaacattgccattgctgtt

SEQ ID NO: 76809 - DNA, 25 bp, S. pombe
aactgctgcaattcgtgatttgtct

SEQ ID NO: 76810 - DNA, 25 bp, S. pombe
aactgctggcagtggatcctgtagc

SEQ ID NO: 76811 - DNA, 25 bp, S. pombe
aactggtctgcttctttgggtgagg

SEQ ID NO: 76812 - DNA, 25 bp, S. pombe
aactggttgggctttggacgcactg

SEQ ID NO: 76813 - DNA, 25 bp, S. pombe
aactcggtgtttttctctctcttga

SEQ ID NO: 76814 - DNA, 25 bp, S. pombe
aaccggaattatctgcttcgtcggc

SEQ ID NO: 76815 - DNA, 25 bp, S. pombe
aactgggaattacggttgcgctcgc

SEQ ID NO: 76816 - DNA, 25 bp, S. pombe
aactgcggaattgggatcttcggcc

SEQ ID NO: 76817 - DNA, 25 bp, S. pombe
aactccgaatttgggtctctggtgg

SEQ ID NO: 76818 - DNA, 25 bp, S. pombe
aactgcctgtttccgtatgcttggt

SEQ ID NO: 76819 - DNA, 25 bp, S. pombe
aacgtgctgctatgaggcctttggg

SEQ ID NO: 76820 - DNA, 25 bp, S. pombe
aactgactgatccatctgctcatta

SEQ ID NO: 76821 - DNA, 25 bp, S. pombe
aactcttgccttggcattccttctt

SEQ ID NO: 76822 - DNA, 25 bp, S. pombe
aactcattctctaacttctctttta

SEQ ID NO: 76823 - DNA, 25 bp, S. pombe
aactgctattccacttagtaccgaa

SEQ ID NO: 76824 - DNA, 25 bp, S. pombe
aactcccatgggaacagaggcttct

SEQ ID NO: 76825 - DNA, 25 bp, S. pombe
aactcgcctttgagcaagttgttca

SEQ ID NO: 76826 - DNA, 25 bp, S. pombe
aactacctttattcgcgtttgcatc

SEQ ID NO: 76827 - DNA, 25 bp, S. pombe
aactcgggatggtcttcgtgcggta

SEQ ID NO: 76828 - DNA, 25 bp, S. pombe
aactgtaccgacgtgtcaattcaaa

SEQ ID NO: 76829 - DNA, 25 bp, S. pombe
aagcttttcggttctaacgccatat

SEQ ID NO: 76830 - DNA, 25 bp, S. pombe
aactcacaatggcttttcctgaaga

SEQ ID NO: 76831 - DNA, 25 bp, S. pombe
aactactatggttactcttcgccag

SEQ ID NO: 76832 - DNA, 25 bp, S. pombe
aactaattgtgtgcgctggtgtcca

SEQ ID NO: 76833 - DNA, 25 bp, S. pombe
aactaattgctcttcgtgtgcctta

SEQ ID NO: 76834 - DNA, 25 bp, S. pombe
aactgccttgctaatctattggaca

SEQ ID NO: 76835 - DNA, 25 bp, S. pombe
aactgcgagatcttctttttcatca

SEQ ID NO: 76836 - DNA, 25 bp, S. pombe
aactctgaggagtttttccctgcag

SEQ ID NO: 76837 - DNA, 25 bp, S. pombe
aacggcactgctttatcaactaact

SEQ ID NO: 76838 - DNA, 25 bp, S. pombe
aactggctaccaacctattggcgta

SEQ ID NO: 76839 - DNA, 25 bp, S. pombe
aactgtgccagagtatatgcgtcta

SEQ ID NO: 76840 - DNA, 25 bp, S. pombe
aactggctatgctataaattctggt

SEQ ID NO: 76841 - DNA, 25 bp, S. pombe
aactgcttggtttgctggatggaaa

SEQ ID NO: 76842 - DNA, 25 bp, S. pombe
aactgctttggtttctgctcgagaa

SEQ ID NO: 76843 - DNA, 25 bp, S. pombe
aactgtttgtcttccaggtagcaag

SEQ ID NO: 76844 - DNA, 25 bp, S. pombe
aactccctgtttttcgtattgcgca

SEQ ID NO: 76845 - DNA, 25 bp, S. pombe
aactgttttgcgtagcggtgtaccg

SEQ ID NO: 76846 - DNA, 25 bp, S. pombe
aacggtttcatgtactacttactca

SEQ ID NO: 76847 - DNA, 25 bp, S. pombe
aactaacactcattcttcatccatt

SEQ ID NO: 76848 - DNA, 25 bp, S. pombe
aactaatcctctctttgcacaataa

SEQ ID NO: 76849 - DNA, 25 bp, S. pombe
aacgtgactactttggtgcccatac

SEQ ID NO: 76850 - DNA, 25 bp, S. pombe
aactcagcgatgttttgggtgtcac

SEQ ID NO: 76851 - DNA, 25 bp, S. pombe
aactcgatgtgtgttggtgtgccaa

SEQ ID NO: 76852 - DNA, 25 bp, S. pombe
aactgcttctgagcgtgaacgtcta

SEQ ID NO: 76853 - DNA, 25 bp, S. pombe
aacgttttacgtcgcacagttgagc

SEQ ID NO: 76854 - DNA, 25 bp, S. pombe
aacgatttcttttcaaatgttcagg

SEQ ID NO: 76855 - DNA, 25 bp, S. pombe
aactgtttctcgtgcaaactctgtc

SEQ ID NO: 76856 - DNA, 25 bp, S. pombe
aacgttgttgttgaagagagcccct

SEQ ID NO: 76857 - DNA, 25 bp, S. pombe
aacgccgtggtgataaggacgccct

SEQ ID NO: 76858 - DNA, 25 bp, S. pombe
aacgaagctcgtgctaaggacgctg

SEQ ID NO: 76859 - DNA, 25 bp, S. pombe
aacggattccgtgctggcaagccta

SEQ ID NO: 76860 - DNA, 25 bp, S. pombe
aacgactcttcatttgggacattgc

SEQ ID NO: 76861 - DNA, 25 bp, S. pombe
aacgtccattggtgatcttttaaga

SEQ ID NO: 76862 - DNA, 25 bp, S. pombe
aatcccaacggtactattcctgaat

SEQ ID NO: 76863 - DNA, 25 bp, S. pombe
aacggactcttttatgctattggac

SEQ ID NO: 76864 - DNA, 25 bp, S. pombe
aacgtttggttctctcaccctcgca

SEQ ID NO: 76865 - DNA, 25 bp, S. pombe
aactgtttgcagagcctaaatcctt

SEQ ID NO: 76866 - DNA, 25 bp, S. pombe
aacggagcgggcgaattctgagacc

SEQ ID NO: 76867 - DNA, 25 bp, S. pombe
aacgttgcatatgctcgtgcttaca

SEQ ID NO: 76868 - DNA, 25 bp, S. pombe
aactgcgtggctattgcatcggact

SEQ ID NO: 76869 - DNA, 25 bp, S. pombe
aactgttgagctactatctctggaa

SEQ ID NO: 76870 - DNA, 25 bp, S. pombe
aactggtgatgctcgtctcttgaaa

SEQ ID NO: 76871 - DNA, 25 bp, S. pombe
aactcttcgcgcgttggttgaacaa

SEQ ID NO: 76872 - DNA, 25 bp, S. pombe
aactcttcgcgctttttggtactga

SEQ ID NO: 76873 - DNA, 25 bp, S. pombe
aactctttccacttttggcttcaat

SEQ ID NO: 76874 - DNA, 25 bp, S. pombe
aacgatttgaacgtcttccttgcac

SEQ ID NO: 76875 - DNA, 25 bp, S. pombe
aactcggtgaagatcctcttggcat

SEQ ID NO: 76876 - DNA, 25 bp, S. pombe
aactcgggagaaggtccttgcgcac

SEQ ID NO: 76877 - DNA, 25 bp, S. pombe
aaccggtgacatgtctactttgcca

SEQ ID NO: 76878 - DNA, 25 bp, S. pombe
aaccgccgacgaagtgaatcctgac

SEQ ID NO: 76879 - DNA, 25 bp, S. pombe
aactccctacaagaagcatcgcgaa

SEQ ID NO: 76880 - DNA, 25 bp, S. pombe
aactggccttttgtattttggtcat

SEQ ID NO: 76881 - DNA, 25 bp, S. pombe
aactccgttgtttcctcaatcaatg

SEQ ID NO: 76882 - DNA, 25 bp, S. pombe
aactcggcgtgttttacagtacatc

SEQ ID NO: 76883 - DNA, 25 bp, S. pombe
aatcttcgggtccattccagtacta

SEQ ID NO: 76884 - DNA, 25 bp, S. pombe
aactcgaatcgtttgatgctggttc

SEQ ID NO: 76885 - DNA, 25 bp, S. pombe
aaccgatcatcgcatggtctgaaac

SEQ ID NO: 76886 - DNA, 25 bp, S. pombe
aacgtgacttggaccgcattgcata

SEQ ID NO: 76887 - DNA, 25 bp, S. pombe
aacgattctgaggaaagcagcagta

SEQ ID NO: 76888 - DNA, 25 bp, S. pombe
aactccatgataccatctccaaggt

SEQ ID NO: 76889 - DNA, 25 bp, S. pombe
aactcctgttgcttctttcaaatgg

SEQ ID NO: 76890 - DNA, 25 bp, S. pombe
aactctgcagctagtacgtgttcaa

SEQ ID NO: 76891 - DNA, 25 bp, S. pombe
aactctgcaaacacgttctcaacga

SEQ ID NO: 76892 - DNA, 25 bp, S. pombe
aacgaaaactcctttgctcatatcc

SEQ ID NO: 76893 - DNA, 25 bp, S. pombe
aacgcgaaaacctttgcgctttcat

SEQ ID NO: 76894 - DNA, 25 bp, S. pombe
aactggtaaagcttcagctcctgct

SEQ ID NO: 76895 - DNA, 25 bp, S. pombe
aacgaataaagcctcaccacatggg

SEQ ID NO: 76896 - DNA, 25 bp, S. pombe
aacgaccgccttgattttggctaat

SEQ ID NO: 76897 - DNA, 25 bp, S. pombe
aactgatcctcctcaaattatccat

SEQ ID NO: 76898 - DNA, 25 bp, S. pombe
aactggcgattgaatgggtgctgca

SEQ ID NO: 76899 - DNA, 25 bp, S. pombe
aactgtgctgataactccggtgcta

SEQ ID NO: 76900 - DNA, 25 bp, S. pombe
aactgttcgggtagcttcttcatta

SEQ ID NO: 76901 - DNA, 25 bp, S. pombe
aacgtgtgcacttttcggttacgat

SEQ ID NO: 76902 - DNA, 25 bp, S. pombe
aagctagtcgtttgtcggctagacc

SEQ ID NO: 76903 - DNA, 25 bp, S. pombe
aactccttatgtatctggcactgac

SEQ ID NO: 76904 - DNA, 25 bp, S. pombe
aactgcacttattttcatggacggt

SEQ ID NO: 76905 - DNA, 25 bp, S. pombe
aactgctggtgattgcgcgaattcc

SEQ ID NO: 76906 - DNA, 25 bp, S. pombe
aactcgttcaatccgattcttctag

SEQ ID NO: 76907 - DNA, 25 bp, S. pombe
aacggttctttcgatatgcacctca

SEQ ID NO: 76908 - DNA, 25 bp, S. pombe
aactggttcgttgttgaccctagag

SEQ ID NO: 76909 - DNA, 25 bp, S. pombe
aactgtttcagttgtttacgcctga

SEQ ID NO: 76910 - DNA, 25 bp, S. pombe
aacgcttacagttgactattcccaa

SEQ ID NO: 76911 - DNA, 25 bp, S. pombe
aacccgctcgtatatctactcaagt

SEQ ID NO: 76912 - DNA, 25 bp, S. pombe
aaccggcctggagattccgcaatta

SEQ ID NO: 76913 - DNA, 25 bp, S. pombe
aacgagagccggatcactttattat

SEQ ID NO: 76914 - DNA, 25 bp, S. pombe
aacggaactgtcgactgctttacta

SEQ ID NO: 76915 - DNA, 25 bp, S. pombe
aactggaccagtcatcatcttcaac

SEQ ID NO: 76916 - DNA, 25 bp, S. pombe
aagactaccgaagactccctgaagg

SEQ ID NO: 76917 - DNA, 25 bp, S. pombe
aacgcttccgaagagccagttgcaa

SEQ ID NO: 76918 - DNA, 25 bp, S. pombe
aaccataccagaacgtccaggtgct

SEQ ID NO: 76919 - DNA, 25 bp, S. pombe
aacgcaaacgacatcccagaggcaa

SEQ ID NO: 76920 - DNA, 25 bp, S. pombe
aacggctctaagttctctgtccaac

SEQ ID NO: 76921 - DNA, 25 bp, S. pombe
aacgatctcgatcacgcagaacctt

SEQ ID NO: 76922 - DNA, 25 bp, S. pombe
aagcgtcgatactgggatgtttcaa

SEQ ID NO: 76923 - DNA, 25 bp, S. pombe
aactgttaaccccaattatgctaga

SEQ ID NO: 76924 - DNA, 25 bp, S. pombe
aactgttaaacgctgcttacttgaa

SEQ ID NO: 76925 - DNA, 25 bp, S. pombe
aactggtccgttttgtatcacgcca

SEQ ID NO: 76926 - DNA, 25 bp, S. pombe
aaggccaaggagcaaacctccgcga

SEQ ID NO: 76927 - DNA, 25 bp, S. pombe
aacgaagaaggcttgctgcacatag

SEQ ID NO: 76928 - DNA, 25 bp, S. pombe
aactggagcaatacgttgcctcaaa

SEQ ID NO: 76929 - DNA, 25 bp, S. pombe
aacgccttgtagatgtcaccgtgtc

SEQ ID NO: 76930 - DNA, 25 bp, S. pombe
aactggtctaatacttgctccgtgt

SEQ ID NO: 76931 - DNA, 25 bp, S. pombe
aacgtggtagaactcttccgcttga

SEQ ID NO: 76932 - DNA, 25 bp, S. pombe
aaccgagttaaatgcttcctggaat

SEQ ID NO: 76933 - DNA, 25 bp, S. pombe
aactgtttcttagagcttcccgaag

SEQ ID NO: 76934 - DNA, 25 bp, S. pombe
aacggagtcttacaattcggcaaag

SEQ ID NO: 76935 - DNA, 25 bp, S. pombe
aagggtccttactccttggaatatg

SEQ ID NO: 76936 - DNA, 25 bp, S. pombe
aacgaattcgattcttctcgcgacg

SEQ ID NO: 76937 - DNA, 25 bp, S. pombe
aacgtattaattgtgctgcctatcg

SEQ ID NO: 76938 - DNA, 25 bp, S. pombe
aactgccatctttgtattatctgcc

SEQ ID NO: 76939 - DNA, 25 bp, S. pombe
aacgagctgtccgatgatttactat

SEQ ID NO: 76940 - DNA, 25 bp, S. pombe
aactgtgccccgaattatcattagc

SEQ ID NO: 76941 - DNA, 25 bp, S. pombe
aactgctgcgcttctaatgttcatt

SEQ ID NO: 76942 - DNA, 25 bp, S. pombe
aacgatagcagatcctccagagggt

SEQ ID NO: 76943 - DNA, 25 bp, S. pombe
aacggtgctagtggtgccgagctaa

SEQ ID NO: 76944 - DNA, 25 bp, S. pombe
aacgttccgtcgctcatgcagagaa

SEQ ID NO: 76945 - DNA, 25 bp, S. pombe
aactgtcgctcgtcaagctgctaat

SEQ ID NO: 76946 - DNA, 25 bp, S. pombe
aacgtcgtcgaccatgtgcttaagc

SEQ ID NO: 76947 - DNA, 25 bp, S. pombe
aactgtcatgtctaccagtgctgtg

SEQ ID NO: 76948 - DNA, 25 bp, S. pombe
aactgcctgctgtagccgatgctat

SEQ ID NO: 76949 - DNA, 25 bp, S. pombe
aactgctgctgactactttggcgaa

SEQ ID NO: 76950 - DNA, 25 bp, S. pombe
aacgtgatccgactatcgtgtcagc

SEQ ID NO: 76951 - DNA, 25 bp, S. pombe
aacgtgatcgaagcttgcatgtcca

SEQ ID NO: 76952 - DNA, 25 bp, S. pombe
aactgattcgttggttgagctccga

SEQ ID NO: 76953 - DNA, 25 bp, S. pombe
aacgttcctggtatgagccgtggtc

SEQ ID NO: 76954 - DNA, 25 bp, S. pombe
gttcgttgccgacaagaccaagttt

SEQ ID NO: 76955 - DNA, 25 bp, S. pombe
aacgttactggcttatacccatcct

SEQ ID NO: 76956 - DNA, 25 bp, S. pombe
aacgatgtgacgaaaaatgccctat

SEQ ID NO: 76957 - DNA, 25 bp, S. pombe
aactgtgctgaaaacgaacctcttg

SEQ ID NO: 76958 - DNA, 25 bp, S. pombe
aacgcattgacttccgtgagcttgt

SEQ ID NO: 76959 - DNA, 25 bp, S. pombe
aacgatatgctttcggctgcagact

SEQ ID NO: 76960 - DNA, 25 bp, S. pombe
aacgagcaacatccatcttctacta

SEQ ID NO: 76961 - DNA, 25 bp, S. pombe
aactgctcaactggtttctatgcta

SEQ ID NO: 76962 - DNA, 25 bp, S. pombe
aactgactggcctattctctttaat

SEQ ID NO: 76963 - DNA, 25 bp, S. pombe
aactgggagccattccatctttgaa

SEQ ID NO: 76964 - DNA, 25 bp, S. pombe
aacgtgtgcccattgatacttctaa

SEQ ID NO: 76965 - DNA, 25 bp, S. pombe
aactggctcctatgaatgtctgtaa

SEQ ID NO: 76966 - DNA, 25 bp, S. pombe
aacggcattctttggtgaggacgct

SEQ ID NO: 76967 - DNA, 25 bp, S. pombe
aactggttctgcgagttcagtacct

SEQ ID NO: 76968 - DNA, 25 bp, S. pombe
aacggagtctgggatcgatcaattc

SEQ ID NO: 76969 - DNA, 25 bp, S. pombe
aacgactcatttgactcgaccaagt

SEQ ID NO: 76970 - DNA, 25 bp, S. pombe
aactgagtattcacacttagccgat

SEQ ID NO: 76971 - DNA, 25 bp, S. pombe
aacgactatttctacgataccgtca

SEQ ID NO: 76972 - DNA, 25 bp, S. pombe
aacgggctattctcgtgaacgacca

SEQ ID NO: 76973 - DNA, 25 bp, S. pombe
aacgatttggcattcctgtggacga

SEQ ID NO: 76974 - DNA, 25 bp, S. pombe
aactgattatcgctcattgcatgga

SEQ ID NO: 76975 - DNA, 25 bp, S. pombe
aacgtggacgtgtcattcatgctga

SEQ ID NO: 76976 - DNA, 25 bp, S. pombe
aacgtggatccatgtcatcagccga

SEQ ID NO: 76977 - DNA, 25 bp, S. pombe
aacggaatcctaactactcgactga

SEQ ID NO: 76978 - DNA, 25 bp, S. pombe
aacgaatggaatattggcgcagaca

SEQ ID NO: 76979 - DNA, 25 bp, S. pombe
aacgtagcggtctttgtcacaaatc

SEQ ID NO: 76980 - DNA, 25 bp, S. pombe
aacgtcgcggttacttctgctaatt

SEQ ID NO: 76981 - DNA, 25 bp, S. pombe
aacctttaccgattgcttcaactgt

SEQ ID NO: 76982 - DNA, 25 bp, S. pombe
aaccgtgtacctctgcttgatatgt

SEQ ID NO: 76983 - DNA, 25 bp, S. pombe
aaccgttcaacgcagttatgtggct

SEQ ID NO: 76984 - DNA, 25 bp, S. pombe
aactggttacgcttggttgctttat

SEQ ID NO: 76985 - DNA, 25 bp, S. pombe
aacgggttctcatgccattagtcat

SEQ ID NO: 76986 - DNA, 25 bp, S. pombe
aacggatttctcttcttgtgtacat

SEQ ID NO: 76987 - DNA, 25 bp, S. pombe
aacgtgatactttgactgcagaaga

SEQ ID NO: 76988 - DNA, 25 bp, S. pombe
aacggtcgcacaccaatgcattggg

SEQ ID NO: 76989 - DNA, 25 bp, S. pombe
aacggcgctgtttattgcttgcaag

SEQ ID NO: 76990 - DNA, 25 bp, S. pombe
aactgtggtgctttcactcttgaag

SEQ ID NO: 76991 - DNA, 25 bp, S. pombe
aacgaggttattgctcctggagcca

SEQ ID NO: 76992 - DNA, 25 bp, S. pombe
aacggtgtcaatatcattagccctt

SEQ ID NO: 76993 - DNA, 25 bp, S. pombe
aactgatgttcttaccttggcaaat

SEQ ID NO: 76994 - DNA, 25 bp, S. pombe
aacgggtcttcattcattgccaaat

SEQ ID NO: 76995 - DNA, 25 bp, S. pombe
aacgggatcttctacaactctatat

SEQ ID NO: 76996 - DNA, 25 bp, S. pombe
aacgaactccacacaatgcctataa

SEQ ID NO: 76997 - DNA, 25 bp, S. pombe
aactgtttacattctacctcattgg

SEQ ID NO: 76998 - DNA, 25 bp, S. pombe
aactgatacttgtttctcctatgcg

SEQ ID NO: 76999 - DNA, 25 bp, S. pombe
aacgactatttttgtccctcgtatg

SEQ ID NO: 77000 - DNA, 25 bp, S. pombe
aacgatcctcttgttgacgatatgg

SEQ ID NO: 77001 - DNA, 25 bp, S. pombe
aaccctaagttactcgactgtctgt

SEQ ID NO: 77002 - DNA, 25 bp, S. pombe
aacggtattaactatcggcatcgca

SEQ ID NO: 77003 - DNA, 25 bp, S. pombe
aactggtcctagcaataccgatgat

SEQ ID NO: 77004 - DNA, 25 bp, S. pombe
aactggtctaggtcaatcaccgagt

SEQ ID NO: 77005 - DNA, 25 bp, S. pombe
aacggtcatcaagctcgtgagtgca

SEQ ID NO: 77006 - DNA, 25 bp, S. pombe
aactggtgttatgcggatcttctga

SEQ ID NO: 77007 - DNA, 25 bp, S. pombe
aacgtctttgttattggcgaggctg

SEQ ID NO: 77008 - DNA, 25 bp, S. pombe
aacgtctttgttttgtgagctaatt

SEQ ID NO: 77009 - DNA, 25 bp, S. pombe
aacgttttcgttattggtgagactg

SEQ ID NO: 77010 - DNA, 25 bp, S. pombe
aacgtcctatcgataagctggctaa

SEQ ID NO: 77011 - DNA, 25 bp, S. pombe
aacgcgtgcgtcgtctcaaacgtaa

SEQ ID NO: 77012 - DNA, 25 bp, S. pombe
aactgggcgtgtcaagactgctgaa

SEQ ID NO: 77013 - DNA, 25 bp, S. pombe
aacggccgtatcaacaaatgtggag

SEQ ID NO: 77014 - DNA, 25 bp, S. pombe
aaccctcgtacttccaaagatatgg

SEQ ID NO: 77015 - DNA, 25 bp, S. pombe
aacggtgttggatcccatctcaagg

SEQ ID NO: 77016 - DNA, 25 bp, S. pombe
aacggatgttggtttgcgctggcaa

SEQ ID NO: 77017 - DNA, 25 bp, S. pombe
aacgcgtgtttatgtggaggccgat

SEQ ID NO: 77018 - DNA, 25 bp, S. pombe
aacggtcccgatgtcatgagatggc

SEQ ID NO: 77019 - DNA, 25 bp, S. pombe
aagctggtcttctcgtcaagatggc

SEQ ID NO: 77020 - DNA, 25 bp, S. pombe
aagccggctacaggttggttcgact

SEQ ID NO: 77021 - DNA, 25 bp, S. pombe
aacgggcgaaccaagtgtcatctac

SEQ ID NO: 77022 - DNA, 25 bp, S. pombe
aacgggttagccaagttcatgccaa

SEQ ID NO: 77023 - DNA, 25 bp, S. pombe
aacgggttgggaattgcattggcat

SEQ ID NO: 77024 - DNA, 25 bp, S. pombe
aactggctccatttttgcatttgcg

SEQ ID NO: 77025 - DNA, 25 bp, S. pombe
aacgtgtcatagatactgctcttct

SEQ ID NO: 77026 - DNA, 25 bp, S. pombe
aacggcttagatactcctttgcttg

SEQ ID NO: 77027 - DNA, 25 bp, S. pombe
aacgtgttcaggatccacatttatt

SEQ ID NO: 77028 - DNA, 25 bp, S. pombe
aacgttgccggaatgactacttctt

SEQ ID NO: 77029 - DNA, 25 bp, S. pombe
aacggtcgtcatatcattcttttag

SEQ ID NO: 77030 - DNA, 25 bp, S. pombe
aagcaggtttggttagactctagta

SEQ ID NO: 77031 - DNA, 25 bp, S. pombe
aacgttgactttgacatctccgaaa

SEQ ID NO: 77032 - DNA, 25 bp, S. pombe
aacgatggtctctggtttctcgaac

SEQ ID NO: 77033 - DNA, 25 bp, S. pombe
aacgacgtactttgtgcttctctaa

SEQ ID NO: 77034 - DNA, 25 bp, S. pombe
aagctccttacatgggtcaagccga

SEQ ID NO: 77035 - DNA, 25 bp, S. pombe
aacgcatttcggagtaatacttcat

SEQ ID NO: 77036 - DNA, 25 bp, S. pombe
aacggaagcgttttagataccactg

SEQ ID NO: 77037 - DNA, 25 bp, S. pombe
aagccggcggttttggtatcaatct

SEQ ID NO: 77038 - DNA, 25 bp, S. pombe
aaccgccggatctgatggtactttt

SEQ ID NO: 77039 - DNA, 25 bp, S. pombe
aaccccgttgtgttatcttgacgcg

SEQ ID NO: 77040 - DNA, 25 bp, S. pombe
aacgtacgtttattcgtctacaatg

SEQ ID NO: 77041 - DNA, 25 bp, S. pombe
aacggttattccttctgttacagat

SEQ ID NO: 77042 - DNA, 25 bp, S. pombe
aactggcttttatttctgctgttta

SEQ ID NO: 77043 - DNA, 25 bp, S. pombe
aacggatcacctgttcttatcataa

SEQ ID NO: 77044 - DNA, 25 bp, S. pombe
aacgtgtcccgcaacttcaaaagat

SEQ ID NO: 77045 - DNA, 25 bp, S. pombe
aacgttccggaaagctcacacaaat

SEQ ID NO: 77046 - DNA, 25 bp, S. pombe
aacgcaaagagcgtttcaacgccaa

SEQ ID NO: 77047 - DNA, 25 bp, S. pombe
aacgacagtgatgttggcttggccg

SEQ ID NO: 77048 - DNA, 25 bp, S. pombe
aactggcatgcaactatgtggctct

SEQ ID NO: 77049 - DNA, 25 bp, S. pombe
aacgtgagatccatgctgctcttga

SEQ ID NO: 77050 - DNA, 25 bp, S. pombe
aacggagctgttccatgttaatcat

SEQ ID NO: 77051 - DNA, 25 bp, S. pombe
aacgtggtttgcgtgctgctgaaac

SEQ ID NO: 77052 - DNA, 25 bp, S. pombe
aacggttgttgcgagtcatgactac

SEQ ID NO: 77053 - DNA, 25 bp, S. pombe
aacggtttcgacgagtcctgaatca

SEQ ID NO: 77054 - DNA, 25 bp, S. pombe
aacggctcttttgttccttatcaat

SEQ ID NO: 77055 - DNA, 25 bp, S. pombe
aacgggtactcgaatgtctgcaaaa

SEQ ID NO: 77056 - DNA, 25 bp, S. pombe
aacgagcgaagcctgtctttgcaga

SEQ ID NO: 77057 - DNA, 25 bp, S. pombe
aacgtctagagccattcattgatca

SEQ ID NO: 77058 - DNA, 25 bp, S. pombe
aactggaggatgctctcaatgcaaa

SEQ ID NO: 77059 - DNA, 25 bp, S. pombe
aacgctaggtggtctcaactcaggg

SEQ ID NO: 77060 - DNA, 25 bp, S. pombe
aacggctgttttccatgctcaaagt

SEQ ID NO: 77061 - DNA, 25 bp, S. pombe
aacgtgtcacctgctcaagagagag

SEQ ID NO: 77062 - DNA, 25 bp, S. pombe
aacgagaccctatcattcttggtgt

SEQ ID NO: 77063 - DNA, 25 bp, S. pombe
aacgaatcaccttctttcttagatg

SEQ ID NO: 77064 - DNA, 25 bp, S. pombe
aacggatatccttcctattctgatg

SEQ ID NO: 77065 - DNA, 25 bp, S. pombe
aacggcaatgctgtattttctgaaa

SEQ ID NO: 77066 - DNA, 25 bp, S. pombe
aacggcatatcaggtacttcattag

SEQ ID NO: 77067 - DNA, 25 bp, S. pombe
aacggcagctcaaattcttttgcat

SEQ ID NO: 77068 - DNA, 25 bp, S. pombe
aatccagcgctaaatgcccgagtat

SEQ ID NO: 77069 - DNA, 25 bp, S. pombe
aacgcgctgatggtcatgaacttca

SEQ ID NO: 77070 - DNA, 25 bp, S. pombe
aacgtatatgggaaactcgtcgata

SEQ ID NO: 77071 - DNA, 25 bp, S. pombe
aacgttgcacccagcatgtataagg

SEQ ID NO: 77072 - DNA, 25 bp, S. pombe
aacgttagcgttaatgcgggactgg

SEQ ID NO: 77073 - DNA, 25 bp, S. pombe
aaccttcccttagaaatgctgccaa

SEQ ID NO: 77074 - DNA, 25 bp, S. pombe
aaccctccttttgttcagcatcaaa

SEQ ID NO: 77075 - DNA, 25 bp, S. pombe
aaccccatccttcatgagatctgta

SEQ ID NO: 77076 - DNA, 25 bp, S. pombe
aacccactcctactaattctgatga

SEQ ID NO: 77077 - DNA, 25 bp, S. pombe
aaccaaatgcaacttcaggatcccc

SEQ ID NO: 77078 - DNA, 25 bp, S. pombe
aaccctttgttttgtggcgcagaca

SEQ ID NO: 77079 - DNA, 25 bp, S. pombe
aacgaaattgcgacttgtgccgaga

SEQ ID NO: 77080 - DNA, 25 bp, S. pombe
aacgagagtgtcaaaatgcccgcaa

SEQ ID NO: 77081 - DNA, 25 bp, S. pombe
aacggatgcttctagagaccccaag

SEQ ID NO: 77082 - DNA, 25 bp, S. pombe
aacgtactatgctggagctcctcaa

SEQ ID NO: 77083 - DNA, 25 bp, S. pombe
aacgtatcacacctagacatcttca

SEQ ID NO: 77084 - DNA, 25 bp, S. pombe
aacgtcatcttcaaaggtacctcga

SEQ ID NO: 77085 - DNA, 25 bp, S. pombe
aacgatttgactctatggagcagcg

SEQ ID NO: 77086 - DNA, 25 bp, S. pombe
aacgtttgatctttgctggcaagca

SEQ ID NO: 77087 - DNA, 25 bp, S. pombe
aacgattatcttgctgctctcaatc

SEQ ID NO: 77088 - DNA, 25 bp, S. pombe
aacgtgtacttgttgctgctgctat

SEQ ID NO: 77089 - DNA, 25 bp, S. pombe
aacgtctattattcccgctatgcat

SEQ ID NO: 77090 - DNA, 25 bp, S. pombe
aacgtctttgcaaacagagctgagc

SEQ ID NO: 77091 - DNA, 25 bp, S. pombe
aacgacttggcatcaacgagcttcc

SEQ ID NO: 77092 - DNA, 25 bp, S. pombe
aacgagttgagaaagctatcccgaa

SEQ ID NO: 77093 - DNA, 25 bp, S. pombe
aacgttttagtgacttctcaccagg

SEQ ID NO: 77094 - DNA, 25 bp, S. pombe
aaccttgagcgttcttcaacttaca

SEQ ID NO: 77095 - DNA, 25 bp, S. pombe
aacctattcgttctcaggcttttga

SEQ ID NO: 77096 - DNA, 25 bp, S. pombe
aacgatttcgttcatgctttccttg

SEQ ID NO: 77097 - DNA, 25 bp, S. pombe
aacgtcgcagttcctactcattttt

SEQ ID NO: 77098 - DNA, 25 bp, S. pombe
aacgtgctgcagagatcaatcctaa

SEQ ID NO: 77099 - DNA, 25 bp, S. pombe
aagcgaagaggactcctccttgttc

SEQ ID NO: 77100 - DNA, 25 bp, S. pombe
aagccaagtggatccctgttttaga

SEQ ID NO: 77101 - DNA, 25 bp, S. pombe
aacgctttggatgctaaatttctag

SEQ ID NO: 77102 - DNA, 25 bp, S. pombe
aaccttggtgactcaggatttctta

SEQ ID NO: 77103 - DNA, 25 bp, S. pombe
aacctttggcactttggattccata

SEQ ID NO: 77104 - DNA, 25 bp, S. pombe
aacctttaacgtctgatttgccaca

SEQ ID NO: 77105 - DNA, 25 bp, S. pombe
aaccgttggaagagtttgcgcctca

SEQ ID NO: 77106 - DNA, 25 bp, S. pombe
aacggtaagaagctcttggccactc

SEQ ID NO: 77107 - DNA, 25 bp, S. pombe
aacgacttggcattttgcttcacat

SEQ ID NO: 77108 - DNA, 25 bp, S. pombe
aacgtcttctcattctttgcaacta

SEQ ID NO: 77109 - DNA, 25 bp, S. pombe
aacgtgcttttactcttcatattgg

SEQ ID NO: 77110 - DNA, 25 bp, S. pombe
aacccactcttcaatcctatagctt

SEQ ID NO: 77111 - DNA, 25 bp, S. pombe
aacccagcgctgaagaacgtgactt

SEQ ID NO: 77112 - DNA, 25 bp, S. pombe
aacgcgacagcgaatttccatgcca

SEQ ID NO: 77113 - DNA, 25 bp, S. pombe
aacccatgagcgttttaatgcctgc

SEQ ID NO: 77114 - DNA, 25 bp, S. pombe
ttggcccaggaacaggagttgcacc

SEQ ID NO: 77115 - DNA, 25 bp, S. pombe
ttggccaaagtgtgttagcttcccc

SEQ ID NO: 77116 - DNA, 25 bp, S. pombe
aagctcaagctgaaattatgcgtgc

SEQ ID NO: 77117 - DNA, 25 bp, S. pombe
aacgaactatatatctctggtgcta

SEQ ID NO: 77118 - DNA, 25 bp, S. pombe
aacgatacctcattgcttcttggtc

SEQ ID NO: 77119 - DNA, 25 bp, S. pombe
aacgatgaactcttgcttgcggtag

SEQ ID NO: 77120 - DNA, 25 bp, S. pombe
aagcacaccatcttcgtagacaatg

SEQ ID NO: 77121 - DNA, 25 bp, S. pombe
aaccccacattctcgacatgatgga

SEQ ID NO: 77122 - DNA, 25 bp, S. pombe
aaccgcatggccagggcttctgaaa

SEQ ID NO: 77123 - DNA, 25 bp, S. pombe
aacgatcgggcggactttttgcata

SEQ ID NO: 77124 - DNA, 25 bp, S. pombe
aagtcaagcctacaccttcgattta

SEQ ID NO: 77125 - DNA, 25 bp, S. pombe
aagccaacaataccacctacggatt

SEQ ID NO: 77126 - DNA, 25 bp, S. pombe
aatctcccgcatgtacttttgggta

SEQ ID NO: 77127 - DNA, 25 bp, S. pombe
aacgacgctgtcaaacatacatttt

SEQ ID NO: 77128 - DNA, 25 bp, S. pombe
aatcccaagaccgatgttatttcaa

SEQ ID NO: 77129 - DNA, 25 bp, S. pombe
aaccgaatactctctattctcacga

SEQ ID NO: 77130 - DNA, 25 bp, S. pombe
aacgagacgtgctcctaagaactct

SEQ ID NO: 77131 - DNA, 25 bp, S. pombe
aacgtacttcttggcttaaagctgc

SEQ ID NO: 77132 - DNA, 25 bp, S. pombe
aacgactttctgtctttaaatgcgc

SEQ ID NO: 77133 - DNA, 25 bp, S. pombe
aacgacttatacctgttccacatgg

SEQ ID NO: 77134 - DNA, 25 bp, S. pombe
aacgacttacgcgatttcagacaac

SEQ ID NO: 77135 - DNA, 25 bp, S. pombe
aacgacttcaagaagcgattggctt

SEQ ID NO: 77136 - DNA, 25 bp, S. pombe
aaccctagaggtggaatcctctgac

SEQ ID NO: 77137 - DNA, 25 bp, S. pombe
aacgcagtaattgtatctcccgacg

SEQ ID NO: 77138 - DNA, 25 bp, S. pombe
aacgttacatgccccaactcataca

SEQ ID NO: 77139 - DNA, 25 bp, S. pombe
aacgttttggctcaaatgcatcagc

SEQ ID NO: 77140 - DNA, 25 bp, S. pombe
aaccttgttggtcatgatactaaaa

SEQ ID NO: 77141 - DNA, 25 bp, S. pombe
aacgagggtcgtcttagcacataaa

SEQ ID NO: 77142 - DNA, 25 bp, S. pombe
aacgattgcgctttcttctttgaat

SEQ ID NO: 77143 - DNA, 25 bp, S. pombe
aacgagttggatgatttggctgaca

SEQ ID NO: 77144 - DNA, 25 bp, S. pombe
aacgatgttgttgtttttgccaagt

SEQ ID NO: 77145 - DNA, 25 bp, S. pombe
aacgcatatgttctcttttcgccta

SEQ ID NO: 77146 - DNA, 25 bp, S. pombe
aacgacgatatttttccaggaacat

SEQ ID NO: 77147 - DNA, 25 bp, S. pombe
aacgattgatttttgccggaaagca

SEQ ID NO: 77148 - DNA, 25 bp, S. pombe
aacgctatcattgaagccgccttgg

SEQ ID NO: 77149 - DNA, 25 bp, S. pombe
aacgtatggcatccaaggttttgat

SEQ ID NO: 77150 - DNA, 25 bp, S. pombe
aacgatcgcttttcagaggattcac

SEQ ID NO: 77151 - DNA, 25 bp, S. pombe
aacgagctttatttccttcaggaag

SEQ ID NO: 77152 - DNA, 25 bp, S. pombe
aacgaattttttgctgaacctgata

SEQ ID NO: 77153 - DNA, 25 bp, S. pombe
aacgacattttggtctctatcccta

SEQ ID NO: 77154 - DNA, 25 bp, S. pombe
aacgagtcgttgagcctaccattga

SEQ ID NO: 77155 - DNA, 25 bp, S. pombe
aacgaacgttatcatgtcaccgaaa

SEQ ID NO: 77156 - DNA, 25 bp, S. pombe
aagcttacgtttcttctcaggacaa

SEQ ID NO: 77157 - DNA, 25 bp, S. pombe
aacgaaattctgtatctcacgagat

SEQ ID NO: 77158 - DNA, 25 bp, S. pombe
aacgcagtttctaatgtcacggatc

SEQ ID NO: 77159 - DNA, 25 bp, S. pombe
aagcgggttaaaatactccaagatg

SEQ ID NO: 77160 - DNA, 25 bp, S. pombe
aatggcggttcatcaacctacgaat

SEQ ID NO: 77161 - DNA, 25 bp, S. pombe
aacgttgtttcaatacttgtcagaa

SEQ ID NO: 77162 - DNA, 25 bp, S. pombe
aacgctaattacagattttcaggat

SEQ ID NO: 77163 - DNA, 25 bp, S. pombe
aaccaatttttccattcttcacgag

SEQ ID NO: 77164 - DNA, 25 bp, S. pombe
aaccgttcaatgtcggctggtacga

SEQ ID NO: 77165 - DNA, 25 bp, S. pombe
aacgttgttatgtctggtggtacca

SEQ ID NO: 77166 - DNA, 25 bp, S. pombe
aacgatgttctcattcatgctaaga

SEQ ID NO: 77167 - DNA, 25 bp, S. pombe
aacgctagtcaggtttgtctttcta

SEQ ID NO: 77168 - DNA, 25 bp, S. pombe
aacgcggccggtgcatgtttacagg

SEQ ID NO: 77169 - DNA, 25 bp, S. pombe
aaccaaacgagtgcgctgctgttga

SEQ ID NO: 77170 - DNA, 25 bp, S. pombe
aacgctgaacgattcaccgtgtaat

SEQ ID NO: 77171 - DNA, 25 bp, S. pombe
aaccgatgtcgatttcctttagagg

SEQ ID NO: 77172 - DNA, 25 bp, S. pombe
aaccctaatgtctctggtgaagcta

SEQ ID NO: 77173 - DNA, 25 bp, S. pombe
aaccctttctgaacgggaatctcat

SEQ ID NO: 77174 - DNA, 25 bp, S. pombe
aacgctctttacctcttgggtattg

SEQ ID NO: 77175 - DNA, 25 bp, S. pombe
aagtccatgacttctgcagttgagg

SEQ ID NO: 77176 - DNA, 25 bp, S. pombe
aacgctgaatctgccttagctgaca

SEQ ID NO: 77177 - DNA, 25 bp, S. pombe
aacgattcgcaaacattatgagatg

SEQ ID NO: 77178 - DNA, 25 bp, S. pombe
aacgttcacgttatgcagaggacta

SEQ ID NO: 77179 - DNA, 25 bp, S. pombe
aacgttgtaaaagccgccgctcaag

SEQ ID NO: 77180 - DNA, 25 bp, S. pombe
aagccaatccatcattaactcgttc

SEQ ID NO: 77181 - DNA, 25 bp, S. pombe
aagccaaacggagcatactcagaat

SEQ ID NO: 77182 - DNA, 25 bp, S. pombe
aagccaatcaccaaagaagccgttt

SEQ ID NO: 77183 - DNA, 25 bp, S. pombe
aacgcaagccctagattagcctgtt

SEQ ID NO: 77184 - DNA, 25 bp, S. pombe
aacgatggctcattagcttcacctg

SEQ ID NO: 77185 - DNA, 25 bp, S. pombe
aaccgacccaagaagcattgccaag

SEQ ID NO: 77186 - DNA, 25 bp, S. pombe
aacgacagccgttgactgagtcaaa

SEQ ID NO: 77187 - DNA, 25 bp, S. pombe
aagcgacttgcagctatggagcctc

SEQ ID NO: 77188 - DNA, 25 bp, S. pombe
aacgatcttctgttgtaagcctttg

SEQ ID NO: 77189 - DNA, 25 bp, S. pombe
aacgctcttcgtttaatgcatcctt

SEQ ID NO: 77190 - DNA, 25 bp, S. pombe
aacgctactagcagtcaagatcagt

SEQ ID NO: 77191 - DNA, 25 bp, S. pombe
aacgctatgctactccagacttggt

SEQ ID NO: 77192 - DNA, 25 bp, S. pombe
aacgaccaattcacgcttcaagagc

SEQ ID NO: 77193 - DNA, 25 bp, S. pombe
aaccgaacgatcgactttctctgag

SEQ ID NO: 77194 - DNA, 25 bp, S. pombe
aagcctaggcgcagcattttttgga

SEQ ID NO: 77195 - DNA, 25 bp, S. pombe
aagcccgtgccatgtattcttttgc

SEQ ID NO: 77196 - DNA, 25 bp, S. pombe
aacgccaagcctgttgtttttgcaa

SEQ ID NO: 77197 - DNA, 25 bp, S. pombe
aacctattcaatcgcggtgtgcaat

SEQ ID NO: 77198 - DNA, 25 bp, S. pombe
aaccgatatcgctgctgttgtagat

SEQ ID NO: 77199 - DNA, 25 bp, S. pombe
aacccaaccatacattccagacaat

SEQ ID NO: 77200 - DNA, 25 bp, S. pombe
aacgccagacgcaatgtattttcaa

SEQ ID NO: 77201 - DNA, 25 bp, S. pombe
aagccaaccagcagtatggttcaag

SEQ ID NO: 77202 - DNA, 25 bp, S. pombe
aagcctgacgttgttatcctgggta

SEQ ID NO: 77203 - DNA, 25 bp, S. pombe
aagccaacggttgttccatgaagga

SEQ ID NO: 77204 - DNA, 25 bp, S. pombe
aaccaaagggccgtgcttataagcg

SEQ ID NO: 77205 - DNA, 25 bp, S. pombe
aaccaaagggccgtgcttataagcg

SEQ ID NO: 77206 - DNA, 25 bp, S. pombe
aaccttctggtaccgttgtgaatat

SEQ ID NO: 77207 - DNA, 25 bp, S. pombe
aagcgttctttcactaagcgactta

SEQ ID NO: 77208 - DNA, 25 bp, S. pombe
cagaccgttacgatggttttcgaga

SEQ ID NO: 77209 - DNA, 25 bp, S. pombe
aaccgttctgcgaatggtcgttctg

SEQ ID NO: 77210 - DNA, 25 bp, S. pombe
aacctgagctttttgctaaccgcat

SEQ ID NO: 77211 - DNA, 25 bp, S. pombe
aaccgagcaccgacattgcttttga

SEQ ID NO: 77212 - DNA, 25 bp, S. pombe
aaccgatttaacttccttgtgtatg

SEQ ID NO: 77213 - DNA, 25 bp, S. pombe
aatcccttttcatttccgtagtgag

SEQ ID NO: 77214 - DNA, 25 bp, S. pombe
aacccaataattctccatgtcgtac

SEQ ID NO: 77215 - DNA, 25 bp, S. pombe
aagccggtccgaagagcctcagtaa

SEQ ID NO: 77216 - DNA, 25 bp, S. pombe
aagctaattactctgcgaacgaaag

SEQ ID NO: 77217 - DNA, 25 bp, S. pombe
aacgcccgtgcgatgactgtgtcga

SEQ ID NO: 77218 - DNA, 25 bp, S. pombe
aacgacattgattccgtcaaaggtg

SEQ ID NO: 77219 - DNA, 25 bp, S. pombe
aacccttctgccgaggatgctgagg

SEQ ID NO: 77220 - DNA, 25 bp, S. pombe
aagcaccttcagaccggacgtggag

SEQ ID NO: 77221 - DNA, 25 bp, S. pombe
aacgccttcagcaactcgtagagaa

SEQ ID NO: 77222 - DNA, 25 bp, S. pombe
aacgcgattccgactaagaggcaaa

SEQ ID NO: 77223 - DNA, 25 bp, S. pombe
aaccttgttcgtgtcagcgttggaa

SEQ ID NO: 77224 - DNA, 25 bp, S. pombe
aacctgataattccctacgttggca

SEQ ID NO: 77225 - DNA, 25 bp, S. pombe
aacctttaccttcttctgcaattgt

SEQ ID NO: 77226 - DNA, 25 bp, S. pombe
aacctcttactttgtggtctactct

SEQ ID NO: 77227 - DNA, 25 bp, S. pombe
aaccttaacttctattcctactgca

SEQ ID NO: 77228 - DNA, 25 bp, S. pombe
aacccattagttcattttcagcatc

SEQ ID NO: 77229 - DNA, 25 bp, S. pombe
aacccatttgcctcatttgttgata

SEQ ID NO: 77230 - DNA, 25 bp, S. pombe
aacgcctttggacgctggtttgcaa

SEQ ID NO: 77231 - DNA, 25 bp, S. pombe
aagcgtcctacaatcgaagtggttt

SEQ ID NO: 77232 - DNA, 25 bp, S. pombe
aacgaagttggctctccagctaagg

SEQ ID NO: 77233 - DNA, 25 bp, S. pombe
aaccaatttggttgcactcatgaaa

SEQ ID NO: 77234 - DNA, 25 bp, S. pombe
aacgccaattcaacgaggtgtcagt

SEQ ID NO: 77235 - DNA, 25 bp, S. pombe
aagcccgtgtagcagacgttcgaaa

SEQ ID NO: 77236 - DNA, 25 bp, S. pombe
aagcgtcgtcaacaacgttacacta

SEQ ID NO: 77237 - DNA, 25 bp, S. pombe
aagcgctctgagtatcgaagacttc

SEQ ID NO: 77238 - DNA, 25 bp, S. pombe
aacgctctctgtttagtgcatcttt

SEQ ID NO: 77239 - DNA, 25 bp, S. pombe
aacgcgcttatgttaggcatctgtt

SEQ ID NO: 77240 - DNA, 25 bp, S. pombe
aacgctgctgttacacatgcattag

SEQ ID NO: 77241 - DNA, 25 bp, S. pombe
aacgcagtgtgtggccgattggctt

SEQ ID NO: 77242 - DNA, 25 bp, S. pombe
aaccgcgtgttcgtatttgcaattc

SEQ ID NO: 77243 - DNA, 25 bp, S. pombe
aacgctgccgttttttcacatatat

SEQ ID NO: 77244 - DNA, 25 bp, S. pombe
aacccattctcgtgttttatcttct

SEQ ID NO: 77245 - DNA, 25 bp, S. pombe
aacccttttagtgcagctttctttg

SEQ ID NO: 77246 - DNA, 25 bp, S. pombe
aaccttcctctatccgtttgatgta

SEQ ID NO: 77247 - DNA, 25 bp, S. pombe
aaccactgtctatacctcttattac

SEQ ID NO: 77248 - DNA, 25 bp, S. pombe
aacctctggcaatcctcattggaat

SEQ ID NO: 77249 - DNA, 25 bp, S. pombe
aagccgtattaagcattcgaggaaa

SEQ ID NO: 77250 - DNA, 25 bp, S. pombe
aaccgtcaaaacgttccaggcattg

SEQ ID NO: 77251 - DNA, 25 bp, S. pombe
aaccgtaacggttctcattgtgcct

SEQ ID NO: 77252 - DNA, 25 bp, S. pombe
aaccttgcaatcgatcctattactg

SEQ ID NO: 77253 - DNA, 25 bp, S. pombe
aacctggttcatacgatttatcttc

SEQ ID NO: 77254 - DNA, 25 bp, S. pombe
aaccgggtatgtcttcttttgctca

SEQ ID NO: 77255 - DNA, 25 bp, S. pombe
aacgcccagtttatgttagcatcgg

SEQ ID NO: 77256 - DNA, 25 bp, S. pombe
aaccccaatgtcaactttactcaga

SEQ ID NO: 77257 - DNA, 25 bp, S. pombe
aaccctgcagactacgttgcttgta

SEQ ID NO: 77258 - DNA, 25 bp, S. pombe
aacgctggatcgtttgttgcagaaa

SEQ ID NO: 77259 - DNA, 25 bp, S. pombe
aacctggagcgcttcattgagtact

SEQ ID NO: 77260 - DNA, 25 bp, S. pombe
aaccgatggtgctattcatgatcta

SEQ ID NO: 77261 - DNA, 25 bp, S. pombe
aaccattgtaattggaacacctcac

SEQ ID NO: 77262 - DNA, 25 bp, S. pombe
aagccaattatctcctgtcgaaagt

SEQ ID NO: 77263 - DNA, 25 bp, S. pombe
aaccgattgcaacacttctaaagat

SEQ ID NO: 77264 - DNA, 25 bp, S. pombe
aacgcaatgcttttatcggcttcac

SEQ ID NO: 77265 - DNA, 25 bp, S. pombe
aacgctaattatactgcctcttctc

SEQ ID NO: 77266 - DNA, 25 bp, S. pombe
aacccatgtttcctctatttctaat

SEQ ID NO: 77267 - DNA, 25 bp, S. pombe
aaccgcttctccctattataatcag

SEQ ID NO: 77268 - DNA, 25 bp, S. pombe
aaccaatagttcttgcgctgaagct

SEQ ID NO: 77269 - DNA, 25 bp, S. pombe
aagccgtatacttcggtgaagctga

SEQ ID NO: 77270 - DNA, 25 bp, S. pombe
aacgcgtttctgaggtggagcgcac

SEQ ID NO: 77271 - DNA, 25 bp, S. pombe
aacgctttcttttatgggcttccat

SEQ ID NO: 77272 - DNA, 25 bp, S. pombe
aacgctgcttactcaatgggtcttt

SEQ ID NO: 77273 - DNA, 25 bp, S. pombe
aacgctcttgatggtcactatggtc

SEQ ID NO: 77274 - DNA, 25 bp, S. pombe
aaccaaattcattcatccgtaggag

SEQ ID NO: 77275 - DNA, 25 bp, S. pombe
aaccaagatgttgtgcccgacgagc

SEQ ID NO: 77276 - DNA, 25 bp, S. pombe
aaccaagagttgttactgctttgac

SEQ ID NO: 77277 - DNA, 25 bp, S. pombe
aaccatcgcttttttgtgcttcagg

SEQ ID NO: 77278 - DNA, 25 bp, S. pombe
aaccggaggcgtaccattctagcat

SEQ ID NO: 77279 - DNA, 25 bp, S. pombe
aagcccgcatcttttggtttagtct

SEQ ID NO: 77280 - DNA, 25 bp, S. pombe
aaccctcatcatttcttgtctgtca

SEQ ID NO: 77281 - DNA, 25 bp, S. pombe
aaccgctcacaatcgccatgagaag

SEQ ID NO: 77282 - DNA, 25 bp, S. pombe
aaccgtgcagcgttggacattgata

SEQ ID NO: 77283 - DNA, 25 bp, S. pombe
aacctcagggagttgcagtcgttat

SEQ ID NO: 77284 - DNA, 25 bp, S. pombe
aacgctcagcgtctttactgtatat

SEQ ID NO: 77285 - DNA, 25 bp, S. pombe
aacgcccgtcgtctggtagaatgca

SEQ ID NO: 77286 - DNA, 25 bp, S. pombe
aaccgatctgaaactcctacacaat

SEQ ID NO: 77287 - DNA, 25 bp, S. pombe
aagcctcttcctcagttgcatatag

SEQ ID NO: 77288 - DNA, 25 bp, S. pombe
aacgcgtcctcagtgtcagcttgag

SEQ ID NO: 77289 - DNA, 25 bp, S. pombe
aacgctgtacgtgctttcaacactt

SEQ ID NO: 77290 - DNA, 25 bp, S. pombe
aacgcggtcgtggaaactatggtca

SEQ ID NO: 77291 - DNA, 25 bp, S. pombe
aaccctccctgcgtatattcagttt

SEQ ID NO: 77292 - DNA, 25 bp, S. pombe
aacctcgcctcataaaatatcctgt

SEQ ID NO: 77293 - DNA, 25 bp, S. pombe
aaccaatctggttatggccaatcca

SEQ ID NO: 77294 - DNA, 25 bp, S. pombe
aacgccatttggcagatcaacaaaa

SEQ ID NO: 77295 - DNA, 25 bp, S. pombe
aacgcgcatttaaacatacccctat

SEQ ID NO: 77296 - DNA, 25 bp, S. pombe
aaccgactactgtaaacattgcaac

SEQ ID NO: 77297 - DNA, 25 bp, S. pombe
aacgcgcacccttgaatacttcgga

SEQ ID NO: 77298 - DNA, 25 bp, S. pombe
aagcgcaatggcagctggattccct

SEQ ID NO: 77299 - DNA, 25 bp, S. pombe
aagccattcatgagagtttgcgtac

SEQ ID NO: 77300 - DNA, 25 bp, S. pombe
aacgccgctttgatgtttattcaga

SEQ ID NO: 77301 - DNA, 25 bp, S. pombe
aacgcgcgtttaatgattctatgtc

SEQ ID NO: 77302 - DNA, 25 bp, S. pombe
aacgccagattatcgacagcttgtc

SEQ ID NO: 77303 - DNA, 25 bp, S. pombe
aagcgcgccgaatcttacgatgctg

SEQ ID NO: 77304 - DNA, 25 bp, S. pombe
aacgcgccaaatgtgtcagcagaga

SEQ ID NO: 77305 - DNA, 25 bp, S. pombe
aacgcctcgaacagctgcacaagaa

SEQ ID NO: 77306 - DNA, 25 bp, S. pombe
aacgcctcatcaaggttgacggaaa

SEQ ID NO: 77307 - DNA, 25 bp, S. pombe
aacctttgcattatctggcggaagt

SEQ ID NO: 77308 - DNA, 25 bp, S. pombe
aaccttatggttgctcctaaacgtg

SEQ ID NO: 77309 - DNA, 25 bp, S. pombe
aaccgcggtgttactcattgtatca

SEQ ID NO: 77310 - DNA, 25 bp, S. pombe
aacccagggcatgactgcttttatc

SEQ ID NO: 77311 - DNA, 25 bp, S. pombe
aacccaatggctatcaggtcttatt

SEQ ID NO: 77312 - DNA, 25 bp, S. pombe
aacgccgaggatatggtgtcttttt

SEQ ID NO: 77313 - DNA, 25 bp, S. pombe
aagccccggataacaatgatttaca

SEQ ID NO: 77314 - DNA, 25 bp, S. pombe
aaccccggatgattctagacctgaa

SEQ ID NO: 77315 - DNA, 25 bp, S. pombe
aaccgccttggctatcgaacttatt

SEQ ID NO: 77316 - DNA, 25 bp, S. pombe
aaccgccttcctatagactaattcg

SEQ ID NO: 77317 - DNA, 25 bp, S. pombe
aacccatgtgtcctttctatttttg

SEQ ID NO: 77318 - DNA, 25 bp, S. pombe
aaccctcgatttttcacaatttatg

SEQ ID NO: 77319 - DNA, 25 bp, S. pombe
aagcccggtttctaacaactctatg

SEQ ID NO: 77320 - DNA, 25 bp, S. pombe
aagctgctgagcgtttgcaaaaacc

SEQ ID NO: 77321 - DNA, 25 bp, S. pombe
aagccgcaagtggtgcagcaaacct

SEQ ID NO: 77322 - DNA, 25 bp, S. pombe
aagccgaaagcagtgccgctgagat

SEQ ID NO: 77323 - DNA, 25 bp, S. pombe
aagccgaaatagtccctggtgtact

SEQ ID NO: 77324 - DNA, 25 bp, S. pombe
aacctatggtaagcctgttcatcag

SEQ ID NO: 77325 - DNA, 25 bp, S. pombe
aaccatttgctgctggcgattttgt

SEQ ID NO: 77326 - DNA, 25 bp, S. pombe
aagccatttggcctgtgtatttctc

SEQ ID NO: 77327 - DNA, 25 bp, S. pombe
aaccatttctatattttgcgctccc

SEQ ID NO: 77328 - DNA, 25 bp, S. pombe
aaccaacttgatttgtttccctcag

SEQ ID NO: 77329 - DNA, 25 bp, S. pombe
aaccacgttgactgtttcctttgat

SEQ ID NO: 77330 - DNA, 25 bp, S. pombe
aaccgtggtgaaattcttcctcctg

SEQ ID NO: 77331 - DNA, 25 bp, S. pombe
aacctgttaaacacatcccttctga

SEQ ID NO: 77332 - DNA, 25 bp, S. pombe
aacctgcatttcaactttacaccgg

SEQ ID NO: 77333 - DNA, 25 bp, S. pombe
aagccctctactgacattggagcga

SEQ ID NO: 77334 - DNA, 25 bp, S. pombe
aagccgtgctactaaatcgaagcct

SEQ ID NO: 77335 - DNA, 25 bp, S. pombe
aagccactacttgaggaggatgttc

SEQ ID NO: 77336 - DNA, 25 bp, S. pombe
aacctgtgagtggtgtcgctgagac

SEQ ID NO: 77337 - DNA, 25 bp, S. pombe
aacctggagatgctgtttgcgacgt

SEQ ID NO: 77338 - DNA, 25 bp, S. pombe
aacctggagtttgttgcttcgcctg

SEQ ID NO: 77339 - DNA, 25 bp, S. pombe
aacccatattgctatttcctggaat

SEQ ID NO: 77340 - DNA, 25 bp, S. pombe
aacgccatatctgcttcatctttag

SEQ ID NO: 77341 - DNA, 25 bp, S. pombe
aaccgtatcagcgatcttgatccgg

SEQ ID NO: 77342 - DNA, 25 bp, S. pombe
aagccgactatgcagctttccaagc

SEQ ID NO: 77343 - DNA, 25 bp, S. pombe
aagccaattttttacatctcaacgg

SEQ ID NO: 77344 - DNA, 25 bp, S. pombe
aagcgtgagtttgaagctgccccag

SEQ ID NO: 77345 - DNA, 25 bp, S. pombe
aagcgtcgttatgaccgcaagcaaa

SEQ ID NO: 77346 - DNA, 25 bp, S. pombe
aagcagtttatctggcgtccgagac

SEQ ID NO: 77347 - DNA, 25 bp, S. pombe
aagcgtgtcgttgatcgtcctgaac

SEQ ID NO: 77348 - DNA, 25 bp, S. pombe
aagccagtggttcatgcagctcttg

SEQ ID NO: 77349 - DNA, 25 bp, S. pombe
aaccagattgttatgactttgccaa

SEQ ID NO: 77350 - DNA, 25 bp, S. pombe
aagctcgattttatgcctaatggga

SEQ ID NO: 77351 - DNA, 25 bp, S. pombe
aacctgaagttagtccatttggcgc

SEQ ID NO: 77352 - DNA, 25 bp, S. pombe
aacccgattcgaatgctctgttggc

SEQ ID NO: 77353 - DNA, 25 bp, S. pombe
aaccacgattccagtttacgcaaca

SEQ ID NO: 77354 - DNA, 25 bp, S. pombe
aagcgatacccaccgattatttcaa

SEQ ID NO: 77355 - DNA, 25 bp, S. pombe
aagccatatcctgggttctacttca

SEQ ID NO: 77356 - DNA, 25 bp, S. pombe
aagcgaaactagaactccacttgag

SEQ ID NO: 77357 - DNA, 25 bp, S. pombe
aaccaagcggttcatgctcttgcta

SEQ ID NO: 77358 - DNA, 25 bp, S. pombe
aacctgatgcgtttgaacatttgct

SEQ ID NO: 77359 - DNA, 25 bp, S. pombe
aatccccggctccattggagtgtaa

SEQ ID NO: 77360 - DNA, 25 bp, S. pombe
aaccttgggccctgtagtgagcaaa

SEQ ID NO: 77361 - DNA, 25 bp, S. pombe
aacctgctgaatctccgtttggcaa

SEQ ID NO: 77362 - DNA, 25 bp, S. pombe
aaccaatcaattgcgtcttggacaa

SEQ ID NO: 77363 - DNA, 25 bp, S. pombe
aacctgacggctgcttggctgaaga

SEQ ID NO: 77364 - DNA, 25 bp, S. pombe
aacctcatccttggcttggtgaaga

SEQ ID NO: 77365 - DNA, 25 bp, S. pombe
aaccgattcttcgttagtgcatcaa

SEQ ID NO: 77366 - DNA, 25 bp, S. pombe
aagccagattctgcgactactgaga

SEQ ID NO: 77367 - DNA, 25 bp, S. pombe
aagctcctcctgaaggtacatggta

SEQ ID NO: 77368 - DNA, 25 bp, S. pombe
aagcagcttgcccacgagaatcggt

SEQ ID NO: 77369 - DNA, 25 bp, S. pombe
aagctgctcagctgcatcgtgaaaa

SEQ ID NO: 77370 - DNA, 25 bp, S. pombe
aagcccgtggtatgcgtcgagctga

SEQ ID NO: 77371 - DNA, 25 bp, S. pombe
aagaatggaggtgagcgacgcaaac

SEQ ID NO: 77372 - DNA, 25 bp, S. pombe
aacctgctacattgggctggcacaa

SEQ ID NO: 77373 - DNA, 25 bp, S. pombe
aacctctaatgatgatgctcctgca

SEQ ID NO: 77374 - DNA, 25 bp, S. pombe
aaccgctcaatgacttctcgtgaag

SEQ ID NO: 77375 - DNA, 25 bp, S. pombe
aaccgctgttgtgcgtgcgcgaaat

SEQ ID NO: 77376 - DNA, 25 bp, S. pombe
aaccgtcttcttcgatcagcgaaat

SEQ ID NO: 77377 - DNA, 25 bp, S. pombe
aagccgtcttttctaaacaatctga

SEQ ID NO: 77378 - DNA, 25 bp, S. pombe
aacctggtttctctcgtcaaattgt

SEQ ID NO: 77379 - DNA, 25 bp, S. pombe
aacctacgttgggatctattgaagt

SEQ ID NO: 77380 - DNA, 25 bp, S. pombe
aacctcacagttgcttttagacagt

SEQ ID NO: 77381 - DNA, 25 bp, S. pombe
aaccaccatcttcgtatgtttggat

SEQ ID NO: 77382 - DNA, 25 bp, S. pombe
aaccctcctatgatgatgtcttgcg

SEQ ID NO: 77383 - DNA, 25 bp, S. pombe
aacccctctatgatgtttgctgcaa

SEQ ID NO: 77384 - DNA, 25 bp, S. pombe
aaccgttcttaatcgtgtgtccaat

SEQ ID NO: 77385 - DNA, 25 bp, S. pombe
aagctgtcatttatcagttccccga

SEQ ID NO: 77386 - DNA, 25 bp, S. pombe
aaccgtgtctaatgtgtgctgctgc

SEQ ID NO: 77387 - DNA, 25 bp, S. pombe
aacctgtgcctaagttgttccgtat

SEQ ID NO: 77388 - DNA, 25 bp, S. pombe
aagcctccttgaagaagttcccatt

SEQ ID NO: 77389 - DNA, 25 bp, S. pombe
aaccgtatcggttactagcactcaa

SEQ ID NO: 77390 - DNA, 25 bp, S. pombe
aaccggatctagattatgcacctta

SEQ ID NO: 77391 - DNA, 25 bp, S. pombe
aaccggttcgtattgtgcattgagc

SEQ ID NO: 77392 - DNA, 25 bp, S. pombe
aagccgctctgttaaatgccaatta

SEQ ID NO: 77393 - DNA, 25 bp, S. pombe
aaccggcattacatggcagcatcaa

SEQ ID NO: 77394 - DNA, 25 bp, S. pombe
aaccggatacacttggacgcgattt

SEQ ID NO: 77395 - DNA, 25 bp, S. pombe
aaccgtgcaaacttgatgctcgccg

SEQ ID NO: 77396 - DNA, 25 bp, S. pombe
aagccttgggaaaaagccatcgaca

SEQ ID NO: 77397 - DNA, 25 bp, S. pombe
aacctaagctgtgcgttcaatcgaa

SEQ ID NO: 77398 - DNA, 25 bp, S. pombe
aaccttgcaggttctgttcaacaaa

SEQ ID NO: 77399 - DNA, 25 bp, S. pombe
aaccttctggccttgttctagaata

SEQ ID NO: 77400 - DNA, 25 bp, S. pombe
aacctactggccaatctttgcaaca

SEQ ID NO: 77401 - DNA, 25 bp, S. pombe
aaccacaatggcgtctctcaatgaa

SEQ ID NO: 77402 - DNA, 25 bp, S. pombe
aagcctccggcaactgtcgaaatgg

SEQ ID NO: 77403 - DNA, 25 bp, S. pombe
aacctgttcgtcatcagctgtgaca

SEQ ID NO: 77404 - DNA, 25 bp, S. pombe
aacctagtcctaacgctgagctatc

SEQ ID NO: 77405 - DNA, 25 bp, S. pombe
aacctgaccactatgctgatgcgta

SEQ ID NO: 77406 - DNA, 25 bp, S. pombe
aaccgacgataatcttcaccatgga

SEQ ID NO: 77407 - DNA, 25 bp, S. pombe
aaccattattaatctctcaccatcg

SEQ ID NO: 77408 - DNA, 25 bp, S. pombe
aaccatttaccattgtatcggatcg

SEQ ID NO: 77409 - DNA, 25 bp, S. pombe
aacctttctttatcaccttattgct

SEQ ID NO: 77410 - DNA, 25 bp, S. pombe
aaccgttctttacctcatgtctttg

SEQ ID NO: 77411 - DNA, 25 bp, S. pombe
aacctcgatggtttccttactggat

SEQ ID NO: 77412 - DNA, 25 bp, S. pombe
aaccggatgttattctcttgctcga

SEQ ID NO: 77413 - DNA, 25 bp, S. pombe
aacctgtatatgttacggctttccg

SEQ ID NO: 77414 - DNA, 25 bp, S. pombe
aaccttgtaattcctgtcgtttctg

SEQ ID NO: 77415 - DNA, 25 bp, S. pombe
aaccggtaactgctgttgcgattgc

SEQ ID NO: 77416 - DNA, 25 bp, S. pombe
aaccatcgcgattcttatacatatg

SEQ ID NO: 77417 - DNA, 25 bp, S. pombe
aagcgctcaacgtatctgctgcaga

SEQ ID NO: 77418 - DNA, 25 bp, S. pombe
aagccaatgcaccatctgtcgatga

SEQ ID NO: 77419 - DNA, 25 bp, S. pombe
aagccaagcctgtttcacatacggt

SEQ ID NO: 77420 - DNA, 25 bp, S. pombe
aagccaacggtactcattcacggaa

SEQ ID NO: 77421 - DNA, 25 bp, S. pombe
cggtcaatttagcaagcggcggtaa

SEQ ID NO: 77422 - DNA, 25 bp, S. pombe
aagctttaaattctcctggtggtgt

SEQ ID NO: 77423 - DNA, 25 bp, S. pombe
aagcattggaagatttcccctgccg

SEQ ID NO: 77424 - DNA, 25 bp, S. pombe
aagcatgctgtatgcgttacactac

SEQ ID NO: 77425 - DNA, 25 bp, S. pombe
aagccagggttgttgctgacaacat

SEQ ID NO: 77426 - DNA, 25 bp, S. pombe
aacctcgtctgcgtgtacgatcaaa

SEQ ID NO: 77427 - DNA, 25 bp, S. pombe
aaccagccgctgatattgatgtaga

SEQ ID NO: 77428 - DNA, 25 bp, S. pombe
aaccgtcaatgatttggagtcagca

SEQ ID NO: 77429 - DNA, 25 bp, S. pombe
aagctgcgaaatctatggaccacat

SEQ ID NO: 77430 - DNA, 25 bp, S. pombe
aagccgcattacgtgtttctactga

SEQ ID NO: 77431 - DNA, 25 bp, S. pombe
aaccgtcgtggtgctactagtatag

SEQ ID NO: 77432 - DNA, 25 bp, S. pombe
aagcctatgaagttgtcccctaagt

SEQ ID NO: 77433 - DNA, 25 bp, S. pombe
aagccaggagagtttgccctcttgg

SEQ ID NO: 77434 - DNA, 25 bp, S. pombe
aagctgaacatggttctgcccctag

SEQ ID NO: 77435 - DNA, 25 bp, S. pombe
aagcggactggtatcttccttttga

SEQ ID NO: 77436 - DNA, 25 bp, S. pombe
aagggccaagatataccgtttcgat

SEQ ID NO: 77437 - DNA, 25 bp, S. pombe
aacctcacagaagcctatcacattt

SEQ ID NO: 77438 - DNA, 25 bp, S. pombe
aagcatgtggcctgaactttcgact

SEQ ID NO: 77439 - DNA, 25 bp, S. pombe
aagctaggacgttacttgccgttga

SEQ ID NO: 77440 - DNA, 25 bp, S. pombe
aagccgaaggtgttttacgaatgat

SEQ ID NO: 77441 - DNA, 25 bp, S. pombe
aacctgggcaggatatttcgaagat

SEQ ID NO: 77442 - DNA, 25 bp, S. pombe
aacctgttcaggactatctctcaaa

SEQ ID NO: 77443 - DNA, 25 bp, S. pombe
aagctttgtgaccaggtttctgact

SEQ ID NO: 77444 - DNA, 25 bp, S. pombe
aacctgtcaaacctgttggtggaat

SEQ ID NO: 77445 - DNA, 25 bp, S. pombe
aacctatcaaggctgctcgggtata

SEQ ID NO: 77446 - DNA, 25 bp, S. pombe
aagctttagaagctgccggcgttcg

SEQ ID NO: 77447 - DNA, 25 bp, S. pombe
aagcgttaaaatccctccgcattca

SEQ ID NO: 77448 - DNA, 25 bp, S. pombe
aagctctttcaaaaccttcctactg

SEQ ID NO: 77449 - DNA, 25 bp, S. pombe
aagcttatccagaacctattcctac

SEQ ID NO: 77450 - DNA, 25 bp, S. pombe
aagcctaccctatctttcattagaa

SEQ ID NO: 77451 - DNA, 25 bp, S. pombe
aagcctgaccgcaaagagttcttga

SEQ ID NO: 77452 - DNA, 25 bp, S. pombe
aagccgagcctttgacaactggtca

SEQ ID NO: 77453 - DNA, 25 bp, S. pombe
aagacgatatatccggaatcccttg

SEQ ID NO: 77454 - DNA, 25 bp, S. pombe
aagcccatagcaggacgagttttag

SEQ ID NO: 77455 - DNA, 25 bp, S. pombe
aagcgactacctccatcagtttaag

SEQ ID NO: 77456 - DNA, 25 bp, S. pombe
aagccctaggcgtccagtagagcat

SEQ ID NO: 77457 - DNA, 25 bp, S. pombe
aagcccttttgatcagctattgcag

SEQ ID NO: 77458 - DNA, 25 bp, S. pombe
aagccgctacttcacaaattcgtgg

SEQ ID NO: 77459 - DNA, 25 bp, S. pombe
aagccctgacttctgatgacgacga

SEQ ID NO: 77460 - DNA, 25 bp, S. pombe
aagcctgcgccctcgaaagagaaat

SEQ ID NO: 77461 - DNA, 25 bp, S. pombe
aacctgtgtcagcttctcaattaat

SEQ ID NO: 77462 - DNA, 25 bp, S. pombe
aacctttacctcctgcaattaatga

SEQ ID NO: 77463 - DNA, 25 bp, S. pombe
aaccattcttccttcatcgattact

SEQ ID NO: 77464 - DNA, 25 bp, S. pombe
aacctgttttgcttgatggctctga

SEQ ID NO: 77465 - DNA, 25 bp, S. pombe
aacctgtgttgattttggcactgat

SEQ ID NO: 77466 - DNA, 25 bp, S. pombe
aacctcgtctctttgtagccatgat

SEQ ID NO: 77467 - DNA, 25 bp, S. pombe
aacctcttcctcatctgattcagat

SEQ ID NO: 77468 - DNA, 25 bp, S. pombe
aagccagctatttacctagatccag

SEQ ID NO: 77469 - DNA, 25 bp, S. pombe
aacctccaggtttgcattagttgca

SEQ ID NO: 77470 - DNA, 25 bp, S. pombe
aaccttcggttcttcgctatatgat

SEQ ID NO: 77471 - DNA, 25 bp, S. pombe
aagcgttcagggagactgcttcaga

SEQ ID NO: 77472 - DNA, 25 bp, S. pombe
aagcctacaggttttcatgctagca

SEQ ID NO: 77473 - DNA, 25 bp, S. pombe
aagccggtgcagagttcgttgaccc

SEQ ID NO: 77474 - DNA, 25 bp, S. pombe
aagcccgtagttaagcctgattcta

SEQ ID NO: 77475 - DNA, 25 bp, S. pombe
aagccggtaattctcgtgacatata

SEQ ID NO: 77476 - DNA, 25 bp, S. pombe
aagccgctcttcttcgtcagtggaa

SEQ ID NO: 77477 - DNA, 25 bp, S. pombe
aagcgatcttcgtaccgcagtggaa

SEQ ID NO: 77478 - DNA, 25 bp, S. pombe
aagcgacatttctctctaggtgtag

SEQ ID NO: 77479 - DNA, 25 bp, S. pombe
aagctttatccgtgtatctcggtgc

SEQ ID NO: 77480 - DNA, 25 bp, S. pombe
aacctctgaactgctttcatttcgt

SEQ ID NO: 77481 - DNA, 25 bp, S. pombe
aagccctaactcctagtgtcttgga

SEQ ID NO: 77482 - DNA, 25 bp, S. pombe
aagcccttcgtgatacttctatgag

SEQ ID NO: 77483 - DNA, 25 bp, S. pombe
aagcccttgaggttgcacgtgttca

SEQ ID NO: 77484 - DNA, 25 bp, S. pombe
aagcgttcttggttcatctatttga

SEQ ID NO: 77485 - DNA, 25 bp, S. pombe
aagcgttctgccgatgatgcatcag

SEQ ID NO: 77486 - DNA, 25 bp, S. pombe
aagcgtggtcatggcgatgcatcaa

SEQ ID NO: 77487 - DNA, 25 bp, S. pombe
aagcgatgagtattgtccgaactgc

SEQ ID NO: 77488 - DNA, 25 bp, S. pombe
aagccaatgtggatgccgtagccat

SEQ ID NO: 77489 - DNA, 25 bp, S. pombe
aagcgcctgtcatctcattataaac

SEQ ID NO: 77490 - DNA, 25 bp, S. pombe
aagcgctcgtgctactatcgatgaa

SEQ ID NO: 77491 - DNA, 25 bp, S. pombe
aagccattgcctttgttaccacagg

SEQ ID NO: 77492 - DNA, 25 bp, S. pombe
aagccactacttcgttcggaagctg

SEQ ID NO: 77493 - DNA, 25 bp, S. pombe
aagccctatctcagtatcggaatcg

SEQ ID NO: 77494 - DNA, 25 bp, S. pombe
aagcctgtatccttgctgtgggaac

SEQ ID NO: 77495 - DNA, 25 bp, S. pombe
aagccatcagatgcctgttgacaga

SEQ ID NO: 77496 - DNA, 25 bp, S. pombe
aagctgccccagagaagagttatgc

SEQ ID NO: 77497 - DNA, 25 bp, S. pombe
aagcctttgctgtaatcactgattc

SEQ ID NO: 77498 - DNA, 25 bp, S. pombe
aacctttctgtgaacatgtctactt

SEQ ID NO: 77499 - DNA, 25 bp, S. pombe
aaccttggctgtcaatcatcgtgtt

SEQ ID NO: 77500 - DNA, 25 bp, S. pombe
aagcctggccgtaagtctcgtgtta

SEQ ID NO: 77501 - DNA, 25 bp, S. pombe
aagcctgttcagtatcgtgttcgtt

SEQ ID NO: 77502 - DNA, 25 bp, S. pombe
aagcgcgttatgttggtgtcggtaa

SEQ ID NO: 77503 - DNA, 25 bp, S. pombe
aagtcgtattgcctctcgaaaccta

SEQ ID NO: 77504 - DNA, 25 bp, S. pombe
aagttagttcgtgcggtcaagtcca

SEQ ID NO: 77505 - DNA, 25 bp, S. pombe
aagcccgtatttggcagcaagaaat

SEQ ID NO: 77506 - DNA, 25 bp, S. pombe
aagccttgagcaaactgaggctcga
